United States Patent 8,178,503 (RIBONUCLEIC ACID INTERFERENCE MOLECULES AND BINDING SITES DERIVED BY ANALYZING INTERGENIC AND INTRONIC REGIONS OF GENOMES) - sequence listing, part 3

SEQ ID NO: 89100 - DNA, 16 bp, H. sapiens
ctgagtcagagctgca

SEQ ID NO: 89101 - DNA, 16 bp, H. sapiens
ctgagtcaggagaatc

SEQ ID NO: 89102 - DNA, 16 bp, H. sapiens
ctgagtcctccccagc

SEQ ID NO: 89103 - DNA, 16 bp, H. sapiens
ctgagtcctgaagacc

SEQ ID NO: 89104 - DNA, 16 bp, H. sapiens
ctgagtctatttccag

SEQ ID NO: 89105 - DNA, 16 bp, H. sapiens
ctgagtctccctctgt

SEQ ID NO: 89106 - DNA, 16 bp, H. sapiens
ctgagtctgcttctgg

SEQ ID NO: 89107 - DNA, 16 bp, H. sapiens
ctgagtctggggtctt

SEQ ID NO: 89108 - DNA, 16 bp, H. sapiens
ctgagtgaaaaagcca

SEQ ID NO: 89109 - DNA, 16 bp, H. sapiens
ctgagtgacaagagca

SEQ ID NO: 89110 - DNA, 16 bp, H. sapiens
ctgagtgacagactga

SEQ ID NO: 89111 - DNA, 16 bp, H. sapiens
ctgagtgacagagaaa

SEQ ID NO: 89112 - DNA, 16 bp, H. sapiens
ctgagtgagagaagcc

SEQ ID NO: 89113 - DNA, 16 bp, H. sapiens
ctgagtgaggaaggca

SEQ ID NO: 89114 - DNA, 16 bp, H. sapiens
ctgagtgcagtggcac

SEQ ID NO: 89115 - DNA, 16 bp, H. sapiens
ctgagtgcttactatg

SEQ ID NO: 89116 - DNA, 16 bp, H. sapiens
ctgagtgggagctgca

SEQ ID NO: 89117 - DNA, 16 bp, H. sapiens
ctgagtggggaggatg

SEQ ID NO: 89118 - DNA, 16 bp, H. sapiens
ctgagtgtctgtccct

SEQ ID NO: 89119 - DNA, 16 bp, H. sapiens
ctgagtgtggtggtat

SEQ ID NO: 89120 - DNA, 16 bp, H. sapiens
ctgagtgtgtgtgtgt

SEQ ID NO: 89121 - DNA, 16 bp, H. sapiens
ctgagttatttcactt

SEQ ID NO: 89122 - DNA, 16 bp, H. sapiens
ctgagttcaaatcctg

SEQ ID NO: 89123 - DNA, 16 bp, H. sapiens
ctgagttcaaatcttg

SEQ ID NO: 89124 - DNA, 16 bp, H. sapiens
ctgagttcaagcaatc

SEQ ID NO: 89125 - DNA, 16 bp, H. sapiens
ctgagttcaagtgatt

SEQ ID NO: 89126 - DNA, 16 bp, H. sapiens
ctgagttcacacaaga

SEQ ID NO: 89127 - DNA, 16 bp, H. sapiens
ctgagttccacctcct

SEQ ID NO: 89128 - DNA, 16 bp, H. sapiens
ctgagttccagtcctg

SEQ ID NO: 89129 - DNA, 16 bp, H. sapiens
ctgagttccagtttga

SEQ ID NO: 89130 - DNA, 16 bp, H. sapiens
ctgagtttctgcattt

SEQ ID NO: 89131 - DNA, 16 bp, H. sapiens
ctgagttttaattttt

SEQ ID NO: 89132 - DNA, 16 bp, H. sapiens
ctgagttttctatttt

SEQ ID NO: 89133 - DNA, 16 bp, H. sapiens
ctgagtttttaaaatg

SEQ ID NO: 89134 - DNA, 16 bp, H. sapiens
ctgataaacaacttca

SEQ ID NO: 89135 - DNA, 16 bp, H. sapiens
ctgataaagaacatct

SEQ ID NO: 89136 - DNA, 16 bp, H. sapiens
ctgataaagaatttgt

SEQ ID NO: 89137 - DNA, 16 bp, H. sapiens
ctgataaagacatatc

SEQ ID NO: 89138 - DNA, 16 bp, H. sapiens
ctgataaatattgatg

SEQ ID NO: 89139 - DNA, 16 bp, H. sapiens
ctgataaatgacttca

SEQ ID NO: 89140 - DNA, 16 bp, H. sapiens
ctgataaccaagatgg

SEQ ID NO: 89141 - DNA, 16 bp, H. sapiens
ctgataagaagcattt

SEQ ID NO: 89142 - DNA, 17 bp, H. sapiens
ctgataagcaacttcaa

SEQ ID NO: 89143 - DNA, 16 bp, H. sapiens
ctgataatgatgatga

SEQ ID NO: 89144 - DNA, 16 bp, H. sapiens
ctgataatgatggttt

SEQ ID NO: 89145 - DNA, 16 bp, H. sapiens
ctgataatgcttctgt

SEQ ID NO: 89146 - DNA, 16 bp, H. sapiens
ctgataatttaaaagg

SEQ ID NO: 89147 - DNA, 16 bp, H. sapiens
ctgataatttcaaaat

SEQ ID NO: 89148 - DNA, 16 bp, H. sapiens
ctgatacagctgaaaa

SEQ ID NO: 89149 - DNA, 16 bp, H. sapiens
ctgataccaaaaccag

SEQ ID NO: 89150 - DNA, 16 bp, H. sapiens
ctgataccaaaacctg

SEQ ID NO: 89151 - DNA, 16 bp, H. sapiens
ctgataccaaaatctg

SEQ ID NO: 89152 - DNA, 29 bp, H. sapiens
ctgataccaaagccaggcagagacacaac

SEQ ID NO: 89153 - DNA, 29 bp, H. sapiens
ctgataccaaagccgggcagagacacaac

SEQ ID NO: 89154 - DNA, 30 bp, H. sapiens
ctgataccaaagcctggcagagacacaacc

SEQ ID NO: 89155 - DNA, 29 bp, H. sapiens
ctgataccaaagctgggcagagacacaac

SEQ ID NO: 89156 - DNA, 16 bp, H. sapiens
ctgatagaaatataga

SEQ ID NO: 89157 - DNA, 16 bp, H. sapiens
ctgatagaacagactt

SEQ ID NO: 89158 - DNA, 16 bp, H. sapiens
ctgatagaattcaact

SEQ ID NO: 89159 - DNA, 16 bp, H. sapiens
ctgatagaattctaaa

SEQ ID NO: 89160 - DNA, 16 bp, H. sapiens
ctgatagagctgaaaa

SEQ ID NO: 89161 - DNA, 16 bp, H. sapiens
ctgatagctttgaaga

SEQ ID NO: 89162 - DNA, 16 bp, H. sapiens
ctgatagtgagtgagt

SEQ ID NO: 89163 - DNA, 16 bp, H. sapiens
ctgatatcctttcttc

SEQ ID NO: 89164 - DNA, 16 bp, H. sapiens
ctgatatgatttggct

SEQ ID NO: 89165 - DNA, 20 bp, H. sapiens
ctgatatgcagaaataatgg

SEQ ID NO: 89166 - DNA, 16 bp, H. sapiens
ctgatatggtttggat

SEQ ID NO: 89167 - DNA, 16 bp, H. sapiens
ctgatattttaaaatt

SEQ ID NO: 89168 - DNA, 16 bp, H. sapiens
ctgatattttgtattt

SEQ ID NO: 89169 - DNA, 16 bp, H. sapiens
ctgatatttttactgt

SEQ ID NO: 89170 - DNA, 16 bp, H. sapiens
ctgatcatcagtgatg

SEQ ID NO: 89171 - DNA, 16 bp, H. sapiens
ctgatcattcctctgg

SEQ ID NO: 89172 - DNA, 19 bp, H. sapiens
ctgatccacccacctcggc

SEQ ID NO: 89173 - DNA, 16 bp, H. sapiens
ctgatcccagagaaat

SEQ ID NO: 89174 - DNA, 16 bp, H. sapiens
ctgatcctcccacctt

SEQ ID NO: 89175 - DNA, 16 bp, H. sapiens
ctgatcctcctgcctt

SEQ ID NO: 89176 - DNA, 16 bp, H. sapiens
ctgatcctctcccacc

SEQ ID NO: 89177 - DNA, 16 bp, H. sapiens
ctgatcctgggctttt

SEQ ID NO: 89178 - DNA, 16 bp, H. sapiens
ctgatctcaggtgatc

SEQ ID NO: 89179 - DNA, 21 bp, H. sapiens
ctgatctcggctcactgcaag

SEQ ID NO: 89180 - DNA, 16 bp, H. sapiens
ctgatctgacagcagg

SEQ ID NO: 89181 - DNA, 16 bp, H. sapiens
ctgatctgacaggagg

SEQ ID NO: 89182 - DNA, 16 bp, H. sapiens
ctgatctgctttctat

SEQ ID NO: 89183 - DNA, 16 bp, H. sapiens
ctgatcttagctcact

SEQ ID NO: 89184 - DNA, 16 bp, H. sapiens
ctgatcttagtgagaa

SEQ ID NO: 89185 - DNA, 16 bp, H. sapiens
ctgatcttcaataaag

SEQ ID NO: 89186 - DNA, 16 bp, H. sapiens
ctgatcttccacaaag

SEQ ID NO: 89187 - DNA, 16 bp, H. sapiens
ctgatcttgagctcct

SEQ ID NO: 89188 - DNA, 16 bp, H. sapiens
ctgatcttgcttttcc

SEQ ID NO: 89189 - DNA, 16 bp, H. sapiens
ctgatctttgacaaat

SEQ ID NO: 89190 - DNA, 16 bp, H. sapiens
ctgatctttgacaacc

SEQ ID NO: 89191 - DNA, 16 bp, H. sapiens
ctgatcttttcactgt

SEQ ID NO: 89192 - DNA, 16 bp, H. sapiens
ctgatgaaaaaaatca

SEQ ID NO: 89193 - DNA, 16 bp, H. sapiens
ctgatgaaaatatttt

SEQ ID NO: 89194 - DNA, 16 bp, H. sapiens
ctgatgaaaattgatg

SEQ ID NO: 89195 - DNA, 16 bp, H. sapiens
ctgatgaaagaaattg

SEQ ID NO: 89196 - DNA, 16 bp, H. sapiens
ctgatgaaagaggtgg

SEQ ID NO: 89197 - DNA, 16 bp, H. sapiens
ctgatgaacaatgatg

SEQ ID NO: 89198 - DNA, 16 bp, H. sapiens
ctgatgaacaccaatg

SEQ ID NO: 89199 - DNA, 16 bp, H. sapiens
ctgatgaacagagatg

SEQ ID NO: 89200 - DNA, 16 bp, H. sapiens
ctgatgaactttgatg

SEQ ID NO: 89201 - DNA, 16 bp, H. sapiens
ctgatgaagaaactga

SEQ ID NO: 89202 - DNA, 16 bp, H. sapiens
ctgatgaagatgctgt

SEQ ID NO: 89203 - DNA, 16 bp, H. sapiens
ctgatgaagttctatt

SEQ ID NO: 89204 - DNA, 16 bp, H. sapiens
ctgatgaatatcgatg

SEQ ID NO: 89205 - DNA, 16 bp, H. sapiens
ctgatgaccccagcag

SEQ ID NO: 89206 - DNA, 16 bp, H. sapiens
ctgatgactaatgatg

SEQ ID NO: 89207 - DNA, 16 bp, H. sapiens
ctgatgagaaatctgt

SEQ ID NO: 89208 - DNA, 16 bp, H. sapiens
ctgatgagaatgtgga

SEQ ID NO: 89209 - DNA, 16 bp, H. sapiens
ctgatgagagaaattg

SEQ ID NO: 89210 - DNA, 16 bp, H. sapiens
ctgatgaggaggagga

SEQ ID NO: 89211 - DNA, 16 bp, H. sapiens
ctgatgaggatgtgga

SEQ ID NO: 89212 - DNA, 16 bp, H. sapiens
ctgatgaggctgcaga

SEQ ID NO: 89213 - DNA, 16 bp, H. sapiens
ctgatgagggctttct

SEQ ID NO: 89214 - DNA, 16 bp, H. sapiens
ctgatgatagtttgtt

SEQ ID NO: 89215 - DNA, 16 bp, H. sapiens
ctgatgatccacccac

SEQ ID NO: 89216 - DNA, 16 bp, H. sapiens
ctgatgatgaggagga

SEQ ID NO: 89217 - DNA, 16 bp, H. sapiens
ctgatgatggacattt

SEQ ID NO: 89218 - DNA, 16 bp, H. sapiens
ctgatgattagtgatg

SEQ ID NO: 89219 - DNA, 16 bp, H. sapiens
ctgatgcaaaaattct

SEQ ID NO: 89220 - DNA, 16 bp, H. sapiens
ctgatgcaagaagtag

SEQ ID NO: 89221 - DNA, 16 bp, H. sapiens
ctgatgcagcagcaga

SEQ ID NO: 89222 - DNA, 16 bp, H. sapiens
ctgatgcagtggctca

SEQ ID NO: 89223 - DNA, 16 bp, H. sapiens
ctgatgcatgctaaag

SEQ ID NO: 89224 - DNA, 16 bp, H. sapiens
ctgatgcattcttcat

SEQ ID NO: 89225 - DNA, 16 bp, H. sapiens
ctgatgccatgtaaga

SEQ ID NO: 89226 - DNA, 16 bp, H. sapiens
ctgatgcccaggctgg

SEQ ID NO: 89227 - DNA, 16 bp, H. sapiens
ctgatgcggtggctca

SEQ ID NO: 89228 - DNA, 16 bp, H. sapiens
ctgatgctctctctcc

SEQ ID NO: 89229 - DNA, 16 bp, H. sapiens
ctgatgctgaggagga

SEQ ID NO: 89230 - DNA, 16 bp, H. sapiens
ctgatgcttttataag

SEQ ID NO: 89231 - DNA, 16 bp, H. sapiens
ctgatggaaatgtaca

SEQ ID NO: 89232 - DNA, 16 bp, H. sapiens
ctgatggagaagctgt

SEQ ID NO: 89233 - DNA, 16 bp, H. sapiens
ctgatggagctgaaaa

SEQ ID NO: 89234 - DNA, 16 bp, H. sapiens
ctgatggagctgaaga

SEQ ID NO: 89235 - DNA, 16 bp, H. sapiens
ctgatggagctgcaaa

SEQ ID NO: 89236 - DNA, 16 bp, H. sapiens
ctgatggatctgaaaa

SEQ ID NO: 89237 - DNA, 16 bp, H. sapiens
ctgatggctttggcag

SEQ ID NO: 89238 - DNA, 16 bp, H. sapiens
ctgatgggaatgaaaa

SEQ ID NO: 89239 - DNA, 16 bp, H. sapiens
ctgatgggatttcctt

SEQ ID NO: 89240 - DNA, 16 bp, H. sapiens
ctgatggggacactga

SEQ ID NO: 89241 - DNA, 18 bp, H. sapiens
ctgatggggacgtggaga

SEQ ID NO: 89242 - DNA, 16 bp, H. sapiens
ctgatggggacttgga

SEQ ID NO: 89243 - DNA, 16 bp, H. sapiens
ctgatggggatgtgga

SEQ ID NO: 89244 - DNA, 16 bp, H. sapiens
ctgatgggtgtgaagt

SEQ ID NO: 89245 - DNA, 17 bp, H. sapiens
ctgatggtagtctgtat

SEQ ID NO: 89246 - DNA, 17 bp, H. sapiens
ctgatggtgatgatgat

SEQ ID NO: 89247 - DNA, 16 bp, H. sapiens
ctgatggtggtggtgg

SEQ ID NO: 89248 - DNA, 16 bp, H. sapiens
ctgatggtttttaaag

SEQ ID NO: 89249 - DNA, 16 bp, H. sapiens
ctgatgtccacctggg

SEQ ID NO: 89250 - DNA, 16 bp, H. sapiens
ctgatgtctcttctta

SEQ ID NO: 89251 - DNA, 16 bp, H. sapiens
ctgatgtgattattat

SEQ ID NO: 89252 - DNA, 16 bp, H. sapiens
ctgatgtggggtgggg

SEQ ID NO: 89253 - DNA, 16 bp, H. sapiens
ctgatgtggtctcaga

SEQ ID NO: 89254 - DNA, 16 bp, H. sapiens
ctgatgtttcctgact

SEQ ID NO: 89255 - DNA, 16 bp, H. sapiens
ctgatgtttcttctca

SEQ ID NO: 89256 - DNA, 16 bp, H. sapiens
ctgatgttttaatttt

SEQ ID NO: 89257 - DNA, 16 bp, H. sapiens
ctgattaaaaagtggg

SEQ ID NO: 89258 - DNA, 16 bp, H. sapiens
ctgattaaataaatga

SEQ ID NO: 89259 - DNA, 16 bp, H. sapiens
ctgattattagagaaa

SEQ ID NO: 89260 - DNA, 16 bp, H. sapiens
ctgattatttccttag

SEQ ID NO: 89261 - DNA, 16 bp, H. sapiens
ctgattcagtgggtct

SEQ ID NO: 89262 - DNA, 16 bp, H. sapiens
ctgattccttttattg

SEQ ID NO: 89263 - DNA, 16 bp, H. sapiens
ctgattctgccactta

SEQ ID NO: 89264 - DNA, 16 bp, H. sapiens
ctgattctttgaaaaa

SEQ ID NO: 89265 - DNA, 16 bp, H. sapiens
ctgattctttgaaaag

SEQ ID NO: 89266 - DNA, 16 bp, H. sapiens
ctgattcttttttatg

SEQ ID NO: 89267 - DNA, 16 bp, H. sapiens
ctgattgagaaccact

SEQ ID NO: 89268 - DNA, 16 bp, H. sapiens
ctgattgctgtgttta

SEQ ID NO: 89269 - DNA, 16 bp, H. sapiens
ctgattggacaaggcc

SEQ ID NO: 89270 - DNA, 16 bp, H. sapiens
ctgattggtgtgtttg

SEQ ID NO: 89271 - DNA, 16 bp, H. sapiens
ctgattgtaaaacatg

SEQ ID NO: 89272 - DNA, 16 bp, H. sapiens
ctgattgttaaatttt

SEQ ID NO: 89273 - DNA, 16 bp, H. sapiens
ctgattgtttcctcat

SEQ ID NO: 89274 - DNA, 16 bp, H. sapiens
ctgattgttttctttg

SEQ ID NO: 89275 - DNA, 16 bp, H. sapiens
ctgatttaaaaaaaaa

SEQ ID NO: 89276 - DNA, 16 bp, H. sapiens
ctgatttaaagtcttt

SEQ ID NO: 89277 - DNA, 16 bp, H. sapiens
ctgatttacattttca

SEQ ID NO: 89278 - DNA, 16 bp, H. sapiens
ctgatttatcaagaca

SEQ ID NO: 89279 - DNA, 16 bp, H. sapiens
ctgatttcaaaatata

SEQ ID NO: 89280 - DNA, 16 bp, H. sapiens
ctgatttcaaagccca

SEQ ID NO: 89281 - DNA, 16 bp, H. sapiens
ctgatttcctttcatt

SEQ ID NO: 89282 - DNA, 16 bp, H. sapiens
ctgatttcctttcttc

SEQ ID NO: 89283 - DNA, 16 bp, H. sapiens
ctgatttctattttta

SEQ ID NO: 89284 - DNA, 16 bp, H. sapiens
ctgatttctccctttt

SEQ ID NO: 89285 - DNA, 16 bp, H. sapiens
ctgatttctcttttct

SEQ ID NO: 89286 - DNA, 16 bp, H. sapiens
ctgatttctttggggc

SEQ ID NO: 89287 - DNA, 16 bp, H. sapiens
ctgatttctttgtatt

SEQ ID NO: 89288 - DNA, 16 bp, H. sapiens
ctgatttgacaggagg

SEQ ID NO: 89289 - DNA, 16 bp, H. sapiens
ctgatttgagtaataa

SEQ ID NO: 89290 - DNA, 16 bp, H. sapiens
ctgatttgctttctgt

SEQ ID NO: 89291 - DNA, 16 bp, H. sapiens
ctgatttgggaaaggt

SEQ ID NO: 89292 - DNA, 16 bp, H. sapiens
ctgattttaaaaaaat

SEQ ID NO: 89293 - DNA, 16 bp, H. sapiens
ctgattttaaaactta

SEQ ID NO: 89294 - DNA, 16 bp, H. sapiens
ctgattttaaaatgtt

SEQ ID NO: 89295 - DNA, 16 bp, H. sapiens
ctgattttacaaataa

SEQ ID NO: 89296 - DNA, 16 bp, H. sapiens
ctgattttagttgttt

SEQ ID NO: 89297 - DNA, 16 bp, H. sapiens
ctgattttctgcctgc

SEQ ID NO: 89298 - DNA, 16 bp, H. sapiens
ctgattttctgtctgg

SEQ ID NO: 89299 - DNA, 16 bp, H. sapiens
ctgattttcttaataa

SEQ ID NO: 89300 - DNA, 16 bp, H. sapiens
ctgattttgaaaaaaa

SEQ ID NO: 89301 - DNA, 16 bp, H. sapiens
ctgattttgatatttt

SEQ ID NO: 89302 - DNA, 16 bp, H. sapiens
ctgattttgctgaggg

SEQ ID NO: 89303 - DNA, 16 bp, H. sapiens
ctgatttttaaaaata

SEQ ID NO: 89304 - DNA, 16 bp, H. sapiens
ctgatttttaaatgtt

SEQ ID NO: 89305 - DNA, 16 bp, H. sapiens
ctgatttttcaaattc

SEQ ID NO: 89306 - DNA, 16 bp, H. sapiens
ctgatttttctctttc

SEQ ID NO: 89307 - DNA, 16 bp, H. sapiens
ctgatttttgtatgtt

SEQ ID NO: 89308 - DNA, 16 bp, H. sapiens
ctgatttttgtatttg

SEQ ID NO: 89309 - DNA, 16 bp, H. sapiens
ctgatttttttaaaaa

SEQ ID NO: 89310 - DNA, 16 bp, H. sapiens
ctgatttttttaaaga

SEQ ID NO: 89311 - DNA, 16 bp, H. sapiens
ctgatttttttgagca

SEQ ID NO: 89312 - DNA, 16 bp, H. sapiens
ctgattttttttaaat

SEQ ID NO: 89313 - DNA, 16 bp, H. sapiens
ctgcaaaaataaaaat

SEQ ID NO: 89314 - DNA, 16 bp, H. sapiens
ctgcaaaagacatcat

SEQ ID NO: 89315 - DNA, 16 bp, H. sapiens
ctgcaaaagacatgat

SEQ ID NO: 89316 - DNA, 31 bp, H. sapiens
ctgcaaaatcatgccaaaatgtaaagaccat

SEQ ID NO: 89317 - DNA, 16 bp, H. sapiens
ctgcaaaatggggata

SEQ ID NO: 89318 - DNA, 16 bp, H. sapiens
ctgcaaaatgggggtg

SEQ ID NO: 89319 - DNA, 16 bp, H. sapiens
ctgcaaacagagacag

SEQ ID NO: 89320 - DNA, 16 bp, H. sapiens
ctgcaaaccctgctgt

SEQ ID NO: 89321 - DNA, 16 bp, H. sapiens
ctgcaaagaaaaagaa

SEQ ID NO: 89322 - DNA, 16 bp, H. sapiens
ctgcaaagaaaaataa

SEQ ID NO: 89323 - DNA, 16 bp, H. sapiens
ctgcaaagaacatggt

SEQ ID NO: 89324 - DNA, 16 bp, H. sapiens
ctgcaaagacacaggg

SEQ ID NO: 89325 - DNA, 16 bp, H. sapiens
ctgcaaagacactttt

SEQ ID NO: 89326 - DNA, 23 bp, H. sapiens
ctgcaaagagacttagactccca

SEQ ID NO: 89327 - DNA, 16 bp, H. sapiens
ctgcaaagctgaaaat

SEQ ID NO: 89328 - DNA, 16 bp, H. sapiens
ctgcaaaggatgtgaa

SEQ ID NO: 89329 - DNA, 17 bp, H. sapiens
ctgcaaagtctcttgtg

SEQ ID NO: 89330 - DNA, 16 bp, H. sapiens
ctgcaaatatttattg

SEQ ID NO: 89331 - DNA, 16 bp, H. sapiens
ctgcaaattttccaaa

SEQ ID NO: 89332 - DNA, 16 bp, H. sapiens
ctgcaacaacaacaac

SEQ ID NO: 89333 - DNA, 16 bp, H. sapiens
ctgcaacaggccccag

SEQ ID NO: 89334 - DNA, 16 bp, H. sapiens
ctgcaacatccacctc

SEQ ID NO: 89335 - DNA, 16 bp, H. sapiens
ctgcaacatccgcttc

SEQ ID NO: 89336 - DNA, 16 bp, H. sapiens
ctgcaaccaccacctc

SEQ ID NO: 89337 - DNA, 16 bp, H. sapiens
ctgcaaccactgcctc

SEQ ID NO: 89338 - DNA, 16 bp, H. sapiens
ctgcaaccccaacctc

SEQ ID NO: 89339 - DNA, 16 bp, H. sapiens
ctgcaaccccacctcc

SEQ ID NO: 89340 - DNA, 16 bp, H. sapiens
ctgcaacccccgcttc

SEQ ID NO: 89341 - DNA, 16 bp, H. sapiens
ctgcaacccctgcccc

SEQ ID NO: 89342 - DNA, 16 bp, H. sapiens
ctgcaaccctctgcct

SEQ ID NO: 89343 - DNA, 16 bp, H. sapiens
ctgcaacctcaaccac

SEQ ID NO: 89344 - DNA, 16 bp, H. sapiens
ctgcaacctcagcccc

SEQ ID NO: 89345 - DNA, 16 bp, H. sapiens
ctgcaacctcagcctt

SEQ ID NO: 89346 - DNA, 16 bp, H. sapiens
ctgcaacctccactac

SEQ ID NO: 89347 - DNA, 16 bp, H. sapiens
ctgcaacctctcctcc

SEQ ID NO: 89348 - DNA, 18 bp, H. sapiens
ctgcaacctctgcccccc

SEQ ID NO: 89349 - DNA, 16 bp, H. sapiens
ctgcaaccttggcttc

SEQ ID NO: 89350 - DNA, 16 bp, H. sapiens
ctgcaactcctgggct

SEQ ID NO: 89351 - DNA, 16 bp, H. sapiens
ctgcaacttctccctc

SEQ ID NO: 89352 - DNA, 16 bp, H. sapiens
ctgcaacttctgcttt

SEQ ID NO: 89353 - DNA, 16 bp, H. sapiens
ctgcaacttgcctttt

SEQ ID NO: 89354 - DNA, 16 bp, H. sapiens
ctgcaacttggaatgg

SEQ ID NO: 89355 - DNA, 16 bp, H. sapiens
ctgcaagaaaatattt

SEQ ID NO: 89356 - DNA, 16 bp, H. sapiens
ctgcaagacagagaag

SEQ ID NO: 89357 - DNA, 16 bp, H. sapiens
ctgcaagagaagctgg

SEQ ID NO: 89358 - DNA, 16 bp, H. sapiens
ctgcaagagaatcaga

SEQ ID NO: 89359 - DNA, 16 bp, H. sapiens
ctgcaagagccacagc

SEQ ID NO: 89360 - DNA, 16 bp, H. sapiens
ctgcaagcagcttcca

SEQ ID NO: 89361 - DNA, 16 bp, H. sapiens
ctgcaagctccaccac

SEQ ID NO: 89362 - DNA, 16 bp, H. sapiens
ctgcaagctctgcctg

SEQ ID NO: 89363 - DNA, 16 bp, H. sapiens
ctgcaagctgagggag

SEQ ID NO: 89364 - DNA, 16 bp, H. sapiens
ctgcaaggccacaggg

SEQ ID NO: 89365 - DNA, 16 bp, H. sapiens
ctgcaagggagactgg

SEQ ID NO: 89366 - DNA, 16 bp, H. sapiens
ctgcaataaacataaa

SEQ ID NO: 89367 - DNA, 16 bp, H. sapiens
ctgcaataaccaaaac

SEQ ID NO: 89368 - DNA, 16 bp, H. sapiens
ctgcaatatctctgag

SEQ ID NO: 89369 - DNA, 16 bp, H. sapiens
ctgcaatcccagcacc

SEQ ID NO: 89370 - DNA, 18 bp, H. sapiens
ctgcaatctcagcacttt

SEQ ID NO: 89371 - DNA, 16 bp, H. sapiens
ctgcaatgaaaactat

SEQ ID NO: 89372 - DNA, 16 bp, H. sapiens
ctgcaatgaacatttg

SEQ ID NO: 89373 - DNA, 16 bp, H. sapiens
ctgcaatgaatgtggg

SEQ ID NO: 89374 - DNA, 16 bp, H. sapiens
ctgcaatgagccaaga

SEQ ID NO: 89375 - DNA, 16 bp, H. sapiens
ctgcaatgatagaaat

SEQ ID NO: 89376 - DNA, 16 bp, H. sapiens
ctgcaatgcagcctgg

SEQ ID NO: 89377 - DNA, 16 bp, H. sapiens
ctgcaatgtccacctc

SEQ ID NO: 89378 - DNA, 16 bp, H. sapiens
ctgcacaaacaaaatc

SEQ ID NO: 89379 - DNA, 16 bp, H. sapiens
ctgcacaaagccctct

SEQ ID NO: 89380 - DNA, 17 bp, H. sapiens
ctgcacaactacatgga

SEQ ID NO: 89381 - DNA, 16 bp, H. sapiens
ctgcacaagcaggaag

SEQ ID NO: 89382 - DNA, 18 bp, H. sapiens
ctgcacaataaaacttgg

SEQ ID NO: 89383 - DNA, 16 bp, H. sapiens
ctgcacacacatgttt

SEQ ID NO: 89384 - DNA, 16 bp, H. sapiens
ctgcacacagcacggg

SEQ ID NO: 89385 - DNA, 16 bp, H. sapiens
ctgcacacagccaggc

SEQ ID NO: 89386 - DNA, 16 bp, H. sapiens
ctgcacacagcctggg

SEQ ID NO: 89387 - DNA, 16 bp, H. sapiens
ctgcacacctcggcct

SEQ ID NO: 89388 - DNA, 16 bp, H. sapiens
ctgcacacctgcctgg

SEQ ID NO: 89389 - DNA, 16 bp, H. sapiens
ctgcacactggaatca

SEQ ID NO: 89390 - DNA, 16 bp, H. sapiens
ctgcacactttttttt

SEQ ID NO: 89391 - DNA, 16 bp, H. sapiens
ctgcacagagcagcag

SEQ ID NO: 89392 - DNA, 16 bp, H. sapiens
ctgcacagagcagctg

SEQ ID NO: 89393 - DNA, 16 bp, H. sapiens
ctgcacagagcaggag

SEQ ID NO: 89394 - DNA, 16 bp, H. sapiens
ctgcacagataaaacc

SEQ ID NO: 89395 - DNA, 17 bp, H. sapiens
ctgcacagatcatccca

SEQ ID NO: 89396 - DNA, 16 bp, H. sapiens
ctgcacagatcatctc

SEQ ID NO: 89397 - DNA, 17 bp, H. sapiens
ctgcacagcaaaagaaa

SEQ ID NO: 89398 - DNA, 16 bp, H. sapiens
ctgcacagcaaagaaa

SEQ ID NO: 89399 - DNA, 16 bp, H. sapiens
ctgcacagccagctct

SEQ ID NO: 89400 - DNA, 16 bp, H. sapiens
ctgcacagcctgcaga

SEQ ID NO: 89401 - DNA, 16 bp, H. sapiens
ctgcacagctaaagaa

SEQ ID NO: 89402 - DNA, 16 bp, H. sapiens
ctgcacaggaaaagaa

SEQ ID NO: 89403 - DNA, 16 bp, H. sapiens
ctgcacaggaaaggaa

SEQ ID NO: 89404 - DNA, 16 bp, H. sapiens
ctgcacaggaacccac

SEQ ID NO: 89405 - DNA, 16 bp, H. sapiens
ctgcacatccttgcca

SEQ ID NO: 89406 - DNA, 16 bp, H. sapiens
ctgcacatgaatccca

SEQ ID NO: 89407 - DNA, 16 bp, H. sapiens
ctgcacatgagatggg

SEQ ID NO: 89408 - DNA, 16 bp, H. sapiens
ctgcacatggaacatt

SEQ ID NO: 89409 - DNA, 16 bp, H. sapiens
ctgcacattgtggaca

SEQ ID NO: 89410 - DNA, 16 bp, H. sapiens
ctgcaccaaaaaaaaa

SEQ ID NO: 89411 - DNA, 16 bp, H. sapiens
ctgcaccaacacagat

SEQ ID NO: 89412 - DNA, 16 bp, H. sapiens
ctgcaccacactgctc

SEQ ID NO: 89413 - DNA, 16 bp, H. sapiens
ctgcaccacagcactc

SEQ ID NO: 89414 - DNA, 16 bp, H. sapiens
ctgcaccacagcctgg

SEQ ID NO: 89415 - DNA, 16 bp, H. sapiens
ctgcaccaccacgccc

SEQ ID NO: 89416 - DNA, 16 bp, H. sapiens
ctgcaccactgccctc

SEQ ID NO: 89417 - DNA, 16 bp, H. sapiens
ctgcacccacagctgc

SEQ ID NO: 89418 - DNA, 16 bp, H. sapiens
ctgcacccagccaaac

SEQ ID NO: 89419 - DNA, 16 bp, H. sapiens
ctgcacccagccaaga

SEQ ID NO: 89420 - DNA, 16 bp, H. sapiens
ctgcacccagccagcc

SEQ ID NO: 89421 - DNA, 16 bp, H. sapiens
ctgcacccagccaggt

SEQ ID NO: 89422 - DNA, 16 bp, H. sapiens
ctgcacccagcccacc

SEQ ID NO: 89423 - DNA, 16 bp, H. sapiens
ctgcacccagccccag

SEQ ID NO: 89424 - DNA, 16 bp, H. sapiens
ctgcacccagccctct

SEQ ID NO: 89425 - DNA, 16 bp, H. sapiens
ctgcacccagccctgc

SEQ ID NO: 89426 - DNA, 16 bp, H. sapiens
ctgcacccagcctcct

SEQ ID NO: 89427 - DNA, 16 bp, H. sapiens
ctgcacccagcctgac

SEQ ID NO: 89428 - DNA, 16 bp, H. sapiens
ctgcacccagcctgcc

SEQ ID NO: 89429 - DNA, 16 bp, H. sapiens
ctgcacccagcctgga

SEQ ID NO: 89430 - DNA, 16 bp, H. sapiens
ctgcacccagcctggc

SEQ ID NO: 89431 - DNA, 16 bp, H. sapiens
ctgcacccagcctggg

SEQ ID NO: 89432 - DNA, 16 bp, H. sapiens
ctgcacccagcctggt

SEQ ID NO: 89433 - DNA, 16 bp, H. sapiens
ctgcaccccagccagg

SEQ ID NO: 89434 - DNA, 16 bp, H. sapiens
ctgcaccccagccctg

SEQ ID NO: 89435 - DNA, 16 bp, H. sapiens
ctgcaccccagcctgg

SEQ ID NO: 89436 - DNA, 16 bp, H. sapiens
ctgcaccccaggctgg

SEQ ID NO: 89437 - DNA, 16 bp, H. sapiens
ctgcaccccatcctgg

SEQ ID NO: 89438 - DNA, 16 bp, H. sapiens
ctgcacccccagcctg

SEQ ID NO: 89439 - DNA, 16 bp, H. sapiens
ctgcacccggccatct

SEQ ID NO: 89440 - DNA, 16 bp, H. sapiens
ctgcacccggccccta

SEQ ID NO: 89441 - DNA, 16 bp, H. sapiens
ctgcaccctcaccacc

SEQ ID NO: 89442 - DNA, 16 bp, H. sapiens
ctgcaccctccacctc

SEQ ID NO: 89443 - DNA, 16 bp, H. sapiens
ctgcaccctcctcctc

SEQ ID NO: 89444 - DNA, 16 bp, H. sapiens
ctgcaccgcagcctgg

SEQ ID NO: 89445 - DNA, 16 bp, H. sapiens
ctgcacctccacctcc

SEQ ID NO: 89446 - DNA, 18 bp, H. sapiens
ctgcacctggaactgttt

SEQ ID NO: 89447 - DNA, 16 bp, H. sapiens
ctgcacctggccaagg

SEQ ID NO: 89448 - DNA, 16 bp, H. sapiens
ctgcacctggccaagt

SEQ ID NO: 89449 - DNA, 16 bp, H. sapiens
ctgcacctggccacca

SEQ ID NO: 89450 - DNA, 16 bp, H. sapiens
ctgcacctggccacct

SEQ ID NO: 89451 - DNA, 16 bp, H. sapiens
ctgcacctggccagag

SEQ ID NO: 89452 - DNA, 16 bp, H. sapiens
ctgcacctggccagcc

SEQ ID NO: 89453 - DNA, 16 bp, H. sapiens
ctgcacctggccaggc

SEQ ID NO: 89454 - DNA, 16 bp, H. sapiens
ctgcacctggccatgt

SEQ ID NO: 89455 - DNA, 16 bp, H. sapiens
ctgcacctggcccagg

SEQ ID NO: 89456 - DNA, 16 bp, H. sapiens
ctgcacctggcccagt

SEQ ID NO: 89457 - DNA, 16 bp, H. sapiens
ctgcacctggccccct

SEQ ID NO: 89458 - DNA, 16 bp, H. sapiens
ctgcacctggcccctt

SEQ ID NO: 89459 - DNA, 16 bp, H. sapiens
ctgcacctggccctga

SEQ ID NO: 89460 - DNA, 16 bp, H. sapiens
ctgcacctggcccttt

SEQ ID NO: 89461 - DNA, 16 bp, H. sapiens
ctgcacctggccgaga

SEQ ID NO: 89462 - DNA, 16 bp, H. sapiens
ctgcacctggcctggg

SEQ ID NO: 89463 - DNA, 16 bp, H. sapiens
ctgcacctggccttca

SEQ ID NO: 89464 - DNA, 16 bp, H. sapiens
ctgcacctggccttcc

SEQ ID NO: 89465 - DNA, 16 bp, H. sapiens
ctgcacctggctgagc

SEQ ID NO: 89466 - DNA, 16 bp, H. sapiens
ctgcaccttctgcctc

SEQ ID NO: 89467 - DNA, 16 bp, H. sapiens
ctgcaccttcttaggg

SEQ ID NO: 89468 - DNA, 16 bp, H. sapiens
ctgcacgcagccccgg

SEQ ID NO: 89469 - DNA, 16 bp, H. sapiens
ctgcactatttttttt

SEQ ID NO: 89470 - DNA, 16 bp, H. sapiens
ctgcactcactgtcca

SEQ ID NO: 89471 - DNA, 16 bp, H. sapiens
ctgcactccacccagg

SEQ ID NO: 89472 - DNA, 16 bp, H. sapiens
ctgcactccactccac

SEQ ID NO: 89473 - DNA, 16 bp, H. sapiens
ctgcactccagcccct

SEQ ID NO: 89474 - DNA, 24 bp, H. sapiens
ctgcactccagcccgggcgacaga

SEQ ID NO: 89475 - DNA, 16 bp, H. sapiens
ctgcactccagcctat

SEQ ID NO: 89476 - DNA, 16 bp, H. sapiens
ctgcactccagtgtgg

SEQ ID NO: 89477 - DNA, 16 bp, H. sapiens
ctgcactccatcctgt

SEQ ID NO: 89478 - DNA, 16 bp, H. sapiens
ctgcactccatgctgg

SEQ ID NO: 89479 - DNA, 16 bp, H. sapiens
ctgcactcctcagcct

SEQ ID NO: 89480 - DNA, 16 bp, H. sapiens
ctgcactcctgggcga

SEQ ID NO: 89481 - DNA, 16 bp, H. sapiens
ctgcactcggagcagc

SEQ ID NO: 89482 - DNA, 16 bp, H. sapiens
ctgcactgatcaccca

SEQ ID NO: 89483 - DNA, 16 bp, H. sapiens
ctgcactgcagccagg

SEQ ID NO: 89484 - DNA, 16 bp, H. sapiens
ctgcactgcagcccag

SEQ ID NO: 89485 - DNA, 16 bp, H. sapiens
ctgcactgcagccttg

SEQ ID NO: 89486 - DNA, 16 bp, H. sapiens
ctgcactgcggcctgg

SEQ ID NO: 89487 - DNA, 16 bp, H. sapiens
ctgcactgctgcctgg

SEQ ID NO: 89488 - DNA, 16 bp, H. sapiens
ctgcactggcctccca

SEQ ID NO: 89489 - DNA, 19 bp, H. sapiens
ctgcactgtgggagcccct

SEQ ID NO: 89490 - DNA, 16 bp, H. sapiens
ctgcactgtgggaggc

SEQ ID NO: 89491 - DNA, 16 bp, H. sapiens
ctgcactgttcttgtg

SEQ ID NO: 89492 - DNA, 16 bp, H. sapiens
ctgcacttaaaaaaaa

SEQ ID NO: 89493 - DNA, 16 bp, H. sapiens
ctgcacttcagcatgg

SEQ ID NO: 89494 - DNA, 16 bp, H. sapiens
ctgcacttcctgcaca

SEQ ID NO: 89495 - DNA, 16 bp, H. sapiens
ctgcacttctctctcc

SEQ ID NO: 89496 - DNA, 16 bp, H. sapiens
ctgcacttctgcctgg

SEQ ID NO: 89497 - DNA, 16 bp, H. sapiens
ctgcagaaatacaaaa

SEQ ID NO: 89498 - DNA, 16 bp, H. sapiens
ctgcagaaatgagctg

SEQ ID NO: 89499 - DNA, 16 bp, H. sapiens
ctgcagaaatttgcaa

SEQ ID NO: 89500 - DNA, 16 bp, H. sapiens
ctgcagaacagcagat

SEQ ID NO: 89501 - DNA, 16 bp, H. sapiens
ctgcagaactgtaaga

SEQ ID NO: 89502 - DNA, 16 bp, H. sapiens
ctgcagaagaaaaatt

SEQ ID NO: 89503 - DNA, 16 bp, H. sapiens
ctgcagaagacattat

SEQ ID NO: 89504 - DNA, 19 bp, H. sapiens
ctgcagaagtttctgctgc

SEQ ID NO: 89505 - DNA, 16 bp, H. sapiens
ctgcagaagttttttt

SEQ ID NO: 89506 - DNA, 16 bp, H. sapiens
ctgcagaccacagctg

SEQ ID NO: 89507 - DNA, 16 bp, H. sapiens
ctgcagacccaggcat

SEQ ID NO: 89508 - DNA, 16 bp, H. sapiens
ctgcagaccttcccag

SEQ ID NO: 89509 - DNA, 16 bp, H. sapiens
ctgcagactccacctc

SEQ ID NO: 89510 - DNA, 16 bp, H. sapiens
ctgcagactgcagtgg

SEQ ID NO: 89511 - DNA, 16 bp, H. sapiens
ctgcagagaaaaagaa

SEQ ID NO: 89512 - DNA, 16 bp, H. sapiens
ctgcagagacagaaag

SEQ ID NO: 89513 - DNA, 16 bp, H. sapiens
ctgcagagactgtggc

SEQ ID NO: 89514 - DNA, 16 bp, H. sapiens
ctgcagagagctgtga

SEQ ID NO: 89515 - DNA, 16 bp, H. sapiens
ctgcagagaggagcca

SEQ ID NO: 89516 - DNA, 16 bp, H. sapiens
ctgcagagccacaggg

SEQ ID NO: 89517 - DNA, 16 bp, H. sapiens
ctgcagagctggggct

SEQ ID NO: 89518 - DNA, 16 bp, H. sapiens
ctgcagaggaaaggga

SEQ ID NO: 89519 - DNA, 16 bp, H. sapiens
ctgcagaggacatgaa

SEQ ID NO: 89520 - DNA, 16 bp, H. sapiens
ctgcagaggaggctgg

SEQ ID NO: 89521 - DNA, 16 bp, H. sapiens
ctgcagaggcagaggc

SEQ ID NO: 89522 - DNA, 16 bp, H. sapiens
ctgcagaggcagtggc

SEQ ID NO: 89523 - DNA, 16 bp, H. sapiens
ctgcagaggctgttct

SEQ ID NO: 89524 - DNA, 16 bp, H. sapiens
ctgcagagtcccaagg

SEQ ID NO: 89525 - DNA, 16 bp, H. sapiens
ctgcagatgtggatcc

SEQ ID NO: 89526 - DNA, 16 bp, H. sapiens
ctgcagcaagccctgc

SEQ ID NO: 89527 - DNA, 16 bp, H. sapiens
ctgcagcaccatttgg

SEQ ID NO: 89528 - DNA, 16 bp, H. sapiens
ctgcagcagagaggcc

SEQ ID NO: 89529 - DNA, 16 bp, H. sapiens
ctgcagcagaggaaca

SEQ ID NO: 89530 - DNA, 16 bp, H. sapiens
ctgcagcagaggggcc

SEQ ID NO: 89531 - DNA, 16 bp, H. sapiens
ctgcagcagagggtcc

SEQ ID NO: 89532 - DNA, 16 bp, H. sapiens
ctgcagcagcagccag

SEQ ID NO: 89533 - DNA, 16 bp, H. sapiens
ctgcagcagccatctt

SEQ ID NO: 89534 - DNA, 16 bp, H. sapiens
ctgcagcagcctcctc

SEQ ID NO: 89535 - DNA, 16 bp, H. sapiens
ctgcagcagctgctgc

SEQ ID NO: 89536 - DNA, 16 bp, H. sapiens
ctgcagcaggagcatg

SEQ ID NO: 89537 - DNA, 16 bp, H. sapiens
ctgcagcaggaggaag

SEQ ID NO: 89538 - DNA, 16 bp, H. sapiens
ctgcagcaggggaggc

SEQ ID NO: 89539 - DNA, 16 bp, H. sapiens
ctgcagcatcagcctc

SEQ ID NO: 89540 - DNA, 16 bp, H. sapiens
ctgcagcattgaactc

SEQ ID NO: 89541 - DNA, 16 bp, H. sapiens
ctgcagccacactggc

SEQ ID NO: 89542 - DNA, 16 bp, H. sapiens
ctgcagccacagcctc

SEQ ID NO: 89543 - DNA, 16 bp, H. sapiens
ctgcagccaccacctc

SEQ ID NO: 89544 - DNA, 16 bp, H. sapiens
ctgcagccactgcctc

SEQ ID NO: 89545 - DNA, 16 bp, H. sapiens
ctgcagccactgctgc

SEQ ID NO: 89546 - DNA, 16 bp, H. sapiens
ctgcagccactggccc

SEQ ID NO: 89547 - DNA, 16 bp, H. sapiens
ctgcagccactgtggg

SEQ ID NO: 89548 - DNA, 16 bp, H. sapiens
ctgcagccagggtgtc

SEQ ID NO: 89549 - DNA, 16 bp, H. sapiens
ctgcagcccagagagg

SEQ ID NO: 89550 - DNA, 16 bp, H. sapiens
ctgcagcccagccagg

SEQ ID NO: 89551 - DNA, 16 bp, H. sapiens
ctgcagcccagctctg

SEQ ID NO: 89552 - DNA, 16 bp, H. sapiens
ctgcagcccaggagtt

SEQ ID NO: 89553 - DNA, 16 bp, H. sapiens
ctgcagcccaggggtt

SEQ ID NO: 89554 - DNA, 16 bp, H. sapiens
ctgcagccccagccaa

SEQ ID NO: 89555 - DNA, 16 bp, H. sapiens
ctgcagccccagctac

SEQ ID NO: 89556 - DNA, 16 bp, H. sapiens
ctgcagccccagcttc

SEQ ID NO: 89557 - DNA, 16 bp, H. sapiens
ctgcagccccaggccc

SEQ ID NO: 89558 - DNA, 16 bp, H. sapiens
ctgcagcccccagccc

SEQ ID NO: 89559 - DNA, 16 bp, H. sapiens
ctgcagccccctccct

SEQ ID NO: 89560 - DNA, 16 bp, H. sapiens
ctgcagcccctcctcc

SEQ ID NO: 89561 - DNA, 16 bp, H. sapiens
ctgcagcccctgcctc

SEQ ID NO: 89562 - DNA, 16 bp, H. sapiens
ctgcagcccctgctgg

SEQ ID NO: 89563 - DNA, 16 bp, H. sapiens
ctgcagccctgacctc

SEQ ID NO: 89564 - DNA, 16 bp, H. sapiens
ctgcagccctgcagcc

SEQ ID NO: 89565 - DNA, 16 bp, H. sapiens
ctgcagccctgccctg

SEQ ID NO: 89566 - DNA, 16 bp, H. sapiens
ctgcagccctggtgcg

SEQ ID NO: 89567 - DNA, 16 bp, H. sapiens
ctgcagccgccacctc

SEQ ID NO: 89568 - DNA, 16 bp, H. sapiens
ctgcagccgctggccc

SEQ ID NO: 89569 - DNA, 16 bp, H. sapiens
ctgcagcctcaaactg

SEQ ID NO: 89570 - DNA, 16 bp, H. sapiens
ctgcagcctcaccagc

SEQ ID NO: 89571 - DNA, 16 bp, H. sapiens
ctgcagcctcacctcc

SEQ ID NO: 89572 - DNA, 16 bp, H. sapiens
ctgcagcctcagattc

SEQ ID NO: 89573 - DNA, 16 bp, H. sapiens
ctgcagcctcagccac

SEQ ID NO: 89574 - DNA, 16 bp, H. sapiens
ctgcagcctcagcctc

SEQ ID NO: 89575 - DNA, 16 bp, H. sapiens
ctgcagcctcagctgg

SEQ ID NO: 89576 - DNA, 16 bp, H. sapiens
ctgcagcctcatcctc

SEQ ID NO: 89577 - DNA, 16 bp, H. sapiens
ctgcagcctccacttc

SEQ ID NO: 89578 - DNA, 16 bp, H. sapiens
ctgcagcctcccaaag

SEQ ID NO: 89579 - DNA, 16 bp, H. sapiens
ctgcagcctccccagc

SEQ ID NO: 89580 - DNA, 16 bp, H. sapiens
ctgcagcctcccgagt

SEQ ID NO: 89581 - DNA, 16 bp, H. sapiens
ctgcagcctccctccc

SEQ ID NO: 89582 - DNA, 16 bp, H. sapiens
ctgcagcctccctctc

SEQ ID NO: 89583 - DNA, 16 bp, H. sapiens
ctgcagcctccctgcc

SEQ ID NO: 89584 - DNA, 16 bp, H. sapiens
ctgcagcctcctcccc

SEQ ID NO: 89585 - DNA, 16 bp, H. sapiens
ctgcagcctcctcctc

SEQ ID NO: 89586 - DNA, 16 bp, H. sapiens
ctgcagcctcctcctg

SEQ ID NO: 89587 - DNA, 16 bp, H. sapiens
ctgcagcctcctgcct

SEQ ID NO: 89588 - DNA, 16 bp, H. sapiens
ctgcagcctcctgggc

SEQ ID NO: 89589 - DNA, 16 bp, H. sapiens
ctgcagcctcgacctg

SEQ ID NO: 89590 - DNA, 16 bp, H. sapiens
ctgcagcctctccctc

SEQ ID NO: 89591 - DNA, 16 bp, H. sapiens
ctgcagcctctcctgg

SEQ ID NO: 89592 - DNA, 16 bp, H. sapiens
ctgcagcctctctcct

SEQ ID NO: 89593 - DNA, 16 bp, H. sapiens
ctgcagcctctgcccg

SEQ ID NO: 89594 - DNA, 16 bp, H. sapiens
ctgcagcctctgccct

SEQ ID NO: 89595 - DNA, 16 bp, H. sapiens
ctgcagcctctgccgc

SEQ ID NO: 89596 - DNA, 16 bp, H. sapiens
ctgcagcctctgctga

SEQ ID NO: 89597 - DNA, 17 bp, H. sapiens
ctgcagcctctgctggt

SEQ ID NO: 89598 - DNA, 16 bp, H. sapiens
ctgcagcctctgtccc

SEQ ID NO: 89599 - DNA, 16 bp, H. sapiens
ctgcagcctcttcctc

SEQ ID NO: 89600 - DNA, 16 bp, H. sapiens
ctgcagcctgagagtt

SEQ ID NO: 89601 - DNA, 16 bp, H. sapiens
ctgcagcctgcaccct

SEQ ID NO: 89602 - DNA, 16 bp, H. sapiens
ctgcagcctgcagcct

SEQ ID NO: 89603 - DNA, 16 bp, H. sapiens
ctgcagcctggacaac

SEQ ID NO: 89604 - DNA, 16 bp, H. sapiens
ctgcagcctggacctg

SEQ ID NO: 89605 - DNA, 16 bp, H. sapiens
ctgcagcctggagctg

SEQ ID NO: 89606 - DNA, 16 bp, H. sapiens
ctgcagcctggcaggg

SEQ ID NO: 89607 - DNA, 16 bp, H. sapiens
ctgcagcctggcccgg

SEQ ID NO: 89608 - DNA, 16 bp, H. sapiens
ctgcagcctggcctgg

SEQ ID NO: 89609 - DNA, 16 bp, H. sapiens
ctgcagcctgggcaag

SEQ ID NO: 89610 - DNA, 16 bp, H. sapiens
ctgcagcctgggcagc

SEQ ID NO: 89611 - DNA, 16 bp, H. sapiens
ctgcagcctgggcctc

SEQ ID NO: 89612 - DNA, 16 bp, H. sapiens
ctgcagccttaacctc

SEQ ID NO: 89613 - DNA, 16 bp, H. sapiens
ctgcagccttccacag

SEQ ID NO: 89614 - DNA, 16 bp, H. sapiens
ctgcagccttgactgc

SEQ ID NO: 89615 - DNA, 17 bp, H. sapiens
ctgcagctagctcggtg

SEQ ID NO: 89616 - DNA, 16 bp, H. sapiens
ctgcagctcaaactcc

SEQ ID NO: 89617 - DNA, 16 bp, H. sapiens
ctgcagctccagctcc

SEQ ID NO: 89618 - DNA, 18 bp, H. sapiens
ctgcagctcccagcgtga

SEQ ID NO: 89619 - DNA, 16 bp, H. sapiens
ctgcagctcccaggga

SEQ ID NO: 89620 - DNA, 16 bp, H. sapiens
ctgcagctccgcctcc

SEQ ID NO: 89621 - DNA, 16 bp, H. sapiens
ctgcagctgaggctcc

SEQ ID NO: 89622 - DNA, 16 bp, H. sapiens
ctgcagctgaggggcc

SEQ ID NO: 89623 - DNA, 16 bp, H. sapiens
ctgcagctgcagcctc

SEQ ID NO: 89624 - DNA, 16 bp, H. sapiens
ctgcagctgcagctgg

SEQ ID NO: 89625 - DNA, 16 bp, H. sapiens
ctgcagctgcaggaag

SEQ ID NO: 89626 - DNA, 16 bp, H. sapiens
ctgcagctgcaggcat

SEQ ID NO: 89627 - DNA, 16 bp, H. sapiens
ctgcagctgcccaagc

SEQ ID NO: 89628 - DNA, 16 bp, H. sapiens
ctgcagctgcccaagt

SEQ ID NO: 89629 - DNA, 16 bp, H. sapiens
ctgcagctgcccagct

SEQ ID NO: 89630 - DNA, 16 bp, H. sapiens
ctgcagctgctcctgc

SEQ ID NO: 89631 - DNA, 16 bp, H. sapiens
ctgcagctgctggccc

SEQ ID NO: 89632 - DNA, 16 bp, H. sapiens
ctgcagctggaccaga

SEQ ID NO: 89633 - DNA, 16 bp, H. sapiens
ctgcagctggcattgg

SEQ ID NO: 89634 - DNA, 16 bp, H. sapiens
ctgcagctggcttgga

SEQ ID NO: 89635 - DNA, 16 bp, H. sapiens
ctgcagctggtgctct

SEQ ID NO: 89636 - DNA, 16 bp, H. sapiens
ctgcagctgtgcccag

SEQ ID NO: 89637 - DNA, 16 bp, H. sapiens
ctgcagctgtgcctgg

SEQ ID NO: 89638 - DNA, 16 bp, H. sapiens
ctgcagcttccacttc

SEQ ID NO: 89639 - DNA, 16 bp, H. sapiens
ctgcagcttcccaaag

SEQ ID NO: 89640 - DNA, 16 bp, H. sapiens
ctgcagcttctgctgg

SEQ ID NO: 89641 - DNA, 16 bp, H. sapiens
ctgcagcttctgcttc

SEQ ID NO: 89642 - DNA, 16 bp, H. sapiens
ctgcagctttggcctc

SEQ ID NO: 89643 - DNA, 16 bp, H. sapiens
ctgcagcttttcctgg

SEQ ID NO: 89644 - DNA, 16 bp, H. sapiens
ctgcaggaattttttt

SEQ ID NO: 89645 - DNA, 16 bp, H. sapiens
ctgcaggagaagccag

SEQ ID NO: 89646 - DNA, 16 bp, H. sapiens
ctgcaggagagagagc

SEQ ID NO: 89647 - DNA, 16 bp, H. sapiens
ctgcaggaggaggaag

SEQ ID NO: 89648 - DNA, 16 bp, H. sapiens
ctgcaggagttttttt

SEQ ID NO: 89649 - DNA, 16 bp, H. sapiens
ctgcaggatgtggaca

SEQ ID NO: 89650 - DNA, 16 bp, H. sapiens
ctgcaggcacgcacca

SEQ ID NO: 89651 - DNA, 16 bp, H. sapiens
ctgcaggcactcaatg

SEQ ID NO: 89652 - DNA, 16 bp, H. sapiens
ctgcaggcagagctgg

SEQ ID NO: 89653 - DNA, 16 bp, H. sapiens
ctgcaggcatcacact

SEQ ID NO: 89654 - DNA, 16 bp, H. sapiens
ctgcaggccaatatcc

SEQ ID NO: 89655 - DNA, 16 bp, H. sapiens
ctgcaggccaggctgg

SEQ ID NO: 89656 - DNA, 16 bp, H. sapiens
ctgcaggcctccatct

SEQ ID NO: 89657 - DNA, 16 bp, H. sapiens
ctgcaggcctcctggg

SEQ ID NO: 89658 - DNA, 16 bp, H. sapiens
ctgcaggcgcgcacca

SEQ ID NO: 89659 - DNA, 16 bp, H. sapiens
ctgcaggctcaacttc

SEQ ID NO: 89660 - DNA, 16 bp, H. sapiens
ctgcaggctccacctc

SEQ ID NO: 89661 - DNA, 16 bp, H. sapiens
ctgcaggctccctgag

SEQ ID NO: 89662 - DNA, 16 bp, H. sapiens
ctgcaggctctgcctt

SEQ ID NO: 89663 - DNA, 16 bp, H. sapiens
ctgcaggctctgtggg

SEQ ID NO: 89664 - DNA, 16 bp, H. sapiens
ctgcaggctgcacagg

SEQ ID NO: 89665 - DNA, 16 bp, H. sapiens
ctgcaggctgcaggct

SEQ ID NO: 89666 - DNA, 16 bp, H. sapiens
ctgcaggctggggagg

SEQ ID NO: 89667 - DNA, 16 bp, H. sapiens
ctgcaggctgtacagg

SEQ ID NO: 89668 - DNA, 16 bp, H. sapiens
ctgcaggcttcatctt

SEQ ID NO: 89669 - DNA, 16 bp, H. sapiens
ctgcaggctttggaga

SEQ ID NO: 89670 - DNA, 16 bp, H. sapiens
ctgcagggagccgaga

SEQ ID NO: 89671 - DNA, 16 bp, H. sapiens
ctgcagggcaggaggc

SEQ ID NO: 89672 - DNA, 16 bp, H. sapiens
ctgcagggcaggctgg

SEQ ID NO: 89673 - DNA, 16 bp, H. sapiens
ctgcagggccagggcc

SEQ ID NO: 89674 - DNA, 16 bp, H. sapiens
ctgcagggctgctgtg

SEQ ID NO: 89675 - DNA, 16 bp, H. sapiens
ctgcagggctgggagg

SEQ ID NO: 89676 - DNA, 16 bp, H. sapiens
ctgcaggggaactggg

SEQ ID NO: 89677 - DNA, 16 bp, H. sapiens
ctgcaggggcagagcc

SEQ ID NO: 89678 - DNA, 16 bp, H. sapiens
ctgcaggggcggggcc

SEQ ID NO: 89679 - DNA, 16 bp, H. sapiens
ctgcaggggcggggct

SEQ ID NO: 89680 - DNA, 16 bp, H. sapiens
ctgcaggggctggggg

SEQ ID NO: 89681 - DNA, 16 bp, H. sapiens
ctgcaggggtggagcc

SEQ ID NO: 89682 - DNA, 16 bp, H. sapiens
ctgcaggggtggggct

SEQ ID NO: 89683 - DNA, 16 bp, H. sapiens
ctgcagggtgggctgg

SEQ ID NO: 89684 - DNA, 16 bp, H. sapiens
ctgcaggtaactgaaa

SEQ ID NO: 89685 - DNA, 16 bp, H. sapiens
ctgcaggtccccagcc

SEQ ID NO: 89686 - DNA, 16 bp, H. sapiens
ctgcaggtctgctgca

SEQ ID NO: 89687 - DNA, 16 bp, H. sapiens
ctgcaggtgccacagg

SEQ ID NO: 89688 - DNA, 16 bp, H. sapiens
ctgcaggtggacattt

SEQ ID NO: 89689 - DNA, 16 bp, H. sapiens
ctgcaggtggagctgc

SEQ ID NO: 89690 - DNA, 16 bp, H. sapiens
ctgcaggtggcagggg

SEQ ID NO: 89691 - DNA, 16 bp, H. sapiens
ctgcaggtgtcacctc

SEQ ID NO: 89692 - DNA, 16 bp, H. sapiens
ctgcaggttgtacagg

SEQ ID NO: 89693 - DNA, 17 bp, H. sapiens
ctgcagtaaccaaaaca

SEQ ID NO: 89694 - DNA, 16 bp, H. sapiens
ctgcagtcacagctac

SEQ ID NO: 89695 - DNA, 16 bp, H. sapiens
ctgcagtcagccaaga

SEQ ID NO: 89696 - DNA, 16 bp, H. sapiens
ctgcagtccaccctgg

SEQ ID NO: 89697 - DNA, 16 bp, H. sapiens
ctgcagtccagactgg

SEQ ID NO: 89698 - DNA, 16 bp, H. sapiens
ctgcagtccagcatgg

SEQ ID NO: 89699 - DNA, 16 bp, H. sapiens
ctgcagtccagcctag

SEQ ID NO: 89700 - DNA, 16 bp, H. sapiens
ctgcagtccaggctgg

SEQ ID NO: 89701 - DNA, 16 bp, H. sapiens
ctgcagtcccagcttc

SEQ ID NO: 89702 - DNA, 18 bp, H. sapiens
ctgcagtccggcctgggc

SEQ ID NO: 89703 - DNA, 16 bp, H. sapiens
ctgcagtctggctctc

SEQ ID NO: 89704 - DNA, 16 bp, H. sapiens
ctgcagtgaacacatg

SEQ ID NO: 89705 - DNA, 16 bp, H. sapiens
ctgcagtgaacataca

SEQ ID NO: 89706 - DNA, 16 bp, H. sapiens
ctgcagtgaaccatga

SEQ ID NO: 89707 - DNA, 16 bp, H. sapiens
ctgcagtgagcaaaga

SEQ ID NO: 89708 - DNA, 16 bp, H. sapiens
ctgcagtgagcagaga

SEQ ID NO: 89709 - DNA, 21 bp, H. sapiens
ctgcagtgagccaagatcgcg

SEQ ID NO: 89710 - DNA, 16 bp, H. sapiens
ctgcagtgagctatgc

SEQ ID NO: 89711 - DNA, 16 bp, H. sapiens
ctgcagtgagtggaga

SEQ ID NO: 89712 - DNA, 16 bp, H. sapiens
ctgcagtgcactgtga

SEQ ID NO: 89713 - DNA, 16 bp, H. sapiens
ctgcagtgcagcctgg

SEQ ID NO: 89714 - DNA, 16 bp, H. sapiens
ctgcagtgcagtggca

SEQ ID NO: 89715 - DNA, 16 bp, H. sapiens
ctgcagtgcagtggcc

SEQ ID NO: 89716 - DNA, 16 bp, H. sapiens
ctgcagtgcagtggta

SEQ ID NO: 89717 - DNA, 16 bp, H. sapiens
ctgcagtgcagtgtca

SEQ ID NO: 89718 - DNA, 16 bp, H. sapiens
ctgcagtgcattggca

SEQ ID NO: 89719 - DNA, 16 bp, H. sapiens
ctgcagtgcccaggac

SEQ ID NO: 89720 - DNA, 16 bp, H. sapiens
ctgcagtgcctggcac

SEQ ID NO: 89721 - DNA, 16 bp, H. sapiens
ctgcagtgctgtggtg

SEQ ID NO: 89722 - DNA, 16 bp, H. sapiens
ctgcagtggcacgatc

SEQ ID NO: 89723 - DNA, 16 bp, H. sapiens
ctgcagtggctgaact

SEQ ID NO: 89724 - DNA, 16 bp, H. sapiens
ctgcagtgggctctgc

SEQ ID NO: 89725 - DNA, 16 bp, H. sapiens
ctgcagtggtgtgatc

SEQ ID NO: 89726 - DNA, 16 bp, H. sapiens
ctgcagtgtgccatga

SEQ ID NO: 89727 - DNA, 16 bp, H. sapiens
ctgcagtgtgctgtga

SEQ ID NO: 89728 - DNA, 16 bp, H. sapiens
ctgcagtgtttggttt

SEQ ID NO: 89729 - DNA, 16 bp, H. sapiens
ctgcagttcctggcat

SEQ ID NO: 89730 - DNA, 16 bp, H. sapiens
ctgcagtttgaaaaac

SEQ ID NO: 89731 - DNA, 16 bp, H. sapiens
ctgcagttttatggaa

SEQ ID NO: 89732 - DNA, 16 bp, H. sapiens
ctgcagttttattttt

SEQ ID NO: 89733 - DNA, 16 bp, H. sapiens
ctgcagttttgaaaca

SEQ ID NO: 89734 - DNA, 16 bp, H. sapiens
ctgcagttttgttttt

SEQ ID NO: 89735 - DNA, 16 bp, H. sapiens
ctgcataacaaaccac

SEQ ID NO: 89736 - DNA, 16 bp, H. sapiens
ctgcataatattccat

SEQ ID NO: 89737 - DNA, 16 bp, H. sapiens
ctgcatacctcattct

SEQ ID NO: 89738 - DNA, 16 bp, H. sapiens
ctgcatatctacaact

SEQ ID NO: 89739 - DNA, 16 bp, H. sapiens
ctgcatattagtcctt

SEQ ID NO: 89740 - DNA, 16 bp, H. sapiens
ctgcatattctttttt

SEQ ID NO: 89741 - DNA, 16 bp, H. sapiens
ctgcatcaaaaagtct

SEQ ID NO: 89742 - DNA, 16 bp, H. sapiens
ctgcatcagaatcacc

SEQ ID NO: 89743 - DNA, 16 bp, H. sapiens
ctgcatcagcctccca

SEQ ID NO: 89744 - DNA, 16 bp, H. sapiens
ctgcatcagcctcccg

SEQ ID NO: 89745 - DNA, 16 bp, H. sapiens
ctgcatccagcctggg

SEQ ID NO: 89746 - DNA, 16 bp, H. sapiens
ctgcatccatgttcct

SEQ ID NO: 89747 - DNA, 16 bp, H. sapiens
ctgcatcccagaggtt

SEQ ID NO: 89748 - DNA, 16 bp, H. sapiens
ctgcatcccaggctca

SEQ ID NO: 89749 - DNA, 16 bp, H. sapiens
ctgcatccctccctcc

SEQ ID NO: 89750 - DNA, 16 bp, H. sapiens
ctgcatccctgcagct

SEQ ID NO: 89751 - DNA, 16 bp, H. sapiens
ctgcatccctggcctc

SEQ ID NO: 89752 - DNA, 16 bp, H. sapiens
ctgcatcctcaacttc

SEQ ID NO: 89753 - DNA, 16 bp, H. sapiens
ctgcatcctccacctc

SEQ ID NO: 89754 - DNA, 16 bp, H. sapiens
ctgcatcctccagaga

SEQ ID NO: 89755 - DNA, 16 bp, H. sapiens
ctgcatcctcctcctc

SEQ ID NO: 89756 - DNA, 16 bp, H. sapiens
ctgcatccttgccagc

SEQ ID NO: 89757 - DNA, 16 bp, H. sapiens
ctgcatctcaaaataa

SEQ ID NO: 89758 - DNA, 16 bp, H. sapiens
ctgcatctggccaaaa

SEQ ID NO: 89759 - DNA, 16 bp, H. sapiens
ctgcatctgtgaaatg

SEQ ID NO: 89760 - DNA, 16 bp, H. sapiens
ctgcatctgttaagat

SEQ ID NO: 89761 - DNA, 16 bp, H. sapiens
ctgcatcttctcactt

SEQ ID NO: 89762 - DNA, 16 bp, H. sapiens
ctgcatgcacagtggc

SEQ ID NO: 89763 - DNA, 16 bp, H. sapiens
ctgcatgcatgtgtgt

SEQ ID NO: 89764 - DNA, 16 bp, H. sapiens
ctgcatgccagcctga

SEQ ID NO: 89765 - DNA, 16 bp, H. sapiens
ctgcatgccagcctgg

SEQ ID NO: 89766 - DNA, 16 bp, H. sapiens
ctgcatgtgtgtctgt

SEQ ID NO: 89767 - DNA, 16 bp, H. sapiens
ctgcatgttctcattt

SEQ ID NO: 89768 - DNA, 16 bp, H. sapiens
ctgcattaatttgctt

SEQ ID NO: 89769 - DNA, 16 bp, H. sapiens
ctgcattattttattt

SEQ ID NO: 89770 - DNA, 16 bp, H. sapiens
ctgcattccagccttg

SEQ ID NO: 89771 - DNA, 16 bp, H. sapiens
ctgcattcccaggaga

SEQ ID NO: 89772 - DNA, 16 bp, H. sapiens
ctgcattcctgcctgg

SEQ ID NO: 89773 - DNA, 16 bp, H. sapiens
ctgcattctctctctc

SEQ ID NO: 89774 - DNA, 16 bp, H. sapiens
ctgcatttaaaagaaa

SEQ ID NO: 89775 - DNA, 16 bp, H. sapiens
ctgcatttaatgttac

SEQ ID NO: 89776 - DNA, 16 bp, H. sapiens
ctgcatttccaacaag

SEQ ID NO: 89777 - DNA, 16 bp, H. sapiens
ctgcatttcccagtct

SEQ ID NO: 89778 - DNA, 16 bp, H. sapiens
ctgcatttctttttat

SEQ ID NO: 89779 - DNA, 16 bp, H. sapiens
ctgcattttagcaaga

SEQ ID NO: 89780 - DNA, 16 bp, H. sapiens
ctgcattttattttat

SEQ ID NO: 89781 - DNA, 16 bp, H. sapiens
ctgcattttcttacta

SEQ ID NO: 89782 - DNA, 16 bp, H. sapiens
ctgcattttcttcatt

SEQ ID NO: 89783 - DNA, 16 bp, H. sapiens
ctgcatttttaaacaa

SEQ ID NO: 89784 - DNA, 16 bp, H. sapiens
ctgcatttttacataa

SEQ ID NO: 89785 - DNA, 16 bp, H. sapiens
ctgcattttttccttt

SEQ ID NO: 89786 - DNA, 16 bp, H. sapiens
ctgccaaaaacaatct

SEQ ID NO: 89787 - DNA, 16 bp, H. sapiens
ctgccaaaaatattct

SEQ ID NO: 89788 - DNA, 16 bp, H. sapiens
ctgccaaaacagtgtt

SEQ ID NO: 89789 - DNA, 16 bp, H. sapiens
ctgccaaaaccaagat

SEQ ID NO: 89790 - DNA, 16 bp, H. sapiens
ctgccaaagtgggagc

SEQ ID NO: 89791 - DNA, 16 bp, H. sapiens
ctgccaaattggataa

SEQ ID NO: 89792 - DNA, 16 bp, H. sapiens
ctgccaacaccctgat

SEQ ID NO: 89793 - DNA, 16 bp, H. sapiens
ctgccaagccacaggg

SEQ ID NO: 89794 - DNA, 16 bp, H. sapiens
ctgccaagccttgggg

SEQ ID NO: 89795 - DNA, 16 bp, H. sapiens
ctgccaaggcttggtg

SEQ ID NO: 89796 - DNA, 16 bp, H. sapiens
ctgccaagtgaggaca

SEQ ID NO: 89797 - DNA, 16 bp, H. sapiens
ctgccaataccttgat

SEQ ID NO: 89798 - DNA, 16 bp, H. sapiens
ctgccacaagccaaga

SEQ ID NO: 89799 - DNA, 16 bp, H. sapiens
ctgccacagccacccc

SEQ ID NO: 89800 - DNA, 16 bp, H. sapiens
ctgccacagcctccag

SEQ ID NO: 89801 - DNA, 16 bp, H. sapiens
ctgccacagctgctgt

SEQ ID NO: 89802 - DNA, 16 bp, H. sapiens
ctgccacagcttccca

SEQ ID NO: 89803 - DNA, 16 bp, H. sapiens
ctgccacagtgcctgg

SEQ ID NO: 89804 - DNA, 18 bp, H. sapiens
ctgccaccaagcccagct

SEQ ID NO: 89805 - DNA, 16 bp, H. sapiens
ctgccaccacacccaa

SEQ ID NO: 89806 - DNA, 16 bp, H. sapiens
ctgccaccacacctag

SEQ ID NO: 89807 - DNA, 16 bp, H. sapiens
ctgccaccacaggccc

SEQ ID NO: 89808 - DNA, 16 bp, H. sapiens
ctgccaccacccccgg

SEQ ID NO: 89809 - DNA, 16 bp, H. sapiens
ctgccaccacccctgg

SEQ ID NO: 89810 - DNA, 16 bp, H. sapiens
ctgccaccaccctggc

SEQ ID NO: 89811 - DNA, 16 bp, H. sapiens
ctgccaccacgactgg

SEQ ID NO: 89812 - DNA, 16 bp, H. sapiens
ctgccaccacgcccca

SEQ ID NO: 89813 - DNA, 18 bp, H. sapiens
ctgccaccacgcccggct

SEQ ID NO: 89814 - DNA, 23 bp, H. sapiens
ctgccaccacgcctggctatttt

SEQ ID NO: 89815 - DNA, 16 bp, H. sapiens
ctgccaccacggctgg

SEQ ID NO: 89816 - DNA, 16 bp, H. sapiens
ctgccaccactgccac

SEQ ID NO: 89817 - DNA, 16 bp, H. sapiens
ctgccaccagacccag

SEQ ID NO: 89818 - DNA, 16 bp, H. sapiens
ctgccaccagatgcag

SEQ ID NO: 89819 - DNA, 16 bp, H. sapiens
ctgccaccatcaccac

SEQ ID NO: 89820 - DNA, 19 bp, H. sapiens
ctgccaccatgcccggcta

SEQ ID NO: 89821 - DNA, 16 bp, H. sapiens
ctgccaccatgcctga

SEQ ID NO: 89822 - DNA, 16 bp, H. sapiens
ctgccaccatgtaaga

SEQ ID NO: 89823 - DNA, 16 bp, H. sapiens
ctgccacccagactgg

SEQ ID NO: 89824 - DNA, 16 bp, H. sapiens
ctgccacccagcctgg

SEQ ID NO: 89825 - DNA, 16 bp, H. sapiens
ctgccacccaggctga

SEQ ID NO: 89826 - DNA, 16 bp, H. sapiens
ctgccacccaggctgc

SEQ ID NO: 89827 - DNA, 16 bp, H. sapiens
ctgccacctcaaattc

SEQ ID NO: 89828 - DNA, 16 bp, H. sapiens
ctgccacctccacctc

SEQ ID NO: 89829 - DNA, 16 bp, H. sapiens
ctgccacctccacctt

SEQ ID NO: 89830 - DNA, 16 bp, H. sapiens
ctgccacctccgcctt

SEQ ID NO: 89831 - DNA, 16 bp, H. sapiens
ctgccacctctgccac

SEQ ID NO: 89832 - DNA, 16 bp, H. sapiens
ctgccacctctgcctt

SEQ ID NO: 89833 - DNA, 16 bp, H. sapiens
ctgccacctctgcttc

SEQ ID NO: 89834 - DNA, 16 bp, H. sapiens
ctgccacctggtggca

SEQ ID NO: 89835 - DNA, 16 bp, H. sapiens
ctgccacctggtggcc

SEQ ID NO: 89836 - DNA, 16 bp, H. sapiens
ctgccaccttgctccc

SEQ ID NO: 89837 - DNA, 16 bp, H. sapiens
ctgccaccttggcccc

SEQ ID NO: 89838 - DNA, 16 bp, H. sapiens
ctgccaccttggcctc

SEQ ID NO: 89839 - DNA, 16 bp, H. sapiens
ctgccacgacgcctgg

SEQ ID NO: 89840 - DNA, 16 bp, H. sapiens
ctgccactacactcca

SEQ ID NO: 89841 - DNA, 16 bp, H. sapiens
ctgccactaccaccac

SEQ ID NO: 89842 - DNA, 16 bp, H. sapiens
ctgccactgcacttca

SEQ ID NO: 89843 - DNA, 16 bp, H. sapiens
ctgccactgccacagc

SEQ ID NO: 89844 - DNA, 16 bp, H. sapiens
ctgccactgccaccac

SEQ ID NO: 89845 - DNA, 16 bp, H. sapiens
ctgccactgccacctc

SEQ ID NO: 89846 - DNA, 16 bp, H. sapiens
ctgccactgccactgc

SEQ ID NO: 89847 - DNA, 16 bp, H. sapiens
ctgccactgcctctgc

SEQ ID NO: 89848 - DNA, 16 bp, H. sapiens
ctgccacttactagct

SEQ ID NO: 89849 - DNA, 16 bp, H. sapiens
ctgccacttcccagct

SEQ ID NO: 89850 - DNA, 16 bp, H. sapiens
ctgccacttgctggct

SEQ ID NO: 89851 - DNA, 16 bp, H. sapiens
ctgccagactactgcc

SEQ ID NO: 89852 - DNA, 16 bp, H. sapiens
ctgccagagtgctggg

SEQ ID NO: 89853 - DNA, 16 bp, H. sapiens
ctgccagcacactgtc

SEQ ID NO: 89854 - DNA, 16 bp, H. sapiens
ctgccagcacagcagt

SEQ ID NO: 89855 - DNA, 16 bp, H. sapiens
ctgccagcacagccag

SEQ ID NO: 89856 - DNA, 24 bp, H. sapiens
ctgccagcacgctgtcacctctca

SEQ ID NO: 89857 - DNA, 16 bp, H. sapiens
ctgccagcagcagaga

SEQ ID NO: 89858 - DNA, 24 bp, H. sapiens
ctgccagcatgctgtcacctctca

SEQ ID NO: 89859 - DNA, 16 bp, H. sapiens
ctgccagccagagaac

SEQ ID NO: 89860 - DNA, 16 bp, H. sapiens
ctgccagccccgggca

SEQ ID NO: 89861 - DNA, 16 bp, H. sapiens
ctgccagcccctgccc

SEQ ID NO: 89862 - DNA, 16 bp, H. sapiens
ctgccagcccttcctc

SEQ ID NO: 89863 - DNA, 16 bp, H. sapiens
ctgccagcctaccctg

SEQ ID NO: 89864 - DNA, 16 bp, H. sapiens
ctgccagcctccagaa

SEQ ID NO: 89865 - DNA, 16 bp, H. sapiens
ctgccagcgccttgat

SEQ ID NO: 89866 - DNA, 16 bp, H. sapiens
ctgccagctcagggcc

SEQ ID NO: 89867 - DNA, 16 bp, H. sapiens
ctgccagctccacctc

SEQ ID NO: 89868 - DNA, 16 bp, H. sapiens
ctgccagctccatgga

SEQ ID NO: 89869 - DNA, 16 bp, H. sapiens
ctgccagctctgaaga

SEQ ID NO: 89870 - DNA, 16 bp, H. sapiens
ctgccagctctgcctc

SEQ ID NO: 89871 - DNA, 16 bp, H. sapiens
ctgccagctgtgtgac

SEQ ID NO: 89872 - DNA, 16 bp, H. sapiens
ctgccaggactgggtt

SEQ ID NO: 89873 - DNA, 16 bp, H. sapiens
ctgccaggccactgcc

SEQ ID NO: 89874 - DNA, 16 bp, H. sapiens
ctgccaggccctgccc

SEQ ID NO: 89875 - DNA, 16 bp, H. sapiens
ctgccaggcggagggg

SEQ ID NO: 89876 - DNA, 16 bp, H. sapiens
ctgccaggctgcagcc

SEQ ID NO: 89877 - DNA, 16 bp, H. sapiens
ctgccaggctgttttc

SEQ ID NO: 89878 - DNA, 16 bp, H. sapiens
ctgccagggcctgggg

SEQ ID NO: 89879 - DNA, 16 bp, H. sapiens
ctgccagggctgccag

SEQ ID NO: 89880 - DNA, 16 bp, H. sapiens
ctgccaggtagctggg

SEQ ID NO: 89881 - DNA, 16 bp, H. sapiens
ctgccaggttttggaa

SEQ ID NO: 89882 - DNA, 16 bp, H. sapiens
ctgccagtctcagcct

SEQ ID NO: 89883 - DNA, 16 bp, H. sapiens
ctgccagtgccctgcc

SEQ ID NO: 89884 - DNA, 16 bp, H. sapiens
ctgccagtgccttgat

SEQ ID NO: 89885 - DNA, 16 bp, H. sapiens
ctgccagtgctcattt

SEQ ID NO: 89886 - DNA, 16 bp, H. sapiens
ctgccatatgtgacaa

SEQ ID NO: 89887 - DNA, 16 bp, H. sapiens
ctgccatcaccttgat

SEQ ID NO: 89888 - DNA, 16 bp, H. sapiens
ctgccatcatctctca

SEQ ID NO: 89889 - DNA, 16 bp, H. sapiens
ctgccatccaggcttt

SEQ ID NO: 89890 - DNA, 16 bp, H. sapiens
ctgccatgactgtgag

SEQ ID NO: 89891 - DNA, 16 bp, H. sapiens
ctgccatggcttctgt

SEQ ID NO: 89892 - DNA, 16 bp, H. sapiens
ctgccatggttttcag

SEQ ID NO: 89893 - DNA, 16 bp, H. sapiens
ctgccatgtgaagaac

SEQ ID NO: 89894 - DNA, 16 bp, H. sapiens
ctgccattgtagtgca

SEQ ID NO: 89895 - DNA, 16 bp, H. sapiens
ctgccattttgcctct

SEQ ID NO: 89896 - DNA, 16 bp, H. sapiens
ctgccattttttgttt

SEQ ID NO: 89897 - DNA, 16 bp, H. sapiens
ctgccatttttttcct

SEQ ID NO: 89898 - DNA, 16 bp, H. sapiens
ctgcccaaagtgctga

SEQ ID NO: 89899 - DNA, 16 bp, H. sapiens
ctgcccaacacggtga

SEQ ID NO: 89900 - DNA, 16 bp, H. sapiens
ctgcccaagaaagcct

SEQ ID NO: 89901 - DNA, 16 bp, H. sapiens
ctgcccaagaccctgg

SEQ ID NO: 89902 - DNA, 16 bp, H. sapiens
ctgcccaaggagaggc

SEQ ID NO: 89903 - DNA, 16 bp, H. sapiens
ctgcccaaggccacag

SEQ ID NO: 89904 - DNA, 16 bp, H. sapiens
ctgcccaaggccctgg

SEQ ID NO: 89905 - DNA, 16 bp, H. sapiens
ctgcccaaggctttgg

SEQ ID NO: 89906 - DNA, 16 bp, H. sapiens
ctgcccaaggtgaggg

SEQ ID NO: 89907 - DNA, 16 bp, H. sapiens
ctgcccacaagcagca

SEQ ID NO: 89908 - DNA, 16 bp, H. sapiens
ctgcccacaccttgat

SEQ ID NO: 89909 - DNA, 16 bp, H. sapiens
ctgcccaccagcctgg

SEQ ID NO: 89910 - DNA, 16 bp, H. sapiens
ctgcccaccctgcctg

SEQ ID NO: 89911 - DNA, 16 bp, H. sapiens
ctgcccaccctgctgc

SEQ ID NO: 89912 - DNA, 16 bp, H. sapiens
ctgcccaccctggcct

SEQ ID NO: 89913 - DNA, 16 bp, H. sapiens
ctgcccaccgcggcct

SEQ ID NO: 89914 - DNA, 16 bp, H. sapiens
ctgcccacctcaccct

SEQ ID NO: 89915 - DNA, 16 bp, H. sapiens
ctgcccacctcacctc

SEQ ID NO: 89916 - DNA, 16 bp, H. sapiens
ctgcccacctcagctt

SEQ ID NO: 89917 - DNA, 16 bp, H. sapiens
ctgcccacctcccaaa

SEQ ID NO: 89918 - DNA, 16 bp, H. sapiens
ctgcccacctctacct

SEQ ID NO: 89919 - DNA, 16 bp, H. sapiens
ctgcccacctgcccca

SEQ ID NO: 89920 - DNA, 16 bp, H. sapiens
ctgcccacctggcctc

SEQ ID NO: 89921 - DNA, 16 bp, H. sapiens
ctgcccactgccctcc

SEQ ID NO: 89922 - DNA, 16 bp, H. sapiens
ctgcccactgggaaga

SEQ ID NO: 89923 - DNA, 16 bp, H. sapiens
ctgcccacttcggcct

SEQ ID NO: 89924 - DNA, 16 bp, H. sapiens
ctgcccagcacccagc

SEQ ID NO: 89925 - DNA, 16 bp, H. sapiens
ctgcccagccaccacc

SEQ ID NO: 89926 - DNA, 16 bp, H. sapiens
ctgcccagccacccct

SEQ ID NO: 89927 - DNA, 16 bp, H. sapiens
ctgcccagcccaccac

SEQ ID NO: 89928 - DNA, 16 bp, H. sapiens
ctgcccagcccagccc

SEQ ID NO: 89929 - DNA, 16 bp, H. sapiens
ctgcccagcccagcct

SEQ ID NO: 89930 - DNA, 16 bp, H. sapiens
ctgcccagccccagcc

SEQ ID NO: 89931 - DNA, 16 bp, H. sapiens
ctgcccagcccccagc

SEQ ID NO: 89932 - DNA, 16 bp, H. sapiens
ctgcccagccctgccc

SEQ ID NO: 89933 - DNA, 16 bp, H. sapiens
ctgcccagccctgcct

SEQ ID NO: 89934 - DNA, 17 bp, H. sapiens
ctgcccagccgccaccc

SEQ ID NO: 89935 - DNA, 16 bp, H. sapiens
ctgcccagcctgggca

SEQ ID NO: 89936 - DNA, 16 bp, H. sapiens
ctgcccagctgccccg

SEQ ID NO: 89937 - DNA, 16 bp, H. sapiens
ctgcccagctgcccct

SEQ ID NO: 89938 - DNA, 16 bp, H. sapiens
ctgcccaggcccctcc

SEQ ID NO: 89939 - DNA, 16 bp, H. sapiens
ctgcccaggcccctgg

SEQ ID NO: 89940 - DNA, 16 bp, H. sapiens
ctgcccaggccctgcc

SEQ ID NO: 89941 - DNA, 16 bp, H. sapiens
ctgcccaggccggagt

SEQ ID NO: 89942 - DNA, 16 bp, H. sapiens
ctgcccaggcctccca

SEQ ID NO: 89943 - DNA, 16 bp, H. sapiens
ctgcccaggctggtct

SEQ ID NO: 89944 - DNA, 16 bp, H. sapiens
ctgcccagggaggagg

SEQ ID NO: 89945 - DNA, 16 bp, H. sapiens
ctgcccagggcctggg

SEQ ID NO: 89946 - DNA, 16 bp, H. sapiens
ctgcccagggctctgc

SEQ ID NO: 89947 - DNA, 16 bp, H. sapiens
ctgcccagggctgcct

SEQ ID NO: 89948 - DNA, 16 bp, H. sapiens
ctgcccagggtcacac

SEQ ID NO: 89949 - DNA, 16 bp, H. sapiens
ctgcccagtccaaact

SEQ ID NO: 89950 - DNA, 16 bp, H. sapiens
ctgcccagtgaagagg

SEQ ID NO: 89951 - DNA, 16 bp, H. sapiens
ctgcccatggagggag

SEQ ID NO: 89952 - DNA, 16 bp, H. sapiens
ctgcccatggccaccc

SEQ ID NO: 89953 - DNA, 16 bp, H. sapiens
ctgccccacacccaga

SEQ ID NO: 89954 - DNA, 16 bp, H. sapiens
ctgccccaccccaggc

SEQ ID NO: 89955 - DNA, 19 bp, H. sapiens
ctgccccaccctaactgat

SEQ ID NO: 89956 - DNA, 16 bp, H. sapiens
ctgccccaccgccctg

SEQ ID NO: 89957 - DNA, 16 bp, H. sapiens
ctgccccacctcagcc

SEQ ID NO: 89958 - DNA, 16 bp, H. sapiens
ctgccccagacctgga

SEQ ID NO: 89959 - DNA, 16 bp, H. sapiens
ctgccccagccaaact

SEQ ID NO: 89960 - DNA, 16 bp, H. sapiens
ctgccccagccccagg

SEQ ID NO: 89961 - DNA, 16 bp, H. sapiens
ctgccccagccctggg

SEQ ID NO: 89962 - DNA, 16 bp, H. sapiens
ctgccccagcctcccg

SEQ ID NO: 89963 - DNA, 16 bp, H. sapiens
ctgccccagcctctgg

SEQ ID NO: 89964 - DNA, 16 bp, H. sapiens
ctgccccatcaagatg

SEQ ID NO: 89965 - DNA, 16 bp, H. sapiens
ctgccccatcccctgg

SEQ ID NO: 89966 - DNA, 16 bp, H. sapiens
ctgcccccaaacacac

SEQ ID NO: 89967 - DNA, 16 bp, H. sapiens
ctgcccccaaggagct

SEQ ID NO: 89968 - DNA, 16 bp, H. sapiens
ctgcccccaccccatg

SEQ ID NO: 89969 - DNA, 17 bp, H. sapiens
ctgcccccaccctagct

SEQ ID NO: 89970 - DNA, 16 bp, H. sapiens
ctgcccccactgtcct

SEQ ID NO: 89971 - DNA, 16 bp, H. sapiens
ctgcccccactgtctg

SEQ ID NO: 89972 - DNA, 16 bp, H. sapiens
ctgcccccagcccagg

SEQ ID NO: 89973 - DNA, 16 bp, H. sapiens
ctgcccccatgaccca

SEQ ID NO: 89974 - DNA, 16 bp, H. sapiens
ctgcccccatgaccta

SEQ ID NO: 89975 - DNA, 16 bp, H. sapiens
ctgcccccatgattca

SEQ ID NO: 89976 - DNA, 16 bp, H. sapiens
ctgccccccagcctgg

SEQ ID NO: 89977 - DNA, 16 bp, H. sapiens
ctgcccccctgggttc

SEQ ID NO: 89978 - DNA, 16 bp, H. sapiens
ctgccccctgagttca

SEQ ID NO: 89979 - DNA, 16 bp, H. sapiens
ctgccccctgccccag

SEQ ID NO: 89980 - DNA, 16 bp, H. sapiens
ctgccccctgctggct

SEQ ID NO: 89981 - DNA, 16 bp, H. sapiens
ctgccccctggtggcc

SEQ ID NO: 89982 - DNA, 16 bp, H. sapiens
ctgcccccttcagcct

SEQ ID NO: 89983 - DNA, 16 bp, H. sapiens
ctgcccccttgatcca

SEQ ID NO: 89984 - DNA, 16 bp, H. sapiens
ctgcccccttggcctc

SEQ ID NO: 89985 - DNA, 16 bp, H. sapiens
ctgccccgcagggagg

SEQ ID NO: 89986 - DNA, 16 bp, H. sapiens
ctgccccgtgggaagg

SEQ ID NO: 89987 - DNA, 16 bp, H. sapiens
ctgcccctacctgatg

SEQ ID NO: 89988 - DNA, 16 bp, H. sapiens
ctgcccctatgaccca

SEQ ID NO: 89989 - DNA, 16 bp, H. sapiens
ctgcccctcaccttcc

SEQ ID NO: 89990 - DNA, 16 bp, H. sapiens
ctgcccctcagcctct

SEQ ID NO: 89991 - DNA, 16 bp, H. sapiens
ctgcccctcctcccag

SEQ ID NO: 89992 - DNA, 16 bp, H. sapiens
ctgcccctctcagcct

SEQ ID NO: 89993 - DNA, 16 bp, H. sapiens
ctgcccctctccccag

SEQ ID NO: 89994 - DNA, 16 bp, H. sapiens
ctgcccctcttcccca

SEQ ID NO: 89995 - DNA, 16 bp, H. sapiens
ctgcccctgcagcagg

SEQ ID NO: 89996 - DNA, 16 bp, H. sapiens
ctgcccctgcccacca

SEQ ID NO: 89997 - DNA, 16 bp, H. sapiens
ctgcccctgccctgac

SEQ ID NO: 89998 - DNA, 27 bp, H. sapiens
ctgcccctgccctgactcccagccctg

SEQ ID NO: 89999 - DNA, 16 bp, H. sapiens
ctgcccctgccctggc

SEQ ID NO: 90000 - DNA, 16 bp, H. sapiens
ctgcccctgcctcctg

SEQ ID NO: 90001 - DNA, 16 bp, H. sapiens
ctgcccctgctgcctg

SEQ ID NO: 90002 - DNA, 16 bp, H. sapiens
ctgcccctgctgctgc

SEQ ID NO: 90003 - DNA, 16 bp, H. sapiens
ctgcccctggccctgg

SEQ ID NO: 90004 - DNA, 16 bp, H. sapiens
ctgcccctggcctctc

SEQ ID NO: 90005 - DNA, 16 bp, H. sapiens
ctgcccctgtggcttt

SEQ ID NO: 90006 - DNA, 16 bp, H. sapiens
ctgccccttcccagcc

SEQ ID NO: 90007 - DNA, 16 bp, H. sapiens
ctgccccttcccccag

SEQ ID NO: 90008 - DNA, 16 bp, H. sapiens
ctgccccttccctcag

SEQ ID NO: 90009 - DNA, 16 bp, H. sapiens
ctgcccctttcccaga

SEQ ID NO: 90010 - DNA, 16 bp, H. sapiens
ctgcccctttgagatg

SEQ ID NO: 90011 - DNA, 18 bp, H. sapiens
ctgcccgccagagaacaa

SEQ ID NO: 90012 - DNA, 16 bp, H. sapiens
ctgcccgcctcaccct

SEQ ID NO: 90013 - DNA, 16 bp, H. sapiens
ctgcccgcctgagcct

SEQ ID NO: 90014 - DNA, 16 bp, H. sapiens
ctgcccgcctgcctgc

SEQ ID NO: 90015 - DNA, 16 bp, H. sapiens
ctgcccggccagccac

SEQ ID NO: 90016 - DNA, 16 bp, H. sapiens
ctgcccggccagctgc

SEQ ID NO: 90017 - DNA, 16 bp, H. sapiens
ctgcccggctgcccag

SEQ ID NO: 90018 - DNA, 16 bp, H. sapiens
ctgcccgggctggagt

SEQ ID NO: 90019 - DNA, 16 bp, H. sapiens
ctgcccgtccctgggc

SEQ ID NO: 90020 - DNA, 16 bp, H. sapiens
ctgcccgtctctgcct

SEQ ID NO: 90021 - DNA, 16 bp, H. sapiens
ctgccctagaagaggt

SEQ ID NO: 90022 - DNA, 16 bp, H. sapiens
ctgccctcaaacatcg

SEQ ID NO: 90023 - DNA, 16 bp, H. sapiens
ctgccctcaagaagct

SEQ ID NO: 90024 - DNA, 16 bp, H. sapiens
ctgccctcaaggagca

SEQ ID NO: 90025 - DNA, 16 bp, H. sapiens
ctgccctcaaggagct

SEQ ID NO: 90026 - DNA, 16 bp, H. sapiens
ctgccctcaatgtggg

SEQ ID NO: 90027 - DNA, 16 bp, H. sapiens
ctgccctcagagagct

SEQ ID NO: 90028 - DNA, 16 bp, H. sapiens
ctgccctcagccccac

SEQ ID NO: 90029 - DNA, 16 bp, H. sapiens
ctgccctcagggaact

SEQ ID NO: 90030 - DNA, 16 bp, H. sapiens
ctgccctcagggagct

SEQ ID NO: 90031 - DNA, 16 bp, H. sapiens
ctgccctcaggtgatc

SEQ ID NO: 90032 - DNA, 16 bp, H. sapiens
ctgccctcatagagct

SEQ ID NO: 90033 - DNA, 16 bp, H. sapiens
ctgccctccatcctgg

SEQ ID NO: 90034 - DNA, 16 bp, H. sapiens
ctgccctcccagccca

SEQ ID NO: 90035 - DNA, 16 bp, H. sapiens
ctgccctccccagcct

SEQ ID NO: 90036 - DNA, 16 bp, H. sapiens
ctgccctccctgcctg

SEQ ID NO: 90037 - DNA, 16 bp, H. sapiens
ctgccctcctcaacct

SEQ ID NO: 90038 - DNA, 16 bp, H. sapiens
ctgccctcctcaccct

SEQ ID NO: 90039 - DNA, 16 bp, H. sapiens
ctgccctcctccagcc

SEQ ID NO: 90040 - DNA, 16 bp, H. sapiens
ctgccctcctgcctgc

SEQ ID NO: 90041 - DNA, 16 bp, H. sapiens
ctgccctcctggagct

SEQ ID NO: 90042 - DNA, 16 bp, H. sapiens
ctgccctcctgggcct

SEQ ID NO: 90043 - DNA, 16 bp, H. sapiens
ctgccctcctgggtgc

SEQ ID NO: 90044 - DNA, 16 bp, H. sapiens
ctgccctctcctagga

SEQ ID NO: 90045 - DNA, 16 bp, H. sapiens
ctgccctctcctccca

SEQ ID NO: 90046 - DNA, 16 bp, H. sapiens
ctgccctctgcagcct

SEQ ID NO: 90047 - DNA, 16 bp, H. sapiens
ctgccctctgcctgcc

SEQ ID NO: 90048 - DNA, 16 bp, H. sapiens
ctgccctctgggttca

SEQ ID NO: 90049 - DNA, 16 bp, H. sapiens
ctgccctctggtggcc

SEQ ID NO: 90050 - DNA, 16 bp, H. sapiens
ctgccctgactcagcc

SEQ ID NO: 90051 - DNA, 16 bp, H. sapiens
ctgccctgactcccgc

SEQ ID NO: 90052 - DNA, 16 bp, H. sapiens
ctgccctgcacagcct

SEQ ID NO: 90053 - DNA, 16 bp, H. sapiens
ctgccctgcagcctgg

SEQ ID NO: 90054 - DNA, 16 bp, H. sapiens
ctgccctgcccaccct

SEQ ID NO: 90055 - DNA, 16 bp, H. sapiens
ctgccctgcccagccc

SEQ ID NO: 90056 - DNA, 16 bp, H. sapiens
ctgccctgcccagcct

SEQ ID NO: 90057 - DNA, 16 bp, H. sapiens
ctgccctgcccaggcc

SEQ ID NO: 90058 - DNA, 16 bp, H. sapiens
ctgccctgccgccacc

SEQ ID NO: 90059 - DNA, 16 bp, H. sapiens
ctgccctgcctgccct

SEQ ID NO: 90060 - DNA, 16 bp, H. sapiens
ctgccctgccttgccc

SEQ ID NO: 90061 - DNA, 16 bp, H. sapiens
ctgccctgctgccctc

SEQ ID NO: 90062 - DNA, 16 bp, H. sapiens
ctgccctgctggattt

SEQ ID NO: 90063 - DNA, 16 bp, H. sapiens
ctgccctggaaagggg

SEQ ID NO: 90064 - DNA, 16 bp, H. sapiens
ctgccctggagatttg

SEQ ID NO: 90065 - DNA, 16 bp, H. sapiens
ctgccctggccaaact

SEQ ID NO: 90066 - DNA, 16 bp, H. sapiens
ctgccctggccaggac

SEQ ID NO: 90067 - DNA, 16 bp, H. sapiens
ctgccctggccccacc

SEQ ID NO: 90068 - DNA, 16 bp, H. sapiens
ctgccctggccctgaa

SEQ ID NO: 90069 - DNA, 16 bp, H. sapiens
ctgccctggccctggt

SEQ ID NO: 90070 - DNA, 16 bp, H. sapiens
ctgccctggcctcctg

SEQ ID NO: 90071 - DNA, 16 bp, H. sapiens
ctgccctggcctggcc

SEQ ID NO: 90072 - DNA, 16 bp, H. sapiens
ctgccctggctgcccc

SEQ ID NO: 90073 - DNA, 16 bp, H. sapiens
ctgccctggcttcttc

SEQ ID NO: 90074 - DNA, 16 bp, H. sapiens
ctgccctgggcctcag

SEQ ID NO: 90075 - DNA, 16 bp, H. sapiens
ctgccctgggctgggc

SEQ ID NO: 90076 - DNA, 16 bp, H. sapiens
ctgccctggtccttcc

SEQ ID NO: 90077 - DNA, 16 bp, H. sapiens
ctgccctgtgaggtgt

SEQ ID NO: 90078 - DNA, 16 bp, H. sapiens
ctgccctgtgcaacct

SEQ ID NO: 90079 - DNA, 16 bp, H. sapiens
ctgccctgtggggagg

SEQ ID NO: 90080 - DNA, 16 bp, H. sapiens
ctgccctgtgtccatg

SEQ ID NO: 90081 - DNA, 16 bp, H. sapiens
ctgcccttatggagct

SEQ ID NO: 90082 - DNA, 16 bp, H. sapiens
ctgcccttcacatttt

SEQ ID NO: 90083 - DNA, 16 bp, H. sapiens
ctgcccttgaggagct

SEQ ID NO: 90084 - DNA, 16 bp, H. sapiens
ctgccctttacatttt

SEQ ID NO: 90085 - DNA, 16 bp, H. sapiens
ctgccgccatgtgaag

SEQ ID NO: 90086 - DNA, 16 bp, H. sapiens
ctgccgccccatctgg

SEQ ID NO: 90087 - DNA, 16 bp, H. sapiens
ctgccgcctcctgggt

SEQ ID NO: 90088 - DNA, 16 bp, H. sapiens
ctgccgctgccgctgc

SEQ ID NO: 90089 - DNA, 16 bp, H. sapiens
ctgccggccccaggca

SEQ ID NO: 90090 - DNA, 16 bp, H. sapiens
ctgccggccttggcct

SEQ ID NO: 90091 - DNA, 16 bp, H. sapiens
ctgccggctctgaaga

SEQ ID NO: 90092 - DNA, 16 bp, H. sapiens
ctgccgggcagaggcg

SEQ ID NO: 90093 - DNA, 16 bp, H. sapiens
ctgccgggtggagacg

SEQ ID NO: 90094 - DNA, 16 bp, H. sapiens
ctgcctacctgggcct

SEQ ID NO: 90095 - DNA, 16 bp, H. sapiens
ctgcctactttggcct

SEQ ID NO: 90096 - DNA, 16 bp, H. sapiens
ctgcctaggcatccag

SEQ ID NO: 90097 - DNA, 16 bp, H. sapiens
ctgcctatgaagtagc

SEQ ID NO: 90098 - DNA, 16 bp, H. sapiens
ctgcctcaaaaacaaa

SEQ ID NO: 90099 - DNA, 16 bp, H. sapiens
ctgcctcaaaacaaca

SEQ ID NO: 90100 - DNA, 16 bp, H. sapiens
ctgcctcaacctcccc

SEQ ID NO: 90101 - DNA, 16 bp, H. sapiens
ctgcctcaacctcctc

SEQ ID NO: 90102 - DNA, 16 bp, H. sapiens
ctgcctcaagcctccc

SEQ ID NO: 90103 - DNA, 16 bp, H. sapiens
ctgcctcaagctccca

SEQ ID NO: 90104 - DNA, 16 bp, H. sapiens
ctgcctcaagctcctg

SEQ ID NO: 90105 - DNA, 16 bp, H. sapiens
ctgcctcacaggattg

SEQ ID NO: 90106 - DNA, 16 bp, H. sapiens
ctgcctcactctcctg

SEQ ID NO: 90107 - DNA, 16 bp, H. sapiens
ctgcctcactgcctca

SEQ ID NO: 90108 - DNA, 16 bp, H. sapiens
ctgcctcacttgggaa

SEQ ID NO: 90109 - DNA, 16 bp, H. sapiens
ctgcctcagacccctg

SEQ ID NO: 90110 - DNA, 16 bp, H. sapiens
ctgcctcagcagcctc

SEQ ID NO: 90111 - DNA, 16 bp, H. sapiens
ctgcctcagcattcca

SEQ ID NO: 90112 - DNA, 16 bp, H. sapiens
ctgcctcagccaccaa

SEQ ID NO: 90113 - DNA, 16 bp, H. sapiens
ctgcctcagccaccac

SEQ ID NO: 90114 - DNA, 16 bp, H. sapiens
ctgcctcagccactca

SEQ ID NO: 90115 - DNA, 16 bp, H. sapiens
ctgcctcagcccccag

SEQ ID NO: 90116 - DNA, 16 bp, H. sapiens
ctgcctcagcccctgc

SEQ ID NO: 90117 - DNA, 16 bp, H. sapiens
ctgcctcagcccctgg

SEQ ID NO: 90118 - DNA, 16 bp, H. sapiens
ctgcctcagccctccg

SEQ ID NO: 90119 - DNA, 16 bp, H. sapiens
ctgcctcagccgcccc

SEQ ID NO: 90120 - DNA, 16 bp, H. sapiens
ctgcctcagcctcagc

SEQ ID NO: 90121 - DNA, 30 bp, H. sapiens
ctgcctcagcctcccaaagtgctgggattg

SEQ ID NO: 90122 - DNA, 18 bp, H. sapiens
ctgcctcagcctcccagt

SEQ ID NO: 90123 - DNA, 16 bp, H. sapiens
ctgcctcagcctctga

SEQ ID NO: 90124 - DNA, 16 bp, H. sapiens
ctgcctcagcctgcca

SEQ ID NO: 90125 - DNA, 16 bp, H. sapiens
ctgcctcagccttccc

SEQ ID NO: 90126 - DNA, 16 bp, H. sapiens
ctgcctcagccttctc

SEQ ID NO: 90127 - DNA, 16 bp, H. sapiens
ctgcctcagctacctg

SEQ ID NO: 90128 - DNA, 16 bp, H. sapiens
ctgcctcagctcttct

SEQ ID NO: 90129 - DNA, 16 bp, H. sapiens
ctgcctcagctgcccc

SEQ ID NO: 90130 - DNA, 16 bp, H. sapiens
ctgcctcagctgggac

SEQ ID NO: 90131 - DNA, 16 bp, H. sapiens
ctgcctcaggccccca

SEQ ID NO: 90132 - DNA, 16 bp, H. sapiens
ctgcctcaggctcctg

SEQ ID NO: 90133 - DNA, 16 bp, H. sapiens
ctgcctcaggttccca

SEQ ID NO: 90134 - DNA, 16 bp, H. sapiens
ctgcctcagtccccca

SEQ ID NO: 90135 - DNA, 16 bp, H. sapiens
ctgcctcatcctcccc

SEQ ID NO: 90136 - DNA, 16 bp, H. sapiens
ctgcctccaaaaccca

SEQ ID NO: 90137 - DNA, 16 bp, H. sapiens
ctgcctccaaagaaag

SEQ ID NO: 90138 - DNA, 16 bp, H. sapiens
ctgcctccaccccaca

SEQ ID NO: 90139 - DNA, 16 bp, H. sapiens
ctgcctccactcctgc

SEQ ID NO: 90140 - DNA, 16 bp, H. sapiens
ctgcctccagccccag

SEQ ID NO: 90141 - DNA, 16 bp, H. sapiens
ctgcctccagcccctg

SEQ ID NO: 90142 - DNA, 16 bp, H. sapiens
ctgcctccagcctccc

SEQ ID NO: 90143 - DNA, 16 bp, H. sapiens
ctgcctccagcctctc

SEQ ID NO: 90144 - DNA, 16 bp, H. sapiens
ctgcctccaggaagcc

SEQ ID NO: 90145 - DNA, 16 bp, H. sapiens
ctgcctccaggccttt

SEQ ID NO: 90146 - DNA, 16 bp, H. sapiens
ctgcctccaggctgga

SEQ ID NO: 90147 - DNA, 16 bp, H. sapiens
ctgcctccatgatcca

SEQ ID NO: 90148 - DNA, 16 bp, H. sapiens
ctgcctcccaaactgc

SEQ ID NO: 90149 - DNA, 16 bp, H. sapiens
ctgcctcccaaagtgg

SEQ ID NO: 90150 - DNA, 16 bp, H. sapiens
ctgcctcccaagaagc

SEQ ID NO: 90151 - DNA, 16 bp, H. sapiens
ctgcctcccacctcct

SEQ ID NO: 90152 - DNA, 16 bp, H. sapiens
ctgcctcccaccttcc

SEQ ID NO: 90153 - DNA, 16 bp, H. sapiens
ctgcctcccagcagcc

SEQ ID NO: 90154 - DNA, 16 bp, H. sapiens
ctgcctcccagccctg

SEQ ID NO: 90155 - DNA, 16 bp, H. sapiens
ctgcctcccagcctca

SEQ ID NO: 90156 - DNA, 16 bp, H. sapiens
ctgcctcccagcctcc

SEQ ID NO: 90157 - DNA, 16 bp, H. sapiens
ctgcctcccaggctgg

SEQ ID NO: 90158 - DNA, 16 bp, H. sapiens
ctgcctcccaggtcct

SEQ ID NO: 90159 - DNA, 16 bp, H. sapiens
ctgcctcccaggttct

SEQ ID NO: 90160 - DNA, 16 bp, H. sapiens
ctgcctcccaggtttc

SEQ ID NO: 90161 - DNA, 16 bp, H. sapiens
ctgcctcccatcaccc

SEQ ID NO: 90162 - DNA, 17 bp, H. sapiens
ctgcctccccgcagggc

SEQ ID NO: 90163 - DNA, 16 bp, H. sapiens
ctgcctcccctgaccc

SEQ ID NO: 90164 - DNA, 16 bp, H. sapiens
ctgcctcccggtggcc

SEQ ID NO: 90165 - DNA, 16 bp, H. sapiens
ctgcctccctgcagcc

SEQ ID NO: 90166 - DNA, 16 bp, H. sapiens
ctgcctccctgcccag

SEQ ID NO: 90167 - DNA, 16 bp, H. sapiens
ctgcctccctgcctgc

SEQ ID NO: 90168 - DNA, 16 bp, H. sapiens
ctgcctccctggcctc

SEQ ID NO: 90169 - DNA, 16 bp, H. sapiens
ctgcctccctgggctc

SEQ ID NO: 90170 - DNA, 16 bp, H. sapiens
ctgcctccctgggttc

SEQ ID NO: 90171 - DNA, 16 bp, H. sapiens
ctgcctcccttggcct

SEQ ID NO: 90172 - DNA, 16 bp, H. sapiens
ctgcctccgcctccgg

SEQ ID NO: 90173 - DNA, 16 bp, H. sapiens
ctgcctccgcttccca

SEQ ID NO: 90174 - DNA, 16 bp, H. sapiens
ctgcctcctcaggtgg

SEQ ID NO: 90175 - DNA, 16 bp, H. sapiens
ctgcctcctccagccc

SEQ ID NO: 90176 - DNA, 16 bp, H. sapiens
ctgcctcctccagcct

SEQ ID NO: 90177 - DNA, 16 bp, H. sapiens
ctgcctcctcccacct

SEQ ID NO: 90178 - DNA, 16 bp, H. sapiens
ctgcctcctcctccag

SEQ ID NO: 90179 - DNA, 16 bp, H. sapiens
ctgcctcctcctgggt

SEQ ID NO: 90180 - DNA, 16 bp, H. sapiens
ctgcctcctgccacca

SEQ ID NO: 90181 - DNA, 16 bp, H. sapiens
ctgcctcctgcccacc

SEQ ID NO: 90182 - DNA, 16 bp, H. sapiens
ctgcctcctgccctgc

SEQ ID NO: 90183 - DNA, 16 bp, H. sapiens
ctgcctcctgccctgg

SEQ ID NO: 90184 - DNA, 16 bp, H. sapiens
ctgcctcctgcctgcc

SEQ ID NO: 90185 - DNA, 16 bp, H. sapiens
ctgcctcctgcctggc

SEQ ID NO: 90186 - DNA, 16 bp, H. sapiens
ctgcctcctgcctggg

SEQ ID NO: 90187 - DNA, 16 bp, H. sapiens
ctgcctcctggcctca

SEQ ID NO: 90188 - DNA, 16 bp, H. sapiens
ctgcctcctggctgac

SEQ ID NO: 90189 - DNA, 16 bp, H. sapiens
ctgcctcctggctgct

SEQ ID NO: 90190 - DNA, 16 bp, H. sapiens
ctgcctcctggcttca

SEQ ID NO: 90191 - DNA, 16 bp, H. sapiens
ctgcctcctgggctca

SEQ ID NO: 90192 - DNA, 16 bp, H. sapiens
ctgcctcctgggctct

SEQ ID NO: 90193 - DNA, 16 bp, H. sapiens
ctgcctcctgggttgg

SEQ ID NO: 90194 - DNA, 16 bp, H. sapiens
ctgcctcggccaccca

SEQ ID NO: 90195 - DNA, 25 bp, H. sapiens
ctgcctcggcctcccaaagtgctga

SEQ ID NO: 90196 - DNA, 16 bp, H. sapiens
ctgcctcggcctcctg

SEQ ID NO: 90197 - DNA, 16 bp, H. sapiens
ctgcctctactttatt

SEQ ID NO: 90198 - DNA, 16 bp, H. sapiens
ctgcctctcagcctct

SEQ ID NO: 90199 - DNA, 16 bp, H. sapiens
ctgcctctccagcctc

SEQ ID NO: 90200 - DNA, 16 bp, H. sapiens
ctgcctctccagcctt

SEQ ID NO: 90201 - DNA, 16 bp, H. sapiens
ctgcctctcccacctc

SEQ ID NO: 90202 - DNA, 16 bp, H. sapiens
ctgcctctcccagctc

SEQ ID NO: 90203 - DNA, 16 bp, H. sapiens
ctgcctctccctctgg

SEQ ID NO: 90204 - DNA, 16 bp, H. sapiens
ctgcctctctgccctt

SEQ ID NO: 90205 - DNA, 16 bp, H. sapiens
ctgcctctctggcctc

SEQ ID NO: 90206 - DNA, 16 bp, H. sapiens
ctgcctctgccaccca

SEQ ID NO: 90207 - DNA, 16 bp, H. sapiens
ctgcctctgccacccc

SEQ ID NO: 90208 - DNA, 16 bp, H. sapiens
ctgcctctgccatccc

SEQ ID NO: 90209 - DNA, 16 bp, H. sapiens
ctgcctctgccccagc

SEQ ID NO: 90210 - DNA, 16 bp, H. sapiens
ctgcctctgcccccag

SEQ ID NO: 90211 - DNA, 16 bp, H. sapiens
ctgcctctgcccctgc

SEQ ID NO: 90212 - DNA, 16 bp, H. sapiens
ctgcctctgcctccgg

SEQ ID NO: 90213 - DNA, 16 bp, H. sapiens
ctgcctctgcctcctg

SEQ ID NO: 90214 - DNA, 16 bp, H. sapiens
ctgcctctgccttcca

SEQ ID NO: 90215 - DNA, 16 bp, H. sapiens
ctgcctctgctgcaca

SEQ ID NO: 90216 - DNA, 16 bp, H. sapiens
ctgcctctgcttcctc

SEQ ID NO: 90217 - DNA, 16 bp, H. sapiens
ctgcctctgcttcctg

SEQ ID NO: 90218 - DNA, 16 bp, H. sapiens
ctgcctctgcttctct

SEQ ID NO: 90219 - DNA, 16 bp, H. sapiens
ctgcctctgggctcaa

SEQ ID NO: 90220 - DNA, 16 bp, H. sapiens
ctgcctctggggctca

SEQ ID NO: 90221 - DNA, 16 bp, H. sapiens
ctgcctctgggtgggg

SEQ ID NO: 90222 - DNA, 16 bp, H. sapiens
ctgcctctggtcacct

SEQ ID NO: 90223 - DNA, 16 bp, H. sapiens
ctgcctctgtcaccca

SEQ ID NO: 90224 - DNA, 16 bp, H. sapiens
ctgcctctgtccccca

SEQ ID NO: 90225 - DNA, 16 bp, H. sapiens
ctgcctctgtccctct

SEQ ID NO: 90226 - DNA, 16 bp, H. sapiens
ctgcctctgtcctcac

SEQ ID NO: 90227 - DNA, 16 bp, H. sapiens
ctgcctctgtcgccca

SEQ ID NO: 90228 - DNA, 16 bp, H. sapiens
ctgcctctgtctccac

SEQ ID NO: 90229 - DNA, 16 bp, H. sapiens
ctgcctctgtctctct

SEQ ID NO: 90230 - DNA, 16 bp, H. sapiens
ctgcctctgtctcttt

SEQ ID NO: 90231 - DNA, 16 bp, H. sapiens
ctgcctctgtcttcac

SEQ ID NO: 90232 - DNA, 16 bp, H. sapiens
ctgcctctgtcttcat

SEQ ID NO: 90233 - DNA, 16 bp, H. sapiens
ctgcctctgtggctct

SEQ ID NO: 90234 - DNA, 16 bp, H. sapiens
ctgcctctgttgccca

SEQ ID NO: 90235 - DNA, 16 bp, H. sapiens
ctgcctgaaatgcttt

SEQ ID NO: 90236 - DNA, 16 bp, H. sapiens
ctgcctgagagccagg

SEQ ID NO: 90237 - DNA, 16 bp, H. sapiens
ctgcctgagcaacatg

SEQ ID NO: 90238 - DNA, 16 bp, H. sapiens
ctgcctgagcccagga

SEQ ID NO: 90239 - DNA, 16 bp, H. sapiens
ctgcctgagcctcccg

SEQ ID NO: 90240 - DNA, 16 bp, H. sapiens
ctgcctgagcttcctg

SEQ ID NO: 90241 - DNA, 16 bp, H. sapiens
ctgcctgaggtcagga

SEQ ID NO: 90242 - DNA, 16 bp, H. sapiens
ctgcctgaggttgttt

SEQ ID NO: 90243 - DNA, 16 bp, H. sapiens
ctgcctgatggctctg

SEQ ID NO: 90244 - DNA, 16 bp, H. sapiens
ctgcctgattctcctg

SEQ ID NO: 90245 - DNA, 16 bp, H. sapiens
ctgcctgcagaccctg

SEQ ID NO: 90246 - DNA, 16 bp, H. sapiens
ctgcctgcagagagga

SEQ ID NO: 90247 - DNA, 16 bp, H. sapiens
ctgcctgcagtcccag

SEQ ID NO: 90248 - DNA, 16 bp, H. sapiens
ctgcctgcattctttg

SEQ ID NO: 90249 - DNA, 16 bp, H. sapiens
ctgcctgccacagcct

SEQ ID NO: 90250 - DNA, 16 bp, H. sapiens
ctgcctgcccaccctg

SEQ ID NO: 90251 - DNA, 16 bp, H. sapiens
ctgcctgcccacctcc

SEQ ID NO: 90252 - DNA, 16 bp, H. sapiens
ctgcctgcccacctgc

SEQ ID NO: 90253 - DNA, 16 bp, H. sapiens
ctgcctgcccagcctc

SEQ ID NO: 90254 - DNA, 16 bp, H. sapiens
ctgcctgccccactgc

SEQ ID NO: 90255 - DNA, 16 bp, H. sapiens
ctgcctgccccagcct

SEQ ID NO: 90256 - DNA, 16 bp, H. sapiens
ctgcctgcccctggga

SEQ ID NO: 90257 - DNA, 16 bp, H. sapiens
ctgcctgccctgccac

SEQ ID NO: 90258 - DNA, 16 bp, H. sapiens
ctgcctgccctgctgc

SEQ ID NO: 90259 - DNA, 16 bp, H. sapiens
ctgcctgccctggcct

SEQ ID NO: 90260 - DNA, 16 bp, H. sapiens
ctgcctgcctcagccc

SEQ ID NO: 90261 - DNA, 16 bp, H. sapiens
ctgcctgcctcagtct

SEQ ID NO: 90262 - DNA, 16 bp, H. sapiens
ctgcctgcctcagttt

SEQ ID NO: 90263 - DNA, 16 bp, H. sapiens
ctgcctgcctcggccc

SEQ ID NO: 90264 - DNA, 16 bp, H. sapiens
ctgcctgcctcggctt

SEQ ID NO: 90265 - DNA, 16 bp, H. sapiens
ctgcctgcctcggtct

SEQ ID NO: 90266 - DNA, 16 bp, H. sapiens
ctgcctgcctctacct

SEQ ID NO: 90267 - DNA, 16 bp, H. sapiens
ctgcctgcctctgcct

SEQ ID NO: 90268 - DNA, 16 bp, H. sapiens
ctgcctgcctgcccca

SEQ ID NO: 90269 - DNA, 16 bp, H. sapiens
ctgcctgcctgcctgt

SEQ ID NO: 90270 - DNA, 16 bp, H. sapiens
ctgcctgcctgctctg

SEQ ID NO: 90271 - DNA, 16 bp, H. sapiens
ctgcctgcctggcctc

SEQ ID NO: 90272 - DNA, 16 bp, H. sapiens
ctgcctgcctggcctg

SEQ ID NO: 90273 - DNA, 16 bp, H. sapiens
ctgcctgcctggggcc

SEQ ID NO: 90274 - DNA, 16 bp, H. sapiens
ctgcctgccttcctgc

SEQ ID NO: 90275 - DNA, 16 bp, H. sapiens
ctgcctgccttcttcc

SEQ ID NO: 90276 - DNA, 16 bp, H. sapiens
ctgcctgccttggctc

SEQ ID NO: 90277 - DNA, 16 bp, H. sapiens
ctgcctgcctttgcct

SEQ ID NO: 90278 - DNA, 16 bp, H. sapiens
ctgcctgctcaagtgg

SEQ ID NO: 90279 - DNA, 16 bp, H. sapiens
ctgcctgctccatgga

SEQ ID NO: 90280 - DNA, 16 bp, H. sapiens
ctgcctgctcctggcc

SEQ ID NO: 90281 - DNA, 16 bp, H. sapiens
ctgcctgctccttctt

SEQ ID NO: 90282 - DNA, 16 bp, H. sapiens
ctgcctgctctgtgga

SEQ ID NO: 90283 - DNA, 16 bp, H. sapiens
ctgcctgctggctctg

SEQ ID NO: 90284 - DNA, 16 bp, H. sapiens
ctgcctgctgggctca

SEQ ID NO: 90285 - DNA, 16 bp, H. sapiens
ctgcctggaatgccct

SEQ ID NO: 90286 - DNA, 16 bp, H. sapiens
ctgcctggaatgtttt

SEQ ID NO: 90287 - DNA, 16 bp, H. sapiens
ctgcctggacattcag

SEQ ID NO: 90288 - DNA, 16 bp, H. sapiens
ctgcctggaggagggg

SEQ ID NO: 90289 - DNA, 16 bp, H. sapiens
ctgcctggagtgctgt

SEQ ID NO: 90290 - DNA, 16 bp, H. sapiens
ctgcctggcacagagc

SEQ ID NO: 90291 - DNA, 16 bp, H. sapiens
ctgcctggcagccaag

SEQ ID NO: 90292 - DNA, 17 bp, H. sapiens
ctgcctggcagccgagg

SEQ ID NO: 90293 - DNA, 16 bp, H. sapiens
ctgcctggcagctctg

SEQ ID NO: 90294 - DNA, 16 bp, H. sapiens
ctgcctggcatggtgg

SEQ ID NO: 90295 - DNA, 16 bp, H. sapiens
ctgcctggccaacata

SEQ ID NO: 90296 - DNA, 16 bp, H. sapiens
ctgcctggccctgcag

SEQ ID NO: 90297 - DNA, 16 bp, H. sapiens
ctgcctggccgcccag

SEQ ID NO: 90298 - DNA, 16 bp, H. sapiens
ctgcctggcctcctgc

SEQ ID NO: 90299 - DNA, 16 bp, H. sapiens
ctgcctggcctctctc

SEQ ID NO: 90300 - DNA, 16 bp, H. sapiens
ctgcctggctaatttt

SEQ ID NO: 90301 - DNA, 16 bp, H. sapiens
ctgcctggctccctcc

SEQ ID NO: 90302 - DNA, 16 bp, H. sapiens
ctgcctggctccttcc

SEQ ID NO: 90303 - DNA, 16 bp, H. sapiens
ctgcctggctctagtg

SEQ ID NO: 90304 - DNA, 16 bp, H. sapiens
ctgcctggctgcccca

SEQ ID NO: 90305 - DNA, 16 bp, H. sapiens
ctgcctggctgcccct

SEQ ID NO: 90306 - DNA, 16 bp, H. sapiens
ctgcctggctgcctct

SEQ ID NO: 90307 - DNA, 16 bp, H. sapiens
ctgcctggctggctgg

SEQ ID NO: 90308 - DNA, 16 bp, H. sapiens
ctgcctgggagccagg

SEQ ID NO: 90309 - DNA, 16 bp, H. sapiens
ctgcctgggaggaggg

SEQ ID NO: 90310 - DNA, 16 bp, H. sapiens
ctgcctgggccctgct

SEQ ID NO: 90311 - DNA, 21 bp, H. sapiens
ctgcctgggctcccactttgg

SEQ ID NO: 90312 - DNA, 16 bp, H. sapiens
ctgcctgggctctgcc

SEQ ID NO: 90313 - DNA, 16 bp, H. sapiens
ctgcctgggctggagt

SEQ ID NO: 90314 - DNA, 16 bp, H. sapiens
ctgcctgggctggtct

SEQ ID NO: 90315 - DNA, 16 bp, H. sapiens
ctgcctggggcctggg

SEQ ID NO: 90316 - DNA, 16 bp, H. sapiens
ctgcctggggtcagcc

SEQ ID NO: 90317 - DNA, 16 bp, H. sapiens
ctgcctggggttgggg

SEQ ID NO: 90318 - DNA, 16 bp, H. sapiens
ctgcctgggtggcaga

SEQ ID NO: 90319 - DNA, 16 bp, H. sapiens
ctgcctggtgtgtcct

SEQ ID NO: 90320 - DNA, 16 bp, H. sapiens
ctgcctggtgttgctt

SEQ ID NO: 90321 - DNA, 16 bp, H. sapiens
ctgcctggttcaagcg

SEQ ID NO: 90322 - DNA, 16 bp, H. sapiens
ctgcctgtcacccagt

SEQ ID NO: 90323 - DNA, 16 bp, H. sapiens
ctgcctgtccccaccc

SEQ ID NO: 90324 - DNA, 16 bp, H. sapiens
ctgcctgtctgcctgc

SEQ ID NO: 90325 - DNA, 16 bp, H. sapiens
ctgcctgtcttccttc

SEQ ID NO: 90326 - DNA, 16 bp, H. sapiens
ctgcctgtgctctaca

SEQ ID NO: 90327 - DNA, 16 bp, H. sapiens
ctgcctgtgggctggg

SEQ ID NO: 90328 - DNA, 16 bp, H. sapiens
ctgcctgtggggtcag

SEQ ID NO: 90329 - DNA, 16 bp, H. sapiens
ctgcctgtgtcagcct

SEQ ID NO: 90330 - DNA, 16 bp, H. sapiens
ctgcctgtgtccatgt

SEQ ID NO: 90331 - DNA, 16 bp, H. sapiens
ctgcctgtgtcttcac

SEQ ID NO: 90332 - DNA, 16 bp, H. sapiens
ctgcctgttctcactt

SEQ ID NO: 90333 - DNA, 16 bp, H. sapiens
ctgccttaaaaaaaaa

SEQ ID NO: 90334 - DNA, 16 bp, H. sapiens
ctgccttaactgatta

SEQ ID NO: 90335 - DNA, 16 bp, H. sapiens
ctgccttaacttcatt

SEQ ID NO: 90336 - DNA, 16 bp, H. sapiens
ctgccttacaaaagct

SEQ ID NO: 90337 - DNA, 16 bp, H. sapiens
ctgccttagcctacca

SEQ ID NO: 90338 - DNA, 16 bp, H. sapiens
ctgccttaggctccca

SEQ ID NO: 90339 - DNA, 16 bp, H. sapiens
ctgccttagtctcctg

SEQ ID NO: 90340 - DNA, 16 bp, H. sapiens
ctgccttataagaaat

SEQ ID NO: 90341 - DNA, 16 bp, H. sapiens
ctgccttattgcaagg

SEQ ID NO: 90342 - DNA, 16 bp, H. sapiens
ctgccttcaaggagct

SEQ ID NO: 90343 - DNA, 16 bp, H. sapiens
ctgccttcaaggagtt

SEQ ID NO: 90344 - DNA, 16 bp, H. sapiens
ctgccttcagagagct

SEQ ID NO: 90345 - DNA, 16 bp, H. sapiens
ctgccttcatctttac

SEQ ID NO: 90346 - DNA, 16 bp, H. sapiens
ctgccttcatggaact

SEQ ID NO: 90347 - DNA, 16 bp, H. sapiens
ctgccttcatggagct

SEQ ID NO: 90348 - DNA, 16 bp, H. sapiens
ctgccttcatgggctg

SEQ ID NO: 90349 - DNA, 16 bp, H. sapiens
ctgccttccacctcca

SEQ ID NO: 90350 - DNA, 16 bp, H. sapiens
ctgccttccatgttca

SEQ ID NO: 90351 - DNA, 16 bp, H. sapiens
ctgccttcccagcctc

SEQ ID NO: 90352 - DNA, 16 bp, H. sapiens
ctgccttccccagccc

SEQ ID NO: 90353 - DNA, 16 bp, H. sapiens
ctgccttcctggctgt

SEQ ID NO: 90354 - DNA, 16 bp, H. sapiens
ctgccttctcaagtgg

SEQ ID NO: 90355 - DNA, 16 bp, H. sapiens
ctgccttctccagcct

SEQ ID NO: 90356 - DNA, 16 bp, H. sapiens
ctgccttctcccacct

SEQ ID NO: 90357 - DNA, 16 bp, H. sapiens
ctgccttctctctgcc

SEQ ID NO: 90358 - DNA, 16 bp, H. sapiens
ctgccttctctggttt

SEQ ID NO: 90359 - DNA, 16 bp, H. sapiens
ctgccttctgccatga

SEQ ID NO: 90360 - DNA, 16 bp, H. sapiens
ctgccttctggcttct

SEQ ID NO: 90361 - DNA, 16 bp, H. sapiens
ctgccttcttctttca

SEQ ID NO: 90362 - DNA, 16 bp, H. sapiens
ctgccttggcccctca

SEQ ID NO: 90363 - DNA, 16 bp, H. sapiens
ctgccttggcctcccg

SEQ ID NO: 90364 - DNA, 16 bp, H. sapiens
ctgccttggcctccga

SEQ ID NO: 90365 - DNA, 16 bp, H. sapiens
ctgccttggcctcctg

SEQ ID NO: 90366 - DNA, 16 bp, H. sapiens
ctgccttggcctctca

SEQ ID NO: 90367 - DNA, 16 bp, H. sapiens
ctgccttggctcccca

SEQ ID NO: 90368 - DNA, 16 bp, H. sapiens
ctgccttgggactctg

SEQ ID NO: 90369 - DNA, 16 bp, H. sapiens
ctgccttgggcctccc

SEQ ID NO: 90370 - DNA, 16 bp, H. sapiens
ctgccttgggcttcca

SEQ ID NO: 90371 - DNA, 16 bp, H. sapiens
ctgccttggtctccca

SEQ ID NO: 90372 - DNA, 16 bp, H. sapiens
ctgccttggtcttcca

SEQ ID NO: 90373 - DNA, 16 bp, H. sapiens
ctgccttgtgccagtt

SEQ ID NO: 90374 - DNA, 16 bp, H. sapiens
ctgcctttaaaaaaaa

SEQ ID NO: 90375 - DNA, 16 bp, H. sapiens
ctgcctttatggagct

SEQ ID NO: 90376 - DNA, 16 bp, H. sapiens
ctgcctttcaaagtgc

SEQ ID NO: 90377 - DNA, 16 bp, H. sapiens
ctgcctttcattctat

SEQ ID NO: 90378 - DNA, 16 bp, H. sapiens
ctgcctttccctggtg

SEQ ID NO: 90379 - DNA, 16 bp, H. sapiens
ctgcctttgcaaaaat

SEQ ID NO: 90380 - DNA, 16 bp, H. sapiens
ctgcctttgcttttat

SEQ ID NO: 90381 - DNA, 16 bp, H. sapiens
ctgcctttggggctcc

SEQ ID NO: 90382 - DNA, 16 bp, H. sapiens
ctgccttttgtttagc

SEQ ID NO: 90383 - DNA, 17 bp, H. sapiens
ctgcgagggctgccagc

SEQ ID NO: 90384 - DNA, 16 bp, H. sapiens
ctgcgatactgggagt

SEQ ID NO: 90385 - DNA, 16 bp, H. sapiens
ctgcgatctctgcctc

SEQ ID NO: 90386 - DNA, 16 bp, H. sapiens
ctgcgcacctcggcct

SEQ ID NO: 90387 - DNA, 16 bp, H. sapiens
ctgcgcagcaaaagaa

SEQ ID NO: 90388 - DNA, 16 bp, H. sapiens
ctgcgcatcctgcaca

SEQ ID NO: 90389 - DNA, 16 bp, H. sapiens
ctgcgcccagccagac

SEQ ID NO: 90390 - DNA, 16 bp, H. sapiens
ctgcgcccagccatgt

SEQ ID NO: 90391 - DNA, 16 bp, H. sapiens
ctgcgcccagcccaag

SEQ ID NO: 90392 - DNA, 16 bp, H. sapiens
ctgcgcccagccccag

SEQ ID NO: 90393 - DNA, 16 bp, H. sapiens
ctgcgcccagcctccc

SEQ ID NO: 90394 - DNA, 16 bp, H. sapiens
ctgcgcccagcctctc

SEQ ID NO: 90395 - DNA, 16 bp, H. sapiens
ctgcgcccggccatga

SEQ ID NO: 90396 - DNA, 16 bp, H. sapiens
ctgcgcccggcccagc

SEQ ID NO: 90397 - DNA, 16 bp, H. sapiens
ctgcgcccggccccac

SEQ ID NO: 90398 - DNA, 16 bp, H. sapiens
ctgcgcccggccctgg

SEQ ID NO: 90399 - DNA, 16 bp, H. sapiens
ctgcgcccggcccttc

SEQ ID NO: 90400 - DNA, 16 bp, H. sapiens
ctgcgcccggcctggc

SEQ ID NO: 90401 - DNA, 16 bp, H. sapiens
ctgcgcctgcgccggc

SEQ ID NO: 90402 - DNA, 16 bp, H. sapiens
ctgcgcctggccaaga

SEQ ID NO: 90403 - DNA, 16 bp, H. sapiens
ctgcgcctggccacca

SEQ ID NO: 90404 - DNA, 16 bp, H. sapiens
ctgcgcctggccatcc

SEQ ID NO: 90405 - DNA, 16 bp, H. sapiens
ctgcgcctggccatct

SEQ ID NO: 90406 - DNA, 16 bp, H. sapiens
ctgcgcctggcccaga

SEQ ID NO: 90407 - DNA, 16 bp, H. sapiens
ctgcgcctggcccagc

SEQ ID NO: 90408 - DNA, 16 bp, H. sapiens
ctgcgcctggccccaa

SEQ ID NO: 90409 - DNA, 16 bp, H. sapiens
ctgcgcctggccctgg

SEQ ID NO: 90410 - DNA, 16 bp, H. sapiens
ctgcgcctggcctact

SEQ ID NO: 90411 - DNA, 16 bp, H. sapiens
ctgcgcctggcctcac

SEQ ID NO: 90412 - DNA, 16 bp, H. sapiens
ctgcgcctggcctgcc

SEQ ID NO: 90413 - DNA, 16 bp, H. sapiens
ctgcgcctggcctggt

SEQ ID NO: 90414 - DNA, 16 bp, H. sapiens
ctgcgcctggccttgg

SEQ ID NO: 90415 - DNA, 16 bp, H. sapiens
ctgcgctacagcctgg

SEQ ID NO: 90416 - DNA, 16 bp, H. sapiens
ctgcgctccaggctgg

SEQ ID NO: 90417 - DNA, 16 bp, H. sapiens
ctgcgctcgatttctc

SEQ ID NO: 90418 - DNA, 16 bp, H. sapiens
ctgcgcttgatttctc

SEQ ID NO: 90419 - DNA, 16 bp, H. sapiens
ctgcgggtctcctctg

SEQ ID NO: 90420 - DNA, 16 bp, H. sapiens
ctgcggtgagctgtga

SEQ ID NO: 90421 - DNA, 16 bp, H. sapiens
ctgcgtcagcctcccc

SEQ ID NO: 90422 - DNA, 16 bp, H. sapiens
ctgcgtggctggggag

SEQ ID NO: 90423 - DNA, 16 bp, H. sapiens
ctgcgtgtgtctgtgt

SEQ ID NO: 90424 - DNA, 16 bp, H. sapiens
ctgctaatattttatt

SEQ ID NO: 90425 - DNA, 16 bp, H. sapiens
ctgctaatttaaaaaa

SEQ ID NO: 90426 - DNA, 16 bp, H. sapiens
ctgctacaaatacaaa

SEQ ID NO: 90427 - DNA, 16 bp, H. sapiens
ctgctacagcatggcc

SEQ ID NO: 90428 - DNA, 16 bp, H. sapiens
ctgctaccaccacagc

SEQ ID NO: 90429 - DNA, 16 bp, H. sapiens
ctgctaccatgcccag

SEQ ID NO: 90430 - DNA, 16 bp, H. sapiens
ctgctactgccactgc

SEQ ID NO: 90431 - DNA, 16 bp, H. sapiens
ctgctactgctactgc

SEQ ID NO: 90432 - DNA, 16 bp, H. sapiens
ctgctacttggaggct

SEQ ID NO: 90433 - DNA, 16 bp, H. sapiens
ctgctagagtttgctg

SEQ ID NO: 90434 - DNA, 16 bp, H. sapiens
ctgctagggcaatgtg

SEQ ID NO: 90435 - DNA, 16 bp, H. sapiens
ctgctaggggacccag

SEQ ID NO: 90436 - DNA, 16 bp, H. sapiens
ctgctagtgggagtgt

SEQ ID NO: 90437 - DNA, 16 bp, H. sapiens
ctgctagttctgagga

SEQ ID NO: 90438 - DNA, 16 bp, H. sapiens
ctgctagtttcaaact

SEQ ID NO: 90439 - DNA, 16 bp, H. sapiens
ctgctagttttggggt

SEQ ID NO: 90440 - DNA, 16 bp, H. sapiens
ctgctataaagatact

SEQ ID NO: 90441 - DNA, 16 bp, H. sapiens
ctgctatacaccaaca

SEQ ID NO: 90442 - DNA, 16 bp, H. sapiens
ctgctatgaagaaaca

SEQ ID NO: 90443 - DNA, 16 bp, H. sapiens
ctgctatgattataag

SEQ ID NO: 90444 - DNA, 16 bp, H. sapiens
ctgctatgtggcctgg

SEQ ID NO: 90445 - DNA, 16 bp, H. sapiens
ctgctattattgtatt

SEQ ID NO: 90446 - DNA, 16 bp, H. sapiens
ctgctatttatttatt

SEQ ID NO: 90447 - DNA, 16 bp, H. sapiens
ctgctcaaaatccttc

SEQ ID NO: 90448 - DNA, 16 bp, H. sapiens
ctgctcaaagaaatca

SEQ ID NO: 90449 - DNA, 16 bp, H. sapiens
ctgctcaaagaaatga

SEQ ID NO: 90450 - DNA, 16 bp, H. sapiens
ctgctcaaggaaatca

SEQ ID NO: 90451 - DNA, 16 bp, H. sapiens
ctgctcaaggccatgg

SEQ ID NO: 90452 - DNA, 16 bp, H. sapiens
ctgctcaaggtcattg

SEQ ID NO: 90453 - DNA, 16 bp, H. sapiens
ctgctcaatgaaaagt

SEQ ID NO: 90454 - DNA, 16 bp, H. sapiens
ctgctcaatgagataa

SEQ ID NO: 90455 - DNA, 16 bp, H. sapiens
ctgctcaccacagcct

SEQ ID NO: 90456 - DNA, 16 bp, H. sapiens
ctgctcaccagcctgg

SEQ ID NO: 90457 - DNA, 16 bp, H. sapiens
ctgctcacccacattg

SEQ ID NO: 90458 - DNA, 16 bp, H. sapiens
ctgctcacccactgcc

SEQ ID NO: 90459 - DNA, 16 bp, H. sapiens
ctgctcaccgcaagct

SEQ ID NO: 90460 - DNA, 16 bp, H. sapiens
ctgctcacctcagtct

SEQ ID NO: 90461 - DNA, 16 bp, H. sapiens
ctgctcacctccttct

SEQ ID NO: 90462 - DNA, 16 bp, H. sapiens
ctgctcacctgggcct

SEQ ID NO: 90463 - DNA, 18 bp, H. sapiens
ctgctcactctttgggtc

SEQ ID NO: 90464 - DNA, 16 bp, H. sapiens
ctgctcagcaaaataa

SEQ ID NO: 90465 - DNA, 16 bp, H. sapiens
ctgctcagcaccctgc

SEQ ID NO: 90466 - DNA, 16 bp, H. sapiens
ctgctcagccccctgg

SEQ ID NO: 90467 - DNA, 16 bp, H. sapiens
ctgctcagctccctgg

SEQ ID NO: 90468 - DNA, 16 bp, H. sapiens
ctgctcagctctggct

SEQ ID NO: 90469 - DNA, 16 bp, H. sapiens
ctgctcaggaggatga

SEQ ID NO: 90470 - DNA, 16 bp, H. sapiens
ctgctcagggggctga

SEQ ID NO: 90471 - DNA, 16 bp, H. sapiens
ctgctcatgtctgact

SEQ ID NO: 90472 - DNA, 16 bp, H. sapiens
ctgctcattggcaatg

SEQ ID NO: 90473 - DNA, 16 bp, H. sapiens
ctgctccacagcgccc

SEQ ID NO: 90474 - DNA, 16 bp, H. sapiens
ctgctccaccagcttc

SEQ ID NO: 90475 - DNA, 16 bp, H. sapiens
ctgctccactgactgg

SEQ ID NO: 90476 - DNA, 16 bp, H. sapiens
ctgctccagaggctga

SEQ ID NO: 90477 - DNA, 16 bp, H. sapiens
ctgctccagccacaca

SEQ ID NO: 90478 - DNA, 16 bp, H. sapiens
ctgctccagcctcctg

SEQ ID NO: 90479 - DNA, 16 bp, H. sapiens
ctgctccagctcctgc

SEQ ID NO: 90480 - DNA, 16 bp, H. sapiens
ctgctccatcagcctg

SEQ ID NO: 90481 - DNA, 16 bp, H. sapiens
ctgctcccagaggtgg

SEQ ID NO: 90482 - DNA, 16 bp, H. sapiens
ctgctcccagccccag

SEQ ID NO: 90483 - DNA, 16 bp, H. sapiens
ctgctcccagccctgg

SEQ ID NO: 90484 - DNA, 16 bp, H. sapiens
ctgctccccaaatgct

SEQ ID NO: 90485 - DNA, 16 bp, H. sapiens
ctgctccccaccccag

SEQ ID NO: 90486 - DNA, 16 bp, H. sapiens
ctgctccccagctcct

SEQ ID NO: 90487 - DNA, 16 bp, H. sapiens
ctgctccctcagcctc

SEQ ID NO: 90488 - DNA, 16 bp, H. sapiens
ctgctcctcccagccc

SEQ ID NO: 90489 - DNA, 16 bp, H. sapiens
ctgctcctccctgggc

SEQ ID NO: 90490 - DNA, 16 bp, H. sapiens
ctgctcctcctcaggt

SEQ ID NO: 90491 - DNA, 16 bp, H. sapiens
ctgctcctcctgatct

SEQ ID NO: 90492 - DNA, 16 bp, H. sapiens
ctgctcctgaattcct

SEQ ID NO: 90493 - DNA, 16 bp, H. sapiens
ctgctcctgaggcttc

SEQ ID NO: 90494 - DNA, 16 bp, H. sapiens
ctgctcctgcagagca

SEQ ID NO: 90495 - DNA, 16 bp, H. sapiens
ctgctcctgcagcaga

SEQ ID NO: 90496 - DNA, 16 bp, H. sapiens
ctgctcctgcaggacc

SEQ ID NO: 90497 - DNA, 16 bp, H. sapiens
ctgctcctgccccacc

SEQ ID NO: 90498 - DNA, 16 bp, H. sapiens
ctgctcctgcctgccc

SEQ ID NO: 90499 - DNA, 16 bp, H. sapiens
ctgctcctggcacacc

SEQ ID NO: 90500 - DNA, 16 bp, H. sapiens
ctgctcctggcccctc

SEQ ID NO: 90501 - DNA, 16 bp, H. sapiens
ctgctcctgtggcccc

SEQ ID NO: 90502 - DNA, 16 bp, H. sapiens
ctgctcctgtggcttt

SEQ ID NO: 90503 - DNA, 16 bp, H. sapiens
ctgctccttcccctgg

SEQ ID NO: 90504 - DNA, 16 bp, H. sapiens
ctgctccttctcctgg

SEQ ID NO: 90505 - DNA, 16 bp, H. sapiens
ctgctccttctgctgt

SEQ ID NO: 90506 - DNA, 16 bp, H. sapiens
ctgctctcaaggagct

SEQ ID NO: 90507 - DNA, 16 bp, H. sapiens
ctgctctcaaggagtt

SEQ ID NO: 90508 - DNA, 16 bp, H. sapiens
ctgctctcacaggctg

SEQ ID NO: 90509 - DNA, 16 bp, H. sapiens
ctgctctcaccactcc

SEQ ID NO: 90510 - DNA, 16 bp, H. sapiens
ctgctctcagcctccc

SEQ ID NO: 90511 - DNA, 16 bp, H. sapiens
ctgctctccagcttgg

SEQ ID NO: 90512 - DNA, 16 bp, H. sapiens
ctgctctcctactaca

SEQ ID NO: 90513 - DNA, 16 bp, H. sapiens
ctgctctcctggcccc

SEQ ID NO: 90514 - DNA, 16 bp, H. sapiens
ctgctctctatctcca

SEQ ID NO: 90515 - DNA, 16 bp, H. sapiens
ctgctctcttcagagc

SEQ ID NO: 90516 - DNA, 16 bp, H. sapiens
ctgctctctttaaagc

SEQ ID NO: 90517 - DNA, 16 bp, H. sapiens
ctgctctgaagaaata

SEQ ID NO: 90518 - DNA, 16 bp, H. sapiens
ctgctctgaagggtga

SEQ ID NO: 90519 - DNA, 16 bp, H. sapiens
ctgctctgagccccag

SEQ ID NO: 90520 - DNA, 16 bp, H. sapiens
ctgctctgatttcagt

SEQ ID NO: 90521 - DNA, 16 bp, H. sapiens
ctgctctgattttttt

SEQ ID NO: 90522 - DNA, 16 bp, H. sapiens
ctgctctgcagcctcc

SEQ ID NO: 90523 - DNA, 16 bp, H. sapiens
ctgctctgccacttgg

SEQ ID NO: 90524 - DNA, 16 bp, H. sapiens
ctgctctgccatggta

SEQ ID NO: 90525 - DNA, 16 bp, H. sapiens
ctgctctgccctgccc

SEQ ID NO: 90526 - DNA, 16 bp, H. sapiens
ctgctctgctctgctc

SEQ ID NO: 90527 - DNA, 16 bp, H. sapiens
ctgctctgctgctctg

SEQ ID NO: 90528 - DNA, 16 bp, H. sapiens
ctgctctggagagggg

SEQ ID NO: 90529 - DNA, 16 bp, H. sapiens
ctgctctgggccacag

SEQ ID NO: 90530 - DNA, 16 bp, H. sapiens
ctgctctggggtcagg

SEQ ID NO: 90531 - DNA, 16 bp, H. sapiens
ctgctctgtccccagc

SEQ ID NO: 90532 - DNA, 16 bp, H. sapiens
ctgctctgtgaaaatg

SEQ ID NO: 90533 - DNA, 16 bp, H. sapiens
ctgctctgtgcctcag

SEQ ID NO: 90534 - DNA, 16 bp, H. sapiens
ctgctctgtgctgggc

SEQ ID NO: 90535 - DNA, 16 bp, H. sapiens
ctgctctgtggcccag

SEQ ID NO: 90536 - DNA, 16 bp, H. sapiens
ctgctctgtggcctgg

SEQ ID NO: 90537 - DNA, 16 bp, H. sapiens
ctgctctgtgtcctgg

SEQ ID NO: 90538 - DNA, 16 bp, H. sapiens
ctgctctgttttggtt

SEQ ID NO: 90539 - DNA, 16 bp, H. sapiens
ctgctcttatctttgt

SEQ ID NO: 90540 - DNA, 16 bp, H. sapiens
ctgctcttgaacccct

SEQ ID NO: 90541 - DNA, 16 bp, H. sapiens
ctgctcttgaatgact

SEQ ID NO: 90542 - DNA, 16 bp, H. sapiens
ctgctcttgtctgcag

SEQ ID NO: 90543 - DNA, 16 bp, H. sapiens
ctgctgaactgtgagt

SEQ ID NO: 90544 - DNA, 16 bp, H. sapiens
ctgctgaagctgtgcc

SEQ ID NO: 90545 - DNA, 16 bp, H. sapiens
ctgctgaagtttgctg

SEQ ID NO: 90546 - DNA, 16 bp, H. sapiens
ctgctgaatacaaaga

SEQ ID NO: 90547 - DNA, 16 bp, H. sapiens
ctgctgaatcaaaaga

SEQ ID NO: 90548 - DNA, 16 bp, H. sapiens
ctgctgaatgaataaa

SEQ ID NO: 90549 - DNA, 18 bp, H. sapiens
ctgctgaccctctcccca

SEQ ID NO: 90550 - DNA, 16 bp, H. sapiens
ctgctgacctcaagtg

SEQ ID NO: 90551 - DNA, 16 bp, H. sapiens
ctgctgactttgaaga

SEQ ID NO: 90552 - DNA, 16 bp, H. sapiens
ctgctgagaaatcagc

SEQ ID NO: 90553 - DNA, 16 bp, H. sapiens
ctgctgagaaatcttc

SEQ ID NO: 90554 - DNA, 16 bp, H. sapiens
ctgctgagaaatttct

SEQ ID NO: 90555 - DNA, 16 bp, H. sapiens
ctgctgaggcctcagg

SEQ ID NO: 90556 - DNA, 16 bp, H. sapiens
ctgctgagggcctcag

SEQ ID NO: 90557 - DNA, 16 bp, H. sapiens
ctgctgaggtcacctg

SEQ ID NO: 90558 - DNA, 16 bp, H. sapiens
ctgctgatacccaggc

SEQ ID NO: 90559 - DNA, 16 bp, H. sapiens
ctgctgatctggcagg

SEQ ID NO: 90560 - DNA, 16 bp, H. sapiens
ctgctgatgctgctgg

SEQ ID NO: 90561 - DNA, 16 bp, H. sapiens
ctgctgattggctggg

SEQ ID NO: 90562 - DNA, 16 bp, H. sapiens
ctgctgcacagacaaa

SEQ ID NO: 90563 - DNA, 16 bp, H. sapiens
ctgctgcacctggccc

SEQ ID NO: 90564 - DNA, 16 bp, H. sapiens
ctgctgcagaactgat

SEQ ID NO: 90565 - DNA, 16 bp, H. sapiens
ctgctgcagcagctgg

SEQ ID NO: 90566 - DNA, 16 bp, H. sapiens
ctgctgcagccacact

SEQ ID NO: 90567 - DNA, 16 bp, H. sapiens
ctgctgcagcctctgc

SEQ ID NO: 90568 - DNA, 16 bp, H. sapiens
ctgctgcagctccagc

SEQ ID NO: 90569 - DNA, 16 bp, H. sapiens
ctgctgcagctgctgc

SEQ ID NO: 90570 - DNA, 16 bp, H. sapiens
ctgctgcagctgctgg

SEQ ID NO: 90571 - DNA, 16 bp, H. sapiens
ctgctgcaggagcaga

SEQ ID NO: 90572 - DNA, 16 bp, H. sapiens
ctgctgcagggacaga

SEQ ID NO: 90573 - DNA, 16 bp, H. sapiens
ctgctgcaggggcaga

SEQ ID NO: 90574 - DNA, 16 bp, H. sapiens
ctgctgcagggggtcc

SEQ ID NO: 90575 - DNA, 16 bp, H. sapiens
ctgctgcaggggtgga

SEQ ID NO: 90576 - DNA, 16 bp, H. sapiens
ctgctgcagggttctg

SEQ ID NO: 90577 - DNA, 16 bp, H. sapiens
ctgctgcaggtgaccc

SEQ ID NO: 90578 - DNA, 16 bp, H. sapiens
ctgctgcagtatgctg

SEQ ID NO: 90579 - DNA, 16 bp, H. sapiens
ctgctgcattccagcc

SEQ ID NO: 90580 - DNA, 16 bp, H. sapiens
ctgctgccaccaccac

SEQ ID NO: 90581 - DNA, 16 bp, H. sapiens
ctgctgccaccctgtg

SEQ ID NO: 90582 - DNA, 16 bp, H. sapiens
ctgctgccactgccca

SEQ ID NO: 90583 - DNA, 16 bp, H. sapiens
ctgctgccagccctgg

SEQ ID NO: 90584 - DNA, 16 bp, H. sapiens
ctgctgccatccatgt

SEQ ID NO: 90585 - DNA, 16 bp, H. sapiens
ctgctgccatgcccag

SEQ ID NO: 90586 - DNA, 16 bp, H. sapiens
ctgctgccatgtaaga

SEQ ID NO: 90587 - DNA, 16 bp, H. sapiens
ctgctgccatgtgaga

SEQ ID NO: 90588 - DNA, 16 bp, H. sapiens
ctgctgcccagccctg

SEQ ID NO: 90589 - DNA, 16 bp, H. sapiens
ctgctgcccaggctgc

SEQ ID NO: 90590 - DNA, 16 bp, H. sapiens
ctgctgcccagggtgg

SEQ ID NO: 90591 - DNA, 16 bp, H. sapiens
ctgctgcccatgctgg

SEQ ID NO: 90592 - DNA, 16 bp, H. sapiens
ctgctgccccactgtg

SEQ ID NO: 90593 - DNA, 16 bp, H. sapiens
ctgctgcccctcccag

SEQ ID NO: 90594 - DNA, 16 bp, H. sapiens
ctgctgcccgggctgg

SEQ ID NO: 90595 - DNA, 16 bp, H. sapiens
ctgctgccctccagcc

SEQ ID NO: 90596 - DNA, 16 bp, H. sapiens
ctgctgccctctgctg

SEQ ID NO: 90597 - DNA, 16 bp, H. sapiens
ctgctgccctggccct

SEQ ID NO: 90598 - DNA, 16 bp, H. sapiens
ctgctgccctggctgg

SEQ ID NO: 90599 - DNA, 16 bp, H. sapiens
ctgctgccctgtgcag

SEQ ID NO: 90600 - DNA, 16 bp, H. sapiens
ctgctgccgccctaat

SEQ ID NO: 90601 - DNA, 16 bp, H. sapiens
ctgctgcctaagatga

SEQ ID NO: 90602 - DNA, 16 bp, H. sapiens
ctgctgcctactccca

SEQ ID NO: 90603 - DNA, 16 bp, H. sapiens
ctgctgcctcaaattc

SEQ ID NO: 90604 - DNA, 16 bp, H. sapiens
ctgctgcctcagcctc

SEQ ID NO: 90605 - DNA, 16 bp, H. sapiens
ctgctgcctcagcttc

SEQ ID NO: 90606 - DNA, 16 bp, H. sapiens
ctgctgcctcagtctc

SEQ ID NO: 90607 - DNA, 16 bp, H. sapiens
ctgctgcctcccctga

SEQ ID NO: 90608 - DNA, 16 bp, H. sapiens
ctgctgcctcggcctc

SEQ ID NO: 90609 - DNA, 16 bp, H. sapiens
ctgctgcctctgcctg

SEQ ID NO: 90610 - DNA, 16 bp, H. sapiens
ctgctgcctctgctcc

SEQ ID NO: 90611 - DNA, 16 bp, H. sapiens
ctgctgcctgcctgcc

SEQ ID NO: 90612 - DNA, 16 bp, H. sapiens
ctgctgcctggcctct

SEQ ID NO: 90613 - DNA, 16 bp, H. sapiens
ctgctgcctgggcctc

SEQ ID NO: 90614 - DNA, 16 bp, H. sapiens
ctgctgcctgggctgg

SEQ ID NO: 90615 - DNA, 16 bp, H. sapiens
ctgctgccttctctct

SEQ ID NO: 90616 - DNA, 16 bp, H. sapiens
ctgctgccttgaagag

SEQ ID NO: 90617 - DNA, 16 bp, H. sapiens
ctgctgccttggcccc

SEQ ID NO: 90618 - DNA, 16 bp, H. sapiens
ctgctgccttggcctc

SEQ ID NO: 90619 - DNA, 16 bp, H. sapiens
ctgctgccttgtgaag

SEQ ID NO: 90620 - DNA, 16 bp, H. sapiens
ctgctgccttttgttt

SEQ ID NO: 90621 - DNA, 16 bp, H. sapiens
ctgctgcggctccagc

SEQ ID NO: 90622 - DNA, 16 bp, H. sapiens
ctgctgcgtggtggtg

SEQ ID NO: 90623 - DNA, 16 bp, H. sapiens
ctgctgctactgctgc

SEQ ID NO: 90624 - DNA, 16 bp, H. sapiens
ctgctgctcaaggtca

SEQ ID NO: 90625 - DNA, 16 bp, H. sapiens
ctgctgctcagaagaa

SEQ ID NO: 90626 - DNA, 16 bp, H. sapiens
ctgctgctcagtcttt

SEQ ID NO: 90627 - DNA, 16 bp, H. sapiens
ctgctgctccagaggg

SEQ ID NO: 90628 - DNA, 16 bp, H. sapiens
ctgctgctccaggaac

SEQ ID NO: 90629 - DNA, 16 bp, H. sapiens
ctgctgctccctgccc

SEQ ID NO: 90630 - DNA, 16 bp, H. sapiens
ctgctgctcctgctcc

SEQ ID NO: 90631 - DNA, 16 bp, H. sapiens
ctgctgctctgctgct

SEQ ID NO: 90632 - DNA, 16 bp, H. sapiens
ctgctgctcttctgct

SEQ ID NO: 90633 - DNA, 16 bp, H. sapiens
ctgctgctgacaccca

SEQ ID NO: 90634 - DNA, 16 bp, H. sapiens
ctgctgctgataaaga

SEQ ID NO: 90635 - DNA, 16 bp, H. sapiens
ctgctgctgccaccac

SEQ ID NO: 90636 - DNA, 16 bp, H. sapiens
ctgctgctgccagggc

SEQ ID NO: 90637 - DNA, 16 bp, H. sapiens
ctgctgctgcctgctg

SEQ ID NO: 90638 - DNA, 16 bp, H. sapiens
ctgctgctgcctgtcc

SEQ ID NO: 90639 - DNA, 16 bp, H. sapiens
ctgctgctgctcctgg

SEQ ID NO: 90640 - DNA, 16 bp, H. sapiens
ctgctgctgctgatgg

SEQ ID NO: 90641 - DNA, 16 bp, H. sapiens
ctgctgctgctgcaga

SEQ ID NO: 90642 - DNA, 16 bp, H. sapiens
ctgctgctgctgccat

SEQ ID NO: 90643 - DNA, 16 bp, H. sapiens
ctgctgctgctgcccc

SEQ ID NO: 90644 - DNA, 16 bp, H. sapiens
ctgctgctgctgcctc

SEQ ID NO: 90645 - DNA, 16 bp, H. sapiens
ctgctgctgctgcctt

SEQ ID NO: 90646 - DNA, 16 bp, H. sapiens
ctgctgctgctgctaa

SEQ ID NO: 90647 - DNA, 16 bp, H. sapiens
ctgctgctgctgctat

SEQ ID NO: 90648 - DNA, 16 bp, H. sapiens
ctgctgctgctgcttc

SEQ ID NO: 90649 - DNA, 16 bp, H. sapiens
ctgctgctgctgtaca

SEQ ID NO: 90650 - DNA, 16 bp, H. sapiens
ctgctgctgctgtcac

SEQ ID NO: 90651 - DNA, 16 bp, H. sapiens
ctgctgctgctgttct

SEQ ID NO: 90652 - DNA, 16 bp, H. sapiens
ctgctgctgctgttgg

SEQ ID NO: 90653 - DNA, 16 bp, H. sapiens
ctgctgctgcttcctc

SEQ ID NO: 90654 - DNA, 16 bp, H. sapiens
ctgctgctgcttctcc

SEQ ID NO: 90655 - DNA, 16 bp, H. sapiens
ctgctgctgcttctct

SEQ ID NO: 90656 - DNA, 16 bp, H. sapiens
ctgctgctgcttctgc

SEQ ID NO: 90657 - DNA, 16 bp, H. sapiens
ctgctgctgctttatc

SEQ ID NO: 90658 - DNA, 16 bp, H. sapiens
ctgctgctggcacatg

SEQ ID NO: 90659 - DNA, 16 bp, H. sapiens
ctgctgctggcagatt

SEQ ID NO: 90660 - DNA, 16 bp, H. sapiens
ctgctgctggctgctg

SEQ ID NO: 90661 - DNA, 16 bp, H. sapiens
ctgctgctgggctctg

SEQ ID NO: 90662 - DNA, 16 bp, H. sapiens
ctgctgctgtgctggc

SEQ ID NO: 90663 - DNA, 16 bp, H. sapiens
ctgctgctgttgctgt

SEQ ID NO: 90664 - DNA, 16 bp, H. sapiens
ctgctgcttcctcctc

SEQ ID NO: 90665 - DNA, 16 bp, H. sapiens
ctgctgcttcctctgc

SEQ ID NO: 90666 - DNA, 16 bp, H. sapiens
ctgctgcttctacttt

SEQ ID NO: 90667 - DNA, 16 bp, H. sapiens
ctgctgcttctcctcc

SEQ ID NO: 90668 - DNA, 16 bp, H. sapiens
ctgctgcttctctcct

SEQ ID NO: 90669 - DNA, 16 bp, H. sapiens
ctgctgcttctgcttc

SEQ ID NO: 90670 - DNA, 16 bp, H. sapiens
ctgctgcttctgcttt

SEQ ID NO: 90671 - DNA, 16 bp, H. sapiens
ctgctgcttgctgcac

SEQ ID NO: 90672 - DNA, 16 bp, H. sapiens
ctgctgctttctctac

SEQ ID NO: 90673 - DNA, 16 bp, H. sapiens
ctgctgcttttccagg

SEQ ID NO: 90674 - DNA, 16 bp, H. sapiens
ctgctgctttttaaaa

SEQ ID NO: 90675 - DNA, 16 bp, H. sapiens
ctgctggaatttgctg

SEQ ID NO: 90676 - DNA, 16 bp, H. sapiens
ctgctggagaggatgt

SEQ ID NO: 90677 - DNA, 16 bp, H. sapiens
ctgctggagctccagc

SEQ ID NO: 90678 - DNA, 16 bp, H. sapiens
ctgctggaggactgga

SEQ ID NO: 90679 - DNA, 16 bp, H. sapiens
ctgctggaggaggaga

SEQ ID NO: 90680 - DNA, 16 bp, H. sapiens
ctgctggagtttgctg

SEQ ID NO: 90681 - DNA, 16 bp, H. sapiens
ctgctggattttgaac

SEQ ID NO: 90682 - DNA, 16 bp, H. sapiens
ctgctggattttggat

SEQ ID NO: 90683 - DNA, 16 bp, H. sapiens
ctgctggcagctgggg

SEQ ID NO: 90684 - DNA, 16 bp, H. sapiens
ctgctggcattcaccc

SEQ ID NO: 90685 - DNA, 16 bp, H. sapiens
ctgctggccccaggca

SEQ ID NO: 90686 - DNA, 16 bp, H. sapiens
ctgctggccctgggca

SEQ ID NO: 90687 - DNA, 16 bp, H. sapiens
ctgctggccgggcgcg

SEQ ID NO: 90688 - DNA, 16 bp, H. sapiens
ctgctggcctcaggca

SEQ ID NO: 90689 - DNA, 16 bp, H. sapiens
ctgctggcctctgcct

SEQ ID NO: 90690 - DNA, 16 bp, H. sapiens
ctgctggcctgggtgc

SEQ ID NO: 90691 - DNA, 16 bp, H. sapiens
ctgctggcctgtgggg

SEQ ID NO: 90692 - DNA, 16 bp, H. sapiens
ctgctggctctggaga

SEQ ID NO: 90693 - DNA, 16 bp, H. sapiens
ctgctggctgcccatt

SEQ ID NO: 90694 - DNA, 16 bp, H. sapiens
ctgctggctgccttcc

SEQ ID NO: 90695 - DNA, 16 bp, H. sapiens
ctgctggctgtgttct

SEQ ID NO: 90696 - DNA, 16 bp, H. sapiens
ctgctggctttaaaga

SEQ ID NO: 90697 - DNA, 16 bp, H. sapiens
ctgctggctttgaaga

SEQ ID NO: 90698 - DNA, 16 bp, H. sapiens
ctgctggctttgcttt

SEQ ID NO: 90699 - DNA, 16 bp, H. sapiens
ctgctggctttggaga

SEQ ID NO: 90700 - DNA, 16 bp, H. sapiens
ctgctgggaatgtaaa

SEQ ID NO: 90701 - DNA, 16 bp, H. sapiens
ctgctgggacacaggg

SEQ ID NO: 90702 - DNA, 16 bp, H. sapiens
ctgctgggattacaag

SEQ ID NO: 90703 - DNA, 18 bp, H. sapiens
ctgctgggattataggca

SEQ ID NO: 90704 - DNA, 16 bp, H. sapiens
ctgctgggcacagtgg

SEQ ID NO: 90705 - DNA, 16 bp, H. sapiens
ctgctgggcactgtgg

SEQ ID NO: 90706 - DNA, 16 bp, H. sapiens
ctgctgggctcaagct

SEQ ID NO: 90707 - DNA, 16 bp, H. sapiens
ctgctgggctctgcct

SEQ ID NO: 90708 - DNA, 16 bp, H. sapiens
ctgctggggaagctga

SEQ ID NO: 90709 - DNA, 16 bp, H. sapiens
ctgctgggggacccgg

SEQ ID NO: 90710 - DNA, 16 bp, H. sapiens
ctgctgggggacctgg

SEQ ID NO: 90711 - DNA, 16 bp, H. sapiens
ctgctgggggtgcctc

SEQ ID NO: 90712 - DNA, 16 bp, H. sapiens
ctgctggtgaccctgg

SEQ ID NO: 90713 - DNA, 16 bp, H. sapiens
ctgctggtgctgctgc

SEQ ID NO: 90714 - DNA, 16 bp, H. sapiens
ctgctggtgctgctgg

SEQ ID NO: 90715 - DNA, 16 bp, H. sapiens
ctgctggtggaaatgt

SEQ ID NO: 90716 - DNA, 16 bp, H. sapiens
ctgctggtgtgtgtgt

SEQ ID NO: 90717 - DNA, 16 bp, H. sapiens
ctgctggttctgtttc

SEQ ID NO: 90718 - DNA, 16 bp, H. sapiens
ctgctggttgctaaga

SEQ ID NO: 90719 - DNA, 16 bp, H. sapiens
ctgctggttttgaaga

SEQ ID NO: 90720 - DNA, 16 bp, H. sapiens
ctgctgtaaagatacc

SEQ ID NO: 90721 - DNA, 16 bp, H. sapiens
ctgctgtaacaaatca

SEQ ID NO: 90722 - DNA, 16 bp, H. sapiens
ctgctgtatcctcagt

SEQ ID NO: 90723 - DNA, 16 bp, H. sapiens
ctgctgtatctccagc

SEQ ID NO: 90724 - DNA, 16 bp, H. sapiens
ctgctgtcactgtctt

SEQ ID NO: 90725 - DNA, 16 bp, H. sapiens
ctgctgtcagaggagc

SEQ ID NO: 90726 - DNA, 16 bp, H. sapiens
ctgctgtcctcaccct

SEQ ID NO: 90727 - DNA, 16 bp, H. sapiens
ctgctgtcctgtgaag

SEQ ID NO: 90728 - DNA, 16 bp, H. sapiens
ctgctgtctcttcctc

SEQ ID NO: 90729 - DNA, 16 bp, H. sapiens
ctgctgtctgcagatc

SEQ ID NO: 90730 - DNA, 16 bp, H. sapiens
ctgctgtctgccatgt

SEQ ID NO: 90731 - DNA, 16 bp, H. sapiens
ctgctgtctgtcatgt

SEQ ID NO: 90732 - DNA, 16 bp, H. sapiens
ctgctgtcttcagagc

SEQ ID NO: 90733 - DNA, 16 bp, H. sapiens
ctgctgtgaacattca

SEQ ID NO: 90734 - DNA, 16 bp, H. sapiens
ctgctgtgaacatttt

SEQ ID NO: 90735 - DNA, 16 bp, H. sapiens
ctgctgtgcggcctgg

SEQ ID NO: 90736 - DNA, 16 bp, H. sapiens
ctgctgtgctccagcc

SEQ ID NO: 90737 - DNA, 16 bp, H. sapiens
ctgctgtgctggcagc

SEQ ID NO: 90738 - DNA, 16 bp, H. sapiens
ctgctgtggctccagc

SEQ ID NO: 90739 - DNA, 16 bp, H. sapiens
ctgctgtggcttcagc

SEQ ID NO: 90740 - DNA, 16 bp, H. sapiens
ctgctgtggcttctgt

SEQ ID NO: 90741 - DNA, 16 bp, H. sapiens
ctgctgtgtaccaggc

SEQ ID NO: 90742 - DNA, 16 bp, H. sapiens
ctgctgtgtctttccc

SEQ ID NO: 90743 - DNA, 16 bp, H. sapiens
ctgctgtgtgacctgg

SEQ ID NO: 90744 - DNA, 16 bp, H. sapiens
ctgctgtgtgaggaca

SEQ ID NO: 90745 - DNA, 16 bp, H. sapiens
ctgctgtgtgcagcct

SEQ ID NO: 90746 - DNA, 16 bp, H. sapiens
ctgctgtgtgccagcc

SEQ ID NO: 90747 - DNA, 16 bp, H. sapiens
ctgctgtgtgcccagc

SEQ ID NO: 90748 - DNA, 16 bp, H. sapiens
ctgctgtgtggccctg

SEQ ID NO: 90749 - DNA, 16 bp, H. sapiens
ctgctgttaaaaaaaa

SEQ ID NO: 90750 - DNA, 16 bp, H. sapiens
ctgctgttaatatttt

SEQ ID NO: 90751 - DNA, 16 bp, H. sapiens
ctgctgttacttttct

SEQ ID NO: 90752 - DNA, 16 bp, H. sapiens
ctgctgttccttctgc

SEQ ID NO: 90753 - DNA, 17 bp, H. sapiens
ctgctgttctcatgata

SEQ ID NO: 90754 - DNA, 16 bp, H. sapiens
ctgctgttctctgtgc

SEQ ID NO: 90755 - DNA, 16 bp, H. sapiens
ctgctgttctcttaac

SEQ ID NO: 90756 - DNA, 16 bp, H. sapiens
ctgctgttgaagcttt

SEQ ID NO: 90757 - DNA, 16 bp, H. sapiens
ctgctgttgccatctt

SEQ ID NO: 90758 - DNA, 16 bp, H. sapiens
ctgctgttgctgtctt

SEQ ID NO: 90759 - DNA, 16 bp, H. sapiens
ctgcttaaaacccttt

SEQ ID NO: 90760 - DNA, 16 bp, H. sapiens
ctgcttaaagaaatca

SEQ ID NO: 90761 - DNA, 16 bp, H. sapiens
ctgcttagcacccaat

SEQ ID NO: 90762 - DNA, 16 bp, H. sapiens
ctgcttaggcctccca

SEQ ID NO: 90763 - DNA, 16 bp, H. sapiens
ctgcttcaccttccac

SEQ ID NO: 90764 - DNA, 16 bp, H. sapiens
ctgcttcagactcctg

SEQ ID NO: 90765 - DNA, 16 bp, H. sapiens
ctgcttcagaggatgc

SEQ ID NO: 90766 - DNA, 16 bp, H. sapiens
ctgcttcagagggtgc

SEQ ID NO: 90767 - DNA, 16 bp, H. sapiens
ctgcttcagcctctgg

SEQ ID NO: 90768 - DNA, 16 bp, H. sapiens
ctgcttcagctcagga

SEQ ID NO: 90769 - DNA, 16 bp, H. sapiens
ctgcttcagcttccca

SEQ ID NO: 90770 - DNA, 16 bp, H. sapiens
ctgcttccaagctcac

SEQ ID NO: 90771 - DNA, 16 bp, H. sapiens
ctgcttccacattttt

SEQ ID NO: 90772 - DNA, 16 bp, H. sapiens
ctgcttccattttaaa

SEQ ID NO: 90773 - DNA, 16 bp, H. sapiens
ctgcttcccaagttca

SEQ ID NO: 90774 - DNA, 16 bp, H. sapiens
ctgcttcccagctcct

SEQ ID NO: 90775 - DNA, 16 bp, H. sapiens
ctgcttcccagcttca

SEQ ID NO: 90776 - DNA, 16 bp, H. sapiens
ctgcttccccttcacc

SEQ ID NO: 90777 - DNA, 16 bp, H. sapiens
ctgcttccccttcatc

SEQ ID NO: 90778 - DNA, 16 bp, H. sapiens
ctgcttccctcactcc

SEQ ID NO: 90779 - DNA, 16 bp, H. sapiens
ctgcttccctggctca

SEQ ID NO: 90780 - DNA, 16 bp, H. sapiens
ctgcttcccttgtaaa

SEQ ID NO: 90781 - DNA, 16 bp, H. sapiens
ctgcttcctcctcctg

SEQ ID NO: 90782 - DNA, 16 bp, H. sapiens
ctgcttcctctactcc

SEQ ID NO: 90783 - DNA, 16 bp, H. sapiens
ctgcttcctctgcctc

SEQ ID NO: 90784 - DNA, 16 bp, H. sapiens
ctgcttcctcttcacc

SEQ ID NO: 90785 - DNA, 16 bp, H. sapiens
ctgcttcctgctgaat

SEQ ID NO: 90786 - DNA, 16 bp, H. sapiens
ctgcttcctggctcct

SEQ ID NO: 90787 - DNA, 16 bp, H. sapiens
ctgcttcctgggctca

SEQ ID NO: 90788 - DNA, 16 bp, H. sapiens
ctgcttcggcctccta

SEQ ID NO: 90789 - DNA, 16 bp, H. sapiens
ctgcttcggcttccca

SEQ ID NO: 90790 - DNA, 16 bp, H. sapiens
ctgcttctcaaaaaaa

SEQ ID NO: 90791 - DNA, 16 bp, H. sapiens
ctgcttctcaggaggc

SEQ ID NO: 90792 - DNA, 16 bp, H. sapiens
ctgcttctcatttaaa

SEQ ID NO: 90793 - DNA, 16 bp, H. sapiens
ctgcttctcctcctgc

SEQ ID NO: 90794 - DNA, 16 bp, H. sapiens
ctgcttctcctctgcc

SEQ ID NO: 90795 - DNA, 16 bp, H. sapiens
ctgcttctccttcacc

SEQ ID NO: 90796 - DNA, 16 bp, H. sapiens
ctgcttctctctgcct

SEQ ID NO: 90797 - DNA, 16 bp, H. sapiens
ctgcttctctgctctg

SEQ ID NO: 90798 - DNA, 16 bp, H. sapiens
ctgcttctgctgcctg

SEQ ID NO: 90799 - DNA, 16 bp, H. sapiens
ctgcttctgctgcttc

SEQ ID NO: 90800 - DNA, 16 bp, H. sapiens
ctgcttctgcttccca

SEQ ID NO: 90801 - DNA, 16 bp, H. sapiens
ctgcttctgcttcttc

SEQ ID NO: 90802 - DNA, 16 bp, H. sapiens
ctgcttctgtggcttt

SEQ ID NO: 90803 - DNA, 16 bp, H. sapiens
ctgcttcttaaaaaaa

SEQ ID NO: 90804 - DNA, 16 bp, H. sapiens
ctgcttcttcctgtcc

SEQ ID NO: 90805 - DNA, 16 bp, H. sapiens
ctgcttgagaccagaa

SEQ ID NO: 90806 - DNA, 16 bp, H. sapiens
ctgcttgagcatcctc

SEQ ID NO: 90807 - DNA, 16 bp, H. sapiens
ctgcttgagccctgga

SEQ ID NO: 90808 - DNA, 16 bp, H. sapiens
ctgcttgagttcagga

SEQ ID NO: 90809 - DNA, 16 bp, H. sapiens
ctgcttgctttctcag

SEQ ID NO: 90810 - DNA, 16 bp, H. sapiens
ctgcttggaatgccct

SEQ ID NO: 90811 - DNA, 16 bp, H. sapiens
ctgcttgggtggctga

SEQ ID NO: 90812 - DNA, 16 bp, H. sapiens
ctgcttgggttcaaat

SEQ ID NO: 90813 - DNA, 16 bp, H. sapiens
ctgcttggtgttctac

SEQ ID NO: 90814 - DNA, 16 bp, H. sapiens
ctgcttggtgttctct

SEQ ID NO: 90815 - DNA, 16 bp, H. sapiens
ctgcttgtacctctgg

SEQ ID NO: 90816 - DNA, 16 bp, H. sapiens
ctgcttgtctgttgtt

SEQ ID NO: 90817 - DNA, 16 bp, H. sapiens
ctgctttaaagatttt

SEQ ID NO: 90818 - DNA, 16 bp, H. sapiens
ctgctttattttcctc

SEQ ID NO: 90819 - DNA, 16 bp, H. sapiens
ctgctttcaaaattct

SEQ ID NO: 90820 - DNA, 16 bp, H. sapiens
ctgctttcatttttat

SEQ ID NO: 90821 - DNA, 16 bp, H. sapiens
ctgctttccactgtgg

SEQ ID NO: 90822 - DNA, 16 bp, H. sapiens
ctgctttcccttctgc

SEQ ID NO: 90823 - DNA, 16 bp, H. sapiens
ctgctttcctgctaca

SEQ ID NO: 90824 - DNA, 16 bp, H. sapiens
ctgctttcctggggca

SEQ ID NO: 90825 - DNA, 16 bp, H. sapiens
ctgctttccttctgga

SEQ ID NO: 90826 - DNA, 16 bp, H. sapiens
ctgctttctctctctg

SEQ ID NO: 90827 - DNA, 16 bp, H. sapiens
ctgctttctgtctctg

SEQ ID NO: 90828 - DNA, 16 bp, H. sapiens
ctgctttgattactgt

SEQ ID NO: 90829 - DNA, 16 bp, H. sapiens
ctgctttggaaaacat

SEQ ID NO: 90830 - DNA, 16 bp, H. sapiens
ctgctttggccagtgg

SEQ ID NO: 90831 - DNA, 16 bp, H. sapiens
ctgctttggcctctca

SEQ ID NO: 90832 - DNA, 16 bp, H. sapiens
ctgctttgtcacccag

SEQ ID NO: 90833 - DNA, 16 bp, H. sapiens
ctgctttgtgaagaag

SEQ ID NO: 90834 - DNA, 16 bp, H. sapiens
ctgctttgtgatgtgg

SEQ ID NO: 90835 - DNA, 16 bp, H. sapiens
ctgctttgttcactgc

SEQ ID NO: 90836 - DNA, 16 bp, H. sapiens
ctgctttgtttacctc

SEQ ID NO: 90837 - DNA, 16 bp, H. sapiens
ctgctttgtttacctt

SEQ ID NO: 90838 - DNA, 16 bp, H. sapiens
ctgcttttaaaataaa

SEQ ID NO: 90839 - DNA, 16 bp, H. sapiens
ctgcttttaaggtttt

SEQ ID NO: 90840 - DNA, 16 bp, H. sapiens
ctgcttttaagttttt

SEQ ID NO: 90841 - DNA, 16 bp, H. sapiens
ctgcttttaatatttt

SEQ ID NO: 90842 - DNA, 16 bp, H. sapiens
ctgcttttataaataa

SEQ ID NO: 90843 - DNA, 16 bp, H. sapiens
ctgcttttattattat

SEQ ID NO: 90844 - DNA, 16 bp, H. sapiens
ctgcttttcaactttt

SEQ ID NO: 90845 - DNA, 16 bp, H. sapiens
ctgcttttccaccagt

SEQ ID NO: 90846 - DNA, 16 bp, H. sapiens
ctgcttttctcaagca

SEQ ID NO: 90847 - DNA, 16 bp, H. sapiens
ctgctttttattctct

SEQ ID NO: 90848 - DNA, 16 bp, H. sapiens
ctgctttttgtctcta

SEQ ID NO: 90849 - DNA, 16 bp, H. sapiens
ctgcttttttccccca

SEQ ID NO: 90850 - DNA, 16 bp, H. sapiens
ctggaaaaaaaaatta

SEQ ID NO: 90851 - DNA, 16 bp, H. sapiens
ctggaaaaaaataatg

SEQ ID NO: 90852 - DNA, 16 bp, H. sapiens
ctggaaaaaatttaaa

SEQ ID NO: 90853 - DNA, 16 bp, H. sapiens
ctggaaaaagaaaaga

SEQ ID NO: 90854 - DNA, 16 bp, H. sapiens
ctggaaaaagcaagaa

SEQ ID NO: 90855 - DNA, 16 bp, H. sapiens
ctggaaaacaaagtga

SEQ ID NO: 90856 - DNA, 16 bp, H. sapiens
ctggaaaacagagaga

SEQ ID NO: 90857 - DNA, 16 bp, H. sapiens
ctggaaaacatagcaa

SEQ ID NO: 90858 - DNA, 16 bp, H. sapiens
ctggaaaagatccctt

SEQ ID NO: 90859 - DNA, 16 bp, H. sapiens
ctggaaaagcagcagg

SEQ ID NO: 90860 - DNA, 16 bp, H. sapiens
ctggaaaagcctcagg

SEQ ID NO: 90861 - DNA, 16 bp, H. sapiens
ctggaaaagctacaga

SEQ ID NO: 90862 - DNA, 16 bp, H. sapiens
ctggaaaagctgcagg

SEQ ID NO: 90863 - DNA, 16 bp, H. sapiens
ctggaaaaggaaaaac

SEQ ID NO: 90864 - DNA, 16 bp, H. sapiens
ctggaaaaggcaaact

SEQ ID NO: 90865 - DNA, 16 bp, H. sapiens
ctggaaaatcaggaca

SEQ ID NO: 90866 - DNA, 16 bp, H. sapiens
ctggaaaattccactg

SEQ ID NO: 90867 - DNA, 16 bp, H. sapiens
ctggaaaattctacca

SEQ ID NO: 90868 - DNA, 16 bp, H. sapiens
ctggaaacaacacaaa

SEQ ID NO: 90869 - DNA, 16 bp, H. sapiens
ctggaaacagactcag

SEQ ID NO: 90870 - DNA, 16 bp, H. sapiens
ctggaaaccaccattc

SEQ ID NO: 90871 - DNA, 17 bp, H. sapiens
ctggaaaccatcatcct

SEQ ID NO: 90872 - DNA, 24 bp, H. sapiens
ctggaaaccatcattcttagcaaa

SEQ ID NO: 90873 - DNA, 16 bp, H. sapiens
ctggaaacctctgtgg

SEQ ID NO: 90874 - DNA, 16 bp, H. sapiens
ctggaaactacaaaac

SEQ ID NO: 90875 - DNA, 16 bp, H. sapiens
ctggaaactctgctct

SEQ ID NO: 90876 - DNA, 16 bp, H. sapiens
ctggaaagaaaaagaa

SEQ ID NO: 90877 - DNA, 16 bp, H. sapiens
ctggaaagcagtggca

SEQ ID NO: 90878 - DNA, 16 bp, H. sapiens
ctggaaaggagatgga

SEQ ID NO: 90879 - DNA, 16 bp, H. sapiens
ctggaaaggaggctga

SEQ ID NO: 90880 - DNA, 16 bp, H. sapiens
ctggaaaggcgggaca

SEQ ID NO: 90881 - DNA, 16 bp, H. sapiens
ctggaaagggaaggag

SEQ ID NO: 90882 - DNA, 16 bp, H. sapiens
ctggaaagtggaggtt

SEQ ID NO: 90883 - DNA, 16 bp, H. sapiens
ctggaaataccctcac

SEQ ID NO: 90884 - DNA, 16 bp, H. sapiens
ctggaaatatttttaa

SEQ ID NO: 90885 - DNA, 16 bp, H. sapiens
ctggaaatgaaaaaaa

SEQ ID NO: 90886 - DNA, 16 bp, H. sapiens
ctggaaatgaaagaca

SEQ ID NO: 90887 - DNA, 16 bp, H. sapiens
ctggaaatgattttat

SEQ ID NO: 90888 - DNA, 16 bp, H. sapiens
ctggaaattcaggtaa

SEQ ID NO: 90889 - DNA, 16 bp, H. sapiens
ctggaaatttgtgctg

SEQ ID NO: 90890 - DNA, 16 bp, H. sapiens
ctggaacaagaaaagg

SEQ ID NO: 90891 - DNA, 16 bp, H. sapiens
ctggaacaaggcaaga

SEQ ID NO: 90892 - DNA, 16 bp, H. sapiens
ctggaacagaaaagag

SEQ ID NO: 90893 - DNA, 16 bp, H. sapiens
ctggaacagagcctgg

SEQ ID NO: 90894 - DNA, 16 bp, H. sapiens
ctggaacagcaccctg

SEQ ID NO: 90895 - DNA, 16 bp, H. sapiens
ctggaacaggacctca

SEQ ID NO: 90896 - DNA, 16 bp, H. sapiens
ctggaaccaatcctcc

SEQ ID NO: 90897 - DNA, 16 bp, H. sapiens
ctggaacccgggaggc

SEQ ID NO: 90898 - DNA, 16 bp, H. sapiens
ctggaacccgggaggt

SEQ ID NO: 90899 - DNA, 16 bp, H. sapiens
ctggaacctctgcctc

SEQ ID NO: 90900 - DNA, 16 bp, H. sapiens
ctggaacctgggaggc

SEQ ID NO: 90901 - DNA, 16 bp, H. sapiens
ctggaacgcctgacct

SEQ ID NO: 90902 - DNA, 16 bp, H. sapiens
ctggaactacaagcat

SEQ ID NO: 90903 - DNA, 16 bp, H. sapiens
ctggaactacaggaat

SEQ ID NO: 90904 - DNA, 16 bp, H. sapiens
ctggaactacaggcat

SEQ ID NO: 90905 - DNA, 16 bp, H. sapiens
ctggaactacagggat

SEQ ID NO: 90906 - DNA, 16 bp, H. sapiens
ctggaactacaggggt

SEQ ID NO: 90907 - DNA, 16 bp, H. sapiens
ctggaactacagtcat

SEQ ID NO: 90908 - DNA, 16 bp, H. sapiens
ctggaactcctggact

SEQ ID NO: 90909 - DNA, 16 bp, H. sapiens
ctggaactcctgggct

SEQ ID NO: 90910 - DNA, 16 bp, H. sapiens
ctggaactggagcagc

SEQ ID NO: 90911 - DNA, 16 bp, H. sapiens
ctggaacttctgggct

SEQ ID NO: 90912 - DNA, 16 bp, H. sapiens
ctggaagaaaacatgg

SEQ ID NO: 90913 - DNA, 16 bp, H. sapiens
ctggaagaaaggatat

SEQ ID NO: 90914 - DNA, 16 bp, H. sapiens
ctggaagaagaaagaa

SEQ ID NO: 90915 - DNA, 16 bp, H. sapiens
ctggaagaagaaattt

SEQ ID NO: 90916 - DNA, 16 bp, H. sapiens
ctggaagaagatattt

SEQ ID NO: 90917 - DNA, 16 bp, H. sapiens
ctggaagaagtggata

SEQ ID NO: 90918 - DNA, 16 bp, H. sapiens
ctggaagacaaagtga

SEQ ID NO: 90919 - DNA, 16 bp, H. sapiens
ctggaagaggcaaaga

SEQ ID NO: 90920 - DNA, 16 bp, H. sapiens
ctggaagaggcaggaa

SEQ ID NO: 90921 - DNA, 16 bp, H. sapiens
ctggaagaggtgtatg

SEQ ID NO: 90922 - DNA, 16 bp, H. sapiens
ctggaagcagagcctg

SEQ ID NO: 90923 - DNA, 16 bp, H. sapiens
ctggaagcagaggttg

SEQ ID NO: 90924 - DNA, 16 bp, H. sapiens
ctggaagcagatgctg

SEQ ID NO: 90925 - DNA, 16 bp, H. sapiens
ctggaagcattcccat

SEQ ID NO: 90926 - DNA, 33 bp, H. sapiens
ctggaagcattccctttgaaaactggcacaagg

SEQ ID NO: 90927 - DNA, 29 bp, H. sapiens
ctggaagcattccctttgaaaactggcat

SEQ ID NO: 90928 - DNA, 23 bp, H. sapiens
ctggaagcattccctttgaaaat

SEQ ID NO: 90929 - DNA, 16 bp, H. sapiens
ctggaagcattccttt

SEQ ID NO: 90930 - DNA, 16 bp, H. sapiens
ctggaagcattttttt

SEQ ID NO: 90931 - DNA, 16 bp, H. sapiens
ctggaagctatcatcc

SEQ ID NO: 90932 - DNA, 16 bp, H. sapiens
ctggaagctccacctc

SEQ ID NO: 90933 - DNA, 16 bp, H. sapiens
ctggaagctgagcaga

SEQ ID NO: 90934 - DNA, 16 bp, H. sapiens
ctggaagctgcagaga

SEQ ID NO: 90935 - DNA, 16 bp, H. sapiens
ctggaagctgggaaat

SEQ ID NO: 90936 - DNA, 16 bp, H. sapiens
ctggaagctgggaagt

SEQ ID NO: 90937 - DNA, 16 bp, H. sapiens
ctggaagcttcttccc

SEQ ID NO: 90938 - DNA, 16 bp, H. sapiens
ctggaagctttgtccc

SEQ ID NO: 90939 - DNA, 16 bp, H. sapiens
ctggaaggaaaagaaa

SEQ ID NO: 90940 - DNA, 16 bp, H. sapiens
ctggaaggaaatattt

SEQ ID NO: 90941 - DNA, 16 bp, H. sapiens
ctggaaggatctctct

SEQ ID NO: 90942 - DNA, 16 bp, H. sapiens
ctggaaggcagagctt

SEQ ID NO: 90943 - DNA, 16 bp, H. sapiens
ctggaaggcagtggcg

SEQ ID NO: 90944 - DNA, 16 bp, H. sapiens
ctggaaggccaaggca

SEQ ID NO: 90945 - DNA, 16 bp, H. sapiens
ctggaagggagggagg

SEQ ID NO: 90946 - DNA, 16 bp, H. sapiens
ctggaagggtgggaca

SEQ ID NO: 90947 - DNA, 16 bp, H. sapiens
ctggaaggtgcactgc

SEQ ID NO: 90948 - DNA, 16 bp, H. sapiens
ctggaaggtggagctt

SEQ ID NO: 90949 - DNA, 16 bp, H. sapiens
ctggaagtaaagcact

SEQ ID NO: 90950 - DNA, 16 bp, H. sapiens
ctggaagtgagagaga

SEQ ID NO: 90951 - DNA, 16 bp, H. sapiens
ctggaagttctggcca

SEQ ID NO: 90952 - DNA, 16 bp, H. sapiens
ctggaagttgctgtgg

SEQ ID NO: 90953 - DNA, 16 bp, H. sapiens
ctggaatacagtgatg

SEQ ID NO: 90954 - DNA, 16 bp, H. sapiens
ctggaatacagtggca

SEQ ID NO: 90955 - DNA, 16 bp, H. sapiens
ctggaatagcaggcat

SEQ ID NO: 90956 - DNA, 16 bp, H. sapiens
ctggaatatataagga

SEQ ID NO: 90957 - DNA, 16 bp, H. sapiens
ctggaatattttattt

SEQ ID NO: 90958 - DNA, 16 bp, H. sapiens
ctggaatcccagcacc

SEQ ID NO: 90959 - DNA, 16 bp, H. sapiens
ctggaatcccagccct

SEQ ID NO: 90960 - DNA, 16 bp, H. sapiens
ctggaatcccagctct

SEQ ID NO: 90961 - DNA, 16 bp, H. sapiens
ctggaatcctatctga

SEQ ID NO: 90962 - DNA, 16 bp, H. sapiens
ctggaatcctatttga

SEQ ID NO: 90963 - DNA, 16 bp, H. sapiens
ctggaatcctggcagc

SEQ ID NO: 90964 - DNA, 16 bp, H. sapiens
ctggaatcctggcagg

SEQ ID NO: 90965 - DNA, 16 bp, H. sapiens
ctggaatcctttgtga

SEQ ID NO: 90966 - DNA, 16 bp, H. sapiens
ctggaatgcaaggata

SEQ ID NO: 90967 - DNA, 16 bp, H. sapiens
ctggaatgcagtgatg

SEQ ID NO: 90968 - DNA, 16 bp, H. sapiens
ctggaatggctgagtt

SEQ ID NO: 90969 - DNA, 16 bp, H. sapiens
ctggaattacagacac

SEQ ID NO: 90970 - DNA, 16 bp, H. sapiens
ctggaattacaggcac

SEQ ID NO: 90971 - DNA, 24 bp, H. sapiens
ctggaattacaggtgtgagccacc

SEQ ID NO: 90972 - DNA, 16 bp, H. sapiens
ctggaattagaggcat

SEQ ID NO: 90973 - DNA, 16 bp, H. sapiens
ctggaattataggcat

SEQ ID NO: 90974 - DNA, 16 bp, H. sapiens
ctggaattcaatctgt

SEQ ID NO: 90975 - DNA, 16 bp, H. sapiens
ctggaatttcccttga

SEQ ID NO: 90976 - DNA, 16 bp, H. sapiens
ctggaatttttcattt

SEQ ID NO: 90977 - DNA, 16 bp, H. sapiens
ctggacaaaaacaagc

SEQ ID NO: 90978 - DNA, 16 bp, H. sapiens
ctggacaaaggaatga

SEQ ID NO: 90979 - DNA, 16 bp, H. sapiens
ctggacaacaaaagca

SEQ ID NO: 90980 - DNA, 21 bp, H. sapiens
ctggacaacatggtgaaacct

SEQ ID NO: 90981 - DNA, 16 bp, H. sapiens
ctggacaacatgttga

SEQ ID NO: 90982 - DNA, 16 bp, H. sapiens
ctggacaagatggtga

SEQ ID NO: 90983 - DNA, 16 bp, H. sapiens
ctggacaaggacctgg

SEQ ID NO: 90984 - DNA, 16 bp, H. sapiens
ctggacacaggacaag

SEQ ID NO: 90985 - DNA, 16 bp, H. sapiens
ctggacaccaaggctc

SEQ ID NO: 90986 - DNA, 16 bp, H. sapiens
ctggacactggacaag

SEQ ID NO: 90987 - DNA, 16 bp, H. sapiens
ctggacactggccttg

SEQ ID NO: 90988 - DNA, 16 bp, H. sapiens
ctggacagaggatgag

SEQ ID NO: 90989 - DNA, 16 bp, H. sapiens
ctggacagctgtcctc

SEQ ID NO: 90990 - DNA, 16 bp, H. sapiens
ctggacaggcacctgc

SEQ ID NO: 90991 - DNA, 16 bp, H. sapiens
ctggacatgatggcac

SEQ ID NO: 90992 - DNA, 16 bp, H. sapiens
ctggacatgatggctc

SEQ ID NO: 90993 - DNA, 16 bp, H. sapiens
ctggacatggtggctg

SEQ ID NO: 90994 - DNA, 16 bp, H. sapiens
ctggacattgccatgg

SEQ ID NO: 90995 - DNA, 16 bp, H. sapiens
ctggaccagattgagg

SEQ ID NO: 90996 - DNA, 16 bp, H. sapiens
ctggaccccagcctgg

SEQ ID NO: 90997 - DNA, 16 bp, H. sapiens
ctggaccccatcctta

SEQ ID NO: 90998 - DNA, 16 bp, H. sapiens
ctggacccccttcctt

SEQ ID NO: 90999 - DNA, 16 bp, H. sapiens
ctggacccctgggtct

SEQ ID NO: 91000 - DNA, 16 bp, H. sapiens
ctggacccctttcctg

SEQ ID NO: 91001 - DNA, 16 bp, H. sapiens
ctggacctgccctgga

SEQ ID NO: 91002 - DNA, 16 bp, H. sapiens
ctggacctgccctggg

SEQ ID NO: 91003 - DNA, 16 bp, H. sapiens
ctggacctgccttggg

SEQ ID NO: 91004 - DNA, 16 bp, H. sapiens
ctggacctgctgcaga

SEQ ID NO: 91005 - DNA, 16 bp, H. sapiens
ctggaccttcaggttc

SEQ ID NO: 91006 - DNA, 16 bp, H. sapiens
ctggacgacagagcca

SEQ ID NO: 91007 - DNA, 16 bp, H. sapiens
ctggacgcagtggctc

SEQ ID NO: 91008 - DNA, 16 bp, H. sapiens
ctggacgttgagagga

SEQ ID NO: 91009 - DNA, 16 bp, H. sapiens
ctggactcaaactcct

SEQ ID NO: 91010 - DNA, 16 bp, H. sapiens
ctggactcaagtgacc

SEQ ID NO: 91011 - DNA, 16 bp, H. sapiens
ctggactccagccagg

SEQ ID NO: 91012 - DNA, 16 bp, H. sapiens
ctggactccaggctgg

SEQ ID NO: 91013 - DNA, 16 bp, H. sapiens
ctggactccatcctgg

SEQ ID NO: 91014 - DNA, 16 bp, H. sapiens
ctggactcctgggtct

SEQ ID NO: 91015 - DNA, 16 bp, H. sapiens
ctggactgcagcctgg

SEQ ID NO: 91016 - DNA, 16 bp, H. sapiens
ctggactgtgctgctg

SEQ ID NO: 91017 - DNA, 16 bp, H. sapiens
ctggacttcccaggct

SEQ ID NO: 91018 - DNA, 16 bp, H. sapiens
ctggacttcctgggtc

SEQ ID NO: 91019 - DNA, 16 bp, H. sapiens
ctggacttcctgggtt

SEQ ID NO: 91020 - DNA, 16 bp, H. sapiens
ctggacttctcagcct

SEQ ID NO: 91021 - DNA, 16 bp, H. sapiens
ctggactttattgtcc

SEQ ID NO: 91022 - DNA, 16 bp, H. sapiens
ctggagaaaacccatg

SEQ ID NO: 91023 - DNA, 16 bp, H. sapiens
ctggagaaacaaagat

SEQ ID NO: 91024 - DNA, 16 bp, H. sapiens
ctggagaaacaagaac

SEQ ID NO: 91025 - DNA, 16 bp, H. sapiens
ctggagaaacagaaat

SEQ ID NO: 91026 - DNA, 16 bp, H. sapiens
ctggagaaacagaacc

SEQ ID NO: 91027 - DNA, 16 bp, H. sapiens
ctggagaaagaggctg

SEQ ID NO: 91028 - DNA, 16 bp, H. sapiens
ctggagaaagatgtag

SEQ ID NO: 91029 - DNA, 16 bp, H. sapiens
ctggagaaataggaat

SEQ ID NO: 91030 - DNA, 16 bp, H. sapiens
ctggagaaccctgacc

SEQ ID NO: 91031 - DNA, 16 bp, H. sapiens
ctggagaaccctgact

SEQ ID NO: 91032 - DNA, 16 bp, H. sapiens
ctggagaacttcccca

SEQ ID NO: 91033 - DNA, 16 bp, H. sapiens
ctggagaactttgccc

SEQ ID NO: 91034 - DNA, 16 bp, H. sapiens
ctggagaagagaaaaa

SEQ ID NO: 91035 - DNA, 16 bp, H. sapiens
ctggagaagctgggat

SEQ ID NO: 91036 - DNA, 16 bp, H. sapiens
ctggagaagctgtctg

SEQ ID NO: 91037 - DNA, 16 bp, H. sapiens
ctggagaaggaggaag

SEQ ID NO: 91038 - DNA, 16 bp, H. sapiens
ctggagaaggcaagga

SEQ ID NO: 91039 - DNA, 16 bp, H. sapiens
ctggagaatcaggaaa

SEQ ID NO: 91040 - DNA, 16 bp, H. sapiens
ctggagaatcctgact

SEQ ID NO: 91041 - DNA, 16 bp, H. sapiens
ctggagaatttcccca

SEQ ID NO: 91042 - DNA, 16 bp, H. sapiens
ctggagacagagcgag

SEQ ID NO: 91043 - DNA, 16 bp, H. sapiens
ctggagacattttcca

SEQ ID NO: 91044 - DNA, 16 bp, H. sapiens
ctggagacattttcct

SEQ ID NO: 91045 - DNA, 16 bp, H. sapiens
ctggagaccagcccgg

SEQ ID NO: 91046 - DNA, 16 bp, H. sapiens
ctggagaccataatcc

SEQ ID NO: 91047 - DNA, 16 bp, H. sapiens
ctggagacccaagaga

SEQ ID NO: 91048 - DNA, 16 bp, H. sapiens
ctggagacccaggaaa

SEQ ID NO: 91049 - DNA, 16 bp, H. sapiens
ctggagacccaggaag

SEQ ID NO: 91050 - DNA, 16 bp, H. sapiens
ctggagactcagggaa

SEQ ID NO: 91051 - DNA, 16 bp, H. sapiens
ctggagactggaagtc

SEQ ID NO: 91052 - DNA, 16 bp, H. sapiens
ctggagagaaagagag

SEQ ID NO: 91053 - DNA, 16 bp, H. sapiens
ctggagagaagaaaga

SEQ ID NO: 91054 - DNA, 16 bp, H. sapiens
ctggagagaagcagag

SEQ ID NO: 91055 - DNA, 16 bp, H. sapiens
ctggagagaaggaaaa

SEQ ID NO: 91056 - DNA, 16 bp, H. sapiens
ctggagagcagtggag

SEQ ID NO: 91057 - DNA, 16 bp, H. sapiens
ctggagaggaggaggg

SEQ ID NO: 91058 - DNA, 16 bp, H. sapiens
ctggagaggatatgga

SEQ ID NO: 91059 - DNA, 16 bp, H. sapiens
ctggagaggatttgga

SEQ ID NO: 91060 - DNA, 16 bp, H. sapiens
ctggagaggctgagat

SEQ ID NO: 91061 - DNA, 16 bp, H. sapiens
ctggagagggagaggg

SEQ ID NO: 91062 - DNA, 16 bp, H. sapiens
ctggagagggaggagg

SEQ ID NO: 91063 - DNA, 16 bp, H. sapiens
ctggagaggggctggg

SEQ ID NO: 91064 - DNA, 16 bp, H. sapiens
ctggagaggtaggcag

SEQ ID NO: 91065 - DNA, 16 bp, H. sapiens
ctggagaggttgaggc

SEQ ID NO: 91066 - DNA, 16 bp, H. sapiens
ctggagagtatgtgga

SEQ ID NO: 91067 - DNA, 16 bp, H. sapiens
ctggagagtgcagtgg

SEQ ID NO: 91068 - DNA, 16 bp, H. sapiens
ctggagatccaggaaa

SEQ ID NO: 91069 - DNA, 16 bp, H. sapiens
ctggagatccaggaga

SEQ ID NO: 91070 - DNA, 16 bp, H. sapiens
ctggagatgaaattct

SEQ ID NO: 91071 - DNA, 16 bp, H. sapiens
ctggagatgatgtgga

SEQ ID NO: 91072 - DNA, 16 bp, H. sapiens
ctggagatggacagtg

SEQ ID NO: 91073 - DNA, 16 bp, H. sapiens
ctggagatggatgatg

SEQ ID NO: 91074 - DNA, 16 bp, H. sapiens
ctggagatttgtggaa

SEQ ID NO: 91075 - DNA, 16 bp, H. sapiens
ctggagcaagacaagg

SEQ ID NO: 91076 - DNA, 16 bp, H. sapiens
ctggagcaagagagag

SEQ ID NO: 91077 - DNA, 16 bp, H. sapiens
ctggagcacaatggca

SEQ ID NO: 91078 - DNA, 16 bp, H. sapiens
ctggagcagcagcagc

SEQ ID NO: 91079 - DNA, 16 bp, H. sapiens
ctggagcagctcacag

SEQ ID NO: 91080 - DNA, 16 bp, H. sapiens
ctggagcagctgctgc

SEQ ID NO: 91081 - DNA, 16 bp, H. sapiens
ctggagcaggaagaag

SEQ ID NO: 91082 - DNA, 16 bp, H. sapiens
ctggagcaggaggaag

SEQ ID NO: 91083 - DNA, 16 bp, H. sapiens
ctggagcagggtgggc

SEQ ID NO: 91084 - DNA, 16 bp, H. sapiens
ctggagcatttcagat

SEQ ID NO: 91085 - DNA, 16 bp, H. sapiens
ctggagccaccaggag

SEQ ID NO: 91086 - DNA, 16 bp, H. sapiens
ctggagccaggctggg

SEQ ID NO: 91087 - DNA, 16 bp, H. sapiens
ctggagccagggccag

SEQ ID NO: 91088 - DNA, 16 bp, H. sapiens
ctggagcccaggaggc

SEQ ID NO: 91089 - DNA, 16 bp, H. sapiens
ctggagcccaggaggt

SEQ ID NO: 91090 - DNA, 16 bp, H. sapiens
ctggagcccaggagtt

SEQ ID NO: 91091 - DNA, 16 bp, H. sapiens
ctggagcccagtggca

SEQ ID NO: 91092 - DNA, 16 bp, H. sapiens
ctggagccccagggcc

SEQ ID NO: 91093 - DNA, 16 bp, H. sapiens
ctggagcccccacaca

SEQ ID NO: 91094 - DNA, 16 bp, H. sapiens
ctggagcccgggaggc

SEQ ID NO: 91095 - DNA, 16 bp, H. sapiens
ctggagccgtggcaga

SEQ ID NO: 91096 - DNA, 16 bp, H. sapiens
ctggagcctaggagtt

SEQ ID NO: 91097 - DNA, 16 bp, H. sapiens
ctggagcctcagtaaa

SEQ ID NO: 91098 - DNA, 16 bp, H. sapiens
ctggagcctgaggcag

SEQ ID NO: 91099 - DNA, 16 bp, H. sapiens
ctggagcctgggaagt

SEQ ID NO: 91100 - DNA, 16 bp, H. sapiens
ctggagcctggggctg

SEQ ID NO: 91101 - DNA, 16 bp, H. sapiens
ctggagcctgggtgac

SEQ ID NO: 91102 - DNA, 16 bp, H. sapiens
ctggagccttcagagg

SEQ ID NO: 91103 - DNA, 16 bp, H. sapiens
ctggagctcaggagag

SEQ ID NO: 91104 - DNA, 16 bp, H. sapiens
ctggagctcaggagtt

SEQ ID NO: 91105 - DNA, 16 bp, H. sapiens
ctggagctccagcagc

SEQ ID NO: 91106 - DNA, 16 bp, H. sapiens
ctggagctgcctgccc

SEQ ID NO: 91107 - DNA, 16 bp, H. sapiens
ctggagctgctgcagc

SEQ ID NO: 91108 - DNA, 16 bp, H. sapiens
ctggagctgctgcctt

SEQ ID NO: 91109 - DNA, 16 bp, H. sapiens
ctggagctgctgggac

SEQ ID NO: 91110 - DNA, 16 bp, H. sapiens
ctggagctggagcagc

SEQ ID NO: 91111 - DNA, 16 bp, H. sapiens
ctggagctggagcagt

SEQ ID NO: 91112 - DNA, 16 bp, H. sapiens
ctggagctggaggagg

SEQ ID NO: 91113 - DNA, 16 bp, H. sapiens
ctggagctggaggtgg

SEQ ID NO: 91114 - DNA, 16 bp, H. sapiens
ctggagctggagtggc

SEQ ID NO: 91115 - DNA, 16 bp, H. sapiens
ctggagctgggagagg

SEQ ID NO: 91116 - DNA, 16 bp, H. sapiens
ctggagctgggagtgg

SEQ ID NO: 91117 - DNA, 16 bp, H. sapiens
ctggagctgggatttg

SEQ ID NO: 91118 - DNA, 16 bp, H. sapiens
ctggagctggggctgg

SEQ ID NO: 91119 - DNA, 16 bp, H. sapiens
ctggagctgggggagg

SEQ ID NO: 91120 - DNA, 16 bp, H. sapiens
ctggagctgggggtgg

SEQ ID NO: 91121 - DNA, 16 bp, H. sapiens
ctggagctgttccttt

SEQ ID NO: 91122 - DNA, 17 bp, H. sapiens
ctggagcttagctggct

SEQ ID NO: 91123 - DNA, 16 bp, H. sapiens
ctggaggaaaaaaaaa

SEQ ID NO: 91124 - DNA, 16 bp, H. sapiens
ctggaggaaaaacaaa

SEQ ID NO: 91125 - DNA, 16 bp, H. sapiens
ctggaggaaaagaaaa

SEQ ID NO: 91126 - DNA, 16 bp, H. sapiens
ctggaggaaaggtgat

SEQ ID NO: 91127 - DNA, 16 bp, H. sapiens
ctggaggaacccctgg

SEQ ID NO: 91128 - DNA, 16 bp, H. sapiens
ctggaggaaggagcag

SEQ ID NO: 91129 - DNA, 16 bp, H. sapiens
ctggaggaaggtggcc

SEQ ID NO: 91130 - DNA, 16 bp, H. sapiens
ctggaggacagtggcc

SEQ ID NO: 91131 - DNA, 16 bp, H. sapiens
ctggaggacagtggtg

SEQ ID NO: 91132 - DNA, 16 bp, H. sapiens
ctggaggacatcatgt

SEQ ID NO: 91133 - DNA, 16 bp, H. sapiens
ctggaggacattgtgt

SEQ ID NO: 91134 - DNA, 16 bp, H. sapiens
ctggaggacgaggagg

SEQ ID NO: 91135 - DNA, 16 bp, H. sapiens
ctggaggacggtggcc

SEQ ID NO: 91136 - DNA, 16 bp, H. sapiens
ctggaggagatagaga

SEQ ID NO: 91137 - DNA, 16 bp, H. sapiens
ctggaggagcagctgg

SEQ ID NO: 91138 - DNA, 16 bp, H. sapiens
ctggaggagcccttca

SEQ ID NO: 91139 - DNA, 16 bp, H. sapiens
ctggaggaggagcagg

SEQ ID NO: 91140 - DNA, 16 bp, H. sapiens
ctggaggaggaggaag

SEQ ID NO: 91141 - DNA, 16 bp, H. sapiens
ctggaggaggaggagg

SEQ ID NO: 91142 - DNA, 16 bp, H. sapiens
ctggaggaggaggtgg

SEQ ID NO: 91143 - DNA, 16 bp, H. sapiens
ctggaggagggcaggg

SEQ ID NO: 91144 - DNA, 16 bp, H. sapiens
ctggaggaggggaagg

SEQ ID NO: 91145 - DNA, 16 bp, H. sapiens
ctggaggaggtggcag

SEQ ID NO: 91146 - DNA, 16 bp, H. sapiens
ctggaggatgagcaga

SEQ ID NO: 91147 - DNA, 16 bp, H. sapiens
ctggaggatgaggcag

SEQ ID NO: 91148 - DNA, 16 bp, H. sapiens
ctggaggatggtgacc

SEQ ID NO: 91149 - DNA, 16 bp, H. sapiens
ctggaggcagagacca

SEQ ID NO: 91150 - DNA, 16 bp, H. sapiens
ctggaggcagagaggg

SEQ ID NO: 91151 - DNA, 16 bp, H. sapiens
ctggaggcagaggctg

SEQ ID NO: 91152 - DNA, 16 bp, H. sapiens
ctggaggcagatgttg

SEQ ID NO: 91153 - DNA, 16 bp, H. sapiens
ctggaggcagggagac

SEQ ID NO: 91154 - DNA, 16 bp, H. sapiens
ctggaggcagggcata

SEQ ID NO: 91155 - DNA, 16 bp, H. sapiens
ctggaggcatcgcact

SEQ ID NO: 91156 - DNA, 16 bp, H. sapiens
ctggaggcatcttgct

SEQ ID NO: 91157 - DNA, 16 bp, H. sapiens
ctggaggccaaggagc

SEQ ID NO: 91158 - DNA, 16 bp, H. sapiens
ctggaggccaaggagg

SEQ ID NO: 91159 - DNA, 16 bp, H. sapiens
ctggaggccagcctgg

SEQ ID NO: 91160 - DNA, 16 bp, H. sapiens
ctggaggccaggagtt

SEQ ID NO: 91161 - DNA, 16 bp, H. sapiens
ctggaggcccagctgt

SEQ ID NO: 91162 - DNA, 16 bp, H. sapiens
ctggaggcccaggagg

SEQ ID NO: 91163 - DNA, 16 bp, H. sapiens
ctggaggcctcacact

SEQ ID NO: 91164 - DNA, 16 bp, H. sapiens
ctggaggcctcatgct

SEQ ID NO: 91165 - DNA, 16 bp, H. sapiens
ctggaggcctccccag

SEQ ID NO: 91166 - DNA, 16 bp, H. sapiens
ctggaggcggagcttg

SEQ ID NO: 91167 - DNA, 16 bp, H. sapiens
ctggaggcggaggcag

SEQ ID NO: 91168 - DNA, 16 bp, H. sapiens
ctggaggctaaggtgg

SEQ ID NO: 91169 - DNA, 16 bp, H. sapiens
ctggaggctcagagag

SEQ ID NO: 91170 - DNA, 16 bp, H. sapiens
ctggaggctcaggcag

SEQ ID NO: 91171 - DNA, 16 bp, H. sapiens
ctggaggctctgagag

SEQ ID NO: 91172 - DNA, 16 bp, H. sapiens
ctggaggctctgagga

SEQ ID NO: 91173 - DNA, 16 bp, H. sapiens
ctggaggctgacacag

SEQ ID NO: 91174 - DNA, 16 bp, H. sapiens
ctggaggctgacgcag

SEQ ID NO: 91175 - DNA, 16 bp, H. sapiens
ctggaggctgagctgg

SEQ ID NO: 91176 - DNA, 16 bp, H. sapiens
ctggaggctgaggagt

SEQ ID NO: 91177 - DNA, 16 bp, H. sapiens
ctggaggctgaggcac

SEQ ID NO: 91178 - DNA, 16 bp, H. sapiens
ctggaggctgaggcag

SEQ ID NO: 91179 - DNA, 16 bp, H. sapiens
ctggaggctgaggctg

SEQ ID NO: 91180 - DNA, 16 bp, H. sapiens
ctggaggctgaggtgg

SEQ ID NO: 91181 - DNA, 16 bp, H. sapiens
ctggaggctgagtgtg

SEQ ID NO: 91182 - DNA, 16 bp, H. sapiens
ctggaggctgcagtga

SEQ ID NO: 91183 - DNA, 16 bp, H. sapiens
ctggaggctggaaggt

SEQ ID NO: 91184 - DNA, 16 bp, H. sapiens
ctggaggctgggaaag

SEQ ID NO: 91185 - DNA, 16 bp, H. sapiens
ctggaggctgggaggc

SEQ ID NO: 91186 - DNA, 16 bp, H. sapiens
ctggaggctggggcag

SEQ ID NO: 91187 - DNA, 16 bp, H. sapiens
ctggaggcttcatcta

SEQ ID NO: 91188 - DNA, 16 bp, H. sapiens
ctggagggagcatggc

SEQ ID NO: 91189 - DNA, 16 bp, H. sapiens
ctggagggcaggggca

SEQ ID NO: 91190 - DNA, 16 bp, H. sapiens
ctggagggcagtggcc

SEQ ID NO: 91191 - DNA, 17 bp, H. sapiens
ctggagggcagtggcgc

SEQ ID NO: 91192 - DNA, 16 bp, H. sapiens
ctggagggcagtggtg

SEQ ID NO: 91193 - DNA, 16 bp, H. sapiens
ctggagggcagtgtct

SEQ ID NO: 91194 - DNA, 16 bp, H. sapiens
ctggaggggatgtgga

SEQ ID NO: 91195 - DNA, 16 bp, H. sapiens
ctggaggggcctcagg

SEQ ID NO: 91196 - DNA, 16 bp, H. sapiens
ctggagggggaggttg

SEQ ID NO: 91197 - DNA, 16 bp, H. sapiens
ctggagggggccaagg

SEQ ID NO: 91198 - DNA, 16 bp, H. sapiens
ctggagggggctgagg

SEQ ID NO: 91199 - DNA, 16 bp, H. sapiens
ctggagggtggtggcc

SEQ ID NO: 91200 - DNA, 16 bp, H. sapiens
ctggagggtttttttt

SEQ ID NO: 91201 - DNA, 16 bp, H. sapiens
ctggaggtcacaagat

SEQ ID NO: 91202 - DNA, 16 bp, H. sapiens
ctggaggtcaggagtc

SEQ ID NO: 91203 - DNA, 16 bp, H. sapiens
ctggaggtcaggagtt

SEQ ID NO: 91204 - DNA, 16 bp, H. sapiens
ctggaggtgaggcctg

SEQ ID NO: 91205 - DNA, 16 bp, H. sapiens
ctggaggtggagcttg

SEQ ID NO: 91206 - DNA, 16 bp, H. sapiens
ctggaggtggaggcag

SEQ ID NO: 91207 - DNA, 16 bp, H. sapiens
ctggaggtggaggctg

SEQ ID NO: 91208 - DNA, 16 bp, H. sapiens
ctggaggtgggagtgg

SEQ ID NO: 91209 - DNA, 16 bp, H. sapiens
ctggaggtggggaagt

SEQ ID NO: 91210 - DNA, 16 bp, H. sapiens
ctggaggtggggctgg

SEQ ID NO: 91211 - DNA, 16 bp, H. sapiens
ctggaggtgggggctg

SEQ ID NO: 91212 - DNA, 16 bp, H. sapiens
ctggaggtggtggctc

SEQ ID NO: 91213 - DNA, 16 bp, H. sapiens
ctggaggtggtggtgg

SEQ ID NO: 91214 - DNA, 16 bp, H. sapiens
ctggaggttcctggag

SEQ ID NO: 91215 - DNA, 16 bp, H. sapiens
ctggaggttggaagtc

SEQ ID NO: 91216 - DNA, 16 bp, H. sapiens
ctggaggtttcttgca

SEQ ID NO: 91217 - DNA, 16 bp, H. sapiens
ctggagtacaatgtca

SEQ ID NO: 91218 - DNA, 20 bp, H. sapiens
ctggagtacagtggcgcgat

SEQ ID NO: 91219 - DNA, 16 bp, H. sapiens
ctggagtacagtggct

SEQ ID NO: 91220 - DNA, 16 bp, H. sapiens
ctggagtcaaaggaga

SEQ ID NO: 91221 - DNA, 16 bp, H. sapiens
ctggagtcaagtgatc

SEQ ID NO: 91222 - DNA, 16 bp, H. sapiens
ctggagtcagaggttg

SEQ ID NO: 91223 - DNA, 16 bp, H. sapiens
ctggagtcagggctgg

SEQ ID NO: 91224 - DNA, 16 bp, H. sapiens
ctggagtccaggagtt

SEQ ID NO: 91225 - DNA, 16 bp, H. sapiens
ctggagtcccagctgc

SEQ ID NO: 91226 - DNA, 16 bp, H. sapiens
ctggagtcctttaaaa

SEQ ID NO: 91227 - DNA, 16 bp, H. sapiens
ctggagtctgagaagt

SEQ ID NO: 91228 - DNA, 16 bp, H. sapiens
ctggagtctgggaagt

SEQ ID NO: 91229 - DNA, 20 bp, H. sapiens
ctggagtgcaatggtgtgat

SEQ ID NO: 91230 - DNA, 16 bp, H. sapiens
ctggagtgcactggca

SEQ ID NO: 91231 - DNA, 16 bp, H. sapiens
ctggagtgcagcctca

SEQ ID NO: 91232 - DNA, 16 bp, H. sapiens
ctggagtgcaggctgg

SEQ ID NO: 91233 - DNA, 16 bp, H. sapiens
ctggagtgcagtgctg

SEQ ID NO: 91234 - DNA, 18 bp, H. sapiens
ctggagtgcagtggcaga

SEQ ID NO: 91235 - DNA, 16 bp, H. sapiens
ctggagtgcagtgtgc

SEQ ID NO: 91236 - DNA, 16 bp, H. sapiens
ctggagtgcatggagt

SEQ ID NO: 91237 - DNA, 16 bp, H. sapiens
ctggagtgcggcggcg

SEQ ID NO: 91238 - DNA, 16 bp, H. sapiens
ctggagtgcggtgatg

SEQ ID NO: 91239 - DNA, 16 bp, H. sapiens
ctggagtgctgtgctg

SEQ ID NO: 91240 - DNA, 16 bp, H. sapiens
ctggagtgctgtggca

SEQ ID NO: 91241 - DNA, 16 bp, H. sapiens
ctggagtggaccccca

SEQ ID NO: 91242 - DNA, 16 bp, H. sapiens
ctggagtggagggagg

SEQ ID NO: 91243 - DNA, 16 bp, H. sapiens
ctggagtggccagctt

SEQ ID NO: 91244 - DNA, 16 bp, H. sapiens
ctggagtggctgaagc

SEQ ID NO: 91245 - DNA, 16 bp, H. sapiens
ctggagtgtaggggtg

SEQ ID NO: 91246 - DNA, 19 bp, H. sapiens
ctggagtgtagtggcgcca

SEQ ID NO: 91247 - DNA, 16 bp, H. sapiens
ctggagtgtatcctga

SEQ ID NO: 91248 - DNA, 16 bp, H. sapiens
ctggagttcaggagtt

SEQ ID NO: 91249 - DNA, 16 bp, H. sapiens
ctggagttcagggaag

SEQ ID NO: 91250 - DNA, 16 bp, H. sapiens
ctggagttcagtgatg

SEQ ID NO: 91251 - DNA, 16 bp, H. sapiens
ctggagttcagtggcg

SEQ ID NO: 91252 - DNA, 16 bp, H. sapiens
ctggagttccaggcac

SEQ ID NO: 91253 - DNA, 16 bp, H. sapiens
ctggagttcttgcatt

SEQ ID NO: 91254 - DNA, 16 bp, H. sapiens
ctggagttggaggctg

SEQ ID NO: 91255 - DNA, 16 bp, H. sapiens
ctggataaagagaatg

SEQ ID NO: 91256 - DNA, 16 bp, H. sapiens
ctggataaagagccaa

SEQ ID NO: 91257 - DNA, 16 bp, H. sapiens
ctggataacttactgc

SEQ ID NO: 91258 - DNA, 16 bp, H. sapiens
ctggataatgttccat

SEQ ID NO: 91259 - DNA, 16 bp, H. sapiens
ctggataatttcaaat

SEQ ID NO: 91260 - DNA, 16 bp, H. sapiens
ctggataatttctgta

SEQ ID NO: 91261 - DNA, 16 bp, H. sapiens
ctggatagacatttct

SEQ ID NO: 91262 - DNA, 16 bp, H. sapiens
ctggatatatattcaa

SEQ ID NO: 91263 - DNA, 16 bp, H. sapiens
ctggatatcaccagca

SEQ ID NO: 91264 - DNA, 16 bp, H. sapiens
ctggatatccaggcat

SEQ ID NO: 91265 - DNA, 16 bp, H. sapiens
ctggatatgaaatttt

SEQ ID NO: 91266 - DNA, 16 bp, H. sapiens
ctggatatgtctgtga

SEQ ID NO: 91267 - DNA, 16 bp, H. sapiens
ctggatattaaacttt

SEQ ID NO: 91268 - DNA, 16 bp, H. sapiens
ctggatattaactctt

SEQ ID NO: 91269 - DNA, 16 bp, H. sapiens
ctggatcaaagggtat

SEQ ID NO: 91270 - DNA, 16 bp, H. sapiens
ctggatcaggaaaaga

SEQ ID NO: 91271 - DNA, 16 bp, H. sapiens
ctggatcatattgtag

SEQ ID NO: 91272 - DNA, 16 bp, H. sapiens
ctggatcatccaggtg

SEQ ID NO: 91273 - DNA, 16 bp, H. sapiens
ctggatccagacccct

SEQ ID NO: 91274 - DNA, 16 bp, H. sapiens
ctggatccctatctct

SEQ ID NO: 91275 - DNA, 16 bp, H. sapiens
ctggatcccttccttc

SEQ ID NO: 91276 - DNA, 16 bp, H. sapiens
ctggatctcattcttt

SEQ ID NO: 91277 - DNA, 16 bp, H. sapiens
ctggatgacacagtga

SEQ ID NO: 91278 - DNA, 16 bp, H. sapiens
ctggatgacagagacc

SEQ ID NO: 91279 - DNA, 16 bp, H. sapiens
ctggatgacagcaaga

SEQ ID NO: 91280 - DNA, 16 bp, H. sapiens
ctggatgaggtggctc

SEQ ID NO: 91281 - DNA, 16 bp, H. sapiens
ctggatgatatggtaa

SEQ ID NO: 91282 - DNA, 16 bp, H. sapiens
ctggatgcagtggctt

SEQ ID NO: 91283 - DNA, 16 bp, H. sapiens
ctggatgcttcctgcc

SEQ ID NO: 91284 - DNA, 16 bp, H. sapiens
ctggatgcttcttgcc

SEQ ID NO: 91285 - DNA, 16 bp, H. sapiens
ctggatggagctggag

SEQ ID NO: 91286 - DNA, 16 bp, H. sapiens
ctggatggagtgcagt

SEQ ID NO: 91287 - DNA, 16 bp, H. sapiens
ctggatggcaaggaag

SEQ ID NO: 91288 - DNA, 16 bp, H. sapiens
ctggatgtgaggcatg

SEQ ID NO: 91289 - DNA, 16 bp, H. sapiens
ctggatgtgatggcac

SEQ ID NO: 91290 - DNA, 16 bp, H. sapiens
ctggatgtggtggctg

SEQ ID NO: 91291 - DNA, 16 bp, H. sapiens
ctggatgttgctgtga

SEQ ID NO: 91292 - DNA, 16 bp, H. sapiens
ctggattacaagcatg

SEQ ID NO: 91293 - DNA, 16 bp, H. sapiens
ctggattacctgggtg

SEQ ID NO: 91294 - DNA, 16 bp, H. sapiens
ctggattatctgggtg

SEQ ID NO: 91295 - DNA, 16 bp, H. sapiens
ctggattcaaatccca

SEQ ID NO: 91296 - DNA, 16 bp, H. sapiens
ctggattcaaatctca

SEQ ID NO: 91297 - DNA, 16 bp, H. sapiens
ctggattcaagcaatc

SEQ ID NO: 91298 - DNA, 16 bp, H. sapiens
ctggattcagcagttt

SEQ ID NO: 91299 - DNA, 16 bp, H. sapiens
ctggattcagtttgtc

SEQ ID NO: 91300 - DNA, 16 bp, H. sapiens
ctggattcatggattt

SEQ ID NO: 91301 - DNA, 16 bp, H. sapiens
ctggattcattggttt

SEQ ID NO: 91302 - DNA, 16 bp, H. sapiens
ctggattccagcctgg

SEQ ID NO: 91303 - DNA, 16 bp, H. sapiens
ctggattccatttatt

SEQ ID NO: 91304 - DNA, 16 bp, H. sapiens
ctggattctatccaag

SEQ ID NO: 91305 - DNA, 16 bp, H. sapiens
ctggattgatcccttt

SEQ ID NO: 91306 - DNA, 16 bp, H. sapiens
ctggatttggagtcag

SEQ ID NO: 91307 - DNA, 16 bp, H. sapiens
ctggatttgtctgatt

SEQ ID NO: 91308 - DNA, 16 bp, H. sapiens
ctggattttattttta

SEQ ID NO: 91309 - DNA, 16 bp, H. sapiens
ctggattttccaggtg

SEQ ID NO: 91310 - DNA, 16 bp, H. sapiens
ctggattttggaattg

SEQ ID NO: 91311 - DNA, 16 bp, H. sapiens
ctggattttgtttgcc

SEQ ID NO: 91312 - DNA, 16 bp, H. sapiens
ctggatttttatattt

SEQ ID NO: 91313 - DNA, 16 bp, H. sapiens
ctggcaaaaacaagaa

SEQ ID NO: 91314 - DNA, 16 bp, H. sapiens
ctggcaaactgaaccc

SEQ ID NO: 91315 - DNA, 16 bp, H. sapiens
ctggcaaagatggtga

SEQ ID NO: 91316 - DNA, 16 bp, H. sapiens
ctggcaaagctgcaga

SEQ ID NO: 91317 - DNA, 16 bp, H. sapiens
ctggcaaattctacca

SEQ ID NO: 91318 - DNA, 24 bp, H. sapiens
ctggcaaattggataaacagtcaa

SEQ ID NO: 91319 - DNA, 16 bp, H. sapiens
ctggcaacaacaacaa

SEQ ID NO: 91320 - DNA, 16 bp, H. sapiens
ctggcaaccaccattg

SEQ ID NO: 91321 - DNA, 16 bp, H. sapiens
ctggcaaggctgcaga

SEQ ID NO: 91322 - DNA, 16 bp, H. sapiens
ctggcaagttggtgct

SEQ ID NO: 91323 - DNA, 16 bp, H. sapiens
ctggcaagtttttgta

SEQ ID NO: 91324 - DNA, 21 bp, H. sapiens
ctggcacaagacagggatgtc

SEQ ID NO: 91325 - DNA, 16 bp, H. sapiens
ctggcacacagtaagt

SEQ ID NO: 91326 - DNA, 16 bp, H. sapiens
ctggcacagagtagat

SEQ ID NO: 91327 - DNA, 16 bp, H. sapiens
ctggcacagtgcccag

SEQ ID NO: 91328 - DNA, 16 bp, H. sapiens
ctggcacagtgcctgg

SEQ ID NO: 91329 - DNA, 16 bp, H. sapiens
ctggcacagtggctca

SEQ ID NO: 91330 - DNA, 16 bp, H. sapiens
ctggcacatagtaatt

SEQ ID NO: 91331 - DNA, 16 bp, H. sapiens
ctggcacccagagaaa

SEQ ID NO: 91332 - DNA, 16 bp, H. sapiens
ctggcacctggagctg

SEQ ID NO: 91333 - DNA, 16 bp, H. sapiens
ctggcacgcaccacca

SEQ ID NO: 91334 - DNA, 16 bp, H. sapiens
ctggcactgagtgcct

SEQ ID NO: 91335 - DNA, 16 bp, H. sapiens
ctggcactgtgctggg

SEQ ID NO: 91336 - DNA, 16 bp, H. sapiens
ctggcacttagtaggt

SEQ ID NO: 91337 - DNA, 16 bp, H. sapiens
ctggcagaacccccac

SEQ ID NO: 91338 - DNA, 16 bp, H. sapiens
ctggcagaagaaattc

SEQ ID NO: 91339 - DNA, 16 bp, H. sapiens
ctggcagacaaggtga

SEQ ID NO: 91340 - DNA, 16 bp, H. sapiens
ctggcagagggcagag

SEQ ID NO: 91341 - DNA, 16 bp, H. sapiens
ctggcagatctggtgt

SEQ ID NO: 91342 - DNA, 16 bp, H. sapiens
ctggcagatttgatgt

SEQ ID NO: 91343 - DNA, 18 bp, H. sapiens
ctggcagcaaccccaaca

SEQ ID NO: 91344 - DNA, 16 bp, H. sapiens
ctggcagcagaccacc

SEQ ID NO: 91345 - DNA, 16 bp, H. sapiens
ctggcagcagagcaag

SEQ ID NO: 91346 - DNA, 16 bp, H. sapiens
ctggcagcagaggtgg

SEQ ID NO: 91347 - DNA, 16 bp, H. sapiens
ctggcagcagagtgag

SEQ ID NO: 91348 - DNA, 16 bp, H. sapiens
ctggcagcagcagcag

SEQ ID NO: 91349 - DNA, 16 bp, H. sapiens
ctggcagcattcacca

SEQ ID NO: 91350 - DNA, 16 bp, H. sapiens
ctggcagcattcatca

SEQ ID NO: 91351 - DNA, 16 bp, H. sapiens
ctggcagcccagcccc

SEQ ID NO: 91352 - DNA, 16 bp, H. sapiens
ctggcagccctcactc

SEQ ID NO: 91353 - DNA, 16 bp, H. sapiens
ctggcagcctgggcaa

SEQ ID NO: 91354 - DNA, 16 bp, H. sapiens
ctggcagctgatgaga

SEQ ID NO: 91355 - DNA, 16 bp, H. sapiens
ctggcagctggtgttt

SEQ ID NO: 91356 - DNA, 16 bp, H. sapiens
ctggcagcttccatgt

SEQ ID NO: 91357 - DNA, 16 bp, H. sapiens
ctggcagctttgaaga

SEQ ID NO: 91358 - DNA, 16 bp, H. sapiens
ctggcaggagcaggct

SEQ ID NO: 91359 - DNA, 16 bp, H. sapiens
ctggcaggagcagggg

SEQ ID NO: 91360 - DNA, 16 bp, H. sapiens
ctggcaggaggagggg

SEQ ID NO: 91361 - DNA, 16 bp, H. sapiens
ctggcaggaggcagag

SEQ ID NO: 91362 - DNA, 16 bp, H. sapiens
ctggcaggatttgcag

SEQ ID NO: 91363 - DNA, 16 bp, H. sapiens
ctggcaggcagagtgg

SEQ ID NO: 91364 - DNA, 16 bp, H. sapiens
ctggcaggccctggtg

SEQ ID NO: 91365 - DNA, 16 bp, H. sapiens
ctggcagggatgtgga

SEQ ID NO: 91366 - DNA, 16 bp, H. sapiens
ctggcagtgagctgca

SEQ ID NO: 91367 - DNA, 16 bp, H. sapiens
ctggcagtgctggggg

SEQ ID NO: 91368 - DNA, 16 bp, H. sapiens
ctggcagttgtgccaa

SEQ ID NO: 91369 - DNA, 16 bp, H. sapiens
ctggcatagagtaggt

SEQ ID NO: 91370 - DNA, 16 bp, H. sapiens
ctggcatatttcaaaa

SEQ ID NO: 91371 - DNA, 16 bp, H. sapiens
ctggcatctgctcctg

SEQ ID NO: 91372 - DNA, 16 bp, H. sapiens
ctggcatctggcagat

SEQ ID NO: 91373 - DNA, 16 bp, H. sapiens
ctggcatctttcactt

SEQ ID NO: 91374 - DNA, 16 bp, H. sapiens
ctggcatgaggcttcc

SEQ ID NO: 91375 - DNA, 16 bp, H. sapiens
ctggcatgatggtgtg

SEQ ID NO: 91376 - DNA, 16 bp, H. sapiens
ctggcatgccagcaaa

SEQ ID NO: 91377 - DNA, 16 bp, H. sapiens
ctggcatgccctggag

SEQ ID NO: 91378 - DNA, 16 bp, H. sapiens
ctggcatggtggcaga

SEQ ID NO: 91379 - DNA, 16 bp, H. sapiens
ctggcatggtggctca

SEQ ID NO: 91380 - DNA, 16 bp, H. sapiens
ctggcatttcccctac

SEQ ID NO: 91381 - DNA, 16 bp, H. sapiens
ctggcattttgggagg

SEQ ID NO: 91382 - DNA, 16 bp, H. sapiens
ctggccaaaaaaattt

SEQ ID NO: 91383 - DNA, 16 bp, H. sapiens
ctggccaaaaaggtga

SEQ ID NO: 91384 - DNA, 16 bp, H. sapiens
ctggccaaaagggtga

SEQ ID NO: 91385 - DNA, 16 bp, H. sapiens
ctggccaacaccttga

SEQ ID NO: 91386 - DNA, 16 bp, H. sapiens
ctggccaacactgtga

SEQ ID NO: 91387 - DNA, 16 bp, H. sapiens
ctggccaacagaatga

SEQ ID NO: 91388 - DNA, 16 bp, H. sapiens
ctggccaacatagaaa

SEQ ID NO: 91389 - DNA, 16 bp, H. sapiens
ctggccaacatagaga

SEQ ID NO: 91390 - DNA, 16 bp, H. sapiens
ctggccaacatagtgg

SEQ ID NO: 91391 - DNA, 17 bp, H. sapiens
ctggccaacatgatgaa

SEQ ID NO: 91392 - DNA, 16 bp, H. sapiens
ctggccaacatggcca

SEQ ID NO: 91393 - DNA, 16 bp, H. sapiens
ctggccaaccccaggc

SEQ ID NO: 91394 - DNA, 16 bp, H. sapiens
ctggccaaggagaagc

SEQ ID NO: 91395 - DNA, 16 bp, H. sapiens
ctggccaaggcctgct

SEQ ID NO: 91396 - DNA, 16 bp, H. sapiens
ctggccaaggtgctga

SEQ ID NO: 91397 - DNA, 16 bp, H. sapiens
ctggccaaggtggtga

SEQ ID NO: 91398 - DNA, 16 bp, H. sapiens
ctggccaatggggtga

SEQ ID NO: 91399 - DNA, 16 bp, H. sapiens
ctggccacacagcagg

SEQ ID NO: 91400 - DNA, 16 bp, H. sapiens
ctggccacactggcag

SEQ ID NO: 91401 - DNA, 16 bp, H. sapiens
ctggccacactggcct

SEQ ID NO: 91402 - DNA, 16 bp, H. sapiens
ctggccacagagaacc

SEQ ID NO: 91403 - DNA, 16 bp, H. sapiens
ctggccacagcagcct

SEQ ID NO: 91404 - DNA, 16 bp, H. sapiens
ctggccaccacgccca

SEQ ID NO: 91405 - DNA, 16 bp, H. sapiens
ctggccaccacggtga

SEQ ID NO: 91406 - DNA, 16 bp, H. sapiens
ctggccaccatggcaa

SEQ ID NO: 91407 - DNA, 16 bp, H. sapiens
ctggccaccatggtga

SEQ ID NO: 91408 - DNA, 16 bp, H. sapiens
ctggccacctcagcct

SEQ ID NO: 91409 - DNA, 16 bp, H. sapiens
ctggccaccttggcct

SEQ ID NO: 91410 - DNA, 16 bp, H. sapiens
ctggccaccttgggca

SEQ ID NO: 91411 - DNA, 16 bp, H. sapiens
ctggccactaggccaa

SEQ ID NO: 91412 - DNA, 16 bp, H. sapiens
ctggccactgcggttc

SEQ ID NO: 91413 - DNA, 16 bp, H. sapiens
ctggccagaactccca

SEQ ID NO: 91414 - DNA, 16 bp, H. sapiens
ctggccagaatttcca

SEQ ID NO: 91415 - DNA, 16 bp, H. sapiens
ctggccagcatggaga

SEQ ID NO: 91416 - DNA, 16 bp, H. sapiens
ctggccaggatggtct

SEQ ID NO: 91417 - DNA, 16 bp, H. sapiens
ctggccaggccccagg

SEQ ID NO: 91418 - DNA, 16 bp, H. sapiens
ctggccaggctgctct

SEQ ID NO: 91419 - DNA, 16 bp, H. sapiens
ctggccaggctggtct

SEQ ID NO: 91420 - DNA, 17 bp, H. sapiens
ctggccagggaaatcag

SEQ ID NO: 91421 - DNA, 16 bp, H. sapiens
ctggccagggccacag

SEQ ID NO: 91422 - DNA, 16 bp, H. sapiens
ctggccaggttggtct

SEQ ID NO: 91423 - DNA, 27 bp, H. sapiens
ctggccataaacaaaatctctgcagca

SEQ ID NO: 91424 - DNA, 40 bp, H. sapiens
ctggccatatgtagaaagctgaaactggatcccttcctta

SEQ ID NO: 91425 - DNA, 16 bp, H. sapiens
ctggccatcatggtaa

SEQ ID NO: 91426 - DNA, 16 bp, H. sapiens
ctggccatggtggcag

SEQ ID NO: 91427 - DNA, 16 bp, H. sapiens
ctggccatgttggcca

SEQ ID NO: 91428 - DNA, 16 bp, H. sapiens
ctggcccaaaatgtca

SEQ ID NO: 91429 - DNA, 16 bp, H. sapiens
ctggcccaaggctctc

SEQ ID NO: 91430 - DNA, 16 bp, H. sapiens
ctggcccaaggctctg

SEQ ID NO: 91431 - DNA, 16 bp, H. sapiens
ctggcccacaaagcca

SEQ ID NO: 91432 - DNA, 18 bp, H. sapiens
ctggcccacatggtgaaa

SEQ ID NO: 91433 - DNA, 16 bp, H. sapiens
ctggcccagaattttt

SEQ ID NO: 91434 - DNA, 16 bp, H. sapiens
ctggcccagatcccac

SEQ ID NO: 91435 - DNA, 16 bp, H. sapiens
ctggcccagcccagcc

SEQ ID NO: 91436 - DNA, 16 bp, H. sapiens
ctggcccagccccagc

SEQ ID NO: 91437 - DNA, 16 bp, H. sapiens
ctggcccagcccctcc

SEQ ID NO: 91438 - DNA, 16 bp, H. sapiens
ctggcccagcccctgc

SEQ ID NO: 91439 - DNA, 16 bp, H. sapiens
ctggcccagcctccca

SEQ ID NO: 91440 - DNA, 16 bp, H. sapiens
ctggcccaggatgtgt

SEQ ID NO: 91441 - DNA, 16 bp, H. sapiens
ctggcccagggagcag

SEQ ID NO: 91442 - DNA, 16 bp, H. sapiens
ctggcccagggcccag

SEQ ID NO: 91443 - DNA, 16 bp, H. sapiens
ctggcccagggccctg

SEQ ID NO: 91444 - DNA, 16 bp, H. sapiens
ctggcccagggcctgg

SEQ ID NO: 91445 - DNA, 16 bp, H. sapiens
ctggccccaaactcct

SEQ ID NO: 91446 - DNA, 16 bp, H. sapiens
ctggccccacccttga

SEQ ID NO: 91447 - DNA, 16 bp, H. sapiens
ctggccccagccctgc

SEQ ID NO: 91448 - DNA, 16 bp, H. sapiens
ctggcccccaccccag

SEQ ID NO: 91449 - DNA, 16 bp, H. sapiens
ctggccccctggctcc

SEQ ID NO: 91450 - DNA, 16 bp, H. sapiens
ctggcccctacccact

SEQ ID NO: 91451 - DNA, 16 bp, H. sapiens
ctggcccctgccccag

SEQ ID NO: 91452 - DNA, 16 bp, H. sapiens
ctggcccctgcctgcc

SEQ ID NO: 91453 - DNA, 16 bp, H. sapiens
ctggccccttcctggc

SEQ ID NO: 91454 - DNA, 17 bp, H. sapiens
ctggcccgggtgctaag

SEQ ID NO: 91455 - DNA, 16 bp, H. sapiens
ctggccctattttttt

SEQ ID NO: 91456 - DNA, 16 bp, H. sapiens
ctggccctgacccaga

SEQ ID NO: 91457 - DNA, 16 bp, H. sapiens
ctggccctgccctcct

SEQ ID NO: 91458 - DNA, 16 bp, H. sapiens
ctggccctgccctgcc

SEQ ID NO: 91459 - DNA, 16 bp, H. sapiens
ctggccctgcctcctg

SEQ ID NO: 91460 - DNA, 16 bp, H. sapiens
ctggccctgcctgcct

SEQ ID NO: 91461 - DNA, 16 bp, H. sapiens
ctggccctgcctgggg

SEQ ID NO: 91462 - DNA, 16 bp, H. sapiens
ctggccctgccttggc

SEQ ID NO: 91463 - DNA, 16 bp, H. sapiens
ctggccctgctcccag

SEQ ID NO: 91464 - DNA, 16 bp, H. sapiens
ctggccctgctggccc

SEQ ID NO: 91465 - DNA, 16 bp, H. sapiens
ctggccctggcccagg

SEQ ID NO: 91466 - DNA, 16 bp, H. sapiens
ctggccctggccctga

SEQ ID NO: 91467 - DNA, 16 bp, H. sapiens
ctggccctggccctgt

SEQ ID NO: 91468 - DNA, 16 bp, H. sapiens
ctggccctggctcctg

SEQ ID NO: 91469 - DNA, 16 bp, H. sapiens
ctggccctggctctgg

SEQ ID NO: 91470 - DNA, 16 bp, H. sapiens
ctggccctgggctctg

SEQ ID NO: 91471 - DNA, 16 bp, H. sapiens
ctggccctggggactg

SEQ ID NO: 91472 - DNA, 16 bp, H. sapiens
ctggccctgtgctggg

SEQ ID NO: 91473 - DNA, 16 bp, H. sapiens
ctggccgtggtggcag

SEQ ID NO: 91474 - DNA, 16 bp, H. sapiens
ctggccgtggtggtgc

SEQ ID NO: 91475 - DNA, 16 bp, H. sapiens
ctggcctatttcactt

SEQ ID NO: 91476 - DNA, 16 bp, H. sapiens
ctggcctcaaacacct

SEQ ID NO: 91477 - DNA, 16 bp, H. sapiens
ctggcctcaagcaatt

SEQ ID NO: 91478 - DNA, 16 bp, H. sapiens
ctggcctcaagtgagc

SEQ ID NO: 91479 - DNA, 16 bp, H. sapiens
ctggcctcacaaaatg

SEQ ID NO: 91480 - DNA, 16 bp, H. sapiens
ctggcctcagcctccc

SEQ ID NO: 91481 - DNA, 16 bp, H. sapiens
ctggcctcagtctccc

SEQ ID NO: 91482 - DNA, 16 bp, H. sapiens
ctggcctcagtctcct

SEQ ID NO: 91483 - DNA, 16 bp, H. sapiens
ctggcctcagtttccc

SEQ ID NO: 91484 - DNA, 16 bp, H. sapiens
ctggcctcataaaagg

SEQ ID NO: 91485 - DNA, 16 bp, H. sapiens
ctggcctcccagagtg

SEQ ID NO: 91486 - DNA, 16 bp, H. sapiens
ctggcctccctgagct

SEQ ID NO: 91487 - DNA, 16 bp, H. sapiens
ctggcctccctgcagc

SEQ ID NO: 91488 - DNA, 16 bp, H. sapiens
ctggcctccctgcctc

SEQ ID NO: 91489 - DNA, 16 bp, H. sapiens
ctggcctcctctcctt

SEQ ID NO: 91490 - DNA, 16 bp, H. sapiens
ctggcctcctgcctgg

SEQ ID NO: 91491 - DNA, 16 bp, H. sapiens
ctggcctcgaacttct

SEQ ID NO: 91492 - DNA, 16 bp, H. sapiens
ctggcctcggccagcc

SEQ ID NO: 91493 - DNA, 16 bp, H. sapiens
ctggcctcggcttccc

SEQ ID NO: 91494 - DNA, 16 bp, H. sapiens
ctggcctctacccact

SEQ ID NO: 91495 - DNA, 16 bp, H. sapiens
ctggcctctactcact

SEQ ID NO: 91496 - DNA, 16 bp, H. sapiens
ctggcctctagtgatc

SEQ ID NO: 91497 - DNA, 16 bp, H. sapiens
ctggcctctccctttc

SEQ ID NO: 91498 - DNA, 16 bp, H. sapiens
ctggcctctcctgcct

SEQ ID NO: 91499 - DNA, 16 bp, H. sapiens
ctggcctctcctgggg

SEQ ID NO: 91500 - DNA, 16 bp, H. sapiens
ctggcctctgaggagg

SEQ ID NO: 91501 - DNA, 16 bp, H. sapiens
ctggcctctgcacctg

SEQ ID NO: 91502 - DNA, 16 bp, H. sapiens
ctggcctctgcccacc

SEQ ID NO: 91503 - DNA, 16 bp, H. sapiens
ctggcctctgcctgcc

SEQ ID NO: 91504 - DNA, 16 bp, H. sapiens
ctggcctctgccttcc

SEQ ID NO: 91505 - DNA, 16 bp, H. sapiens
ctggcctctggtgatc

SEQ ID NO: 91506 - DNA, 16 bp, H. sapiens
ctggcctcttctctgt

SEQ ID NO: 91507 - DNA, 16 bp, H. sapiens
ctggcctgaaattctt

SEQ ID NO: 91508 - DNA, 16 bp, H. sapiens
ctggcctgagcaacat

SEQ ID NO: 91509 - DNA, 16 bp, H. sapiens
ctggcctgaggtcaca

SEQ ID NO: 91510 - DNA, 16 bp, H. sapiens
ctggcctgaggtgatc

SEQ ID NO: 91511 - DNA, 16 bp, H. sapiens
ctggcctgcaaagttt

SEQ ID NO: 91512 - DNA, 16 bp, H. sapiens
ctggcctgcccagggc

SEQ ID NO: 91513 - DNA, 16 bp, H. sapiens
ctggcctgcctgcctg

SEQ ID NO: 91514 - DNA, 16 bp, H. sapiens
ctggcctgccttcagc

SEQ ID NO: 91515 - DNA, 16 bp, H. sapiens
ctggcctgctgctcac

SEQ ID NO: 91516 - DNA, 16 bp, H. sapiens
ctggcctggaacctgg

SEQ ID NO: 91517 - DNA, 16 bp, H. sapiens
ctggcctggagagagg

SEQ ID NO: 91518 - DNA, 16 bp, H. sapiens
ctggcctggagcctgg

SEQ ID NO: 91519 - DNA, 16 bp, H. sapiens
ctggcctggatcccac

SEQ ID NO: 91520 - DNA, 16 bp, H. sapiens
ctggcctggcacagtg

SEQ ID NO: 91521 - DNA, 16 bp, H. sapiens
ctggcctggcagaggg

SEQ ID NO: 91522 - DNA, 16 bp, H. sapiens
ctggcctggccaacac

SEQ ID NO: 91523 - DNA, 16 bp, H. sapiens
ctggcctggccaacat

SEQ ID NO: 91524 - DNA, 16 bp, H. sapiens
ctggcctggccctgcc

SEQ ID NO: 91525 - DNA, 16 bp, H. sapiens
ctggcctggcctcccc

SEQ ID NO: 91526 - DNA, 16 bp, H. sapiens
ctggcctggctcctgc

SEQ ID NO: 91527 - DNA, 16 bp, H. sapiens
ctggcctgggagtcag

SEQ ID NO: 91528 - DNA, 16 bp, H. sapiens
ctggcctgggggacag

SEQ ID NO: 91529 - DNA, 16 bp, H. sapiens
ctggcctgggtgacag

SEQ ID NO: 91530 - DNA, 16 bp, H. sapiens
ctggcctggtggtgca

SEQ ID NO: 91531 - DNA, 16 bp, H. sapiens
ctggcctgtttcctga

SEQ ID NO: 91532 - DNA, 16 bp, H. sapiens
ctggccttaaagagga

SEQ ID NO: 91533 - DNA, 16 bp, H. sapiens
ctggccttcagagaaa

SEQ ID NO: 91534 - DNA, 16 bp, H. sapiens
ctggccttggccctga

SEQ ID NO: 91535 - DNA, 16 bp, H. sapiens
ctggccttggcctccc

SEQ ID NO: 91536 - DNA, 16 bp, H. sapiens
ctggccttggtctccc

SEQ ID NO: 91537 - DNA, 16 bp, H. sapiens
ctggcgacagagcgag

SEQ ID NO: 91538 - DNA, 16 bp, H. sapiens
ctggcgtgagccaccg

SEQ ID NO: 91539 - DNA, 16 bp, H. sapiens
ctggctaaattttaaa

SEQ ID NO: 91540 - DNA, 16 bp, H. sapiens
ctggctaacacaatga

SEQ ID NO: 91541 - DNA, 16 bp, H. sapiens
ctggctaactttattt

SEQ ID NO: 91542 - DNA, 16 bp, H. sapiens
ctggctaagggagctc

SEQ ID NO: 91543 - DNA, 16 bp, H. sapiens
ctggctaagttttgta

SEQ ID NO: 91544 - DNA, 16 bp, H. sapiens
ctggctaatattttaa

SEQ ID NO: 91545 - DNA, 16 bp, H. sapiens
ctggctaatctttttg

SEQ ID NO: 91546 - DNA, 16 bp, H. sapiens
ctggctaattaaaaaa

SEQ ID NO: 91547 - DNA, 16 bp, H. sapiens
ctggctaattatttat

SEQ ID NO: 91548 - DNA, 16 bp, H. sapiens
ctggctaatttatttt

SEQ ID NO: 91549 - DNA, 16 bp, H. sapiens
ctggctaatttgtttt

SEQ ID NO: 91550 - DNA, 16 bp, H. sapiens
ctggctaattttctta

SEQ ID NO: 91551 - DNA, 16 bp, H. sapiens
ctggctaattttgggg

SEQ ID NO: 91552 - DNA, 16 bp, H. sapiens
ctggctaatttttttc

SEQ ID NO: 91553 - DNA, 16 bp, H. sapiens
ctggctagagatttat

SEQ ID NO: 91554 - DNA, 16 bp, H. sapiens
ctggctagttttttct

SEQ ID NO: 91555 - DNA, 16 bp, H. sapiens
ctggctatttttgtgt

SEQ ID NO: 91556 - DNA, 16 bp, H. sapiens
ctggctcaaaaaaaga

SEQ ID NO: 91557 - DNA, 16 bp, H. sapiens
ctggctcaaggtctct

SEQ ID NO: 91558 - DNA, 16 bp, H. sapiens
ctggctcacacctgca

SEQ ID NO: 91559 - DNA, 18 bp, H. sapiens
ctggctcacacctgtaat

SEQ ID NO: 91560 - DNA, 17 bp, H. sapiens
ctggctcacatctgtaa

SEQ ID NO: 91561 - DNA, 20 bp, H. sapiens
ctggctcacgcctgtaatct

SEQ ID NO: 91562 - DNA, 18 bp, H. sapiens
ctggctcagaagctcccc

SEQ ID NO: 91563 - DNA, 16 bp, H. sapiens
ctggctcagcctcctg

SEQ ID NO: 91564 - DNA, 16 bp, H. sapiens
ctggctcagccttctg

SEQ ID NO: 91565 - DNA, 16 bp, H. sapiens
ctggctcagcttcccg

SEQ ID NO: 91566 - DNA, 16 bp, H. sapiens
ctggctccagaaccca

SEQ ID NO: 91567 - DNA, 16 bp, H. sapiens
ctggctccagagccct

SEQ ID NO: 91568 - DNA, 16 bp, H. sapiens
ctggctccagagcctg

SEQ ID NO: 91569 - DNA, 16 bp, H. sapiens
ctggctccagagctca

SEQ ID NO: 91570 - DNA, 16 bp, H. sapiens
ctggctccaggtctct

SEQ ID NO: 91571 - DNA, 16 bp, H. sapiens
ctggctccatcaccca

SEQ ID NO: 91572 - DNA, 16 bp, H. sapiens
ctggctcccagacagc

SEQ ID NO: 91573 - DNA, 16 bp, H. sapiens
ctggctcccccatctg

SEQ ID NO: 91574 - DNA, 16 bp, H. sapiens
ctggctccctcctgtc

SEQ ID NO: 91575 - DNA, 16 bp, H. sapiens
ctggctcctgcacctg

SEQ ID NO: 91576 - DNA, 16 bp, H. sapiens
ctggctcctgcctggc

SEQ ID NO: 91577 - DNA, 16 bp, H. sapiens
ctggctcctggacagc

SEQ ID NO: 91578 - DNA, 16 bp, H. sapiens
ctggctcctggatggc

SEQ ID NO: 91579 - DNA, 16 bp, H. sapiens
ctggctccttctcatc

SEQ ID NO: 91580 - DNA, 16 bp, H. sapiens
ctggctctaagcccag

SEQ ID NO: 91581 - DNA, 16 bp, H. sapiens
ctggctctctcaccca

SEQ ID NO: 91582 - DNA, 16 bp, H. sapiens
ctggctctcttcctgc

SEQ ID NO: 91583 - DNA, 16 bp, H. sapiens
ctggctctgagtctct

SEQ ID NO: 91584 - DNA, 16 bp, H. sapiens
ctggctctgccaccca

SEQ ID NO: 91585 - DNA, 16 bp, H. sapiens
ctggctctgccacctg

SEQ ID NO: 91586 - DNA, 16 bp, H. sapiens
ctggctctgccactta

SEQ ID NO: 91587 - DNA, 16 bp, H. sapiens
ctggctctgccctggg

SEQ ID NO: 91588 - DNA, 16 bp, H. sapiens
ctggctctgcctctcc

SEQ ID NO: 91589 - DNA, 16 bp, H. sapiens
ctggctctgcctctga

SEQ ID NO: 91590 - DNA, 16 bp, H. sapiens
ctggctctgcctcttg

SEQ ID NO: 91591 - DNA, 16 bp, H. sapiens
ctggctctgcgtgaat

SEQ ID NO: 91592 - DNA, 16 bp, H. sapiens
ctggctctggccttgg

SEQ ID NO: 91593 - DNA, 16 bp, H. sapiens
ctggctctggtggcca

SEQ ID NO: 91594 - DNA, 16 bp, H. sapiens
ctggctctgtcaccag

SEQ ID NO: 91595 - DNA, 16 bp, H. sapiens
ctggctctgtcaccga

SEQ ID NO: 91596 - DNA, 16 bp, H. sapiens
ctggctctgtcactga

SEQ ID NO: 91597 - DNA, 16 bp, H. sapiens
ctggctctgtcattta

SEQ ID NO: 91598 - DNA, 16 bp, H. sapiens
ctggctctgtgccagg

SEQ ID NO: 91599 - DNA, 16 bp, H. sapiens
ctggctctgtgcctgc

SEQ ID NO: 91600 - DNA, 16 bp, H. sapiens
ctggctctgtgtctcc

SEQ ID NO: 91601 - DNA, 16 bp, H. sapiens
ctggctgaaatgacag

SEQ ID NO: 91602 - DNA, 16 bp, H. sapiens
ctggctgacagaggga

SEQ ID NO: 91603 - DNA, 16 bp, H. sapiens
ctggctgagcccaggg

SEQ ID NO: 91604 - DNA, 16 bp, H. sapiens
ctggctgagcctgggg

SEQ ID NO: 91605 - DNA, 16 bp, H. sapiens
ctggctgagcgtggtg

SEQ ID NO: 91606 - DNA, 16 bp, H. sapiens
ctggctgaggaggaag

SEQ ID NO: 91607 - DNA, 16 bp, H. sapiens
ctggctgagtccaggg

SEQ ID NO: 91608 - DNA, 16 bp, H. sapiens
ctggctgatttcattt

SEQ ID NO: 91609 - DNA, 16 bp, H. sapiens
ctggctgatttctgta

SEQ ID NO: 91610 - DNA, 16 bp, H. sapiens
ctggctgcaaaaattt

SEQ ID NO: 91611 - DNA, 16 bp, H. sapiens
ctggctgcaaactcct

SEQ ID NO: 91612 - DNA, 16 bp, H. sapiens
ctggctgcacactgga

SEQ ID NO: 91613 - DNA, 16 bp, H. sapiens
ctggctgcagaaattt

SEQ ID NO: 91614 - DNA, 16 bp, H. sapiens
ctggctgcagcagggg

SEQ ID NO: 91615 - DNA, 16 bp, H. sapiens
ctggctgccctcccca

SEQ ID NO: 91616 - DNA, 16 bp, H. sapiens
ctggctgccctgaaca

SEQ ID NO: 91617 - DNA, 16 bp, H. sapiens
ctggctgccttcacag

SEQ ID NO: 91618 - DNA, 16 bp, H. sapiens
ctggctgccttccctg

SEQ ID NO: 91619 - DNA, 16 bp, H. sapiens
ctggctgctcacctcc

SEQ ID NO: 91620 - DNA, 16 bp, H. sapiens
ctggctgctccagctc

SEQ ID NO: 91621 - DNA, 16 bp, H. sapiens
ctggctgctctgagtg

SEQ ID NO: 91622 - DNA, 16 bp, H. sapiens
ctggctgctgaaactg

SEQ ID NO: 91623 - DNA, 16 bp, H. sapiens
ctggctgctgcttctc

SEQ ID NO: 91624 - DNA, 16 bp, H. sapiens
ctggctgctgtgtgga

SEQ ID NO: 91625 - DNA, 16 bp, H. sapiens
ctggctggacatggtg

SEQ ID NO: 91626 - DNA, 16 bp, H. sapiens
ctggctggagttgctg

SEQ ID NO: 91627 - DNA, 16 bp, H. sapiens
ctggctggagttgttg

SEQ ID NO: 91628 - DNA, 16 bp, H. sapiens
ctggctggcaggggtg

SEQ ID NO: 91629 - DNA, 16 bp, H. sapiens
ctggctggcatctggc

SEQ ID NO: 91630 - DNA, 16 bp, H. sapiens
ctggctggctggctgc

SEQ ID NO: 91631 - DNA, 16 bp, H. sapiens
ctggctggctgtcttg

SEQ ID NO: 91632 - DNA, 16 bp, H. sapiens
ctggctggctttgcca

SEQ ID NO: 91633 - DNA, 16 bp, H. sapiens
ctggctggctttgtca

SEQ ID NO: 91634 - DNA, 16 bp, H. sapiens
ctggctgggcacagtg

SEQ ID NO: 91635 - DNA, 16 bp, H. sapiens
ctggctgggctggctg

SEQ ID NO: 91636 - DNA, 16 bp, H. sapiens
ctggctggggctgcag

SEQ ID NO: 91637 - DNA, 16 bp, H. sapiens
ctggctggggtgggga

SEQ ID NO: 91638 - DNA, 16 bp, H. sapiens
ctggctgggtacggtg

SEQ ID NO: 91639 - DNA, 16 bp, H. sapiens
ctggctgggtggctgg

SEQ ID NO: 91640 - DNA, 16 bp, H. sapiens
ctggctgtagaaattt

SEQ ID NO: 91641 - DNA, 16 bp, H. sapiens
ctggctgtgcaggaga

SEQ ID NO: 91642 - DNA, 16 bp, H. sapiens
ctggctgtgcgggaga

SEQ ID NO: 91643 - DNA, 16 bp, H. sapiens
ctggctgtggcagact

SEQ ID NO: 91644 - DNA, 16 bp, H. sapiens
ctggctgtgggctggg

SEQ ID NO: 91645 - DNA, 16 bp, H. sapiens
ctggctgtggtggtgt

SEQ ID NO: 91646 - DNA, 16 bp, H. sapiens
ctggctgtgtcctcac

SEQ ID NO: 91647 - DNA, 16 bp, H. sapiens
ctggctgtgtcgccca

SEQ ID NO: 91648 - DNA, 16 bp, H. sapiens
ctggctgtgtgacctt

SEQ ID NO: 91649 - DNA, 16 bp, H. sapiens
ctggctgtgtggcctt

SEQ ID NO: 91650 - DNA, 16 bp, H. sapiens
ctggctgttccctctg

SEQ ID NO: 91651 - DNA, 16 bp, H. sapiens
ctggctgttggcagga

SEQ ID NO: 91652 - DNA, 16 bp, H. sapiens
ctggcttagcctccca

SEQ ID NO: 91653 - DNA, 16 bp, H. sapiens
ctggcttcaaaatata

SEQ ID NO: 91654 - DNA, 16 bp, H. sapiens
ctggcttcaaagtttc

SEQ ID NO: 91655 - DNA, 16 bp, H. sapiens
ctggcttcaagcaatc

SEQ ID NO: 91656 - DNA, 16 bp, H. sapiens
ctggcttcagagtctg

SEQ ID NO: 91657 - DNA, 16 bp, H. sapiens
ctggcttcagcccctt

SEQ ID NO: 91658 - DNA, 16 bp, H. sapiens
ctggcttcagcctccc

SEQ ID NO: 91659 - DNA, 16 bp, H. sapiens
ctggcttcatgccatt

SEQ ID NO: 91660 - DNA, 16 bp, H. sapiens
ctggcttccccccacc

SEQ ID NO: 91661 - DNA, 16 bp, H. sapiens
ctggcttccccttgag

SEQ ID NO: 91662 - DNA, 16 bp, H. sapiens
ctggcttcctccagag

SEQ ID NO: 91663 - DNA, 16 bp, H. sapiens
ctggcttcctgggctg

SEQ ID NO: 91664 - DNA, 16 bp, H. sapiens
ctggcttccttcactt

SEQ ID NO: 91665 - DNA, 16 bp, H. sapiens
ctggcttccttgcttc

SEQ ID NO: 91666 - DNA, 16 bp, H. sapiens
ctggcttcctttctcc

SEQ ID NO: 91667 - DNA, 16 bp, H. sapiens
ctggcttctccccact

SEQ ID NO: 91668 - DNA, 16 bp, H. sapiens
ctggcttctctcactg

SEQ ID NO: 91669 - DNA, 16 bp, H. sapiens
ctggcttctctctctc

SEQ ID NO: 91670 - DNA, 16 bp, H. sapiens
ctggcttctggctggg

SEQ ID NO: 91671 - DNA, 16 bp, H. sapiens
ctggcttcttcctctt

SEQ ID NO: 91672 - DNA, 16 bp, H. sapiens
ctggcttctttattgc

SEQ ID NO: 91673 - DNA, 16 bp, H. sapiens
ctggcttctttccttc

SEQ ID NO: 91674 - DNA, 16 bp, H. sapiens
ctggcttggctgactg

SEQ ID NO: 91675 - DNA, 16 bp, H. sapiens
ctggcttggggagccc

SEQ ID NO: 91676 - DNA, 16 bp, H. sapiens
ctggctttaccacctg

SEQ ID NO: 91677 - DNA, 16 bp, H. sapiens
ctggctttatttttct

SEQ ID NO: 91678 - DNA, 16 bp, H. sapiens
ctggctttgaagatgg

SEQ ID NO: 91679 - DNA, 16 bp, H. sapiens
ctggctttgcagatgg

SEQ ID NO: 91680 - DNA, 16 bp, H. sapiens
ctggctttggagaaaa

SEQ ID NO: 91681 - DNA, 16 bp, H. sapiens
ctggctttggggaaaa

SEQ ID NO: 91682 - DNA, 16 bp, H. sapiens
ctggctttgtttctgg

SEQ ID NO: 91683 - DNA, 16 bp, H. sapiens
ctggctttttgaaaag

SEQ ID NO: 91684 - DNA, 16 bp, H. sapiens
ctgggaaaactggaca

SEQ ID NO: 91685 - DNA, 16 bp, H. sapiens
ctgggaaaagaaaaga

SEQ ID NO: 91686 - DNA, 16 bp, H. sapiens
ctgggaaaagcagaag

SEQ ID NO: 91687 - DNA, 16 bp, H. sapiens
ctgggaaaatatttgc

SEQ ID NO: 91688 - DNA, 16 bp, H. sapiens
ctgggaaaatctttat

SEQ ID NO: 91689 - DNA, 16 bp, H. sapiens
ctgggaaacaaagtga

SEQ ID NO: 91690 - DNA, 16 bp, H. sapiens
ctgggaaacagagcga

SEQ ID NO: 91691 - DNA, 16 bp, H. sapiens
ctgggaaacagagtaa

SEQ ID NO: 91692 - DNA, 16 bp, H. sapiens
ctgggaaacagtagaa

SEQ ID NO: 91693 - DNA, 18 bp, H. sapiens
ctgggaaacatggcaaaa

SEQ ID NO: 91694 - DNA, 16 bp, H. sapiens
ctgggaaacccctcag

SEQ ID NO: 91695 - DNA, 16 bp, H. sapiens
ctgggaaacttattta

SEQ ID NO: 91696 - DNA, 16 bp, H. sapiens
ctgggaaagaagggag

SEQ ID NO: 91697 - DNA, 16 bp, H. sapiens
ctgggaaaggaaagga

SEQ ID NO: 91698 - DNA, 16 bp, H. sapiens
ctgggaaagggaattc

SEQ ID NO: 91699 - DNA, 16 bp, H. sapiens
ctgggaaataaaatat

SEQ ID NO: 91700 - DNA, 16 bp, H. sapiens
ctgggaaatgaggagc

SEQ ID NO: 91701 - DNA, 16 bp, H. sapiens
ctgggaaatgtagtcc

SEQ ID NO: 91702 - DNA, 16 bp, H. sapiens
ctgggaaatgtagttt

SEQ ID NO: 91703 - DNA, 16 bp, H. sapiens
ctgggaacaaagagag

SEQ ID NO: 91704 - DNA, 16 bp, H. sapiens
ctgggaacacaggcac

SEQ ID NO: 91705 - DNA, 16 bp, H. sapiens
ctgggaagaaaaagaa

SEQ ID NO: 91706 - DNA, 16 bp, H. sapiens
ctgggaagacttcctg

SEQ ID NO: 91707 - DNA, 16 bp, H. sapiens
ctgggaagatgcccgt

SEQ ID NO: 91708 - DNA, 16 bp, H. sapiens
ctgggaagccgaggcg

SEQ ID NO: 91709 - DNA, 16 bp, H. sapiens
ctgggaagccttcctt

SEQ ID NO: 91710 - DNA, 16 bp, H. sapiens
ctgggaagccttctct

SEQ ID NO: 91711 - DNA, 16 bp, H. sapiens
ctgggaaggaaggagg

SEQ ID NO: 91712 - DNA, 16 bp, H. sapiens
ctgggaagggaagggc

SEQ ID NO: 91713 - DNA, 16 bp, H. sapiens
ctgggaaggggcatga

SEQ ID NO: 91714 - DNA, 16 bp, H. sapiens
ctgggaaggtggaggt

SEQ ID NO: 91715 - DNA, 16 bp, H. sapiens
ctgggaagtccaagag

SEQ ID NO: 91716 - DNA, 16 bp, H. sapiens
ctgggaagtccaagat

SEQ ID NO: 91717 - DNA, 16 bp, H. sapiens
ctgggaagtccaaggg

SEQ ID NO: 91718 - DNA, 16 bp, H. sapiens
ctgggaagtcctcagg

SEQ ID NO: 91719 - DNA, 16 bp, H. sapiens
ctgggaagtgaggagc

SEQ ID NO: 91720 - DNA, 16 bp, H. sapiens
ctgggaatacagtggt

SEQ ID NO: 91721 - DNA, 16 bp, H. sapiens
ctgggaatcaaatttc

SEQ ID NO: 91722 - DNA, 16 bp, H. sapiens
ctgggaatgcagctca

SEQ ID NO: 91723 - DNA, 16 bp, H. sapiens
ctgggaattcaagacc

SEQ ID NO: 91724 - DNA, 16 bp, H. sapiens
ctgggaattgtgggag

SEQ ID NO: 91725 - DNA, 16 bp, H. sapiens
ctgggaatttgcattt

SEQ ID NO: 91726 - DNA, 18 bp, H. sapiens
ctgggacaacaggcgccc

SEQ ID NO: 91727 - DNA, 16 bp, H. sapiens
ctgggacaactggaca

SEQ ID NO: 91728 - DNA, 16 bp, H. sapiens
ctgggacactgtcccc

SEQ ID NO: 91729 - DNA, 16 bp, H. sapiens
ctgggacagagcttcc

SEQ ID NO: 91730 - DNA, 16 bp, H. sapiens
ctgggacagccctggg

SEQ ID NO: 91731 - DNA, 16 bp, H. sapiens
ctgggacaggagaatc

SEQ ID NO: 91732 - DNA, 16 bp, H. sapiens
ctgggacatatttaaa

SEQ ID NO: 91733 - DNA, 16 bp, H. sapiens
ctgggaccacaggagc

SEQ ID NO: 91734 - DNA, 16 bp, H. sapiens
ctgggaccacaggcgc

SEQ ID NO: 91735 - DNA, 16 bp, H. sapiens
ctgggaccacaggcgt

SEQ ID NO: 91736 - DNA, 16 bp, H. sapiens
ctgggaccagaaccca

SEQ ID NO: 91737 - DNA, 16 bp, H. sapiens
ctgggacccaggaggc

SEQ ID NO: 91738 - DNA, 16 bp, H. sapiens
ctgggactaaaggcac

SEQ ID NO: 91739 - DNA, 16 bp, H. sapiens
ctgggactacaaggtg

SEQ ID NO: 91740 - DNA, 16 bp, H. sapiens
ctgggactacaagtac

SEQ ID NO: 91741 - DNA, 16 bp, H. sapiens
ctgggactacagcacc

SEQ ID NO: 91742 - DNA, 16 bp, H. sapiens
ctgggactacagcgcc

SEQ ID NO: 91743 - DNA, 24 bp, H. sapiens
ctgggactacaggcacctgccacc

SEQ ID NO: 91744 - DNA, 16 bp, H. sapiens
ctgggactacaggcag

SEQ ID NO: 91745 - DNA, 17 bp, H. sapiens
ctgggactacaggcgcg

SEQ ID NO: 91746 - DNA, 20 bp, H. sapiens
ctgggactacaggggcctgc

SEQ ID NO: 91747 - DNA, 16 bp, H. sapiens
ctgggactaccagtgt

SEQ ID NO: 91748 - DNA, 16 bp, H. sapiens
ctgggactataggcgt

SEQ ID NO: 91749 - DNA, 16 bp, H. sapiens
ctgggactcagtttcc

SEQ ID NO: 91750 - DNA, 16 bp, H. sapiens
ctgggactgcagatgc

SEQ ID NO: 91751 - DNA, 16 bp, H. sapiens
ctgggactgcagtcac

SEQ ID NO: 91752 - DNA, 16 bp, H. sapiens
ctgggactgggactac

SEQ ID NO: 91753 - DNA, 16 bp, H. sapiens
ctgggacttcccagcc

SEQ ID NO: 91754 - DNA, 16 bp, H. sapiens
ctgggagaaaaccaaa

SEQ ID NO: 91755 - DNA, 16 bp, H. sapiens
ctgggagaaccaccac

SEQ ID NO: 91756 - DNA, 16 bp, H. sapiens
ctgggagaaccactgt

SEQ ID NO: 91757 - DNA, 16 bp, H. sapiens
ctgggagacacaggag

SEQ ID NO: 91758 - DNA, 16 bp, H. sapiens
ctgggagacacagtga

SEQ ID NO: 91759 - DNA, 16 bp, H. sapiens
ctgggagacagagcta

SEQ ID NO: 91760 - DNA, 16 bp, H. sapiens
ctgggagacagggaga

SEQ ID NO: 91761 - DNA, 16 bp, H. sapiens
ctgggagactgaggtg

SEQ ID NO: 91762 - DNA, 16 bp, H. sapiens
ctgggagactgaggtt

SEQ ID NO: 91763 - DNA, 16 bp, H. sapiens
ctgggagagaggcatg

SEQ ID NO: 91764 - DNA, 16 bp, H. sapiens
ctgggagagaggctgt

SEQ ID NO: 91765 - DNA, 16 bp, H. sapiens
ctgggagagctgggag

SEQ ID NO: 91766 - DNA, 16 bp, H. sapiens
ctgggagaggctgagg

SEQ ID NO: 91767 - DNA, 16 bp, H. sapiens
ctgggagaggggaagg

SEQ ID NO: 91768 - DNA, 16 bp, H. sapiens
ctgggagatcaaggct

SEQ ID NO: 91769 - DNA, 16 bp, H. sapiens
ctgggagatctgctgt

SEQ ID NO: 91770 - DNA, 16 bp, H. sapiens
ctgggagatggggagg

SEQ ID NO: 91771 - DNA, 16 bp, H. sapiens
ctgggagatttttatt

SEQ ID NO: 91772 - DNA, 16 bp, H. sapiens
ctgggagcacaggcat

SEQ ID NO: 91773 - DNA, 16 bp, H. sapiens
ctgggagcagaggttg

SEQ ID NO: 91774 - DNA, 16 bp, H. sapiens
ctgggagcagccctca

SEQ ID NO: 91775 - DNA, 16 bp, H. sapiens
ctgggagcagggagag

SEQ ID NO: 91776 - DNA, 16 bp, H. sapiens
ctgggagccaggcagg

SEQ ID NO: 91777 - DNA, 16 bp, H. sapiens
ctgggagcctgaggca

SEQ ID NO: 91778 - DNA, 16 bp, H. sapiens
ctgggagctccaggct

SEQ ID NO: 91779 - DNA, 16 bp, H. sapiens
ctgggagctccctgag

SEQ ID NO: 91780 - DNA, 16 bp, H. sapiens
ctgggagctgaggcag

SEQ ID NO: 91781 - DNA, 16 bp, H. sapiens
ctgggagctgggggag

SEQ ID NO: 91782 - DNA, 16 bp, H. sapiens
ctgggagcttgaggct

SEQ ID NO: 91783 - DNA, 16 bp, H. sapiens
ctgggaggaagggaag

SEQ ID NO: 91784 - DNA, 16 bp, H. sapiens
ctgggaggagaggcag

SEQ ID NO: 91785 - DNA, 16 bp, H. sapiens
ctgggaggagagtgag

SEQ ID NO: 91786 - DNA, 16 bp, H. sapiens
ctgggaggagcccagg

SEQ ID NO: 91787 - DNA, 16 bp, H. sapiens
ctgggaggaggagagg

SEQ ID NO: 91788 - DNA, 16 bp, H. sapiens
ctgggaggaggcagag

SEQ ID NO: 91789 - DNA, 16 bp, H. sapiens
ctgggaggcaaaggct

SEQ ID NO: 91790 - DNA, 16 bp, H. sapiens
ctgggaggcagaagtc

SEQ ID NO: 91791 - DNA, 16 bp, H. sapiens
ctgggaggcagatgct

SEQ ID NO: 91792 - DNA, 16 bp, H. sapiens
ctgggaggcaggggag

SEQ ID NO: 91793 - DNA, 16 bp, H. sapiens
ctgggaggccaaggca

SEQ ID NO: 91794 - DNA, 19 bp, H. sapiens
ctgggaggccaaggtgggc

SEQ ID NO: 91795 - DNA, 16 bp, H. sapiens
ctgggaggcccaggtg

SEQ ID NO: 91796 - DNA, 16 bp, H. sapiens
ctgggaggcggtggtt

SEQ ID NO: 91797 - DNA, 16 bp, H. sapiens
ctgggaggctgaagct

SEQ ID NO: 91798 - DNA, 16 bp, H. sapiens
ctgggaggctggggag

SEQ ID NO: 91799 - DNA, 16 bp, H. sapiens
ctgggagggaggaagg

SEQ ID NO: 91800 - DNA, 16 bp, H. sapiens
ctgggagggagggaag

SEQ ID NO: 91801 - DNA, 16 bp, H. sapiens
ctgggaggggagagga

SEQ ID NO: 91802 - DNA, 16 bp, H. sapiens
ctgggaggggaggcag

SEQ ID NO: 91803 - DNA, 16 bp, H. sapiens
ctgggaggtccaggct

SEQ ID NO: 91804 - DNA, 16 bp, H. sapiens
ctgggaggtgaaggtt

SEQ ID NO: 91805 - DNA, 16 bp, H. sapiens
ctgggaggtggagatt

SEQ ID NO: 91806 - DNA, 16 bp, H. sapiens
ctgggaggtggagctg

SEQ ID NO: 91807 - DNA, 16 bp, H. sapiens
ctgggaggtggggagc

SEQ ID NO: 91808 - DNA, 16 bp, H. sapiens
ctgggagtacaggagc

SEQ ID NO: 91809 - DNA, 16 bp, H. sapiens
ctgggagtggctgctg

SEQ ID NO: 91810 - DNA, 16 bp, H. sapiens
ctgggagtggtggcag

SEQ ID NO: 91811 - DNA, 16 bp, H. sapiens
ctgggagttccaggct

SEQ ID NO: 91812 - DNA, 16 bp, H. sapiens
ctgggataacagacat

SEQ ID NO: 91813 - DNA, 16 bp, H. sapiens
ctgggatcagaggcat

SEQ ID NO: 91814 - DNA, 16 bp, H. sapiens
ctgggatctctgttct

SEQ ID NO: 91815 - DNA, 16 bp, H. sapiens
ctgggatctgaaccca

SEQ ID NO: 91816 - DNA, 16 bp, H. sapiens
ctgggatgacagatgc

SEQ ID NO: 91817 - DNA, 16 bp, H. sapiens
ctgggatgaggggtgc

SEQ ID NO: 91818 - DNA, 16 bp, H. sapiens
ctgggatgggggcagg

SEQ ID NO: 91819 - DNA, 16 bp, H. sapiens
ctgggattacaaagtg

SEQ ID NO: 91820 - DNA, 16 bp, H. sapiens
ctgggattacagaagt

SEQ ID NO: 91821 - DNA, 26 bp, H. sapiens
ctgggattacagacatgagccactgc

SEQ ID NO: 91822 - DNA, 16 bp, H. sapiens
ctgggattacagccat

SEQ ID NO: 91823 - DNA, 16 bp, H. sapiens
ctgggattacaggcga

SEQ ID NO: 91824 - DNA, 17 bp, H. sapiens
ctgggattacaggcgca

SEQ ID NO: 91825 - DNA, 18 bp, H. sapiens
ctgggattacaggcgcgc

SEQ ID NO: 91826 - DNA, 16 bp, H. sapiens
ctgggattacagggcc

SEQ ID NO: 91827 - DNA, 16 bp, H. sapiens
ctgggattacaggggc

SEQ ID NO: 91828 - DNA, 23 bp, H. sapiens
ctgggattacaggtgtgaaccac

SEQ ID NO: 91829 - DNA, 16 bp, H. sapiens
ctgggattacatatgt

SEQ ID NO: 91830 - DNA, 16 bp, H. sapiens
ctgggattacatgcat

SEQ ID NO: 91831 - DNA, 16 bp, H. sapiens
ctgggattacatttgt

SEQ ID NO: 91832 - DNA, 16 bp, H. sapiens
ctgggattagaggcac

SEQ ID NO: 91833 - DNA, 16 bp, H. sapiens
ctgggattataggcaa

SEQ ID NO: 91834 - DNA, 18 bp, H. sapiens
ctgggattataggcacga

SEQ ID NO: 91835 - DNA, 16 bp, H. sapiens
ctgggattatgggcac

SEQ ID NO: 91836 - DNA, 16 bp, H. sapiens
ctgggattcaaacctg

SEQ ID NO: 91837 - DNA, 16 bp, H. sapiens
ctgggattccaggtgt

SEQ ID NO: 91838 - DNA, 16 bp, H. sapiens
ctgggattctgcattt

SEQ ID NO: 91839 - DNA, 16 bp, H. sapiens
ctgggattctttttct

SEQ ID NO: 91840 - DNA, 24 bp, H. sapiens
ctgggattgcaggcgtgagccact

SEQ ID NO: 91841 - DNA, 16 bp, H. sapiens
ctgggattttccattt

SEQ ID NO: 91842 - DNA, 16 bp, H. sapiens
ctgggattttgactgg

SEQ ID NO: 91843 - DNA, 16 bp, H. sapiens
ctgggattttgattgg

SEQ ID NO: 91844 - DNA, 16 bp, H. sapiens
ctgggcaaaagagtga

SEQ ID NO: 91845 - DNA, 16 bp, H. sapiens
ctgggcaaaagggtga

SEQ ID NO: 91846 - DNA, 16 bp, H. sapiens
ctgggcaaaatagtga

SEQ ID NO: 91847 - DNA, 16 bp, H. sapiens
ctgggcaaaggtttct

SEQ ID NO: 91848 - DNA, 16 bp, H. sapiens
ctgggcaaagtggtga

SEQ ID NO: 91849 - DNA, 16 bp, H. sapiens
ctgggcaacagaagga

SEQ ID NO: 91850 - DNA, 16 bp, H. sapiens
ctgggcaacagagtga

SEQ ID NO: 91851 - DNA, 16 bp, H. sapiens
ctgggcaacagcaaga

SEQ ID NO: 91852 - DNA, 16 bp, H. sapiens
ctgggcaacagggtga

SEQ ID NO: 91853 - DNA, 16 bp, H. sapiens
ctgggcaacataatga

SEQ ID NO: 91854 - DNA, 16 bp, H. sapiens
ctgggcaacatagcag

SEQ ID NO: 91855 - DNA, 16 bp, H. sapiens
ctgggcaacatggcat

SEQ ID NO: 91856 - DNA, 16 bp, H. sapiens
ctgggcaacatgggga

SEQ ID NO: 91857 - DNA, 16 bp, H. sapiens
ctgggcaaccccaggc

SEQ ID NO: 91858 - DNA, 16 bp, H. sapiens
ctgggcaacgtagtga

SEQ ID NO: 91859 - DNA, 16 bp, H. sapiens
ctgggcaacgtggtga

SEQ ID NO: 91860 - DNA, 16 bp, H. sapiens
ctgggcaactgagtga

SEQ ID NO: 91861 - DNA, 16 bp, H. sapiens
ctgggcaacttggtga

SEQ ID NO: 91862 - DNA, 16 bp, H. sapiens
ctgggcaagaaagcaa

SEQ ID NO: 91863 - DNA, 16 bp, H. sapiens
ctgggcaagacagagc

SEQ ID NO: 91864 - DNA, 16 bp, H. sapiens
ctgggcaaggtggcat

SEQ ID NO: 91865 - DNA, 16 bp, H. sapiens
ctgggcaaggtggtgc

SEQ ID NO: 91866 - DNA, 16 bp, H. sapiens
ctgggcaatagagcag

SEQ ID NO: 91867 - DNA, 16 bp, H. sapiens
ctgggcaatatgttga

SEQ ID NO: 91868 - DNA, 16 bp, H. sapiens
ctgggcaatgaagtga

SEQ ID NO: 91869 - DNA, 16 bp, H. sapiens
ctgggcaatggagtga

SEQ ID NO: 91870 - DNA, 16 bp, H. sapiens
ctgggcaatgtaatga

SEQ ID NO: 91871 - DNA, 16 bp, H. sapiens
ctgggcaatttttgta

SEQ ID NO: 91872 - DNA, 16 bp, H. sapiens
ctgggcacaacagttt

SEQ ID NO: 91873 - DNA, 16 bp, H. sapiens
ctgggcacagcagctc

SEQ ID NO: 91874 - DNA, 16 bp, H. sapiens
ctgggcacagggcctg

SEQ ID NO: 91875 - DNA, 16 bp, H. sapiens
ctgggcacagtggctc

SEQ ID NO: 91876 - DNA, 16 bp, H. sapiens
ctgggcacagtggtgc

SEQ ID NO: 91877 - DNA, 16 bp, H. sapiens
ctgggcaccagagcaa

SEQ ID NO: 91878 - DNA, 16 bp, H. sapiens
ctgggcaccatggccc

SEQ ID NO: 91879 - DNA, 16 bp, H. sapiens
ctgggcaccatggctt

SEQ ID NO: 91880 - DNA, 16 bp, H. sapiens
ctgggcaccatggtga

SEQ ID NO: 91881 - DNA, 16 bp, H. sapiens
ctgggcacccacaggc

SEQ ID NO: 91882 - DNA, 16 bp, H. sapiens
ctgggcaccgtggagc

SEQ ID NO: 91883 - DNA, 16 bp, H. sapiens
ctgggcacggtggctc

SEQ ID NO: 91884 - DNA, 16 bp, H. sapiens
ctgggcactcagcagt

SEQ ID NO: 91885 - DNA, 16 bp, H. sapiens
ctgggcactgcagggt

SEQ ID NO: 91886 - DNA, 16 bp, H. sapiens
ctgggcactgtgccag

SEQ ID NO: 91887 - DNA, 16 bp, H. sapiens
ctgggcactgtggccc

SEQ ID NO: 91888 - DNA, 16 bp, H. sapiens
ctgggcactgtggctt

SEQ ID NO: 91889 - DNA, 16 bp, H. sapiens
ctgggcagaaggacca

SEQ ID NO: 91890 - DNA, 16 bp, H. sapiens
ctgggcagaagggggc

SEQ ID NO: 91891 - DNA, 16 bp, H. sapiens
ctgggcagaggcgccc

SEQ ID NO: 91892 - DNA, 16 bp, H. sapiens
ctgggcagaggctgca

SEQ ID NO: 91893 - DNA, 16 bp, H. sapiens
ctgggcagcaagagtg

SEQ ID NO: 91894 - DNA, 16 bp, H. sapiens
ctgggcagcagcagga

SEQ ID NO: 91895 - DNA, 16 bp, H. sapiens
ctgggcagcagcaggg

SEQ ID NO: 91896 - DNA, 16 bp, H. sapiens
ctgggcagcatagtga

SEQ ID NO: 91897 - DNA, 16 bp, H. sapiens
ctgggcaggacactcc

SEQ ID NO: 91898 - DNA, 16 bp, H. sapiens
ctgggcaggagctgag

SEQ ID NO: 91899 - DNA, 16 bp, H. sapiens
ctgggcagggaggggc

SEQ ID NO: 91900 - DNA, 16 bp, H. sapiens
ctgggcagggcagggg

SEQ ID NO: 91901 - DNA, 16 bp, H. sapiens
ctgggcagggctgggg

SEQ ID NO: 91902 - DNA, 16 bp, H. sapiens
ctgggcaggggaaggg

SEQ ID NO: 91903 - DNA, 16 bp, H. sapiens
ctgggcaggggcaggg

SEQ ID NO: 91904 - DNA, 16 bp, H. sapiens
ctgggcagggtggcag

SEQ ID NO: 91905 - DNA, 16 bp, H. sapiens
ctgggcagggtggggc

SEQ ID NO: 91906 - DNA, 16 bp, H. sapiens
ctgggcagtagtggca

SEQ ID NO: 91907 - DNA, 16 bp, H. sapiens
ctgggcagtatagtga

SEQ ID NO: 91908 - DNA, 16 bp, H. sapiens
ctgggcagtatggctt

SEQ ID NO: 91909 - DNA, 16 bp, H. sapiens
ctgggcagtggggagg

SEQ ID NO: 91910 - DNA, 16 bp, H. sapiens
ctgggcatagtggtgt

SEQ ID NO: 91911 - DNA, 16 bp, H. sapiens
ctgggcatcaagagtg

SEQ ID NO: 91912 - DNA, 16 bp, H. sapiens
ctgggcatcagtttcc

SEQ ID NO: 91913 - DNA, 16 bp, H. sapiens
ctgggcatcatggtga

SEQ ID NO: 91914 - DNA, 16 bp, H. sapiens
ctgggcatccctgtgc

SEQ ID NO: 91915 - DNA, 16 bp, H. sapiens
ctgggcatgatggtgg

SEQ ID NO: 91916 - DNA, 16 bp, H. sapiens
ctgggcatgctggcag

SEQ ID NO: 91917 - DNA, 16 bp, H. sapiens
ctgggcatggtagtgg

SEQ ID NO: 91918 - DNA, 16 bp, H. sapiens
ctgggcatggtggcat

SEQ ID NO: 91919 - DNA, 17 bp, H. sapiens
ctgggcatggtggtggg

SEQ ID NO: 91920 - DNA, 16 bp, H. sapiens
ctgggcatggtgtcac

SEQ ID NO: 91921 - DNA, 16 bp, H. sapiens
ctgggcatgtctgtga

SEQ ID NO: 91922 - DNA, 16 bp, H. sapiens
ctgggcatgtggctca

SEQ ID NO: 91923 - DNA, 16 bp, H. sapiens
ctgggcattgtggtgg

SEQ ID NO: 91924 - DNA, 16 bp, H. sapiens
ctgggcatttattcca

SEQ ID NO: 91925 - DNA, 16 bp, H. sapiens
ctgggccacagaacaa

SEQ ID NO: 91926 - DNA, 16 bp, H. sapiens
ctgggccacagtttcc

SEQ ID NO: 91927 - DNA, 16 bp, H. sapiens
ctgggccacatggtaa

SEQ ID NO: 91928 - DNA, 16 bp, H. sapiens
ctgggccaccaggggt

SEQ ID NO: 91929 - DNA, 16 bp, H. sapiens
ctgggccagccctgcc

SEQ ID NO: 91930 - DNA, 16 bp, H. sapiens
ctgggccaggcctggt

SEQ ID NO: 91931 - DNA, 16 bp, H. sapiens
ctgggccagggctggg

SEQ ID NO: 91932 - DNA, 16 bp, H. sapiens
ctgggccaggtccagg

SEQ ID NO: 91933 - DNA, 16 bp, H. sapiens
ctgggccaggtgctgg

SEQ ID NO: 91934 - DNA, 16 bp, H. sapiens
ctgggccagtggctgc

SEQ ID NO: 91935 - DNA, 16 bp, H. sapiens
ctgggcccacaggcac

SEQ ID NO: 91936 - DNA, 16 bp, H. sapiens
ctgggcccagagacag

SEQ ID NO: 91937 - DNA, 16 bp, H. sapiens
ctgggcccagcccagg

SEQ ID NO: 91938 - DNA, 16 bp, H. sapiens
ctgggcccagccccag

SEQ ID NO: 91939 - DNA, 16 bp, H. sapiens
ctgggcccaggaggtc

SEQ ID NO: 91940 - DNA, 16 bp, H. sapiens
ctgggcccaggagttt

SEQ ID NO: 91941 - DNA, 16 bp, H. sapiens
ctgggcccaggctggg

SEQ ID NO: 91942 - DNA, 16 bp, H. sapiens
ctgggccccacccctg

SEQ ID NO: 91943 - DNA, 16 bp, H. sapiens
ctgggccccacctcca

SEQ ID NO: 91944 - DNA, 16 bp, H. sapiens
ctgggccccacctgcc

SEQ ID NO: 91945 - DNA, 16 bp, H. sapiens
ctgggccccactccca

SEQ ID NO: 91946 - DNA, 16 bp, H. sapiens
ctgggccccacttcca

SEQ ID NO: 91947 - DNA, 16 bp, H. sapiens
ctgggccccagggagg

SEQ ID NO: 91948 - DNA, 16 bp, H. sapiens
ctgggcccccagaagg

SEQ ID NO: 91949 - DNA, 16 bp, H. sapiens
ctgggcccctcctcca

SEQ ID NO: 91950 - DNA, 16 bp, H. sapiens
ctgggccctgcccaca

SEQ ID NO: 91951 - DNA, 16 bp, H. sapiens
ctgggccctgccctca

SEQ ID NO: 91952 - DNA, 16 bp, H. sapiens
ctgggccctgccctcc

SEQ ID NO: 91953 - DNA, 16 bp, H. sapiens
ctgggccctgccctgc

SEQ ID NO: 91954 - DNA, 16 bp, H. sapiens
ctgggccctgcctggg

SEQ ID NO: 91955 - DNA, 16 bp, H. sapiens
ctgggccctggccctg

SEQ ID NO: 91956 - DNA, 16 bp, H. sapiens
ctgggccctgggccag

SEQ ID NO: 91957 - DNA, 16 bp, H. sapiens
ctgggccctgggggag

SEQ ID NO: 91958 - DNA, 16 bp, H. sapiens
ctgggcctcaattttc

SEQ ID NO: 91959 - DNA, 16 bp, H. sapiens
ctgggcctcaccccca

SEQ ID NO: 91960 - DNA, 16 bp, H. sapiens
ctgggcctcactttcc

SEQ ID NO: 91961 - DNA, 16 bp, H. sapiens
ctgggcctcagcctcc

SEQ ID NO: 91962 - DNA, 16 bp, H. sapiens
ctgggcctcagctttc

SEQ ID NO: 91963 - DNA, 16 bp, H. sapiens
ctgggcctcagtttcc

SEQ ID NO: 91964 - DNA, 16 bp, H. sapiens
ctgggcctccaggcct

SEQ ID NO: 91965 - DNA, 16 bp, H. sapiens
ctgggcctcccaaagc

SEQ ID NO: 91966 - DNA, 16 bp, H. sapiens
ctgggcctccgtttcc

SEQ ID NO: 91967 - DNA, 16 bp, H. sapiens
ctgggcctcctgcctc

SEQ ID NO: 91968 - DNA, 16 bp, H. sapiens
ctgggcctcctgggct

SEQ ID NO: 91969 - DNA, 16 bp, H. sapiens
ctgggcctcggtttcc

SEQ ID NO: 91970 - DNA, 16 bp, H. sapiens
ctgggcctctcaaagt

SEQ ID NO: 91971 - DNA, 16 bp, H. sapiens
ctgggcctctgatggg

SEQ ID NO: 91972 - DNA, 16 bp, H. sapiens
ctgggcctgagaaggg

SEQ ID NO: 91973 - DNA, 16 bp, H. sapiens
ctgggcctgagcccct

SEQ ID NO: 91974 - DNA, 16 bp, H. sapiens
ctgggcctggagaagc

SEQ ID NO: 91975 - DNA, 16 bp, H. sapiens
ctgggcctggccctca

SEQ ID NO: 91976 - DNA, 16 bp, H. sapiens
ctgggcctggcctggc

SEQ ID NO: 91977 - DNA, 16 bp, H. sapiens
ctgggcctggcctggg

SEQ ID NO: 91978 - DNA, 16 bp, H. sapiens
ctgggcctgggccagg

SEQ ID NO: 91979 - DNA, 16 bp, H. sapiens
ctgggcctgggcctgc

SEQ ID NO: 91980 - DNA, 16 bp, H. sapiens
ctgggcctgggcctgg

SEQ ID NO: 91981 - DNA, 16 bp, H. sapiens
ctgggcctgggctggg

SEQ ID NO: 91982 - DNA, 16 bp, H. sapiens
ctgggcctggggctgg

SEQ ID NO: 91983 - DNA, 16 bp, H. sapiens
ctgggcctggtggcag

SEQ ID NO: 91984 - DNA, 16 bp, H. sapiens
ctgggcctggtggcat

SEQ ID NO: 91985 - DNA, 16 bp, H. sapiens
ctgggcctggtggtgt

SEQ ID NO: 91986 - DNA, 16 bp, H. sapiens
ctgggcctgttttctc

SEQ ID NO: 91987 - DNA, 16 bp, H. sapiens
ctgggcctttgcactt

SEQ ID NO: 91988 - DNA, 16 bp, H. sapiens
ctgggcgacagagaga

SEQ ID NO: 91989 - DNA, 16 bp, H. sapiens
ctgggcgacagagcct

SEQ ID NO: 91990 - DNA, 16 bp, H. sapiens
ctgggcgcaggggctc

SEQ ID NO: 91991 - DNA, 17 bp, H. sapiens
ctgggcgcagtggctca

SEQ ID NO: 91992 - DNA, 16 bp, H. sapiens
ctgggcgcagtggtgc

SEQ ID NO: 91993 - DNA, 16 bp, H. sapiens
ctgggcgccatggagc

SEQ ID NO: 91994 - DNA, 17 bp, H. sapiens
ctgggcgccgtggctca

SEQ ID NO: 91995 - DNA, 16 bp, H. sapiens
ctgggcgtcgtggtgc

SEQ ID NO: 91996 - DNA, 16 bp, H. sapiens
ctgggcgtgctggtgc

SEQ ID NO: 91997 - DNA, 16 bp, H. sapiens
ctgggcgtggtggcga

SEQ ID NO: 91998 - DNA, 16 bp, H. sapiens
ctgggcgtggtggtcc

SEQ ID NO: 91999 - DNA, 16 bp, H. sapiens
ctgggctaaagcaatc

SEQ ID NO: 92000 - DNA, 16 bp, H. sapiens
ctgggctcaaattcca

SEQ ID NO: 92001 - DNA, 16 bp, H. sapiens
ctgggctcaagagacc

SEQ ID NO: 92002 - DNA, 16 bp, H. sapiens
ctgggctcaagccaac

SEQ ID NO: 92003 - DNA, 16 bp, H. sapiens
ctgggctcaaggaaca

SEQ ID NO: 92004 - DNA, 16 bp, H. sapiens
ctgggctcaaggaatc

SEQ ID NO: 92005 - DNA, 22 bp, H. sapiens
ctgggctcaagtgatcctcccg

SEQ ID NO: 92006 - DNA, 16 bp, H. sapiens
ctgggctcacacctgt

SEQ ID NO: 92007 - DNA, 16 bp, H. sapiens
ctgggctcactgcagg

SEQ ID NO: 92008 - DNA, 16 bp, H. sapiens
ctgggctcagagccag

SEQ ID NO: 92009 - DNA, 16 bp, H. sapiens
ctgggctcaggcagtc

SEQ ID NO: 92010 - DNA, 16 bp, H. sapiens
ctgggctcagtggcac

SEQ ID NO: 92011 - DNA, 16 bp, H. sapiens
ctgggctccaccccca

SEQ ID NO: 92012 - DNA, 16 bp, H. sapiens
ctgggctccagccatc

SEQ ID NO: 92013 - DNA, 16 bp, H. sapiens
ctgggctccagcctgg

SEQ ID NO: 92014 - DNA, 16 bp, H. sapiens
ctgggctcccaaggcc

SEQ ID NO: 92015 - DNA, 16 bp, H. sapiens
ctgggctccgtggctc

SEQ ID NO: 92016 - DNA, 16 bp, H. sapiens
ctgggctccgtggggg

SEQ ID NO: 92017 - DNA, 16 bp, H. sapiens
ctgggctcctgcctca

SEQ ID NO: 92018 - DNA, 16 bp, H. sapiens
ctgggctctgcacagg

SEQ ID NO: 92019 - DNA, 16 bp, H. sapiens
ctgggctctggctggg

SEQ ID NO: 92020 - DNA, 16 bp, H. sapiens
ctgggctctgggaagg

SEQ ID NO: 92021 - DNA, 16 bp, H. sapiens
ctgggctctgggctca

SEQ ID NO: 92022 - DNA, 16 bp, H. sapiens
ctgggctctgggctgg

SEQ ID NO: 92023 - DNA, 16 bp, H. sapiens
ctgggctctggggctg

SEQ ID NO: 92024 - DNA, 16 bp, H. sapiens
ctgggctctgtggctc

SEQ ID NO: 92025 - DNA, 16 bp, H. sapiens
ctgggctgaagtgatc

SEQ ID NO: 92026 - DNA, 16 bp, H. sapiens
ctgggctgcaatgtgg

SEQ ID NO: 92027 - DNA, 16 bp, H. sapiens
ctgggctgcacagcag

SEQ ID NO: 92028 - DNA, 16 bp, H. sapiens
ctgggctgcttatctt

SEQ ID NO: 92029 - DNA, 16 bp, H. sapiens
ctgggctggaagctct

SEQ ID NO: 92030 - DNA, 16 bp, H. sapiens
ctgggctggagagcag

SEQ ID NO: 92031 - DNA, 16 bp, H. sapiens
ctgggctggagtgcac

SEQ ID NO: 92032 - DNA, 16 bp, H. sapiens
ctgggctggagttcag

SEQ ID NO: 92033 - DNA, 16 bp, H. sapiens
ctgggctggattttta

SEQ ID NO: 92034 - DNA, 16 bp, H. sapiens
ctgggctggccctgcc

SEQ ID NO: 92035 - DNA, 16 bp, H. sapiens
ctgggctggcctgggc

SEQ ID NO: 92036 - DNA, 16 bp, H. sapiens
ctgggctggctgaggc

SEQ ID NO: 92037 - DNA, 16 bp, H. sapiens
ctgggctggctggctg

SEQ ID NO: 92038 - DNA, 16 bp, H. sapiens
ctgggctgggaggcag

SEQ ID NO: 92039 - DNA, 16 bp, H. sapiens
ctgggctgggccaggc

SEQ ID NO: 92040 - DNA, 16 bp, H. sapiens
ctgggctgggcctggg

SEQ ID NO: 92041 - DNA, 16 bp, H. sapiens
ctgggctgggctgagc

SEQ ID NO: 92042 - DNA, 16 bp, H. sapiens
ctgggctgggctggac

SEQ ID NO: 92043 - DNA, 16 bp, H. sapiens
ctgggctgggctggag

SEQ ID NO: 92044 - DNA, 16 bp, H. sapiens
ctgggctgggctggct

SEQ ID NO: 92045 - DNA, 16 bp, H. sapiens
ctgggctgggctgggt

SEQ ID NO: 92046 - DNA, 16 bp, H. sapiens
ctgggctggggatggg

SEQ ID NO: 92047 - DNA, 16 bp, H. sapiens
ctgggctggggcaggg

SEQ ID NO: 92048 - DNA, 16 bp, H. sapiens
ctgggctggggcctgg

SEQ ID NO: 92049 - DNA, 16 bp, H. sapiens
ctgggctggggtgcag

SEQ ID NO: 92050 - DNA, 16 bp, H. sapiens
ctgggctggtgctggg

SEQ ID NO: 92051 - DNA, 16 bp, H. sapiens
ctgggctggtggctca

SEQ ID NO: 92052 - DNA, 16 bp, H. sapiens
ctgggctggttttgaa

SEQ ID NO: 92053 - DNA, 16 bp, H. sapiens
ctgggctgtctattct

SEQ ID NO: 92054 - DNA, 16 bp, H. sapiens
ctgggcttcagtttcc

SEQ ID NO: 92055 - DNA, 16 bp, H. sapiens
ctgggcttcagttttt

SEQ ID NO: 92056 - DNA, 16 bp, H. sapiens
ctgggcttccagagct

SEQ ID NO: 92057 - DNA, 16 bp, H. sapiens
ctgggcttgagcagtc

SEQ ID NO: 92058 - DNA, 16 bp, H. sapiens
ctgggcttggagccag

SEQ ID NO: 92059 - DNA, 16 bp, H. sapiens
ctgggcttggccatgt

SEQ ID NO: 92060 - DNA, 16 bp, H. sapiens
ctgggcttggtgatgc

SEQ ID NO: 92061 - DNA, 16 bp, H. sapiens
ctgggctttgaaccca

SEQ ID NO: 92062 - DNA, 16 bp, H. sapiens
ctgggctttgaaggat

SEQ ID NO: 92063 - DNA, 16 bp, H. sapiens
ctgggctttggtggaa

SEQ ID NO: 92064 - DNA, 16 bp, H. sapiens
ctggggaaaggagaga

SEQ ID NO: 92065 - DNA, 16 bp, H. sapiens
ctggggaacagagcca

SEQ ID NO: 92066 - DNA, 16 bp, H. sapiens
ctggggaacttttaaa

SEQ ID NO: 92067 - DNA, 16 bp, H. sapiens
ctggggaaggaaggag

SEQ ID NO: 92068 - DNA, 16 bp, H. sapiens
ctggggaaggagggaa

SEQ ID NO: 92069 - DNA, 16 bp, H. sapiens
ctggggaaggcagacc

SEQ ID NO: 92070 - DNA, 16 bp, H. sapiens
ctggggacacagagcc

SEQ ID NO: 92071 - DNA, 16 bp, H. sapiens
ctggggacacagaggt

SEQ ID NO: 92072 - DNA, 16 bp, H. sapiens
ctggggacagggaggg

SEQ ID NO: 92073 - DNA, 16 bp, H. sapiens
ctggggacagggtggg

SEQ ID NO: 92074 - DNA, 16 bp, H. sapiens
ctggggacccagggag

SEQ ID NO: 92075 - DNA, 16 bp, H. sapiens
ctggggaccccaagag

SEQ ID NO: 92076 - DNA, 16 bp, H. sapiens
ctggggaccccttccc

SEQ ID NO: 92077 - DNA, 16 bp, H. sapiens
ctggggactaccagag

SEQ ID NO: 92078 - DNA, 16 bp, H. sapiens
ctggggactggggagg

SEQ ID NO: 92079 - DNA, 16 bp, H. sapiens
ctggggactgtcgtgg

SEQ ID NO: 92080 - DNA, 16 bp, H. sapiens
ctggggactgttttgg

SEQ ID NO: 92081 - DNA, 16 bp, H. sapiens
ctggggagaaagggaa

SEQ ID NO: 92082 - DNA, 16 bp, H. sapiens
ctggggagaagggaga

SEQ ID NO: 92083 - DNA, 16 bp, H. sapiens
ctggggagagaggaag

SEQ ID NO: 92084 - DNA, 16 bp, H. sapiens
ctggggagagagggga

SEQ ID NO: 92085 - DNA, 16 bp, H. sapiens
ctggggagcagggagg

SEQ ID NO: 92086 - DNA, 16 bp, H. sapiens
ctggggagccctcagg

SEQ ID NO: 92087 - DNA, 16 bp, H. sapiens
ctggggaggaggagga

SEQ ID NO: 92088 - DNA, 16 bp, H. sapiens
ctggggaggagggcag

SEQ ID NO: 92089 - DNA, 16 bp, H. sapiens
ctggggaggcagagct

SEQ ID NO: 92090 - DNA, 16 bp, H. sapiens
ctggggaggcagaggc

SEQ ID NO: 92091 - DNA, 16 bp, H. sapiens
ctggggaggccacagg

SEQ ID NO: 92092 - DNA, 16 bp, H. sapiens
ctggggaggccccagg

SEQ ID NO: 92093 - DNA, 16 bp, H. sapiens
ctggggaggccgcagg

SEQ ID NO: 92094 - DNA, 16 bp, H. sapiens
ctggggaggcctcagg

SEQ ID NO: 92095 - DNA, 16 bp, H. sapiens
ctggggaggcctccca

SEQ ID NO: 92096 - DNA, 16 bp, H. sapiens
ctggggaggcctccgg

SEQ ID NO: 92097 - DNA, 16 bp, H. sapiens
ctggggaggcctcggg

SEQ ID NO: 92098 - DNA, 16 bp, H. sapiens
ctggggaggctgagac

SEQ ID NO: 92099 - DNA, 16 bp, H. sapiens
ctggggaggctgaggc

SEQ ID NO: 92100 - DNA, 16 bp, H. sapiens
ctggggaggctgcagc

SEQ ID NO: 92101 - DNA, 16 bp, H. sapiens
ctggggaggctgcagg

SEQ ID NO: 92102 - DNA, 16 bp, H. sapiens
ctggggagggaagagg

SEQ ID NO: 92103 - DNA, 16 bp, H. sapiens
ctggggagggagagca

SEQ ID NO: 92104 - DNA, 16 bp, H. sapiens
ctggggaggggagaag

SEQ ID NO: 92105 - DNA, 16 bp, H. sapiens
ctggggaggggcaagg

SEQ ID NO: 92106 - DNA, 16 bp, H. sapiens
ctggggaggggctgcc

SEQ ID NO: 92107 - DNA, 16 bp, H. sapiens
ctggggagggggctgc

SEQ ID NO: 92108 - DNA, 16 bp, H. sapiens
ctggggaggtagaggc

SEQ ID NO: 92109 - DNA, 16 bp, H. sapiens
ctggggaggtcaaggc

SEQ ID NO: 92110 - DNA, 16 bp, H. sapiens
ctggggaggtggaggc

SEQ ID NO: 92111 - DNA, 16 bp, H. sapiens
ctggggaggtggaggt

SEQ ID NO: 92112 - DNA, 16 bp, H. sapiens
ctggggaggtgtcagg

SEQ ID NO: 92113 - DNA, 16 bp, H. sapiens
ctggggaggtttggcc

SEQ ID NO: 92114 - DNA, 16 bp, H. sapiens
ctggggagtcatgccc

SEQ ID NO: 92115 - DNA, 16 bp, H. sapiens
ctggggagtctgaggt

SEQ ID NO: 92116 - DNA, 16 bp, H. sapiens
ctggggatacagcagt

SEQ ID NO: 92117 - DNA, 16 bp, H. sapiens
ctggggatagaaggaa

SEQ ID NO: 92118 - DNA, 16 bp, H. sapiens
ctggggatcttgttaa

SEQ ID NO: 92119 - DNA, 16 bp, H. sapiens
ctggggatgcctcagg

SEQ ID NO: 92120 - DNA, 16 bp, H. sapiens
ctggggatggggcagg

SEQ ID NO: 92121 - DNA, 16 bp, H. sapiens
ctggggatggggccca

SEQ ID NO: 92122 - DNA, 16 bp, H. sapiens
ctggggatggtggcac

SEQ ID NO: 92123 - DNA, 16 bp, H. sapiens
ctggggattttttttt

SEQ ID NO: 92124 - DNA, 16 bp, H. sapiens
ctggggcaacagagtg

SEQ ID NO: 92125 - DNA, 16 bp, H. sapiens
ctggggcaatgttaat

SEQ ID NO: 92126 - DNA, 16 bp, H. sapiens
ctggggcacagagaag

SEQ ID NO: 92127 - DNA, 16 bp, H. sapiens
ctggggcagaaggatc

SEQ ID NO: 92128 - DNA, 16 bp, H. sapiens
ctggggcagagctggg

SEQ ID NO: 92129 - DNA, 16 bp, H. sapiens
ctggggcagaggcagg

SEQ ID NO: 92130 - DNA, 16 bp, H. sapiens
ctggggcaggaagggg

SEQ ID NO: 92131 - DNA, 16 bp, H. sapiens
ctggggcaggaggagg

SEQ ID NO: 92132 - DNA, 16 bp, H. sapiens
ctggggcaggaggatc

SEQ ID NO: 92133 - DNA, 16 bp, H. sapiens
ctggggcaggaggatg

SEQ ID NO: 92134 - DNA, 16 bp, H. sapiens
ctggggcaggcaggag

SEQ ID NO: 92135 - DNA, 16 bp, H. sapiens
ctggggcaggcagggc

SEQ ID NO: 92136 - DNA, 16 bp, H. sapiens
ctggggcagggaaaat

SEQ ID NO: 92137 - DNA, 16 bp, H. sapiens
ctggggcagggcccag

SEQ ID NO: 92138 - DNA, 16 bp, H. sapiens
ctggggcagggcctgg

SEQ ID NO: 92139 - DNA, 16 bp, H. sapiens
ctggggcagggctggg

SEQ ID NO: 92140 - DNA, 16 bp, H. sapiens
ctggggcaggggaagg

SEQ ID NO: 92141 - DNA, 16 bp, H. sapiens
ctggggcaggggagag

SEQ ID NO: 92142 - DNA, 16 bp, H. sapiens
ctggggcagtgcagaa

SEQ ID NO: 92143 - DNA, 16 bp, H. sapiens
ctggggccacaggtgc

SEQ ID NO: 92144 - DNA, 16 bp, H. sapiens
ctggggccacaggtgg

SEQ ID NO: 92145 - DNA, 16 bp, H. sapiens
ctggggccagcagggc

SEQ ID NO: 92146 - DNA, 16 bp, H. sapiens
ctggggccaggccctg

SEQ ID NO: 92147 - DNA, 16 bp, H. sapiens
ctggggccaggcgcgg

SEQ ID NO: 92148 - DNA, 16 bp, H. sapiens
ctggggccaggctgcc

SEQ ID NO: 92149 - DNA, 16 bp, H. sapiens
ctggggccaggctggg

SEQ ID NO: 92150 - DNA, 16 bp, H. sapiens
ctggggccagggcagg

SEQ ID NO: 92151 - DNA, 16 bp, H. sapiens
ctggggccagggccag

SEQ ID NO: 92152 - DNA, 16 bp, H. sapiens
ctggggccaggtgcag

SEQ ID NO: 92153 - DNA, 16 bp, H. sapiens
ctggggcccagcccca

SEQ ID NO: 92154 - DNA, 16 bp, H. sapiens
ctggggcccaggcagg

SEQ ID NO: 92155 - DNA, 16 bp, H. sapiens
ctggggccccaggaga

SEQ ID NO: 92156 - DNA, 16 bp, H. sapiens
ctggggccccttcctc

SEQ ID NO: 92157 - DNA, 16 bp, H. sapiens
ctggggccctgggctg

SEQ ID NO: 92158 - DNA, 16 bp, H. sapiens
ctggggcctaataaaa

SEQ ID NO: 92159 - DNA, 16 bp, H. sapiens
ctggggcctatgggag

SEQ ID NO: 92160 - DNA, 16 bp, H. sapiens
ctggggcctcaggagc

SEQ ID NO: 92161 - DNA, 16 bp, H. sapiens
ctggggcctggaggag

SEQ ID NO: 92162 - DNA, 16 bp, H. sapiens
ctggggcctggaggat

SEQ ID NO: 92163 - DNA, 16 bp, H. sapiens
ctggggcctgggcctg

SEQ ID NO: 92164 - DNA, 16 bp, H. sapiens
ctggggcctgtgcatg

SEQ ID NO: 92165 - DNA, 16 bp, H. sapiens
ctggggcctgttgggg

SEQ ID NO: 92166 - DNA, 16 bp, H. sapiens
ctggggctacaggtga

SEQ ID NO: 92167 - DNA, 16 bp, H. sapiens
ctggggctacaggtgc

SEQ ID NO: 92168 - DNA, 16 bp, H. sapiens
ctggggctcatgcctg

SEQ ID NO: 92169 - DNA, 16 bp, H. sapiens
ctggggctctacaatt

SEQ ID NO: 92170 - DNA, 16 bp, H. sapiens
ctggggctctggggct

SEQ ID NO: 92171 - DNA, 16 bp, H. sapiens
ctggggctgcaggtgc

SEQ ID NO: 92172 - DNA, 16 bp, H. sapiens
ctggggctgcaggtgg

SEQ ID NO: 92173 - DNA, 16 bp, H. sapiens
ctggggctgcaggtgt

SEQ ID NO: 92174 - DNA, 16 bp, H. sapiens
ctggggctgcagtcac

SEQ ID NO: 92175 - DNA, 16 bp, H. sapiens
ctggggctgccagaag

SEQ ID NO: 92176 - DNA, 16 bp, H. sapiens
ctggggctgctggagg

SEQ ID NO: 92177 - DNA, 16 bp, H. sapiens
ctggggctgctgtggg

SEQ ID NO: 92178 - DNA, 16 bp, H. sapiens
ctggggctggagctgg

SEQ ID NO: 92179 - DNA, 16 bp, H. sapiens
ctggggctggcagagg

SEQ ID NO: 92180 - DNA, 16 bp, H. sapiens
ctggggctggctgagg

SEQ ID NO: 92181 - DNA, 16 bp, H. sapiens
ctggggctgggagagg

SEQ ID NO: 92182 - DNA, 16 bp, H. sapiens
ctggggctgggagcag

SEQ ID NO: 92183 - DNA, 16 bp, H. sapiens
ctggggctgggcacag

SEQ ID NO: 92184 - DNA, 16 bp, H. sapiens
ctggggctgggcccag

SEQ ID NO: 92185 - DNA, 16 bp, H. sapiens
ctggggctgggctctg

SEQ ID NO: 92186 - DNA, 16 bp, H. sapiens
ctggggctgggctgag

SEQ ID NO: 92187 - DNA, 16 bp, H. sapiens
ctggggctggggaagg

SEQ ID NO: 92188 - DNA, 16 bp, H. sapiens
ctggggctggggatgg

SEQ ID NO: 92189 - DNA, 16 bp, H. sapiens
ctggggctggggccag

SEQ ID NO: 92190 - DNA, 16 bp, H. sapiens
ctggggctggggccca

SEQ ID NO: 92191 - DNA, 16 bp, H. sapiens
ctggggctgggggcag

SEQ ID NO: 92192 - DNA, 16 bp, H. sapiens
ctggggctgtgtgtgt

SEQ ID NO: 92193 - DNA, 16 bp, H. sapiens
ctggggcttatcagag

SEQ ID NO: 92194 - DNA, 16 bp, H. sapiens
ctggggcttggtttcc

SEQ ID NO: 92195 - DNA, 16 bp, H. sapiens
ctggggctttctctgc

SEQ ID NO: 92196 - DNA, 16 bp, H. sapiens
ctgggggaaaaaaaat

SEQ ID NO: 92197 - DNA, 16 bp, H. sapiens
ctgggggaagaggaaa

SEQ ID NO: 92198 - DNA, 16 bp, H. sapiens
ctgggggaagaggaga

SEQ ID NO: 92199 - DNA, 16 bp, H. sapiens
ctgggggaagggacag

SEQ ID NO: 92200 - DNA, 16 bp, H. sapiens
ctgggggaagggggaa

SEQ ID NO: 92201 - DNA, 16 bp, H. sapiens
ctgggggacagagaaa

SEQ ID NO: 92202 - DNA, 16 bp, H. sapiens
ctgggggacagagaga

SEQ ID NO: 92203 - DNA, 16 bp, H. sapiens
ctgggggacccggtgc

SEQ ID NO: 92204 - DNA, 16 bp, H. sapiens
ctgggggacctggcgc

SEQ ID NO: 92205 - DNA, 16 bp, H. sapiens
ctgggggacctggtgc

SEQ ID NO: 92206 - DNA, 16 bp, H. sapiens
ctgggggagaggagag

SEQ ID NO: 92207 - DNA, 16 bp, H. sapiens
ctgggggaggagagag

SEQ ID NO: 92208 - DNA, 16 bp, H. sapiens
ctgggggaggcagagg

SEQ ID NO: 92209 - DNA, 16 bp, H. sapiens
ctgggggaggctgagg

SEQ ID NO: 92210 - DNA, 16 bp, H. sapiens
ctgggggagggacttg

SEQ ID NO: 92211 - DNA, 16 bp, H. sapiens
ctgggggaggggagcc

SEQ ID NO: 92212 - DNA, 16 bp, H. sapiens
ctgggggaggggcgcc

SEQ ID NO: 92213 - DNA, 16 bp, H. sapiens
ctgggggatgctgaag

SEQ ID NO: 92214 - DNA, 16 bp, H. sapiens
ctgggggcaggcaggg

SEQ ID NO: 92215 - DNA, 16 bp, H. sapiens
ctgggggcagggcaga

SEQ ID NO: 92216 - DNA, 16 bp, H. sapiens
ctgggggcagggctgg

SEQ ID NO: 92217 - DNA, 16 bp, H. sapiens
ctgggggcagtggctc

SEQ ID NO: 92218 - DNA, 16 bp, H. sapiens
ctgggggcgctgcagg

SEQ ID NO: 92219 - DNA, 16 bp, H. sapiens
ctgggggctcctgtat

SEQ ID NO: 92220 - DNA, 16 bp, H. sapiens
ctgggggctggaggga

SEQ ID NO: 92221 - DNA, 16 bp, H. sapiens
ctgggggctgggaagg

SEQ ID NO: 92222 - DNA, 16 bp, H. sapiens
ctgggggctgggagga

SEQ ID NO: 92223 - DNA, 16 bp, H. sapiens
ctgggggctgggctgc

SEQ ID NO: 92224 - DNA, 16 bp, H. sapiens
ctgggggctgtggcag

SEQ ID NO: 92225 - DNA, 16 bp, H. sapiens
ctgggggctgtggctc

SEQ ID NO: 92226 - DNA, 16 bp, H. sapiens
ctggggggcagtggtg

SEQ ID NO: 92227 - DNA, 16 bp, H. sapiens
ctgggggggcctcagg

SEQ ID NO: 92228 - DNA, 16 bp, H. sapiens
ctggggggtgcctccc

SEQ ID NO: 92229 - DNA, 16 bp, H. sapiens
ctgggggtccactcca

SEQ ID NO: 92230 - DNA, 16 bp, H. sapiens
ctgggggtcctggaac

SEQ ID NO: 92231 - DNA, 16 bp, H. sapiens
ctgggggtgctgcagg

SEQ ID NO: 92232 - DNA, 16 bp, H. sapiens
ctgggggtggcaggag

SEQ ID NO: 92233 - DNA, 16 bp, H. sapiens
ctgggggtggggacag

SEQ ID NO: 92234 - DNA, 16 bp, H. sapiens
ctgggggtgggtctct

SEQ ID NO: 92235 - DNA, 16 bp, H. sapiens
ctgggggtggtggcat

SEQ ID NO: 92236 - DNA, 16 bp, H. sapiens
ctggggtacgaaaaaa

SEQ ID NO: 92237 - DNA, 16 bp, H. sapiens
ctggggtatttatcca

SEQ ID NO: 92238 - DNA, 16 bp, H. sapiens
ctggggtgaggcccag

SEQ ID NO: 92239 - DNA, 16 bp, H. sapiens
ctggggtgcagtggtg

SEQ ID NO: 92240 - DNA, 16 bp, H. sapiens
ctggggtggctgaggt

SEQ ID NO: 92241 - DNA, 16 bp, H. sapiens
ctggggtgggaagatt

SEQ ID NO: 92242 - DNA, 16 bp, H. sapiens
ctggggtgggagtgtg

SEQ ID NO: 92243 - DNA, 16 bp, H. sapiens
ctggggtggggaagga

SEQ ID NO: 92244 - DNA, 16 bp, H. sapiens
ctggggtggggacagg

SEQ ID NO: 92245 - DNA, 16 bp, H. sapiens
ctggggtggggactgg

SEQ ID NO: 92246 - DNA, 18 bp, H. sapiens
ctggggttacaggcgtgc

SEQ ID NO: 92247 - DNA, 16 bp, H. sapiens
ctggggttacatgtgt

SEQ ID NO: 92248 - DNA, 16 bp, H. sapiens
ctggggttgggagagg

SEQ ID NO: 92249 - DNA, 16 bp, H. sapiens
ctggggttgggggtga

SEQ ID NO: 92250 - DNA, 16 bp, H. sapiens
ctgggtaacaaagtga

SEQ ID NO: 92251 - DNA, 16 bp, H. sapiens
ctgggtaacacagcaa

SEQ ID NO: 92252 - DNA, 16 bp, H. sapiens
ctgggtaacagagcca

SEQ ID NO: 92253 - DNA, 16 bp, H. sapiens
ctgggtaatttataaa

SEQ ID NO: 92254 - DNA, 16 bp, H. sapiens
ctgggtaatttctaaa

SEQ ID NO: 92255 - DNA, 16 bp, H. sapiens
ctgggtaatttgtaga

SEQ ID NO: 92256 - DNA, 16 bp, H. sapiens
ctgggtagcaggcaga

SEQ ID NO: 92257 - DNA, 16 bp, H. sapiens
ctgggtagtttataaa

SEQ ID NO: 92258 - DNA, 16 bp, H. sapiens
ctgggtatagaaggaa

SEQ ID NO: 92259 - DNA, 16 bp, H. sapiens
ctgggtatattttgaa

SEQ ID NO: 92260 - DNA, 16 bp, H. sapiens
ctgggtatgtctgtga

SEQ ID NO: 92261 - DNA, 16 bp, H. sapiens
ctgggtcaaatggtag

SEQ ID NO: 92262 - DNA, 19 bp, H. sapiens
ctgggtcaaatggtatttc

SEQ ID NO: 92263 - DNA, 16 bp, H. sapiens
ctgggtcaaatggtgt

SEQ ID NO: 92264 - DNA, 16 bp, H. sapiens
ctgggtcacacctgaa

SEQ ID NO: 92265 - DNA, 16 bp, H. sapiens
ctgggtcagagacaaa

SEQ ID NO: 92266 - DNA, 16 bp, H. sapiens
ctgggtcagaggggag

SEQ ID NO: 92267 - DNA, 16 bp, H. sapiens
ctgggtcaggtgggga

SEQ ID NO: 92268 - DNA, 16 bp, H. sapiens
ctgggtcatatgacaa

SEQ ID NO: 92269 - DNA, 16 bp, H. sapiens
ctgggtcatatggaaa

SEQ ID NO: 92270 - DNA, 16 bp, H. sapiens
ctgggtccagggcccc

SEQ ID NO: 92271 - DNA, 16 bp, H. sapiens
ctgggtccctcccact

SEQ ID NO: 92272 - DNA, 16 bp, H. sapiens
ctgggtccctgaatca

SEQ ID NO: 92273 - DNA, 16 bp, H. sapiens
ctgggtccctgccaca

SEQ ID NO: 92274 - DNA, 16 bp, H. sapiens
ctgggtcctctgctca

SEQ ID NO: 92275 - DNA, 16 bp, H. sapiens
ctgggtcctgcccacc

SEQ ID NO: 92276 - DNA, 16 bp, H. sapiens
ctgggtctcacccaag

SEQ ID NO: 92277 - DNA, 16 bp, H. sapiens
ctgggtctcagcttcc

SEQ ID NO: 92278 - DNA, 16 bp, H. sapiens
ctgggtctccctgtgt

SEQ ID NO: 92279 - DNA, 16 bp, H. sapiens
ctgggtctgagggagg

SEQ ID NO: 92280 - DNA, 16 bp, H. sapiens
ctgggtctgcagctgc

SEQ ID NO: 92281 - DNA, 16 bp, H. sapiens
ctgggtctggtgggga

SEQ ID NO: 92282 - DNA, 16 bp, H. sapiens
ctgggtctggtggtgc

SEQ ID NO: 92283 - DNA, 16 bp, H. sapiens
ctgggtctgtttctat

SEQ ID NO: 92284 - DNA, 16 bp, H. sapiens
ctgggtcttctgtggt

SEQ ID NO: 92285 - DNA, 16 bp, H. sapiens
ctgggtcttgccatgt

SEQ ID NO: 92286 - DNA, 16 bp, H. sapiens
ctgggtgaaacagcaa

SEQ ID NO: 92287 - DNA, 16 bp, H. sapiens
ctgggtgaaagagcaa

SEQ ID NO: 92288 - DNA, 16 bp, H. sapiens
ctgggtgaagggtata

SEQ ID NO: 92289 - DNA, 16 bp, H. sapiens
ctgggtgacaagaatg

SEQ ID NO: 92290 - DNA, 16 bp, H. sapiens
ctgggtgacagaagga

SEQ ID NO: 92291 - DNA, 16 bp, H. sapiens
ctgggtgacagagaag

SEQ ID NO: 92292 - DNA, 16 bp, H. sapiens
ctgggtgacagagagt

SEQ ID NO: 92293 - DNA, 16 bp, H. sapiens
ctgggtgacagagata

SEQ ID NO: 92294 - DNA, 16 bp, H. sapiens
ctgggtgacagagtga

SEQ ID NO: 92295 - DNA, 16 bp, H. sapiens
ctgggtgacagcacaa

SEQ ID NO: 92296 - DNA, 16 bp, H. sapiens
ctgggtgacaggatga

SEQ ID NO: 92297 - DNA, 16 bp, H. sapiens
ctgggtgacagtgaaa

SEQ ID NO: 92298 - DNA, 16 bp, H. sapiens
ctgggtgacagtgaga

SEQ ID NO: 92299 - DNA, 16 bp, H. sapiens
ctgggtgaccctgggc

SEQ ID NO: 92300 - DNA, 16 bp, H. sapiens
ctgggtgacctcaggc

SEQ ID NO: 92301 - DNA, 16 bp, H. sapiens
ctgggtgaggtggcag

SEQ ID NO: 92302 - DNA, 16 bp, H. sapiens
ctgggtgaggtggctc

SEQ ID NO: 92303 - DNA, 16 bp, H. sapiens
ctgggtgaggtggtgg

SEQ ID NO: 92304 - DNA, 16 bp, H. sapiens
ctgggtgatttataag

SEQ ID NO: 92305 - DNA, 16 bp, H. sapiens
ctgggtgcaggcgggc

SEQ ID NO: 92306 - DNA, 16 bp, H. sapiens
ctgggtgcagtggctt

SEQ ID NO: 92307 - DNA, 16 bp, H. sapiens
ctgggtgcccttaaca

SEQ ID NO: 92308 - DNA, 16 bp, H. sapiens
ctgggtgcctcccaca

SEQ ID NO: 92309 - DNA, 16 bp, H. sapiens
ctgggtgctgggggag

SEQ ID NO: 92310 - DNA, 16 bp, H. sapiens
ctgggtgctgggtgct

SEQ ID NO: 92311 - DNA, 16 bp, H. sapiens
ctgggtggagcccaca

SEQ ID NO: 92312 - DNA, 16 bp, H. sapiens
ctgggtggagcccact

SEQ ID NO: 92313 - DNA, 16 bp, H. sapiens
ctgggtggcttaaaaa

SEQ ID NO: 92314 - DNA, 16 bp, H. sapiens
ctgggtggcttgaaac

SEQ ID NO: 92315 - DNA, 16 bp, H. sapiens
ctgggtgggcattttt

SEQ ID NO: 92316 - DNA, 16 bp, H. sapiens
ctgggtggggccacag

SEQ ID NO: 92317 - DNA, 16 bp, H. sapiens
ctgggtggtggttaca

SEQ ID NO: 92318 - DNA, 16 bp, H. sapiens
ctgggtggttgaggct

SEQ ID NO: 92319 - DNA, 16 bp, H. sapiens
ctgggtgtgctggcat

SEQ ID NO: 92320 - DNA, 16 bp, H. sapiens
ctgggtgtgctggtgc

SEQ ID NO: 92321 - DNA, 16 bp, H. sapiens
ctgggtgtggcagtgg

SEQ ID NO: 92322 - DNA, 16 bp, H. sapiens
ctgggtgtggtggagc

SEQ ID NO: 92323 - DNA, 16 bp, H. sapiens
ctgggtgtggtggcat

SEQ ID NO: 92324 - DNA, 16 bp, H. sapiens
ctgggtgtggtggccc

SEQ ID NO: 92325 - DNA, 16 bp, H. sapiens
ctgggtgtggtgttgc

SEQ ID NO: 92326 - DNA, 16 bp, H. sapiens
ctgggtgtgtctgtga

SEQ ID NO: 92327 - DNA, 16 bp, H. sapiens
ctgggttagggtctcc

SEQ ID NO: 92328 - DNA, 16 bp, H. sapiens
ctgggttcaaatcctg

SEQ ID NO: 92329 - DNA, 16 bp, H. sapiens
ctgggttcaaatcttg

SEQ ID NO: 92330 - DNA, 16 bp, H. sapiens
ctgggttcaaattcca

SEQ ID NO: 92331 - DNA, 16 bp, H. sapiens
ctgggttcaaattctg

SEQ ID NO: 92332 - DNA, 16 bp, H. sapiens
ctgggttcaagtccca

SEQ ID NO: 92333 - DNA, 20 bp, H. sapiens
ctgggttcaagtgattcttg

SEQ ID NO: 92334 - DNA, 16 bp, H. sapiens
ctgggttcagtggctc

SEQ ID NO: 92335 - DNA, 16 bp, H. sapiens
ctgggttccagcccca

SEQ ID NO: 92336 - DNA, 16 bp, H. sapiens
ctgggttctagtccca

SEQ ID NO: 92337 - DNA, 16 bp, H. sapiens
ctgggttctcttttat

SEQ ID NO: 92338 - DNA, 16 bp, H. sapiens
ctgggttcttgtctca

SEQ ID NO: 92339 - DNA, 16 bp, H. sapiens
ctgggtttaaatccca

SEQ ID NO: 92340 - DNA, 18 bp, H. sapiens
ctgggtttacaggtgtgt

SEQ ID NO: 92341 - DNA, 16 bp, H. sapiens
ctgggtttatttttat

SEQ ID NO: 92342 - DNA, 16 bp, H. sapiens
ctgggtttcaccattt

SEQ ID NO: 92343 - DNA, 16 bp, H. sapiens
ctgggtttcagacttg

SEQ ID NO: 92344 - DNA, 16 bp, H. sapiens
ctgggtttcagcaatt

SEQ ID NO: 92345 - DNA, 16 bp, H. sapiens
ctgggtttgaatccca

SEQ ID NO: 92346 - DNA, 16 bp, H. sapiens
ctgggtttgaatcctg

SEQ ID NO: 92347 - DNA, 16 bp, H. sapiens
ctgggtttgaattctg

SEQ ID NO: 92348 - DNA, 16 bp, H. sapiens
ctgggttttttaaaaa

SEQ ID NO: 92349 - DNA, 16 bp, H. sapiens
ctggtaaaaatacaaa

SEQ ID NO: 92350 - DNA, 16 bp, H. sapiens
ctggtaaatttttggt

SEQ ID NO: 92351 - DNA, 16 bp, H. sapiens
ctggtaataaagacat

SEQ ID NO: 92352 - DNA, 16 bp, H. sapiens
ctggtaccagctgctg

SEQ ID NO: 92353 - DNA, 16 bp, H. sapiens
ctggtacctcagcctc

SEQ ID NO: 92354 - DNA, 16 bp, H. sapiens
ctggtactacaggcat

SEQ ID NO: 92355 - DNA, 16 bp, H. sapiens
ctggtactacaggcgc

SEQ ID NO: 92356 - DNA, 16 bp, H. sapiens
ctggtagccctgctgg

SEQ ID NO: 92357 - DNA, 16 bp, H. sapiens
ctggtagctgggatta

SEQ ID NO: 92358 - DNA, 16 bp, H. sapiens
ctggtataaaagtaga

SEQ ID NO: 92359 - DNA, 16 bp, H. sapiens
ctggtataatttggct

SEQ ID NO: 92360 - DNA, 16 bp, H. sapiens
ctggtatctagtgggt

SEQ ID NO: 92361 - DNA, 16 bp, H. sapiens
ctggtatgttgtatct

SEQ ID NO: 92362 - DNA, 16 bp, H. sapiens
ctggtattcctttata

SEQ ID NO: 92363 - DNA, 16 bp, H. sapiens
ctggtatttgaccaaa

SEQ ID NO: 92364 - DNA, 16 bp, H. sapiens
ctggtcaacatggtga

SEQ ID NO: 92365 - DNA, 16 bp, H. sapiens
ctggtcacattttcat

SEQ ID NO: 92366 - DNA, 16 bp, H. sapiens
ctggtcaccatggtga

SEQ ID NO: 92367 - DNA, 16 bp, H. sapiens
ctggtcactggaaaga

SEQ ID NO: 92368 - DNA, 16 bp, H. sapiens
ctggtcaggctggtct

SEQ ID NO: 92369 - DNA, 16 bp, H. sapiens
ctggtccaagccacca

SEQ ID NO: 92370 - DNA, 16 bp, H. sapiens
ctggtccagctgcagc

SEQ ID NO: 92371 - DNA, 16 bp, H. sapiens
ctggtcccaagcattt

SEQ ID NO: 92372 - DNA, 16 bp, H. sapiens
ctggtcccttccctga

SEQ ID NO: 92373 - DNA, 17 bp, H. sapiens
ctggtcctgaacatcca

SEQ ID NO: 92374 - DNA, 16 bp, H. sapiens
ctggtcctgccatggc

SEQ ID NO: 92375 - DNA, 16 bp, H. sapiens
ctggtctacaactcct

SEQ ID NO: 92376 - DNA, 16 bp, H. sapiens
ctggtctattcaggga

SEQ ID NO: 92377 - DNA, 16 bp, H. sapiens
ctggtctcaaactcac

SEQ ID NO: 92378 - DNA, 16 bp, H. sapiens
ctggtctcaaactccc

SEQ ID NO: 92379 - DNA, 16 bp, H. sapiens
ctggtctcaaactccg

SEQ ID NO: 92380 - DNA, 16 bp, H. sapiens
ctggtctccaactcct

SEQ ID NO: 92381 - DNA, 16 bp, H. sapiens
ctggtctccaagtcct

SEQ ID NO: 92382 - DNA, 16 bp, H. sapiens
ctggtctccatctctt

SEQ ID NO: 92383 - DNA, 16 bp, H. sapiens
ctggtctcccagcttc

SEQ ID NO: 92384 - DNA, 16 bp, H. sapiens
ctggtctccttgcttc

SEQ ID NO: 92385 - DNA, 16 bp, H. sapiens
ctggtctctctgcctc

SEQ ID NO: 92386 - DNA, 16 bp, H. sapiens
ctggtctgcagttccc

SEQ ID NO: 92387 - DNA, 16 bp, H. sapiens
ctggtctgcgggttgc

SEQ ID NO: 92388 - DNA, 16 bp, H. sapiens
ctggtctgctggggcc

SEQ ID NO: 92389 - DNA, 16 bp, H. sapiens
ctggtctggaagtcct

SEQ ID NO: 92390 - DNA, 16 bp, H. sapiens
ctggtcttaaagtcct

SEQ ID NO: 92391 - DNA, 16 bp, H. sapiens
ctggtcttcaactctt

SEQ ID NO: 92392 - DNA, 16 bp, H. sapiens
ctggtcttcctcactg

SEQ ID NO: 92393 - DNA, 16 bp, H. sapiens
ctggtcttgaactccc

SEQ ID NO: 92394 - DNA, 16 bp, H. sapiens
ctggtcttgaagtcct

SEQ ID NO: 92395 - DNA, 16 bp, H. sapiens
ctggtcttggactttt

SEQ ID NO: 92396 - DNA, 16 bp, H. sapiens
ctggtgaaaatgtgaa

SEQ ID NO: 92397 - DNA, 19 bp, H. sapiens
ctggtgaaaccccatctct

SEQ ID NO: 92398 - DNA, 16 bp, H. sapiens
ctggtgaaaccctatc

SEQ ID NO: 92399 - DNA, 16 bp, H. sapiens
ctggtgaagatgctat

SEQ ID NO: 92400 - DNA, 16 bp, H. sapiens
ctggtgaagatgtgga

SEQ ID NO: 92401 - DNA, 16 bp, H. sapiens
ctggtgactcatgcct

SEQ ID NO: 92402 - DNA, 16 bp, H. sapiens
ctggtgagaatgcaga

SEQ ID NO: 92403 - DNA, 16 bp, H. sapiens
ctggtgagattgcaga

SEQ ID NO: 92404 - DNA, 16 bp, H. sapiens
ctggtgaggagctgcc

SEQ ID NO: 92405 - DNA, 16 bp, H. sapiens
ctggtgaggagctgcg

SEQ ID NO: 92406 - DNA, 16 bp, H. sapiens
ctggtgaggcctcagg

SEQ ID NO: 92407 - DNA, 16 bp, H. sapiens
ctggtgagggttctct

SEQ ID NO: 92408 - DNA, 16 bp, H. sapiens
ctggtgatgatgatga

SEQ ID NO: 92409 - DNA, 16 bp, H. sapiens
ctggtgatttttgcac

SEQ ID NO: 92410 - DNA, 16 bp, H. sapiens
ctggtgcacaccacca

SEQ ID NO: 92411 - DNA, 16 bp, H. sapiens
ctggtgcactgtgctg

SEQ ID NO: 92412 - DNA, 16 bp, H. sapiens
ctggtgcagagctgag

SEQ ID NO: 92413 - DNA, 16 bp, H. sapiens
ctggtgcaggatccac

SEQ ID NO: 92414 - DNA, 16 bp, H. sapiens
ctggtgcccaggctgg

SEQ ID NO: 92415 - DNA, 16 bp, H. sapiens
ctggtgccctgatctt

SEQ ID NO: 92416 - DNA, 16 bp, H. sapiens
ctggtgcctcagcctc

SEQ ID NO: 92417 - DNA, 16 bp, H. sapiens
ctggtgcctgccacca

SEQ ID NO: 92418 - DNA, 21 bp, H. sapiens
ctggtgcgctgcacccactaa

SEQ ID NO: 92419 - DNA, 16 bp, H. sapiens
ctggtgctgctggtcc

SEQ ID NO: 92420 - DNA, 16 bp, H. sapiens
ctggtgctgggctggg

SEQ ID NO: 92421 - DNA, 16 bp, H. sapiens
ctggtgctgtcagtgg

SEQ ID NO: 92422 - DNA, 16 bp, H. sapiens
ctggtggaaatgaaaa

SEQ ID NO: 92423 - DNA, 16 bp, H. sapiens
ctggtggaggtggtgg

SEQ ID NO: 92424 - DNA, 16 bp, H. sapiens
ctggtggcacatgcct

SEQ ID NO: 92425 - DNA, 16 bp, H. sapiens
ctggtggcaggtgcct

SEQ ID NO: 92426 - DNA, 16 bp, H. sapiens
ctggtggcattgtgcc

SEQ ID NO: 92427 - DNA, 16 bp, H. sapiens
ctggtggctcacacct

SEQ ID NO: 92428 - DNA, 16 bp, H. sapiens
ctggtggctcacatct

SEQ ID NO: 92429 - DNA, 16 bp, H. sapiens
ctggtggctcacgcct

SEQ ID NO: 92430 - DNA, 16 bp, H. sapiens
ctggtggctcatgcct

SEQ ID NO: 92431 - DNA, 16 bp, H. sapiens
ctggtggctccacccc

SEQ ID NO: 92432 - DNA, 16 bp, H. sapiens
ctggtggctgaggcat

SEQ ID NO: 92433 - DNA, 16 bp, H. sapiens
ctggtggctgctggca

SEQ ID NO: 92434 - DNA, 16 bp, H. sapiens
ctggtggctgggggcc

SEQ ID NO: 92435 - DNA, 16 bp, H. sapiens
ctggtgggaatataaa

SEQ ID NO: 92436 - DNA, 16 bp, H. sapiens
ctggtgggaatgtaaa

SEQ ID NO: 92437 - DNA, 16 bp, H. sapiens
ctggtgggagcaggct

SEQ ID NO: 92438 - DNA, 16 bp, H. sapiens
ctggtggggaagtgga

SEQ ID NO: 92439 - DNA, 16 bp, H. sapiens
ctggtggggaatgttg

SEQ ID NO: 92440 - DNA, 18 bp, H. sapiens
ctggtggggacgtggaga

SEQ ID NO: 92441 - DNA, 16 bp, H. sapiens
ctggtgggtggtgatt

SEQ ID NO: 92442 - DNA, 16 bp, H. sapiens
ctggtgggtgtgaagt

SEQ ID NO: 92443 - DNA, 16 bp, H. sapiens
ctggtggtctttctct

SEQ ID NO: 92444 - DNA, 16 bp, H. sapiens
ctggtggtggcagtgg

SEQ ID NO: 92445 - DNA, 16 bp, H. sapiens
ctggtggtggcctgtg

SEQ ID NO: 92446 - DNA, 16 bp, H. sapiens
ctggtggtgggcgcct

SEQ ID NO: 92447 - DNA, 16 bp, H. sapiens
ctggtggtggtggcag

SEQ ID NO: 92448 - DNA, 16 bp, H. sapiens
ctggtggttctgagca

SEQ ID NO: 92449 - DNA, 16 bp, H. sapiens
ctggtgtccacctggg

SEQ ID NO: 92450 - DNA, 16 bp, H. sapiens
ctggtgtctcttcttt

SEQ ID NO: 92451 - DNA, 16 bp, H. sapiens
ctggtgtctgggatga

SEQ ID NO: 92452 - DNA, 16 bp, H. sapiens
ctggtgtgctgcaacc

SEQ ID NO: 92453 - DNA, 16 bp, H. sapiens
ctggtgtgctgtattc

SEQ ID NO: 92454 - DNA, 16 bp, H. sapiens
ctggtgtggtggcagg

SEQ ID NO: 92455 - DNA, 16 bp, H. sapiens
ctggtgtgtgcagaga

SEQ ID NO: 92456 - DNA, 16 bp, H. sapiens
ctggtgttgataaaat

SEQ ID NO: 92457 - DNA, 16 bp, H. sapiens
ctggtgttggcagtgg

SEQ ID NO: 92458 - DNA, 16 bp, H. sapiens
ctggtgtttgccagca

SEQ ID NO: 92459 - DNA, 16 bp, H. sapiens
ctggttaaaaaacaaa

SEQ ID NO: 92460 - DNA, 16 bp, H. sapiens
ctggttagaaatttct

SEQ ID NO: 92461 - DNA, 16 bp, H. sapiens
ctggttatcccagcac

SEQ ID NO: 92462 - DNA, 16 bp, H. sapiens
ctggttattatgcaga

SEQ ID NO: 92463 - DNA, 16 bp, H. sapiens
ctggttatttatttat

SEQ ID NO: 92464 - DNA, 16 bp, H. sapiens
ctggttattttttgta

SEQ ID NO: 92465 - DNA, 16 bp, H. sapiens
ctggttcaggccatga

SEQ ID NO: 92466 - DNA, 16 bp, H. sapiens
ctggttccaggacctc

SEQ ID NO: 92467 - DNA, 16 bp, H. sapiens
ctggttccatattttt

SEQ ID NO: 92468 - DNA, 16 bp, H. sapiens
ctggttccttgaaaag

SEQ ID NO: 92469 - DNA, 16 bp, H. sapiens
ctggttctcaggactt

SEQ ID NO: 92470 - DNA, 16 bp, H. sapiens
ctggttctcaggcctt

SEQ ID NO: 92471 - DNA, 16 bp, H. sapiens
ctggttctggaggctg

SEQ ID NO: 92472 - DNA, 16 bp, H. sapiens
ctggttgaagtgattc

SEQ ID NO: 92473 - DNA, 16 bp, H. sapiens
ctggttgcagaaattt

SEQ ID NO: 92474 - DNA, 16 bp, H. sapiens
ctggttgccactgctg

SEQ ID NO: 92475 - DNA, 16 bp, H. sapiens
ctggttgtttaaaaga

SEQ ID NO: 92476 - DNA, 22 bp, H. sapiens
ctggtttattgagactagagaa

SEQ ID NO: 92477 - DNA, 16 bp, H. sapiens
ctggtttcaaactccc

SEQ ID NO: 92478 - DNA, 16 bp, H. sapiens
ctggtttcaaactgct

SEQ ID NO: 92479 - DNA, 16 bp, H. sapiens
ctggtttcaagcgatt

SEQ ID NO: 92480 - DNA, 16 bp, H. sapiens
ctggtttcagccccct

SEQ ID NO: 92481 - DNA, 16 bp, H. sapiens
ctggtttcgaactccc

SEQ ID NO: 92482 - DNA, 16 bp, H. sapiens
ctggtttctaagacaa

SEQ ID NO: 92483 - DNA, 16 bp, H. sapiens
ctggtttctccctgct

SEQ ID NO: 92484 - DNA, 16 bp, H. sapiens
ctggtttcttctcatt

SEQ ID NO: 92485 - DNA, 16 bp, H. sapiens
ctggtttctttcactc

SEQ ID NO: 92486 - DNA, 16 bp, H. sapiens
ctggttttcaaagaga

SEQ ID NO: 92487 - DNA, 16 bp, H. sapiens
ctggttttcctcctac

SEQ ID NO: 92488 - DNA, 16 bp, H. sapiens
ctggttttgaaatcct

SEQ ID NO: 92489 - DNA, 16 bp, H. sapiens
ctggttttgaggcttt

SEQ ID NO: 92490 - DNA, 16 bp, H. sapiens
ctggttttgatatcaa

SEQ ID NO: 92491 - DNA, 16 bp, H. sapiens
ctggttttgatctcct

SEQ ID NO: 92492 - DNA, 16 bp, H. sapiens
ctggtttttctgctct

SEQ ID NO: 92493 - DNA, 16 bp, H. sapiens
ctgtaaaaaataaaat

SEQ ID NO: 92494 - DNA, 16 bp, H. sapiens
ctgtaaaaacaaaaac

SEQ ID NO: 92495 - DNA, 16 bp, H. sapiens
ctgtaaaactacaaat

SEQ ID NO: 92496 - DNA, 16 bp, H. sapiens
ctgtaaaactcctaga

SEQ ID NO: 92497 - DNA, 16 bp, H. sapiens
ctgtaaaatagagatg

SEQ ID NO: 92498 - DNA, 16 bp, H. sapiens
ctgtaaaatatttgga

SEQ ID NO: 92499 - DNA, 16 bp, H. sapiens
ctgtaaaatgagaatt

SEQ ID NO: 92500 - DNA, 16 bp, H. sapiens
ctgtaaaatggacaca

SEQ ID NO: 92501 - DNA, 16 bp, H. sapiens
ctgtaaaatggaggtg

SEQ ID NO: 92502 - DNA, 16 bp, H. sapiens
ctgtaaaatgggacca

SEQ ID NO: 92503 - DNA, 16 bp, H. sapiens
ctgtaaaatggggaaa

SEQ ID NO: 92504 - DNA, 16 bp, H. sapiens
ctgtaaaatggggatg

SEQ ID NO: 92505 - DNA, 16 bp, H. sapiens
ctgtaaaatggtgata

SEQ ID NO: 92506 - DNA, 16 bp, H. sapiens
ctgtaaaatgtaaata

SEQ ID NO: 92507 - DNA, 16 bp, H. sapiens
ctgtaaaatgtggatg

SEQ ID NO: 92508 - DNA, 16 bp, H. sapiens
ctgtaaactacttcaa

SEQ ID NO: 92509 - DNA, 16 bp, H. sapiens
ctgtaaactttaaaga

SEQ ID NO: 92510 - DNA, 16 bp, H. sapiens
ctgtaaagaaaaataa

SEQ ID NO: 92511 - DNA, 16 bp, H. sapiens
ctgtaaaggtttttat

SEQ ID NO: 92512 - DNA, 16 bp, H. sapiens
ctgtaaagtggggatg

SEQ ID NO: 92513 - DNA, 16 bp, H. sapiens
ctgtaaataaagtttt

SEQ ID NO: 92514 - DNA, 16 bp, H. sapiens
ctgtaaataatgctgc

SEQ ID NO: 92515 - DNA, 16 bp, H. sapiens
ctgtaaatcctgccct

SEQ ID NO: 92516 - DNA, 16 bp, H. sapiens
ctgtaacaaaatacca

SEQ ID NO: 92517 - DNA, 16 bp, H. sapiens
ctgtaacaacaacaac

SEQ ID NO: 92518 - DNA, 30 bp, H. sapiens
ctgtaaccaatctgacaataatgtgttcat

SEQ ID NO: 92519 - DNA, 16 bp, H. sapiens
ctgtaaccacagcact

SEQ ID NO: 92520 - DNA, 16 bp, H. sapiens
ctgtaaccccaactac

SEQ ID NO: 92521 - DNA, 16 bp, H. sapiens
ctgtaaccccagcact

SEQ ID NO: 92522 - DNA, 17 bp, H. sapiens
ctgtaaccccagctact

SEQ ID NO: 92523 - DNA, 17 bp, H. sapiens
ctgtaaccctagctact

SEQ ID NO: 92524 - DNA, 16 bp, H. sapiens
ctgtaaccttgaactt

SEQ ID NO: 92525 - DNA, 16 bp, H. sapiens
ctgtaactcaatttca

SEQ ID NO: 92526 - DNA, 16 bp, H. sapiens
ctgtaactccaacact

SEQ ID NO: 92527 - DNA, 16 bp, H. sapiens
ctgtaagaaaatgaat

SEQ ID NO: 92528 - DNA, 16 bp, H. sapiens
ctgtaagaaataaatt

SEQ ID NO: 92529 - DNA, 16 bp, H. sapiens
ctgtaagataatatat

SEQ ID NO: 92530 - DNA, 16 bp, H. sapiens
ctgtaagctccaggag

SEQ ID NO: 92531 - DNA, 16 bp, H. sapiens
ctgtaagtccaatgaa

SEQ ID NO: 92532 - DNA, 16 bp, H. sapiens
ctgtaataaaaagttt

SEQ ID NO: 92533 - DNA, 17 bp, H. sapiens
ctgtaataccagctact

SEQ ID NO: 92534 - DNA, 16 bp, H. sapiens
ctgtaatcacagcatt

SEQ ID NO: 92535 - DNA, 16 bp, H. sapiens
ctgtaatcccaaatac

SEQ ID NO: 92536 - DNA, 17 bp, H. sapiens
ctgtaatcccaactact

SEQ ID NO: 92537 - DNA, 17 bp, H. sapiens
ctgtaatcccacctact

SEQ ID NO: 92538 - DNA, 17 bp, H. sapiens
ctgtaatcccagatact

SEQ ID NO: 92539 - DNA, 16 bp, H. sapiens
ctgtaatcccagcatg

SEQ ID NO: 92540 - DNA, 16 bp, H. sapiens
ctgtaatcccagctaa

SEQ ID NO: 92541 - DNA, 17 bp, H. sapiens
ctgtaatcccagctacc

SEQ ID NO: 92542 - DNA, 17 bp, H. sapiens
ctgtaatcccagctact

SEQ ID NO: 92543 - DNA, 16 bp, H. sapiens
ctgtaatcccagctag

SEQ ID NO: 92544 - DNA, 16 bp, H. sapiens
ctgtaatcccagctat

SEQ ID NO: 92545 - DNA, 17 bp, H. sapiens
ctgtaatcccagctgct

SEQ ID NO: 92546 - DNA, 17 bp, H. sapiens
ctgtaatcccagcttct

SEQ ID NO: 92547 - DNA, 16 bp, H. sapiens
ctgtaatcccaggtat

SEQ ID NO: 92548 - DNA, 17 bp, H. sapiens
ctgtaatcccagttact

SEQ ID NO: 92549 - DNA, 16 bp, H. sapiens
ctgtaatcctagcacg

SEQ ID NO: 92550 - DNA, 17 bp, H. sapiens
ctgtaatcctagctact

SEQ ID NO: 92551 - DNA, 16 bp, H. sapiens
ctgtaatctcaatact

SEQ ID NO: 92552 - DNA, 17 bp, H. sapiens
ctgtaatctcagctact

SEQ ID NO: 92553 - DNA, 16 bp, H. sapiens
ctgtaatctcagctat

SEQ ID NO: 92554 - DNA, 17 bp, H. sapiens
ctgtaattacagctact

SEQ ID NO: 92555 - DNA, 17 bp, H. sapiens
ctgtaattccagctact

SEQ ID NO: 92556 - DNA, 16 bp, H. sapiens
ctgtaatttctttcag

SEQ ID NO: 92557 - DNA, 16 bp, H. sapiens
ctgtaattttttaaaa

SEQ ID NO: 92558 - DNA, 16 bp, H. sapiens
ctgtaatttttttaaa

SEQ ID NO: 92559 - DNA, 16 bp, H. sapiens
ctgtacaacaaatccc

SEQ ID NO: 92560 - DNA, 16 bp, H. sapiens
ctgtacaagaagtatg

SEQ ID NO: 92561 - DNA, 16 bp, H. sapiens
ctgtacaatgtgtttg

SEQ ID NO: 92562 - DNA, 16 bp, H. sapiens
ctgtacaccaaactcc

SEQ ID NO: 92563 - DNA, 16 bp, H. sapiens
ctgtacagaaactttt

SEQ ID NO: 92564 - DNA, 16 bp, H. sapiens
ctgtacagcctgctga

SEQ ID NO: 92565 - DNA, 16 bp, H. sapiens
ctgtacatgttcagta

SEQ ID NO: 92566 - DNA, 16 bp, H. sapiens
ctgtacatttattttt

SEQ ID NO: 92567 - DNA, 16 bp, H. sapiens
ctgtaccattttgtat

SEQ ID NO: 92568 - DNA, 16 bp, H. sapiens
ctgtacccagcctatt

SEQ ID NO: 92569 - DNA, 16 bp, H. sapiens
ctgtacccattaaaca

SEQ ID NO: 92570 - DNA, 16 bp, H. sapiens
ctgtacctggcctttt

SEQ ID NO: 92571 - DNA, 16 bp, H. sapiens
ctgtactaatttccat

SEQ ID NO: 92572 - DNA, 16 bp, H. sapiens
ctgtactacagcctgg

SEQ ID NO: 92573 - DNA, 17 bp, H. sapiens
ctgtactcccagctact

SEQ ID NO: 92574 - DNA, 16 bp, H. sapiens
ctgtactgaaaatgaa

SEQ ID NO: 92575 - DNA, 16 bp, H. sapiens
ctgtactgcctgcaga

SEQ ID NO: 92576 - DNA, 16 bp, H. sapiens
ctgtactttatttatt

SEQ ID NO: 92577 - DNA, 16 bp, H. sapiens
ctgtactttgggaggc

SEQ ID NO: 92578 - DNA, 16 bp, H. sapiens
ctgtagaaaaggaaga

SEQ ID NO: 92579 - DNA, 16 bp, H. sapiens
ctgtagaaaaggagga

SEQ ID NO: 92580 - DNA, 16 bp, H. sapiens
ctgtagaatggatgtt

SEQ ID NO: 92581 - DNA, 16 bp, H. sapiens
ctgtagaccaaatgga

SEQ ID NO: 92582 - DNA, 16 bp, H. sapiens
ctgtagactttataaa

SEQ ID NO: 92583 - DNA, 16 bp, H. sapiens
ctgtagagaaaatctg

SEQ ID NO: 92584 - DNA, 16 bp, H. sapiens
ctgtagagaaccctga

SEQ ID NO: 92585 - DNA, 16 bp, H. sapiens
ctgtagatatttttaa

SEQ ID NO: 92586 - DNA, 16 bp, H. sapiens
ctgtagattgcttggg

SEQ ID NO: 92587 - DNA, 16 bp, H. sapiens
ctgtagatttctttgg

SEQ ID NO: 92588 - DNA, 16 bp, H. sapiens
ctgtagcatgtgatgc

SEQ ID NO: 92589 - DNA, 16 bp, H. sapiens
ctgtagcattttgcat

SEQ ID NO: 92590 - DNA, 16 bp, H. sapiens
ctgtagcctccacttc

SEQ ID NO: 92591 - DNA, 16 bp, H. sapiens
ctgtagctcacgcctg

SEQ ID NO: 92592 - DNA, 16 bp, H. sapiens
ctgtagctcagtagct

SEQ ID NO: 92593 - DNA, 16 bp, H. sapiens
ctgtagcttttccagg

SEQ ID NO: 92594 - DNA, 17 bp, H. sapiens
ctgtaggaggacataaa

SEQ ID NO: 92595 - DNA, 16 bp, H. sapiens
ctgtaggcatcacatt

SEQ ID NO: 92596 - DNA, 16 bp, H. sapiens
ctgtagggtttctgca

SEQ ID NO: 92597 - DNA, 17 bp, H. sapiens
ctgtagtaccagctact

SEQ ID NO: 92598 - DNA, 16 bp, H. sapiens
ctgtagtccaagctac

SEQ ID NO: 92599 - DNA, 16 bp, H. sapiens
ctgtagtccagctact

SEQ ID NO: 92600 - DNA, 16 bp, H. sapiens
ctgtagtcccaactat

SEQ ID NO: 92601 - DNA, 17 bp, H. sapiens
ctgtagtcccacctact

SEQ ID NO: 92602 - DNA, 16 bp, H. sapiens
ctgtagtcccagatgc

SEQ ID NO: 92603 - DNA, 16 bp, H. sapiens
ctgtagtcccagccac

SEQ ID NO: 92604 - DNA, 16 bp, H. sapiens
ctgtagtcccagccat

SEQ ID NO: 92605 - DNA, 16 bp, H. sapiens
ctgtagtcccagctaa

SEQ ID NO: 92606 - DNA, 17 bp, H. sapiens
ctgtagtcccagctaca

SEQ ID NO: 92607 - DNA, 17 bp, H. sapiens
ctgtagtcccagctact

SEQ ID NO: 92608 - DNA, 16 bp, H. sapiens
ctgtagtcccagctag

SEQ ID NO: 92609 - DNA, 16 bp, H. sapiens
ctgtagtcccagctat

SEQ ID NO: 92610 - DNA, 18 bp, H. sapiens
ctgtagtcccagttacta

SEQ ID NO: 92611 - DNA, 16 bp, H. sapiens
ctgtagtcctagctag

SEQ ID NO: 92612 - DNA, 16 bp, H. sapiens
ctgtagtcctagctat

SEQ ID NO: 92613 - DNA, 17 bp, H. sapiens
ctgtagtcgcagctact

SEQ ID NO: 92614 - DNA, 16 bp, H. sapiens
ctgtagtctcagctag

SEQ ID NO: 92615 - DNA, 16 bp, H. sapiens
ctgtagtgaagtggca

SEQ ID NO: 92616 - DNA, 16 bp, H. sapiens
ctgtagttccagctaa

SEQ ID NO: 92617 - DNA, 16 bp, H. sapiens
ctgtagttccagctat

SEQ ID NO: 92618 - DNA, 16 bp, H. sapiens
ctgtagttttgccttt

SEQ ID NO: 92619 - DNA, 16 bp, H. sapiens
ctgtagttttgtaata

SEQ ID NO: 92620 - DNA, 16 bp, H. sapiens
ctgtatagctgggatt

SEQ ID NO: 92621 - DNA, 16 bp, H. sapiens
ctgtatagggtgtctg

SEQ ID NO: 92622 - DNA, 16 bp, H. sapiens
ctgtatatatttatgg

SEQ ID NO: 92623 - DNA, 16 bp, H. sapiens
ctgtatatttcaaaat

SEQ ID NO: 92624 - DNA, 16 bp, H. sapiens
ctgtatcaaaaataaa

SEQ ID NO: 92625 - DNA, 16 bp, H. sapiens
ctgtatccaggccatc

SEQ ID NO: 92626 - DNA, 16 bp, H. sapiens
ctgtatccccagtgcc

SEQ ID NO: 92627 - DNA, 16 bp, H. sapiens
ctgtatcccccaggct

SEQ ID NO: 92628 - DNA, 16 bp, H. sapiens
ctgtatcctgagctct

SEQ ID NO: 92629 - DNA, 16 bp, H. sapiens
ctgtatctatctatct

SEQ ID NO: 92630 - DNA, 16 bp, H. sapiens
ctgtatctgtgtgtgt

SEQ ID NO: 92631 - DNA, 16 bp, H. sapiens
ctgtatcttgactgtg

SEQ ID NO: 92632 - DNA, 24 bp, H. sapiens
ctgtatctttaacctccttgttaa

SEQ ID NO: 92633 - DNA, 16 bp, H. sapiens
ctgtatcttttaagtg

SEQ ID NO: 92634 - DNA, 16 bp, H. sapiens
ctgtatcttttctaag

SEQ ID NO: 92635 - DNA, 16 bp, H. sapiens
ctgtatgaccttgggc

SEQ ID NO: 92636 - DNA, 16 bp, H. sapiens
ctgtatgactttgggc

SEQ ID NO: 92637 - DNA, 16 bp, H. sapiens
ctgtatgccagcctgg

SEQ ID NO: 92638 - DNA, 16 bp, H. sapiens
ctgtatgccttttttt

SEQ ID NO: 92639 - DNA, 16 bp, H. sapiens
ctgtatggcctgcaga

SEQ ID NO: 92640 - DNA, 16 bp, H. sapiens
ctgtatgggaagcatg

SEQ ID NO: 92641 - DNA, 16 bp, H. sapiens
ctgtatgtcatttccc

SEQ ID NO: 92642 - DNA, 16 bp, H. sapiens
ctgtatgtctgtcttt

SEQ ID NO: 92643 - DNA, 16 bp, H. sapiens
ctgtatgtgtatgtat

SEQ ID NO: 92644 - DNA, 16 bp, H. sapiens
ctgtatgtgtctttat

SEQ ID NO: 92645 - DNA, 17 bp, H. sapiens
ctgtatgtgtgtgtgta

SEQ ID NO: 92646 - DNA, 16 bp, H. sapiens
ctgtatgttgtctttt

SEQ ID NO: 92647 - DNA, 16 bp, H. sapiens
ctgtattaaaaaaaaa

SEQ ID NO: 92648 - DNA, 16 bp, H. sapiens
ctgtattaaagaaaaa

SEQ ID NO: 92649 - DNA, 16 bp, H. sapiens
ctgtattattttttaa

SEQ ID NO: 92650 - DNA, 16 bp, H. sapiens
ctgtattccatcctgg

SEQ ID NO: 92651 - DNA, 16 bp, H. sapiens
ctgtattcccagcagt

SEQ ID NO: 92652 - DNA, 16 bp, H. sapiens
ctgtattcccagctat

SEQ ID NO: 92653 - DNA, 16 bp, H. sapiens
ctgtattcccctgcac

SEQ ID NO: 92654 - DNA, 16 bp, H. sapiens
ctgtattctctccctt

SEQ ID NO: 92655 - DNA, 16 bp, H. sapiens
ctgtattcttacaata

SEQ ID NO: 92656 - DNA, 16 bp, H. sapiens
ctgtattcttgaaaat

SEQ ID NO: 92657 - DNA, 16 bp, H. sapiens
ctgtattgcccagtct

SEQ ID NO: 92658 - DNA, 16 bp, H. sapiens
ctgtatttaaaaaaaa

SEQ ID NO: 92659 - DNA, 16 bp, H. sapiens
ctgtatttaaaatttt

SEQ ID NO: 92660 - DNA, 16 bp, H. sapiens
ctgtatttacccaatg

SEQ ID NO: 92661 - DNA, 16 bp, H. sapiens
ctgtatttcactcagc

SEQ ID NO: 92662 - DNA, 16 bp, H. sapiens
ctgtatttcttgaatt

SEQ ID NO: 92663 - DNA, 16 bp, H. sapiens
ctgtatttgaagataa

SEQ ID NO: 92664 - DNA, 16 bp, H. sapiens
ctgtatttggagagag

SEQ ID NO: 92665 - DNA, 16 bp, H. sapiens
ctgtatttgtataaat

SEQ ID NO: 92666 - DNA, 16 bp, H. sapiens
ctgtatttgtctgtgt

SEQ ID NO: 92667 - DNA, 16 bp, H. sapiens
ctgtattttaatttta

SEQ ID NO: 92668 - DNA, 16 bp, H. sapiens
ctgtattttcaaataa

SEQ ID NO: 92669 - DNA, 16 bp, H. sapiens
ctgtattttcatttaa

SEQ ID NO: 92670 - DNA, 16 bp, H. sapiens
ctgtattttgtgctga

SEQ ID NO: 92671 - DNA, 16 bp, H. sapiens
ctgtatttttaaaaat

SEQ ID NO: 92672 - DNA, 16 bp, H. sapiens
ctgtatttttactgta

SEQ ID NO: 92673 - DNA, 18 bp, H. sapiens
ctgtatttttagtagaga

SEQ ID NO: 92674 - DNA, 16 bp, H. sapiens
ctgtattttttaattg

SEQ ID NO: 92675 - DNA, 16 bp, H. sapiens
ctgtcaaaaacaaaaa

SEQ ID NO: 92676 - DNA, 16 bp, H. sapiens
ctgtcaaaaagaaaga

SEQ ID NO: 92677 - DNA, 16 bp, H. sapiens
ctgtcaaatcacagag

SEQ ID NO: 92678 - DNA, 16 bp, H. sapiens
ctgtcaaatgctgctg

SEQ ID NO: 92679 - DNA, 16 bp, H. sapiens
ctgtcaaatggggata

SEQ ID NO: 92680 - DNA, 16 bp, H. sapiens
ctgtcaaggatgtgga

SEQ ID NO: 92681 - DNA, 16 bp, H. sapiens
ctgtcaatggagtatt

SEQ ID NO: 92682 - DNA, 16 bp, H. sapiens
ctgtcacaactactca

SEQ ID NO: 92683 - DNA, 16 bp, H. sapiens
ctgtcacaaggctgga

SEQ ID NO: 92684 - DNA, 16 bp, H. sapiens
ctgtcaccaagctgga

SEQ ID NO: 92685 - DNA, 16 bp, H. sapiens
ctgtcaccacccaggc

SEQ ID NO: 92686 - DNA, 16 bp, H. sapiens
ctgtcaccagaacagc

SEQ ID NO: 92687 - DNA, 16 bp, H. sapiens
ctgtcaccaggccaga

SEQ ID NO: 92688 - DNA, 17 bp, H. sapiens
ctgtcacccacgctgga

SEQ ID NO: 92689 - DNA, 16 bp, H. sapiens
ctgtcacccagagctg

SEQ ID NO: 92690 - DNA, 16 bp, H. sapiens
ctgtcacccaggagtg

SEQ ID NO: 92691 - DNA, 16 bp, H. sapiens
ctgtcacccaggctac

SEQ ID NO: 92692 - DNA, 17 bp, H. sapiens
ctgtcacccaggctggt

SEQ ID NO: 92693 - DNA, 16 bp, H. sapiens
ctgtcacctaggatgg

SEQ ID NO: 92694 - DNA, 16 bp, H. sapiens
ctgtcacctctcagaa

SEQ ID NO: 92695 - DNA, 16 bp, H. sapiens
ctgtcacctgactcta

SEQ ID NO: 92696 - DNA, 16 bp, H. sapiens
ctgtcactcaggctaa

SEQ ID NO: 92697 - DNA, 16 bp, H. sapiens
ctgtcactgcagaaaa

SEQ ID NO: 92698 - DNA, 16 bp, H. sapiens
ctgtcactgtcttgaa

SEQ ID NO: 92699 - DNA, 16 bp, H. sapiens
ctgtcacttattagct

SEQ ID NO: 92700 - DNA, 16 bp, H. sapiens
ctgtcacttccctgct

SEQ ID NO: 92701 - DNA, 16 bp, H. sapiens
ctgtcactttaaaaaa

SEQ ID NO: 92702 - DNA, 16 bp, H. sapiens
ctgtcactttcaggca

SEQ ID NO: 92703 - DNA, 16 bp, H. sapiens
ctgtcagaccacagtg

SEQ ID NO: 92704 - DNA, 16 bp, H. sapiens
ctgtcagaggagcaga

SEQ ID NO: 92705 - DNA, 16 bp, H. sapiens
ctgtcagcaggaagca

SEQ ID NO: 92706 - DNA, 16 bp, H. sapiens
ctgtcagcattagaca

SEQ ID NO: 92707 - DNA, 16 bp, H. sapiens
ctgtcagccaagctgg

SEQ ID NO: 92708 - DNA, 16 bp, H. sapiens
ctgtcagccaggctgc

SEQ ID NO: 92709 - DNA, 16 bp, H. sapiens
ctgtcagctctgaagg

SEQ ID NO: 92710 - DNA, 16 bp, H. sapiens
ctgtcagtcaattaaa

SEQ ID NO: 92711 - DNA, 16 bp, H. sapiens
ctgtcagtcttatgat

SEQ ID NO: 92712 - DNA, 16 bp, H. sapiens
ctgtcagtttttcttt

SEQ ID NO: 92713 - DNA, 17 bp, H. sapiens
ctgtcatcccaccactt

SEQ ID NO: 92714 - DNA, 16 bp, H. sapiens
ctgtcatctcctataa

SEQ ID NO: 92715 - DNA, 16 bp, H. sapiens
ctgtcattatgatggt

SEQ ID NO: 92716 - DNA, 16 bp, H. sapiens
ctgtcattctgtcatt

SEQ ID NO: 92717 - DNA, 16 bp, H. sapiens
ctgtcattgatgggca

SEQ ID NO: 92718 - DNA, 16 bp, H. sapiens
ctgtcattgtctccca

SEQ ID NO: 92719 - DNA, 16 bp, H. sapiens
ctgtcatttgcaaaaa

SEQ ID NO: 92720 - DNA, 16 bp, H. sapiens
ctgtcattttattaat

SEQ ID NO: 92721 - DNA, 16 bp, H. sapiens
ctgtccaacatggcaa

SEQ ID NO: 92722 - DNA, 16 bp, H. sapiens
ctgtccacacacacac

SEQ ID NO: 92723 - DNA, 16 bp, H. sapiens
ctgtccagcatggtga

SEQ ID NO: 92724 - DNA, 16 bp, H. sapiens
ctgtccagtgctgaaa

SEQ ID NO: 92725 - DNA, 16 bp, H. sapiens
ctgtccatccatccac

SEQ ID NO: 92726 - DNA, 16 bp, H. sapiens
ctgtccatgagcatgg

SEQ ID NO: 92727 - DNA, 16 bp, H. sapiens
ctgtccatggtgctga

SEQ ID NO: 92728 - DNA, 16 bp, H. sapiens
ctgtccatgtgttctc

SEQ ID NO: 92729 - DNA, 16 bp, H. sapiens
ctgtccatttttgctt

SEQ ID NO: 92730 - DNA, 16 bp, H. sapiens
ctgtcccagcctccca

SEQ ID NO: 92731 - DNA, 16 bp, H. sapiens
ctgtcccagctactca

SEQ ID NO: 92732 - DNA, 16 bp, H. sapiens
ctgtcccagctacttg

SEQ ID NO: 92733 - DNA, 16 bp, H. sapiens
ctgtcccattggtctg

SEQ ID NO: 92734 - DNA, 16 bp, H. sapiens
ctgtccccaccctgcc

SEQ ID NO: 92735 - DNA, 16 bp, H. sapiens
ctgtccccacctcctc

SEQ ID NO: 92736 - DNA, 16 bp, H. sapiens
ctgtccccagagctgt

SEQ ID NO: 92737 - DNA, 16 bp, H. sapiens
ctgtccccagcaccca

SEQ ID NO: 92738 - DNA, 16 bp, H. sapiens
ctgtccccagggctgg

SEQ ID NO: 92739 - DNA, 16 bp, H. sapiens
ctgtccccattaaaca

SEQ ID NO: 92740 - DNA, 16 bp, H. sapiens
ctgtcccctctgcctg

SEQ ID NO: 92741 - DNA, 16 bp, H. sapiens
ctgtccccttccccca

SEQ ID NO: 92742 - DNA, 16 bp, H. sapiens
ctgtccctaccaaaaa

SEQ ID NO: 92743 - DNA, 16 bp, H. sapiens
ctgtccctcaggctgg

SEQ ID NO: 92744 - DNA, 16 bp, H. sapiens
ctgtccctctgcctgg

SEQ ID NO: 92745 - DNA, 16 bp, H. sapiens
ctgtccctctggagaa

SEQ ID NO: 92746 - DNA, 16 bp, H. sapiens
ctgtccctgagcctct

SEQ ID NO: 92747 - DNA, 16 bp, H. sapiens
ctgtccctgaggctgg

SEQ ID NO: 92748 - DNA, 16 bp, H. sapiens
ctgtccctgccctcag

SEQ ID NO: 92749 - DNA, 16 bp, H. sapiens
ctgtccctgccctgcc

SEQ ID NO: 92750 - DNA, 16 bp, H. sapiens
ctgtccctgtctctct

SEQ ID NO: 92751 - DNA, 16 bp, H. sapiens
ctgtccctgtctgaca

SEQ ID NO: 92752 - DNA, 16 bp, H. sapiens
ctgtccctgtttgcag

SEQ ID NO: 92753 - DNA, 16 bp, H. sapiens
ctgtcctaaaaccaga

SEQ ID NO: 92754 - DNA, 16 bp, H. sapiens
ctgtcctaaaagagct

SEQ ID NO: 92755 - DNA, 16 bp, H. sapiens
ctgtcctcaaggagct

SEQ ID NO: 92756 - DNA, 16 bp, H. sapiens
ctgtcctcatagagct

SEQ ID NO: 92757 - DNA, 16 bp, H. sapiens
ctgtcctccagaccct

SEQ ID NO: 92758 - DNA, 16 bp, H. sapiens
ctgtcctccagccccc

SEQ ID NO: 92759 - DNA, 16 bp, H. sapiens
ctgtcctccaggctgg

SEQ ID NO: 92760 - DNA, 16 bp, H. sapiens
ctgtcctcctgttctt

SEQ ID NO: 92761 - DNA, 17 bp, H. sapiens
ctgtcctctagacccca

SEQ ID NO: 92762 - DNA, 16 bp, H. sapiens
ctgtcctctctgaacc

SEQ ID NO: 92763 - DNA, 16 bp, H. sapiens
ctgtcctctctgcctg

SEQ ID NO: 92764 - DNA, 16 bp, H. sapiens
ctgtcctcttcactgc

SEQ ID NO: 92765 - DNA, 16 bp, H. sapiens
ctgtcctgcctcagcc

SEQ ID NO: 92766 - DNA, 16 bp, H. sapiens
ctgtcctgcctggctc

SEQ ID NO: 92767 - DNA, 16 bp, H. sapiens
ctgtcctgctccatcc

SEQ ID NO: 92768 - DNA, 16 bp, H. sapiens
ctgtcctgggcactgt

SEQ ID NO: 92769 - DNA, 16 bp, H. sapiens
ctgtcctgtacattgt

SEQ ID NO: 92770 - DNA, 16 bp, H. sapiens
ctgtcctgtgcccact

SEQ ID NO: 92771 - DNA, 16 bp, H. sapiens
ctgtccttaaaaaaaa

SEQ ID NO: 92772 - DNA, 16 bp, H. sapiens
ctgtccttcaggaatg

SEQ ID NO: 92773 - DNA, 16 bp, H. sapiens
ctgtccttcttgagaa

SEQ ID NO: 92774 - DNA, 16 bp, H. sapiens
ctgtcctttgtccaca

SEQ ID NO: 92775 - DNA, 16 bp, H. sapiens
ctgtcgccaggctggt

SEQ ID NO: 92776 - DNA, 16 bp, H. sapiens
ctgtcgccagggctgg

SEQ ID NO: 92777 - DNA, 16 bp, H. sapiens
ctgtcgcccaggctgc

SEQ ID NO: 92778 - DNA, 16 bp, H. sapiens
ctgtcgtctcagctac

SEQ ID NO: 92779 - DNA, 16 bp, H. sapiens
ctgtctaaaaatatat

SEQ ID NO: 92780 - DNA, 16 bp, H. sapiens
ctgtctaggtttgatg

SEQ ID NO: 92781 - DNA, 16 bp, H. sapiens
ctgtctatatatatag

SEQ ID NO: 92782 - DNA, 16 bp, H. sapiens
ctgtctatgtcttgaa

SEQ ID NO: 92783 - DNA, 16 bp, H. sapiens
ctgtctcaaaaaaagt

SEQ ID NO: 92784 - DNA, 16 bp, H. sapiens
ctgtctcaaaaacgaa

SEQ ID NO: 92785 - DNA, 16 bp, H. sapiens
ctgtctcaaaaatgaa

SEQ ID NO: 92786 - DNA, 16 bp, H. sapiens
ctgtctcaaacacaca

SEQ ID NO: 92787 - DNA, 16 bp, H. sapiens
ctgtctcaaagaagaa

SEQ ID NO: 92788 - DNA, 16 bp, H. sapiens
ctgtctcaactactca

SEQ ID NO: 92789 - DNA, 16 bp, H. sapiens
ctgtctcagaaagaaa

SEQ ID NO: 92790 - DNA, 16 bp, H. sapiens
ctgtctcagaagaaaa

SEQ ID NO: 92791 - DNA, 20 bp, H. sapiens
ctgtctcagcctcccaagta

SEQ ID NO: 92792 - DNA, 16 bp, H. sapiens
ctgtctcagcctcccg

SEQ ID NO: 92793 - DNA, 16 bp, H. sapiens
ctgtctcagcctctgg

SEQ ID NO: 92794 - DNA, 16 bp, H. sapiens
ctgtctcagccttctg

SEQ ID NO: 92795 - DNA, 16 bp, H. sapiens
ctgtctcaggctggag

SEQ ID NO: 92796 - DNA, 16 bp, H. sapiens
ctgtctcataaaaaat

SEQ ID NO: 92797 - DNA, 16 bp, H. sapiens
ctgtctcatcctcccg

SEQ ID NO: 92798 - DNA, 16 bp, H. sapiens
ctgtctcatcctcctg

SEQ ID NO: 92799 - DNA, 16 bp, H. sapiens
ctgtctcattttaatg

SEQ ID NO: 92800 - DNA, 16 bp, H. sapiens
ctgtctccaaaaaaag

SEQ ID NO: 92801 - DNA, 16 bp, H. sapiens
ctgtctccagaaaaaa

SEQ ID NO: 92802 - DNA, 16 bp, H. sapiens
ctgtctccagaaacca

SEQ ID NO: 92803 - DNA, 16 bp, H. sapiens
ctgtctccaggctctg

SEQ ID NO: 92804 - DNA, 16 bp, H. sapiens
ctgtctccatgagttt

SEQ ID NO: 92805 - DNA, 16 bp, H. sapiens
ctgtctccatgattca

SEQ ID NO: 92806 - DNA, 16 bp, H. sapiens
ctgtctcccagagcct

SEQ ID NO: 92807 - DNA, 16 bp, H. sapiens
ctgtctcccaggttca

SEQ ID NO: 92808 - DNA, 16 bp, H. sapiens
ctgtctcccagtctct

SEQ ID NO: 92809 - DNA, 16 bp, H. sapiens
ctgtctccccagcacc

SEQ ID NO: 92810 - DNA, 16 bp, H. sapiens
ctgtctccccggctgg

SEQ ID NO: 92811 - DNA, 16 bp, H. sapiens
ctgtctccctctgtct

SEQ ID NO: 92812 - DNA, 16 bp, H. sapiens
ctgtctccctgtctct

SEQ ID NO: 92813 - DNA, 16 bp, H. sapiens
ctgtctcctcaactca

SEQ ID NO: 92814 - DNA, 16 bp, H. sapiens
ctgtctcctgctcatc

SEQ ID NO: 92815 - DNA, 16 bp, H. sapiens
ctgtctcctgggttcc

SEQ ID NO: 92816 - DNA, 16 bp, H. sapiens
ctgtctcctgggttta

SEQ ID NO: 92817 - DNA, 16 bp, H. sapiens
ctgtctcctgtcaccc

SEQ ID NO: 92818 - DNA, 16 bp, H. sapiens
ctgtctccttggttca

SEQ ID NO: 92819 - DNA, 16 bp, H. sapiens
ctgtctcgtggatctg

SEQ ID NO: 92820 - DNA, 16 bp, H. sapiens
ctgtctctaaaaaaca

SEQ ID NO: 92821 - DNA, 16 bp, H. sapiens
ctgtctctaaaaagag

SEQ ID NO: 92822 - DNA, 16 bp, H. sapiens
ctgtctctacataaaa

SEQ ID NO: 92823 - DNA, 16 bp, H. sapiens
ctgtctctactggaaa

SEQ ID NO: 92824 - DNA, 16 bp, H. sapiens
ctgtctctacttaaaa

SEQ ID NO: 92825 - DNA, 16 bp, H. sapiens
ctgtctctagaaaaaa

SEQ ID NO: 92826 - DNA, 16 bp, H. sapiens
ctgtctctatggattt

SEQ ID NO: 92827 - DNA, 16 bp, H. sapiens
ctgtctctcaaaccac

SEQ ID NO: 92828 - DNA, 16 bp, H. sapiens
ctgtctctcacacaca

SEQ ID NO: 92829 - DNA, 16 bp, H. sapiens
ctgtctctccacctct

SEQ ID NO: 92830 - DNA, 16 bp, H. sapiens
ctgtctctccagtttt

SEQ ID NO: 92831 - DNA, 16 bp, H. sapiens
ctgtctctctaaaaca

SEQ ID NO: 92832 - DNA, 16 bp, H. sapiens
ctgtctctctcacaca

SEQ ID NO: 92833 - DNA, 16 bp, H. sapiens
ctgtctctctcctgct

SEQ ID NO: 92834 - DNA, 16 bp, H. sapiens
ctgtctctctctgcct

SEQ ID NO: 92835 - DNA, 16 bp, H. sapiens
ctgtctctgaaaacaa

SEQ ID NO: 92836 - DNA, 16 bp, H. sapiens
ctgtctctgaaataaa

SEQ ID NO: 92837 - DNA, 16 bp, H. sapiens
ctgtctctgtgggttt

SEQ ID NO: 92838 - DNA, 16 bp, H. sapiens
ctgtctcttagaaaaa

SEQ ID NO: 92839 - DNA, 16 bp, H. sapiens
ctgtctcttgctcctg

SEQ ID NO: 92840 - DNA, 16 bp, H. sapiens
ctgtctctttgaaatg

SEQ ID NO: 92841 - DNA, 16 bp, H. sapiens
ctgtctcttttaaaaa

SEQ ID NO: 92842 - DNA, 16 bp, H. sapiens
ctgtctgaaaaaaaaa

SEQ ID NO: 92843 - DNA, 16 bp, H. sapiens
ctgtctgaaaaaaaga

SEQ ID NO: 92844 - DNA, 16 bp, H. sapiens
ctgtctgaaacaaaca

SEQ ID NO: 92845 - DNA, 16 bp, H. sapiens
ctgtctgaaagaaaga

SEQ ID NO: 92846 - DNA, 16 bp, H. sapiens
ctgtctgagtgggagc

SEQ ID NO: 92847 - DNA, 16 bp, H. sapiens
ctgtctgatctttgac

SEQ ID NO: 92848 - DNA, 16 bp, H. sapiens
ctgtctgcagacagca

SEQ ID NO: 92849 - DNA, 16 bp, H. sapiens
ctgtctgccaggcact

SEQ ID NO: 92850 - DNA, 16 bp, H. sapiens
ctgtctgcctctgcct

SEQ ID NO: 92851 - DNA, 16 bp, H. sapiens
ctgtctgcctgcctca

SEQ ID NO: 92852 - DNA, 16 bp, H. sapiens
ctgtctgccttctgct

SEQ ID NO: 92853 - DNA, 16 bp, H. sapiens
ctgtctgcttctctct

SEQ ID NO: 92854 - DNA, 16 bp, H. sapiens
ctgtctgggagggagg

SEQ ID NO: 92855 - DNA, 16 bp, H. sapiens
ctgtctgggttcaaat

SEQ ID NO: 92856 - DNA, 16 bp, H. sapiens
ctgtctgtactaaaat

SEQ ID NO: 92857 - DNA, 16 bp, H. sapiens
ctgtctgtccctccag

SEQ ID NO: 92858 - DNA, 16 bp, H. sapiens
ctgtctgtccgtctgt

SEQ ID NO: 92859 - DNA, 16 bp, H. sapiens
ctgtctgtctctcctt

SEQ ID NO: 92860 - DNA, 17 bp, H. sapiens
ctgtctgtctctctctc

SEQ ID NO: 92861 - DNA, 16 bp, H. sapiens
ctgtctgtctgtccct

SEQ ID NO: 92862 - DNA, 16 bp, H. sapiens
ctgtctgtctgtctca

SEQ ID NO: 92863 - DNA, 16 bp, H. sapiens
ctgtctgtctgtctct

SEQ ID NO: 92864 - DNA, 16 bp, H. sapiens
ctgtctgtctgtctgt

SEQ ID NO: 92865 - DNA, 16 bp, H. sapiens
ctgtctgtctgtgtct

SEQ ID NO: 92866 - DNA, 16 bp, H. sapiens
ctgtctgtgtcttgaa

SEQ ID NO: 92867 - DNA, 16 bp, H. sapiens
ctgtctgtgtgactgt

SEQ ID NO: 92868 - DNA, 16 bp, H. sapiens
ctgtctgtgtgtctct

SEQ ID NO: 92869 - DNA, 16 bp, H. sapiens
ctgtcttaaaaacaac

SEQ ID NO: 92870 - DNA, 16 bp, H. sapiens
ctgtcttaaacaaaaa

SEQ ID NO: 92871 - DNA, 16 bp, H. sapiens
ctgtcttagtcagctc

SEQ ID NO: 92872 - DNA, 16 bp, H. sapiens
ctgtcttcaagaagct

SEQ ID NO: 92873 - DNA, 16 bp, H. sapiens
ctgtcttcaaggaaca

SEQ ID NO: 92874 - DNA, 16 bp, H. sapiens
ctgtcttcagcctcct

SEQ ID NO: 92875 - DNA, 16 bp, H. sapiens
ctgtcttccagcctgg

SEQ ID NO: 92876 - DNA, 16 bp, H. sapiens
ctgtcttccctcccag

SEQ ID NO: 92877 - DNA, 16 bp, H. sapiens
ctgtcttcctccagga

SEQ ID NO: 92878 - DNA, 16 bp, H. sapiens
ctgtcttcctcctgct

SEQ ID NO: 92879 - DNA, 16 bp, H. sapiens
ctgtcttcctgccttc

SEQ ID NO: 92880 - DNA, 16 bp, H. sapiens
ctgtcttcctgtctct

SEQ ID NO: 92881 - DNA, 16 bp, H. sapiens
ctgtcttctgggttca

SEQ ID NO: 92882 - DNA, 16 bp, H. sapiens
ctgtcttctgtctcct

SEQ ID NO: 92883 - DNA, 16 bp, H. sapiens
ctgtcttctgtcttcc

SEQ ID NO: 92884 - DNA, 16 bp, H. sapiens
ctgtcttcttctgatc

SEQ ID NO: 92885 - DNA, 16 bp, H. sapiens
ctgtcttcttgcactg

SEQ ID NO: 92886 - DNA, 16 bp, H. sapiens
ctgtcttctttcactt

SEQ ID NO: 92887 - DNA, 16 bp, H. sapiens
ctgtcttctttttaaa

SEQ ID NO: 92888 - DNA, 16 bp, H. sapiens
ctgtcttgcaagaaga

SEQ ID NO: 92889 - DNA, 16 bp, H. sapiens
ctgtcttgcctgccac

SEQ ID NO: 92890 - DNA, 16 bp, H. sapiens
ctgtcttgcctgctgc

SEQ ID NO: 92891 - DNA, 16 bp, H. sapiens
ctgtcttgctctctct

SEQ ID NO: 92892 - DNA, 16 bp, H. sapiens
ctgtcttggcctcctg

SEQ ID NO: 92893 - DNA, 16 bp, H. sapiens
ctgtcttgtgccagct

SEQ ID NO: 92894 - DNA, 16 bp, H. sapiens
ctgtctttaccaaaaa

SEQ ID NO: 92895 - DNA, 16 bp, H. sapiens
ctgtctttactaaaca

SEQ ID NO: 92896 - DNA, 16 bp, H. sapiens
ctgtctttcaagttta

SEQ ID NO: 92897 - DNA, 16 bp, H. sapiens
ctgtctttcacagtgg

SEQ ID NO: 92898 - DNA, 16 bp, H. sapiens
ctgtctttgtctctgt

SEQ ID NO: 92899 - DNA, 16 bp, H. sapiens
ctgtctttgtctttga

SEQ ID NO: 92900 - DNA, 16 bp, H. sapiens
ctgtcttttattatag

SEQ ID NO: 92901 - DNA, 16 bp, H. sapiens
ctgtcttttccccatt

SEQ ID NO: 92902 - DNA, 16 bp, H. sapiens
ctgtcttttctccagt

SEQ ID NO: 92903 - DNA, 16 bp, H. sapiens
ctgtcttttctccatt

SEQ ID NO: 92904 - DNA, 16 bp, H. sapiens
ctgtctttttaatgat

SEQ ID NO: 92905 - DNA, 16 bp, H. sapiens
ctgtcttttttttgag

SEQ ID NO: 92906 - DNA, 16 bp, H. sapiens
ctgtgaaaaacaatat

SEQ ID NO: 92907 - DNA, 16 bp, H. sapiens
ctgtgaaaaacaattt

SEQ ID NO: 92908 - DNA, 16 bp, H. sapiens
ctgtgaaaaaggaaat

SEQ ID NO: 92909 - DNA, 16 bp, H. sapiens
ctgtgaaaaataaatg

SEQ ID NO: 92910 - DNA, 16 bp, H. sapiens
ctgtgaaaacactttg

SEQ ID NO: 92911 - DNA, 16 bp, H. sapiens
ctgtgaaaagaaaata

SEQ ID NO: 92912 - DNA, 16 bp, H. sapiens
ctgtgaaacagctttg

SEQ ID NO: 92913 - DNA, 16 bp, H. sapiens
ctgtgaaagaaaaata

SEQ ID NO: 92914 - DNA, 16 bp, H. sapiens
ctgtgaaagtgctttg

SEQ ID NO: 92915 - DNA, 16 bp, H. sapiens
ctgtgaaatgaatgaa

SEQ ID NO: 92916 - DNA, 16 bp, H. sapiens
ctgtgaacagccactg

SEQ ID NO: 92917 - DNA, 16 bp, H. sapiens
ctgtgaacatttgtgt

SEQ ID NO: 92918 - DNA, 16 bp, H. sapiens
ctgtgaaccaggaagc

SEQ ID NO: 92919 - DNA, 16 bp, H. sapiens
ctgtgaacccgggagg

SEQ ID NO: 92920 - DNA, 16 bp, H. sapiens
ctgtgaagaaaataaa

SEQ ID NO: 92921 - DNA, 16 bp, H. sapiens
ctgtgaagaaactcaa

SEQ ID NO: 92922 - DNA, 16 bp, H. sapiens
ctgtgaagaagctttt

SEQ ID NO: 92923 - DNA, 16 bp, H. sapiens
ctgtgaagaataatgg

SEQ ID NO: 92924 - DNA, 16 bp, H. sapiens
ctgtgaagaatattat

SEQ ID NO: 92925 - DNA, 16 bp, H. sapiens
ctgtgaagaatgtaaa

SEQ ID NO: 92926 - DNA, 16 bp, H. sapiens
ctgtgaagaatttcat

SEQ ID NO: 92927 - DNA, 16 bp, H. sapiens
ctgtgaagacagtcat

SEQ ID NO: 92928 - DNA, 16 bp, H. sapiens
ctgtgaagactataat

SEQ ID NO: 92929 - DNA, 16 bp, H. sapiens
ctgtgaaggtgttttt

SEQ ID NO: 92930 - DNA, 22 bp, H. sapiens
ctgtgaatagccactgcactcc

SEQ ID NO: 92931 - DNA, 16 bp, H. sapiens
ctgtgaatatgttact

SEQ ID NO: 92932 - DNA, 16 bp, H. sapiens
ctgtgaatatgttatg

SEQ ID NO: 92933 - DNA, 16 bp, H. sapiens
ctgtgaatattcaaca

SEQ ID NO: 92934 - DNA, 16 bp, H. sapiens
ctgtgaattgtctttt

SEQ ID NO: 92935 - DNA, 16 bp, H. sapiens
ctgtgaattttccaaa

SEQ ID NO: 92936 - DNA, 16 bp, H. sapiens
ctgtgaattttggtat

SEQ ID NO: 92937 - DNA, 16 bp, H. sapiens
ctgtgaatttttaaaa

SEQ ID NO: 92938 - DNA, 16 bp, H. sapiens
ctgtgacaaaattcaa

SEQ ID NO: 92939 - DNA, 16 bp, H. sapiens
ctgtgacaggagaatc

SEQ ID NO: 92940 - DNA, 16 bp, H. sapiens
ctgtgacatgtgttta

SEQ ID NO: 92941 - DNA, 16 bp, H. sapiens
ctgtgaccccagctac

SEQ ID NO: 92942 - DNA, 16 bp, H. sapiens
ctgtgacctgcaggta

SEQ ID NO: 92943 - DNA, 16 bp, H. sapiens
ctgtgaccttcacaag

SEQ ID NO: 92944 - DNA, 16 bp, H. sapiens
ctgtgaccttgctgaa

SEQ ID NO: 92945 - DNA, 16 bp, H. sapiens
ctgtgaccttgggaag

SEQ ID NO: 92946 - DNA, 16 bp, H. sapiens
ctgtgactcttgcaga

SEQ ID NO: 92947 - DNA, 16 bp, H. sapiens
ctgtgacttgcacgta

SEQ ID NO: 92948 - DNA, 16 bp, H. sapiens
ctgtgacttgcttcta

SEQ ID NO: 92949 - DNA, 16 bp, H. sapiens
ctgtgactttggacaa

SEQ ID NO: 92950 - DNA, 16 bp, H. sapiens
ctgtgagagaataaat

SEQ ID NO: 92951 - DNA, 16 bp, H. sapiens
ctgtgagagcagccac

SEQ ID NO: 92952 - DNA, 16 bp, H. sapiens
ctgtgagaggaatcca

SEQ ID NO: 92953 - DNA, 16 bp, H. sapiens
ctgtgagataaatgca

SEQ ID NO: 92954 - DNA, 16 bp, H. sapiens
ctgtgagattaatcca

SEQ ID NO: 92955 - DNA, 16 bp, H. sapiens
ctgtgagcaaattaaa

SEQ ID NO: 92956 - DNA, 16 bp, H. sapiens
ctgtgagccaaataaa

SEQ ID NO: 92957 - DNA, 16 bp, H. sapiens
ctgtgagccaaataca

SEQ ID NO: 92958 - DNA, 16 bp, H. sapiens
ctgtgagccaaggaat

SEQ ID NO: 92959 - DNA, 16 bp, H. sapiens
ctgtgagccatgatca

SEQ ID NO: 92960 - DNA, 16 bp, H. sapiens
ctgtgagccgagatcg

SEQ ID NO: 92961 - DNA, 16 bp, H. sapiens
ctgtgagctatgattg

SEQ ID NO: 92962 - DNA, 16 bp, H. sapiens
ctgtgagctgaactgc

SEQ ID NO: 92963 - DNA, 16 bp, H. sapiens
ctgtgagctgcactgc

SEQ ID NO: 92964 - DNA, 16 bp, H. sapiens
ctgtgagctgtgattg

SEQ ID NO: 92965 - DNA, 16 bp, H. sapiens
ctgtgaggaaaaaaaa

SEQ ID NO: 92966 - DNA, 16 bp, H. sapiens
ctgtgaggatggcttc

SEQ ID NO: 92967 - DNA, 16 bp, H. sapiens
ctgtgaggattaaatg

SEQ ID NO: 92968 - DNA, 16 bp, H. sapiens
ctgtgaggctgtggct

SEQ ID NO: 92969 - DNA, 16 bp, H. sapiens
ctgtgagggaggctgg

SEQ ID NO: 92970 - DNA, 16 bp, H. sapiens
ctgtgagggttcttgg

SEQ ID NO: 92971 - DNA, 16 bp, H. sapiens
ctgtgaggtgaatcca

SEQ ID NO: 92972 - DNA, 16 bp, H. sapiens
ctgtgaggttgaggct

SEQ ID NO: 92973 - DNA, 16 bp, H. sapiens
ctgtgagtcccctgat

SEQ ID NO: 92974 - DNA, 16 bp, H. sapiens
ctgtgagtgtaaaata

SEQ ID NO: 92975 - DNA, 16 bp, H. sapiens
ctgtgatactgttctt

SEQ ID NO: 92976 - DNA, 16 bp, H. sapiens
ctgtgatattggaagt

SEQ ID NO: 92977 - DNA, 16 bp, H. sapiens
ctgtgatcagtgattt

SEQ ID NO: 92978 - DNA, 16 bp, H. sapiens
ctgtgatccaggctgg

SEQ ID NO: 92979 - DNA, 16 bp, H. sapiens
ctgtgatcccaccact

SEQ ID NO: 92980 - DNA, 17 bp, H. sapiens
ctgtgatcccagctact

SEQ ID NO: 92981 - DNA, 16 bp, H. sapiens
ctgtgatcttaccact

SEQ ID NO: 92982 - DNA, 16 bp, H. sapiens
ctgtgatgacaccact

SEQ ID NO: 92983 - DNA, 16 bp, H. sapiens
ctgtgatgatagaaat

SEQ ID NO: 92984 - DNA, 16 bp, H. sapiens
ctgtgatggccagtga

SEQ ID NO: 92985 - DNA, 16 bp, H. sapiens
ctgtgattctgccact

SEQ ID NO: 92986 - DNA, 16 bp, H. sapiens
ctgtgattgaaccact

SEQ ID NO: 92987 - DNA, 16 bp, H. sapiens
ctgtgcaacacagcga

SEQ ID NO: 92988 - DNA, 16 bp, H. sapiens
ctgtgcaaccttgggc

SEQ ID NO: 92989 - DNA, 16 bp, H. sapiens
ctgtgcaatagaacac

SEQ ID NO: 92990 - DNA, 16 bp, H. sapiens
ctgtgcaatcatcacc

SEQ ID NO: 92991 - DNA, 16 bp, H. sapiens
ctgtgcacacagaaaa

SEQ ID NO: 92992 - DNA, 16 bp, H. sapiens
ctgtgcaccaggcact

SEQ ID NO: 92993 - DNA, 16 bp, H. sapiens
ctgtgcactccttatg

SEQ ID NO: 92994 - DNA, 16 bp, H. sapiens
ctgtgcagaaggtttt

SEQ ID NO: 92995 - DNA, 16 bp, H. sapiens
ctgtgcagatgagaag

SEQ ID NO: 92996 - DNA, 16 bp, H. sapiens
ctgtgcagatgctctt

SEQ ID NO: 92997 - DNA, 16 bp, H. sapiens
ctgtgcagattctcag

SEQ ID NO: 92998 - DNA, 16 bp, H. sapiens
ctgtgcagcaggcagg

SEQ ID NO: 92999 - DNA, 16 bp, H. sapiens
ctgtgcagcctcagga

SEQ ID NO: 93000 - DNA, 16 bp, H. sapiens
ctgtgcagcctctgga

SEQ ID NO: 93001 - DNA, 16 bp, H. sapiens
ctgtgcagctgcaagg

SEQ ID NO: 93002 - DNA, 16 bp, H. sapiens
ctgtgcaggaccccac

SEQ ID NO: 93003 - DNA, 16 bp, H. sapiens
ctgtgcagtagctttt

SEQ ID NO: 93004 - DNA, 16 bp, H. sapiens
ctgtgcagtttgacct

SEQ ID NO: 93005 - DNA, 16 bp, H. sapiens
ctgtgcatatatatat

SEQ ID NO: 93006 - DNA, 16 bp, H. sapiens
ctgtgcatggtggcac

SEQ ID NO: 93007 - DNA, 16 bp, H. sapiens
ctgtgcattgcaggat

SEQ ID NO: 93008 - DNA, 16 bp, H. sapiens
ctgtgcattgtaagat

SEQ ID NO: 93009 - DNA, 16 bp, H. sapiens
ctgtgcattgtaggat

SEQ ID NO: 93010 - DNA, 16 bp, H. sapiens
ctgtgccaagcacttt

SEQ ID NO: 93011 - DNA, 16 bp, H. sapiens
ctgtgccaccacacct

SEQ ID NO: 93012 - DNA, 16 bp, H. sapiens
ctgtgccactgtactc

SEQ ID NO: 93013 - DNA, 16 bp, H. sapiens
ctgtgccaggcacaga

SEQ ID NO: 93014 - DNA, 16 bp, H. sapiens
ctgtgccaggcactgt

SEQ ID NO: 93015 - DNA, 16 bp, H. sapiens
ctgtgccaggccccag

SEQ ID NO: 93016 - DNA, 16 bp, H. sapiens
ctgtgccaggccctgg

SEQ ID NO: 93017 - DNA, 16 bp, H. sapiens
ctgtgccagggctggg

SEQ ID NO: 93018 - DNA, 16 bp, H. sapiens
ctgtgcccagcacagg

SEQ ID NO: 93019 - DNA, 16 bp, H. sapiens
ctgtgcccagcactgc

SEQ ID NO: 93020 - DNA, 16 bp, H. sapiens
ctgtgcccagccaacc

SEQ ID NO: 93021 - DNA, 16 bp, H. sapiens
ctgtgcccagccaagg

SEQ ID NO: 93022 - DNA, 16 bp, H. sapiens
ctgtgcccagccacag

SEQ ID NO: 93023 - DNA, 16 bp, H. sapiens
ctgtgcccagccacat

SEQ ID NO: 93024 - DNA, 16 bp, H. sapiens
ctgtgcccagccactc

SEQ ID NO: 93025 - DNA, 16 bp, H. sapiens
ctgtgcccagccactg

SEQ ID NO: 93026 - DNA, 16 bp, H. sapiens
ctgtgcccagccagcc

SEQ ID NO: 93027 - DNA, 16 bp, H. sapiens
ctgtgcccagccagga

SEQ ID NO: 93028 - DNA, 16 bp, H. sapiens
ctgtgcccagccatgg

SEQ ID NO: 93029 - DNA, 16 bp, H. sapiens
ctgtgcccagcccaac

SEQ ID NO: 93030 - DNA, 16 bp, H. sapiens
ctgtgcccagcccaca

SEQ ID NO: 93031 - DNA, 16 bp, H. sapiens
ctgtgcccagcccaga

SEQ ID NO: 93032 - DNA, 16 bp, H. sapiens
ctgtgcccagcccagg

SEQ ID NO: 93033 - DNA, 16 bp, H. sapiens
ctgtgcccagccccac

SEQ ID NO: 93034 - DNA, 16 bp, H. sapiens
ctgtgcccagccccag

SEQ ID NO: 93035 - DNA, 16 bp, H. sapiens
ctgtgcccagcccctg

SEQ ID NO: 93036 - DNA, 16 bp, H. sapiens
ctgtgcccagccctaa

SEQ ID NO: 93037 - DNA, 16 bp, H. sapiens
ctgtgcccagccctct

SEQ ID NO: 93038 - DNA, 16 bp, H. sapiens
ctgtgcccagccctga

SEQ ID NO: 93039 - DNA, 16 bp, H. sapiens
ctgtgcccagccctgc

SEQ ID NO: 93040 - DNA, 16 bp, H. sapiens
ctgtgcccagcctacc

SEQ ID NO: 93041 - DNA, 16 bp, H. sapiens
ctgtgcccagcctaga

SEQ ID NO: 93042 - DNA, 16 bp, H. sapiens
ctgtgcccagcctcag

SEQ ID NO: 93043 - DNA, 16 bp, H. sapiens
ctgtgcccagcctcct

SEQ ID NO: 93044 - DNA, 16 bp, H. sapiens
ctgtgcccagcctctt

SEQ ID NO: 93045 - DNA, 16 bp, H. sapiens
ctgtgcccagcctgat

SEQ ID NO: 93046 - DNA, 16 bp, H. sapiens
ctgtgcccagcctgca

SEQ ID NO: 93047 - DNA, 16 bp, H. sapiens
ctgtgcccagcctgct

SEQ ID NO: 93048 - DNA, 16 bp, H. sapiens
ctgtgcccagcctgga

SEQ ID NO: 93049 - DNA, 16 bp, H. sapiens
ctgtgcccagcctgtg

SEQ ID NO: 93050 - DNA, 16 bp, H. sapiens
ctgtgcccagctaact

SEQ ID NO: 93051 - DNA, 16 bp, H. sapiens
ctgtgcccagctggca

SEQ ID NO: 93052 - DNA, 16 bp, H. sapiens
ctgtgcccatggacct

SEQ ID NO: 93053 - DNA, 16 bp, H. sapiens
ctgtgcccggccaggc

SEQ ID NO: 93054 - DNA, 16 bp, H. sapiens
ctgtgcccggcccacc

SEQ ID NO: 93055 - DNA, 16 bp, H. sapiens
ctgtgcccggccccac

SEQ ID NO: 93056 - DNA, 16 bp, H. sapiens
ctgtgcccggccctcc

SEQ ID NO: 93057 - DNA, 16 bp, H. sapiens
ctgtgcccggcctcag

SEQ ID NO: 93058 - DNA, 16 bp, H. sapiens
ctgtgcccggcctttc

SEQ ID NO: 93059 - DNA, 16 bp, H. sapiens
ctgtgccctcacaggg

SEQ ID NO: 93060 - DNA, 16 bp, H. sapiens
ctgtgccctctctgat

SEQ ID NO: 93061 - DNA, 16 bp, H. sapiens
ctgtgccctctgcctg

SEQ ID NO: 93062 - DNA, 16 bp, H. sapiens
ctgtgccctgaccacc

SEQ ID NO: 93063 - DNA, 16 bp, H. sapiens
ctgtgccctgcctcca

SEQ ID NO: 93064 - DNA, 16 bp, H. sapiens
ctgtgccctgtgccct

SEQ ID NO: 93065 - DNA, 16 bp, H. sapiens
ctgtgcctcacttctg

SEQ ID NO: 93066 - DNA, 16 bp, H. sapiens
ctgtgcctcagttccc

SEQ ID NO: 93067 - DNA, 16 bp, H. sapiens
ctgtgcctcagtttcc

SEQ ID NO: 93068 - DNA, 16 bp, H. sapiens
ctgtgcctcctgggct

SEQ ID NO: 93069 - DNA, 16 bp, H. sapiens
ctgtgcctgacccaag

SEQ ID NO: 93070 - DNA, 16 bp, H. sapiens
ctgtgcctgctctgcc

SEQ ID NO: 93071 - DNA, 16 bp, H. sapiens
ctgtgcctggcaaatt

SEQ ID NO: 93072 - DNA, 16 bp, H. sapiens
ctgtgcctggccaacc

SEQ ID NO: 93073 - DNA, 16 bp, H. sapiens
ctgtgcctggccaagg

SEQ ID NO: 93074 - DNA, 16 bp, H. sapiens
ctgtgcctggccaggc

SEQ ID NO: 93075 - DNA, 16 bp, H. sapiens
ctgtgcctggccaggg

SEQ ID NO: 93076 - DNA, 16 bp, H. sapiens
ctgtgcctggccagtg

SEQ ID NO: 93077 - DNA, 16 bp, H. sapiens
ctgtgcctggcccacc

SEQ ID NO: 93078 - DNA, 16 bp, H. sapiens
ctgtgcctggccccag

SEQ ID NO: 93079 - DNA, 16 bp, H. sapiens
ctgtgcctggccccca

SEQ ID NO: 93080 - DNA, 16 bp, H. sapiens
ctgtgcctggcccctc

SEQ ID NO: 93081 - DNA, 16 bp, H. sapiens
ctgtgcctggcccctg

SEQ ID NO: 93082 - DNA, 16 bp, H. sapiens
ctgtgcctggcccctt

SEQ ID NO: 93083 - DNA, 16 bp, H. sapiens
ctgtgcctggccctgt

SEQ ID NO: 93084 - DNA, 16 bp, H. sapiens
ctgtgcctggcctatt

SEQ ID NO: 93085 - DNA, 16 bp, H. sapiens
ctgtgcctggcctgcc

SEQ ID NO: 93086 - DNA, 16 bp, H. sapiens
ctgtgcctgggagggt

SEQ ID NO: 93087 - DNA, 16 bp, H. sapiens
ctgtgcctggtgctga

SEQ ID NO: 93088 - DNA, 16 bp, H. sapiens
ctgtgcctgtttcctc

SEQ ID NO: 93089 - DNA, 16 bp, H. sapiens
ctgtgccttaagaaca

SEQ ID NO: 93090 - DNA, 16 bp, H. sapiens
ctgtgccttcattttc

SEQ ID NO: 93091 - DNA, 16 bp, H. sapiens
ctgtgccttggtttct

SEQ ID NO: 93092 - DNA, 16 bp, H. sapiens
ctgtgccttttctatg

SEQ ID NO: 93093 - DNA, 16 bp, H. sapiens
ctgtgcgacagagtga

SEQ ID NO: 93094 - DNA, 16 bp, H. sapiens
ctgtgctaagaacttt

SEQ ID NO: 93095 - DNA, 16 bp, H. sapiens
ctgtgctaagctcttt

SEQ ID NO: 93096 - DNA, 16 bp, H. sapiens
ctgtgctaagtgcttt

SEQ ID NO: 93097 - DNA, 16 bp, H. sapiens
ctgtgctaggtacttt

SEQ ID NO: 93098 - DNA, 16 bp, H. sapiens
ctgtgctatctggccc

SEQ ID NO: 93099 - DNA, 16 bp, H. sapiens
ctgtgctcactgcctg

SEQ ID NO: 93100 - DNA, 16 bp, H. sapiens
ctgtgctcgatttctc

SEQ ID NO: 93101 - DNA, 16 bp, H. sapiens
ctgtgctctacaaatg

SEQ ID NO: 93102 - DNA, 16 bp, H. sapiens
ctgtgctctatgcagc

SEQ ID NO: 93103 - DNA, 16 bp, H. sapiens
ctgtgctcttctcatg

SEQ ID NO: 93104 - DNA, 16 bp, H. sapiens
ctgtgctgaactgtga

SEQ ID NO: 93105 - DNA, 16 bp, H. sapiens
ctgtgctgaatgcttt

SEQ ID NO: 93106 - DNA, 16 bp, H. sapiens
ctgtgctgagctgcct

SEQ ID NO: 93107 - DNA, 16 bp, H. sapiens
ctgtgctgcattctgg

SEQ ID NO: 93108 - DNA, 16 bp, H. sapiens
ctgtgctgcctgaggc

SEQ ID NO: 93109 - DNA, 16 bp, H. sapiens
ctgtgctgctgccatc

SEQ ID NO: 93110 - DNA, 16 bp, H. sapiens
ctgtgctggatgcttt

SEQ ID NO: 93111 - DNA, 16 bp, H. sapiens
ctgtgctgggctctgg

SEQ ID NO: 93112 - DNA, 16 bp, H. sapiens
ctgtgctggggcaggg

SEQ ID NO: 93113 - DNA, 16 bp, H. sapiens
ctgtgctggtggtggc

SEQ ID NO: 93114 - DNA, 16 bp, H. sapiens
ctgtgctgtgcctgct

SEQ ID NO: 93115 - DNA, 16 bp, H. sapiens
ctgtgctgtgctgggg

SEQ ID NO: 93116 - DNA, 16 bp, H. sapiens
ctgtgctgtgtgcagt

SEQ ID NO: 93117 - DNA, 16 bp, H. sapiens
ctgtgcttgatttctc

SEQ ID NO: 93118 - DNA, 16 bp, H. sapiens
ctgtgcttttgagttc

SEQ ID NO: 93119 - DNA, 16 bp, H. sapiens
ctgtggaaaacaattt

SEQ ID NO: 93120 - DNA, 16 bp, H. sapiens
ctgtggaaaacacttt

SEQ ID NO: 93121 - DNA, 16 bp, H. sapiens
ctgtggaaaagagttt

SEQ ID NO: 93122 - DNA, 16 bp, H. sapiens
ctgtggaaaatatttt

SEQ ID NO: 93123 - DNA, 16 bp, H. sapiens
ctgtggaaaatgacat

SEQ ID NO: 93124 - DNA, 16 bp, H. sapiens
ctgtggactcgccctg

SEQ ID NO: 93125 - DNA, 16 bp, H. sapiens
ctgtggactctgggtg

SEQ ID NO: 93126 - DNA, 16 bp, H. sapiens
ctgtggactgcagtgg

SEQ ID NO: 93127 - DNA, 16 bp, H. sapiens
ctgtggagaaaaggga

SEQ ID NO: 93128 - DNA, 16 bp, H. sapiens
ctgtggagaacagttt

SEQ ID NO: 93129 - DNA, 16 bp, H. sapiens
ctgtggagatatttaa

SEQ ID NO: 93130 - DNA, 16 bp, H. sapiens
ctgtggaggaggtgga

SEQ ID NO: 93131 - DNA, 16 bp, H. sapiens
ctgtggaggctgaagc

SEQ ID NO: 93132 - DNA, 16 bp, H. sapiens
ctgtggaggctgttgt

SEQ ID NO: 93133 - DNA, 16 bp, H. sapiens
ctgtggaggggtgtgg

SEQ ID NO: 93134 - DNA, 17 bp, H. sapiens
ctgtggagggtgtactg

SEQ ID NO: 93135 - DNA, 16 bp, H. sapiens
ctgtggatcaggagat

SEQ ID NO: 93136 - DNA, 16 bp, H. sapiens
ctgtggattgtctttt

SEQ ID NO: 93137 - DNA, 16 bp, H. sapiens
ctgtggatttgcctgt

SEQ ID NO: 93138 - DNA, 16 bp, H. sapiens
ctgtggatttttaaaa

SEQ ID NO: 93139 - DNA, 16 bp, H. sapiens
ctgtggcaaactggag

SEQ ID NO: 93140 - DNA, 16 bp, H. sapiens
ctgtggcagactgcag

SEQ ID NO: 93141 - DNA, 16 bp, H. sapiens
ctgtggcaggaggatt

SEQ ID NO: 93142 - DNA, 16 bp, H. sapiens
ctgtggccaccaacac

SEQ ID NO: 93143 - DNA, 16 bp, H. sapiens
ctgtggccaccagcac

SEQ ID NO: 93144 - DNA, 16 bp, H. sapiens
ctgtggccacccctcc

SEQ ID NO: 93145 - DNA, 16 bp, H. sapiens
ctgtggccaggtgtgg

SEQ ID NO: 93146 - DNA, 16 bp, H. sapiens
ctgtggccatcaccac

SEQ ID NO: 93147 - DNA, 16 bp, H. sapiens
ctgtggcccagagcag

SEQ ID NO: 93148 - DNA, 16 bp, H. sapiens
ctgtggcccaggatgg

SEQ ID NO: 93149 - DNA, 16 bp, H. sapiens
ctgtggcccaggcagg

SEQ ID NO: 93150 - DNA, 16 bp, H. sapiens
ctgtggcccaggccag

SEQ ID NO: 93151 - DNA, 16 bp, H. sapiens
ctgtggcccaggctga

SEQ ID NO: 93152 - DNA, 16 bp, H. sapiens
ctgtggcccaggctgt

SEQ ID NO: 93153 - DNA, 16 bp, H. sapiens
ctgtggccccagctgc

SEQ ID NO: 93154 - DNA, 16 bp, H. sapiens
ctgtggcccccaccca

SEQ ID NO: 93155 - DNA, 16 bp, H. sapiens
ctgtggccctggctgg

SEQ ID NO: 93156 - DNA, 16 bp, H. sapiens
ctgtggcctccccaga

SEQ ID NO: 93157 - DNA, 16 bp, H. sapiens
ctgtggcctctgcctc

SEQ ID NO: 93158 - DNA, 16 bp, H. sapiens
ctgtggcctgggctgg

SEQ ID NO: 93159 - DNA, 16 bp, H. sapiens
ctgtggccttccacag

SEQ ID NO: 93160 - DNA, 16 bp, H. sapiens
ctgtggccttggcctc

SEQ ID NO: 93161 - DNA, 16 bp, H. sapiens
ctgtggcctttccagg

SEQ ID NO: 93162 - DNA, 17 bp, H. sapiens
ctgtggctagtgagcct

SEQ ID NO: 93163 - DNA, 16 bp, H. sapiens
ctgtggctcacaccta

SEQ ID NO: 93164 - DNA, 16 bp, H. sapiens
ctgtggctcacacctg

SEQ ID NO: 93165 - DNA, 16 bp, H. sapiens
ctgtggctcacgcctg

SEQ ID NO: 93166 - DNA, 16 bp, H. sapiens
ctgtggctcatgcctg

SEQ ID NO: 93167 - DNA, 16 bp, H. sapiens
ctgtggctccagctac

SEQ ID NO: 93168 - DNA, 16 bp, H. sapiens
ctgtggctccagctgc

SEQ ID NO: 93169 - DNA, 16 bp, H. sapiens
ctgtggctcccacctg

SEQ ID NO: 93170 - DNA, 16 bp, H. sapiens
ctgtggctcccgcctg

SEQ ID NO: 93171 - DNA, 16 bp, H. sapiens
ctgtggctctcacctg

SEQ ID NO: 93172 - DNA, 16 bp, H. sapiens
ctgtggctctgcagag

SEQ ID NO: 93173 - DNA, 16 bp, H. sapiens
ctgtggctgacacctg

SEQ ID NO: 93174 - DNA, 16 bp, H. sapiens
ctgtggctgctctcac

SEQ ID NO: 93175 - DNA, 16 bp, H. sapiens
ctgtggctgctgcaac

SEQ ID NO: 93176 - DNA, 16 bp, H. sapiens
ctgtggctgctgtaac

SEQ ID NO: 93177 - DNA, 16 bp, H. sapiens
ctgtggctgctgtgga

SEQ ID NO: 93178 - DNA, 16 bp, H. sapiens
ctgtggctgctttcaa

SEQ ID NO: 93179 - DNA, 16 bp, H. sapiens
ctgtggctgggctggg

SEQ ID NO: 93180 - DNA, 16 bp, H. sapiens
ctgtggctgggtgcag

SEQ ID NO: 93181 - DNA, 16 bp, H. sapiens
ctgtggctgtgcaggg

SEQ ID NO: 93182 - DNA, 16 bp, H. sapiens
ctgtggctgtggctgc

SEQ ID NO: 93183 - DNA, 17 bp, H. sapiens
ctgtggctgtggctgtg

SEQ ID NO: 93184 - DNA, 16 bp, H. sapiens
ctgtggctttccaggg

SEQ ID NO: 93185 - DNA, 16 bp, H. sapiens
ctgtggctttgcaggt

SEQ ID NO: 93186 - DNA, 16 bp, H. sapiens
ctgtggcttttccaga

SEQ ID NO: 93187 - DNA, 16 bp, H. sapiens
ctgtgggaccctgggc

SEQ ID NO: 93188 - DNA, 16 bp, H. sapiens
ctgtgggagaccaagg

SEQ ID NO: 93189 - DNA, 16 bp, H. sapiens
ctgtgggagcccagag

SEQ ID NO: 93190 - DNA, 16 bp, H. sapiens
ctgtgggaggcctagg

SEQ ID NO: 93191 - DNA, 17 bp, H. sapiens
ctgtgggaggctgagga

SEQ ID NO: 93192 - DNA, 16 bp, H. sapiens
ctgtgggatctgtggt

SEQ ID NO: 93193 - DNA, 16 bp, H. sapiens
ctgtgggatgtaaatt

SEQ ID NO: 93194 - DNA, 16 bp, H. sapiens
ctgtgggcacaacttc

SEQ ID NO: 93195 - DNA, 16 bp, H. sapiens
ctgtgggcacagcttc

SEQ ID NO: 93196 - DNA, 16 bp, H. sapiens
ctgtgggccaggcatg

SEQ ID NO: 93197 - DNA, 16 bp, H. sapiens
ctgtgggccatagttt

SEQ ID NO: 93198 - DNA, 16 bp, H. sapiens
ctgtgggccttggaga

SEQ ID NO: 93199 - DNA, 16 bp, H. sapiens
ctgtgggctctctggg

SEQ ID NO: 93200 - DNA, 16 bp, H. sapiens
ctgtgggctgtaccca

SEQ ID NO: 93201 - DNA, 16 bp, H. sapiens
ctgtgggctgtagttt

SEQ ID NO: 93202 - DNA, 16 bp, H. sapiens
ctgtgggctttggaga

SEQ ID NO: 93203 - DNA, 16 bp, H. sapiens
ctgtgggcttttcata

SEQ ID NO: 93204 - DNA, 16 bp, H. sapiens
ctgtggggaaaaaaaa

SEQ ID NO: 93205 - DNA, 16 bp, H. sapiens
ctgtggggagggcagg

SEQ ID NO: 93206 - DNA, 16 bp, H. sapiens
ctgtggggaggggcag

SEQ ID NO: 93207 - DNA, 16 bp, H. sapiens
ctgtggggccctggct

SEQ ID NO: 93208 - DNA, 17 bp, H. sapiens
ctgtggggctggtccct

SEQ ID NO: 93209 - DNA, 16 bp, H. sapiens
ctgtgggggcccctct

SEQ ID NO: 93210 - DNA, 16 bp, H. sapiens
ctgtgggtcaggaatc

SEQ ID NO: 93211 - DNA, 16 bp, H. sapiens
ctgtgggtgggagtgt

SEQ ID NO: 93212 - DNA, 16 bp, H. sapiens
ctgtgggtttctcata

SEQ ID NO: 93213 - DNA, 16 bp, H. sapiens
ctgtgggtttgtcatg

SEQ ID NO: 93214 - DNA, 16 bp, H. sapiens
ctgtggtaccagctac

SEQ ID NO: 93215 - DNA, 16 bp, H. sapiens
ctgtggtcatgccact

SEQ ID NO: 93216 - DNA, 16 bp, H. sapiens
ctgtggtcccagctat

SEQ ID NO: 93217 - DNA, 16 bp, H. sapiens
ctgtggtcccagctct

SEQ ID NO: 93218 - DNA, 16 bp, H. sapiens
ctgtggtcccagttac

SEQ ID NO: 93219 - DNA, 16 bp, H. sapiens
ctgtggtctcagctac

SEQ ID NO: 93220 - DNA, 16 bp, H. sapiens
ctgtggtgactttaat

SEQ ID NO: 93221 - DNA, 16 bp, H. sapiens
ctgtggtgagccgaga

SEQ ID NO: 93222 - DNA, 16 bp, H. sapiens
ctgtggtgagctgtga

SEQ ID NO: 93223 - DNA, 16 bp, H. sapiens
ctgtggtgcagtggca

SEQ ID NO: 93224 - DNA, 16 bp, H. sapiens
ctgtggtggcagtggc

SEQ ID NO: 93225 - DNA, 16 bp, H. sapiens
ctgtggtgggagatgg

SEQ ID NO: 93226 - DNA, 16 bp, H. sapiens
ctgtggtgtatatgta

SEQ ID NO: 93227 - DNA, 16 bp, H. sapiens
ctgtggtgtgcacctg

SEQ ID NO: 93228 - DNA, 16 bp, H. sapiens
ctgtggtgtgtgcctg

SEQ ID NO: 93229 - DNA, 16 bp, H. sapiens
ctgtggttcacgcctg

SEQ ID NO: 93230 - DNA, 16 bp, H. sapiens
ctgtggttctgcaggg

SEQ ID NO: 93231 - DNA, 16 bp, H. sapiens
ctgtggtttataagcc

SEQ ID NO: 93232 - DNA, 16 bp, H. sapiens
ctgtggtttctttcag

SEQ ID NO: 93233 - DNA, 16 bp, H. sapiens
ctgtggttttcagctc

SEQ ID NO: 93234 - DNA, 16 bp, H. sapiens
ctgtgtaacaaattac

SEQ ID NO: 93235 - DNA, 16 bp, H. sapiens
ctgtgtaatttacaaa

SEQ ID NO: 93236 - DNA, 16 bp, H. sapiens
ctgtgtacacacacac

SEQ ID NO: 93237 - DNA, 16 bp, H. sapiens
ctgtgtacatgtgtgt

SEQ ID NO: 93238 - DNA, 16 bp, H. sapiens
ctgtgtacctggaaaa

SEQ ID NO: 93239 - DNA, 16 bp, H. sapiens
ctgtgtagcaaacctg

SEQ ID NO: 93240 - DNA, 17 bp, H. sapiens
ctgtgtatgtatatgtg

SEQ ID NO: 93241 - DNA, 16 bp, H. sapiens
ctgtgtatgtatgtgt

SEQ ID NO: 93242 - DNA, 16 bp, H. sapiens
ctgtgtatgtgtatat

SEQ ID NO: 93243 - DNA, 16 bp, H. sapiens
ctgtgtatgtgtatgt

SEQ ID NO: 93244 - DNA, 16 bp, H. sapiens
ctgtgtattttcaaat

SEQ ID NO: 93245 - DNA, 16 bp, H. sapiens
ctgtgtcacgcaggct

SEQ ID NO: 93246 - DNA, 16 bp, H. sapiens
ctgtgtcacgggccat

SEQ ID NO: 93247 - DNA, 16 bp, H. sapiens
ctgtgtcactgcactc

SEQ ID NO: 93248 - DNA, 16 bp, H. sapiens
ctgtgtcatgggtcat

SEQ ID NO: 93249 - DNA, 16 bp, H. sapiens
ctgtgtccaaatttcc

SEQ ID NO: 93250 - DNA, 16 bp, H. sapiens
ctgtgtccaagaagaa

SEQ ID NO: 93251 - DNA, 16 bp, H. sapiens
ctgtgtccagatgttg

SEQ ID NO: 93252 - DNA, 16 bp, H. sapiens
ctgtgtccagtctact

SEQ ID NO: 93253 - DNA, 16 bp, H. sapiens
ctgtgtcccaggcact

SEQ ID NO: 93254 - DNA, 16 bp, H. sapiens
ctgtgtcccatctgtg

SEQ ID NO: 93255 - DNA, 16 bp, H. sapiens
ctgtgtccccaccccc

SEQ ID NO: 93256 - DNA, 16 bp, H. sapiens
ctgtgtccccagcact

SEQ ID NO: 93257 - DNA, 16 bp, H. sapiens
ctgtgtccccagggcc

SEQ ID NO: 93258 - DNA, 16 bp, H. sapiens
ctgtgtcccctcaaaa

SEQ ID NO: 93259 - DNA, 16 bp, H. sapiens
ctgtgtccctgtgtcc

SEQ ID NO: 93260 - DNA, 16 bp, H. sapiens
ctgtgtcctcacatgg

SEQ ID NO: 93261 - DNA, 16 bp, H. sapiens
ctgtgtcctcaggtgg

SEQ ID NO: 93262 - DNA, 16 bp, H. sapiens
ctgtgtcctcatgtgg

SEQ ID NO: 93263 - DNA, 16 bp, H. sapiens
ctgtgtcctccctcca

SEQ ID NO: 93264 - DNA, 16 bp, H. sapiens
ctgtgtcctgccccca

SEQ ID NO: 93265 - DNA, 16 bp, H. sapiens
ctgtgtctaaaaataa

SEQ ID NO: 93266 - DNA, 16 bp, H. sapiens
ctgtgtctactgaaaa

SEQ ID NO: 93267 - DNA, 16 bp, H. sapiens
ctgtgtctagatttat

SEQ ID NO: 93268 - DNA, 22 bp, H. sapiens
ctgtgtctagctcagggtttgt

SEQ ID NO: 93269 - DNA, 16 bp, H. sapiens
ctgtgtctcactctgt

SEQ ID NO: 93270 - DNA, 16 bp, H. sapiens
ctgtgtctcaggaatg

SEQ ID NO: 93271 - DNA, 16 bp, H. sapiens
ctgtgtctcagtctcc

SEQ ID NO: 93272 - DNA, 16 bp, H. sapiens
ctgtgtctccaggctg

SEQ ID NO: 93273 - DNA, 16 bp, H. sapiens
ctgtgtctctctcttc

SEQ ID NO: 93274 - DNA, 16 bp, H. sapiens
ctgtgtctctgccaga

SEQ ID NO: 93275 - DNA, 16 bp, H. sapiens
ctgtgtctctgtctgt

SEQ ID NO: 93276 - DNA, 16 bp, H. sapiens
ctgtgtctctgtgtgt

SEQ ID NO: 93277 - DNA, 16 bp, H. sapiens
ctgtgtctgtcttctt

SEQ ID NO: 93278 - DNA, 16 bp, H. sapiens
ctgtgtctgtgtatat

SEQ ID NO: 93279 - DNA, 16 bp, H. sapiens
ctgtgtctgtgtgtgt

SEQ ID NO: 93280 - DNA, 16 bp, H. sapiens
ctgtgtctgttttgct

SEQ ID NO: 93281 - DNA, 16 bp, H. sapiens
ctgtgtcttgaatggt

SEQ ID NO: 93282 - DNA, 16 bp, H. sapiens
ctgtgtcttttaatta

SEQ ID NO: 93283 - DNA, 16 bp, H. sapiens
ctgtgtcttttcatgg

SEQ ID NO: 93284 - DNA, 16 bp, H. sapiens
ctgtgtgacaaagcaa

SEQ ID NO: 93285 - DNA, 16 bp, H. sapiens
ctgtgtgaccctgggt

SEQ ID NO: 93286 - DNA, 16 bp, H. sapiens
ctgtgtgacctcaggc

SEQ ID NO: 93287 - DNA, 16 bp, H. sapiens
ctgtgtgacctggagc

SEQ ID NO: 93288 - DNA, 16 bp, H. sapiens
ctgtgtgaccttgaac

SEQ ID NO: 93289 - DNA, 16 bp, H. sapiens
ctgtgtgaccttgaca

SEQ ID NO: 93290 - DNA, 16 bp, H. sapiens
ctgtgtgaccttgggc

SEQ ID NO: 93291 - DNA, 16 bp, H. sapiens
ctgtgtgaccttgggg

SEQ ID NO: 93292 - DNA, 16 bp, H. sapiens
ctgtgtgaccttgggt

SEQ ID NO: 93293 - DNA, 16 bp, H. sapiens
ctgtgtgacttgggca

SEQ ID NO: 93294 - DNA, 16 bp, H. sapiens
ctgtgtgactttggaa

SEQ ID NO: 93295 - DNA, 16 bp, H. sapiens
ctgtgtgactttgggc

SEQ ID NO: 93296 - DNA, 16 bp, H. sapiens
ctgtgtgaggtgtctg

SEQ ID NO: 93297 - DNA, 16 bp, H. sapiens
ctgtgtgatgctgagg

SEQ ID NO: 93298 - DNA, 16 bp, H. sapiens
ctgtgtgatgctgggg

SEQ ID NO: 93299 - DNA, 16 bp, H. sapiens
ctgtgtgattttgggc

SEQ ID NO: 93300 - DNA, 16 bp, H. sapiens
ctgtgtgcagcagctg

SEQ ID NO: 93301 - DNA, 16 bp, H. sapiens
ctgtgtgcatgtgtgt

SEQ ID NO: 93302 - DNA, 16 bp, H. sapiens
ctgtgtgccaagcact

SEQ ID NO: 93303 - DNA, 16 bp, H. sapiens
ctgtgtgccagacatt

SEQ ID NO: 93304 - DNA, 16 bp, H. sapiens
ctgtgtgccaggcaca

SEQ ID NO: 93305 - DNA, 16 bp, H. sapiens
ctgtgtgccaggcact

SEQ ID NO: 93306 - DNA, 16 bp, H. sapiens
ctgtgtgccaggcgct

SEQ ID NO: 93307 - DNA, 16 bp, H. sapiens
ctgtgtgccaggctgg

SEQ ID NO: 93308 - DNA, 16 bp, H. sapiens
ctgtgtgcccagcacc

SEQ ID NO: 93309 - DNA, 16 bp, H. sapiens
ctgtgtgcccaggaag

SEQ ID NO: 93310 - DNA, 16 bp, H. sapiens
ctgtgtgccgggcact

SEQ ID NO: 93311 - DNA, 16 bp, H. sapiens
ctgtgtgcctcagttt

SEQ ID NO: 93312 - DNA, 16 bp, H. sapiens
ctgtgtgcctggcact

SEQ ID NO: 93313 - DNA, 16 bp, H. sapiens
ctgtgtgcctggccct

SEQ ID NO: 93314 - DNA, 16 bp, H. sapiens
ctgtgtgcgtgtctgt

SEQ ID NO: 93315 - DNA, 16 bp, H. sapiens
ctgtgtgctgaagagg

SEQ ID NO: 93316 - DNA, 16 bp, H. sapiens
ctgtgtggaaagaagt

SEQ ID NO: 93317 - DNA, 16 bp, H. sapiens
ctgtgtggaacctggg

SEQ ID NO: 93318 - DNA, 16 bp, H. sapiens
ctgtgtggacatcctt

SEQ ID NO: 93319 - DNA, 16 bp, H. sapiens
ctgtgtggaggctcca

SEQ ID NO: 93320 - DNA, 16 bp, H. sapiens
ctgtgtggccaggttc

SEQ ID NO: 93321 - DNA, 16 bp, H. sapiens
ctgtgtggcccagttc

SEQ ID NO: 93322 - DNA, 16 bp, H. sapiens
ctgtgtggccctggac

SEQ ID NO: 93323 - DNA, 16 bp, H. sapiens
ctgtgtggccctgggc

SEQ ID NO: 93324 - DNA, 16 bp, H. sapiens
ctgtgtggcctgggca

SEQ ID NO: 93325 - DNA, 16 bp, H. sapiens
ctgtgtggctttgggg

SEQ ID NO: 93326 - DNA, 16 bp, H. sapiens
ctgtgtggtcctgggc

SEQ ID NO: 93327 - DNA, 16 bp, H. sapiens
ctgtgtgtactcaatg

SEQ ID NO: 93328 - DNA, 16 bp, H. sapiens
ctgtgtgtcagactga

SEQ ID NO: 93329 - DNA, 16 bp, H. sapiens
ctgtgtgtcaggctct

SEQ ID NO: 93330 - DNA, 16 bp, H. sapiens
ctgtgtgtctctgtat

SEQ ID NO: 93331 - DNA, 16 bp, H. sapiens
ctgtgtgtctgtctgt

SEQ ID NO: 93332 - DNA, 16 bp, H. sapiens
ctgtgtgtgacctgat

SEQ ID NO: 93333 - DNA, 16 bp, H. sapiens
ctgtgtgtgattgtgt

SEQ ID NO: 93334 - DNA, 16 bp, H. sapiens
ctgtgtgtgcctctgt

SEQ ID NO: 93335 - DNA, 16 bp, H. sapiens
ctgtgtgtgtacgtgt

SEQ ID NO: 93336 - DNA, 16 bp, H. sapiens
ctgtgtgtgtatgtat

SEQ ID NO: 93337 - DNA, 16 bp, H. sapiens
ctgtgtgtgtatgtgt

SEQ ID NO: 93338 - DNA, 16 bp, H. sapiens
ctgtgtgtgtctgtct

SEQ ID NO: 93339 - DNA, 16 bp, H. sapiens
ctgtgtgtgtctgtgt

SEQ ID NO: 93340 - DNA, 18 bp, H. sapiens
ctgtgtgtgtgcatgtgt

SEQ ID NO: 93341 - DNA, 16 bp, H. sapiens
ctgtgtgtgtgcgtgt

SEQ ID NO: 93342 - DNA, 16 bp, H. sapiens
ctgtgtgtgtgtctgt

SEQ ID NO: 93343 - DNA, 16 bp, H. sapiens
ctgtgtgtgtgtgtat

SEQ ID NO: 93344 - DNA, 16 bp, H. sapiens
ctgtgtgttcttgggc

SEQ ID NO: 93345 - DNA, 16 bp, H. sapiens
ctgtgttccaagaaaa

SEQ ID NO: 93346 - DNA, 16 bp, H. sapiens
ctgtgttcccagctgc

SEQ ID NO: 93347 - DNA, 16 bp, H. sapiens
ctgtgttctcacatgg

SEQ ID NO: 93348 - DNA, 16 bp, H. sapiens
ctgtgttctcatgctg

SEQ ID NO: 93349 - DNA, 16 bp, H. sapiens
ctgtgttctcatgtgg

SEQ ID NO: 93350 - DNA, 16 bp, H. sapiens
ctgtgttctttccact

SEQ ID NO: 93351 - DNA, 16 bp, H. sapiens
ctgtgttcttttgaca

SEQ ID NO: 93352 - DNA, 16 bp, H. sapiens
ctgtgttgaatagaag

SEQ ID NO: 93353 - DNA, 16 bp, H. sapiens
ctgtgttgcccaagct

SEQ ID NO: 93354 - DNA, 16 bp, H. sapiens
ctgtgttgcccagggt

SEQ ID NO: 93355 - DNA, 17 bp, H. sapiens
ctgtgttggctgggctg

SEQ ID NO: 93356 - DNA, 16 bp, H. sapiens
ctgtgttgggcaggct

SEQ ID NO: 93357 - DNA, 16 bp, H. sapiens
ctgtgttggtttgctg

SEQ ID NO: 93358 - DNA, 16 bp, H. sapiens
ctgtgttgtggaagga

SEQ ID NO: 93359 - DNA, 16 bp, H. sapiens
ctgtgtttcaataaaa

SEQ ID NO: 93360 - DNA, 16 bp, H. sapiens
ctgtgttttaaatttt

SEQ ID NO: 93361 - DNA, 16 bp, H. sapiens
ctgtgttttaacaaac

SEQ ID NO: 93362 - DNA, 16 bp, H. sapiens
ctgtgttttcttctgg

SEQ ID NO: 93363 - DNA, 16 bp, H. sapiens
ctgtgtttttaaattt

SEQ ID NO: 93364 - DNA, 16 bp, H. sapiens
ctgtgttttttaattg

SEQ ID NO: 93365 - DNA, 16 bp, H. sapiens
ctgttaaaaataaaat

SEQ ID NO: 93366 - DNA, 16 bp, H. sapiens
ctgttaaaagaaaaac

SEQ ID NO: 93367 - DNA, 16 bp, H. sapiens
ctgttaaatttttctg

SEQ ID NO: 93368 - DNA, 16 bp, H. sapiens
ctgttaacattttgat

SEQ ID NO: 93369 - DNA, 16 bp, H. sapiens
ctgttaaccaccattc

SEQ ID NO: 93370 - DNA, 16 bp, H. sapiens
ctgttaatatggtgta

SEQ ID NO: 93371 - DNA, 16 bp, H. sapiens
ctgttaatgaacattt

SEQ ID NO: 93372 - DNA, 16 bp, H. sapiens
ctgttaattactgcct

SEQ ID NO: 93373 - DNA, 16 bp, H. sapiens
ctgttacaaaagaaaa

SEQ ID NO: 93374 - DNA, 16 bp, H. sapiens
ctgttacaaatgaaaa

SEQ ID NO: 93375 - DNA, 16 bp, H. sapiens
ctgttacaagattata

SEQ ID NO: 93376 - DNA, 16 bp, H. sapiens
ctgttacccacgctgg

SEQ ID NO: 93377 - DNA, 16 bp, H. sapiens
ctgttactgatttcta

SEQ ID NO: 93378 - DNA, 16 bp, H. sapiens
ctgttactggagaatt

SEQ ID NO: 93379 - DNA, 16 bp, H. sapiens
ctgttactttaaaaaa

SEQ ID NO: 93380 - DNA, 22 bp, H. sapiens
ctgttagaaggaaaactaacaa

SEQ ID NO: 93381 - DNA, 16 bp, H. sapiens
ctgttagcaattttca

SEQ ID NO: 93382 - DNA, 16 bp, H. sapiens
ctgttagtaggaatgt

SEQ ID NO: 93383 - DNA, 16 bp, H. sapiens
ctgttatagcagcaaa

SEQ ID NO: 93384 - DNA, 16 bp, H. sapiens
ctgttatattattcat

SEQ ID NO: 93385 - DNA, 16 bp, H. sapiens
ctgttatcccagcaat

SEQ ID NO: 93386 - DNA, 16 bp, H. sapiens
ctgttatcccaggact

SEQ ID NO: 93387 - DNA, 18 bp, H. sapiens
ctgttatcctgttctttt

SEQ ID NO: 93388 - DNA, 16 bp, H. sapiens
ctgttatgcagcaata

SEQ ID NO: 93389 - DNA, 16 bp, H. sapiens
ctgttattaaaaaaaa

SEQ ID NO: 93390 - DNA, 16 bp, H. sapiens
ctgttattaaaaagaa

SEQ ID NO: 93391 - DNA, 16 bp, H. sapiens
ctgttattattattgt

SEQ ID NO: 93392 - DNA, 16 bp, H. sapiens
ctgttatttaagatgt

SEQ ID NO: 93393 - DNA, 16 bp, H. sapiens
ctgttatttttgactt

SEQ ID NO: 93394 - DNA, 16 bp, H. sapiens
ctgttcaagttaaact

SEQ ID NO: 93395 - DNA, 16 bp, H. sapiens
ctgttcacccaggctg

SEQ ID NO: 93396 - DNA, 16 bp, H. sapiens
ctgttcactgcagcct

SEQ ID NO: 93397 - DNA, 16 bp, H. sapiens
ctgttcactgtcaccc

SEQ ID NO: 93398 - DNA, 16 bp, H. sapiens
ctgttcagaaaaaaaa

SEQ ID NO: 93399 - DNA, 16 bp, H. sapiens
ctgttcaggtttttta

SEQ ID NO: 93400 - DNA, 16 bp, H. sapiens
ctgttcatatggataa

SEQ ID NO: 93401 - DNA, 16 bp, H. sapiens
ctgttcatctcctttg

SEQ ID NO: 93402 - DNA, 16 bp, H. sapiens
ctgttcatctgttgat

SEQ ID NO: 93403 - DNA, 16 bp, H. sapiens
ctgttcatgagggatc

SEQ ID NO: 93404 - DNA, 16 bp, H. sapiens
ctgttcatgtcctctg

SEQ ID NO: 93405 - DNA, 16 bp, H. sapiens
ctgttcattcattcat

SEQ ID NO: 93406 - DNA, 16 bp, H. sapiens
ctgttcatttaaaaaa

SEQ ID NO: 93407 - DNA, 16 bp, H. sapiens
ctgttccacctcaggt

SEQ ID NO: 93408 - DNA, 16 bp, H. sapiens
ctgttccagtctctgc

SEQ ID NO: 93409 - DNA, 16 bp, H. sapiens
ctgttccattcatctg

SEQ ID NO: 93410 - DNA, 16 bp, H. sapiens
ctgttccccagaaacc

SEQ ID NO: 93411 - DNA, 16 bp, H. sapiens
ctgttccccctgcctg

SEQ ID NO: 93412 - DNA, 17 bp, H. sapiens
ctgttcccctcatgaca

SEQ ID NO: 93413 - DNA, 16 bp, H. sapiens
ctgttccctcagcctg

SEQ ID NO: 93414 - DNA, 16 bp, H. sapiens
ctgttccctctgcctg

SEQ ID NO: 93415 - DNA, 16 bp, H. sapiens
ctgttccctctgctga

SEQ ID NO: 93416 - DNA, 16 bp, H. sapiens
ctgttccctttgcctg

SEQ ID NO: 93417 - DNA, 16 bp, H. sapiens
ctgttcctattctgcc

SEQ ID NO: 93418 - DNA, 16 bp, H. sapiens
ctgttcctctgcctgg

SEQ ID NO: 93419 - DNA, 16 bp, H. sapiens
ctgttccttctgcctg

SEQ ID NO: 93420 - DNA, 16 bp, H. sapiens
ctgttcctttctctgg

SEQ ID NO: 93421 - DNA, 16 bp, H. sapiens
ctgttccttttgctgt

SEQ ID NO: 93422 - DNA, 16 bp, H. sapiens
ctgttctaagtgcctt

SEQ ID NO: 93423 - DNA, 16 bp, H. sapiens
ctgttctcaagctgct

SEQ ID NO: 93424 - DNA, 16 bp, H. sapiens
ctgttctcatgaagct

SEQ ID NO: 93425 - DNA, 16 bp, H. sapiens
ctgttctcatgctgcc

SEQ ID NO: 93426 - DNA, 16 bp, H. sapiens
ctgttctcatggcagt

SEQ ID NO: 93427 - DNA, 16 bp, H. sapiens
ctgttctccatagtgg

SEQ ID NO: 93428 - DNA, 16 bp, H. sapiens
ctgttctcccactgct

SEQ ID NO: 93429 - DNA, 16 bp, H. sapiens
ctgttctcgtgatagt

SEQ ID NO: 93430 - DNA, 16 bp, H. sapiens
ctgttctcgtggtagt

SEQ ID NO: 93431 - DNA, 16 bp, H. sapiens
ctgttctgcagcatcc

SEQ ID NO: 93432 - DNA, 16 bp, H. sapiens
ctgttctgcctggccc

SEQ ID NO: 93433 - DNA, 16 bp, H. sapiens
ctgttctgggcactgg

SEQ ID NO: 93434 - DNA, 16 bp, H. sapiens
ctgttctgtctgtcca

SEQ ID NO: 93435 - DNA, 16 bp, H. sapiens
ctgttctttctgcctg

SEQ ID NO: 93436 - DNA, 17 bp, H. sapiens
ctgttctttgctccgtg

SEQ ID NO: 93437 - DNA, 16 bp, H. sapiens
ctgttctttgtggggg

SEQ ID NO: 93438 - DNA, 16 bp, H. sapiens
ctgttcttttaaaaaa

SEQ ID NO: 93439 - DNA, 16 bp, H. sapiens
ctgttcttttgcattt

SEQ ID NO: 93440 - DNA, 16 bp, H. sapiens
ctgttgaaggacatct

SEQ ID NO: 93441 - DNA, 16 bp, H. sapiens
ctgttgagcacttgaa

SEQ ID NO: 93442 - DNA, 16 bp, H. sapiens
ctgttgaggcggcggc

SEQ ID NO: 93443 - DNA, 16 bp, H. sapiens
ctgttgatgaacattt

SEQ ID NO: 93444 - DNA, 16 bp, H. sapiens
ctgttgatgagcattt

SEQ ID NO: 93445 - DNA, 16 bp, H. sapiens
ctgttgatggacattt

SEQ ID NO: 93446 - DNA, 16 bp, H. sapiens
ctgttgatgggaatgc

SEQ ID NO: 93447 - DNA, 16 bp, H. sapiens
ctgttgccatggaaac

SEQ ID NO: 93448 - DNA, 16 bp, H. sapiens
ctgttgcccagcctgg

SEQ ID NO: 93449 - DNA, 16 bp, H. sapiens
ctgttgcccaggcaac

SEQ ID NO: 93450 - DNA, 17 bp, H. sapiens
ctgttgcccaggctggg

SEQ ID NO: 93451 - DNA, 16 bp, H. sapiens
ctgttgcctacaagaa

SEQ ID NO: 93452 - DNA, 16 bp, H. sapiens
ctgttgcctggctttg

SEQ ID NO: 93453 - DNA, 16 bp, H. sapiens
ctgttgctcaataaaa

SEQ ID NO: 93454 - DNA, 16 bp, H. sapiens
ctgttgctggctttga

SEQ ID NO: 93455 - DNA, 16 bp, H. sapiens
ctgttgctgttgagct

SEQ ID NO: 93456 - DNA, 16 bp, H. sapiens
ctgttgcttaaaccac

SEQ ID NO: 93457 - DNA, 16 bp, H. sapiens
ctgttgctttggggtg

SEQ ID NO: 93458 - DNA, 16 bp, H. sapiens
ctgttggagctgaaaa

SEQ ID NO: 93459 - DNA, 16 bp, H. sapiens
ctgttggccaggttgg

SEQ ID NO: 93460 - DNA, 16 bp, H. sapiens
ctgttggcccaggctg

SEQ ID NO: 93461 - DNA, 16 bp, H. sapiens
ctgttggcctcaagca

SEQ ID NO: 93462 - DNA, 16 bp, H. sapiens
ctgttgggaaccaggc

SEQ ID NO: 93463 - DNA, 16 bp, H. sapiens
ctgttggtggcaatgt

SEQ ID NO: 93464 - DNA, 16 bp, H. sapiens
ctgttggtgggagagt

SEQ ID NO: 93465 - DNA, 16 bp, H. sapiens
ctgttggttagaagca

SEQ ID NO: 93466 - DNA, 16 bp, H. sapiens
ctgttgtaagtgcttt

SEQ ID NO: 93467 - DNA, 16 bp, H. sapiens
ctgttgtaggcactgg

SEQ ID NO: 93468 - DNA, 16 bp, H. sapiens
ctgttgtccaggctaa

SEQ ID NO: 93469 - DNA, 16 bp, H. sapiens
ctgttgtgaggtgggg

SEQ ID NO: 93470 - DNA, 16 bp, H. sapiens
ctgttgtgagtagtgc

SEQ ID NO: 93471 - DNA, 16 bp, H. sapiens
ctgttgtggggagggg

SEQ ID NO: 93472 - DNA, 16 bp, H. sapiens
ctgttgttaagcaaca

SEQ ID NO: 93473 - DNA, 16 bp, H. sapiens
ctgttgttgctgctgc

SEQ ID NO: 93474 - DNA, 16 bp, H. sapiens
ctgttgttgtaagcca

SEQ ID NO: 93475 - DNA, 16 bp, H. sapiens
ctgttgttgttttgag

SEQ ID NO: 93476 - DNA, 16 bp, H. sapiens
ctgttgtttaaaataa

SEQ ID NO: 93477 - DNA, 16 bp, H. sapiens
ctgttgtttagtgtaa

SEQ ID NO: 93478 - DNA, 26 bp, H. sapiens
ctgttgtttcctgactttttaatgat

SEQ ID NO: 93479 - DNA, 16 bp, H. sapiens
ctgtttaaaagaaaaa

SEQ ID NO: 93480 - DNA, 16 bp, H. sapiens
ctgtttaagtcaccca

SEQ ID NO: 93481 - DNA, 16 bp, H. sapiens
ctgtttacattcaagg

SEQ ID NO: 93482 - DNA, 16 bp, H. sapiens
ctgtttatataaatta

SEQ ID NO: 93483 - DNA, 16 bp, H. sapiens
ctgtttatatggtgta

SEQ ID NO: 93484 - DNA, 16 bp, H. sapiens
ctgtttatgcaaatga

SEQ ID NO: 93485 - DNA, 16 bp, H. sapiens
ctgtttatggtatttt

SEQ ID NO: 93486 - DNA, 16 bp, H. sapiens
ctgtttattctaatta

SEQ ID NO: 93487 - DNA, 16 bp, H. sapiens
ctgtttatttttccct

SEQ ID NO: 93488 - DNA, 16 bp, H. sapiens
ctgtttcaaaaaaaaa

SEQ ID NO: 93489 - DNA, 16 bp, H. sapiens
ctgtttcaaaaataaa

SEQ ID NO: 93490 - DNA, 16 bp, H. sapiens
ctgtttcagcctctgc

SEQ ID NO: 93491 - DNA, 16 bp, H. sapiens
ctgtttcatgcctctc

SEQ ID NO: 93492 - DNA, 16 bp, H. sapiens
ctgtttccacactgct

SEQ ID NO: 93493 - DNA, 16 bp, H. sapiens
ctgtttccatggaaac

SEQ ID NO: 93494 - DNA, 16 bp, H. sapiens
ctgtttcccaggctca

SEQ ID NO: 93495 - DNA, 16 bp, H. sapiens
ctgtttcccatcaccc

SEQ ID NO: 93496 - DNA, 16 bp, H. sapiens
ctgtttcccatgctgg

SEQ ID NO: 93497 - DNA, 16 bp, H. sapiens
ctgtttcctaggctgg

SEQ ID NO: 93498 - DNA, 16 bp, H. sapiens
ctgtttcctcacctgt

SEQ ID NO: 93499 - DNA, 16 bp, H. sapiens
ctgtttcctcatcagt

SEQ ID NO: 93500 - DNA, 16 bp, H. sapiens
ctgtttcctcccaatg

SEQ ID NO: 93501 - DNA, 16 bp, H. sapiens
ctgtttcctctgccag

SEQ ID NO: 93502 - DNA, 16 bp, H. sapiens
ctgtttcctctgctga

SEQ ID NO: 93503 - DNA, 17 bp, H. sapiens
ctgtttcctgacttttt

SEQ ID NO: 93504 - DNA, 16 bp, H. sapiens
ctgtttcctggcatac

SEQ ID NO: 93505 - DNA, 16 bp, H. sapiens
ctgtttctaaaaaaaa

SEQ ID NO: 93506 - DNA, 16 bp, H. sapiens
ctgtttctacaaaata

SEQ ID NO: 93507 - DNA, 16 bp, H. sapiens
ctgtttctccacatcc

SEQ ID NO: 93508 - DNA, 16 bp, H. sapiens
ctgtttctcccctgtg

SEQ ID NO: 93509 - DNA, 16 bp, H. sapiens
ctgtttctctgaaaaa

SEQ ID NO: 93510 - DNA, 16 bp, H. sapiens
ctgtttctctggaaaa

SEQ ID NO: 93511 - DNA, 16 bp, H. sapiens
ctgtttctgccctgtg

SEQ ID NO: 93512 - DNA, 16 bp, H. sapiens
ctgtttctgtctctgt

SEQ ID NO: 93513 - DNA, 16 bp, H. sapiens
ctgtttcttcatttgt

SEQ ID NO: 93514 - DNA, 16 bp, H. sapiens
ctgtttcttgacctgg

SEQ ID NO: 93515 - DNA, 16 bp, H. sapiens
ctgtttcttttcactt

SEQ ID NO: 93516 - DNA, 16 bp, H. sapiens
ctgtttcttttgtaaa

SEQ ID NO: 93517 - DNA, 16 bp, H. sapiens
ctgtttgacagcattt

SEQ ID NO: 93518 - DNA, 16 bp, H. sapiens
ctgtttgataacattt

SEQ ID NO: 93519 - DNA, 16 bp, H. sapiens
ctgtttgatagcattt

SEQ ID NO: 93520 - DNA, 16 bp, H. sapiens
ctgtttgcagaagaca

SEQ ID NO: 93521 - DNA, 16 bp, H. sapiens
ctgtttgcaggagaag

SEQ ID NO: 93522 - DNA, 16 bp, H. sapiens
ctgtttgccattttta

SEQ ID NO: 93523 - DNA, 16 bp, H. sapiens
ctgtttggagatgaca

SEQ ID NO: 93524 - DNA, 16 bp, H. sapiens
ctgtttgggaagatga

SEQ ID NO: 93525 - DNA, 16 bp, H. sapiens
ctgtttgggcaactta

SEQ ID NO: 93526 - DNA, 16 bp, H. sapiens
ctgtttgtgggactgt

SEQ ID NO: 93527 - DNA, 16 bp, H. sapiens
ctgttttaaaaaagaa

SEQ ID NO: 93528 - DNA, 16 bp, H. sapiens
ctgttttaaaattcat

SEQ ID NO: 93529 - DNA, 16 bp, H. sapiens
ctgttttaaaatttta

SEQ ID NO: 93530 - DNA, 16 bp, H. sapiens
ctgttttaaggctctg

SEQ ID NO: 93531 - DNA, 16 bp, H. sapiens
ctgttttaatgttaaa

SEQ ID NO: 93532 - DNA, 16 bp, H. sapiens
ctgttttacagagagc

SEQ ID NO: 93533 - DNA, 16 bp, H. sapiens
ctgttttatagataag

SEQ ID NO: 93534 - DNA, 16 bp, H. sapiens
ctgttttcaaaatata

SEQ ID NO: 93535 - DNA, 16 bp, H. sapiens
ctgttttcagaatttt

SEQ ID NO: 93536 - DNA, 16 bp, H. sapiens
ctgttttcagctcttt

SEQ ID NO: 93537 - DNA, 16 bp, H. sapiens
ctgttttcatgctgcc

SEQ ID NO: 93538 - DNA, 16 bp, H. sapiens
ctgttttcatttcatt

SEQ ID NO: 93539 - DNA, 16 bp, H. sapiens
ctgttttcatttgtaa

SEQ ID NO: 93540 - DNA, 16 bp, H. sapiens
ctgttttccaaaatga

SEQ ID NO: 93541 - DNA, 16 bp, H. sapiens
ctgttttccaaagctg

SEQ ID NO: 93542 - DNA, 16 bp, H. sapiens
ctgttttccaaataaa

SEQ ID NO: 93543 - DNA, 16 bp, H. sapiens
ctgttttccacagcag

SEQ ID NO: 93544 - DNA, 16 bp, H. sapiens
ctgttttccagaatgg

SEQ ID NO: 93545 - DNA, 16 bp, H. sapiens
ctgttttccatagtgt

SEQ ID NO: 93546 - DNA, 16 bp, H. sapiens
ctgttttccatttgtt

SEQ ID NO: 93547 - DNA, 16 bp, H. sapiens
ctgttttctacaatgg

SEQ ID NO: 93548 - DNA, 16 bp, H. sapiens
ctgttttctacagtgg

SEQ ID NO: 93549 - DNA, 16 bp, H. sapiens
ctgttttctataatgg

SEQ ID NO: 93550 - DNA, 16 bp, H. sapiens
ctgttttctattcatt

SEQ ID NO: 93551 - DNA, 16 bp, H. sapiens
ctgttttctccctgtg

SEQ ID NO: 93552 - DNA, 16 bp, H. sapiens
ctgttttctctgcctg

SEQ ID NO: 93553 - DNA, 16 bp, H. sapiens
ctgttttctggaagaa

SEQ ID NO: 93554 - DNA, 16 bp, H. sapiens
ctgttttcttttgaaa

SEQ ID NO: 93555 - DNA, 16 bp, H. sapiens
ctgttttcttttgcaa

SEQ ID NO: 93556 - DNA, 16 bp, H. sapiens
ctgttttctttttaaa

SEQ ID NO: 93557 - DNA, 16 bp, H. sapiens
ctgttttggaaccagt

SEQ ID NO: 93558 - DNA, 16 bp, H. sapiens
ctgttttggttacagt

SEQ ID NO: 93559 - DNA, 16 bp, H. sapiens
ctgttttgttcactgt

SEQ ID NO: 93560 - DNA, 16 bp, H. sapiens
ctgtttttaaaaccat

SEQ ID NO: 93561 - DNA, 16 bp, H. sapiens
ctgtttttatttaaaa

SEQ ID NO: 93562 - DNA, 16 bp, H. sapiens
ctgtttttatttcact

SEQ ID NO: 93563 - DNA, 16 bp, H. sapiens
ctgtttttatttctca

SEQ ID NO: 93564 - DNA, 16 bp, H. sapiens
ctgtttttcagatgaa

SEQ ID NO: 93565 - DNA, 16 bp, H. sapiens
ctgtttttccatctgt

SEQ ID NO: 93566 - DNA, 16 bp, H. sapiens
ctgtttttccatttgt

SEQ ID NO: 93567 - DNA, 16 bp, H. sapiens
ctgtttttctaaataa

SEQ ID NO: 93568 - DNA, 16 bp, H. sapiens
ctgtttttctgtggct

SEQ ID NO: 93569 - DNA, 16 bp, H. sapiens
ctgtttttggttggta

SEQ ID NO: 93570 - DNA, 16 bp, H. sapiens
ctgtttttgttgaatc

SEQ ID NO: 93571 - DNA, 16 bp, H. sapiens
ctgttttttaaggaat

SEQ ID NO: 93572 - DNA, 16 bp, H. sapiens
ctgttttttagtagag

SEQ ID NO: 93573 - DNA, 16 bp, H. sapiens
ctgtttttttaaaaaa

SEQ ID NO: 93574 - DNA, 16 bp, H. sapiens
ctgtttttttaaataa

SEQ ID NO: 93575 - DNA, 16 bp, H. sapiens
cttaaaaaaaagtttt

SEQ ID NO: 93576 - DNA, 16 bp, H. sapiens
cttaaaaacaacagaa

SEQ ID NO: 93577 - DNA, 16 bp, H. sapiens
cttaaaaacatttttt

SEQ ID NO: 93578 - DNA, 16 bp, H. sapiens
cttaaaaagaaatcag

SEQ ID NO: 93579 - DNA, 16 bp, H. sapiens
cttaaaaaggtgattg

SEQ ID NO: 93580 - DNA, 16 bp, H. sapiens
cttaaaaagttaaaaa

SEQ ID NO: 93581 - DNA, 16 bp, H. sapiens
cttaaaaagttgtttt

SEQ ID NO: 93582 - DNA, 16 bp, H. sapiens
cttaaaaataagtttt

SEQ ID NO: 93583 - DNA, 16 bp, H. sapiens
cttaaaaatatttact

SEQ ID NO: 93584 - DNA, 16 bp, H. sapiens
cttaaaaattaacaag

SEQ ID NO: 93585 - DNA, 16 bp, H. sapiens
cttaaaaattgttaaa

SEQ ID NO: 93586 - DNA, 16 bp, H. sapiens
cttaaaaatttagaaa

SEQ ID NO: 93587 - DNA, 16 bp, H. sapiens
cttaaaacaacagaat

SEQ ID NO: 93588 - DNA, 16 bp, H. sapiens
cttaaaacaacagcaa

SEQ ID NO: 93589 - DNA, 16 bp, H. sapiens
cttaaaacaacattta

SEQ ID NO: 93590 - DNA, 16 bp, H. sapiens
cttaaaacaaccacca

SEQ ID NO: 93591 - DNA, 16 bp, H. sapiens
cttaaaacaatagaaa

SEQ ID NO: 93592 - DNA, 16 bp, H. sapiens
cttaaaacacacacac

SEQ ID NO: 93593 - DNA, 16 bp, H. sapiens
cttaaaacacagattg

SEQ ID NO: 93594 - DNA, 16 bp, H. sapiens
cttaaaacctagatga

SEQ ID NO: 93595 - DNA, 16 bp, H. sapiens
cttaaaagcaagaccc

SEQ ID NO: 93596 - DNA, 16 bp, H. sapiens
cttaaaaggaaaagct

SEQ ID NO: 93597 - DNA, 16 bp, H. sapiens
cttaaaagtaaaacct

SEQ ID NO: 93598 - DNA, 16 bp, H. sapiens
cttaaaagttaaagaa

SEQ ID NO: 93599 - DNA, 16 bp, H. sapiens
cttaaaagtttaaaaa

SEQ ID NO: 93600 - DNA, 16 bp, H. sapiens
cttaaaataaaatcca

SEQ ID NO: 93601 - DNA, 16 bp, H. sapiens
cttaaaatacatttct

SEQ ID NO: 93602 - DNA, 16 bp, H. sapiens
cttaaaatatatcttt

SEQ ID NO: 93603 - DNA, 16 bp, H. sapiens
cttaaaatctactctg

SEQ ID NO: 93604 - DNA, 16 bp, H. sapiens
cttaaaatgaaattaa

SEQ ID NO: 93605 - DNA, 16 bp, H. sapiens
cttaaaattcttaatt

SEQ ID NO: 93606 - DNA, 16 bp, H. sapiens
cttaaaatttttgaaa

SEQ ID NO: 93607 - DNA, 16 bp, H. sapiens
cttaaacaaatttata

SEQ ID NO: 93608 - DNA, 16 bp, H. sapiens
cttaaacaactaaaag

SEQ ID NO: 93609 - DNA, 16 bp, H. sapiens
cttaaacccgggaggc

SEQ ID NO: 93610 - DNA, 16 bp, H. sapiens
cttaaacctgagaggc

SEQ ID NO: 93611 - DNA, 16 bp, H. sapiens
cttaaacctgggaagt

SEQ ID NO: 93612 - DNA, 17 bp, H. sapiens
cttaaacctgggaggca

SEQ ID NO: 93613 - DNA, 16 bp, H. sapiens
cttaaactatttcaaa

SEQ ID NO: 93614 - DNA, 16 bp, H. sapiens
cttaaagaaataattt

SEQ ID NO: 93615 - DNA, 16 bp, H. sapiens
cttaaagaaatatttt

SEQ ID NO: 93616 - DNA, 16 bp, H. sapiens
cttaaagaactaaagg

SEQ ID NO: 93617 - DNA, 16 bp, H. sapiens
cttaaagaagaaaatt

SEQ ID NO: 93618 - DNA, 16 bp, H. sapiens
cttaaagaataataaa

SEQ ID NO: 93619 - DNA, 16 bp, H. sapiens
cttaaagagatatttg

SEQ ID NO: 93620 - DNA, 16 bp, H. sapiens
cttaaagatggcacag

SEQ ID NO: 93621 - DNA, 16 bp, H. sapiens
cttaaagcagtggttc

SEQ ID NO: 93622 - DNA, 33 bp, H. sapiens
cttaaaggagctgatggagctgaaagccaaggc

SEQ ID NO: 93623 - DNA, 17 bp, H. sapiens
cttaaaggcattcttaa

SEQ ID NO: 93624 - DNA, 16 bp, H. sapiens
cttaaagtaaaagaaa

SEQ ID NO: 93625 - DNA, 16 bp, H. sapiens
cttaaagttctgggat

SEQ ID NO: 93626 - DNA, 16 bp, H. sapiens
cttaaagttggaattt

SEQ ID NO: 93627 - DNA, 16 bp, H. sapiens
cttaaagtttcaaaat

SEQ ID NO: 93628 - DNA, 16 bp, H. sapiens
cttaaataaaagaaat

SEQ ID NO: 93629 - DNA, 16 bp, H. sapiens
cttaaatatttcatat

SEQ ID NO: 93630 - DNA, 16 bp, H. sapiens
cttaaatattttgtca

SEQ ID NO: 93631 - DNA, 16 bp, H. sapiens
cttaaatgatctgcct

SEQ ID NO: 93632 - DNA, 16 bp, H. sapiens
cttaaatgcaagacct

SEQ ID NO: 93633 - DNA, 16 bp, H. sapiens
cttaaatgtaaaaccc

SEQ ID NO: 93634 - DNA, 16 bp, H. sapiens
cttaaatgtaaaatga

SEQ ID NO: 93635 - DNA, 17 bp, H. sapiens
cttaaatgttagaccta

SEQ ID NO: 93636 - DNA, 17 bp, H. sapiens
cttaaatgttagacctg

SEQ ID NO: 93637 - DNA, 16 bp, H. sapiens
cttaaatgttctcatc

SEQ ID NO: 93638 - DNA, 16 bp, H. sapiens
cttaaatttaaatggg

SEQ ID NO: 93639 - DNA, 16 bp, H. sapiens
cttaacagatatttac

SEQ ID NO: 93640 - DNA, 16 bp, H. sapiens
cttaacagctgtgtga

SEQ ID NO: 93641 - DNA, 16 bp, H. sapiens
cttaacaggaaacatg

SEQ ID NO: 93642 - DNA, 16 bp, H. sapiens
cttaacataatatttt

SEQ ID NO: 93643 - DNA, 16 bp, H. sapiens
cttaacataatgtcct

SEQ ID NO: 93644 - DNA, 16 bp, H. sapiens
cttaacctcccaagta

SEQ ID NO: 93645 - DNA, 16 bp, H. sapiens
cttaacctctctgtgc

SEQ ID NO: 93646 - DNA, 16 bp, H. sapiens
cttaactcaagcattt

SEQ ID NO: 93647 - DNA, 16 bp, H. sapiens
cttaactgctctgtgc

SEQ ID NO: 93648 - DNA, 16 bp, H. sapiens
cttaacttctctgtgt

SEQ ID NO: 93649 - DNA, 16 bp, H. sapiens
cttaacttttaaaaaa

SEQ ID NO: 93650 - DNA, 16 bp, H. sapiens
cttaagaaaatggaaa

SEQ ID NO: 93651 - DNA, 16 bp, H. sapiens
cttaagaaataaaaca

SEQ ID NO: 93652 - DNA, 16 bp, H. sapiens
cttaagaaatacattt

SEQ ID NO: 93653 - DNA, 16 bp, H. sapiens
cttaagaccttcaact

SEQ ID NO: 93654 - DNA, 16 bp, H. sapiens
cttaagagatcctcct

SEQ ID NO: 93655 - DNA, 16 bp, H. sapiens
cttaagattttctaca

SEQ ID NO: 93656 - DNA, 16 bp, H. sapiens
cttaagcaaaaagaac

SEQ ID NO: 93657 - DNA, 16 bp, H. sapiens
cttaagcagtcttcct

SEQ ID NO: 93658 - DNA, 16 bp, H. sapiens
cttaagccatcctcct

SEQ ID NO: 93659 - DNA, 16 bp, H. sapiens
cttaagcccaggagct

SEQ ID NO: 93660 - DNA, 16 bp, H. sapiens
cttaagcccaggagtt

SEQ ID NO: 93661 - DNA, 16 bp, H. sapiens
cttaagcctggaaggt

SEQ ID NO: 93662 - DNA, 16 bp, H. sapiens
cttaagctcaggagtt

SEQ ID NO: 93663 - DNA, 16 bp, H. sapiens
cttaaggaaataaaag

SEQ ID NO: 93664 - DNA, 16 bp, H. sapiens
cttaaggaactagaga

SEQ ID NO: 93665 - DNA, 16 bp, H. sapiens
cttaaggagaggagag

SEQ ID NO: 93666 - DNA, 16 bp, H. sapiens
cttaaggccaggagtt

SEQ ID NO: 93667 - DNA, 16 bp, H. sapiens
cttaagggaacattgg

SEQ ID NO: 93668 - DNA, 16 bp, H. sapiens
cttaaggtcaggagtt

SEQ ID NO: 93669 - DNA, 16 bp, H. sapiens
cttaagtctgggaggt

SEQ ID NO: 93670 - DNA, 16 bp, H. sapiens
cttaagtctttaatcc

SEQ ID NO: 93671 - DNA, 16 bp, H. sapiens
cttaagtgtgtttttg

SEQ ID NO: 93672 - DNA, 16 bp, H. sapiens
cttaagtgttcatcaa

SEQ ID NO: 93673 - DNA, 16 bp, H. sapiens
cttaagttccttgtag

SEQ ID NO: 93674 - DNA, 16 bp, H. sapiens
cttaataaagctgaaa

SEQ ID NO: 93675 - DNA, 16 bp, H. sapiens
cttaataaatacttgt

SEQ ID NO: 93676 - DNA, 16 bp, H. sapiens
cttaataaatgtttct

SEQ ID NO: 93677 - DNA, 16 bp, H. sapiens
cttaataaatgtttga

SEQ ID NO: 93678 - DNA, 16 bp, H. sapiens
cttaataaatgttttt

SEQ ID NO: 93679 - DNA, 16 bp, H. sapiens
cttaataaatttaaga

SEQ ID NO: 93680 - DNA, 16 bp, H. sapiens
cttaataatttttaag

SEQ ID NO: 93681 - DNA, 16 bp, H. sapiens
cttaatacctaggtga

SEQ ID NO: 93682 - DNA, 16 bp, H. sapiens
cttaatatggacattt

SEQ ID NO: 93683 - DNA, 16 bp, H. sapiens
cttaatattctgttcc

SEQ ID NO: 93684 - DNA, 16 bp, H. sapiens
cttaatcccatcatct

SEQ ID NO: 93685 - DNA, 16 bp, H. sapiens
cttaatcctcagaaca

SEQ ID NO: 93686 - DNA, 16 bp, H. sapiens
cttaatctataaaatg

SEQ ID NO: 93687 - DNA, 16 bp, H. sapiens
cttaatctcctcttct

SEQ ID NO: 93688 - DNA, 16 bp, H. sapiens
cttaatctcttcattg

SEQ ID NO: 93689 - DNA, 16 bp, H. sapiens
cttaatctgtggggtc

SEQ ID NO: 93690 - DNA, 16 bp, H. sapiens
cttaatgacagagata

SEQ ID NO: 93691 - DNA, 16 bp, H. sapiens
cttaatgccattgaac

SEQ ID NO: 93692 - DNA, 16 bp, H. sapiens
cttaatggcatttaga

SEQ ID NO: 93693 - DNA, 16 bp, H. sapiens
cttaatggtatgctga

SEQ ID NO: 93694 - DNA, 16 bp, H. sapiens
cttaatgtctctgagc

SEQ ID NO: 93695 - DNA, 16 bp, H. sapiens
cttaatgttttttaaa

SEQ ID NO: 93696 - DNA, 16 bp, H. sapiens
cttaattagatcccat

SEQ ID NO: 93697 - DNA, 16 bp, H. sapiens
cttaattctcctttgc

SEQ ID NO: 93698 - DNA, 16 bp, H. sapiens
cttaatttaaaaatac

SEQ ID NO: 93699 - DNA, 16 bp, H. sapiens
cttaatttcctttttg

SEQ ID NO: 93700 - DNA, 16 bp, H. sapiens
cttaatttggttctca

SEQ ID NO: 93701 - DNA, 16 bp, H. sapiens
cttaattttgtgtgtg

SEQ ID NO: 93702 - DNA, 16 bp, H. sapiens
cttaattttttttaga

SEQ ID NO: 93703 - DNA, 16 bp, H. sapiens
cttacaaaatgcattt

SEQ ID NO: 93704 - DNA, 16 bp, H. sapiens
cttacaaatggttaaa

SEQ ID NO: 93705 - DNA, 16 bp, H. sapiens
cttacaacatggcagc

SEQ ID NO: 93706 - DNA, 16 bp, H. sapiens
cttacaagaaaaaaca

SEQ ID NO: 93707 - DNA, 16 bp, H. sapiens
cttacaagtgtaatga

SEQ ID NO: 93708 - DNA, 16 bp, H. sapiens
cttacaatgatggcag

SEQ ID NO: 93709 - DNA, 16 bp, H. sapiens
cttacaattgtggcag

SEQ ID NO: 93710 - DNA, 16 bp, H. sapiens
cttacacaaggactgg

SEQ ID NO: 93711 - DNA, 16 bp, H. sapiens
cttacacacatagcct

SEQ ID NO: 93712 - DNA, 16 bp, H. sapiens
cttacacatttcttca

SEQ ID NO: 93713 - DNA, 16 bp, H. sapiens
cttacagaaaaagttt

SEQ ID NO: 93714 - DNA, 16 bp, H. sapiens
cttacagatttttttt

SEQ ID NO: 93715 - DNA, 16 bp, H. sapiens
cttacagttccacagg

SEQ ID NO: 93716 - DNA, 16 bp, H. sapiens
cttacagttccacatg

SEQ ID NO: 93717 - DNA, 16 bp, H. sapiens
cttacagttctatgtg

SEQ ID NO: 93718 - DNA, 16 bp, H. sapiens
cttacataaaatggtg

SEQ ID NO: 93719 - DNA, 16 bp, H. sapiens
cttacataaccatggt

SEQ ID NO: 93720 - DNA, 16 bp, H. sapiens
cttacatgaaaattgt

SEQ ID NO: 93721 - DNA, 16 bp, H. sapiens
cttacatgctgttagt

SEQ ID NO: 93722 - DNA, 16 bp, H. sapiens
cttacatgctgttggt

SEQ ID NO: 93723 - DNA, 16 bp, H. sapiens
cttacatggcaggagc

SEQ ID NO: 93724 - DNA, 16 bp, H. sapiens
cttacatgggatgtga

SEQ ID NO: 93725 - DNA, 16 bp, H. sapiens
cttacccaaggtcaca

SEQ ID NO: 93726 - DNA, 17 bp, H. sapiens
cttacccgatttaaaat

SEQ ID NO: 93727 - DNA, 16 bp, H. sapiens
cttacctcatgatcca

SEQ ID NO: 93728 - DNA, 16 bp, H. sapiens
cttacctgtaaaatgg

SEQ ID NO: 93729 - DNA, 16 bp, H. sapiens
cttaccttagcctccc

SEQ ID NO: 93730 - DNA, 16 bp, H. sapiens
cttacctttaaaaaaa

SEQ ID NO: 93731 - DNA, 16 bp, H. sapiens
cttactaaacataaga

SEQ ID NO: 93732 - DNA, 16 bp, H. sapiens
cttactatcatgagaa

SEQ ID NO: 93733 - DNA, 16 bp, H. sapiens
cttactatgctttagc

SEQ ID NO: 93734 - DNA, 16 bp, H. sapiens
cttactcagttgccca

SEQ ID NO: 93735 - DNA, 16 bp, H. sapiens
cttactctcttctcca

SEQ ID NO: 93736 - DNA, 16 bp, H. sapiens
cttactgaatatttta

SEQ ID NO: 93737 - DNA, 16 bp, H. sapiens
cttactgataaaacag

SEQ ID NO: 93738 - DNA, 16 bp, H. sapiens
cttactgatttatttt

SEQ ID NO: 93739 - DNA, 16 bp, H. sapiens
cttactgcagcctcag

SEQ ID NO: 93740 - DNA, 16 bp, H. sapiens
cttactgcagccttga

SEQ ID NO: 93741 - DNA, 16 bp, H. sapiens
cttactggctgtgtga

SEQ ID NO: 93742 - DNA, 16 bp, H. sapiens
cttactggggaaagaa

SEQ ID NO: 93743 - DNA, 16 bp, H. sapiens
cttactgtaaaaaaaa

SEQ ID NO: 93744 - DNA, 16 bp, H. sapiens
cttactgtaacatttt

SEQ ID NO: 93745 - DNA, 16 bp, H. sapiens
cttactgtaatttttt

SEQ ID NO: 93746 - DNA, 16 bp, H. sapiens
cttactgtcttccttt

SEQ ID NO: 93747 - DNA, 20 bp, H. sapiens
cttactgttttaggctggcc

SEQ ID NO: 93748 - DNA, 16 bp, H. sapiens
cttacttcaacctcca

SEQ ID NO: 93749 - DNA, 16 bp, H. sapiens
cttactttgtgccagg

SEQ ID NO: 93750 - DNA, 16 bp, H. sapiens
cttagaaagtttattt

SEQ ID NO: 93751 - DNA, 16 bp, H. sapiens
cttagaaattcttttt

SEQ ID NO: 93752 - DNA, 16 bp, H. sapiens
cttagaaattttttct

SEQ ID NO: 93753 - DNA, 16 bp, H. sapiens
cttagaacctggaagg

SEQ ID NO: 93754 - DNA, 16 bp, H. sapiens
cttagaagaaaacaga

SEQ ID NO: 93755 - DNA, 16 bp, H. sapiens
cttagaatagtgcctg

SEQ ID NO: 93756 - DNA, 16 bp, H. sapiens
cttagaatatatatat

SEQ ID NO: 93757 - DNA, 16 bp, H. sapiens
cttagaatattttcaa

SEQ ID NO: 93758 - DNA, 16 bp, H. sapiens
cttagaatggtgcctg

SEQ ID NO: 93759 - DNA, 16 bp, H. sapiens
cttagacaacactctt

SEQ ID NO: 93760 - DNA, 16 bp, H. sapiens
cttagactcccccaca

SEQ ID NO: 93761 - DNA, 16 bp, H. sapiens
cttagaggaaatgctt

SEQ ID NO: 93762 - DNA, 16 bp, H. sapiens
cttagattttttttaa

SEQ ID NO: 93763 - DNA, 16 bp, H. sapiens
cttagcaacttttact

SEQ ID NO: 93764 - DNA, 16 bp, H. sapiens
cttagcacaatgtttt

SEQ ID NO: 93765 - DNA, 17 bp, H. sapiens
cttagcacccgggccag

SEQ ID NO: 93766 - DNA, 17 bp, H. sapiens
cttagcacctgggccag

SEQ ID NO: 93767 - DNA, 23 bp, H. sapiens
cttagcacctgggccagcagctg

SEQ ID NO: 93768 - DNA, 16 bp, H. sapiens
cttagcataaggtttt

SEQ ID NO: 93769 - DNA, 16 bp, H. sapiens
cttagcataatgtctg

SEQ ID NO: 93770 - DNA, 16 bp, H. sapiens
cttagcattttctttt

SEQ ID NO: 93771 - DNA, 16 bp, H. sapiens
cttagcccagtgcctg

SEQ ID NO: 93772 - DNA, 16 bp, H. sapiens
cttagcctcagtttcc

SEQ ID NO: 93773 - DNA, 16 bp, H. sapiens
cttagcctcccaggtt

SEQ ID NO: 93774 - DNA, 16 bp, H. sapiens
cttagcctgggtgaca

SEQ ID NO: 93775 - DNA, 16 bp, H. sapiens
cttagctgccttcctg

SEQ ID NO: 93776 - DNA, 16 bp, H. sapiens
cttagctgggcgtggt

SEQ ID NO: 93777 - DNA, 16 bp, H. sapiens
cttaggaaagaaaaaa

SEQ ID NO: 93778 - DNA, 16 bp, H. sapiens
cttaggaatatacata

SEQ ID NO: 93779 - DNA, 16 bp, H. sapiens
cttaggaatgacttgg

SEQ ID NO: 93780 - DNA, 16 bp, H. sapiens
cttaggatacttctga

SEQ ID NO: 93781 - DNA, 16 bp, H. sapiens
cttaggattgctttga

SEQ ID NO: 93782 - DNA, 16 bp, H. sapiens
cttaggcaagtcattt

SEQ ID NO: 93783 - DNA, 16 bp, H. sapiens
cttaggctggagtgca

SEQ ID NO: 93784 - DNA, 16 bp, H. sapiens
cttaggtgatccgccc

SEQ ID NO: 93785 - DNA, 16 bp, H. sapiens
cttagtacctgggtga

SEQ ID NO: 93786 - DNA, 19 bp, H. sapiens
cttagtagagatggggttt

SEQ ID NO: 93787 - DNA, 16 bp, H. sapiens
cttagtagctaggact

SEQ ID NO: 93788 - DNA, 16 bp, H. sapiens
cttagtagctatgtga

SEQ ID NO: 93789 - DNA, 16 bp, H. sapiens
cttagtattccatggt

SEQ ID NO: 93790 - DNA, 16 bp, H. sapiens
cttagtctgtaagaga

SEQ ID NO: 93791 - DNA, 16 bp, H. sapiens
cttagtgattttgggg

SEQ ID NO: 93792 - DNA, 16 bp, H. sapiens
cttagtggacacagca

SEQ ID NO: 93793 - DNA, 16 bp, H. sapiens
cttagttaaaaaaaaa

SEQ ID NO: 93794 - DNA, 16 bp, H. sapiens
cttagttattttaaaa

SEQ ID NO: 93795 - DNA, 16 bp, H. sapiens
cttagtttccccatct

SEQ ID NO: 93796 - DNA, 16 bp, H. sapiens
cttagtttcctcaact

SEQ ID NO: 93797 - DNA, 16 bp, H. sapiens
cttagtttccttattt

SEQ ID NO: 93798 - DNA, 16 bp, H. sapiens
cttagtttcttcatgt

SEQ ID NO: 93799 - DNA, 16 bp, H. sapiens
cttagtttgttcttct

SEQ ID NO: 93800 - DNA, 16 bp, H. sapiens
cttagttttaaaaatt

SEQ ID NO: 93801 - DNA, 16 bp, H. sapiens
cttataaaaaggaaaa

SEQ ID NO: 93802 - DNA, 16 bp, H. sapiens
cttataaaacagaaat

SEQ ID NO: 93803 - DNA, 16 bp, H. sapiens
cttataaaagagatcc

SEQ ID NO: 93804 - DNA, 16 bp, H. sapiens
cttataaataaaagag

SEQ ID NO: 93805 - DNA, 16 bp, H. sapiens
cttataaattacccag

SEQ ID NO: 93806 - DNA, 16 bp, H. sapiens
cttataagaagaaatt

SEQ ID NO: 93807 - DNA, 16 bp, H. sapiens
cttataaggacatttg

SEQ ID NO: 93808 - DNA, 16 bp, H. sapiens
cttataatacctagta

SEQ ID NO: 93809 - DNA, 16 bp, H. sapiens
cttataatttaatgta

SEQ ID NO: 93810 - DNA, 16 bp, H. sapiens
cttataccaaaataaa

SEQ ID NO: 93811 - DNA, 16 bp, H. sapiens
cttatactttttaaaa

SEQ ID NO: 93812 - DNA, 16 bp, H. sapiens
cttatagttattttta

SEQ ID NO: 93813 - DNA, 16 bp, H. sapiens
cttatatcagaaaaaa

SEQ ID NO: 93814 - DNA, 16 bp, H. sapiens
cttatatcagacaaaa

SEQ ID NO: 93815 - DNA, 16 bp, H. sapiens
cttatatctcattggc

SEQ ID NO: 93816 - DNA, 16 bp, H. sapiens
cttatatctctgcacc

SEQ ID NO: 93817 - DNA, 16 bp, H. sapiens
cttatatcttatacaa

SEQ ID NO: 93818 - DNA, 16 bp, H. sapiens
cttatattaattttgc

SEQ ID NO: 93819 - DNA, 16 bp, H. sapiens
cttatattagaaaata

SEQ ID NO: 93820 - DNA, 16 bp, H. sapiens
cttatattcattcatt

SEQ ID NO: 93821 - DNA, 16 bp, H. sapiens
cttatcaccttaagga

SEQ ID NO: 93822 - DNA, 16 bp, H. sapiens
cttatcaggaaggaat

SEQ ID NO: 93823 - DNA, 16 bp, H. sapiens
cttatccaagatcaca

SEQ ID NO: 93824 - DNA, 16 bp, H. sapiens
cttatctaaacctaat

SEQ ID NO: 93825 - DNA, 16 bp, H. sapiens
cttatctaagattcct

SEQ ID NO: 93826 - DNA, 16 bp, H. sapiens
cttatctatgaaatgg

SEQ ID NO: 93827 - DNA, 16 bp, H. sapiens
cttatctccacaaaaa

SEQ ID NO: 93828 - DNA, 16 bp, H. sapiens
cttatctgtaaaatat

SEQ ID NO: 93829 - DNA, 16 bp, H. sapiens
cttatctgtaaaatga

SEQ ID NO: 93830 - DNA, 16 bp, H. sapiens
cttatctgtaaaatgg

SEQ ID NO: 93831 - DNA, 16 bp, H. sapiens
cttatcttgtgctggt

SEQ ID NO: 93832 - DNA, 16 bp, H. sapiens
cttatgaaaatctaac

SEQ ID NO: 93833 - DNA, 16 bp, H. sapiens
cttatgagatgcagca

SEQ ID NO: 93834 - DNA, 16 bp, H. sapiens
cttatgcattgctggt

SEQ ID NO: 93835 - DNA, 16 bp, H. sapiens
cttatgcctcagtttc

SEQ ID NO: 93836 - DNA, 16 bp, H. sapiens
cttatgcctttacatc

SEQ ID NO: 93837 - DNA, 16 bp, H. sapiens
cttatgctgataaggt

SEQ ID NO: 93838 - DNA, 16 bp, H. sapiens
cttatgggaccattgt

SEQ ID NO: 93839 - DNA, 16 bp, H. sapiens
cttatgggctcaagtg

SEQ ID NO: 93840 - DNA, 16 bp, H. sapiens
cttattaaaaggaaaa

SEQ ID NO: 93841 - DNA, 16 bp, H. sapiens
cttattaaaatatgta

SEQ ID NO: 93842 - DNA, 16 bp, H. sapiens
cttattaaaatgaaaa

SEQ ID NO: 93843 - DNA, 16 bp, H. sapiens
cttattaatctgtctt

SEQ ID NO: 93844 - DNA, 16 bp, H. sapiens
cttattacttatgcaa

SEQ ID NO: 93845 - DNA, 16 bp, H. sapiens
cttattcaaagaaata

SEQ ID NO: 93846 - DNA, 16 bp, H. sapiens
cttattcactgtcacg

SEQ ID NO: 93847 - DNA, 16 bp, H. sapiens
cttattccagttctta

SEQ ID NO: 93848 - DNA, 16 bp, H. sapiens
cttattcctcctacct

SEQ ID NO: 93849 - DNA, 16 bp, H. sapiens
cttattcctttccaat

SEQ ID NO: 93850 - DNA, 16 bp, H. sapiens
cttattctaaaattga

SEQ ID NO: 93851 - DNA, 16 bp, H. sapiens
cttattgaatggtttt

SEQ ID NO: 93852 - DNA, 16 bp, H. sapiens
cttattgagcatctac

SEQ ID NO: 93853 - DNA, 16 bp, H. sapiens
cttattgggaactgga

SEQ ID NO: 93854 - DNA, 16 bp, H. sapiens
cttattggtgcattta

SEQ ID NO: 93855 - DNA, 16 bp, H. sapiens
cttattgtaagaatac

SEQ ID NO: 93856 - DNA, 16 bp, H. sapiens
cttattgtatattttc

SEQ ID NO: 93857 - DNA, 16 bp, H. sapiens
cttatttaacttaaca

SEQ ID NO: 93858 - DNA, 16 bp, H. sapiens
cttatttaataaatgg

SEQ ID NO: 93859 - DNA, 16 bp, H. sapiens
cttatttaatcctcat

SEQ ID NO: 93860 - DNA, 16 bp, H. sapiens
cttatttacaaaataa

SEQ ID NO: 93861 - DNA, 16 bp, H. sapiens
cttatttatcaaaaat

SEQ ID NO: 93862 - DNA, 16 bp, H. sapiens
cttatttattttgaaa

SEQ ID NO: 93863 - DNA, 16 bp, H. sapiens
cttatttcaaaattgg

SEQ ID NO: 93864 - DNA, 16 bp, H. sapiens
cttatttcagataaaa

SEQ ID NO: 93865 - DNA, 16 bp, H. sapiens
cttatttcagtaagtt

SEQ ID NO: 93866 - DNA, 16 bp, H. sapiens
cttatttctttaaaaa

SEQ ID NO: 93867 - DNA, 16 bp, H. sapiens
cttatttgaacatggt

SEQ ID NO: 93868 - DNA, 16 bp, H. sapiens
cttatttggaaatgga

SEQ ID NO: 93869 - DNA, 16 bp, H. sapiens
cttatttgtggaagct

SEQ ID NO: 93870 - DNA, 16 bp, H. sapiens
cttatttgttttaaaa

SEQ ID NO: 93871 - DNA, 16 bp, H. sapiens
cttattttacaaatga

SEQ ID NO: 93872 - DNA, 16 bp, H. sapiens
cttattttagaaaatt

SEQ ID NO: 93873 - DNA, 16 bp, H. sapiens
cttattttaggaaatt

SEQ ID NO: 93874 - DNA, 16 bp, H. sapiens
cttattttatgcattt

SEQ ID NO: 93875 - DNA, 16 bp, H. sapiens
cttattttcctatttg

SEQ ID NO: 93876 - DNA, 16 bp, H. sapiens
cttattttgtaaattt

SEQ ID NO: 93877 - DNA, 16 bp, H. sapiens
cttattttgtcatatt

SEQ ID NO: 93878 - DNA, 16 bp, H. sapiens
cttatttttctcaaaa

SEQ ID NO: 93879 - DNA, 16 bp, H. sapiens
cttattttttaatgaa

SEQ ID NO: 93880 - DNA, 16 bp, H. sapiens
cttatttttttagaga

SEQ ID NO: 93881 - DNA, 16 bp, H. sapiens
cttcaaaaaaccaact

SEQ ID NO: 93882 - DNA, 16 bp, H. sapiens
cttcaaaaaagtaaaa

SEQ ID NO: 93883 - DNA, 16 bp, H. sapiens
cttcaaaaaataaatg

SEQ ID NO: 93884 - DNA, 18 bp, H. sapiens
cttcaaaaaatcaatgaa

SEQ ID NO: 93885 - DNA, 16 bp, H. sapiens
cttcaaaaatattttt

SEQ ID NO: 93886 - DNA, 16 bp, H. sapiens
cttcaaaactcatttt

SEQ ID NO: 93887 - DNA, 16 bp, H. sapiens
cttcaaaagcaaagga

SEQ ID NO: 93888 - DNA, 16 bp, H. sapiens
cttcaaaagtgaagaa

SEQ ID NO: 93889 - DNA, 16 bp, H. sapiens
cttcaaaagtgtcaag

SEQ ID NO: 93890 - DNA, 16 bp, H. sapiens
cttcaaaatatatctg

SEQ ID NO: 93891 - DNA, 16 bp, H. sapiens
cttcaaaatatgtcaa

SEQ ID NO: 93892 - DNA, 16 bp, H. sapiens
cttcaaaatgaaaaat

SEQ ID NO: 93893 - DNA, 16 bp, H. sapiens
cttcaaaatggttaag

SEQ ID NO: 93894 - DNA, 16 bp, H. sapiens
cttcaaacagaataaa

SEQ ID NO: 93895 - DNA, 16 bp, H. sapiens
cttcaaactataatat

SEQ ID NO: 93896 - DNA, 40 bp, H. sapiens
cttcaaactatactacaaggctacagtaaccaaaacagca

SEQ ID NO: 93897 - DNA, 16 bp, H. sapiens
cttcaaactgttccaa

SEQ ID NO: 93898 - DNA, 16 bp, H. sapiens
cttcaaagaaaatata

SEQ ID NO: 93899 - DNA, 16 bp, H. sapiens
cttcaaagaatcagta

SEQ ID NO: 93900 - DNA, 16 bp, H. sapiens
cttcaaagccacaggg

SEQ ID NO: 93901 - DNA, 16 bp, H. sapiens
cttcaaagccagcaac

SEQ ID NO: 93902 - DNA, 16 bp, H. sapiens
cttcaaatatatttta

SEQ ID NO: 93903 - DNA, 16 bp, H. sapiens
cttcaaatatttgaaa

SEQ ID NO: 93904 - DNA, 16 bp, H. sapiens
cttcaaatcccagctc

SEQ ID NO: 93905 - DNA, 16 bp, H. sapiens
cttcaaatgatcctcc

SEQ ID NO: 93906 - DNA, 16 bp, H. sapiens
cttcaaattattttca

SEQ ID NO: 93907 - DNA, 16 bp, H. sapiens
cttcaacaaaatacaa

SEQ ID NO: 93908 - DNA, 16 bp, H. sapiens
cttcaacacaggaatt

SEQ ID NO: 93909 - DNA, 16 bp, H. sapiens
cttcaacacctcactg

SEQ ID NO: 93910 - DNA, 16 bp, H. sapiens
cttcaacatatacatt

SEQ ID NO: 93911 - DNA, 16 bp, H. sapiens
cttcaacatatgaatt

SEQ ID NO: 93912 - DNA, 16 bp, H. sapiens
cttcaacccaggaagc

SEQ ID NO: 93913 - DNA, 16 bp, H. sapiens
cttcaacccgggaggc

SEQ ID NO: 93914 - DNA, 16 bp, H. sapiens
cttcaaccctgggatg

SEQ ID NO: 93915 - DNA, 16 bp, H. sapiens
cttcaacctgggaggc

SEQ ID NO: 93916 - DNA, 16 bp, H. sapiens
cttcaacctgggaggt

SEQ ID NO: 93917 - DNA, 16 bp, H. sapiens
cttcaacttaaaatca

SEQ ID NO: 93918 - DNA, 16 bp, H. sapiens
cttcaacttcctgggc

SEQ ID NO: 93919 - DNA, 16 bp, H. sapiens
cttcaactttgttctt

SEQ ID NO: 93920 - DNA, 16 bp, H. sapiens
cttcaagaaaaccttg

SEQ ID NO: 93921 - DNA, 16 bp, H. sapiens
cttcaagaaactagaa

SEQ ID NO: 93922 - DNA, 16 bp, H. sapiens
cttcaagaaatctcca

SEQ ID NO: 93923 - DNA, 16 bp, H. sapiens
cttcaagaactttttc

SEQ ID NO: 93924 - DNA, 16 bp, H. sapiens
cttcaagaatgaagat

SEQ ID NO: 93925 - DNA, 17 bp, H. sapiens
cttcaagaatgaagcca

SEQ ID NO: 93926 - DNA, 16 bp, H. sapiens
cttcaagaccagcctg

SEQ ID NO: 93927 - DNA, 16 bp, H. sapiens
cttcaagctaaaggag

SEQ ID NO: 93928 - DNA, 16 bp, H. sapiens
cttcaaggagaacaac

SEQ ID NO: 93929 - DNA, 17 bp, H. sapiens
cttcaaggagaactaca

SEQ ID NO: 93930 - DNA, 16 bp, H. sapiens
cttcaaggctctcatc

SEQ ID NO: 93931 - DNA, 19 bp, H. sapiens
cttcaaggtatccaggtcc

SEQ ID NO: 93932 - DNA, 16 bp, H. sapiens
cttcaagtctcagctt

SEQ ID NO: 93933 - DNA, 16 bp, H. sapiens
cttcaagtgatctgcc

SEQ ID NO: 93934 - DNA, 16 bp, H. sapiens
cttcaataaagtttta

SEQ ID NO: 93935 - DNA, 16 bp, H. sapiens
cttcaataaatggtat

SEQ ID NO: 93936 - DNA, 16 bp, H. sapiens
cttcaatctctgaaca

SEQ ID NO: 93937 - DNA, 16 bp, H. sapiens
cttcaattcctggcct

SEQ ID NO: 93938 - DNA, 16 bp, H. sapiens
cttcaattcttgactt

SEQ ID NO: 93939 - DNA, 16 bp, H. sapiens
cttcacaaaataaaat

SEQ ID NO: 93940 - DNA, 16 bp, H. sapiens
cttcacaatccatgtt

SEQ ID NO: 93941 - DNA, 16 bp, H. sapiens
cttcacacaaagaaaa

SEQ ID NO: 93942 - DNA, 16 bp, H. sapiens
cttcacacattctaca

SEQ ID NO: 93943 - DNA, 21 bp, H. sapiens
cttcacacttggagggttgca

SEQ ID NO: 93944 - DNA, 16 bp, H. sapiens
cttcacagaatgggaa

SEQ ID NO: 93945 - DNA, 16 bp, H. sapiens
cttcacagagaaaata

SEQ ID NO: 93946 - DNA, 16 bp, H. sapiens
cttcacagaggaagtg

SEQ ID NO: 93947 - DNA, 16 bp, H. sapiens
cttcacagaggaggtg

SEQ ID NO: 93948 - DNA, 16 bp, H. sapiens
cttcacagatgaggaa

SEQ ID NO: 93949 - DNA, 16 bp, H. sapiens
cttcacagcagccact

SEQ ID NO: 93950 - DNA, 16 bp, H. sapiens
cttcacagccttgcca

SEQ ID NO: 93951 - DNA, 16 bp, H. sapiens
cttcacataaaatgta

SEQ ID NO: 93952 - DNA, 16 bp, H. sapiens
cttcacatcctctcca

SEQ ID NO: 93953 - DNA, 16 bp, H. sapiens
cttcacatggcagtag

SEQ ID NO: 93954 - DNA, 16 bp, H. sapiens
cttcacatggtggtag

SEQ ID NO: 93955 - DNA, 16 bp, H. sapiens
cttcacattcccacca

SEQ ID NO: 93956 - DNA, 16 bp, H. sapiens
cttcacattgtgcaca

SEQ ID NO: 93957 - DNA, 16 bp, H. sapiens
cttcaccaaagaggat

SEQ ID NO: 93958 - DNA, 16 bp, H. sapiens
cttcaccactattttg

SEQ ID NO: 93959 - DNA, 16 bp, H. sapiens
cttcaccagggacctg

SEQ ID NO: 93960 - DNA, 16 bp, H. sapiens
cttcaccatcatcatc

SEQ ID NO: 93961 - DNA, 17 bp, H. sapiens
cttcaccatgttggcca

SEQ ID NO: 93962 - DNA, 16 bp, H. sapiens
cttcacccagttcgag

SEQ ID NO: 93963 - DNA, 16 bp, H. sapiens
cttcacccatgtccct

SEQ ID NO: 93964 - DNA, 16 bp, H. sapiens
cttcacctcccaggct

SEQ ID NO: 93965 - DNA, 16 bp, H. sapiens
cttcacctctctgtgc

SEQ ID NO: 93966 - DNA, 16 bp, H. sapiens
cttcacctgtgaaatg

SEQ ID NO: 93967 - DNA, 16 bp, H. sapiens
cttcaccttcaccttc

SEQ ID NO: 93968 - DNA, 16 bp, H. sapiens
cttcactaatgaagct

SEQ ID NO: 93969 - DNA, 16 bp, H. sapiens
cttcactccagcatgg

SEQ ID NO: 93970 - DNA, 16 bp, H. sapiens
cttcactcccctgcta

SEQ ID NO: 93971 - DNA, 16 bp, H. sapiens
cttcactgtctcccct

SEQ ID NO: 93972 - DNA, 16 bp, H. sapiens
cttcacttctgaagct

SEQ ID NO: 93973 - DNA, 16 bp, H. sapiens
cttcagaaaaatagaa

SEQ ID NO: 93974 - DNA, 16 bp, H. sapiens
cttcagaaataacacc

SEQ ID NO: 93975 - DNA, 16 bp, H. sapiens
cttcagaaatgaaaac

SEQ ID NO: 93976 - DNA, 16 bp, H. sapiens
cttcagaaatgaagac

SEQ ID NO: 93977 - DNA, 16 bp, H. sapiens
cttcagaactataaga

SEQ ID NO: 93978 - DNA, 16 bp, H. sapiens
cttcagaatcagtttg

SEQ ID NO: 93979 - DNA, 16 bp, H. sapiens
cttcagacattgccaa

SEQ ID NO: 93980 - DNA, 16 bp, H. sapiens
cttcagagaaaataga

SEQ ID NO: 93981 - DNA, 16 bp, H. sapiens
cttcagagagaacaga

SEQ ID NO: 93982 - DNA, 16 bp, H. sapiens
cttcagagagaagaaa

SEQ ID NO: 93983 - DNA, 16 bp, H. sapiens
cttcagagcaagaaaa

SEQ ID NO: 93984 - DNA, 16 bp, H. sapiens
cttcagagctgccagg

SEQ ID NO: 93985 - DNA, 16 bp, H. sapiens
cttcagagggtggaag

SEQ ID NO: 93986 - DNA, 16 bp, H. sapiens
cttcagagtcagcagg

SEQ ID NO: 93987 - DNA, 16 bp, H. sapiens
cttcagatatgtccag

SEQ ID NO: 93988 - DNA, 16 bp, H. sapiens
cttcagatttttttct

SEQ ID NO: 93989 - DNA, 16 bp, H. sapiens
cttcagcaactaccac

SEQ ID NO: 93990 - DNA, 16 bp, H. sapiens
cttcagcactttggga

SEQ ID NO: 93991 - DNA, 16 bp, H. sapiens
cttcagcagcacatat

SEQ ID NO: 93992 - DNA, 16 bp, H. sapiens
cttcagcagccaccac

SEQ ID NO: 93993 - DNA, 16 bp, H. sapiens
cttcagcagtctcagg

SEQ ID NO: 93994 - DNA, 16 bp, H. sapiens
cttcagcagtgtaaga

SEQ ID NO: 93995 - DNA, 16 bp, H. sapiens
cttcagccaccatgcc

SEQ ID NO: 93996 - DNA, 16 bp, H. sapiens
cttcagccatgactgt

SEQ ID NO: 93997 - DNA, 16 bp, H. sapiens
cttcagcccagaaggt

SEQ ID NO: 93998 - DNA, 16 bp, H. sapiens
cttcagcccaggagat

SEQ ID NO: 93999 - DNA, 16 bp, H. sapiens
cttcagcccaggagtt

SEQ ID NO: 94000 - DNA, 16 bp, H. sapiens
cttcagccggtccctc

SEQ ID NO: 94001 - DNA, 16 bp, H. sapiens
cttcagcctcacaagt

SEQ ID NO: 94002 - DNA, 16 bp, H. sapiens
cttcagcctcagcttc

SEQ ID NO: 94003 - DNA, 16 bp, H. sapiens
cttcagcctcccagag

SEQ ID NO: 94004 - DNA, 16 bp, H. sapiens
cttcagcctccccagc

SEQ ID NO: 94005 - DNA, 16 bp, H. sapiens
cttcagcctccctaag

SEQ ID NO: 94006 - DNA, 16 bp, H. sapiens
cttcagcctcctttcc

SEQ ID NO: 94007 - DNA, 16 bp, H. sapiens
cttcagcctctctccc

SEQ ID NO: 94008 - DNA, 16 bp, H. sapiens
cttcagcctctgcctc

SEQ ID NO: 94009 - DNA, 16 bp, H. sapiens
cttcagcctctgctcc

SEQ ID NO: 94010 - DNA, 16 bp, H. sapiens
cttcagcctgagcgac

SEQ ID NO: 94011 - DNA, 16 bp, H. sapiens
cttcagcctggacaat

SEQ ID NO: 94012 - DNA, 16 bp, H. sapiens
cttcagcctgggcatc

SEQ ID NO: 94013 - DNA, 16 bp, H. sapiens
cttcagccttcctagt

SEQ ID NO: 94014 - DNA, 16 bp, H. sapiens
cttcagccttgacctc

SEQ ID NO: 94015 - DNA, 16 bp, H. sapiens
cttcagcgtcctgagt

SEQ ID NO: 94016 - DNA, 16 bp, H. sapiens
cttcagctaccagggc

SEQ ID NO: 94017 - DNA, 16 bp, H. sapiens
cttcagctccagctgt

SEQ ID NO: 94018 - DNA, 16 bp, H. sapiens
cttcagctcctggcct

SEQ ID NO: 94019 - DNA, 16 bp, H. sapiens
cttcagctcctgtgtg

SEQ ID NO: 94020 - DNA, 16 bp, H. sapiens
cttcagcttcctcaaa

SEQ ID NO: 94021 - DNA, 16 bp, H. sapiens
cttcagcttgccctct

SEQ ID NO: 94022 - DNA, 16 bp, H. sapiens
cttcagctttcttttg

SEQ ID NO: 94023 - DNA, 16 bp, H. sapiens
cttcaggaactctttt

SEQ ID NO: 94024 - DNA, 16 bp, H. sapiens
cttcaggaagctgagg

SEQ ID NO: 94025 - DNA, 16 bp, H. sapiens
cttcaggacctgcttg

SEQ ID NO: 94026 - DNA, 16 bp, H. sapiens
cttcaggactcagatc

SEQ ID NO: 94027 - DNA, 16 bp, H. sapiens
cttcaggagctctttc

SEQ ID NO: 94028 - DNA, 16 bp, H. sapiens
cttcaggaggaattcc

SEQ ID NO: 94029 - DNA, 16 bp, H. sapiens
cttcaggaggcccagg

SEQ ID NO: 94030 - DNA, 16 bp, H. sapiens
cttcaggagttctttt

SEQ ID NO: 94031 - DNA, 16 bp, H. sapiens
cttcaggatattatct

SEQ ID NO: 94032 - DNA, 16 bp, H. sapiens
cttcaggatgatggag

SEQ ID NO: 94033 - DNA, 16 bp, H. sapiens
cttcaggatggagaca

SEQ ID NO: 94034 - DNA, 16 bp, H. sapiens
cttcaggcagaagaaa

SEQ ID NO: 94035 - DNA, 16 bp, H. sapiens
cttcaggccaggagtt

SEQ ID NO: 94036 - DNA, 16 bp, H. sapiens
cttcaggccagggagg

SEQ ID NO: 94037 - DNA, 16 bp, H. sapiens
cttcaggccctccctg

SEQ ID NO: 94038 - DNA, 16 bp, H. sapiens
cttcaggctgaaatga

SEQ ID NO: 94039 - DNA, 16 bp, H. sapiens
cttcagggagcttaca

SEQ ID NO: 94040 - DNA, 16 bp, H. sapiens
cttcagggcagtggac

SEQ ID NO: 94041 - DNA, 16 bp, H. sapiens
cttcaggggaaaaaaa

SEQ ID NO: 94042 - DNA, 16 bp, H. sapiens
cttcagggttttcttt

SEQ ID NO: 94043 - DNA, 16 bp, H. sapiens
cttcaggtcaggagtt

SEQ ID NO: 94044 - DNA, 16 bp, H. sapiens
cttcagtatatgaatt

SEQ ID NO: 94045 - DNA, 16 bp, H. sapiens
cttcagtcagcaggtg

SEQ ID NO: 94046 - DNA, 16 bp, H. sapiens
cttcagtctccacttc

SEQ ID NO: 94047 - DNA, 16 bp, H. sapiens
cttcagtctcctgagt

SEQ ID NO: 94048 - DNA, 16 bp, H. sapiens
cttcagtcttctgagt

SEQ ID NO: 94049 - DNA, 16 bp, H. sapiens
cttcagtgaaccatga

SEQ ID NO: 94050 - DNA, 16 bp, H. sapiens
cttcagtgagcagtga

SEQ ID NO: 94051 - DNA, 16 bp, H. sapiens
cttcagtggctcccca

SEQ ID NO: 94052 - DNA, 16 bp, H. sapiens
cttcagtggcttccca

SEQ ID NO: 94053 - DNA, 16 bp, H. sapiens
cttcagtgtccagagt

SEQ ID NO: 94054 - DNA, 16 bp, H. sapiens
cttcagttctgctctg

SEQ ID NO: 94055 - DNA, 16 bp, H. sapiens
cttcagtttcatccat

SEQ ID NO: 94056 - DNA, 16 bp, H. sapiens
cttcagtttcccaaag

SEQ ID NO: 94057 - DNA, 16 bp, H. sapiens
cttcagtttctccagt

SEQ ID NO: 94058 - DNA, 16 bp, H. sapiens
cttcataacagcatga

SEQ ID NO: 94059 - DNA, 17 bp, H. sapiens
cttcatagaaaggtact

SEQ ID NO: 94060 - DNA, 16 bp, H. sapiens
cttcatagaactgaag

SEQ ID NO: 94061 - DNA, 16 bp, H. sapiens
cttcatagatgaggaa

SEQ ID NO: 94062 - DNA, 16 bp, H. sapiens
cttcatagcaatgcaa

SEQ ID NO: 94063 - DNA, 16 bp, H. sapiens
cttcatagggacatgg

SEQ ID NO: 94064 - DNA, 16 bp, H. sapiens
cttcatataaacttta

SEQ ID NO: 94065 - DNA, 16 bp, H. sapiens
cttcatataaatggaa

SEQ ID NO: 94066 - DNA, 16 bp, H. sapiens
cttcatatattcatct

SEQ ID NO: 94067 - DNA, 16 bp, H. sapiens
cttcatattactgaaa

SEQ ID NO: 94068 - DNA, 16 bp, H. sapiens
cttcatcaaagaagat

SEQ ID NO: 94069 - DNA, 16 bp, H. sapiens
cttcatcacccaggct

SEQ ID NO: 94070 - DNA, 16 bp, H. sapiens
cttcatcagggtcctc

SEQ ID NO: 94071 - DNA, 16 bp, H. sapiens
cttcatccaagtccct

SEQ ID NO: 94072 - DNA, 16 bp, H. sapiens
cttcatcccctggggc

SEQ ID NO: 94073 - DNA, 16 bp, H. sapiens
cttcatccttgtcatc

SEQ ID NO: 94074 - DNA, 16 bp, H. sapiens
cttcatctctctgagc

SEQ ID NO: 94075 - DNA, 16 bp, H. sapiens
cttcatctgtatttat

SEQ ID NO: 94076 - DNA, 16 bp, H. sapiens
cttcatctgtgaaatg

SEQ ID NO: 94077 - DNA, 16 bp, H. sapiens
cttcatctgttttgtt

SEQ ID NO: 94078 - DNA, 16 bp, H. sapiens
cttcatcttcaacatc

SEQ ID NO: 94079 - DNA, 16 bp, H. sapiens
cttcatctttgtcttc

SEQ ID NO: 94080 - DNA, 16 bp, H. sapiens
cttcatgaagcataca

SEQ ID NO: 94081 - DNA, 16 bp, H. sapiens
cttcatgaatgggatt

SEQ ID NO: 94082 - DNA, 16 bp, H. sapiens
cttcatgaatggttta

SEQ ID NO: 94083 - DNA, 16 bp, H. sapiens
cttcatgactaaatca

SEQ ID NO: 94084 - DNA, 16 bp, H. sapiens
cttcatgcaaaaaact

SEQ ID NO: 94085 - DNA, 16 bp, H. sapiens
cttcatgcccaggcag

SEQ ID NO: 94086 - DNA, 16 bp, H. sapiens
cttcatgctaaaactc

SEQ ID NO: 94087 - DNA, 16 bp, H. sapiens
cttcatggaattgaag

SEQ ID NO: 94088 - DNA, 16 bp, H. sapiens
cttcatggagaaggtg

SEQ ID NO: 94089 - DNA, 16 bp, H. sapiens
cttcatggagcttaca

SEQ ID NO: 94090 - DNA, 16 bp, H. sapiens
cttcatggagcttata

SEQ ID NO: 94091 - DNA, 16 bp, H. sapiens
cttcatggaggaagtg

SEQ ID NO: 94092 - DNA, 16 bp, H. sapiens
cttcatggaggaggtg

SEQ ID NO: 94093 - DNA, 16 bp, H. sapiens
cttcatgtattttgaa

SEQ ID NO: 94094 - DNA, 16 bp, H. sapiens
cttcatgtatttttaa

SEQ ID NO: 94095 - DNA, 16 bp, H. sapiens
cttcatgtctttgtgt

SEQ ID NO: 94096 - DNA, 16 bp, H. sapiens
cttcatgtggcagcag

SEQ ID NO: 94097 - DNA, 16 bp, H. sapiens
cttcatgtggccttct

SEQ ID NO: 94098 - DNA, 16 bp, H. sapiens
cttcatgtgtaaaata

SEQ ID NO: 94099 - DNA, 16 bp, H. sapiens
cttcatgttgaaaact

SEQ ID NO: 94100 - DNA, 16 bp, H. sapiens
cttcattaaagaagtg

SEQ ID NO: 94101 - DNA, 16 bp, H. sapiens
cttcattcctgaagtc

SEQ ID NO: 94102 - DNA, 16 bp, H. sapiens
cttcattccttttatg

SEQ ID NO: 94103 - DNA, 16 bp, H. sapiens
cttcattctccatggg

SEQ ID NO: 94104 - DNA, 16 bp, H. sapiens
cttcattctttttatg

SEQ ID NO: 94105 - DNA, 16 bp, H. sapiens
cttcattgagtgacag

SEQ ID NO: 94106 - DNA, 16 bp, H. sapiens
cttcattgcctgatgt

SEQ ID NO: 94107 - DNA, 16 bp, H. sapiens
cttcattggtaaaatg

SEQ ID NO: 94108 - DNA, 16 bp, H. sapiens
cttcatttataaagct

SEQ ID NO: 94109 - DNA, 17 bp, H. sapiens
cttcatttattcattca

SEQ ID NO: 94110 - DNA, 16 bp, H. sapiens
cttcatttgttaaaaa

SEQ ID NO: 94111 - DNA, 16 bp, H. sapiens
cttcattttaaccttg

SEQ ID NO: 94112 - DNA, 16 bp, H. sapiens
cttcattttcaaattt

SEQ ID NO: 94113 - DNA, 16 bp, H. sapiens
cttcattttgttgata

SEQ ID NO: 94114 - DNA, 16 bp, H. sapiens
cttcatttttaacaaa

SEQ ID NO: 94115 - DNA, 16 bp, H. sapiens
cttcatttttgaagtc

SEQ ID NO: 94116 - DNA, 16 bp, H. sapiens
cttccaaaatgcaatg

SEQ ID NO: 94117 - DNA, 16 bp, H. sapiens
cttccaaactcatttt

SEQ ID NO: 94118 - DNA, 16 bp, H. sapiens
cttccaaagtcctggg

SEQ ID NO: 94119 - DNA, 16 bp, H. sapiens
cttccaaatctcatgt

SEQ ID NO: 94120 - DNA, 16 bp, H. sapiens
cttccaacttttgccc

SEQ ID NO: 94121 - DNA, 16 bp, H. sapiens
cttccaagatacagtg

SEQ ID NO: 94122 - DNA, 16 bp, H. sapiens
cttccaagatggcacc

SEQ ID NO: 94123 - DNA, 16 bp, H. sapiens
cttccaagatggcggc

SEQ ID NO: 94124 - DNA, 16 bp, H. sapiens
cttccaagctttggca

SEQ ID NO: 94125 - DNA, 16 bp, H. sapiens
cttccaagttcattca

SEQ ID NO: 94126 - DNA, 16 bp, H. sapiens
cttccaagttttcttc

SEQ ID NO: 94127 - DNA, 16 bp, H. sapiens
cttccacaaccagcag

SEQ ID NO: 94128 - DNA, 16 bp, H. sapiens
cttccacaagatatca

SEQ ID NO: 94129 - DNA, 16 bp, H. sapiens
cttccacatcagcctc

SEQ ID NO: 94130 - DNA, 16 bp, H. sapiens
cttccacatggtgtta

SEQ ID NO: 94131 - DNA, 16 bp, H. sapiens
cttccacattgtggaa

SEQ ID NO: 94132 - DNA, 16 bp, H. sapiens
cttccaccacctccaa

SEQ ID NO: 94133 - DNA, 16 bp, H. sapiens
cttccaccaggttcct

SEQ ID NO: 94134 - DNA, 16 bp, H. sapiens
cttccaccatgattgt

SEQ ID NO: 94135 - DNA, 16 bp, H. sapiens
cttccacccaggctgg

SEQ ID NO: 94136 - DNA, 16 bp, H. sapiens
cttccacctcagactc

SEQ ID NO: 94137 - DNA, 16 bp, H. sapiens
cttccacctcagtctc

SEQ ID NO: 94138 - DNA, 16 bp, H. sapiens
cttccacctcccggat

SEQ ID NO: 94139 - DNA, 16 bp, H. sapiens
cttccacctcctggat

SEQ ID NO: 94140 - DNA, 16 bp, H. sapiens
cttccacctccttggt

SEQ ID NO: 94141 - DNA, 16 bp, H. sapiens
cttccacctgtgagcc

SEQ ID NO: 94142 - DNA, 16 bp, H. sapiens
cttccaccttagcctc

SEQ ID NO: 94143 - DNA, 16 bp, H. sapiens
cttccaccttctgcca

SEQ ID NO: 94144 - DNA, 16 bp, H. sapiens
cttccaccttctggct

SEQ ID NO: 94145 - DNA, 16 bp, H. sapiens
cttccaccttctgggt

SEQ ID NO: 94146 - DNA, 16 bp, H. sapiens
cttccactgaatacac

SEQ ID NO: 94147 - DNA, 16 bp, H. sapiens
cttccacttcaacctc

SEQ ID NO: 94148 - DNA, 16 bp, H. sapiens
cttccacttccaccat

SEQ ID NO: 94149 - DNA, 16 bp, H. sapiens
cttccacttccacttc

SEQ ID NO: 94150 - DNA, 16 bp, H. sapiens
cttccacttttaagga

SEQ ID NO: 94151 - DNA, 16 bp, H. sapiens
cttccagaaaaaaaca

SEQ ID NO: 94152 - DNA, 16 bp, H. sapiens
cttccagaacattcca

SEQ ID NO: 94153 - DNA, 16 bp, H. sapiens
cttccagaaccgtgag

SEQ ID NO: 94154 - DNA, 16 bp, H. sapiens
cttccagaactatgag

SEQ ID NO: 94155 - DNA, 16 bp, H. sapiens
cttccagaagaaggaa

SEQ ID NO: 94156 - DNA, 16 bp, H. sapiens
cttccagagaaaggaa

SEQ ID NO: 94157 - DNA, 16 bp, H. sapiens
cttccagagaaaggat

SEQ ID NO: 94158 - DNA, 16 bp, H. sapiens
cttccagagcccctgg

SEQ ID NO: 94159 - DNA, 16 bp, H. sapiens
cttccagcccccagaa

SEQ ID NO: 94160 - DNA, 16 bp, H. sapiens
cttccagcctctggaa

SEQ ID NO: 94161 - DNA, 16 bp, H. sapiens
cttccagccttccaag

SEQ ID NO: 94162 - DNA, 16 bp, H. sapiens
cttccagctcagcctc

SEQ ID NO: 94163 - DNA, 16 bp, H. sapiens
cttccagctgtgccca

SEQ ID NO: 94164 - DNA, 16 bp, H. sapiens
cttccagctgtgcctg

SEQ ID NO: 94165 - DNA, 16 bp, H. sapiens
cttccagcttccagtg

SEQ ID NO: 94166 - DNA, 16 bp, H. sapiens
cttccagcttccttat

SEQ ID NO: 94167 - DNA, 16 bp, H. sapiens
cttccagcttctgctg

SEQ ID NO: 94168 - DNA, 16 bp, H. sapiens
cttccagcttctggta

SEQ ID NO: 94169 - DNA, 16 bp, H. sapiens
cttccagcttttgtct

SEQ ID NO: 94170 - DNA, 16 bp, H. sapiens
cttccaggaagccttc

SEQ ID NO: 94171 - DNA, 16 bp, H. sapiens
cttccaggactgtgag

SEQ ID NO: 94172 - DNA, 16 bp, H. sapiens
cttccaggcagctgtc

SEQ ID NO: 94173 - DNA, 16 bp, H. sapiens
cttccaggccctccca

SEQ ID NO: 94174 - DNA, 16 bp, H. sapiens
cttccaggctcaagag

SEQ ID NO: 94175 - DNA, 16 bp, H. sapiens
cttccaggctcaagca

SEQ ID NO: 94176 - DNA, 16 bp, H. sapiens
cttccagggattttat

SEQ ID NO: 94177 - DNA, 16 bp, H. sapiens
cttccaggtgattctg

SEQ ID NO: 94178 - DNA, 16 bp, H. sapiens
cttccaggtgccactg

SEQ ID NO: 94179 - DNA, 16 bp, H. sapiens
cttccaggttcacgcc

SEQ ID NO: 94180 - DNA, 16 bp, H. sapiens
cttccagtctgtagct

SEQ ID NO: 94181 - DNA, 16 bp, H. sapiens
cttccagttcttgccc

SEQ ID NO: 94182 - DNA, 17 bp, H. sapiens
cttccagttgatcacat

SEQ ID NO: 94183 - DNA, 16 bp, H. sapiens
cttccagtttctgccc

SEQ ID NO: 94184 - DNA, 16 bp, H. sapiens
cttccatatgatccag

SEQ ID NO: 94185 - DNA, 16 bp, H. sapiens
cttccatattttaaaa

SEQ ID NO: 94186 - DNA, 16 bp, H. sapiens
cttccatcaaagccaa

SEQ ID NO: 94187 - DNA, 16 bp, H. sapiens
cttccatcatgatttt

SEQ ID NO: 94188 - DNA, 16 bp, H. sapiens
cttccatccatccttc

SEQ ID NO: 94189 - DNA, 16 bp, H. sapiens
cttccatctcaacctc

SEQ ID NO: 94190 - DNA, 16 bp, H. sapiens
cttccatctccacatc

SEQ ID NO: 94191 - DNA, 16 bp, H. sapiens
cttccatgaaacctgt

SEQ ID NO: 94192 - DNA, 16 bp, H. sapiens
cttccatgccctctcc

SEQ ID NO: 94193 - DNA, 16 bp, H. sapiens
cttccatggcagcagg

SEQ ID NO: 94194 - DNA, 16 bp, H. sapiens
cttccatgtcttggct

SEQ ID NO: 94195 - DNA, 16 bp, H. sapiens
cttccatgtgaatttt

SEQ ID NO: 94196 - DNA, 16 bp, H. sapiens
cttccattccagtgca

SEQ ID NO: 94197 - DNA, 16 bp, H. sapiens
cttccattctgtaggt

SEQ ID NO: 94198 - DNA, 16 bp, H. sapiens
cttccatttataaaac

SEQ ID NO: 94199 - DNA, 16 bp, H. sapiens
cttccatttcttctgc

SEQ ID NO: 94200 - DNA, 16 bp, H. sapiens
cttccatttggccttt

SEQ ID NO: 94201 - DNA, 16 bp, H. sapiens
cttcccaaaggccaca

SEQ ID NO: 94202 - DNA, 16 bp, H. sapiens
cttcccaaagtgctca

SEQ ID NO: 94203 - DNA, 16 bp, H. sapiens
cttcccaaagtgctga

SEQ ID NO: 94204 - DNA, 16 bp, H. sapiens
cttcccaaatcatttt

SEQ ID NO: 94205 - DNA, 16 bp, H. sapiens
cttcccaacagccccc

SEQ ID NO: 94206 - DNA, 16 bp, H. sapiens
cttcccaagaaggaca

SEQ ID NO: 94207 - DNA, 16 bp, H. sapiens
cttcccaaggagctgg

SEQ ID NO: 94208 - DNA, 16 bp, H. sapiens
cttcccaagttcaagc

SEQ ID NO: 94209 - DNA, 16 bp, H. sapiens
cttcccacagtggctg

SEQ ID NO: 94210 - DNA, 16 bp, H. sapiens
cttcccaccctcactg

SEQ ID NO: 94211 - DNA, 16 bp, H. sapiens
cttcccacctcagcca

SEQ ID NO: 94212 - DNA, 16 bp, H. sapiens
cttcccaccttggcct

SEQ ID NO: 94213 - DNA, 16 bp, H. sapiens
cttcccactgcactcc

SEQ ID NO: 94214 - DNA, 16 bp, H. sapiens
cttcccagaaggagcc

SEQ ID NO: 94215 - DNA, 16 bp, H. sapiens
cttcccagagaggagg

SEQ ID NO: 94216 - DNA, 16 bp, H. sapiens
cttcccagatcttctc

SEQ ID NO: 94217 - DNA, 16 bp, H. sapiens
cttcccagattcaagc

SEQ ID NO: 94218 - DNA, 16 bp, H. sapiens
cttcccagcactcctg

SEQ ID NO: 94219 - DNA, 16 bp, H. sapiens
cttcccagcccccagc

SEQ ID NO: 94220 - DNA, 16 bp, H. sapiens
cttcccagcctccagg

SEQ ID NO: 94221 - DNA, 16 bp, H. sapiens
cttcccagcctcctga

SEQ ID NO: 94222 - DNA, 16 bp, H. sapiens
cttcccagcctgcaga

SEQ ID NO: 94223 - DNA, 16 bp, H. sapiens
cttcccagcctgcagg

SEQ ID NO: 94224 - DNA, 16 bp, H. sapiens
cttcccagctctcagc

SEQ ID NO: 94225 - DNA, 16 bp, H. sapiens
cttcccagcttccaaa

SEQ ID NO: 94226 - DNA, 16 bp, H. sapiens
cttcccaggcccctga

SEQ ID NO: 94227 - DNA, 16 bp, H. sapiens
cttcccaggctccagt

SEQ ID NO: 94228 - DNA, 16 bp, H. sapiens
cttcccaggtgattct

SEQ ID NO: 94229 - DNA, 16 bp, H. sapiens
cttcccaggttcaagc

SEQ ID NO: 94230 - DNA, 17 bp, H. sapiens
cttcccaggttcacgcc

SEQ ID NO: 94231 - DNA, 16 bp, H. sapiens
cttcccagtctctgtt

SEQ ID NO: 94232 - DNA, 16 bp, H. sapiens
cttcccatcagcccct

SEQ ID NO: 94233 - DNA, 16 bp, H. sapiens
cttcccatctcagcct

SEQ ID NO: 94234 - DNA, 16 bp, H. sapiens
cttcccatgtgccagg

SEQ ID NO: 94235 - DNA, 16 bp, H. sapiens
cttcccattggttctc

SEQ ID NO: 94236 - DNA, 16 bp, H. sapiens
cttcccattttacaga

SEQ ID NO: 94237 - DNA, 16 bp, H. sapiens
cttccccaaagtcaca

SEQ ID NO: 94238 - DNA, 16 bp, H. sapiens
cttccccaacccagca

SEQ ID NO: 94239 - DNA, 16 bp, H. sapiens
cttccccagccatgcc

SEQ ID NO: 94240 - DNA, 16 bp, H. sapiens
cttccccagcccctgg

SEQ ID NO: 94241 - DNA, 16 bp, H. sapiens
cttccccagcctccag

SEQ ID NO: 94242 - DNA, 16 bp, H. sapiens
cttccccagcctccca

SEQ ID NO: 94243 - DNA, 16 bp, H. sapiens
cttccccagctatgtg

SEQ ID NO: 94244 - DNA, 16 bp, H. sapiens
cttccccagctcccag

SEQ ID NO: 94245 - DNA, 16 bp, H. sapiens
cttccccagcttgcag

SEQ ID NO: 94246 - DNA, 16 bp, H. sapiens
cttccccagtcaagcc

SEQ ID NO: 94247 - DNA, 16 bp, H. sapiens
cttccccatcatcctt

SEQ ID NO: 94248 - DNA, 16 bp, H. sapiens
cttcccccaacccctg

SEQ ID NO: 94249 - DNA, 16 bp, H. sapiens
cttcccccagcccctg

SEQ ID NO: 94250 - DNA, 16 bp, H. sapiens
cttcccccaggtgctc

SEQ ID NO: 94251 - DNA, 16 bp, H. sapiens
cttcccctccaaagga

SEQ ID NO: 94252 - DNA, 16 bp, H. sapiens
cttcccctctccccag

SEQ ID NO: 94253 - DNA, 16 bp, H. sapiens
cttcccctctctgggc

SEQ ID NO: 94254 - DNA, 16 bp, H. sapiens
cttcccctctgctggg

SEQ ID NO: 94255 - DNA, 16 bp, H. sapiens
cttcccctgaagtctg

SEQ ID NO: 94256 - DNA, 16 bp, H. sapiens
cttccccttcctgcca

SEQ ID NO: 94257 - DNA, 16 bp, H. sapiens
cttcccgaggctccac

SEQ ID NO: 94258 - DNA, 16 bp, H. sapiens
cttcccgagttcaagc

SEQ ID NO: 94259 - DNA, 16 bp, H. sapiens
cttcccgggtagctgg

SEQ ID NO: 94260 - DNA, 16 bp, H. sapiens
cttcccgggttcaagc

SEQ ID NO: 94261 - DNA, 16 bp, H. sapiens
cttccctaagtgctgg

SEQ ID NO: 94262 - DNA, 16 bp, H. sapiens
cttccctacttttgag

SEQ ID NO: 94263 - DNA, 16 bp, H. sapiens
cttccctcagcctccc

SEQ ID NO: 94264 - DNA, 16 bp, H. sapiens
cttccctcaggaggcc

SEQ ID NO: 94265 - DNA, 16 bp, H. sapiens
cttccctcccagccct

SEQ ID NO: 94266 - DNA, 16 bp, H. sapiens
cttccctcccagcctc

SEQ ID NO: 94267 - DNA, 16 bp, H. sapiens
cttccctcctcagaca

SEQ ID NO: 94268 - DNA, 16 bp, H. sapiens
cttccctcctccccag

SEQ ID NO: 94269 - DNA, 16 bp, H. sapiens
cttccctctctgggcc

SEQ ID NO: 94270 - DNA, 16 bp, H. sapiens
cttccctgacctccca

SEQ ID NO: 94271 - DNA, 16 bp, H. sapiens
cttccctgcctctggt

SEQ ID NO: 94272 - DNA, 16 bp, H. sapiens
cttccctgctgccatg

SEQ ID NO: 94273 - DNA, 16 bp, H. sapiens
cttccctggctccagc

SEQ ID NO: 94274 - DNA, 16 bp, H. sapiens
cttccctggctccttc

SEQ ID NO: 94275 - DNA, 16 bp, H. sapiens
cttccctgggccacag

SEQ ID NO: 94276 - DNA, 16 bp, H. sapiens
cttccctgggcctcag

SEQ ID NO: 94277 - DNA, 16 bp, H. sapiens
cttccctgggcctctg

SEQ ID NO: 94278 - DNA, 16 bp, H. sapiens
cttccctgggctctgc

SEQ ID NO: 94279 - DNA, 16 bp, H. sapiens
cttccctgtgtgtgtg

SEQ ID NO: 94280 - DNA, 16 bp, H. sapiens
cttcccttaaactcac

SEQ ID NO: 94281 - DNA, 16 bp, H. sapiens
cttcccttcaaggaag

SEQ ID NO: 94282 - DNA, 16 bp, H. sapiens
cttcccttcagggcag

SEQ ID NO: 94283 - DNA, 16 bp, H. sapiens
cttcccttccctccag

SEQ ID NO: 94284 - DNA, 16 bp, H. sapiens
cttcccttctgggcct

SEQ ID NO: 94285 - DNA, 16 bp, H. sapiens
cttccgagtagctgga

SEQ ID NO: 94286 - DNA, 16 bp, H. sapiens
cttccgagtagttggg

SEQ ID NO: 94287 - DNA, 16 bp, H. sapiens
cttccggggttcaagc

SEQ ID NO: 94288 - DNA, 17 bp, H. sapiens
cttccgggttcaagtga

SEQ ID NO: 94289 - DNA, 16 bp, H. sapiens
cttcctaaaagtaatc

SEQ ID NO: 94290 - DNA, 16 bp, H. sapiens
cttcctaaaataattt

SEQ ID NO: 94291 - DNA, 16 bp, H. sapiens
cttcctaattatttta

SEQ ID NO: 94292 - DNA, 16 bp, H. sapiens
cttcctacacagcctg

SEQ ID NO: 94293 - DNA, 16 bp, H. sapiens
cttcctatatagcctg

SEQ ID NO: 94294 - DNA, 16 bp, H. sapiens
cttcctattcatgagc

SEQ ID NO: 94295 - DNA, 16 bp, H. sapiens
cttcctatttatgagc

SEQ ID NO: 94296 - DNA, 16 bp, H. sapiens
cttcctcaacctccca

SEQ ID NO: 94297 - DNA, 16 bp, H. sapiens
cttcctcaaggaagcc

SEQ ID NO: 94298 - DNA, 16 bp, H. sapiens
cttcctcactgggtgg

SEQ ID NO: 94299 - DNA, 16 bp, H. sapiens
cttcctcagcatccac

SEQ ID NO: 94300 - DNA, 16 bp, H. sapiens
cttcctcagcccccca

SEQ ID NO: 94301 - DNA, 16 bp, H. sapiens
cttcctcagcctcccg

SEQ ID NO: 94302 - DNA, 16 bp, H. sapiens
cttcctcagcctcctg

SEQ ID NO: 94303 - DNA, 16 bp, H. sapiens
cttcctcaggaaatga

SEQ ID NO: 94304 - DNA, 16 bp, H. sapiens
cttcctcaggaacacc

SEQ ID NO: 94305 - DNA, 16 bp, H. sapiens
cttcctcatctgaaaa

SEQ ID NO: 94306 - DNA, 16 bp, H. sapiens
cttcctcatctgcaaa

SEQ ID NO: 94307 - DNA, 16 bp, H. sapiens
cttcctcatctgtaaa

SEQ ID NO: 94308 - DNA, 16 bp, H. sapiens
cttcctccagaaagcc

SEQ ID NO: 94309 - DNA, 16 bp, H. sapiens
cttcctccagcttctg

SEQ ID NO: 94310 - DNA, 16 bp, H. sapiens
cttcctccaggaagcc

SEQ ID NO: 94311 - DNA, 16 bp, H. sapiens
cttcctccaggcagcc

SEQ ID NO: 94312 - DNA, 16 bp, H. sapiens
cttcctccaggtccct

SEQ ID NO: 94313 - DNA, 16 bp, H. sapiens
cttcctccaggtgctc

SEQ ID NO: 94314 - DNA, 16 bp, H. sapiens
cttcctccatctccaa

SEQ ID NO: 94315 - DNA, 16 bp, H. sapiens
cttcctcccacctgcc

SEQ ID NO: 94316 - DNA, 16 bp, H. sapiens
cttcctccccaaaaca

SEQ ID NO: 94317 - DNA, 16 bp, H. sapiens
cttcctccccaggctg

SEQ ID NO: 94318 - DNA, 16 bp, H. sapiens
cttcctccctcagcct

SEQ ID NO: 94319 - DNA, 16 bp, H. sapiens
cttcctccctgcctgg

SEQ ID NO: 94320 - DNA, 16 bp, H. sapiens
cttcctccctgggatg

SEQ ID NO: 94321 - DNA, 16 bp, H. sapiens
cttcctcctcagcctc

SEQ ID NO: 94322 - DNA, 16 bp, H. sapiens
cttcctcctcatcatc

SEQ ID NO: 94323 - DNA, 16 bp, H. sapiens
cttcctcctccccagc

SEQ ID NO: 94324 - DNA, 16 bp, H. sapiens
cttcctcctcctcagc

SEQ ID NO: 94325 - DNA, 16 bp, H. sapiens
cttcctcctcctgggc

SEQ ID NO: 94326 - DNA, 16 bp, H. sapiens
cttcctcctggaagtc

SEQ ID NO: 94327 - DNA, 16 bp, H. sapiens
cttcctcctgtgctgg

SEQ ID NO: 94328 - DNA, 16 bp, H. sapiens
cttcctctactcctgt

SEQ ID NO: 94329 - DNA, 16 bp, H. sapiens
cttcctctccagcctc

SEQ ID NO: 94330 - DNA, 16 bp, H. sapiens
cttcctctccccagcc

SEQ ID NO: 94331 - DNA, 16 bp, H. sapiens
cttcctctcctcaggc

SEQ ID NO: 94332 - DNA, 16 bp, H. sapiens
cttcctctcctcccag

SEQ ID NO: 94333 - DNA, 16 bp, H. sapiens
cttcctctctcagcct

SEQ ID NO: 94334 - DNA, 16 bp, H. sapiens
cttcctctgcctggaa

SEQ ID NO: 94335 - DNA, 16 bp, H. sapiens
cttcctctgcctggct

SEQ ID NO: 94336 - DNA, 16 bp, H. sapiens
cttcctctgcctgggc

SEQ ID NO: 94337 - DNA, 16 bp, H. sapiens
cttcctctgctgcctc

SEQ ID NO: 94338 - DNA, 16 bp, H. sapiens
cttcctctggaagctt

SEQ ID NO: 94339 - DNA, 16 bp, H. sapiens
cttcctctgtaaaatg

SEQ ID NO: 94340 - DNA, 16 bp, H. sapiens
cttcctcttcagcctc

SEQ ID NO: 94341 - DNA, 16 bp, H. sapiens
cttcctcttcctcagc

SEQ ID NO: 94342 - DNA, 16 bp, H. sapiens
cttcctctttggcctc

SEQ ID NO: 94343 - DNA, 16 bp, H. sapiens
cttcctgaaggacctg

SEQ ID NO: 94344 - DNA, 16 bp, H. sapiens
cttcctgaaggaggtg

SEQ ID NO: 94345 - DNA, 16 bp, H. sapiens
cttcctgaagtgctgg

SEQ ID NO: 94346 - DNA, 16 bp, H. sapiens
cttcctgagcctcagt

SEQ ID NO: 94347 - DNA, 16 bp, H. sapiens
cttcctgaggccccac

SEQ ID NO: 94348 - DNA, 16 bp, H. sapiens
cttcctgaggcctcat

SEQ ID NO: 94349 - DNA, 16 bp, H. sapiens
cttcctgaggctccac

SEQ ID NO: 94350 - DNA, 16 bp, H. sapiens
cttcctgagggaagct

SEQ ID NO: 94351 - DNA, 16 bp, H. sapiens
cttcctgagtagttgg

SEQ ID NO: 94352 - DNA, 16 bp, H. sapiens
cttcctgagttgctgg

SEQ ID NO: 94353 - DNA, 16 bp, H. sapiens
cttcctgatccttcct

SEQ ID NO: 94354 - DNA, 16 bp, H. sapiens
cttcctgatgctcttc

SEQ ID NO: 94355 - DNA, 16 bp, H. sapiens
cttcctgattctccca

SEQ ID NO: 94356 - DNA, 16 bp, H. sapiens
cttcctgcagaaccac

SEQ ID NO: 94357 - DNA, 16 bp, H. sapiens
cttcctgcagctgcag

SEQ ID NO: 94358 - DNA, 16 bp, H. sapiens
cttcctgcagctgctg

SEQ ID NO: 94359 - DNA, 16 bp, H. sapiens
cttcctgcatcctttt

SEQ ID NO: 94360 - DNA, 16 bp, H. sapiens
cttcctgccacagcct

SEQ ID NO: 94361 - DNA, 16 bp, H. sapiens
cttcctgccatcctgc

SEQ ID NO: 94362 - DNA, 16 bp, H. sapiens
cttcctgcccaggctg

SEQ ID NO: 94363 - DNA, 16 bp, H. sapiens
cttcctgcccttgaac

SEQ ID NO: 94364 - DNA, 16 bp, H. sapiens
cttcctgcctctgctg

SEQ ID NO: 94365 - DNA, 16 bp, H. sapiens
cttcctgcctgagcct

SEQ ID NO: 94366 - DNA, 16 bp, H. sapiens
cttcctgcctgccctg

SEQ ID NO: 94367 - DNA, 16 bp, H. sapiens
cttcctgcctgctgca

SEQ ID NO: 94368 - DNA, 16 bp, H. sapiens
cttcctgccttagcct

SEQ ID NO: 94369 - DNA, 16 bp, H. sapiens
cttcctgcctttgaac

SEQ ID NO: 94370 - DNA, 16 bp, H. sapiens
cttcctgcctttgctt

SEQ ID NO: 94371 - DNA, 16 bp, H. sapiens
cttcctgctccatccc

SEQ ID NO: 94372 - DNA, 16 bp, H. sapiens
cttcctgctgtgtcct

SEQ ID NO: 94373 - DNA, 16 bp, H. sapiens
cttcctgcttcagcct

SEQ ID NO: 94374 - DNA, 16 bp, H. sapiens
cttcctggaagaggtg

SEQ ID NO: 94375 - DNA, 16 bp, H. sapiens
cttcctggagaaggtg

SEQ ID NO: 94376 - DNA, 16 bp, H. sapiens
cttcctggaggaagac

SEQ ID NO: 94377 - DNA, 16 bp, H. sapiens
cttcctggaggaagag

SEQ ID NO: 94378 - DNA, 16 bp, H. sapiens
cttcctggaggaaggg

SEQ ID NO: 94379 - DNA, 16 bp, H. sapiens
cttcctggaggagctg

SEQ ID NO: 94380 - DNA, 16 bp, H. sapiens
cttcctggaggaggag

SEQ ID NO: 94381 - DNA, 16 bp, H. sapiens
cttcctggaggaggtg

SEQ ID NO: 94382 - DNA, 16 bp, H. sapiens
cttcctggaggtggtg

SEQ ID NO: 94383 - DNA, 16 bp, H. sapiens
cttcctggcagccaaa

SEQ ID NO: 94384 - DNA, 16 bp, H. sapiens
cttcctggcagccaag

SEQ ID NO: 94385 - DNA, 16 bp, H. sapiens
cttcctggcctctctg

SEQ ID NO: 94386 - DNA, 16 bp, H. sapiens
cttcctggcctctttg

SEQ ID NO: 94387 - DNA, 16 bp, H. sapiens
cttcctggctccttca

SEQ ID NO: 94388 - DNA, 16 bp, H. sapiens
cttcctggcttgcaga

SEQ ID NO: 94389 - DNA, 16 bp, H. sapiens
cttcctgggctcaagc

SEQ ID NO: 94390 - DNA, 16 bp, H. sapiens
cttcctgggctcaagt

SEQ ID NO: 94391 - DNA, 19 bp, H. sapiens
cttcctgggctcaggtgat

SEQ ID NO: 94392 - DNA, 16 bp, H. sapiens
cttcctgggggaggtg

SEQ ID NO: 94393 - DNA, 16 bp, H. sapiens
cttcctggggtcaagc

SEQ ID NO: 94394 - DNA, 16 bp, H. sapiens
cttcctgggtagctgg

SEQ ID NO: 94395 - DNA, 16 bp, H. sapiens
cttcctgggtggagtg

SEQ ID NO: 94396 - DNA, 16 bp, H. sapiens
cttcctggttcataaa

SEQ ID NO: 94397 - DNA, 16 bp, H. sapiens
cttcctgtacatcctg

SEQ ID NO: 94398 - DNA, 16 bp, H. sapiens
cttcctgtcagatcag

SEQ ID NO: 94399 - DNA, 16 bp, H. sapiens
cttcctgtctcagctt

SEQ ID NO: 94400 - DNA, 16 bp, H. sapiens
cttcctgtctctctgt

SEQ ID NO: 94401 - DNA, 16 bp, H. sapiens
cttcctgtgtcccagt

SEQ ID NO: 94402 - DNA, 16 bp, H. sapiens
cttcctgtgtctggct

SEQ ID NO: 94403 - DNA, 16 bp, H. sapiens
cttcctgtgtggtttt

SEQ ID NO: 94404 - DNA, 16 bp, H. sapiens
cttcctgtgttcaagc

SEQ ID NO: 94405 - DNA, 16 bp, H. sapiens
cttccttaaagtttca

SEQ ID NO: 94406 - DNA, 16 bp, H. sapiens
cttccttacaccatat

SEQ ID NO: 94407 - DNA, 16 bp, H. sapiens
cttccttacactatat

SEQ ID NO: 94408 - DNA, 16 bp, H. sapiens
cttccttatctgtaaa

SEQ ID NO: 94409 - DNA, 16 bp, H. sapiens
cttccttcaggtgctc

SEQ ID NO: 94410 - DNA, 16 bp, H. sapiens
cttccttcatcttcaa

SEQ ID NO: 94411 - DNA, 16 bp, H. sapiens
cttccttcctcttcag

SEQ ID NO: 94412 - DNA, 16 bp, H. sapiens
cttccttctgattttc

SEQ ID NO: 94413 - DNA, 16 bp, H. sapiens
cttccttctgctccag

SEQ ID NO: 94414 - DNA, 16 bp, H. sapiens
cttccttctttccaat

SEQ ID NO: 94415 - DNA, 16 bp, H. sapiens
cttccttgctgcttct

SEQ ID NO: 94416 - DNA, 16 bp, H. sapiens
cttccttggcatctgg

SEQ ID NO: 94417 - DNA, 16 bp, H. sapiens
cttccttggcctcctg

SEQ ID NO: 94418 - DNA, 16 bp, H. sapiens
cttcctttaaaaaaaa

SEQ ID NO: 94419 - DNA, 16 bp, H. sapiens
cttcctttgctgtgca

SEQ ID NO: 94420 - DNA, 16 bp, H. sapiens
cttcctttgggagctc

SEQ ID NO: 94421 - DNA, 16 bp, H. sapiens
cttccttttaatgaag

SEQ ID NO: 94422 - DNA, 16 bp, H. sapiens
cttccttttcaatctg

SEQ ID NO: 94423 - DNA, 16 bp, H. sapiens
cttccttttggtgggt

SEQ ID NO: 94424 - DNA, 16 bp, H. sapiens
cttccttttgttccca

SEQ ID NO: 94425 - DNA, 16 bp, H. sapiens
cttcgagaggccgagg

SEQ ID NO: 94426 - DNA, 16 bp, H. sapiens
cttcgggagactgagg

SEQ ID NO: 94427 - DNA, 16 bp, H. sapiens
cttcgggaggtggagg

SEQ ID NO: 94428 - DNA, 16 bp, H. sapiens
cttcggttctgctctg

SEQ ID NO: 94429 - DNA, 16 bp, H. sapiens
cttcgtgatccacctg

SEQ ID NO: 94430 - DNA, 18 bp, H. sapiens
cttcgttcttgaagtcag

SEQ ID NO: 94431 - DNA, 16 bp, H. sapiens
cttctaaaagaaaaaa

SEQ ID NO: 94432 - DNA, 16 bp, H. sapiens
cttctaaacaaccaga

SEQ ID NO: 94433 - DNA, 16 bp, H. sapiens
cttctaaggcctctct

SEQ ID NO: 94434 - DNA, 16 bp, H. sapiens
cttctaagttgtattc

SEQ ID NO: 94435 - DNA, 16 bp, H. sapiens
cttctaagttttctag

SEQ ID NO: 94436 - DNA, 16 bp, H. sapiens
cttctacaaaaatcaa

SEQ ID NO: 94437 - DNA, 16 bp, H. sapiens
cttctacctagttttt

SEQ ID NO: 94438 - DNA, 16 bp, H. sapiens
cttctacctctggctt

SEQ ID NO: 94439 - DNA, 16 bp, H. sapiens
cttctacctcttggct

SEQ ID NO: 94440 - DNA, 16 bp, H. sapiens
cttctacctggacatc

SEQ ID NO: 94441 - DNA, 16 bp, H. sapiens
cttctacgcaaataaa

SEQ ID NO: 94442 - DNA, 16 bp, H. sapiens
cttctagaaagaagag

SEQ ID NO: 94443 - DNA, 16 bp, H. sapiens
cttctagaagaaagca

SEQ ID NO: 94444 - DNA, 16 bp, H. sapiens
cttctagattgtctag

SEQ ID NO: 94445 - DNA, 16 bp, H. sapiens
cttctagctgtgtcct

SEQ ID NO: 94446 - DNA, 16 bp, H. sapiens
cttctaggagttttaa

SEQ ID NO: 94447 - DNA, 16 bp, H. sapiens
cttctagggtttttgt

SEQ ID NO: 94448 - DNA, 16 bp, H. sapiens
cttctagtcagccatc

SEQ ID NO: 94449 - DNA, 16 bp, H. sapiens
cttctatgtcttcttc

SEQ ID NO: 94450 - DNA, 16 bp, H. sapiens
cttctatgtgccagac

SEQ ID NO: 94451 - DNA, 16 bp, H. sapiens
cttctatgttttcttc

SEQ ID NO: 94452 - DNA, 16 bp, H. sapiens
cttctattcaacacag

SEQ ID NO: 94453 - DNA, 16 bp, H. sapiens
cttctattcaacatgg

SEQ ID NO: 94454 - DNA, 16 bp, H. sapiens
cttctatttaaaaata

SEQ ID NO: 94455 - DNA, 16 bp, H. sapiens
cttctatttcattgag

SEQ ID NO: 94456 - DNA, 16 bp, H. sapiens
cttctcaaaagaagaa

SEQ ID NO: 94457 - DNA, 16 bp, H. sapiens
cttctcaaaaggagac

SEQ ID NO: 94458 - DNA, 16 bp, H. sapiens
cttctcaactggaaaa

SEQ ID NO: 94459 - DNA, 16 bp, H. sapiens
cttctcaataaatatt

SEQ ID NO: 94460 - DNA, 16 bp, H. sapiens
cttctcaatactgcca

SEQ ID NO: 94461 - DNA, 16 bp, H. sapiens
cttctcactgtgtcct

SEQ ID NO: 94462 - DNA, 52 bp, H. sapiens
cttctcagagctgctgtccaacctgcactcgcgtgggaacgagaagacactc

SEQ ID NO: 94463 - DNA, 16 bp, H. sapiens
cttctcagatggggtg

SEQ ID NO: 94464 - DNA, 16 bp, H. sapiens
cttctcagattggctt

SEQ ID NO: 94465 - DNA, 16 bp, H. sapiens
cttctcagcaaatgta

SEQ ID NO: 94466 - DNA, 16 bp, H. sapiens
cttctcagcagcattt

SEQ ID NO: 94467 - DNA, 16 bp, H. sapiens
cttctcagcctctgta

SEQ ID NO: 94468 - DNA, 16 bp, H. sapiens
cttctcagcctgcaga

SEQ ID NO: 94469 - DNA, 16 bp, H. sapiens
cttctcaggcctctct

SEQ ID NO: 94470 - DNA, 16 bp, H. sapiens
cttctcagggctagct

SEQ ID NO: 94471 - DNA, 16 bp, H. sapiens
cttctcagtctctggt

SEQ ID NO: 94472 - DNA, 16 bp, H. sapiens
cttctcatgagatctg

SEQ ID NO: 94473 - DNA, 16 bp, H. sapiens
cttctcatgttctcac

SEQ ID NO: 94474 - DNA, 16 bp, H. sapiens
cttctcatttgtgtag

SEQ ID NO: 94475 - DNA, 16 bp, H. sapiens
cttctccagccacatg

SEQ ID NO: 94476 - DNA, 16 bp, H. sapiens
cttctccagcctctct

SEQ ID NO: 94477 - DNA, 16 bp, H. sapiens
cttctccaggaagccc

SEQ ID NO: 94478 - DNA, 16 bp, H. sapiens
cttctccatgttggtc

SEQ ID NO: 94479 - DNA, 16 bp, H. sapiens
cttctcccaaactcct

SEQ ID NO: 94480 - DNA, 16 bp, H. sapiens
cttctcccaggctgga

SEQ ID NO: 94481 - DNA, 16 bp, H. sapiens
cttctccccagtccct

SEQ ID NO: 94482 - DNA, 16 bp, H. sapiens
cttctccctcagcctc

SEQ ID NO: 94483 - DNA, 16 bp, H. sapiens
cttctccctcctgcca

SEQ ID NO: 94484 - DNA, 16 bp, H. sapiens
cttctccctggacatc

SEQ ID NO: 94485 - DNA, 16 bp, H. sapiens
cttctccctgtaactg

SEQ ID NO: 94486 - DNA, 16 bp, H. sapiens
cttctccctgtgtcca

SEQ ID NO: 94487 - DNA, 16 bp, H. sapiens
cttctcctccaaatga

SEQ ID NO: 94488 - DNA, 16 bp, H. sapiens
cttctcctcccaggtt

SEQ ID NO: 94489 - DNA, 16 bp, H. sapiens
cttctcctcctccaaa

SEQ ID NO: 94490 - DNA, 16 bp, H. sapiens
cttctcctctctgctg

SEQ ID NO: 94491 - DNA, 16 bp, H. sapiens
cttctcctctctgggc

SEQ ID NO: 94492 - DNA, 16 bp, H. sapiens
cttctcctgcctaatt

SEQ ID NO: 94493 - DNA, 20 bp, H. sapiens
cttctcctgcctcagcctcc

SEQ ID NO: 94494 - DNA, 16 bp, H. sapiens
cttctcctgcctcatt

SEQ ID NO: 94495 - DNA, 16 bp, H. sapiens
cttctccttcctgcag

SEQ ID NO: 94496 - DNA, 16 bp, H. sapiens
cttctccttcctgcca

SEQ ID NO: 94497 - DNA, 16 bp, H. sapiens
cttctccttttaaaat

SEQ ID NO: 94498 - DNA, 16 bp, H. sapiens
cttctcgctttatttc

SEQ ID NO: 94499 - DNA, 16 bp, H. sapiens
cttctctaccaaaaat

SEQ ID NO: 94500 - DNA, 16 bp, H. sapiens
cttctctatttaaaaa

SEQ ID NO: 94501 - DNA, 16 bp, H. sapiens
cttctctcagcctccc

SEQ ID NO: 94502 - DNA, 16 bp, H. sapiens
cttctctcagctcttc

SEQ ID NO: 94503 - DNA, 16 bp, H. sapiens
cttctctcagcttctt

SEQ ID NO: 94504 - DNA, 16 bp, H. sapiens
cttctctcatgaatca

SEQ ID NO: 94505 - DNA, 16 bp, H. sapiens
cttctctcctctgctg

SEQ ID NO: 94506 - DNA, 16 bp, H. sapiens
cttctctctgcctctg

SEQ ID NO: 94507 - DNA, 16 bp, H. sapiens
cttctctctgctgaga

SEQ ID NO: 94508 - DNA, 16 bp, H. sapiens
cttctctctggctgcc

SEQ ID NO: 94509 - DNA, 16 bp, H. sapiens
cttctctgaacaatgg

SEQ ID NO: 94510 - DNA, 16 bp, H. sapiens
cttctctgaacctcag

SEQ ID NO: 94511 - DNA, 16 bp, H. sapiens
cttctctgaccctcag

SEQ ID NO: 94512 - DNA, 16 bp, H. sapiens
cttctctgagccacag

SEQ ID NO: 94513 - DNA, 16 bp, H. sapiens
cttctctgagcctgtt

SEQ ID NO: 94514 - DNA, 16 bp, H. sapiens
cttctctgagctccag

SEQ ID NO: 94515 - DNA, 16 bp, H. sapiens
cttctctgaggaagtg

SEQ ID NO: 94516 - DNA, 16 bp, H. sapiens
cttctctgatttttct

SEQ ID NO: 94517 - DNA, 16 bp, H. sapiens
cttctctgcatttgtt

SEQ ID NO: 94518 - DNA, 16 bp, H. sapiens
cttctctgccctgctc

SEQ ID NO: 94519 - DNA, 16 bp, H. sapiens
cttctctgcttctcca

SEQ ID NO: 94520 - DNA, 16 bp, H. sapiens
cttctctgctttggtt

SEQ ID NO: 94521 - DNA, 16 bp, H. sapiens
cttctctggccaggcc

SEQ ID NO: 94522 - DNA, 16 bp, H. sapiens
cttctctgggactcag

SEQ ID NO: 94523 - DNA, 16 bp, H. sapiens
cttctctggttttggt

SEQ ID NO: 94524 - DNA, 16 bp, H. sapiens
cttctctgtaaagtgg

SEQ ID NO: 94525 - DNA, 16 bp, H. sapiens
cttctctgtacctcag

SEQ ID NO: 94526 - DNA, 16 bp, H. sapiens
cttctctgtctctcca

SEQ ID NO: 94527 - DNA, 16 bp, H. sapiens
cttctctgtgaagcct

SEQ ID NO: 94528 - DNA, 16 bp, H. sapiens
cttctctgtgcctcag

SEQ ID NO: 94529 - DNA, 16 bp, H. sapiens
cttctctgtgctccca

SEQ ID NO: 94530 - DNA, 16 bp, H. sapiens
cttctctgtgtccatg

SEQ ID NO: 94531 - DNA, 16 bp, H. sapiens
cttctctgtgtgtctt

SEQ ID NO: 94532 - DNA, 16 bp, H. sapiens
cttctcttcctagttt

SEQ ID NO: 94533 - DNA, 16 bp, H. sapiens
cttctcttgaaaaatg

SEQ ID NO: 94534 - DNA, 16 bp, H. sapiens
cttctctttggcatat

SEQ ID NO: 94535 - DNA, 16 bp, H. sapiens
cttctcttttaaaatt

SEQ ID NO: 94536 - DNA, 16 bp, H. sapiens
cttctgaaattaaaaa

SEQ ID NO: 94537 - DNA, 16 bp, H. sapiens
cttctgaagactactt

SEQ ID NO: 94538 - DNA, 16 bp, H. sapiens
cttctgaagcctacct

SEQ ID NO: 94539 - DNA, 16 bp, H. sapiens
cttctgaagctgggag

SEQ ID NO: 94540 - DNA, 16 bp, H. sapiens
cttctgaatccaggaa

SEQ ID NO: 94541 - DNA, 16 bp, H. sapiens
cttctgaccaactggc

SEQ ID NO: 94542 - DNA, 16 bp, H. sapiens
cttctgacccacagaa

SEQ ID NO: 94543 - DNA, 16 bp, H. sapiens
cttctgacctcaaggg

SEQ ID NO: 94544 - DNA, 16 bp, H. sapiens
cttctgacctccagga

SEQ ID NO: 94545 - DNA, 17 bp, H. sapiens
cttctgacctcgtgatc

SEQ ID NO: 94546 - DNA, 16 bp, H. sapiens
cttctgacctcttgat

SEQ ID NO: 94547 - DNA, 16 bp, H. sapiens
cttctgacttccagaa

SEQ ID NO: 94548 - DNA, 16 bp, H. sapiens
cttctgacttctagaa

SEQ ID NO: 94549 - DNA, 16 bp, H. sapiens
cttctgagccccccaa

SEQ ID NO: 94550 - DNA, 16 bp, H. sapiens
cttctgagctcaagcc

SEQ ID NO: 94551 - DNA, 16 bp, H. sapiens
cttctgagctcaggtg

SEQ ID NO: 94552 - DNA, 16 bp, H. sapiens
cttctgaggccttcca

SEQ ID NO: 94553 - DNA, 16 bp, H. sapiens
cttctgagtctcagtt

SEQ ID NO: 94554 - DNA, 16 bp, H. sapiens
cttctgagtttctgat

SEQ ID NO: 94555 - DNA, 16 bp, H. sapiens
cttctgataaggacac

SEQ ID NO: 94556 - DNA, 16 bp, H. sapiens
cttctgattaaaaaaa

SEQ ID NO: 94557 - DNA, 16 bp, H. sapiens
cttctgatttcttctt

SEQ ID NO: 94558 - DNA, 16 bp, H. sapiens
cttctgatttttctct

SEQ ID NO: 94559 - DNA, 16 bp, H. sapiens
cttctgcacagcaaag

SEQ ID NO: 94560 - DNA, 16 bp, H. sapiens
cttctgcacagcacag

SEQ ID NO: 94561 - DNA, 16 bp, H. sapiens
cttctgcagttttctc

SEQ ID NO: 94562 - DNA, 16 bp, H. sapiens
cttctgcagttttctt

SEQ ID NO: 94563 - DNA, 16 bp, H. sapiens
cttctgcatagaaaaa

SEQ ID NO: 94564 - DNA, 16 bp, H. sapiens
cttctgcatatgggta

SEQ ID NO: 94565 - DNA, 16 bp, H. sapiens
cttctgccacagcctc

SEQ ID NO: 94566 - DNA, 16 bp, H. sapiens
cttctgccagacaccc

SEQ ID NO: 94567 - DNA, 16 bp, H. sapiens
cttctgccatgtgggg

SEQ ID NO: 94568 - DNA, 16 bp, H. sapiens
cttctgcccagcaaag

SEQ ID NO: 94569 - DNA, 16 bp, H. sapiens
cttctgccccatccct

SEQ ID NO: 94570 - DNA, 16 bp, H. sapiens
cttctgccgtggcttc

SEQ ID NO: 94571 - DNA, 16 bp, H. sapiens
cttctgcctaagcctc

SEQ ID NO: 94572 - DNA, 16 bp, H. sapiens
cttctgcctcagccct

SEQ ID NO: 94573 - DNA, 16 bp, H. sapiens
cttctgcctcagcgtc

SEQ ID NO: 94574 - DNA, 16 bp, H. sapiens
cttctgcctcagtctc

SEQ ID NO: 94575 - DNA, 16 bp, H. sapiens
cttctgcctccacctc

SEQ ID NO: 94576 - DNA, 16 bp, H. sapiens
cttctgcctcccaggc

SEQ ID NO: 94577 - DNA, 16 bp, H. sapiens
cttctgcctcctgcca

SEQ ID NO: 94578 - DNA, 16 bp, H. sapiens
cttctgcctcctggat

SEQ ID NO: 94579 - DNA, 16 bp, H. sapiens
cttctgcctcggcctc

SEQ ID NO: 94580 - DNA, 16 bp, H. sapiens
cttctgcctctgccac

SEQ ID NO: 94581 - DNA, 16 bp, H. sapiens
cttctgcctctgccat

SEQ ID NO: 94582 - DNA, 16 bp, H. sapiens
cttctgcctctgccct

SEQ ID NO: 94583 - DNA, 16 bp, H. sapiens
cttctgcctgaaatgt

SEQ ID NO: 94584 - DNA, 16 bp, H. sapiens
cttctgcctgagcatc

SEQ ID NO: 94585 - DNA, 16 bp, H. sapiens
cttctgcctgctgggt

SEQ ID NO: 94586 - DNA, 16 bp, H. sapiens
cttctgcctggaacac

SEQ ID NO: 94587 - DNA, 16 bp, H. sapiens
cttctgcctggacatg

SEQ ID NO: 94588 - DNA, 16 bp, H. sapiens
cttctgcctgggcacc

SEQ ID NO: 94589 - DNA, 16 bp, H. sapiens
cttctgccttagtctc

SEQ ID NO: 94590 - DNA, 16 bp, H. sapiens
cttctgccttctgcct

SEQ ID NO: 94591 - DNA, 16 bp, H. sapiens
cttctgctatcttgct

SEQ ID NO: 94592 - DNA, 16 bp, H. sapiens
cttctgctcacattcc

SEQ ID NO: 94593 - DNA, 16 bp, H. sapiens
cttctgctcacatttt

SEQ ID NO: 94594 - DNA, 16 bp, H. sapiens
cttctgctcctctcca

SEQ ID NO: 94595 - DNA, 16 bp, H. sapiens
cttctgctccttcagc

SEQ ID NO: 94596 - DNA, 16 bp, H. sapiens
cttctgctctaaaact

SEQ ID NO: 94597 - DNA, 16 bp, H. sapiens
cttctgctgagtttgg

SEQ ID NO: 94598 - DNA, 16 bp, H. sapiens
cttctgctgcaggtct

SEQ ID NO: 94599 - DNA, 16 bp, H. sapiens
cttctgctgctgctgt

SEQ ID NO: 94600 - DNA, 16 bp, H. sapiens
cttctgctgctgcttt

SEQ ID NO: 94601 - DNA, 16 bp, H. sapiens
cttctgcttacctttt

SEQ ID NO: 94602 - DNA, 16 bp, H. sapiens
cttctgcttattttga

SEQ ID NO: 94603 - DNA, 16 bp, H. sapiens
cttctgcttcagcttc

SEQ ID NO: 94604 - DNA, 16 bp, H. sapiens
cttctgcttctgagga

SEQ ID NO: 94605 - DNA, 16 bp, H. sapiens
cttctgcttctgccac

SEQ ID NO: 94606 - DNA, 16 bp, H. sapiens
cttctgcttctggcca

SEQ ID NO: 94607 - DNA, 16 bp, H. sapiens
cttctgcttctgggag

SEQ ID NO: 94608 - DNA, 16 bp, H. sapiens
cttctgcttttctgcc

SEQ ID NO: 94609 - DNA, 16 bp, H. sapiens
cttctggaagctgcag

SEQ ID NO: 94610 - DNA, 16 bp, H. sapiens
cttctggagcctgggg

SEQ ID NO: 94611 - DNA, 16 bp, H. sapiens
cttctggaggctctga

SEQ ID NO: 94612 - DNA, 16 bp, H. sapiens
cttctggatgacattt

SEQ ID NO: 94613 - DNA, 16 bp, H. sapiens
cttctggcctccatgg

SEQ ID NO: 94614 - DNA, 16 bp, H. sapiens
cttctggcctctggaa

SEQ ID NO: 94615 - DNA, 16 bp, H. sapiens
cttctgggaagggaga

SEQ ID NO: 94616 - DNA, 16 bp, H. sapiens
cttctgggaggaggtg

SEQ ID NO: 94617 - DNA, 16 bp, H. sapiens
cttctgggagttttat

SEQ ID NO: 94618 - DNA, 16 bp, H. sapiens
cttctgggcctcagtt

SEQ ID NO: 94619 - DNA, 16 bp, H. sapiens
cttctggggaggcctc

SEQ ID NO: 94620 - DNA, 16 bp, H. sapiens
cttctgggggctccag

SEQ ID NO: 94621 - DNA, 16 bp, H. sapiens
cttctgggtagctggg

SEQ ID NO: 94622 - DNA, 16 bp, H. sapiens
cttctgggtgtgtctg

SEQ ID NO: 94623 - DNA, 16 bp, H. sapiens
cttctgggttcaaatg

SEQ ID NO: 94624 - DNA, 16 bp, H. sapiens
cttctggtatgagaaa

SEQ ID NO: 94625 - DNA, 16 bp, H. sapiens
cttctggtcttaaagc

SEQ ID NO: 94626 - DNA, 16 bp, H. sapiens
cttctggtggttgcca

SEQ ID NO: 94627 - DNA, 32 bp, H. sapiens
cttctgtaatatgcttccccctgcacagatct

SEQ ID NO: 94628 - DNA, 16 bp, H. sapiens
cttctgtagttctttt

SEQ ID NO: 94629 - DNA, 16 bp, H. sapiens
cttctgtattcccctg

SEQ ID NO: 94630 - DNA, 16 bp, H. sapiens
cttctgtcttagcctc

SEQ ID NO: 94631 - DNA, 16 bp, H. sapiens
cttctgtcttgtagag

SEQ ID NO: 94632 - DNA, 16 bp, H. sapiens
cttctgtgaaatgggg

SEQ ID NO: 94633 - DNA, 16 bp, H. sapiens
cttctgtggctcccca

SEQ ID NO: 94634 - DNA, 16 bp, H. sapiens
cttctgtggtgtaaat

SEQ ID NO: 94635 - DNA, 16 bp, H. sapiens
cttctgtgtcatctgt

SEQ ID NO: 94636 - DNA, 16 bp, H. sapiens
cttctgtgtcctcaca

SEQ ID NO: 94637 - DNA, 16 bp, H. sapiens
cttctgtgtctggttt

SEQ ID NO: 94638 - DNA, 16 bp, H. sapiens
cttctgtgttctgcct

SEQ ID NO: 94639 - DNA, 16 bp, H. sapiens
cttctgttggaagaag

SEQ ID NO: 94640 - DNA, 16 bp, H. sapiens
cttctgttttctcaaa

SEQ ID NO: 94641 - DNA, 16 bp, H. sapiens
cttctgtttttcaaaa

SEQ ID NO: 94642 - DNA, 16 bp, H. sapiens
cttctgtttttccaaa

SEQ ID NO: 94643 - DNA, 16 bp, H. sapiens
cttcttaaatatcttt

SEQ ID NO: 94644 - DNA, 16 bp, H. sapiens
cttcttaactttctgt

SEQ ID NO: 94645 - DNA, 16 bp, H. sapiens
cttcttaagctgataa

SEQ ID NO: 94646 - DNA, 20 bp, H. sapiens
cttcttaagggtgggggaga

SEQ ID NO: 94647 - DNA, 16 bp, H. sapiens
cttcttataagagcac

SEQ ID NO: 94648 - DNA, 16 bp, H. sapiens
cttcttatgagaatct

SEQ ID NO: 94649 - DNA, 16 bp, H. sapiens
cttcttcacaaggctg

SEQ ID NO: 94650 - DNA, 16 bp, H. sapiens
cttcttcacatggctg

SEQ ID NO: 94651 - DNA, 16 bp, H. sapiens
cttcttcagagaaatg

SEQ ID NO: 94652 - DNA, 16 bp, H. sapiens
cttcttcagctccaag

SEQ ID NO: 94653 - DNA, 16 bp, H. sapiens
cttcttcagctgataa

SEQ ID NO: 94654 - DNA, 16 bp, H. sapiens
cttcttcagggaagcc

SEQ ID NO: 94655 - DNA, 16 bp, H. sapiens
cttcttccaaaagaag

SEQ ID NO: 94656 - DNA, 16 bp, H. sapiens
cttcttccagtgtggt

SEQ ID NO: 94657 - DNA, 16 bp, H. sapiens
cttcttccccaaggca

SEQ ID NO: 94658 - DNA, 16 bp, H. sapiens
cttcttcctcagaaac

SEQ ID NO: 94659 - DNA, 16 bp, H. sapiens
cttcttcctcaggaat

SEQ ID NO: 94660 - DNA, 16 bp, H. sapiens
cttcttcctcatcatc

SEQ ID NO: 94661 - DNA, 16 bp, H. sapiens
cttcttcctctccaat

SEQ ID NO: 94662 - DNA, 16 bp, H. sapiens
cttcttcctctgccca

SEQ ID NO: 94663 - DNA, 16 bp, H. sapiens
cttcttcctgccatca

SEQ ID NO: 94664 - DNA, 16 bp, H. sapiens
cttcttcctgctgaca

SEQ ID NO: 94665 - DNA, 16 bp, H. sapiens
cttcttcctggacatc

SEQ ID NO: 94666 - DNA, 16 bp, H. sapiens
cttcttcctttcaaat

SEQ ID NO: 94667 - DNA, 16 bp, H. sapiens
cttcttcctttccagt

SEQ ID NO: 94668 - DNA, 16 bp, H. sapiens
cttcttctaaagaaga

SEQ ID NO: 94669 - DNA, 16 bp, H. sapiens
cttcttctatgtcttc

SEQ ID NO: 94670 - DNA, 16 bp, H. sapiens
cttcttctgtcaccca

SEQ ID NO: 94671 - DNA, 16 bp, H. sapiens
cttcttctgtctgtgt

SEQ ID NO: 94672 - DNA, 16 bp, H. sapiens
cttcttgaaggcaggg

SEQ ID NO: 94673 - DNA, 16 bp, H. sapiens
cttcttgatggattga

SEQ ID NO: 94674 - DNA, 16 bp, H. sapiens
cttcttgcctggggac

SEQ ID NO: 94675 - DNA, 16 bp, H. sapiens
cttcttgctggtggag

SEQ ID NO: 94676 - DNA, 16 bp, H. sapiens
cttcttgctgtgtcct

SEQ ID NO: 94677 - DNA, 16 bp, H. sapiens
cttcttgcttcatttc

SEQ ID NO: 94678 - DNA, 16 bp, H. sapiens
cttcttggaggaggtg

SEQ ID NO: 94679 - DNA, 16 bp, H. sapiens
cttcttggatctgtgg

SEQ ID NO: 94680 - DNA, 16 bp, H. sapiens
cttcttggcttccata

SEQ ID NO: 94681 - DNA, 16 bp, H. sapiens
cttcttggcttctctg

SEQ ID NO: 94682 - DNA, 16 bp, H. sapiens
cttcttggtgctgttc

SEQ ID NO: 94683 - DNA, 16 bp, H. sapiens
cttcttgttgaaatga

SEQ ID NO: 94684 - DNA, 16 bp, H. sapiens
cttcttgttgcatcct

SEQ ID NO: 94685 - DNA, 16 bp, H. sapiens
cttcttgtttcattta

SEQ ID NO: 94686 - DNA, 16 bp, H. sapiens
cttctttaaaaaagaa

SEQ ID NO: 94687 - DNA, 16 bp, H. sapiens
cttctttaaaatcttt

SEQ ID NO: 94688 - DNA, 16 bp, H. sapiens
cttctttatacatctg

SEQ ID NO: 94689 - DNA, 16 bp, H. sapiens
cttctttcaaaattag

SEQ ID NO: 94690 - DNA, 16 bp, H. sapiens
cttctttcacttagta

SEQ ID NO: 94691 - DNA, 16 bp, H. sapiens
cttctttccagttttt

SEQ ID NO: 94692 - DNA, 16 bp, H. sapiens
cttctttccctctggg

SEQ ID NO: 94693 - DNA, 16 bp, H. sapiens
cttctttctagtttat

SEQ ID NO: 94694 - DNA, 16 bp, H. sapiens
cttctttctctttaaa

SEQ ID NO: 94695 - DNA, 16 bp, H. sapiens
cttctttgacctattg

SEQ ID NO: 94696 - DNA, 16 bp, H. sapiens
cttctttgagacagag

SEQ ID NO: 94697 - DNA, 16 bp, H. sapiens
cttctttgtctcattt

SEQ ID NO: 94698 - DNA, 16 bp, H. sapiens
cttcttttaagaagta

SEQ ID NO: 94699 - DNA, 16 bp, H. sapiens
cttcttttaagatttt

SEQ ID NO: 94700 - DNA, 16 bp, H. sapiens
cttcttttaatgtttg

SEQ ID NO: 94701 - DNA, 16 bp, H. sapiens
cttcttttacttagca

SEQ ID NO: 94702 - DNA, 16 bp, H. sapiens
cttcttttcagaagtg

SEQ ID NO: 94703 - DNA, 16 bp, H. sapiens
cttcttttcctaattg

SEQ ID NO: 94704 - DNA, 16 bp, H. sapiens
cttcttttcctctggg

SEQ ID NO: 94705 - DNA, 16 bp, H. sapiens
cttcttttgaaaagca

SEQ ID NO: 94706 - DNA, 16 bp, H. sapiens
cttcttttgaaaatta

SEQ ID NO: 94707 - DNA, 16 bp, H. sapiens
cttcttttggattatt

SEQ ID NO: 94708 - DNA, 16 bp, H. sapiens
cttctttttcaaaact

SEQ ID NO: 94709 - DNA, 16 bp, H. sapiens
cttcttttttaaaaaa

SEQ ID NO: 94710 - DNA, 16 bp, H. sapiens
cttcttttttaagact

SEQ ID NO: 94711 - DNA, 16 bp, H. sapiens
cttcttttttaaggct

SEQ ID NO: 94712 - DNA, 16 bp, H. sapiens
cttgaaaaaaatcaaa

SEQ ID NO: 94713 - DNA, 16 bp, H. sapiens
cttgaaaaagaaaagc

SEQ ID NO: 94714 - DNA, 16 bp, H. sapiens
cttgaaaacagcagat

SEQ ID NO: 94715 - DNA, 16 bp, H. sapiens
cttgaaaactggaaca

SEQ ID NO: 94716 - DNA, 16 bp, H. sapiens
cttgaaaaggaacaaa

SEQ ID NO: 94717 - DNA, 16 bp, H. sapiens
cttgaaaaggaaggaa

SEQ ID NO: 94718 - DNA, 16 bp, H. sapiens
cttgaaaatattgttt

SEQ ID NO: 94719 - DNA, 16 bp, H. sapiens
cttgaaaatattttct

SEQ ID NO: 94720 - DNA, 16 bp, H. sapiens
cttgaaaatcactaag

SEQ ID NO: 94721 - DNA, 16 bp, H. sapiens
cttgaaaattattttt

SEQ ID NO: 94722 - DNA, 16 bp, H. sapiens
cttgaaaattgcttag

SEQ ID NO: 94723 - DNA, 16 bp, H. sapiens
cttgaaaccaggagtt

SEQ ID NO: 94724 - DNA, 16 bp, H. sapiens
cttgaaaccgggaggc

SEQ ID NO: 94725 - DNA, 16 bp, H. sapiens
cttgaaactcagggcc

SEQ ID NO: 94726 - DNA, 16 bp, H. sapiens
cttgaaactgggaggc

SEQ ID NO: 94727 - DNA, 16 bp, H. sapiens
cttgaaacttaaaaaa

SEQ ID NO: 94728 - DNA, 16 bp, H. sapiens
cttgaaagaaaagaac

SEQ ID NO: 94729 - DNA, 16 bp, H. sapiens
cttgaaagaagacatt

SEQ ID NO: 94730 - DNA, 16 bp, H. sapiens
cttgaaagtcagaatt

SEQ ID NO: 94731 - DNA, 16 bp, H. sapiens
cttgaaatatattttg

SEQ ID NO: 94732 - DNA, 16 bp, H. sapiens
cttgaaatcaggagtt

SEQ ID NO: 94733 - DNA, 16 bp, H. sapiens
cttgaaatgtggccag

SEQ ID NO: 94734 - DNA, 16 bp, H. sapiens
cttgaaatttgctgag

SEQ ID NO: 94735 - DNA, 16 bp, H. sapiens
cttgaacaagtcattt

SEQ ID NO: 94736 - DNA, 16 bp, H. sapiens
cttgaacaatactata

SEQ ID NO: 94737 - DNA, 16 bp, H. sapiens
cttgaacacaggaggc

SEQ ID NO: 94738 - DNA, 16 bp, H. sapiens
cttgaacacctggcct

SEQ ID NO: 94739 - DNA, 16 bp, H. sapiens
cttgaacacgggaggc

SEQ ID NO: 94740 - DNA, 16 bp, H. sapiens
cttgaacatgggaggt

SEQ ID NO: 94741 - DNA, 16 bp, H. sapiens
cttgaaccaggaaggc

SEQ ID NO: 94742 - DNA, 16 bp, H. sapiens
cttgaaccagggaggc

SEQ ID NO: 94743 - DNA, 18 bp, H. sapiens
cttgaaccagggagttgg

SEQ ID NO: 94744 - DNA, 16 bp, H. sapiens
cttgaacccaagaggc

SEQ ID NO: 94745 - DNA, 16 bp, H. sapiens
cttgaacccagaagga

SEQ ID NO: 94746 - DNA, 16 bp, H. sapiens
cttgaacccagaaggc

SEQ ID NO: 94747 - DNA, 16 bp, H. sapiens
cttgaacccagaaggt

SEQ ID NO: 94748 - DNA, 16 bp, H. sapiens
cttgaacccagcaggc

SEQ ID NO: 94749 - DNA, 16 bp, H. sapiens
cttgaacccaggaagc

SEQ ID NO: 94750 - DNA, 16 bp, H. sapiens
cttgaacccaggaagt

SEQ ID NO: 94751 - DNA, 16 bp, H. sapiens
cttgaacccaggagcc

SEQ ID NO: 94752 - DNA, 16 bp, H. sapiens
cttgaacccaggagga

SEQ ID NO: 94753 - DNA, 16 bp, H. sapiens
cttgaacccaggaggc

SEQ ID NO: 94754 - DNA, 16 bp, H. sapiens
cttgaacccaggaggt

SEQ ID NO: 94755 - DNA, 16 bp, H. sapiens
cttgaacccaggatgc

SEQ ID NO: 94756 - DNA, 16 bp, H. sapiens
cttgaacccaggcggc

SEQ ID NO: 94757 - DNA, 16 bp, H. sapiens
cttgaacccagggggc

SEQ ID NO: 94758 - DNA, 16 bp, H. sapiens
cttgaacccaggtggc

SEQ ID NO: 94759 - DNA, 16 bp, H. sapiens
cttgaacccatgaggc

SEQ ID NO: 94760 - DNA, 16 bp, H. sapiens
cttgaaccccggaggc

SEQ ID NO: 94761 - DNA, 16 bp, H. sapiens
cttgaaccccggaggt

SEQ ID NO: 94762 - DNA, 16 bp, H. sapiens
cttgaacccgaaaggc

SEQ ID NO: 94763 - DNA, 16 bp, H. sapiens
cttgaacccgagaggc

SEQ ID NO: 94764 - DNA, 16 bp, H. sapiens
cttgaacccggaaggc

SEQ ID NO: 94765 - DNA, 16 bp, H. sapiens
cttgaacccgggaagt

SEQ ID NO: 94766 - DNA, 16 bp, H. sapiens
cttgaacccgggagga

SEQ ID NO: 94767 - DNA, 16 bp, H. sapiens
cttgaacccgggaggc

SEQ ID NO: 94768 - DNA, 16 bp, H. sapiens
cttgaacccgggaggg

SEQ ID NO: 94769 - DNA, 16 bp, H. sapiens
cttgaacccgggaggt

SEQ ID NO: 94770 - DNA, 16 bp, H. sapiens
cttgaacccgggagtt

SEQ ID NO: 94771 - DNA, 16 bp, H. sapiens
cttgaacccgggtggc

SEQ ID NO: 94772 - DNA, 16 bp, H. sapiens
cttgaacccgtgaggc

SEQ ID NO: 94773 - DNA, 16 bp, H. sapiens
cttgaaccctagaggc

SEQ ID NO: 94774 - DNA, 16 bp, H. sapiens
cttgaaccctgaaggc

SEQ ID NO: 94775 - DNA, 16 bp, H. sapiens
cttgaaccctggaggc

SEQ ID NO: 94776 - DNA, 16 bp, H. sapiens
cttgaaccctggaggt

SEQ ID NO: 94777 - DNA, 16 bp, H. sapiens
cttgaacctaagaggc

SEQ ID NO: 94778 - DNA, 16 bp, H. sapiens
cttgaacctaggaggc

SEQ ID NO: 94779 - DNA, 16 bp, H. sapiens
cttgaacctcggaggc

SEQ ID NO: 94780 - DNA, 16 bp, H. sapiens
cttgaacctgagaggc

SEQ ID NO: 94781 - DNA, 16 bp, H. sapiens
cttgaacctgagaggt

SEQ ID NO: 94782 - DNA, 16 bp, H. sapiens
cttgaacctgcgaggc

SEQ ID NO: 94783 - DNA, 16 bp, H. sapiens
cttgaacctggaaggc

SEQ ID NO: 94784 - DNA, 16 bp, H. sapiens
cttgaacctggaggtg

SEQ ID NO: 94785 - DNA, 16 bp, H. sapiens
cttgaacctggcaagt

SEQ ID NO: 94786 - DNA, 16 bp, H. sapiens
cttgaacctggcaggc

SEQ ID NO: 94787 - DNA, 16 bp, H. sapiens
cttgaacctgggaaac

SEQ ID NO: 94788 - DNA, 16 bp, H. sapiens
cttgaacctgggacac

SEQ ID NO: 94789 - DNA, 21 bp, H. sapiens
cttgaacctgggagatggaga

SEQ ID NO: 94790 - DNA, 16 bp, H. sapiens
cttgaacctgggagga

SEQ ID NO: 94791 - DNA, 16 bp, H. sapiens
cttgaacctgggaggc

SEQ ID NO: 94792 - DNA, 16 bp, H. sapiens
cttgaacctgggaggg

SEQ ID NO: 94793 - DNA, 16 bp, H. sapiens
cttgaacctgggaggt

SEQ ID NO: 94794 - DNA, 16 bp, H. sapiens
cttgaacctgggcagc

SEQ ID NO: 94795 - DNA, 16 bp, H. sapiens
cttgaacctggggggc

SEQ ID NO: 94796 - DNA, 16 bp, H. sapiens
cttgaacgcaggaggc

SEQ ID NO: 94797 - DNA, 16 bp, H. sapiens
cttgaacgcctgacct

SEQ ID NO: 94798 - DNA, 16 bp, H. sapiens
cttgaacgcgggaggc

SEQ ID NO: 94799 - DNA, 16 bp, H. sapiens
cttgaactcagaaggc

SEQ ID NO: 94800 - DNA, 16 bp, H. sapiens
cttgaactcagctctg

SEQ ID NO: 94801 - DNA, 16 bp, H. sapiens
cttgaactcagctgtg

SEQ ID NO: 94802 - DNA, 16 bp, H. sapiens
cttgaactcaggagat

SEQ ID NO: 94803 - DNA, 16 bp, H. sapiens
cttgaactcaggaggc

SEQ ID NO: 94804 - DNA, 16 bp, H. sapiens
cttgaactccagagct

SEQ ID NO: 94805 - DNA, 16 bp, H. sapiens
cttgaactcctggacc

SEQ ID NO: 94806 - DNA, 16 bp, H. sapiens
cttgaactcctggatg

SEQ ID NO: 94807 - DNA, 16 bp, H. sapiens
cttgaactcctggctt

SEQ ID NO: 94808 - DNA, 16 bp, H. sapiens
cttgaactcctgggtt

SEQ ID NO: 94809 - DNA, 16 bp, H. sapiens
cttgaactcctggttc

SEQ ID NO: 94810 - DNA, 16 bp, H. sapiens
cttgaactccttgcct

SEQ ID NO: 94811 - DNA, 16 bp, H. sapiens
cttgaactcggctctg

SEQ ID NO: 94812 - DNA, 16 bp, H. sapiens
cttgaactcgggaggc

SEQ ID NO: 94813 - DNA, 16 bp, H. sapiens
cttgaactcgggaggt

SEQ ID NO: 94814 - DNA, 16 bp, H. sapiens
cttgaactctggacct

SEQ ID NO: 94815 - DNA, 16 bp, H. sapiens
cttgaactctggggct

SEQ ID NO: 94816 - DNA, 16 bp, H. sapiens
cttgaactggggaagc

SEQ ID NO: 94817 - DNA, 16 bp, H. sapiens
cttgaactggggaggt

SEQ ID NO: 94818 - DNA, 16 bp, H. sapiens
cttgaacttctggcct

SEQ ID NO: 94819 - DNA, 16 bp, H. sapiens
cttgaacttgggaggc

SEQ ID NO: 94820 - DNA, 16 bp, H. sapiens
cttgaacttgggaggg

SEQ ID NO: 94821 - DNA, 16 bp, H. sapiens
cttgaacttgggaggt

SEQ ID NO: 94822 - DNA, 16 bp, H. sapiens
cttgaactttggaggc

SEQ ID NO: 94823 - DNA, 16 bp, H. sapiens
cttgaagaatctgatg

SEQ ID NO: 94824 - DNA, 16 bp, H. sapiens
cttgaagacagagcaa

SEQ ID NO: 94825 - DNA, 16 bp, H. sapiens
cttgaagacagcagaa

SEQ ID NO: 94826 - DNA, 16 bp, H. sapiens
cttgaagacattatgc

SEQ ID NO: 94827 - DNA, 16 bp, H. sapiens
cttgaagaccttccag

SEQ ID NO: 94828 - DNA, 16 bp, H. sapiens
cttgaagcaaatgaaa

SEQ ID NO: 94829 - DNA, 16 bp, H. sapiens
cttgaagccagcacag

SEQ ID NO: 94830 - DNA, 16 bp, H. sapiens
cttgaagccaggagtt

SEQ ID NO: 94831 - DNA, 16 bp, H. sapiens
cttgaagccagtagtt

SEQ ID NO: 94832 - DNA, 16 bp, H. sapiens
cttgaagccgggaggt

SEQ ID NO: 94833 - DNA, 16 bp, H. sapiens
cttgaagccgggagtt

SEQ ID NO: 94834 - DNA, 16 bp, H. sapiens
cttgaaggaaaagacc

SEQ ID NO: 94835 - DNA, 16 bp, H. sapiens
cttgaaggaactcaag

SEQ ID NO: 94836 - DNA, 16 bp, H. sapiens
cttgaaggatgaatgc

SEQ ID NO: 94837 - DNA, 16 bp, H. sapiens
cttgaaggcagggact

SEQ ID NO: 94838 - DNA, 16 bp, H. sapiens
cttgaaggctgaggca

SEQ ID NO: 94839 - DNA, 16 bp, H. sapiens
cttgaagtcaggagtt

SEQ ID NO: 94840 - DNA, 16 bp, H. sapiens
cttgaataaacatcag

SEQ ID NO: 94841 - DNA, 16 bp, H. sapiens
cttgaataggggctgg

SEQ ID NO: 94842 - DNA, 16 bp, H. sapiens
cttgaatccaagaggc

SEQ ID NO: 94843 - DNA, 16 bp, H. sapiens
cttgaatccagcaggc

SEQ ID NO: 94844 - DNA, 16 bp, H. sapiens
cttgaatccaggaggc

SEQ ID NO: 94845 - DNA, 16 bp, H. sapiens
cttgaatccaggaggt

SEQ ID NO: 94846 - DNA, 16 bp, H. sapiens
cttgaatccaggagtt

SEQ ID NO: 94847 - DNA, 16 bp, H. sapiens
cttgaatccgggaggc

SEQ ID NO: 94848 - DNA, 16 bp, H. sapiens
cttgaatccgggaggt

SEQ ID NO: 94849 - DNA, 16 bp, H. sapiens
cttgaatctaaaataa

SEQ ID NO: 94850 - DNA, 16 bp, H. sapiens
cttgaatctaggaggc

SEQ ID NO: 94851 - DNA, 16 bp, H. sapiens
cttgaatctgggagat

SEQ ID NO: 94852 - DNA, 16 bp, H. sapiens
cttgaatctgggaggc

SEQ ID NO: 94853 - DNA, 16 bp, H. sapiens
cttgaatgctttgcca

SEQ ID NO: 94854 - DNA, 16 bp, H. sapiens
cttgaattcaggaggc

SEQ ID NO: 94855 - DNA, 16 bp, H. sapiens
cttgaattcaggaggt

SEQ ID NO: 94856 - DNA, 16 bp, H. sapiens
cttgaattcctcctca

SEQ ID NO: 94857 - DNA, 16 bp, H. sapiens
cttgaattcctgtcct

SEQ ID NO: 94858 - DNA, 16 bp, H. sapiens
cttgaattctagctcc

SEQ ID NO: 94859 - DNA, 17 bp, H. sapiens
cttgacaaaattcaaca

SEQ ID NO: 94860 - DNA, 16 bp, H. sapiens
cttgacagtgtccttt

SEQ ID NO: 94861 - DNA, 16 bp, H. sapiens
cttgacattttttcct

SEQ ID NO: 94862 - DNA, 16 bp, H. sapiens
cttgacccaggaggca

SEQ ID NO: 94863 - DNA, 16 bp, H. sapiens
cttgacccaggagttc

SEQ ID NO: 94864 - DNA, 16 bp, H. sapiens
cttgaccccaggaggt

SEQ ID NO: 94865 - DNA, 16 bp, H. sapiens
cttgaccctaggagtt

SEQ ID NO: 94866 - DNA, 16 bp, H. sapiens
cttgaccctggacttc

SEQ ID NO: 94867 - DNA, 16 bp, H. sapiens
cttgaccctgggaagt

SEQ ID NO: 94868 - DNA, 16 bp, H. sapiens
cttgacctccccaagt

SEQ ID NO: 94869 - DNA, 16 bp, H. sapiens
cttgacctcctaggct

SEQ ID NO: 94870 - DNA, 16 bp, H. sapiens
cttgacctcctgactt

SEQ ID NO: 94871 - DNA, 16 bp, H. sapiens
cttgaccttccaggtt

SEQ ID NO: 94872 - DNA, 16 bp, H. sapiens
cttgaccttcctgggc

SEQ ID NO: 94873 - DNA, 16 bp, H. sapiens
cttgaccttgatggag

SEQ ID NO: 94874 - DNA, 16 bp, H. sapiens
cttgactccaggagtt

SEQ ID NO: 94875 - DNA, 16 bp, H. sapiens
cttgactgaaacttta

SEQ ID NO: 94876 - DNA, 16 bp, H. sapiens
cttgacttaaaaaaaa

SEQ ID NO: 94877 - DNA, 16 bp, H. sapiens
cttgacttcaaatgat

SEQ ID NO: 94878 - DNA, 16 bp, H. sapiens
cttgacttcagaggga

SEQ ID NO: 94879 - DNA, 16 bp, H. sapiens
cttgacttcctggact

SEQ ID NO: 94880 - DNA, 17 bp, H. sapiens
cttgacttgtctcagat

SEQ ID NO: 94881 - DNA, 16 bp, H. sapiens
cttgactttctcccca

SEQ ID NO: 94882 - DNA, 16 bp, H. sapiens
cttgactttgctcctc

SEQ ID NO: 94883 - DNA, 16 bp, H. sapiens
cttgacttttcccttt

SEQ ID NO: 94884 - DNA, 16 bp, H. sapiens
cttgacttttctttct

SEQ ID NO: 94885 - DNA, 16 bp, H. sapiens
cttgagaaaagaagag

SEQ ID NO: 94886 - DNA, 16 bp, H. sapiens
cttgagaaaattactt

SEQ ID NO: 94887 - DNA, 16 bp, H. sapiens
cttgagaagaaaaaaa

SEQ ID NO: 94888 - DNA, 16 bp, H. sapiens
cttgagaagctgggac

SEQ ID NO: 94889 - DNA, 16 bp, H. sapiens
cttgagaccaagagtt

SEQ ID NO: 94890 - DNA, 16 bp, H. sapiens
cttgagaccaggagtt

SEQ ID NO: 94891 - DNA, 16 bp, H. sapiens
cttgagatattttgca

SEQ ID NO: 94892 - DNA, 16 bp, H. sapiens
cttgagatcaggagtt

SEQ ID NO: 94893 - DNA, 16 bp, H. sapiens
cttgagatttttttct

SEQ ID NO: 94894 - DNA, 16 bp, H. sapiens
cttgagcaaattaaca

SEQ ID NO: 94895 - DNA, 16 bp, H. sapiens
cttgagcaagtcactt

SEQ ID NO: 94896 - DNA, 16 bp, H. sapiens
cttgagcaagtcattt

SEQ ID NO: 94897 - DNA, 16 bp, H. sapiens
cttgagcacaggaggt

SEQ ID NO: 94898 - DNA, 16 bp, H. sapiens
cttgagcacaggagtt

SEQ ID NO: 94899 - DNA, 16 bp, H. sapiens
cttgagccactgtgcc

SEQ ID NO: 94900 - DNA, 16 bp, H. sapiens
cttgagcccaaaagtt

SEQ ID NO: 94901 - DNA, 16 bp, H. sapiens
cttgagcccaagaggt

SEQ ID NO: 94902 - DNA, 16 bp, H. sapiens
cttgagcccaagagtc

SEQ ID NO: 94903 - DNA, 16 bp, H. sapiens
cttgagcccaagagtt

SEQ ID NO: 94904 - DNA, 16 bp, H. sapiens
cttgagcccaaggggt

SEQ ID NO: 94905 - DNA, 16 bp, H. sapiens
cttgagcccagaagat

SEQ ID NO: 94906 - DNA, 16 bp, H. sapiens
cttgagcccagaagtt

SEQ ID NO: 94907 - DNA, 16 bp, H. sapiens
cttgagcccagacgtt

SEQ ID NO: 94908 - DNA, 16 bp, H. sapiens
cttgagcccagaggtt

SEQ ID NO: 94909 - DNA, 16 bp, H. sapiens
cttgagcccagcagat

SEQ ID NO: 94910 - DNA, 16 bp, H. sapiens
cttgagcccaggaatt

SEQ ID NO: 94911 - DNA, 16 bp, H. sapiens
cttgagcccaggactt

SEQ ID NO: 94912 - DNA, 16 bp, H. sapiens
cttgagcccaggagga

SEQ ID NO: 94913 - DNA, 16 bp, H. sapiens
cttgagcccaggaggc

SEQ ID NO: 94914 - DNA, 16 bp, H. sapiens
cttgagcccaggaggt

SEQ ID NO: 94915 - DNA, 16 bp, H. sapiens
cttgagcccaggagtc

SEQ ID NO: 94916 - DNA, 16 bp, H. sapiens
cttgagcccaggagtt

SEQ ID NO: 94917 - DNA, 16 bp, H. sapiens
cttgagcccaggattt

SEQ ID NO: 94918 - DNA, 16 bp, H. sapiens
cttgagcccaggcagt

SEQ ID NO: 94919 - DNA, 16 bp, H. sapiens
cttgagcccaggggtt

SEQ ID NO: 94920 - DNA, 16 bp, H. sapiens
cttgagcccaggtggt

SEQ ID NO: 94921 - DNA, 16 bp, H. sapiens
cttgagcccaggtgtt

SEQ ID NO: 94922 - DNA, 16 bp, H. sapiens
cttgagcccatgaatt

SEQ ID NO: 94923 - DNA, 16 bp, H. sapiens
cttgagccccggaggt

SEQ ID NO: 94924 - DNA, 16 bp, H. sapiens
cttgagcccctgagtt

SEQ ID NO: 94925 - DNA, 16 bp, H. sapiens
cttgagcccgagaggt

SEQ ID NO: 94926 - DNA, 16 bp, H. sapiens
cttgagccctggaatt

SEQ ID NO: 94927 - DNA, 16 bp, H. sapiens
cttgagccctggagat

SEQ ID NO: 94928 - DNA, 16 bp, H. sapiens
cttgagccctggaggt

SEQ ID NO: 94929 - DNA, 16 bp, H. sapiens
cttgagccgaggagtt

SEQ ID NO: 94930 - DNA, 16 bp, H. sapiens
cttgagcctagaagtt

SEQ ID NO: 94931 - DNA, 16 bp, H. sapiens
cttgagcctaggagtt

SEQ ID NO: 94932 - DNA, 16 bp, H. sapiens
cttgagcctatgagtt

SEQ ID NO: 94933 - DNA, 16 bp, H. sapiens
cttgagcctgagaagt

SEQ ID NO: 94934 - DNA, 16 bp, H. sapiens
cttgagcctggcaggt

SEQ ID NO: 94935 - DNA, 16 bp, H. sapiens
cttgagcctgggaagt

SEQ ID NO: 94936 - DNA, 16 bp, H. sapiens
cttgagcctgggaggc

SEQ ID NO: 94937 - DNA, 16 bp, H. sapiens
cttgagcctgggaggt

SEQ ID NO: 94938 - DNA, 16 bp, H. sapiens
cttgagcctgggagtt

SEQ ID NO: 94939 - DNA, 16 bp, H. sapiens
cttgagccttggtttt

SEQ ID NO: 94940 - DNA, 16 bp, H. sapiens
cttgagcgcaggagtt

SEQ ID NO: 94941 - DNA, 16 bp, H. sapiens
cttgagctagggaggt

SEQ ID NO: 94942 - DNA, 16 bp, H. sapiens
cttgagctcaagtgat

SEQ ID NO: 94943 - DNA, 16 bp, H. sapiens
cttgagctcaggaatt

SEQ ID NO: 94944 - DNA, 16 bp, H. sapiens
cttgagctcaggagct

SEQ ID NO: 94945 - DNA, 16 bp, H. sapiens
cttgagctcaggagtt

SEQ ID NO: 94946 - DNA, 16 bp, H. sapiens
cttgagctcatgagtt

SEQ ID NO: 94947 - DNA, 16 bp, H. sapiens
cttgagctgcagtggg

SEQ ID NO: 94948 - DNA, 16 bp, H. sapiens
cttgagcttagaagtt

SEQ ID NO: 94949 - DNA, 16 bp, H. sapiens
cttgaggaaaggagag

SEQ ID NO: 94950 - DNA, 16 bp, H. sapiens
cttgaggaactagaaa

SEQ ID NO: 94951 - DNA, 16 bp, H. sapiens
cttgaggaagcagtct

SEQ ID NO: 94952 - DNA, 16 bp, H. sapiens
cttgaggacagggact

SEQ ID NO: 94953 - DNA, 16 bp, H. sapiens
cttgaggcagagtctt

SEQ ID NO: 94954 - DNA, 16 bp, H. sapiens
cttgaggcaggagttt

SEQ ID NO: 94955 - DNA, 16 bp, H. sapiens
cttgaggccaagagtt

SEQ ID NO: 94956 - DNA, 16 bp, H. sapiens
cttgaggccaagggtt

SEQ ID NO: 94957 - DNA, 16 bp, H. sapiens
cttgaggccacaagtt

SEQ ID NO: 94958 - DNA, 16 bp, H. sapiens
cttgaggccagaagtt

SEQ ID NO: 94959 - DNA, 16 bp, H. sapiens
cttgaggccagaggtt

SEQ ID NO: 94960 - DNA, 16 bp, H. sapiens
cttgaggccagcagtt

SEQ ID NO: 94961 - DNA, 16 bp, H. sapiens
cttgaggccaggaatt

SEQ ID NO: 94962 - DNA, 16 bp, H. sapiens
cttgaggccaggagct

SEQ ID NO: 94963 - DNA, 16 bp, H. sapiens
cttgaggccaggaggt

SEQ ID NO: 94964 - DNA, 16 bp, H. sapiens
cttgaggccaggagtt

SEQ ID NO: 94965 - DNA, 16 bp, H. sapiens
cttgaggccaggtgtt

SEQ ID NO: 94966 - DNA, 16 bp, H. sapiens
cttgaggccgggagtt

SEQ ID NO: 94967 - DNA, 16 bp, H. sapiens
cttgaggcctggaatt

SEQ ID NO: 94968 - DNA, 16 bp, H. sapiens
cttgaggcgaggagtt

SEQ ID NO: 94969 - DNA, 16 bp, H. sapiens
cttgaggctaggagtt

SEQ ID NO: 94970 - DNA, 16 bp, H. sapiens
cttgaggctgaggcag

SEQ ID NO: 94971 - DNA, 16 bp, H. sapiens
cttgaggctgggagtt

SEQ ID NO: 94972 - DNA, 16 bp, H. sapiens
cttgagggcagagact

SEQ ID NO: 94973 - DNA, 16 bp, H. sapiens
cttgagggcaggagtt

SEQ ID NO: 94974 - DNA, 16 bp, H. sapiens
cttgagggggaaaaaa

SEQ ID NO: 94975 - DNA, 16 bp, H. sapiens
cttgagggtcaattga

SEQ ID NO: 94976 - DNA, 16 bp, H. sapiens
cttgaggtcaagagtt

SEQ ID NO: 94977 - DNA, 16 bp, H. sapiens
cttgaggtcagaaatt

SEQ ID NO: 94978 - DNA, 16 bp, H. sapiens
cttgaggtcagcctgg

SEQ ID NO: 94979 - DNA, 16 bp, H. sapiens
cttgaggtcaggaatt

SEQ ID NO: 94980 - DNA, 16 bp, H. sapiens
cttgaggtcaggagat

SEQ ID NO: 94981 - DNA, 16 bp, H. sapiens
cttgaggtcaggagtt

SEQ ID NO: 94982 - DNA, 16 bp, H. sapiens
cttgaggtcaggggtt

SEQ ID NO: 94983 - DNA, 16 bp, H. sapiens
cttgaggtcatgagtt

SEQ ID NO: 94984 - DNA, 16 bp, H. sapiens
cttgaggtgaggagtt

SEQ ID NO: 94985 - DNA, 16 bp, H. sapiens
cttgaggttaggagtt

SEQ ID NO: 94986 - DNA, 16 bp, H. sapiens
cttgaggttgggagtt

SEQ ID NO: 94987 - DNA, 16 bp, H. sapiens
cttgagtacaggagtt

SEQ ID NO: 94988 - DNA, 16 bp, H. sapiens
cttgagtacagtggtg

SEQ ID NO: 94989 - DNA, 16 bp, H. sapiens
cttgagtccaagagtt

SEQ ID NO: 94990 - DNA, 16 bp, H. sapiens
cttgagtccacgagtt

SEQ ID NO: 94991 - DNA, 16 bp, H. sapiens
cttgagtccagaagtt

SEQ ID NO: 94992 - DNA, 16 bp, H. sapiens
cttgagtccaggaatt

SEQ ID NO: 94993 - DNA, 16 bp, H. sapiens
cttgagtccaggaggt

SEQ ID NO: 94994 - DNA, 16 bp, H. sapiens
cttgagtccaggagtt

SEQ ID NO: 94995 - DNA, 16 bp, H. sapiens
cttgagtccaggattt

SEQ ID NO: 94996 - DNA, 16 bp, H. sapiens
cttgagtctaggagtt

SEQ ID NO: 94997 - DNA, 16 bp, H. sapiens
cttgagtgcaggagtt

SEQ ID NO: 94998 - DNA, 16 bp, H. sapiens
cttgagtggatggata

SEQ ID NO: 94999 - DNA, 16 bp, H. sapiens
cttgagttaacttttt

SEQ ID NO: 95000 - DNA, 16 bp, H. sapiens
cttgagttcaggagtt

SEQ ID NO: 95001 - DNA, 16 bp, H. sapiens
cttgagttgtttttca

SEQ ID NO: 95002 - DNA, 20 bp, H. sapiens
cttgagtttatctgtctagt

SEQ ID NO: 95003 - DNA, 16 bp, H. sapiens
cttgagtttttaaaat

SEQ ID NO: 95004 - DNA, 16 bp, H. sapiens
cttgataaatcagctc

SEQ ID NO: 95005 - DNA, 16 bp, H. sapiens
cttgataccaaaagca

SEQ ID NO: 95006 - DNA, 16 bp, H. sapiens
cttgataggaagaaat

SEQ ID NO: 95007 - DNA, 16 bp, H. sapiens
cttgatataattttga

SEQ ID NO: 95008 - DNA, 16 bp, H. sapiens
cttgatatgatttcag

SEQ ID NO: 95009 - DNA, 16 bp, H. sapiens
cttgatattatcatct

SEQ ID NO: 95010 - DNA, 16 bp, H. sapiens
cttgatcaataaatgc

SEQ ID NO: 95011 - DNA, 16 bp, H. sapiens
cttgatcataatgaat

SEQ ID NO: 95012 - DNA, 16 bp, H. sapiens
cttgatcccaggaggc

SEQ ID NO: 95013 - DNA, 16 bp, H. sapiens
cttgatcccaggagtt

SEQ ID NO: 95014 - DNA, 16 bp, H. sapiens
cttgatcctaggagtt

SEQ ID NO: 95015 - DNA, 16 bp, H. sapiens
cttgatctcaagtgat

SEQ ID NO: 95016 - DNA, 16 bp, H. sapiens
cttgatctcagacttc

SEQ ID NO: 95017 - DNA, 16 bp, H. sapiens
cttgatcttgaatttc

SEQ ID NO: 95018 - DNA, 16 bp, H. sapiens
cttgatcttgcacttc

SEQ ID NO: 95019 - DNA, 16 bp, H. sapiens
cttgatcttggacttc

SEQ ID NO: 95020 - DNA, 16 bp, H. sapiens
cttgatgctgaggttt

SEQ ID NO: 95021 - DNA, 16 bp, H. sapiens
cttgatggatcagctg

SEQ ID NO: 95022 - DNA, 16 bp, H. sapiens
cttgatgtaattccat

SEQ ID NO: 95023 - DNA, 16 bp, H. sapiens
cttgatgtttcttcag

SEQ ID NO: 95024 - DNA, 16 bp, H. sapiens
cttgattattttaaat

SEQ ID NO: 95025 - DNA, 16 bp, H. sapiens
cttgattgaatcagct

SEQ ID NO: 95026 - DNA, 16 bp, H. sapiens
cttgattgatagtttg

SEQ ID NO: 95027 - DNA, 16 bp, H. sapiens
cttgatttaacccacc

SEQ ID NO: 95028 - DNA, 16 bp, H. sapiens
cttgatttccttttct

SEQ ID NO: 95029 - DNA, 16 bp, H. sapiens
cttgatttctttctca

SEQ ID NO: 95030 - DNA, 16 bp, H. sapiens
cttgattttagatttc

SEQ ID NO: 95031 - DNA, 16 bp, H. sapiens
cttgattttagcccag

SEQ ID NO: 95032 - DNA, 16 bp, H. sapiens
cttgattttctagttt

SEQ ID NO: 95033 - DNA, 16 bp, H. sapiens
cttgattttggacttc

SEQ ID NO: 95034 - DNA, 16 bp, H. sapiens
cttgatttttctcctt

SEQ ID NO: 95035 - DNA, 16 bp, H. sapiens
cttgcaaaattcctga

SEQ ID NO: 95036 - DNA, 16 bp, H. sapiens
cttgcaaactgtctga

SEQ ID NO: 95037 - DNA, 16 bp, H. sapiens
cttgcaactgcacact

SEQ ID NO: 95038 - DNA, 16 bp, H. sapiens
cttgcaactggtgtct

SEQ ID NO: 95039 - DNA, 16 bp, H. sapiens
cttgcaattctggagg

SEQ ID NO: 95040 - DNA, 16 bp, H. sapiens
cttgcacacagtaggc

SEQ ID NO: 95041 - DNA, 16 bp, H. sapiens
cttgcaccttgcacct

SEQ ID NO: 95042 - DNA, 16 bp, H. sapiens
cttgcagaaggcctat

SEQ ID NO: 95043 - DNA, 16 bp, H. sapiens
cttgcagacagcctat

SEQ ID NO: 95044 - DNA, 16 bp, H. sapiens
cttgcagactcacaga

SEQ ID NO: 95045 - DNA, 16 bp, H. sapiens
cttgcagcgagccaag

SEQ ID NO: 95046 - DNA, 16 bp, H. sapiens
cttgcaggactgaaag

SEQ ID NO: 95047 - DNA, 16 bp, H. sapiens
cttgcaggagggagca

SEQ ID NO: 95048 - DNA, 16 bp, H. sapiens
cttgcaggtggctgcc

SEQ ID NO: 95049 - DNA, 16 bp, H. sapiens
cttgcagtgagacgag

SEQ ID NO: 95050 - DNA, 17 bp, H. sapiens
cttgcagttagccgaga

SEQ ID NO: 95051 - DNA, 16 bp, H. sapiens
cttgcagttttctttt

SEQ ID NO: 95052 - DNA, 16 bp, H. sapiens
cttgcatatgcatgtt

SEQ ID NO: 95053 - DNA, 16 bp, H. sapiens
cttgcatcccagggat

SEQ ID NO: 95054 - DNA, 16 bp, H. sapiens
cttgcatttccctgat

SEQ ID NO: 95055 - DNA, 16 bp, H. sapiens
cttgccaaaacggtga

SEQ ID NO: 95056 - DNA, 16 bp, H. sapiens
cttgccaaaggtcaca

SEQ ID NO: 95057 - DNA, 16 bp, H. sapiens
cttgccactatgccca

SEQ ID NO: 95058 - DNA, 16 bp, H. sapiens
cttgccactctgtgcc

SEQ ID NO: 95059 - DNA, 16 bp, H. sapiens
cttgccagacaccaaa

SEQ ID NO: 95060 - DNA, 16 bp, H. sapiens
cttgccatcaccacag

SEQ ID NO: 95061 - DNA, 16 bp, H. sapiens
cttgccatcatgccca

SEQ ID NO: 95062 - DNA, 16 bp, H. sapiens
cttgcccaaagtcaca

SEQ ID NO: 95063 - DNA, 16 bp, H. sapiens
cttgcccaaagttgca

SEQ ID NO: 95064 - DNA, 16 bp, H. sapiens
cttgcccaacatcaca

SEQ ID NO: 95065 - DNA, 16 bp, H. sapiens
cttgcccaaggccaca

SEQ ID NO: 95066 - DNA, 16 bp, H. sapiens
cttgcccaaggtcaca

SEQ ID NO: 95067 - DNA, 16 bp, H. sapiens
cttgcccaaggtcacc

SEQ ID NO: 95068 - DNA, 16 bp, H. sapiens
cttgcccaaggtctca

SEQ ID NO: 95069 - DNA, 16 bp, H. sapiens
cttgcccaaggtgaca

SEQ ID NO: 95070 - DNA, 16 bp, H. sapiens
cttgcccagtgtcaca

SEQ ID NO: 95071 - DNA, 16 bp, H. sapiens
cttgcccatggtcaca

SEQ ID NO: 95072 - DNA, 16 bp, H. sapiens
cttgccccaaatcaca

SEQ ID NO: 95073 - DNA, 16 bp, H. sapiens
cttgccccaagggttt

SEQ ID NO: 95074 - DNA, 16 bp, H. sapiens
cttgccccaagtcaca

SEQ ID NO: 95075 - DNA, 16 bp, H. sapiens
cttgcccctcccccag

SEQ ID NO: 95076 - DNA, 16 bp, H. sapiens
cttgcccctcctccag

SEQ ID NO: 95077 - DNA, 16 bp, H. sapiens
cttgcccctcctctag

SEQ ID NO: 95078 - DNA, 16 bp, H. sapiens
cttgccctcattctgg

SEQ ID NO: 95079 - DNA, 16 bp, H. sapiens
cttgccctgcctccat

SEQ ID NO: 95080 - DNA, 16 bp, H. sapiens
cttgccctggccagaa

SEQ ID NO: 95081 - DNA, 16 bp, H. sapiens
cttgcccttcaccttc

SEQ ID NO: 95082 - DNA, 16 bp, H. sapiens
cttgccgggcgcggtg

SEQ ID NO: 95083 - DNA, 16 bp, H. sapiens
cttgcctaaggccaca

SEQ ID NO: 95084 - DNA, 16 bp, H. sapiens
cttgcctaatttttct

SEQ ID NO: 95085 - DNA, 16 bp, H. sapiens
cttgcctactgccatg

SEQ ID NO: 95086 - DNA, 16 bp, H. sapiens
cttgcctcagcttccc

SEQ ID NO: 95087 - DNA, 16 bp, H. sapiens
cttgcctcagcttctt

SEQ ID NO: 95088 - DNA, 16 bp, H. sapiens
cttgcctcagtctcct

SEQ ID NO: 95089 - DNA, 16 bp, H. sapiens
cttgcctcccaggggc

SEQ ID NO: 95090 - DNA, 16 bp, H. sapiens
cttgcctcctcagagg

SEQ ID NO: 95091 - DNA, 16 bp, H. sapiens
cttgcctcctccagct

SEQ ID NO: 95092 - DNA, 16 bp, H. sapiens
cttgcctcctgctgtg

SEQ ID NO: 95093 - DNA, 16 bp, H. sapiens
cttgcctcctgggctc

SEQ ID NO: 95094 - DNA, 16 bp, H. sapiens
cttgcctcttcctggc

SEQ ID NO: 95095 - DNA, 16 bp, H. sapiens
cttgcctgaggtcaca

SEQ ID NO: 95096 - DNA, 16 bp, H. sapiens
cttgcctgccctgcat

SEQ ID NO: 95097 - DNA, 16 bp, H. sapiens
cttgcctgctgccagg

SEQ ID NO: 95098 - DNA, 16 bp, H. sapiens
cttgcctgctgccata

SEQ ID NO: 95099 - DNA, 16 bp, H. sapiens
cttgcctgtcaccatg

SEQ ID NO: 95100 - DNA, 16 bp, H. sapiens
cttgccttcaaggtgt

SEQ ID NO: 95101 - DNA, 16 bp, H. sapiens
cttgccttcatggagc

SEQ ID NO: 95102 - DNA, 16 bp, H. sapiens
cttgccttggtctctt

SEQ ID NO: 95103 - DNA, 16 bp, H. sapiens
cttgccttgtctaaga

SEQ ID NO: 95104 - DNA, 16 bp, H. sapiens
cttgccttttcagctt

SEQ ID NO: 95105 - DNA, 16 bp, H. sapiens
cttgccttttcatttt

SEQ ID NO: 95106 - DNA, 16 bp, H. sapiens
cttgccttttccaact

SEQ ID NO: 95107 - DNA, 16 bp, H. sapiens
cttgccttttgccatg

SEQ ID NO: 95108 - DNA, 21 bp, H. sapiens
cttgcgggccagctggagttc

SEQ ID NO: 95109 - DNA, 16 bp, H. sapiens
cttgctacaacctcca

SEQ ID NO: 95110 - DNA, 16 bp, H. sapiens
cttgctactcaaagtg

SEQ ID NO: 95111 - DNA, 16 bp, H. sapiens
cttgctacttcacctt

SEQ ID NO: 95112 - DNA, 16 bp, H. sapiens
cttgctagagacctag

SEQ ID NO: 95113 - DNA, 16 bp, H. sapiens
cttgctagctgtgtgg

SEQ ID NO: 95114 - DNA, 16 bp, H. sapiens
cttgctatagtttact

SEQ ID NO: 95115 - DNA, 16 bp, H. sapiens
cttgctatgttgctca

SEQ ID NO: 95116 - DNA, 16 bp, H. sapiens
cttgctattgaattgt

SEQ ID NO: 95117 - DNA, 16 bp, H. sapiens
cttgctatttatttta

SEQ ID NO: 95118 - DNA, 16 bp, H. sapiens
cttgctcaaggtcatg

SEQ ID NO: 95119 - DNA, 16 bp, H. sapiens
cttgctcaagttcaca

SEQ ID NO: 95120 - DNA, 16 bp, H. sapiens
cttgctcacacacccc

SEQ ID NO: 95121 - DNA, 16 bp, H. sapiens
cttgctcagagtcaca

SEQ ID NO: 95122 - DNA, 16 bp, H. sapiens
cttgctcctgctccag

SEQ ID NO: 95123 - DNA, 16 bp, H. sapiens
cttgctcctgcttctg

SEQ ID NO: 95124 - DNA, 16 bp, H. sapiens
cttgctctcccaggct

SEQ ID NO: 95125 - DNA, 18 bp, H. sapiens
cttgctctcggcacctcc

SEQ ID NO: 95126 - DNA, 16 bp, H. sapiens
cttgctctgccatcca

SEQ ID NO: 95127 - DNA, 16 bp, H. sapiens
cttgctctgcttccca

SEQ ID NO: 95128 - DNA, 16 bp, H. sapiens
cttgctctgtctggag

SEQ ID NO: 95129 - DNA, 16 bp, H. sapiens
cttgctctgtgcccca

SEQ ID NO: 95130 - DNA, 16 bp, H. sapiens
cttgctctgtgtccca

SEQ ID NO: 95131 - DNA, 16 bp, H. sapiens
cttgctcttcagcttg

SEQ ID NO: 95132 - DNA, 16 bp, H. sapiens
cttgctcttccttctg

SEQ ID NO: 95133 - DNA, 16 bp, H. sapiens
cttgctcttgtcacct

SEQ ID NO: 95134 - DNA, 16 bp, H. sapiens
cttgctgaacttgttt

SEQ ID NO: 95135 - DNA, 16 bp, H. sapiens
cttgctgagaaaaata

SEQ ID NO: 95136 - DNA, 16 bp, H. sapiens
cttgctgagcaagtcc

SEQ ID NO: 95137 - DNA, 16 bp, H. sapiens
cttgctgagcctcagt

SEQ ID NO: 95138 - DNA, 16 bp, H. sapiens
cttgctgcagcttcca

SEQ ID NO: 95139 - DNA, 16 bp, H. sapiens
cttgctgccatcttgg

SEQ ID NO: 95140 - DNA, 16 bp, H. sapiens
cttgctgctgattggt

SEQ ID NO: 95141 - DNA, 16 bp, H. sapiens
cttgctgctgttcact

SEQ ID NO: 95142 - DNA, 16 bp, H. sapiens
cttgctggatcaggag

SEQ ID NO: 95143 - DNA, 16 bp, H. sapiens
cttgctggctcaggag

SEQ ID NO: 95144 - DNA, 16 bp, H. sapiens
cttgctggctgtcagc

SEQ ID NO: 95145 - DNA, 16 bp, H. sapiens
cttgctgtctcagagg

SEQ ID NO: 95146 - DNA, 16 bp, H. sapiens
cttgctgtggctgctg

SEQ ID NO: 95147 - DNA, 16 bp, H. sapiens
cttgctgtgtccccca

SEQ ID NO: 95148 - DNA, 16 bp, H. sapiens
cttgctgtgtcttcat

SEQ ID NO: 95149 - DNA, 16 bp, H. sapiens
cttgctgtgtgcccag

SEQ ID NO: 95150 - DNA, 16 bp, H. sapiens
cttgctgtgttgttca

SEQ ID NO: 95151 - DNA, 16 bp, H. sapiens
cttgctgttttcatga

SEQ ID NO: 95152 - DNA, 16 bp, H. sapiens
cttgctgtttttagga

SEQ ID NO: 95153 - DNA, 16 bp, H. sapiens
cttgcttaaaatattt

SEQ ID NO: 95154 - DNA, 16 bp, H. sapiens
cttgcttcagcctccc

SEQ ID NO: 95155 - DNA, 16 bp, H. sapiens
cttgcttcattttctt

SEQ ID NO: 95156 - DNA, 16 bp, H. sapiens
cttgcttccttcacta

SEQ ID NO: 95157 - DNA, 16 bp, H. sapiens
cttgcttctctagttt

SEQ ID NO: 95158 - DNA, 16 bp, H. sapiens
cttgcttgcctgctgc

SEQ ID NO: 95159 - DNA, 16 bp, H. sapiens
cttgcttgcttccttc

SEQ ID NO: 95160 - DNA, 16 bp, H. sapiens
cttgcttgcttgcttt

SEQ ID NO: 95161 - DNA, 16 bp, H. sapiens
cttgcttggtgccctg

SEQ ID NO: 95162 - DNA, 16 bp, H. sapiens
cttgctttatgaaact

SEQ ID NO: 95163 - DNA, 16 bp, H. sapiens
cttgctttcctcatct

SEQ ID NO: 95164 - DNA, 16 bp, H. sapiens
cttgctttggatttta

SEQ ID NO: 95165 - DNA, 16 bp, H. sapiens
cttgcttttctaattc

SEQ ID NO: 95166 - DNA, 16 bp, H. sapiens
cttgcttttctcactt

SEQ ID NO: 95167 - DNA, 16 bp, H. sapiens
cttggaaaaacaaaat

SEQ ID NO: 95168 - DNA, 16 bp, H. sapiens
cttggaaaaacagtgt

SEQ ID NO: 95169 - DNA, 16 bp, H. sapiens
cttggaaaaataaact

SEQ ID NO: 95170 - DNA, 16 bp, H. sapiens
cttggaaaagttattt

SEQ ID NO: 95171 - DNA, 16 bp, H. sapiens
cttggaaagcatattt

SEQ ID NO: 95172 - DNA, 16 bp, H. sapiens
cttggaaatgccttga

SEQ ID NO: 95173 - DNA, 16 bp, H. sapiens
cttggaaattcaaagt

SEQ ID NO: 95174 - DNA, 16 bp, H. sapiens
cttggaagcagacagc

SEQ ID NO: 95175 - DNA, 16 bp, H. sapiens
cttggaagcagagaga

SEQ ID NO: 95176 - DNA, 16 bp, H. sapiens
cttggaagcagatcct

SEQ ID NO: 95177 - DNA, 16 bp, H. sapiens
cttggaagtggatcct

SEQ ID NO: 95178 - DNA, 16 bp, H. sapiens
cttggaataaaatcca

SEQ ID NO: 95179 - DNA, 16 bp, H. sapiens
cttggaatttaaaaaa

SEQ ID NO: 95180 - DNA, 16 bp, H. sapiens
cttggacaagggaggg

SEQ ID NO: 95181 - DNA, 16 bp, H. sapiens
cttggacaagtcattt

SEQ ID NO: 95182 - DNA, 16 bp, H. sapiens
cttggacaatacccag

SEQ ID NO: 95183 - DNA, 16 bp, H. sapiens
cttggaccacagcaca

SEQ ID NO: 95184 - DNA, 16 bp, H. sapiens
cttggacccgggaggt

SEQ ID NO: 95185 - DNA, 16 bp, H. sapiens
cttggacctgggaggc

SEQ ID NO: 95186 - DNA, 16 bp, H. sapiens
cttggactcaagcaat

SEQ ID NO: 95187 - DNA, 16 bp, H. sapiens
cttggactcccagcct

SEQ ID NO: 95188 - DNA, 16 bp, H. sapiens
cttggacttcagcctc

SEQ ID NO: 95189 - DNA, 16 bp, H. sapiens
cttggacttctagctt

SEQ ID NO: 95190 - DNA, 16 bp, H. sapiens
cttggagaaaatattt

SEQ ID NO: 95191 - DNA, 16 bp, H. sapiens
cttggagaaatggcta

SEQ ID NO: 95192 - DNA, 16 bp, H. sapiens
cttggagaaatggctg

SEQ ID NO: 95193 - DNA, 16 bp, H. sapiens
cttggagaacctgatg

SEQ ID NO: 95194 - DNA, 16 bp, H. sapiens
cttggagaggccgagg

SEQ ID NO: 95195 - DNA, 16 bp, H. sapiens
cttggagatgctgtga

SEQ ID NO: 95196 - DNA, 16 bp, H. sapiens
cttggagatttctcaa

SEQ ID NO: 95197 - DNA, 16 bp, H. sapiens
cttggagctgaagaag

SEQ ID NO: 95198 - DNA, 16 bp, H. sapiens
cttggagctgctcttc

SEQ ID NO: 95199 - DNA, 16 bp, H. sapiens
cttggaggagtttgtt

SEQ ID NO: 95200 - DNA, 16 bp, H. sapiens
cttggaggcctatggt

SEQ ID NO: 95201 - DNA, 16 bp, H. sapiens
cttggaggctgcagtg

SEQ ID NO: 95202 - DNA, 16 bp, H. sapiens
cttggaggctttcttt

SEQ ID NO: 95203 - DNA, 16 bp, H. sapiens
cttggagggtcccatg

SEQ ID NO: 95204 - DNA, 16 bp, H. sapiens
cttggataaaatgttc

SEQ ID NO: 95205 - DNA, 16 bp, H. sapiens
cttggataactggcta

SEQ ID NO: 95206 - DNA, 20 bp, H. sapiens
cttggatagaatccagggct

SEQ ID NO: 95207 - DNA, 16 bp, H. sapiens
cttggatcttctctct

SEQ ID NO: 95208 - DNA, 16 bp, H. sapiens
cttggatgacagagtg

SEQ ID NO: 95209 - DNA, 16 bp, H. sapiens
cttggattgaaaatat

SEQ ID NO: 95210 - DNA, 16 bp, H. sapiens
cttggatttacaccag

SEQ ID NO: 95211 - DNA, 16 bp, H. sapiens
cttggcaacagaacaa

SEQ ID NO: 95212 - DNA, 16 bp, H. sapiens
cttggcaatgcaggct

SEQ ID NO: 95213 - DNA, 16 bp, H. sapiens
cttggcacatagtagg

SEQ ID NO: 95214 - DNA, 16 bp, H. sapiens
cttggcacccactctg

SEQ ID NO: 95215 - DNA, 16 bp, H. sapiens
cttggcacccttgttg

SEQ ID NO: 95216 - DNA, 16 bp, H. sapiens
cttggcacctcctctg

SEQ ID NO: 95217 - DNA, 16 bp, H. sapiens
cttggcagaaactcta

SEQ ID NO: 95218 - DNA, 16 bp, H. sapiens
cttggcagcctccacc

SEQ ID NO: 95219 - DNA, 16 bp, H. sapiens
cttggcattccttggc

SEQ ID NO: 95220 - DNA, 16 bp, H. sapiens
cttggcattgaagagt

SEQ ID NO: 95221 - DNA, 16 bp, H. sapiens
cttggccaaactttag

SEQ ID NO: 95222 - DNA, 16 bp, H. sapiens
cttggccaaagtcaca

SEQ ID NO: 95223 - DNA, 16 bp, H. sapiens
cttggccaacatggtg

SEQ ID NO: 95224 - DNA, 16 bp, H. sapiens
cttggccaacgtggca

SEQ ID NO: 95225 - DNA, 16 bp, H. sapiens
cttggccaagcatggt

SEQ ID NO: 95226 - DNA, 16 bp, H. sapiens
cttggccaagtcactt

SEQ ID NO: 95227 - DNA, 16 bp, H. sapiens
cttggccacgctggtc

SEQ ID NO: 95228 - DNA, 16 bp, H. sapiens
cttggccagccccaga

SEQ ID NO: 95229 - DNA, 16 bp, H. sapiens
cttggccctggccctg

SEQ ID NO: 95230 - DNA, 16 bp, H. sapiens
cttggccgggtgtggt

SEQ ID NO: 95231 - DNA, 16 bp, H. sapiens
cttggcctcccaaagg

SEQ ID NO: 95232 - DNA, 16 bp, H. sapiens
cttggcctcccaagtg

SEQ ID NO: 95233 - DNA, 16 bp, H. sapiens
cttggcctcccagaat

SEQ ID NO: 95234 - DNA, 16 bp, H. sapiens
cttggcctcccagatt

SEQ ID NO: 95235 - DNA, 16 bp, H. sapiens
cttggcctcctgaagt

SEQ ID NO: 95236 - DNA, 16 bp, H. sapiens
cttggcctctccaagt

SEQ ID NO: 95237 - DNA, 16 bp, H. sapiens
cttggcctctctgagc

SEQ ID NO: 95238 - DNA, 16 bp, H. sapiens
cttggctattgtggat

SEQ ID NO: 95239 - DNA, 16 bp, H. sapiens
cttggctcacggcaac

SEQ ID NO: 95240 - DNA, 16 bp, H. sapiens
cttggctcactacaag

SEQ ID NO: 95241 - DNA, 16 bp, H. sapiens
cttggctcagggcaac

SEQ ID NO: 95242 - DNA, 16 bp, H. sapiens
cttggctccaccctcc

SEQ ID NO: 95243 - DNA, 16 bp, H. sapiens
cttggctccctgcagc

SEQ ID NO: 95244 - DNA, 16 bp, H. sapiens
cttggctctgccttct

SEQ ID NO: 95245 - DNA, 16 bp, H. sapiens
cttggctgaattcttt

SEQ ID NO: 95246 - DNA, 17 bp, H. sapiens
cttggctgcataaatgt

SEQ ID NO: 95247 - DNA, 16 bp, H. sapiens
cttggctgcctggctg

SEQ ID NO: 95248 - DNA, 16 bp, H. sapiens
cttggctgggcgtggt

SEQ ID NO: 95249 - DNA, 16 bp, H. sapiens
cttggctggggctggg

SEQ ID NO: 95250 - DNA, 16 bp, H. sapiens
cttggctgggtgcagt

SEQ ID NO: 95251 - DNA, 16 bp, H. sapiens
cttggcttacagcaac

SEQ ID NO: 95252 - DNA, 16 bp, H. sapiens
cttggcttatggcagc

SEQ ID NO: 95253 - DNA, 16 bp, H. sapiens
cttggcttcctcttct

SEQ ID NO: 95254 - DNA, 16 bp, H. sapiens
cttggcttctgggagg

SEQ ID NO: 95255 - DNA, 16 bp, H. sapiens
cttggcttttctccca

SEQ ID NO: 95256 - DNA, 16 bp, H. sapiens
cttgggaaagttactt

SEQ ID NO: 95257 - DNA, 16 bp, H. sapiens
cttgggaggatcactt

SEQ ID NO: 95258 - DNA, 16 bp, H. sapiens
cttgggaggcagaggg

SEQ ID NO: 95259 - DNA, 16 bp, H. sapiens
cttgggaggctcaggc

SEQ ID NO: 95260 - DNA, 22 bp, H. sapiens
cttgggaggctgaggcaggaag

SEQ ID NO: 95261 - DNA, 20 bp, H. sapiens
cttgggaggctgaggcaggt

SEQ ID NO: 95262 - DNA, 16 bp, H. sapiens
cttgggagggaggctg

SEQ ID NO: 95263 - DNA, 16 bp, H. sapiens
cttgggcaacaaagtg

SEQ ID NO: 95264 - DNA, 16 bp, H. sapiens
cttgggcaacacaggg

SEQ ID NO: 95265 - DNA, 16 bp, H. sapiens
cttgggcaagtaattt

SEQ ID NO: 95266 - DNA, 16 bp, H. sapiens
cttgggcaagtcacct

SEQ ID NO: 95267 - DNA, 16 bp, H. sapiens
cttgggcaagtcactc

SEQ ID NO: 95268 - DNA, 16 bp, H. sapiens
cttgggcaagtcactg

SEQ ID NO: 95269 - DNA, 16 bp, H. sapiens
cttgggcaagtcattt

SEQ ID NO: 95270 - DNA, 16 bp, H. sapiens
cttgggcaagtttctt

SEQ ID NO: 95271 - DNA, 16 bp, H. sapiens
cttgggcagctcagcc

SEQ ID NO: 95272 - DNA, 16 bp, H. sapiens
cttgggcagctcctcc

SEQ ID NO: 95273 - DNA, 16 bp, H. sapiens
cttgggcagctctgcc

SEQ ID NO: 95274 - DNA, 16 bp, H. sapiens
cttgggcccaagagtt

SEQ ID NO: 95275 - DNA, 17 bp, H. sapiens
cttgggcccacagcaca

SEQ ID NO: 95276 - DNA, 16 bp, H. sapiens
cttgggcccaggaatt

SEQ ID NO: 95277 - DNA, 16 bp, H. sapiens
cttgggcccaggagtt

SEQ ID NO: 95278 - DNA, 16 bp, H. sapiens
cttgggcctcagccct

SEQ ID NO: 95279 - DNA, 16 bp, H. sapiens
cttgggcctgggaggt

SEQ ID NO: 95280 - DNA, 17 bp, H. sapiens
cttgggctacagagtga

SEQ ID NO: 95281 - DNA, 16 bp, H. sapiens
cttgggctcaagcaat

SEQ ID NO: 95282 - DNA, 16 bp, H. sapiens
cttgggctcaagcgat

SEQ ID NO: 95283 - DNA, 16 bp, H. sapiens
cttgggctgccataac

SEQ ID NO: 95284 - DNA, 16 bp, H. sapiens
cttgggcttaagtgat

SEQ ID NO: 95285 - DNA, 16 bp, H. sapiens
cttggggaaaaaaaaa

SEQ ID NO: 95286 - DNA, 16 bp, H. sapiens
cttggggaagaaaaca

SEQ ID NO: 95287 - DNA, 16 bp, H. sapiens
cttggggaagaggaat

SEQ ID NO: 95288 - DNA, 16 bp, H. sapiens
cttggggaagctgagg

SEQ ID NO: 95289 - DNA, 16 bp, H. sapiens
cttggggaggccaggg

SEQ ID NO: 95290 - DNA, 16 bp, H. sapiens
cttggggaggccgagg

SEQ ID NO: 95291 - DNA, 16 bp, H. sapiens
cttggggcagccaggc

SEQ ID NO: 95292 - DNA, 16 bp, H. sapiens
cttggggccagaagtt

SEQ ID NO: 95293 - DNA, 16 bp, H. sapiens
cttgggggacagagca

SEQ ID NO: 95294 - DNA, 16 bp, H. sapiens
cttgggggactgaggc

SEQ ID NO: 95295 - DNA, 16 bp, H. sapiens
cttgggggcctgaggc

SEQ ID NO: 95296 - DNA, 16 bp, H. sapiens
cttggggggcagaggt

SEQ ID NO: 95297 - DNA, 16 bp, H. sapiens
cttgggtgaccagatg

SEQ ID NO: 95298 - DNA, 16 bp, H. sapiens
cttgggttcaaatcct

SEQ ID NO: 95299 - DNA, 16 bp, H. sapiens
cttgggttcacaccat

SEQ ID NO: 95300 - DNA, 16 bp, H. sapiens
cttggtaaaagtcatc

SEQ ID NO: 95301 - DNA, 16 bp, H. sapiens
cttggtaaatttttct

SEQ ID NO: 95302 - DNA, 16 bp, H. sapiens
cttggtactgtccttg

SEQ ID NO: 95303 - DNA, 16 bp, H. sapiens
cttggtatatatccaa

SEQ ID NO: 95304 - DNA, 16 bp, H. sapiens
cttggtcatgataaat

SEQ ID NO: 95305 - DNA, 16 bp, H. sapiens
cttggtcctcttccaa

SEQ ID NO: 95306 - DNA, 16 bp, H. sapiens
cttggtctgctggcct

SEQ ID NO: 95307 - DNA, 16 bp, H. sapiens
cttggtgcagggctga

SEQ ID NO: 95308 - DNA, 16 bp, H. sapiens
cttggtgccctccctg

SEQ ID NO: 95309 - DNA, 16 bp, H. sapiens
cttggtgctgttcttg

SEQ ID NO: 95310 - DNA, 16 bp, H. sapiens
cttggtggagggaggg

SEQ ID NO: 95311 - DNA, 16 bp, H. sapiens
cttggtggcaggcacc

SEQ ID NO: 95312 - DNA, 16 bp, H. sapiens
cttggtggctcatgcc

SEQ ID NO: 95313 - DNA, 16 bp, H. sapiens
cttggtggctgaggca

SEQ ID NO: 95314 - DNA, 16 bp, H. sapiens
cttggtggcttaaagc

SEQ ID NO: 95315 - DNA, 16 bp, H. sapiens
cttggtgggaatgcaa

SEQ ID NO: 95316 - DNA, 16 bp, H. sapiens
cttggtgggagtgtaa

SEQ ID NO: 95317 - DNA, 16 bp, H. sapiens
cttggtgggctcctgg

SEQ ID NO: 95318 - DNA, 16 bp, H. sapiens
cttggtggggctgagg

SEQ ID NO: 95319 - DNA, 16 bp, H. sapiens
cttggtgtacctgaaa

SEQ ID NO: 95320 - DNA, 16 bp, H. sapiens
cttggtgtctgaggag

SEQ ID NO: 95321 - DNA, 16 bp, H. sapiens
cttggtgtctgcttct

SEQ ID NO: 95322 - DNA, 16 bp, H. sapiens
cttggttaaatttgtt

SEQ ID NO: 95323 - DNA, 16 bp, H. sapiens
cttggttagctgtatt

SEQ ID NO: 95324 - DNA, 16 bp, H. sapiens
cttggttcaaatccca

SEQ ID NO: 95325 - DNA, 16 bp, H. sapiens
cttggttgctggtgaa

SEQ ID NO: 95326 - DNA, 16 bp, H. sapiens
cttggtttccacaacc

SEQ ID NO: 95327 - DNA, 16 bp, H. sapiens
cttggtttcctcacct

SEQ ID NO: 95328 - DNA, 16 bp, H. sapiens
cttggtttgctagtat

SEQ ID NO: 95329 - DNA, 16 bp, H. sapiens
cttggttttccattcc

SEQ ID NO: 95330 - DNA, 16 bp, H. sapiens
cttggttttctcattt

SEQ ID NO: 95331 - DNA, 16 bp, H. sapiens
cttggttttcttctag

SEQ ID NO: 95332 - DNA, 16 bp, H. sapiens
cttggttttggccaat

SEQ ID NO: 95333 - DNA, 16 bp, H. sapiens
cttgtaaagatctttc

SEQ ID NO: 95334 - DNA, 16 bp, H. sapiens
cttgtaaatatttttt

SEQ ID NO: 95335 - DNA, 16 bp, H. sapiens
cttgtaaatgtgtttg

SEQ ID NO: 95336 - DNA, 16 bp, H. sapiens
cttgtaaatttctttg

SEQ ID NO: 95337 - DNA, 16 bp, H. sapiens
cttgtaaatttgtata

SEQ ID NO: 95338 - DNA, 16 bp, H. sapiens
cttgtaagttgtattt

SEQ ID NO: 95339 - DNA, 16 bp, H. sapiens
cttgtaatcccaacta

SEQ ID NO: 95340 - DNA, 18 bp, H. sapiens
cttgtaatcccagtactt

SEQ ID NO: 95341 - DNA, 16 bp, H. sapiens
cttgtaattccagtgc

SEQ ID NO: 95342 - DNA, 16 bp, H. sapiens
cttgtaatttatattt

SEQ ID NO: 95343 - DNA, 16 bp, H. sapiens
cttgtaattttctgtt

SEQ ID NO: 95344 - DNA, 16 bp, H. sapiens
cttgtacacacacaca

SEQ ID NO: 95345 - DNA, 16 bp, H. sapiens
cttgtacacagatgtt

SEQ ID NO: 95346 - DNA, 16 bp, H. sapiens
cttgtaccaatttact

SEQ ID NO: 95347 - DNA, 16 bp, H. sapiens
cttgtaccccctaaat

SEQ ID NO: 95348 - DNA, 16 bp, H. sapiens
cttgtactcctgggct

SEQ ID NO: 95349 - DNA, 16 bp, H. sapiens
cttgtagaaaaaaaaa

SEQ ID NO: 95350 - DNA, 16 bp, H. sapiens
cttgtagaattcagct

SEQ ID NO: 95351 - DNA, 16 bp, H. sapiens
cttgtagagacctttc

SEQ ID NO: 95352 - DNA, 16 bp, H. sapiens
cttgtatcctgtgacc

SEQ ID NO: 95353 - DNA, 16 bp, H. sapiens
cttgtatgcagaatat

SEQ ID NO: 95354 - DNA, 16 bp, H. sapiens
cttgtatgtcttgttt

SEQ ID NO: 95355 - DNA, 16 bp, H. sapiens
cttgtcattgtaaatt

SEQ ID NO: 95356 - DNA, 16 bp, H. sapiens
cttgtccaaagtcaca

SEQ ID NO: 95357 - DNA, 16 bp, H. sapiens
cttgtccaaagttaca

SEQ ID NO: 95358 - DNA, 16 bp, H. sapiens
cttgtccaagatggca

SEQ ID NO: 95359 - DNA, 16 bp, H. sapiens
cttgtccaaggccaca

SEQ ID NO: 95360 - DNA, 16 bp, H. sapiens
cttgtccaaggtcaca

SEQ ID NO: 95361 - DNA, 16 bp, H. sapiens
cttgtccccacagccc

SEQ ID NO: 95362 - DNA, 16 bp, H. sapiens
cttgtccccaccccca

SEQ ID NO: 95363 - DNA, 16 bp, H. sapiens
cttgtccttcctgagt

SEQ ID NO: 95364 - DNA, 16 bp, H. sapiens
cttgtctcaagaaaaa

SEQ ID NO: 95365 - DNA, 16 bp, H. sapiens
cttgtctctacaaaaa

SEQ ID NO: 95366 - DNA, 16 bp, H. sapiens
cttgtctctagaaaaa

SEQ ID NO: 95367 - DNA, 16 bp, H. sapiens
cttgtctctcctaaaa

SEQ ID NO: 95368 - DNA, 16 bp, H. sapiens
cttgtctctgcctcct

SEQ ID NO: 95369 - DNA, 16 bp, H. sapiens
cttgtctggtgtccag

SEQ ID NO: 95370 - DNA, 16 bp, H. sapiens
cttgtctgtaaaatgg

SEQ ID NO: 95371 - DNA, 16 bp, H. sapiens
cttgtcttattcctga

SEQ ID NO: 95372 - DNA, 16 bp, H. sapiens
cttgtcttctggtcac

SEQ ID NO: 95373 - DNA, 16 bp, H. sapiens
cttgtcttgttcctga

SEQ ID NO: 95374 - DNA, 16 bp, H. sapiens
cttgtcttgttcctgg

SEQ ID NO: 95375 - DNA, 16 bp, H. sapiens
cttgtctttataaatt

SEQ ID NO: 95376 - DNA, 16 bp, H. sapiens
cttgtctttccattct

SEQ ID NO: 95377 - DNA, 16 bp, H. sapiens
cttgtctttgatttta

SEQ ID NO: 95378 - DNA, 16 bp, H. sapiens
cttgtgaaaaaaaaaa

SEQ ID NO: 95379 - DNA, 16 bp, H. sapiens
cttgtgaaattccttc

SEQ ID NO: 95380 - DNA, 16 bp, H. sapiens
cttgtgaatttgttta

SEQ ID NO: 95381 - DNA, 16 bp, H. sapiens
cttgtgacctctggct

SEQ ID NO: 95382 - DNA, 16 bp, H. sapiens
cttgtgaggttagaag

SEQ ID NO: 95383 - DNA, 16 bp, H. sapiens
cttgtgatcttgctct

SEQ ID NO: 95384 - DNA, 16 bp, H. sapiens
cttgtgatgatgtgag

SEQ ID NO: 95385 - DNA, 16 bp, H. sapiens
cttgtgattttgattt

SEQ ID NO: 95386 - DNA, 16 bp, H. sapiens
cttgtgcagtgaacaa

SEQ ID NO: 95387 - DNA, 16 bp, H. sapiens
cttgtgccagttttca

SEQ ID NO: 95388 - DNA, 16 bp, H. sapiens
cttgtgcccaggagtt

SEQ ID NO: 95389 - DNA, 16 bp, H. sapiens
cttgtgcctaggagtt

SEQ ID NO: 95390 - DNA, 16 bp, H. sapiens
cttgtgcctcagcccc

SEQ ID NO: 95391 - DNA, 16 bp, H. sapiens
cttgtgcctgggaggt

SEQ ID NO: 95392 - DNA, 16 bp, H. sapiens
cttgtggaaaggggag

SEQ ID NO: 95393 - DNA, 16 bp, H. sapiens
cttgtggaagcaaaaa

SEQ ID NO: 95394 - DNA, 16 bp, H. sapiens
cttgtggccaggagtt

SEQ ID NO: 95395 - DNA, 16 bp, H. sapiens
cttgtggccatttagt

SEQ ID NO: 95396 - DNA, 16 bp, H. sapiens
cttgtgtcttccgttt

SEQ ID NO: 95397 - DNA, 16 bp, H. sapiens
cttgttaaaaatgcag

SEQ ID NO: 95398 - DNA, 16 bp, H. sapiens
cttgttaaaaattcag

SEQ ID NO: 95399 - DNA, 16 bp, H. sapiens
cttgttaaaagtaaaa

SEQ ID NO: 95400 - DNA, 16 bp, H. sapiens
cttgttaaaataaaaa

SEQ ID NO: 95401 - DNA, 16 bp, H. sapiens
cttgttaaatgaataa

SEQ ID NO: 95402 - DNA, 21 bp, H. sapiens
cttgttaacaaaatgtttaca

SEQ ID NO: 95403 - DNA, 18 bp, H. sapiens
cttgttaacaatatgttt

SEQ ID NO: 95404 - DNA, 16 bp, H. sapiens
cttgttaattaaaaaa

SEQ ID NO: 95405 - DNA, 16 bp, H. sapiens
cttgttacccaagctg

SEQ ID NO: 95406 - DNA, 16 bp, H. sapiens
cttgttacttatgcaa

SEQ ID NO: 95407 - DNA, 16 bp, H. sapiens
cttgttcaaaagagaa

SEQ ID NO: 95408 - DNA, 16 bp, H. sapiens
cttgttcacatgttta

SEQ ID NO: 95409 - DNA, 16 bp, H. sapiens
cttgttcatttttgct

SEQ ID NO: 95410 - DNA, 16 bp, H. sapiens
cttgttcctcagcctc

SEQ ID NO: 95411 - DNA, 16 bp, H. sapiens
cttgttcctgatttta

SEQ ID NO: 95412 - DNA, 16 bp, H. sapiens
cttgttctcccacttc

SEQ ID NO: 95413 - DNA, 16 bp, H. sapiens
cttgttctgtcacctg

SEQ ID NO: 95414 - DNA, 16 bp, H. sapiens
cttgttctgttgccag

SEQ ID NO: 95415 - DNA, 16 bp, H. sapiens
cttgttcttttgccca

SEQ ID NO: 95416 - DNA, 16 bp, H. sapiens
cttgttgaatgagtga

SEQ ID NO: 95417 - DNA, 16 bp, H. sapiens
cttgttgaattgcttt

SEQ ID NO: 95418 - DNA, 16 bp, H. sapiens
cttgttgatattttat

SEQ ID NO: 95419 - DNA, 16 bp, H. sapiens
cttgttgcacaggctg

SEQ ID NO: 95420 - DNA, 16 bp, H. sapiens
cttgttgcctaggcta

SEQ ID NO: 95421 - DNA, 16 bp, H. sapiens
cttgttggccattttt

SEQ ID NO: 95422 - DNA, 16 bp, H. sapiens
cttgttgggaactgca

SEQ ID NO: 95423 - DNA, 16 bp, H. sapiens
cttgttgggaactggg

SEQ ID NO: 95424 - DNA, 16 bp, H. sapiens
cttgttgttttatata

SEQ ID NO: 95425 - DNA, 18 bp, H. sapiens
cttgtttactcatgtggt

SEQ ID NO: 95426 - DNA, 16 bp, H. sapiens
cttgtttctattaaaa

SEQ ID NO: 95427 - DNA, 16 bp, H. sapiens
cttgtttctttatcca

SEQ ID NO: 95428 - DNA, 16 bp, H. sapiens
cttgtttctttgtatg

SEQ ID NO: 95429 - DNA, 16 bp, H. sapiens
cttgtttctttttcaa

SEQ ID NO: 95430 - DNA, 16 bp, H. sapiens
cttgtttgccaggctg

SEQ ID NO: 95431 - DNA, 16 bp, H. sapiens
cttgtttggatcctga

SEQ ID NO: 95432 - DNA, 16 bp, H. sapiens
cttgtttgtgtgattg

SEQ ID NO: 95433 - DNA, 16 bp, H. sapiens
cttgttttatacataa

SEQ ID NO: 95434 - DNA, 16 bp, H. sapiens
cttgttttatggccta

SEQ ID NO: 95435 - DNA, 16 bp, H. sapiens
cttgttttatgtcctt

SEQ ID NO: 95436 - DNA, 16 bp, H. sapiens
cttgttttattgtgct

SEQ ID NO: 95437 - DNA, 16 bp, H. sapiens
cttgttttgctggaaa

SEQ ID NO: 95438 - DNA, 16 bp, H. sapiens
cttgttttggttttca

SEQ ID NO: 95439 - DNA, 16 bp, H. sapiens
cttgttttgtgactta

SEQ ID NO: 95440 - DNA, 16 bp, H. sapiens
cttgtttttaaaagaa

SEQ ID NO: 95441 - DNA, 16 bp, H. sapiens
cttgtttttgccagct

SEQ ID NO: 95442 - DNA, 16 bp, H. sapiens
cttgtttttggaattt

SEQ ID NO: 95443 - DNA, 16 bp, H. sapiens
cttgtttttgtaaata

SEQ ID NO: 95444 - DNA, 16 bp, H. sapiens
cttgttttttaaataa

SEQ ID NO: 95445 - DNA, 16 bp, H. sapiens
ctttaaaaaaatagaa

SEQ ID NO: 95446 - DNA, 16 bp, H. sapiens
ctttaaaaaagaaaag

SEQ ID NO: 95447 - DNA, 16 bp, H. sapiens
ctttaaaaaagagaga

SEQ ID NO: 95448 - DNA, 16 bp, H. sapiens
ctttaaaaaatacaca

SEQ ID NO: 95449 - DNA, 16 bp, H. sapiens
ctttaaaaaatgggca

SEQ ID NO: 95450 - DNA, 16 bp, H. sapiens
ctttaaaaaatggttt

SEQ ID NO: 95451 - DNA, 16 bp, H. sapiens
ctttaaaaagaatgaa

SEQ ID NO: 95452 - DNA, 16 bp, H. sapiens
ctttaaaaagacattt

SEQ ID NO: 95453 - DNA, 16 bp, H. sapiens
ctttaaaaaggaagga

SEQ ID NO: 95454 - DNA, 16 bp, H. sapiens
ctttaaaaataaagaa

SEQ ID NO: 95455 - DNA, 16 bp, H. sapiens
ctttaaaaataaagtt

SEQ ID NO: 95456 - DNA, 16 bp, H. sapiens
ctttaaaaatatgact

SEQ ID NO: 95457 - DNA, 16 bp, H. sapiens
ctttaaaaatattgaa

SEQ ID NO: 95458 - DNA, 16 bp, H. sapiens
ctttaaaaatatttct

SEQ ID NO: 95459 - DNA, 16 bp, H. sapiens
ctttaaaaatgatttt

SEQ ID NO: 95460 - DNA, 16 bp, H. sapiens
ctttaaaaattatctt

SEQ ID NO: 95461 - DNA, 16 bp, H. sapiens
ctttaaaaattattgt

SEQ ID NO: 95462 - DNA, 16 bp, H. sapiens
ctttaaaacaaaatga

SEQ ID NO: 95463 - DNA, 16 bp, H. sapiens
ctttaaaacaacaaca

SEQ ID NO: 95464 - DNA, 16 bp, H. sapiens
ctttaaaagaaattaa

SEQ ID NO: 95465 - DNA, 16 bp, H. sapiens
ctttaaaagagaaata

SEQ ID NO: 95466 - DNA, 16 bp, H. sapiens
ctttaaaagccaaggt

SEQ ID NO: 95467 - DNA, 16 bp, H. sapiens
ctttaaaaggaaataa

SEQ ID NO: 95468 - DNA, 16 bp, H. sapiens
ctttaaaaggtcttat

SEQ ID NO: 95469 - DNA, 16 bp, H. sapiens
ctttaaaagtaaagaa

SEQ ID NO: 95470 - DNA, 16 bp, H. sapiens
ctttaaaagttaaaaa

SEQ ID NO: 95471 - DNA, 16 bp, H. sapiens
ctttaaaataaaagca

SEQ ID NO: 95472 - DNA, 16 bp, H. sapiens
ctttaaaatatgtatt

SEQ ID NO: 95473 - DNA, 16 bp, H. sapiens
ctttaaaatattttca

SEQ ID NO: 95474 - DNA, 16 bp, H. sapiens
ctttaaaatgatgaat

SEQ ID NO: 95475 - DNA, 16 bp, H. sapiens
ctttaaaatggagaac

SEQ ID NO: 95476 - DNA, 16 bp, H. sapiens
ctttaaaatgtaatga

SEQ ID NO: 95477 - DNA, 16 bp, H. sapiens
ctttaaaatgtaattt

SEQ ID NO: 95478 - DNA, 16 bp, H. sapiens
ctttaaaattacattt

SEQ ID NO: 95479 - DNA, 16 bp, H. sapiens
ctttaaaattattggt

SEQ ID NO: 95480 - DNA, 16 bp, H. sapiens
ctttaaaattcaagag

SEQ ID NO: 95481 - DNA, 16 bp, H. sapiens
ctttaaaatttttcaa

SEQ ID NO: 95482 - DNA, 16 bp, H. sapiens
ctttaaacatttcttt

SEQ ID NO: 95483 - DNA, 16 bp, H. sapiens
ctttaaacctcagttt

SEQ ID NO: 95484 - DNA, 16 bp, H. sapiens
ctttaaagaagttttt

SEQ ID NO: 95485 - DNA, 16 bp, H. sapiens
ctttaaagatgaaaaa

SEQ ID NO: 95486 - DNA, 16 bp, H. sapiens
ctttaaagggagagaa

SEQ ID NO: 95487 - DNA, 16 bp, H. sapiens
ctttaaagtcattttt

SEQ ID NO: 95488 - DNA, 16 bp, H. sapiens
ctttaaagtggttttt

SEQ ID NO: 95489 - DNA, 16 bp, H. sapiens
ctttaaagtttgagaa

SEQ ID NO: 95490 - DNA, 16 bp, H. sapiens
ctttaaagttttattt

SEQ ID NO: 95491 - DNA, 16 bp, H. sapiens
ctttaaatataaatga

SEQ ID NO: 95492 - DNA, 16 bp, H. sapiens
ctttaaatatgtcata

SEQ ID NO: 95493 - DNA, 16 bp, H. sapiens
ctttaaatatgtcatg

SEQ ID NO: 95494 - DNA, 16 bp, H. sapiens
ctttaaatatgtgaag

SEQ ID NO: 95495 - DNA, 16 bp, H. sapiens
ctttaaatattttaca

SEQ ID NO: 95496 - DNA, 16 bp, H. sapiens
ctttaaatattttgct

SEQ ID NO: 95497 - DNA, 16 bp, H. sapiens
ctttaaatcaaaagct

SEQ ID NO: 95498 - DNA, 16 bp, H. sapiens
ctttaaatctttaaat

SEQ ID NO: 95499 - DNA, 16 bp, H. sapiens
ctttaaattttgtatt

SEQ ID NO: 95500 - DNA, 16 bp, H. sapiens
ctttaacatattttga

SEQ ID NO: 95501 - DNA, 16 bp, H. sapiens
ctttaacccaggaggc

SEQ ID NO: 95502 - DNA, 16 bp, H. sapiens
ctttaacctttacaag

SEQ ID NO: 95503 - DNA, 16 bp, H. sapiens
ctttaactcaggaggc

SEQ ID NO: 95504 - DNA, 16 bp, H. sapiens
ctttaacttttgaaaa

SEQ ID NO: 95505 - DNA, 16 bp, H. sapiens
ctttaagaactgtgac

SEQ ID NO: 95506 - DNA, 16 bp, H. sapiens
ctttaagaatattgaa

SEQ ID NO: 95507 - DNA, 16 bp, H. sapiens
ctttaagaatgtggaa

SEQ ID NO: 95508 - DNA, 16 bp, H. sapiens
ctttaagaattttgaa

SEQ ID NO: 95509 - DNA, 16 bp, H. sapiens
ctttaagatttaatga

SEQ ID NO: 95510 - DNA, 16 bp, H. sapiens
ctttaagcagctgttt

SEQ ID NO: 95511 - DNA, 16 bp, H. sapiens
ctttaagcttcagttt

SEQ ID NO: 95512 - DNA, 16 bp, H. sapiens
ctttaaggacttctct

SEQ ID NO: 95513 - DNA, 16 bp, H. sapiens
ctttaagtactgcttt

SEQ ID NO: 95514 - DNA, 16 bp, H. sapiens
ctttaagtcaaaaatt

SEQ ID NO: 95515 - DNA, 16 bp, H. sapiens
ctttaagtcaggagtt

SEQ ID NO: 95516 - DNA, 16 bp, H. sapiens
ctttaagtccattaaa

SEQ ID NO: 95517 - DNA, 16 bp, H. sapiens
ctttaagttttaaggt

SEQ ID NO: 95518 - DNA, 16 bp, H. sapiens
ctttaagttttaggct

SEQ ID NO: 95519 - DNA, 16 bp, H. sapiens
ctttaatagatataga

SEQ ID NO: 95520 - DNA, 16 bp, H. sapiens
ctttaatagtcataga

SEQ ID NO: 95521 - DNA, 25 bp, H. sapiens
ctttaatagtcatagatttaaaaga

SEQ ID NO: 95522 - DNA, 16 bp, H. sapiens
ctttaatatttaatga

SEQ ID NO: 95523 - DNA, 16 bp, H. sapiens
ctttaatattttaatg

SEQ ID NO: 95524 - DNA, 16 bp, H. sapiens
ctttaatccatctgga

SEQ ID NO: 95525 - DNA, 17 bp, H. sapiens
ctttaatctcttaatcc

SEQ ID NO: 95526 - DNA, 16 bp, H. sapiens
ctttaatgtctggctt

SEQ ID NO: 95527 - DNA, 16 bp, H. sapiens
ctttaattagatccca

SEQ ID NO: 95528 - DNA, 16 bp, H. sapiens
ctttaattgctgtcag

SEQ ID NO: 95529 - DNA, 16 bp, H. sapiens
ctttaatttcttgctt

SEQ ID NO: 95530 - DNA, 16 bp, H. sapiens
ctttacaaaaagtaaa

SEQ ID NO: 95531 - DNA, 16 bp, H. sapiens
ctttacaaacaagcaa

SEQ ID NO: 95532 - DNA, 16 bp, H. sapiens
ctttacaaactttttt

SEQ ID NO: 95533 - DNA, 16 bp, H. sapiens
ctttacaatggagaaa

SEQ ID NO: 95534 - DNA, 16 bp, H. sapiens
ctttacagaaaaaaat

SEQ ID NO: 95535 - DNA, 24 bp, H. sapiens
ctttacagacaagcaaatgctgac

SEQ ID NO: 95536 - DNA, 16 bp, H. sapiens
ctttacagagaagcaa

SEQ ID NO: 95537 - DNA, 16 bp, H. sapiens
ctttacagataaggaa

SEQ ID NO: 95538 - DNA, 16 bp, H. sapiens
ctttacagatggagaa

SEQ ID NO: 95539 - DNA, 16 bp, H. sapiens
ctttacagatgggaaa

SEQ ID NO: 95540 - DNA, 16 bp, H. sapiens
ctttacagatggggaa

SEQ ID NO: 95541 - DNA, 16 bp, H. sapiens
ctttacagcaatgcaa

SEQ ID NO: 95542 - DNA, 16 bp, H. sapiens
ctttacagcaatgccc

SEQ ID NO: 95543 - DNA, 16 bp, H. sapiens
ctttacagcagcaccc

SEQ ID NO: 95544 - DNA, 16 bp, H. sapiens
ctttacaggtgaagtg

SEQ ID NO: 95545 - DNA, 16 bp, H. sapiens
ctttacagtttgcaaa

SEQ ID NO: 95546 - DNA, 16 bp, H. sapiens
ctttacatttattagc

SEQ ID NO: 95547 - DNA, 16 bp, H. sapiens
ctttaccaatatgtaa

SEQ ID NO: 95548 - DNA, 16 bp, H. sapiens
ctttacctctctgggc

SEQ ID NO: 95549 - DNA, 16 bp, H. sapiens
ctttacctgtaaaatg

SEQ ID NO: 95550 - DNA, 16 bp, H. sapiens
ctttacctttctctgg

SEQ ID NO: 95551 - DNA, 16 bp, H. sapiens
ctttactattatgaat

SEQ ID NO: 95552 - DNA, 19 bp, H. sapiens
ctttactgaaaatacaaaa

SEQ ID NO: 95553 - DNA, 16 bp, H. sapiens
ctttactgaattaatt

SEQ ID NO: 95554 - DNA, 16 bp, H. sapiens
ctttacttcccagtat

SEQ ID NO: 95555 - DNA, 16 bp, H. sapiens
ctttagaaaaaataaa

SEQ ID NO: 95556 - DNA, 16 bp, H. sapiens
ctttagaaaaattaat

SEQ ID NO: 95557 - DNA, 16 bp, H. sapiens
ctttagaaaatagttt

SEQ ID NO: 95558 - DNA, 16 bp, H. sapiens
ctttagaaggaagtca

SEQ ID NO: 95559 - DNA, 16 bp, H. sapiens
ctttagaaggctgagg

SEQ ID NO: 95560 - DNA, 16 bp, H. sapiens
ctttagaccaaatgga

SEQ ID NO: 95561 - DNA, 16 bp, H. sapiens
ctttagagttttctac

SEQ ID NO: 95562 - DNA, 16 bp, H. sapiens
ctttagatctaaaaga

SEQ ID NO: 95563 - DNA, 16 bp, H. sapiens
ctttagcattttttat

SEQ ID NO: 95564 - DNA, 16 bp, H. sapiens
ctttagcccaggagtt

SEQ ID NO: 95565 - DNA, 16 bp, H. sapiens
ctttagcctcttgagt

SEQ ID NO: 95566 - DNA, 16 bp, H. sapiens
ctttagcctgggcaac

SEQ ID NO: 95567 - DNA, 16 bp, H. sapiens
ctttagctcaggagtt

SEQ ID NO: 95568 - DNA, 16 bp, H. sapiens
ctttagctccagccac

SEQ ID NO: 95569 - DNA, 16 bp, H. sapiens
ctttaggaaaaaaaga

SEQ ID NO: 95570 - DNA, 16 bp, H. sapiens
ctttaggaggtgattg

SEQ ID NO: 95571 - DNA, 16 bp, H. sapiens
ctttaggcctcagaag

SEQ ID NO: 95572 - DNA, 16 bp, H. sapiens
ctttaggtttagtttg

SEQ ID NO: 95573 - DNA, 20 bp, H. sapiens
ctttagtagagatggggttt

SEQ ID NO: 95574 - DNA, 24 bp, H. sapiens
ctttagtgctataaaacagggacc

SEQ ID NO: 95575 - DNA, 16 bp, H. sapiens
ctttagtttaatcaga

SEQ ID NO: 95576 - DNA, 16 bp, H. sapiens
ctttataaaaccatta

SEQ ID NO: 95577 - DNA, 16 bp, H. sapiens
ctttataaaatgaatt

SEQ ID NO: 95578 - DNA, 16 bp, H. sapiens
ctttataaacactgta

SEQ ID NO: 95579 - DNA, 16 bp, H. sapiens
ctttataaattacagt

SEQ ID NO: 95580 - DNA, 16 bp, H. sapiens
ctttataataaatcag

SEQ ID NO: 95581 - DNA, 16 bp, H. sapiens
ctttataatttaccca

SEQ ID NO: 95582 - DNA, 16 bp, H. sapiens
ctttatacaaaaatta

SEQ ID NO: 95583 - DNA, 16 bp, H. sapiens
ctttatacttttctgt

SEQ ID NO: 95584 - DNA, 16 bp, H. sapiens
ctttatagatgaagaa

SEQ ID NO: 95585 - DNA, 16 bp, H. sapiens
ctttatagtaagtctt

SEQ ID NO: 95586 - DNA, 16 bp, H. sapiens
ctttatagtgatgcaa

SEQ ID NO: 95587 - DNA, 16 bp, H. sapiens
ctttatagttttatca

SEQ ID NO: 95588 - DNA, 16 bp, H. sapiens
ctttatatacacatat

SEQ ID NO: 95589 - DNA, 16 bp, H. sapiens
ctttatatattaaaga

SEQ ID NO: 95590 - DNA, 16 bp, H. sapiens
ctttatcatgtaacat

SEQ ID NO: 95591 - DNA, 16 bp, H. sapiens
ctttatccagcttgcc

SEQ ID NO: 95592 - DNA, 16 bp, H. sapiens
ctttatctgagaccac

SEQ ID NO: 95593 - DNA, 16 bp, H. sapiens
ctttatctgcatctat

SEQ ID NO: 95594 - DNA, 16 bp, H. sapiens
ctttatctgtgaaatg

SEQ ID NO: 95595 - DNA, 16 bp, H. sapiens
ctttatgagaaataaa

SEQ ID NO: 95596 - DNA, 16 bp, H. sapiens
ctttatgcctcagttt

SEQ ID NO: 95597 - DNA, 16 bp, H. sapiens
ctttatgggaggcaga

SEQ ID NO: 95598 - DNA, 16 bp, H. sapiens
ctttatgtctagctca

SEQ ID NO: 95599 - DNA, 16 bp, H. sapiens
ctttatgtctctgtgt

SEQ ID NO: 95600 - DNA, 16 bp, H. sapiens
ctttatgtgtgtgtgt

SEQ ID NO: 95601 - DNA, 16 bp, H. sapiens
ctttattaaaaataca

SEQ ID NO: 95602 - DNA, 16 bp, H. sapiens
ctttattaaaactaaa

SEQ ID NO: 95603 - DNA, 16 bp, H. sapiens
ctttattattgtacac

SEQ ID NO: 95604 - DNA, 16 bp, H. sapiens
ctttattcagtctacc

SEQ ID NO: 95605 - DNA, 16 bp, H. sapiens
ctttattcataatcac

SEQ ID NO: 95606 - DNA, 16 bp, H. sapiens
ctttattcctgaagga

SEQ ID NO: 95607 - DNA, 16 bp, H. sapiens
ctttattgcaatattt

SEQ ID NO: 95608 - DNA, 16 bp, H. sapiens
ctttattgtccatatt

SEQ ID NO: 95609 - DNA, 16 bp, H. sapiens
ctttatttatgaagct

SEQ ID NO: 95610 - DNA, 16 bp, H. sapiens
ctttatttctaaaaat

SEQ ID NO: 95611 - DNA, 16 bp, H. sapiens
ctttatttctcaacat

SEQ ID NO: 95612 - DNA, 16 bp, H. sapiens
ctttatttcttcatac

SEQ ID NO: 95613 - DNA, 16 bp, H. sapiens
ctttatttgaaatgat

SEQ ID NO: 95614 - DNA, 16 bp, H. sapiens
ctttatttgcagtgtg

SEQ ID NO: 95615 - DNA, 16 bp, H. sapiens
ctttattttaaattgt

SEQ ID NO: 95616 - DNA, 16 bp, H. sapiens
ctttattttaccttca

SEQ ID NO: 95617 - DNA, 16 bp, H. sapiens
ctttattttactgtgg

SEQ ID NO: 95618 - DNA, 16 bp, H. sapiens
ctttattttatgtaaa

SEQ ID NO: 95619 - DNA, 16 bp, H. sapiens
ctttattttctgaaaa

SEQ ID NO: 95620 - DNA, 16 bp, H. sapiens
ctttattttcttctgc

SEQ ID NO: 95621 - DNA, 16 bp, H. sapiens
ctttattttcttgtaa

SEQ ID NO: 95622 - DNA, 16 bp, H. sapiens
ctttatttttcaaaac

SEQ ID NO: 95623 - DNA, 16 bp, H. sapiens
ctttattttttagagc

SEQ ID NO: 95624 - DNA, 16 bp, H. sapiens
ctttatttttttagag

SEQ ID NO: 95625 - DNA, 17 bp, H. sapiens
ctttatttttttgagac

SEQ ID NO: 95626 - DNA, 16 bp, H. sapiens
ctttcaaaagaaaaca

SEQ ID NO: 95627 - DNA, 16 bp, H. sapiens
ctttcaaaagaaaggt

SEQ ID NO: 95628 - DNA, 16 bp, H. sapiens
ctttcaaaagcaaata

SEQ ID NO: 95629 - DNA, 16 bp, H. sapiens
ctttcaaaatattatt

SEQ ID NO: 95630 - DNA, 16 bp, H. sapiens
ctttcaaatataattt

SEQ ID NO: 95631 - DNA, 16 bp, H. sapiens
ctttcaagacagcatc

SEQ ID NO: 95632 - DNA, 16 bp, H. sapiens
ctttcaagcaaaaatt

SEQ ID NO: 95633 - DNA, 16 bp, H. sapiens
ctttcaaggaattggt

SEQ ID NO: 95634 - DNA, 16 bp, H. sapiens
ctttcaatgacaaaaa

SEQ ID NO: 95635 - DNA, 16 bp, H. sapiens
ctttcaattcttttgg

SEQ ID NO: 95636 - DNA, 16 bp, H. sapiens
ctttcaattgagcagt

SEQ ID NO: 95637 - DNA, 16 bp, H. sapiens
ctttcaattgtatttt

SEQ ID NO: 95638 - DNA, 16 bp, H. sapiens
ctttcacagagtagaa

SEQ ID NO: 95639 - DNA, 16 bp, H. sapiens
ctttcaccaatgtttt

SEQ ID NO: 95640 - DNA, 16 bp, H. sapiens
ctttcaccatgtgagg

SEQ ID NO: 95641 - DNA, 16 bp, H. sapiens
ctttcaccttccacca

SEQ ID NO: 95642 - DNA, 16 bp, H. sapiens
ctttcactattaagta

SEQ ID NO: 95643 - DNA, 16 bp, H. sapiens
ctttcactcctgctct

SEQ ID NO: 95644 - DNA, 16 bp, H. sapiens
ctttcactctcactgc

SEQ ID NO: 95645 - DNA, 16 bp, H. sapiens
ctttcactgtaataaa

SEQ ID NO: 95646 - DNA, 16 bp, H. sapiens
ctttcagaactgtgag

SEQ ID NO: 95647 - DNA, 16 bp, H. sapiens
ctttcagaatgttgaa

SEQ ID NO: 95648 - DNA, 16 bp, H. sapiens
ctttcagacttttttt

SEQ ID NO: 95649 - DNA, 16 bp, H. sapiens
ctttcagatgactgca

SEQ ID NO: 95650 - DNA, 16 bp, H. sapiens
ctttcagatttctctt

SEQ ID NO: 95651 - DNA, 16 bp, H. sapiens
ctttcagcagagtttt

SEQ ID NO: 95652 - DNA, 16 bp, H. sapiens
ctttcagcattgaaca

SEQ ID NO: 95653 - DNA, 16 bp, H. sapiens
ctttcagccccaccct

SEQ ID NO: 95654 - DNA, 16 bp, H. sapiens
ctttcagcctccaaaa

SEQ ID NO: 95655 - DNA, 16 bp, H. sapiens
ctttcagctccagttt

SEQ ID NO: 95656 - DNA, 16 bp, H. sapiens
ctttcagtagtttcat

SEQ ID NO: 95657 - DNA, 16 bp, H. sapiens
ctttcagtcatggcag

SEQ ID NO: 95658 - DNA, 16 bp, H. sapiens
ctttcagtgatatgaa

SEQ ID NO: 95659 - DNA, 16 bp, H. sapiens
ctttcagtgcctggct

SEQ ID NO: 95660 - DNA, 16 bp, H. sapiens
ctttcagttacaccaa

SEQ ID NO: 95661 - DNA, 16 bp, H. sapiens
ctttcagttctgctct

SEQ ID NO: 95662 - DNA, 16 bp, H. sapiens
ctttcagttctttgaa

SEQ ID NO: 95663 - DNA, 16 bp, H. sapiens
ctttcagtttcctcat

SEQ ID NO: 95664 - DNA, 16 bp, H. sapiens
ctttcagttttaaaac

SEQ ID NO: 95665 - DNA, 16 bp, H. sapiens
ctttcataaaatattt

SEQ ID NO: 95666 - DNA, 16 bp, H. sapiens
ctttcataactagaga

SEQ ID NO: 95667 - DNA, 16 bp, H. sapiens
ctttcatagctagaga

SEQ ID NO: 95668 - DNA, 16 bp, H. sapiens
ctttcatatttctgtg

SEQ ID NO: 95669 - DNA, 16 bp, H. sapiens
ctttcatgaaaggaaa

SEQ ID NO: 95670 - DNA, 16 bp, H. sapiens
ctttcattaatgtttt

SEQ ID NO: 95671 - DNA, 16 bp, H. sapiens
ctttcattccacaaac

SEQ ID NO: 95672 - DNA, 16 bp, H. sapiens
ctttcattcctcagaa

SEQ ID NO: 95673 - DNA, 16 bp, H. sapiens
ctttccaaaatataaa

SEQ ID NO: 95674 - DNA, 16 bp, H. sapiens
ctttccaaagaaccag

SEQ ID NO: 95675 - DNA, 16 bp, H. sapiens
ctttccaaaggcagag

SEQ ID NO: 95676 - DNA, 16 bp, H. sapiens
ctttccaaagtgactg

SEQ ID NO: 95677 - DNA, 16 bp, H. sapiens
ctttccaaatatccac

SEQ ID NO: 95678 - DNA, 16 bp, H. sapiens
ctttccaacctccaga

SEQ ID NO: 95679 - DNA, 16 bp, H. sapiens
ctttccaacttctgtc

SEQ ID NO: 95680 - DNA, 16 bp, H. sapiens
ctttccaccatgattg

SEQ ID NO: 95681 - DNA, 16 bp, H. sapiens
ctttccacctcagcct

SEQ ID NO: 95682 - DNA, 16 bp, H. sapiens
ctttccagatattcaa

SEQ ID NO: 95683 - DNA, 16 bp, H. sapiens
ctttccagtccatttc

SEQ ID NO: 95684 - DNA, 16 bp, H. sapiens
ctttccagtttaaaaa

SEQ ID NO: 95685 - DNA, 16 bp, H. sapiens
ctttccagtttttctc

SEQ ID NO: 95686 - DNA, 16 bp, H. sapiens
ctttccatctctgtgt

SEQ ID NO: 95687 - DNA, 16 bp, H. sapiens
ctttccatgtaaattt

SEQ ID NO: 95688 - DNA, 16 bp, H. sapiens
ctttccatttatttaa

SEQ ID NO: 95689 - DNA, 16 bp, H. sapiens
ctttccatttccttgg

SEQ ID NO: 95690 - DNA, 16 bp, H. sapiens
ctttcccaacccactg

SEQ ID NO: 95691 - DNA, 16 bp, H. sapiens
ctttcccacttccaca

SEQ ID NO: 95692 - DNA, 16 bp, H. sapiens
ctttcccagagcctcc

SEQ ID NO: 95693 - DNA, 16 bp, H. sapiens
ctttcccagctcctgg

SEQ ID NO: 95694 - DNA, 16 bp, H. sapiens
ctttccccactgtgtg

SEQ ID NO: 95695 - DNA, 16 bp, H. sapiens
ctttccccagccacct

SEQ ID NO: 95696 - DNA, 16 bp, H. sapiens
ctttccccattccttg

SEQ ID NO: 95697 - DNA, 16 bp, H. sapiens
ctttcccctcccccag

SEQ ID NO: 95698 - DNA, 20 bp, H. sapiens
ctttcccggtctgctaagta

SEQ ID NO: 95699 - DNA, 16 bp, H. sapiens
ctttccctcccacctg

SEQ ID NO: 95700 - DNA, 16 bp, H. sapiens
ctttccctggcactgg

SEQ ID NO: 95701 - DNA, 16 bp, H. sapiens
ctttcccttctcagaa

SEQ ID NO: 95702 - DNA, 16 bp, H. sapiens
ctttccctttttaaaa

SEQ ID NO: 95703 - DNA, 16 bp, H. sapiens
ctttcctacatcttcc

SEQ ID NO: 95704 - DNA, 16 bp, H. sapiens
ctttcctagcaaaggg

SEQ ID NO: 95705 - DNA, 16 bp, H. sapiens
ctttcctcattgaatg

SEQ ID NO: 95706 - DNA, 16 bp, H. sapiens
ctttcctccacttgat

SEQ ID NO: 95707 - DNA, 16 bp, H. sapiens
ctttcctctgaggagg

SEQ ID NO: 95708 - DNA, 16 bp, H. sapiens
ctttcctctggaagct

SEQ ID NO: 95709 - DNA, 16 bp, H. sapiens
ctttcctcttccagct

SEQ ID NO: 95710 - DNA, 16 bp, H. sapiens
ctttcctgacacctgg

SEQ ID NO: 95711 - DNA, 16 bp, H. sapiens
ctttcctgagctccag

SEQ ID NO: 95712 - DNA, 16 bp, H. sapiens
ctttcctgcctctgtg

SEQ ID NO: 95713 - DNA, 16 bp, H. sapiens
ctttcctgctctaaag

SEQ ID NO: 95714 - DNA, 16 bp, H. sapiens
ctttcctgcttaaaat

SEQ ID NO: 95715 - DNA, 16 bp, H. sapiens
ctttcctgggcagagg

SEQ ID NO: 95716 - DNA, 16 bp, H. sapiens
ctttcctggtcgtgtg

SEQ ID NO: 95717 - DNA, 16 bp, H. sapiens
ctttcctggttctcca

SEQ ID NO: 95718 - DNA, 16 bp, H. sapiens
ctttccttggcctccc

SEQ ID NO: 95719 - DNA, 16 bp, H. sapiens
ctttcctttaaaatta

SEQ ID NO: 95720 - DNA, 16 bp, H. sapiens
ctttcctttgatagag

SEQ ID NO: 95721 - DNA, 16 bp, H. sapiens
ctttcctttgtaagtt

SEQ ID NO: 95722 - DNA, 16 bp, H. sapiens
ctttcctttgtcttga

SEQ ID NO: 95723 - DNA, 16 bp, H. sapiens
ctttccttttaaatgt

SEQ ID NO: 95724 - DNA, 16 bp, H. sapiens
ctttcctttttctaaa

SEQ ID NO: 95725 - DNA, 16 bp, H. sapiens
ctttctaaaactaaaa

SEQ ID NO: 95726 - DNA, 16 bp, H. sapiens
ctttctaaaccaaagt

SEQ ID NO: 95727 - DNA, 16 bp, H. sapiens
ctttctaaagaaaaac

SEQ ID NO: 95728 - DNA, 16 bp, H. sapiens
ctttctaaataaactt

SEQ ID NO: 95729 - DNA, 16 bp, H. sapiens
ctttctaacaggccca

SEQ ID NO: 95730 - DNA, 16 bp, H. sapiens
ctttctaagaaagaaa

SEQ ID NO: 95731 - DNA, 16 bp, H. sapiens
ctttctacacagacac

SEQ ID NO: 95732 - DNA, 16 bp, H. sapiens
ctttctattcaataaa

SEQ ID NO: 95733 - DNA, 16 bp, H. sapiens
ctttctatttcatcat

SEQ ID NO: 95734 - DNA, 16 bp, H. sapiens
ctttctcaaaaaagaa

SEQ ID NO: 95735 - DNA, 16 bp, H. sapiens
ctttctcaaaaaataa

SEQ ID NO: 95736 - DNA, 16 bp, H. sapiens
ctttctcaaaacactc

SEQ ID NO: 95737 - DNA, 16 bp, H. sapiens
ctttctcacattttcc

SEQ ID NO: 95738 - DNA, 16 bp, H. sapiens
ctttctcagaaaaaaa

SEQ ID NO: 95739 - DNA, 16 bp, H. sapiens
ctttctcagaaagaaa

SEQ ID NO: 95740 - DNA, 16 bp, H. sapiens
ctttctcagacaaaca

SEQ ID NO: 95741 - DNA, 16 bp, H. sapiens
ctttctcagcctcctg

SEQ ID NO: 95742 - DNA, 16 bp, H. sapiens
ctttctcagcctctct

SEQ ID NO: 95743 - DNA, 16 bp, H. sapiens
ctttctcaggaatgcc

SEQ ID NO: 95744 - DNA, 16 bp, H. sapiens
ctttctcatctgtaaa

SEQ ID NO: 95745 - DNA, 16 bp, H. sapiens
ctttctcatgatttac

SEQ ID NO: 95746 - DNA, 16 bp, H. sapiens
ctttctccacagaatt

SEQ ID NO: 95747 - DNA, 16 bp, H. sapiens
ctttctccacagcctt

SEQ ID NO: 95748 - DNA, 16 bp, H. sapiens
ctttctccagcccctg

SEQ ID NO: 95749 - DNA, 16 bp, H. sapiens
ctttctccatcttcaa

SEQ ID NO: 95750 - DNA, 16 bp, H. sapiens
ctttctcccctgctgg

SEQ ID NO: 95751 - DNA, 16 bp, H. sapiens
ctttctcccgtgctgg

SEQ ID NO: 95752 - DNA, 16 bp, H. sapiens
ctttctccctgagtcc

SEQ ID NO: 95753 - DNA, 16 bp, H. sapiens
ctttctccctggctgc

SEQ ID NO: 95754 - DNA, 16 bp, H. sapiens
ctttctccttcctgat

SEQ ID NO: 95755 - DNA, 16 bp, H. sapiens
ctttctctagttttct

SEQ ID NO: 95756 - DNA, 16 bp, H. sapiens
ctttctctattgaatt

SEQ ID NO: 95757 - DNA, 16 bp, H. sapiens
ctttctctctctctaa

SEQ ID NO: 95758 - DNA, 16 bp, H. sapiens
ctttctctctggcttc

SEQ ID NO: 95759 - DNA, 16 bp, H. sapiens
ctttctctctgtctca

SEQ ID NO: 95760 - DNA, 16 bp, H. sapiens
ctttctctgaaaaaaa

SEQ ID NO: 95761 - DNA, 16 bp, H. sapiens
ctttctctgaattttt

SEQ ID NO: 95762 - DNA, 16 bp, H. sapiens
ctttctctgggcacca

SEQ ID NO: 95763 - DNA, 16 bp, H. sapiens
ctttctctgggtgcca

SEQ ID NO: 95764 - DNA, 16 bp, H. sapiens
ctttctctgtgcctca

SEQ ID NO: 95765 - DNA, 16 bp, H. sapiens
ctttctctgtgccttc

SEQ ID NO: 95766 - DNA, 16 bp, H. sapiens
ctttctctgtgtgtgt

SEQ ID NO: 95767 - DNA, 16 bp, H. sapiens
ctttctcttcctggct

SEQ ID NO: 95768 - DNA, 16 bp, H. sapiens
ctttctcttgctcctg

SEQ ID NO: 95769 - DNA, 16 bp, H. sapiens
ctttctctttcctgat

SEQ ID NO: 95770 - DNA, 16 bp, H. sapiens
ctttctctttgacttt

SEQ ID NO: 95771 - DNA, 16 bp, H. sapiens
ctttctctttttccag

SEQ ID NO: 95772 - DNA, 16 bp, H. sapiens
ctttctgaaataattt

SEQ ID NO: 95773 - DNA, 16 bp, H. sapiens
ctttctgagagactgc

SEQ ID NO: 95774 - DNA, 16 bp, H. sapiens
ctttctgatggagtct

SEQ ID NO: 95775 - DNA, 16 bp, H. sapiens
ctttctgattggtgag

SEQ ID NO: 95776 - DNA, 16 bp, H. sapiens
ctttctgctcctggct

SEQ ID NO: 95777 - DNA, 16 bp, H. sapiens
ctttctgctgacttca

SEQ ID NO: 95778 - DNA, 16 bp, H. sapiens
ctttctgcttcagcct

SEQ ID NO: 95779 - DNA, 16 bp, H. sapiens
ctttctggaaaagaaa

SEQ ID NO: 95780 - DNA, 16 bp, H. sapiens
ctttctggaaaaggca

SEQ ID NO: 95781 - DNA, 16 bp, H. sapiens
ctttctggaggaggtg

SEQ ID NO: 95782 - DNA, 16 bp, H. sapiens
ctttctggctgcttgt

SEQ ID NO: 95783 - DNA, 16 bp, H. sapiens
ctttctgggccaaacc

SEQ ID NO: 95784 - DNA, 16 bp, H. sapiens
ctttctgggcctggct

SEQ ID NO: 95785 - DNA, 16 bp, H. sapiens
ctttctgggctcaagt

SEQ ID NO: 95786 - DNA, 16 bp, H. sapiens
ctttctgtatttagtg

SEQ ID NO: 95787 - DNA, 16 bp, H. sapiens
ctttctgtcactatag

SEQ ID NO: 95788 - DNA, 16 bp, H. sapiens
ctttctgtctctgtcc

SEQ ID NO: 95789 - DNA, 16 bp, H. sapiens
ctttctgtgccaggct

SEQ ID NO: 95790 - DNA, 16 bp, H. sapiens
ctttctgtgcctagtt

SEQ ID NO: 95791 - DNA, 16 bp, H. sapiens
ctttctgttctcatga

SEQ ID NO: 95792 - DNA, 16 bp, H. sapiens
ctttctgtttccattt

SEQ ID NO: 95793 - DNA, 16 bp, H. sapiens
ctttctgttttggaag

SEQ ID NO: 95794 - DNA, 16 bp, H. sapiens
ctttcttaaaacattt

SEQ ID NO: 95795 - DNA, 16 bp, H. sapiens
ctttcttagcattttt

SEQ ID NO: 95796 - DNA, 16 bp, H. sapiens
ctttcttatataaaat

SEQ ID NO: 95797 - DNA, 16 bp, H. sapiens
ctttcttcacagaagt

SEQ ID NO: 95798 - DNA, 16 bp, H. sapiens
ctttcttcagcctttt

SEQ ID NO: 95799 - DNA, 16 bp, H. sapiens
ctttcttcagtgtttt

SEQ ID NO: 95800 - DNA, 16 bp, H. sapiens
ctttcttcatagaatt

SEQ ID NO: 95801 - DNA, 16 bp, H. sapiens
ctttcttcctcagctt

SEQ ID NO: 95802 - DNA, 16 bp, H. sapiens
ctttcttccttcctga

SEQ ID NO: 95803 - DNA, 16 bp, H. sapiens
ctttcttctctggctg

SEQ ID NO: 95804 - DNA, 16 bp, H. sapiens
ctttcttctgcctggt

SEQ ID NO: 95805 - DNA, 16 bp, H. sapiens
ctttcttctgctgagt

SEQ ID NO: 95806 - DNA, 16 bp, H. sapiens
ctttcttctggaaatt

SEQ ID NO: 95807 - DNA, 16 bp, H. sapiens
ctttcttctttgtcac

SEQ ID NO: 95808 - DNA, 16 bp, H. sapiens
ctttctttccaattta

SEQ ID NO: 95809 - DNA, 16 bp, H. sapiens
ctttctttctggctgc

SEQ ID NO: 95810 - DNA, 16 bp, H. sapiens
ctttctttgacttgga

SEQ ID NO: 95811 - DNA, 16 bp, H. sapiens
ctttctttggaggcag

SEQ ID NO: 95812 - DNA, 16 bp, H. sapiens
ctttcttttcagaaat

SEQ ID NO: 95813 - DNA, 16 bp, H. sapiens
ctttcttttgaatgag

SEQ ID NO: 95814 - DNA, 16 bp, H. sapiens
ctttcttttgacaggg

SEQ ID NO: 95815 - DNA, 16 bp, H. sapiens
ctttcttttgcttgat

SEQ ID NO: 95816 - DNA, 16 bp, H. sapiens
ctttcttttgtaaatt

SEQ ID NO: 95817 - DNA, 16 bp, H. sapiens
ctttcttttgtacatt

SEQ ID NO: 95818 - DNA, 16 bp, H. sapiens
ctttcttttgtgaatt

SEQ ID NO: 95819 - DNA, 16 bp, H. sapiens
ctttcttttttatggc

SEQ ID NO: 95820 - DNA, 16 bp, H. sapiens
ctttgaaaaaaatgct

SEQ ID NO: 95821 - DNA, 16 bp, H. sapiens
ctttgaaaaaacttta

SEQ ID NO: 95822 - DNA, 16 bp, H. sapiens
ctttgaaaaaatataa

SEQ ID NO: 95823 - DNA, 16 bp, H. sapiens
ctttgaaaaagaaaaa

SEQ ID NO: 95824 - DNA, 16 bp, H. sapiens
ctttgaaaaagaagaa

SEQ ID NO: 95825 - DNA, 16 bp, H. sapiens
ctttgaaaaatagttt

SEQ ID NO: 95826 - DNA, 16 bp, H. sapiens
ctttgaaaacaaaaga

SEQ ID NO: 95827 - DNA, 16 bp, H. sapiens
ctttgaaaacaatgag

SEQ ID NO: 95828 - DNA, 16 bp, H. sapiens
ctttgaaaactggaac

SEQ ID NO: 95829 - DNA, 16 bp, H. sapiens
ctttgaaaagcagttt

SEQ ID NO: 95830 - DNA, 16 bp, H. sapiens
ctttgaaaatattttt

SEQ ID NO: 95831 - DNA, 16 bp, H. sapiens
ctttgaaaatgaaaaa

SEQ ID NO: 95832 - DNA, 16 bp, H. sapiens
ctttgaaaatgctttg

SEQ ID NO: 95833 - DNA, 16 bp, H. sapiens
ctttgaaaatgtaaat

SEQ ID NO: 95834 - DNA, 16 bp, H. sapiens
ctttgaaaatgttttt

SEQ ID NO: 95835 - DNA, 16 bp, H. sapiens
ctttgaaacaaccaat

SEQ ID NO: 95836 - DNA, 16 bp, H. sapiens
ctttgaaaggctgaag

SEQ ID NO: 95837 - DNA, 16 bp, H. sapiens
ctttgaaataaatatt

SEQ ID NO: 95838 - DNA, 16 bp, H. sapiens
ctttgaaatattaaaa

SEQ ID NO: 95839 - DNA, 16 bp, H. sapiens
ctttgaaatatttgaa

SEQ ID NO: 95840 - DNA, 16 bp, H. sapiens
ctttgaaatgtataaa

SEQ ID NO: 95841 - DNA, 16 bp, H. sapiens
ctttgaaattgtttta

SEQ ID NO: 95842 - DNA, 16 bp, H. sapiens
ctttgaaattttcttt

SEQ ID NO: 95843 - DNA, 16 bp, H. sapiens
ctttgaacccaaactg

SEQ ID NO: 95844 - DNA, 16 bp, H. sapiens
ctttgaacctcagttt

SEQ ID NO: 95845 - DNA, 16 bp, H. sapiens
ctttgaacttgaaaga

SEQ ID NO: 95846 - DNA, 16 bp, H. sapiens
ctttgaagaaaatgaa

SEQ ID NO: 95847 - DNA, 16 bp, H. sapiens
ctttgaagagagaagt

SEQ ID NO: 95848 - DNA, 16 bp, H. sapiens
ctttgaagagagtagc

SEQ ID NO: 95849 - DNA, 16 bp, H. sapiens
ctttgaagatgaaaga

SEQ ID NO: 95850 - DNA, 16 bp, H. sapiens
ctttgaagatgaagaa

SEQ ID NO: 95851 - DNA, 16 bp, H. sapiens
ctttgaagatgaagga

SEQ ID NO: 95852 - DNA, 16 bp, H. sapiens
ctttgaagatggaagg

SEQ ID NO: 95853 - DNA, 16 bp, H. sapiens
ctttgaagatgtgatt

SEQ ID NO: 95854 - DNA, 19 bp, H. sapiens
ctttgaagcaactgtgaat

SEQ ID NO: 95855 - DNA, 16 bp, H. sapiens
ctttgaagcagttgtg

SEQ ID NO: 95856 - DNA, 16 bp, H. sapiens
ctttgaagctctgaag

SEQ ID NO: 95857 - DNA, 16 bp, H. sapiens
ctttgaaggaagcaga

SEQ ID NO: 95858 - DNA, 16 bp, H. sapiens
ctttgaaggctgaggc

SEQ ID NO: 95859 - DNA, 16 bp, H. sapiens
ctttgaataaaataaa

SEQ ID NO: 95860 - DNA, 16 bp, H. sapiens
ctttgaatagaccaat

SEQ ID NO: 95861 - DNA, 16 bp, H. sapiens
ctttgaatatattttt

SEQ ID NO: 95862 - DNA, 16 bp, H. sapiens
ctttgaatcatctcta

SEQ ID NO: 95863 - DNA, 16 bp, H. sapiens
ctttgaatgtggccca

SEQ ID NO: 95864 - DNA, 16 bp, H. sapiens
ctttgaatgtgtttgc

SEQ ID NO: 95865 - DNA, 16 bp, H. sapiens
ctttgaattaattttt

SEQ ID NO: 95866 - DNA, 16 bp, H. sapiens
ctttgaattattttct

SEQ ID NO: 95867 - DNA, 16 bp, H. sapiens
ctttgaattctttttc

SEQ ID NO: 95868 - DNA, 16 bp, H. sapiens
ctttgaatttattttg

SEQ ID NO: 95869 - DNA, 16 bp, H. sapiens
ctttgacaaaccagac

SEQ ID NO: 95870 - DNA, 16 bp, H. sapiens
ctttgacaaacctgac

SEQ ID NO: 95871 - DNA, 16 bp, H. sapiens
ctttgacaccatgtct

SEQ ID NO: 95872 - DNA, 16 bp, H. sapiens
ctttgacagttgagtg

SEQ ID NO: 95873 - DNA, 16 bp, H. sapiens
ctttgactatttgggg

SEQ ID NO: 95874 - DNA, 16 bp, H. sapiens
ctttgactggaatggt

SEQ ID NO: 95875 - DNA, 16 bp, H. sapiens
ctttgacttggggttt

SEQ ID NO: 95876 - DNA, 16 bp, H. sapiens
ctttgactttctgtgt

SEQ ID NO: 95877 - DNA, 16 bp, H. sapiens
ctttgacttttaaaaa

SEQ ID NO: 95878 - DNA, 16 bp, H. sapiens
ctttgagaaattttca

SEQ ID NO: 95879 - DNA, 16 bp, H. sapiens
ctttgagaaccactgc

SEQ ID NO: 95880 - DNA, 16 bp, H. sapiens
ctttgagacatctcca

SEQ ID NO: 95881 - DNA, 16 bp, H. sapiens
ctttgagaggatgagg

SEQ ID NO: 95882 - DNA, 16 bp, H. sapiens
ctttgagaggccaaga

SEQ ID NO: 95883 - DNA, 16 bp, H. sapiens
ctttgagataaatgaa

SEQ ID NO: 95884 - DNA, 16 bp, H. sapiens
ctttgagatggggtct

SEQ ID NO: 95885 - DNA, 16 bp, H. sapiens
ctttgagcatcatgtt

SEQ ID NO: 95886 - DNA, 16 bp, H. sapiens
ctttgagcatttttaa

SEQ ID NO: 95887 - DNA, 16 bp, H. sapiens
ctttgagcctcagctt

SEQ ID NO: 95888 - DNA, 16 bp, H. sapiens
ctttgagctcctgggc

SEQ ID NO: 95889 - DNA, 16 bp, H. sapiens
ctttgagctctgaagt

SEQ ID NO: 95890 - DNA, 16 bp, H. sapiens
ctttgaggaaaaaaaa

SEQ ID NO: 95891 - DNA, 16 bp, H. sapiens
ctttgaggaattgcca

SEQ ID NO: 95892 - DNA, 16 bp, H. sapiens
ctttgagggaaaaaaa

SEQ ID NO: 95893 - DNA, 16 bp, H. sapiens
ctttgaggtagatatt

SEQ ID NO: 95894 - DNA, 16 bp, H. sapiens
ctttgagtcttggttt

SEQ ID NO: 95895 - DNA, 16 bp, H. sapiens
ctttgagtttcctcag

SEQ ID NO: 95896 - DNA, 16 bp, H. sapiens
ctttgatattaaaaat

SEQ ID NO: 95897 - DNA, 16 bp, H. sapiens
ctttgatctcattatt

SEQ ID NO: 95898 - DNA, 16 bp, H. sapiens
ctttgatcttggactt

SEQ ID NO: 95899 - DNA, 16 bp, H. sapiens
ctttgatgaagtgtct

SEQ ID NO: 95900 - DNA, 16 bp, H. sapiens
ctttgatgatgatgac

SEQ ID NO: 95901 - DNA, 16 bp, H. sapiens
ctttgatgcccttgag

SEQ ID NO: 95902 - DNA, 16 bp, H. sapiens
ctttgattactatagc

SEQ ID NO: 95903 - DNA, 16 bp, H. sapiens
ctttgattttggactt

SEQ ID NO: 95904 - DNA, 16 bp, H. sapiens
ctttgcaaaaattata

SEQ ID NO: 95905 - DNA, 16 bp, H. sapiens
ctttgcaaatataatt

SEQ ID NO: 95906 - DNA, 16 bp, H. sapiens
ctttgcaactgggtaa

SEQ ID NO: 95907 - DNA, 16 bp, H. sapiens
ctttgcacatgctgtt

SEQ ID NO: 95908 - DNA, 16 bp, H. sapiens
ctttgcacgtgctgtt

SEQ ID NO: 95909 - DNA, 16 bp, H. sapiens
ctttgcacttgccatt

SEQ ID NO: 95910 - DNA, 16 bp, H. sapiens
ctttgcagacaacatg

SEQ ID NO: 95911 - DNA, 16 bp, H. sapiens
ctttgcagacactccc

SEQ ID NO: 95912 - DNA, 16 bp, H. sapiens
ctttgcagatgatatg

SEQ ID NO: 95913 - DNA, 16 bp, H. sapiens
ctttgcagatggagga

SEQ ID NO: 95914 - DNA, 16 bp, H. sapiens
ctttgcagatgtgatt

SEQ ID NO: 95915 - DNA, 16 bp, H. sapiens
ctttgcagattctaaa

SEQ ID NO: 95916 - DNA, 16 bp, H. sapiens
ctttgcagattctaca

SEQ ID NO: 95917 - DNA, 16 bp, H. sapiens
ctttgcagcagctgct

SEQ ID NO: 95918 - DNA, 16 bp, H. sapiens
ctttgcaggcacatgg

SEQ ID NO: 95919 - DNA, 16 bp, H. sapiens
ctttgcatttatttat

SEQ ID NO: 95920 - DNA, 16 bp, H. sapiens
ctttgcatttcttctt

SEQ ID NO: 95921 - DNA, 16 bp, H. sapiens
ctttgcatttgctgtt

SEQ ID NO: 95922 - DNA, 16 bp, H. sapiens
ctttgcattttagttt

SEQ ID NO: 95923 - DNA, 16 bp, H. sapiens
ctttgccaacatctgt

SEQ ID NO: 95924 - DNA, 16 bp, H. sapiens
ctttgccagctgccat

SEQ ID NO: 95925 - DNA, 16 bp, H. sapiens
ctttgccaggttttga

SEQ ID NO: 95926 - DNA, 16 bp, H. sapiens
ctttgccatgaaatct

SEQ ID NO: 95927 - DNA, 16 bp, H. sapiens
ctttgccattgtgaac

SEQ ID NO: 95928 - DNA, 16 bp, H. sapiens
ctttgcccagatccat

SEQ ID NO: 95929 - DNA, 16 bp, H. sapiens
ctttgcccattgttta

SEQ ID NO: 95930 - DNA, 16 bp, H. sapiens
ctttgcccatttttct

SEQ ID NO: 95931 - DNA, 19 bp, H. sapiens
ctttgccccagccactttg

SEQ ID NO: 95932 - DNA, 16 bp, H. sapiens
ctttgccctccaccat

SEQ ID NO: 95933 - DNA, 16 bp, H. sapiens
ctttgcccttctgcca

SEQ ID NO: 95934 - DNA, 16 bp, H. sapiens
ctttgcctccattttc

SEQ ID NO: 95935 - DNA, 16 bp, H. sapiens
ctttgcctcttttgat

SEQ ID NO: 95936 - DNA, 16 bp, H. sapiens
ctttgcctgagttctt

SEQ ID NO: 95937 - DNA, 16 bp, H. sapiens
ctttgcctgtttttta

SEQ ID NO: 95938 - DNA, 16 bp, H. sapiens
ctttgccttatttgaa

SEQ ID NO: 95939 - DNA, 16 bp, H. sapiens
ctttgccttccactat

SEQ ID NO: 95940 - DNA, 16 bp, H. sapiens
ctttgccttcctccat

SEQ ID NO: 95941 - DNA, 16 bp, H. sapiens
ctttgcctttaaaaaa

SEQ ID NO: 95942 - DNA, 16 bp, H. sapiens
ctttgcctttgatttt

SEQ ID NO: 95943 - DNA, 16 bp, H. sapiens
ctttgctaaaataaaa

SEQ ID NO: 95944 - DNA, 16 bp, H. sapiens
ctttgctacactgaga

SEQ ID NO: 95945 - DNA, 16 bp, H. sapiens
ctttgctattgcaaat

SEQ ID NO: 95946 - DNA, 16 bp, H. sapiens
ctttgctcacatgttt

SEQ ID NO: 95947 - DNA, 16 bp, H. sapiens
ctttgctcatttttct

SEQ ID NO: 95948 - DNA, 16 bp, H. sapiens
ctttgctccagccctg

SEQ ID NO: 95949 - DNA, 16 bp, H. sapiens
ctttgctccagcctgg

SEQ ID NO: 95950 - DNA, 16 bp, H. sapiens
ctttgctccagttccc

SEQ ID NO: 95951 - DNA, 16 bp, H. sapiens
ctttgctcctgcatct

SEQ ID NO: 95952 - DNA, 16 bp, H. sapiens
ctttgctgaaaatcag

SEQ ID NO: 95953 - DNA, 16 bp, H. sapiens
ctttgctgaagttgtc

SEQ ID NO: 95954 - DNA, 16 bp, H. sapiens
ctttgctgaatttttt

SEQ ID NO: 95955 - DNA, 16 bp, H. sapiens
ctttgctgatgttgct

SEQ ID NO: 95956 - DNA, 16 bp, H. sapiens
ctttgctgctctgcag

SEQ ID NO: 95957 - DNA, 16 bp, H. sapiens
ctttgctgctgctgct

SEQ ID NO: 95958 - DNA, 16 bp, H. sapiens
ctttgctgctgtgaat

SEQ ID NO: 95959 - DNA, 16 bp, H. sapiens
ctttgctgggtatagt

SEQ ID NO: 95960 - DNA, 16 bp, H. sapiens
ctttgctgtctgtgtg

SEQ ID NO: 95961 - DNA, 16 bp, H. sapiens
ctttgctgtgtagaag

SEQ ID NO: 95962 - DNA, 16 bp, H. sapiens
ctttgctgtgtggaag

SEQ ID NO: 95963 - DNA, 16 bp, H. sapiens
ctttgctgttctcatg

SEQ ID NO: 95964 - DNA, 16 bp, H. sapiens
ctttgcttggaaggag

SEQ ID NO: 95965 - DNA, 16 bp, H. sapiens
ctttgctttccatttg

SEQ ID NO: 95966 - DNA, 16 bp, H. sapiens
ctttgctttgttcact

SEQ ID NO: 95967 - DNA, 16 bp, H. sapiens
ctttgcttttgtaaat

SEQ ID NO: 95968 - DNA, 16 bp, H. sapiens
ctttggaaaaacagtt

SEQ ID NO: 95969 - DNA, 16 bp, H. sapiens
ctttggaaaaatgttt

SEQ ID NO: 95970 - DNA, 16 bp, H. sapiens
ctttggaaaacagttt

SEQ ID NO: 95971 - DNA, 16 bp, H. sapiens
ctttggaaaataattt

SEQ ID NO: 95972 - DNA, 16 bp, H. sapiens
ctttggaaaatcattt

SEQ ID NO: 95973 - DNA, 16 bp, H. sapiens
ctttggaaacattttt

SEQ ID NO: 95974 - DNA, 16 bp, H. sapiens
ctttggaaagcagttt

SEQ ID NO: 95975 - DNA, 16 bp, H. sapiens
ctttggaaagccaagg

SEQ ID NO: 95976 - DNA, 16 bp, H. sapiens
ctttggaaagtaattt

SEQ ID NO: 95977 - DNA, 16 bp, H. sapiens
ctttggaaattggcta

SEQ ID NO: 95978 - DNA, 16 bp, H. sapiens
ctttggaaccaggtaa

SEQ ID NO: 95979 - DNA, 16 bp, H. sapiens
ctttggaactaggtaa

SEQ ID NO: 95980 - DNA, 16 bp, H. sapiens
ctttggaactgggtaa

SEQ ID NO: 95981 - DNA, 16 bp, H. sapiens
ctttggaaggcccagg

SEQ ID NO: 95982 - DNA, 18 bp, H. sapiens
ctttggaaggctgaggca

SEQ ID NO: 95983 - DNA, 16 bp, H. sapiens
ctttggaaggctgtgg

SEQ ID NO: 95984 - DNA, 16 bp, H. sapiens
ctttggaaggtaatta

SEQ ID NO: 95985 - DNA, 16 bp, H. sapiens
ctttggagaaaagtct

SEQ ID NO: 95986 - DNA, 16 bp, H. sapiens
ctttggagaaaataaa

SEQ ID NO: 95987 - DNA, 16 bp, H. sapiens
ctttggagaaaggcat

SEQ ID NO: 95988 - DNA, 16 bp, H. sapiens
ctttggagaaggagag

SEQ ID NO: 95989 - DNA, 16 bp, H. sapiens
ctttggagaattgtct

SEQ ID NO: 95990 - DNA, 16 bp, H. sapiens
ctttggagagcccaag

SEQ ID NO: 95991 - DNA, 16 bp, H. sapiens
ctttggaggagaagaa

SEQ ID NO: 95992 - DNA, 16 bp, H. sapiens
ctttggaggcagaagc

SEQ ID NO: 95993 - DNA, 16 bp, H. sapiens
ctttggaggccgaggc

SEQ ID NO: 95994 - DNA, 16 bp, H. sapiens
ctttggaggctctgga

SEQ ID NO: 95995 - DNA, 16 bp, H. sapiens
ctttggagggagcatg

SEQ ID NO: 95996 - DNA, 16 bp, H. sapiens
ctttggagtttgtttg

SEQ ID NO: 95997 - DNA, 16 bp, H. sapiens
ctttggattaaatctg

SEQ ID NO: 95998 - DNA, 16 bp, H. sapiens
ctttggattcagcaat

SEQ ID NO: 95999 - DNA, 16 bp, H. sapiens
ctttggattttttaaa

SEQ ID NO: 96000 - DNA, 16 bp, H. sapiens
ctttggcaggctccca

SEQ ID NO: 96001 - DNA, 16 bp, H. sapiens
ctttggccaacagaat

SEQ ID NO: 96002 - DNA, 16 bp, H. sapiens
ctttggccattgagag

SEQ ID NO: 96003 - DNA, 16 bp, H. sapiens
ctttggccattgggag

SEQ ID NO: 96004 - DNA, 16 bp, H. sapiens
ctttggccctgccctg

SEQ ID NO: 96005 - DNA, 16 bp, H. sapiens
ctttggcctcctgaag

SEQ ID NO: 96006 - DNA, 16 bp, H. sapiens
ctttggctattatgaa

SEQ ID NO: 96007 - DNA, 16 bp, H. sapiens
ctttggctcagaggcc

SEQ ID NO: 96008 - DNA, 16 bp, H. sapiens
ctttggctctgtgggc

SEQ ID NO: 96009 - DNA, 16 bp, H. sapiens
ctttggctgtgtgggc

SEQ ID NO: 96010 - DNA, 16 bp, H. sapiens
ctttggcttgcagatg

SEQ ID NO: 96011 - DNA, 16 bp, H. sapiens
ctttggctttccaaag

SEQ ID NO: 96012 - DNA, 16 bp, H. sapiens
ctttgggaaaaaaaaa

SEQ ID NO: 96013 - DNA, 16 bp, H. sapiens
ctttgggaaaaaaaat

SEQ ID NO: 96014 - DNA, 16 bp, H. sapiens
ctttgggaaacagtct

SEQ ID NO: 96015 - DNA, 16 bp, H. sapiens
ctttgggaaagttatt

SEQ ID NO: 96016 - DNA, 16 bp, H. sapiens
ctttgggaaatgctga

SEQ ID NO: 96017 - DNA, 16 bp, H. sapiens
ctttgggaaatgctgc

SEQ ID NO: 96018 - DNA, 16 bp, H. sapiens
ctttgggaacccaagg

SEQ ID NO: 96019 - DNA, 16 bp, H. sapiens
ctttgggaagcaaagg

SEQ ID NO: 96020 - DNA, 16 bp, H. sapiens
ctttgggaagccaaga

SEQ ID NO: 96021 - DNA, 16 bp, H. sapiens
ctttgggaagcccaag

SEQ ID NO: 96022 - DNA, 16 bp, H. sapiens
ctttgggaagctcagg

SEQ ID NO: 96023 - DNA, 16 bp, H. sapiens
ctttgggaagtgatta

SEQ ID NO: 96024 - DNA, 16 bp, H. sapiens
ctttgggaagtggagg

SEQ ID NO: 96025 - DNA, 16 bp, H. sapiens
ctttgggagaaaaaaa

SEQ ID NO: 96026 - DNA, 16 bp, H. sapiens
ctttgggagaccaatg

SEQ ID NO: 96027 - DNA, 16 bp, H. sapiens
ctttgggagaccgagg

SEQ ID NO: 96028 - DNA, 16 bp, H. sapiens
ctttgggagactgggg

SEQ ID NO: 96029 - DNA, 16 bp, H. sapiens
ctttgggagctgaggc

SEQ ID NO: 96030 - DNA, 16 bp, H. sapiens
ctttgggaggccacgg

SEQ ID NO: 96031 - DNA, 16 bp, H. sapiens
ctttgggaggccatgg

SEQ ID NO: 96032 - DNA, 16 bp, H. sapiens
ctttgggaggccgaat

SEQ ID NO: 96033 - DNA, 16 bp, H. sapiens
ctttgggaggccgacg

SEQ ID NO: 96034 - DNA, 16 bp, H. sapiens
ctttgggaggctgaca

SEQ ID NO: 96035 - DNA, 17 bp, H. sapiens
ctttgggaggctgagtc

SEQ ID NO: 96036 - DNA, 16 bp, H. sapiens
ctttgggaggctgcgg

SEQ ID NO: 96037 - DNA, 16 bp, H. sapiens
ctttgggatgcctagg

SEQ ID NO: 96038 - DNA, 16 bp, H. sapiens
ctttgggatgctgaag

SEQ ID NO: 96039 - DNA, 16 bp, H. sapiens
ctttgggcaagtgact

SEQ ID NO: 96040 - DNA, 16 bp, H. sapiens
ctttgggctggtgact

SEQ ID NO: 96041 - DNA, 16 bp, H. sapiens
ctttgggctgtatggc

SEQ ID NO: 96042 - DNA, 16 bp, H. sapiens
ctttgggctgtatttg

SEQ ID NO: 96043 - DNA, 16 bp, H. sapiens
ctttggggaagaggga

SEQ ID NO: 96044 - DNA, 16 bp, H. sapiens
ctttggggactcagtg

SEQ ID NO: 96045 - DNA, 16 bp, H. sapiens
ctttggggcagagact

SEQ ID NO: 96046 - DNA, 16 bp, H. sapiens
ctttggggctctgtgg

SEQ ID NO: 96047 - DNA, 16 bp, H. sapiens
ctttgggggacacatt

SEQ ID NO: 96048 - DNA, 16 bp, H. sapiens
ctttgggggacagttg

SEQ ID NO: 96049 - DNA, 16 bp, H. sapiens
ctttggggggcccagg

SEQ ID NO: 96050 - DNA, 16 bp, H. sapiens
ctttggggtgctgagg

SEQ ID NO: 96051 - DNA, 16 bp, H. sapiens
ctttgggtactatgga

SEQ ID NO: 96052 - DNA, 16 bp, H. sapiens
ctttgggtataaaccc

SEQ ID NO: 96053 - DNA, 16 bp, H. sapiens
ctttgggtggccgagg

SEQ ID NO: 96054 - DNA, 16 bp, H. sapiens
ctttgggttacaaaca

SEQ ID NO: 96055 - DNA, 16 bp, H. sapiens
ctttgggtttattttg

SEQ ID NO: 96056 - DNA, 16 bp, H. sapiens
ctttggtaggccaaga

SEQ ID NO: 96057 - DNA, 16 bp, H. sapiens
ctttggtgaggtatct

SEQ ID NO: 96058 - DNA, 16 bp, H. sapiens
ctttggttaataataa

SEQ ID NO: 96059 - DNA, 16 bp, H. sapiens
ctttggttaattctta

SEQ ID NO: 96060 - DNA, 16 bp, H. sapiens
ctttggttgtctgtgc

SEQ ID NO: 96061 - DNA, 16 bp, H. sapiens
ctttgtaaactgtgaa

SEQ ID NO: 96062 - DNA, 16 bp, H. sapiens
ctttgtaaatattttt

SEQ ID NO: 96063 - DNA, 16 bp, H. sapiens
ctttgtaacttttctg

SEQ ID NO: 96064 - DNA, 16 bp, H. sapiens
ctttgtaatatgtttt

SEQ ID NO: 96065 - DNA, 16 bp, H. sapiens
ctttgtaatattctcc

SEQ ID NO: 96066 - DNA, 16 bp, H. sapiens
ctttgtaatttttaaa

SEQ ID NO: 96067 - DNA, 16 bp, H. sapiens
ctttgtaattttttaa

SEQ ID NO: 96068 - DNA, 16 bp, H. sapiens
ctttgtagattctgaa

SEQ ID NO: 96069 - DNA, 16 bp, H. sapiens
ctttgtaggtgaagtg

SEQ ID NO: 96070 - DNA, 16 bp, H. sapiens
ctttgtagtatatttt

SEQ ID NO: 96071 - DNA, 16 bp, H. sapiens
ctttgtatattttgaa

SEQ ID NO: 96072 - DNA, 16 bp, H. sapiens
ctttgtatcctttaat

SEQ ID NO: 96073 - DNA, 16 bp, H. sapiens
ctttgtattttaaaat

SEQ ID NO: 96074 - DNA, 16 bp, H. sapiens
ctttgtatttttaaaa

SEQ ID NO: 96075 - DNA, 16 bp, H. sapiens
ctttgtcaaagatcag

SEQ ID NO: 96076 - DNA, 16 bp, H. sapiens
ctttgtcaccaccagg

SEQ ID NO: 96077 - DNA, 16 bp, H. sapiens
ctttgtcaccatgtgt

SEQ ID NO: 96078 - DNA, 16 bp, H. sapiens
ctttgtcagatgagaa

SEQ ID NO: 96079 - DNA, 16 bp, H. sapiens
ctttgtcagatgcatt

SEQ ID NO: 96080 - DNA, 16 bp, H. sapiens
ctttgtcagtagaggg

SEQ ID NO: 96081 - DNA, 16 bp, H. sapiens
ctttgtcctcacttgc

SEQ ID NO: 96082 - DNA, 16 bp, H. sapiens
ctttgtctcaaaataa

SEQ ID NO: 96083 - DNA, 16 bp, H. sapiens
ctttgtctcagagggg

SEQ ID NO: 96084 - DNA, 16 bp, H. sapiens
ctttgtctctcccaga

SEQ ID NO: 96085 - DNA, 18 bp, H. sapiens
ctttgtctcttttgatct

SEQ ID NO: 96086 - DNA, 16 bp, H. sapiens
ctttgtctgtacttca

SEQ ID NO: 96087 - DNA, 16 bp, H. sapiens
ctttgtcttaaaaata

SEQ ID NO: 96088 - DNA, 16 bp, H. sapiens
ctttgtcttggaaatg

SEQ ID NO: 96089 - DNA, 16 bp, H. sapiens
ctttgtcttgtcattt

SEQ ID NO: 96090 - DNA, 16 bp, H. sapiens
ctttgtctttaaaaaa

SEQ ID NO: 96091 - DNA, 16 bp, H. sapiens
ctttgtgaatattttc

SEQ ID NO: 96092 - DNA, 16 bp, H. sapiens
ctttgtgacagcagcc

SEQ ID NO: 96093 - DNA, 16 bp, H. sapiens
ctttgtgaccttgggc

SEQ ID NO: 96094 - DNA, 16 bp, H. sapiens
ctttgtgatgtgtgaa

SEQ ID NO: 96095 - DNA, 16 bp, H. sapiens
ctttgtggaaaatcaa

SEQ ID NO: 96096 - DNA, 16 bp, H. sapiens
ctttgtggaaggctga

SEQ ID NO: 96097 - DNA, 16 bp, H. sapiens
ctttgtggaggaggca

SEQ ID NO: 96098 - DNA, 16 bp, H. sapiens
ctttgtggaggaggtg

SEQ ID NO: 96099 - DNA, 16 bp, H. sapiens
ctttgtggccttctct

SEQ ID NO: 96100 - DNA, 16 bp, H. sapiens
ctttgtggggaaaaaa

SEQ ID NO: 96101 - DNA, 16 bp, H. sapiens
ctttgtggggccgagg

SEQ ID NO: 96102 - DNA, 16 bp, H. sapiens
ctttgtgggggaaaat

SEQ ID NO: 96103 - DNA, 16 bp, H. sapiens
ctttgtggtgagtgtt

SEQ ID NO: 96104 - DNA, 16 bp, H. sapiens
ctttgtggtttatcta

SEQ ID NO: 96105 - DNA, 16 bp, H. sapiens
ctttgtgtctctctgt

SEQ ID NO: 96106 - DNA, 16 bp, H. sapiens
ctttgtgtctctgtat

SEQ ID NO: 96107 - DNA, 16 bp, H. sapiens
ctttgtgtgtatgtgt

SEQ ID NO: 96108 - DNA, 16 bp, H. sapiens
ctttgttaaatgcttt

SEQ ID NO: 96109 - DNA, 16 bp, H. sapiens
ctttgttacagcaacc

SEQ ID NO: 96110 - DNA, 16 bp, H. sapiens
ctttgttagatgagta

SEQ ID NO: 96111 - DNA, 16 bp, H. sapiens
ctttgttcagggctca

SEQ ID NO: 96112 - DNA, 16 bp, H. sapiens
ctttgttccttttcat

SEQ ID NO: 96113 - DNA, 16 bp, H. sapiens
ctttgttctcattaat

SEQ ID NO: 96114 - DNA, 16 bp, H. sapiens
ctttgttctgctgctg

SEQ ID NO: 96115 - DNA, 16 bp, H. sapiens
ctttgttcttccttca

SEQ ID NO: 96116 - DNA, 16 bp, H. sapiens
ctttgttctttggctc

SEQ ID NO: 96117 - DNA, 16 bp, H. sapiens
ctttgttcttttaaaa

SEQ ID NO: 96118 - DNA, 16 bp, H. sapiens
ctttgttgaacatcag

SEQ ID NO: 96119 - DNA, 16 bp, H. sapiens
ctttgttgagagattt

SEQ ID NO: 96120 - DNA, 16 bp, H. sapiens
ctttgttggcttatta

SEQ ID NO: 96121 - DNA, 16 bp, H. sapiens
ctttgttggctttctg

SEQ ID NO: 96122 - DNA, 16 bp, H. sapiens
ctttgttgtcatttca

SEQ ID NO: 96123 - DNA, 16 bp, H. sapiens
ctttgttgttttaaag

SEQ ID NO: 96124 - DNA, 16 bp, H. sapiens
ctttgtttaaaaaaaa

SEQ ID NO: 96125 - DNA, 16 bp, H. sapiens
ctttgtttcaaaataa

SEQ ID NO: 96126 - DNA, 16 bp, H. sapiens
ctttgtttcatttaaa

SEQ ID NO: 96127 - DNA, 16 bp, H. sapiens
ctttgtttcattttaa

SEQ ID NO: 96128 - DNA, 16 bp, H. sapiens
ctttgtttcccaggct

SEQ ID NO: 96129 - DNA, 16 bp, H. sapiens
ctttgtttccccacct

SEQ ID NO: 96130 - DNA, 16 bp, H. sapiens
ctttgtttcctcatct

SEQ ID NO: 96131 - DNA, 16 bp, H. sapiens
ctttgtttccttatct

SEQ ID NO: 96132 - DNA, 16 bp, H. sapiens
ctttgtttgtttaaag

SEQ ID NO: 96133 - DNA, 16 bp, H. sapiens
ctttgttttaaatata

SEQ ID NO: 96134 - DNA, 16 bp, H. sapiens
ctttgttttaataaaa

SEQ ID NO: 96135 - DNA, 16 bp, H. sapiens
ctttgttttaatataa

SEQ ID NO: 96136 - DNA, 16 bp, H. sapiens
ctttgttttcttctaa

SEQ ID NO: 96137 - DNA, 16 bp, H. sapiens
ctttgttttgtaaatt

SEQ ID NO: 96138 - DNA, 16 bp, H. sapiens
ctttgtttttaaactt

SEQ ID NO: 96139 - DNA, 16 bp, H. sapiens
ctttgtttttaatgta

SEQ ID NO: 96140 - DNA, 16 bp, H. sapiens
ctttgtttttattcag

SEQ ID NO: 96141 - DNA, 16 bp, H. sapiens
ctttgtttttccactt

SEQ ID NO: 96142 - DNA, 16 bp, H. sapiens
cttttaaaaaaacaac

SEQ ID NO: 96143 - DNA, 16 bp, H. sapiens
cttttaaaaaaacatt

SEQ ID NO: 96144 - DNA, 16 bp, H. sapiens
cttttaaaaaaatgtt

SEQ ID NO: 96145 - DNA, 16 bp, H. sapiens
cttttaaaaaactttt

SEQ ID NO: 96146 - DNA, 16 bp, H. sapiens
cttttaaaaaatatct

SEQ ID NO: 96147 - DNA, 16 bp, H. sapiens
cttttaaaaaatgact

SEQ ID NO: 96148 - DNA, 16 bp, H. sapiens
cttttaaaaaatgtta

SEQ ID NO: 96149 - DNA, 16 bp, H. sapiens
cttttaaaaaattatc

SEQ ID NO: 96150 - DNA, 16 bp, H. sapiens
cttttaaaaacttgtt

SEQ ID NO: 96151 - DNA, 16 bp, H. sapiens
cttttaaaaagtttta

SEQ ID NO: 96152 - DNA, 16 bp, H. sapiens
cttttaaaaataaagt

SEQ ID NO: 96153 - DNA, 16 bp, H. sapiens
cttttaaaaatactat

SEQ ID NO: 96154 - DNA, 16 bp, H. sapiens
cttttaaaaatagagc

SEQ ID NO: 96155 - DNA, 16 bp, H. sapiens
cttttaaaaatcagaa

SEQ ID NO: 96156 - DNA, 16 bp, H. sapiens
cttttaaaaatccatt

SEQ ID NO: 96157 - DNA, 16 bp, H. sapiens
cttttaaaaatgaatt

SEQ ID NO: 96158 - DNA, 16 bp, H. sapiens
cttttaaaaatgattt

SEQ ID NO: 96159 - DNA, 16 bp, H. sapiens
cttttaaaaatgtaaa

SEQ ID NO: 96160 - DNA, 16 bp, H. sapiens
cttttaaaaattactg

SEQ ID NO: 96161 - DNA, 16 bp, H. sapiens
cttttaaaaattactt

SEQ ID NO: 96162 - DNA, 16 bp, H. sapiens
cttttaaaaattttgt

SEQ ID NO: 96163 - DNA, 16 bp, H. sapiens
cttttaaaacattatt

SEQ ID NO: 96164 - DNA, 16 bp, H. sapiens
cttttaaaagcaaatt

SEQ ID NO: 96165 - DNA, 16 bp, H. sapiens
cttttaaaagtctaat

SEQ ID NO: 96166 - DNA, 16 bp, H. sapiens
cttttaaaatacattt

SEQ ID NO: 96167 - DNA, 16 bp, H. sapiens
cttttaaaatattcta

SEQ ID NO: 96168 - DNA, 16 bp, H. sapiens
cttttaaaatcagaag

SEQ ID NO: 96169 - DNA, 16 bp, H. sapiens
cttttaaaatcatcag

SEQ ID NO: 96170 - DNA, 16 bp, H. sapiens
cttttaaaatgtgtgt

SEQ ID NO: 96171 - DNA, 16 bp, H. sapiens
cttttaaaattatgaa

SEQ ID NO: 96172 - DNA, 16 bp, H. sapiens
cttttaaaattctgta

SEQ ID NO: 96173 - DNA, 16 bp, H. sapiens
cttttaaacacatttt

SEQ ID NO: 96174 - DNA, 16 bp, H. sapiens
cttttaaagaattttt

SEQ ID NO: 96175 - DNA, 16 bp, H. sapiens
cttttaaagcttttta

SEQ ID NO: 96176 - DNA, 16 bp, H. sapiens
cttttaaagtaaaata

SEQ ID NO: 96177 - DNA, 16 bp, H. sapiens
cttttaaagttatttt

SEQ ID NO: 96178 - DNA, 16 bp, H. sapiens
cttttaaataaaatct

SEQ ID NO: 96179 - DNA, 16 bp, H. sapiens
cttttaaataaaatgt

SEQ ID NO: 96180 - DNA, 16 bp, H. sapiens
cttttaaatatgttta

SEQ ID NO: 96181 - DNA, 16 bp, H. sapiens
cttttaaatgaccaaa

SEQ ID NO: 96182 - DNA, 16 bp, H. sapiens
cttttaaatttaaact

SEQ ID NO: 96183 - DNA, 16 bp, H. sapiens
cttttaaatttactga

SEQ ID NO: 96184 - DNA, 16 bp, H. sapiens
cttttaaatttgatgt

SEQ ID NO: 96185 - DNA, 16 bp, H. sapiens
cttttaaatttgttga

SEQ ID NO: 96186 - DNA, 16 bp, H. sapiens
cttttaaccattttaa

SEQ ID NO: 96187 - DNA, 16 bp, H. sapiens
cttttaactctagtat

SEQ ID NO: 96188 - DNA, 16 bp, H. sapiens
cttttaacttttaaaa

SEQ ID NO: 96189 - DNA, 16 bp, H. sapiens
cttttaagaaatgtct

SEQ ID NO: 96190 - DNA, 16 bp, H. sapiens
cttttaaggacaccag

SEQ ID NO: 96191 - DNA, 16 bp, H. sapiens
cttttaaggccttcaa

SEQ ID NO: 96192 - DNA, 16 bp, H. sapiens
cttttaagttcaggga

SEQ ID NO: 96193 - DNA, 16 bp, H. sapiens
cttttaagtttaatct

SEQ ID NO: 96194 - DNA, 16 bp, H. sapiens
cttttaataacaaaag

SEQ ID NO: 96195 - DNA, 16 bp, H. sapiens
cttttaatatgcttat

SEQ ID NO: 96196 - DNA, 16 bp, H. sapiens
cttttaatggcagaaa

SEQ ID NO: 96197 - DNA, 16 bp, H. sapiens
cttttaattctcttaa

SEQ ID NO: 96198 - DNA, 16 bp, H. sapiens
cttttaatttaaaagt

SEQ ID NO: 96199 - DNA, 16 bp, H. sapiens
cttttacaaaattatt

SEQ ID NO: 96200 - DNA, 16 bp, H. sapiens
cttttacactgttggg

SEQ ID NO: 96201 - DNA, 16 bp, H. sapiens
cttttacagaaaaagt

SEQ ID NO: 96202 - DNA, 16 bp, H. sapiens
cttttacattaaaaat

SEQ ID NO: 96203 - DNA, 16 bp, H. sapiens
cttttacatttaggtt

SEQ ID NO: 96204 - DNA, 16 bp, H. sapiens
cttttacatttgcaga

SEQ ID NO: 96205 - DNA, 16 bp, H. sapiens
cttttacctctgtcct

SEQ ID NO: 96206 - DNA, 16 bp, H. sapiens
cttttacctttttaaa

SEQ ID NO: 96207 - DNA, 16 bp, H. sapiens
cttttactacctaata

SEQ ID NO: 96208 - DNA, 16 bp, H. sapiens
cttttactttaaacca

SEQ ID NO: 96209 - DNA, 16 bp, H. sapiens
cttttacttttcttgg

SEQ ID NO: 96210 - DNA, 16 bp, H. sapiens
cttttagaaaaacaca

SEQ ID NO: 96211 - DNA, 16 bp, H. sapiens
cttttagaaaataata

SEQ ID NO: 96212 - DNA, 16 bp, H. sapiens
cttttagaagaaaata

SEQ ID NO: 96213 - DNA, 16 bp, H. sapiens
cttttagaagaaagca

SEQ ID NO: 96214 - DNA, 16 bp, H. sapiens
cttttagccacagctg

SEQ ID NO: 96215 - DNA, 16 bp, H. sapiens
cttttagccctgccat

SEQ ID NO: 96216 - DNA, 16 bp, H. sapiens
cttttagcttccctgg

SEQ ID NO: 96217 - DNA, 16 bp, H. sapiens
cttttaggatcctttt

SEQ ID NO: 96218 - DNA, 26 bp, H. sapiens
cttttagtagagacagggtttcacca

SEQ ID NO: 96219 - DNA, 26 bp, H. sapiens
cttttagtagagacggggtttcacca

SEQ ID NO: 96220 - DNA, 16 bp, H. sapiens
cttttataagggcatt

SEQ ID NO: 96221 - DNA, 16 bp, H. sapiens
cttttataataaacca

SEQ ID NO: 96222 - DNA, 16 bp, H. sapiens
cttttatacctgtttt

SEQ ID NO: 96223 - DNA, 16 bp, H. sapiens
cttttatactttggtt

SEQ ID NO: 96224 - DNA, 16 bp, H. sapiens
cttttatatactgatt

SEQ ID NO: 96225 - DNA, 16 bp, H. sapiens
cttttatattttgaaa

SEQ ID NO: 96226 - DNA, 16 bp, H. sapiens
cttttatgactggctt

SEQ ID NO: 96227 - DNA, 16 bp, H. sapiens
cttttatgcagccaaa

SEQ ID NO: 96228 - DNA, 16 bp, H. sapiens
cttttatgtgcactgg

SEQ ID NO: 96229 - DNA, 16 bp, H. sapiens
cttttattagagaatg

SEQ ID NO: 96230 - DNA, 16 bp, H. sapiens
cttttattatgcaaat

SEQ ID NO: 96231 - DNA, 16 bp, H. sapiens
cttttattatggaaaa

SEQ ID NO: 96232 - DNA, 16 bp, H. sapiens
cttttattatgttgag

SEQ ID NO: 96233 - DNA, 16 bp, H. sapiens
cttttattcaaaataa

SEQ ID NO: 96234 - DNA, 16 bp, H. sapiens
cttttattcctcactc

SEQ ID NO: 96235 - DNA, 16 bp, H. sapiens
cttttattgaaaatat

SEQ ID NO: 96236 - DNA, 16 bp, H. sapiens
cttttattgcccaggc

SEQ ID NO: 96237 - DNA, 18 bp, H. sapiens
cttttattgctgagtagt

SEQ ID NO: 96238 - DNA, 16 bp, H. sapiens
cttttattgtgttgag

SEQ ID NO: 96239 - DNA, 16 bp, H. sapiens
cttttatttcattcag

SEQ ID NO: 96240 - DNA, 16 bp, H. sapiens
cttttatttctctgag

SEQ ID NO: 96241 - DNA, 16 bp, H. sapiens
cttttatttctgactt

SEQ ID NO: 96242 - DNA, 16 bp, H. sapiens
cttttattttaaaaca

SEQ ID NO: 96243 - DNA, 16 bp, H. sapiens
cttttcaaaaaaacaa

SEQ ID NO: 96244 - DNA, 16 bp, H. sapiens
cttttcaaaaaatcag

SEQ ID NO: 96245 - DNA, 16 bp, H. sapiens
cttttcaaataaaata

SEQ ID NO: 96246 - DNA, 16 bp, H. sapiens
cttttcaaataaccaa

SEQ ID NO: 96247 - DNA, 16 bp, H. sapiens
cttttcaaccacagcc

SEQ ID NO: 96248 - DNA, 16 bp, H. sapiens
cttttcacatttcaaa

SEQ ID NO: 96249 - DNA, 16 bp, H. sapiens
cttttcactttcctga

SEQ ID NO: 96250 - DNA, 16 bp, H. sapiens
cttttcagaaaaaata

SEQ ID NO: 96251 - DNA, 16 bp, H. sapiens
cttttcagaaggtttt

SEQ ID NO: 96252 - DNA, 16 bp, H. sapiens
cttttcagactcagcc

SEQ ID NO: 96253 - DNA, 16 bp, H. sapiens
cttttcagagccagca

SEQ ID NO: 96254 - DNA, 16 bp, H. sapiens
cttttcagatatttga

SEQ ID NO: 96255 - DNA, 16 bp, H. sapiens
cttttcagattggctt

SEQ ID NO: 96256 - DNA, 16 bp, H. sapiens
cttttcagatttttat

SEQ ID NO: 96257 - DNA, 16 bp, H. sapiens
cttttcagtaatttaa

SEQ ID NO: 96258 - DNA, 16 bp, H. sapiens
cttttcagttctaaaa

SEQ ID NO: 96259 - DNA, 16 bp, H. sapiens
cttttcataaaacttt

SEQ ID NO: 96260 - DNA, 16 bp, H. sapiens
cttttcatatgctaat

SEQ ID NO: 96261 - DNA, 16 bp, H. sapiens
cttttcatggtctatt

SEQ ID NO: 96262 - DNA, 16 bp, H. sapiens
cttttcatgtctctat

SEQ ID NO: 96263 - DNA, 16 bp, H. sapiens
cttttcattctcttaa

SEQ ID NO: 96264 - DNA, 16 bp, H. sapiens
cttttcattgctgaat

SEQ ID NO: 96265 - DNA, 16 bp, H. sapiens
cttttcatttattcaa

SEQ ID NO: 96266 - DNA, 16 bp, H. sapiens
cttttcatttcactga

SEQ ID NO: 96267 - DNA, 16 bp, H. sapiens
cttttcatttcttaaa

SEQ ID NO: 96268 - DNA, 16 bp, H. sapiens
cttttcatttctttgc

SEQ ID NO: 96269 - DNA, 16 bp, H. sapiens
cttttcatttggaaaa

SEQ ID NO: 96270 - DNA, 16 bp, H. sapiens
cttttccaatcaatgc

SEQ ID NO: 96271 - DNA, 16 bp, H. sapiens
cttttccaggaacctt

SEQ ID NO: 96272 - DNA, 30 bp, H. sapiens
cttttccaggctcagcagggagctgctgga

SEQ ID NO: 96273 - DNA, 16 bp, H. sapiens
cttttccaggtgcaag

SEQ ID NO: 96274 - DNA, 16 bp, H. sapiens
cttttccagtgactcc

SEQ ID NO: 96275 - DNA, 16 bp, H. sapiens
cttttccagtggtctt

SEQ ID NO: 96276 - DNA, 16 bp, H. sapiens
cttttccatttctgca

SEQ ID NO: 96277 - DNA, 16 bp, H. sapiens
cttttcccactttttg

SEQ ID NO: 96278 - DNA, 16 bp, H. sapiens
cttttcccagcaccat

SEQ ID NO: 96279 - DNA, 16 bp, H. sapiens
cttttcccagcaggaa

SEQ ID NO: 96280 - DNA, 16 bp, H. sapiens
cttttcccatggtctt

SEQ ID NO: 96281 - DNA, 16 bp, H. sapiens
cttttccccattgctt

SEQ ID NO: 96282 - DNA, 16 bp, H. sapiens
cttttcccccaggctg

SEQ ID NO: 96283 - DNA, 22 bp, H. sapiens
cttttccgacgggcttaaaaaa

SEQ ID NO: 96284 - DNA, 16 bp, H. sapiens
cttttcctatttgaat

SEQ ID NO: 96285 - DNA, 16 bp, H. sapiens
cttttcctatttgtat

SEQ ID NO: 96286 - DNA, 16 bp, H. sapiens
cttttcctcattgtct

SEQ ID NO: 96287 - DNA, 16 bp, H. sapiens
cttttcctttaaaaat

SEQ ID NO: 96288 - DNA, 16 bp, H. sapiens
cttttcctttctttag

SEQ ID NO: 96289 - DNA, 16 bp, H. sapiens
cttttccttttaaaaa

SEQ ID NO: 96290 - DNA, 16 bp, H. sapiens
cttttctaacagaaag

SEQ ID NO: 96291 - DNA, 16 bp, H. sapiens
cttttctaagaaaatt

SEQ ID NO: 96292 - DNA, 16 bp, H. sapiens
cttttctaataaactt

SEQ ID NO: 96293 - DNA, 16 bp, H. sapiens
cttttctatatttaga

SEQ ID NO: 96294 - DNA, 16 bp, H. sapiens
cttttctcaaaataaa

SEQ ID NO: 96295 - DNA, 16 bp, H. sapiens
cttttctcaaatagaa

SEQ ID NO: 96296 - DNA, 16 bp, H. sapiens
cttttctcctccaaat

SEQ ID NO: 96297 - DNA, 16 bp, H. sapiens
cttttctctacatcct

SEQ ID NO: 96298 - DNA, 16 bp, H. sapiens
cttttctctactaaaa

SEQ ID NO: 96299 - DNA, 16 bp, H. sapiens
cttttctctgaaaaga

SEQ ID NO: 96300 - DNA, 16 bp, H. sapiens
cttttctctgcaacct

SEQ ID NO: 96301 - DNA, 16 bp, H. sapiens
cttttctctgcatttt

SEQ ID NO: 96302 - DNA, 16 bp, H. sapiens
cttttctctgtgtgtc

SEQ ID NO: 96303 - DNA, 16 bp, H. sapiens
cttttctcttttaaaa

SEQ ID NO: 96304 - DNA, 16 bp, H. sapiens
cttttctgaaaagaaa

SEQ ID NO: 96305 - DNA, 16 bp, H. sapiens
cttttctgaagttgct

SEQ ID NO: 96306 - DNA, 16 bp, H. sapiens
cttttctgaagtttta

SEQ ID NO: 96307 - DNA, 16 bp, H. sapiens
cttttctgagctccag

SEQ ID NO: 96308 - DNA, 16 bp, H. sapiens
cttttctgatttggat

SEQ ID NO: 96309 - DNA, 16 bp, H. sapiens
cttttctgctttttaa

SEQ ID NO: 96310 - DNA, 16 bp, H. sapiens
cttttctggaatgtca

SEQ ID NO: 96311 - DNA, 16 bp, H. sapiens
cttttctggctttggt

SEQ ID NO: 96312 - DNA, 16 bp, H. sapiens
cttttctgggcagtgg

SEQ ID NO: 96313 - DNA, 16 bp, H. sapiens
cttttctgggtctcag

SEQ ID NO: 96314 - DNA, 16 bp, H. sapiens
cttttctgtaaagggc

SEQ ID NO: 96315 - DNA, 16 bp, H. sapiens
cttttctgtaaatata

SEQ ID NO: 96316 - DNA, 16 bp, H. sapiens
cttttctgtcccagga

SEQ ID NO: 96317 - DNA, 16 bp, H. sapiens
cttttctgtgaatttt

SEQ ID NO: 96318 - DNA, 16 bp, H. sapiens
cttttctgtttttcaa

SEQ ID NO: 96319 - DNA, 16 bp, H. sapiens
cttttcttattaaaaa

SEQ ID NO: 96320 - DNA, 16 bp, H. sapiens
cttttcttcatttatg

SEQ ID NO: 96321 - DNA, 16 bp, H. sapiens
cttttcttctctttga

SEQ ID NO: 96322 - DNA, 16 bp, H. sapiens
cttttcttctgaaact

SEQ ID NO: 96323 - DNA, 16 bp, H. sapiens
cttttcttctgcaatg

SEQ ID NO: 96324 - DNA, 16 bp, H. sapiens
cttttcttctttagaa

SEQ ID NO: 96325 - DNA, 16 bp, H. sapiens
cttttcttgttccagt

SEQ ID NO: 96326 - DNA, 16 bp, H. sapiens
cttttctttaaagatg

SEQ ID NO: 96327 - DNA, 16 bp, H. sapiens
cttttctttactgaga

SEQ ID NO: 96328 - DNA, 16 bp, H. sapiens
cttttctttcctcaga

SEQ ID NO: 96329 - DNA, 16 bp, H. sapiens
cttttctttctgactg

SEQ ID NO: 96330 - DNA, 16 bp, H. sapiens
cttttctttgtgggaa

SEQ ID NO: 96331 - DNA, 16 bp, H. sapiens
cttttcttttaggaaa

SEQ ID NO: 96332 - DNA, 16 bp, H. sapiens
cttttcttttctcaaa

SEQ ID NO: 96333 - DNA, 16 bp, H. sapiens
cttttcttttgatgga

SEQ ID NO: 96334 - DNA, 16 bp, H. sapiens
cttttctttttaaatg

SEQ ID NO: 96335 - DNA, 16 bp, H. sapiens
cttttctttttgaaac

SEQ ID NO: 96336 - DNA, 16 bp, H. sapiens
cttttcttttttgaaa

SEQ ID NO: 96337 - DNA, 16 bp, H. sapiens
cttttgaaaaaaaaaa

SEQ ID NO: 96338 - DNA, 16 bp, H. sapiens
cttttgaaaaaataaa

SEQ ID NO: 96339 - DNA, 16 bp, H. sapiens
cttttgaaaaattcaa

SEQ ID NO: 96340 - DNA, 16 bp, H. sapiens
cttttgaaaagggtct

SEQ ID NO: 96341 - DNA, 16 bp, H. sapiens
cttttgaaaatagttt

SEQ ID NO: 96342 - DNA, 16 bp, H. sapiens
cttttgaagcttagtt

SEQ ID NO: 96343 - DNA, 16 bp, H. sapiens
cttttgaatgtatttt

SEQ ID NO: 96344 - DNA, 16 bp, H. sapiens
cttttgaatgtttttg

SEQ ID NO: 96345 - DNA, 16 bp, H. sapiens
cttttgaatttctttg

SEQ ID NO: 96346 - DNA, 16 bp, H. sapiens
cttttgaattttgaat

SEQ ID NO: 96347 - DNA, 16 bp, H. sapiens
cttttgaatttttagt

SEQ ID NO: 96348 - DNA, 16 bp, H. sapiens
cttttgactcctttgt

SEQ ID NO: 96349 - DNA, 16 bp, H. sapiens
cttttgacttccccaa

SEQ ID NO: 96350 - DNA, 16 bp, H. sapiens
cttttgactttgttta

SEQ ID NO: 96351 - DNA, 16 bp, H. sapiens
cttttgagaattgcct

SEQ ID NO: 96352 - DNA, 16 bp, H. sapiens
cttttgagaattttct

SEQ ID NO: 96353 - DNA, 16 bp, H. sapiens
cttttgagatatcttt

SEQ ID NO: 96354 - DNA, 16 bp, H. sapiens
cttttgaggtaatttt

SEQ ID NO: 96355 - DNA, 16 bp, H. sapiens
cttttgagttaatgtt

SEQ ID NO: 96356 - DNA, 17 bp, H. sapiens
cttttgatctttgttgg

SEQ ID NO: 96357 - DNA, 16 bp, H. sapiens
cttttgatgaacagaa

SEQ ID NO: 96358 - DNA, 16 bp, H. sapiens
cttttgatgatgattc

SEQ ID NO: 96359 - DNA, 16 bp, H. sapiens
cttttgatgtctgcag

SEQ ID NO: 96360 - DNA, 16 bp, H. sapiens
cttttgatgtcttcat

SEQ ID NO: 96361 - DNA, 16 bp, H. sapiens
cttttgattataaatt

SEQ ID NO: 96362 - DNA, 16 bp, H. sapiens
cttttgatttaaaata

SEQ ID NO: 96363 - DNA, 16 bp, H. sapiens
cttttgattttgaaat

SEQ ID NO: 96364 - DNA, 16 bp, H. sapiens
cttttgattttgcagg

SEQ ID NO: 96365 - DNA, 16 bp, H. sapiens
cttttgcaaatatttt

SEQ ID NO: 96366 - DNA, 16 bp, H. sapiens
cttttgcaacaacatg

SEQ ID NO: 96367 - DNA, 16 bp, H. sapiens
cttttgcacagcaaaa

SEQ ID NO: 96368 - DNA, 16 bp, H. sapiens
cttttgcacagcaaag

SEQ ID NO: 96369 - DNA, 16 bp, H. sapiens
cttttgcagctttctc

SEQ ID NO: 96370 - DNA, 16 bp, H. sapiens
cttttgccacttctat

SEQ ID NO: 96371 - DNA, 16 bp, H. sapiens
cttttgcccagcctgg

SEQ ID NO: 96372 - DNA, 16 bp, H. sapiens
cttttgcccattttga

SEQ ID NO: 96373 - DNA, 16 bp, H. sapiens
cttttgcctaggctgg

SEQ ID NO: 96374 - DNA, 16 bp, H. sapiens
cttttgctatgcaaaa

SEQ ID NO: 96375 - DNA, 16 bp, H. sapiens
cttttgctatttctac

SEQ ID NO: 96376 - DNA, 16 bp, H. sapiens
cttttgctgcctgtgc

SEQ ID NO: 96377 - DNA, 16 bp, H. sapiens
cttttgctgtatccca

SEQ ID NO: 96378 - DNA, 16 bp, H. sapiens
cttttgctgtccagaa

SEQ ID NO: 96379 - DNA, 16 bp, H. sapiens
cttttggaagaaaaca

SEQ ID NO: 96380 - DNA, 16 bp, H. sapiens
cttttggaggaggaga

SEQ ID NO: 96381 - DNA, 16 bp, H. sapiens
cttttggaggcagagg

SEQ ID NO: 96382 - DNA, 16 bp, H. sapiens
cttttggaggccaaag

SEQ ID NO: 96383 - DNA, 16 bp, H. sapiens
cttttggagtctccaa

SEQ ID NO: 96384 - DNA, 16 bp, H. sapiens
cttttggcatttttgt

SEQ ID NO: 96385 - DNA, 16 bp, H. sapiens
cttttggcctaggatt

SEQ ID NO: 96386 - DNA, 16 bp, H. sapiens
cttttggctattggga

SEQ ID NO: 96387 - DNA, 16 bp, H. sapiens
cttttggcttcaatat

SEQ ID NO: 96388 - DNA, 16 bp, H. sapiens
cttttggcttgtaggg

SEQ ID NO: 96389 - DNA, 16 bp, H. sapiens
cttttggctttcctgg

SEQ ID NO: 96390 - DNA, 16 bp, H. sapiens
cttttggctttgttaa

SEQ ID NO: 96391 - DNA, 16 bp, H. sapiens
cttttgggactggctt

SEQ ID NO: 96392 - DNA, 16 bp, H. sapiens
cttttgggctcaagtg

SEQ ID NO: 96393 - DNA, 16 bp, H. sapiens
cttttgggggaaaaaa

SEQ ID NO: 96394 - DNA, 16 bp, H. sapiens
cttttggggttttatg

SEQ ID NO: 96395 - DNA, 16 bp, H. sapiens
cttttgggtttttata

SEQ ID NO: 96396 - DNA, 16 bp, H. sapiens
cttttggtatccattt

SEQ ID NO: 96397 - DNA, 16 bp, H. sapiens
cttttggtgcctggct

SEQ ID NO: 96398 - DNA, 16 bp, H. sapiens
cttttggtgtcatatc

SEQ ID NO: 96399 - DNA, 16 bp, H. sapiens
cttttggtgtccattt

SEQ ID NO: 96400 - DNA, 16 bp, H. sapiens
cttttggtgtttcagt

SEQ ID NO: 96401 - DNA, 16 bp, H. sapiens
cttttggtttccctgg

SEQ ID NO: 96402 - DNA, 16 bp, H. sapiens
cttttgtaaaaataaa

SEQ ID NO: 96403 - DNA, 16 bp, H. sapiens
cttttgtaaaataaaa

SEQ ID NO: 96404 - DNA, 17 bp, H. sapiens
cttttgtaaataaagtt

SEQ ID NO: 96405 - DNA, 16 bp, H. sapiens
cttttgtaataaaaat

SEQ ID NO: 96406 - DNA, 16 bp, H. sapiens
cttttgtattttagta

SEQ ID NO: 96407 - DNA, 16 bp, H. sapiens
cttttgtcttcagcta

SEQ ID NO: 96408 - DNA, 16 bp, H. sapiens
cttttgtcttccctgg

SEQ ID NO: 96409 - DNA, 16 bp, H. sapiens
cttttgtctttgatgt

SEQ ID NO: 96410 - DNA, 16 bp, H. sapiens
cttttgtgaatggctt

SEQ ID NO: 96411 - DNA, 16 bp, H. sapiens
cttttgtgactggctt

SEQ ID NO: 96412 - DNA, 16 bp, H. sapiens
cttttgtgcctggctt

SEQ ID NO: 96413 - DNA, 16 bp, H. sapiens
cttttgtgtctagctt

SEQ ID NO: 96414 - DNA, 16 bp, H. sapiens
cttttgttaacatttt

SEQ ID NO: 96415 - DNA, 16 bp, H. sapiens
cttttgttacttaggc

SEQ ID NO: 96416 - DNA, 16 bp, H. sapiens
cttttgttcattcagt

SEQ ID NO: 96417 - DNA, 16 bp, H. sapiens
cttttgttgccatctt

SEQ ID NO: 96418 - DNA, 16 bp, H. sapiens
cttttgttggtgtata

SEQ ID NO: 96419 - DNA, 16 bp, H. sapiens
cttttgtttcaataaa

SEQ ID NO: 96420 - DNA, 16 bp, H. sapiens
cttttgtttcctctga

SEQ ID NO: 96421 - DNA, 16 bp, H. sapiens
cttttgtttcctgtgc

SEQ ID NO: 96422 - DNA, 16 bp, H. sapiens
cttttgttttttaaaa

SEQ ID NO: 96423 - DNA, 16 bp, H. sapiens
ctttttaaaaaaatct

SEQ ID NO: 96424 - DNA, 16 bp, H. sapiens
ctttttaaaaaacttt

SEQ ID NO: 96425 - DNA, 16 bp, H. sapiens
ctttttaaaaaatgtt

SEQ ID NO: 96426 - DNA, 16 bp, H. sapiens
ctttttaaaaacataa

SEQ ID NO: 96427 - DNA, 16 bp, H. sapiens
ctttttaaaaacatgt

SEQ ID NO: 96428 - DNA, 16 bp, H. sapiens
ctttttaaaaagtaga

SEQ ID NO: 96429 - DNA, 16 bp, H. sapiens
ctttttaaaaatacac

SEQ ID NO: 96430 - DNA, 16 bp, H. sapiens
ctttttaaaaatctgg

SEQ ID NO: 96431 - DNA, 16 bp, H. sapiens
ctttttaaaaatgaaa

SEQ ID NO: 96432 - DNA, 16 bp, H. sapiens
ctttttaaaaatgaat

SEQ ID NO: 96433 - DNA, 16 bp, H. sapiens
ctttttaaaaatgtga

SEQ ID NO: 96434 - DNA, 16 bp, H. sapiens
ctttttaaaaatgtgt

SEQ ID NO: 96435 - DNA, 16 bp, H. sapiens
ctttttaaaaatgttt

SEQ ID NO: 96436 - DNA, 16 bp, H. sapiens
ctttttaaaaattgtt

SEQ ID NO: 96437 - DNA, 16 bp, H. sapiens
ctttttaaaaatttgt

SEQ ID NO: 96438 - DNA, 16 bp, H. sapiens
ctttttaaaaccatta

SEQ ID NO: 96439 - DNA, 16 bp, H. sapiens
ctttttaaaactttgt

SEQ ID NO: 96440 - DNA, 16 bp, H. sapiens
ctttttaaaagaaaaa

SEQ ID NO: 96441 - DNA, 16 bp, H. sapiens
ctttttaaaagaagta

SEQ ID NO: 96442 - DNA, 16 bp, H. sapiens
ctttttaaaagacatt

SEQ ID NO: 96443 - DNA, 16 bp, H. sapiens
ctttttaaaagtaatt

SEQ ID NO: 96444 - DNA, 16 bp, H. sapiens
ctttttaaaatgtatt

SEQ ID NO: 96445 - DNA, 16 bp, H. sapiens
ctttttaaaattatgt

SEQ ID NO: 96446 - DNA, 16 bp, H. sapiens
ctttttaaaattcaaa

SEQ ID NO: 96447 - DNA, 16 bp, H. sapiens
ctttttaaaatttggt

SEQ ID NO: 96448 - DNA, 16 bp, H. sapiens
ctttttaaaatttttg

SEQ ID NO: 96449 - DNA, 16 bp, H. sapiens
ctttttaaagaaaata

SEQ ID NO: 96450 - DNA, 16 bp, H. sapiens
ctttttaaagaaaatt

SEQ ID NO: 96451 - DNA, 16 bp, H. sapiens
ctttttaaagcacttt

SEQ ID NO: 96452 - DNA, 16 bp, H. sapiens
ctttttaaagcatgct

SEQ ID NO: 96453 - DNA, 16 bp, H. sapiens
ctttttaaagtattta

SEQ ID NO: 96454 - DNA, 16 bp, H. sapiens
ctttttaaatttttag

SEQ ID NO: 96455 - DNA, 16 bp, H. sapiens
ctttttaagaaactgt

SEQ ID NO: 96456 - DNA, 16 bp, H. sapiens
ctttttaagaaatatt

SEQ ID NO: 96457 - DNA, 16 bp, H. sapiens
ctttttaagtttttaa

SEQ ID NO: 96458 - DNA, 16 bp, H. sapiens
ctttttaatgcattgt

SEQ ID NO: 96459 - DNA, 16 bp, H. sapiens
ctttttaatggggttg

SEQ ID NO: 96460 - DNA, 16 bp, H. sapiens
ctttttaatgtattgt

SEQ ID NO: 96461 - DNA, 16 bp, H. sapiens
ctttttaatgtgttat

SEQ ID NO: 96462 - DNA, 16 bp, H. sapiens
ctttttaattactgtg

SEQ ID NO: 96463 - DNA, 16 bp, H. sapiens
ctttttaatttgatgt

SEQ ID NO: 96464 - DNA, 16 bp, H. sapiens
ctttttacaaataaat

SEQ ID NO: 96465 - DNA, 16 bp, H. sapiens
ctttttacatttttga

SEQ ID NO: 96466 - DNA, 16 bp, H. sapiens
ctttttagaaaaatta

SEQ ID NO: 96467 - DNA, 16 bp, H. sapiens
ctttttagaaaagttt

SEQ ID NO: 96468 - DNA, 16 bp, H. sapiens
ctttttagtagagaca

SEQ ID NO: 96469 - DNA, 16 bp, H. sapiens
ctttttagtttaatga

SEQ ID NO: 96470 - DNA, 16 bp, H. sapiens
ctttttatagccaaat

SEQ ID NO: 96471 - DNA, 16 bp, H. sapiens
ctttttatatgcctgt

SEQ ID NO: 96472 - DNA, 16 bp, H. sapiens
ctttttatcattaaaa

SEQ ID NO: 96473 - DNA, 16 bp, H. sapiens
ctttttatggctgaat

SEQ ID NO: 96474 - DNA, 16 bp, H. sapiens
ctttttatggctgaga

SEQ ID NO: 96475 - DNA, 22 bp, H. sapiens
ctttttatggctgcatagtatt

SEQ ID NO: 96476 - DNA, 16 bp, H. sapiens
ctttttattaccaaat

SEQ ID NO: 96477 - DNA, 16 bp, H. sapiens
ctttttattatggaaa

SEQ ID NO: 96478 - DNA, 16 bp, H. sapiens
ctttttattttgcaat

SEQ ID NO: 96479 - DNA, 16 bp, H. sapiens
ctttttattttgccaa

SEQ ID NO: 96480 - DNA, 16 bp, H. sapiens
ctttttcaaaaaacaa

SEQ ID NO: 96481 - DNA, 16 bp, H. sapiens
ctttttcaaaattctt

SEQ ID NO: 96482 - DNA, 16 bp, H. sapiens
ctttttcaaataatga

SEQ ID NO: 96483 - DNA, 16 bp, H. sapiens
ctttttcaaatgcttt

SEQ ID NO: 96484 - DNA, 16 bp, H. sapiens
ctttttcaacaaatgg

SEQ ID NO: 96485 - DNA, 16 bp, H. sapiens
ctttttcaagattgtt

SEQ ID NO: 96486 - DNA, 16 bp, H. sapiens
ctttttcaaggttttt

SEQ ID NO: 96487 - DNA, 16 bp, H. sapiens
ctttttcacaattaaa

SEQ ID NO: 96488 - DNA, 16 bp, H. sapiens
ctttttcaccagaggc

SEQ ID NO: 96489 - DNA, 16 bp, H. sapiens
ctttttcagaaaaaca

SEQ ID NO: 96490 - DNA, 16 bp, H. sapiens
ctttttcagacagggt

SEQ ID NO: 96491 - DNA, 16 bp, H. sapiens
ctttttcagattattt

SEQ ID NO: 96492 - DNA, 16 bp, H. sapiens
ctttttcagcagtgtg

SEQ ID NO: 96493 - DNA, 16 bp, H. sapiens
ctttttcagggtttgc

SEQ ID NO: 96494 - DNA, 16 bp, H. sapiens
ctttttcatatgatga

SEQ ID NO: 96495 - DNA, 16 bp, H. sapiens
ctttttcatggggttg

SEQ ID NO: 96496 - DNA, 16 bp, H. sapiens
ctttttcatttcaaaa

SEQ ID NO: 96497 - DNA, 16 bp, H. sapiens
ctttttcatttctgca

SEQ ID NO: 96498 - DNA, 16 bp, H. sapiens
ctttttcatttgctga

SEQ ID NO: 96499 - DNA, 16 bp, H. sapiens
ctttttccaaaacaaa

SEQ ID NO: 96500 - DNA, 16 bp, H. sapiens
ctttttccaattctgt

SEQ ID NO: 96501 - DNA, 16 bp, H. sapiens
ctttttccagttctca

SEQ ID NO: 96502 - DNA, 16 bp, H. sapiens
ctttttcctttgtaaa

SEQ ID NO: 96503 - DNA, 16 bp, H. sapiens
ctttttctacttctgt

SEQ ID NO: 96504 - DNA, 16 bp, H. sapiens
ctttttctcagtttta

SEQ ID NO: 96505 - DNA, 16 bp, H. sapiens
ctttttctctctcagg

SEQ ID NO: 96506 - DNA, 16 bp, H. sapiens
ctttttctctgaagaa

SEQ ID NO: 96507 - DNA, 16 bp, H. sapiens
ctttttctgagccttc

SEQ ID NO: 96508 - DNA, 16 bp, H. sapiens
ctttttctgtaaagga

SEQ ID NO: 96509 - DNA, 16 bp, H. sapiens
ctttttctgtctgtaa

SEQ ID NO: 96510 - DNA, 16 bp, H. sapiens
ctttttcttccaatgt

SEQ ID NO: 96511 - DNA, 16 bp, H. sapiens
ctttttcttgaatcat

SEQ ID NO: 96512 - DNA, 16 bp, H. sapiens
ctttttcttgctgagt

SEQ ID NO: 96513 - DNA, 16 bp, H. sapiens
ctttttcttggttaat

SEQ ID NO: 96514 - DNA, 16 bp, H. sapiens
ctttttcttgtaatgt

SEQ ID NO: 96515 - DNA, 16 bp, H. sapiens
ctttttctttatagat

SEQ ID NO: 96516 - DNA, 16 bp, H. sapiens
ctttttctttctgaga

SEQ ID NO: 96517 - DNA, 16 bp, H. sapiens
ctttttctttgaaaaa

SEQ ID NO: 96518 - DNA, 16 bp, H. sapiens
ctttttgaaaaattaa

SEQ ID NO: 96519 - DNA, 16 bp, H. sapiens
ctttttgaaaggatca

SEQ ID NO: 96520 - DNA, 16 bp, H. sapiens
ctttttgaaataaaaa

SEQ ID NO: 96521 - DNA, 16 bp, H. sapiens
ctttttgaaataaagt

SEQ ID NO: 96522 - DNA, 16 bp, H. sapiens
ctttttgaaatgcaaa

SEQ ID NO: 96523 - DNA, 16 bp, H. sapiens
ctttttgaatttttaa

SEQ ID NO: 96524 - DNA, 16 bp, H. sapiens
ctttttgagacatagt

SEQ ID NO: 96525 - DNA, 19 bp, H. sapiens
ctttttgagatggagtctt

SEQ ID NO: 96526 - DNA, 16 bp, H. sapiens
ctttttgagcactgac

SEQ ID NO: 96527 - DNA, 16 bp, H. sapiens
ctttttgaggagctgc

SEQ ID NO: 96528 - DNA, 16 bp, H. sapiens
ctttttgatggaattg

SEQ ID NO: 96529 - DNA, 16 bp, H. sapiens
ctttttgatgggactg

SEQ ID NO: 96530 - DNA, 16 bp, H. sapiens
ctttttgatgggtttt

SEQ ID NO: 96531 - DNA, 16 bp, H. sapiens
ctttttgctattgtga

SEQ ID NO: 96532 - DNA, 16 bp, H. sapiens
ctttttgcttacaatt

SEQ ID NO: 96533 - DNA, 16 bp, H. sapiens
ctttttgcttctgcaa

SEQ ID NO: 96534 - DNA, 16 bp, H. sapiens
ctttttgcttttgcaa

SEQ ID NO: 96535 - DNA, 16 bp, H. sapiens
ctttttggatgagtct

SEQ ID NO: 96536 - DNA, 16 bp, H. sapiens
ctttttggccacttgt

SEQ ID NO: 96537 - DNA, 16 bp, H. sapiens
ctttttggtggaatga

SEQ ID NO: 96538 - DNA, 16 bp, H. sapiens
ctttttgtagaaactg

SEQ ID NO: 96539 - DNA, 16 bp, H. sapiens
ctttttgtagaatttg

SEQ ID NO: 96540 - DNA, 16 bp, H. sapiens
ctttttgtagagaggg

SEQ ID NO: 96541 - DNA, 16 bp, H. sapiens
ctttttgtagattctg

SEQ ID NO: 96542 - DNA, 16 bp, H. sapiens
ctttttgtatgctaat

SEQ ID NO: 96543 - DNA, 16 bp, H. sapiens
ctttttgtggaatcta

SEQ ID NO: 96544 - DNA, 16 bp, H. sapiens
ctttttgttaatgttg

SEQ ID NO: 96545 - DNA, 16 bp, H. sapiens
ctttttgttatttaaa

SEQ ID NO: 96546 - DNA, 16 bp, H. sapiens
ctttttgttcctctga

SEQ ID NO: 96547 - DNA, 16 bp, H. sapiens
ctttttgttgatgctg

SEQ ID NO: 96548 - DNA, 16 bp, H. sapiens
ctttttgtttaggata

SEQ ID NO: 96549 - DNA, 16 bp, H. sapiens
ctttttgtttttgaga

SEQ ID NO: 96550 - DNA, 16 bp, H. sapiens
cttttttaaaaaaaac

SEQ ID NO: 96551 - DNA, 16 bp, H. sapiens
cttttttaaaaaacca

SEQ ID NO: 96552 - DNA, 16 bp, H. sapiens
cttttttaaaaaagtg

SEQ ID NO: 96553 - DNA, 16 bp, H. sapiens
cttttttaaaaaatct

SEQ ID NO: 96554 - DNA, 16 bp, H. sapiens
cttttttaaaaagaaa

SEQ ID NO: 96555 - DNA, 16 bp, H. sapiens
cttttttaaaaataga

SEQ ID NO: 96556 - DNA, 16 bp, H. sapiens
cttttttaaaaatttg

SEQ ID NO: 96557 - DNA, 16 bp, H. sapiens
cttttttaaaagattt

SEQ ID NO: 96558 - DNA, 16 bp, H. sapiens
cttttttaaacaaaca

SEQ ID NO: 96559 - DNA, 16 bp, H. sapiens
cttttttaaaggctga

SEQ ID NO: 96560 - DNA, 16 bp, H. sapiens
cttttttaaatgtttg

SEQ ID NO: 96561 - DNA, 16 bp, H. sapiens
cttttttatgattgaa

SEQ ID NO: 96562 - DNA, 16 bp, H. sapiens
cttttttatgtttaaa

SEQ ID NO: 96563 - DNA, 16 bp, H. sapiens
cttttttattaaaatg

SEQ ID NO: 96564 - DNA, 16 bp, H. sapiens
cttttttattatagcc

SEQ ID NO: 96565 - DNA, 16 bp, H. sapiens
cttttttcaaaagaaa

SEQ ID NO: 96566 - DNA, 16 bp, H. sapiens
cttttttcacttaaca

SEQ ID NO: 96567 - DNA, 16 bp, H. sapiens
cttttttcacttaata

SEQ ID NO: 96568 - DNA, 16 bp, H. sapiens
cttttttcccccaaat

SEQ ID NO: 96569 - DNA, 16 bp, H. sapiens
cttttttcccccaact

SEQ ID NO: 96570 - DNA, 16 bp, H. sapiens
cttttttccccccaaa

SEQ ID NO: 96571 - DNA, 16 bp, H. sapiens
cttttttccccctgaa

SEQ ID NO: 96572 - DNA, 16 bp, H. sapiens
cttttttcccccttaa

SEQ ID NO: 96573 - DNA, 16 bp, H. sapiens
cttttttctaattctg

SEQ ID NO: 96574 - DNA, 16 bp, H. sapiens
cttttttctctaaagt

SEQ ID NO: 96575 - DNA, 16 bp, H. sapiens
cttttttctcttcaaa

SEQ ID NO: 96576 - DNA, 16 bp, H. sapiens
cttttttcttcaaata

SEQ ID NO: 96577 - DNA, 16 bp, H. sapiens
cttttttcttgataaa

SEQ ID NO: 96578 - DNA, 16 bp, H. sapiens
cttttttcttgtaaat

SEQ ID NO: 96579 - DNA, 16 bp, H. sapiens
cttttttctttctgaa

SEQ ID NO: 96580 - DNA, 16 bp, H. sapiens
cttttttgaaatggag

SEQ ID NO: 96581 - DNA, 16 bp, H. sapiens
cttttttgagacagaa

SEQ ID NO: 96582 - DNA, 16 bp, H. sapiens
cttttttgagacatgg

SEQ ID NO: 96583 - DNA, 16 bp, H. sapiens
cttttttgagatgcag

SEQ ID NO: 96584 - DNA, 16 bp, H. sapiens
cttttttgatgtagat

SEQ ID NO: 96585 - DNA, 16 bp, H. sapiens
cttttttgcctttaaa

SEQ ID NO: 96586 - DNA, 16 bp, H. sapiens
cttttttggggggatg

SEQ ID NO: 96587 - DNA, 16 bp, H. sapiens
cttttttgtgtagata

SEQ ID NO: 96588 - DNA, 16 bp, H. sapiens
ctttttttaaaaaatc

SEQ ID NO: 96589 - DNA, 16 bp, H. sapiens
ctttttttaaaaaatg

SEQ ID NO: 96590 - DNA, 16 bp, H. sapiens
ctttttttaaaataag

SEQ ID NO: 96591 - DNA, 16 bp, H. sapiens
ctttttttaaacaaga

SEQ ID NO: 96592 - DNA, 16 bp, H. sapiens
ctttttttccccctga

SEQ ID NO: 96593 - DNA, 16 bp, H. sapiens
ctttttttctcagtct

SEQ ID NO: 96594 - DNA, 16 bp, H. sapiens
ctttttttcttagtca

SEQ ID NO: 96595 - DNA, 16 bp, H. sapiens
ctttttttctttagaa

SEQ ID NO: 96596 - DNA, 16 bp, H. sapiens
ctttttttctttgaga

SEQ ID NO: 96597 - DNA, 16 bp, H. sapiens
ctttttttgaaaaaaa

SEQ ID NO: 96598 - DNA, 16 bp, H. sapiens
ctttttttgtaaatat

SEQ ID NO: 96599 - DNA, 16 bp, H. sapiens
ctttttttgtttaaaa

SEQ ID NO: 96600 - DNA, 16 bp, H. sapiens
cttttttttaaagaat

SEQ ID NO: 96601 - DNA, 16 bp, H. sapiens
cttttttttccccaca

SEQ ID NO: 96602 - DNA, 23 bp, H. sapiens
cttttttttgagatggagtctcg

SEQ ID NO: 96603 - DNA, 16 bp, H. sapiens
ctttttttttaaatag

SEQ ID NO: 96604 - DNA, 16 bp, H. sapiens
ctttttttttaagaga

SEQ ID NO: 96605 - DNA, 16 bp, H. sapiens
ctttttttttcctgaa

SEQ ID NO: 96606 - DNA, 16 bp, H. sapiens
ctttttttttgaaaca

SEQ ID NO: 96607 - DNA, 16 bp, H. sapiens
ctttttttttgagata

SEQ ID NO: 96608 - DNA, 16 bp, H. sapiens
cttttttttttaagac

SEQ ID NO: 96609 - DNA, 16 bp, H. sapiens
cttttttttttgacac

SEQ ID NO: 96610 - DNA, 16 bp, H. sapiens
gaaaaaaaaacattct

SEQ ID NO: 96611 - DNA, 16 bp, H. sapiens
gaaaaaaaaatctgct

SEQ ID NO: 96612 - DNA, 16 bp, H. sapiens
gaaaaaaaagtttttt

SEQ ID NO: 96613 - DNA, 16 bp, H. sapiens
gaaaaaaaatatttct

SEQ ID NO: 96614 - DNA, 16 bp, H. sapiens
gaaaaaaaatcacatt

SEQ ID NO: 96615 - DNA, 16 bp, H. sapiens
gaaaaaaaatcatctt

SEQ ID NO: 96616 - DNA, 16 bp, H. sapiens
gaaaaaaaatcatttt

SEQ ID NO: 96617 - DNA, 16 bp, H. sapiens
gaaaaaaaatccacat

SEQ ID NO: 96618 - DNA, 16 bp, H. sapiens
gaaaaaaaatctctat

SEQ ID NO: 96619 - DNA, 16 bp, H. sapiens
gaaaaaaaattacact

SEQ ID NO: 96620 - DNA, 16 bp, H. sapiens
gaaaaaaaatttgcaa

SEQ ID NO: 96621 - DNA, 16 bp, H. sapiens
gaaaaaaacacacatt

SEQ ID NO: 96622 - DNA, 16 bp, H. sapiens
gaaaaaaacattattt

SEQ ID NO: 96623 - DNA, 16 bp, H. sapiens
gaaaaaaactcaacat

SEQ ID NO: 96624 - DNA, 16 bp, H. sapiens
gaaaaaaactggaaat

SEQ ID NO: 96625 - DNA, 16 bp, H. sapiens
gaaaaaaagctcatca

SEQ ID NO: 96626 - DNA, 16 bp, H. sapiens
gaaaaaaaggctgggc

SEQ ID NO: 96627 - DNA, 16 bp, H. sapiens
gaaaaaaatagttttt

SEQ ID NO: 96628 - DNA, 16 bp, H. sapiens
gaaaaaaatcaagatt

SEQ ID NO: 96629 - DNA, 16 bp, H. sapiens
gaaaaaaatcagaatt

SEQ ID NO: 96630 - DNA, 16 bp, H. sapiens
gaaaaaaatcatttta

SEQ ID NO: 96631 - DNA, 16 bp, H. sapiens
gaaaaaaatctccaaa

SEQ ID NO: 96632 - DNA, 16 bp, H. sapiens
gaaaaaaatctggaaa

SEQ ID NO: 96633 - DNA, 16 bp, H. sapiens
gaaaaaaatgcccaac

SEQ ID NO: 96634 - DNA, 16 bp, H. sapiens
gaaaaaaattacttta

SEQ ID NO: 96635 - DNA, 16 bp, H. sapiens
gaaaaaaattcacatt

SEQ ID NO: 96636 - DNA, 16 bp, H. sapiens
gaaaaaaattcttgaa

SEQ ID NO: 96637 - DNA, 16 bp, H. sapiens
gaaaaaaattgtcttc

SEQ ID NO: 96638 - DNA, 16 bp, H. sapiens
gaaaaaacattccatc

SEQ ID NO: 96639 - DNA, 16 bp, H. sapiens
gaaaaaacccttcaaa

SEQ ID NO: 96640 - DNA, 16 bp, H. sapiens
gaaaaaactgcatcaa

SEQ ID NO: 96641 - DNA, 16 bp, H. sapiens
gaaaaaagaaatctgt

SEQ ID NO: 96642 - DNA, 16 bp, H. sapiens
gaaaaaagaacaggat

SEQ ID NO: 96643 - DNA, 16 bp, H. sapiens
gaaaaaagactggaag

SEQ ID NO: 96644 - DNA, 16 bp, H. sapiens
gaaaaaagaggccagg

SEQ ID NO: 96645 - DNA, 16 bp, H. sapiens
gaaaaaagattcagag

SEQ ID NO: 96646 - DNA, 16 bp, H. sapiens
gaaaaaagccagtcac

SEQ ID NO: 96647 - DNA, 16 bp, H. sapiens
gaaaaaagcttcaaaa

SEQ ID NO: 96648 - DNA, 16 bp, H. sapiens
gaaaaaaggaaagttt

SEQ ID NO: 96649 - DNA, 16 bp, H. sapiens
gaaaaaaggccaggtg

SEQ ID NO: 96650 - DNA, 16 bp, H. sapiens
gaaaaaaggttttaaa

SEQ ID NO: 96651 - DNA, 16 bp, H. sapiens
gaaaaaatatctttca

SEQ ID NO: 96652 - DNA, 16 bp, H. sapiens
gaaaaaatatttgaca

SEQ ID NO: 96653 - DNA, 16 bp, H. sapiens
gaaaaaatcaggtaaa

SEQ ID NO: 96654 - DNA, 16 bp, H. sapiens
gaaaaaatcttgaaag

SEQ ID NO: 96655 - DNA, 16 bp, H. sapiens
gaaaaaatgcattttt

SEQ ID NO: 96656 - DNA, 16 bp, H. sapiens
gaaaaaatgtattttt

SEQ ID NO: 96657 - DNA, 16 bp, H. sapiens
gaaaaaattcctagaa

SEQ ID NO: 96658 - DNA, 16 bp, H. sapiens
gaaaaacaaaaggttt

SEQ ID NO: 96659 - DNA, 16 bp, H. sapiens
gaaaaacaaattttcc

SEQ ID NO: 96660 - DNA, 16 bp, H. sapiens
gaaaaacacttcaaaa

SEQ ID NO: 96661 - DNA, 16 bp, H. sapiens
gaaaaacagaatattt

SEQ ID NO: 96662 - DNA, 16 bp, H. sapiens
gaaaaacagatttaaa

SEQ ID NO: 96663 - DNA, 16 bp, H. sapiens
gaaaaacaggcagtta

SEQ ID NO: 96664 - DNA, 16 bp, H. sapiens
gaaaaacagtttggca

SEQ ID NO: 96665 - DNA, 16 bp, H. sapiens
gaaaaacatattttca

SEQ ID NO: 96666 - DNA, 16 bp, H. sapiens
gaaaaacatctgaaaa

SEQ ID NO: 96667 - DNA, 16 bp, H. sapiens
gaaaaacatggcacga

SEQ ID NO: 96668 - DNA, 16 bp, H. sapiens
gaaaaacattcaaata

SEQ ID NO: 96669 - DNA, 16 bp, H. sapiens
gaaaaacattctgtgc

SEQ ID NO: 96670 - DNA, 16 bp, H. sapiens
gaaaaacattttctaa

SEQ ID NO: 96671 - DNA, 17 bp, H. sapiens
gaaaaaccagtgcaaaa

SEQ ID NO: 96672 - DNA, 16 bp, H. sapiens
gaaaaacctaaaaatt

SEQ ID NO: 96673 - DNA, 16 bp, H. sapiens
gaaaaacctagaagaa

SEQ ID NO: 96674 - DNA, 16 bp, H. sapiens
gaaaaactaaatggaa

SEQ ID NO: 96675 - DNA, 16 bp, H. sapiens
gaaaaactactttaaa

SEQ ID NO: 96676 - DNA, 16 bp, H. sapiens
gaaaaactatttaaaa

SEQ ID NO: 96677 - DNA, 16 bp, H. sapiens
gaaaaactgacatctt

SEQ ID NO: 96678 - DNA, 16 bp, H. sapiens
gaaaaactgcaaactg

SEQ ID NO: 96679 - DNA, 16 bp, H. sapiens
gaaaaactttcagaaa

SEQ ID NO: 96680 - DNA, 16 bp, H. sapiens
gaaaaactttttttaa

SEQ ID NO: 96681 - DNA, 16 bp, H. sapiens
gaaaaagaaaaaggct

SEQ ID NO: 96682 - DNA, 16 bp, H. sapiens
gaaaaagaaaacattt

SEQ ID NO: 96683 - DNA, 16 bp, H. sapiens
gaaaaagaaaaccatt

SEQ ID NO: 96684 - DNA, 16 bp, H. sapiens
gaaaaagaaactgtca

SEQ ID NO: 96685 - DNA, 16 bp, H. sapiens
gaaaaagaaatgctta

SEQ ID NO: 96686 - DNA, 16 bp, H. sapiens
gaaaaagaacaaagct

SEQ ID NO: 96687 - DNA, 16 bp, H. sapiens
gaaaaagaaggaatcc

SEQ ID NO: 96688 - DNA, 16 bp, H. sapiens
gaaaaagaatattttg

SEQ ID NO: 96689 - DNA, 16 bp, H. sapiens
gaaaaagacaagaatg

SEQ ID NO: 96690 - DNA, 18 bp, H. sapiens
gaaaaagacctgtacttt

SEQ ID NO: 96691 - DNA, 16 bp, H. sapiens
gaaaaagagcaaatta

SEQ ID NO: 96692 - DNA, 16 bp, H. sapiens
gaaaaagagtccagga

SEQ ID NO: 96693 - DNA, 16 bp, H. sapiens
gaaaaagatattttat

SEQ ID NO: 96694 - DNA, 16 bp, H. sapiens
gaaaaagatgatttaa

SEQ ID NO: 96695 - DNA, 16 bp, H. sapiens
gaaaaagatttaattg

SEQ ID NO: 96696 - DNA, 16 bp, H. sapiens
gaaaaagcaatggaaa

SEQ ID NO: 96697 - DNA, 16 bp, H. sapiens
gaaaaagcactggaca

SEQ ID NO: 96698 - DNA, 16 bp, H. sapiens
gaaaaagcattcaaca

SEQ ID NO: 96699 - DNA, 16 bp, H. sapiens
gaaaaagccaaactct

SEQ ID NO: 96700 - DNA, 16 bp, H. sapiens
gaaaaagccagacaca

SEQ ID NO: 96701 - DNA, 16 bp, H. sapiens
gaaaaagccatgaaag

SEQ ID NO: 96702 - DNA, 16 bp, H. sapiens
gaaaaagcttatagaa

SEQ ID NO: 96703 - DNA, 16 bp, H. sapiens
gaaaaaggaaaatgac

SEQ ID NO: 96704 - DNA, 16 bp, H. sapiens
gaaaaaggaaatattt

SEQ ID NO: 96705 - DNA, 16 bp, H. sapiens
gaaaaagtctccattc

SEQ ID NO: 96706 - DNA, 16 bp, H. sapiens
gaaaaagttattttaa

SEQ ID NO: 96707 - DNA, 16 bp, H. sapiens
gaaaaagttctgaaga

SEQ ID NO: 96708 - DNA, 16 bp, H. sapiens
gaaaaataaagacatt

SEQ ID NO: 96709 - DNA, 16 bp, H. sapiens
gaaaaataaagcagga

SEQ ID NO: 96710 - DNA, 16 bp, H. sapiens
gaaaaataaatggttt

SEQ ID NO: 96711 - DNA, 16 bp, H. sapiens
gaaaaataaatttctg

SEQ ID NO: 96712 - DNA, 16 bp, H. sapiens
gaaaaataagacattt

SEQ ID NO: 96713 - DNA, 16 bp, H. sapiens
gaaaaataatcctaaa

SEQ ID NO: 96714 - DNA, 16 bp, H. sapiens
gaaaaataattcagaa

SEQ ID NO: 96715 - DNA, 16 bp, H. sapiens
gaaaaatacaataact

SEQ ID NO: 96716 - DNA, 16 bp, H. sapiens
gaaaaatacaggaaag

SEQ ID NO: 96717 - DNA, 16 bp, H. sapiens
gaaaaatacagtatct

SEQ ID NO: 96718 - DNA, 16 bp, H. sapiens
gaaaaatacatttgaa

SEQ ID NO: 96719 - DNA, 16 bp, H. sapiens
gaaaaatactgctttt

SEQ ID NO: 96720 - DNA, 16 bp, H. sapiens
gaaaaataggaacact

SEQ ID NO: 96721 - DNA, 16 bp, H. sapiens
gaaaaatattcaagaa

SEQ ID NO: 96722 - DNA, 16 bp, H. sapiens
gaaaaatatttctata

SEQ ID NO: 96723 - DNA, 16 bp, H. sapiens
gaaaaatatttgcaac

SEQ ID NO: 96724 - DNA, 16 bp, H. sapiens
gaaaaatcaaaatcag

SEQ ID NO: 96725 - DNA, 16 bp, H. sapiens
gaaaaatcacaatttt

SEQ ID NO: 96726 - DNA, 16 bp, H. sapiens
gaaaaatcagaaagca

SEQ ID NO: 96727 - DNA, 16 bp, H. sapiens
gaaaaatcatcttcca

SEQ ID NO: 96728 - DNA, 16 bp, H. sapiens
gaaaaatcgaaagtgc

SEQ ID NO: 96729 - DNA, 16 bp, H. sapiens
gaaaaatctaaaattg

SEQ ID NO: 96730 - DNA, 16 bp, H. sapiens
gaaaaatctccaaata

SEQ ID NO: 96731 - DNA, 16 bp, H. sapiens
gaaaaatcttcaacaa

SEQ ID NO: 96732 - DNA, 16 bp, H. sapiens
gaaaaatgaagcaggg

SEQ ID NO: 96733 - DNA, 16 bp, H. sapiens
gaaaaatgaatatttt

SEQ ID NO: 96734 - DNA, 16 bp, H. sapiens
gaaaaatgaatgagat

SEQ ID NO: 96735 - DNA, 16 bp, H. sapiens
gaaaaatgacattgaa

SEQ ID NO: 96736 - DNA, 16 bp, H. sapiens
gaaaaatgagcaaaga

SEQ ID NO: 96737 - DNA, 16 bp, H. sapiens
gaaaaatgcaatagag

SEQ ID NO: 96738 - DNA, 16 bp, H. sapiens
gaaaaatgcatttttt

SEQ ID NO: 96739 - DNA, 16 bp, H. sapiens
gaaaaatgctcatcat

SEQ ID NO: 96740 - DNA, 16 bp, H. sapiens
gaaaaatgctccacat

SEQ ID NO: 96741 - DNA, 16 bp, H. sapiens
gaaaaatggaacagaa

SEQ ID NO: 96742 - DNA, 16 bp, H. sapiens
gaaaaatgtctgttca

SEQ ID NO: 96743 - DNA, 16 bp, H. sapiens
gaaaaatgtgaaattt

SEQ ID NO: 96744 - DNA, 16 bp, H. sapiens
gaaaaatgtgggaaag

SEQ ID NO: 96745 - DNA, 16 bp, H. sapiens
gaaaaatgttcatttt

SEQ ID NO: 96746 - DNA, 16 bp, H. sapiens
gaaaaatgttgctttt

SEQ ID NO: 96747 - DNA, 16 bp, H. sapiens
gaaaaatgttttataa

SEQ ID NO: 96748 - DNA, 16 bp, H. sapiens
gaaaaatgtttttaaa

SEQ ID NO: 96749 - DNA, 16 bp, H. sapiens
gaaaaatgtttttgtt

SEQ ID NO: 96750 - DNA, 16 bp, H. sapiens
gaaaaattaaagttga

SEQ ID NO: 96751 - DNA, 16 bp, H. sapiens
gaaaaattcaaaatat

SEQ ID NO: 96752 - DNA, 16 bp, H. sapiens
gaaaaattcaagctgg

SEQ ID NO: 96753 - DNA, 16 bp, H. sapiens
gaaaaattcagagaaa

SEQ ID NO: 96754 - DNA, 16 bp, H. sapiens
gaaaaattctcaacaa

SEQ ID NO: 96755 - DNA, 16 bp, H. sapiens
gaaaaattctcagtca

SEQ ID NO: 96756 - DNA, 16 bp, H. sapiens
gaaaaattgctttttt

SEQ ID NO: 96757 - DNA, 16 bp, H. sapiens
gaaaaattggccaaaa

SEQ ID NO: 96758 - DNA, 16 bp, H. sapiens
gaaaaattggtgacaa

SEQ ID NO: 96759 - DNA, 16 bp, H. sapiens
gaaaaattgtcttcaa

SEQ ID NO: 96760 - DNA, 16 bp, H. sapiens
gaaaaattgtgaagat

SEQ ID NO: 96761 - DNA, 16 bp, H. sapiens
gaaaaatttcaaataa

SEQ ID NO: 96762 - DNA, 16 bp, H. sapiens
gaaaaatttcaaatat

SEQ ID NO: 96763 - DNA, 16 bp, H. sapiens
gaaaaatttcaagaaa

SEQ ID NO: 96764 - DNA, 16 bp, H. sapiens
gaaaaattttgcaaat

SEQ ID NO: 96765 - DNA, 16 bp, H. sapiens
gaaaacaaaaatgtat

SEQ ID NO: 96766 - DNA, 16 bp, H. sapiens
gaaaacaaaaatgttt

SEQ ID NO: 96767 - DNA, 16 bp, H. sapiens
gaaaacaaaactcaga

SEQ ID NO: 96768 - DNA, 16 bp, H. sapiens
gaaaacaaagattttt

SEQ ID NO: 96769 - DNA, 16 bp, H. sapiens
gaaaacaaatgttttt

SEQ ID NO: 96770 - DNA, 16 bp, H. sapiens
gaaaacaacctaaatg

SEQ ID NO: 96771 - DNA, 16 bp, H. sapiens
gaaaacaagatggaaa

SEQ ID NO: 96772 - DNA, 20 bp, H. sapiens
gaaaacaagcaatggggaaa

SEQ ID NO: 96773 - DNA, 16 bp, H. sapiens
gaaaacaagctcagag

SEQ ID NO: 96774 - DNA, 16 bp, H. sapiens
gaaaacaaggaaaatg

SEQ ID NO: 96775 - DNA, 16 bp, H. sapiens
gaaaacaataccccaa

SEQ ID NO: 96776 - DNA, 16 bp, H. sapiens
gaaaacaatatatttt

SEQ ID NO: 96777 - DNA, 16 bp, H. sapiens
gaaaacaatgagattt

SEQ ID NO: 96778 - DNA, 16 bp, H. sapiens
gaaaacaattcaattt

SEQ ID NO: 96779 - DNA, 16 bp, H. sapiens
gaaaacacaaatttaa

SEQ ID NO: 96780 - DNA, 16 bp, H. sapiens
gaaaacacacatacac

SEQ ID NO: 96781 - DNA, 16 bp, H. sapiens
gaaaacactggaaaaa

SEQ ID NO: 96782 - DNA, 16 bp, H. sapiens
gaaaacacttcaggat

SEQ ID NO: 96783 - DNA, 16 bp, H. sapiens
gaaaacactttgtaaa

SEQ ID NO: 96784 - DNA, 16 bp, H. sapiens
gaaaacagaacactta

SEQ ID NO: 96785 - DNA, 16 bp, H. sapiens
gaaaacagcaagtgca

SEQ ID NO: 96786 - DNA, 16 bp, H. sapiens
gaaaacaggaaaatgt

SEQ ID NO: 96787 - DNA, 16 bp, H. sapiens
gaaaacaggaaatcaa

SEQ ID NO: 96788 - DNA, 16 bp, H. sapiens
gaaaacagtatggcaa

SEQ ID NO: 96789 - DNA, 16 bp, H. sapiens
gaaaacagtatggcag

SEQ ID NO: 96790 - DNA, 16 bp, H. sapiens
gaaaacagtgcagaga

SEQ ID NO: 96791 - DNA, 16 bp, H. sapiens
gaaaacagtgtggaga

SEQ ID NO: 96792 - DNA, 16 bp, H. sapiens
gaaaacagttgtttca

SEQ ID NO: 96793 - DNA, 16 bp, H. sapiens
gaaaacagtttgaaaa

SEQ ID NO: 96794 - DNA, 16 bp, H. sapiens
gaaaacagtttggcaa

SEQ ID NO: 96795 - DNA, 16 bp, H. sapiens
gaaaacagtttttcca

SEQ ID NO: 96796 - DNA, 16 bp, H. sapiens
gaaaacagtttttttt

SEQ ID NO: 96797 - DNA, 16 bp, H. sapiens
gaaaacataggaaaat

SEQ ID NO: 96798 - DNA, 16 bp, H. sapiens
gaaaacataggagaaa

SEQ ID NO: 96799 - DNA, 16 bp, H. sapiens
gaaaacatcagagaaa

SEQ ID NO: 96800 - DNA, 16 bp, H. sapiens
gaaaacatcttaaaaa

SEQ ID NO: 96801 - DNA, 16 bp, H. sapiens
gaaaacatggaagaaa

SEQ ID NO: 96802 - DNA, 16 bp, H. sapiens
gaaaacatgtgagcaa

SEQ ID NO: 96803 - DNA, 16 bp, H. sapiens
gaaaacattagggaaa

SEQ ID NO: 96804 - DNA, 16 bp, H. sapiens
gaaaacattccatcct

SEQ ID NO: 96805 - DNA, 16 bp, H. sapiens
gaaaacattcttcagg

SEQ ID NO: 96806 - DNA, 16 bp, H. sapiens
gaaaacatttcaaatt

SEQ ID NO: 96807 - DNA, 16 bp, H. sapiens
gaaaacatttgaaatt

SEQ ID NO: 96808 - DNA, 16 bp, H. sapiens
gaaaacatttgaattt

SEQ ID NO: 96809 - DNA, 16 bp, H. sapiens
gaaaacatttgccaac

SEQ ID NO: 96810 - DNA, 16 bp, H. sapiens
gaaaacatttggaaaa

SEQ ID NO: 96811 - DNA, 16 bp, H. sapiens
gaaaacatttgggaaa

SEQ ID NO: 96812 - DNA, 16 bp, H. sapiens
gaaaacattttattct

SEQ ID NO: 96813 - DNA, 16 bp, H. sapiens
gaaaaccaaaattata

SEQ ID NO: 96814 - DNA, 16 bp, H. sapiens
gaaaaccaaaatttaa

SEQ ID NO: 96815 - DNA, 16 bp, H. sapiens
gaaaaccaaacacctc

SEQ ID NO: 96816 - DNA, 16 bp, H. sapiens
gaaaaccaaatacaca

SEQ ID NO: 96817 - DNA, 16 bp, H. sapiens
gaaaaccaaatacctc

SEQ ID NO: 96818 - DNA, 16 bp, H. sapiens
gaaaaccaaattttac

SEQ ID NO: 96819 - DNA, 21 bp, H. sapiens
gaaaaccatggcacaagaact

SEQ ID NO: 96820 - DNA, 16 bp, H. sapiens
gaaaacccaactcaaa

SEQ ID NO: 96821 - DNA, 16 bp, H. sapiens
gaaaaccctaaagact

SEQ ID NO: 96822 - DNA, 16 bp, H. sapiens
gaaaacctagaaaaca

SEQ ID NO: 96823 - DNA, 16 bp, H. sapiens
gaaaacctagaagaaa

SEQ ID NO: 96824 - DNA, 16 bp, H. sapiens
gaaaacctagaagaga

SEQ ID NO: 96825 - DNA, 16 bp, H. sapiens
gaaaacctaggaaata

SEQ ID NO: 96826 - DNA, 16 bp, H. sapiens
gaaaacctaggcaaaa

SEQ ID NO: 96827 - DNA, 16 bp, H. sapiens
gaaaacctcaacaaac

SEQ ID NO: 96828 - DNA, 16 bp, H. sapiens
gaaaacctcctggaaa

SEQ ID NO: 96829 - DNA, 16 bp, H. sapiens
gaaaacctctgacatg

SEQ ID NO: 96830 - DNA, 16 bp, H. sapiens
gaaaacctgaacaaac

SEQ ID NO: 96831 - DNA, 16 bp, H. sapiens
gaaaacctgaacagac

SEQ ID NO: 96832 - DNA, 16 bp, H. sapiens
gaaaacctgcacaaga

SEQ ID NO: 96833 - DNA, 16 bp, H. sapiens
gaaaacctggaagaaa

SEQ ID NO: 96834 - DNA, 16 bp, H. sapiens
gaaaaccttccagtgg

SEQ ID NO: 96835 - DNA, 16 bp, H. sapiens
gaaaaccttctggaaa

SEQ ID NO: 96836 - DNA, 16 bp, H. sapiens
gaaaactaaaattata

SEQ ID NO: 96837 - DNA, 16 bp, H. sapiens
gaaaactaaattttaa

SEQ ID NO: 96838 - DNA, 16 bp, H. sapiens
gaaaactaagaaaatt

SEQ ID NO: 96839 - DNA, 16 bp, H. sapiens
gaaaactacattttaa

SEQ ID NO: 96840 - DNA, 16 bp, H. sapiens
gaaaactccagaaata

SEQ ID NO: 96841 - DNA, 16 bp, H. sapiens
gaaaactgaaaatgga

SEQ ID NO: 96842 - DNA, 16 bp, H. sapiens
gaaaactgaagaaaga

SEQ ID NO: 96843 - DNA, 16 bp, H. sapiens
gaaaactgaagcccaa

SEQ ID NO: 96844 - DNA, 16 bp, H. sapiens
gaaaactgaggccaga

SEQ ID NO: 96845 - DNA, 16 bp, H. sapiens
gaaaactgcagaagca

SEQ ID NO: 96846 - DNA, 16 bp, H. sapiens
gaaaactgcttaaagg

SEQ ID NO: 96847 - DNA, 16 bp, H. sapiens
gaaaactggaaatcca

SEQ ID NO: 96848 - DNA, 16 bp, H. sapiens
gaaaactggaacaaaa

SEQ ID NO: 96849 - DNA, 27 bp, H. sapiens
gaaaactggaagcattccctttgaaaa

SEQ ID NO: 96850 - DNA, 16 bp, H. sapiens
gaaaactggagagaga

SEQ ID NO: 96851 - DNA, 16 bp, H. sapiens
gaaaactggatataca

SEQ ID NO: 96852 - DNA, 16 bp, H. sapiens
gaaaactggatatcca

SEQ ID NO: 96853 - DNA, 16 bp, H. sapiens
gaaaactggcgagcca

SEQ ID NO: 96854 - DNA, 16 bp, H. sapiens
gaaaactggctggcca

SEQ ID NO: 96855 - DNA, 16 bp, H. sapiens
gaaaactggctgggca

SEQ ID NO: 96856 - DNA, 16 bp, H. sapiens
gaaaactgtctagcca

SEQ ID NO: 96857 - DNA, 16 bp, H. sapiens
gaaaactgtgtgtgtg

SEQ ID NO: 96858 - DNA, 16 bp, H. sapiens
gaaaacttaagacaaa

SEQ ID NO: 96859 - DNA, 16 bp, H. sapiens
gaaaacttagatgaaa

SEQ ID NO: 96860 - DNA, 16 bp, H. sapiens
gaaaacttgtatctgc

SEQ ID NO: 96861 - DNA, 16 bp, H. sapiens
gaaaacttgtctctac

SEQ ID NO: 96862 - DNA, 16 bp, H. sapiens
gaaaactttctggaaa

SEQ ID NO: 96863 - DNA, 16 bp, H. sapiens
gaaaactttggagaaa

SEQ ID NO: 96864 - DNA, 16 bp, H. sapiens
gaaaagaaaaactact

SEQ ID NO: 96865 - DNA, 16 bp, H. sapiens
gaaaagaaaaagttct

SEQ ID NO: 96866 - DNA, 16 bp, H. sapiens
gaaaagaaaactattt

SEQ ID NO: 96867 - DNA, 16 bp, H. sapiens
gaaaagaaaactgagg

SEQ ID NO: 96868 - DNA, 16 bp, H. sapiens
gaaaagaaaagatgct

SEQ ID NO: 96869 - DNA, 16 bp, H. sapiens
gaaaagaaaatccaat

SEQ ID NO: 96870 - DNA, 16 bp, H. sapiens
gaaaagaaaatgtgtt

SEQ ID NO: 96871 - DNA, 16 bp, H. sapiens
gaaaagaaaatgttat

SEQ ID NO: 96872 - DNA, 16 bp, H. sapiens
gaaaagaaaatgtttt

SEQ ID NO: 96873 - DNA, 16 bp, H. sapiens
gaaaagaaaattagca

SEQ ID NO: 96874 - DNA, 16 bp, H. sapiens
gaaaagaaaattcatt

SEQ ID NO: 96875 - DNA, 16 bp, H. sapiens
gaaaagaaaattctat

SEQ ID NO: 96876 - DNA, 16 bp, H. sapiens
gaaaagaaagattcaa

SEQ ID NO: 96877 - DNA, 16 bp, H. sapiens
gaaaagaaagcttgga

SEQ ID NO: 96878 - DNA, 16 bp, H. sapiens
gaaaagaaaggttcaa

SEQ ID NO: 96879 - DNA, 16 bp, H. sapiens
gaaaagaaaggtttaa

SEQ ID NO: 96880 - DNA, 16 bp, H. sapiens
gaaaagaaagtttatt

SEQ ID NO: 96881 - DNA, 16 bp, H. sapiens
gaaaagaaagtttgta

SEQ ID NO: 96882 - DNA, 16 bp, H. sapiens
gaaaagaaatcataga

SEQ ID NO: 96883 - DNA, 16 bp, H. sapiens
gaaaagaaatctgaaa

SEQ ID NO: 96884 - DNA, 16 bp, H. sapiens
gaaaagaaatttctgt

SEQ ID NO: 96885 - DNA, 16 bp, H. sapiens
gaaaagaactttcaac

SEQ ID NO: 96886 - DNA, 16 bp, H. sapiens
gaaaagaaggccaggc

SEQ ID NO: 96887 - DNA, 16 bp, H. sapiens
gaaaagaagtcattat

SEQ ID NO: 96888 - DNA, 16 bp, H. sapiens
gaaaagaagtttcaac

SEQ ID NO: 96889 - DNA, 16 bp, H. sapiens
gaaaagaatatttatt

SEQ ID NO: 96890 - DNA, 16 bp, H. sapiens
gaaaagaatcagtgaa

SEQ ID NO: 96891 - DNA, 16 bp, H. sapiens
gaaaagaatctgaaca

SEQ ID NO: 96892 - DNA, 16 bp, H. sapiens
gaaaagaatgaaatca

SEQ ID NO: 96893 - DNA, 16 bp, H. sapiens
gaaaagaatgtacatt

SEQ ID NO: 96894 - DNA, 16 bp, H. sapiens
gaaaagaatgtgtgtt

SEQ ID NO: 96895 - DNA, 16 bp, H. sapiens
gaaaagaatgttttaa

SEQ ID NO: 96896 - DNA, 16 bp, H. sapiens
gaaaagaattttcaat

SEQ ID NO: 96897 - DNA, 16 bp, H. sapiens
gaaaagaattttcagc

SEQ ID NO: 96898 - DNA, 16 bp, H. sapiens
gaaaagaattttcttt

SEQ ID NO: 96899 - DNA, 16 bp, H. sapiens
gaaaagacaattcttt

SEQ ID NO: 96900 - DNA, 16 bp, H. sapiens
gaaaagacacagactg

SEQ ID NO: 96901 - DNA, 16 bp, H. sapiens
gaaaagacagccatct

SEQ ID NO: 96902 - DNA, 16 bp, H. sapiens
gaaaagacataaagga

SEQ ID NO: 96903 - DNA, 16 bp, H. sapiens
gaaaagacatttgata

SEQ ID NO: 96904 - DNA, 16 bp, H. sapiens
gaaaagaccattcttt

SEQ ID NO: 96905 - DNA, 16 bp, H. sapiens
gaaaagactaaatcta

SEQ ID NO: 96906 - DNA, 16 bp, H. sapiens
gaaaagactgtatctt

SEQ ID NO: 96907 - DNA, 16 bp, H. sapiens
gaaaagactgtctttt

SEQ ID NO: 96908 - DNA, 16 bp, H. sapiens
gaaaagagaaaacatt

SEQ ID NO: 96909 - DNA, 16 bp, H. sapiens
gaaaagagaacacttc

SEQ ID NO: 96910 - DNA, 16 bp, H. sapiens
gaaaagagaagtcaaa

SEQ ID NO: 96911 - DNA, 16 bp, H. sapiens
gaaaagagaattttta

SEQ ID NO: 96912 - DNA, 16 bp, H. sapiens
gaaaagagagaagcat

SEQ ID NO: 96913 - DNA, 16 bp, H. sapiens
gaaaagagatgtattt

SEQ ID NO: 96914 - DNA, 16 bp, H. sapiens
gaaaagagatttattt

SEQ ID NO: 96915 - DNA, 16 bp, H. sapiens
gaaaagagattttaaa

SEQ ID NO: 96916 - DNA, 16 bp, H. sapiens
gaaaagaggtataatt

SEQ ID NO: 96917 - DNA, 16 bp, H. sapiens
gaaaagaggttcaatt

SEQ ID NO: 96918 - DNA, 16 bp, H. sapiens
gaaaagaggtttattt

SEQ ID NO: 96919 - DNA, 16 bp, H. sapiens
gaaaagaggttttatt

SEQ ID NO: 96920 - DNA, 16 bp, H. sapiens
gaaaagagttttaaaa

SEQ ID NO: 96921 - DNA, 16 bp, H. sapiens
gaaaagatacttgaca

SEQ ID NO: 96922 - DNA, 16 bp, H. sapiens
gaaaagatagtctttt

SEQ ID NO: 96923 - DNA, 16 bp, H. sapiens
gaaaagatatttaaca

SEQ ID NO: 96924 - DNA, 16 bp, H. sapiens
gaaaagatatttgcaa

SEQ ID NO: 96925 - DNA, 16 bp, H. sapiens
gaaaagatcaacaaga

SEQ ID NO: 96926 - DNA, 16 bp, H. sapiens
gaaaagatgctgaaca

SEQ ID NO: 96927 - DNA, 16 bp, H. sapiens
gaaaagatgcttagca

SEQ ID NO: 96928 - DNA, 16 bp, H. sapiens
gaaaagatggccatct

SEQ ID NO: 96929 - DNA, 16 bp, H. sapiens
gaaaagattcaccatt

SEQ ID NO: 96930 - DNA, 16 bp, H. sapiens
gaaaagattcctttca

SEQ ID NO: 96931 - DNA, 16 bp, H. sapiens
gaaaagattttcaaca

SEQ ID NO: 96932 - DNA, 16 bp, H. sapiens
gaaaagcaaaggaaat

SEQ ID NO: 96933 - DNA, 16 bp, H. sapiens
gaaaagcagaagaaat

SEQ ID NO: 96934 - DNA, 16 bp, H. sapiens
gaaaagcagcagcagc

SEQ ID NO: 96935 - DNA, 16 bp, H. sapiens
gaaaagcatagtatct

SEQ ID NO: 96936 - DNA, 16 bp, H. sapiens
gaaaagcattttataa

SEQ ID NO: 96937 - DNA, 16 bp, H. sapiens
gaaaagcatttttaaa

SEQ ID NO: 96938 - DNA, 16 bp, H. sapiens
gaaaagccacagaaac

SEQ ID NO: 96939 - DNA, 16 bp, H. sapiens
gaaaagcccagaacct

SEQ ID NO: 96940 - DNA, 16 bp, H. sapiens
gaaaagctgaggcagg

SEQ ID NO: 96941 - DNA, 16 bp, H. sapiens
gaaaagctgcaggcat

SEQ ID NO: 96942 - DNA, 16 bp, H. sapiens
gaaaagctgttcaaca

SEQ ID NO: 96943 - DNA, 16 bp, H. sapiens
gaaaagctttcagttt

SEQ ID NO: 96944 - DNA, 16 bp, H. sapiens
gaaaagcttttagctt

SEQ ID NO: 96945 - DNA, 16 bp, H. sapiens
gaaaagcttttgataa

SEQ ID NO: 96946 - DNA, 16 bp, H. sapiens
gaaaaggaaaaatctt

SEQ ID NO: 96947 - DNA, 16 bp, H. sapiens
gaaaaggaaaattatt

SEQ ID NO: 96948 - DNA, 16 bp, H. sapiens
gaaaaggaaactgaaa

SEQ ID NO: 96949 - DNA, 16 bp, H. sapiens
gaaaaggaaactgaga

SEQ ID NO: 96950 - DNA, 16 bp, H. sapiens
gaaaaggaaatcagta

SEQ ID NO: 96951 - DNA, 16 bp, H. sapiens
gaaaaggaaatgctta

SEQ ID NO: 96952 - DNA, 16 bp, H. sapiens
gaaaaggaagacataa

SEQ ID NO: 96953 - DNA, 16 bp, H. sapiens
gaaaaggaagactgga

SEQ ID NO: 96954 - DNA, 16 bp, H. sapiens
gaaaaggaagcagcag

SEQ ID NO: 96955 - DNA, 16 bp, H. sapiens
gaaaaggagcaggtag

SEQ ID NO: 96956 - DNA, 16 bp, H. sapiens
gaaaaggcaacattca

SEQ ID NO: 96957 - DNA, 16 bp, H. sapiens
gaaaaggcagagggcc

SEQ ID NO: 96958 - DNA, 16 bp, H. sapiens
gaaaaggcctttgaga

SEQ ID NO: 96959 - DNA, 16 bp, H. sapiens
gaaaaggctatgtact

SEQ ID NO: 96960 - DNA, 16 bp, H. sapiens
gaaaaggctttcaaca

SEQ ID NO: 96961 - DNA, 16 bp, H. sapiens
gaaaagggaaacaaat

SEQ ID NO: 96962 - DNA, 16 bp, H. sapiens
gaaaagggcctattga

SEQ ID NO: 96963 - DNA, 16 bp, H. sapiens
gaaaaggtatgttcaa

SEQ ID NO: 96964 - DNA, 16 bp, H. sapiens
gaaaaggtctcactat

SEQ ID NO: 96965 - DNA, 16 bp, H. sapiens
gaaaaggtttcaccat

SEQ ID NO: 96966 - DNA, 16 bp, H. sapiens
gaaaagtaatttattt

SEQ ID NO: 96967 - DNA, 16 bp, H. sapiens
gaaaagtacaaaaatt

SEQ ID NO: 96968 - DNA, 16 bp, H. sapiens
gaaaagtacaaagaag

SEQ ID NO: 96969 - DNA, 16 bp, H. sapiens
gaaaagtcaaattcat

SEQ ID NO: 96970 - DNA, 16 bp, H. sapiens
gaaaagtcaagctgag

SEQ ID NO: 96971 - DNA, 16 bp, H. sapiens
gaaaagtctttatttc

SEQ ID NO: 96972 - DNA, 16 bp, H. sapiens
gaaaagtggccagact

SEQ ID NO: 96973 - DNA, 16 bp, H. sapiens
gaaaagtgtgaagcta

SEQ ID NO: 96974 - DNA, 16 bp, H. sapiens
gaaaagttaagcaaaa

SEQ ID NO: 96975 - DNA, 16 bp, H. sapiens
gaaaagttccccaagt

SEQ ID NO: 96976 - DNA, 16 bp, H. sapiens
gaaaagttctggaaat

SEQ ID NO: 96977 - DNA, 16 bp, H. sapiens
gaaaagttgcaagaat

SEQ ID NO: 96978 - DNA, 16 bp, H. sapiens
gaaaagtttgagaagg

SEQ ID NO: 96979 - DNA, 16 bp, H. sapiens
gaaaagtttgctgatc

SEQ ID NO: 96980 - DNA, 16 bp, H. sapiens
gaaaagtttggaggtt

SEQ ID NO: 96981 - DNA, 16 bp, H. sapiens
gaaaagtttttgaaaa

SEQ ID NO: 96982 - DNA, 16 bp, H. sapiens
gaaaataaaaatcatc

SEQ ID NO: 96983 - DNA, 16 bp, H. sapiens
gaaaataaaattgttt

SEQ ID NO: 96984 - DNA, 16 bp, H. sapiens
gaaaataaaatttcag

SEQ ID NO: 96985 - DNA, 16 bp, H. sapiens
gaaaataaaccttggg

SEQ ID NO: 96986 - DNA, 16 bp, H. sapiens
gaaaataaactttttt

SEQ ID NO: 96987 - DNA, 16 bp, H. sapiens
gaaaataaagccaaat

SEQ ID NO: 96988 - DNA, 16 bp, H. sapiens
gaaaataaatcattaa

SEQ ID NO: 96989 - DNA, 16 bp, H. sapiens
gaaaataaatcattct

SEQ ID NO: 96990 - DNA, 16 bp, H. sapiens
gaaaataaatcttgag

SEQ ID NO: 96991 - DNA, 16 bp, H. sapiens
gaaaataaatgagttt

SEQ ID NO: 96992 - DNA, 16 bp, H. sapiens
gaaaataaatgatttt

SEQ ID NO: 96993 - DNA, 16 bp, H. sapiens
gaaaataaatgtacat

SEQ ID NO: 96994 - DNA, 16 bp, H. sapiens
gaaaataaattcaaat

SEQ ID NO: 96995 - DNA, 16 bp, H. sapiens
gaaaataacagatgtt

SEQ ID NO: 96996 - DNA, 16 bp, H. sapiens
gaaaataactttaaaa

SEQ ID NO: 96997 - DNA, 16 bp, H. sapiens
gaaaataagtcaaatt

SEQ ID NO: 96998 - DNA, 16 bp, H. sapiens
gaaaataataaacatt

SEQ ID NO: 96999 - DNA, 16 bp, H. sapiens
gaaaataatgtatatt

SEQ ID NO: 97000 - DNA, 16 bp, H. sapiens
gaaaataattctgaaa

SEQ ID NO: 97001 - DNA, 16 bp, H. sapiens
gaaaataattttcaaa

SEQ ID NO: 97002 - DNA, 16 bp, H. sapiens
gaaaataattttgtct

SEQ ID NO: 97003 - DNA, 16 bp, H. sapiens
gaaaatacaaaatatt

SEQ ID NO: 97004 - DNA, 16 bp, H. sapiens
gaaaatacaaagatga

SEQ ID NO: 97005 - DNA, 16 bp, H. sapiens
gaaaatacaaagatta

SEQ ID NO: 97006 - DNA, 16 bp, H. sapiens
gaaaatacagaaatta

SEQ ID NO: 97007 - DNA, 16 bp, H. sapiens
gaaaatacaggaagaa

SEQ ID NO: 97008 - DNA, 16 bp, H. sapiens
gaaaatacaggagaaa

SEQ ID NO: 97009 - DNA, 16 bp, H. sapiens
gaaaatacattttcaa

SEQ ID NO: 97010 - DNA, 16 bp, H. sapiens
gaaaatactttgaaat

SEQ ID NO: 97011 - DNA, 16 bp, H. sapiens
gaaaatagcctcaaag

SEQ ID NO: 97012 - DNA, 16 bp, H. sapiens
gaaaataggattttct

SEQ ID NO: 97013 - DNA, 16 bp, H. sapiens
gaaaatagggtctgga

SEQ ID NO: 97014 - DNA, 16 bp, H. sapiens
gaaaatagtatggagg

SEQ ID NO: 97015 - DNA, 16 bp, H. sapiens
gaaaatatacttaaaa

SEQ ID NO: 97016 - DNA, 16 bp, H. sapiens
gaaaatatataccatg

SEQ ID NO: 97017 - DNA, 16 bp, H. sapiens
gaaaatatatcttaaa

SEQ ID NO: 97018 - DNA, 16 bp, H. sapiens
gaaaatatattttcaa

SEQ ID NO: 97019 - DNA, 16 bp, H. sapiens
gaaaatatctttcttt

SEQ ID NO: 97020 - DNA, 16 bp, H. sapiens
gaaaatatgggcttgg

SEQ ID NO: 97021 - DNA, 16 bp, H. sapiens
gaaaatatggtaaata

SEQ ID NO: 97022 - DNA, 16 bp, H. sapiens
gaaaatatggtataaa

SEQ ID NO: 97023 - DNA, 16 bp, H. sapiens
gaaaatatgtatgtgt

SEQ ID NO: 97024 - DNA, 16 bp, H. sapiens
gaaaatattatgctaa

SEQ ID NO: 97025 - DNA, 16 bp, H. sapiens
gaaaatattcacaaaa

SEQ ID NO: 97026 - DNA, 16 bp, H. sapiens
gaaaatattcattcat

SEQ ID NO: 97027 - DNA, 16 bp, H. sapiens
gaaaatattgacaaat

SEQ ID NO: 97028 - DNA, 16 bp, H. sapiens
gaaaatatttatgaag

SEQ ID NO: 97029 - DNA, 16 bp, H. sapiens
gaaaatatttcccaaa

SEQ ID NO: 97030 - DNA, 16 bp, H. sapiens
gaaaatatttctttaa

SEQ ID NO: 97031 - DNA, 16 bp, H. sapiens
gaaaatatttgccaaa

SEQ ID NO: 97032 - DNA, 16 bp, H. sapiens
gaaaatatttgccaat

SEQ ID NO: 97033 - DNA, 16 bp, H. sapiens
gaaaatatttgctgag

SEQ ID NO: 97034 - DNA, 16 bp, H. sapiens
gaaaatatttgtaagc

SEQ ID NO: 97035 - DNA, 16 bp, H. sapiens
gaaaatatttgtgaat

SEQ ID NO: 97036 - DNA, 16 bp, H. sapiens
gaaaatattttcaaca

SEQ ID NO: 97037 - DNA, 16 bp, H. sapiens
gaaaatattttcagaa

SEQ ID NO: 97038 - DNA, 16 bp, H. sapiens
gaaaatattttccttt

SEQ ID NO: 97039 - DNA, 16 bp, H. sapiens
gaaaatattttgaaat

SEQ ID NO: 97040 - DNA, 16 bp, H. sapiens
gaaaatatttttttct

SEQ ID NO: 97041 - DNA, 16 bp, H. sapiens
gaaaatcaagagcaaa

SEQ ID NO: 97042 - DNA, 16 bp, H. sapiens
gaaaatcaataaattt

SEQ ID NO: 97043 - DNA, 16 bp, H. sapiens
gaaaatcaatatatca

SEQ ID NO: 97044 - DNA, 16 bp, H. sapiens
gaaaatcagattttct

SEQ ID NO: 97045 - DNA, 16 bp, H. sapiens
gaaaatcagcacaaga

SEQ ID NO: 97046 - DNA, 16 bp, H. sapiens
gaaaatcagcttttct

SEQ ID NO: 97047 - DNA, 16 bp, H. sapiens
gaaaatcatgaaaaga

SEQ ID NO: 97048 - DNA, 16 bp, H. sapiens
gaaaatcatgaaagag

SEQ ID NO: 97049 - DNA, 16 bp, H. sapiens
gaaaatcattttttct

SEQ ID NO: 97050 - DNA, 16 bp, H. sapiens
gaaaatccagaagaaa

SEQ ID NO: 97051 - DNA, 16 bp, H. sapiens
gaaaatccagaggaaa

SEQ ID NO: 97052 - DNA, 16 bp, H. sapiens
gaaaatcctaagaaat

SEQ ID NO: 97053 - DNA, 16 bp, H. sapiens
gaaaatcctcaagaaa

SEQ ID NO: 97054 - DNA, 16 bp, H. sapiens
gaaaatcgcttgaatc

SEQ ID NO: 97055 - DNA, 16 bp, H. sapiens
gaaaatctacaggaaa

SEQ ID NO: 97056 - DNA, 16 bp, H. sapiens
gaaaatctagaggaaa

SEQ ID NO: 97057 - DNA, 16 bp, H. sapiens
gaaaatctagggaaaa

SEQ ID NO: 97058 - DNA, 16 bp, H. sapiens
gaaaatctcaaggaat

SEQ ID NO: 97059 - DNA, 16 bp, H. sapiens
gaaaatctgagacagg

SEQ ID NO: 97060 - DNA, 16 bp, H. sapiens
gaaaatctggaagaaa

SEQ ID NO: 97061 - DNA, 16 bp, H. sapiens
gaaaatctttcccaga

SEQ ID NO: 97062 - DNA, 16 bp, H. sapiens
gaaaatgaaaaagttc

SEQ ID NO: 97063 - DNA, 16 bp, H. sapiens
gaaaatgaaaactgaa

SEQ ID NO: 97064 - DNA, 16 bp, H. sapiens
gaaaatgaaacaaatt

SEQ ID NO: 97065 - DNA, 16 bp, H. sapiens
gaaaatgaactaagac

SEQ ID NO: 97066 - DNA, 16 bp, H. sapiens
gaaaatgaagacacag

SEQ ID NO: 97067 - DNA, 16 bp, H. sapiens
gaaaatgaagacagaa

SEQ ID NO: 97068 - DNA, 16 bp, H. sapiens
gaaaatgaagagcaaa

SEQ ID NO: 97069 - DNA, 16 bp, H. sapiens
gaaaatgaagcacaga

SEQ ID NO: 97070 - DNA, 16 bp, H. sapiens
gaaaatgaatatattt

SEQ ID NO: 97071 - DNA, 16 bp, H. sapiens
gaaaatgaatgaatac

SEQ ID NO: 97072 - DNA, 16 bp, H. sapiens
gaaaatgacaattgaa

SEQ ID NO: 97073 - DNA, 16 bp, H. sapiens
gaaaatgacagaattt

SEQ ID NO: 97074 - DNA, 16 bp, H. sapiens
gaaaatgagacagaaa

SEQ ID NO: 97075 - DNA, 16 bp, H. sapiens
gaaaatgagagacaga

SEQ ID NO: 97076 - DNA, 16 bp, H. sapiens
gaaaatgagcaaagaa

SEQ ID NO: 97077 - DNA, 16 bp, H. sapiens
gaaaatgaggaaaaac

SEQ ID NO: 97078 - DNA, 16 bp, H. sapiens
gaaaatgaggaagatg

SEQ ID NO: 97079 - DNA, 16 bp, H. sapiens
gaaaatgaggcagaga

SEQ ID NO: 97080 - DNA, 16 bp, H. sapiens
gaaaatgagtttactg

SEQ ID NO: 97081 - DNA, 16 bp, H. sapiens
gaaaatgatgatgatg

SEQ ID NO: 97082 - DNA, 16 bp, H. sapiens
gaaaatgattttctct

SEQ ID NO: 97083 - DNA, 16 bp, H. sapiens
gaaaatgcaaagaaat

SEQ ID NO: 97084 - DNA, 16 bp, H. sapiens
gaaaatgcacatcaaa

SEQ ID NO: 97085 - DNA, 16 bp, H. sapiens
gaaaatgcagagaacc

SEQ ID NO: 97086 - DNA, 16 bp, H. sapiens
gaaaatgcagattaaa

SEQ ID NO: 97087 - DNA, 16 bp, H. sapiens
gaaaatgcagattcct

SEQ ID NO: 97088 - DNA, 16 bp, H. sapiens
gaaaatgcatttaata

SEQ ID NO: 97089 - DNA, 16 bp, H. sapiens
gaaaatgcattttctt

SEQ ID NO: 97090 - DNA, 16 bp, H. sapiens
gaaaatgctaataaaa

SEQ ID NO: 97091 - DNA, 16 bp, H. sapiens
gaaaatgctctttcct

SEQ ID NO: 97092 - DNA, 16 bp, H. sapiens
gaaaatgctgggatta

SEQ ID NO: 97093 - DNA, 16 bp, H. sapiens
gaaaatggaaaacaga

SEQ ID NO: 97094 - DNA, 16 bp, H. sapiens
gaaaatggaaacacag

SEQ ID NO: 97095 - DNA, 16 bp, H. sapiens
gaaaatggaaaccaaa

SEQ ID NO: 97096 - DNA, 16 bp, H. sapiens
gaaaatggaagtgaga

SEQ ID NO: 97097 - DNA, 16 bp, H. sapiens
gaaaatggaatgaaat

SEQ ID NO: 97098 - DNA, 16 bp, H. sapiens
gaaaatggaattttta

SEQ ID NO: 97099 - DNA, 16 bp, H. sapiens
gaaaatggacaaagga

SEQ ID NO: 97100 - DNA, 16 bp, H. sapiens
gaaaatggacatactg

SEQ ID NO: 97101 - DNA, 16 bp, H. sapiens
gaaaatggacttttct

SEQ ID NO: 97102 - DNA, 16 bp, H. sapiens
gaaaatggatgaatac

SEQ ID NO: 97103 - DNA, 16 bp, H. sapiens
gaaaatggattctccc

SEQ ID NO: 97104 - DNA, 16 bp, H. sapiens
gaaaatggatttttct

SEQ ID NO: 97105 - DNA, 16 bp, H. sapiens
gaaaatggcagagctg

SEQ ID NO: 97106 - DNA, 16 bp, H. sapiens
gaaaatgggatgatat

SEQ ID NO: 97107 - DNA, 16 bp, H. sapiens
gaaaatggggagatgt

SEQ ID NO: 97108 - DNA, 16 bp, H. sapiens
gaaaatgggtttctct

SEQ ID NO: 97109 - DNA, 16 bp, H. sapiens
gaaaatggtacaacca

SEQ ID NO: 97110 - DNA, 16 bp, H. sapiens
gaaaatggtattttct

SEQ ID NO: 97111 - DNA, 16 bp, H. sapiens
gaaaatgtaattattt

SEQ ID NO: 97112 - DNA, 16 bp, H. sapiens
gaaaatgtatagcttt

SEQ ID NO: 97113 - DNA, 16 bp, H. sapiens
gaaaatgtatgttttt

SEQ ID NO: 97114 - DNA, 16 bp, H. sapiens
gaaaatgtcaaaatta

SEQ ID NO: 97115 - DNA, 16 bp, H. sapiens
gaaaatgtcaaagaaa

SEQ ID NO: 97116 - DNA, 16 bp, H. sapiens
gaaaatgtcaacaaat

SEQ ID NO: 97117 - DNA, 16 bp, H. sapiens
gaaaatgtgaattaaa

SEQ ID NO: 97118 - DNA, 16 bp, H. sapiens
gaaaatgtgatactta

SEQ ID NO: 97119 - DNA, 16 bp, H. sapiens
gaaaatgtgatccata

SEQ ID NO: 97120 - DNA, 16 bp, H. sapiens
gaaaatgtgcagcctg

SEQ ID NO: 97121 - DNA, 16 bp, H. sapiens
gaaaatgtggaagtga

SEQ ID NO: 97122 - DNA, 16 bp, H. sapiens
gaaaatgtggaggcaa

SEQ ID NO: 97123 - DNA, 16 bp, H. sapiens
gaaaatgtgggaaatt

SEQ ID NO: 97124 - DNA, 16 bp, H. sapiens
gaaaatgttattttat

SEQ ID NO: 97125 - DNA, 16 bp, H. sapiens
gaaaatgttccctgtg

SEQ ID NO: 97126 - DNA, 16 bp, H. sapiens
gaaaatgttctaaaat

SEQ ID NO: 97127 - DNA, 16 bp, H. sapiens
gaaaatgttgaaagca

SEQ ID NO: 97128 - DNA, 16 bp, H. sapiens
gaaaatgtttaaatat

SEQ ID NO: 97129 - DNA, 16 bp, H. sapiens
gaaaatgtttcaagaa

SEQ ID NO: 97130 - DNA, 16 bp, H. sapiens
gaaaatgtttcctctt

SEQ ID NO: 97131 - DNA, 16 bp, H. sapiens
gaaaatgttttaaaat

SEQ ID NO: 97132 - DNA, 16 bp, H. sapiens
gaaaattaatgcaaaa

SEQ ID NO: 97133 - DNA, 16 bp, H. sapiens
gaaaattacaatcaaa

SEQ ID NO: 97134 - DNA, 16 bp, H. sapiens
gaaaattagcaaggat

SEQ ID NO: 97135 - DNA, 16 bp, H. sapiens
gaaaattatcttttaa

SEQ ID NO: 97136 - DNA, 16 bp, H. sapiens
gaaaattatttctaaa

SEQ ID NO: 97137 - DNA, 16 bp, H. sapiens
gaaaattcacaaagaa

SEQ ID NO: 97138 - DNA, 16 bp, H. sapiens
gaaaattctaaagaat

SEQ ID NO: 97139 - DNA, 16 bp, H. sapiens
gaaaattctagaagat

SEQ ID NO: 97140 - DNA, 16 bp, H. sapiens
gaaaattctgaaaaca

SEQ ID NO: 97141 - DNA, 16 bp, H. sapiens
gaaaattctgccattt

SEQ ID NO: 97142 - DNA, 16 bp, H. sapiens
gaaaattgaccacata

SEQ ID NO: 97143 - DNA, 16 bp, H. sapiens
gaaaattggataaaga

SEQ ID NO: 97144 - DNA, 16 bp, H. sapiens
gaaaattggatatcta

SEQ ID NO: 97145 - DNA, 16 bp, H. sapiens
gaaaattgtaaaacat

SEQ ID NO: 97146 - DNA, 16 bp, H. sapiens
gaaaattgtttaactt

SEQ ID NO: 97147 - DNA, 16 bp, H. sapiens
gaaaatttaacaaaat

SEQ ID NO: 97148 - DNA, 16 bp, H. sapiens
gaaaatttagaaaaca

SEQ ID NO: 97149 - DNA, 16 bp, H. sapiens
gaaaatttagaggaaa

SEQ ID NO: 97150 - DNA, 16 bp, H. sapiens
gaaaatttatcatttt

SEQ ID NO: 97151 - DNA, 16 bp, H. sapiens
gaaaatttcattaaaa

SEQ ID NO: 97152 - DNA, 16 bp, H. sapiens
gaaaatttgaaattta

SEQ ID NO: 97153 - DNA, 16 bp, H. sapiens
gaaaatttgagacagg

SEQ ID NO: 97154 - DNA, 16 bp, H. sapiens
gaaaatttgcagcctg

SEQ ID NO: 97155 - DNA, 16 bp, H. sapiens
gaaaatttgcagcttg

SEQ ID NO: 97156 - DNA, 16 bp, H. sapiens
gaaaatttgctgcctg

SEQ ID NO: 97157 - DNA, 16 bp, H. sapiens
gaaaatttggaacttt

SEQ ID NO: 97158 - DNA, 16 bp, H. sapiens
gaaaattttaattaca

SEQ ID NO: 97159 - DNA, 16 bp, H. sapiens
gaaaattttcaaacac

SEQ ID NO: 97160 - DNA, 16 bp, H. sapiens
gaaaattttcttgaaa

SEQ ID NO: 97161 - DNA, 16 bp, H. sapiens
gaaaattttctttatt

SEQ ID NO: 97162 - DNA, 16 bp, H. sapiens
gaaaattttgaaaatt

SEQ ID NO: 97163 - DNA, 16 bp, H. sapiens
gaaaattttgttttaa

SEQ ID NO: 97164 - DNA, 16 bp, H. sapiens
gaaaatttttgcaaat

SEQ ID NO: 97165 - DNA, 16 bp, H. sapiens
gaaacaaaaagttggt

SEQ ID NO: 97166 - DNA, 16 bp, H. sapiens
gaaacaaaatgtggtc

SEQ ID NO: 97167 - DNA, 16 bp, H. sapiens
gaaacaaagtctcact

SEQ ID NO: 97168 - DNA, 16 bp, H. sapiens
gaaacaaataatattt

SEQ ID NO: 97169 - DNA, 16 bp, H. sapiens
gaaacaaatgaaaatg

SEQ ID NO: 97170 - DNA, 16 bp, H. sapiens
gaaacaaatggaagaa

SEQ ID NO: 97171 - DNA, 16 bp, H. sapiens
gaaacaaattattcat

SEQ ID NO: 97172 - DNA, 16 bp, H. sapiens
gaaacaacagaagctg

SEQ ID NO: 97173 - DNA, 16 bp, H. sapiens
gaaacaacccaaaggt

SEQ ID NO: 97174 - DNA, 16 bp, H. sapiens
gaaacaacttgctgaa

SEQ ID NO: 97175 - DNA, 16 bp, H. sapiens
gaaacaagaacaagcc

SEQ ID NO: 97176 - DNA, 16 bp, H. sapiens
gaaacaagctggaaaa

SEQ ID NO: 97177 - DNA, 16 bp, H. sapiens
gaaacaatataaatgt

SEQ ID NO: 97178 - DNA, 16 bp, H. sapiens
gaaacaatctaaatgt

SEQ ID NO: 97179 - DNA, 16 bp, H. sapiens
gaaacaatgtaaatgt

SEQ ID NO: 97180 - DNA, 16 bp, H. sapiens
gaaacacaataatagt

SEQ ID NO: 97181 - DNA, 16 bp, H. sapiens
gaaacacacacagaga

SEQ ID NO: 97182 - DNA, 16 bp, H. sapiens
gaaacacaggcacaga

SEQ ID NO: 97183 - DNA, 16 bp, H. sapiens
gaaacacatttcacct

SEQ ID NO: 97184 - DNA, 16 bp, H. sapiens
gaaacacatttttaaa

SEQ ID NO: 97185 - DNA, 16 bp, H. sapiens
gaaacaccatctctac

SEQ ID NO: 97186 - DNA, 16 bp, H. sapiens
gaaacaccattctgga

SEQ ID NO: 97187 - DNA, 16 bp, H. sapiens
gaaacactgctctctt

SEQ ID NO: 97188 - DNA, 16 bp, H. sapiens
gaaacactgttttcct

SEQ ID NO: 97189 - DNA, 16 bp, H. sapiens
gaaacactgttttgtt

SEQ ID NO: 97190 - DNA, 16 bp, H. sapiens
gaaacactttttttgt

SEQ ID NO: 97191 - DNA, 16 bp, H. sapiens
gaaacagaaaaatatg

SEQ ID NO: 97192 - DNA, 16 bp, H. sapiens
gaaacagaaaatatga

SEQ ID NO: 97193 - DNA, 16 bp, H. sapiens
gaaacagaaaatctga

SEQ ID NO: 97194 - DNA, 16 bp, H. sapiens
gaaacagaaagcctga

SEQ ID NO: 97195 - DNA, 16 bp, H. sapiens
gaaacagaaatgcttt

SEQ ID NO: 97196 - DNA, 16 bp, H. sapiens
gaaacagaaattcaaa

SEQ ID NO: 97197 - DNA, 16 bp, H. sapiens
gaaacagaagaaatat

SEQ ID NO: 97198 - DNA, 16 bp, H. sapiens
gaaacagaagatatta

SEQ ID NO: 97199 - DNA, 16 bp, H. sapiens
gaaacagaagcacaga

SEQ ID NO: 97200 - DNA, 16 bp, H. sapiens
gaaacagaatgaagaa

SEQ ID NO: 97201 - DNA, 16 bp, H. sapiens
gaaacagaattgagag

SEQ ID NO: 97202 - DNA, 16 bp, H. sapiens
gaaacagacaaatcca

SEQ ID NO: 97203 - DNA, 16 bp, H. sapiens
gaaacagacacataaa

SEQ ID NO: 97204 - DNA, 16 bp, H. sapiens
gaaacagacagggaga

SEQ ID NO: 97205 - DNA, 16 bp, H. sapiens
gaaacagagaagttaa

SEQ ID NO: 97206 - DNA, 16 bp, H. sapiens
gaaacagagagagacc

SEQ ID NO: 97207 - DNA, 16 bp, H. sapiens
gaaacagagcaagacc

SEQ ID NO: 97208 - DNA, 16 bp, H. sapiens
gaaacagagtctcact

SEQ ID NO: 97209 - DNA, 16 bp, H. sapiens
gaaacagatttttaaa

SEQ ID NO: 97210 - DNA, 18 bp, H. sapiens
gaaacagcaggtgctgga

SEQ ID NO: 97211 - DNA, 16 bp, H. sapiens
gaaacagctaaagcag

SEQ ID NO: 97212 - DNA, 16 bp, H. sapiens
gaaacaggaaatcaaa

SEQ ID NO: 97213 - DNA, 16 bp, H. sapiens
gaaacaggaagaaatt

SEQ ID NO: 97214 - DNA, 16 bp, H. sapiens
gaaacaggagcttggc

SEQ ID NO: 97215 - DNA, 16 bp, H. sapiens
gaaacaggatctcact

SEQ ID NO: 97216 - DNA, 16 bp, H. sapiens
gaaacaggcccagaga

SEQ ID NO: 97217 - DNA, 16 bp, H. sapiens
gaaacaggctcagaga

SEQ ID NO: 97218 - DNA, 16 bp, H. sapiens
gaaacagggtcttcct

SEQ ID NO: 97219 - DNA, 16 bp, H. sapiens
gaaacagtgagattgg

SEQ ID NO: 97220 - DNA, 16 bp, H. sapiens
gaaacatcatctctac

SEQ ID NO: 97221 - DNA, 16 bp, H. sapiens
gaaacatccaaactga

SEQ ID NO: 97222 - DNA, 16 bp, H. sapiens
gaaacatgaagaaaac

SEQ ID NO: 97223 - DNA, 16 bp, H. sapiens
gaaacatgaagaaaat

SEQ ID NO: 97224 - DNA, 16 bp, H. sapiens
gaaacatggaaaggaa

SEQ ID NO: 97225 - DNA, 16 bp, H. sapiens
gaaacatgttttgggg

SEQ ID NO: 97226 - DNA, 16 bp, H. sapiens
gaaacattcaaattat

SEQ ID NO: 97227 - DNA, 16 bp, H. sapiens
gaaacattctacaaaa

SEQ ID NO: 97228 - DNA, 16 bp, H. sapiens
gaaacattctgaaaaa

SEQ ID NO: 97229 - DNA, 16 bp, H. sapiens
gaaacattctttttgt

SEQ ID NO: 97230 - DNA, 16 bp, H. sapiens
gaaacatttagaaaaa

SEQ ID NO: 97231 - DNA, 16 bp, H. sapiens
gaaacattttcatttt

SEQ ID NO: 97232 - DNA, 16 bp, H. sapiens
gaaacatttttgaaaa

SEQ ID NO: 97233 - DNA, 16 bp, H. sapiens
gaaacattttttaaaa

SEQ ID NO: 97234 - DNA, 16 bp, H. sapiens
gaaacatttttttaaa

SEQ ID NO: 97235 - DNA, 16 bp, H. sapiens
gaaaccaaaactcaga

SEQ ID NO: 97236 - DNA, 16 bp, H. sapiens
gaaaccaaaagttgtt

SEQ ID NO: 97237 - DNA, 16 bp, H. sapiens
gaaaccaaagcccaga

SEQ ID NO: 97238 - DNA, 16 bp, H. sapiens
gaaaccaaggcacaga

SEQ ID NO: 97239 - DNA, 16 bp, H. sapiens
gaaaccaaggctgaga

SEQ ID NO: 97240 - DNA, 16 bp, H. sapiens
gaaaccaatgagaaga

SEQ ID NO: 97241 - DNA, 16 bp, H. sapiens
gaaaccaatttttttt

SEQ ID NO: 97242 - DNA, 16 bp, H. sapiens
gaaaccacagataata

SEQ ID NO: 97243 - DNA, 16 bp, H. sapiens
gaaaccacctctctac

SEQ ID NO: 97244 - DNA, 16 bp, H. sapiens
gaaaccacttctctac

SEQ ID NO: 97245 - DNA, 16 bp, H. sapiens
gaaaccacttttgcaa

SEQ ID NO: 97246 - DNA, 16 bp, H. sapiens
gaaaccagcctgaaca

SEQ ID NO: 97247 - DNA, 16 bp, H. sapiens
gaaaccagcctgatca

SEQ ID NO: 97248 - DNA, 16 bp, H. sapiens
gaaaccagcctggaca

SEQ ID NO: 97249 - DNA, 16 bp, H. sapiens
gaaaccaggaagtgga

SEQ ID NO: 97250 - DNA, 16 bp, H. sapiens
gaaaccaggaattcaa

SEQ ID NO: 97251 - DNA, 16 bp, H. sapiens
gaaaccaggagacaaa

SEQ ID NO: 97252 - DNA, 16 bp, H. sapiens
gaaaccaggcctgggc

SEQ ID NO: 97253 - DNA, 17 bp, H. sapiens
gaaaccaggcctgggcc

SEQ ID NO: 97254 - DNA, 16 bp, H. sapiens
gaaaccagggctcaga

SEQ ID NO: 97255 - DNA, 16 bp, H. sapiens
gaaaccataattctga

SEQ ID NO: 97256 - DNA, 16 bp, H. sapiens
gaaaccatcatgctca

SEQ ID NO: 97257 - DNA, 16 bp, H. sapiens
gaaaccatctgggcct

SEQ ID NO: 97258 - DNA, 16 bp, H. sapiens
gaaaccatggaagcca

SEQ ID NO: 97259 - DNA, 16 bp, H. sapiens
gaaaccatggagacca

SEQ ID NO: 97260 - DNA, 16 bp, H. sapiens
gaaacccagcctctac

SEQ ID NO: 97261 - DNA, 16 bp, H. sapiens
gaaacccatctctact

SEQ ID NO: 97262 - DNA, 16 bp, H. sapiens
gaaaccccaagccttg

SEQ ID NO: 97263 - DNA, 16 bp, H. sapiens
gaaaccccagctctac

SEQ ID NO: 97264 - DNA, 16 bp, H. sapiens
gaaaccccatcactat

SEQ ID NO: 97265 - DNA, 16 bp, H. sapiens
gaaaccccatccctgc

SEQ ID NO: 97266 - DNA, 16 bp, H. sapiens
gaaaccccatctctaa

SEQ ID NO: 97267 - DNA, 16 bp, H. sapiens
gaaaccccatctctcc

SEQ ID NO: 97268 - DNA, 16 bp, H. sapiens
gaaaccccatctctgg

SEQ ID NO: 97269 - DNA, 16 bp, H. sapiens
gaaaccccatctttgc

SEQ ID NO: 97270 - DNA, 16 bp, H. sapiens
gaaaccccatgtctac

SEQ ID NO: 97271 - DNA, 16 bp, H. sapiens
gaaaccccctatctac

SEQ ID NO: 97272 - DNA, 16 bp, H. sapiens
gaaaccccgtctctat

SEQ ID NO: 97273 - DNA, 16 bp, H. sapiens
gaaacccctaataaac

SEQ ID NO: 97274 - DNA, 16 bp, H. sapiens
gaaacccctgataaac

SEQ ID NO: 97275 - DNA, 16 bp, H. sapiens
gaaaccctatctttac

SEQ ID NO: 97276 - DNA, 16 bp, H. sapiens
gaaaccctcatctcta

SEQ ID NO: 97277 - DNA, 16 bp, H. sapiens
gaaaccctggctctac

SEQ ID NO: 97278 - DNA, 20 bp, H. sapiens
gaaaccctgtctactaaaaa

SEQ ID NO: 97279 - DNA, 16 bp, H. sapiens
gaaaccctgtctcaac

SEQ ID NO: 97280 - DNA, 16 bp, H. sapiens
gaaaccctgtctcttc

SEQ ID NO: 97281 - DNA, 16 bp, H. sapiens
gaaaccctgtctgtaa

SEQ ID NO: 97282 - DNA, 16 bp, H. sapiens
gaaaccctgtgtctac

SEQ ID NO: 97283 - DNA, 16 bp, H. sapiens
gaaaccctgtttctaa

SEQ ID NO: 97284 - DNA, 16 bp, H. sapiens
gaaaccctgtttctat

SEQ ID NO: 97285 - DNA, 16 bp, H. sapiens
gaaaccgaggcccagg

SEQ ID NO: 97286 - DNA, 16 bp, H. sapiens
gaaacctacaaagaga

SEQ ID NO: 97287 - DNA, 16 bp, H. sapiens
gaaacctacttctgtc

SEQ ID NO: 97288 - DNA, 16 bp, H. sapiens
gaaacctcatcgctac

SEQ ID NO: 97289 - DNA, 16 bp, H. sapiens
gaaacctcgtctctaa

SEQ ID NO: 97290 - DNA, 16 bp, H. sapiens
gaaacctcttttcttt

SEQ ID NO: 97291 - DNA, 16 bp, H. sapiens
gaaacctggtctctac

SEQ ID NO: 97292 - DNA, 16 bp, H. sapiens
gaaacctggtctttac

SEQ ID NO: 97293 - DNA, 16 bp, H. sapiens
gaaacctgttatgcca

SEQ ID NO: 97294 - DNA, 16 bp, H. sapiens
gaaaccttagaaatct

SEQ ID NO: 97295 - DNA, 16 bp, H. sapiens
gaaaccttatctctac

SEQ ID NO: 97296 - DNA, 16 bp, H. sapiens
gaaacctttttttttt

SEQ ID NO: 97297 - DNA, 16 bp, H. sapiens
gaaacgcctggatgcc

SEQ ID NO: 97298 - DNA, 16 bp, H. sapiens
gaaacggaatggaatg

SEQ ID NO: 97299 - DNA, 16 bp, H. sapiens
gaaactaaaattttaa

SEQ ID NO: 97300 - DNA, 16 bp, H. sapiens
gaaactaatgagaaaa

SEQ ID NO: 97301 - DNA, 16 bp, H. sapiens
gaaactaattttttaa

SEQ ID NO: 97302 - DNA, 16 bp, H. sapiens
gaaactacatttccca

SEQ ID NO: 97303 - DNA, 16 bp, H. sapiens
gaaactacattttaaa

SEQ ID NO: 97304 - DNA, 16 bp, H. sapiens
gaaactaccagaagaa

SEQ ID NO: 97305 - DNA, 16 bp, H. sapiens
gaaactactcctggtg

SEQ ID NO: 97306 - DNA, 16 bp, H. sapiens
gaaactactttgtgat

SEQ ID NO: 97307 - DNA, 16 bp, H. sapiens
gaaactagaaaaagat

SEQ ID NO: 97308 - DNA, 16 bp, H. sapiens
gaaactagaaaatgaa

SEQ ID NO: 97309 - DNA, 16 bp, H. sapiens
gaaactagaaagagaa

SEQ ID NO: 97310 - DNA, 16 bp, H. sapiens
gaaactcaatgagatc

SEQ ID NO: 97311 - DNA, 30 bp, H. sapiens
gaaactcagcttggctgtcagagtttgcag

SEQ ID NO: 97312 - DNA, 16 bp, H. sapiens
gaaactcaggctcaga

SEQ ID NO: 97313 - DNA, 16 bp, H. sapiens
gaaactctcctttata

SEQ ID NO: 97314 - DNA, 16 bp, H. sapiens
gaaactctctttttgt

SEQ ID NO: 97315 - DNA, 16 bp, H. sapiens
gaaactctggctcaaa

SEQ ID NO: 97316 - DNA, 16 bp, H. sapiens
gaaactctgtccccat

SEQ ID NO: 97317 - DNA, 16 bp, H. sapiens
gaaactgaagaacctg

SEQ ID NO: 97318 - DNA, 16 bp, H. sapiens
gaaactgaagaagaca

SEQ ID NO: 97319 - DNA, 16 bp, H. sapiens
gaaactgaagagagaa

SEQ ID NO: 97320 - DNA, 16 bp, H. sapiens
gaaactgaagcacagt

SEQ ID NO: 97321 - DNA, 16 bp, H. sapiens
gaaactgaatcaacta

SEQ ID NO: 97322 - DNA, 16 bp, H. sapiens
gaaactgaattttaaa

SEQ ID NO: 97323 - DNA, 16 bp, H. sapiens
gaaactgagacccagg

SEQ ID NO: 97324 - DNA, 16 bp, H. sapiens
gaaactgagagtcaga

SEQ ID NO: 97325 - DNA, 16 bp, H. sapiens
gaaactgaggcacaaa

SEQ ID NO: 97326 - DNA, 16 bp, H. sapiens
gaaactgaggcacaga

SEQ ID NO: 97327 - DNA, 16 bp, H. sapiens
gaaactgaggcagaag

SEQ ID NO: 97328 - DNA, 16 bp, H. sapiens
gaaactgaggcccagg

SEQ ID NO: 97329 - DNA, 16 bp, H. sapiens
gaaactgaggctgcag

SEQ ID NO: 97330 - DNA, 16 bp, H. sapiens
gaaactgaggctggag

SEQ ID NO: 97331 - DNA, 16 bp, H. sapiens
gaaactgaggttcaag

SEQ ID NO: 97332 - DNA, 16 bp, H. sapiens
gaaactgaggttcagg

SEQ ID NO: 97333 - DNA, 16 bp, H. sapiens
gaaactgaggttgaga

SEQ ID NO: 97334 - DNA, 16 bp, H. sapiens
gaaactgatgctcaga

SEQ ID NO: 97335 - DNA, 16 bp, H. sapiens
gaaactgatttgtgat

SEQ ID NO: 97336 - DNA, 16 bp, H. sapiens
gaaactgatttttttt

SEQ ID NO: 97337 - DNA, 16 bp, H. sapiens
gaaactgcagaagaaa

SEQ ID NO: 97338 - DNA, 16 bp, H. sapiens
gaaactgcatctcaaa

SEQ ID NO: 97339 - DNA, 16 bp, H. sapiens
gaaactgccaaactgt

SEQ ID NO: 97340 - DNA, 16 bp, H. sapiens
gaaactgccacactgt

SEQ ID NO: 97341 - DNA, 16 bp, H. sapiens
gaaactgccagaagga

SEQ ID NO: 97342 - DNA, 16 bp, H. sapiens
gaaactgcccacatga

SEQ ID NO: 97343 - DNA, 16 bp, H. sapiens
gaaactgcttggtgat

SEQ ID NO: 97344 - DNA, 16 bp, H. sapiens
gaaactggaaaatgaa

SEQ ID NO: 97345 - DNA, 16 bp, H. sapiens
gaaactggaatcctca

SEQ ID NO: 97346 - DNA, 16 bp, H. sapiens
gaaactggacccattc

SEQ ID NO: 97347 - DNA, 16 bp, H. sapiens
gaaactggagctcaga

SEQ ID NO: 97348 - DNA, 20 bp, H. sapiens
gaaactggatccctttctta

SEQ ID NO: 97349 - DNA, 16 bp, H. sapiens
gaaactggatgccttc

SEQ ID NO: 97350 - DNA, 16 bp, H. sapiens
gaaactgggaagaaaa

SEQ ID NO: 97351 - DNA, 16 bp, H. sapiens
gaaactgtcaaactat

SEQ ID NO: 97352 - DNA, 16 bp, H. sapiens
gaaactgttttaaaat

SEQ ID NO: 97353 - DNA, 16 bp, H. sapiens
gaaacttaaaatattt

SEQ ID NO: 97354 - DNA, 16 bp, H. sapiens
gaaacttaatccctaa

SEQ ID NO: 97355 - DNA, 16 bp, H. sapiens
gaaacttacagcaaaa

SEQ ID NO: 97356 - DNA, 16 bp, H. sapiens
gaaacttaccagatca

SEQ ID NO: 97357 - DNA, 16 bp, H. sapiens
gaaacttcaaaagaaa

SEQ ID NO: 97358 - DNA, 16 bp, H. sapiens
gaaacttccacctcag

SEQ ID NO: 97359 - DNA, 17 bp, H. sapiens
gaaacttcgtctcaaaa

SEQ ID NO: 97360 - DNA, 16 bp, H. sapiens
gaaacttctgcctccc

SEQ ID NO: 97361 - DNA, 16 bp, H. sapiens
gaaacttctggaggtc

SEQ ID NO: 97362 - DNA, 16 bp, H. sapiens
gaaactttcttttgtt

SEQ ID NO: 97363 - DNA, 16 bp, H. sapiens
gaaactttgaaaaaaa

SEQ ID NO: 97364 - DNA, 16 bp, H. sapiens
gaaactttggaaaata

SEQ ID NO: 97365 - DNA, 16 bp, H. sapiens
gaaactttttgaatgc

SEQ ID NO: 97366 - DNA, 16 bp, H. sapiens
gaaagaaaaaaatgtc

SEQ ID NO: 97367 - DNA, 16 bp, H. sapiens
gaaagaaaaaatgcta

SEQ ID NO: 97368 - DNA, 16 bp, H. sapiens
gaaagaaaaaatgttg

SEQ ID NO: 97369 - DNA, 16 bp, H. sapiens
gaaagaaaaagacatt

SEQ ID NO: 97370 - DNA, 16 bp, H. sapiens
gaaagaaaaagaggct

SEQ ID NO: 97371 - DNA, 16 bp, H. sapiens
gaaagaaaaatatcac

SEQ ID NO: 97372 - DNA, 16 bp, H. sapiens
gaaagaaaaatgcttt

SEQ ID NO: 97373 - DNA, 16 bp, H. sapiens
gaaagaaaaattctaa

SEQ ID NO: 97374 - DNA, 16 bp, H. sapiens
gaaagaaaacaattat

SEQ ID NO: 97375 - DNA, 16 bp, H. sapiens
gaaagaaaacagaatt

SEQ ID NO: 97376 - DNA, 16 bp, H. sapiens
gaaagaaaactgaaga

SEQ ID NO: 97377 - DNA, 16 bp, H. sapiens
gaaagaaaagaaatct

SEQ ID NO: 97378 - DNA, 16 bp, H. sapiens
gaaagaaaagaacatt

SEQ ID NO: 97379 - DNA, 16 bp, H. sapiens
gaaagaaaagaatgtt

SEQ ID NO: 97380 - DNA, 16 bp, H. sapiens
gaaagaaaagaccatt

SEQ ID NO: 97381 - DNA, 16 bp, H. sapiens
gaaagaaaaggacatt

SEQ ID NO: 97382 - DNA, 16 bp, H. sapiens
gaaagaaaataacttt

SEQ ID NO: 97383 - DNA, 16 bp, H. sapiens
gaaagaaaatatttca

SEQ ID NO: 97384 - DNA, 16 bp, H. sapiens
gaaagaaaatcccatt

SEQ ID NO: 97385 - DNA, 16 bp, H. sapiens
gaaagaaaatgaattc

SEQ ID NO: 97386 - DNA, 16 bp, H. sapiens
gaaagaaacaactggt

SEQ ID NO: 97387 - DNA, 16 bp, H. sapiens
gaaagaaactgaagaa

SEQ ID NO: 97388 - DNA, 16 bp, H. sapiens
gaaagaaactgccaaa

SEQ ID NO: 97389 - DNA, 16 bp, H. sapiens
gaaagaaagaaaacct

SEQ ID NO: 97390 - DNA, 16 bp, H. sapiens
gaaagaaagaaaccat

SEQ ID NO: 97391 - DNA, 16 bp, H. sapiens
gaaagaaagaaatcag

SEQ ID NO: 97392 - DNA, 16 bp, H. sapiens
gaaagaaagaaatctt

SEQ ID NO: 97393 - DNA, 16 bp, H. sapiens
gaaagaaagaaattct

SEQ ID NO: 97394 - DNA, 16 bp, H. sapiens
gaaagaaaggtagcag

SEQ ID NO: 97395 - DNA, 16 bp, H. sapiens
gaaagaaagtaaatca

SEQ ID NO: 97396 - DNA, 16 bp, H. sapiens
gaaagaaatgaagtca

SEQ ID NO: 97397 - DNA, 16 bp, H. sapiens
gaaagaaattcagaaa

SEQ ID NO: 97398 - DNA, 16 bp, H. sapiens
gaaagaaattgaagat

SEQ ID NO: 97399 - DNA, 16 bp, H. sapiens
gaaagaaatttaaagg

SEQ ID NO: 97400 - DNA, 16 bp, H. sapiens
gaaagaacaaaacttc

SEQ ID NO: 97401 - DNA, 16 bp, H. sapiens
gaaagaacattttttt

SEQ ID NO: 97402 - DNA, 16 bp, H. sapiens
gaaagaacttaaacaa

SEQ ID NO: 97403 - DNA, 16 bp, H. sapiens
gaaagaagaaaaactg

SEQ ID NO: 97404 - DNA, 16 bp, H. sapiens
gaaagaagaaaacttt

SEQ ID NO: 97405 - DNA, 16 bp, H. sapiens
gaaagaagaaaagcat

SEQ ID NO: 97406 - DNA, 16 bp, H. sapiens
gaaagaagaaactccg

SEQ ID NO: 97407 - DNA, 16 bp, H. sapiens
gaaagaagaaatcaca

SEQ ID NO: 97408 - DNA, 16 bp, H. sapiens
gaaagaagagaaaact

SEQ ID NO: 97409 - DNA, 16 bp, H. sapiens
gaaagaagataaaact

SEQ ID NO: 97410 - DNA, 16 bp, H. sapiens
gaaagaagatccaaat

SEQ ID NO: 97411 - DNA, 16 bp, H. sapiens
gaaagaagttgattcc

SEQ ID NO: 97412 - DNA, 16 bp, H. sapiens
gaaagaataaaatact

SEQ ID NO: 97413 - DNA, 16 bp, H. sapiens
gaaagaataaatgttt

SEQ ID NO: 97414 - DNA, 16 bp, H. sapiens
gaaagaatcaatatca

SEQ ID NO: 97415 - DNA, 16 bp, H. sapiens
gaaagaatgagtgagc

SEQ ID NO: 97416 - DNA, 16 bp, H. sapiens
gaaagaatttcagaaa

SEQ ID NO: 97417 - DNA, 16 bp, H. sapiens
gaaagacaaaaatcat

SEQ ID NO: 97418 - DNA, 16 bp, H. sapiens
gaaagacacagtgaga

SEQ ID NO: 97419 - DNA, 16 bp, H. sapiens
gaaagacagagataaa

SEQ ID NO: 97420 - DNA, 16 bp, H. sapiens
gaaagacatgaagaaa

SEQ ID NO: 97421 - DNA, 16 bp, H. sapiens
gaaagactgtttcaaa

SEQ ID NO: 97422 - DNA, 16 bp, H. sapiens
gaaagacttaatattg

SEQ ID NO: 97423 - DNA, 18 bp, H. sapiens
gaaagacttgctgttgtt

SEQ ID NO: 97424 - DNA, 16 bp, H. sapiens
gaaagacttttttttt

SEQ ID NO: 97425 - DNA, 16 bp, H. sapiens
gaaagagaaaagcagt

SEQ ID NO: 97426 - DNA, 16 bp, H. sapiens
gaaagagaaaatgcaa

SEQ ID NO: 97427 - DNA, 16 bp, H. sapiens
gaaagagaagcagcag

SEQ ID NO: 97428 - DNA, 16 bp, H. sapiens
gaaagagaattcaaaa

SEQ ID NO: 97429 - DNA, 16 bp, H. sapiens
gaaagagataaaaggc

SEQ ID NO: 97430 - DNA, 16 bp, H. sapiens
gaaagagcactggact

SEQ ID NO: 97431 - DNA, 16 bp, H. sapiens
gaaagaggagacatca

SEQ ID NO: 97432 - DNA, 16 bp, H. sapiens
gaaagaggcattgaag

SEQ ID NO: 97433 - DNA, 16 bp, H. sapiens
gaaagagggtctcact

SEQ ID NO: 97434 - DNA, 16 bp, H. sapiens
gaaagagggtttcaaa

SEQ ID NO: 97435 - DNA, 16 bp, H. sapiens
gaaagaggtagacatg

SEQ ID NO: 97436 - DNA, 16 bp, H. sapiens
gaaagagtaagaccct

SEQ ID NO: 97437 - DNA, 16 bp, H. sapiens
gaaagagtagatttta

SEQ ID NO: 97438 - DNA, 16 bp, H. sapiens
gaaagagtgtgtgtgt

SEQ ID NO: 97439 - DNA, 16 bp, H. sapiens
gaaagagtttgagaag

SEQ ID NO: 97440 - DNA, 16 bp, H. sapiens
gaaagataaataccac

SEQ ID NO: 97441 - DNA, 16 bp, H. sapiens
gaaagataatacattt

SEQ ID NO: 97442 - DNA, 16 bp, H. sapiens
gaaagatacagtcatt

SEQ ID NO: 97443 - DNA, 16 bp, H. sapiens
gaaagatatattttaa

SEQ ID NO: 97444 - DNA, 16 bp, H. sapiens
gaaagatatcaacatt

SEQ ID NO: 97445 - DNA, 16 bp, H. sapiens
gaaagatgtgtgtgtg

SEQ ID NO: 97446 - DNA, 16 bp, H. sapiens
gaaagatgttaccaga

SEQ ID NO: 97447 - DNA, 16 bp, H. sapiens
gaaagatttcaaataa

SEQ ID NO: 97448 - DNA, 16 bp, H. sapiens
gaaagatttggaaaat

SEQ ID NO: 97449 - DNA, 16 bp, H. sapiens
gaaagattttaagaaa

SEQ ID NO: 97450 - DNA, 16 bp, H. sapiens
gaaagatttttgtttt

SEQ ID NO: 97451 - DNA, 16 bp, H. sapiens
gaaagcaaccaaaatg

SEQ ID NO: 97452 - DNA, 16 bp, H. sapiens
gaaagcaatgagaaca

SEQ ID NO: 97453 - DNA, 20 bp, H. sapiens
gaaagcaatggcaacaaaag

SEQ ID NO: 97454 - DNA, 16 bp, H. sapiens
gaaagcaatgtggcaa

SEQ ID NO: 97455 - DNA, 16 bp, H. sapiens
gaaagcaattgacttt

SEQ ID NO: 97456 - DNA, 16 bp, H. sapiens
gaaagcaattgcaaca

SEQ ID NO: 97457 - DNA, 16 bp, H. sapiens
gaaagcaatttttaaa

SEQ ID NO: 97458 - DNA, 16 bp, H. sapiens
gaaagcaccactgcac

SEQ ID NO: 97459 - DNA, 16 bp, H. sapiens
gaaagcactttgaaaa

SEQ ID NO: 97460 - DNA, 16 bp, H. sapiens
gaaagcagaacataaa

SEQ ID NO: 97461 - DNA, 16 bp, H. sapiens
gaaagcagccaggaaa

SEQ ID NO: 97462 - DNA, 16 bp, H. sapiens
gaaagcaggaaaataa

SEQ ID NO: 97463 - DNA, 16 bp, H. sapiens
gaaagcaggaaagatg

SEQ ID NO: 97464 - DNA, 16 bp, H. sapiens
gaaagcattttatttt

SEQ ID NO: 97465 - DNA, 16 bp, H. sapiens
gaaagcattttcattt

SEQ ID NO: 97466 - DNA, 16 bp, H. sapiens
gaaagcattttctgca

SEQ ID NO: 97467 - DNA, 16 bp, H. sapiens
gaaagccaagcaaaag

SEQ ID NO: 97468 - DNA, 16 bp, H. sapiens
gaaagccacaatgaga

SEQ ID NO: 97469 - DNA, 16 bp, H. sapiens
gaaagcccaggaccag

SEQ ID NO: 97470 - DNA, 16 bp, H. sapiens
gaaagccgaggtgggc

SEQ ID NO: 97471 - DNA, 16 bp, H. sapiens
gaaagcctcagatggg

SEQ ID NO: 97472 - DNA, 16 bp, H. sapiens
gaaagccttccttgac

SEQ ID NO: 97473 - DNA, 16 bp, H. sapiens
gaaagcctttatttct

SEQ ID NO: 97474 - DNA, 16 bp, H. sapiens
gaaagctagaaatgat

SEQ ID NO: 97475 - DNA, 16 bp, H. sapiens
gaaagctgaaactgaa

SEQ ID NO: 97476 - DNA, 16 bp, H. sapiens
gaaagctgaggcccag

SEQ ID NO: 97477 - DNA, 16 bp, H. sapiens
gaaagctgaggtggaa

SEQ ID NO: 97478 - DNA, 16 bp, H. sapiens
gaaagcttcctggagg

SEQ ID NO: 97479 - DNA, 16 bp, H. sapiens
gaaagcttctttctgg

SEQ ID NO: 97480 - DNA, 16 bp, H. sapiens
gaaaggaaaaactgat

SEQ ID NO: 97481 - DNA, 16 bp, H. sapiens
gaaaggaaaaccagac

SEQ ID NO: 97482 - DNA, 16 bp, H. sapiens
gaaaggaaaatatatt

SEQ ID NO: 97483 - DNA, 16 bp, H. sapiens
gaaaggaaaatcttgg

SEQ ID NO: 97484 - DNA, 16 bp, H. sapiens
gaaaggaaacaaaatt

SEQ ID NO: 97485 - DNA, 16 bp, H. sapiens
gaaaggaaagaacatt

SEQ ID NO: 97486 - DNA, 16 bp, H. sapiens
gaaaggaaattagtat

SEQ ID NO: 97487 - DNA, 16 bp, H. sapiens
gaaaggaagaattgca

SEQ ID NO: 97488 - DNA, 16 bp, H. sapiens
gaaaggaaggacccag

SEQ ID NO: 97489 - DNA, 16 bp, H. sapiens
gaaaggaaggcacaga

SEQ ID NO: 97490 - DNA, 16 bp, H. sapiens
gaaaggaaggcaggca

SEQ ID NO: 97491 - DNA, 16 bp, H. sapiens
gaaaggaatggattgg

SEQ ID NO: 97492 - DNA, 16 bp, H. sapiens
gaaaggaattttaaaa

SEQ ID NO: 97493 - DNA, 16 bp, H. sapiens
gaaaggacaacctatt

SEQ ID NO: 97494 - DNA, 16 bp, H. sapiens
gaaaggacattttgga

SEQ ID NO: 97495 - DNA, 17 bp, H. sapiens
gaaaggagaaagtggtt

SEQ ID NO: 97496 - DNA, 16 bp, H. sapiens
gaaaggatgtcagaga

SEQ ID NO: 97497 - DNA, 16 bp, H. sapiens
gaaaggcaaagaaact

SEQ ID NO: 97498 - DNA, 16 bp, H. sapiens
gaaaggcaaataaaat

SEQ ID NO: 97499 - DNA, 16 bp, H. sapiens
gaaaggcaaatcaaaa

SEQ ID NO: 97500 - DNA, 16 bp, H. sapiens
gaaaggcagaggttgc

SEQ ID NO: 97501 - DNA, 16 bp, H. sapiens
gaaaggcaggacaact

SEQ ID NO: 97502 - DNA, 16 bp, H. sapiens
gaaaggcagtctccca

SEQ ID NO: 97503 - DNA, 16 bp, H. sapiens
gaaaggcatgtcttac

SEQ ID NO: 97504 - DNA, 16 bp, H. sapiens
gaaaggccgaggcagg

SEQ ID NO: 97505 - DNA, 16 bp, H. sapiens
gaaaggctgaggctgg

SEQ ID NO: 97506 - DNA, 16 bp, H. sapiens
gaaagggaaaacccct

SEQ ID NO: 97507 - DNA, 16 bp, H. sapiens
gaaagggaaatgcaaa

SEQ ID NO: 97508 - DNA, 24 bp, H. sapiens
gaaagggaactccctgaccccttg

SEQ ID NO: 97509 - DNA, 16 bp, H. sapiens
gaaagggaagatgttg

SEQ ID NO: 97510 - DNA, 17 bp, H. sapiens
gaaagggaattccctga

SEQ ID NO: 97511 - DNA, 16 bp, H. sapiens
gaaagggcaaaactat

SEQ ID NO: 97512 - DNA, 16 bp, H. sapiens
gaaagggctttattca

SEQ ID NO: 97513 - DNA, 16 bp, H. sapiens
gaaaggggaggtgcta

SEQ ID NO: 97514 - DNA, 16 bp, H. sapiens
gaaaggggtccagttt

SEQ ID NO: 97515 - DNA, 16 bp, H. sapiens
gaaaggggtggctgtg

SEQ ID NO: 97516 - DNA, 16 bp, H. sapiens
gaaaggtacagtaaaa

SEQ ID NO: 97517 - DNA, 16 bp, H. sapiens
gaaaggtcaaggctgc

SEQ ID NO: 97518 - DNA, 16 bp, H. sapiens
gaaaggtgaaaaagct

SEQ ID NO: 97519 - DNA, 16 bp, H. sapiens
gaaagtaaaaatcact

SEQ ID NO: 97520 - DNA, 16 bp, H. sapiens
gaaagtaaaatatact

SEQ ID NO: 97521 - DNA, 16 bp, H. sapiens
gaaagtaatgacaaaa

SEQ ID NO: 97522 - DNA, 16 bp, H. sapiens
gaaagtactagaagaa

SEQ ID NO: 97523 - DNA, 16 bp, H. sapiens
gaaagtactttataaa

SEQ ID NO: 97524 - DNA, 16 bp, H. sapiens
gaaagtagaatggttg

SEQ ID NO: 97525 - DNA, 16 bp, H. sapiens
gaaagtagattagcag

SEQ ID NO: 97526 - DNA, 16 bp, H. sapiens
gaaagtatttctcctt

SEQ ID NO: 97527 - DNA, 16 bp, H. sapiens
gaaagtatttttataa

SEQ ID NO: 97528 - DNA, 16 bp, H. sapiens
gaaagtatttttttaa

SEQ ID NO: 97529 - DNA, 16 bp, H. sapiens
gaaagtcattggtagg

SEQ ID NO: 97530 - DNA, 16 bp, H. sapiens
gaaagtccatctctac

SEQ ID NO: 97531 - DNA, 16 bp, H. sapiens
gaaagtcccttctgcc

SEQ ID NO: 97532 - DNA, 16 bp, H. sapiens
gaaagtctgaaagagc

SEQ ID NO: 97533 - DNA, 16 bp, H. sapiens
gaaagtcttcatttct

SEQ ID NO: 97534 - DNA, 16 bp, H. sapiens
gaaagtctttatctct

SEQ ID NO: 97535 - DNA, 16 bp, H. sapiens
gaaagtgaaaaacaat

SEQ ID NO: 97536 - DNA, 16 bp, H. sapiens
gaaagtgaaagcaagt

SEQ ID NO: 97537 - DNA, 16 bp, H. sapiens
gaaagtgaaatgacaa

SEQ ID NO: 97538 - DNA, 16 bp, H. sapiens
gaaagtgaaattaaga

SEQ ID NO: 97539 - DNA, 16 bp, H. sapiens
gaaagtgaaggaatgg

SEQ ID NO: 97540 - DNA, 27 bp, H. sapiens
gaaagtgacagggagaatggaaccaag

SEQ ID NO: 97541 - DNA, 16 bp, H. sapiens
gaaagtgaggctcaga

SEQ ID NO: 97542 - DNA, 16 bp, H. sapiens
gaaagtgatatgcatt

SEQ ID NO: 97543 - DNA, 16 bp, H. sapiens
gaaagtgatggagaga

SEQ ID NO: 97544 - DNA, 16 bp, H. sapiens
gaaagtgctaggatta

SEQ ID NO: 97545 - DNA, 16 bp, H. sapiens
gaaagtgctgggatta

SEQ ID NO: 97546 - DNA, 16 bp, H. sapiens
gaaagtgctttgtaaa

SEQ ID NO: 97547 - DNA, 16 bp, H. sapiens
gaaagtggaaaacaga

SEQ ID NO: 97548 - DNA, 16 bp, H. sapiens
gaaagtggaccaggag

SEQ ID NO: 97549 - DNA, 16 bp, H. sapiens
gaaagtggcttttttt

SEQ ID NO: 97550 - DNA, 16 bp, H. sapiens
gaaagtgtctacccag

SEQ ID NO: 97551 - DNA, 16 bp, H. sapiens
gaaagttaatttttaa

SEQ ID NO: 97552 - DNA, 16 bp, H. sapiens
gaaagttcactgaaaa

SEQ ID NO: 97553 - DNA, 16 bp, H. sapiens
gaaagttctttatata

SEQ ID NO: 97554 - DNA, 16 bp, H. sapiens
gaaagtttatgaattt

SEQ ID NO: 97555 - DNA, 16 bp, H. sapiens
gaaagtttgaaacttc

SEQ ID NO: 97556 - DNA, 16 bp, H. sapiens
gaaagttttaagaaaa

SEQ ID NO: 97557 - DNA, 16 bp, H. sapiens
gaaagttttcagctat

SEQ ID NO: 97558 - DNA, 16 bp, H. sapiens
gaaataaaaagcatga

SEQ ID NO: 97559 - DNA, 16 bp, H. sapiens
gaaataaaaattgttt

SEQ ID NO: 97560 - DNA, 16 bp, H. sapiens
gaaataaaacacttta

SEQ ID NO: 97561 - DNA, 16 bp, H. sapiens
gaaataaaacaggata

SEQ ID NO: 97562 - DNA, 16 bp, H. sapiens
gaaataaaactttaaa

SEQ ID NO: 97563 - DNA, 16 bp, H. sapiens
gaaataaaactttttt

SEQ ID NO: 97564 - DNA, 16 bp, H. sapiens
gaaataaaagaagacc

SEQ ID NO: 97565 - DNA, 16 bp, H. sapiens
gaaataaaagacatct

SEQ ID NO: 97566 - DNA, 16 bp, H. sapiens
gaaataaaaggacaga

SEQ ID NO: 97567 - DNA, 16 bp, H. sapiens
gaaataaaagtcatcc

SEQ ID NO: 97568 - DNA, 16 bp, H. sapiens
gaaataaaagtgattt

SEQ ID NO: 97569 - DNA, 16 bp, H. sapiens
gaaataaaatcactat

SEQ ID NO: 97570 - DNA, 16 bp, H. sapiens
gaaataaaatcagcat

SEQ ID NO: 97571 - DNA, 16 bp, H. sapiens
gaaataaaatcctttt

SEQ ID NO: 97572 - DNA, 16 bp, H. sapiens
gaaataaaattttctt

SEQ ID NO: 97573 - DNA, 16 bp, H. sapiens
gaaataaacaagttct

SEQ ID NO: 97574 - DNA, 16 bp, H. sapiens
gaaataaacattttaa

SEQ ID NO: 97575 - DNA, 16 bp, H. sapiens
gaaataaacttatttt

SEQ ID NO: 97576 - DNA, 16 bp, H. sapiens
gaaataaacttcaaaa

SEQ ID NO: 97577 - DNA, 16 bp, H. sapiens
gaaataaagacttttt

SEQ ID NO: 97578 - DNA, 16 bp, H. sapiens
gaaataaagctctcct

SEQ ID NO: 97579 - DNA, 16 bp, H. sapiens
gaaataaaggcagaaa

SEQ ID NO: 97580 - DNA, 16 bp, H. sapiens
gaaataaagggcatct

SEQ ID NO: 97581 - DNA, 16 bp, H. sapiens
gaaataaagggcattt

SEQ ID NO: 97582 - DNA, 17 bp, H. sapiens
gaaataaagggtattca

SEQ ID NO: 97583 - DNA, 18 bp, H. sapiens
gaaataaagggtattcga

SEQ ID NO: 97584 - DNA, 16 bp, H. sapiens
gaaataaaggtatttt

SEQ ID NO: 97585 - DNA, 16 bp, H. sapiens
gaaataaagtattttt

SEQ ID NO: 97586 - DNA, 16 bp, H. sapiens
gaaataaatctctatt

SEQ ID NO: 97587 - DNA, 16 bp, H. sapiens
gaaataaatgcatttt

SEQ ID NO: 97588 - DNA, 16 bp, H. sapiens
gaaataaatgtctgtg

SEQ ID NO: 97589 - DNA, 16 bp, H. sapiens
gaaataaatgtctgtt

SEQ ID NO: 97590 - DNA, 16 bp, H. sapiens
gaaataaattcaaata

SEQ ID NO: 97591 - DNA, 16 bp, H. sapiens
gaaataaatttctgat

SEQ ID NO: 97592 - DNA, 16 bp, H. sapiens
gaaataaattttgttt

SEQ ID NO: 97593 - DNA, 16 bp, H. sapiens
gaaataacacaaatgt

SEQ ID NO: 97594 - DNA, 16 bp, H. sapiens
gaaataacacctcaca

SEQ ID NO: 97595 - DNA, 17 bp, H. sapiens
gaaataactaagatcac

SEQ ID NO: 97596 - DNA, 16 bp, H. sapiens
gaaataactccaagaa

SEQ ID NO: 97597 - DNA, 16 bp, H. sapiens
gaaataactgagatca

SEQ ID NO: 97598 - DNA, 16 bp, H. sapiens
gaaataactttttctt

SEQ ID NO: 97599 - DNA, 16 bp, H. sapiens
gaaataagacaggaca

SEQ ID NO: 97600 - DNA, 16 bp, H. sapiens
gaaataagagagaaca

SEQ ID NO: 97601 - DNA, 16 bp, H. sapiens
gaaataagatcacaca

SEQ ID NO: 97602 - DNA, 16 bp, H. sapiens
gaaataagatcttttt

SEQ ID NO: 97603 - DNA, 16 bp, H. sapiens
gaaataagattctttt

SEQ ID NO: 97604 - DNA, 16 bp, H. sapiens
gaaataagattttttt

SEQ ID NO: 97605 - DNA, 16 bp, H. sapiens
gaaataagccagccac

SEQ ID NO: 97606 - DNA, 16 bp, H. sapiens
gaaataagccagtctc

SEQ ID NO: 97607 - DNA, 18 bp, H. sapiens
gaaataataccacacatc

SEQ ID NO: 97608 - DNA, 16 bp, H. sapiens
gaaataatagatgaca

SEQ ID NO: 97609 - DNA, 16 bp, H. sapiens
gaaataatattgattt

SEQ ID NO: 97610 - DNA, 16 bp, H. sapiens
gaaataatcaagatca

SEQ ID NO: 97611 - DNA, 16 bp, H. sapiens
gaaataatcagcagaa

SEQ ID NO: 97612 - DNA, 16 bp, H. sapiens
gaaataatctaaatgt

SEQ ID NO: 97613 - DNA, 16 bp, H. sapiens
gaaataatgaaatgat

SEQ ID NO: 97614 - DNA, 16 bp, H. sapiens
gaaataatgactaaaa

SEQ ID NO: 97615 - DNA, 16 bp, H. sapiens
gaaataatggccaaaa

SEQ ID NO: 97616 - DNA, 16 bp, H. sapiens
gaaataatggttgaaa

SEQ ID NO: 97617 - DNA, 16 bp, H. sapiens
gaaataatgtcatttg

SEQ ID NO: 97618 - DNA, 16 bp, H. sapiens
gaaataattaagctta

SEQ ID NO: 97619 - DNA, 16 bp, H. sapiens
gaaataattgataagc

SEQ ID NO: 97620 - DNA, 16 bp, H. sapiens
gaaataattgccaaat

SEQ ID NO: 97621 - DNA, 16 bp, H. sapiens
gaaatacaaagaggaa

SEQ ID NO: 97622 - DNA, 16 bp, H. sapiens
gaaatacaaattaata

SEQ ID NO: 97623 - DNA, 16 bp, H. sapiens
gaaatacaatgaaaat

SEQ ID NO: 97624 - DNA, 16 bp, H. sapiens
gaaatacagagaaagc

SEQ ID NO: 97625 - DNA, 23 bp, H. sapiens
gaaatacagagaacgccacaaag

SEQ ID NO: 97626 - DNA, 16 bp, H. sapiens
gaaatacatgtttgtt

SEQ ID NO: 97627 - DNA, 16 bp, H. sapiens
gaaatacatttctgtt

SEQ ID NO: 97628 - DNA, 16 bp, H. sapiens
gaaatacatttttttt

SEQ ID NO: 97629 - DNA, 19 bp, H. sapiens
gaaataccatttgacccag

SEQ ID NO: 97630 - DNA, 16 bp, H. sapiens
gaaatacccttctgga

SEQ ID NO: 97631 - DNA, 16 bp, H. sapiens
gaaatactaaagaaag

SEQ ID NO: 97632 - DNA, 16 bp, H. sapiens
gaaatactcttcttga

SEQ ID NO: 97633 - DNA, 16 bp, H. sapiens
gaaatacttgggacca

SEQ ID NO: 97634 - DNA, 16 bp, H. sapiens
gaaatagaaaaatctg

SEQ ID NO: 97635 - DNA, 16 bp, H. sapiens
gaaatagaaaacagga

SEQ ID NO: 97636 - DNA, 16 bp, H. sapiens
gaaatagaaactacca

SEQ ID NO: 97637 - DNA, 16 bp, H. sapiens
gaaatagaaggaaaca

SEQ ID NO: 97638 - DNA, 16 bp, H. sapiens
gaaatagaattagaag

SEQ ID NO: 97639 - DNA, 16 bp, H. sapiens
gaaatagaattgctgg

SEQ ID NO: 97640 - DNA, 16 bp, H. sapiens
gaaatagacaaattta

SEQ ID NO: 97641 - DNA, 16 bp, H. sapiens
gaaatagacacaataa

SEQ ID NO: 97642 - DNA, 16 bp, H. sapiens
gaaataggaaaatgtg

SEQ ID NO: 97643 - DNA, 16 bp, H. sapiens
gaaataggatcttgct

SEQ ID NO: 97644 - DNA, 16 bp, H. sapiens
gaaatatagagaatgc

SEQ ID NO: 97645 - DNA, 16 bp, H. sapiens
gaaatatatgtatttt

SEQ ID NO: 97646 - DNA, 16 bp, H. sapiens
gaaatatatgtgtata

SEQ ID NO: 97647 - DNA, 16 bp, H. sapiens
gaaatatatgtgtgtg

SEQ ID NO: 97648 - DNA, 16 bp, H. sapiens
gaaatatatttctgaa

SEQ ID NO: 97649 - DNA, 16 bp, H. sapiens
gaaatatccaggttct

SEQ ID NO: 97650 - DNA, 16 bp, H. sapiens
gaaatatctaaaattg

SEQ ID NO: 97651 - DNA, 16 bp, H. sapiens
gaaatatctatttaaa

SEQ ID NO: 97652 - DNA, 16 bp, H. sapiens
gaaatatctccagata

SEQ ID NO: 97653 - DNA, 16 bp, H. sapiens
gaaatatcttcagaaa

SEQ ID NO: 97654 - DNA, 16 bp, H. sapiens
gaaatatgaacatttt

SEQ ID NO: 97655 - DNA, 35 bp, H. sapiens
gaaatattactccaatgttatgatcacttgcaaaa

SEQ ID NO: 97656 - DNA, 16 bp, H. sapiens
gaaatattcattaaaa

SEQ ID NO: 97657 - DNA, 16 bp, H. sapiens
gaaatatttagaattt

SEQ ID NO: 97658 - DNA, 16 bp, H. sapiens
gaaatatttgaagaaa

SEQ ID NO: 97659 - DNA, 16 bp, H. sapiens
gaaatatttgcagaaa

SEQ ID NO: 97660 - DNA, 16 bp, H. sapiens
gaaatattttatatac

SEQ ID NO: 97661 - DNA, 16 bp, H. sapiens
gaaatattttctcatt

SEQ ID NO: 97662 - DNA, 16 bp, H. sapiens
gaaatatttttttttc

SEQ ID NO: 97663 - DNA, 16 bp, H. sapiens
gaaatcaaagaagaca

SEQ ID NO: 97664 - DNA, 16 bp, H. sapiens
gaaatcaaatcagtaa

SEQ ID NO: 97665 - DNA, 16 bp, H. sapiens
gaaatcaaatggaaat

SEQ ID NO: 97666 - DNA, 17 bp, H. sapiens
gaaatcaagaccatcct

SEQ ID NO: 97667 - DNA, 16 bp, H. sapiens
gaaatcaagatgaaaa

SEQ ID NO: 97668 - DNA, 16 bp, H. sapiens
gaaatcaaggtggaaa

SEQ ID NO: 97669 - DNA, 16 bp, H. sapiens
gaaatcaataaacgta

SEQ ID NO: 97670 - DNA, 16 bp, H. sapiens
gaaatcaatttttaaa

SEQ ID NO: 97671 - DNA, 16 bp, H. sapiens
gaaatcacaatggaaa

SEQ ID NO: 97672 - DNA, 16 bp, H. sapiens
gaaatcacagatacca

SEQ ID NO: 97673 - DNA, 16 bp, H. sapiens
gaaatcacagatattt

SEQ ID NO: 97674 - DNA, 17 bp, H. sapiens
gaaatcaccagcatccc

SEQ ID NO: 97675 - DNA, 16 bp, H. sapiens
gaaatcagaccttatc

SEQ ID NO: 97676 - DNA, 16 bp, H. sapiens
gaaatcagagattaca

SEQ ID NO: 97677 - DNA, 16 bp, H. sapiens
gaaatcaggaaaataa

SEQ ID NO: 97678 - DNA, 16 bp, H. sapiens
gaaatcaggagagaga

SEQ ID NO: 97679 - DNA, 16 bp, H. sapiens
gaaatcataaatgttt

SEQ ID NO: 97680 - DNA, 16 bp, H. sapiens
gaaatcataacaaaca

SEQ ID NO: 97681 - DNA, 16 bp, H. sapiens
gaaatcatgtcttttg

SEQ ID NO: 97682 - DNA, 16 bp, H. sapiens
gaaatcatgttctttg

SEQ ID NO: 97683 - DNA, 16 bp, H. sapiens
gaaatcattttttcct

SEQ ID NO: 97684 - DNA, 16 bp, H. sapiens
gaaatccaaatccaaa

SEQ ID NO: 97685 - DNA, 16 bp, H. sapiens
gaaatccagtttatca

SEQ ID NO: 97686 - DNA, 16 bp, H. sapiens
gaaatccatttttttt

SEQ ID NO: 97687 - DNA, 16 bp, H. sapiens
gaaatcccatatctac

SEQ ID NO: 97688 - DNA, 16 bp, H. sapiens
gaaatcccatctccac

SEQ ID NO: 97689 - DNA, 16 bp, H. sapiens
gaaatcccatgtctac

SEQ ID NO: 97690 - DNA, 16 bp, H. sapiens
gaaatcctaagcaaaa

SEQ ID NO: 97691 - DNA, 16 bp, H. sapiens
gaaatcctaggcaata

SEQ ID NO: 97692 - DNA, 16 bp, H. sapiens
gaaatcctgtctctac

SEQ ID NO: 97693 - DNA, 16 bp, H. sapiens
gaaatcctgtctttac

SEQ ID NO: 97694 - DNA, 16 bp, H. sapiens
gaaatctcaagggaaa

SEQ ID NO: 97695 - DNA, 16 bp, H. sapiens
gaaatctccaaactgc

SEQ ID NO: 97696 - DNA, 16 bp, H. sapiens
gaaatctgaaacactt

SEQ ID NO: 97697 - DNA, 16 bp, H. sapiens
gaaatctgaataaact

SEQ ID NO: 97698 - DNA, 16 bp, H. sapiens
gaaatctgcattttaa

SEQ ID NO: 97699 - DNA, 16 bp, H. sapiens
gaaatctggagagaca

SEQ ID NO: 97700 - DNA, 16 bp, H. sapiens
gaaatctggcagtctg

SEQ ID NO: 97701 - DNA, 16 bp, H. sapiens
gaaatctggggaagag

SEQ ID NO: 97702 - DNA, 16 bp, H. sapiens
gaaatcttgccttcct

SEQ ID NO: 97703 - DNA, 16 bp, H. sapiens
gaaatctttgccaagg

SEQ ID NO: 97704 - DNA, 16 bp, H. sapiens
gaaatctttgctgttc

SEQ ID NO: 97705 - DNA, 16 bp, H. sapiens
gaaatgaaaaagcaga

SEQ ID NO: 97706 - DNA, 16 bp, H. sapiens
gaaatgaaaacatagg

SEQ ID NO: 97707 - DNA, 16 bp, H. sapiens
gaaatgaaacagaaga

SEQ ID NO: 97708 - DNA, 16 bp, H. sapiens
gaaatgaaagacaaat

SEQ ID NO: 97709 - DNA, 16 bp, H. sapiens
gaaatgaaaggacatt

SEQ ID NO: 97710 - DNA, 16 bp, H. sapiens
gaaatgaaatgggaga

SEQ ID NO: 97711 - DNA, 16 bp, H. sapiens
gaaatgaaattatatt

SEQ ID NO: 97712 - DNA, 16 bp, H. sapiens
gaaatgaaattgctgg

SEQ ID NO: 97713 - DNA, 16 bp, H. sapiens
gaaatgaagccagttg

SEQ ID NO: 97714 - DNA, 16 bp, H. sapiens
gaaatgaagtcagaaa

SEQ ID NO: 97715 - DNA, 16 bp, H. sapiens
gaaatgaagtcttgct

SEQ ID NO: 97716 - DNA, 16 bp, H. sapiens
gaaatgaatgaaaatg

SEQ ID NO: 97717 - DNA, 16 bp, H. sapiens
gaaatgacaaatgttt

SEQ ID NO: 97718 - DNA, 16 bp, H. sapiens
gaaatgacatcttcct

SEQ ID NO: 97719 - DNA, 16 bp, H. sapiens
gaaatgactaacaagg

SEQ ID NO: 97720 - DNA, 16 bp, H. sapiens
gaaatgagaacacatg

SEQ ID NO: 97721 - DNA, 16 bp, H. sapiens
gaaatgagaagcaaag

SEQ ID NO: 97722 - DNA, 16 bp, H. sapiens
gaaatgagaattttaa

SEQ ID NO: 97723 - DNA, 16 bp, H. sapiens
gaaatgagatgagatg

SEQ ID NO: 97724 - DNA, 16 bp, H. sapiens
gaaatgagatttggga

SEQ ID NO: 97725 - DNA, 16 bp, H. sapiens
gaaatgagctctcaag

SEQ ID NO: 97726 - DNA, 16 bp, H. sapiens
gaaatgaggaactttt

SEQ ID NO: 97727 - DNA, 16 bp, H. sapiens
gaaatgaggagatgtt

SEQ ID NO: 97728 - DNA, 16 bp, H. sapiens
gaaatgaggctggaga

SEQ ID NO: 97729 - DNA, 16 bp, H. sapiens
gaaatgaggctgggtg

SEQ ID NO: 97730 - DNA, 16 bp, H. sapiens
gaaatgataaacgttt

SEQ ID NO: 97731 - DNA, 16 bp, H. sapiens
gaaatgatcaacaaaa

SEQ ID NO: 97732 - DNA, 16 bp, H. sapiens
gaaatgatggctgaaa

SEQ ID NO: 97733 - DNA, 16 bp, H. sapiens
gaaatgattacatttt

SEQ ID NO: 97734 - DNA, 16 bp, H. sapiens
gaaatgattttttaaa

SEQ ID NO: 97735 - DNA, 16 bp, H. sapiens
gaaatgcaaaagtctg

SEQ ID NO: 97736 - DNA, 16 bp, H. sapiens
gaaatgcaaaggacct

SEQ ID NO: 97737 - DNA, 16 bp, H. sapiens
gaaatgcaaattaaaa

SEQ ID NO: 97738 - DNA, 16 bp, H. sapiens
gaaatgcacattcttg

SEQ ID NO: 97739 - DNA, 16 bp, H. sapiens
gaaatgcagaaattac

SEQ ID NO: 97740 - DNA, 16 bp, H. sapiens
gaaatgcagaagtcac

SEQ ID NO: 97741 - DNA, 16 bp, H. sapiens
gaaatgccacactgtc

SEQ ID NO: 97742 - DNA, 16 bp, H. sapiens
gaaatgccagatgctt

SEQ ID NO: 97743 - DNA, 16 bp, H. sapiens
gaaatgccttcagaat

SEQ ID NO: 97744 - DNA, 16 bp, H. sapiens
gaaatgctctttggag

SEQ ID NO: 97745 - DNA, 16 bp, H. sapiens
gaaatgcttcagaaca

SEQ ID NO: 97746 - DNA, 16 bp, H. sapiens
gaaatggaaacagaga

SEQ ID NO: 97747 - DNA, 16 bp, H. sapiens
gaaatggaagctcaga

SEQ ID NO: 97748 - DNA, 16 bp, H. sapiens
gaaatggaatctcact

SEQ ID NO: 97749 - DNA, 16 bp, H. sapiens
gaaatggagacagaga

SEQ ID NO: 97750 - DNA, 16 bp, H. sapiens
gaaatggagagttgtt

SEQ ID NO: 97751 - DNA, 16 bp, H. sapiens
gaaatggaggcccaga

SEQ ID NO: 97752 - DNA, 16 bp, H. sapiens
gaaatggaggctcagg

SEQ ID NO: 97753 - DNA, 16 bp, H. sapiens
gaaatggagtctcact

SEQ ID NO: 97754 - DNA, 16 bp, H. sapiens
gaaatggcaccactgc

SEQ ID NO: 97755 - DNA, 16 bp, H. sapiens
gaaatggctttgtgat

SEQ ID NO: 97756 - DNA, 16 bp, H. sapiens
gaaatgggagaaaatt

SEQ ID NO: 97757 - DNA, 16 bp, H. sapiens
gaaatgggagagttcc

SEQ ID NO: 97758 - DNA, 16 bp, H. sapiens
gaaatgggagttttat

SEQ ID NO: 97759 - DNA, 16 bp, H. sapiens
gaaatgggattgctgg

SEQ ID NO: 97760 - DNA, 16 bp, H. sapiens
gaaatggggttttgct

SEQ ID NO: 97761 - DNA, 16 bp, H. sapiens
gaaatgggtgtattta

SEQ ID NO: 97762 - DNA, 16 bp, H. sapiens
gaaatggtgttggaga

SEQ ID NO: 97763 - DNA, 16 bp, H. sapiens
gaaatggttaagatgg

SEQ ID NO: 97764 - DNA, 16 bp, H. sapiens
gaaatggttaatttta

SEQ ID NO: 97765 - DNA, 16 bp, H. sapiens
gaaatgtaaactagta

SEQ ID NO: 97766 - DNA, 16 bp, H. sapiens
gaaatgtacatcaaaa

SEQ ID NO: 97767 - DNA, 16 bp, H. sapiens
gaaatgtacttttttt

SEQ ID NO: 97768 - DNA, 16 bp, H. sapiens
gaaatgtccaaaatag

SEQ ID NO: 97769 - DNA, 16 bp, H. sapiens
gaaatgtccagaaaag

SEQ ID NO: 97770 - DNA, 16 bp, H. sapiens
gaaatgtctagaaaag

SEQ ID NO: 97771 - DNA, 16 bp, H. sapiens
gaaatgtctatttaag

SEQ ID NO: 97772 - DNA, 16 bp, H. sapiens
gaaatgtctcttcaag

SEQ ID NO: 97773 - DNA, 16 bp, H. sapiens
gaaatgtcttattttt

SEQ ID NO: 97774 - DNA, 16 bp, H. sapiens
gaaatgtcttcaaaat

SEQ ID NO: 97775 - DNA, 16 bp, H. sapiens
gaaatgtgaataagta

SEQ ID NO: 97776 - DNA, 16 bp, H. sapiens
gaaatgtgatttttat

SEQ ID NO: 97777 - DNA, 16 bp, H. sapiens
gaaatgtggagaaaag

SEQ ID NO: 97778 - DNA, 16 bp, H. sapiens
gaaatgtgggaaagtt

SEQ ID NO: 97779 - DNA, 16 bp, H. sapiens
gaaatgtgggattgga

SEQ ID NO: 97780 - DNA, 16 bp, H. sapiens
gaaatgttaaaagaag

SEQ ID NO: 97781 - DNA, 16 bp, H. sapiens
gaaatgttaatttaaa

SEQ ID NO: 97782 - DNA, 16 bp, H. sapiens
gaaatgttctacatct

SEQ ID NO: 97783 - DNA, 16 bp, H. sapiens
gaaatgttctgtattt

SEQ ID NO: 97784 - DNA, 16 bp, H. sapiens
gaaatgtttaaatctg

SEQ ID NO: 97785 - DNA, 16 bp, H. sapiens
gaaatgtttcagattt

SEQ ID NO: 97786 - DNA, 16 bp, H. sapiens
gaaatgttttaaaata

SEQ ID NO: 97787 - DNA, 16 bp, H. sapiens
gaaatgttttaaattt

SEQ ID NO: 97788 - DNA, 16 bp, H. sapiens
gaaatgttttctttct

SEQ ID NO: 97789 - DNA, 16 bp, H. sapiens
gaaatgtttttttaaa

SEQ ID NO: 97790 - DNA, 16 bp, H. sapiens
gaaattaaaaacatga

SEQ ID NO: 97791 - DNA, 16 bp, H. sapiens
gaaattaaaacatttt

SEQ ID NO: 97792 - DNA, 16 bp, H. sapiens
gaaattaaagaagaca

SEQ ID NO: 97793 - DNA, 16 bp, H. sapiens
gaaattaaagaaggca

SEQ ID NO: 97794 - DNA, 16 bp, H. sapiens
gaaattaaagatgaca

SEQ ID NO: 97795 - DNA, 16 bp, H. sapiens
gaaattaaggcaaaaa

SEQ ID NO: 97796 - DNA, 16 bp, H. sapiens
gaaattaaggcagaga

SEQ ID NO: 97797 - DNA, 16 bp, H. sapiens
gaaattaatgttgttt

SEQ ID NO: 97798 - DNA, 16 bp, H. sapiens
gaaattacaaaaatta

SEQ ID NO: 97799 - DNA, 16 bp, H. sapiens
gaaattagacaagaaa

SEQ ID NO: 97800 - DNA, 16 bp, H. sapiens
gaaattagccaggctt

SEQ ID NO: 97801 - DNA, 16 bp, H. sapiens
gaaattataaaactga

SEQ ID NO: 97802 - DNA, 16 bp, H. sapiens
gaaattatccatttct

SEQ ID NO: 97803 - DNA, 16 bp, H. sapiens
gaaattatgtcaaaat

SEQ ID NO: 97804 - DNA, 16 bp, H. sapiens
gaaattcaaatcaaaa

SEQ ID NO: 97805 - DNA, 16 bp, H. sapiens
gaaattcaacagaact

SEQ ID NO: 97806 - DNA, 16 bp, H. sapiens
gaaattcagaatctca

SEQ ID NO: 97807 - DNA, 16 bp, H. sapiens
gaaattcagatttcat

SEQ ID NO: 97808 - DNA, 16 bp, H. sapiens
gaaattcagattttta

SEQ ID NO: 97809 - DNA, 16 bp, H. sapiens
gaaattcatccatttc

SEQ ID NO: 97810 - DNA, 16 bp, H. sapiens
gaaattcattttaaaa

SEQ ID NO: 97811 - DNA, 16 bp, H. sapiens
gaaattccatctcaaa

SEQ ID NO: 97812 - DNA, 16 bp, H. sapiens
gaaattccatttcaaa

SEQ ID NO: 97813 - DNA, 16 bp, H. sapiens
gaaattcccacaggga

SEQ ID NO: 97814 - DNA, 16 bp, H. sapiens
gaaattcctatcaaaa

SEQ ID NO: 97815 - DNA, 16 bp, H. sapiens
gaaattccttaaagaa

SEQ ID NO: 97816 - DNA, 16 bp, H. sapiens
gaaattctaaccaaga

SEQ ID NO: 97817 - DNA, 16 bp, H. sapiens
gaaattctagaattga

SEQ ID NO: 97818 - DNA, 16 bp, H. sapiens
gaaattctgcatttct

SEQ ID NO: 97819 - DNA, 16 bp, H. sapiens
gaaattctgtatttct

SEQ ID NO: 97820 - DNA, 16 bp, H. sapiens
gaaattcttttaaaaa

SEQ ID NO: 97821 - DNA, 16 bp, H. sapiens
gaaattgaaaaagaca

SEQ ID NO: 97822 - DNA, 16 bp, H. sapiens
gaaattgaaaacagaa

SEQ ID NO: 97823 - DNA, 16 bp, H. sapiens
gaaattgaaatcagta

SEQ ID NO: 97824 - DNA, 16 bp, H. sapiens
gaaattgaagaaaaca

SEQ ID NO: 97825 - DNA, 16 bp, H. sapiens
gaaattgaagctcaaa

SEQ ID NO: 97826 - DNA, 16 bp, H. sapiens
gaaattgaggcaatag

SEQ ID NO: 97827 - DNA, 16 bp, H. sapiens
gaaattgaggcacaaa

SEQ ID NO: 97828 - DNA, 16 bp, H. sapiens
gaaattgaggcagaaa

SEQ ID NO: 97829 - DNA, 16 bp, H. sapiens
gaaattgaggcagaga

SEQ ID NO: 97830 - DNA, 16 bp, H. sapiens
gaaattgaggcccaaa

SEQ ID NO: 97831 - DNA, 16 bp, H. sapiens
gaaattgataggaagc

SEQ ID NO: 97832 - DNA, 16 bp, H. sapiens
gaaattgccacagcca

SEQ ID NO: 97833 - DNA, 16 bp, H. sapiens
gaaattgctgaaaatc

SEQ ID NO: 97834 - DNA, 16 bp, H. sapiens
gaaattgctgagtcaa

SEQ ID NO: 97835 - DNA, 16 bp, H. sapiens
gaaattggaaatcatt

SEQ ID NO: 97836 - DNA, 16 bp, H. sapiens
gaaattgttacaaagt

SEQ ID NO: 97837 - DNA, 16 bp, H. sapiens
gaaatttatcagaaaa

SEQ ID NO: 97838 - DNA, 16 bp, H. sapiens
gaaatttatcagagaa

SEQ ID NO: 97839 - DNA, 16 bp, H. sapiens
gaaatttattatctca

SEQ ID NO: 97840 - DNA, 16 bp, H. sapiens
gaaatttatttcttat

SEQ ID NO: 97841 - DNA, 16 bp, H. sapiens
gaaatttcttttttct

SEQ ID NO: 97842 - DNA, 16 bp, H. sapiens
gaaatttgaacactga

SEQ ID NO: 97843 - DNA, 16 bp, H. sapiens
gaaatttgagaccagc

SEQ ID NO: 97844 - DNA, 16 bp, H. sapiens
gaaattttaaaaatcc

SEQ ID NO: 97845 - DNA, 16 bp, H. sapiens
gaaattttacatttta

SEQ ID NO: 97846 - DNA, 16 bp, H. sapiens
gaaattttactgaagt

SEQ ID NO: 97847 - DNA, 16 bp, H. sapiens
gaaattttcatggatg

SEQ ID NO: 97848 - DNA, 16 bp, H. sapiens
gaaattttctttaaaa

SEQ ID NO: 97849 - DNA, 16 bp, H. sapiens
gaaattttcttttatt

SEQ ID NO: 97850 - DNA, 16 bp, H. sapiens
gaaattttgtgtgtgt

SEQ ID NO: 97851 - DNA, 16 bp, H. sapiens
gaaatttttcaacata

SEQ ID NO: 97852 - DNA, 16 bp, H. sapiens
gaacaaaactgaagaa

SEQ ID NO: 97853 - DNA, 16 bp, H. sapiens
gaacaaaactggatgg

SEQ ID NO: 97854 - DNA, 16 bp, H. sapiens
gaacaaacactcagaa

SEQ ID NO: 97855 - DNA, 16 bp, H. sapiens
gaacaaaccctccaag

SEQ ID NO: 97856 - DNA, 16 bp, H. sapiens
gaacaaagaaaatgtt

SEQ ID NO: 97857 - DNA, 16 bp, H. sapiens
gaacaaagaacagatg

SEQ ID NO: 97858 - DNA, 16 bp, H. sapiens
gaacaaagacaaaatg

SEQ ID NO: 97859 - DNA, 16 bp, H. sapiens
gaacaaagctgcaggc

SEQ ID NO: 97860 - DNA, 29 bp, H. sapiens
gaacaaagctggacggagaatgactttga

SEQ ID NO: 97861 - DNA, 23 bp, H. sapiens
gaacaaagctggatggagaatga

SEQ ID NO: 97862 - DNA, 16 bp, H. sapiens
gaacaaaggaatgaat

SEQ ID NO: 97863 - DNA, 16 bp, H. sapiens
gaacaaaggtctctgg

SEQ ID NO: 97864 - DNA, 16 bp, H. sapiens
gaacaaagttgaagga

SEQ ID NO: 97865 - DNA, 16 bp, H. sapiens
gaacaaagttggaggt

SEQ ID NO: 97866 - DNA, 16 bp, H. sapiens
gaacaaatattttaaa

SEQ ID NO: 97867 - DNA, 16 bp, H. sapiens
gaacaaatgaagaaat

SEQ ID NO: 97868 - DNA, 16 bp, H. sapiens
gaacaacagagcaaga

SEQ ID NO: 97869 - DNA, 16 bp, H. sapiens
gaacaaccagacagaa

SEQ ID NO: 97870 - DNA, 31 bp, H. sapiens
gaacaacctgctcctcaatgactactgggta

SEQ ID NO: 97871 - DNA, 16 bp, H. sapiens
gaacaacctggccaac

SEQ ID NO: 97872 - DNA, 16 bp, H. sapiens
gaacaactggaactct

SEQ ID NO: 97873 - DNA, 16 bp, H. sapiens
gaacaagactctgcct

SEQ ID NO: 97874 - DNA, 16 bp, H. sapiens
gaacaagctgctcctg

SEQ ID NO: 97875 - DNA, 16 bp, H. sapiens
gaacaaggagagccag

SEQ ID NO: 97876 - DNA, 16 bp, H. sapiens
gaacaaggcctccaag

SEQ ID NO: 97877 - DNA, 16 bp, H. sapiens
gaacaagggaggcaga

SEQ ID NO: 97878 - DNA, 16 bp, H. sapiens
gaacaatgtcacagaa

SEQ ID NO: 97879 - DNA, 16 bp, H. sapiens
gaacaatgtgaaaaag

SEQ ID NO: 97880 - DNA, 16 bp, H. sapiens
gaacacaatagagaac

SEQ ID NO: 97881 - DNA, 16 bp, H. sapiens
gaacacagccctgctg

SEQ ID NO: 97882 - DNA, 16 bp, H. sapiens
gaacacaggccaaggg

SEQ ID NO: 97883 - DNA, 16 bp, H. sapiens
gaacacagtggctggg

SEQ ID NO: 97884 - DNA, 16 bp, H. sapiens
gaacacagtttgaaaa

SEQ ID NO: 97885 - DNA, 16 bp, H. sapiens
gaacacattcaaatca

SEQ ID NO: 97886 - DNA, 16 bp, H. sapiens
gaacaccacacactgg

SEQ ID NO: 97887 - DNA, 16 bp, H. sapiens
gaacacccagaacttt

SEQ ID NO: 97888 - DNA, 16 bp, H. sapiens
gaacacctgacctcaa

SEQ ID NO: 97889 - DNA, 16 bp, H. sapiens
gaacacctgaggctgg

SEQ ID NO: 97890 - DNA, 16 bp, H. sapiens
gaacactgaaaactca

SEQ ID NO: 97891 - DNA, 16 bp, H. sapiens
gaacacttctgtctac

SEQ ID NO: 97892 - DNA, 17 bp, H. sapiens
gaacacttggacacagg

SEQ ID NO: 97893 - DNA, 16 bp, H. sapiens
gaacacttggacactg

SEQ ID NO: 97894 - DNA, 16 bp, H. sapiens
gaacactttgggaggc

SEQ ID NO: 97895 - DNA, 16 bp, H. sapiens
gaacagaaagccaaat

SEQ ID NO: 97896 - DNA, 16 bp, H. sapiens
gaacagaaaggacatc

SEQ ID NO: 97897 - DNA, 16 bp, H. sapiens
gaacagaaatttctca

SEQ ID NO: 97898 - DNA, 16 bp, H. sapiens
gaacagaataaagagt

SEQ ID NO: 97899 - DNA, 16 bp, H. sapiens
gaacagaattgagaat

SEQ ID NO: 97900 - DNA, 16 bp, H. sapiens
gaacagagaacccaga

SEQ ID NO: 97901 - DNA, 16 bp, H. sapiens
gaacagagagacagag

SEQ ID NO: 97902 - DNA, 16 bp, H. sapiens
gaacagagaggttaag

SEQ ID NO: 97903 - DNA, 16 bp, H. sapiens
gaacagagcaagaccc

SEQ ID NO: 97904 - DNA, 16 bp, H. sapiens
gaacagaggccttaga

SEQ ID NO: 97905 - DNA, 16 bp, H. sapiens
gaacagagtccagaaa

SEQ ID NO: 97906 - DNA, 16 bp, H. sapiens
gaacagatatttattt

SEQ ID NO: 97907 - DNA, 16 bp, H. sapiens
gaacagatgaataaaa

SEQ ID NO: 97908 - DNA, 16 bp, H. sapiens
gaacagattctcccct

SEQ ID NO: 97909 - DNA, 16 bp, H. sapiens
gaacagcaaatgcaaa

SEQ ID NO: 97910 - DNA, 16 bp, H. sapiens
gaacagcagcaggagg

SEQ ID NO: 97911 - DNA, 16 bp, H. sapiens
gaacagcaggtgcagc

SEQ ID NO: 97912 - DNA, 16 bp, H. sapiens
gaacagcatggaaaaa

SEQ ID NO: 97913 - DNA, 16 bp, H. sapiens
gaacagcatgggcaaa

SEQ ID NO: 97914 - DNA, 16 bp, H. sapiens
gaacagcatgtgcaga

SEQ ID NO: 97915 - DNA, 16 bp, H. sapiens
gaacagcttgggcaac

SEQ ID NO: 97916 - DNA, 16 bp, H. sapiens
gaacaggaaaccaaac

SEQ ID NO: 97917 - DNA, 16 bp, H. sapiens
gaacaggcagtatttg

SEQ ID NO: 97918 - DNA, 16 bp, H. sapiens
gaacagggagtgactg

SEQ ID NO: 97919 - DNA, 16 bp, H. sapiens
gaacagtatggggaaa

SEQ ID NO: 97920 - DNA, 16 bp, H. sapiens
gaacagtgccacaata

SEQ ID NO: 97921 - DNA, 16 bp, H. sapiens
gaacagtgctgggcac

SEQ ID NO: 97922 - DNA, 16 bp, H. sapiens
gaacagtgggttttgt

SEQ ID NO: 97923 - DNA, 16 bp, H. sapiens
gaacagtggttaccag

SEQ ID NO: 97924 - DNA, 16 bp, H. sapiens
gaacagtgtgtggaga

SEQ ID NO: 97925 - DNA, 16 bp, H. sapiens
gaacatatttgcaaaa

SEQ ID NO: 97926 - DNA, 16 bp, H. sapiens
gaacatcaaactccaa

SEQ ID NO: 97927 - DNA, 16 bp, H. sapiens
gaacatcagctcctcc

SEQ ID NO: 97928 - DNA, 16 bp, H. sapiens
gaacatccttatctct

SEQ ID NO: 97929 - DNA, 16 bp, H. sapiens
gaacatctgagcccct

SEQ ID NO: 97930 - DNA, 16 bp, H. sapiens
gaacatctttccattt

SEQ ID NO: 97931 - DNA, 16 bp, H. sapiens
gaacatctttttatat

SEQ ID NO: 97932 - DNA, 16 bp, H. sapiens
gaacatgagagagatg

SEQ ID NO: 97933 - DNA, 16 bp, H. sapiens
gaacatgcaggatttg

SEQ ID NO: 97934 - DNA, 16 bp, H. sapiens
gaacatgcagttttgt

SEQ ID NO: 97935 - DNA, 16 bp, H. sapiens
gaacatggactttgga

SEQ ID NO: 97936 - DNA, 16 bp, H. sapiens
gaacatggattgtgaa

SEQ ID NO: 97937 - DNA, 16 bp, H. sapiens
gaacatggtgaaaccc

SEQ ID NO: 97938 - DNA, 16 bp, H. sapiens
gaacatggtttgaaca

SEQ ID NO: 97939 - DNA, 16 bp, H. sapiens
gaacatgtggtgcttg

SEQ ID NO: 97940 - DNA, 16 bp, H. sapiens
gaacatgtgtgtgtgt

SEQ ID NO: 97941 - DNA, 16 bp, H. sapiens
gaacattattcagcct

SEQ ID NO: 97942 - DNA, 16 bp, H. sapiens
gaacattccaattcca

SEQ ID NO: 97943 - DNA, 16 bp, H. sapiens
gaacattgagaacaca

SEQ ID NO: 97944 - DNA, 16 bp, H. sapiens
gaacatttcagatttc

SEQ ID NO: 97945 - DNA, 16 bp, H. sapiens
gaacatttcagatttt

SEQ ID NO: 97946 - DNA, 16 bp, H. sapiens
gaacatttcatgtaaa

SEQ ID NO: 97947 - DNA, 16 bp, H. sapiens
gaacatttccatcacc

SEQ ID NO: 97948 - DNA, 16 bp, H. sapiens
gaacatttccattacc

SEQ ID NO: 97949 - DNA, 16 bp, H. sapiens
gaacatttgtttacaa

SEQ ID NO: 97950 - DNA, 16 bp, H. sapiens
gaacattttaacagta

SEQ ID NO: 97951 - DNA, 16 bp, H. sapiens
gaacattttaatattt

SEQ ID NO: 97952 - DNA, 16 bp, H. sapiens
gaacattttcatcatc

SEQ ID NO: 97953 - DNA, 16 bp, H. sapiens
gaacattttgaaaaaa

SEQ ID NO: 97954 - DNA, 16 bp, H. sapiens
gaacattttgaatatt

SEQ ID NO: 97955 - DNA, 16 bp, H. sapiens
gaacatttttccatgt

SEQ ID NO: 97956 - DNA, 16 bp, H. sapiens
gaacatttttgtacat

SEQ ID NO: 97957 - DNA, 16 bp, H. sapiens
gaaccaaaaatcagat

SEQ ID NO: 97958 - DNA, 16 bp, H. sapiens
gaaccaaataaaagcc

SEQ ID NO: 97959 - DNA, 16 bp, H. sapiens
gaaccaaatcaagaat

SEQ ID NO: 97960 - DNA, 16 bp, H. sapiens
gaaccaagaaataaag

SEQ ID NO: 97961 - DNA, 16 bp, H. sapiens
gaaccaagatttgaac

SEQ ID NO: 97962 - DNA, 16 bp, H. sapiens
gaaccaaggaggcaga

SEQ ID NO: 97963 - DNA, 16 bp, H. sapiens
gaaccaatgtatttct

SEQ ID NO: 97964 - DNA, 16 bp, H. sapiens
gaaccaattccttgaa

SEQ ID NO: 97965 - DNA, 16 bp, H. sapiens
gaaccaatttacactc

SEQ ID NO: 97966 - DNA, 16 bp, H. sapiens
gaaccacaggcacaca

SEQ ID NO: 97967 - DNA, 16 bp, H. sapiens
gaaccacccttgcatc

SEQ ID NO: 97968 - DNA, 16 bp, H. sapiens
gaaccagaaactctgg

SEQ ID NO: 97969 - DNA, 16 bp, H. sapiens
gaaccagaaagaaatt

SEQ ID NO: 97970 - DNA, 16 bp, H. sapiens
gaaccagaaagtgggc

SEQ ID NO: 97971 - DNA, 16 bp, H. sapiens
gaaccagactccgtct

SEQ ID NO: 97972 - DNA, 16 bp, H. sapiens
gaaccagagcccacac

SEQ ID NO: 97973 - DNA, 16 bp, H. sapiens
gaaccagccctgccca

SEQ ID NO: 97974 - DNA, 16 bp, H. sapiens
gaaccagcttctgctt

SEQ ID NO: 97975 - DNA, 16 bp, H. sapiens
gaaccaggaaagccag

SEQ ID NO: 97976 - DNA, 16 bp, H. sapiens
gaaccaggaggcagag

SEQ ID NO: 97977 - DNA, 16 bp, H. sapiens
gaaccagggaagcaga

SEQ ID NO: 97978 - DNA, 16 bp, H. sapiens
gaaccagggaggagga

SEQ ID NO: 97979 - DNA, 16 bp, H. sapiens
gaaccagggaggtaga

SEQ ID NO: 97980 - DNA, 16 bp, H. sapiens
gaaccagtgcaagaac

SEQ ID NO: 97981 - DNA, 19 bp, H. sapiens
gaacccaacttacaaggga

SEQ ID NO: 97982 - DNA, 16 bp, H. sapiens
gaacccaagaggcgga

SEQ ID NO: 97983 - DNA, 16 bp, H. sapiens
gaacccaagaggtcaa

SEQ ID NO: 97984 - DNA, 16 bp, H. sapiens
gaacccagaaacaaat

SEQ ID NO: 97985 - DNA, 16 bp, H. sapiens
gaacccagcaaggcct

SEQ ID NO: 97986 - DNA, 16 bp, H. sapiens
gaacccaggagaaaga

SEQ ID NO: 97987 - DNA, 16 bp, H. sapiens
gaacccaggagacagg

SEQ ID NO: 97988 - DNA, 16 bp, H. sapiens
gaacccaggagtttca

SEQ ID NO: 97989 - DNA, 16 bp, H. sapiens
gaacccctggcagctg

SEQ ID NO: 97990 - DNA, 16 bp, H. sapiens
gaacccctgggcttaa

SEQ ID NO: 97991 - DNA, 16 bp, H. sapiens
gaacccctgggttcaa

SEQ ID NO: 97992 - DNA, 16 bp, H. sapiens
gaacccgagaggcaga

SEQ ID NO: 97993 - DNA, 16 bp, H. sapiens
gaacccgggaaatgga

SEQ ID NO: 97994 - DNA, 16 bp, H. sapiens
gaacccgggagccaga

SEQ ID NO: 97995 - DNA, 16 bp, H. sapiens
gaacccgggagcggag

SEQ ID NO: 97996 - DNA, 16 bp, H. sapiens
gaacccgggaggggag

SEQ ID NO: 97997 - DNA, 16 bp, H. sapiens
gaacccggggagcaga

SEQ ID NO: 97998 - DNA, 16 bp, H. sapiens
gaaccctccaccccaa

SEQ ID NO: 97999 - DNA, 16 bp, H. sapiens
gaaccggccttgcatc

SEQ ID NO: 98000 - DNA, 16 bp, H. sapiens
gaacctaaaatagaag

SEQ ID NO: 98001 - DNA, 16 bp, H. sapiens
gaacctcagcttcctt

SEQ ID NO: 98002 - DNA, 16 bp, H. sapiens
gaacctcagtttcccc

SEQ ID NO: 98003 - DNA, 16 bp, H. sapiens
gaacctccgcctcccg

SEQ ID NO: 98004 - DNA, 16 bp, H. sapiens
gaacctctgacctcag

SEQ ID NO: 98005 - DNA, 16 bp, H. sapiens
gaacctctttcttttg

SEQ ID NO: 98006 - DNA, 16 bp, H. sapiens
gaacctgaaataaaag

SEQ ID NO: 98007 - DNA, 16 bp, H. sapiens
gaacctgagaagcaga

SEQ ID NO: 98008 - DNA, 16 bp, H. sapiens
gaacctgagactcaga

SEQ ID NO: 98009 - DNA, 16 bp, H. sapiens
gaacctgaggctcaga

SEQ ID NO: 98010 - DNA, 16 bp, H. sapiens
gaacctgagggaaact

SEQ ID NO: 98011 - DNA, 16 bp, H. sapiens
gaacctgccagatgga

SEQ ID NO: 98012 - DNA, 16 bp, H. sapiens
gaacctgctggcacct

SEQ ID NO: 98013 - DNA, 16 bp, H. sapiens
gaacctggacaccctc

SEQ ID NO: 98014 - DNA, 16 bp, H. sapiens
gaacctggagggcgga

SEQ ID NO: 98015 - DNA, 16 bp, H. sapiens
gaacctgggaatcaga

SEQ ID NO: 98016 - DNA, 16 bp, H. sapiens
gaacctgggagacaaa

SEQ ID NO: 98017 - DNA, 16 bp, H. sapiens
gaacctgggagatgga

SEQ ID NO: 98018 - DNA, 16 bp, H. sapiens
gaacctgggaggccaa

SEQ ID NO: 98019 - DNA, 21 bp, H. sapiens
gaacctgggaggcggagctta

SEQ ID NO: 98020 - DNA, 16 bp, H. sapiens
gaacctgggaggcggg

SEQ ID NO: 98021 - DNA, 16 bp, H. sapiens
gaacctgggagttcaa

SEQ ID NO: 98022 - DNA, 16 bp, H. sapiens
gaacctggggaggtgg

SEQ ID NO: 98023 - DNA, 16 bp, H. sapiens
gaacctgtaaatatgt

SEQ ID NO: 98024 - DNA, 16 bp, H. sapiens
gaacctgtgaatgtta

SEQ ID NO: 98025 - DNA, 16 bp, H. sapiens
gaacctgtgttttgat

SEQ ID NO: 98026 - DNA, 16 bp, H. sapiens
gaaccttcagcttttt

SEQ ID NO: 98027 - DNA, 16 bp, H. sapiens
gaaccttggagacaga

SEQ ID NO: 98028 - DNA, 16 bp, H. sapiens
gaacgagactccgtct

SEQ ID NO: 98029 - DNA, 16 bp, H. sapiens
gaacgcgggaggcaga

SEQ ID NO: 98030 - DNA, 16 bp, H. sapiens
gaacgttgaatattgg

SEQ ID NO: 98031 - DNA, 16 bp, H. sapiens
gaactaaaaaagcaag

SEQ ID NO: 98032 - DNA, 16 bp, H. sapiens
gaactaaaggagatag

SEQ ID NO: 98033 - DNA, 16 bp, H. sapiens
gaactaatttttttaa

SEQ ID NO: 98034 - DNA, 16 bp, H. sapiens
gaactacaaaccattg

SEQ ID NO: 98035 - DNA, 16 bp, H. sapiens
gaactacaggtgcata

SEQ ID NO: 98036 - DNA, 16 bp, H. sapiens
gaactacatttcccag

SEQ ID NO: 98037 - DNA, 16 bp, H. sapiens
gaactaccacatgatc

SEQ ID NO: 98038 - DNA, 16 bp, H. sapiens
gaactaccatctgacc

SEQ ID NO: 98039 - DNA, 16 bp, H. sapiens
gaactactgcaggaat

SEQ ID NO: 98040 - DNA, 16 bp, H. sapiens
gaactagaaaaagaag

SEQ ID NO: 98041 - DNA, 16 bp, H. sapiens
gaactagaaaagcaaa

SEQ ID NO: 98042 - DNA, 16 bp, H. sapiens
gaactagaaaatcaag

SEQ ID NO: 98043 - DNA, 16 bp, H. sapiens
gaactagactgccttt

SEQ ID NO: 98044 - DNA, 16 bp, H. sapiens
gaactagatagtggtg

SEQ ID NO: 98045 - DNA, 16 bp, H. sapiens
gaactaggaagaaatt

SEQ ID NO: 98046 - DNA, 16 bp, H. sapiens
gaactatgatcacact

SEQ ID NO: 98047 - DNA, 18 bp, H. sapiens
gaactcaaacaaatttag

SEQ ID NO: 98048 - DNA, 16 bp, H. sapiens
gaactcaaacaagtca

SEQ ID NO: 98049 - DNA, 16 bp, H. sapiens
gaactcaaatgatcct

SEQ ID NO: 98050 - DNA, 16 bp, H. sapiens
gaactcaacattggac

SEQ ID NO: 98051 - DNA, 16 bp, H. sapiens
gaactcaagaggcaga

SEQ ID NO: 98052 - DNA, 16 bp, H. sapiens
gaactcactcactgtc

SEQ ID NO: 98053 - DNA, 16 bp, H. sapiens
gaactcactcattgtc

SEQ ID NO: 98054 - DNA, 16 bp, H. sapiens
gaactcagcccctttt

SEQ ID NO: 98055 - DNA, 16 bp, H. sapiens
gaactcagctctggaa

SEQ ID NO: 98056 - DNA, 16 bp, H. sapiens
gaactcaggaggagga

SEQ ID NO: 98057 - DNA, 16 bp, H. sapiens
gaactcaggattcaga

SEQ ID NO: 98058 - DNA, 16 bp, H. sapiens
gaactcaggcaatccg

SEQ ID NO: 98059 - DNA, 16 bp, H. sapiens
gaactcatacaactca

SEQ ID NO: 98060 - DNA, 16 bp, H. sapiens
gaactcatcattgttt

SEQ ID NO: 98061 - DNA, 16 bp, H. sapiens
gaactcatgaggcaga

SEQ ID NO: 98062 - DNA, 16 bp, H. sapiens
gaactcattcttcttt

SEQ ID NO: 98063 - DNA, 16 bp, H. sapiens
gaactcatttttgaca

SEQ ID NO: 98064 - DNA, 16 bp, H. sapiens
gaactccagaggcaga

SEQ ID NO: 98065 - DNA, 16 bp, H. sapiens
gaactccagcctgagc

SEQ ID NO: 98066 - DNA, 16 bp, H. sapiens
gaactccagcctggag

SEQ ID NO: 98067 - DNA, 16 bp, H. sapiens
gaactccagcctgggt

SEQ ID NO: 98068 - DNA, 16 bp, H. sapiens
gaactccaggctgggc

SEQ ID NO: 98069 - DNA, 16 bp, H. sapiens
gaactccaggttctct

SEQ ID NO: 98070 - DNA, 16 bp, H. sapiens
gaactcccaaactcag

SEQ ID NO: 98071 - DNA, 16 bp, H. sapiens
gaactcccaaccacag

SEQ ID NO: 98072 - DNA, 18 bp, H. sapiens
gaactcccaacctcaggt

SEQ ID NO: 98073 - DNA, 19 bp, H. sapiens
gaactcccgacctcaggtg

SEQ ID NO: 98074 - DNA, 16 bp, H. sapiens
gaactccctacctcag

SEQ ID NO: 98075 - DNA, 16 bp, H. sapiens
gaactcctaacctcag

SEQ ID NO: 98076 - DNA, 16 bp, H. sapiens
gaactcctactcatcc

SEQ ID NO: 98077 - DNA, 16 bp, H. sapiens
gaactcctagcctcaa

SEQ ID NO: 98078 - DNA, 16 bp, H. sapiens
gaactcctgaactcaa

SEQ ID NO: 98079 - DNA, 16 bp, H. sapiens
gaactcctgaccccag

SEQ ID NO: 98080 - DNA, 16 bp, H. sapiens
gaactcctgaccgcag

SEQ ID NO: 98081 - DNA, 18 bp, H. sapiens
gaactcctgacctcgtga

SEQ ID NO: 98082 - DNA, 16 bp, H. sapiens
gaactcctgacctctg

SEQ ID NO: 98083 - DNA, 16 bp, H. sapiens
gaactcctgaccttaa

SEQ ID NO: 98084 - DNA, 16 bp, H. sapiens
gaactcctgaccttag

SEQ ID NO: 98085 - DNA, 16 bp, H. sapiens
gaactcctgactgcaa

SEQ ID NO: 98086 - DNA, 16 bp, H. sapiens
gaactcctgagttcag

SEQ ID NO: 98087 - DNA, 17 bp, H. sapiens
gaactcctggactcaaa

SEQ ID NO: 98088 - DNA, 16 bp, H. sapiens
gaactcctggcctcac

SEQ ID NO: 98089 - DNA, 16 bp, H. sapiens
gaactcctggcttcaa

SEQ ID NO: 98090 - DNA, 16 bp, H. sapiens
gaactcctgggcccaa

SEQ ID NO: 98091 - DNA, 17 bp, H. sapiens
gaactcctgggctcagg

SEQ ID NO: 98092 - DNA, 16 bp, H. sapiens
gaactcctgggctcga

SEQ ID NO: 98093 - DNA, 16 bp, H. sapiens
gaactcctggtcccaa

SEQ ID NO: 98094 - DNA, 16 bp, H. sapiens
gaactcctgtcctcaa

SEQ ID NO: 98095 - DNA, 16 bp, H. sapiens
gaactccttttttttt

SEQ ID NO: 98096 - DNA, 16 bp, H. sapiens
gaactcgagaggcaga

SEQ ID NO: 98097 - DNA, 16 bp, H. sapiens
gaactcggaaggtgga

SEQ ID NO: 98098 - DNA, 16 bp, H. sapiens
gaactctccatactgt

SEQ ID NO: 98099 - DNA, 16 bp, H. sapiens
gaactctgacctcagg

SEQ ID NO: 98100 - DNA, 16 bp, H. sapiens
gaactctgggggaaaa

SEQ ID NO: 98101 - DNA, 16 bp, H. sapiens
gaactctgtattttct

SEQ ID NO: 98102 - DNA, 16 bp, H. sapiens
gaactcttagaagaaa

SEQ ID NO: 98103 - DNA, 16 bp, H. sapiens
gaactcttgggctcaa

SEQ ID NO: 98104 - DNA, 16 bp, H. sapiens
gaactctttttctttt

SEQ ID NO: 98105 - DNA, 16 bp, H. sapiens
gaactgaaacatcagc

SEQ ID NO: 98106 - DNA, 16 bp, H. sapiens
gaactgaaattttaat

SEQ ID NO: 98107 - DNA, 16 bp, H. sapiens
gaactgaacaataata

SEQ ID NO: 98108 - DNA, 16 bp, H. sapiens
gaactgaagagagaaa

SEQ ID NO: 98109 - DNA, 16 bp, H. sapiens
gaactgaaggaaatac

SEQ ID NO: 98110 - DNA, 16 bp, H. sapiens
gaactgaattaaaatg

SEQ ID NO: 98111 - DNA, 16 bp, H. sapiens
gaactgaattccttcc

SEQ ID NO: 98112 - DNA, 16 bp, H. sapiens
gaactgagattgtgcc

SEQ ID NO: 98113 - DNA, 16 bp, H. sapiens
gaactgaggaggtgga

SEQ ID NO: 98114 - DNA, 16 bp, H. sapiens
gaactgataaattcag

SEQ ID NO: 98115 - DNA, 16 bp, H. sapiens
gaactgataagcaaat

SEQ ID NO: 98116 - DNA, 16 bp, H. sapiens
gaactgcccgccttgg

SEQ ID NO: 98117 - DNA, 16 bp, H. sapiens
gaactgcctgctggcc

SEQ ID NO: 98118 - DNA, 16 bp, H. sapiens
gaactgctgacctcaa

SEQ ID NO: 98119 - DNA, 16 bp, H. sapiens
gaactgctgacctcag

SEQ ID NO: 98120 - DNA, 16 bp, H. sapiens
gaactgctggaaccca

SEQ ID NO: 98121 - DNA, 16 bp, H. sapiens
gaactgctggatcaaa

SEQ ID NO: 98122 - DNA, 16 bp, H. sapiens
gaactgcttgaatctg

SEQ ID NO: 98123 - DNA, 16 bp, H. sapiens
gaactggaaatcatta

SEQ ID NO: 98124 - DNA, 16 bp, H. sapiens
gaactggaacaagaaa

SEQ ID NO: 98125 - DNA, 16 bp, H. sapiens
gaactggaataaaggt

SEQ ID NO: 98126 - DNA, 16 bp, H. sapiens
gaactggaattagaag

SEQ ID NO: 98127 - DNA, 16 bp, H. sapiens
gaactggagaagcaag

SEQ ID NO: 98128 - DNA, 16 bp, H. sapiens
gaactggagattatta

SEQ ID NO: 98129 - DNA, 18 bp, H. sapiens
gaactggcaggcagctcc

SEQ ID NO: 98130 - DNA, 16 bp, H. sapiens
gaactgggctcactgc

SEQ ID NO: 98131 - DNA, 16 bp, H. sapiens
gaactggggaggcaga

SEQ ID NO: 98132 - DNA, 16 bp, H. sapiens
gaactgtaagataaat

SEQ ID NO: 98133 - DNA, 16 bp, H. sapiens
gaactgtcttccaaag

SEQ ID NO: 98134 - DNA, 17 bp, H. sapiens
gaactgtgagtcaatta

SEQ ID NO: 98135 - DNA, 16 bp, H. sapiens
gaactgtgggacaata

SEQ ID NO: 98136 - DNA, 16 bp, H. sapiens
gaactgtttatttctg

SEQ ID NO: 98137 - DNA, 16 bp, H. sapiens
gaactgttttatatca

SEQ ID NO: 98138 - DNA, 16 bp, H. sapiens
gaacttaaaacaaatt

SEQ ID NO: 98139 - DNA, 16 bp, H. sapiens
gaacttaaaataaaag

SEQ ID NO: 98140 - DNA, 16 bp, H. sapiens
gaacttaaagtaaaaa

SEQ ID NO: 98141 - DNA, 16 bp, H. sapiens
gaacttaaagtgaaat

SEQ ID NO: 98142 - DNA, 16 bp, H. sapiens
gaacttacaatcatgg

SEQ ID NO: 98143 - DNA, 16 bp, H. sapiens
gaacttacacaaattt

SEQ ID NO: 98144 - DNA, 16 bp, H. sapiens
gaacttacagtaaaat

SEQ ID NO: 98145 - DNA, 16 bp, H. sapiens
gaacttattcctccta

SEQ ID NO: 98146 - DNA, 16 bp, H. sapiens
gaacttattgggaact

SEQ ID NO: 98147 - DNA, 16 bp, H. sapiens
gaacttattttttcta

SEQ ID NO: 98148 - DNA, 16 bp, H. sapiens
gaacttcaaaatgcct

SEQ ID NO: 98149 - DNA, 16 bp, H. sapiens
gaacttcaaagtagtt

SEQ ID NO: 98150 - DNA, 16 bp, H. sapiens
gaacttcagagaacaa

SEQ ID NO: 98151 - DNA, 16 bp, H. sapiens
gaacttcatgaaacat

SEQ ID NO: 98152 - DNA, 16 bp, H. sapiens
gaacttcatgatgcat

SEQ ID NO: 98153 - DNA, 16 bp, H. sapiens
gaacttccaaaactat

SEQ ID NO: 98154 - DNA, 16 bp, H. sapiens
gaacttctaacactat

SEQ ID NO: 98155 - DNA, 16 bp, H. sapiens
gaacttctaatactat

SEQ ID NO: 98156 - DNA, 16 bp, H. sapiens
gaacttctgacctctg

SEQ ID NO: 98157 - DNA, 16 bp, H. sapiens
gaacttctgagctcaa

SEQ ID NO: 98158 - DNA, 16 bp, H. sapiens
gaacttctggcctcaa

SEQ ID NO: 98159 - DNA, 16 bp, H. sapiens
gaacttctggctcaag

SEQ ID NO: 98160 - DNA, 16 bp, H. sapiens
gaacttgaaataaaag

SEQ ID NO: 98161 - DNA, 16 bp, H. sapiens
gaacttgagagagatt

SEQ ID NO: 98162 - DNA, 16 bp, H. sapiens
gaacttgctggaaatg

SEQ ID NO: 98163 - DNA, 16 bp, H. sapiens
gaacttgggcaagtca

SEQ ID NO: 98164 - DNA, 16 bp, H. sapiens
gaacttgttaaaaatg

SEQ ID NO: 98165 - DNA, 16 bp, H. sapiens
gaacttgttattggta

SEQ ID NO: 98166 - DNA, 16 bp, H. sapiens
gaactttctcatcttg

SEQ ID NO: 98167 - DNA, 16 bp, H. sapiens
gaactttgaaaacatg

SEQ ID NO: 98168 - DNA, 16 bp, H. sapiens
gaactttttaaaagaa

SEQ ID NO: 98169 - DNA, 16 bp, H. sapiens
gaagaaaaaaaggttt

SEQ ID NO: 98170 - DNA, 16 bp, H. sapiens
gaagaaaaaatattct

SEQ ID NO: 98171 - DNA, 16 bp, H. sapiens
gaagaaaaacaaaggt

SEQ ID NO: 98172 - DNA, 16 bp, H. sapiens
gaagaaaaagaatttt

SEQ ID NO: 98173 - DNA, 16 bp, H. sapiens
gaagaaaaagatattt

SEQ ID NO: 98174 - DNA, 16 bp, H. sapiens
gaagaaaaagcatttg

SEQ ID NO: 98175 - DNA, 16 bp, H. sapiens
gaagaaaaaggtttaa

SEQ ID NO: 98176 - DNA, 16 bp, H. sapiens
gaagaaaaatctcaaa

SEQ ID NO: 98177 - DNA, 16 bp, H. sapiens
gaagaaaaatgttcat

SEQ ID NO: 98178 - DNA, 16 bp, H. sapiens
gaagaaaaattacatg

SEQ ID NO: 98179 - DNA, 16 bp, H. sapiens
gaagaaaacagctttc

SEQ ID NO: 98180 - DNA, 16 bp, H. sapiens
gaagaaaacataggtg

SEQ ID NO: 98181 - DNA, 16 bp, H. sapiens
gaagaaaacttcctca

SEQ ID NO: 98182 - DNA, 16 bp, H. sapiens
gaagaaaacttggaag

SEQ ID NO: 98183 - DNA, 16 bp, H. sapiens
gaagaaaagaaatcat

SEQ ID NO: 98184 - DNA, 16 bp, H. sapiens
gaagaaaagacagctg

SEQ ID NO: 98185 - DNA, 16 bp, H. sapiens
gaagaaaagaggtttc

SEQ ID NO: 98186 - DNA, 16 bp, H. sapiens
gaagaaaagatttgaa

SEQ ID NO: 98187 - DNA, 16 bp, H. sapiens
gaagaaaagcttgaag

SEQ ID NO: 98188 - DNA, 16 bp, H. sapiens
gaagaaaagtattttt

SEQ ID NO: 98189 - DNA, 16 bp, H. sapiens
gaagaaaataaatgac

SEQ ID NO: 98190 - DNA, 16 bp, H. sapiens
gaagaaaatattcaaa

SEQ ID NO: 98191 - DNA, 16 bp, H. sapiens
gaagaaaatattgcaa

SEQ ID NO: 98192 - DNA, 16 bp, H. sapiens
gaagaaaatattggca

SEQ ID NO: 98193 - DNA, 16 bp, H. sapiens
gaagaaaatctaaaat

SEQ ID NO: 98194 - DNA, 36 bp, H. sapiens
gaagaaaatgtggcacatatacaccatggaatacta

SEQ ID NO: 98195 - DNA, 16 bp, H. sapiens
gaagaaaatgttttca

SEQ ID NO: 98196 - DNA, 16 bp, H. sapiens
gaagaaaattatttta

SEQ ID NO: 98197 - DNA, 16 bp, H. sapiens
gaagaaaattattttt

SEQ ID NO: 98198 - DNA, 16 bp, H. sapiens
gaagaaaattctgaaa

SEQ ID NO: 98199 - DNA, 16 bp, H. sapiens
gaagaaacacctgaga

SEQ ID NO: 98200 - DNA, 16 bp, H. sapiens
gaagaaacagaaaatg

SEQ ID NO: 98201 - DNA, 16 bp, H. sapiens
gaagaaacagaaactc

SEQ ID NO: 98202 - DNA, 16 bp, H. sapiens
gaagaaacagaaagcc

SEQ ID NO: 98203 - DNA, 16 bp, H. sapiens
gaagaaacagacccaa

SEQ ID NO: 98204 - DNA, 16 bp, H. sapiens
gaagaaaccaaacctg

SEQ ID NO: 98205 - DNA, 16 bp, H. sapiens
gaagaaactgaggctt

SEQ ID NO: 98206 - DNA, 16 bp, H. sapiens
gaagaaactgcatgaa

SEQ ID NO: 98207 - DNA, 16 bp, H. sapiens
gaagaaactgcattaa

SEQ ID NO: 98208 - DNA, 16 bp, H. sapiens
gaagaaactggacaca

SEQ ID NO: 98209 - DNA, 16 bp, H. sapiens
gaagaaactgtatcaa

SEQ ID NO: 98210 - DNA, 16 bp, H. sapiens
gaagaaagaatggttt

SEQ ID NO: 98211 - DNA, 16 bp, H. sapiens
gaagaaagccatgtga

SEQ ID NO: 98212 - DNA, 16 bp, H. sapiens
gaagaaaggatatcag

SEQ ID NO: 98213 - DNA, 16 bp, H. sapiens
gaagaaagggaatcag

SEQ ID NO: 98214 - DNA, 16 bp, H. sapiens
gaagaaagggtgtcag

SEQ ID NO: 98215 - DNA, 16 bp, H. sapiens
gaagaaagtatatttt

SEQ ID NO: 98216 - DNA, 16 bp, H. sapiens
gaagaaagtatttcaa

SEQ ID NO: 98217 - DNA, 16 bp, H. sapiens
gaagaaagtccttggt

SEQ ID NO: 98218 - DNA, 16 bp, H. sapiens
gaagaaataaaacagt

SEQ ID NO: 98219 - DNA, 16 bp, H. sapiens
gaagaaataaagagca

SEQ ID NO: 98220 - DNA, 16 bp, H. sapiens
gaagaaataatttcaa

SEQ ID NO: 98221 - DNA, 16 bp, H. sapiens
gaagaaatacatatat

SEQ ID NO: 98222 - DNA, 16 bp, H. sapiens
gaagaaatacctgagg

SEQ ID NO: 98223 - DNA, 16 bp, H. sapiens
gaagaaatattttcat

SEQ ID NO: 98224 - DNA, 16 bp, H. sapiens
gaagaaatcaatgaaa

SEQ ID NO: 98225 - DNA, 16 bp, H. sapiens
gaagaaatcacaagga

SEQ ID NO: 98226 - DNA, 18 bp, H. sapiens
gaagaaatgactgtggtg

SEQ ID NO: 98227 - DNA, 16 bp, H. sapiens
gaagaaatgatggaat

SEQ ID NO: 98228 - DNA, 16 bp, H. sapiens
gaagaaatgctcaaca

SEQ ID NO: 98229 - DNA, 16 bp, H. sapiens
gaagaaatgctgaaaa

SEQ ID NO: 98230 - DNA, 16 bp, H. sapiens
gaagaaatgcttcagg

SEQ ID NO: 98231 - DNA, 16 bp, H. sapiens
gaagaaatggaccaat

SEQ ID NO: 98232 - DNA, 16 bp, H. sapiens
gaagaaatggataaat

SEQ ID NO: 98233 - DNA, 16 bp, H. sapiens
gaagaaatggataatt

SEQ ID NO: 98234 - DNA, 16 bp, H. sapiens
gaagaaatggcatcaa

SEQ ID NO: 98235 - DNA, 16 bp, H. sapiens
gaagaaatgtataaat

SEQ ID NO: 98236 - DNA, 16 bp, H. sapiens
gaagaaatgttttctt

SEQ ID NO: 98237 - DNA, 16 bp, H. sapiens
gaagaaattctgcctg

SEQ ID NO: 98238 - DNA, 16 bp, H. sapiens
gaagaaattgaggctt

SEQ ID NO: 98239 - DNA, 16 bp, H. sapiens
gaagaaatttatttta

SEQ ID NO: 98240 - DNA, 16 bp, H. sapiens
gaagaaatttctaaac

SEQ ID NO: 98241 - DNA, 16 bp, H. sapiens
gaagaaattttgaaat

SEQ ID NO: 98242 - DNA, 16 bp, H. sapiens
gaagaacaaaaaccat

SEQ ID NO: 98243 - DNA, 16 bp, H. sapiens
gaagaacaaagctgaa

SEQ ID NO: 98244 - DNA, 16 bp, H. sapiens
gaagaacaaatgaatg

SEQ ID NO: 98245 - DNA, 16 bp, H. sapiens
gaagaacagaaatgta

SEQ ID NO: 98246 - DNA, 16 bp, H. sapiens
gaagaacatgaaaaga

SEQ ID NO: 98247 - DNA, 16 bp, H. sapiens
gaagaacattccatga

SEQ ID NO: 98248 - DNA, 16 bp, H. sapiens
gaagaacccagtcctg

SEQ ID NO: 98249 - DNA, 16 bp, H. sapiens
gaagaacctgctcctg

SEQ ID NO: 98250 - DNA, 16 bp, H. sapiens
gaagaacttaaatgac

SEQ ID NO: 98251 - DNA, 16 bp, H. sapiens
gaagaagaaaaatctg

SEQ ID NO: 98252 - DNA, 16 bp, H. sapiens
gaagaagaaaacagct

SEQ ID NO: 98253 - DNA, 16 bp, H. sapiens
gaagaagaaaggggtc

SEQ ID NO: 98254 - DNA, 16 bp, H. sapiens
gaagaagaaattccac

SEQ ID NO: 98255 - DNA, 16 bp, H. sapiens
gaagaagaagaaacat

SEQ ID NO: 98256 - DNA, 16 bp, H. sapiens
gaagaagaagaaacta

SEQ ID NO: 98257 - DNA, 16 bp, H. sapiens
gaagaagaagaaatac

SEQ ID NO: 98258 - DNA, 16 bp, H. sapiens
gaagaagaagaagctg

SEQ ID NO: 98259 - DNA, 16 bp, H. sapiens
gaagaagaagaagttt

SEQ ID NO: 98260 - DNA, 16 bp, H. sapiens
gaagaagaagaatttg

SEQ ID NO: 98261 - DNA, 16 bp, H. sapiens
gaagaagaagaatttt

SEQ ID NO: 98262 - DNA, 16 bp, H. sapiens
gaagaagaattgtctt

SEQ ID NO: 98263 - DNA, 16 bp, H. sapiens
gaagaagaattttctt

SEQ ID NO: 98264 - DNA, 16 bp, H. sapiens
gaagaagacaaagatg

SEQ ID NO: 98265 - DNA, 16 bp, H. sapiens
gaagaagacagaaata

SEQ ID NO: 98266 - DNA, 16 bp, H. sapiens
gaagaagagaaatctg

SEQ ID NO: 98267 - DNA, 16 bp, H. sapiens
gaagaagagcataaaa

SEQ ID NO: 98268 - DNA, 16 bp, H. sapiens
gaagaagatattccat

SEQ ID NO: 98269 - DNA, 17 bp, H. sapiens
gaagaagatgaatctct

SEQ ID NO: 98270 - DNA, 16 bp, H. sapiens
gaagaagcacagacca

SEQ ID NO: 98271 - DNA, 16 bp, H. sapiens
gaagaagcagaagcag

SEQ ID NO: 98272 - DNA, 16 bp, H. sapiens
gaagaagcagcaggaa

SEQ ID NO: 98273 - DNA, 16 bp, H. sapiens
gaagaagcagctggac

SEQ ID NO: 98274 - DNA, 16 bp, H. sapiens
gaagaagctgaggctc

SEQ ID NO: 98275 - DNA, 16 bp, H. sapiens
gaagaagctgcagcaa

SEQ ID NO: 98276 - DNA, 16 bp, H. sapiens
gaagaagctttctgag

SEQ ID NO: 98277 - DNA, 16 bp, H. sapiens
gaagaagctttttaac

SEQ ID NO: 98278 - DNA, 16 bp, H. sapiens
gaagaaggaactgtca

SEQ ID NO: 98279 - DNA, 16 bp, H. sapiens
gaagaaggaattttca

SEQ ID NO: 98280 - DNA, 16 bp, H. sapiens
gaagaaggacttgttt

SEQ ID NO: 98281 - DNA, 16 bp, H. sapiens
gaagaaggttcctgct

SEQ ID NO: 98282 - DNA, 16 bp, H. sapiens
gaagaagtaaaactct

SEQ ID NO: 98283 - DNA, 16 bp, H. sapiens
gaagaagtaaaatttt

SEQ ID NO: 98284 - DNA, 16 bp, H. sapiens
gaagaagtcaaattgt

SEQ ID NO: 98285 - DNA, 16 bp, H. sapiens
gaagaagtccttcatg

SEQ ID NO: 98286 - DNA, 16 bp, H. sapiens
gaagaagttgcagaag

SEQ ID NO: 98287 - DNA, 16 bp, H. sapiens
gaagaatatgaacaga

SEQ ID NO: 98288 - DNA, 16 bp, H. sapiens
gaagaatatgccttgg

SEQ ID NO: 98289 - DNA, 16 bp, H. sapiens
gaagaatatttgaaaa

SEQ ID NO: 98290 - DNA, 16 bp, H. sapiens
gaagaatcaaataaat

SEQ ID NO: 98291 - DNA, 16 bp, H. sapiens
gaagaatcacctgagc

SEQ ID NO: 98292 - DNA, 16 bp, H. sapiens
gaagaatcactggaac

SEQ ID NO: 98293 - DNA, 16 bp, H. sapiens
gaagaatcacttgaaa

SEQ ID NO: 98294 - DNA, 16 bp, H. sapiens
gaagaatcagaaatca

SEQ ID NO: 98295 - DNA, 16 bp, H. sapiens
gaagaatcagatcaca

SEQ ID NO: 98296 - DNA, 16 bp, H. sapiens
gaagaatcatgggaaa

SEQ ID NO: 98297 - DNA, 16 bp, H. sapiens
gaagaatcggatcaca

SEQ ID NO: 98298 - DNA, 16 bp, H. sapiens
gaagaatctacttcca

SEQ ID NO: 98299 - DNA, 16 bp, H. sapiens
gaagaatctagacaga

SEQ ID NO: 98300 - DNA, 16 bp, H. sapiens
gaagaatgatgaggtt

SEQ ID NO: 98301 - DNA, 16 bp, H. sapiens
gaagaatggaaccaag

SEQ ID NO: 98302 - DNA, 16 bp, H. sapiens
gaagaatggcttgaac

SEQ ID NO: 98303 - DNA, 16 bp, H. sapiens
gaagaatgtggaagga

SEQ ID NO: 98304 - DNA, 16 bp, H. sapiens
gaagaatgtttattct

SEQ ID NO: 98305 - DNA, 16 bp, H. sapiens
gaagaattaaatagac

SEQ ID NO: 98306 - DNA, 16 bp, H. sapiens
gaagaattaatgttgt

SEQ ID NO: 98307 - DNA, 16 bp, H. sapiens
gaagaattgccacact

SEQ ID NO: 98308 - DNA, 16 bp, H. sapiens
gaagaattgcttgaag

SEQ ID NO: 98309 - DNA, 16 bp, H. sapiens
gaagaattgtcttggg

SEQ ID NO: 98310 - DNA, 16 bp, H. sapiens
gaagaatttaaattat

SEQ ID NO: 98311 - DNA, 16 bp, H. sapiens
gaagaatttattttaa

SEQ ID NO: 98312 - DNA, 16 bp, H. sapiens
gaagaatttgagaagg

SEQ ID NO: 98313 - DNA, 16 bp, H. sapiens
gaagaattttgaaaaa

SEQ ID NO: 98314 - DNA, 16 bp, H. sapiens
gaagacaaaggcagag

SEQ ID NO: 98315 - DNA, 16 bp, H. sapiens
gaagacaacaataaat

SEQ ID NO: 98316 - DNA, 25 bp, H. sapiens
gaagacaaccataaggtctgactgc

SEQ ID NO: 98317 - DNA, 16 bp, H. sapiens
gaagacaaggaggagc

SEQ ID NO: 98318 - DNA, 16 bp, H. sapiens
gaagacaatatttcca

SEQ ID NO: 98319 - DNA, 16 bp, H. sapiens
gaagacaatttttcca

SEQ ID NO: 98320 - DNA, 16 bp, H. sapiens
gaagacacacaaatgg

SEQ ID NO: 98321 - DNA, 16 bp, H. sapiens
gaagacacagagagga

SEQ ID NO: 98322 - DNA, 16 bp, H. sapiens
gaagacacagggagaa

SEQ ID NO: 98323 - DNA, 16 bp, H. sapiens
gaagacacctaccctg

SEQ ID NO: 98324 - DNA, 16 bp, H. sapiens
gaagacactggctttt

SEQ ID NO: 98325 - DNA, 16 bp, H. sapiens
gaagacagaagcagag

SEQ ID NO: 98326 - DNA, 16 bp, H. sapiens
gaagacagaggcaaag

SEQ ID NO: 98327 - DNA, 16 bp, H. sapiens
gaagacagaggcagaa

SEQ ID NO: 98328 - DNA, 16 bp, H. sapiens
gaagacagaggcagag

SEQ ID NO: 98329 - DNA, 16 bp, H. sapiens
gaagacagagtggcaa

SEQ ID NO: 98330 - DNA, 16 bp, H. sapiens
gaagacagccctcacc

SEQ ID NO: 98331 - DNA, 16 bp, H. sapiens
gaagacaggaaaatgc

SEQ ID NO: 98332 - DNA, 16 bp, H. sapiens
gaagacagggatgccc

SEQ ID NO: 98333 - DNA, 16 bp, H. sapiens
gaagacagtctggcag

SEQ ID NO: 98334 - DNA, 16 bp, H. sapiens
gaagacagtgacagat

SEQ ID NO: 98335 - DNA, 16 bp, H. sapiens
gaagacagtggaataa

SEQ ID NO: 98336 - DNA, 16 bp, H. sapiens
gaagacagtggggcaa

SEQ ID NO: 98337 - DNA, 16 bp, H. sapiens
gaagacagtgtggcta

SEQ ID NO: 98338 - DNA, 16 bp, H. sapiens
gaagacatacaagcag

SEQ ID NO: 98339 - DNA, 16 bp, H. sapiens
gaagacatagaaatga

SEQ ID NO: 98340 - DNA, 16 bp, H. sapiens
gaagacatataaatga

SEQ ID NO: 98341 - DNA, 16 bp, H. sapiens
gaagacatgaacagaa

SEQ ID NO: 98342 - DNA, 16 bp, H. sapiens
gaagacatgaagaaaa

SEQ ID NO: 98343 - DNA, 16 bp, H. sapiens
gaagacatgagacatc

SEQ ID NO: 98344 - DNA, 16 bp, H. sapiens
gaagacatgagagaga

SEQ ID NO: 98345 - DNA, 16 bp, H. sapiens
gaagacattatgttaa

SEQ ID NO: 98346 - DNA, 16 bp, H. sapiens
gaagacatttatgagg

SEQ ID NO: 98347 - DNA, 16 bp, H. sapiens
gaagacattttaaaaa

SEQ ID NO: 98348 - DNA, 16 bp, H. sapiens
gaagaccaagatggga

SEQ ID NO: 98349 - DNA, 16 bp, H. sapiens
gaagaccaaggtggga

SEQ ID NO: 98350 - DNA, 16 bp, H. sapiens
gaagaccatccccaag

SEQ ID NO: 98351 - DNA, 16 bp, H. sapiens
gaagacttcttggagg

SEQ ID NO: 98352 - DNA, 16 bp, H. sapiens
gaagacttttgcatct

SEQ ID NO: 98353 - DNA, 16 bp, H. sapiens
gaagagaaaaaatcca

SEQ ID NO: 98354 - DNA, 16 bp, H. sapiens
gaagagaaagaaatca

SEQ ID NO: 98355 - DNA, 16 bp, H. sapiens
gaagagaaaggactca

SEQ ID NO: 98356 - DNA, 16 bp, H. sapiens
gaagagaaatgaaaac

SEQ ID NO: 98357 - DNA, 16 bp, H. sapiens
gaagagaacaagagtc

SEQ ID NO: 98358 - DNA, 16 bp, H. sapiens
gaagagaacagaggcc

SEQ ID NO: 98359 - DNA, 16 bp, H. sapiens
gaagagaaccctcacc

SEQ ID NO: 98360 - DNA, 16 bp, H. sapiens
gaagagaagaatgtat

SEQ ID NO: 98361 - DNA, 16 bp, H. sapiens
gaagagaagataatct

SEQ ID NO: 98362 - DNA, 16 bp, H. sapiens
gaagagaatgaagtga

SEQ ID NO: 98363 - DNA, 16 bp, H. sapiens
gaagagacaaatctcc

SEQ ID NO: 98364 - DNA, 16 bp, H. sapiens
gaagagacaccagagc

SEQ ID NO: 98365 - DNA, 16 bp, H. sapiens
gaagagacagacagag

SEQ ID NO: 98366 - DNA, 16 bp, H. sapiens
gaagagacctggagcc

SEQ ID NO: 98367 - DNA, 16 bp, H. sapiens
gaagagacggagtttc

SEQ ID NO: 98368 - DNA, 16 bp, H. sapiens
gaagagactgtttttt

SEQ ID NO: 98369 - DNA, 16 bp, H. sapiens
gaagagagaaaaatct

SEQ ID NO: 98370 - DNA, 16 bp, H. sapiens
gaagagagaaaacaat

SEQ ID NO: 98371 - DNA, 16 bp, H. sapiens
gaagagagaaatagac

SEQ ID NO: 98372 - DNA, 16 bp, H. sapiens
gaagagagagaccctc

SEQ ID NO: 98373 - DNA, 16 bp, H. sapiens
gaagagaggaagccaa

SEQ ID NO: 98374 - DNA, 16 bp, H. sapiens
gaagagatagataaat

SEQ ID NO: 98375 - DNA, 16 bp, H. sapiens
gaagagattccaggag

SEQ ID NO: 98376 - DNA, 16 bp, H. sapiens
gaagagatttttttaa

SEQ ID NO: 98377 - DNA, 16 bp, H. sapiens
gaagagcaaccacaag

SEQ ID NO: 98378 - DNA, 16 bp, H. sapiens
gaagagcacactgaca

SEQ ID NO: 98379 - DNA, 16 bp, H. sapiens
gaagagcagagcagag

SEQ ID NO: 98380 - DNA, 16 bp, H. sapiens
gaagagcctttgggcc

SEQ ID NO: 98381 - DNA, 16 bp, H. sapiens
gaagagctctggctgg

SEQ ID NO: 98382 - DNA, 16 bp, H. sapiens
gaagagctgaaatgtt

SEQ ID NO: 98383 - DNA, 16 bp, H. sapiens
gaagagctgcagccct

SEQ ID NO: 98384 - DNA, 17 bp, H. sapiens
gaagagctgggcccgga

SEQ ID NO: 98385 - DNA, 16 bp, H. sapiens
gaagaggaaaatgaca

SEQ ID NO: 98386 - DNA, 16 bp, H. sapiens
gaagaggaaactgaga

SEQ ID NO: 98387 - DNA, 16 bp, H. sapiens
gaagaggaagaggcac

SEQ ID NO: 98388 - DNA, 16 bp, H. sapiens
gaagaggaagcaaggc

SEQ ID NO: 98389 - DNA, 16 bp, H. sapiens
gaagaggaagcaggca

SEQ ID NO: 98390 - DNA, 16 bp, H. sapiens
gaagaggacacaaata

SEQ ID NO: 98391 - DNA, 16 bp, H. sapiens
gaagaggaccctcacc

SEQ ID NO: 98392 - DNA, 16 bp, H. sapiens
gaagaggagactgagg

SEQ ID NO: 98393 - DNA, 16 bp, H. sapiens
gaagaggagattaaga

SEQ ID NO: 98394 - DNA, 16 bp, H. sapiens
gaagaggaggagccag

SEQ ID NO: 98395 - DNA, 16 bp, H. sapiens
gaagaggaggagctgg

SEQ ID NO: 98396 - DNA, 16 bp, H. sapiens
gaagaggcaaatccat

SEQ ID NO: 98397 - DNA, 16 bp, H. sapiens
gaagaggctgggcgtg

SEQ ID NO: 98398 - DNA, 16 bp, H. sapiens
gaagagggatagcatt

SEQ ID NO: 98399 - DNA, 16 bp, H. sapiens
gaagagggtgggggcc

SEQ ID NO: 98400 - DNA, 16 bp, H. sapiens
gaagagggtggttccc

SEQ ID NO: 98401 - DNA, 16 bp, H. sapiens
gaagaggtgccacaca

SEQ ID NO: 98402 - DNA, 16 bp, H. sapiens
gaagaggttacagtga

SEQ ID NO: 98403 - DNA, 16 bp, H. sapiens
gaagagtcaaagatga

SEQ ID NO: 98404 - DNA, 16 bp, H. sapiens
gaagagtgactgctaa

SEQ ID NO: 98405 - DNA, 18 bp, H. sapiens
gaagagtgttgtttttac

SEQ ID NO: 98406 - DNA, 16 bp, H. sapiens
gaagagtttagaaaga

SEQ ID NO: 98407 - DNA, 16 bp, H. sapiens
gaagagtttgtgaaga

SEQ ID NO: 98408 - DNA, 16 bp, H. sapiens
gaagagttttttctag

SEQ ID NO: 98409 - DNA, 16 bp, H. sapiens
gaagataaatatattt

SEQ ID NO: 98410 - DNA, 16 bp, H. sapiens
gaagataatttctttt

SEQ ID NO: 98411 - DNA, 16 bp, H. sapiens
gaagatacacagatgg

SEQ ID NO: 98412 - DNA, 16 bp, H. sapiens
gaagatataccaagca

SEQ ID NO: 98413 - DNA, 16 bp, H. sapiens
gaagatattccttttt

SEQ ID NO: 98414 - DNA, 16 bp, H. sapiens
gaagatatttttaaaa

SEQ ID NO: 98415 - DNA, 16 bp, H. sapiens
gaagatccagtttcat

SEQ ID NO: 98416 - DNA, 16 bp, H. sapiens
gaagatctaaataaac

SEQ ID NO: 98417 - DNA, 16 bp, H. sapiens
gaagatctacaaagca

SEQ ID NO: 98418 - DNA, 16 bp, H. sapiens
gaagatctagccaaga

SEQ ID NO: 98419 - DNA, 16 bp, H. sapiens
gaagatctgttaggag

SEQ ID NO: 98420 - DNA, 16 bp, H. sapiens
gaagatgaaaatgttc

SEQ ID NO: 98421 - DNA, 16 bp, H. sapiens
gaagatgaaaggcaca

SEQ ID NO: 98422 - DNA, 16 bp, H. sapiens
gaagatgaaatgaata

SEQ ID NO: 98423 - DNA, 16 bp, H. sapiens
gaagatgaatgaggag

SEQ ID NO: 98424 - DNA, 16 bp, H. sapiens
gaagatgacagaggaa

SEQ ID NO: 98425 - DNA, 16 bp, H. sapiens
gaagatgagctggaaa

SEQ ID NO: 98426 - DNA, 16 bp, H. sapiens
gaagatgaggaaactg

SEQ ID NO: 98427 - DNA, 16 bp, H. sapiens
gaagatgaggctgcag

SEQ ID NO: 98428 - DNA, 16 bp, H. sapiens
gaagatgatggtgatg

SEQ ID NO: 98429 - DNA, 16 bp, H. sapiens
gaagatgatgtgaaga

SEQ ID NO: 98430 - DNA, 16 bp, H. sapiens
gaagatgatttttttt

SEQ ID NO: 98431 - DNA, 16 bp, H. sapiens
gaagatgcagtgagcc

SEQ ID NO: 98432 - DNA, 16 bp, H. sapiens
gaagatgctggccttg

SEQ ID NO: 98433 - DNA, 16 bp, H. sapiens
gaagatgctgtgaaca

SEQ ID NO: 98434 - DNA, 16 bp, H. sapiens
gaagatgctttgtaaa

SEQ ID NO: 98435 - DNA, 16 bp, H. sapiens
gaagatgtgaagaaat

SEQ ID NO: 98436 - DNA, 16 bp, H. sapiens
gaagatgtggaaaagt

SEQ ID NO: 98437 - DNA, 16 bp, H. sapiens
gaagatgtttttattt

SEQ ID NO: 98438 - DNA, 16 bp, H. sapiens
gaagattaaaactaga

SEQ ID NO: 98439 - DNA, 16 bp, H. sapiens
gaagattaaaccagcc

SEQ ID NO: 98440 - DNA, 16 bp, H. sapiens
gaagattgaaactgta

SEQ ID NO: 98441 - DNA, 16 bp, H. sapiens
gaagattgaggctgca

SEQ ID NO: 98442 - DNA, 16 bp, H. sapiens
gaagatttcattttaa

SEQ ID NO: 98443 - DNA, 16 bp, H. sapiens
gaagatttgaaatgtt

SEQ ID NO: 98444 - DNA, 16 bp, H. sapiens
gaagattttatttctt

SEQ ID NO: 98445 - DNA, 16 bp, H. sapiens
gaagatttttcccttc

SEQ ID NO: 98446 - DNA, 16 bp, H. sapiens
gaagatttttcttttt

SEQ ID NO: 98447 - DNA, 16 bp, H. sapiens
gaagatttttgagaaa

SEQ ID NO: 98448 - DNA, 16 bp, H. sapiens
gaagcaaaaagtagaa

SEQ ID NO: 98449 - DNA, 16 bp, H. sapiens
gaagcaaaaatatttt

SEQ ID NO: 98450 - DNA, 16 bp, H. sapiens
gaagcaaacacgtctt

SEQ ID NO: 98451 - DNA, 16 bp, H. sapiens
gaagcaaacacttcct

SEQ ID NO: 98452 - DNA, 16 bp, H. sapiens
gaagcaaaggcaggaa

SEQ ID NO: 98453 - DNA, 16 bp, H. sapiens
gaagcaacccaaatgt

SEQ ID NO: 98454 - DNA, 16 bp, H. sapiens
gaagcaagaaattaaa

SEQ ID NO: 98455 - DNA, 16 bp, H. sapiens
gaagcaagaggattgc

SEQ ID NO: 98456 - DNA, 16 bp, H. sapiens
gaagcaagcaagcaag

SEQ ID NO: 98457 - DNA, 16 bp, H. sapiens
gaagcaagcaccttct

SEQ ID NO: 98458 - DNA, 16 bp, H. sapiens
gaagcaagcagatcac

SEQ ID NO: 98459 - DNA, 16 bp, H. sapiens
gaagcaagctgccatg

SEQ ID NO: 98460 - DNA, 16 bp, H. sapiens
gaagcaatagaaaact

SEQ ID NO: 98461 - DNA, 16 bp, H. sapiens
gaagcaatcaagatgt

SEQ ID NO: 98462 - DNA, 16 bp, H. sapiens
gaagcaatcctcccac

SEQ ID NO: 98463 - DNA, 16 bp, H. sapiens
gaagcaattcaaatgt

SEQ ID NO: 98464 - DNA, 17 bp, H. sapiens
gaagcaatttgccttca

SEQ ID NO: 98465 - DNA, 16 bp, H. sapiens
gaagcacagagaggct

SEQ ID NO: 98466 - DNA, 16 bp, H. sapiens
gaagcaccagggtcag

SEQ ID NO: 98467 - DNA, 16 bp, H. sapiens
gaagcacccagattca

SEQ ID NO: 98468 - DNA, 16 bp, H. sapiens
gaagcagaaccagtag

SEQ ID NO: 98469 - DNA, 16 bp, H. sapiens
gaagcagaagcagaag

SEQ ID NO: 98470 - DNA, 16 bp, H. sapiens
gaagcagaaggatcac

SEQ ID NO: 98471 - DNA, 16 bp, H. sapiens
gaagcagacttttcag

SEQ ID NO: 98472 - DNA, 16 bp, H. sapiens
gaagcagagaaaagtc

SEQ ID NO: 98473 - DNA, 16 bp, H. sapiens
gaagcagagaaaccag

SEQ ID NO: 98474 - DNA, 16 bp, H. sapiens
gaagcagagaataaaa

SEQ ID NO: 98475 - DNA, 16 bp, H. sapiens
gaagcagagagcagaa

SEQ ID NO: 98476 - DNA, 16 bp, H. sapiens
gaagcagagatgggag

SEQ ID NO: 98477 - DNA, 16 bp, H. sapiens
gaagcagagcataaga

SEQ ID NO: 98478 - DNA, 16 bp, H. sapiens
gaagcagaggctcaga

SEQ ID NO: 98479 - DNA, 16 bp, H. sapiens
gaagcagaggtcagag

SEQ ID NO: 98480 - DNA, 16 bp, H. sapiens
gaagcagaggttacag

SEQ ID NO: 98481 - DNA, 16 bp, H. sapiens
gaagcagaggtttcag

SEQ ID NO: 98482 - DNA, 16 bp, H. sapiens
gaagcagatgctgcca

SEQ ID NO: 98483 - DNA, 16 bp, H. sapiens
gaagcagatgctggtg

SEQ ID NO: 98484 - DNA, 16 bp, H. sapiens
gaagcagatgttcagg

SEQ ID NO: 98485 - DNA, 16 bp, H. sapiens
gaagcagcagagccag

SEQ ID NO: 98486 - DNA, 16 bp, H. sapiens
gaagcagcagcaggaa

SEQ ID NO: 98487 - DNA, 16 bp, H. sapiens
gaagcagcagcaggag

SEQ ID NO: 98488 - DNA, 16 bp, H. sapiens
gaagcagcagcccaag

SEQ ID NO: 98489 - DNA, 16 bp, H. sapiens
gaagcagccaagatgt

SEQ ID NO: 98490 - DNA, 16 bp, H. sapiens
gaagcagcctgaggtc

SEQ ID NO: 98491 - DNA, 16 bp, H. sapiens
gaagcagctggacatc

SEQ ID NO: 98492 - DNA, 16 bp, H. sapiens
gaagcagcttgaggcc

SEQ ID NO: 98493 - DNA, 16 bp, H. sapiens
gaagcaggaaaatcgc

SEQ ID NO: 98494 - DNA, 16 bp, H. sapiens
gaagcaggagcaagag

SEQ ID NO: 98495 - DNA, 16 bp, H. sapiens
gaagcaggaggagcag

SEQ ID NO: 98496 - DNA, 16 bp, H. sapiens
gaagcaggcagatcac

SEQ ID NO: 98497 - DNA, 16 bp, H. sapiens
gaagcaggcaggcctc

SEQ ID NO: 98498 - DNA, 16 bp, H. sapiens
gaagcaggctgagaaa

SEQ ID NO: 98499 - DNA, 16 bp, H. sapiens
gaagcagggacaggga

SEQ ID NO: 98500 - DNA, 16 bp, H. sapiens
gaagcagttacagaaa

SEQ ID NO: 98501 - DNA, 16 bp, H. sapiens
gaagcagtttctcaga

SEQ ID NO: 98502 - DNA, 16 bp, H. sapiens
gaagcatcaaatagac

SEQ ID NO: 98503 - DNA, 16 bp, H. sapiens
gaagcatgagaacaga

SEQ ID NO: 98504 - DNA, 17 bp, H. sapiens
gaagcatgtgatctctg

SEQ ID NO: 98505 - DNA, 16 bp, H. sapiens
gaagcattatttataa

SEQ ID NO: 98506 - DNA, 16 bp, H. sapiens
gaagcatttagcccat

SEQ ID NO: 98507 - DNA, 16 bp, H. sapiens
gaagcatttcagattt

SEQ ID NO: 98508 - DNA, 16 bp, H. sapiens
gaagcatttcttcaaa

SEQ ID NO: 98509 - DNA, 16 bp, H. sapiens
gaagcatttttttaaa

SEQ ID NO: 98510 - DNA, 16 bp, H. sapiens
gaagcatttttttttt

SEQ ID NO: 98511 - DNA, 16 bp, H. sapiens
gaagccaaagcaggag

SEQ ID NO: 98512 - DNA, 16 bp, H. sapiens
gaagccaaatacaaaa

SEQ ID NO: 98513 - DNA, 16 bp, H. sapiens
gaagccaacagacaca

SEQ ID NO: 98514 - DNA, 16 bp, H. sapiens
gaagccaacctgaaaa

SEQ ID NO: 98515 - DNA, 16 bp, H. sapiens
gaagccaagcagatac

SEQ ID NO: 98516 - DNA, 16 bp, H. sapiens
gaagccaagcagatgc

SEQ ID NO: 98517 - DNA, 16 bp, H. sapiens
gaagccaaggcaggag

SEQ ID NO: 98518 - DNA, 16 bp, H. sapiens
gaagccaaggcgggag

SEQ ID NO: 98519 - DNA, 16 bp, H. sapiens
gaagccaaggtgggca

SEQ ID NO: 98520 - DNA, 16 bp, H. sapiens
gaagccaatcagaaaa

SEQ ID NO: 98521 - DNA, 16 bp, H. sapiens
gaagccaatctgaaaa

SEQ ID NO: 98522 - DNA, 16 bp, H. sapiens
gaagccaatggcaaaa

SEQ ID NO: 98523 - DNA, 16 bp, H. sapiens
gaagccacagaccttc

SEQ ID NO: 98524 - DNA, 16 bp, H. sapiens
gaagccacagcccgag

SEQ ID NO: 98525 - DNA, 16 bp, H. sapiens
gaagccaccaagactt

SEQ ID NO: 98526 - DNA, 16 bp, H. sapiens
gaagccagaaataaag

SEQ ID NO: 98527 - DNA, 16 bp, H. sapiens
gaagccagaagagaag

SEQ ID NO: 98528 - DNA, 16 bp, H. sapiens
gaagccagacacagag

SEQ ID NO: 98529 - DNA, 16 bp, H. sapiens
gaagccagagagacca

SEQ ID NO: 98530 - DNA, 16 bp, H. sapiens
gaagccagagagagag

SEQ ID NO: 98531 - DNA, 16 bp, H. sapiens
gaagccagaggagagg

SEQ ID NO: 98532 - DNA, 16 bp, H. sapiens
gaagccagcaagacca

SEQ ID NO: 98533 - DNA, 16 bp, H. sapiens
gaagccagccaggctt

SEQ ID NO: 98534 - DNA, 16 bp, H. sapiens
gaagccagccaggttt

SEQ ID NO: 98535 - DNA, 16 bp, H. sapiens
gaagccagctgccatg

SEQ ID NO: 98536 - DNA, 16 bp, H. sapiens
gaagccaggggttcaa

SEQ ID NO: 98537 - DNA, 16 bp, H. sapiens
gaagccagtggtggat

SEQ ID NO: 98538 - DNA, 16 bp, H. sapiens
gaagccatcagcagtg

SEQ ID NO: 98539 - DNA, 16 bp, H. sapiens
gaagccatcatcctca

SEQ ID NO: 98540 - DNA, 16 bp, H. sapiens
gaagccatcatcttca

SEQ ID NO: 98541 - DNA, 16 bp, H. sapiens
gaagccatctggacct

SEQ ID NO: 98542 - DNA, 16 bp, H. sapiens
gaagccatgagtgact

SEQ ID NO: 98543 - DNA, 16 bp, H. sapiens
gaagccattattctca

SEQ ID NO: 98544 - DNA, 16 bp, H. sapiens
gaagccattcaacaag

SEQ ID NO: 98545 - DNA, 16 bp, H. sapiens
gaagccatttccataa

SEQ ID NO: 98546 - DNA, 16 bp, H. sapiens
gaagccattttttaaa

SEQ ID NO: 98547 - DNA, 16 bp, H. sapiens
gaagcccaaacctcac

SEQ ID NO: 98548 - DNA, 16 bp, H. sapiens
gaagcccaaggtcaag

SEQ ID NO: 98549 - DNA, 16 bp, H. sapiens
gaagcccaggaggaaa

SEQ ID NO: 98550 - DNA, 16 bp, H. sapiens
gaagccccctccccgc

SEQ ID NO: 98551 - DNA, 16 bp, H. sapiens
gaagccctaacaccca

SEQ ID NO: 98552 - DNA, 16 bp, H. sapiens
gaagccctctctcacc

SEQ ID NO: 98553 - DNA, 16 bp, H. sapiens
gaagccctttataaaa

SEQ ID NO: 98554 - DNA, 16 bp, H. sapiens
gaagccgagcagatgc

SEQ ID NO: 98555 - DNA, 23 bp, H. sapiens
gaagccgaggcgggtggatcacc

SEQ ID NO: 98556 - DNA, 16 bp, H. sapiens
gaagcctcaggaagct

SEQ ID NO: 98557 - DNA, 16 bp, H. sapiens
gaagcctcagggagct

SEQ ID NO: 98558 - DNA, 16 bp, H. sapiens
gaagcctccacctcct

SEQ ID NO: 98559 - DNA, 16 bp, H. sapiens
gaagcctcccctgact

SEQ ID NO: 98560 - DNA, 16 bp, H. sapiens
gaagcctctgcctccc

SEQ ID NO: 98561 - DNA, 16 bp, H. sapiens
gaagcctgagatcaag

SEQ ID NO: 98562 - DNA, 16 bp, H. sapiens
gaagcctgaggcagga

SEQ ID NO: 98563 - DNA, 16 bp, H. sapiens
gaagcctgggggccag

SEQ ID NO: 98564 - DNA, 16 bp, H. sapiens
gaagcctttttttttt

SEQ ID NO: 98565 - DNA, 16 bp, H. sapiens
gaagcggaagttgcag

SEQ ID NO: 98566 - DNA, 16 bp, H. sapiens
gaagcggaggttgtgg

SEQ ID NO: 98567 - DNA, 16 bp, H. sapiens
gaagctagaaaaagaa

SEQ ID NO: 98568 - DNA, 16 bp, H. sapiens
gaagctagaaaaggca

SEQ ID NO: 98569 - DNA, 16 bp, H. sapiens
gaagctagaagtctga

SEQ ID NO: 98570 - DNA, 16 bp, H. sapiens
gaagctagcagaagac

SEQ ID NO: 98571 - DNA, 16 bp, H. sapiens
gaagctagcagaagtt

SEQ ID NO: 98572 - DNA, 16 bp, H. sapiens
gaagctatatgagaaa

SEQ ID NO: 98573 - DNA, 16 bp, H. sapiens
gaagctatctgtgaaa

SEQ ID NO: 98574 - DNA, 16 bp, H. sapiens
gaagctcaagatcaag

SEQ ID NO: 98575 - DNA, 16 bp, H. sapiens
gaagctcagagaagct

SEQ ID NO: 98576 - DNA, 16 bp, H. sapiens
gaagctcagagaggct

SEQ ID NO: 98577 - DNA, 16 bp, H. sapiens
gaagctcagtgagata

SEQ ID NO: 98578 - DNA, 16 bp, H. sapiens
gaagctccacacccct

SEQ ID NO: 98579 - DNA, 16 bp, H. sapiens
gaagctccacgcccct

SEQ ID NO: 98580 - DNA, 16 bp, H. sapiens
gaagctctggccaggg

SEQ ID NO: 98581 - DNA, 16 bp, H. sapiens
gaagctcttctggaga

SEQ ID NO: 98582 - DNA, 16 bp, H. sapiens
gaagctgaaaaagcat

SEQ ID NO: 98583 - DNA, 16 bp, H. sapiens
gaagctgaaaaaggca

SEQ ID NO: 98584 - DNA, 16 bp, H. sapiens
gaagctgaagaaaaaa

SEQ ID NO: 98585 - DNA, 16 bp, H. sapiens
gaagctgaagaagaaa

SEQ ID NO: 98586 - DNA, 16 bp, H. sapiens
gaagctgaagagggag

SEQ ID NO: 98587 - DNA, 16 bp, H. sapiens
gaagctgaagcaggag

SEQ ID NO: 98588 - DNA, 16 bp, H. sapiens
gaagctgaaggaggag

SEQ ID NO: 98589 - DNA, 16 bp, H. sapiens
gaagctgacagtgcag

SEQ ID NO: 98590 - DNA, 16 bp, H. sapiens
gaagctgacgcaggag

SEQ ID NO: 98591 - DNA, 16 bp, H. sapiens
gaagctgagaaaggag

SEQ ID NO: 98592 - DNA, 16 bp, H. sapiens
gaagctgagacaggca

SEQ ID NO: 98593 - DNA, 16 bp, H. sapiens
gaagctgagattggag

SEQ ID NO: 98594 - DNA, 20 bp, H. sapiens
gaagctgaggcagaagaatt

SEQ ID NO: 98595 - DNA, 16 bp, H. sapiens
gaagctgaggcagaga

SEQ ID NO: 98596 - DNA, 16 bp, H. sapiens
gaagctgaggcaggaa

SEQ ID NO: 98597 - DNA, 16 bp, H. sapiens
gaagctgaggcaggag

SEQ ID NO: 98598 - DNA, 16 bp, H. sapiens
gaagctgaggcagggc

SEQ ID NO: 98599 - DNA, 16 bp, H. sapiens
gaagctgaggctcagg

SEQ ID NO: 98600 - DNA, 16 bp, H. sapiens
gaagctgaggctgaag

SEQ ID NO: 98601 - DNA, 16 bp, H. sapiens
gaagctgaggctgcag

SEQ ID NO: 98602 - DNA, 16 bp, H. sapiens
gaagctgaggctggtg

SEQ ID NO: 98603 - DNA, 16 bp, H. sapiens
gaagctgaggtgggag

SEQ ID NO: 98604 - DNA, 16 bp, H. sapiens
gaagctgaggtggtag

SEQ ID NO: 98605 - DNA, 16 bp, H. sapiens
gaagctgatgcaggag

SEQ ID NO: 98606 - DNA, 16 bp, H. sapiens
gaagctgcaaaagaaa

SEQ ID NO: 98607 - DNA, 16 bp, H. sapiens
gaagctgcagaacagc

SEQ ID NO: 98608 - DNA, 17 bp, H. sapiens
gaagctgcagaagaaag

SEQ ID NO: 98609 - DNA, 16 bp, H. sapiens
gaagctgcagaccttg

SEQ ID NO: 98610 - DNA, 16 bp, H. sapiens
gaagctgcagcgagcc

SEQ ID NO: 98611 - DNA, 16 bp, H. sapiens
gaagctgcaggagaaa

SEQ ID NO: 98612 - DNA, 16 bp, H. sapiens
gaagctgcagtgagcc

SEQ ID NO: 98613 - DNA, 16 bp, H. sapiens
gaagctgcagtgagct

SEQ ID NO: 98614 - DNA, 16 bp, H. sapiens
gaagctgcatccacag

SEQ ID NO: 98615 - DNA, 16 bp, H. sapiens
gaagctgccaaggctt

SEQ ID NO: 98616 - DNA, 16 bp, H. sapiens
gaagctgcggcaggag

SEQ ID NO: 98617 - DNA, 16 bp, H. sapiens
gaagctgctctgtatg

SEQ ID NO: 98618 - DNA, 16 bp, H. sapiens
gaagctgcttgtggtg

SEQ ID NO: 98619 - DNA, 16 bp, H. sapiens
gaagctggaaaccatt

SEQ ID NO: 98620 - DNA, 16 bp, H. sapiens
gaagctggaaagggca

SEQ ID NO: 98621 - DNA, 16 bp, H. sapiens
gaagctggaagaggca

SEQ ID NO: 98622 - DNA, 16 bp, H. sapiens
gaagctggaaggcaga

SEQ ID NO: 98623 - DNA, 16 bp, H. sapiens
gaagctggaagttcaa

SEQ ID NO: 98624 - DNA, 16 bp, H. sapiens
gaagctggaatgccca

SEQ ID NO: 98625 - DNA, 16 bp, H. sapiens
gaagctggagaaggca

SEQ ID NO: 98626 - DNA, 16 bp, H. sapiens
gaagctggagagagag

SEQ ID NO: 98627 - DNA, 16 bp, H. sapiens
gaagctggagaggatg

SEQ ID NO: 98628 - DNA, 16 bp, H. sapiens
gaagctggaggacatt

SEQ ID NO: 98629 - DNA, 16 bp, H. sapiens
gaagctgggagaggca

SEQ ID NO: 98630 - DNA, 16 bp, H. sapiens
gaagctgttccttctg

SEQ ID NO: 98631 - DNA, 16 bp, H. sapiens
gaagcttatctaacac

SEQ ID NO: 98632 - DNA, 16 bp, H. sapiens
gaagcttccaaaggaa

SEQ ID NO: 98633 - DNA, 16 bp, H. sapiens
gaagcttccagaggaa

SEQ ID NO: 98634 - DNA, 16 bp, H. sapiens
gaagcttccaggtagc

SEQ ID NO: 98635 - DNA, 16 bp, H. sapiens
gaagcttccataaaaa

SEQ ID NO: 98636 - DNA, 16 bp, H. sapiens
gaagcttcctgaggcc

SEQ ID NO: 98637 - DNA, 16 bp, H. sapiens
gaagcttcttgaggcc

SEQ ID NO: 98638 - DNA, 16 bp, H. sapiens
gaagcttgcaatcatg

SEQ ID NO: 98639 - DNA, 16 bp, H. sapiens
gaagctttattcataa

SEQ ID NO: 98640 - DNA, 16 bp, H. sapiens
gaagctttatttgtaa

SEQ ID NO: 98641 - DNA, 16 bp, H. sapiens
gaagctttttaatttt

SEQ ID NO: 98642 - DNA, 16 bp, H. sapiens
gaagctttttgatgtg

SEQ ID NO: 98643 - DNA, 16 bp, H. sapiens
gaaggaaaaaaatgtt

SEQ ID NO: 98644 - DNA, 16 bp, H. sapiens
gaaggaaaaactgtta

SEQ ID NO: 98645 - DNA, 16 bp, H. sapiens
gaaggaaaaatgttaa

SEQ ID NO: 98646 - DNA, 16 bp, H. sapiens
gaaggaaaactaagaa

SEQ ID NO: 98647 - DNA, 16 bp, H. sapiens
gaaggaaaccaaaata

SEQ ID NO: 98648 - DNA, 16 bp, H. sapiens
gaaggaaagaaatgtt

SEQ ID NO: 98649 - DNA, 16 bp, H. sapiens
gaaggaaagacacagt

SEQ ID NO: 98650 - DNA, 16 bp, H. sapiens
gaaggaaagatacagt

SEQ ID NO: 98651 - DNA, 16 bp, H. sapiens
gaaggaaagcaggtgt

SEQ ID NO: 98652 - DNA, 16 bp, H. sapiens
gaaggaaaggacccag

SEQ ID NO: 98653 - DNA, 16 bp, H. sapiens
gaaggaaatcaagaca

SEQ ID NO: 98654 - DNA, 16 bp, H. sapiens
gaaggaaatcctatca

SEQ ID NO: 98655 - DNA, 16 bp, H. sapiens
gaaggaaattctgaca

SEQ ID NO: 98656 - DNA, 16 bp, H. sapiens
gaaggaaattctgata

SEQ ID NO: 98657 - DNA, 16 bp, H. sapiens
gaaggaaattgagaca

SEQ ID NO: 98658 - DNA, 16 bp, H. sapiens
gaaggaaatttgggga

SEQ ID NO: 98659 - DNA, 16 bp, H. sapiens
gaaggaaattttaaaa

SEQ ID NO: 98660 - DNA, 16 bp, H. sapiens
gaaggaacaaattcca

SEQ ID NO: 98661 - DNA, 16 bp, H. sapiens
gaaggaactccccaaa

SEQ ID NO: 98662 - DNA, 16 bp, H. sapiens
gaaggaactgcagatg

SEQ ID NO: 98663 - DNA, 22 bp, H. sapiens
gaaggaactggcacttggagtc

SEQ ID NO: 98664 - DNA, 16 bp, H. sapiens
gaaggaacttgccttg

SEQ ID NO: 98665 - DNA, 16 bp, H. sapiens
gaaggaagaaactcag

SEQ ID NO: 98666 - DNA, 16 bp, H. sapiens
gaaggaagaaactgga

SEQ ID NO: 98667 - DNA, 16 bp, H. sapiens
gaaggaagagaagact

SEQ ID NO: 98668 - DNA, 16 bp, H. sapiens
gaaggaagcagtaaat

SEQ ID NO: 98669 - DNA, 16 bp, H. sapiens
gaaggaagcttccctg

SEQ ID NO: 98670 - DNA, 16 bp, H. sapiens
gaaggaaggaaatttt

SEQ ID NO: 98671 - DNA, 16 bp, H. sapiens
gaaggaaggaagattg

SEQ ID NO: 98672 - DNA, 16 bp, H. sapiens
gaaggaaggaggccag

SEQ ID NO: 98673 - DNA, 16 bp, H. sapiens
gaaggaaggcattgag

SEQ ID NO: 98674 - DNA, 16 bp, H. sapiens
gaaggaagtaactgca

SEQ ID NO: 98675 - DNA, 18 bp, H. sapiens
gaaggaagtcatccgccc

SEQ ID NO: 98676 - DNA, 16 bp, H. sapiens
gaaggaataaattcaa

SEQ ID NO: 98677 - DNA, 16 bp, H. sapiens
gaaggaatctcactct

SEQ ID NO: 98678 - DNA, 16 bp, H. sapiens
gaaggaatgaatgaag

SEQ ID NO: 98679 - DNA, 16 bp, H. sapiens
gaaggaattaatgaaa

SEQ ID NO: 98680 - DNA, 16 bp, H. sapiens
gaaggaattttttttt

SEQ ID NO: 98681 - DNA, 16 bp, H. sapiens
gaaggacaaatgctgc

SEQ ID NO: 98682 - DNA, 16 bp, H. sapiens
gaaggacacaaacctg

SEQ ID NO: 98683 - DNA, 16 bp, H. sapiens
gaaggacacagagaca

SEQ ID NO: 98684 - DNA, 16 bp, H. sapiens
gaaggacatgatctca

SEQ ID NO: 98685 - DNA, 16 bp, H. sapiens
gaaggacattgtgaaa

SEQ ID NO: 98686 - DNA, 16 bp, H. sapiens
gaaggacatttttgct

SEQ ID NO: 98687 - DNA, 16 bp, H. sapiens
gaaggaccaggtggag

SEQ ID NO: 98688 - DNA, 16 bp, H. sapiens
gaaggagaaatcaaat

SEQ ID NO: 98689 - DNA, 16 bp, H. sapiens
gaaggagaagcagaca

SEQ ID NO: 98690 - DNA, 16 bp, H. sapiens
gaaggagaagcagcag

SEQ ID NO: 98691 - DNA, 16 bp, H. sapiens
gaaggagaagcaggca

SEQ ID NO: 98692 - DNA, 16 bp, H. sapiens
gaaggagaattgctgg

SEQ ID NO: 98693 - DNA, 16 bp, H. sapiens
gaaggagagaagagct

SEQ ID NO: 98694 - DNA, 16 bp, H. sapiens
gaaggagagcataaaa

SEQ ID NO: 98695 - DNA, 16 bp, H. sapiens
gaaggagagtataatg

SEQ ID NO: 98696 - DNA, 16 bp, H. sapiens
gaaggagatgaacaga

SEQ ID NO: 98697 - DNA, 16 bp, H. sapiens
gaaggagctctctggg

SEQ ID NO: 98698 - DNA, 16 bp, H. sapiens
gaaggagctggtacca

SEQ ID NO: 98699 - DNA, 16 bp, H. sapiens
gaaggaggcagagaca

SEQ ID NO: 98700 - DNA, 16 bp, H. sapiens
gaaggaggctgaggtg

SEQ ID NO: 98701 - DNA, 16 bp, H. sapiens
gaaggaggctttgggt

SEQ ID NO: 98702 - DNA, 16 bp, H. sapiens
gaaggagtcagagagc

SEQ ID NO: 98703 - DNA, 16 bp, H. sapiens
gaaggagtccctcttt

SEQ ID NO: 98704 - DNA, 16 bp, H. sapiens
gaaggatccacttcca

SEQ ID NO: 98705 - DNA, 16 bp, H. sapiens
gaaggatgagcaggag

SEQ ID NO: 98706 - DNA, 16 bp, H. sapiens
gaaggatgatgggaag

SEQ ID NO: 98707 - DNA, 16 bp, H. sapiens
gaaggatgcaaagtat

SEQ ID NO: 98708 - DNA, 16 bp, H. sapiens
gaaggatggtggccct

SEQ ID NO: 98709 - DNA, 16 bp, H. sapiens
gaaggattctgagaaa

SEQ ID NO: 98710 - DNA, 16 bp, H. sapiens
gaaggattggtaccag

SEQ ID NO: 98711 - DNA, 16 bp, H. sapiens
gaaggcaaagagaggc

SEQ ID NO: 98712 - DNA, 16 bp, H. sapiens
gaaggcaaagctggag

SEQ ID NO: 98713 - DNA, 16 bp, H. sapiens
gaaggcaaggaggagc

SEQ ID NO: 98714 - DNA, 16 bp, H. sapiens
gaaggcaaggaggagt

SEQ ID NO: 98715 - DNA, 16 bp, H. sapiens
gaaggcaccagagaaa

SEQ ID NO: 98716 - DNA, 16 bp, H. sapiens
gaaggcagaaataaaa

SEQ ID NO: 98717 - DNA, 16 bp, H. sapiens
gaaggcagagaccatg

SEQ ID NO: 98718 - DNA, 16 bp, H. sapiens
gaaggcagagctcagg

SEQ ID NO: 98719 - DNA, 16 bp, H. sapiens
gaaggcagcatacgtc

SEQ ID NO: 98720 - DNA, 16 bp, H. sapiens
gaaggcagcatgctca

SEQ ID NO: 98721 - DNA, 16 bp, H. sapiens
gaaggcagctgtctgc

SEQ ID NO: 98722 - DNA, 16 bp, H. sapiens
gaaggcaggaggcaga

SEQ ID NO: 98723 - DNA, 16 bp, H. sapiens
gaaggcagggtggcag

SEQ ID NO: 98724 - DNA, 16 bp, H. sapiens
gaaggcagtcatctgc

SEQ ID NO: 98725 - DNA, 16 bp, H. sapiens
gaaggcagtggcatga

SEQ ID NO: 98726 - DNA, 16 bp, H. sapiens
gaaggcatccttgagg

SEQ ID NO: 98727 - DNA, 16 bp, H. sapiens
gaaggccaaaatcaag

SEQ ID NO: 98728 - DNA, 16 bp, H. sapiens
gaaggccaagatcaag

SEQ ID NO: 98729 - DNA, 16 bp, H. sapiens
gaaggccaagatgggc

SEQ ID NO: 98730 - DNA, 16 bp, H. sapiens
gaaggccaaggctgca

SEQ ID NO: 98731 - DNA, 16 bp, H. sapiens
gaaggccaaggggaag

SEQ ID NO: 98732 - DNA, 16 bp, H. sapiens
gaaggccaaggtgggc

SEQ ID NO: 98733 - DNA, 16 bp, H. sapiens
gaaggccaaggtgggt

SEQ ID NO: 98734 - DNA, 16 bp, H. sapiens
gaaggccaggagtttg

SEQ ID NO: 98735 - DNA, 20 bp, H. sapiens
gaaggccaggtgcagtggct

SEQ ID NO: 98736 - DNA, 16 bp, H. sapiens
gaaggccatgaagaga

SEQ ID NO: 98737 - DNA, 16 bp, H. sapiens
gaaggccatgtgaaaa

SEQ ID NO: 98738 - DNA, 16 bp, H. sapiens
gaaggccattatcctt

SEQ ID NO: 98739 - DNA, 16 bp, H. sapiens
gaaggccctggtggag

SEQ ID NO: 98740 - DNA, 16 bp, H. sapiens
gaaggcctcagaagca

SEQ ID NO: 98741 - DNA, 16 bp, H. sapiens
gaaggccttttctgaa

SEQ ID NO: 98742 - DNA, 16 bp, H. sapiens
gaaggctacagtgagc

SEQ ID NO: 98743 - DNA, 16 bp, H. sapiens
gaaggctatgaacaga

SEQ ID NO: 98744 - DNA, 16 bp, H. sapiens
gaaggctcaggggaca

SEQ ID NO: 98745 - DNA, 16 bp, H. sapiens
gaaggctcaggtgatc

SEQ ID NO: 98746 - DNA, 16 bp, H. sapiens
gaaggctctgcccctg

SEQ ID NO: 98747 - DNA, 16 bp, H. sapiens
gaaggctgaggaggag

SEQ ID NO: 98748 - DNA, 16 bp, H. sapiens
gaaggctgaggcagaa

SEQ ID NO: 98749 - DNA, 16 bp, H. sapiens
gaaggctgaggcaggc

SEQ ID NO: 98750 - DNA, 16 bp, H. sapiens
gaaggctgagtggagg

SEQ ID NO: 98751 - DNA, 16 bp, H. sapiens
gaaggctgccttccct

SEQ ID NO: 98752 - DNA, 16 bp, H. sapiens
gaaggctgggaggagg

SEQ ID NO: 98753 - DNA, 16 bp, H. sapiens
gaaggctgtttctgcc

SEQ ID NO: 98754 - DNA, 16 bp, H. sapiens
gaaggcttaggcagga

SEQ ID NO: 98755 - DNA, 16 bp, H. sapiens
gaaggcttccctgacc

SEQ ID NO: 98756 - DNA, 16 bp, H. sapiens
gaaggcttctctgaag

SEQ ID NO: 98757 - DNA, 16 bp, H. sapiens
gaaggctttcagtttt

SEQ ID NO: 98758 - DNA, 16 bp, H. sapiens
gaagggaaatttgggg

SEQ ID NO: 98759 - DNA, 16 bp, H. sapiens
gaagggaaggagccag

SEQ ID NO: 98760 - DNA, 16 bp, H. sapiens
gaagggagaggggctg

SEQ ID NO: 98761 - DNA, 16 bp, H. sapiens
gaagggagctgagctc

SEQ ID NO: 98762 - DNA, 16 bp, H. sapiens
gaagggaggcagtgag

SEQ ID NO: 98763 - DNA, 22 bp, H. sapiens
gaagggatcaattcaacaagaa

SEQ ID NO: 98764 - DNA, 16 bp, H. sapiens
gaagggcagagccagg

SEQ ID NO: 98765 - DNA, 16 bp, H. sapiens
gaagggcagggctggg

SEQ ID NO: 98766 - DNA, 16 bp, H. sapiens
gaagggcatcttggtt

SEQ ID NO: 98767 - DNA, 16 bp, H. sapiens
gaagggccaggtgcag

SEQ ID NO: 98768 - DNA, 16 bp, H. sapiens
gaagggctgaggtggg

SEQ ID NO: 98769 - DNA, 16 bp, H. sapiens
gaagggctgggtgtgg

SEQ ID NO: 98770 - DNA, 16 bp, H. sapiens
gaagggctgttgaatt

SEQ ID NO: 98771 - DNA, 16 bp, H. sapiens
gaaggggaacataaca

SEQ ID NO: 98772 - DNA, 16 bp, H. sapiens
gaaggggaagatcaca

SEQ ID NO: 98773 - DNA, 16 bp, H. sapiens
gaaggggaagcagcca

SEQ ID NO: 98774 - DNA, 16 bp, H. sapiens
gaaggggaaggtgcta

SEQ ID NO: 98775 - DNA, 17 bp, H. sapiens
gaaggggacccaagtgg

SEQ ID NO: 98776 - DNA, 16 bp, H. sapiens
gaaggggaccccagtg

SEQ ID NO: 98777 - DNA, 16 bp, H. sapiens
gaaggggcagctgtgg

SEQ ID NO: 98778 - DNA, 16 bp, H. sapiens
gaaggggcagggctcc

SEQ ID NO: 98779 - DNA, 16 bp, H. sapiens
gaaggggccaggtgtg

SEQ ID NO: 98780 - DNA, 16 bp, H. sapiens
gaaggggcggggctcc

SEQ ID NO: 98781 - DNA, 16 bp, H. sapiens
gaaggggctgggcatg

SEQ ID NO: 98782 - DNA, 24 bp, H. sapiens
gaaggggtggcctgcccctccaca

SEQ ID NO: 98783 - DNA, 16 bp, H. sapiens
gaaggggtttcctggg

SEQ ID NO: 98784 - DNA, 16 bp, H. sapiens
gaagggtccctggaga

SEQ ID NO: 98785 - DNA, 16 bp, H. sapiens
gaagggtgttccaggc

SEQ ID NO: 98786 - DNA, 16 bp, H. sapiens
gaaggtacttaatgcc

SEQ ID NO: 98787 - DNA, 16 bp, H. sapiens
gaaggtcaagaccagc

SEQ ID NO: 98788 - DNA, 16 bp, H. sapiens
gaaggtcctcaccaga

SEQ ID NO: 98789 - DNA, 16 bp, H. sapiens
gaaggtctttgcttcc

SEQ ID NO: 98790 - DNA, 16 bp, H. sapiens
gaaggtgaaaaaaatt

SEQ ID NO: 98791 - DNA, 16 bp, H. sapiens
gaaggtgaaaggcatg

SEQ ID NO: 98792 - DNA, 16 bp, H. sapiens
gaaggtgaagaggagc

SEQ ID NO: 98793 - DNA, 16 bp, H. sapiens
gaaggtgaagcaggag

SEQ ID NO: 98794 - DNA, 16 bp, H. sapiens
gaaggtgaagcgggag

SEQ ID NO: 98795 - DNA, 16 bp, H. sapiens
gaaggtgaaggggcag

SEQ ID NO: 98796 - DNA, 16 bp, H. sapiens
gaaggtgaatgagaag

SEQ ID NO: 98797 - DNA, 16 bp, H. sapiens
gaaggtgatgatgagg

SEQ ID NO: 98798 - DNA, 16 bp, H. sapiens
gaaggtgattgaatta

SEQ ID NO: 98799 - DNA, 16 bp, H. sapiens
gaaggtgccaagaaca

SEQ ID NO: 98800 - DNA, 16 bp, H. sapiens
gaaggtggaggtggca

SEQ ID NO: 98801 - DNA, 16 bp, H. sapiens
gaaggtggcagagctg

SEQ ID NO: 98802 - DNA, 16 bp, H. sapiens
gaaggtgtttcctttt

SEQ ID NO: 98803 - DNA, 16 bp, H. sapiens
gaaggttatagaacac

SEQ ID NO: 98804 - DNA, 16 bp, H. sapiens
gaaggttattaattat

SEQ ID NO: 98805 - DNA, 16 bp, H. sapiens
gaaggttggaatcaac

SEQ ID NO: 98806 - DNA, 16 bp, H. sapiens
gaaggttgtgggttta

SEQ ID NO: 98807 - DNA, 16 bp, H. sapiens
gaaggtttatggcaac

SEQ ID NO: 98808 - DNA, 16 bp, H. sapiens
gaaggtttcaccatgt

SEQ ID NO: 98809 - DNA, 16 bp, H. sapiens
gaaggtttgtaaaaat

SEQ ID NO: 98810 - DNA, 16 bp, H. sapiens
gaagtaacagaagagg

SEQ ID NO: 98811 - DNA, 16 bp, H. sapiens
gaagtaattaaggtta

SEQ ID NO: 98812 - DNA, 16 bp, H. sapiens
gaagtactgacacatg

SEQ ID NO: 98813 - DNA, 16 bp, H. sapiens
gaagtagaagaaaaca

SEQ ID NO: 98814 - DNA, 16 bp, H. sapiens
gaagtagctattctta

SEQ ID NO: 98815 - DNA, 16 bp, H. sapiens
gaagtatttcagattt

SEQ ID NO: 98816 - DNA, 16 bp, H. sapiens
gaagtatttttaaatg

SEQ ID NO: 98817 - DNA, 16 bp, H. sapiens
gaagtcactcactatc

SEQ ID NO: 98818 - DNA, 16 bp, H. sapiens
gaagtcactgcagatg

SEQ ID NO: 98819 - DNA, 16 bp, H. sapiens
gaagtcagatgtaatt

SEQ ID NO: 98820 - DNA, 16 bp, H. sapiens
gaagtcagcaatttat

SEQ ID NO: 98821 - DNA, 16 bp, H. sapiens
gaagtcaggcattgac

SEQ ID NO: 98822 - DNA, 16 bp, H. sapiens
gaagtcaggtagcatt

SEQ ID NO: 98823 - DNA, 16 bp, H. sapiens
gaagtcagtgagatca

SEQ ID NO: 98824 - DNA, 16 bp, H. sapiens
gaagtcattaaaaaaa

SEQ ID NO: 98825 - DNA, 16 bp, H. sapiens
gaagtccaaagtcaag

SEQ ID NO: 98826 - DNA, 16 bp, H. sapiens
gaagtccaagataaag

SEQ ID NO: 98827 - DNA, 16 bp, H. sapiens
gaagtccaagatcaag

SEQ ID NO: 98828 - DNA, 16 bp, H. sapiens
gaagtccaagatgaaa

SEQ ID NO: 98829 - DNA, 16 bp, H. sapiens
gaagtccaagttcaag

SEQ ID NO: 98830 - DNA, 16 bp, H. sapiens
gaagtccacaatcaag

SEQ ID NO: 98831 - DNA, 16 bp, H. sapiens
gaagtccagagaggtt

SEQ ID NO: 98832 - DNA, 16 bp, H. sapiens
gaagtccaggctgagg

SEQ ID NO: 98833 - DNA, 16 bp, H. sapiens
gaagtccagtttattt

SEQ ID NO: 98834 - DNA, 16 bp, H. sapiens
gaagtcccatctctac

SEQ ID NO: 98835 - DNA, 16 bp, H. sapiens
gaagtcccttccacct

SEQ ID NO: 98836 - DNA, 16 bp, H. sapiens
gaagtcctaaaatcaa

SEQ ID NO: 98837 - DNA, 16 bp, H. sapiens
gaagtcctgggattac

SEQ ID NO: 98838 - DNA, 16 bp, H. sapiens
gaagtcgcaagtactc

SEQ ID NO: 98839 - DNA, 16 bp, H. sapiens
gaagtctatcaatttt

SEQ ID NO: 98840 - DNA, 16 bp, H. sapiens
gaagtctcactctgtc

SEQ ID NO: 98841 - DNA, 16 bp, H. sapiens
gaagtctcaggaaact

SEQ ID NO: 98842 - DNA, 20 bp, H. sapiens
gaagtctcaggatacaaaat

SEQ ID NO: 98843 - DNA, 16 bp, H. sapiens
gaagtctccaaaagca

SEQ ID NO: 98844 - DNA, 16 bp, H. sapiens
gaagtctcgctctgtc

SEQ ID NO: 98845 - DNA, 16 bp, H. sapiens
gaagtctctctctgtc

SEQ ID NO: 98846 - DNA, 16 bp, H. sapiens
gaagtctgaaatgggt

SEQ ID NO: 98847 - DNA, 16 bp, H. sapiens
gaagtctgaggtcaag

SEQ ID NO: 98848 - DNA, 16 bp, H. sapiens
gaagtctgcccccatg

SEQ ID NO: 98849 - DNA, 16 bp, H. sapiens
gaagtgaaagagctct

SEQ ID NO: 98850 - DNA, 16 bp, H. sapiens
gaagtgaaataagcca

SEQ ID NO: 98851 - DNA, 16 bp, H. sapiens
gaagtgaaatatttaa

SEQ ID NO: 98852 - DNA, 16 bp, H. sapiens
gaagtgacagaaaaca

SEQ ID NO: 98853 - DNA, 16 bp, H. sapiens
gaagtgacttacccaa

SEQ ID NO: 98854 - DNA, 16 bp, H. sapiens
gaagtgagcacatgct

SEQ ID NO: 98855 - DNA, 16 bp, H. sapiens
gaagtgagccaagatt

SEQ ID NO: 98856 - DNA, 16 bp, H. sapiens
gaagtgagccctcacc

SEQ ID NO: 98857 - DNA, 16 bp, H. sapiens
gaagtgaggagccccc

SEQ ID NO: 98858 - DNA, 16 bp, H. sapiens
gaagtgaggctcagag

SEQ ID NO: 98859 - DNA, 16 bp, H. sapiens
gaagtgatttgtccaa

SEQ ID NO: 98860 - DNA, 16 bp, H. sapiens
gaagtgcaaggagctg

SEQ ID NO: 98861 - DNA, 16 bp, H. sapiens
gaagtgcagaaatcac

SEQ ID NO: 98862 - DNA, 16 bp, H. sapiens
gaagtgcagtggcgca

SEQ ID NO: 98863 - DNA, 16 bp, H. sapiens
gaagtgccaagcaaag

SEQ ID NO: 98864 - DNA, 17 bp, H. sapiens
gaagtgctgagattaca

SEQ ID NO: 98865 - DNA, 16 bp, H. sapiens
gaagtgctggccaggg

SEQ ID NO: 98866 - DNA, 16 bp, H. sapiens
gaagtgctgtggcatg

SEQ ID NO: 98867 - DNA, 16 bp, H. sapiens
gaagtgcttttttttt

SEQ ID NO: 98868 - DNA, 16 bp, H. sapiens
gaagtggaagaaaatc

SEQ ID NO: 98869 - DNA, 16 bp, H. sapiens
gaagtggaattgatgg

SEQ ID NO: 98870 - DNA, 16 bp, H. sapiens
gaagtggaattgctgg

SEQ ID NO: 98871 - DNA, 16 bp, H. sapiens
gaagtggagcctttgg

SEQ ID NO: 98872 - DNA, 16 bp, H. sapiens
gaagtggaggctgcag

SEQ ID NO: 98873 - DNA, 16 bp, H. sapiens
gaagtgggaagatggc

SEQ ID NO: 98874 - DNA, 16 bp, H. sapiens
gaagtgggaggacagc

SEQ ID NO: 98875 - DNA, 16 bp, H. sapiens
gaagtgggatgatcac

SEQ ID NO: 98876 - DNA, 16 bp, H. sapiens
gaagtgggatttctgg

SEQ ID NO: 98877 - DNA, 16 bp, H. sapiens
gaagtggggagcacct

SEQ ID NO: 98878 - DNA, 16 bp, H. sapiens
gaagtggggcccacag

SEQ ID NO: 98879 - DNA, 16 bp, H. sapiens
gaagtggtatctcgtt

SEQ ID NO: 98880 - DNA, 16 bp, H. sapiens
gaagtggtggtgcatg

SEQ ID NO: 98881 - DNA, 16 bp, H. sapiens
gaagtgtctgttcagg

SEQ ID NO: 98882 - DNA, 16 bp, H. sapiens
gaagtgtgaggatcac

SEQ ID NO: 98883 - DNA, 16 bp, H. sapiens
gaagtgttccctgttc

SEQ ID NO: 98884 - DNA, 16 bp, H. sapiens
gaagtgttctcagaaa

SEQ ID NO: 98885 - DNA, 16 bp, H. sapiens
gaagttaaacattttt

SEQ ID NO: 98886 - DNA, 16 bp, H. sapiens
gaagttaaataacttc

SEQ ID NO: 98887 - DNA, 16 bp, H. sapiens
gaagttaagaaaacaa

SEQ ID NO: 98888 - DNA, 16 bp, H. sapiens
gaagttaccctatatg

SEQ ID NO: 98889 - DNA, 16 bp, H. sapiens
gaagttatttttaaaa

SEQ ID NO: 98890 - DNA, 16 bp, H. sapiens
gaagttcaaaatcaag

SEQ ID NO: 98891 - DNA, 16 bp, H. sapiens
gaagttcaagaacagg

SEQ ID NO: 98892 - DNA, 16 bp, H. sapiens
gaagttcaagactagc

SEQ ID NO: 98893 - DNA, 16 bp, H. sapiens
gaagttcaagagcatg

SEQ ID NO: 98894 - DNA, 16 bp, H. sapiens
gaagttcaagatcaaa

SEQ ID NO: 98895 - DNA, 16 bp, H. sapiens
gaagttcaagatgaag

SEQ ID NO: 98896 - DNA, 16 bp, H. sapiens
gaagttccacactttc

SEQ ID NO: 98897 - DNA, 16 bp, H. sapiens
gaagttccaggctgca

SEQ ID NO: 98898 - DNA, 16 bp, H. sapiens
gaagttctcccagata

SEQ ID NO: 98899 - DNA, 16 bp, H. sapiens
gaagttctctgaaatg

SEQ ID NO: 98900 - DNA, 16 bp, H. sapiens
gaagttctgcccactg

SEQ ID NO: 98901 - DNA, 16 bp, H. sapiens
gaagttctgggattac

SEQ ID NO: 98902 - DNA, 16 bp, H. sapiens
gaagttgaggcagcag

SEQ ID NO: 98903 - DNA, 16 bp, H. sapiens
gaagttgagtgacttg

SEQ ID NO: 98904 - DNA, 16 bp, H. sapiens
gaagttgatttcaacc

SEQ ID NO: 98905 - DNA, 16 bp, H. sapiens
gaagttgcaaagaaat

SEQ ID NO: 98906 - DNA, 16 bp, H. sapiens
gaagttgcagtcaaga

SEQ ID NO: 98907 - DNA, 16 bp, H. sapiens
gaagttgcagtgacct

SEQ ID NO: 98908 - DNA, 16 bp, H. sapiens
gaagttgcagtgagcc

SEQ ID NO: 98909 - DNA, 16 bp, H. sapiens
gaagttggagaagaga

SEQ ID NO: 98910 - DNA, 16 bp, H. sapiens
gaagttgtaattgttt

SEQ ID NO: 98911 - DNA, 16 bp, H. sapiens
gaagttgtagtgagca

SEQ ID NO: 98912 - DNA, 17 bp, H. sapiens
gaagttgtctgctgcct

SEQ ID NO: 98913 - DNA, 16 bp, H. sapiens
gaagttgtggagaaaa

SEQ ID NO: 98914 - DNA, 16 bp, H. sapiens
gaagttgtggtgagcc

SEQ ID NO: 98915 - DNA, 16 bp, H. sapiens
gaagtttaagatcaag

SEQ ID NO: 98916 - DNA, 16 bp, H. sapiens
gaagtttacagcaata

SEQ ID NO: 98917 - DNA, 16 bp, H. sapiens
gaagtttattaagaaa

SEQ ID NO: 98918 - DNA, 16 bp, H. sapiens
gaagtttcagtgagcc

SEQ ID NO: 98919 - DNA, 16 bp, H. sapiens
gaagtttcatagtttt

SEQ ID NO: 98920 - DNA, 16 bp, H. sapiens
gaagtttgtgagaatg

SEQ ID NO: 98921 - DNA, 16 bp, H. sapiens
gaagttttctttaaaa

SEQ ID NO: 98922 - DNA, 16 bp, H. sapiens
gaagttttgcctcatc

SEQ ID NO: 98923 - DNA, 16 bp, H. sapiens
gaagtttttctgcttt

SEQ ID NO: 98924 - DNA, 16 bp, H. sapiens
gaataaaacattttaa

SEQ ID NO: 98925 - DNA, 16 bp, H. sapiens
gaataaaactataaat

SEQ ID NO: 98926 - DNA, 16 bp, H. sapiens
gaataaaagaatgtct

SEQ ID NO: 98927 - DNA, 17 bp, H. sapiens
gaataaaagcaggctgc

SEQ ID NO: 98928 - DNA, 16 bp, H. sapiens
gaataaaattccattg

SEQ ID NO: 98929 - DNA, 20 bp, H. sapiens
gaataaacagccttgttgct

SEQ ID NO: 98930 - DNA, 16 bp, H. sapiens
gaataaagaaaatgtg

SEQ ID NO: 98931 - DNA, 16 bp, H. sapiens
gaataaagctgatata

SEQ ID NO: 98932 - DNA, 16 bp, H. sapiens
gaataaaggtgattct

SEQ ID NO: 98933 - DNA, 16 bp, H. sapiens
gaataaagtttatttt

SEQ ID NO: 98934 - DNA, 16 bp, H. sapiens
gaataaatattttagg

SEQ ID NO: 98935 - DNA, 16 bp, H. sapiens
gaataaatttaatcaa

SEQ ID NO: 98936 - DNA, 16 bp, H. sapiens
gaataaatttttgttg

SEQ ID NO: 98937 - DNA, 16 bp, H. sapiens
gaataacttttttttt

SEQ ID NO: 98938 - DNA, 16 bp, H. sapiens
gaataagatctggtat

SEQ ID NO: 98939 - DNA, 16 bp, H. sapiens
gaataagtgtaatgtg

SEQ ID NO: 98940 - DNA, 16 bp, H. sapiens
gaataatacaatgaat

SEQ ID NO: 98941 - DNA, 16 bp, H. sapiens
gaataatattttattg

SEQ ID NO: 98942 - DNA, 16 bp, H. sapiens
gaataatgagaattga

SEQ ID NO: 98943 - DNA, 16 bp, H. sapiens
gaataatgtcttttta

SEQ ID NO: 98944 - DNA, 16 bp, H. sapiens
gaataatttattttct

SEQ ID NO: 98945 - DNA, 16 bp, H. sapiens
gaataattttaatgtt

SEQ ID NO: 98946 - DNA, 16 bp, H. sapiens
gaatacaaaagagaga

SEQ ID NO: 98947 - DNA, 16 bp, H. sapiens
gaatacaaaattcttg

SEQ ID NO: 98948 - DNA, 25 bp, H. sapiens
gaatacaaactaccatcagagaata

SEQ ID NO: 98949 - DNA, 16 bp, H. sapiens
gaatacagataacaag

SEQ ID NO: 98950 - DNA, 16 bp, H. sapiens
gaatacaggaggcaga

SEQ ID NO: 98951 - DNA, 16 bp, H. sapiens
gaatacaggtgtgtgc

SEQ ID NO: 98952 - DNA, 16 bp, H. sapiens
gaatacatttttcttt

SEQ ID NO: 98953 - DNA, 16 bp, H. sapiens
gaataccttcacataa

SEQ ID NO: 98954 - DNA, 25 bp, H. sapiens
gaatactatgcagccataaaaaagg

SEQ ID NO: 98955 - DNA, 16 bp, H. sapiens
gaatacttcctgaagg

SEQ ID NO: 98956 - DNA, 16 bp, H. sapiens
gaatacttctgtctac

SEQ ID NO: 98957 - DNA, 16 bp, H. sapiens
gaatacttttttaaaa

SEQ ID NO: 98958 - DNA, 16 bp, H. sapiens
gaatagaaatcattct

SEQ ID NO: 98959 - DNA, 16 bp, H. sapiens
gaatagaaggaaacta

SEQ ID NO: 98960 - DNA, 16 bp, H. sapiens
gaatagaagtggtgat

SEQ ID NO: 98961 - DNA, 16 bp, H. sapiens
gaatagaatggtggtt

SEQ ID NO: 98962 - DNA, 16 bp, H. sapiens
gaatagacatttcccc

SEQ ID NO: 98963 - DNA, 16 bp, H. sapiens
gaatagcaagtgaaag

SEQ ID NO: 98964 - DNA, 18 bp, H. sapiens
gaatagcaatcattaaaa

SEQ ID NO: 98965 - DNA, 16 bp, H. sapiens
gaatagcacagaaaag

SEQ ID NO: 98966 - DNA, 16 bp, H. sapiens
gaatagcattgaatct

SEQ ID NO: 98967 - DNA, 16 bp, H. sapiens
gaataggagtggcaag

SEQ ID NO: 98968 - DNA, 16 bp, H. sapiens
gaatagtggtttccag

SEQ ID NO: 98969 - DNA, 16 bp, H. sapiens
gaatataaaatgttat

SEQ ID NO: 98970 - DNA, 16 bp, H. sapiens
gaatataaatgcaaaa

SEQ ID NO: 98971 - DNA, 16 bp, H. sapiens
gaatataaattgttct

SEQ ID NO: 98972 - DNA, 16 bp, H. sapiens
gaatataatgaagttg

SEQ ID NO: 98973 - DNA, 16 bp, H. sapiens
gaatatacattctttt

SEQ ID NO: 98974 - DNA, 16 bp, H. sapiens
gaatatacatttttct

SEQ ID NO: 98975 - DNA, 16 bp, H. sapiens
gaatatactaaaaaac

SEQ ID NO: 98976 - DNA, 16 bp, H. sapiens
gaatatactacaattt

SEQ ID NO: 98977 - DNA, 16 bp, H. sapiens
gaatatataaggaaca

SEQ ID NO: 98978 - DNA, 16 bp, H. sapiens
gaatatataatacata

SEQ ID NO: 98979 - DNA, 16 bp, H. sapiens
gaatatatacatatat

SEQ ID NO: 98980 - DNA, 16 bp, H. sapiens
gaatatatatggaata

SEQ ID NO: 98981 - DNA, 16 bp, H. sapiens
gaatatatatgtgtat

SEQ ID NO: 98982 - DNA, 16 bp, H. sapiens
gaatatatgaatgaat

SEQ ID NO: 98983 - DNA, 16 bp, H. sapiens
gaatatatgtgtgcat

SEQ ID NO: 98984 - DNA, 16 bp, H. sapiens
gaatatattttgagaa

SEQ ID NO: 98985 - DNA, 16 bp, H. sapiens
gaatatctttccattt

SEQ ID NO: 98986 - DNA, 16 bp, H. sapiens
gaatatcttttctttt

SEQ ID NO: 98987 - DNA, 16 bp, H. sapiens
gaatatgccttggctg

SEQ ID NO: 98988 - DNA, 16 bp, H. sapiens
gaatatgtaaagaaca

SEQ ID NO: 98989 - DNA, 16 bp, H. sapiens
gaatatgttttcattt

SEQ ID NO: 98990 - DNA, 16 bp, H. sapiens
gaatattaaatgagat

SEQ ID NO: 98991 - DNA, 16 bp, H. sapiens
gaatattaatgtcttt

SEQ ID NO: 98992 - DNA, 16 bp, H. sapiens
gaatattacaaaggat

SEQ ID NO: 98993 - DNA, 16 bp, H. sapiens
gaatattacacagcca

SEQ ID NO: 98994 - DNA, 16 bp, H. sapiens
gaatattactaataat

SEQ ID NO: 98995 - DNA, 16 bp, H. sapiens
gaatattatgaataat

SEQ ID NO: 98996 - DNA, 16 bp, H. sapiens
gaatattctaaatatt

SEQ ID NO: 98997 - DNA, 16 bp, H. sapiens
gaatattctctttttt

SEQ ID NO: 98998 - DNA, 16 bp, H. sapiens
gaatattctttttaaa

SEQ ID NO: 98999 - DNA, 16 bp, H. sapiens
gaatatttattgagta

SEQ ID NO: 99000 - DNA, 16 bp, H. sapiens
gaatatttgtccctca

SEQ ID NO: 99001 - DNA, 16 bp, H. sapiens
gaatatttgttgaatg

SEQ ID NO: 99002 - DNA, 16 bp, H. sapiens
gaatattttaagccaa

SEQ ID NO: 99003 - DNA, 16 bp, H. sapiens
gaatattttcaatcca

SEQ ID NO: 99004 - DNA, 16 bp, H. sapiens
gaatattttccaaaat

SEQ ID NO: 99005 - DNA, 16 bp, H. sapiens
gaatatttttctctta

SEQ ID NO: 99006 - DNA, 16 bp, H. sapiens
gaatatttttgcattt

SEQ ID NO: 99007 - DNA, 16 bp, H. sapiens
gaatcaaaagaaagat

SEQ ID NO: 99008 - DNA, 16 bp, H. sapiens
gaatcaaaagaaagtt

SEQ ID NO: 99009 - DNA, 16 bp, H. sapiens
gaatcaaaagaatggt

SEQ ID NO: 99010 - DNA, 16 bp, H. sapiens
gaatcaaacaatatgt

SEQ ID NO: 99011 - DNA, 16 bp, H. sapiens
gaatcaacctaagttt

SEQ ID NO: 99012 - DNA, 16 bp, H. sapiens
gaatcaacttcttcca

SEQ ID NO: 99013 - DNA, 16 bp, H. sapiens
gaatcaatctaagtgc

SEQ ID NO: 99014 - DNA, 16 bp, H. sapiens
gaatcaatgaagaaat

SEQ ID NO: 99015 - DNA, 16 bp, H. sapiens
gaatcaatgaatgaaa

SEQ ID NO: 99016 - DNA, 16 bp, H. sapiens
gaatcacacaatattt

SEQ ID NO: 99017 - DNA, 16 bp, H. sapiens
gaatcacacagtatgt

SEQ ID NO: 99018 - DNA, 16 bp, H. sapiens
gaatcacctgaatcca

SEQ ID NO: 99019 - DNA, 16 bp, H. sapiens
gaatcacctgaatctg

SEQ ID NO: 99020 - DNA, 16 bp, H. sapiens
gaatcacctggagagc

SEQ ID NO: 99021 - DNA, 16 bp, H. sapiens
gaatcactcgaacccg

SEQ ID NO: 99022 - DNA, 16 bp, H. sapiens
gaatcacttgagcatg

SEQ ID NO: 99023 - DNA, 16 bp, H. sapiens
gaatcacttttattga

SEQ ID NO: 99024 - DNA, 16 bp, H. sapiens
gaatcagaaaaaatat

SEQ ID NO: 99025 - DNA, 16 bp, H. sapiens
gaatcagaaactctgg

SEQ ID NO: 99026 - DNA, 16 bp, H. sapiens
gaatcagaaataaata

SEQ ID NO: 99027 - DNA, 16 bp, H. sapiens
gaatcagccatttttc

SEQ ID NO: 99028 - DNA, 16 bp, H. sapiens
gaatcaggaaaaataa

SEQ ID NO: 99029 - DNA, 16 bp, H. sapiens
gaatcaggattcaaat

SEQ ID NO: 99030 - DNA, 16 bp, H. sapiens
gaatcaggcagcctcc

SEQ ID NO: 99031 - DNA, 16 bp, H. sapiens
gaatcatacaaaatgt

SEQ ID NO: 99032 - DNA, 16 bp, H. sapiens
gaatcatacaatattt

SEQ ID NO: 99033 - DNA, 16 bp, H. sapiens
gaatcatacactattt

SEQ ID NO: 99034 - DNA, 16 bp, H. sapiens
gaatcatatggtagtt

SEQ ID NO: 99035 - DNA, 16 bp, H. sapiens
gaatcatctaatggaa

SEQ ID NO: 99036 - DNA, 16 bp, H. sapiens
gaatcatctgaacctg

SEQ ID NO: 99037 - DNA, 16 bp, H. sapiens
gaatcatggcgggagg

SEQ ID NO: 99038 - DNA, 16 bp, H. sapiens
gaatcatgggggtgtt

SEQ ID NO: 99039 - DNA, 16 bp, H. sapiens
gaatcatggtgggagg

SEQ ID NO: 99040 - DNA, 16 bp, H. sapiens
gaatcatgtaatattt

SEQ ID NO: 99041 - DNA, 16 bp, H. sapiens
gaatccagaacactgc

SEQ ID NO: 99042 - DNA, 16 bp, H. sapiens
gaatccagaaggtgga

SEQ ID NO: 99043 - DNA, 16 bp, H. sapiens
gaatccagaatccaga

SEQ ID NO: 99044 - DNA, 16 bp, H. sapiens
gaatccaggagctgga

SEQ ID NO: 99045 - DNA, 25 bp, H. sapiens
gaatccaggagctggttttttgaaa

SEQ ID NO: 99046 - DNA, 16 bp, H. sapiens
gaatcccaacactttg

SEQ ID NO: 99047 - DNA, 16 bp, H. sapiens
gaatcccagcactctg

SEQ ID NO: 99048 - DNA, 19 bp, H. sapiens
gaatcccagcactttggga

SEQ ID NO: 99049 - DNA, 16 bp, H. sapiens
gaatcccagctactca

SEQ ID NO: 99050 - DNA, 16 bp, H. sapiens
gaatcccagctccact

SEQ ID NO: 99051 - DNA, 16 bp, H. sapiens
gaatcccagctcctcc

SEQ ID NO: 99052 - DNA, 16 bp, H. sapiens
gaatccccacactgtc

SEQ ID NO: 99053 - DNA, 16 bp, H. sapiens
gaatcccggaggcaga

SEQ ID NO: 99054 - DNA, 16 bp, H. sapiens
gaatccctcctcctca

SEQ ID NO: 99055 - DNA, 16 bp, H. sapiens
gaatcccttgaacctg

SEQ ID NO: 99056 - DNA, 16 bp, H. sapiens
gaatcctaagcaaaaa

SEQ ID NO: 99057 - DNA, 16 bp, H. sapiens
gaatcctagcactttg

SEQ ID NO: 99058 - DNA, 19 bp, H. sapiens
gaatcctatgtgagggaaa

SEQ ID NO: 99059 - DNA, 16 bp, H. sapiens
gaatcctggagctggt

SEQ ID NO: 99060 - DNA, 16 bp, H. sapiens
gaatccttttcctatt

SEQ ID NO: 99061 - DNA, 16 bp, H. sapiens
gaatcgcttgaactgg

SEQ ID NO: 99062 - DNA, 16 bp, H. sapiens
gaatcggaggttgcag

SEQ ID NO: 99063 - DNA, 16 bp, H. sapiens
gaatctaatgataaat

SEQ ID NO: 99064 - DNA, 16 bp, H. sapiens
gaatctatatttttaa

SEQ ID NO: 99065 - DNA, 16 bp, H. sapiens
gaatctcacaattatg

SEQ ID NO: 99066 - DNA, 16 bp, H. sapiens
gaatctcactctgtca

SEQ ID NO: 99067 - DNA, 16 bp, H. sapiens
gaatctcactctgttg

SEQ ID NO: 99068 - DNA, 16 bp, H. sapiens
gaatctcactctttca

SEQ ID NO: 99069 - DNA, 16 bp, H. sapiens
gaatctccaaagtgat

SEQ ID NO: 99070 - DNA, 16 bp, H. sapiens
gaatctcctgcctcag

SEQ ID NO: 99071 - DNA, 16 bp, H. sapiens
gaatctcgctgtcacc

SEQ ID NO: 99072 - DNA, 16 bp, H. sapiens
gaatctcgttctgtcg

SEQ ID NO: 99073 - DNA, 16 bp, H. sapiens
gaatctctgagacaca

SEQ ID NO: 99074 - DNA, 16 bp, H. sapiens
gaatctcttgagcccg

SEQ ID NO: 99075 - DNA, 16 bp, H. sapiens
gaatctgatgaaagct

SEQ ID NO: 99076 - DNA, 16 bp, H. sapiens
gaatctgatgattgtg

SEQ ID NO: 99077 - DNA, 16 bp, H. sapiens
gaatctgcaaagggaa

SEQ ID NO: 99078 - DNA, 16 bp, H. sapiens
gaatctgcatttctaa

SEQ ID NO: 99079 - DNA, 16 bp, H. sapiens
gaatctgcattttaac

SEQ ID NO: 99080 - DNA, 16 bp, H. sapiens
gaatctggagtttgct

SEQ ID NO: 99081 - DNA, 16 bp, H. sapiens
gaatctgggtgctctg

SEQ ID NO: 99082 - DNA, 16 bp, H. sapiens
gaatcttagtttggct

SEQ ID NO: 99083 - DNA, 16 bp, H. sapiens
gaatcttcaacccaga

SEQ ID NO: 99084 - DNA, 16 bp, H. sapiens
gaatcttgctctgtca

SEQ ID NO: 99085 - DNA, 16 bp, H. sapiens
gaatcttgctcttgtc

SEQ ID NO: 99086 - DNA, 16 bp, H. sapiens
gaatctttgttttgtt

SEQ ID NO: 99087 - DNA, 16 bp, H. sapiens
gaatcttttcatgtgc

SEQ ID NO: 99088 - DNA, 16 bp, H. sapiens
gaatgaaaagaaattt

SEQ ID NO: 99089 - DNA, 16 bp, H. sapiens
gaatgaaaagacaaga

SEQ ID NO: 99090 - DNA, 16 bp, H. sapiens
gaatgaaaatgaacaa

SEQ ID NO: 99091 - DNA, 16 bp, H. sapiens
gaatgaaaatgaagac

SEQ ID NO: 99092 - DNA, 16 bp, H. sapiens
gaatgaaagaagtcag

SEQ ID NO: 99093 - DNA, 16 bp, H. sapiens
gaatgaaataatggca

SEQ ID NO: 99094 - DNA, 16 bp, H. sapiens
gaatgaaataatgtct

SEQ ID NO: 99095 - DNA, 16 bp, H. sapiens
gaatgaaatcctgtca

SEQ ID NO: 99096 - DNA, 16 bp, H. sapiens
gaatgaaatgatgaaa

SEQ ID NO: 99097 - DNA, 16 bp, H. sapiens
gaatgaaatggaaagg

SEQ ID NO: 99098 - DNA, 16 bp, H. sapiens
gaatgaaatggaatgg

SEQ ID NO: 99099 - DNA, 16 bp, H. sapiens
gaatgaaattatgtca

SEQ ID NO: 99100 - DNA, 16 bp, H. sapiens
gaatgaaattgagaca

SEQ ID NO: 99101 - DNA, 16 bp, H. sapiens
gaatgaacaaaatctc

SEQ ID NO: 99102 - DNA, 23 bp, H. sapiens
gaatgaacaaagcctccaagaaa

SEQ ID NO: 99103 - DNA, 16 bp, H. sapiens
gaatgaacaatttaag

SEQ ID NO: 99104 - DNA, 16 bp, H. sapiens
gaatgaaccttgaaga

SEQ ID NO: 99105 - DNA, 16 bp, H. sapiens
gaatgaagacctttat

SEQ ID NO: 99106 - DNA, 16 bp, H. sapiens
gaatgaagatgaaaat

SEQ ID NO: 99107 - DNA, 16 bp, H. sapiens
gaatgaagccatggac

SEQ ID NO: 99108 - DNA, 16 bp, H. sapiens
gaatgaagctggaggc

SEQ ID NO: 99109 - DNA, 16 bp, H. sapiens
gaatgaaggaatgagt

SEQ ID NO: 99110 - DNA, 16 bp, H. sapiens
gaatgaaggacaaaat

SEQ ID NO: 99111 - DNA, 16 bp, H. sapiens
gaatgaataaatacat

SEQ ID NO: 99112 - DNA, 16 bp, H. sapiens
gaatgaatgaaaacaa

SEQ ID NO: 99113 - DNA, 16 bp, H. sapiens
gaatgaatgaacaaaa

SEQ ID NO: 99114 - DNA, 16 bp, H. sapiens
gaatgaatgaagaaat

SEQ ID NO: 99115 - DNA, 16 bp, H. sapiens
gaatgaatgaagaaca

SEQ ID NO: 99116 - DNA, 16 bp, H. sapiens
gaatgaatgaatgagc

SEQ ID NO: 99117 - DNA, 16 bp, H. sapiens
gaatgaatgaattcca

SEQ ID NO: 99118 - DNA, 16 bp, H. sapiens
gaatgaatggaagaat

SEQ ID NO: 99119 - DNA, 16 bp, H. sapiens
gaatgaatggctgaat

SEQ ID NO: 99120 - DNA, 16 bp, H. sapiens
gaatgaattaggaaga

SEQ ID NO: 99121 - DNA, 16 bp, H. sapiens
gaatgacaactttggt

SEQ ID NO: 99122 - DNA, 16 bp, H. sapiens
gaatgacacagcagca

SEQ ID NO: 99123 - DNA, 16 bp, H. sapiens
gaatgacatctttaaa

SEQ ID NO: 99124 - DNA, 16 bp, H. sapiens
gaatgactgcatggag

SEQ ID NO: 99125 - DNA, 16 bp, H. sapiens
gaatgactttggggta

SEQ ID NO: 99126 - DNA, 16 bp, H. sapiens
gaatgagaaaagacaa

SEQ ID NO: 99127 - DNA, 16 bp, H. sapiens
gaatgagaacatgcaa

SEQ ID NO: 99128 - DNA, 16 bp, H. sapiens
gaatgagaacatgtcc

SEQ ID NO: 99129 - DNA, 16 bp, H. sapiens
gaatgagaagacaagt

SEQ ID NO: 99130 - DNA, 16 bp, H. sapiens
gaatgagaagagacag

SEQ ID NO: 99131 - DNA, 16 bp, H. sapiens
gaatgagactccgtct

SEQ ID NO: 99132 - DNA, 16 bp, H. sapiens
gaatgagagaatgaat

SEQ ID NO: 99133 - DNA, 16 bp, H. sapiens
gaatgaggaaaagctg

SEQ ID NO: 99134 - DNA, 16 bp, H. sapiens
gaatgaggaagacaca

SEQ ID NO: 99135 - DNA, 25 bp, H. sapiens
gaatgagggcaaggaacacctggcc

SEQ ID NO: 99136 - DNA, 16 bp, H. sapiens
gaatgagtcccagaga

SEQ ID NO: 99137 - DNA, 16 bp, H. sapiens
gaatgagtctcaggag

SEQ ID NO: 99138 - DNA, 16 bp, H. sapiens
gaatgataagaaaaca

SEQ ID NO: 99139 - DNA, 16 bp, H. sapiens
gaatgatacaatatgt

SEQ ID NO: 99140 - DNA, 16 bp, H. sapiens
gaatgatatttcattg

SEQ ID NO: 99141 - DNA, 16 bp, H. sapiens
gaatgatcaataaaaa

SEQ ID NO: 99142 - DNA, 16 bp, H. sapiens
gaatgatcttttcaaa

SEQ ID NO: 99143 - DNA, 16 bp, H. sapiens
gaatgatgacttccaa

SEQ ID NO: 99144 - DNA, 16 bp, H. sapiens
gaatgatgctttccag

SEQ ID NO: 99145 - DNA, 16 bp, H. sapiens
gaatgatggtggtatt

SEQ ID NO: 99146 - DNA, 16 bp, H. sapiens
gaatgattctgtctag

SEQ ID NO: 99147 - DNA, 16 bp, H. sapiens
gaatgatttcttttcc

SEQ ID NO: 99148 - DNA, 16 bp, H. sapiens
gaatgattttggaagt

SEQ ID NO: 99149 - DNA, 16 bp, H. sapiens
gaatgcaatggtgtaa

SEQ ID NO: 99150 - DNA, 16 bp, H. sapiens
gaatgcaatttgaaaa

SEQ ID NO: 99151 - DNA, 16 bp, H. sapiens
gaatgcacaatttctg

SEQ ID NO: 99152 - DNA, 16 bp, H. sapiens
gaatgcagaatggtac

SEQ ID NO: 99153 - DNA, 16 bp, H. sapiens
gaatgcagctggaggc

SEQ ID NO: 99154 - DNA, 16 bp, H. sapiens
gaatgcaggcagcctc

SEQ ID NO: 99155 - DNA, 16 bp, H. sapiens
gaatgcaggccccagg

SEQ ID NO: 99156 - DNA, 16 bp, H. sapiens
gaatgcaggtttctga

SEQ ID NO: 99157 - DNA, 16 bp, H. sapiens
gaatgcagtggtataa

SEQ ID NO: 99158 - DNA, 16 bp, H. sapiens
gaatgcagtggtgccc

SEQ ID NO: 99159 - DNA, 16 bp, H. sapiens
gaatgccagacagtgg

SEQ ID NO: 99160 - DNA, 16 bp, H. sapiens
gaatgcccaggcagaa

SEQ ID NO: 99161 - DNA, 16 bp, H. sapiens
gaatgccctggccaga

SEQ ID NO: 99162 - DNA, 16 bp, H. sapiens
gaatgcctggactcaa

SEQ ID NO: 99163 - DNA, 16 bp, H. sapiens
gaatgcctggctgctg

SEQ ID NO: 99164 - DNA, 16 bp, H. sapiens
gaatgccttttgtttc

SEQ ID NO: 99165 - DNA, 16 bp, H. sapiens
gaatgctcttacactg

SEQ ID NO: 99166 - DNA, 16 bp, H. sapiens
gaatgctgtgctggga

SEQ ID NO: 99167 - DNA, 18 bp, H. sapiens
gaatgcttgtgatttttg

SEQ ID NO: 99168 - DNA, 16 bp, H. sapiens
gaatgcttgtgttttt

SEQ ID NO: 99169 - DNA, 16 bp, H. sapiens
gaatgctttttcactg

SEQ ID NO: 99170 - DNA, 16 bp, H. sapiens
gaatggaaaaaatatt

SEQ ID NO: 99171 - DNA, 16 bp, H. sapiens
gaatggaaaagaatgg

SEQ ID NO: 99172 - DNA, 16 bp, H. sapiens
gaatggaaagagattt

SEQ ID NO: 99173 - DNA, 18 bp, H. sapiens
gaatggaaagaggagtgg

SEQ ID NO: 99174 - DNA, 16 bp, H. sapiens
gaatggaactaagttg

SEQ ID NO: 99175 - DNA, 22 bp, H. sapiens
gaatggaagaacattccatgct

SEQ ID NO: 99176 - DNA, 16 bp, H. sapiens
gaatggaaggaaatat

SEQ ID NO: 99177 - DNA, 16 bp, H. sapiens
gaatggaaggatggat

SEQ ID NO: 99178 - DNA, 16 bp, H. sapiens
gaatggaagtggtgag

SEQ ID NO: 99179 - DNA, 16 bp, H. sapiens
gaatggaatcatccaa

SEQ ID NO: 99180 - DNA, 16 bp, H. sapiens
gaatggaatggagtca

SEQ ID NO: 99181 - DNA, 16 bp, H. sapiens
gaatggagcctgcagg

SEQ ID NO: 99182 - DNA, 16 bp, H. sapiens
gaatggagctggagga

SEQ ID NO: 99183 - DNA, 16 bp, H. sapiens
gaatggagcttgcagg

SEQ ID NO: 99184 - DNA, 16 bp, H. sapiens
gaatggaggacaaaaa

SEQ ID NO: 99185 - DNA, 16 bp, H. sapiens
gaatggataaacaaaa

SEQ ID NO: 99186 - DNA, 16 bp, H. sapiens
gaatggatgaataaat

SEQ ID NO: 99187 - DNA, 16 bp, H. sapiens
gaatggatgagtgaat

SEQ ID NO: 99188 - DNA, 16 bp, H. sapiens
gaatggatgttgtgtt

SEQ ID NO: 99189 - DNA, 16 bp, H. sapiens
gaatggattttaaaaa

SEQ ID NO: 99190 - DNA, 16 bp, H. sapiens
gaatggcaaataaaca

SEQ ID NO: 99191 - DNA, 16 bp, H. sapiens
gaatggcagttaccag

SEQ ID NO: 99192 - DNA, 16 bp, H. sapiens
gaatggcatgaagctg

SEQ ID NO: 99193 - DNA, 16 bp, H. sapiens
gaatggcatttctgga

SEQ ID NO: 99194 - DNA, 16 bp, H. sapiens
gaatggccttttgaag

SEQ ID NO: 99195 - DNA, 16 bp, H. sapiens
gaatggcgtgagccca

SEQ ID NO: 99196 - DNA, 16 bp, H. sapiens
gaatggctaactaaaa

SEQ ID NO: 99197 - DNA, 16 bp, H. sapiens
gaatggctttgacaaa

SEQ ID NO: 99198 - DNA, 16 bp, H. sapiens
gaatgggaaaacattt

SEQ ID NO: 99199 - DNA, 16 bp, H. sapiens
gaatgggaagagcttt

SEQ ID NO: 99200 - DNA, 16 bp, H. sapiens
gaatgggagaaaaatt

SEQ ID NO: 99201 - DNA, 16 bp, H. sapiens
gaatgggattagtgct

SEQ ID NO: 99202 - DNA, 16 bp, H. sapiens
gaatgggcaaaagctg

SEQ ID NO: 99203 - DNA, 16 bp, H. sapiens
gaatggggaacctcac

SEQ ID NO: 99204 - DNA, 16 bp, H. sapiens
gaatggggaatgctga

SEQ ID NO: 99205 - DNA, 16 bp, H. sapiens
gaatggggagatgttg

SEQ ID NO: 99206 - DNA, 16 bp, H. sapiens
gaatgggtgagtggat

SEQ ID NO: 99207 - DNA, 16 bp, H. sapiens
gaatggtaccacctcc

SEQ ID NO: 99208 - DNA, 16 bp, H. sapiens
gaatggtagatccatt

SEQ ID NO: 99209 - DNA, 16 bp, H. sapiens
gaatggtgaaaccctg

SEQ ID NO: 99210 - DNA, 16 bp, H. sapiens
gaatggtgaaatcatt

SEQ ID NO: 99211 - DNA, 16 bp, H. sapiens
gaatggtgccatattg

SEQ ID NO: 99212 - DNA, 16 bp, H. sapiens
gaatggtgctgcagtg

SEQ ID NO: 99213 - DNA, 16 bp, H. sapiens
gaatggtggtgggcgc

SEQ ID NO: 99214 - DNA, 16 bp, H. sapiens
gaatggtggttaacag

SEQ ID NO: 99215 - DNA, 16 bp, H. sapiens
gaatggttttacattt

SEQ ID NO: 99216 - DNA, 16 bp, H. sapiens
gaatggttttgtgggc

SEQ ID NO: 99217 - DNA, 16 bp, H. sapiens
gaatgtaaaatatctt

SEQ ID NO: 99218 - DNA, 16 bp, H. sapiens
gaatgtaaacaaattt

SEQ ID NO: 99219 - DNA, 16 bp, H. sapiens
gaatgtacaacacaaa

SEQ ID NO: 99220 - DNA, 16 bp, H. sapiens
gaatgtatcttttttt

SEQ ID NO: 99221 - DNA, 16 bp, H. sapiens
gaatgtattccttcta

SEQ ID NO: 99222 - DNA, 16 bp, H. sapiens
gaatgtcattggcatt

SEQ ID NO: 99223 - DNA, 16 bp, H. sapiens
gaatgtccttattctt

SEQ ID NO: 99224 - DNA, 17 bp, H. sapiens
gaatgtctcggtgtaaa

SEQ ID NO: 99225 - DNA, 16 bp, H. sapiens
gaatgtctttattttg

SEQ ID NO: 99226 - DNA, 16 bp, H. sapiens
gaatgtgaaggcccag

SEQ ID NO: 99227 - DNA, 16 bp, H. sapiens
gaatgtgacctaattt

SEQ ID NO: 99228 - DNA, 16 bp, H. sapiens
gaatgtgcaaaagctg

SEQ ID NO: 99229 - DNA, 16 bp, H. sapiens
gaatgtgcaatatttg

SEQ ID NO: 99230 - DNA, 16 bp, H. sapiens
gaatgtgctctggaga

SEQ ID NO: 99231 - DNA, 16 bp, H. sapiens
gaatgtgctttttttt

SEQ ID NO: 99232 - DNA, 16 bp, H. sapiens
gaatgtggcttttgtt

SEQ ID NO: 99233 - DNA, 16 bp, H. sapiens
gaatgtgggaaagcct

SEQ ID NO: 99234 - DNA, 16 bp, H. sapiens
gaatgtggtggaagtg

SEQ ID NO: 99235 - DNA, 16 bp, H. sapiens
gaatgtgtattttgca

SEQ ID NO: 99236 - DNA, 16 bp, H. sapiens
gaatgtgtgtgtgcac

SEQ ID NO: 99237 - DNA, 16 bp, H. sapiens
gaatgtgtgtgtgtgc

SEQ ID NO: 99238 - DNA, 16 bp, H. sapiens
gaatgttcatagaagc

SEQ ID NO: 99239 - DNA, 16 bp, H. sapiens
gaatgttcatgaatat

SEQ ID NO: 99240 - DNA, 16 bp, H. sapiens
gaatgttcctcttcag

SEQ ID NO: 99241 - DNA, 16 bp, H. sapiens
gaatgttctatatctt

SEQ ID NO: 99242 - DNA, 16 bp, H. sapiens
gaatgttcttccccca

SEQ ID NO: 99243 - DNA, 16 bp, H. sapiens
gaatgttgaattttat

SEQ ID NO: 99244 - DNA, 16 bp, H. sapiens
gaatgtttccaacctg

SEQ ID NO: 99245 - DNA, 16 bp, H. sapiens
gaatgtttcttcattt

SEQ ID NO: 99246 - DNA, 16 bp, H. sapiens
gaatgtttgtaacaca

SEQ ID NO: 99247 - DNA, 16 bp, H. sapiens
gaattaaaaacagaat

SEQ ID NO: 99248 - DNA, 16 bp, H. sapiens
gaattaaaactttttt

SEQ ID NO: 99249 - DNA, 16 bp, H. sapiens
gaattaacccaatcca

SEQ ID NO: 99250 - DNA, 16 bp, H. sapiens
gaattaacttaaccaa

SEQ ID NO: 99251 - DNA, 16 bp, H. sapiens
gaattaagtgaattaa

SEQ ID NO: 99252 - DNA, 16 bp, H. sapiens
gaattaatattgtgaa

SEQ ID NO: 99253 - DNA, 16 bp, H. sapiens
gaattaatattgttga

SEQ ID NO: 99254 - DNA, 16 bp, H. sapiens
gaattaatgaacaaat

SEQ ID NO: 99255 - DNA, 16 bp, H. sapiens
gaattaatgaatgaat

SEQ ID NO: 99256 - DNA, 16 bp, H. sapiens
gaattaatgaatgcat

SEQ ID NO: 99257 - DNA, 16 bp, H. sapiens
gaattaatgctggaat

SEQ ID NO: 99258 - DNA, 16 bp, H. sapiens
gaattaattaatgaat

SEQ ID NO: 99259 - DNA, 16 bp, H. sapiens
gaattacaagcatgag

SEQ ID NO: 99260 - DNA, 16 bp, H. sapiens
gaattactgagtcaaa

SEQ ID NO: 99261 - DNA, 16 bp, H. sapiens
gaattagaaaaatcaa

SEQ ID NO: 99262 - DNA, 16 bp, H. sapiens
gaattagaaataccat

SEQ ID NO: 99263 - DNA, 16 bp, H. sapiens
gaattagaagtggagc

SEQ ID NO: 99264 - DNA, 16 bp, H. sapiens
gaattagtaatttaaa

SEQ ID NO: 99265 - DNA, 16 bp, H. sapiens
gaattataaaaacaga

SEQ ID NO: 99266 - DNA, 16 bp, H. sapiens
gaattataatccccaa

SEQ ID NO: 99267 - DNA, 16 bp, H. sapiens
gaattatacaatattt

SEQ ID NO: 99268 - DNA, 16 bp, H. sapiens
gaattatcttttaaaa

SEQ ID NO: 99269 - DNA, 16 bp, H. sapiens
gaattattatttccat

SEQ ID NO: 99270 - DNA, 16 bp, H. sapiens
gaattattttgataaa

SEQ ID NO: 99271 - DNA, 16 bp, H. sapiens
gaattattttgtttct

SEQ ID NO: 99272 - DNA, 16 bp, H. sapiens
gaattattttttcctt

SEQ ID NO: 99273 - DNA, 16 bp, H. sapiens
gaattcaaacccagat

SEQ ID NO: 99274 - DNA, 16 bp, H. sapiens
gaattcaacaatatat

SEQ ID NO: 99275 - DNA, 16 bp, H. sapiens
gaattcaagaaagaag

SEQ ID NO: 99276 - DNA, 16 bp, H. sapiens
gaattcagaaaagttt

SEQ ID NO: 99277 - DNA, 16 bp, H. sapiens
gaattcagcaataaag

SEQ ID NO: 99278 - DNA, 16 bp, H. sapiens
gaattcagctctggac

SEQ ID NO: 99279 - DNA, 16 bp, H. sapiens
gaattcaggtttggga

SEQ ID NO: 99280 - DNA, 16 bp, H. sapiens
gaattcataatttaaa

SEQ ID NO: 99281 - DNA, 16 bp, H. sapiens
gaattcataattttaa

SEQ ID NO: 99282 - DNA, 16 bp, H. sapiens
gaattcatcatttttt

SEQ ID NO: 99283 - DNA, 16 bp, H. sapiens
gaattccacttgatca

SEQ ID NO: 99284 - DNA, 16 bp, H. sapiens
gaattcccaacctcag

SEQ ID NO: 99285 - DNA, 16 bp, H. sapiens
gaattcctggaaacat

SEQ ID NO: 99286 - DNA, 16 bp, H. sapiens
gaattcctggcctcaa

SEQ ID NO: 99287 - DNA, 16 bp, H. sapiens
gaattccttcagtttt

SEQ ID NO: 99288 - DNA, 16 bp, H. sapiens
gaattctaaatattac

SEQ ID NO: 99289 - DNA, 16 bp, H. sapiens
gaattctaatttaatt

SEQ ID NO: 99290 - DNA, 16 bp, H. sapiens
gaattctaatttgatt

SEQ ID NO: 99291 - DNA, 16 bp, H. sapiens
gaattctaatttttcc

SEQ ID NO: 99292 - DNA, 16 bp, H. sapiens
gaattctacattttaa

SEQ ID NO: 99293 - DNA, 16 bp, H. sapiens
gaattctaccaaatat

SEQ ID NO: 99294 - DNA, 16 bp, H. sapiens
gaattctcactctctg

SEQ ID NO: 99295 - DNA, 16 bp, H. sapiens
gaattctcctgtgttt

SEQ ID NO: 99296 - DNA, 16 bp, H. sapiens
gaattctctgtactat

SEQ ID NO: 99297 - DNA, 16 bp, H. sapiens
gaattctctgtacttt

SEQ ID NO: 99298 - DNA, 16 bp, H. sapiens
gaattctctttgtctt

SEQ ID NO: 99299 - DNA, 16 bp, H. sapiens
gaattctgagagatac

SEQ ID NO: 99300 - DNA, 18 bp, H. sapiens
gaattctgcattgttgta

SEQ ID NO: 99301 - DNA, 16 bp, H. sapiens
gaattctgcctcagcc

SEQ ID NO: 99302 - DNA, 16 bp, H. sapiens
gaattctggggagaca

SEQ ID NO: 99303 - DNA, 16 bp, H. sapiens
gaattctgtccctgag

SEQ ID NO: 99304 - DNA, 16 bp, H. sapiens
gaattcttccaaactc

SEQ ID NO: 99305 - DNA, 16 bp, H. sapiens
gaattctttatatatt

SEQ ID NO: 99306 - DNA, 16 bp, H. sapiens
gaattgaaaggaatgg

SEQ ID NO: 99307 - DNA, 16 bp, H. sapiens
gaattgaagaaaatat

SEQ ID NO: 99308 - DNA, 16 bp, H. sapiens
gaattgaatctgtaaa

SEQ ID NO: 99309 - DNA, 16 bp, H. sapiens
gaattgaattgaatgg

SEQ ID NO: 99310 - DNA, 16 bp, H. sapiens
gaattgacacttttat

SEQ ID NO: 99311 - DNA, 16 bp, H. sapiens
gaattgacccttttat

SEQ ID NO: 99312 - DNA, 16 bp, H. sapiens
gaattgactcatgtga

SEQ ID NO: 99313 - DNA, 16 bp, H. sapiens
gaattgagagtccaga

SEQ ID NO: 99314 - DNA, 16 bp, H. sapiens
gaattgagtgttgtga

SEQ ID NO: 99315 - DNA, 16 bp, H. sapiens
gaattgcaactcagaa

SEQ ID NO: 99316 - DNA, 16 bp, H. sapiens
gaattgcattgagtct

SEQ ID NO: 99317 - DNA, 16 bp, H. sapiens
gaattgccacactgac

SEQ ID NO: 99318 - DNA, 16 bp, H. sapiens
gaattgccagaaaaaa

SEQ ID NO: 99319 - DNA, 16 bp, H. sapiens
gaattgcccatcccag

SEQ ID NO: 99320 - DNA, 16 bp, H. sapiens
gaattgcttgaggcca

SEQ ID NO: 99321 - DNA, 16 bp, H. sapiens
gaattggaagaattaa

SEQ ID NO: 99322 - DNA, 16 bp, H. sapiens
gaattggaagccatta

SEQ ID NO: 99323 - DNA, 16 bp, H. sapiens
gaattggataaagaaa

SEQ ID NO: 99324 - DNA, 16 bp, H. sapiens
gaattgtaagaattct

SEQ ID NO: 99325 - DNA, 16 bp, H. sapiens
gaattgtaattcccat

SEQ ID NO: 99326 - DNA, 16 bp, H. sapiens
gaattgtacatttaaa

SEQ ID NO: 99327 - DNA, 16 bp, H. sapiens
gaattgtatgatatgt

SEQ ID NO: 99328 - DNA, 16 bp, H. sapiens
gaattgtctatttctt

SEQ ID NO: 99329 - DNA, 16 bp, H. sapiens
gaattgtcttggcatc

SEQ ID NO: 99330 - DNA, 16 bp, H. sapiens
gaattgtggaagttac

SEQ ID NO: 99331 - DNA, 16 bp, H. sapiens
gaattgtttgttttct

SEQ ID NO: 99332 - DNA, 16 bp, H. sapiens
gaattgttttgtagct

SEQ ID NO: 99333 - DNA, 16 bp, H. sapiens
gaatttaaggcaaaaa

SEQ ID NO: 99334 - DNA, 16 bp, H. sapiens
gaatttaagtccagaa

SEQ ID NO: 99335 - DNA, 16 bp, H. sapiens
gaatttaattcaaagt

SEQ ID NO: 99336 - DNA, 16 bp, H. sapiens
gaatttactaaatgga

SEQ ID NO: 99337 - DNA, 16 bp, H. sapiens
gaatttatacaaataa

SEQ ID NO: 99338 - DNA, 16 bp, H. sapiens
gaatttatccatctct

SEQ ID NO: 99339 - DNA, 16 bp, H. sapiens
gaatttatccctttac

SEQ ID NO: 99340 - DNA, 16 bp, H. sapiens
gaatttattaagcaaa

SEQ ID NO: 99341 - DNA, 16 bp, H. sapiens
gaatttattaaggagt

SEQ ID NO: 99342 - DNA, 16 bp, H. sapiens
gaatttattcatctct

SEQ ID NO: 99343 - DNA, 16 bp, H. sapiens
gaatttatttcttata

SEQ ID NO: 99344 - DNA, 16 bp, H. sapiens
gaatttcaaaaataaa

SEQ ID NO: 99345 - DNA, 16 bp, H. sapiens
gaatttcaaaatataa

SEQ ID NO: 99346 - DNA, 16 bp, H. sapiens
gaatttcaaataattt

SEQ ID NO: 99347 - DNA, 16 bp, H. sapiens
gaatttcaatggtagt

SEQ ID NO: 99348 - DNA, 16 bp, H. sapiens
gaatttcagaaaattc

SEQ ID NO: 99349 - DNA, 16 bp, H. sapiens
gaatttcatcatgttg

SEQ ID NO: 99350 - DNA, 16 bp, H. sapiens
gaatttcatgtaaatg

SEQ ID NO: 99351 - DNA, 16 bp, H. sapiens
gaatttcattgagctt

SEQ ID NO: 99352 - DNA, 16 bp, H. sapiens
gaatttcattgagttt

SEQ ID NO: 99353 - DNA, 16 bp, H. sapiens
gaatttcattggtatt

SEQ ID NO: 99354 - DNA, 16 bp, H. sapiens
gaatttcctcagtttt

SEQ ID NO: 99355 - DNA, 16 bp, H. sapiens
gaatttcctcctgtag

SEQ ID NO: 99356 - DNA, 16 bp, H. sapiens
gaatttctaaaatatt

SEQ ID NO: 99357 - DNA, 16 bp, H. sapiens
gaatttctctatttct

SEQ ID NO: 99358 - DNA, 16 bp, H. sapiens
gaatttctgcttggtt

SEQ ID NO: 99359 - DNA, 16 bp, H. sapiens
gaatttcttcccagaa

SEQ ID NO: 99360 - DNA, 16 bp, H. sapiens
gaatttcttctgccag

SEQ ID NO: 99361 - DNA, 16 bp, H. sapiens
gaatttcttttcttta

SEQ ID NO: 99362 - DNA, 16 bp, H. sapiens
gaatttgaaaaggaaa

SEQ ID NO: 99363 - DNA, 16 bp, H. sapiens
gaatttgaaattattt

SEQ ID NO: 99364 - DNA, 16 bp, H. sapiens
gaatttgaatccctga

SEQ ID NO: 99365 - DNA, 16 bp, H. sapiens
gaatttgacaattatg

SEQ ID NO: 99366 - DNA, 16 bp, H. sapiens
gaatttgagatgagcc

SEQ ID NO: 99367 - DNA, 16 bp, H. sapiens
gaatttgatttaaaaa

SEQ ID NO: 99368 - DNA, 16 bp, H. sapiens
gaatttgcaagtggat

SEQ ID NO: 99369 - DNA, 16 bp, H. sapiens
gaatttgcatgtctaa

SEQ ID NO: 99370 - DNA, 16 bp, H. sapiens
gaatttgcatttcaaa

SEQ ID NO: 99371 - DNA, 16 bp, H. sapiens
gaatttggagtctgat

SEQ ID NO: 99372 - DNA, 16 bp, H. sapiens
gaatttggttttctgt

SEQ ID NO: 99373 - DNA, 16 bp, H. sapiens
gaatttgtcaccagca

SEQ ID NO: 99374 - DNA, 16 bp, H. sapiens
gaatttgtctgtctcc

SEQ ID NO: 99375 - DNA, 16 bp, H. sapiens
gaatttgttagaaatg

SEQ ID NO: 99376 - DNA, 16 bp, H. sapiens
gaattttaaaatgttt

SEQ ID NO: 99377 - DNA, 16 bp, H. sapiens
gaattttaaagcaaaa

SEQ ID NO: 99378 - DNA, 16 bp, H. sapiens
gaattttaggaatttt

SEQ ID NO: 99379 - DNA, 16 bp, H. sapiens
gaattttatatatatg

SEQ ID NO: 99380 - DNA, 16 bp, H. sapiens
gaattttatcaaataa

SEQ ID NO: 99381 - DNA, 16 bp, H. sapiens
gaattttatttcattt

SEQ ID NO: 99382 - DNA, 16 bp, H. sapiens
gaattttatttctcct

SEQ ID NO: 99383 - DNA, 16 bp, H. sapiens
gaattttcaaaagaaa

SEQ ID NO: 99384 - DNA, 16 bp, H. sapiens
gaattttcaacacaga

SEQ ID NO: 99385 - DNA, 17 bp, H. sapiens
gaattttcagcttttct

SEQ ID NO: 99386 - DNA, 16 bp, H. sapiens
gaattttcattaaaaa

SEQ ID NO: 99387 - DNA, 16 bp, H. sapiens
gaattttccaattttc

SEQ ID NO: 99388 - DNA, 16 bp, H. sapiens
gaattttccaattttt

SEQ ID NO: 99389 - DNA, 16 bp, H. sapiens
gaattttccatttatt

SEQ ID NO: 99390 - DNA, 16 bp, H. sapiens
gaattttcttttcttc

SEQ ID NO: 99391 - DNA, 16 bp, H. sapiens
gaattttgataggggt

SEQ ID NO: 99392 - DNA, 16 bp, H. sapiens
gaattttggaatattt

SEQ ID NO: 99393 - DNA, 16 bp, H. sapiens
gaattttggacttgca

SEQ ID NO: 99394 - DNA, 16 bp, H. sapiens
gaattttgtttaaaaa

SEQ ID NO: 99395 - DNA, 16 bp, H. sapiens
gaatttttagcatgaa

SEQ ID NO: 99396 - DNA, 16 bp, H. sapiens
gaatttttcaattcag

SEQ ID NO: 99397 - DNA, 16 bp, H. sapiens
gaatttttcagctcca

SEQ ID NO: 99398 - DNA, 16 bp, H. sapiens
gaatttttcagttcca

SEQ ID NO: 99399 - DNA, 16 bp, H. sapiens
gaatttttctattttc

SEQ ID NO: 99400 - DNA, 16 bp, H. sapiens
gaattttttccatttg

SEQ ID NO: 99401 - DNA, 16 bp, H. sapiens
gaatttttttcttaat

SEQ ID NO: 99402 - DNA, 16 bp, H. sapiens
gaattttttttaaaag

SEQ ID NO: 99403 - DNA, 16 bp, H. sapiens
gaattttttttaactt

SEQ ID NO: 99404 - DNA, 16 bp, H. sapiens
gaattttttttctaat

SEQ ID NO: 99405 - DNA, 16 bp, H. sapiens
gacaaaaatggaaaca

SEQ ID NO: 99406 - DNA, 16 bp, H. sapiens
gacaaaacaaatggaa

SEQ ID NO: 99407 - DNA, 16 bp, H. sapiens
gacaaaacaatctgta

SEQ ID NO: 99408 - DNA, 16 bp, H. sapiens
gacaaaacttctcttt

SEQ ID NO: 99409 - DNA, 16 bp, H. sapiens
gacaaaagaatctgaa

SEQ ID NO: 99410 - DNA, 16 bp, H. sapiens
gacaaaataatctgca

SEQ ID NO: 99411 - DNA, 16 bp, H. sapiens
gacaaaattcatttgc

SEQ ID NO: 99412 - DNA, 16 bp, H. sapiens
gacaaaattgaaaacc

SEQ ID NO: 99413 - DNA, 16 bp, H. sapiens
gacaaacccaaagcca

SEQ ID NO: 99414 - DNA, 16 bp, H. sapiens
gacaaaccctgtctct

SEQ ID NO: 99415 - DNA, 16 bp, H. sapiens
gacaaactcttggaaa

SEQ ID NO: 99416 - DNA, 16 bp, H. sapiens
gacaaagaaagtcatt

SEQ ID NO: 99417 - DNA, 16 bp, H. sapiens
gacaaagaagttgaaa

SEQ ID NO: 99418 - DNA, 16 bp, H. sapiens
gacaaagaattaataa

SEQ ID NO: 99419 - DNA, 16 bp, H. sapiens
gacaaagaattcagaa

SEQ ID NO: 99420 - DNA, 16 bp, H. sapiens
gacaaagagagaatcc

SEQ ID NO: 99421 - DNA, 16 bp, H. sapiens
gacaaagagagaattc

SEQ ID NO: 99422 - DNA, 16 bp, H. sapiens
gacaaagataccaaaa

SEQ ID NO: 99423 - DNA, 16 bp, H. sapiens
gacaaagccacagcca

SEQ ID NO: 99424 - DNA, 16 bp, H. sapiens
gacaaagcgaaactcc

SEQ ID NO: 99425 - DNA, 16 bp, H. sapiens
gacaaagcgagactcc

SEQ ID NO: 99426 - DNA, 16 bp, H. sapiens
gacaaaggagcaaagg

SEQ ID NO: 99427 - DNA, 16 bp, H. sapiens
gacaaaggtcaaatat

SEQ ID NO: 99428 - DNA, 16 bp, H. sapiens
gacaaaggtgcaaaag

SEQ ID NO: 99429 - DNA, 17 bp, H. sapiens
gacaaagtgagactcca

SEQ ID NO: 99430 - DNA, 16 bp, H. sapiens
gacaaatattgtatta

SEQ ID NO: 99431 - DNA, 16 bp, H. sapiens
gacaaatattttgaaa

SEQ ID NO: 99432 - DNA, 16 bp, H. sapiens
gacaaatgcaaataaa

SEQ ID NO: 99433 - DNA, 18 bp, H. sapiens
gacaaatgcgatctaatt

SEQ ID NO: 99434 - DNA, 16 bp, H. sapiens
gacaacaaaatgagac

SEQ ID NO: 99435 - DNA, 16 bp, H. sapiens
gacaacatgacaaaac

SEQ ID NO: 99436 - DNA, 16 bp, H. sapiens
gacaacatggtgaaac

SEQ ID NO: 99437 - DNA, 16 bp, H. sapiens
gacaacccacagaaca

SEQ ID NO: 99438 - DNA, 16 bp, H. sapiens
gacaacccacagaata

SEQ ID NO: 99439 - DNA, 16 bp, H. sapiens
gacaacccacaggatg

SEQ ID NO: 99440 - DNA, 16 bp, H. sapiens
gacaacctgcctgtgg

SEQ ID NO: 99441 - DNA, 22 bp, H. sapiens
gacaacctgctcctgaatgact

SEQ ID NO: 99442 - DNA, 17 bp, H. sapiens
gacaacctggagcagca

SEQ ID NO: 99443 - DNA, 16 bp, H. sapiens
gacaactggaagcagg

SEQ ID NO: 99444 - DNA, 16 bp, H. sapiens
gacaagaaaaaaatgt

SEQ ID NO: 99445 - DNA, 16 bp, H. sapiens
gacaagaaggagccag

SEQ ID NO: 99446 - DNA, 16 bp, H. sapiens
gacaagagcaaaactc

SEQ ID NO: 99447 - DNA, 16 bp, H. sapiens
gacaagagcaagactt

SEQ ID NO: 99448 - DNA, 16 bp, H. sapiens
gacaagagcgaaactc

SEQ ID NO: 99449 - DNA, 16 bp, H. sapiens
gacaagagggaaactc

SEQ ID NO: 99450 - DNA, 16 bp, H. sapiens
gacaagagtgaaaatc

SEQ ID NO: 99451 - DNA, 16 bp, H. sapiens
gacaagagtgaaactc

SEQ ID NO: 99452 - DNA, 16 bp, H. sapiens
gacaagagtgagactt

SEQ ID NO: 99453 - DNA, 16 bp, H. sapiens
gacaagatctcggctc

SEQ ID NO: 99454 - DNA, 16 bp, H. sapiens
gacaagatggtggatc

SEQ ID NO: 99455 - DNA, 16 bp, H. sapiens
gacaagatgtggaggc

SEQ ID NO: 99456 - DNA, 16 bp, H. sapiens
gacaagcaaatgctgg

SEQ ID NO: 99457 - DNA, 42 bp, H. sapiens
gacaagcaaatgttgagagattttgtcaccaccaggcctgcc

SEQ ID NO: 99458 - DNA, 16 bp, H. sapiens
gacaagcagagaacca

SEQ ID NO: 99459 - DNA, 16 bp, H. sapiens
gacaagccaagtccct

SEQ ID NO: 99460 - DNA, 16 bp, H. sapiens
gacaaggacactgagg

SEQ ID NO: 99461 - DNA, 16 bp, H. sapiens
gacaaggacttcatga

SEQ ID NO: 99462 - DNA, 16 bp, H. sapiens
gacaaggatgctctct

SEQ ID NO: 99463 - DNA, 16 bp, H. sapiens
gacaaggatgtgaaga

SEQ ID NO: 99464 - DNA, 16 bp, H. sapiens
gacaaggatgtggaga

SEQ ID NO: 99465 - DNA, 16 bp, H. sapiens
gacaaggatgttcact

SEQ ID NO: 99466 - DNA, 16 bp, H. sapiens
gacaaggctgacaaaa

SEQ ID NO: 99467 - DNA, 16 bp, H. sapiens
gacaagggattaatag

SEQ ID NO: 99468 - DNA, 16 bp, H. sapiens
gacaaggtctcacact

SEQ ID NO: 99469 - DNA, 16 bp, H. sapiens
gacaaggtgggtggat

SEQ ID NO: 99470 - DNA, 16 bp, H. sapiens
gacaagtggagggtga

SEQ ID NO: 99471 - DNA, 16 bp, H. sapiens
gacaagtgtgtgtgtg

SEQ ID NO: 99472 - DNA, 16 bp, H. sapiens
gacaatacatttttgt

SEQ ID NO: 99473 - DNA, 16 bp, H. sapiens
gacaatatgtaaataa

SEQ ID NO: 99474 - DNA, 16 bp, H. sapiens
gacaatatttatttat

SEQ ID NO: 99475 - DNA, 16 bp, H. sapiens
gacaatctcactctgt

SEQ ID NO: 99476 - DNA, 16 bp, H. sapiens
gacaatgcctttcaaa

SEQ ID NO: 99477 - DNA, 16 bp, H. sapiens
gacaatgggggaaatg

SEQ ID NO: 99478 - DNA, 16 bp, H. sapiens
gacaatggggttttgt

SEQ ID NO: 99479 - DNA, 16 bp, H. sapiens
gacaatggtgatgatg

SEQ ID NO: 99480 - DNA, 16 bp, H. sapiens
gacaattcaacaataa

SEQ ID NO: 99481 - DNA, 16 bp, H. sapiens
gacaattcaatgggga

SEQ ID NO: 99482 - DNA, 16 bp, H. sapiens
gacaattctgatgatt

SEQ ID NO: 99483 - DNA, 16 bp, H. sapiens
gacaatttttgtattt

SEQ ID NO: 99484 - DNA, 16 bp, H. sapiens
gacacaaacacacata

SEQ ID NO: 99485 - DNA, 16 bp, H. sapiens
gacacaaagaggggag

SEQ ID NO: 99486 - DNA, 16 bp, H. sapiens
gacacaaagatgggaa

SEQ ID NO: 99487 - DNA, 16 bp, H. sapiens
gacacaaagccagaga

SEQ ID NO: 99488 - DNA, 16 bp, H. sapiens
gacacaaataaatggg

SEQ ID NO: 99489 - DNA, 16 bp, H. sapiens
gacacaatcagaaatg

SEQ ID NO: 99490 - DNA, 16 bp, H. sapiens
gacacaatgaactttg

SEQ ID NO: 99491 - DNA, 16 bp, H. sapiens
gacacaatgagactcc

SEQ ID NO: 99492 - DNA, 16 bp, H. sapiens
gacacaattggagaaa

SEQ ID NO: 99493 - DNA, 16 bp, H. sapiens
gacacacacacagata

SEQ ID NO: 99494 - DNA, 16 bp, H. sapiens
gacacacacagacaca

SEQ ID NO: 99495 - DNA, 16 bp, H. sapiens
gacacacactcacaca

SEQ ID NO: 99496 - DNA, 16 bp, H. sapiens
gacacacagagacaca

SEQ ID NO: 99497 - DNA, 16 bp, H. sapiens
gacacacagatacata

SEQ ID NO: 99498 - DNA, 16 bp, H. sapiens
gacacacagtaagcac

SEQ ID NO: 99499 - DNA, 16 bp, H. sapiens
gacacacccaggaaaa

SEQ ID NO: 99500 - DNA, 16 bp, H. sapiens
gacacaccctgggcca

SEQ ID NO: 99501 - DNA, 16 bp, H. sapiens
gacacactgatgcaag

SEQ ID NO: 99502 - DNA, 16 bp, H. sapiens
gacacagaaagaaggt

SEQ ID NO: 99503 - DNA, 16 bp, H. sapiens
gacacagacacgcaca

SEQ ID NO: 99504 - DNA, 16 bp, H. sapiens
gacacagagaagggaa

SEQ ID NO: 99505 - DNA, 16 bp, H. sapiens
gacacagagacagaca

SEQ ID NO: 99506 - DNA, 16 bp, H. sapiens
gacacagagacatgaa

SEQ ID NO: 99507 - DNA, 16 bp, H. sapiens
gacacagagaccaatg

SEQ ID NO: 99508 - DNA, 16 bp, H. sapiens
gacacagaggcaaacc

SEQ ID NO: 99509 - DNA, 16 bp, H. sapiens
gacacagatgttggaa

SEQ ID NO: 99510 - DNA, 16 bp, H. sapiens
gacacagcaagacctt

SEQ ID NO: 99511 - DNA, 25 bp, H. sapiens
gacacagcacatgtttcagagagca

SEQ ID NO: 99512 - DNA, 16 bp, H. sapiens
gacacagcctcaggag

SEQ ID NO: 99513 - DNA, 16 bp, H. sapiens
gacacaggaagcggaa

SEQ ID NO: 99514 - DNA, 16 bp, H. sapiens
gacacaggcacatgta

SEQ ID NO: 99515 - DNA, 16 bp, H. sapiens
gacacagggaagggaa

SEQ ID NO: 99516 - DNA, 16 bp, H. sapiens
gacacagggagaggaa

SEQ ID NO: 99517 - DNA, 16 bp, H. sapiens
gacacagggtctcact

SEQ ID NO: 99518 - DNA, 16 bp, H. sapiens
gacacagggtcttact

SEQ ID NO: 99519 - DNA, 16 bp, H. sapiens
gacacagtgaggggaa

SEQ ID NO: 99520 - DNA, 16 bp, H. sapiens
gacacatacacacaca

SEQ ID NO: 99521 - DNA, 19 bp, H. sapiens
gacacatctgaacatctga

SEQ ID NO: 99522 - DNA, 16 bp, H. sapiens
gacacatgaaagaatg

SEQ ID NO: 99523 - DNA, 17 bp, H. sapiens
gacacatgcacacatac

SEQ ID NO: 99524 - DNA, 16 bp, H. sapiens
gacacatgctacagca

SEQ ID NO: 99525 - DNA, 16 bp, H. sapiens
gacacattctgagaaa

SEQ ID NO: 99526 - DNA, 16 bp, H. sapiens
gacacatttctcagaa

SEQ ID NO: 99527 - DNA, 16 bp, H. sapiens
gacaccaaaccacaga

SEQ ID NO: 99528 - DNA, 16 bp, H. sapiens
gacaccaacaaatgga

SEQ ID NO: 99529 - DNA, 16 bp, H. sapiens
gacaccacctcctcaa

SEQ ID NO: 99530 - DNA, 16 bp, H. sapiens
gacaccacctcctcca

SEQ ID NO: 99531 - DNA, 16 bp, H. sapiens
gacaccagctcagcca

SEQ ID NO: 99532 - DNA, 17 bp, H. sapiens
gacaccaggctaatttt

SEQ ID NO: 99533 - DNA, 19 bp, H. sapiens
gacaccatcctggctaaca

SEQ ID NO: 99534 - DNA, 16 bp, H. sapiens
gacaccatctacctgg

SEQ ID NO: 99535 - DNA, 17 bp, H. sapiens
gacacccagctaatttt

SEQ ID NO: 99536 - DNA, 17 bp, H. sapiens
gacacccagctttaaaa

SEQ ID NO: 99537 - DNA, 16 bp, H. sapiens
gacaccccagagatcc

SEQ ID NO: 99538 - DNA, 16 bp, H. sapiens
gacaccctgctggatc

SEQ ID NO: 99539 - DNA, 16 bp, H. sapiens
gacaccctgttcaaca

SEQ ID NO: 99540 - DNA, 16 bp, H. sapiens
gacacctccagaccca

SEQ ID NO: 99541 - DNA, 16 bp, H. sapiens
gacacctctgaaacat

SEQ ID NO: 99542 - DNA, 16 bp, H. sapiens
gacacctgtcattgga

SEQ ID NO: 99543 - DNA, 16 bp, H. sapiens
gacaccttgacttcag

SEQ ID NO: 99544 - DNA, 16 bp, H. sapiens
gacaccttgattttgg

SEQ ID NO: 99545 - DNA, 16 bp, H. sapiens
gacacctttgctttct

SEQ ID NO: 99546 - DNA, 18 bp, H. sapiens
gacacgccacctttaaga

SEQ ID NO: 99547 - DNA, 16 bp, H. sapiens
gacacgctgcctttaa

SEQ ID NO: 99548 - DNA, 16 bp, H. sapiens
gacactatcaagagag

SEQ ID NO: 99549 - DNA, 16 bp, H. sapiens
gacactcagggatgga

SEQ ID NO: 99550 - DNA, 16 bp, H. sapiens
gacactgctccctgtg

SEQ ID NO: 99551 - DNA, 16 bp, H. sapiens
gacactgctgctgata

SEQ ID NO: 99552 - DNA, 16 bp, H. sapiens
gacactggagcttggt

SEQ ID NO: 99553 - DNA, 16 bp, H. sapiens
gacactggttatttta

SEQ ID NO: 99554 - DNA, 16 bp, H. sapiens
gacactgtctacctgg

SEQ ID NO: 99555 - DNA, 16 bp, H. sapiens
gacactgtgcccagcc

SEQ ID NO: 99556 - DNA, 16 bp, H. sapiens
gacactgttggtggga

SEQ ID NO: 99557 - DNA, 16 bp, H. sapiens
gacacttcaccaaaga

SEQ ID NO: 99558 - DNA, 16 bp, H. sapiens
gacacttctcaaaaaa

SEQ ID NO: 99559 - DNA, 16 bp, H. sapiens
gacacttctcaaagga

SEQ ID NO: 99560 - DNA, 16 bp, H. sapiens
gacacttgggctgttt

SEQ ID NO: 99561 - DNA, 16 bp, H. sapiens
gacacttggggattat

SEQ ID NO: 99562 - DNA, 16 bp, H. sapiens
gacacttttgagagtg

SEQ ID NO: 99563 - DNA, 16 bp, H. sapiens
gacagaaaaatgtgaa

SEQ ID NO: 99564 - DNA, 16 bp, H. sapiens
gacagaaaaattctga

SEQ ID NO: 99565 - DNA, 16 bp, H. sapiens
gacagaaaaccagaca

SEQ ID NO: 99566 - DNA, 16 bp, H. sapiens
gacagaaaatcagtaa

SEQ ID NO: 99567 - DNA, 16 bp, H. sapiens
gacagaaaattaacaa

SEQ ID NO: 99568 - DNA, 16 bp, H. sapiens
gacagaaacaagcaat

SEQ ID NO: 99569 - DNA, 16 bp, H. sapiens
gacagaaaccatatga

SEQ ID NO: 99570 - DNA, 16 bp, H. sapiens
gacagaaagagactcc

SEQ ID NO: 99571 - DNA, 16 bp, H. sapiens
gacagaaagttaaaaa

SEQ ID NO: 99572 - DNA, 16 bp, H. sapiens
gacagaaataaagatg

SEQ ID NO: 99573 - DNA, 16 bp, H. sapiens
gacagaaatccaaacc

SEQ ID NO: 99574 - DNA, 16 bp, H. sapiens
gacagaacgagactcc

SEQ ID NO: 99575 - DNA, 16 bp, H. sapiens
gacagaactgaaaaga

SEQ ID NO: 99576 - DNA, 16 bp, H. sapiens
gacagaagcagaggga

SEQ ID NO: 99577 - DNA, 16 bp, H. sapiens
gacagaagctatctga

SEQ ID NO: 99578 - DNA, 16 bp, H. sapiens
gacagaaggcaaggag

SEQ ID NO: 99579 - DNA, 16 bp, H. sapiens
gacagaaggggaagca

SEQ ID NO: 99580 - DNA, 17 bp, H. sapiens
gacagaatccctgagtt

SEQ ID NO: 99581 - DNA, 16 bp, H. sapiens
gacagaatctccttct

SEQ ID NO: 99582 - DNA, 16 bp, H. sapiens
gacagaatcttgctct

SEQ ID NO: 99583 - DNA, 16 bp, H. sapiens
gacagaatcttgttct

SEQ ID NO: 99584 - DNA, 16 bp, H. sapiens
gacagaatgaaactcc

SEQ ID NO: 99585 - DNA, 16 bp, H. sapiens
gacagaatggtggaat

SEQ ID NO: 99586 - DNA, 16 bp, H. sapiens
gacagaattaatggaa

SEQ ID NO: 99587 - DNA, 16 bp, H. sapiens
gacagaatttttaaaa

SEQ ID NO: 99588 - DNA, 16 bp, H. sapiens
gacagacaaggtccct

SEQ ID NO: 99589 - DNA, 16 bp, H. sapiens
gacagacacagagaca

SEQ ID NO: 99590 - DNA, 16 bp, H. sapiens
gacagacacagaggga

SEQ ID NO: 99591 - DNA, 16 bp, H. sapiens
gacagacaccaaacca

SEQ ID NO: 99592 - DNA, 16 bp, H. sapiens
gacagacagacagaaa

SEQ ID NO: 99593 - DNA, 16 bp, H. sapiens
gacagacagacagagg

SEQ ID NO: 99594 - DNA, 16 bp, H. sapiens
gacagacagagagagg

SEQ ID NO: 99595 - DNA, 16 bp, H. sapiens
gacagacagagcagca

SEQ ID NO: 99596 - DNA, 16 bp, H. sapiens
gacagacagatggaca

SEQ ID NO: 99597 - DNA, 16 bp, H. sapiens
gacagacaggcagaca

SEQ ID NO: 99598 - DNA, 16 bp, H. sapiens
gacagacatatagatc

SEQ ID NO: 99599 - DNA, 16 bp, H. sapiens
gacagaccacatatac

SEQ ID NO: 99600 - DNA, 16 bp, H. sapiens
gacagaccccacagag

SEQ ID NO: 99601 - DNA, 16 bp, H. sapiens
gacagaccgagactcc

SEQ ID NO: 99602 - DNA, 16 bp, H. sapiens
gacagactcactctgt

SEQ ID NO: 99603 - DNA, 16 bp, H. sapiens
gacagactgagaccct

SEQ ID NO: 99604 - DNA, 16 bp, H. sapiens
gacagagaaaaatttg

SEQ ID NO: 99605 - DNA, 16 bp, H. sapiens
gacagagaaataaaga

SEQ ID NO: 99606 - DNA, 16 bp, H. sapiens
gacagagacacaacca

SEQ ID NO: 99607 - DNA, 16 bp, H. sapiens
gacagagacagacaga

SEQ ID NO: 99608 - DNA, 17 bp, H. sapiens
gacagagaccctgtctc

SEQ ID NO: 99609 - DNA, 16 bp, H. sapiens
gacagagactatatgg

SEQ ID NO: 99610 - DNA, 16 bp, H. sapiens
gacagagactccattt

SEQ ID NO: 99611 - DNA, 16 bp, H. sapiens
gacagagagaaactcc

SEQ ID NO: 99612 - DNA, 16 bp, H. sapiens
gacagagagagaccat

SEQ ID NO: 99613 - DNA, 16 bp, H. sapiens
gacagagagtctcact

SEQ ID NO: 99614 - DNA, 16 bp, H. sapiens
gacagagatggacaga

SEQ ID NO: 99615 - DNA, 16 bp, H. sapiens
gacagagcaaaactgt

SEQ ID NO: 99616 - DNA, 16 bp, H. sapiens
gacagagcaagaagac

SEQ ID NO: 99617 - DNA, 16 bp, H. sapiens
gacagagcaagacctc

SEQ ID NO: 99618 - DNA, 16 bp, H. sapiens
gacagagcaagactcc

SEQ ID NO: 99619 - DNA, 19 bp, H. sapiens
gacagagcaagactctgtg

SEQ ID NO: 99620 - DNA, 22 bp, H. sapiens
gacagagcaagactgtgtctca

SEQ ID NO: 99621 - DNA, 16 bp, H. sapiens
gacagagcaagatctt

SEQ ID NO: 99622 - DNA, 16 bp, H. sapiens
gacagagcaagattcc

SEQ ID NO: 99623 - DNA, 16 bp, H. sapiens
gacagagcaagattct

SEQ ID NO: 99624 - DNA, 16 bp, H. sapiens
gacagagcaaggcctt

SEQ ID NO: 99625 - DNA, 16 bp, H. sapiens
gacagagcaaggctcc

SEQ ID NO: 99626 - DNA, 16 bp, H. sapiens
gacagagcaatactcc

SEQ ID NO: 99627 - DNA, 16 bp, H. sapiens
gacagagcagactcca

SEQ ID NO: 99628 - DNA, 16 bp, H. sapiens
gacagagcaggactcc

SEQ ID NO: 99629 - DNA, 16 bp, H. sapiens
gacagagcaggactct

SEQ ID NO: 99630 - DNA, 16 bp, H. sapiens
gacagagcatgaccct

SEQ ID NO: 99631 - DNA, 16 bp, H. sapiens
gacagagccagactcc

SEQ ID NO: 99632 - DNA, 16 bp, H. sapiens
gacagagcgaaactcc

SEQ ID NO: 99633 - DNA, 16 bp, H. sapiens
gacagagcgagacacc

SEQ ID NO: 99634 - DNA, 16 bp, H. sapiens
gacagagcgagacgcc

SEQ ID NO: 99635 - DNA, 16 bp, H. sapiens
gacagagcgagactcc

SEQ ID NO: 99636 - DNA, 16 bp, H. sapiens
gacagagcgagactcg

SEQ ID NO: 99637 - DNA, 17 bp, H. sapiens
gacagagcgagactcta

SEQ ID NO: 99638 - DNA, 16 bp, H. sapiens
gacagagcgagacttc

SEQ ID NO: 99639 - DNA, 16 bp, H. sapiens
gacagagcgagacttg

SEQ ID NO: 99640 - DNA, 16 bp, H. sapiens
gacagagcgagattcc

SEQ ID NO: 99641 - DNA, 16 bp, H. sapiens
gacagagcgaggctcc

SEQ ID NO: 99642 - DNA, 16 bp, H. sapiens
gacagagctagactcc

SEQ ID NO: 99643 - DNA, 16 bp, H. sapiens
gacagagctaggaaag

SEQ ID NO: 99644 - DNA, 16 bp, H. sapiens
gacagaggaagactcc

SEQ ID NO: 99645 - DNA, 16 bp, H. sapiens
gacagaggcagagatg

SEQ ID NO: 99646 - DNA, 16 bp, H. sapiens
gacagaggcaggagaa

SEQ ID NO: 99647 - DNA, 16 bp, H. sapiens
gacagagggaacagca

SEQ ID NO: 99648 - DNA, 16 bp, H. sapiens
gacagagggagactcc

SEQ ID NO: 99649 - DNA, 16 bp, H. sapiens
gacagagggagacttg

SEQ ID NO: 99650 - DNA, 16 bp, H. sapiens
gacagaggtggctggg

SEQ ID NO: 99651 - DNA, 16 bp, H. sapiens
gacagagtaaaactgt

SEQ ID NO: 99652 - DNA, 16 bp, H. sapiens
gacagagtaagacctt

SEQ ID NO: 99653 - DNA, 16 bp, H. sapiens
gacagagtaagactgt

SEQ ID NO: 99654 - DNA, 16 bp, H. sapiens
gacagagtctcagtca

SEQ ID NO: 99655 - DNA, 16 bp, H. sapiens
gacagagtctcagtct

SEQ ID NO: 99656 - DNA, 16 bp, H. sapiens
gacagagtctccatct

SEQ ID NO: 99657 - DNA, 16 bp, H. sapiens
gacagagtctccctgt

SEQ ID NO: 99658 - DNA, 16 bp, H. sapiens
gacagagtctcccttt

SEQ ID NO: 99659 - DNA, 16 bp, H. sapiens
gacagagtctcgttct

SEQ ID NO: 99660 - DNA, 16 bp, H. sapiens
gacagagtctctctct

SEQ ID NO: 99661 - DNA, 16 bp, H. sapiens
gacagagtctggctct

SEQ ID NO: 99662 - DNA, 16 bp, H. sapiens
gacagagtcttgctct

SEQ ID NO: 99663 - DNA, 16 bp, H. sapiens
gacagagtcttgctgt

SEQ ID NO: 99664 - DNA, 16 bp, H. sapiens
gacagagtcttgttct

SEQ ID NO: 99665 - DNA, 16 bp, H. sapiens
gacagagtgaaaccct

SEQ ID NO: 99666 - DNA, 16 bp, H. sapiens
gacagagtgaaactcc

SEQ ID NO: 99667 - DNA, 16 bp, H. sapiens
gacagagtgagacgtc

SEQ ID NO: 99668 - DNA, 16 bp, H. sapiens
gacagagtgagactat

SEQ ID NO: 99669 - DNA, 16 bp, H. sapiens
gacagagtgagactcc

SEQ ID NO: 99670 - DNA, 16 bp, H. sapiens
gacagagtgagactcg

SEQ ID NO: 99671 - DNA, 16 bp, H. sapiens
gacagagtgagatcct

SEQ ID NO: 99672 - DNA, 16 bp, H. sapiens
gacagagtgaggctgt

SEQ ID NO: 99673 - DNA, 16 bp, H. sapiens
gacagagtgtctctct

SEQ ID NO: 99674 - DNA, 16 bp, H. sapiens
gacagagtgtgtgtgt

SEQ ID NO: 99675 - DNA, 16 bp, H. sapiens
gacagagtttcgatct

SEQ ID NO: 99676 - DNA, 17 bp, H. sapiens
gacagagtttcgctcta

SEQ ID NO: 99677 - DNA, 17 bp, H. sapiens
gacagagtttcgctttg

SEQ ID NO: 99678 - DNA, 16 bp, H. sapiens
gacagagtttctttct

SEQ ID NO: 99679 - DNA, 16 bp, H. sapiens
gacagagtttggctct

SEQ ID NO: 99680 - DNA, 16 bp, H. sapiens
gacagagttttgccaa

SEQ ID NO: 99681 - DNA, 16 bp, H. sapiens
gacagataataaacaa

SEQ ID NO: 99682 - DNA, 16 bp, H. sapiens
gacagatcatcagaca

SEQ ID NO: 99683 - DNA, 16 bp, H. sapiens
gacagatccagcaggc

SEQ ID NO: 99684 - DNA, 16 bp, H. sapiens
gacagatgatttctgc

SEQ ID NO: 99685 - DNA, 16 bp, H. sapiens
gacagatggacagaca

SEQ ID NO: 99686 - DNA, 16 bp, H. sapiens
gacagatttgagctgg

SEQ ID NO: 99687 - DNA, 16 bp, H. sapiens
gacagattttcaccat

SEQ ID NO: 99688 - DNA, 16 bp, H. sapiens
gacagattttttttaa

SEQ ID NO: 99689 - DNA, 16 bp, H. sapiens
gacagcaaaaccaacc

SEQ ID NO: 99690 - DNA, 16 bp, H. sapiens
gacagcaagaccaacc

SEQ ID NO: 99691 - DNA, 16 bp, H. sapiens
gacagcaagccagtga

SEQ ID NO: 99692 - DNA, 16 bp, H. sapiens
gacagcaaggaggcca

SEQ ID NO: 99693 - DNA, 16 bp, H. sapiens
gacagcaccactgcac

SEQ ID NO: 99694 - DNA, 16 bp, H. sapiens
gacagcagcagcagca

SEQ ID NO: 99695 - DNA, 16 bp, H. sapiens
gacagcagcctggcca

SEQ ID NO: 99696 - DNA, 16 bp, H. sapiens
gacagcagggagaagc

SEQ ID NO: 99697 - DNA, 16 bp, H. sapiens
gacagcatcaagccat

SEQ ID NO: 99698 - DNA, 16 bp, H. sapiens
gacagccaagtaaaaa

SEQ ID NO: 99699 - DNA, 16 bp, H. sapiens
gacagccatctgcaag

SEQ ID NO: 99700 - DNA, 16 bp, H. sapiens
gacagccccacaacaa

SEQ ID NO: 99701 - DNA, 16 bp, H. sapiens
gacagcccctcccatc

SEQ ID NO: 99702 - DNA, 16 bp, H. sapiens
gacagcgtgagactct

SEQ ID NO: 99703 - DNA, 16 bp, H. sapiens
gacagcgtttcgctct

SEQ ID NO: 99704 - DNA, 16 bp, H. sapiens
gacagctcatctctgc

SEQ ID NO: 99705 - DNA, 16 bp, H. sapiens
gacagctgaagaaagg

SEQ ID NO: 99706 - DNA, 16 bp, H. sapiens
gacagcttgcaccatg

SEQ ID NO: 99707 - DNA, 16 bp, H. sapiens
gacagcttgcactgtg

SEQ ID NO: 99708 - DNA, 16 bp, H. sapiens
gacaggaccaggtgga

SEQ ID NO: 99709 - DNA, 16 bp, H. sapiens
gacaggacccagtgtg

SEQ ID NO: 99710 - DNA, 16 bp, H. sapiens
gacaggaggatccttt

SEQ ID NO: 99711 - DNA, 16 bp, H. sapiens
gacaggagtccagctc

SEQ ID NO: 99712 - DNA, 16 bp, H. sapiens
gacaggatcaagttca

SEQ ID NO: 99713 - DNA, 16 bp, H. sapiens
gacaggatcaattgta

SEQ ID NO: 99714 - DNA, 16 bp, H. sapiens
gacaggatctcactct

SEQ ID NO: 99715 - DNA, 16 bp, H. sapiens
gacaggatctcagtct

SEQ ID NO: 99716 - DNA, 16 bp, H. sapiens
gacaggatctcattct

SEQ ID NO: 99717 - DNA, 16 bp, H. sapiens
gacaggatcttacttt

SEQ ID NO: 99718 - DNA, 16 bp, H. sapiens
gacaggatcttcctct

SEQ ID NO: 99719 - DNA, 16 bp, H. sapiens
gacaggattttgctgt

SEQ ID NO: 99720 - DNA, 16 bp, H. sapiens
gacaggcagatggctt

SEQ ID NO: 99721 - DNA, 16 bp, H. sapiens
gacaggcagcccggcg

SEQ ID NO: 99722 - DNA, 16 bp, H. sapiens
gacaggcccaggaacc

SEQ ID NO: 99723 - DNA, 16 bp, H. sapiens
gacaggcctcagtgtg

SEQ ID NO: 99724 - DNA, 16 bp, H. sapiens
gacaggcctggtggtg

SEQ ID NO: 99725 - DNA, 16 bp, H. sapiens
gacaggcgcctgccac

SEQ ID NO: 99726 - DNA, 16 bp, H. sapiens
gacaggcttgctgggg

SEQ ID NO: 99727 - DNA, 16 bp, H. sapiens
gacaggcttttgccat

SEQ ID NO: 99728 - DNA, 16 bp, H. sapiens
gacagggacagagaga

SEQ ID NO: 99729 - DNA, 16 bp, H. sapiens
gacagggacagggaga

SEQ ID NO: 99730 - DNA, 16 bp, H. sapiens
gacagggactcactct

SEQ ID NO: 99731 - DNA, 16 bp, H. sapiens
gacagggagagactcc

SEQ ID NO: 99732 - DNA, 20 bp, H. sapiens
gacagggccaccagagggct

SEQ ID NO: 99733 - DNA, 16 bp, H. sapiens
gacagggcgagactcc

SEQ ID NO: 99734 - DNA, 16 bp, H. sapiens
gacaggggagatggag

SEQ ID NO: 99735 - DNA, 18 bp, H. sapiens
gacagggggcccttccct

SEQ ID NO: 99736 - DNA, 16 bp, H. sapiens
gacagggggtctcact

SEQ ID NO: 99737 - DNA, 16 bp, H. sapiens
gacagggtatcaccat

SEQ ID NO: 99738 - DNA, 16 bp, H. sapiens
gacagggtcgtgctct

SEQ ID NO: 99739 - DNA, 16 bp, H. sapiens
gacagggtctcacccc

SEQ ID NO: 99740 - DNA, 16 bp, H. sapiens
gacagggtctcactgt

SEQ ID NO: 99741 - DNA, 16 bp, H. sapiens
gacagggtctccctgt

SEQ ID NO: 99742 - DNA, 16 bp, H. sapiens
gacagggtctctctct

SEQ ID NO: 99743 - DNA, 16 bp, H. sapiens
gacagggtcttgctcc

SEQ ID NO: 99744 - DNA, 17 bp, H. sapiens
gacagggtcttgctcta

SEQ ID NO: 99745 - DNA, 16 bp, H. sapiens
gacagggtgagactcc

SEQ ID NO: 99746 - DNA, 21 bp, H. sapiens
gacagggtttcaccatgttga

SEQ ID NO: 99747 - DNA, 17 bp, H. sapiens
gacagggtttcaccgtg

SEQ ID NO: 99748 - DNA, 16 bp, H. sapiens
gacagggttttgccat

SEQ ID NO: 99749 - DNA, 16 bp, H. sapiens
gacagggttttgtcat

SEQ ID NO: 99750 - DNA, 16 bp, H. sapiens
gacaggtcatcaagac

SEQ ID NO: 99751 - DNA, 16 bp, H. sapiens
gacagtatttgcaagc

SEQ ID NO: 99752 - DNA, 16 bp, H. sapiens
gacagtctcgccctgt

SEQ ID NO: 99753 - DNA, 16 bp, H. sapiens
gacagtctcgctctgt

SEQ ID NO: 99754 - DNA, 16 bp, H. sapiens
gacagtctgacttcct

SEQ ID NO: 99755 - DNA, 16 bp, H. sapiens
gacagtctgttcaata

SEQ ID NO: 99756 - DNA, 16 bp, H. sapiens
gacagtcttgctctat

SEQ ID NO: 99757 - DNA, 16 bp, H. sapiens
gacagtcttgctctgt

SEQ ID NO: 99758 - DNA, 16 bp, H. sapiens
gacagtgaaagagatc

SEQ ID NO: 99759 - DNA, 16 bp, H. sapiens
gacagtgaccctcttc

SEQ ID NO: 99760 - DNA, 16 bp, H. sapiens
gacagtgagacagaga

SEQ ID NO: 99761 - DNA, 16 bp, H. sapiens
gacagtgccactgcac

SEQ ID NO: 99762 - DNA, 16 bp, H. sapiens
gacagtgccactgtac

SEQ ID NO: 99763 - DNA, 16 bp, H. sapiens
gacagtgcgagactgt

SEQ ID NO: 99764 - DNA, 16 bp, H. sapiens
gacagtgcttcctgta

SEQ ID NO: 99765 - DNA, 16 bp, H. sapiens
gacagtgggcacaggc

SEQ ID NO: 99766 - DNA, 18 bp, H. sapiens
gacagtgggtgcagccca

SEQ ID NO: 99767 - DNA, 16 bp, H. sapiens
gacagtggtggtggtg

SEQ ID NO: 99768 - DNA, 16 bp, H. sapiens
gacagtgtctcactct

SEQ ID NO: 99769 - DNA, 16 bp, H. sapiens
gacagtgtcttgctct

SEQ ID NO: 99770 - DNA, 16 bp, H. sapiens
gacagtgttgtgattc

SEQ ID NO: 99771 - DNA, 16 bp, H. sapiens
gacagtttcttaaaaa

SEQ ID NO: 99772 - DNA, 16 bp, H. sapiens
gacagtttttaaaaat

SEQ ID NO: 99773 - DNA, 16 bp, H. sapiens
gacagtttttccacgg

SEQ ID NO: 99774 - DNA, 16 bp, H. sapiens
gacataaattttgggg

SEQ ID NO: 99775 - DNA, 16 bp, H. sapiens
gacataaggtatttca

SEQ ID NO: 99776 - DNA, 16 bp, H. sapiens
gacataatttttttta

SEQ ID NO: 99777 - DNA, 18 bp, H. sapiens
gacatacaccctcccaag

SEQ ID NO: 99778 - DNA, 16 bp, H. sapiens
gacatacagaccaatg

SEQ ID NO: 99779 - DNA, 16 bp, H. sapiens
gacatagagaaagaga

SEQ ID NO: 99780 - DNA, 16 bp, H. sapiens
gacatagcgagactcc

SEQ ID NO: 99781 - DNA, 16 bp, H. sapiens
gacatatatatgtgtg

SEQ ID NO: 99782 - DNA, 16 bp, H. sapiens
gacatatctgcactcc

SEQ ID NO: 99783 - DNA, 16 bp, H. sapiens
gacatatttgataaag

SEQ ID NO: 99784 - DNA, 16 bp, H. sapiens
gacatcacatggcaag

SEQ ID NO: 99785 - DNA, 16 bp, H. sapiens
gacatcatagatgaca

SEQ ID NO: 99786 - DNA, 16 bp, H. sapiens
gacatcatcaaaatta

SEQ ID NO: 99787 - DNA, 16 bp, H. sapiens
gacatcatgatccgcc

SEQ ID NO: 99788 - DNA, 16 bp, H. sapiens
gacatccatcttctgc

SEQ ID NO: 99789 - DNA, 16 bp, H. sapiens
gacatcccaggctcaa

SEQ ID NO: 99790 - DNA, 16 bp, H. sapiens
gacatcccatcacctt

SEQ ID NO: 99791 - DNA, 16 bp, H. sapiens
gacatctgcaccccca

SEQ ID NO: 99792 - DNA, 16 bp, H. sapiens
gacatcttgatcttgg

SEQ ID NO: 99793 - DNA, 16 bp, H. sapiens
gacatcttggttgctt

SEQ ID NO: 99794 - DNA, 16 bp, H. sapiens
gacatgaaaagacatt

SEQ ID NO: 99795 - DNA, 16 bp, H. sapiens
gacatgaaagacctct

SEQ ID NO: 99796 - DNA, 16 bp, H. sapiens
gacatgaacagaaaca

SEQ ID NO: 99797 - DNA, 16 bp, H. sapiens
gacatgaacatctttg

SEQ ID NO: 99798 - DNA, 16 bp, H. sapiens
gacatgaaccactgtg

SEQ ID NO: 99799 - DNA, 16 bp, H. sapiens
gacatgaatggacact

SEQ ID NO: 99800 - DNA, 18 bp, H. sapiens
gacatgaattcatcattt

SEQ ID NO: 99801 - DNA, 16 bp, H. sapiens
gacatgagcctcctga

SEQ ID NO: 99802 - DNA, 16 bp, H. sapiens
gacatgatatctcatt

SEQ ID NO: 99803 - DNA, 16 bp, H. sapiens
gacatgatggcacatg

SEQ ID NO: 99804 - DNA, 29 bp, H. sapiens
gacatgattgtttatctagaaaaccccat

SEQ ID NO: 99805 - DNA, 16 bp, H. sapiens
gacatgatttccttct

SEQ ID NO: 99806 - DNA, 16 bp, H. sapiens
gacatgctgtacaggt

SEQ ID NO: 99807 - DNA, 16 bp, H. sapiens
gacatggaagttcatt

SEQ ID NO: 99808 - DNA, 16 bp, H. sapiens
gacatggacacacaca

SEQ ID NO: 99809 - DNA, 16 bp, H. sapiens
gacatggactcaacct

SEQ ID NO: 99810 - DNA, 16 bp, H. sapiens
gacatggagaaactgg

SEQ ID NO: 99811 - DNA, 16 bp, H. sapiens
gacatggagtcaagga

SEQ ID NO: 99812 - DNA, 16 bp, H. sapiens
gacatggatgaaattg

SEQ ID NO: 99813 - DNA, 16 bp, H. sapiens
gacatggatgaagcca

SEQ ID NO: 99814 - DNA, 16 bp, H. sapiens
gacatggatgaagttg

SEQ ID NO: 99815 - DNA, 16 bp, H. sapiens
gacatggcaaaaccct

SEQ ID NO: 99816 - DNA, 16 bp, H. sapiens
gacatggcgaaacccc

SEQ ID NO: 99817 - DNA, 16 bp, H. sapiens
gacatgggatttggga

SEQ ID NO: 99818 - DNA, 16 bp, H. sapiens
gacatggtgaaacccc

SEQ ID NO: 99819 - DNA, 16 bp, H. sapiens
gacatggtggcgcatg

SEQ ID NO: 99820 - DNA, 16 bp, H. sapiens
gacatggtggctcagg

SEQ ID NO: 99821 - DNA, 16 bp, H. sapiens
gacattaaagtaaaaa

SEQ ID NO: 99822 - DNA, 16 bp, H. sapiens
gacattaatccattca

SEQ ID NO: 99823 - DNA, 16 bp, H. sapiens
gacattacaattgata

SEQ ID NO: 99824 - DNA, 16 bp, H. sapiens
gacattagtgggaaaa

SEQ ID NO: 99825 - DNA, 16 bp, H. sapiens
gacattcaagtggaga

SEQ ID NO: 99826 - DNA, 16 bp, H. sapiens
gacattcaccccattt

SEQ ID NO: 99827 - DNA, 16 bp, H. sapiens
gacattcaggtgtttc

SEQ ID NO: 99828 - DNA, 17 bp, H. sapiens
gacattcctgccttctt

SEQ ID NO: 99829 - DNA, 16 bp, H. sapiens
gacattctacaaaata

SEQ ID NO: 99830 - DNA, 16 bp, H. sapiens
gacattctagaaaaga

SEQ ID NO: 99831 - DNA, 16 bp, H. sapiens
gacattctggaaaagg

SEQ ID NO: 99832 - DNA, 16 bp, H. sapiens
gacattctggagaagg

SEQ ID NO: 99833 - DNA, 16 bp, H. sapiens
gacattgaggcaggca

SEQ ID NO: 99834 - DNA, 16 bp, H. sapiens
gacattgtgaaacttc

SEQ ID NO: 99835 - DNA, 16 bp, H. sapiens
gacattgtgaatttta

SEQ ID NO: 99836 - DNA, 16 bp, H. sapiens
gacatttaaaaaatga

SEQ ID NO: 99837 - DNA, 16 bp, H. sapiens
gacatttacattgttt

SEQ ID NO: 99838 - DNA, 16 bp, H. sapiens
gacatttaccatctat

SEQ ID NO: 99839 - DNA, 16 bp, H. sapiens
gacatttaggttaatt

SEQ ID NO: 99840 - DNA, 16 bp, H. sapiens
gacatttcaaataaat

SEQ ID NO: 99841 - DNA, 16 bp, H. sapiens
gacatttcatatcaat

SEQ ID NO: 99842 - DNA, 16 bp, H. sapiens
gacatttcatatgaat

SEQ ID NO: 99843 - DNA, 16 bp, H. sapiens
gacatttctctaaaaa

SEQ ID NO: 99844 - DNA, 16 bp, H. sapiens
gacatttcttcaagga

SEQ ID NO: 99845 - DNA, 16 bp, H. sapiens
gacatttcttccacca

SEQ ID NO: 99846 - DNA, 16 bp, H. sapiens
gacatttgacttgttt

SEQ ID NO: 99847 - DNA, 16 bp, H. sapiens
gacatttgagcagaaa

SEQ ID NO: 99848 - DNA, 16 bp, H. sapiens
gacatttgcactgatg

SEQ ID NO: 99849 - DNA, 16 bp, H. sapiens
gacatttggacacaga

SEQ ID NO: 99850 - DNA, 16 bp, H. sapiens
gacatttggtgccaaa

SEQ ID NO: 99851 - DNA, 16 bp, H. sapiens
gacattttatagaaat

SEQ ID NO: 99852 - DNA, 16 bp, H. sapiens
gacattttatttattt

SEQ ID NO: 99853 - DNA, 16 bp, H. sapiens
gacattttcaaagaaa

SEQ ID NO: 99854 - DNA, 16 bp, H. sapiens
gacattttcctcattg

SEQ ID NO: 99855 - DNA, 16 bp, H. sapiens
gacattttggaaaagg

SEQ ID NO: 99856 - DNA, 16 bp, H. sapiens
gacattttgggctgga

SEQ ID NO: 99857 - DNA, 16 bp, H. sapiens
gacatttttaaaaaat

SEQ ID NO: 99858 - DNA, 16 bp, H. sapiens
gacatttttattttat

SEQ ID NO: 99859 - DNA, 16 bp, H. sapiens
gacatttttgagagtg

SEQ ID NO: 99860 - DNA, 16 bp, H. sapiens
gaccaaaaagggggaa

SEQ ID NO: 99861 - DNA, 16 bp, H. sapiens
gaccaaaatgttgata

SEQ ID NO: 99862 - DNA, 16 bp, H. sapiens
gaccaaaatgttgtta

SEQ ID NO: 99863 - DNA, 16 bp, H. sapiens
gaccaaacagattcac

SEQ ID NO: 99864 - DNA, 16 bp, H. sapiens
gaccaaatctatgact

SEQ ID NO: 99865 - DNA, 16 bp, H. sapiens
gaccaacagcatcagc

SEQ ID NO: 99866 - DNA, 16 bp, H. sapiens
gaccaacatctctcca

SEQ ID NO: 99867 - DNA, 16 bp, H. sapiens
gaccaacatgctgaaa

SEQ ID NO: 99868 - DNA, 16 bp, H. sapiens
gaccaacatggagaag

SEQ ID NO: 99869 - DNA, 16 bp, H. sapiens
gaccaaccagcttcaa

SEQ ID NO: 99870 - DNA, 16 bp, H. sapiens
gaccaacctggagaaa

SEQ ID NO: 99871 - DNA, 16 bp, H. sapiens
gaccaacctggccaat

SEQ ID NO: 99872 - DNA, 16 bp, H. sapiens
gaccaacctggtgaaa

SEQ ID NO: 99873 - DNA, 16 bp, H. sapiens
gaccaacgtgggcaac

SEQ ID NO: 99874 - DNA, 16 bp, H. sapiens
gaccaagaggcagcag

SEQ ID NO: 99875 - DNA, 16 bp, H. sapiens
gaccaagctggtctca

SEQ ID NO: 99876 - DNA, 16 bp, H. sapiens
gaccaagctggtctcg

SEQ ID NO: 99877 - DNA, 18 bp, H. sapiens
gaccaaggcaggcatccc

SEQ ID NO: 99878 - DNA, 16 bp, H. sapiens
gaccaatacagtgaaa

SEQ ID NO: 99879 - DNA, 16 bp, H. sapiens
gaccaatatagtgaaa

SEQ ID NO: 99880 - DNA, 16 bp, H. sapiens
gaccaatatggagaaa

SEQ ID NO: 99881 - DNA, 16 bp, H. sapiens
gaccaatctgggcaat

SEQ ID NO: 99882 - DNA, 16 bp, H. sapiens
gaccacactttcagaa

SEQ ID NO: 99883 - DNA, 16 bp, H. sapiens
gaccacactttgagaa

SEQ ID NO: 99884 - DNA, 16 bp, H. sapiens
gaccacaggcaagcac

SEQ ID NO: 99885 - DNA, 16 bp, H. sapiens
gaccacaggcaagtgc

SEQ ID NO: 99886 - DNA, 16 bp, H. sapiens
gaccacaggcacatgc

SEQ ID NO: 99887 - DNA, 16 bp, H. sapiens
gaccacaggcactcac

SEQ ID NO: 99888 - DNA, 16 bp, H. sapiens
gaccacaggtgtgtgt

SEQ ID NO: 99889 - DNA, 45 bp, H. sapiens
gaccacatacttggaagtaaagctctcctcagcaaatgtaaaaga

SEQ ID NO: 99890 - DNA, 16 bp, H. sapiens
gaccacattttgctta

SEQ ID NO: 99891 - DNA, 16 bp, H. sapiens
gaccaccaaggaaata

SEQ ID NO: 99892 - DNA, 16 bp, H. sapiens
gaccaccagcagcagc

SEQ ID NO: 99893 - DNA, 16 bp, H. sapiens
gaccaccctggccagc

SEQ ID NO: 99894 - DNA, 16 bp, H. sapiens
gaccacctcagcctcc

SEQ ID NO: 99895 - DNA, 16 bp, H. sapiens
gaccacctgctccacc

SEQ ID NO: 99896 - DNA, 17 bp, H. sapiens
gaccacgaggtcaggag

SEQ ID NO: 99897 - DNA, 18 bp, H. sapiens
gaccacgcccagctaatt

SEQ ID NO: 99898 - DNA, 16 bp, H. sapiens
gaccactctggcctgc

SEQ ID NO: 99899 - DNA, 16 bp, H. sapiens
gaccactgactcaaat

SEQ ID NO: 99900 - DNA, 16 bp, H. sapiens
gaccagaactgaagga

SEQ ID NO: 99901 - DNA, 16 bp, H. sapiens
gaccagaaggcagtga

SEQ ID NO: 99902 - DNA, 16 bp, H. sapiens
gaccagactggccagc

SEQ ID NO: 99903 - DNA, 16 bp, H. sapiens
gaccagactgggcaaa

SEQ ID NO: 99904 - DNA, 16 bp, H. sapiens
gaccagactgtgcaac

SEQ ID NO: 99905 - DNA, 16 bp, H. sapiens
gaccagcagcatcaac

SEQ ID NO: 99906 - DNA, 16 bp, H. sapiens
gaccagcagcctggcc

SEQ ID NO: 99907 - DNA, 16 bp, H. sapiens
gaccagcatagccaac

SEQ ID NO: 99908 - DNA, 16 bp, H. sapiens
gaccagccagggaaac

SEQ ID NO: 99909 - DNA, 17 bp, H. sapiens
gaccagcccggccaaca

SEQ ID NO: 99910 - DNA, 16 bp, H. sapiens
gaccagccctgccaac

SEQ ID NO: 99911 - DNA, 17 bp, H. sapiens
gaccagcctgaacaaca

SEQ ID NO: 99912 - DNA, 16 bp, H. sapiens
gaccagcctgaccagc

SEQ ID NO: 99913 - DNA, 16 bp, H. sapiens
gaccagcctggcccac

SEQ ID NO: 99914 - DNA, 16 bp, H. sapiens
gaccagcctggctcac

SEQ ID NO: 99915 - DNA, 16 bp, H. sapiens
gaccagcctgggctat

SEQ ID NO: 99916 - DNA, 16 bp, H. sapiens
gaccagcctggggaaa

SEQ ID NO: 99917 - DNA, 16 bp, H. sapiens
gaccagcctggtcacc

SEQ ID NO: 99918 - DNA, 16 bp, H. sapiens
gaccagcctgtccagc

SEQ ID NO: 99919 - DNA, 16 bp, H. sapiens
gaccagccttgccagc

SEQ ID NO: 99920 - DNA, 16 bp, H. sapiens
gaccagctgaccaaca

SEQ ID NO: 99921 - DNA, 16 bp, H. sapiens
gaccagctggtcaaca

SEQ ID NO: 99922 - DNA, 16 bp, H. sapiens
gaccagcttgggcaat

SEQ ID NO: 99923 - DNA, 16 bp, H. sapiens
gaccaggagttcgaga

SEQ ID NO: 99924 - DNA, 17 bp, H. sapiens
gaccaggatggtctcga

SEQ ID NO: 99925 - DNA, 16 bp, H. sapiens
gaccaggctggagtgt

SEQ ID NO: 99926 - DNA, 16 bp, H. sapiens
gaccaggctggccaaa

SEQ ID NO: 99927 - DNA, 16 bp, H. sapiens
gaccaggctggtcctg

SEQ ID NO: 99928 - DNA, 16 bp, H. sapiens
gaccaggctggtctag

SEQ ID NO: 99929 - DNA, 16 bp, H. sapiens
gaccaggctggtgtca

SEQ ID NO: 99930 - DNA, 16 bp, H. sapiens
gaccaggtggaggtga

SEQ ID NO: 99931 - DNA, 16 bp, H. sapiens
gaccagtagcatcagc

SEQ ID NO: 99932 - DNA, 16 bp, H. sapiens
gaccagtcagaacaga

SEQ ID NO: 99933 - DNA, 16 bp, H. sapiens
gaccagtctgggcagc

SEQ ID NO: 99934 - DNA, 16 bp, H. sapiens
gaccagtgatgatgat

SEQ ID NO: 99935 - DNA, 16 bp, H. sapiens
gaccagtggttttcaa

SEQ ID NO: 99936 - DNA, 16 bp, H. sapiens
gaccagttacagaaac

SEQ ID NO: 99937 - DNA, 16 bp, H. sapiens
gaccagttaggagact

SEQ ID NO: 99938 - DNA, 16 bp, H. sapiens
gaccataaatgtaagg

SEQ ID NO: 99939 - DNA, 16 bp, H. sapiens
gaccatactttgagaa

SEQ ID NO: 99940 - DNA, 16 bp, H. sapiens
gaccatcccggccaac

SEQ ID NO: 99941 - DNA, 16 bp, H. sapiens
gaccatcctgggcagc

SEQ ID NO: 99942 - DNA, 16 bp, H. sapiens
gaccatgaggtcagga

SEQ ID NO: 99943 - DNA, 16 bp, H. sapiens
gaccatggaaacccac

SEQ ID NO: 99944 - DNA, 16 bp, H. sapiens
gaccatggtgaaaccc

SEQ ID NO: 99945 - DNA, 16 bp, H. sapiens
gaccatgtttcaaaaa

SEQ ID NO: 99946 - DNA, 16 bp, H. sapiens
gacccaaaaatgctaa

SEQ ID NO: 99947 - DNA, 16 bp, H. sapiens
gacccaaacctttatt

SEQ ID NO: 99948 - DNA, 18 bp, H. sapiens
gacccaaagagtgagcag

SEQ ID NO: 99949 - DNA, 16 bp, H. sapiens
gacccaaaggaaatag

SEQ ID NO: 99950 - DNA, 16 bp, H. sapiens
gacccaaagggggttg

SEQ ID NO: 99951 - DNA, 16 bp, H. sapiens
gacccaagtctaaaca

SEQ ID NO: 99952 - DNA, 16 bp, H. sapiens
gacccaatttccaaat

SEQ ID NO: 99953 - DNA, 25 bp, H. sapiens
gacccaccagtgtgctgtattcagg

SEQ ID NO: 99954 - DNA, 16 bp, H. sapiens
gacccaccatgcctgg

SEQ ID NO: 99955 - DNA, 16 bp, H. sapiens
gacccacccaccttgg

SEQ ID NO: 99956 - DNA, 16 bp, H. sapiens
gacccacccccatgac

SEQ ID NO: 99957 - DNA, 16 bp, H. sapiens
gacccactgagccagg

SEQ ID NO: 99958 - DNA, 16 bp, H. sapiens
gacccacttgaggaag

SEQ ID NO: 99959 - DNA, 16 bp, H. sapiens
gacccagaatagccaa

SEQ ID NO: 99960 - DNA, 16 bp, H. sapiens
gacccagacaaaatag

SEQ ID NO: 99961 - DNA, 16 bp, H. sapiens
gacccagagaggccag

SEQ ID NO: 99962 - DNA, 16 bp, H. sapiens
gacccagcaataccat

SEQ ID NO: 99963 - DNA, 16 bp, H. sapiens
gacccagcaatcccct

SEQ ID NO: 99964 - DNA, 16 bp, H. sapiens
gacccagccctgccct

SEQ ID NO: 99965 - DNA, 16 bp, H. sapiens
gacccaggaagagcca

SEQ ID NO: 99966 - DNA, 16 bp, H. sapiens
gacccaggaagtccag

SEQ ID NO: 99967 - DNA, 16 bp, H. sapiens
gacccaggaatctcat

SEQ ID NO: 99968 - DNA, 16 bp, H. sapiens
gacccaggcatctctg

SEQ ID NO: 99969 - DNA, 16 bp, H. sapiens
gacccaggcctggcag

SEQ ID NO: 99970 - DNA, 16 bp, H. sapiens
gacccaggcctggcca

SEQ ID NO: 99971 - DNA, 16 bp, H. sapiens
gacccagtgattccat

SEQ ID NO: 99972 - DNA, 16 bp, H. sapiens
gacccatatggattca

SEQ ID NO: 99973 - DNA, 26 bp, H. sapiens
gacccatcagtgtgctgtattcagga

SEQ ID NO: 99974 - DNA, 16 bp, H. sapiens
gaccccaagagagggc

SEQ ID NO: 99975 - DNA, 16 bp, H. sapiens
gaccccaccacagctc

SEQ ID NO: 99976 - DNA, 16 bp, H. sapiens
gaccccagttgggagg

SEQ ID NO: 99977 - DNA, 17 bp, H. sapiens
gaccccatcaaaaagtg

SEQ ID NO: 99978 - DNA, 16 bp, H. sapiens
gacccccagtgcctgg

SEQ ID NO: 99979 - DNA, 16 bp, H. sapiens
gacccccgtctctaca

SEQ ID NO: 99980 - DNA, 16 bp, H. sapiens
gacccccgtgcctcct

SEQ ID NO: 99981 - DNA, 16 bp, H. sapiens
gacccctcagctgcag

SEQ ID NO: 99982 - DNA, 16 bp, H. sapiens
gacccctccaaactgt

SEQ ID NO: 99983 - DNA, 16 bp, H. sapiens
gacccctgctgggagg

SEQ ID NO: 99984 - DNA, 16 bp, H. sapiens
gacccctggaccgacc

SEQ ID NO: 99985 - DNA, 16 bp, H. sapiens
gacccctgtgcctcct

SEQ ID NO: 99986 - DNA, 16 bp, H. sapiens
gacccgagatcacacc

SEQ ID NO: 99987 - DNA, 17 bp, H. sapiens
gacccgcctggccaaca

SEQ ID NO: 99988 - DNA, 16 bp, H. sapiens
gacccgcctgggcaac

SEQ ID NO: 99989 - DNA, 27 bp, H. sapiens
gaccctacttagtcatctatagtaccc

SEQ ID NO: 99990 - DNA, 16 bp, H. sapiens
gaccctcagagccagg

SEQ ID NO: 99991 - DNA, 16 bp, H. sapiens
gaccctccagccccag

SEQ ID NO: 99992 - DNA, 16 bp, H. sapiens
gaccctcccacctcgg

SEQ ID NO: 99993 - DNA, 16 bp, H. sapiens
gaccctccgcctggca

SEQ ID NO: 99994 - DNA, 41 bp, H. sapiens
gaccctccgcgaatcccggcctccggagaccgtcctggtaa

SEQ ID NO: 99995 - DNA, 16 bp, H. sapiens
gaccctcggagccagg

SEQ ID NO: 99996 - DNA, 16 bp, H. sapiens
gaccctctgccttatc

SEQ ID NO: 99997 - DNA, 16 bp, H. sapiens
gaccctgaaacttgga

SEQ ID NO: 99998 - DNA, 16 bp, H. sapiens
gaccctgaacagaggg

SEQ ID NO: 99999 - DNA, 16 bp, H. sapiens
gaccctgaatggaggg

SEQ ID NO: 100000 - DNA, 16 bp, H. sapiens
gaccctgactccaaaa

SEQ ID NO: 100001 - DNA, 16 bp, H. sapiens
gaccctgagcaagtca

SEQ ID NO: 100002 - DNA, 16 bp, H. sapiens
gaccctgcagctctgg

SEQ ID NO: 100003 - DNA, 16 bp, H. sapiens
gaccctgcccttctct

SEQ ID NO: 100004 - DNA, 16 bp, H. sapiens
gaccctgcctcaaaac

SEQ ID NO: 100005 - DNA, 16 bp, H. sapiens
gaccctggccctggcc

SEQ ID NO: 100006 - DNA, 16 bp, H. sapiens
gaccctgggcctggcc

SEQ ID NO: 100007 - DNA, 16 bp, H. sapiens
gaccctgggcctggct

SEQ ID NO: 100008 - DNA, 16 bp, H. sapiens
gaccctgggctcagcc

SEQ ID NO: 100009 - DNA, 16 bp, H. sapiens
gaccctggggccttcc

SEQ ID NO: 100010 - DNA, 16 bp, H. sapiens
gaccctgtctctccaa

SEQ ID NO: 100011 - DNA, 16 bp, H. sapiens
gaccctgtctgtattt

SEQ ID NO: 100012 - DNA, 16 bp, H. sapiens
gaccctgtggccatga

SEQ ID NO: 100013 - DNA, 16 bp, H. sapiens
gaccctgtggccttcc

SEQ ID NO: 100014 - DNA, 16 bp, H. sapiens
gaccctgtgtcaaaat

SEQ ID NO: 100015 - DNA, 16 bp, H. sapiens
gaccctgtttcaaaac

SEQ ID NO: 100016 - DNA, 16 bp, H. sapiens
gacccttgaacaacaa

SEQ ID NO: 100017 - DNA, 16 bp, H. sapiens
gaccctttccttacac

SEQ ID NO: 100018 - DNA, 16 bp, H. sapiens
gaccgacctggccaac

SEQ ID NO: 100019 - DNA, 16 bp, H. sapiens
gaccgtcctggccaac

SEQ ID NO: 100020 - DNA, 16 bp, H. sapiens
gacctaaacataaaag

SEQ ID NO: 100021 - DNA, 16 bp, H. sapiens
gacctaaagtgatcca

SEQ ID NO: 100022 - DNA, 29 bp, H. sapiens
gacctaatagacatctacagaactctcca

SEQ ID NO: 100023 - DNA, 16 bp, H. sapiens
gacctacaaagagaca

SEQ ID NO: 100024 - DNA, 30 bp, H. sapiens
gacctacaaagagacttagactcccacaca

SEQ ID NO: 100025 - DNA, 16 bp, H. sapiens
gacctacagaatcaga

SEQ ID NO: 100026 - DNA, 16 bp, H. sapiens
gacctacctggccaac

SEQ ID NO: 100027 - DNA, 16 bp, H. sapiens
gacctactggatcaga

SEQ ID NO: 100028 - DNA, 30 bp, H. sapiens
gacctagaaagagacttagactcccacaca

SEQ ID NO: 100029 - DNA, 16 bp, H. sapiens
gacctatggtagaaaa

SEQ ID NO: 100030 - DNA, 16 bp, H. sapiens
gacctcaagccatcca

SEQ ID NO: 100031 - DNA, 16 bp, H. sapiens
gacctcaagccatcct

SEQ ID NO: 100032 - DNA, 16 bp, H. sapiens
gacctcactttgagaa

SEQ ID NO: 100033 - DNA, 16 bp, H. sapiens
gacctcagagaaagcc

SEQ ID NO: 100034 - DNA, 16 bp, H. sapiens
gacctcagatgattca

SEQ ID NO: 100035 - DNA, 16 bp, H. sapiens
gacctcagcagaggag

SEQ ID NO: 100036 - DNA, 16 bp, H. sapiens
gacctcagcatgggct

SEQ ID NO: 100037 - DNA, 16 bp, H. sapiens
gacctcagcctcccag

SEQ ID NO: 100038 - DNA, 16 bp, H. sapiens
gacctcagcttcctga

SEQ ID NO: 100039 - DNA, 16 bp, H. sapiens
gacctcaggggatccg

SEQ ID NO: 100040 - DNA, 16 bp, H. sapiens
gacctcaggtggtcca

SEQ ID NO: 100041 - DNA, 16 bp, H. sapiens
gacctcagtttcccca

SEQ ID NO: 100042 - DNA, 16 bp, H. sapiens
gacctcagtttcctca

SEQ ID NO: 100043 - DNA, 16 bp, H. sapiens
gacctcagttttctca

SEQ ID NO: 100044 - DNA, 16 bp, H. sapiens
gacctcatcagcctgg

SEQ ID NO: 100045 - DNA, 16 bp, H. sapiens
gacctcatcatccacc

SEQ ID NO: 100046 - DNA, 16 bp, H. sapiens
gacctcatctctacca

SEQ ID NO: 100047 - DNA, 16 bp, H. sapiens
gacctcatctctgaaa

SEQ ID NO: 100048 - DNA, 16 bp, H. sapiens
gacctcatgaactgcc

SEQ ID NO: 100049 - DNA, 16 bp, H. sapiens
gacctcatgaatggga

SEQ ID NO: 100050 - DNA, 16 bp, H. sapiens
gacctcatgagccacc

SEQ ID NO: 100051 - DNA, 16 bp, H. sapiens
gacctccagcaaacac

SEQ ID NO: 100052 - DNA, 16 bp, H. sapiens
gacctccagcctccag

SEQ ID NO: 100053 - DNA, 16 bp, H. sapiens
gacctcccaaaatgct

SEQ ID NO: 100054 - DNA, 16 bp, H. sapiens
gacctcccaactgggg

SEQ ID NO: 100055 - DNA, 16 bp, H. sapiens
gacctccctcccccag

SEQ ID NO: 100056 - DNA, 16 bp, H. sapiens
gacctccctggctcag

SEQ ID NO: 100057 - DNA, 16 bp, H. sapiens
gacctcctggacccaa

SEQ ID NO: 100058 - DNA, 16 bp, H. sapiens
gacctcctggacttaa

SEQ ID NO: 100059 - DNA, 16 bp, H. sapiens
gacctcctgggcacaa

SEQ ID NO: 100060 - DNA, 16 bp, H. sapiens
gacctcctggtctcaa

SEQ ID NO: 100061 - DNA, 16 bp, H. sapiens
gacctcgggatccgcc

SEQ ID NO: 100062 - DNA, 16 bp, H. sapiens
gacctcgtgagccgcc

SEQ ID NO: 100063 - DNA, 16 bp, H. sapiens
gacctctcacctggat

SEQ ID NO: 100064 - DNA, 16 bp, H. sapiens
gacctctcagcagaaa

SEQ ID NO: 100065 - DNA, 16 bp, H. sapiens
gacctctgacctccag

SEQ ID NO: 100066 - DNA, 16 bp, H. sapiens
gacctctgcccaccat

SEQ ID NO: 100067 - DNA, 16 bp, H. sapiens
gacctctgggcctgtg

SEQ ID NO: 100068 - DNA, 16 bp, H. sapiens
gacctctgtctcccag

SEQ ID NO: 100069 - DNA, 16 bp, H. sapiens
gacctcttcaagaaga

SEQ ID NO: 100070 - DNA, 16 bp, H. sapiens
gacctgaagctataaa

SEQ ID NO: 100071 - DNA, 16 bp, H. sapiens
gacctgaagctgaggg

SEQ ID NO: 100072 - DNA, 16 bp, H. sapiens
gacctgaaggaggtga

SEQ ID NO: 100073 - DNA, 16 bp, H. sapiens
gacctgactattagaa

SEQ ID NO: 100074 - DNA, 18 bp, H. sapiens
gacctgaggtcaggagtt

SEQ ID NO: 100075 - DNA, 16 bp, H. sapiens
gacctgatgaagctga

SEQ ID NO: 100076 - DNA, 17 bp, H. sapiens
gacctgatgcagctgaa

SEQ ID NO: 100077 - DNA, 16 bp, H. sapiens
gacctgatggggctga

SEQ ID NO: 100078 - DNA, 16 bp, H. sapiens
gacctgcagaatcaga

SEQ ID NO: 100079 - DNA, 16 bp, H. sapiens
gacctgcccaaggcca

SEQ ID NO: 100080 - DNA, 16 bp, H. sapiens
gacctgcccaaggtca

SEQ ID NO: 100081 - DNA, 16 bp, H. sapiens
gacctgcccaggctcc

SEQ ID NO: 100082 - DNA, 16 bp, H. sapiens
gacctgccccccatga

SEQ ID NO: 100083 - DNA, 16 bp, H. sapiens
gacctgccctcatgat

SEQ ID NO: 100084 - DNA, 16 bp, H. sapiens
gacctgcctcttctct

SEQ ID NO: 100085 - DNA, 16 bp, H. sapiens
gacctgcctgaggttg

SEQ ID NO: 100086 - DNA, 16 bp, H. sapiens
gacctgcctgcctcag

SEQ ID NO: 100087 - DNA, 16 bp, H. sapiens
gacctgccttacagga

SEQ ID NO: 100088 - DNA, 16 bp, H. sapiens
gacctggaaccaaccc

SEQ ID NO: 100089 - DNA, 16 bp, H. sapiens
gacctggaagccctct

SEQ ID NO: 100090 - DNA, 16 bp, H. sapiens
gacctggccaacatgg

SEQ ID NO: 100091 - DNA, 16 bp, H. sapiens
gacctggctatggcca

SEQ ID NO: 100092 - DNA, 21 bp, H. sapiens
gacctggggttcttggcctca

SEQ ID NO: 100093 - DNA, 16 bp, H. sapiens
gacctggtgatctgcc

SEQ ID NO: 100094 - DNA, 16 bp, H. sapiens
gacctgtaatcccagc

SEQ ID NO: 100095 - DNA, 16 bp, H. sapiens
gaccttatggagctga

SEQ ID NO: 100096 - DNA, 16 bp, H. sapiens
gaccttcaaagagatt

SEQ ID NO: 100097 - DNA, 16 bp, H. sapiens
gaccttccaggctcaa

SEQ ID NO: 100098 - DNA, 16 bp, H. sapiens
gaccttctatctcatc

SEQ ID NO: 100099 - DNA, 16 bp, H. sapiens
gaccttgaataagtca

SEQ ID NO: 100100 - DNA, 16 bp, H. sapiens
gaccttgagcaagtga

SEQ ID NO: 100101 - DNA, 16 bp, H. sapiens
gaccttggaaaatctg

SEQ ID NO: 100102 - DNA, 16 bp, H. sapiens
gaccttggacaagcca

SEQ ID NO: 100103 - DNA, 16 bp, H. sapiens
gaccttggacaggtca

SEQ ID NO: 100104 - DNA, 16 bp, H. sapiens
gaccttggctcaccac

SEQ ID NO: 100105 - DNA, 16 bp, H. sapiens
gaccttgggaaagtca

SEQ ID NO: 100106 - DNA, 16 bp, H. sapiens
gaccttgggcaagtta

SEQ ID NO: 100107 - DNA, 16 bp, H. sapiens
gaccttgggcaagttc

SEQ ID NO: 100108 - DNA, 16 bp, H. sapiens
gaccttgggcaagttg

SEQ ID NO: 100109 - DNA, 17 bp, H. sapiens
gaccttgtttgcctggg

SEQ ID NO: 100110 - DNA, 16 bp, H. sapiens
gacctttctctctctc

SEQ ID NO: 100111 - DNA, 16 bp, H. sapiens
gacctttgtcacatgc

SEQ ID NO: 100112 - DNA, 16 bp, H. sapiens
gaccttttaaagctga

SEQ ID NO: 100113 - DNA, 16 bp, H. sapiens
gacgaaactccatctc

SEQ ID NO: 100114 - DNA, 16 bp, H. sapiens
gacgaaccttgaaaac

SEQ ID NO: 100115 - DNA, 16 bp, H. sapiens
gacgagactctgtctc

SEQ ID NO: 100116 - DNA, 16 bp, H. sapiens
gacgatcctggccaac

SEQ ID NO: 100117 - DNA, 16 bp, H. sapiens
gacgatgggcggccgg

SEQ ID NO: 100118 - DNA, 16 bp, H. sapiens
gacgcacatgaaattt

SEQ ID NO: 100119 - DNA, 16 bp, H. sapiens
gacgcaggttgcagtg

SEQ ID NO: 100120 - DNA, 16 bp, H. sapiens
gacgctgaggcaggag

SEQ ID NO: 100121 - DNA, 21 bp, H. sapiens
gacgctgaggtgggaggatca

SEQ ID NO: 100122 - DNA, 16 bp, H. sapiens
gacggaatttcgctct

SEQ ID NO: 100123 - DNA, 16 bp, H. sapiens
gacggacagacagaca

SEQ ID NO: 100124 - DNA, 16 bp, H. sapiens
gacggagagaatggaa

SEQ ID NO: 100125 - DNA, 16 bp, H. sapiens
gacggaggcaggagaa

SEQ ID NO: 100126 - DNA, 16 bp, H. sapiens
gacggagtctcactcc

SEQ ID NO: 100127 - DNA, 16 bp, H. sapiens
gacggagtcttgctgt

SEQ ID NO: 100128 - DNA, 16 bp, H. sapiens
gacggccagtgatgat

SEQ ID NO: 100129 - DNA, 16 bp, H. sapiens
gacggggctgctggcc

SEQ ID NO: 100130 - DNA, 16 bp, H. sapiens
gacggggtctcgctgt

SEQ ID NO: 100131 - DNA, 16 bp, H. sapiens
gacggggtggctgggc

SEQ ID NO: 100132 - DNA, 16 bp, H. sapiens
gacggggttacaccat

SEQ ID NO: 100133 - DNA, 16 bp, H. sapiens
gacggggtttcaccct

SEQ ID NO: 100134 - DNA, 16 bp, H. sapiens
gacggggtttcgccgt

SEQ ID NO: 100135 - DNA, 16 bp, H. sapiens
gacgggtggatcatga

SEQ ID NO: 100136 - DNA, 17 bp, H. sapiens
gacggtggctcacgcct

SEQ ID NO: 100137 - DNA, 16 bp, H. sapiens
gacggtgtctcactct

SEQ ID NO: 100138 - DNA, 16 bp, H. sapiens
gacgtcatgatccacc

SEQ ID NO: 100139 - DNA, 16 bp, H. sapiens
gacgtgagccacctca

SEQ ID NO: 100140 - DNA, 16 bp, H. sapiens
gacgtggtggcgcatg

SEQ ID NO: 100141 - DNA, 16 bp, H. sapiens
gacgtggtggcgggtg

SEQ ID NO: 100142 - DNA, 16 bp, H. sapiens
gacgtgtgccaccatg

SEQ ID NO: 100143 - DNA, 16 bp, H. sapiens
gacgttgcagtgagcc

SEQ ID NO: 100144 - DNA, 16 bp, H. sapiens
gactaacattagccac

SEQ ID NO: 100145 - DNA, 16 bp, H. sapiens
gactaactttttgtat

SEQ ID NO: 100146 - DNA, 16 bp, H. sapiens
gactacagacacaagc

SEQ ID NO: 100147 - DNA, 16 bp, H. sapiens
gactacaggaacatac

SEQ ID NO: 100148 - DNA, 16 bp, H. sapiens
gactacaggcaggtgc

SEQ ID NO: 100149 - DNA, 16 bp, H. sapiens
gactacaggcctgtgc

SEQ ID NO: 100150 - DNA, 16 bp, H. sapiens
gactacaggtgcacag

SEQ ID NO: 100151 - DNA, 16 bp, H. sapiens
gactacaggtgtgcgt

SEQ ID NO: 100152 - DNA, 16 bp, H. sapiens
gactacatctgcaaag

SEQ ID NO: 100153 - DNA, 16 bp, H. sapiens
gactacatttcccaga

SEQ ID NO: 100154 - DNA, 16 bp, H. sapiens
gactacattttgagaa

SEQ ID NO: 100155 - DNA, 16 bp, H. sapiens
gactaccagctgcaga

SEQ ID NO: 100156 - DNA, 16 bp, H. sapiens
gactactactcagcca

SEQ ID NO: 100157 - DNA, 16 bp, H. sapiens
gactagatctcattct

SEQ ID NO: 100158 - DNA, 16 bp, H. sapiens
gactagcctaggcaat

SEQ ID NO: 100159 - DNA, 17 bp, H. sapiens
gactaggagcgtgacca

SEQ ID NO: 100160 - DNA, 16 bp, H. sapiens
gactataaaacccctg

SEQ ID NO: 100161 - DNA, 16 bp, H. sapiens
gactataatcccagct

SEQ ID NO: 100162 - DNA, 16 bp, H. sapiens
gactataggcatgtgc

SEQ ID NO: 100163 - DNA, 16 bp, H. sapiens
gactatagtcaataac

SEQ ID NO: 100164 - DNA, 16 bp, H. sapiens
gactatagttgataat

SEQ ID NO: 100165 - DNA, 16 bp, H. sapiens
gactatcaaaaatagt

SEQ ID NO: 100166 - DNA, 18 bp, H. sapiens
gactatgcagccataaaa

SEQ ID NO: 100167 - DNA, 16 bp, H. sapiens
gactcaaaatagccaa

SEQ ID NO: 100168 - DNA, 16 bp, H. sapiens
gactcaaataaataaa

SEQ ID NO: 100169 - DNA, 16 bp, H. sapiens
gactcaagggctgctg

SEQ ID NO: 100170 - DNA, 16 bp, H. sapiens
gactcacaagaagttg

SEQ ID NO: 100171 - DNA, 16 bp, H. sapiens
gactcacaattccaca

SEQ ID NO: 100172 - DNA, 16 bp, H. sapiens
gactcacagcaacctc

SEQ ID NO: 100173 - DNA, 16 bp, H. sapiens
gactcacagccaaatt

SEQ ID NO: 100174 - DNA, 16 bp, H. sapiens
gactcacagttccaca

SEQ ID NO: 100175 - DNA, 16 bp, H. sapiens
gactcacctttccact

SEQ ID NO: 100176 - DNA, 16 bp, H. sapiens
gactcagcagaggcag

SEQ ID NO: 100177 - DNA, 26 bp, H. sapiens
gactcagcccacctgcacccaggtga

SEQ ID NO: 100178 - DNA, 16 bp, H. sapiens
gactcagcccaggtca

SEQ ID NO: 100179 - DNA, 16 bp, H. sapiens
gactcagcctcctgag

SEQ ID NO: 100180 - DNA, 16 bp, H. sapiens
gactcagccttctgag

SEQ ID NO: 100181 - DNA, 16 bp, H. sapiens
gactcagttctgcatg

SEQ ID NO: 100182 - DNA, 17 bp, H. sapiens
gactcagtttattctag

SEQ ID NO: 100183 - DNA, 16 bp, H. sapiens
gactcagtttccctct

SEQ ID NO: 100184 - DNA, 16 bp, H. sapiens
gactccaaagcctgtg

SEQ ID NO: 100185 - DNA, 16 bp, H. sapiens
gactccaattctgaaa

SEQ ID NO: 100186 - DNA, 16 bp, H. sapiens
gactccacaggcaggg

SEQ ID NO: 100187 - DNA, 16 bp, H. sapiens
gactccaccagctgca

SEQ ID NO: 100188 - DNA, 16 bp, H. sapiens
gactccacttctgggg

SEQ ID NO: 100189 - DNA, 16 bp, H. sapiens
gactccagaactgtga

SEQ ID NO: 100190 - DNA, 16 bp, H. sapiens
gactccagagcccaca

SEQ ID NO: 100191 - DNA, 16 bp, H. sapiens
gactccagagctgtga

SEQ ID NO: 100192 - DNA, 16 bp, H. sapiens
gactccagagtagctg

SEQ ID NO: 100193 - DNA, 16 bp, H. sapiens
gactccagagttccaa

SEQ ID NO: 100194 - DNA, 16 bp, H. sapiens
gactccagcctccaga

SEQ ID NO: 100195 - DNA, 16 bp, H. sapiens
gactccagggtctgag

SEQ ID NO: 100196 - DNA, 16 bp, H. sapiens
gactccagtctcaaaa

SEQ ID NO: 100197 - DNA, 16 bp, H. sapiens
gactccagtctgggtg

SEQ ID NO: 100198 - DNA, 16 bp, H. sapiens
gactccatcctcccag

SEQ ID NO: 100199 - DNA, 16 bp, H. sapiens
gactccatctctgaaa

SEQ ID NO: 100200 - DNA, 16 bp, H. sapiens
gactccatctttacaa

SEQ ID NO: 100201 - DNA, 16 bp, H. sapiens
gactccatttaaaaaa

SEQ ID NO: 100202 - DNA, 16 bp, H. sapiens
gactcccagcccagtg

SEQ ID NO: 100203 - DNA, 16 bp, H. sapiens
gactcccagtccagtg

SEQ ID NO: 100204 - DNA, 16 bp, H. sapiens
gactccccagacccct

SEQ ID NO: 100205 - DNA, 16 bp, H. sapiens
gactccctcctcctcc

SEQ ID NO: 100206 - DNA, 16 bp, H. sapiens
gactccctctttttct

SEQ ID NO: 100207 - DNA, 16 bp, H. sapiens
gactccctggttcagg

SEQ ID NO: 100208 - DNA, 17 bp, H. sapiens
gactccggaggacaagg

SEQ ID NO: 100209 - DNA, 16 bp, H. sapiens
gactcctcctcctcct

SEQ ID NO: 100210 - DNA, 16 bp, H. sapiens
gactcctgacctcaag

SEQ ID NO: 100211 - DNA, 16 bp, H. sapiens
gactcctgacctccag

SEQ ID NO: 100212 - DNA, 16 bp, H. sapiens
gactcctgctgggagg

SEQ ID NO: 100213 - DNA, 18 bp, H. sapiens
gactcctgggctcaagcg

SEQ ID NO: 100214 - DNA, 16 bp, H. sapiens
gactcctgggcttaag

SEQ ID NO: 100215 - DNA, 16 bp, H. sapiens
gactcctgggtctgag

SEQ ID NO: 100216 - DNA, 17 bp, H. sapiens
gactcctgggttcaagc

SEQ ID NO: 100217 - DNA, 16 bp, H. sapiens
gactccttgggaaaac

SEQ ID NO: 100218 - DNA, 16 bp, H. sapiens
gactctgcagatgtga

SEQ ID NO: 100219 - DNA, 16 bp, H. sapiens
gactctgccatttact

SEQ ID NO: 100220 - DNA, 16 bp, H. sapiens
gactctgtctcgggaa

SEQ ID NO: 100221 - DNA, 16 bp, H. sapiens
gactctgtcttaaaag

SEQ ID NO: 100222 - DNA, 16 bp, H. sapiens
gactctgtcttggaaa

SEQ ID NO: 100223 - DNA, 16 bp, H. sapiens
gactctgtgagggtcc

SEQ ID NO: 100224 - DNA, 16 bp, H. sapiens
gactctgtgtggggct

SEQ ID NO: 100225 - DNA, 16 bp, H. sapiens
gactctgtttccaaaa

SEQ ID NO: 100226 - DNA, 16 bp, H. sapiens
gactcttgcagccaga

SEQ ID NO: 100227 - DNA, 16 bp, H. sapiens
gactctttatccagct

SEQ ID NO: 100228 - DNA, 16 bp, H. sapiens
gactcttttacattat

SEQ ID NO: 100229 - DNA, 16 bp, H. sapiens
gactgaaagaaaaatg

SEQ ID NO: 100230 - DNA, 16 bp, H. sapiens
gactgaaagaaaataa

SEQ ID NO: 100231 - DNA, 16 bp, H. sapiens
gactgaagtgatcctc

SEQ ID NO: 100232 - DNA, 16 bp, H. sapiens
gactgaagtgggagaa

SEQ ID NO: 100233 - DNA, 16 bp, H. sapiens
gactgacagctgactt

SEQ ID NO: 100234 - DNA, 16 bp, H. sapiens
gactgactgactgaat

SEQ ID NO: 100235 - DNA, 16 bp, H. sapiens
gactgagaaactgaat

SEQ ID NO: 100236 - DNA, 16 bp, H. sapiens
gactgagacagaagaa

SEQ ID NO: 100237 - DNA, 16 bp, H. sapiens
gactgagaccctgcct

SEQ ID NO: 100238 - DNA, 16 bp, H. sapiens
gactgagccagactcc

SEQ ID NO: 100239 - DNA, 16 bp, H. sapiens
gactgaggcaggagat

SEQ ID NO: 100240 - DNA, 16 bp, H. sapiens
gactgaggtccctgtt

SEQ ID NO: 100241 - DNA, 16 bp, H. sapiens
gactgcactttgagaa

SEQ ID NO: 100242 - DNA, 16 bp, H. sapiens
gactgcagccacccct

SEQ ID NO: 100243 - DNA, 16 bp, H. sapiens
gactgcagccccagct

SEQ ID NO: 100244 - DNA, 16 bp, H. sapiens
gactgcaggtgcatgc

SEQ ID NO: 100245 - DNA, 16 bp, H. sapiens
gactgcagtggcagga

SEQ ID NO: 100246 - DNA, 16 bp, H. sapiens
gactgcagtggcataa

SEQ ID NO: 100247 - DNA, 16 bp, H. sapiens
gactgcatttttaaaa

SEQ ID NO: 100248 - DNA, 16 bp, H. sapiens
gactgccctaaaagag

SEQ ID NO: 100249 - DNA, 16 bp, H. sapiens
gactgcctgcagggtc

SEQ ID NO: 100250 - DNA, 16 bp, H. sapiens
gactgccttctttcac

SEQ ID NO: 100251 - DNA, 16 bp, H. sapiens
gactgctgccatgtaa

SEQ ID NO: 100252 - DNA, 16 bp, H. sapiens
gactgctgggaaggca

SEQ ID NO: 100253 - DNA, 16 bp, H. sapiens
gactgctgggatgggc

SEQ ID NO: 100254 - DNA, 16 bp, H. sapiens
gactgctgtggggtgg

SEQ ID NO: 100255 - DNA, 16 bp, H. sapiens
gactgcttgagttcag

SEQ ID NO: 100256 - DNA, 16 bp, H. sapiens
gactgcttgggcccag

SEQ ID NO: 100257 - DNA, 16 bp, H. sapiens
gactggaaggcctcag

SEQ ID NO: 100258 - DNA, 16 bp, H. sapiens
gactggaagtttcctg

SEQ ID NO: 100259 - DNA, 16 bp, H. sapiens
gactggaatagtttca

SEQ ID NO: 100260 - DNA, 16 bp, H. sapiens
gactggactgcagtgg

SEQ ID NO: 100261 - DNA, 16 bp, H. sapiens
gactggagagagaaaa

SEQ ID NO: 100262 - DNA, 16 bp, H. sapiens
gactggagctgctcct

SEQ ID NO: 100263 - DNA, 16 bp, H. sapiens
gactggagctgctgcc

SEQ ID NO: 100264 - DNA, 16 bp, H. sapiens
gactggagggagggag

SEQ ID NO: 100265 - DNA, 16 bp, H. sapiens
gactggagtgcaatgg

SEQ ID NO: 100266 - DNA, 16 bp, H. sapiens
gactggagttcagtgg

SEQ ID NO: 100267 - DNA, 16 bp, H. sapiens
gactggataatttttt

SEQ ID NO: 100268 - DNA, 16 bp, H. sapiens
gactggatcatgaagg

SEQ ID NO: 100269 - DNA, 16 bp, H. sapiens
gactggatccttccct

SEQ ID NO: 100270 - DNA, 16 bp, H. sapiens
gactggattatttcaa

SEQ ID NO: 100271 - DNA, 16 bp, H. sapiens
gactggcaaaacagaa

SEQ ID NO: 100272 - DNA, 16 bp, H. sapiens
gactggcaaagcagaa

SEQ ID NO: 100273 - DNA, 16 bp, H. sapiens
gactggcctgaccaac

SEQ ID NO: 100274 - DNA, 16 bp, H. sapiens
gactggccttgtcttc

SEQ ID NO: 100275 - DNA, 16 bp, H. sapiens
gactggctgatttcac

SEQ ID NO: 100276 - DNA, 16 bp, H. sapiens
gactggctgtccttgc

SEQ ID NO: 100277 - DNA, 16 bp, H. sapiens
gactggcttccttact

SEQ ID NO: 100278 - DNA, 16 bp, H. sapiens
gactgggagaagcaga

SEQ ID NO: 100279 - DNA, 16 bp, H. sapiens
gactgggagaggcaga

SEQ ID NO: 100280 - DNA, 16 bp, H. sapiens
gactgggcatggtggc

SEQ ID NO: 100281 - DNA, 16 bp, H. sapiens
gactgggcgcagtggc

SEQ ID NO: 100282 - DNA, 16 bp, H. sapiens
gactgggctcagctgg

SEQ ID NO: 100283 - DNA, 16 bp, H. sapiens
gactgggcttggtggc

SEQ ID NO: 100284 - DNA, 16 bp, H. sapiens
gactggggaggcctca

SEQ ID NO: 100285 - DNA, 16 bp, H. sapiens
gactggggtgcaatgg

SEQ ID NO: 100286 - DNA, 16 bp, H. sapiens
gactgggtgacagaga

SEQ ID NO: 100287 - DNA, 16 bp, H. sapiens
gactgggtggcttcaa

SEQ ID NO: 100288 - DNA, 16 bp, H. sapiens
gactgggtggcttgaa

SEQ ID NO: 100289 - DNA, 16 bp, H. sapiens
gactgggttttgctct

SEQ ID NO: 100290 - DNA, 16 bp, H. sapiens
gactggtgcatttaca

SEQ ID NO: 100291 - DNA, 16 bp, H. sapiens
gactggtgttagatgg

SEQ ID NO: 100292 - DNA, 16 bp, H. sapiens
gactgtaagcttcctg

SEQ ID NO: 100293 - DNA, 16 bp, H. sapiens
gactgtaatttataaa

SEQ ID NO: 100294 - DNA, 16 bp, H. sapiens
gactgtagggaaggca

SEQ ID NO: 100295 - DNA, 16 bp, H. sapiens
gactgtatttttcctt

SEQ ID NO: 100296 - DNA, 16 bp, H. sapiens
gactgtcaggcctctg

SEQ ID NO: 100297 - DNA, 16 bp, H. sapiens
gactgtcctgggcaaa

SEQ ID NO: 100298 - DNA, 16 bp, H. sapiens
gactgtctccagaaaa

SEQ ID NO: 100299 - DNA, 16 bp, H. sapiens
gactgtcttcccaagt

SEQ ID NO: 100300 - DNA, 16 bp, H. sapiens
gactgtgacagtttct

SEQ ID NO: 100301 - DNA, 16 bp, H. sapiens
gactgtgagaaataaa

SEQ ID NO: 100302 - DNA, 16 bp, H. sapiens
gactgtgagcttcctg

SEQ ID NO: 100303 - DNA, 16 bp, H. sapiens
gactgtggccctcttc

SEQ ID NO: 100304 - DNA, 16 bp, H. sapiens
gactgtggctgctgcc

SEQ ID NO: 100305 - DNA, 16 bp, H. sapiens
gactgtggtggggtgg

SEQ ID NO: 100306 - DNA, 16 bp, H. sapiens
gactgtgtctcaagaa

SEQ ID NO: 100307 - DNA, 16 bp, H. sapiens
gactgtgttccttctg

SEQ ID NO: 100308 - DNA, 16 bp, H. sapiens
gactgttcccagtgta

SEQ ID NO: 100309 - DNA, 16 bp, H. sapiens
gactgttccttttgcc

SEQ ID NO: 100310 - DNA, 16 bp, H. sapiens
gacttaaagtgagaga

SEQ ID NO: 100311 - DNA, 16 bp, H. sapiens
gacttaacagatacat

SEQ ID NO: 100312 - DNA, 16 bp, H. sapiens
gacttaactgtaaaac

SEQ ID NO: 100313 - DNA, 19 bp, H. sapiens
gacttacaagggatgtgaa

SEQ ID NO: 100314 - DNA, 16 bp, H. sapiens
gacttaccatatgacc

SEQ ID NO: 100315 - DNA, 16 bp, H. sapiens
gacttattttcctttg

SEQ ID NO: 100316 - DNA, 16 bp, H. sapiens
gacttatttttattat

SEQ ID NO: 100317 - DNA, 16 bp, H. sapiens
gacttcaagccatcct

SEQ ID NO: 100318 - DNA, 16 bp, H. sapiens
gacttcaagtgatctt

SEQ ID NO: 100319 - DNA, 16 bp, H. sapiens
gacttcaatattccac

SEQ ID NO: 100320 - DNA, 16 bp, H. sapiens
gacttcaccttgtgat

SEQ ID NO: 100321 - DNA, 16 bp, H. sapiens
gacttcagattttttt

SEQ ID NO: 100322 - DNA, 16 bp, H. sapiens
gacttcagctcactgc

SEQ ID NO: 100323 - DNA, 16 bp, H. sapiens
gacttcagggaagaga

SEQ ID NO: 100324 - DNA, 16 bp, H. sapiens
gacttcagtgaaggaa

SEQ ID NO: 100325 - DNA, 16 bp, H. sapiens
gacttcagtgaccaca

SEQ ID NO: 100326 - DNA, 16 bp, H. sapiens
gacttcataaaaatta

SEQ ID NO: 100327 - DNA, 16 bp, H. sapiens
gacttcattaaaatta

SEQ ID NO: 100328 - DNA, 16 bp, H. sapiens
gacttcattcctgttg

SEQ ID NO: 100329 - DNA, 16 bp, H. sapiens
gacttcattgtctata

SEQ ID NO: 100330 - DNA, 16 bp, H. sapiens
gacttccagctccatc

SEQ ID NO: 100331 - DNA, 16 bp, H. sapiens
gacttccagcttccag

SEQ ID NO: 100332 - DNA, 16 bp, H. sapiens
gacttccagtataatg

SEQ ID NO: 100333 - DNA, 16 bp, H. sapiens
gacttccagtcaacag

SEQ ID NO: 100334 - DNA, 16 bp, H. sapiens
gacttcccagcctcca

SEQ ID NO: 100335 - DNA, 16 bp, H. sapiens
gacttcccgcaacatc

SEQ ID NO: 100336 - DNA, 16 bp, H. sapiens
gacttcctctctttct

SEQ ID NO: 100337 - DNA, 16 bp, H. sapiens
gacttcctgcctccag

SEQ ID NO: 100338 - DNA, 16 bp, H. sapiens
gacttcctggaggaag

SEQ ID NO: 100339 - DNA, 16 bp, H. sapiens
gacttcctgggctgaa

SEQ ID NO: 100340 - DNA, 21 bp, H. sapiens
gacttcctgggtcgagtgggg

SEQ ID NO: 100341 - DNA, 16 bp, H. sapiens
gacttcctggttcaag

SEQ ID NO: 100342 - DNA, 16 bp, H. sapiens
gacttctaagacaaaa

SEQ ID NO: 100343 - DNA, 16 bp, H. sapiens
gacttctcagcctcct

SEQ ID NO: 100344 - DNA, 16 bp, H. sapiens
gacttctgacttccag

SEQ ID NO: 100345 - DNA, 16 bp, H. sapiens
gacttcttggaggagg

SEQ ID NO: 100346 - DNA, 16 bp, H. sapiens
gacttcttgtcagaaa

SEQ ID NO: 100347 - DNA, 16 bp, H. sapiens
gacttctttctggttt

SEQ ID NO: 100348 - DNA, 16 bp, H. sapiens
gacttctttttgtttc

SEQ ID NO: 100349 - DNA, 16 bp, H. sapiens
gacttgaaaatatttt

SEQ ID NO: 100350 - DNA, 16 bp, H. sapiens
gacttgaacatctgtg

SEQ ID NO: 100351 - DNA, 16 bp, H. sapiens
gacttgaatttttttt

SEQ ID NO: 100352 - DNA, 16 bp, H. sapiens
gacttgagaccaggag

SEQ ID NO: 100353 - DNA, 16 bp, H. sapiens
gacttgagcatctgtg

SEQ ID NO: 100354 - DNA, 16 bp, H. sapiens
gacttgcaccctctga

SEQ ID NO: 100355 - DNA, 16 bp, H. sapiens
gacttgcatggggcct

SEQ ID NO: 100356 - DNA, 16 bp, H. sapiens
gacttgcccaaggtca

SEQ ID NO: 100357 - DNA, 16 bp, H. sapiens
gacttgcccaggtcac

SEQ ID NO: 100358 - DNA, 16 bp, H. sapiens
gacttgctcaaagtca

SEQ ID NO: 100359 - DNA, 16 bp, H. sapiens
gacttgctcagggtca

SEQ ID NO: 100360 - DNA, 16 bp, H. sapiens
gacttgctgagtcttc

SEQ ID NO: 100361 - DNA, 16 bp, H. sapiens
gacttgctttgtggcc

SEQ ID NO: 100362 - DNA, 16 bp, H. sapiens
gacttggactgagcca

SEQ ID NO: 100363 - DNA, 16 bp, H. sapiens
gacttggagaactttt

SEQ ID NO: 100364 - DNA, 16 bp, H. sapiens
gacttggatgaagctg

SEQ ID NO: 100365 - DNA, 16 bp, H. sapiens
gacttggatttttttt

SEQ ID NO: 100366 - DNA, 16 bp, H. sapiens
gacttggcctcccaga

SEQ ID NO: 100367 - DNA, 16 bp, H. sapiens
gacttggggaaagggt

SEQ ID NO: 100368 - DNA, 16 bp, H. sapiens
gacttggtgggaggtg

SEQ ID NO: 100369 - DNA, 16 bp, H. sapiens
gacttgtcttgtctca

SEQ ID NO: 100370 - DNA, 16 bp, H. sapiens
gacttgttttgtgacc

SEQ ID NO: 100371 - DNA, 16 bp, H. sapiens
gactttactcacatgc

SEQ ID NO: 100372 - DNA, 16 bp, H. sapiens
gactttactttttaaa

SEQ ID NO: 100373 - DNA, 16 bp, H. sapiens
gactttaggcaagtta

SEQ ID NO: 100374 - DNA, 16 bp, H. sapiens
gactttaggtgatccg

SEQ ID NO: 100375 - DNA, 16 bp, H. sapiens
gactttatgaccaaga

SEQ ID NO: 100376 - DNA, 16 bp, H. sapiens
gactttattattattt

SEQ ID NO: 100377 - DNA, 16 bp, H. sapiens
gactttcacaatggtt

SEQ ID NO: 100378 - DNA, 16 bp, H. sapiens
gactttcctcatctgt

SEQ ID NO: 100379 - DNA, 16 bp, H. sapiens
gactttctcttttcct

SEQ ID NO: 100380 - DNA, 25 bp, H. sapiens
gactttctgcctccactattgctct

SEQ ID NO: 100381 - DNA, 16 bp, H. sapiens
gactttctttgtctct

SEQ ID NO: 100382 - DNA, 16 bp, H. sapiens
gactttgagaggccaa

SEQ ID NO: 100383 - DNA, 16 bp, H. sapiens
gactttgagggactgt

SEQ ID NO: 100384 - DNA, 16 bp, H. sapiens
gactttgcagatggaa

SEQ ID NO: 100385 - DNA, 16 bp, H. sapiens
gactttgcagatgtgg

SEQ ID NO: 100386 - DNA, 16 bp, H. sapiens
gactttgcattggaac

SEQ ID NO: 100387 - DNA, 16 bp, H. sapiens
gactttgctcttcatt

SEQ ID NO: 100388 - DNA, 16 bp, H. sapiens
gactttggaaaaaagg

SEQ ID NO: 100389 - DNA, 16 bp, H. sapiens
gactttggacttggac

SEQ ID NO: 100390 - DNA, 19 bp, H. sapiens
gactttgggaggccaaggt

SEQ ID NO: 100391 - DNA, 17 bp, H. sapiens
gactttgggaggccgag

SEQ ID NO: 100392 - DNA, 16 bp, H. sapiens
gactttgggcaagtga

SEQ ID NO: 100393 - DNA, 16 bp, H. sapiens
gactttggggggctgt

SEQ ID NO: 100394 - DNA, 16 bp, H. sapiens
gactttgtaaacactg

SEQ ID NO: 100395 - DNA, 16 bp, H. sapiens
gactttgtcaccccca

SEQ ID NO: 100396 - DNA, 16 bp, H. sapiens
gactttgtttttaaaa

SEQ ID NO: 100397 - DNA, 16 bp, H. sapiens
gacttttaaatattaa

SEQ ID NO: 100398 - DNA, 20 bp, H. sapiens
gacttttaccaagcatactg

SEQ ID NO: 100399 - DNA, 16 bp, H. sapiens
gacttttagaaggaaa

SEQ ID NO: 100400 - DNA, 16 bp, H. sapiens
gacttttcatcagaaa

SEQ ID NO: 100401 - DNA, 16 bp, H. sapiens
gacttttgttctcttc

SEQ ID NO: 100402 - DNA, 16 bp, H. sapiens
gactttttaaaaaaaa

SEQ ID NO: 100403 - DNA, 16 bp, H. sapiens
gactttttaaaaaaat

SEQ ID NO: 100404 - DNA, 16 bp, H. sapiens
gactttttaaaaaatg

SEQ ID NO: 100405 - DNA, 16 bp, H. sapiens
gactttttaacaaaag

SEQ ID NO: 100406 - DNA, 16 bp, H. sapiens
gactttttaatgtttg

SEQ ID NO: 100407 - DNA, 16 bp, H. sapiens
gactttttagtaataa

SEQ ID NO: 100408 - DNA, 16 bp, H. sapiens
gactttttccaaactg

SEQ ID NO: 100409 - DNA, 16 bp, H. sapiens
gacttttttaaagctg

SEQ ID NO: 100410 - DNA, 16 bp, H. sapiens
gactttttttggttgg

SEQ ID NO: 100411 - DNA, 16 bp, H. sapiens
gactttttttggtttg

SEQ ID NO: 100412 - DNA, 16 bp, H. sapiens
gactttttttgtttgg

SEQ ID NO: 100413 - DNA, 16 bp, H. sapiens
gagaaaaaaaatcact

SEQ ID NO: 100414 - DNA, 16 bp, H. sapiens
gagaaaaacaacacat

SEQ ID NO: 100415 - DNA, 16 bp, H. sapiens
gagaaaaaccacatga

SEQ ID NO: 100416 - DNA, 16 bp, H. sapiens
gagaaaaaccatatga

SEQ ID NO: 100417 - DNA, 16 bp, H. sapiens
gagaaaaagaaaccct

SEQ ID NO: 100418 - DNA, 16 bp, H. sapiens
gagaaaaagaagtcat

SEQ ID NO: 100419 - DNA, 16 bp, H. sapiens
gagaaaaataattaca

SEQ ID NO: 100420 - DNA, 16 bp, H. sapiens
gagaaaaataattcag

SEQ ID NO: 100421 - DNA, 16 bp, H. sapiens
gagaaaaatcattttt

SEQ ID NO: 100422 - DNA, 16 bp, H. sapiens
gagaaaaatctttaaa

SEQ ID NO: 100423 - DNA, 16 bp, H. sapiens
gagaaaaatgttgcaa

SEQ ID NO: 100424 - DNA, 16 bp, H. sapiens
gagaaaaatttaccaa

SEQ ID NO: 100425 - DNA, 16 bp, H. sapiens
gagaaaacagaagcca

SEQ ID NO: 100426 - DNA, 16 bp, H. sapiens
gagaaaacagagacac

SEQ ID NO: 100427 - DNA, 16 bp, H. sapiens
gagaaaacaggctcag

SEQ ID NO: 100428 - DNA, 16 bp, H. sapiens
gagaaaacatttgcaa

SEQ ID NO: 100429 - DNA, 16 bp, H. sapiens
gagaaaactcaaagaa

SEQ ID NO: 100430 - DNA, 16 bp, H. sapiens
gagaaaactgaagcct

SEQ ID NO: 100431 - DNA, 16 bp, H. sapiens
gagaaaactgaagctc

SEQ ID NO: 100432 - DNA, 16 bp, H. sapiens
gagaaaactgaggcca

SEQ ID NO: 100433 - DNA, 16 bp, H. sapiens
gagaaaactgaggctt

SEQ ID NO: 100434 - DNA, 16 bp, H. sapiens
gagaaaagaactttta

SEQ ID NO: 100435 - DNA, 16 bp, H. sapiens
gagaaaagaatcaaag

SEQ ID NO: 100436 - DNA, 16 bp, H. sapiens
gagaaaagacagtttg

SEQ ID NO: 100437 - DNA, 16 bp, H. sapiens
gagaaaagagaatgct

SEQ ID NO: 100438 - DNA, 16 bp, H. sapiens
gagaaaagcattccag

SEQ ID NO: 100439 - DNA, 16 bp, H. sapiens
gagaaaagccatatga

SEQ ID NO: 100440 - DNA, 16 bp, H. sapiens
gagaaaagctgaagaa

SEQ ID NO: 100441 - DNA, 16 bp, H. sapiens
gagaaaagggaaaact

SEQ ID NO: 100442 - DNA, 16 bp, H. sapiens
gagaaaagggaacctt

SEQ ID NO: 100443 - DNA, 16 bp, H. sapiens
gagaaaagggaacttt

SEQ ID NO: 100444 - DNA, 16 bp, H. sapiens
gagaaaagggaagcct

SEQ ID NO: 100445 - DNA, 16 bp, H. sapiens
gagaaaatatcttcaa

SEQ ID NO: 100446 - DNA, 16 bp, H. sapiens
gagaaaatattacaaa

SEQ ID NO: 100447 - DNA, 16 bp, H. sapiens
gagaaaatatttgaaa

SEQ ID NO: 100448 - DNA, 16 bp, H. sapiens
gagaaaatctacatga

SEQ ID NO: 100449 - DNA, 16 bp, H. sapiens
gagaaaatctagaaga

SEQ ID NO: 100450 - DNA, 16 bp, H. sapiens
gagaaaatcttcacaa

SEQ ID NO: 100451 - DNA, 16 bp, H. sapiens
gagaaaatctttacaa

SEQ ID NO: 100452 - DNA, 16 bp, H. sapiens
gagaaaatctttgcaa

SEQ ID NO: 100453 - DNA, 16 bp, H. sapiens
gagaaaatgaattttt

SEQ ID NO: 100454 - DNA, 16 bp, H. sapiens
gagaaaatgaggcaga

SEQ ID NO: 100455 - DNA, 16 bp, H. sapiens
gagaaaatggaagcaa

SEQ ID NO: 100456 - DNA, 16 bp, H. sapiens
gagaaaatgtttgcag

SEQ ID NO: 100457 - DNA, 16 bp, H. sapiens
gagaaaatttttcttt

SEQ ID NO: 100458 - DNA, 16 bp, H. sapiens
gagaaacaaataattt

SEQ ID NO: 100459 - DNA, 17 bp, H. sapiens
gagaaacacccaagaat

SEQ ID NO: 100460 - DNA, 16 bp, H. sapiens
gagaaacactggttta

SEQ ID NO: 100461 - DNA, 16 bp, H. sapiens
gagaaacagaaccagc

SEQ ID NO: 100462 - DNA, 16 bp, H. sapiens
gagaaacagagacagg

SEQ ID NO: 100463 - DNA, 16 bp, H. sapiens
gagaaacagctttgtg

SEQ ID NO: 100464 - DNA, 16 bp, H. sapiens
gagaaaccattttgtg

SEQ ID NO: 100465 - DNA, 16 bp, H. sapiens
gagaaacccccatctc

SEQ ID NO: 100466 - DNA, 16 bp, H. sapiens
gagaaaccctgctgta

SEQ ID NO: 100467 - DNA, 16 bp, H. sapiens
gagaaacctaaagact

SEQ ID NO: 100468 - DNA, 16 bp, H. sapiens
gagaaacctggcttcc

SEQ ID NO: 100469 - DNA, 16 bp, H. sapiens
gagaaacctttttttt

SEQ ID NO: 100470 - DNA, 16 bp, H. sapiens
gagaaactagaaaaac

SEQ ID NO: 100471 - DNA, 16 bp, H. sapiens
gagaaactgaaactct

SEQ ID NO: 100472 - DNA, 16 bp, H. sapiens
gagaaactgaaagaaa

SEQ ID NO: 100473 - DNA, 16 bp, H. sapiens
gagaaactgaaagcct

SEQ ID NO: 100474 - DNA, 16 bp, H. sapiens
gagaaactgaagaaaa

SEQ ID NO: 100475 - DNA, 16 bp, H. sapiens
gagaaactgaagcaca

SEQ ID NO: 100476 - DNA, 16 bp, H. sapiens
gagaaactggaactct

SEQ ID NO: 100477 - DNA, 16 bp, H. sapiens
gagaaacttgacaaac

SEQ ID NO: 100478 - DNA, 16 bp, H. sapiens
gagaaagaaactcaga

SEQ ID NO: 100479 - DNA, 16 bp, H. sapiens
gagaaagaaataaagc

SEQ ID NO: 100480 - DNA, 16 bp, H. sapiens
gagaaagaaatgtctg

SEQ ID NO: 100481 - DNA, 16 bp, H. sapiens
gagaaagaaccaacac

SEQ ID NO: 100482 - DNA, 16 bp, H. sapiens
gagaaagaatttaatt

SEQ ID NO: 100483 - DNA, 16 bp, H. sapiens
gagaaagaccaccagg

SEQ ID NO: 100484 - DNA, 16 bp, H. sapiens
gagaaagaccagcccc

SEQ ID NO: 100485 - DNA, 16 bp, H. sapiens
gagaaagaccctgtct

SEQ ID NO: 100486 - DNA, 16 bp, H. sapiens
gagaaagagaaatcaa

SEQ ID NO: 100487 - DNA, 16 bp, H. sapiens
gagaaagagaagactt

SEQ ID NO: 100488 - DNA, 16 bp, H. sapiens
gagaaagagactgaaa

SEQ ID NO: 100489 - DNA, 16 bp, H. sapiens
gagaaagagagagcca

SEQ ID NO: 100490 - DNA, 16 bp, H. sapiens
gagaaagagagaggct

SEQ ID NO: 100491 - DNA, 16 bp, H. sapiens
gagaaagagctccaga

SEQ ID NO: 100492 - DNA, 16 bp, H. sapiens
gagaaagagggaatcc

SEQ ID NO: 100493 - DNA, 16 bp, H. sapiens
gagaaagagtaattca

SEQ ID NO: 100494 - DNA, 16 bp, H. sapiens
gagaaagagtttaatt

SEQ ID NO: 100495 - DNA, 16 bp, H. sapiens
gagaaagatcctgtct

SEQ ID NO: 100496 - DNA, 16 bp, H. sapiens
gagaaagatgaagacc

SEQ ID NO: 100497 - DNA, 16 bp, H. sapiens
gagaaagatgaagact

SEQ ID NO: 100498 - DNA, 16 bp, H. sapiens
gagaaagatgcaggct

SEQ ID NO: 100499 - DNA, 16 bp, H. sapiens
gagaaagatggaggct

SEQ ID NO: 100500 - DNA, 16 bp, H. sapiens
gagaaagcaggacaga

SEQ ID NO: 100501 - DNA, 16 bp, H. sapiens
gagaaagcatttgata

SEQ ID NO: 100502 - DNA, 16 bp, H. sapiens
gagaaagctgttgatg

SEQ ID NO: 100503 - DNA, 16 bp, H. sapiens
gagaaaggaaaatatt

SEQ ID NO: 100504 - DNA, 25 bp, H. sapiens
gagaaaggaaccaagttggaaaaca

SEQ ID NO: 100505 - DNA, 16 bp, H. sapiens
gagaaaggaatcaaac

SEQ ID NO: 100506 - DNA, 16 bp, H. sapiens
gagaaaggagaactct

SEQ ID NO: 100507 - DNA, 16 bp, H. sapiens
gagaaaggagagccag

SEQ ID NO: 100508 - DNA, 16 bp, H. sapiens
gagaaaggccagatca

SEQ ID NO: 100509 - DNA, 16 bp, H. sapiens
gagaaagggtctcact

SEQ ID NO: 100510 - DNA, 16 bp, H. sapiens
gagaaagtcaacaaag

SEQ ID NO: 100511 - DNA, 16 bp, H. sapiens
gagaaagtctttattt

SEQ ID NO: 100512 - DNA, 16 bp, H. sapiens
gagaaagtttctttct

SEQ ID NO: 100513 - DNA, 16 bp, H. sapiens
gagaaataaaacattt

SEQ ID NO: 100514 - DNA, 16 bp, H. sapiens
gagaaataaaaccttt

SEQ ID NO: 100515 - DNA, 16 bp, H. sapiens
gagaaataaatacatt

SEQ ID NO: 100516 - DNA, 16 bp, H. sapiens
gagaaataaattcctt

SEQ ID NO: 100517 - DNA, 16 bp, H. sapiens
gagaaataacaatcac

SEQ ID NO: 100518 - DNA, 16 bp, H. sapiens
gagaaatacaaatcaa

SEQ ID NO: 100519 - DNA, 16 bp, H. sapiens
gagaaatacatcatta

SEQ ID NO: 100520 - DNA, 16 bp, H. sapiens
gagaaatagacagcaa

SEQ ID NO: 100521 - DNA, 16 bp, H. sapiens
gagaaatagatgaatc

SEQ ID NO: 100522 - DNA, 18 bp, H. sapiens
gagaaataggaacgcttt

SEQ ID NO: 100523 - DNA, 16 bp, H. sapiens
gagaaatatgagatta

SEQ ID NO: 100524 - DNA, 22 bp, H. sapiens
gagaaatattgctgaattcttt

SEQ ID NO: 100525 - DNA, 16 bp, H. sapiens
gagaaatatttgtaaa

SEQ ID NO: 100526 - DNA, 16 bp, H. sapiens
gagaaatattttgtga

SEQ ID NO: 100527 - DNA, 16 bp, H. sapiens
gagaaatcaagcgcag

SEQ ID NO: 100528 - DNA, 16 bp, H. sapiens
gagaaatcaatttctg

SEQ ID NO: 100529 - DNA, 16 bp, H. sapiens
gagaaatcagacaaaa

SEQ ID NO: 100530 - DNA, 16 bp, H. sapiens
gagaaatcgagcgcag

SEQ ID NO: 100531 - DNA, 16 bp, H. sapiens
gagaaatctttttttt

SEQ ID NO: 100532 - DNA, 16 bp, H. sapiens
gagaaatgaaacagga

SEQ ID NO: 100533 - DNA, 16 bp, H. sapiens
gagaaatgaaacatat

SEQ ID NO: 100534 - DNA, 16 bp, H. sapiens
gagaaatgagaacata

SEQ ID NO: 100535 - DNA, 16 bp, H. sapiens
gagaaatgccaatcaa

SEQ ID NO: 100536 - DNA, 16 bp, H. sapiens
gagaaatggagtcaaa

SEQ ID NO: 100537 - DNA, 16 bp, H. sapiens
gagaaatggttgattc

SEQ ID NO: 100538 - DNA, 16 bp, H. sapiens
gagaaatgtctatcca

SEQ ID NO: 100539 - DNA, 16 bp, H. sapiens
gagaaatgtctattca

SEQ ID NO: 100540 - DNA, 16 bp, H. sapiens
gagaaatgtctattta

SEQ ID NO: 100541 - DNA, 16 bp, H. sapiens
gagaaatgtctgtcca

SEQ ID NO: 100542 - DNA, 16 bp, H. sapiens
gagaaattaaatactt

SEQ ID NO: 100543 - DNA, 16 bp, H. sapiens
gagaaattataacaaa

SEQ ID NO: 100544 - DNA, 16 bp, H. sapiens
gagaaattcaagctag

SEQ ID NO: 100545 - DNA, 16 bp, H. sapiens
gagaaattgaaactct

SEQ ID NO: 100546 - DNA, 16 bp, H. sapiens
gagaaattggccaaaa

SEQ ID NO: 100547 - DNA, 16 bp, H. sapiens
gagaaatttgaagatg

SEQ ID NO: 100548 - DNA, 16 bp, H. sapiens
gagaaattttcatgaa

SEQ ID NO: 100549 - DNA, 16 bp, H. sapiens
gagaacaaagacacga

SEQ ID NO: 100550 - DNA, 16 bp, H. sapiens
gagaacaaagccaggg

SEQ ID NO: 100551 - DNA, 16 bp, H. sapiens
gagaacaataaacact

SEQ ID NO: 100552 - DNA, 16 bp, H. sapiens
gagaacacacaatatt

SEQ ID NO: 100553 - DNA, 16 bp, H. sapiens
gagaacacagagccaa

SEQ ID NO: 100554 - DNA, 16 bp, H. sapiens
gagaacagcaagggga

SEQ ID NO: 100555 - DNA, 16 bp, H. sapiens
gagaacagcaagtgca

SEQ ID NO: 100556 - DNA, 16 bp, H. sapiens
gagaacagcactgggg

SEQ ID NO: 100557 - DNA, 16 bp, H. sapiens
gagaacagcagcatgg

SEQ ID NO: 100558 - DNA, 16 bp, H. sapiens
gagaacagcatagagg

SEQ ID NO: 100559 - DNA, 16 bp, H. sapiens
gagaacagcatgaagg

SEQ ID NO: 100560 - DNA, 16 bp, H. sapiens
gagaacagcatgagag

SEQ ID NO: 100561 - DNA, 16 bp, H. sapiens
gagaacagcatgggtg

SEQ ID NO: 100562 - DNA, 16 bp, H. sapiens
gagaacagcctgatca

SEQ ID NO: 100563 - DNA, 16 bp, H. sapiens
gagaacagccttggca

SEQ ID NO: 100564 - DNA, 16 bp, H. sapiens
gagaacatacaaagtt

SEQ ID NO: 100565 - DNA, 18 bp, H. sapiens
gagaacataggatgtttg

SEQ ID NO: 100566 - DNA, 16 bp, H. sapiens
gagaacatattttgta

SEQ ID NO: 100567 - DNA, 16 bp, H. sapiens
gagaacatcatagagt

SEQ ID NO: 100568 - DNA, 16 bp, H. sapiens
gagaacatcatgctaa

SEQ ID NO: 100569 - DNA, 16 bp, H. sapiens
gagaacatgcaatgtt

SEQ ID NO: 100570 - DNA, 16 bp, H. sapiens
gagaacatgcgatgtt

SEQ ID NO: 100571 - DNA, 16 bp, H. sapiens
gagaacatttggtgtt

SEQ ID NO: 100572 - DNA, 16 bp, H. sapiens
gagaaccactgattta

SEQ ID NO: 100573 - DNA, 16 bp, H. sapiens
gagaaccactggtcta

SEQ ID NO: 100574 - DNA, 16 bp, H. sapiens
gagaaccaggagagct

SEQ ID NO: 100575 - DNA, 16 bp, H. sapiens
gagaaccaggagcact

SEQ ID NO: 100576 - DNA, 16 bp, H. sapiens
gagaaccaggagctct

SEQ ID NO: 100577 - DNA, 16 bp, H. sapiens
gagaacccagaaataa

SEQ ID NO: 100578 - DNA, 16 bp, H. sapiens
gagaaccctcaccaga

SEQ ID NO: 100579 - DNA, 16 bp, H. sapiens
gagaacctgaccaaaa

SEQ ID NO: 100580 - DNA, 16 bp, H. sapiens
gagaacctgtctcaaa

SEQ ID NO: 100581 - DNA, 16 bp, H. sapiens
gagaacctgtctcaga

SEQ ID NO: 100582 - DNA, 16 bp, H. sapiens
gagaacggcatgaacc

SEQ ID NO: 100583 - DNA, 18 bp, H. sapiens
gagaacgggccatgatga

SEQ ID NO: 100584 - DNA, 16 bp, H. sapiens
gagaactaataaatgt

SEQ ID NO: 100585 - DNA, 16 bp, H. sapiens
gagaactatgtgacgc

SEQ ID NO: 100586 - DNA, 16 bp, H. sapiens
gagaactcaaaaataa

SEQ ID NO: 100587 - DNA, 16 bp, H. sapiens
gagaactcaggctcag

SEQ ID NO: 100588 - DNA, 16 bp, H. sapiens
gagaactcataaataa

SEQ ID NO: 100589 - DNA, 16 bp, H. sapiens
gagaactgaaggagat

SEQ ID NO: 100590 - DNA, 16 bp, H. sapiens
gagaactgcttgagct

SEQ ID NO: 100591 - DNA, 16 bp, H. sapiens
gagaactggagcaaga

SEQ ID NO: 100592 - DNA, 16 bp, H. sapiens
gagaacttactatcat

SEQ ID NO: 100593 - DNA, 16 bp, H. sapiens
gagaacttccccaact

SEQ ID NO: 100594 - DNA, 16 bp, H. sapiens
gagaacttcttgattt

SEQ ID NO: 100595 - DNA, 16 bp, H. sapiens
gagaacttgccccagg

SEQ ID NO: 100596 - DNA, 16 bp, H. sapiens
gagaacttgctttatg

SEQ ID NO: 100597 - DNA, 16 bp, H. sapiens
gagaacttgttaaaaa

SEQ ID NO: 100598 - DNA, 16 bp, H. sapiens
gagaagaaaatatatt

SEQ ID NO: 100599 - DNA, 16 bp, H. sapiens
gagaagaaagaaaact

SEQ ID NO: 100600 - DNA, 16 bp, H. sapiens
gagaagaaagcttcag

SEQ ID NO: 100601 - DNA, 16 bp, H. sapiens
gagaagaaatatttga

SEQ ID NO: 100602 - DNA, 16 bp, H. sapiens
gagaagaaatcagaaa

SEQ ID NO: 100603 - DNA, 16 bp, H. sapiens
gagaagaaattttaaa

SEQ ID NO: 100604 - DNA, 16 bp, H. sapiens
gagaagaacatgaatt

SEQ ID NO: 100605 - DNA, 16 bp, H. sapiens
gagaagaaggccactg

SEQ ID NO: 100606 - DNA, 16 bp, H. sapiens
gagaagaagtcaatgc

SEQ ID NO: 100607 - DNA, 16 bp, H. sapiens
gagaagaatgtgaatt

SEQ ID NO: 100608 - DNA, 16 bp, H. sapiens
gagaagaattggtgtt

SEQ ID NO: 100609 - DNA, 16 bp, H. sapiens
gagaagacagccatct

SEQ ID NO: 100610 - DNA, 16 bp, H. sapiens
gagaagactctgctcc

SEQ ID NO: 100611 - DNA, 16 bp, H. sapiens
gagaagagaaacccca

SEQ ID NO: 100612 - DNA, 16 bp, H. sapiens
gagaagagaagagact

SEQ ID NO: 100613 - DNA, 16 bp, H. sapiens
gagaagagaagtttac

SEQ ID NO: 100614 - DNA, 16 bp, H. sapiens
gagaagagcaacacca

SEQ ID NO: 100615 - DNA, 16 bp, H. sapiens
gagaagagcaactcta

SEQ ID NO: 100616 - DNA, 16 bp, H. sapiens
gagaagagcaattaca

SEQ ID NO: 100617 - DNA, 16 bp, H. sapiens
gagaagagctgcggcc

SEQ ID NO: 100618 - DNA, 16 bp, H. sapiens
gagaagaggaggcctg

SEQ ID NO: 100619 - DNA, 16 bp, H. sapiens
gagaagaggtttaatt

SEQ ID NO: 100620 - DNA, 16 bp, H. sapiens
gagaagagtctgttca

SEQ ID NO: 100621 - DNA, 20 bp, H. sapiens
gagaagatacgggagcagga

SEQ ID NO: 100622 - DNA, 16 bp, H. sapiens
gagaagatatttgcaa

SEQ ID NO: 100623 - DNA, 16 bp, H. sapiens
gagaagatattttcaa

SEQ ID NO: 100624 - DNA, 16 bp, H. sapiens
gagaagatcaataaaa

SEQ ID NO: 100625 - DNA, 16 bp, H. sapiens
gagaagatcacttgag

SEQ ID NO: 100626 - DNA, 16 bp, H. sapiens
gagaagatctgggaag

SEQ ID NO: 100627 - DNA, 16 bp, H. sapiens
gagaagatgcagtatt

SEQ ID NO: 100628 - DNA, 16 bp, H. sapiens
gagaagatggccacca

SEQ ID NO: 100629 - DNA, 16 bp, H. sapiens
gagaagatggccatct

SEQ ID NO: 100630 - DNA, 16 bp, H. sapiens
gagaagcaagtacctt

SEQ ID NO: 100631 - DNA, 16 bp, H. sapiens
gagaagcagaagcaga

SEQ ID NO: 100632 - DNA, 16 bp, H. sapiens
gagaagcagcttctgc

SEQ ID NO: 100633 - DNA, 16 bp, H. sapiens
gagaagccaggcagag

SEQ ID NO: 100634 - DNA, 16 bp, H. sapiens
gagaagcctcaggaaa

SEQ ID NO: 100635 - DNA, 16 bp, H. sapiens
gagaagctgcagcaag

SEQ ID NO: 100636 - DNA, 16 bp, H. sapiens
gagaagctgggactgc

SEQ ID NO: 100637 - DNA, 16 bp, H. sapiens
gagaagcttagagaaa

SEQ ID NO: 100638 - DNA, 16 bp, H. sapiens
gagaaggaaaataatt

SEQ ID NO: 100639 - DNA, 16 bp, H. sapiens
gagaaggaaataaagc

SEQ ID NO: 100640 - DNA, 16 bp, H. sapiens
gagaaggaaatctcca

SEQ ID NO: 100641 - DNA, 16 bp, H. sapiens
gagaaggaagagcagt

SEQ ID NO: 100642 - DNA, 16 bp, H. sapiens
gagaaggaattctcta

SEQ ID NO: 100643 - DNA, 16 bp, H. sapiens
gagaaggacatgagat

SEQ ID NO: 100644 - DNA, 16 bp, H. sapiens
gagaaggagcagccag

SEQ ID NO: 100645 - DNA, 16 bp, H. sapiens
gagaaggagccagaaa

SEQ ID NO: 100646 - DNA, 16 bp, H. sapiens
gagaaggaggaggtgc

SEQ ID NO: 100647 - DNA, 16 bp, H. sapiens
gagaaggagtctcgct

SEQ ID NO: 100648 - DNA, 16 bp, H. sapiens
gagaaggagtttcact

SEQ ID NO: 100649 - DNA, 16 bp, H. sapiens
gagaaggatatgagat

SEQ ID NO: 100650 - DNA, 16 bp, H. sapiens
gagaaggattttattt

SEQ ID NO: 100651 - DNA, 16 bp, H. sapiens
gagaaggccatgccag

SEQ ID NO: 100652 - DNA, 16 bp, H. sapiens
gagaaggctggaggag

SEQ ID NO: 100653 - DNA, 16 bp, H. sapiens
gagaagggcaagaggt

SEQ ID NO: 100654 - DNA, 16 bp, H. sapiens
gagaagggcgtgaacc

SEQ ID NO: 100655 - DNA, 16 bp, H. sapiens
gagaaggggcagctgg

SEQ ID NO: 100656 - DNA, 18 bp, H. sapiens
gagaaggggccatgatga

SEQ ID NO: 100657 - DNA, 16 bp, H. sapiens
gagaagggtctgttca

SEQ ID NO: 100658 - DNA, 16 bp, H. sapiens
gagaagggtgtgtgtg

SEQ ID NO: 100659 - DNA, 16 bp, H. sapiens
gagaaggtatctcatt

SEQ ID NO: 100660 - DNA, 16 bp, H. sapiens
gagaaggtcagagaga

SEQ ID NO: 100661 - DNA, 16 bp, H. sapiens
gagaaggtcagcaaga

SEQ ID NO: 100662 - DNA, 16 bp, H. sapiens
gagaaggtgatatttg

SEQ ID NO: 100663 - DNA, 16 bp, H. sapiens
gagaaggtggagctca

SEQ ID NO: 100664 - DNA, 16 bp, H. sapiens
gagaaggtggcatctg

SEQ ID NO: 100665 - DNA, 16 bp, H. sapiens
gagaagtcaaattgtc

SEQ ID NO: 100666 - DNA, 16 bp, H. sapiens
gagaagtcagctgtca

SEQ ID NO: 100667 - DNA, 16 bp, H. sapiens
gagaagtcagtgcctg

SEQ ID NO: 100668 - DNA, 16 bp, H. sapiens
gagaagtccctcctcc

SEQ ID NO: 100669 - DNA, 16 bp, H. sapiens
gagaagtgacagaaaa

SEQ ID NO: 100670 - DNA, 16 bp, H. sapiens
gagaagtgctacacac

SEQ ID NO: 100671 - DNA, 16 bp, H. sapiens
gagaagtttaaagaaa

SEQ ID NO: 100672 - DNA, 17 bp, H. sapiens
gagaagtttctgagaag

SEQ ID NO: 100673 - DNA, 16 bp, H. sapiens
gagaataaaactggat

SEQ ID NO: 100674 - DNA, 16 bp, H. sapiens
gagaatacaatgagaa

SEQ ID NO: 100675 - DNA, 16 bp, H. sapiens
gagaatagcttgaact

SEQ ID NO: 100676 - DNA, 16 bp, H. sapiens
gagaatattatgaaca

SEQ ID NO: 100677 - DNA, 16 bp, H. sapiens
gagaatcacagagaaa

SEQ ID NO: 100678 - DNA, 16 bp, H. sapiens
gagaatcacctgaact

SEQ ID NO: 100679 - DNA, 16 bp, H. sapiens
gagaatcacttcagcc

SEQ ID NO: 100680 - DNA, 16 bp, H. sapiens
gagaatcacttgaacc

SEQ ID NO: 100681 - DNA, 16 bp, H. sapiens
gagaatcacttgaata

SEQ ID NO: 100682 - DNA, 16 bp, H. sapiens
gagaatcatatgaacc

SEQ ID NO: 100683 - DNA, 17 bp, H. sapiens
gagaatcatttgaaccg

SEQ ID NO: 100684 - DNA, 16 bp, H. sapiens
gagaatccatctaaaa

SEQ ID NO: 100685 - DNA, 16 bp, H. sapiens
gagaatcccttgaacc

SEQ ID NO: 100686 - DNA, 16 bp, H. sapiens
gagaatcgcctgaacc

SEQ ID NO: 100687 - DNA, 16 bp, H. sapiens
gagaatcgctcgaacc

SEQ ID NO: 100688 - DNA, 16 bp, H. sapiens
gagaatctaatgactg

SEQ ID NO: 100689 - DNA, 16 bp, H. sapiens
gagaatctgtgtgctt

SEQ ID NO: 100690 - DNA, 16 bp, H. sapiens
gagaatcttgaaaaca

SEQ ID NO: 100691 - DNA, 16 bp, H. sapiens
gagaatgaagacacaa

SEQ ID NO: 100692 - DNA, 16 bp, H. sapiens
gagaatgaagaccttt

SEQ ID NO: 100693 - DNA, 18 bp, H. sapiens
gagaatgactttgacgag

SEQ ID NO: 100694 - DNA, 16 bp, H. sapiens
gagaatgagaatgaat

SEQ ID NO: 100695 - DNA, 16 bp, H. sapiens
gagaatgagacagaga

SEQ ID NO: 100696 - DNA, 16 bp, H. sapiens
gagaatgagactctgt

SEQ ID NO: 100697 - DNA, 16 bp, H. sapiens
gagaatgaggaagaca

SEQ ID NO: 100698 - DNA, 16 bp, H. sapiens
gagaatgatgatttct

SEQ ID NO: 100699 - DNA, 16 bp, H. sapiens
gagaatgcagagaaaa

SEQ ID NO: 100700 - DNA, 16 bp, H. sapiens
gagaatgcagcccagc

SEQ ID NO: 100701 - DNA, 23 bp, H. sapiens
gagaatggaaccaaggtggaaaa

SEQ ID NO: 100702 - DNA, 25 bp, H. sapiens
gagaatggaaccaagttggaaaaca

SEQ ID NO: 100703 - DNA, 16 bp, H. sapiens
gagaatggcttgaacc

SEQ ID NO: 100704 - DNA, 16 bp, H. sapiens
gagaatgtaaattatt

SEQ ID NO: 100705 - DNA, 16 bp, H. sapiens
gagaatgtgaagaaat

SEQ ID NO: 100706 - DNA, 16 bp, H. sapiens
gagaatgtgtgtgtgt

SEQ ID NO: 100707 - DNA, 16 bp, H. sapiens
gagaattaaatgatat

SEQ ID NO: 100708 - DNA, 16 bp, H. sapiens
gagaattccttaaacc

SEQ ID NO: 100709 - DNA, 16 bp, H. sapiens
gagaattctatggcca

SEQ ID NO: 100710 - DNA, 16 bp, H. sapiens
gagaattgaaccaagt

SEQ ID NO: 100711 - DNA, 16 bp, H. sapiens
gagaattgcttgaaat

SEQ ID NO: 100712 - DNA, 16 bp, H. sapiens
gagaattgcttggact

SEQ ID NO: 100713 - DNA, 16 bp, H. sapiens
gagaattgctttaacc

SEQ ID NO: 100714 - DNA, 16 bp, H. sapiens
gagaatttcaggccaa

SEQ ID NO: 100715 - DNA, 16 bp, H. sapiens
gagaattttgaatgtt

SEQ ID NO: 100716 - DNA, 16 bp, H. sapiens
gagaatttttttaaaa

SEQ ID NO: 100717 - DNA, 16 bp, H. sapiens
gagacaaacagttgca

SEQ ID NO: 100718 - DNA, 16 bp, H. sapiens
gagacaaagaaagcca

SEQ ID NO: 100719 - DNA, 16 bp, H. sapiens
gagacaaagatggcca

SEQ ID NO: 100720 - DNA, 16 bp, H. sapiens
gagacaaagcaagacc

SEQ ID NO: 100721 - DNA, 16 bp, H. sapiens
gagacaaagcctcact

SEQ ID NO: 100722 - DNA, 16 bp, H. sapiens
gagacaaaggagacat

SEQ ID NO: 100723 - DNA, 16 bp, H. sapiens
gagacaaagtctcact

SEQ ID NO: 100724 - DNA, 16 bp, H. sapiens
gagacaaagtctggct

SEQ ID NO: 100725 - DNA, 16 bp, H. sapiens
gagacaagatcttgct

SEQ ID NO: 100726 - DNA, 16 bp, H. sapiens
gagacaaggcctcact

SEQ ID NO: 100727 - DNA, 16 bp, H. sapiens
gagacaaggtcacact

SEQ ID NO: 100728 - DNA, 16 bp, H. sapiens
gagacaaggtctcgct

SEQ ID NO: 100729 - DNA, 16 bp, H. sapiens
gagacaaggtcttgct

SEQ ID NO: 100730 - DNA, 16 bp, H. sapiens
gagacaaggtttcacc

SEQ ID NO: 100731 - DNA, 16 bp, H. sapiens
gagacaataattaata

SEQ ID NO: 100732 - DNA, 16 bp, H. sapiens
gagacaatgggatttt

SEQ ID NO: 100733 - DNA, 16 bp, H. sapiens
gagacacacacacaca

SEQ ID NO: 100734 - DNA, 16 bp, H. sapiens
gagacacagaaaggtt

SEQ ID NO: 100735 - DNA, 16 bp, H. sapiens
gagacacagacacaaa

SEQ ID NO: 100736 - DNA, 16 bp, H. sapiens
gagacacagacacaga

SEQ ID NO: 100737 - DNA, 16 bp, H. sapiens
gagacacctgaggaca

SEQ ID NO: 100738 - DNA, 16 bp, H. sapiens
gagacacggtcttgct

SEQ ID NO: 100739 - DNA, 16 bp, H. sapiens
gagacactgcgcctgg

SEQ ID NO: 100740 - DNA, 16 bp, H. sapiens
gagacactgtcaaaaa

SEQ ID NO: 100741 - DNA, 16 bp, H. sapiens
gagacagaaaacaaat

SEQ ID NO: 100742 - DNA, 16 bp, H. sapiens
gagacagaaaattaac

SEQ ID NO: 100743 - DNA, 16 bp, H. sapiens
gagacagaaagtcagc

SEQ ID NO: 100744 - DNA, 16 bp, H. sapiens
gagacagaaagtggaa

SEQ ID NO: 100745 - DNA, 16 bp, H. sapiens
gagacagaactgttca

SEQ ID NO: 100746 - DNA, 16 bp, H. sapiens
gagacagaagaaaatc

SEQ ID NO: 100747 - DNA, 16 bp, H. sapiens
gagacagaatctcact

SEQ ID NO: 100748 - DNA, 16 bp, H. sapiens
gagacagaatctccct

SEQ ID NO: 100749 - DNA, 16 bp, H. sapiens
gagacagaatctggct

SEQ ID NO: 100750 - DNA, 16 bp, H. sapiens
gagacagacacagaga

SEQ ID NO: 100751 - DNA, 16 bp, H. sapiens
gagacagacacagtgc

SEQ ID NO: 100752 - DNA, 16 bp, H. sapiens
gagacagacagacaga

SEQ ID NO: 100753 - DNA, 16 bp, H. sapiens
gagacagagaaataga

SEQ ID NO: 100754 - DNA, 16 bp, H. sapiens
gagacagagacacaaa

SEQ ID NO: 100755 - DNA, 16 bp, H. sapiens
gagacagagacagaca

SEQ ID NO: 100756 - DNA, 16 bp, H. sapiens
gagacagagacagagg

SEQ ID NO: 100757 - DNA, 16 bp, H. sapiens
gagacagagactgaga

SEQ ID NO: 100758 - DNA, 16 bp, H. sapiens
gagacagagagatgga

SEQ ID NO: 100759 - DNA, 16 bp, H. sapiens
gagacagagatagaaa

SEQ ID NO: 100760 - DNA, 16 bp, H. sapiens
gagacagagataggga

SEQ ID NO: 100761 - DNA, 16 bp, H. sapiens
gagacagagatcagag

SEQ ID NO: 100762 - DNA, 16 bp, H. sapiens
gagacagagcctttaa

SEQ ID NO: 100763 - DNA, 16 bp, H. sapiens
gagacagagctagact

SEQ ID NO: 100764 - DNA, 16 bp, H. sapiens
gagacagaggagaggc

SEQ ID NO: 100765 - DNA, 16 bp, H. sapiens
gagacagaggctcgct

SEQ ID NO: 100766 - DNA, 16 bp, H. sapiens
gagacagagtctcact

SEQ ID NO: 100767 - DNA, 16 bp, H. sapiens
gagacagagtctcgca

SEQ ID NO: 100768 - DNA, 16 bp, H. sapiens
gagacagagtctcgcg

SEQ ID NO: 100769 - DNA, 16 bp, H. sapiens
gagacagagtctcgct

SEQ ID NO: 100770 - DNA, 16 bp, H. sapiens
gagacagagtctgact

SEQ ID NO: 100771 - DNA, 16 bp, H. sapiens
gagacagagtctggct

SEQ ID NO: 100772 - DNA, 16 bp, H. sapiens
gagacagagtcttact

SEQ ID NO: 100773 - DNA, 16 bp, H. sapiens
gagacagagtttcact

SEQ ID NO: 100774 - DNA, 16 bp, H. sapiens
gagacagagtttcgca

SEQ ID NO: 100775 - DNA, 16 bp, H. sapiens
gagacagagtttctcc

SEQ ID NO: 100776 - DNA, 16 bp, H. sapiens
gagacagagtttctct

SEQ ID NO: 100777 - DNA, 16 bp, H. sapiens
gagacagagttttgcc

SEQ ID NO: 100778 - DNA, 16 bp, H. sapiens
gagacagatcctcact

SEQ ID NO: 100779 - DNA, 16 bp, H. sapiens
gagacagcaagaacaa

SEQ ID NO: 100780 - DNA, 16 bp, H. sapiens
gagacagcaagaccaa

SEQ ID NO: 100781 - DNA, 16 bp, H. sapiens
gagacagcaccactgc

SEQ ID NO: 100782 - DNA, 16 bp, H. sapiens
gagacagcatctcacc

SEQ ID NO: 100783 - DNA, 16 bp, H. sapiens
gagacagcgtttctcc

SEQ ID NO: 100784 - DNA, 16 bp, H. sapiens
gagacaggagaatggc

SEQ ID NO: 100785 - DNA, 16 bp, H. sapiens
gagacaggagaattgt

SEQ ID NO: 100786 - DNA, 16 bp, H. sapiens
gagacaggagacagga

SEQ ID NO: 100787 - DNA, 16 bp, H. sapiens
gagacaggagggcaag

SEQ ID NO: 100788 - DNA, 16 bp, H. sapiens
gagacaggatctcact

SEQ ID NO: 100789 - DNA, 16 bp, H. sapiens
gagacaggatcttgct

SEQ ID NO: 100790 - DNA, 16 bp, H. sapiens
gagacaggatttcacc

SEQ ID NO: 100791 - DNA, 16 bp, H. sapiens
gagacaggatttcact

SEQ ID NO: 100792 - DNA, 16 bp, H. sapiens
gagacaggcacagaga

SEQ ID NO: 100793 - DNA, 16 bp, H. sapiens
gagacagggactcact

SEQ ID NO: 100794 - DNA, 25 bp, H. sapiens
gagacagggatgccctctctcacca

SEQ ID NO: 100795 - DNA, 16 bp, H. sapiens
gagacagggcctcgct

SEQ ID NO: 100796 - DNA, 16 bp, H. sapiens
gagacagggcttgctc

SEQ ID NO: 100797 - DNA, 16 bp, H. sapiens
gagacaggggctcgct

SEQ ID NO: 100798 - DNA, 16 bp, H. sapiens
gagacagggtcatgct

SEQ ID NO: 100799 - DNA, 16 bp, H. sapiens
gagacagggtcctgct

SEQ ID NO: 100800 - DNA, 16 bp, H. sapiens
gagacagggtcgcact

SEQ ID NO: 100801 - DNA, 16 bp, H. sapiens
gagacagggtctcact

SEQ ID NO: 100802 - DNA, 16 bp, H. sapiens
gagacagggtctcatt

SEQ ID NO: 100803 - DNA, 16 bp, H. sapiens
gagacagggtctccct

SEQ ID NO: 100804 - DNA, 16 bp, H. sapiens
gagacagggtctcgca

SEQ ID NO: 100805 - DNA, 16 bp, H. sapiens
gagacagggtctcgct

SEQ ID NO: 100806 - DNA, 16 bp, H. sapiens
gagacagggtctctgt

SEQ ID NO: 100807 - DNA, 16 bp, H. sapiens
gagacagggtctggct

SEQ ID NO: 100808 - DNA, 16 bp, H. sapiens
gagacagggtcttact

SEQ ID NO: 100809 - DNA, 16 bp, H. sapiens
gagacagggtcttgct

SEQ ID NO: 100810 - DNA, 16 bp, H. sapiens
gagacagggtcttggt

SEQ ID NO: 100811 - DNA, 16 bp, H. sapiens
gagacagggtctttac

SEQ ID NO: 100812 - DNA, 16 bp, H. sapiens
gagacagggtttggct

SEQ ID NO: 100813 - DNA, 16 bp, H. sapiens
gagacagggttttact

SEQ ID NO: 100814 - DNA, 16 bp, H. sapiens
gagacagggttttcca

SEQ ID NO: 100815 - DNA, 16 bp, H. sapiens
gagacagggttttgct

SEQ ID NO: 100816 - DNA, 16 bp, H. sapiens
gagacagtaaaaggat

SEQ ID NO: 100817 - DNA, 16 bp, H. sapiens
gagacagtaattaata

SEQ ID NO: 100818 - DNA, 16 bp, H. sapiens
gagacagtcttgctcc

SEQ ID NO: 100819 - DNA, 16 bp, H. sapiens
gagacagtcttgctgt

SEQ ID NO: 100820 - DNA, 16 bp, H. sapiens
gagacagtcttgcttt

SEQ ID NO: 100821 - DNA, 16 bp, H. sapiens
gagacagtgtctctgt

SEQ ID NO: 100822 - DNA, 16 bp, H. sapiens
gagacagttaacaacc

SEQ ID NO: 100823 - DNA, 16 bp, H. sapiens
gagacagtttctctct

SEQ ID NO: 100824 - DNA, 16 bp, H. sapiens
gagacagttttgctct

SEQ ID NO: 100825 - DNA, 16 bp, H. sapiens
gagacatagaaaacaa

SEQ ID NO: 100826 - DNA, 16 bp, H. sapiens
gagacatcagtcaaat

SEQ ID NO: 100827 - DNA, 16 bp, H. sapiens
gagacatctgcacccc

SEQ ID NO: 100828 - DNA, 16 bp, H. sapiens
gagacatgcattacat

SEQ ID NO: 100829 - DNA, 16 bp, H. sapiens
gagacatgctggtggc

SEQ ID NO: 100830 - DNA, 16 bp, H. sapiens
gagacatggagtcaat

SEQ ID NO: 100831 - DNA, 16 bp, H. sapiens
gagacatttgaaattt

SEQ ID NO: 100832 - DNA, 16 bp, H. sapiens
gagacatttttgtttg

SEQ ID NO: 100833 - DNA, 16 bp, H. sapiens
gagacattttttgttg

SEQ ID NO: 100834 - DNA, 16 bp, H. sapiens
gagaccaaactgcaag

SEQ ID NO: 100835 - DNA, 16 bp, H. sapiens
gagaccaaagcaggag

SEQ ID NO: 100836 - DNA, 16 bp, H. sapiens
gagaccaacctggccg

SEQ ID NO: 100837 - DNA, 16 bp, H. sapiens
gagaccaacctggtca

SEQ ID NO: 100838 - DNA, 16 bp, H. sapiens
gagaccaacgtggcca

SEQ ID NO: 100839 - DNA, 16 bp, H. sapiens
gagaccaaggcagaca

SEQ ID NO: 100840 - DNA, 16 bp, H. sapiens
gagaccaagtctctct

SEQ ID NO: 100841 - DNA, 16 bp, H. sapiens
gagaccaccacaaaga

SEQ ID NO: 100842 - DNA, 16 bp, H. sapiens
gagaccaccctggaca

SEQ ID NO: 100843 - DNA, 16 bp, H. sapiens
gagaccaccctgggca

SEQ ID NO: 100844 - DNA, 16 bp, H. sapiens
gagaccacgaacccac

SEQ ID NO: 100845 - DNA, 16 bp, H. sapiens
gagaccagcaaggggg

SEQ ID NO: 100846 - DNA, 16 bp, H. sapiens
gagaccagcctaggaa

SEQ ID NO: 100847 - DNA, 16 bp, H. sapiens
gagaccagcctgacaa

SEQ ID NO: 100848 - DNA, 16 bp, H. sapiens
gagaccagcctggctg

SEQ ID NO: 100849 - DNA, 16 bp, H. sapiens
gagaccagcctgggca

SEQ ID NO: 100850 - DNA, 17 bp, H. sapiens
gagaccagcctgggcag

SEQ ID NO: 100851 - DNA, 16 bp, H. sapiens
gagaccagcctgggga

SEQ ID NO: 100852 - DNA, 16 bp, H. sapiens
gagaccagcctgtcta

SEQ ID NO: 100853 - DNA, 17 bp, H. sapiens
gagaccagccttggcaa

SEQ ID NO: 100854 - DNA, 16 bp, H. sapiens
gagaccagcgtgggca

SEQ ID NO: 100855 - DNA, 16 bp, H. sapiens
gagaccagctcagtcg

SEQ ID NO: 100856 - DNA, 16 bp, H. sapiens
gagaccagctgggcaa

SEQ ID NO: 100857 - DNA, 16 bp, H. sapiens
gagaccagcttagcca

SEQ ID NO: 100858 - DNA, 16 bp, H. sapiens
gagaccagcttggcca

SEQ ID NO: 100859 - DNA, 16 bp, H. sapiens
gagaccaggagtttca

SEQ ID NO: 100860 - DNA, 16 bp, H. sapiens
gagaccaggtctccct

SEQ ID NO: 100861 - DNA, 16 bp, H. sapiens
gagaccagtctgtgca

SEQ ID NO: 100862 - DNA, 16 bp, H. sapiens
gagaccagtgaggagg

SEQ ID NO: 100863 - DNA, 16 bp, H. sapiens
gagaccatccgggcca

SEQ ID NO: 100864 - DNA, 16 bp, H. sapiens
gagaccatgtggcctg

SEQ ID NO: 100865 - DNA, 16 bp, H. sapiens
gagacccacaaagaga

SEQ ID NO: 100866 - DNA, 16 bp, H. sapiens
gagacccacagtgggt

SEQ ID NO: 100867 - DNA, 16 bp, H. sapiens
gagacccacctgggca

SEQ ID NO: 100868 - DNA, 16 bp, H. sapiens
gagacccagcctggcc

SEQ ID NO: 100869 - DNA, 16 bp, H. sapiens
gagacccaggaaagag

SEQ ID NO: 100870 - DNA, 16 bp, H. sapiens
gagacccaggcctcat

SEQ ID NO: 100871 - DNA, 16 bp, H. sapiens
gagacccaggtgggtg

SEQ ID NO: 100872 - DNA, 16 bp, H. sapiens
gagaccccagagagct

SEQ ID NO: 100873 - DNA, 16 bp, H. sapiens
gagaccccatccctac

SEQ ID NO: 100874 - DNA, 16 bp, H. sapiens
gagaccccatctcaat

SEQ ID NO: 100875 - DNA, 20 bp, H. sapiens
gagaccccatctctaaaaaa

SEQ ID NO: 100876 - DNA, 16 bp, H. sapiens
gagaccccatctctat

SEQ ID NO: 100877 - DNA, 16 bp, H. sapiens
gagaccctaagcagag

SEQ ID NO: 100878 - DNA, 16 bp, H. sapiens
gagaccctatctcaga

SEQ ID NO: 100879 - DNA, 17 bp, H. sapiens
gagaccctccgcctggc

SEQ ID NO: 100880 - DNA, 16 bp, H. sapiens
gagaccctgagccaga

SEQ ID NO: 100881 - DNA, 16 bp, H. sapiens
gagaccctgccactgc

SEQ ID NO: 100882 - DNA, 16 bp, H. sapiens
gagaccctgtatttaa

SEQ ID NO: 100883 - DNA, 16 bp, H. sapiens
gagaccctgtctccaa

SEQ ID NO: 100884 - DNA, 16 bp, H. sapiens
gagaccctgtctccac

SEQ ID NO: 100885 - DNA, 16 bp, H. sapiens
gagaccgaggtgggag

SEQ ID NO: 100886 - DNA, 16 bp, H. sapiens
gagaccgaggtgggca

SEQ ID NO: 100887 - DNA, 16 bp, H. sapiens
gagaccgagtctcact

SEQ ID NO: 100888 - DNA, 16 bp, H. sapiens
gagaccggagttttat

SEQ ID NO: 100889 - DNA, 17 bp, H. sapiens
gagaccggcctggccaa

SEQ ID NO: 100890 - DNA, 17 bp, H. sapiens
gagaccggtagtggccc

SEQ ID NO: 100891 - DNA, 16 bp, H. sapiens
gagaccgtctcaaaaa

SEQ ID NO: 100892 - DNA, 16 bp, H. sapiens
gagaccgtggaaggag

SEQ ID NO: 100893 - DNA, 16 bp, H. sapiens
gagacctcaggaaact

SEQ ID NO: 100894 - DNA, 16 bp, H. sapiens
gagacctcatcagcct

SEQ ID NO: 100895 - DNA, 16 bp, H. sapiens
gagacctcatctcaaa

SEQ ID NO: 100896 - DNA, 16 bp, H. sapiens
gagacctcatctccaa

SEQ ID NO: 100897 - DNA, 16 bp, H. sapiens
gagacctgcctcagat

SEQ ID NO: 100898 - DNA, 16 bp, H. sapiens
gagacctggccaacat

SEQ ID NO: 100899 - DNA, 16 bp, H. sapiens
gagacctgggtttgaa

SEQ ID NO: 100900 - DNA, 16 bp, H. sapiens
gagaccttgtctctat

SEQ ID NO: 100901 - DNA, 16 bp, H. sapiens
gagaccttgtgatcat

SEQ ID NO: 100902 - DNA, 16 bp, H. sapiens
gagacgaagtctcgct

SEQ ID NO: 100903 - DNA, 16 bp, H. sapiens
gagacggagcctcact

SEQ ID NO: 100904 - DNA, 16 bp, H. sapiens
gagacggagtctctct

SEQ ID NO: 100905 - DNA, 16 bp, H. sapiens
gagacggagtcttact

SEQ ID NO: 100906 - DNA, 16 bp, H. sapiens
gagacggagtcttgcc

SEQ ID NO: 100907 - DNA, 16 bp, H. sapiens
gagacggagtgttgct

SEQ ID NO: 100908 - DNA, 16 bp, H. sapiens
gagacggagtttcacg

SEQ ID NO: 100909 - DNA, 16 bp, H. sapiens
gagacggagtttcgcc

SEQ ID NO: 100910 - DNA, 16 bp, H. sapiens
gagacggagttttgct

SEQ ID NO: 100911 - DNA, 16 bp, H. sapiens
gagacggagtttttgc

SEQ ID NO: 100912 - DNA, 20 bp, H. sapiens
gagacgggcggatcacctga

SEQ ID NO: 100913 - DNA, 16 bp, H. sapiens
gagacggggcctcact

SEQ ID NO: 100914 - DNA, 16 bp, H. sapiens
gagacggggtctccct

SEQ ID NO: 100915 - DNA, 16 bp, H. sapiens
gagacggggtttcatt

SEQ ID NO: 100916 - DNA, 16 bp, H. sapiens
gagacgtagtcttgct

SEQ ID NO: 100917 - DNA, 16 bp, H. sapiens
gagactacaggcgcgt

SEQ ID NO: 100918 - DNA, 16 bp, H. sapiens
gagactactgaaaaaa

SEQ ID NO: 100919 - DNA, 16 bp, H. sapiens
gagactagcttggcca

SEQ ID NO: 100920 - DNA, 23 bp, H. sapiens
gagactaggattgcaacccctgc

SEQ ID NO: 100921 - DNA, 16 bp, H. sapiens
gagactattactctaa

SEQ ID NO: 100922 - DNA, 16 bp, H. sapiens
gagactatttttaaaa

SEQ ID NO: 100923 - DNA, 16 bp, H. sapiens
gagactcactctgttg

SEQ ID NO: 100924 - DNA, 17 bp, H. sapiens
gagactcagtctcaaaa

SEQ ID NO: 100925 - DNA, 16 bp, H. sapiens
gagactccatctaaaa

SEQ ID NO: 100926 - DNA, 16 bp, H. sapiens
gagactccattttgtt

SEQ ID NO: 100927 - DNA, 16 bp, H. sapiens
gagactccgtctcaat

SEQ ID NO: 100928 - DNA, 16 bp, H. sapiens
gagactcggtctcaaa

SEQ ID NO: 100929 - DNA, 16 bp, H. sapiens
gagactctctcaaaaa

SEQ ID NO: 100930 - DNA, 16 bp, H. sapiens
gagactctgcttcaaa

SEQ ID NO: 100931 - DNA, 16 bp, H. sapiens
gagactctgtcacaaa

SEQ ID NO: 100932 - DNA, 16 bp, H. sapiens
gagactctgtcgccca

SEQ ID NO: 100933 - DNA, 16 bp, H. sapiens
gagactctgtttcaaa

SEQ ID NO: 100934 - DNA, 16 bp, H. sapiens
gagactctgtttggga

SEQ ID NO: 100935 - DNA, 16 bp, H. sapiens
gagactgaagcaggaa

SEQ ID NO: 100936 - DNA, 16 bp, H. sapiens
gagactgaataattta

SEQ ID NO: 100937 - DNA, 16 bp, H. sapiens
gagactgagacaagag

SEQ ID NO: 100938 - DNA, 16 bp, H. sapiens
gagactgagacagaga

SEQ ID NO: 100939 - DNA, 17 bp, H. sapiens
gagactgagatgggaga

SEQ ID NO: 100940 - DNA, 16 bp, H. sapiens
gagactgaggcaagag

SEQ ID NO: 100941 - DNA, 16 bp, H. sapiens
gagactgaggcagaag

SEQ ID NO: 100942 - DNA, 16 bp, H. sapiens
gagactgaggcagaga

SEQ ID NO: 100943 - DNA, 16 bp, H. sapiens
gagactgaggcagagg

SEQ ID NO: 100944 - DNA, 16 bp, H. sapiens
gagactgaggcaggca

SEQ ID NO: 100945 - DNA, 16 bp, H. sapiens
gagactgaggccagag

SEQ ID NO: 100946 - DNA, 16 bp, H. sapiens
gagactgaggcgggag

SEQ ID NO: 100947 - DNA, 16 bp, H. sapiens
gagactgaggtgggag

SEQ ID NO: 100948 - DNA, 16 bp, H. sapiens
gagactgaggtgggca

SEQ ID NO: 100949 - DNA, 16 bp, H. sapiens
gagactgaggtggtag

SEQ ID NO: 100950 - DNA, 16 bp, H. sapiens
gagactgagtctcact

SEQ ID NO: 100951 - DNA, 16 bp, H. sapiens
gagactgagttttgct

SEQ ID NO: 100952 - DNA, 16 bp, H. sapiens
gagactgattttggac

SEQ ID NO: 100953 - DNA, 16 bp, H. sapiens
gagactgcagagaaaa

SEQ ID NO: 100954 - DNA, 16 bp, H. sapiens
gagactgcagtgagcc

SEQ ID NO: 100955 - DNA, 16 bp, H. sapiens
gagactggatcttgct

SEQ ID NO: 100956 - DNA, 16 bp, H. sapiens
gagactggccttttgg

SEQ ID NO: 100957 - DNA, 16 bp, H. sapiens
gagactgggccactgc

SEQ ID NO: 100958 - DNA, 16 bp, H. sapiens
gagactgggtcttgct

SEQ ID NO: 100959 - DNA, 16 bp, H. sapiens
gagactgtctaaaaaa

SEQ ID NO: 100960 - DNA, 16 bp, H. sapiens
gagactgtggaaagag

SEQ ID NO: 100961 - DNA, 16 bp, H. sapiens
gagactgtggccaccc

SEQ ID NO: 100962 - DNA, 16 bp, H. sapiens
gagacttcaacacacc

SEQ ID NO: 100963 - DNA, 16 bp, H. sapiens
gagacttcaacatccc

SEQ ID NO: 100964 - DNA, 16 bp, H. sapiens
gagacttcagtgagcc

SEQ ID NO: 100965 - DNA, 16 bp, H. sapiens
gagacttcatcaaaaa

SEQ ID NO: 100966 - DNA, 16 bp, H. sapiens
gagacttccccagcca

SEQ ID NO: 100967 - DNA, 16 bp, H. sapiens
gagacttgctggcttc

SEQ ID NO: 100968 - DNA, 16 bp, H. sapiens
gagacttggtctcaaa

SEQ ID NO: 100969 - DNA, 16 bp, H. sapiens
gagactttcaaagatg

SEQ ID NO: 100970 - DNA, 16 bp, H. sapiens
gagactttggatttgg

SEQ ID NO: 100971 - DNA, 16 bp, H. sapiens
gagactttttctgatg

SEQ ID NO: 100972 - DNA, 16 bp, H. sapiens
gagagaaaaacatttt

SEQ ID NO: 100973 - DNA, 16 bp, H. sapiens
gagagaaaacagaaat

SEQ ID NO: 100974 - DNA, 16 bp, H. sapiens
gagagaaaatatttgt

SEQ ID NO: 100975 - DNA, 16 bp, H. sapiens
gagagaaaatgatttt

SEQ ID NO: 100976 - DNA, 16 bp, H. sapiens
gagagaaaatgcaaat

SEQ ID NO: 100977 - DNA, 16 bp, H. sapiens
gagagaaacagtggat

SEQ ID NO: 100978 - DNA, 16 bp, H. sapiens
gagagaaaccccagcc

SEQ ID NO: 100979 - DNA, 16 bp, H. sapiens
gagagaaaggccaagt

SEQ ID NO: 100980 - DNA, 16 bp, H. sapiens
gagagaaagtcttgct

SEQ ID NO: 100981 - DNA, 16 bp, H. sapiens
gagagaaatcacaggc

SEQ ID NO: 100982 - DNA, 16 bp, H. sapiens
gagagaaattaaagat

SEQ ID NO: 100983 - DNA, 16 bp, H. sapiens
gagagaagaaggtttc

SEQ ID NO: 100984 - DNA, 16 bp, H. sapiens
gagagaagacaagatt

SEQ ID NO: 100985 - DNA, 16 bp, H. sapiens
gagagaagagctgcag

SEQ ID NO: 100986 - DNA, 16 bp, H. sapiens
gagagaagatcaaaat

SEQ ID NO: 100987 - DNA, 16 bp, H. sapiens
gagagaagatgcaaat

SEQ ID NO: 100988 - DNA, 16 bp, H. sapiens
gagagaagattcaaat

SEQ ID NO: 100989 - DNA, 16 bp, H. sapiens
gagagaagcaagagca

SEQ ID NO: 100990 - DNA, 16 bp, H. sapiens
gagagaagcagagaca

SEQ ID NO: 100991 - DNA, 16 bp, H. sapiens
gagagaagcagagatg

SEQ ID NO: 100992 - DNA, 16 bp, H. sapiens
gagagaaggggctggg

SEQ ID NO: 100993 - DNA, 16 bp, H. sapiens
gagagaagtggacaga

SEQ ID NO: 100994 - DNA, 16 bp, H. sapiens
gagagaataaatttcc

SEQ ID NO: 100995 - DNA, 16 bp, H. sapiens
gagagaatggcttgaa

SEQ ID NO: 100996 - DNA, 16 bp, H. sapiens
gagagaatgggagaca

SEQ ID NO: 100997 - DNA, 16 bp, H. sapiens
gagagacacagagaga

SEQ ID NO: 100998 - DNA, 16 bp, H. sapiens
gagagacacctcccag

SEQ ID NO: 100999 - DNA, 16 bp, H. sapiens
gagagacagaaaatga

SEQ ID NO: 101000 - DNA, 16 bp, H. sapiens
gagagacagacagatg

SEQ ID NO: 101001 - DNA, 16 bp, H. sapiens
gagagacagagacaga

SEQ ID NO: 101002 - DNA, 16 bp, H. sapiens
gagagacagagcgaga

SEQ ID NO: 101003 - DNA, 16 bp, H. sapiens
gagagacagaggcagg

SEQ ID NO: 101004 - DNA, 16 bp, H. sapiens
gagagacagagtgtgt

SEQ ID NO: 101005 - DNA, 16 bp, H. sapiens
gagagacagagttttg

SEQ ID NO: 101006 - DNA, 16 bp, H. sapiens
gagagacagcaagaga

SEQ ID NO: 101007 - DNA, 16 bp, H. sapiens
gagagacagtgacaga

SEQ ID NO: 101008 - DNA, 16 bp, H. sapiens
gagagacctcaggaaa

SEQ ID NO: 101009 - DNA, 16 bp, H. sapiens
gagagacctggtggaa

SEQ ID NO: 101010 - DNA, 16 bp, H. sapiens
gagagaccttgagcca

SEQ ID NO: 101011 - DNA, 16 bp, H. sapiens
gagagactaagggagg

SEQ ID NO: 101012 - DNA, 16 bp, H. sapiens
gagagactgaggcaag

SEQ ID NO: 101013 - DNA, 16 bp, H. sapiens
gagagactgggctaca

SEQ ID NO: 101014 - DNA, 16 bp, H. sapiens
gagagactgtttgttt

SEQ ID NO: 101015 - DNA, 16 bp, H. sapiens
gagagagaaaaatttt

SEQ ID NO: 101016 - DNA, 16 bp, H. sapiens
gagagagaaaataaca

SEQ ID NO: 101017 - DNA, 16 bp, H. sapiens
gagagagaaactctgt

SEQ ID NO: 101018 - DNA, 16 bp, H. sapiens
gagagagaaactgaga

SEQ ID NO: 101019 - DNA, 16 bp, H. sapiens
gagagagaaatattat

SEQ ID NO: 101020 - DNA, 16 bp, H. sapiens
gagagagaaattgaga

SEQ ID NO: 101021 - DNA, 16 bp, H. sapiens
gagagagaaatttata

SEQ ID NO: 101022 - DNA, 16 bp, H. sapiens
gagagagaactagaca

SEQ ID NO: 101023 - DNA, 16 bp, H. sapiens
gagagagaagaatcaa

SEQ ID NO: 101024 - DNA, 16 bp, H. sapiens
gagagagaataagcaa

SEQ ID NO: 101025 - DNA, 16 bp, H. sapiens
gagagagaatgaggca

SEQ ID NO: 101026 - DNA, 16 bp, H. sapiens
gagagagacacacaga

SEQ ID NO: 101027 - DNA, 16 bp, H. sapiens
gagagagacagacaga

SEQ ID NO: 101028 - DNA, 16 bp, H. sapiens
gagagagacagcgaga

SEQ ID NO: 101029 - DNA, 16 bp, H. sapiens
gagagagacccagaga

SEQ ID NO: 101030 - DNA, 16 bp, H. sapiens
gagagagacctcatct

SEQ ID NO: 101031 - DNA, 16 bp, H. sapiens
gagagagactccctct

SEQ ID NO: 101032 - DNA, 16 bp, H. sapiens
gagagagactgtgtct

SEQ ID NO: 101033 - DNA, 16 bp, H. sapiens
gagagagactttgttt

SEQ ID NO: 101034 - DNA, 16 bp, H. sapiens
gagagagagaaaagct

SEQ ID NO: 101035 - DNA, 16 bp, H. sapiens
gagagagagaaaatct

SEQ ID NO: 101036 - DNA, 16 bp, H. sapiens
gagagagagaaaatgt

SEQ ID NO: 101037 - DNA, 16 bp, H. sapiens
gagagagagaaactga

SEQ ID NO: 101038 - DNA, 16 bp, H. sapiens
gagagagagaaagcca

SEQ ID NO: 101039 - DNA, 16 bp, H. sapiens
gagagagagaaagtca

SEQ ID NO: 101040 - DNA, 16 bp, H. sapiens
gagagagagaaatatt

SEQ ID NO: 101041 - DNA, 16 bp, H. sapiens
gagagagagaaattgg

SEQ ID NO: 101042 - DNA, 16 bp, H. sapiens
gagagagagaacattt

SEQ ID NO: 101043 - DNA, 16 bp, H. sapiens
gagagagagaagcagc

SEQ ID NO: 101044 - DNA, 16 bp, H. sapiens
gagagagagaatgagc

SEQ ID NO: 101045 - DNA, 16 bp, H. sapiens
gagagagagaatgatg

SEQ ID NO: 101046 - DNA, 16 bp, H. sapiens
gagagagagaatttga

SEQ ID NO: 101047 - DNA, 16 bp, H. sapiens
gagagagagacagctt

SEQ ID NO: 101048 - DNA, 16 bp, H. sapiens
gagagagagaccagaa

SEQ ID NO: 101049 - DNA, 16 bp, H. sapiens
gagagagagaccgaga

SEQ ID NO: 101050 - DNA, 16 bp, H. sapiens
gagagagagactgaga

SEQ ID NO: 101051 - DNA, 16 bp, H. sapiens
gagagagagactgcat

SEQ ID NO: 101052 - DNA, 16 bp, H. sapiens
gagagagagagaaatt

SEQ ID NO: 101053 - DNA, 16 bp, H. sapiens
gagagagagagaactg

SEQ ID NO: 101054 - DNA, 16 bp, H. sapiens
gagagagagagacttt

SEQ ID NO: 101055 - DNA, 16 bp, H. sapiens
gagagagagagagact

SEQ ID NO: 101056 - DNA, 16 bp, H. sapiens
gagagagagagagctg

SEQ ID NO: 101057 - DNA, 16 bp, H. sapiens
gagagagagagatcct

SEQ ID NO: 101058 - DNA, 16 bp, H. sapiens
gagagagagagatcga

SEQ ID NO: 101059 - DNA, 16 bp, H. sapiens
gagagagagagatgcc

SEQ ID NO: 101060 - DNA, 16 bp, H. sapiens
gagagagagagatgtg

SEQ ID NO: 101061 - DNA, 16 bp, H. sapiens
gagagagagagattac

SEQ ID NO: 101062 - DNA, 16 bp, H. sapiens
gagagagagagcatga

SEQ ID NO: 101063 - DNA, 16 bp, H. sapiens
gagagagagagctgga

SEQ ID NO: 101064 - DNA, 16 bp, H. sapiens
gagagagagaggtgcc

SEQ ID NO: 101065 - DNA, 16 bp, H. sapiens
gagagagagagtcttg

SEQ ID NO: 101066 - DNA, 16 bp, H. sapiens
gagagagagatgagat

SEQ ID NO: 101067 - DNA, 16 bp, H. sapiens
gagagagagccagaga

SEQ ID NO: 101068 - DNA, 16 bp, H. sapiens
gagagagagcgagagc

SEQ ID NO: 101069 - DNA, 16 bp, H. sapiens
gagagagaggaggctg

SEQ ID NO: 101070 - DNA, 16 bp, H. sapiens
gagagagaggctgggg

SEQ ID NO: 101071 - DNA, 16 bp, H. sapiens
gagagagagtgaagtg

SEQ ID NO: 101072 - DNA, 16 bp, H. sapiens
gagagagagtgagagt

SEQ ID NO: 101073 - DNA, 16 bp, H. sapiens
gagagagagtttcacc

SEQ ID NO: 101074 - DNA, 16 bp, H. sapiens
gagagagatgatttaa

SEQ ID NO: 101075 - DNA, 16 bp, H. sapiens
gagagagatgatttgg

SEQ ID NO: 101076 - DNA, 16 bp, H. sapiens
gagagagattgagaaa

SEQ ID NO: 101077 - DNA, 16 bp, H. sapiens
gagagagcagcagaga

SEQ ID NO: 101078 - DNA, 16 bp, H. sapiens
gagagagcagcccagg

SEQ ID NO: 101079 - DNA, 16 bp, H. sapiens
gagagagcgagagagc

SEQ ID NO: 101080 - DNA, 16 bp, H. sapiens
gagagagctgtttttc

SEQ ID NO: 101081 - DNA, 16 bp, H. sapiens
gagagaggacacaaac

SEQ ID NO: 101082 - DNA, 16 bp, H. sapiens
gagagaggaggctggg

SEQ ID NO: 101083 - DNA, 16 bp, H. sapiens
gagagaggaggggctg

SEQ ID NO: 101084 - DNA, 16 bp, H. sapiens
gagagaggaggtgcca

SEQ ID NO: 101085 - DNA, 16 bp, H. sapiens
gagagaggatgatatt

SEQ ID NO: 101086 - DNA, 16 bp, H. sapiens
gagagagggtctcact

SEQ ID NO: 101087 - DNA, 16 bp, H. sapiens
gagagagggtcttgct

SEQ ID NO: 101088 - DNA, 16 bp, H. sapiens
gagagaggtctcagaa

SEQ ID NO: 101089 - DNA, 16 bp, H. sapiens
gagagaggtttcacca

SEQ ID NO: 101090 - DNA, 16 bp, H. sapiens
gagagagtcagagaga

SEQ ID NO: 101091 - DNA, 16 bp, H. sapiens
gagagagtctctctct

SEQ ID NO: 101092 - DNA, 16 bp, H. sapiens
gagagagtgagagtga

SEQ ID NO: 101093 - DNA, 16 bp, H. sapiens
gagagagtgagtgagt

SEQ ID NO: 101094 - DNA, 16 bp, H. sapiens
gagagagtgtctcact

SEQ ID NO: 101095 - DNA, 16 bp, H. sapiens
gagagatacataaagg

SEQ ID NO: 101096 - DNA, 16 bp, H. sapiens
gagagatccactatta

SEQ ID NO: 101097 - DNA, 16 bp, H. sapiens
gagagatgaagccagc

SEQ ID NO: 101098 - DNA, 16 bp, H. sapiens
gagagatgactgcaga

SEQ ID NO: 101099 - DNA, 16 bp, H. sapiens
gagagattaaatgact

SEQ ID NO: 101100 - DNA, 16 bp, H. sapiens
gagagattgaaataat

SEQ ID NO: 101101 - DNA, 18 bp, H. sapiens
gagagcaaaactccatct

SEQ ID NO: 101102 - DNA, 16 bp, H. sapiens
gagagcaacagagaga

SEQ ID NO: 101103 - DNA, 16 bp, H. sapiens
gagagcaaccagtctg

SEQ ID NO: 101104 - DNA, 16 bp, H. sapiens
gagagcaagacagaga

SEQ ID NO: 101105 - DNA, 18 bp, H. sapiens
gagagcaagactccatct

SEQ ID NO: 101106 - DNA, 16 bp, H. sapiens
gagagcaagagagggc

SEQ ID NO: 101107 - DNA, 16 bp, H. sapiens
gagagcacagagaagg

SEQ ID NO: 101108 - DNA, 16 bp, H. sapiens
gagagcaccacatcaa

SEQ ID NO: 101109 - DNA, 16 bp, H. sapiens
gagagcagagaggagc

SEQ ID NO: 101110 - DNA, 16 bp, H. sapiens
gagagcagagcccagg

SEQ ID NO: 101111 - DNA, 16 bp, H. sapiens
gagagcagcacaggaa

SEQ ID NO: 101112 - DNA, 16 bp, H. sapiens
gagagcagcctgccca

SEQ ID NO: 101113 - DNA, 16 bp, H. sapiens
gagagcagcctggaca

SEQ ID NO: 101114 - DNA, 16 bp, H. sapiens
gagagcagcctgtcca

SEQ ID NO: 101115 - DNA, 16 bp, H. sapiens
gagagcaggagcaaga

SEQ ID NO: 101116 - DNA, 16 bp, H. sapiens
gagagcagtggacctc

SEQ ID NO: 101117 - DNA, 16 bp, H. sapiens
gagagcatcaggataa

SEQ ID NO: 101118 - DNA, 16 bp, H. sapiens
gagagccaagcaaagg

SEQ ID NO: 101119 - DNA, 16 bp, H. sapiens
gagagccacttccacc

SEQ ID NO: 101120 - DNA, 16 bp, H. sapiens
gagagcccagccccca

SEQ ID NO: 101121 - DNA, 16 bp, H. sapiens
gagagcctgagctcag

SEQ ID NO: 101122 - DNA, 20 bp, H. sapiens
gagagcgagaccatcctggc

SEQ ID NO: 101123 - DNA, 16 bp, H. sapiens
gagagcgagagcgaga

SEQ ID NO: 101124 - DNA, 16 bp, H. sapiens
gagagctagttgttta

SEQ ID NO: 101125 - DNA, 16 bp, H. sapiens
gagagctctcttcctg

SEQ ID NO: 101126 - DNA, 16 bp, H. sapiens
gagagctgcagagatg

SEQ ID NO: 101127 - DNA, 16 bp, H. sapiens
gagagctggaggagag

SEQ ID NO: 101128 - DNA, 16 bp, H. sapiens
gagagcttcagagacc

SEQ ID NO: 101129 - DNA, 16 bp, H. sapiens
gagagcttgttagaaa

SEQ ID NO: 101130 - DNA, 16 bp, H. sapiens
gagagctttttaaaaa

SEQ ID NO: 101131 - DNA, 16 bp, H. sapiens
gagaggaaactggtga

SEQ ID NO: 101132 - DNA, 16 bp, H. sapiens
gagaggaaatcaaact

SEQ ID NO: 101133 - DNA, 16 bp, H. sapiens
gagaggaacataaatg

SEQ ID NO: 101134 - DNA, 16 bp, H. sapiens
gagaggaagaccacag

SEQ ID NO: 101135 - DNA, 16 bp, H. sapiens
gagaggaaggtcgggt

SEQ ID NO: 101136 - DNA, 16 bp, H. sapiens
gagaggacagaaaatg

SEQ ID NO: 101137 - DNA, 16 bp, H. sapiens
gagaggacatggagaa

SEQ ID NO: 101138 - DNA, 16 bp, H. sapiens
gagaggacttgaaata

SEQ ID NO: 101139 - DNA, 16 bp, H. sapiens
gagaggagcctggcca

SEQ ID NO: 101140 - DNA, 16 bp, H. sapiens
gagaggagctgcccac

SEQ ID NO: 101141 - DNA, 16 bp, H. sapiens
gagaggaggaggtgcc

SEQ ID NO: 101142 - DNA, 16 bp, H. sapiens
gagaggagggaggtgc

SEQ ID NO: 101143 - DNA, 16 bp, H. sapiens
gagaggagtccctcct

SEQ ID NO: 101144 - DNA, 16 bp, H. sapiens
gagaggatcgcttcag

SEQ ID NO: 101145 - DNA, 16 bp, H. sapiens
gagaggcagagccagg

SEQ ID NO: 101146 - DNA, 16 bp, H. sapiens
gagaggcagaggcaga

SEQ ID NO: 101147 - DNA, 16 bp, H. sapiens
gagaggcaggagctgg

SEQ ID NO: 101148 - DNA, 16 bp, H. sapiens
gagaggcaggattcaa

SEQ ID NO: 101149 - DNA, 16 bp, H. sapiens
gagaggcaggggctgg

SEQ ID NO: 101150 - DNA, 16 bp, H. sapiens
gagaggcaggggttgc

SEQ ID NO: 101151 - DNA, 16 bp, H. sapiens
gagaggcatccctgca

SEQ ID NO: 101152 - DNA, 16 bp, H. sapiens
gagaggccaggccagg

SEQ ID NO: 101153 - DNA, 16 bp, H. sapiens
gagaggccaggcgcag

SEQ ID NO: 101154 - DNA, 16 bp, H. sapiens
gagaggccaggtgcag

SEQ ID NO: 101155 - DNA, 16 bp, H. sapiens
gagaggcccaggcagg

SEQ ID NO: 101156 - DNA, 16 bp, H. sapiens
gagaggcctcagagga

SEQ ID NO: 101157 - DNA, 16 bp, H. sapiens
gagaggcctcaggaaa

SEQ ID NO: 101158 - DNA, 16 bp, H. sapiens
gagaggcctggaacag

SEQ ID NO: 101159 - DNA, 16 bp, H. sapiens
gagaggcctggggagg

SEQ ID NO: 101160 - DNA, 16 bp, H. sapiens
gagaggcggaggctgc

SEQ ID NO: 101161 - DNA, 16 bp, H. sapiens
gagaggctgaagcaga

SEQ ID NO: 101162 - DNA, 16 bp, H. sapiens
gagaggctgagatggg

SEQ ID NO: 101163 - DNA, 16 bp, H. sapiens
gagaggctgaggagag

SEQ ID NO: 101164 - DNA, 16 bp, H. sapiens
gagaggctgaggcgga

SEQ ID NO: 101165 - DNA, 16 bp, H. sapiens
gagaggctgagggagg

SEQ ID NO: 101166 - DNA, 16 bp, H. sapiens
gagaggctgaggtagg

SEQ ID NO: 101167 - DNA, 16 bp, H. sapiens
gagaggctgaggtgag

SEQ ID NO: 101168 - DNA, 16 bp, H. sapiens
gagaggctgcggcagg

SEQ ID NO: 101169 - DNA, 16 bp, H. sapiens
gagaggctggggcagg

SEQ ID NO: 101170 - DNA, 16 bp, H. sapiens
gagagggacctggtgg

SEQ ID NO: 101171 - DNA, 16 bp, H. sapiens
gagagggagaccatgg

SEQ ID NO: 101172 - DNA, 16 bp, H. sapiens
gagagggagactgtgg

SEQ ID NO: 101173 - DNA, 16 bp, H. sapiens
gagagggagtctggct

SEQ ID NO: 101174 - DNA, 16 bp, H. sapiens
gagagggagtttcacc

SEQ ID NO: 101175 - DNA, 16 bp, H. sapiens
gagaggggagctggag

SEQ ID NO: 101176 - DNA, 16 bp, H. sapiens
gagagggtgcagtgag

SEQ ID NO: 101177 - DNA, 23 bp, H. sapiens
gagaggtgacagcatgctggcag

SEQ ID NO: 101178 - DNA, 16 bp, H. sapiens
gagaggttctaagaga

SEQ ID NO: 101179 - DNA, 16 bp, H. sapiens
gagaggtttcagtgag

SEQ ID NO: 101180 - DNA, 16 bp, H. sapiens
gagaggtttggacaaa

SEQ ID NO: 101181 - DNA, 16 bp, H. sapiens
gagagtagaaaaatgg

SEQ ID NO: 101182 - DNA, 16 bp, H. sapiens
gagagtcagagagaga

SEQ ID NO: 101183 - DNA, 16 bp, H. sapiens
gagagtctcgctctgt

SEQ ID NO: 101184 - DNA, 16 bp, H. sapiens
gagagtctgtcttaaa

SEQ ID NO: 101185 - DNA, 23 bp, H. sapiens
gagagtcttctgcctgtgttaaa

SEQ ID NO: 101186 - DNA, 16 bp, H. sapiens
gagagtcttgctctgt

SEQ ID NO: 101187 - DNA, 16 bp, H. sapiens
gagagtgaatggttct

SEQ ID NO: 101188 - DNA, 16 bp, H. sapiens
gagagtgagactccat

SEQ ID NO: 101189 - DNA, 16 bp, H. sapiens
gagagtgagactctgt

SEQ ID NO: 101190 - DNA, 16 bp, H. sapiens
gagagtgcagatgtct

SEQ ID NO: 101191 - DNA, 16 bp, H. sapiens
gagagtgggcattctt

SEQ ID NO: 101192 - DNA, 16 bp, H. sapiens
gagagtggggtgctgc

SEQ ID NO: 101193 - DNA, 16 bp, H. sapiens
gagagtgtgtgtatgt

SEQ ID NO: 101194 - DNA, 16 bp, H. sapiens
gagagtgtgtgtgttt

SEQ ID NO: 101195 - DNA, 16 bp, H. sapiens
gagagtgttttgagaa

SEQ ID NO: 101196 - DNA, 16 bp, H. sapiens
gagagttcattcatga

SEQ ID NO: 101197 - DNA, 16 bp, H. sapiens
gagagttccagttgct

SEQ ID NO: 101198 - DNA, 16 bp, H. sapiens
gagagtttacaaatgc

SEQ ID NO: 101199 - DNA, 16 bp, H. sapiens
gagagtttgttataat

SEQ ID NO: 101200 - DNA, 16 bp, H. sapiens
gagagttttttttaaa

SEQ ID NO: 101201 - DNA, 16 bp, H. sapiens
gagataaagacacaaa

SEQ ID NO: 101202 - DNA, 16 bp, H. sapiens
gagataaagagggaca

SEQ ID NO: 101203 - DNA, 16 bp, H. sapiens
gagataataaatgggt

SEQ ID NO: 101204 - DNA, 16 bp, H. sapiens
gagataatatacataa

SEQ ID NO: 101205 - DNA, 16 bp, H. sapiens
gagataatcatgtggt

SEQ ID NO: 101206 - DNA, 16 bp, H. sapiens
gagataatgcatgtga

SEQ ID NO: 101207 - DNA, 16 bp, H. sapiens
gagataatttgaatca

SEQ ID NO: 101208 - DNA, 16 bp, H. sapiens
gagatacaaagataaa

SEQ ID NO: 101209 - DNA, 16 bp, H. sapiens
gagatacaattcacat

SEQ ID NO: 101210 - DNA, 16 bp, H. sapiens
gagatacacacacata

SEQ ID NO: 101211 - DNA, 16 bp, H. sapiens
gagatacagaaataaa

SEQ ID NO: 101212 - DNA, 16 bp, H. sapiens
gagataccagagaaag

SEQ ID NO: 101213 - DNA, 16 bp, H. sapiens
gagataccagagagct

SEQ ID NO: 101214 - DNA, 21 bp, H. sapiens
gagataccatctcacaccagt

SEQ ID NO: 101215 - DNA, 16 bp, H. sapiens
gagataccatctcata

SEQ ID NO: 101216 - DNA, 16 bp, H. sapiens
gagatagacagtagaa

SEQ ID NO: 101217 - DNA, 16 bp, H. sapiens
gagatagagacagaga

SEQ ID NO: 101218 - DNA, 16 bp, H. sapiens
gagatagagaccaatg

SEQ ID NO: 101219 - DNA, 16 bp, H. sapiens
gagatagagagtagaa

SEQ ID NO: 101220 - DNA, 16 bp, H. sapiens
gagatagagtcttgct

SEQ ID NO: 101221 - DNA, 16 bp, H. sapiens
gagatagagtttcact

SEQ ID NO: 101222 - DNA, 16 bp, H. sapiens
gagatagcgtcttgct

SEQ ID NO: 101223 - DNA, 16 bp, H. sapiens
gagataggagaaaaac

SEQ ID NO: 101224 - DNA, 16 bp, H. sapiens
gagatagggtctcact

SEQ ID NO: 101225 - DNA, 16 bp, H. sapiens
gagatagggtctggct

SEQ ID NO: 101226 - DNA, 16 bp, H. sapiens
gagataggtggatcac

SEQ ID NO: 101227 - DNA, 16 bp, H. sapiens
gagatagtgaaaatag

SEQ ID NO: 101228 - DNA, 16 bp, H. sapiens
gagatatttgggagca

SEQ ID NO: 101229 - DNA, 16 bp, H. sapiens
gagatattttactttt

SEQ ID NO: 101230 - DNA, 16 bp, H. sapiens
gagatattttgataga

SEQ ID NO: 101231 - DNA, 16 bp, H. sapiens
gagatattttggtaca

SEQ ID NO: 101232 - DNA, 17 bp, H. sapiens
gagatcaacaccatcct

SEQ ID NO: 101233 - DNA, 16 bp, H. sapiens
gagatcaagagtttga

SEQ ID NO: 101234 - DNA, 16 bp, H. sapiens
gagatcaaggccagcc

SEQ ID NO: 101235 - DNA, 16 bp, H. sapiens
gagatcaatggacaca

SEQ ID NO: 101236 - DNA, 16 bp, H. sapiens
gagatcaccccagagc

SEQ ID NO: 101237 - DNA, 16 bp, H. sapiens
gagatcaccctactgc

SEQ ID NO: 101238 - DNA, 16 bp, H. sapiens
gagatcaccctgggca

SEQ ID NO: 101239 - DNA, 16 bp, H. sapiens
gagatcacctcactgc

SEQ ID NO: 101240 - DNA, 16 bp, H. sapiens
gagatcacgcaactgc

SEQ ID NO: 101241 - DNA, 16 bp, H. sapiens
gagatcacgccactgt

SEQ ID NO: 101242 - DNA, 16 bp, H. sapiens
gagatcacgctgctgc

SEQ ID NO: 101243 - DNA, 16 bp, H. sapiens
gagatcagcctgccca

SEQ ID NO: 101244 - DNA, 17 bp, H. sapiens
gagatcagcctggccaa

SEQ ID NO: 101245 - DNA, 19 bp, H. sapiens
gagatcatgccaccgcact

SEQ ID NO: 101246 - DNA, 16 bp, H. sapiens
gagatcatgtctttgc

SEQ ID NO: 101247 - DNA, 16 bp, H. sapiens
gagatccagatcatcc

SEQ ID NO: 101248 - DNA, 16 bp, H. sapiens
gagatcccagaggaag

SEQ ID NO: 101249 - DNA, 16 bp, H. sapiens
gagatcccatctctac

SEQ ID NO: 101250 - DNA, 16 bp, H. sapiens
gagatccgccactgca

SEQ ID NO: 101251 - DNA, 16 bp, H. sapiens
gagatcctctccaaag

SEQ ID NO: 101252 - DNA, 16 bp, H. sapiens
gagatcctgtctcaaa

SEQ ID NO: 101253 - DNA, 16 bp, H. sapiens
gagatcctgtttctac

SEQ ID NO: 101254 - DNA, 16 bp, H. sapiens
gagatccttaacttaa

SEQ ID NO: 101255 - DNA, 16 bp, H. sapiens
gagatcgagaccatct

SEQ ID NO: 101256 - DNA, 17 bp, H. sapiens
gagatcgaggccagcct

SEQ ID NO: 101257 - DNA, 16 bp, H. sapiens
gagatcgaggccatcc

SEQ ID NO: 101258 - DNA, 17 bp, H. sapiens
gagatcgcatcactgca

SEQ ID NO: 101259 - DNA, 19 bp, H. sapiens
gagatcgccccactgcact

SEQ ID NO: 101260 - DNA, 16 bp, H. sapiens
gagatcgcgccatggc

SEQ ID NO: 101261 - DNA, 19 bp, H. sapiens
gagatcgctccattgcact

SEQ ID NO: 101262 - DNA, 16 bp, H. sapiens
gagatcggcctgggca

SEQ ID NO: 101263 - DNA, 16 bp, H. sapiens
gagatctgaaggatga

SEQ ID NO: 101264 - DNA, 16 bp, H. sapiens
gagatctgccactgca

SEQ ID NO: 101265 - DNA, 16 bp, H. sapiens
gagatcttattcctag

SEQ ID NO: 101266 - DNA, 16 bp, H. sapiens
gagatctttcacctac

SEQ ID NO: 101267 - DNA, 16 bp, H. sapiens
gagatctttcacctgc

SEQ ID NO: 101268 - DNA, 16 bp, H. sapiens
gagatctttctttttt

SEQ ID NO: 101269 - DNA, 16 bp, H. sapiens
gagatcttttacttct

SEQ ID NO: 101270 - DNA, 16 bp, H. sapiens
gagatgaaatcacagg

SEQ ID NO: 101271 - DNA, 16 bp, H. sapiens
gagatgaaattttgct

SEQ ID NO: 101272 - DNA, 16 bp, H. sapiens
gagatgaagaaactga

SEQ ID NO: 101273 - DNA, 18 bp, H. sapiens
gagatgaagatccagttt

SEQ ID NO: 101274 - DNA, 16 bp, H. sapiens
gagatgaagcagtgaa

SEQ ID NO: 101275 - DNA, 16 bp, H. sapiens
gagatgaagtccttgc

SEQ ID NO: 101276 - DNA, 16 bp, H. sapiens
gagatgaagtctcact

SEQ ID NO: 101277 - DNA, 16 bp, H. sapiens
gagatgaagtctcgct

SEQ ID NO: 101278 - DNA, 16 bp, H. sapiens
gagatgacagctccac

SEQ ID NO: 101279 - DNA, 16 bp, H. sapiens
gagatgagaaacttct

SEQ ID NO: 101280 - DNA, 16 bp, H. sapiens
gagatgagacttgggt

SEQ ID NO: 101281 - DNA, 16 bp, H. sapiens
gagatgagagactgag

SEQ ID NO: 101282 - DNA, 16 bp, H. sapiens
gagatgagcctggaca

SEQ ID NO: 101283 - DNA, 16 bp, H. sapiens
gagatgaggaaggctg

SEQ ID NO: 101284 - DNA, 16 bp, H. sapiens
gagatgagggtcttgc

SEQ ID NO: 101285 - DNA, 16 bp, H. sapiens
gagatgaggtctcact

SEQ ID NO: 101286 - DNA, 16 bp, H. sapiens
gagatgaggtcttggt

SEQ ID NO: 101287 - DNA, 16 bp, H. sapiens
gagatgatatcttgtt

SEQ ID NO: 101288 - DNA, 16 bp, H. sapiens
gagatgatcagaaaaa

SEQ ID NO: 101289 - DNA, 16 bp, H. sapiens
gagatgatgatgatga

SEQ ID NO: 101290 - DNA, 27 bp, H. sapiens
gagatgccaaagtgtggaggtaacaag

SEQ ID NO: 101291 - DNA, 16 bp, H. sapiens
gagatgcggtttcacc

SEQ ID NO: 101292 - DNA, 16 bp, H. sapiens
gagatgctggtcaaag

SEQ ID NO: 101293 - DNA, 16 bp, H. sapiens
gagatgcttgaagaag

SEQ ID NO: 101294 - DNA, 16 bp, H. sapiens
gagatggaatctctct

SEQ ID NO: 101295 - DNA, 16 bp, H. sapiens
gagatggaatcttgct

SEQ ID NO: 101296 - DNA, 16 bp, H. sapiens
gagatggagatgagga

SEQ ID NO: 101297 - DNA, 16 bp, H. sapiens
gagatggagatggaga

SEQ ID NO: 101298 - DNA, 16 bp, H. sapiens
gagatggagccattgc

SEQ ID NO: 101299 - DNA, 16 bp, H. sapiens
gagatggagcctggct

SEQ ID NO: 101300 - DNA, 16 bp, H. sapiens
gagatggagccttgct

SEQ ID NO: 101301 - DNA, 16 bp, H. sapiens
gagatggaggccatcc

SEQ ID NO: 101302 - DNA, 16 bp, H. sapiens
gagatggaggctacag

SEQ ID NO: 101303 - DNA, 16 bp, H. sapiens
gagatggaggctgtgg

SEQ ID NO: 101304 - DNA, 16 bp, H. sapiens
gagatggagtatcgct

SEQ ID NO: 101305 - DNA, 16 bp, H. sapiens
gagatggagtcaccca

SEQ ID NO: 101306 - DNA, 16 bp, H. sapiens
gagatggagtccctct

SEQ ID NO: 101307 - DNA, 16 bp, H. sapiens
gagatggagtctcacg

SEQ ID NO: 101308 - DNA, 16 bp, H. sapiens
gagatggagtcttact

SEQ ID NO: 101309 - DNA, 16 bp, H. sapiens
gagatggagtttggct

SEQ ID NO: 101310 - DNA, 16 bp, H. sapiens
gagatggagttttact

SEQ ID NO: 101311 - DNA, 16 bp, H. sapiens
gagatggatgaagctg

SEQ ID NO: 101312 - DNA, 16 bp, H. sapiens
gagatggatggtgatg

SEQ ID NO: 101313 - DNA, 16 bp, H. sapiens
gagatggatttgaggg

SEQ ID NO: 101314 - DNA, 16 bp, H. sapiens
gagatggcactgctgc

SEQ ID NO: 101315 - DNA, 16 bp, H. sapiens
gagatggcgcccctgc

SEQ ID NO: 101316 - DNA, 16 bp, H. sapiens
gagatggcgtcttgct

SEQ ID NO: 101317 - DNA, 16 bp, H. sapiens
gagatggctactaagt

SEQ ID NO: 101318 - DNA, 16 bp, H. sapiens
gagatgggaggaaacc

SEQ ID NO: 101319 - DNA, 16 bp, H. sapiens
gagatgggatctcact

SEQ ID NO: 101320 - DNA, 16 bp, H. sapiens
gagatgggatcttgct

SEQ ID NO: 101321 - DNA, 16 bp, H. sapiens
gagatgggctctcact

SEQ ID NO: 101322 - DNA, 16 bp, H. sapiens
gagatgggcttcctga

SEQ ID NO: 101323 - DNA, 16 bp, H. sapiens
gagatggggaagactg

SEQ ID NO: 101324 - DNA, 16 bp, H. sapiens
gagatggggatctcac

SEQ ID NO: 101325 - DNA, 16 bp, H. sapiens
gagatggggatggtta

SEQ ID NO: 101326 - DNA, 16 bp, H. sapiens
gagatggggcctcact

SEQ ID NO: 101327 - DNA, 16 bp, H. sapiens
gagatggggcctttgg

SEQ ID NO: 101328 - DNA, 16 bp, H. sapiens
gagatgggggctcact

SEQ ID NO: 101329 - DNA, 16 bp, H. sapiens
gagatgggggtctccc

SEQ ID NO: 101330 - DNA, 16 bp, H. sapiens
gagatggggtcccact

SEQ ID NO: 101331 - DNA, 16 bp, H. sapiens
gagatggggtctcacc

SEQ ID NO: 101332 - DNA, 16 bp, H. sapiens
gagatggggtctcact

SEQ ID NO: 101333 - DNA, 16 bp, H. sapiens
gagatggggtctgact

SEQ ID NO: 101334 - DNA, 16 bp, H. sapiens
gagatggggtcttact

SEQ ID NO: 101335 - DNA, 16 bp, H. sapiens
gagatggggtcttgcc

SEQ ID NO: 101336 - DNA, 16 bp, H. sapiens
gagatggggtttctct

SEQ ID NO: 101337 - DNA, 16 bp, H. sapiens
gagatggggtttttcc

SEQ ID NO: 101338 - DNA, 16 bp, H. sapiens
gagatgggttctcact

SEQ ID NO: 101339 - DNA, 16 bp, H. sapiens
gagatgggttcttact

SEQ ID NO: 101340 - DNA, 16 bp, H. sapiens
gagatggtgaaacccc

SEQ ID NO: 101341 - DNA, 16 bp, H. sapiens
gagatggtgccattgc

SEQ ID NO: 101342 - DNA, 16 bp, H. sapiens
gagatggtggcagtac

SEQ ID NO: 101343 - DNA, 16 bp, H. sapiens
gagatggtgtctcact

SEQ ID NO: 101344 - DNA, 16 bp, H. sapiens
gagatgtaatgatgga

SEQ ID NO: 101345 - DNA, 16 bp, H. sapiens
gagatgtggtctcact

SEQ ID NO: 101346 - DNA, 16 bp, H. sapiens
gagatgttatttgtgg

SEQ ID NO: 101347 - DNA, 16 bp, H. sapiens
gagatgttggactgtg

SEQ ID NO: 101348 - DNA, 16 bp, H. sapiens
gagatgtttttggttg

SEQ ID NO: 101349 - DNA, 16 bp, H. sapiens
gagattaacttttttt

SEQ ID NO: 101350 - DNA, 16 bp, H. sapiens
gagattaagtgacttg

SEQ ID NO: 101351 - DNA, 16 bp, H. sapiens
gagattacaatttgac

SEQ ID NO: 101352 - DNA, 16 bp, H. sapiens
gagattacagggatga

SEQ ID NO: 101353 - DNA, 16 bp, H. sapiens
gagattaggagttcaa

SEQ ID NO: 101354 - DNA, 16 bp, H. sapiens
gagattattatgaaca

SEQ ID NO: 101355 - DNA, 16 bp, H. sapiens
gagattcacatttgag

SEQ ID NO: 101356 - DNA, 16 bp, H. sapiens
gagattcacccatgtt

SEQ ID NO: 101357 - DNA, 16 bp, H. sapiens
gagattcatctgtgtt

SEQ ID NO: 101358 - DNA, 16 bp, H. sapiens
gagattctcctgcgtc

SEQ ID NO: 101359 - DNA, 16 bp, H. sapiens
gagattctgattcagc

SEQ ID NO: 101360 - DNA, 16 bp, H. sapiens
gagattctgattcagt

SEQ ID NO: 101361 - DNA, 16 bp, H. sapiens
gagattctgccactgc

SEQ ID NO: 101362 - DNA, 16 bp, H. sapiens
gagattctggcatgtt

SEQ ID NO: 101363 - DNA, 16 bp, H. sapiens
gagattctgtcaccac

SEQ ID NO: 101364 - DNA, 16 bp, H. sapiens
gagattgaaataataa

SEQ ID NO: 101365 - DNA, 16 bp, H. sapiens
gagattgagtaacttg

SEQ ID NO: 101366 - DNA, 16 bp, H. sapiens
gagattgcaccaccgt

SEQ ID NO: 101367 - DNA, 16 bp, H. sapiens
gagattgcactgagcc

SEQ ID NO: 101368 - DNA, 16 bp, H. sapiens
gagattgcagcaattc

SEQ ID NO: 101369 - DNA, 16 bp, H. sapiens
gagattgcagtaagcc

SEQ ID NO: 101370 - DNA, 16 bp, H. sapiens
gagattgcagtgaacc

SEQ ID NO: 101371 - DNA, 16 bp, H. sapiens
gagattgcagtgagcc

SEQ ID NO: 101372 - DNA, 16 bp, H. sapiens
gagattgcagtgagtc

SEQ ID NO: 101373 - DNA, 16 bp, H. sapiens
gagattgccccagagc

SEQ ID NO: 101374 - DNA, 36 bp, H. sapiens
gagattgcgccactgcagtccgcagtccggcctggg

SEQ ID NO: 101375 - DNA, 16 bp, H. sapiens
gagattgcggtgagcc

SEQ ID NO: 101376 - DNA, 16 bp, H. sapiens
gagattgctgaatcat

SEQ ID NO: 101377 - DNA, 16 bp, H. sapiens
gagattgggttttgct

SEQ ID NO: 101378 - DNA, 16 bp, H. sapiens
gagattgtccttttcc

SEQ ID NO: 101379 - DNA, 16 bp, H. sapiens
gagattgtggagaaaa

SEQ ID NO: 101380 - DNA, 16 bp, H. sapiens
gagatttaacacccca

SEQ ID NO: 101381 - DNA, 17 bp, H. sapiens
gagatttattacaacaa

SEQ ID NO: 101382 - DNA, 16 bp, H. sapiens
gagatttattttcctt

SEQ ID NO: 101383 - DNA, 16 bp, H. sapiens
gagatttcacataaaa

SEQ ID NO: 101384 - DNA, 16 bp, H. sapiens
gagatttcatttattt

SEQ ID NO: 101385 - DNA, 16 bp, H. sapiens
gagatttcttaaataa

SEQ ID NO: 101386 - DNA, 16 bp, H. sapiens
gagatttggaaggggc

SEQ ID NO: 101387 - DNA, 16 bp, H. sapiens
gagatttggatgggac

SEQ ID NO: 101388 - DNA, 16 bp, H. sapiens
gagatttgggtgggat

SEQ ID NO: 101389 - DNA, 16 bp, H. sapiens
gagatttgttttatga

SEQ ID NO: 101390 - DNA, 16 bp, H. sapiens
gagatttgttttgtgg

SEQ ID NO: 101391 - DNA, 16 bp, H. sapiens
gagattttggtacacc

SEQ ID NO: 101392 - DNA, 16 bp, H. sapiens
gagattttggtgagga

SEQ ID NO: 101393 - DNA, 16 bp, H. sapiens
gagatttttttaaaag

SEQ ID NO: 101394 - DNA, 16 bp, H. sapiens
gagcaaaactccgact

SEQ ID NO: 101395 - DNA, 16 bp, H. sapiens
gagcaaaatagccagc

SEQ ID NO: 101396 - DNA, 16 bp, H. sapiens
gagcaaaatcaccagc

SEQ ID NO: 101397 - DNA, 16 bp, H. sapiens
gagcaaacacattaaa

SEQ ID NO: 101398 - DNA, 16 bp, H. sapiens
gagcaaacataggtgg

SEQ ID NO: 101399 - DNA, 16 bp, H. sapiens
gagcaaaccaaattca

SEQ ID NO: 101400 - DNA, 19 bp, H. sapiens
gagcaaactatcgcaagga

SEQ ID NO: 101401 - DNA, 16 bp, H. sapiens
gagcaaactgagtggc

SEQ ID NO: 101402 - DNA, 16 bp, H. sapiens
gagcaaagaaattcaa

SEQ ID NO: 101403 - DNA, 16 bp, H. sapiens
gagcaaagaacatgaa

SEQ ID NO: 101404 - DNA, 16 bp, H. sapiens
gagcaaagctggagga

SEQ ID NO: 101405 - DNA, 16 bp, H. sapiens
gagcaaagctggatgg

SEQ ID NO: 101406 - DNA, 16 bp, H. sapiens
gagcaaaggcaattca

SEQ ID NO: 101407 - DNA, 16 bp, H. sapiens
gagcaaaggcagcagc

SEQ ID NO: 101408 - DNA, 16 bp, H. sapiens
gagcaacaattcaaga

SEQ ID NO: 101409 - DNA, 16 bp, H. sapiens
gagcaacagagggaga

SEQ ID NO: 101410 - DNA, 16 bp, H. sapiens
gagcaacaggaacttt

SEQ ID NO: 101411 - DNA, 16 bp, H. sapiens
gagcaacatagcaaaa

SEQ ID NO: 101412 - DNA, 17 bp, H. sapiens
gagcaactccaagacat

SEQ ID NO: 101413 - DNA, 16 bp, H. sapiens
gagcaactggaacttt

SEQ ID NO: 101414 - DNA, 16 bp, H. sapiens
gagcaacttgcccaag

SEQ ID NO: 101415 - DNA, 16 bp, H. sapiens
gagcaagacatcatct

SEQ ID NO: 101416 - DNA, 16 bp, H. sapiens
gagcaagaccatgaac

SEQ ID NO: 101417 - DNA, 16 bp, H. sapiens
gagcaagaccctgttc

SEQ ID NO: 101418 - DNA, 16 bp, H. sapiens
gagcaagaccctgttt

SEQ ID NO: 101419 - DNA, 16 bp, H. sapiens
gagcaagacctggtct

SEQ ID NO: 101420 - DNA, 16 bp, H. sapiens
gagcaagactttgttt

SEQ ID NO: 101421 - DNA, 16 bp, H. sapiens
gagcaagagcaagagc

SEQ ID NO: 101422 - DNA, 16 bp, H. sapiens
gagcaagatcctctct

SEQ ID NO: 101423 - DNA, 16 bp, H. sapiens
gagcaagatgaagagg

SEQ ID NO: 101424 - DNA, 16 bp, H. sapiens
gagcaagcagctcaag

SEQ ID NO: 101425 - DNA, 16 bp, H. sapiens
gagcaagccccccaaa

SEQ ID NO: 101426 - DNA, 16 bp, H. sapiens
gagcaaggagaaccag

SEQ ID NO: 101427 - DNA, 16 bp, H. sapiens
gagcaaggagagccag

SEQ ID NO: 101428 - DNA, 16 bp, H. sapiens
gagcaaggccctgtca

SEQ ID NO: 101429 - DNA, 16 bp, H. sapiens
gagcaataccatgaac

SEQ ID NO: 101430 - DNA, 16 bp, H. sapiens
gagcaattatcctgca

SEQ ID NO: 101431 - DNA, 16 bp, H. sapiens
gagcaattttcttatt

SEQ ID NO: 101432 - DNA, 16 bp, H. sapiens
gagcacaaataaacaa

SEQ ID NO: 101433 - DNA, 16 bp, H. sapiens
gagcacagccctgctg

SEQ ID NO: 101434 - DNA, 16 bp, H. sapiens
gagcacagcctgccag

SEQ ID NO: 101435 - DNA, 16 bp, H. sapiens
gagcaccacatcaagg

SEQ ID NO: 101436 - DNA, 16 bp, H. sapiens
gagcaccagaaatggt

SEQ ID NO: 101437 - DNA, 17 bp, H. sapiens
gagcacctccaccacca

SEQ ID NO: 101438 - DNA, 16 bp, H. sapiens
gagcacctgaaggaag

SEQ ID NO: 101439 - DNA, 16 bp, H. sapiens
gagcactggaaatgtg

SEQ ID NO: 101440 - DNA, 16 bp, H. sapiens
gagcactgtgctggga

SEQ ID NO: 101441 - DNA, 16 bp, H. sapiens
gagcactttctatgtg

SEQ ID NO: 101442 - DNA, 16 bp, H. sapiens
gagcactttgaggcct

SEQ ID NO: 101443 - DNA, 16 bp, H. sapiens
gagcactttgggaggc

SEQ ID NO: 101444 - DNA, 16 bp, H. sapiens
gagcactttgtggcct

SEQ ID NO: 101445 - DNA, 18 bp, H. sapiens
gagcagaaaagctgaaaa

SEQ ID NO: 101446 - DNA, 16 bp, H. sapiens
gagcagaagcagggcg

SEQ ID NO: 101447 - DNA, 16 bp, H. sapiens
gagcagagacctggag

SEQ ID NO: 101448 - DNA, 16 bp, H. sapiens
gagcagagatggcagc

SEQ ID NO: 101449 - DNA, 16 bp, H. sapiens
gagcagagcagagcag

SEQ ID NO: 101450 - DNA, 16 bp, H. sapiens
gagcagagccctcatg

SEQ ID NO: 101451 - DNA, 16 bp, H. sapiens
gagcagaggctgagga

SEQ ID NO: 101452 - DNA, 16 bp, H. sapiens
gagcagaggggtgact

SEQ ID NO: 101453 - DNA, 16 bp, H. sapiens
gagcagatcacttgag

SEQ ID NO: 101454 - DNA, 16 bp, H. sapiens
gagcagattcctcatg

SEQ ID NO: 101455 - DNA, 16 bp, H. sapiens
gagcagatttattatg

SEQ ID NO: 101456 - DNA, 16 bp, H. sapiens
gagcagcaagtgcaaa

SEQ ID NO: 101457 - DNA, 16 bp, H. sapiens
gagcagcacccacaac

SEQ ID NO: 101458 - DNA, 16 bp, H. sapiens
gagcagcagagcaaga

SEQ ID NO: 101459 - DNA, 16 bp, H. sapiens
gagcagcagagcagca

SEQ ID NO: 101460 - DNA, 16 bp, H. sapiens
gagcagcagcagcagg

SEQ ID NO: 101461 - DNA, 16 bp, H. sapiens
gagcagcatagtgaga

SEQ ID NO: 101462 - DNA, 16 bp, H. sapiens
gagcagccagccagcc

SEQ ID NO: 101463 - DNA, 16 bp, H. sapiens
gagcagccagccggcc

SEQ ID NO: 101464 - DNA, 16 bp, H. sapiens
gagcagccctgggctg

SEQ ID NO: 101465 - DNA, 19 bp, H. sapiens
gagcagccggccggccctg

SEQ ID NO: 101466 - DNA, 16 bp, H. sapiens
gagcagcctagccaac

SEQ ID NO: 101467 - DNA, 16 bp, H. sapiens
gagcagcctgcccaac

SEQ ID NO: 101468 - DNA, 16 bp, H. sapiens
gagcagcctggccaaa

SEQ ID NO: 101469 - DNA, 16 bp, H. sapiens
gagcagcctgggcagc

SEQ ID NO: 101470 - DNA, 16 bp, H. sapiens
gagcagcctggggaga

SEQ ID NO: 101471 - DNA, 16 bp, H. sapiens
gagcagcggggcactg

SEQ ID NO: 101472 - DNA, 16 bp, H. sapiens
gagcagctgaggcagg

SEQ ID NO: 101473 - DNA, 16 bp, H. sapiens
gagcagctgggactcc

SEQ ID NO: 101474 - DNA, 16 bp, H. sapiens
gagcagctgggattat

SEQ ID NO: 101475 - DNA, 16 bp, H. sapiens
gagcagctgggctgtg

SEQ ID NO: 101476 - DNA, 16 bp, H. sapiens
gagcagctggggttac

SEQ ID NO: 101477 - DNA, 16 bp, H. sapiens
gagcagcttcagcaga

SEQ ID NO: 101478 - DNA, 16 bp, H. sapiens
gagcaggaccccatct

SEQ ID NO: 101479 - DNA, 16 bp, H. sapiens
gagcaggagagacaga

SEQ ID NO: 101480 - DNA, 16 bp, H. sapiens
gagcaggagcaagagg

SEQ ID NO: 101481 - DNA, 16 bp, H. sapiens
gagcaggaggaacaga

SEQ ID NO: 101482 - DNA, 16 bp, H. sapiens
gagcaggaggaagaca

SEQ ID NO: 101483 - DNA, 16 bp, H. sapiens
gagcaggaggaggtgg

SEQ ID NO: 101484 - DNA, 16 bp, H. sapiens
gagcaggaggatgggg

SEQ ID NO: 101485 - DNA, 16 bp, H. sapiens
gagcaggagtagctgt

SEQ ID NO: 101486 - DNA, 16 bp, H. sapiens
gagcaggattctgtct

SEQ ID NO: 101487 - DNA, 16 bp, H. sapiens
gagcaggcactcaata

SEQ ID NO: 101488 - DNA, 16 bp, H. sapiens
gagcaggcactgggag

SEQ ID NO: 101489 - DNA, 16 bp, H. sapiens
gagcaggcaggatctg

SEQ ID NO: 101490 - DNA, 16 bp, H. sapiens
gagcaggcatccctgg

SEQ ID NO: 101491 - DNA, 16 bp, H. sapiens
gagcagggagaggcca

SEQ ID NO: 101492 - DNA, 16 bp, H. sapiens
gagcaggggggccctg

SEQ ID NO: 101493 - DNA, 16 bp, H. sapiens
gagcagggggtggtgc

SEQ ID NO: 101494 - DNA, 16 bp, H. sapiens
gagcaggtgaccaggg

SEQ ID NO: 101495 - DNA, 16 bp, H. sapiens
gagcaggtgctgggag

SEQ ID NO: 101496 - DNA, 16 bp, H. sapiens
gagcaggtggtgtttg

SEQ ID NO: 101497 - DNA, 16 bp, H. sapiens
gagcagtcagaacaca

SEQ ID NO: 101498 - DNA, 16 bp, H. sapiens
gagcagtgagagaggg

SEQ ID NO: 101499 - DNA, 16 bp, H. sapiens
gagcagtggctcaccc

SEQ ID NO: 101500 - DNA, 16 bp, H. sapiens
gagcagtggctcaggc

SEQ ID NO: 101501 - DNA, 17 bp, H. sapiens
gagcagtggggcactga

SEQ ID NO: 101502 - DNA, 16 bp, H. sapiens
gagcagtgttttgttg

SEQ ID NO: 101503 - DNA, 16 bp, H. sapiens
gagcagttaaaaaaaa

SEQ ID NO: 101504 - DNA, 16 bp, H. sapiens
gagcagtttgtaaaca

SEQ ID NO: 101505 - DNA, 16 bp, H. sapiens
gagcagttttagtttt

SEQ ID NO: 101506 - DNA, 16 bp, H. sapiens
gagcatattatttaat

SEQ ID NO: 101507 - DNA, 16 bp, H. sapiens
gagcatattttcatgt

SEQ ID NO: 101508 - DNA, 16 bp, H. sapiens
gagcatattttcattt

SEQ ID NO: 101509 - DNA, 16 bp, H. sapiens
gagcatcagcaagact

SEQ ID NO: 101510 - DNA, 16 bp, H. sapiens
gagcatcttttcatct

SEQ ID NO: 101511 - DNA, 16 bp, H. sapiens
gagcatgagctgaagc

SEQ ID NO: 101512 - DNA, 16 bp, H. sapiens
gagcatgcagccccag

SEQ ID NO: 101513 - DNA, 16 bp, H. sapiens
gagcatggaatggttt

SEQ ID NO: 101514 - DNA, 16 bp, H. sapiens
gagcatgggctctggg

SEQ ID NO: 101515 - DNA, 16 bp, H. sapiens
gagcatggggttgggg

SEQ ID NO: 101516 - DNA, 16 bp, H. sapiens
gagcatggtggttcat

SEQ ID NO: 101517 - DNA, 16 bp, H. sapiens
gagcattcctaatcca

SEQ ID NO: 101518 - DNA, 16 bp, H. sapiens
gagcattgaatgtttt

SEQ ID NO: 101519 - DNA, 16 bp, H. sapiens
gagcattttcatcact

SEQ ID NO: 101520 - DNA, 16 bp, H. sapiens
gagcattttgtcatat

SEQ ID NO: 101521 - DNA, 16 bp, H. sapiens
gagcattttgtttaat

SEQ ID NO: 101522 - DNA, 16 bp, H. sapiens
gagcattttttttctt

SEQ ID NO: 101523 - DNA, 16 bp, H. sapiens
gagccaaagctggacg

SEQ ID NO: 101524 - DNA, 16 bp, H. sapiens
gagccaaattctacca

SEQ ID NO: 101525 - DNA, 16 bp, H. sapiens
gagccaagaacatgcc

SEQ ID NO: 101526 - DNA, 16 bp, H. sapiens
gagccaagagcatgcc

SEQ ID NO: 101527 - DNA, 16 bp, H. sapiens
gagccaagatagctcc

SEQ ID NO: 101528 - DNA, 16 bp, H. sapiens
gagccaagatcctgcc

SEQ ID NO: 101529 - DNA, 16 bp, H. sapiens
gagccaagatcttgtc

SEQ ID NO: 101530 - DNA, 16 bp, H. sapiens
gagccaagcacagcct

SEQ ID NO: 101531 - DNA, 16 bp, H. sapiens
gagccaaggaggtcaa

SEQ ID NO: 101532 - DNA, 16 bp, H. sapiens
gagccaaggcctgaaa

SEQ ID NO: 101533 - DNA, 16 bp, H. sapiens
gagccaagtcctggaa

SEQ ID NO: 101534 - DNA, 16 bp, H. sapiens
gagccaattctttaaa

SEQ ID NO: 101535 - DNA, 16 bp, H. sapiens
gagccacacagacagg

SEQ ID NO: 101536 - DNA, 16 bp, H. sapiens
gagccacagagcccag

SEQ ID NO: 101537 - DNA, 16 bp, H. sapiens
gagccacagagcccgg

SEQ ID NO: 101538 - DNA, 16 bp, H. sapiens
gagccacagcaccagg

SEQ ID NO: 101539 - DNA, 16 bp, H. sapiens
gagccacagcacccag

SEQ ID NO: 101540 - DNA, 16 bp, H. sapiens
gagccacagcccctgg

SEQ ID NO: 101541 - DNA, 16 bp, H. sapiens
gagccacagctcccag

SEQ ID NO: 101542 - DNA, 16 bp, H. sapiens
gagccacagggcctgg

SEQ ID NO: 101543 - DNA, 16 bp, H. sapiens
gagccacagtgccagg

SEQ ID NO: 101544 - DNA, 16 bp, H. sapiens
gagccaccacccggcc

SEQ ID NO: 101545 - DNA, 16 bp, H. sapiens
gagccaccacgccagc

SEQ ID NO: 101546 - DNA, 16 bp, H. sapiens
gagccaccactcccag

SEQ ID NO: 101547 - DNA, 16 bp, H. sapiens
gagccaccacttccag

SEQ ID NO: 101548 - DNA, 16 bp, H. sapiens
gagccaccagcccagc

SEQ ID NO: 101549 - DNA, 16 bp, H. sapiens
gagccaccaggcccag

SEQ ID NO: 101550 - DNA, 16 bp, H. sapiens
gagccaccatgcctgc

SEQ ID NO: 101551 - DNA, 16 bp, H. sapiens
gagccacccagcccag

SEQ ID NO: 101552 - DNA, 16 bp, H. sapiens
gagccaccccacctgg

SEQ ID NO: 101553 - DNA, 16 bp, H. sapiens
gagccaccctgcccag

SEQ ID NO: 101554 - DNA, 16 bp, H. sapiens
gagccaccgagccctg

SEQ ID NO: 101555 - DNA, 16 bp, H. sapiens
gagccaccgcacgtgg

SEQ ID NO: 101556 - DNA, 16 bp, H. sapiens
gagccaccgcagccgg

SEQ ID NO: 101557 - DNA, 19 bp, H. sapiens
gagccaccgtgcccggccg

SEQ ID NO: 101558 - DNA, 16 bp, H. sapiens
gagccacctcaccctg

SEQ ID NO: 101559 - DNA, 16 bp, H. sapiens
gagccacctccaccac

SEQ ID NO: 101560 - DNA, 16 bp, H. sapiens
gagccacctctcccag

SEQ ID NO: 101561 - DNA, 16 bp, H. sapiens
gagccacctggcccag

SEQ ID NO: 101562 - DNA, 16 bp, H. sapiens
gagccacctggcctgg

SEQ ID NO: 101563 - DNA, 16 bp, H. sapiens
gagccacggcacccag

SEQ ID NO: 101564 - DNA, 16 bp, H. sapiens
gagccacgtgcccggc

SEQ ID NO: 101565 - DNA, 16 bp, H. sapiens
gagccactgaactcca

SEQ ID NO: 101566 - DNA, 16 bp, H. sapiens
gagccactgagcctga

SEQ ID NO: 101567 - DNA, 16 bp, H. sapiens
gagccactgcactggc

SEQ ID NO: 101568 - DNA, 16 bp, H. sapiens
gagccactgccccagg

SEQ ID NO: 101569 - DNA, 16 bp, H. sapiens
gagccactgcccccaa

SEQ ID NO: 101570 - DNA, 16 bp, H. sapiens
gagccactgcccccag

SEQ ID NO: 101571 - DNA, 16 bp, H. sapiens
gagccactgcgcccat

SEQ ID NO: 101572 - DNA, 17 bp, H. sapiens
gagccactgcgtccggc

SEQ ID NO: 101573 - DNA, 16 bp, H. sapiens
gagccactgctcccag

SEQ ID NO: 101574 - DNA, 16 bp, H. sapiens
gagccactggacctgg

SEQ ID NO: 101575 - DNA, 16 bp, H. sapiens
gagccactgggccagg

SEQ ID NO: 101576 - DNA, 16 bp, H. sapiens
gagccactgggcctgg

SEQ ID NO: 101577 - DNA, 16 bp, H. sapiens
gagccactgtgaccag

SEQ ID NO: 101578 - DNA, 16 bp, H. sapiens
gagccactgtgcgtgg

SEQ ID NO: 101579 - DNA, 16 bp, H. sapiens
gagccactgtggccag

SEQ ID NO: 101580 - DNA, 16 bp, H. sapiens
gagccacttcacccag

SEQ ID NO: 101581 - DNA, 16 bp, H. sapiens
gagccacttcacctgg

SEQ ID NO: 101582 - DNA, 16 bp, H. sapiens
gagccagaagactcag

SEQ ID NO: 101583 - DNA, 16 bp, H. sapiens
gagccagaatgagcca

SEQ ID NO: 101584 - DNA, 16 bp, H. sapiens
gagccagaggctgcag

SEQ ID NO: 101585 - DNA, 16 bp, H. sapiens
gagccagcaggggaaa

SEQ ID NO: 101586 - DNA, 16 bp, H. sapiens
gagccagcatttgaac

SEQ ID NO: 101587 - DNA, 16 bp, H. sapiens
gagccagcccctcccc

SEQ ID NO: 101588 - DNA, 16 bp, H. sapiens
gagccagctccagcac

SEQ ID NO: 101589 - DNA, 16 bp, H. sapiens
gagccaggagaatcac

SEQ ID NO: 101590 - DNA, 16 bp, H. sapiens
gagccaggatcatgct

SEQ ID NO: 101591 - DNA, 19 bp, H. sapiens
gagccaggatggtctcgat

SEQ ID NO: 101592 - DNA, 16 bp, H. sapiens
gagccaggcacagagc

SEQ ID NO: 101593 - DNA, 16 bp, H. sapiens
gagccaggcacaggag

SEQ ID NO: 101594 - DNA, 16 bp, H. sapiens
gagccaggcagggtgg

SEQ ID NO: 101595 - DNA, 16 bp, H. sapiens
gagccaggcccagggc

SEQ ID NO: 101596 - DNA, 16 bp, H. sapiens
gagccaggccctggag

SEQ ID NO: 101597 - DNA, 16 bp, H. sapiens
gagccaggcgcagtgg

SEQ ID NO: 101598 - DNA, 16 bp, H. sapiens
gagccaggctgcctgg

SEQ ID NO: 101599 - DNA, 16 bp, H. sapiens
gagccaggctggctgc

SEQ ID NO: 101600 - DNA, 16 bp, H. sapiens
gagccagggaggctgg

SEQ ID NO: 101601 - DNA, 16 bp, H. sapiens
gagccagggcacctgg

SEQ ID NO: 101602 - DNA, 16 bp, H. sapiens
gagccagtatttcaaa

SEQ ID NO: 101603 - DNA, 16 bp, H. sapiens
gagccagtgggagcca

SEQ ID NO: 101604 - DNA, 16 bp, H. sapiens
gagccatccttgcatc

SEQ ID NO: 101605 - DNA, 16 bp, H. sapiens
gagccatgcttcctgt

SEQ ID NO: 101606 - DNA, 16 bp, H. sapiens
gagccatggtgcccag

SEQ ID NO: 101607 - DNA, 16 bp, H. sapiens
gagccatggtggtttg

SEQ ID NO: 101608 - DNA, 16 bp, H. sapiens
gagccattgtacccag

SEQ ID NO: 101609 - DNA, 16 bp, H. sapiens
gagcccaacagtttga

SEQ ID NO: 101610 - DNA, 16 bp, H. sapiens
gagcccaagagggaga

SEQ ID NO: 101611 - DNA, 16 bp, H. sapiens
gagcccaaggaggtca

SEQ ID NO: 101612 - DNA, 16 bp, H. sapiens
gagcccactgaggcct

SEQ ID NO: 101613 - DNA, 16 bp, H. sapiens
gagcccactgccctga

SEQ ID NO: 101614 - DNA, 16 bp, H. sapiens
gagcccagaaggcgga

SEQ ID NO: 101615 - DNA, 16 bp, H. sapiens
gagcccagacctaggg

SEQ ID NO: 101616 - DNA, 16 bp, H. sapiens
gagcccagaggcagag

SEQ ID NO: 101617 - DNA, 16 bp, H. sapiens
gagcccagaggttcaa

SEQ ID NO: 101618 - DNA, 17 bp, H. sapiens
gagcccagatcgcgcca

SEQ ID NO: 101619 - DNA, 16 bp, H. sapiens
gagcccagcaagacca

SEQ ID NO: 101620 - DNA, 16 bp, H. sapiens
gagcccagcagcagtg

SEQ ID NO: 101621 - DNA, 16 bp, H. sapiens
gagcccagcagttgga

SEQ ID NO: 101622 - DNA, 16 bp, H. sapiens
gagcccagccaggacc

SEQ ID NO: 101623 - DNA, 16 bp, H. sapiens
gagcccagcccagccc

SEQ ID NO: 101624 - DNA, 16 bp, H. sapiens
gagcccagcctgagca

SEQ ID NO: 101625 - DNA, 16 bp, H. sapiens
gagcccaggaaggagg

SEQ ID NO: 101626 - DNA, 16 bp, H. sapiens
gagcccaggaagtcca

SEQ ID NO: 101627 - DNA, 16 bp, H. sapiens
gagcccaggagaccag

SEQ ID NO: 101628 - DNA, 16 bp, H. sapiens
gagcccaggagcagag

SEQ ID NO: 101629 - DNA, 16 bp, H. sapiens
gagcccaggagcccag

SEQ ID NO: 101630 - DNA, 16 bp, H. sapiens
gagcccaggaggagga

SEQ ID NO: 101631 - DNA, 16 bp, H. sapiens
gagcccaggaggctga

SEQ ID NO: 101632 - DNA, 16 bp, H. sapiens
gagcccaggagtcaag

SEQ ID NO: 101633 - DNA, 16 bp, H. sapiens
gagcccaggagtccaa

SEQ ID NO: 101634 - DNA, 16 bp, H. sapiens
gagcccaggagtccca

SEQ ID NO: 101635 - DNA, 17 bp, H. sapiens
gagcccaggcagaggag

SEQ ID NO: 101636 - DNA, 16 bp, H. sapiens
gagcccaggctgcagt

SEQ ID NO: 101637 - DNA, 16 bp, H. sapiens
gagcccaggctgttgc

SEQ ID NO: 101638 - DNA, 16 bp, H. sapiens
gagcccagggaggcag

SEQ ID NO: 101639 - DNA, 16 bp, H. sapiens
gagcccagggagggga

SEQ ID NO: 101640 - DNA, 16 bp, H. sapiens
gagcccagggaggttg

SEQ ID NO: 101641 - DNA, 16 bp, H. sapiens
gagcccagggatgctg

SEQ ID NO: 101642 - DNA, 16 bp, H. sapiens
gagcccagggcctggg

SEQ ID NO: 101643 - DNA, 16 bp, H. sapiens
gagcccaggtgttgga

SEQ ID NO: 101644 - DNA, 16 bp, H. sapiens
gagcccagtagttcaa

SEQ ID NO: 101645 - DNA, 16 bp, H. sapiens
gagcccagtgggaggt

SEQ ID NO: 101646 - DNA, 16 bp, H. sapiens
gagccccaaagcttct

SEQ ID NO: 101647 - DNA, 16 bp, H. sapiens
gagccccacagcctgc

SEQ ID NO: 101648 - DNA, 16 bp, H. sapiens
gagccccacctccaga

SEQ ID NO: 101649 - DNA, 16 bp, H. sapiens
gagccccagagcactt

SEQ ID NO: 101650 - DNA, 17 bp, H. sapiens
gagccccagatgcagtc

SEQ ID NO: 101651 - DNA, 16 bp, H. sapiens
gagccccagccctggg

SEQ ID NO: 101652 - DNA, 16 bp, H. sapiens
gagccccaggaataaa

SEQ ID NO: 101653 - DNA, 16 bp, H. sapiens
gagccccagtctgagg

SEQ ID NO: 101654 - DNA, 16 bp, H. sapiens
gagccccagttgccca

SEQ ID NO: 101655 - DNA, 16 bp, H. sapiens
gagcccccaaacagag

SEQ ID NO: 101656 - DNA, 16 bp, H. sapiens
gagcccccagaaataa

SEQ ID NO: 101657 - DNA, 16 bp, H. sapiens
gagcccccagcccagc

SEQ ID NO: 101658 - DNA, 16 bp, H. sapiens
gagcccccgcgcctgg

SEQ ID NO: 101659 - DNA, 16 bp, H. sapiens
gagcccctaggtctgg

SEQ ID NO: 101660 - DNA, 17 bp, H. sapiens
gagcccctgcgcccagc

SEQ ID NO: 101661 - DNA, 16 bp, H. sapiens
gagcccctgggagctg

SEQ ID NO: 101662 - DNA, 16 bp, H. sapiens
gagcccctgggccctg

SEQ ID NO: 101663 - DNA, 16 bp, H. sapiens
gagcccgggaagcgga

SEQ ID NO: 101664 - DNA, 16 bp, H. sapiens
gagcccgggagacaga

SEQ ID NO: 101665 - DNA, 16 bp, H. sapiens
gagccctcaccctgtg

SEQ ID NO: 101666 - DNA, 16 bp, H. sapiens
gagccctcatcagaca

SEQ ID NO: 101667 - DNA, 16 bp, H. sapiens
gagccctcatgaatgg

SEQ ID NO: 101668 - DNA, 16 bp, H. sapiens
gagccctgccccgtgg

SEQ ID NO: 101669 - DNA, 16 bp, H. sapiens
gagccctgccccttcc

SEQ ID NO: 101670 - DNA, 16 bp, H. sapiens
gagccctggattccat

SEQ ID NO: 101671 - DNA, 17 bp, H. sapiens
gagccgagaccatgcca

SEQ ID NO: 101672 - DNA, 16 bp, H. sapiens
gagccgagatcccacc

SEQ ID NO: 101673 - DNA, 19 bp, H. sapiens
gagccgagatcgcgccacc

SEQ ID NO: 101674 - DNA, 17 bp, H. sapiens
gagccgagatcgcgccg

SEQ ID NO: 101675 - DNA, 16 bp, H. sapiens
gagccgagatggagcc

SEQ ID NO: 101676 - DNA, 16 bp, H. sapiens
gagccgagccgagccg

SEQ ID NO: 101677 - DNA, 16 bp, H. sapiens
gagccgaggaggttga

SEQ ID NO: 101678 - DNA, 17 bp, H. sapiens
gagccgaggttgtgcca

SEQ ID NO: 101679 - DNA, 16 bp, H. sapiens
gagccgatgcaatcaa

SEQ ID NO: 101680 - DNA, 16 bp, H. sapiens
gagccgccattttgaa

SEQ ID NO: 101681 - DNA, 16 bp, H. sapiens
gagccgcccgcctcgg

SEQ ID NO: 101682 - DNA, 16 bp, H. sapiens
gagccgctgcacctgg

SEQ ID NO: 101683 - DNA, 16 bp, H. sapiens
gagccgctgtacccag

SEQ ID NO: 101684 - DNA, 16 bp, H. sapiens
gagccgctgtgcccag

SEQ ID NO: 101685 - DNA, 16 bp, H. sapiens
gagccggagccggagc

SEQ ID NO: 101686 - DNA, 16 bp, H. sapiens
gagccggaggctgcag

SEQ ID NO: 101687 - DNA, 16 bp, H. sapiens
gagccgggattacagg

SEQ ID NO: 101688 - DNA, 16 bp, H. sapiens
gagccgggcgtggtgg

SEQ ID NO: 101689 - DNA, 16 bp, H. sapiens
gagccggggtttcact

SEQ ID NO: 101690 - DNA, 16 bp, H. sapiens
gagcctaaggtgggag

SEQ ID NO: 101691 - DNA, 16 bp, H. sapiens
gagcctacattgccaa

SEQ ID NO: 101692 - DNA, 16 bp, H. sapiens
gagcctagacttccac

SEQ ID NO: 101693 - DNA, 16 bp, H. sapiens
gagcctaggaggctga

SEQ ID NO: 101694 - DNA, 16 bp, H. sapiens
gagcctataaatggac

SEQ ID NO: 101695 - DNA, 16 bp, H. sapiens
gagcctatgtgtgtgt

SEQ ID NO: 101696 - DNA, 16 bp, H. sapiens
gagcctcactctatcc

SEQ ID NO: 101697 - DNA, 16 bp, H. sapiens
gagcctcagttccctc

SEQ ID NO: 101698 - DNA, 16 bp, H. sapiens
gagcctcagttttcct

SEQ ID NO: 101699 - DNA, 16 bp, H. sapiens
gagcctcatctgtaaa

SEQ ID NO: 101700 - DNA, 16 bp, H. sapiens
gagcctccagaaggaa

SEQ ID NO: 101701 - DNA, 16 bp, H. sapiens
gagcctccaggaggaa

SEQ ID NO: 101702 - DNA, 17 bp, H. sapiens
gagcctcccaaagtgct

SEQ ID NO: 101703 - DNA, 16 bp, H. sapiens
gagcctccccaacgag

SEQ ID NO: 101704 - DNA, 16 bp, H. sapiens
gagcctcccgcctcag

SEQ ID NO: 101705 - DNA, 16 bp, H. sapiens
gagcctccgtgcccag

SEQ ID NO: 101706 - DNA, 16 bp, H. sapiens
gagcctcctgcctctg

SEQ ID NO: 101707 - DNA, 16 bp, H. sapiens
gagcctctgcacccag

SEQ ID NO: 101708 - DNA, 16 bp, H. sapiens
gagcctctgcccggcc

SEQ ID NO: 101709 - DNA, 16 bp, H. sapiens
gagcctctggagggag

SEQ ID NO: 101710 - DNA, 16 bp, H. sapiens
gagcctctgtgcctgg

SEQ ID NO: 101711 - DNA, 16 bp, H. sapiens
gagcctctgtttcccc

SEQ ID NO: 101712 - DNA, 16 bp, H. sapiens
gagcctgaaaaaatgc

SEQ ID NO: 101713 - DNA, 16 bp, H. sapiens
gagcctgaagcaggag

SEQ ID NO: 101714 - DNA, 16 bp, H. sapiens
gagcctgaggctggag

SEQ ID NO: 101715 - DNA, 16 bp, H. sapiens
gagcctgaggtccctg

SEQ ID NO: 101716 - DNA, 16 bp, H. sapiens
gagcctgcagagggag

SEQ ID NO: 101717 - DNA, 17 bp, H. sapiens
gagcctgcaggtgcaca

SEQ ID NO: 101718 - DNA, 16 bp, H. sapiens
gagcctgctcccacca

SEQ ID NO: 101719 - DNA, 16 bp, H. sapiens
gagcctggagcctggg

SEQ ID NO: 101720 - DNA, 16 bp, H. sapiens
gagcctggccaacatg

SEQ ID NO: 101721 - DNA, 16 bp, H. sapiens
gagcctgggaagttga

SEQ ID NO: 101722 - DNA, 16 bp, H. sapiens
gagcctgggcaacata

SEQ ID NO: 101723 - DNA, 16 bp, H. sapiens
gagcctgggcaacatg

SEQ ID NO: 101724 - DNA, 16 bp, H. sapiens
gagcctggggaagtca

SEQ ID NO: 101725 - DNA, 16 bp, H. sapiens
gagcctggggaggagg

SEQ ID NO: 101726 - DNA, 16 bp, H. sapiens
gagcctggggaggcag

SEQ ID NO: 101727 - DNA, 16 bp, H. sapiens
gagcctggggaggtcg

SEQ ID NO: 101728 - DNA, 16 bp, H. sapiens
gagcctggggcaggag

SEQ ID NO: 101729 - DNA, 16 bp, H. sapiens
gagcctggggctgggg

SEQ ID NO: 101730 - DNA, 16 bp, H. sapiens
gagcctgggtgctgtc

SEQ ID NO: 101731 - DNA, 16 bp, H. sapiens
gagcctgtctgcctcc

SEQ ID NO: 101732 - DNA, 16 bp, H. sapiens
gagcctgtgaaattaa

SEQ ID NO: 101733 - DNA, 16 bp, H. sapiens
gagcctgtgcccctgg

SEQ ID NO: 101734 - DNA, 16 bp, H. sapiens
gagcctgtgtgtgtct

SEQ ID NO: 101735 - DNA, 16 bp, H. sapiens
gagcctgtttccttat

SEQ ID NO: 101736 - DNA, 16 bp, H. sapiens
gagccttcagaaatga

SEQ ID NO: 101737 - DNA, 16 bp, H. sapiens
gagccttcagatgaga

SEQ ID NO: 101738 - DNA, 16 bp, H. sapiens
gagccttgctctgttg

SEQ ID NO: 101739 - DNA, 16 bp, H. sapiens
gagccttggtttcccc

SEQ ID NO: 101740 - DNA, 16 bp, H. sapiens
gagcgaaactacatct

SEQ ID NO: 101741 - DNA, 16 bp, H. sapiens
gagcgagcgagagaga

SEQ ID NO: 101742 - DNA, 16 bp, H. sapiens
gagcgagcgagcgagc

SEQ ID NO: 101743 - DNA, 16 bp, H. sapiens
gagcgcaggagttcaa

SEQ ID NO: 101744 - DNA, 16 bp, H. sapiens
gagcgcctgggaggcc

SEQ ID NO: 101745 - DNA, 16 bp, H. sapiens
gagcgtggtggtgtgt

SEQ ID NO: 101746 - DNA, 16 bp, H. sapiens
gagctaaaattcacag

SEQ ID NO: 101747 - DNA, 16 bp, H. sapiens
gagctaaataaatgga

SEQ ID NO: 101748 - DNA, 16 bp, H. sapiens
gagctaagaatggttt

SEQ ID NO: 101749 - DNA, 16 bp, H. sapiens
gagctacaggccccat

SEQ ID NO: 101750 - DNA, 16 bp, H. sapiens
gagctactgcgcctgg

SEQ ID NO: 101751 - DNA, 16 bp, H. sapiens
gagctactgtgccagg

SEQ ID NO: 101752 - DNA, 16 bp, H. sapiens
gagctagagaaacaag

SEQ ID NO: 101753 - DNA, 16 bp, H. sapiens
gagctagagtctcact

SEQ ID NO: 101754 - DNA, 16 bp, H. sapiens
gagctaggatttgaat

SEQ ID NO: 101755 - DNA, 16 bp, H. sapiens
gagctatgagaaataa

SEQ ID NO: 101756 - DNA, 16 bp, H. sapiens
gagctatgagaagaga

SEQ ID NO: 101757 - DNA, 16 bp, H. sapiens
gagctatgtggagtct

SEQ ID NO: 101758 - DNA, 16 bp, H. sapiens
gagctcaactgatctg

SEQ ID NO: 101759 - DNA, 16 bp, H. sapiens
gagctcaagaaatcct

SEQ ID NO: 101760 - DNA, 16 bp, H. sapiens
gagctcaaggctgcag

SEQ ID NO: 101761 - DNA, 16 bp, H. sapiens
gagctcacagtctaga

SEQ ID NO: 101762 - DNA, 16 bp, H. sapiens
gagctcactgaggcca

SEQ ID NO: 101763 - DNA, 16 bp, H. sapiens
gagctcactgcagcct

SEQ ID NO: 101764 - DNA, 16 bp, H. sapiens
gagctcagaagagagg

SEQ ID NO: 101765 - DNA, 16 bp, H. sapiens
gagctcagaagttcca

SEQ ID NO: 101766 - DNA, 16 bp, H. sapiens
gagctcagagttcaag

SEQ ID NO: 101767 - DNA, 16 bp, H. sapiens
gagctcagctgggcca

SEQ ID NO: 101768 - DNA, 16 bp, H. sapiens
gagctcaggagtatga

SEQ ID NO: 101769 - DNA, 16 bp, H. sapiens
gagctcaggcagtaat

SEQ ID NO: 101770 - DNA, 16 bp, H. sapiens
gagctcaggcggtaat

SEQ ID NO: 101771 - DNA, 16 bp, H. sapiens
gagctccagaccatcc

SEQ ID NO: 101772 - DNA, 16 bp, H. sapiens
gagctcccaaaggaag

SEQ ID NO: 101773 - DNA, 16 bp, H. sapiens
gagctcccacccccag

SEQ ID NO: 101774 - DNA, 16 bp, H. sapiens
gagctcccagattcat

SEQ ID NO: 101775 - DNA, 16 bp, H. sapiens
gagctccctgaaaaag

SEQ ID NO: 101776 - DNA, 16 bp, H. sapiens
gagctccctgaaggca

SEQ ID NO: 101777 - DNA, 16 bp, H. sapiens
gagctcctgaaagaaa

SEQ ID NO: 101778 - DNA, 16 bp, H. sapiens
gagctcctgaaggagg

SEQ ID NO: 101779 - DNA, 16 bp, H. sapiens
gagctcctgagctcaa

SEQ ID NO: 101780 - DNA, 16 bp, H. sapiens
gagctcctgagggaag

SEQ ID NO: 101781 - DNA, 16 bp, H. sapiens
gagctcctgcacagca

SEQ ID NO: 101782 - DNA, 16 bp, H. sapiens
gagctcctggcctcaa

SEQ ID NO: 101783 - DNA, 16 bp, H. sapiens
gagctcctgggctcag

SEQ ID NO: 101784 - DNA, 16 bp, H. sapiens
gagctctccaaactct

SEQ ID NO: 101785 - DNA, 16 bp, H. sapiens
gagctctcctgtatga

SEQ ID NO: 101786 - DNA, 16 bp, H. sapiens
gagctctgctaaggga

SEQ ID NO: 101787 - DNA, 16 bp, H. sapiens
gagctctggaatcaga

SEQ ID NO: 101788 - DNA, 16 bp, H. sapiens
gagctctggagtcaga

SEQ ID NO: 101789 - DNA, 16 bp, H. sapiens
gagctctgggcagagc

SEQ ID NO: 101790 - DNA, 16 bp, H. sapiens
gagctctgggcttcca

SEQ ID NO: 101791 - DNA, 16 bp, H. sapiens
gagctctggtctgcag

SEQ ID NO: 101792 - DNA, 16 bp, H. sapiens
gagctctgtcccagag

SEQ ID NO: 101793 - DNA, 16 bp, H. sapiens
gagctctgtgtcagaa

SEQ ID NO: 101794 - DNA, 16 bp, H. sapiens
gagctctgtgtcagga

SEQ ID NO: 101795 - DNA, 16 bp, H. sapiens
gagctcttgggtgact

SEQ ID NO: 101796 - DNA, 16 bp, H. sapiens
gagctctttgaggaat

SEQ ID NO: 101797 - DNA, 16 bp, H. sapiens
gagctctttgaggcca

SEQ ID NO: 101798 - DNA, 16 bp, H. sapiens
gagctgaaaaacacaa

SEQ ID NO: 101799 - DNA, 17 bp, H. sapiens
gagctgaacaatgagaa

SEQ ID NO: 101800 - DNA, 17 bp, H. sapiens
gagctgaaccttccttt

SEQ ID NO: 101801 - DNA, 16 bp, H. sapiens
gagctgaagaatgaga

SEQ ID NO: 101802 - DNA, 16 bp, H. sapiens
gagctgaagaccagcc

SEQ ID NO: 101803 - DNA, 16 bp, H. sapiens
gagctgaagagagaga

SEQ ID NO: 101804 - DNA, 16 bp, H. sapiens
gagctgaagcagctgg

SEQ ID NO: 101805 - DNA, 16 bp, H. sapiens
gagctgaaggttgcag

SEQ ID NO: 101806 - DNA, 16 bp, H. sapiens
gagctgagacagtgcc

SEQ ID NO: 101807 - DNA, 17 bp, H. sapiens
gagctgagacagtgcca

SEQ ID NO: 101808 - DNA, 16 bp, H. sapiens
gagctgagactgcact

SEQ ID NO: 101809 - DNA, 16 bp, H. sapiens
gagctgagactgtgct

SEQ ID NO: 101810 - DNA, 16 bp, H. sapiens
gagctgagagccttga

SEQ ID NO: 101811 - DNA, 16 bp, H. sapiens
gagctgagataatgcc

SEQ ID NO: 101812 - DNA, 16 bp, H. sapiens
gagctgagatcaagcc

SEQ ID NO: 101813 - DNA, 16 bp, H. sapiens
gagctgagatcgtggc

SEQ ID NO: 101814 - DNA, 16 bp, H. sapiens
gagctgagattgcagc

SEQ ID NO: 101815 - DNA, 16 bp, H. sapiens
gagctgagcaaagggg

SEQ ID NO: 101816 - DNA, 16 bp, H. sapiens
gagctgagcctgagta

SEQ ID NO: 101817 - DNA, 16 bp, H. sapiens
gagctgagctgagctg

SEQ ID NO: 101818 - DNA, 16 bp, H. sapiens
gagctgaggctgcagt

SEQ ID NO: 101819 - DNA, 16 bp, H. sapiens
gagctgaggctggagc

SEQ ID NO: 101820 - DNA, 16 bp, H. sapiens
gagctgaggtaggagg

SEQ ID NO: 101821 - DNA, 16 bp, H. sapiens
gagctgaggtttcacc

SEQ ID NO: 101822 - DNA, 16 bp, H. sapiens
gagctgatgggtgcag

SEQ ID NO: 101823 - DNA, 16 bp, H. sapiens
gagctgcaacattaaa

SEQ ID NO: 101824 - DNA, 16 bp, H. sapiens
gagctgcagacataga

SEQ ID NO: 101825 - DNA, 16 bp, H. sapiens
gagctgcagagatgac

SEQ ID NO: 101826 - DNA, 16 bp, H. sapiens
gagctgcagctggaga

SEQ ID NO: 101827 - DNA, 16 bp, H. sapiens
gagctgcaggtggagc

SEQ ID NO: 101828 - DNA, 16 bp, H. sapiens
gagctgcagtcagaga

SEQ ID NO: 101829 - DNA, 16 bp, H. sapiens
gagctgcagtgggctc

SEQ ID NO: 101830 - DNA, 16 bp, H. sapiens
gagctgccaagggagg

SEQ ID NO: 101831 - DNA, 16 bp, H. sapiens
gagctgccacgcccag

SEQ ID NO: 101832 - DNA, 16 bp, H. sapiens
gagctgcccaccccac

SEQ ID NO: 101833 - DNA, 16 bp, H. sapiens
gagctgcccagagagg

SEQ ID NO: 101834 - DNA, 16 bp, H. sapiens
gagctgccctcagccc

SEQ ID NO: 101835 - DNA, 16 bp, H. sapiens
gagctgccgtgcctgg

SEQ ID NO: 101836 - DNA, 16 bp, H. sapiens
gagctgcctaagacca

SEQ ID NO: 101837 - DNA, 16 bp, H. sapiens
gagctgcctgcctcgg

SEQ ID NO: 101838 - DNA, 16 bp, H. sapiens
gagctgctgcgcctgg

SEQ ID NO: 101839 - DNA, 16 bp, H. sapiens
gagctgctgggctgtg

SEQ ID NO: 101840 - DNA, 23 bp, H. sapiens
gagctgctgtccaacctgtactc

SEQ ID NO: 101841 - DNA, 16 bp, H. sapiens
gagctgctgtgcccag

SEQ ID NO: 101842 - DNA, 16 bp, H. sapiens
gagctggaagccatca

SEQ ID NO: 101843 - DNA, 16 bp, H. sapiens
gagctggaagctatta

SEQ ID NO: 101844 - DNA, 16 bp, H. sapiens
gagctggaattcaaac

SEQ ID NO: 101845 - DNA, 16 bp, H. sapiens
gagctggacacagtgg

SEQ ID NO: 101846 - DNA, 16 bp, H. sapiens
gagctggacgtggtgg

SEQ ID NO: 101847 - DNA, 16 bp, H. sapiens
gagctggagcagctgg

SEQ ID NO: 101848 - DNA, 16 bp, H. sapiens
gagctggaggaggaag

SEQ ID NO: 101849 - DNA, 16 bp, H. sapiens
gagctggaggcctggg

SEQ ID NO: 101850 - DNA, 16 bp, H. sapiens
gagctggatgcagtgg

SEQ ID NO: 101851 - DNA, 16 bp, H. sapiens
gagctggatggtggtg

SEQ ID NO: 101852 - DNA, 16 bp, H. sapiens
gagctggcacccaagc

SEQ ID NO: 101853 - DNA, 16 bp, H. sapiens
gagctggcacccatgc

SEQ ID NO: 101854 - DNA, 16 bp, H. sapiens
gagctgggaattgaac

SEQ ID NO: 101855 - DNA, 16 bp, H. sapiens
gagctgggactacagg

SEQ ID NO: 101856 - DNA, 16 bp, H. sapiens
gagctgggagaagagg

SEQ ID NO: 101857 - DNA, 16 bp, H. sapiens
gagctgggagctgggg

SEQ ID NO: 101858 - DNA, 16 bp, H. sapiens
gagctgggatctgaag

SEQ ID NO: 101859 - DNA, 16 bp, H. sapiens
gagctgggattacagg

SEQ ID NO: 101860 - DNA, 16 bp, H. sapiens
gagctgggatttgaac

SEQ ID NO: 101861 - DNA, 16 bp, H. sapiens
gagctgggcatggtgg

SEQ ID NO: 101862 - DNA, 16 bp, H. sapiens
gagctgggcccagggc

SEQ ID NO: 101863 - DNA, 16 bp, H. sapiens
gagctgggcccggaga

SEQ ID NO: 101864 - DNA, 16 bp, H. sapiens
gagctgggcccgggga

SEQ ID NO: 101865 - DNA, 16 bp, H. sapiens
gagctgggcctggaga

SEQ ID NO: 101866 - DNA, 16 bp, H. sapiens
gagctgggcctgggga

SEQ ID NO: 101867 - DNA, 16 bp, H. sapiens
gagctgggcctggtga

SEQ ID NO: 101868 - DNA, 16 bp, H. sapiens
gagctgggcctggtgg

SEQ ID NO: 101869 - DNA, 16 bp, H. sapiens
gagctgggcgcggtgg

SEQ ID NO: 101870 - DNA, 16 bp, H. sapiens
gagctgggcgtggtgg

SEQ ID NO: 101871 - DNA, 16 bp, H. sapiens
gagctgggctctgagc

SEQ ID NO: 101872 - DNA, 16 bp, H. sapiens
gagctgggctgggctg

SEQ ID NO: 101873 - DNA, 16 bp, H. sapiens
gagctggggagaggag

SEQ ID NO: 101874 - DNA, 16 bp, H. sapiens
gagctggggagcagaa

SEQ ID NO: 101875 - DNA, 16 bp, H. sapiens
gagctggggaggcctc

SEQ ID NO: 101876 - DNA, 16 bp, H. sapiens
gagctggggccacagg

SEQ ID NO: 101877 - DNA, 16 bp, H. sapiens
gagctggggctgctgg

SEQ ID NO: 101878 - DNA, 16 bp, H. sapiens
gagctggggctggagg

SEQ ID NO: 101879 - DNA, 16 bp, H. sapiens
gagctggggctgggct

SEQ ID NO: 101880 - DNA, 16 bp, H. sapiens
gagctgggggagggat

SEQ ID NO: 101881 - DNA, 16 bp, H. sapiens
gagctgggggctggag

SEQ ID NO: 101882 - DNA, 16 bp, H. sapiens
gagctggggtctcact

SEQ ID NO: 101883 - DNA, 16 bp, H. sapiens
gagctggggtcttgct

SEQ ID NO: 101884 - DNA, 16 bp, H. sapiens
gagctgggtgtgatgg

SEQ ID NO: 101885 - DNA, 16 bp, H. sapiens
gagctggtctcggcaa

SEQ ID NO: 101886 - DNA, 16 bp, H. sapiens
gagctggtgcactgtg

SEQ ID NO: 101887 - DNA, 16 bp, H. sapiens
gagctggtgtttgttt

SEQ ID NO: 101888 - DNA, 16 bp, H. sapiens
gagctgtaaacactca

SEQ ID NO: 101889 - DNA, 16 bp, H. sapiens
gagctgtaacactcac

SEQ ID NO: 101890 - DNA, 16 bp, H. sapiens
gagctgtacctgggcc

SEQ ID NO: 101891 - DNA, 16 bp, H. sapiens
gagctgtgagaagaga

SEQ ID NO: 101892 - DNA, 16 bp, H. sapiens
gagctgtgatcacaac

SEQ ID NO: 101893 - DNA, 16 bp, H. sapiens
gagctgtgattgtgcc

SEQ ID NO: 101894 - DNA, 16 bp, H. sapiens
gagctgtggcagagga

SEQ ID NO: 101895 - DNA, 16 bp, H. sapiens
gagctgtggccctttg

SEQ ID NO: 101896 - DNA, 24 bp, H. sapiens
gagctgttcctattcggccatctt

SEQ ID NO: 101897 - DNA, 16 bp, H. sapiens
gagctgttctagcaaa

SEQ ID NO: 101898 - DNA, 16 bp, H. sapiens
gagctgtttgagttcc

SEQ ID NO: 101899 - DNA, 16 bp, H. sapiens
gagctgtttggaaaca

SEQ ID NO: 101900 - DNA, 16 bp, H. sapiens
gagcttaatttttttt

SEQ ID NO: 101901 - DNA, 16 bp, H. sapiens
gagcttatattctagt

SEQ ID NO: 101902 - DNA, 16 bp, H. sapiens
gagcttccagaaggaa

SEQ ID NO: 101903 - DNA, 16 bp, H. sapiens
gagcttccagtgagcc

SEQ ID NO: 101904 - DNA, 16 bp, H. sapiens
gagcttcccaggtgag

SEQ ID NO: 101905 - DNA, 16 bp, H. sapiens
gagcttcccggctgct

SEQ ID NO: 101906 - DNA, 16 bp, H. sapiens
gagcttcctagcagcc

SEQ ID NO: 101907 - DNA, 16 bp, H. sapiens
gagcttccttgccatc

SEQ ID NO: 101908 - DNA, 16 bp, H. sapiens
gagcttctccacagca

SEQ ID NO: 101909 - DNA, 16 bp, H. sapiens
gagcttctgcacatca

SEQ ID NO: 101910 - DNA, 16 bp, H. sapiens
gagcttgacagcttcc

SEQ ID NO: 101911 - DNA, 16 bp, H. sapiens
gagcttgagaaaaatg

SEQ ID NO: 101912 - DNA, 16 bp, H. sapiens
gagcttgagaagaata

SEQ ID NO: 101913 - DNA, 16 bp, H. sapiens
gagcttgaggtgggag

SEQ ID NO: 101914 - DNA, 16 bp, H. sapiens
gagcttgcagtgacct

SEQ ID NO: 101915 - DNA, 16 bp, H. sapiens
gagcttgcagtgagcc

SEQ ID NO: 101916 - DNA, 16 bp, H. sapiens
gagcttgccagctccc

SEQ ID NO: 101917 - DNA, 16 bp, H. sapiens
gagcttggatttgaac

SEQ ID NO: 101918 - DNA, 16 bp, H. sapiens
gagcttgggctgtggc

SEQ ID NO: 101919 - DNA, 16 bp, H. sapiens
gagcttgtagtgagcc

SEQ ID NO: 101920 - DNA, 16 bp, H. sapiens
gagcttgtgcaggaaa

SEQ ID NO: 101921 - DNA, 16 bp, H. sapiens
gagcttgttagaaatg

SEQ ID NO: 101922 - DNA, 16 bp, H. sapiens
gagctttaacatttga

SEQ ID NO: 101923 - DNA, 16 bp, H. sapiens
gagctttaagatttaa

SEQ ID NO: 101924 - DNA, 16 bp, H. sapiens
gagctttggagtcaga

SEQ ID NO: 101925 - DNA, 16 bp, H. sapiens
gagctttttagatgag

SEQ ID NO: 101926 - DNA, 16 bp, H. sapiens
gaggaaaaaaaatcag

SEQ ID NO: 101927 - DNA, 16 bp, H. sapiens
gaggaaaaaatggttt

SEQ ID NO: 101928 - DNA, 33 bp, H. sapiens
gaggaaaaaatgttaagggcagccagagagaaa

SEQ ID NO: 101929 - DNA, 16 bp, H. sapiens
gaggaaaaagtggttt

SEQ ID NO: 101930 - DNA, 16 bp, H. sapiens
gaggaaaactccatct

SEQ ID NO: 101931 - DNA, 16 bp, H. sapiens
gaggaaaactgaggct

SEQ ID NO: 101932 - DNA, 16 bp, H. sapiens
gaggaaaagacaccag

SEQ ID NO: 101933 - DNA, 16 bp, H. sapiens
gaggaaaagcagggtg

SEQ ID NO: 101934 - DNA, 16 bp, H. sapiens
gaggaaaagcattcag

SEQ ID NO: 101935 - DNA, 16 bp, H. sapiens
gaggaaaaggcacata

SEQ ID NO: 101936 - DNA, 16 bp, H. sapiens
gaggaaaagttaaata

SEQ ID NO: 101937 - DNA, 16 bp, H. sapiens
gaggaaaataaattgt

SEQ ID NO: 101938 - DNA, 16 bp, H. sapiens
gaggaaaatgaaacag

SEQ ID NO: 101939 - DNA, 16 bp, H. sapiens
gaggaaaatgtgggaa

SEQ ID NO: 101940 - DNA, 16 bp, H. sapiens
gaggaaacaacagatg

SEQ ID NO: 101941 - DNA, 16 bp, H. sapiens
gaggaaacagacaaat

SEQ ID NO: 101942 - DNA, 16 bp, H. sapiens
gaggaaacagaggctc

SEQ ID NO: 101943 - DNA, 17 bp, H. sapiens
gaggaaaccctctgcct

SEQ ID NO: 101944 - DNA, 16 bp, H. sapiens
gaggaaaccgaggctt

SEQ ID NO: 101945 - DNA, 16 bp, H. sapiens
gaggaaactaaggctc

SEQ ID NO: 101946 - DNA, 16 bp, H. sapiens
gaggaaactgaagttc

SEQ ID NO: 101947 - DNA, 16 bp, H. sapiens
gaggaaactgaggcct

SEQ ID NO: 101948 - DNA, 16 bp, H. sapiens
gaggaaactgaggtcc

SEQ ID NO: 101949 - DNA, 16 bp, H. sapiens
gaggaaactgagtcac

SEQ ID NO: 101950 - DNA, 16 bp, H. sapiens
gaggaaactgcagaag

SEQ ID NO: 101951 - DNA, 16 bp, H. sapiens
gaggaaagaacaactc

SEQ ID NO: 101952 - DNA, 16 bp, H. sapiens
gaggaaagaatttcag

SEQ ID NO: 101953 - DNA, 16 bp, H. sapiens
gaggaaagaccatgtg

SEQ ID NO: 101954 - DNA, 16 bp, H. sapiens
gaggaaagagcaggca

SEQ ID NO: 101955 - DNA, 16 bp, H. sapiens
gaggaaagaggtttaa

SEQ ID NO: 101956 - DNA, 16 bp, H. sapiens
gaggaaaggctttctg

SEQ ID NO: 101957 - DNA, 16 bp, H. sapiens
gaggaaagggaaccct

SEQ ID NO: 101958 - DNA, 16 bp, H. sapiens
gaggaaatatttccaa

SEQ ID NO: 101959 - DNA, 16 bp, H. sapiens
gaggaaatcaatgaaa

SEQ ID NO: 101960 - DNA, 16 bp, H. sapiens
gaggaaatcccagaga

SEQ ID NO: 101961 - DNA, 16 bp, H. sapiens
gaggaaatgccacact

SEQ ID NO: 101962 - DNA, 16 bp, H. sapiens
gaggaaatggaggcat

SEQ ID NO: 101963 - DNA, 16 bp, H. sapiens
gaggaaatgggaagat

SEQ ID NO: 101964 - DNA, 16 bp, H. sapiens
gaggaacacctgagcc

SEQ ID NO: 101965 - DNA, 16 bp, H. sapiens
gaggaactgaggcaca

SEQ ID NO: 101966 - DNA, 16 bp, H. sapiens
gaggaacttccaaaca

SEQ ID NO: 101967 - DNA, 16 bp, H. sapiens
gaggaacttgccaaac

SEQ ID NO: 101968 - DNA, 16 bp, H. sapiens
gaggaagaccagaggt

SEQ ID NO: 101969 - DNA, 16 bp, H. sapiens
gaggaagaccctatct

SEQ ID NO: 101970 - DNA, 16 bp, H. sapiens
gaggaagagaagacca

SEQ ID NO: 101971 - DNA, 16 bp, H. sapiens
gaggaagagagacctg

SEQ ID NO: 101972 - DNA, 16 bp, H. sapiens
gaggaagaggaactgg

SEQ ID NO: 101973 - DNA, 16 bp, H. sapiens
gaggaagaggatcagg

SEQ ID NO: 101974 - DNA, 16 bp, H. sapiens
gaggaagaggttgtgg

SEQ ID NO: 101975 - DNA, 16 bp, H. sapiens
gaggaagcagaggcag

SEQ ID NO: 101976 - DNA, 16 bp, H. sapiens
gaggaagccagagaga

SEQ ID NO: 101977 - DNA, 16 bp, H. sapiens
gaggaagctgaagaag

SEQ ID NO: 101978 - DNA, 16 bp, H. sapiens
gaggaagctgaggccc

SEQ ID NO: 101979 - DNA, 16 bp, H. sapiens
gaggaagctgaggctc

SEQ ID NO: 101980 - DNA, 16 bp, H. sapiens
gaggaagctgcaggag

SEQ ID NO: 101981 - DNA, 16 bp, H. sapiens
gaggaagctgggagat

SEQ ID NO: 101982 - DNA, 16 bp, H. sapiens
gaggaaggaagctggg

SEQ ID NO: 101983 - DNA, 16 bp, H. sapiens
gaggaaggaatgcttc

SEQ ID NO: 101984 - DNA, 16 bp, H. sapiens
gaggaaggagaatggc

SEQ ID NO: 101985 - DNA, 16 bp, H. sapiens
gaggaaggagaggctg

SEQ ID NO: 101986 - DNA, 17 bp, H. sapiens
gaggaaggatcaggcag

SEQ ID NO: 101987 - DNA, 16 bp, H. sapiens
gaggaaggcatgcctc

SEQ ID NO: 101988 - DNA, 22 bp, H. sapiens
gaggaaggccactgtctcctgc

SEQ ID NO: 101989 - DNA, 16 bp, H. sapiens
gaggaaggcctctgtc

SEQ ID NO: 101990 - DNA, 16 bp, H. sapiens
gaggaaggcttcagaa

SEQ ID NO: 101991 - DNA, 16 bp, H. sapiens
gaggaagggccactct

SEQ ID NO: 101992 - DNA, 16 bp, H. sapiens
gaggaaggggccctgc

SEQ ID NO: 101993 - DNA, 16 bp, H. sapiens
gaggaagtaactgaag

SEQ ID NO: 101994 - DNA, 17 bp, H. sapiens
gaggaagtcaaattgtg

SEQ ID NO: 101995 - DNA, 16 bp, H. sapiens
gaggaagtcagactat

SEQ ID NO: 101996 - DNA, 16 bp, H. sapiens
gaggaagtgccaggct

SEQ ID NO: 101997 - DNA, 16 bp, H. sapiens
gaggaagtggaggcag

SEQ ID NO: 101998 - DNA, 16 bp, H. sapiens
gaggaagtttccctct

SEQ ID NO: 101999 - DNA, 16 bp, H. sapiens
gaggaagttttttttt

SEQ ID NO: 102000 - DNA, 16 bp, H. sapiens
gaggaataaaacataa

SEQ ID NO: 102001 - DNA, 16 bp, H. sapiens
gaggaatacatttctg

SEQ ID NO: 102002 - DNA, 16 bp, H. sapiens
gaggaatacttaccaa

SEQ ID NO: 102003 - DNA, 16 bp, H. sapiens
gaggaatagcaaggag

SEQ ID NO: 102004 - DNA, 16 bp, H. sapiens
gaggaatatgttgcct

SEQ ID NO: 102005 - DNA, 16 bp, H. sapiens
gaggaatccctcctcc

SEQ ID NO: 102006 - DNA, 16 bp, H. sapiens
gaggaatctagaaagg

SEQ ID NO: 102007 - DNA, 16 bp, H. sapiens
gaggaattcaaggctg

SEQ ID NO: 102008 - DNA, 16 bp, H. sapiens
gaggaattccagaaga

SEQ ID NO: 102009 - DNA, 16 bp, H. sapiens
gaggacaaggctgcag

SEQ ID NO: 102010 - DNA, 16 bp, H. sapiens
gaggacacaaaaaatg

SEQ ID NO: 102011 - DNA, 16 bp, H. sapiens
gaggacacaaacaaag

SEQ ID NO: 102012 - DNA, 16 bp, H. sapiens
gaggacacaaagacat

SEQ ID NO: 102013 - DNA, 16 bp, H. sapiens
gaggacacacacacag

SEQ ID NO: 102014 - DNA, 16 bp, H. sapiens
gaggacacagagaagg

SEQ ID NO: 102015 - DNA, 16 bp, H. sapiens
gaggacacagagccag

SEQ ID NO: 102016 - DNA, 16 bp, H. sapiens
gaggacactgaggccc

SEQ ID NO: 102017 - DNA, 16 bp, H. sapiens
gaggacagagcagagg

SEQ ID NO: 102018 - DNA, 16 bp, H. sapiens
gaggacagaggcagca

SEQ ID NO: 102019 - DNA, 16 bp, H. sapiens
gaggacagctgcctgg

SEQ ID NO: 102020 - DNA, 16 bp, H. sapiens
gaggacagggctcaga

SEQ ID NO: 102021 - DNA, 16 bp, H. sapiens
gaggacaggtcacatc

SEQ ID NO: 102022 - DNA, 16 bp, H. sapiens
gaggacattctgctaa

SEQ ID NO: 102023 - DNA, 16 bp, H. sapiens
gaggacccacttcctg

SEQ ID NO: 102024 - DNA, 16 bp, H. sapiens
gaggacccaggacatc

SEQ ID NO: 102025 - DNA, 16 bp, H. sapiens
gaggaccccacccctg

SEQ ID NO: 102026 - DNA, 16 bp, H. sapiens
gaggaccctcagctgc

SEQ ID NO: 102027 - DNA, 16 bp, H. sapiens
gaggaccctggggcct

SEQ ID NO: 102028 - DNA, 16 bp, H. sapiens
gaggaccctgtggcct

SEQ ID NO: 102029 - DNA, 16 bp, H. sapiens
gaggacctcaggctgc

SEQ ID NO: 102030 - DNA, 20 bp, H. sapiens
gaggacctcttcaaggagaa

SEQ ID NO: 102031 - DNA, 17 bp, H. sapiens
gaggacgccgcccacgg

SEQ ID NO: 102032 - DNA, 23 bp, H. sapiens
gaggacgccgcccagggcatcgc

SEQ ID NO: 102033 - DNA, 16 bp, H. sapiens
gaggactcagaagaca

SEQ ID NO: 102034 - DNA, 16 bp, H. sapiens
gaggactccccagcca

SEQ ID NO: 102035 - DNA, 16 bp, H. sapiens
gaggactctcttcctg

SEQ ID NO: 102036 - DNA, 16 bp, H. sapiens
gaggactcttggaagc

SEQ ID NO: 102037 - DNA, 16 bp, H. sapiens
gaggactgcctgagct

SEQ ID NO: 102038 - DNA, 16 bp, H. sapiens
gaggactgcttgagct

SEQ ID NO: 102039 - DNA, 16 bp, H. sapiens
gaggactgcttgtgcc

SEQ ID NO: 102040 - DNA, 16 bp, H. sapiens
gaggactgtggccctc

SEQ ID NO: 102041 - DNA, 16 bp, H. sapiens
gaggacttcctggagg

SEQ ID NO: 102042 - DNA, 16 bp, H. sapiens
gaggactttttttttt

SEQ ID NO: 102043 - DNA, 16 bp, H. sapiens
gaggagaaaaatgtgt

SEQ ID NO: 102044 - DNA, 25 bp, H. sapiens
gaggagaactacaaaccactgctca

SEQ ID NO: 102045 - DNA, 16 bp, H. sapiens
gaggagaagcagctgg

SEQ ID NO: 102046 - DNA, 16 bp, H. sapiens
gaggagaaggccatgt

SEQ ID NO: 102047 - DNA, 16 bp, H. sapiens
gaggagaaggttgcag

SEQ ID NO: 102048 - DNA, 16 bp, H. sapiens
gaggagaatcacttga

SEQ ID NO: 102049 - DNA, 16 bp, H. sapiens
gaggagagcagctcct

SEQ ID NO: 102050 - DNA, 16 bp, H. sapiens
gaggagagccagagaa

SEQ ID NO: 102051 - DNA, 16 bp, H. sapiens
gaggagagcccaggcc

SEQ ID NO: 102052 - DNA, 16 bp, H. sapiens
gaggagagcttgagcc

SEQ ID NO: 102053 - DNA, 16 bp, H. sapiens
gaggagaggcattctg

SEQ ID NO: 102054 - DNA, 16 bp, H. sapiens
gaggagagtcacatca

SEQ ID NO: 102055 - DNA, 16 bp, H. sapiens
gaggagatggatgaat

SEQ ID NO: 102056 - DNA, 16 bp, H. sapiens
gaggagatggatttga

SEQ ID NO: 102057 - DNA, 16 bp, H. sapiens
gaggagcaaaggcatg

SEQ ID NO: 102058 - DNA, 16 bp, H. sapiens
gaggagcagaagagca

SEQ ID NO: 102059 - DNA, 16 bp, H. sapiens
gaggagcagaggagca

SEQ ID NO: 102060 - DNA, 16 bp, H. sapiens
gaggagcagcagcagc

SEQ ID NO: 102061 - DNA, 16 bp, H. sapiens
gaggagcagcagcagg

SEQ ID NO: 102062 - DNA, 16 bp, H. sapiens
gaggagcagggctggg

SEQ ID NO: 102063 - DNA, 16 bp, H. sapiens
gaggagccaggggtgg

SEQ ID NO: 102064 - DNA, 16 bp, H. sapiens
gaggagcccagtggga

SEQ ID NO: 102065 - DNA, 16 bp, H. sapiens
gaggagcccctcttcc

SEQ ID NO: 102066 - DNA, 16 bp, H. sapiens
gaggagccggtgctgc

SEQ ID NO: 102067 - DNA, 16 bp, H. sapiens
gaggagcctgaggtcc

SEQ ID NO: 102068 - DNA, 17 bp, H. sapiens
gaggagcggaggctgag

SEQ ID NO: 102069 - DNA, 16 bp, H. sapiens
gaggagctgagggagg

SEQ ID NO: 102070 - DNA, 16 bp, H. sapiens
gaggagctgccaaact

SEQ ID NO: 102071 - DNA, 16 bp, H. sapiens
gaggagctggaaccat

SEQ ID NO: 102072 - DNA, 16 bp, H. sapiens
gaggagctggatgaaa

SEQ ID NO: 102073 - DNA, 16 bp, H. sapiens
gaggagctggtgctgc

SEQ ID NO: 102074 - DNA, 16 bp, H. sapiens
gaggagctgtgagaag

SEQ ID NO: 102075 - DNA, 16 bp, H. sapiens
gaggaggaaactgagg

SEQ ID NO: 102076 - DNA, 16 bp, H. sapiens
gaggaggaaattgagg

SEQ ID NO: 102077 - DNA, 16 bp, H. sapiens
gaggaggaaccagcaa

SEQ ID NO: 102078 - DNA, 16 bp, H. sapiens
gaggaggaaccctgga

SEQ ID NO: 102079 - DNA, 16 bp, H. sapiens
gaggaggaagcagcag

SEQ ID NO: 102080 - DNA, 16 bp, H. sapiens
gaggaggagacacaga

SEQ ID NO: 102081 - DNA, 16 bp, H. sapiens
gaggaggagaggagct

SEQ ID NO: 102082 - DNA, 16 bp, H. sapiens
gaggaggagcagcagc

SEQ ID NO: 102083 - DNA, 16 bp, H. sapiens
gaggaggagctgaggg

SEQ ID NO: 102084 - DNA, 16 bp, H. sapiens
gaggaggagctggatg

SEQ ID NO: 102085 - DNA, 16 bp, H. sapiens
gaggaggaggagacac

SEQ ID NO: 102086 - DNA, 16 bp, H. sapiens
gaggaggaggagctgg

SEQ ID NO: 102087 - DNA, 16 bp, H. sapiens
gaggaggaggaggact

SEQ ID NO: 102088 - DNA, 16 bp, H. sapiens
gaggaggaggatgcag

SEQ ID NO: 102089 - DNA, 16 bp, H. sapiens
gaggaggaggctgagg

SEQ ID NO: 102090 - DNA, 16 bp, H. sapiens
gaggaggaggctgcag

SEQ ID NO: 102091 - DNA, 16 bp, H. sapiens
gaggaggagggtgcag

SEQ ID NO: 102092 - DNA, 16 bp, H. sapiens
gaggaggaggttgcgg

SEQ ID NO: 102093 - DNA, 16 bp, H. sapiens
gaggaggagtttgcag

SEQ ID NO: 102094 - DNA, 16 bp, H. sapiens
gaggaggatgatgatg

SEQ ID NO: 102095 - DNA, 16 bp, H. sapiens
gaggaggcaccaagag

SEQ ID NO: 102096 - DNA, 16 bp, H. sapiens
gaggaggcagcagcag

SEQ ID NO: 102097 - DNA, 16 bp, H. sapiens
gaggaggcagccctga

SEQ ID NO: 102098 - DNA, 16 bp, H. sapiens
gaggaggcagtgagct

SEQ ID NO: 102099 - DNA, 16 bp, H. sapiens
gaggaggccacagtga

SEQ ID NO: 102100 - DNA, 16 bp, H. sapiens
gaggaggccaggcatg

SEQ ID NO: 102101 - DNA, 16 bp, H. sapiens
gaggaggcgccaagag

SEQ ID NO: 102102 - DNA, 16 bp, H. sapiens
gaggaggctaaggtgg

SEQ ID NO: 102103 - DNA, 16 bp, H. sapiens
gaggaggctgagacag

SEQ ID NO: 102104 - DNA, 16 bp, H. sapiens
gaggaggctgaggagg

SEQ ID NO: 102105 - DNA, 16 bp, H. sapiens
gaggaggctgcagagg

SEQ ID NO: 102106 - DNA, 16 bp, H. sapiens
gaggaggctgctgcag

SEQ ID NO: 102107 - DNA, 16 bp, H. sapiens
gaggaggctggggcag

SEQ ID NO: 102108 - DNA, 16 bp, H. sapiens
gaggaggctggggctg

SEQ ID NO: 102109 - DNA, 16 bp, H. sapiens
gaggagggaaactgag

SEQ ID NO: 102110 - DNA, 16 bp, H. sapiens
gaggagggaggaggct

SEQ ID NO: 102111 - DNA, 16 bp, H. sapiens
gaggagggaggatcac

SEQ ID NO: 102112 - DNA, 16 bp, H. sapiens
gaggaggggcctggtg

SEQ ID NO: 102113 - DNA, 16 bp, H. sapiens
gaggaggggctgggcc

SEQ ID NO: 102114 - DNA, 16 bp, H. sapiens
gaggaggggcttggtg

SEQ ID NO: 102115 - DNA, 23 bp, H. sapiens
gaggagggggccagcctcatccc

SEQ ID NO: 102116 - DNA, 20 bp, H. sapiens
gaggagggtggatcacctga

SEQ ID NO: 102117 - DNA, 16 bp, H. sapiens
gaggagggtggatctc

SEQ ID NO: 102118 - DNA, 16 bp, H. sapiens
gaggaggtcagagaga

SEQ ID NO: 102119 - DNA, 16 bp, H. sapiens
gaggaggtgccacaga

SEQ ID NO: 102120 - DNA, 16 bp, H. sapiens
gaggaggtgccgagag

SEQ ID NO: 102121 - DNA, 16 bp, H. sapiens
gaggaggtggatgcag

SEQ ID NO: 102122 - DNA, 16 bp, H. sapiens
gaggaggttccaagat

SEQ ID NO: 102123 - DNA, 16 bp, H. sapiens
gaggaggtttcagtga

SEQ ID NO: 102124 - DNA, 16 bp, H. sapiens
gaggagtccttcagcc

SEQ ID NO: 102125 - DNA, 16 bp, H. sapiens
gaggagtgcgggcaca

SEQ ID NO: 102126 - DNA, 16 bp, H. sapiens
gaggagtgcgggcgca

SEQ ID NO: 102127 - DNA, 16 bp, H. sapiens
gaggagtggtgacagt

SEQ ID NO: 102128 - DNA, 16 bp, H. sapiens
gaggagttctgggctg

SEQ ID NO: 102129 - DNA, 16 bp, H. sapiens
gaggagttggaagaga

SEQ ID NO: 102130 - DNA, 16 bp, H. sapiens
gaggatacagagaaaa

SEQ ID NO: 102131 - DNA, 16 bp, H. sapiens
gaggatatcttgagcc

SEQ ID NO: 102132 - DNA, 16 bp, H. sapiens
gaggatatgcttgtgt

SEQ ID NO: 102133 - DNA, 16 bp, H. sapiens
gaggatattcagtttt

SEQ ID NO: 102134 - DNA, 16 bp, H. sapiens
gaggatcacaagatca

SEQ ID NO: 102135 - DNA, 16 bp, H. sapiens
gaggatcacttcagct

SEQ ID NO: 102136 - DNA, 16 bp, H. sapiens
gaggatcacttgaaat

SEQ ID NO: 102137 - DNA, 17 bp, H. sapiens
gaggatcacttgggccc

SEQ ID NO: 102138 - DNA, 16 bp, H. sapiens
gaggatcagaaaaata

SEQ ID NO: 102139 - DNA, 16 bp, H. sapiens
gaggatcaggaaaaac

SEQ ID NO: 102140 - DNA, 16 bp, H. sapiens
gaggatcatttgagtt

SEQ ID NO: 102141 - DNA, 16 bp, H. sapiens
gaggatcccctgagcc

SEQ ID NO: 102142 - DNA, 16 bp, H. sapiens
gaggatcgattgaacc

SEQ ID NO: 102143 - DNA, 16 bp, H. sapiens
gaggatgaagagaggt

SEQ ID NO: 102144 - DNA, 16 bp, H. sapiens
gaggatgaagatcttt

SEQ ID NO: 102145 - DNA, 16 bp, H. sapiens
gaggatgagaggggcc

SEQ ID NO: 102146 - DNA, 16 bp, H. sapiens
gaggatgagccaggag

SEQ ID NO: 102147 - DNA, 16 bp, H. sapiens
gaggatgaggcagatg

SEQ ID NO: 102148 - DNA, 16 bp, H. sapiens
gaggatgaggcaggag

SEQ ID NO: 102149 - DNA, 16 bp, H. sapiens
gaggatgaggctgcag

SEQ ID NO: 102150 - DNA, 16 bp, H. sapiens
gaggatgatgacttcc

SEQ ID NO: 102151 - DNA, 16 bp, H. sapiens
gaggatgatgatgata

SEQ ID NO: 102152 - DNA, 17 bp, H. sapiens
gaggatgatgctggcct

SEQ ID NO: 102153 - DNA, 16 bp, H. sapiens
gaggatgatggtttcc

SEQ ID NO: 102154 - DNA, 16 bp, H. sapiens
gaggatgcagaacagc

SEQ ID NO: 102155 - DNA, 16 bp, H. sapiens
gaggatgcagcaagaa

SEQ ID NO: 102156 - DNA, 16 bp, H. sapiens
gaggatgcagtgagct

SEQ ID NO: 102157 - DNA, 16 bp, H. sapiens
gaggatgccttgagcc

SEQ ID NO: 102158 - DNA, 16 bp, H. sapiens
gaggatgctcaagcag

SEQ ID NO: 102159 - DNA, 16 bp, H. sapiens
gaggatggaggcagag

SEQ ID NO: 102160 - DNA, 16 bp, H. sapiens
gaggatggaggctggg

SEQ ID NO: 102161 - DNA, 16 bp, H. sapiens
gaggatggatcacctg

SEQ ID NO: 102162 - DNA, 16 bp, H. sapiens
gaggatggatcacttg

SEQ ID NO: 102163 - DNA, 16 bp, H. sapiens
gaggatggcttgaccc

SEQ ID NO: 102164 - DNA, 16 bp, H. sapiens
gaggatggcttgggcc

SEQ ID NO: 102165 - DNA, 16 bp, H. sapiens
gaggatggggcaggag

SEQ ID NO: 102166 - DNA, 16 bp, H. sapiens
gaggatgggtctgcct

SEQ ID NO: 102167 - DNA, 16 bp, H. sapiens
gaggatgtgaagaaaa

SEQ ID NO: 102168 - DNA, 16 bp, H. sapiens
gaggatgtggtgagcc

SEQ ID NO: 102169 - DNA, 16 bp, H. sapiens
gaggatgttgagaaat

SEQ ID NO: 102170 - DNA, 16 bp, H. sapiens
gaggattacaatttga

SEQ ID NO: 102171 - DNA, 16 bp, H. sapiens
gaggattattttatgt

SEQ ID NO: 102172 - DNA, 16 bp, H. sapiens
gaggattctttttttt

SEQ ID NO: 102173 - DNA, 16 bp, H. sapiens
gaggattgcttgagcc

SEQ ID NO: 102174 - DNA, 16 bp, H. sapiens
gaggattgcttgtggc

SEQ ID NO: 102175 - DNA, 16 bp, H. sapiens
gaggatttcccttcac

SEQ ID NO: 102176 - DNA, 16 bp, H. sapiens
gaggatttttccatca

SEQ ID NO: 102177 - DNA, 16 bp, H. sapiens
gaggcaaaaacatcag

SEQ ID NO: 102178 - DNA, 16 bp, H. sapiens
gaggcaaagatgggag

SEQ ID NO: 102179 - DNA, 16 bp, H. sapiens
gaggcaaaggatgcag

SEQ ID NO: 102180 - DNA, 16 bp, H. sapiens
gaggcaaaggtgggag

SEQ ID NO: 102181 - DNA, 16 bp, H. sapiens
gaggcaagaactgagg

SEQ ID NO: 102182 - DNA, 16 bp, H. sapiens
gaggcaagagaaaatg

SEQ ID NO: 102183 - DNA, 16 bp, H. sapiens
gaggcaagaggtgggc

SEQ ID NO: 102184 - DNA, 16 bp, H. sapiens
gaggcaagcccagaga

SEQ ID NO: 102185 - DNA, 16 bp, H. sapiens
gaggcaagcctggcca

SEQ ID NO: 102186 - DNA, 16 bp, H. sapiens
gaggcaaggtctcact

SEQ ID NO: 102187 - DNA, 16 bp, H. sapiens
gaggcaaggtctcgct

SEQ ID NO: 102188 - DNA, 16 bp, H. sapiens
gaggcaaggtgggagg

SEQ ID NO: 102189 - DNA, 16 bp, H. sapiens
gaggcacaagaatggc

SEQ ID NO: 102190 - DNA, 16 bp, H. sapiens
gaggcacagaaagttt

SEQ ID NO: 102191 - DNA, 16 bp, H. sapiens
gaggcacagagagatg

SEQ ID NO: 102192 - DNA, 16 bp, H. sapiens
gaggcacagagagggc

SEQ ID NO: 102193 - DNA, 16 bp, H. sapiens
gaggcacccccaagca

SEQ ID NO: 102194 - DNA, 16 bp, H. sapiens
gaggcactgggaaaag

SEQ ID NO: 102195 - DNA, 16 bp, H. sapiens
gaggcagaagaaaatc

SEQ ID NO: 102196 - DNA, 16 bp, H. sapiens
gaggcagaagaaaatt

SEQ ID NO: 102197 - DNA, 16 bp, H. sapiens
gaggcagaagaatggt

SEQ ID NO: 102198 - DNA, 16 bp, H. sapiens
gaggcagaagagtcag

SEQ ID NO: 102199 - DNA, 16 bp, H. sapiens
gaggcagaagcaagag

SEQ ID NO: 102200 - DNA, 16 bp, H. sapiens
gaggcagaagctgcag

SEQ ID NO: 102201 - DNA, 16 bp, H. sapiens
gaggcagaagtgggag

SEQ ID NO: 102202 - DNA, 16 bp, H. sapiens
gaggcagaagttgtgg

SEQ ID NO: 102203 - DNA, 16 bp, H. sapiens
gaggcagactttgcag

SEQ ID NO: 102204 - DNA, 16 bp, H. sapiens
gaggcagagactgaag

SEQ ID NO: 102205 - DNA, 16 bp, H. sapiens
gaggcagagactggag

SEQ ID NO: 102206 - DNA, 16 bp, H. sapiens
gaggcagagactgggg

SEQ ID NO: 102207 - DNA, 16 bp, H. sapiens
gaggcagagactgtag

SEQ ID NO: 102208 - DNA, 16 bp, H. sapiens
gaggcagagatcagag

SEQ ID NO: 102209 - DNA, 16 bp, H. sapiens
gaggcagagatggcag

SEQ ID NO: 102210 - DNA, 16 bp, H. sapiens
gaggcagagatgggag

SEQ ID NO: 102211 - DNA, 16 bp, H. sapiens
gaggcagagattagag

SEQ ID NO: 102212 - DNA, 16 bp, H. sapiens
gaggcagagcccaggc

SEQ ID NO: 102213 - DNA, 16 bp, H. sapiens
gaggcagagcctgcag

SEQ ID NO: 102214 - DNA, 16 bp, H. sapiens
gaggcagagctgcagc

SEQ ID NO: 102215 - DNA, 16 bp, H. sapiens
gaggcagagctggcag

SEQ ID NO: 102216 - DNA, 16 bp, H. sapiens
gaggcagaggcaagag

SEQ ID NO: 102217 - DNA, 16 bp, H. sapiens
gaggcagaggcagaag

SEQ ID NO: 102218 - DNA, 16 bp, H. sapiens
gaggcagaggccacag

SEQ ID NO: 102219 - DNA, 16 bp, H. sapiens
gaggcagaggccagag

SEQ ID NO: 102220 - DNA, 17 bp, H. sapiens
gaggcagaggcgggcag

SEQ ID NO: 102221 - DNA, 16 bp, H. sapiens
gaggcagaggctggag

SEQ ID NO: 102222 - DNA, 16 bp, H. sapiens
gaggcagagggtgcag

SEQ ID NO: 102223 - DNA, 16 bp, H. sapiens
gaggcagaggtcagag

SEQ ID NO: 102224 - DNA, 16 bp, H. sapiens
gaggcagaggttaaag

SEQ ID NO: 102225 - DNA, 16 bp, H. sapiens
gaggcagaggttgcac

SEQ ID NO: 102226 - DNA, 16 bp, H. sapiens
gaggcagagtcaggag

SEQ ID NO: 102227 - DNA, 16 bp, H. sapiens
gaggcagagtctccct

SEQ ID NO: 102228 - DNA, 16 bp, H. sapiens
gaggcagagttcaggc

SEQ ID NO: 102229 - DNA, 16 bp, H. sapiens
gaggcagatggatccc

SEQ ID NO: 102230 - DNA, 16 bp, H. sapiens
gaggcagcaatctttg

SEQ ID NO: 102231 - DNA, 16 bp, H. sapiens
gaggcagcagaggcag

SEQ ID NO: 102232 - DNA, 16 bp, H. sapiens
gaggcagcagggagct

SEQ ID NO: 102233 - DNA, 16 bp, H. sapiens
gaggcagcagtgagcc

SEQ ID NO: 102234 - DNA, 16 bp, H. sapiens
gaggcagcagtgagct

SEQ ID NO: 102235 - DNA, 16 bp, H. sapiens
gaggcagccaaatgcc

SEQ ID NO: 102236 - DNA, 16 bp, H. sapiens
gaggcagccggatcac

SEQ ID NO: 102237 - DNA, 16 bp, H. sapiens
gaggcagctgaggctc

SEQ ID NO: 102238 - DNA, 16 bp, H. sapiens
gaggcaggaaaatggc

SEQ ID NO: 102239 - DNA, 16 bp, H. sapiens
gaggcaggaagagcag

SEQ ID NO: 102240 - DNA, 16 bp, H. sapiens
gaggcaggaaggatcc

SEQ ID NO: 102241 - DNA, 16 bp, H. sapiens
gaggcaggaaggtcac

SEQ ID NO: 102242 - DNA, 16 bp, H. sapiens
gaggcaggacagtggg

SEQ ID NO: 102243 - DNA, 16 bp, H. sapiens
gaggcaggagaacctc

SEQ ID NO: 102244 - DNA, 16 bp, H. sapiens
gaggcaggagaagctc

SEQ ID NO: 102245 - DNA, 16 bp, H. sapiens
gaggcaggagagacag

SEQ ID NO: 102246 - DNA, 16 bp, H. sapiens
gaggcaggagaggctg

SEQ ID NO: 102247 - DNA, 16 bp, H. sapiens
gaggcaggagagtggc

SEQ ID NO: 102248 - DNA, 16 bp, H. sapiens
gaggcaggagctgagg

SEQ ID NO: 102249 - DNA, 16 bp, H. sapiens
gaggcaggaggaccat

SEQ ID NO: 102250 - DNA, 16 bp, H. sapiens
gaggcaggaggagctc

SEQ ID NO: 102251 - DNA, 16 bp, H. sapiens
gaggcaggaggagctg

SEQ ID NO: 102252 - DNA, 16 bp, H. sapiens
gaggcaggaggagtgc

SEQ ID NO: 102253 - DNA, 16 bp, H. sapiens
gaggcaggaggatcac

SEQ ID NO: 102254 - DNA, 16 bp, H. sapiens
gaggcaggaggatgga

SEQ ID NO: 102255 - DNA, 17 bp, H. sapiens
gaggcaggaggatggct

SEQ ID NO: 102256 - DNA, 16 bp, H. sapiens
gaggcaggagggtccc

SEQ ID NO: 102257 - DNA, 16 bp, H. sapiens
gaggcaggagggtggc

SEQ ID NO: 102258 - DNA, 16 bp, H. sapiens
gaggcaggagtggagg

SEQ ID NO: 102259 - DNA, 16 bp, H. sapiens
gaggcaggatcttgct

SEQ ID NO: 102260 - DNA, 16 bp, H. sapiens
gaggcaggcaaattgc

SEQ ID NO: 102261 - DNA, 16 bp, H. sapiens
gaggcaggcagacagc

SEQ ID NO: 102262 - DNA, 16 bp, H. sapiens
gaggcaggcagatcac

SEQ ID NO: 102263 - DNA, 19 bp, H. sapiens
gaggcaggcagatcactta

SEQ ID NO: 102264 - DNA, 16 bp, H. sapiens
gaggcaggcagatgac

SEQ ID NO: 102265 - DNA, 16 bp, H. sapiens
gaggcaggcagggcag

SEQ ID NO: 102266 - DNA, 16 bp, H. sapiens
gaggcaggcagggcct

SEQ ID NO: 102267 - DNA, 16 bp, H. sapiens
gaggcaggcggaccac

SEQ ID NO: 102268 - DNA, 16 bp, H. sapiens
gaggcaggcggagcac

SEQ ID NO: 102269 - DNA, 16 bp, H. sapiens
gaggcaggcggatctc

SEQ ID NO: 102270 - DNA, 16 bp, H. sapiens
gaggcaggcggattat

SEQ ID NO: 102271 - DNA, 16 bp, H. sapiens
gaggcagggatcagag

SEQ ID NO: 102272 - DNA, 16 bp, H. sapiens
gaggcagggattggag

SEQ ID NO: 102273 - DNA, 16 bp, H. sapiens
gaggcagggcagggca

SEQ ID NO: 102274 - DNA, 16 bp, H. sapiens
gaggcaggggctgcag

SEQ ID NO: 102275 - DNA, 16 bp, H. sapiens
gaggcaggggtggcag

SEQ ID NO: 102276 - DNA, 16 bp, H. sapiens
gaggcagggtcttgct

SEQ ID NO: 102277 - DNA, 16 bp, H. sapiens
gaggcaggtagatcac

SEQ ID NO: 102278 - DNA, 16 bp, H. sapiens
gaggcaggtggagcac

SEQ ID NO: 102279 - DNA, 16 bp, H. sapiens
gaggcaggtggatcac

SEQ ID NO: 102280 - DNA, 16 bp, H. sapiens
gaggcaggtggttcac

SEQ ID NO: 102281 - DNA, 16 bp, H. sapiens
gaggcagtctgtcctt

SEQ ID NO: 102282 - DNA, 16 bp, H. sapiens
gaggcagtggcaggag

SEQ ID NO: 102283 - DNA, 16 bp, H. sapiens
gaggcagtggtggcag

SEQ ID NO: 102284 - DNA, 16 bp, H. sapiens
gaggcatcagagaaag

SEQ ID NO: 102285 - DNA, 16 bp, H. sapiens
gaggcatggagaagtt

SEQ ID NO: 102286 - DNA, 16 bp, H. sapiens
gaggcatgtctgactc

SEQ ID NO: 102287 - DNA, 16 bp, H. sapiens
gaggccaaagaaggag

SEQ ID NO: 102288 - DNA, 16 bp, H. sapiens
gaggccaaagagggag

SEQ ID NO: 102289 - DNA, 16 bp, H. sapiens
gaggccaaagcaagag

SEQ ID NO: 102290 - DNA, 16 bp, H. sapiens
gaggccaaaggaggag

SEQ ID NO: 102291 - DNA, 16 bp, H. sapiens
gaggccaaagtgagca

SEQ ID NO: 102292 - DNA, 16 bp, H. sapiens
gaggccaacctgacca

SEQ ID NO: 102293 - DNA, 16 bp, H. sapiens
gaggccaacctgggca

SEQ ID NO: 102294 - DNA, 16 bp, H. sapiens
gaggccaagaagggtg

SEQ ID NO: 102295 - DNA, 16 bp, H. sapiens
gaggccaagacaggtg

SEQ ID NO: 102296 - DNA, 16 bp, H. sapiens
gaggccaagatggatg

SEQ ID NO: 102297 - DNA, 16 bp, H. sapiens
gaggccaagatggctg

SEQ ID NO: 102298 - DNA, 16 bp, H. sapiens
gaggccaagccaggag

SEQ ID NO: 102299 - DNA, 16 bp, H. sapiens
gaggccaagctgggca

SEQ ID NO: 102300 - DNA, 16 bp, H. sapiens
gaggccaaggaggaca

SEQ ID NO: 102301 - DNA, 16 bp, H. sapiens
gaggccaaggagggca

SEQ ID NO: 102302 - DNA, 16 bp, H. sapiens
gaggccaaggagggtg

SEQ ID NO: 102303 - DNA, 16 bp, H. sapiens
gaggccaaggcaggac

SEQ ID NO: 102304 - DNA, 20 bp, H. sapiens
gaggccaaggcaggcagata

SEQ ID NO: 102305 - DNA, 18 bp, H. sapiens
gaggccaaggcaggcagg

SEQ ID NO: 102306 - DNA, 17 bp, H. sapiens
gaggccaaggcaggtga

SEQ ID NO: 102307 - DNA, 16 bp, H. sapiens
gaggccaaggcatgag

SEQ ID NO: 102308 - DNA, 16 bp, H. sapiens
gaggccaaggccacag

SEQ ID NO: 102309 - DNA, 16 bp, H. sapiens
gaggccaaggccagag

SEQ ID NO: 102310 - DNA, 16 bp, H. sapiens
gaggccaaggccggag

SEQ ID NO: 102311 - DNA, 16 bp, H. sapiens
gaggccaaggcggatg

SEQ ID NO: 102312 - DNA, 16 bp, H. sapiens
gaggccaaggcggccg

SEQ ID NO: 102313 - DNA, 16 bp, H. sapiens
gaggccaaggcggtgg

SEQ ID NO: 102314 - DNA, 16 bp, H. sapiens
gaggccaaggctgcag

SEQ ID NO: 102315 - DNA, 16 bp, H. sapiens
gaggccaaggctggag

SEQ ID NO: 102316 - DNA, 16 bp, H. sapiens
gaggccaaggtaagag

SEQ ID NO: 102317 - DNA, 17 bp, H. sapiens
gaggccaagtcaggcgg

SEQ ID NO: 102318 - DNA, 16 bp, H. sapiens
gaggccaagtgacttg

SEQ ID NO: 102319 - DNA, 16 bp, H. sapiens
gaggccaatgcaggag

SEQ ID NO: 102320 - DNA, 16 bp, H. sapiens
gaggccaccatcctcc

SEQ ID NO: 102321 - DNA, 16 bp, H. sapiens
gaggccaccctggcca

SEQ ID NO: 102322 - DNA, 16 bp, H. sapiens
gaggccacctggggag

SEQ ID NO: 102323 - DNA, 16 bp, H. sapiens
gaggccacgccccagg

SEQ ID NO: 102324 - DNA, 16 bp, H. sapiens
gaggccagaattctga

SEQ ID NO: 102325 - DNA, 16 bp, H. sapiens
gaggccagacatggtg

SEQ ID NO: 102326 - DNA, 16 bp, H. sapiens
gaggccagagaattgc

SEQ ID NO: 102327 - DNA, 16 bp, H. sapiens
gaggccagaggccagg

SEQ ID NO: 102328 - DNA, 16 bp, H. sapiens
gaggccagcaagacca

SEQ ID NO: 102329 - DNA, 16 bp, H. sapiens
gaggccagcctcatcc

SEQ ID NO: 102330 - DNA, 16 bp, H. sapiens
gaggccagcctggctg

SEQ ID NO: 102331 - DNA, 16 bp, H. sapiens
gaggccagcctgggga

SEQ ID NO: 102332 - DNA, 16 bp, H. sapiens
gaggccagctgggctc

SEQ ID NO: 102333 - DNA, 16 bp, H. sapiens
gaggccaggaacttga

SEQ ID NO: 102334 - DNA, 16 bp, H. sapiens
gaggccaggagctcaa

SEQ ID NO: 102335 - DNA, 16 bp, H. sapiens
gaggccaggaggccag

SEQ ID NO: 102336 - DNA, 16 bp, H. sapiens
gaggccaggcaggcag

SEQ ID NO: 102337 - DNA, 16 bp, H. sapiens
gaggccaggccaggag

SEQ ID NO: 102338 - DNA, 16 bp, H. sapiens
gaggccaggcctgcag

SEQ ID NO: 102339 - DNA, 16 bp, H. sapiens
gaggccaggctgggtg

SEQ ID NO: 102340 - DNA, 16 bp, H. sapiens
gaggccagggatgcta

SEQ ID NO: 102341 - DNA, 16 bp, H. sapiens
gaggccagggatgctg

SEQ ID NO: 102342 - DNA, 16 bp, H. sapiens
gaggccagggcagggc

SEQ ID NO: 102343 - DNA, 16 bp, H. sapiens
gaggccagggctgctg

SEQ ID NO: 102344 - DNA, 16 bp, H. sapiens
gaggccagggctgggc

SEQ ID NO: 102345 - DNA, 16 bp, H. sapiens
gaggccagggctgggg

SEQ ID NO: 102346 - DNA, 16 bp, H. sapiens
gaggccaggggtggtg

SEQ ID NO: 102347 - DNA, 16 bp, H. sapiens
gaggccagggtgagag

SEQ ID NO: 102348 - DNA, 16 bp, H. sapiens
gaggccagggtgggca

SEQ ID NO: 102349 - DNA, 16 bp, H. sapiens
gaggccaggtgcagtg

SEQ ID NO: 102350 - DNA, 16 bp, H. sapiens
gaggccaggtgggcag

SEQ ID NO: 102351 - DNA, 16 bp, H. sapiens
gaggccaggtggggtg

SEQ ID NO: 102352 - DNA, 16 bp, H. sapiens
gaggccaggtgggtgg

SEQ ID NO: 102353 - DNA, 16 bp, H. sapiens
gaggccagtgaggctg

SEQ ID NO: 102354 - DNA, 16 bp, H. sapiens
gaggccagtgtgggag

SEQ ID NO: 102355 - DNA, 16 bp, H. sapiens
gaggccatctgcaagc

SEQ ID NO: 102356 - DNA, 16 bp, H. sapiens
gaggcccaagaattgg

SEQ ID NO: 102357 - DNA, 16 bp, H. sapiens
gaggcccaagcaggag

SEQ ID NO: 102358 - DNA, 16 bp, H. sapiens
gaggcccaaggagagg

SEQ ID NO: 102359 - DNA, 16 bp, H. sapiens
gaggcccagagaagtg

SEQ ID NO: 102360 - DNA, 16 bp, H. sapiens
gaggcccagagagcag

SEQ ID NO: 102361 - DNA, 16 bp, H. sapiens
gaggcccagcaacctg

SEQ ID NO: 102362 - DNA, 16 bp, H. sapiens
gaggcccaggcagcag

SEQ ID NO: 102363 - DNA, 16 bp, H. sapiens
gaggcccaggctgcag

SEQ ID NO: 102364 - DNA, 16 bp, H. sapiens
gaggcccagggctggg

SEQ ID NO: 102365 - DNA, 16 bp, H. sapiens
gaggcccaggtgggcg

SEQ ID NO: 102366 - DNA, 16 bp, H. sapiens
gaggccccacctccca

SEQ ID NO: 102367 - DNA, 16 bp, H. sapiens
gaggccccaggaagct

SEQ ID NO: 102368 - DNA, 16 bp, H. sapiens
gaggcccgccagagga

SEQ ID NO: 102369 - DNA, 16 bp, H. sapiens
gaggccctggagtggg

SEQ ID NO: 102370 - DNA, 16 bp, H. sapiens
gaggccctgggcctgg

SEQ ID NO: 102371 - DNA, 17 bp, H. sapiens
gaggccgaagcgagtgg

SEQ ID NO: 102372 - DNA, 16 bp, H. sapiens
gaggccgagaagggca

SEQ ID NO: 102373 - DNA, 16 bp, H. sapiens
gaggccgagaagggtg

SEQ ID NO: 102374 - DNA, 16 bp, H. sapiens
gaggccgagcaggtgg

SEQ ID NO: 102375 - DNA, 16 bp, H. sapiens
gaggccgagctgggca

SEQ ID NO: 102376 - DNA, 16 bp, H. sapiens
gaggccgaggaggcac

SEQ ID NO: 102377 - DNA, 16 bp, H. sapiens
gaggccgaggcagaga

SEQ ID NO: 102378 - DNA, 16 bp, H. sapiens
gaggccgaggcagagg

SEQ ID NO: 102379 - DNA, 17 bp, H. sapiens
gaggccgaggcaggcga

SEQ ID NO: 102380 - DNA, 16 bp, H. sapiens
gaggccgaggcatgag

SEQ ID NO: 102381 - DNA, 16 bp, H. sapiens
gaggccgaggccagga

SEQ ID NO: 102382 - DNA, 16 bp, H. sapiens
gaggccgaggccagtg

SEQ ID NO: 102383 - DNA, 16 bp, H. sapiens
gaggccgaggcgggaa

SEQ ID NO: 102384 - DNA, 16 bp, H. sapiens
gaggccgaggctgcag

SEQ ID NO: 102385 - DNA, 16 bp, H. sapiens
gaggccgaggctggct

SEQ ID NO: 102386 - DNA, 16 bp, H. sapiens
gaggccgaggtaggag

SEQ ID NO: 102387 - DNA, 16 bp, H. sapiens
gaggccgaggtaggcg

SEQ ID NO: 102388 - DNA, 16 bp, H. sapiens
gaggccgaggtgaggg

SEQ ID NO: 102389 - DNA, 16 bp, H. sapiens
gaggccgaggtggcag

SEQ ID NO: 102390 - DNA, 16 bp, H. sapiens
gaggccgaggtggccg

SEQ ID NO: 102391 - DNA, 17 bp, H. sapiens
gaggccgaggtgggcgg

SEQ ID NO: 102392 - DNA, 21 bp, H. sapiens
gaggccgaggtgggtggatcg

SEQ ID NO: 102393 - DNA, 16 bp, H. sapiens
gaggccgagtcaggtg

SEQ ID NO: 102394 - DNA, 16 bp, H. sapiens
gaggccgagtgggtgg

SEQ ID NO: 102395 - DNA, 19 bp, H. sapiens
gaggccgatgtgggtggat

SEQ ID NO: 102396 - DNA, 16 bp, H. sapiens
gaggccgcagtgagct

SEQ ID NO: 102397 - DNA, 16 bp, H. sapiens
gaggccggacgcggtg

SEQ ID NO: 102398 - DNA, 16 bp, H. sapiens
gaggccggatgtggtg

SEQ ID NO: 102399 - DNA, 16 bp, H. sapiens
gaggccggcagatcac

SEQ ID NO: 102400 - DNA, 16 bp, H. sapiens
gaggccggcggatcac

SEQ ID NO: 102401 - DNA, 16 bp, H. sapiens
gaggccgggcgcggtg

SEQ ID NO: 102402 - DNA, 16 bp, H. sapiens
gaggccggggaatggc

SEQ ID NO: 102403 - DNA, 16 bp, H. sapiens
gaggccggggcaggca

SEQ ID NO: 102404 - DNA, 16 bp, H. sapiens
gaggcctaggaggaaa

SEQ ID NO: 102405 - DNA, 16 bp, H. sapiens
gaggcctaggcagaag

SEQ ID NO: 102406 - DNA, 16 bp, H. sapiens
gaggcctcagaattat

SEQ ID NO: 102407 - DNA, 16 bp, H. sapiens
gaggcctcagagagct

SEQ ID NO: 102408 - DNA, 16 bp, H. sapiens
gaggcctcccagccac

SEQ ID NO: 102409 - DNA, 16 bp, H. sapiens
gaggcctccccagctc

SEQ ID NO: 102410 - DNA, 16 bp, H. sapiens
gaggcctcccccagcc

SEQ ID NO: 102411 - DNA, 16 bp, H. sapiens
gaggcctccccggcca

SEQ ID NO: 102412 - DNA, 16 bp, H. sapiens
gaggcctcctcagccc

SEQ ID NO: 102413 - DNA, 16 bp, H. sapiens
gaggcctcgggaagct

SEQ ID NO: 102414 - DNA, 16 bp, H. sapiens
gaggcctctgcagcca

SEQ ID NO: 102415 - DNA, 16 bp, H. sapiens
gaggcctgaggagagg

SEQ ID NO: 102416 - DNA, 16 bp, H. sapiens
gaggcctgagggagct

SEQ ID NO: 102417 - DNA, 16 bp, H. sapiens
gaggcctgaggtcagg

SEQ ID NO: 102418 - DNA, 16 bp, H. sapiens
gaggcctgcccctgag

SEQ ID NO: 102419 - DNA, 16 bp, H. sapiens
gaggcctgcctgcctc

SEQ ID NO: 102420 - DNA, 16 bp, H. sapiens
gaggcctgcctgcctg

SEQ ID NO: 102421 - DNA, 16 bp, H. sapiens
gaggcctggagagagg

SEQ ID NO: 102422 - DNA, 16 bp, H. sapiens
gaggcctggcgtggtg

SEQ ID NO: 102423 - DNA, 16 bp, H. sapiens
gaggcctgggacagat

SEQ ID NO: 102424 - DNA, 16 bp, H. sapiens
gaggcctgggaggaaa

SEQ ID NO: 102425 - DNA, 16 bp, H. sapiens
gaggcctgggatctgg

SEQ ID NO: 102426 - DNA, 16 bp, H. sapiens
gaggcctgggctgggg

SEQ ID NO: 102427 - DNA, 16 bp, H. sapiens
gaggcctggggaggag

SEQ ID NO: 102428 - DNA, 16 bp, H. sapiens
gaggcctggggcaggg

SEQ ID NO: 102429 - DNA, 16 bp, H. sapiens
gaggcctgtgtggctg

SEQ ID NO: 102430 - DNA, 16 bp, H. sapiens
gaggcctgtgttctgt

SEQ ID NO: 102431 - DNA, 16 bp, H. sapiens
gaggccttcccagccc

SEQ ID NO: 102432 - DNA, 16 bp, H. sapiens
gaggccttccctggcc

SEQ ID NO: 102433 - DNA, 16 bp, H. sapiens
gaggccttcctagaag

SEQ ID NO: 102434 - DNA, 16 bp, H. sapiens
gaggccttcctggagg

SEQ ID NO: 102435 - DNA, 16 bp, H. sapiens
gaggccttgggaagct

SEQ ID NO: 102436 - DNA, 16 bp, H. sapiens
gaggcctttcctgacc

SEQ ID NO: 102437 - DNA, 16 bp, H. sapiens
gaggcggaagctgcag

SEQ ID NO: 102438 - DNA, 16 bp, H. sapiens
gaggcggaaggatcac

SEQ ID NO: 102439 - DNA, 16 bp, H. sapiens
gaggcggaagttgcgg

SEQ ID NO: 102440 - DNA, 20 bp, H. sapiens
gaggcggagcttgcagggag

SEQ ID NO: 102441 - DNA, 16 bp, H. sapiens
gaggcggaggcagcag

SEQ ID NO: 102442 - DNA, 17 bp, H. sapiens
gaggcggaggctgcagc

SEQ ID NO: 102443 - DNA, 16 bp, H. sapiens
gaggcggaggctgcgg

SEQ ID NO: 102444 - DNA, 16 bp, H. sapiens
gaggcggaggttgagt

SEQ ID NO: 102445 - DNA, 16 bp, H. sapiens
gaggcggctgaggccc

SEQ ID NO: 102446 - DNA, 16 bp, H. sapiens
gaggcgggaggactgc

SEQ ID NO: 102447 - DNA, 16 bp, H. sapiens
gaggcgggaggagcac

SEQ ID NO: 102448 - DNA, 16 bp, H. sapiens
gaggcgggcaaatcac

SEQ ID NO: 102449 - DNA, 16 bp, H. sapiens
gaggcgggcagataat

SEQ ID NO: 102450 - DNA, 16 bp, H. sapiens
gaggcgggcagatcac

SEQ ID NO: 102451 - DNA, 16 bp, H. sapiens
gaggcgggcggatcaa

SEQ ID NO: 102452 - DNA, 25 bp, H. sapiens
gaggcgggcggatcacctgaggtca

SEQ ID NO: 102453 - DNA, 16 bp, H. sapiens
gaggcgggcggattac

SEQ ID NO: 102454 - DNA, 16 bp, H. sapiens
gaggcgggcgggtcac

SEQ ID NO: 102455 - DNA, 16 bp, H. sapiens
gaggcggggcctttgg

SEQ ID NO: 102456 - DNA, 16 bp, H. sapiens
gaggcggggcttgcag

SEQ ID NO: 102457 - DNA, 16 bp, H. sapiens
gaggcggggtttcgcc

SEQ ID NO: 102458 - DNA, 16 bp, H. sapiens
gaggcgggtgaatcac

SEQ ID NO: 102459 - DNA, 16 bp, H. sapiens
gaggcgggtggatcac

SEQ ID NO: 102460 - DNA, 16 bp, H. sapiens
gaggcgtgagaatcac

SEQ ID NO: 102461 - DNA, 16 bp, H. sapiens
gaggcgtgagccacag

SEQ ID NO: 102462 - DNA, 16 bp, H. sapiens
gaggctaaaagagctg

SEQ ID NO: 102463 - DNA, 16 bp, H. sapiens
gaggctaagacaggag

SEQ ID NO: 102464 - DNA, 16 bp, H. sapiens
gaggctaagctgggag

SEQ ID NO: 102465 - DNA, 16 bp, H. sapiens
gaggctaaggaagaag

SEQ ID NO: 102466 - DNA, 16 bp, H. sapiens
gaggctaaggcaagaa

SEQ ID NO: 102467 - DNA, 16 bp, H. sapiens
gaggctaaggcagcag

SEQ ID NO: 102468 - DNA, 16 bp, H. sapiens
gaggctaaggcaggaa

SEQ ID NO: 102469 - DNA, 16 bp, H. sapiens
gaggctaaggcaggag

SEQ ID NO: 102470 - DNA, 16 bp, H. sapiens
gaggctaaggcagggg

SEQ ID NO: 102471 - DNA, 16 bp, H. sapiens
gaggctaaggtgggaa

SEQ ID NO: 102472 - DNA, 16 bp, H. sapiens
gaggctaaggtgggag

SEQ ID NO: 102473 - DNA, 16 bp, H. sapiens
gaggctaatgcaggag

SEQ ID NO: 102474 - DNA, 16 bp, H. sapiens
gaggctacaagtccaa

SEQ ID NO: 102475 - DNA, 16 bp, H. sapiens
gaggctacagtgagct

SEQ ID NO: 102476 - DNA, 16 bp, H. sapiens
gaggctactatgagca

SEQ ID NO: 102477 - DNA, 16 bp, H. sapiens
gaggctagaagttcaa

SEQ ID NO: 102478 - DNA, 16 bp, H. sapiens
gaggctagcagttcaa

SEQ ID NO: 102479 - DNA, 16 bp, H. sapiens
gaggctagggcaggag

SEQ ID NO: 102480 - DNA, 16 bp, H. sapiens
gaggctatggcaggag

SEQ ID NO: 102481 - DNA, 16 bp, H. sapiens
gaggctcactctgtca

SEQ ID NO: 102482 - DNA, 16 bp, H. sapiens
gaggctcactctgtcg

SEQ ID NO: 102483 - DNA, 16 bp, H. sapiens
gaggctcagaaaagta

SEQ ID NO: 102484 - DNA, 16 bp, H. sapiens
gaggctcagaaaagtt

SEQ ID NO: 102485 - DNA, 16 bp, H. sapiens
gaggctcagaaaggtg

SEQ ID NO: 102486 - DNA, 16 bp, H. sapiens
gaggctcagaaagttt

SEQ ID NO: 102487 - DNA, 16 bp, H. sapiens
gaggctcagagaactt

SEQ ID NO: 102488 - DNA, 16 bp, H. sapiens
gaggctcagagaagaa

SEQ ID NO: 102489 - DNA, 16 bp, H. sapiens
gaggctcaggcagaag

SEQ ID NO: 102490 - DNA, 16 bp, H. sapiens
gaggctcaggcaggag

SEQ ID NO: 102491 - DNA, 16 bp, H. sapiens
gaggctcaggtgggag

SEQ ID NO: 102492 - DNA, 16 bp, H. sapiens
gaggctccatctccaa

SEQ ID NO: 102493 - DNA, 16 bp, H. sapiens
gaggctcccaaacctc

SEQ ID NO: 102494 - DNA, 16 bp, H. sapiens
gaggctcccccagcca

SEQ ID NO: 102495 - DNA, 16 bp, H. sapiens
gaggctctaggagaga

SEQ ID NO: 102496 - DNA, 16 bp, H. sapiens
gaggctctcaacagca

SEQ ID NO: 102497 - DNA, 16 bp, H. sapiens
gaggctctctgcctct

SEQ ID NO: 102498 - DNA, 16 bp, H. sapiens
gaggctctgaccccac

SEQ ID NO: 102499 - DNA, 16 bp, H. sapiens
gaggctctgagggaga

SEQ ID NO: 102500 - DNA, 16 bp, H. sapiens
gaggctctgggcctgg

SEQ ID NO: 102501 - DNA, 16 bp, H. sapiens
gaggctctggtgggag

SEQ ID NO: 102502 - DNA, 16 bp, H. sapiens
gaggctgaaacaggag

SEQ ID NO: 102503 - DNA, 16 bp, H. sapiens
gaggctgaaagaggag

SEQ ID NO: 102504 - DNA, 16 bp, H. sapiens
gaggctgaaatcaagg

SEQ ID NO: 102505 - DNA, 16 bp, H. sapiens
gaggctgaagaagaga

SEQ ID NO: 102506 - DNA, 16 bp, H. sapiens
gaggctgaagaaggag

SEQ ID NO: 102507 - DNA, 16 bp, H. sapiens
gaggctgaagaggaag

SEQ ID NO: 102508 - DNA, 16 bp, H. sapiens
gaggctgaagagggaa

SEQ ID NO: 102509 - DNA, 16 bp, H. sapiens
gaggctgaagcagagg

SEQ ID NO: 102510 - DNA, 16 bp, H. sapiens
gaggctgaagcaggaa

SEQ ID NO: 102511 - DNA, 16 bp, H. sapiens
gaggctgaagcaggag

SEQ ID NO: 102512 - DNA, 16 bp, H. sapiens
gaggctgaagcagggg

SEQ ID NO: 102513 - DNA, 16 bp, H. sapiens
gaggctgaagccaggg

SEQ ID NO: 102514 - DNA, 16 bp, H. sapiens
gaggctgaaggaagag

SEQ ID NO: 102515 - DNA, 16 bp, H. sapiens
gaggctgaaggaggag

SEQ ID NO: 102516 - DNA, 16 bp, H. sapiens
gaggctgaagtgggaa

SEQ ID NO: 102517 - DNA, 16 bp, H. sapiens
gaggctgaagttgcag

SEQ ID NO: 102518 - DNA, 16 bp, H. sapiens
gaggctgacacaggag

SEQ ID NO: 102519 - DNA, 16 bp, H. sapiens
gaggctgacatgggtg

SEQ ID NO: 102520 - DNA, 17 bp, H. sapiens
gaggctgacgcaggaga

SEQ ID NO: 102521 - DNA, 16 bp, H. sapiens
gaggctgagaaaggta

SEQ ID NO: 102522 - DNA, 16 bp, H. sapiens
gaggctgagaagggaa

SEQ ID NO: 102523 - DNA, 16 bp, H. sapiens
gaggctgagaagggtg

SEQ ID NO: 102524 - DNA, 16 bp, H. sapiens
gaggctgagacagaag

SEQ ID NO: 102525 - DNA, 16 bp, H. sapiens
gaggctgagacagaga

SEQ ID NO: 102526 - DNA, 16 bp, H. sapiens
gaggctgagacaggac

SEQ ID NO: 102527 - DNA, 16 bp, H. sapiens
gaggctgagacaggag

SEQ ID NO: 102528 - DNA, 16 bp, H. sapiens
gaggctgagacaggat

SEQ ID NO: 102529 - DNA, 16 bp, H. sapiens
gaggctgagacataag

SEQ ID NO: 102530 - DNA, 16 bp, H. sapiens
gaggctgagacctact

SEQ ID NO: 102531 - DNA, 16 bp, H. sapiens
gaggctgagagaggag

SEQ ID NO: 102532 - DNA, 16 bp, H. sapiens
gaggctgagagaggct

SEQ ID NO: 102533 - DNA, 16 bp, H. sapiens
gaggctgagaggctgg

SEQ ID NO: 102534 - DNA, 16 bp, H. sapiens
gaggctgagataggag

SEQ ID NO: 102535 - DNA, 16 bp, H. sapiens
gaggctgagatgagaa

SEQ ID NO: 102536 - DNA, 16 bp, H. sapiens
gaggctgagatgagag

SEQ ID NO: 102537 - DNA, 16 bp, H. sapiens
gaggctgagatgagca

SEQ ID NO: 102538 - DNA, 16 bp, H. sapiens
gaggctgagatggaag

SEQ ID NO: 102539 - DNA, 16 bp, H. sapiens
gaggctgagatggatg

SEQ ID NO: 102540 - DNA, 16 bp, H. sapiens
gaggctgagatgggaa

SEQ ID NO: 102541 - DNA, 16 bp, H. sapiens
gaggctgagcaggaga

SEQ ID NO: 102542 - DNA, 16 bp, H. sapiens
gaggctgagcagggag

SEQ ID NO: 102543 - DNA, 16 bp, H. sapiens
gaggctgagccaagag

SEQ ID NO: 102544 - DNA, 16 bp, H. sapiens
gaggctgagccagaga

SEQ ID NO: 102545 - DNA, 16 bp, H. sapiens
gaggctgagccaggtg

SEQ ID NO: 102546 - DNA, 16 bp, H. sapiens
gaggctgagccgggag

SEQ ID NO: 102547 - DNA, 16 bp, H. sapiens
gaggctgagcctggag

SEQ ID NO: 102548 - DNA, 16 bp, H. sapiens
gaggctgagctgggag

SEQ ID NO: 102549 - DNA, 16 bp, H. sapiens
gaggctgagctggggg

SEQ ID NO: 102550 - DNA, 20 bp, H. sapiens
gaggctgagcttgcagtgag

SEQ ID NO: 102551 - DNA, 16 bp, H. sapiens
gaggctgaggaaagag

SEQ ID NO: 102552 - DNA, 16 bp, H. sapiens
gaggctgaggaaggaa

SEQ ID NO: 102553 - DNA, 16 bp, H. sapiens
gaggctgaggaaggag

SEQ ID NO: 102554 - DNA, 16 bp, H. sapiens
gaggctgaggaccaga

SEQ ID NO: 102555 - DNA, 16 bp, H. sapiens
gaggctgaggaccagg

SEQ ID NO: 102556 - DNA, 16 bp, H. sapiens
gaggctgaggagagag

SEQ ID NO: 102557 - DNA, 16 bp, H. sapiens
gaggctgaggagagtg

SEQ ID NO: 102558 - DNA, 16 bp, H. sapiens
gaggctgaggaggagg

SEQ ID NO: 102559 - DNA, 16 bp, H. sapiens
gaggctgaggagggaa

SEQ ID NO: 102560 - DNA, 16 bp, H. sapiens
gaggctgaggagggag

SEQ ID NO: 102561 - DNA, 16 bp, H. sapiens
gaggctgaggagggtg

SEQ ID NO: 102562 - DNA, 16 bp, H. sapiens
gaggctgaggatgcag

SEQ ID NO: 102563 - DNA, 16 bp, H. sapiens
gaggctgaggcaagaa

SEQ ID NO: 102564 - DNA, 16 bp, H. sapiens
gaggctgaggcaagag

SEQ ID NO: 102565 - DNA, 16 bp, H. sapiens
gaggctgaggcacaca

SEQ ID NO: 102566 - DNA, 16 bp, H. sapiens
gaggctgaggcacagg

SEQ ID NO: 102567 - DNA, 16 bp, H. sapiens
gaggctgaggcagaac

SEQ ID NO: 102568 - DNA, 16 bp, H. sapiens
gaggctgaggcagaag

SEQ ID NO: 102569 - DNA, 19 bp, H. sapiens
gaggctgaggcagaagaat

SEQ ID NO: 102570 - DNA, 20 bp, H. sapiens
gaggctgaggcagaagaatc

SEQ ID NO: 102571 - DNA, 16 bp, H. sapiens
gaggctgaggcagaat

SEQ ID NO: 102572 - DNA, 17 bp, H. sapiens
gaggctgaggcagagaa

SEQ ID NO: 102573 - DNA, 16 bp, H. sapiens
gaggctgaggcagcag

SEQ ID NO: 102574 - DNA, 16 bp, H. sapiens
gaggctgaggcaggaa

SEQ ID NO: 102575 - DNA, 18 bp, H. sapiens
gaggctgaggcaggaaaa

SEQ ID NO: 102576 - DNA, 16 bp, H. sapiens
gaggctgaggcaggac

SEQ ID NO: 102577 - DNA, 19 bp, H. sapiens
gaggctgaggcaggagaac

SEQ ID NO: 102578 - DNA, 19 bp, H. sapiens
gaggctgaggcaggagaat

SEQ ID NO: 102579 - DNA, 19 bp, H. sapiens
gaggctgaggcaggagact

SEQ ID NO: 102580 - DNA, 18 bp, H. sapiens
gaggctgaggcaggagat

SEQ ID NO: 102581 - DNA, 16 bp, H. sapiens
gaggctgaggcaggat

SEQ ID NO: 102582 - DNA, 16 bp, H. sapiens
gaggctgaggcagggc

SEQ ID NO: 102583 - DNA, 19 bp, H. sapiens
gaggctgaggcaggggaat

SEQ ID NO: 102584 - DNA, 16 bp, H. sapiens
gaggctgaggcagggt

SEQ ID NO: 102585 - DNA, 16 bp, H. sapiens
gaggctgaggcatcag

SEQ ID NO: 102586 - DNA, 16 bp, H. sapiens
gaggctgaggcatgaa

SEQ ID NO: 102587 - DNA, 16 bp, H. sapiens
gaggctgaggcatgca

SEQ ID NO: 102588 - DNA, 16 bp, H. sapiens
gaggctgaggccaaag

SEQ ID NO: 102589 - DNA, 16 bp, H. sapiens
gaggctgaggccagag

SEQ ID NO: 102590 - DNA, 19 bp, H. sapiens
gaggctgaggccagagaat

SEQ ID NO: 102591 - DNA, 16 bp, H. sapiens
gaggctgaggccagca

SEQ ID NO: 102592 - DNA, 16 bp, H. sapiens
gaggctgaggccgagg

SEQ ID NO: 102593 - DNA, 16 bp, H. sapiens
gaggctgaggccggag

SEQ ID NO: 102594 - DNA, 18 bp, H. sapiens
gaggctgaggccggagaa

SEQ ID NO: 102595 - DNA, 16 bp, H. sapiens
gaggctgaggcgagaa

SEQ ID NO: 102596 - DNA, 16 bp, H. sapiens
gaggctgaggcggcag

SEQ ID NO: 102597 - DNA, 19 bp, H. sapiens
gaggctgaggcgggcagat

SEQ ID NO: 102598 - DNA, 16 bp, H. sapiens
gaggctgaggcgggtg

SEQ ID NO: 102599 - DNA, 16 bp, H. sapiens
gaggctgaggcgtgtg

SEQ ID NO: 102600 - DNA, 16 bp, H. sapiens
gaggctgaggctagag

SEQ ID NO: 102601 - DNA, 16 bp, H. sapiens
gaggctgaggctcaga

SEQ ID NO: 102602 - DNA, 16 bp, H. sapiens
gaggctgaggctgaca

SEQ ID NO: 102603 - DNA, 16 bp, H. sapiens
gaggctgaggctgaga

SEQ ID NO: 102604 - DNA, 16 bp, H. sapiens
gaggctgaggctgagc

SEQ ID NO: 102605 - DNA, 16 bp, H. sapiens
gaggctgaggctgagg

SEQ ID NO: 102606 - DNA, 16 bp, H. sapiens
gaggctgaggctgcag

SEQ ID NO: 102607 - DNA, 16 bp, H. sapiens
gaggctgaggctggag

SEQ ID NO: 102608 - DNA, 16 bp, H. sapiens
gaggctgaggctgggg

SEQ ID NO: 102609 - DNA, 16 bp, H. sapiens
gaggctgaggctgtgg

SEQ ID NO: 102610 - DNA, 16 bp, H. sapiens
gaggctgagggaggag

SEQ ID NO: 102611 - DNA, 16 bp, H. sapiens
gaggctgagggaggtg

SEQ ID NO: 102612 - DNA, 16 bp, H. sapiens
gaggctgagggcagag

SEQ ID NO: 102613 - DNA, 16 bp, H. sapiens
gaggctgagggctgag

SEQ ID NO: 102614 - DNA, 16 bp, H. sapiens
gaggctgagggtggag

SEQ ID NO: 102615 - DNA, 16 bp, H. sapiens
gaggctgaggtaaaag

SEQ ID NO: 102616 - DNA, 16 bp, H. sapiens
gaggctgaggtaagag

SEQ ID NO: 102617 - DNA, 16 bp, H. sapiens
gaggctgaggtaggaa

SEQ ID NO: 102618 - DNA, 16 bp, H. sapiens
gaggctgaggtaggag

SEQ ID NO: 102619 - DNA, 19 bp, H. sapiens
gaggctgaggtaggagaat

SEQ ID NO: 102620 - DNA, 24 bp, H. sapiens
gaggctgaggtaggtggatcacct

SEQ ID NO: 102621 - DNA, 16 bp, H. sapiens
gaggctgaggtatgag

SEQ ID NO: 102622 - DNA, 16 bp, H. sapiens
gaggctgaggtcggag

SEQ ID NO: 102623 - DNA, 16 bp, H. sapiens
gaggctgaggtgaaag

SEQ ID NO: 102624 - DNA, 18 bp, H. sapiens
gaggctgaggtgagcgga

SEQ ID NO: 102625 - DNA, 16 bp, H. sapiens
gaggctgaggtggagg

SEQ ID NO: 102626 - DNA, 16 bp, H. sapiens
gaggctgaggtggcag

SEQ ID NO: 102627 - DNA, 16 bp, H. sapiens
gaggctgaggtgggag

SEQ ID NO: 102628 - DNA, 22 bp, H. sapiens
gaggctgaggtgggaggattgt

SEQ ID NO: 102629 - DNA, 16 bp, H. sapiens
gaggctgaggtggtag

SEQ ID NO: 102630 - DNA, 16 bp, H. sapiens
gaggctgaggttggag

SEQ ID NO: 102631 - DNA, 16 bp, H. sapiens
gaggctgaggttgtgg

SEQ ID NO: 102632 - DNA, 16 bp, H. sapiens
gaggctgagtcaggag

SEQ ID NO: 102633 - DNA, 16 bp, H. sapiens
gaggctgagttgggag

SEQ ID NO: 102634 - DNA, 16 bp, H. sapiens
gaggctgatgcaggag

SEQ ID NO: 102635 - DNA, 16 bp, H. sapiens
gaggctgatgcaggca

SEQ ID NO: 102636 - DNA, 16 bp, H. sapiens
gaggctgatgcgggtg

SEQ ID NO: 102637 - DNA, 16 bp, H. sapiens
gaggctgatgtgagag

SEQ ID NO: 102638 - DNA, 16 bp, H. sapiens
gaggctgcaaagtcca

SEQ ID NO: 102639 - DNA, 16 bp, H. sapiens
gaggctgcaatgagcc

SEQ ID NO: 102640 - DNA, 17 bp, H. sapiens
gaggctgcaatgagcta

SEQ ID NO: 102641 - DNA, 16 bp, H. sapiens
gaggctgcactgagct

SEQ ID NO: 102642 - DNA, 16 bp, H. sapiens
gaggctgcagaacaac

SEQ ID NO: 102643 - DNA, 16 bp, H. sapiens
gaggctgcagaacagc

SEQ ID NO: 102644 - DNA, 16 bp, H. sapiens
gaggctgcagaacagg

SEQ ID NO: 102645 - DNA, 16 bp, H. sapiens
gaggctgcagaagagc

SEQ ID NO: 102646 - DNA, 16 bp, H. sapiens
gaggctgcagagcagc

SEQ ID NO: 102647 - DNA, 16 bp, H. sapiens
gaggctgcagaggaaa

SEQ ID NO: 102648 - DNA, 16 bp, H. sapiens
gaggctgcagaggctg

SEQ ID NO: 102649 - DNA, 16 bp, H. sapiens
gaggctgcagagggag

SEQ ID NO: 102650 - DNA, 16 bp, H. sapiens
gaggctgcagcagaag

SEQ ID NO: 102651 - DNA, 16 bp, H. sapiens
gaggctgcagcaggag

SEQ ID NO: 102652 - DNA, 16 bp, H. sapiens
gaggctgcagcaggtg

SEQ ID NO: 102653 - DNA, 16 bp, H. sapiens
gaggctgcagcgagct

SEQ ID NO: 102654 - DNA, 16 bp, H. sapiens
gaggctgcaggaagcc

SEQ ID NO: 102655 - DNA, 16 bp, H. sapiens
gaggctgcaggagctg

SEQ ID NO: 102656 - DNA, 16 bp, H. sapiens
gaggctgcaggcagag

SEQ ID NO: 102657 - DNA, 16 bp, H. sapiens
gaggctgcagggagct

SEQ ID NO: 102658 - DNA, 16 bp, H. sapiens
gaggctgcaggtggag

SEQ ID NO: 102659 - DNA, 16 bp, H. sapiens
gaggctgcagtcagct

SEQ ID NO: 102660 - DNA, 16 bp, H. sapiens
gaggctgcagtgaaca

SEQ ID NO: 102661 - DNA, 16 bp, H. sapiens
gaggctgcagtgaacc

SEQ ID NO: 102662 - DNA, 16 bp, H. sapiens
gaggctgcagtgaccc

SEQ ID NO: 102663 - DNA, 16 bp, H. sapiens
gaggctgcagtgacct

SEQ ID NO: 102664 - DNA, 16 bp, H. sapiens
gaggctgcagtgagca

SEQ ID NO: 102665 - DNA, 16 bp, H. sapiens
gaggctgcagtgagcc

SEQ ID NO: 102666 - DNA, 16 bp, H. sapiens
gaggctgcagtgagct

SEQ ID NO: 102667 - DNA, 23 bp, H. sapiens
gaggctgcagtgagctgtgatca

SEQ ID NO: 102668 - DNA, 16 bp, H. sapiens
gaggctgcagtgaggt

SEQ ID NO: 102669 - DNA, 16 bp, H. sapiens
gaggctgcagtgagtc

SEQ ID NO: 102670 - DNA, 16 bp, H. sapiens
gaggctgcagtgcgct

SEQ ID NO: 102671 - DNA, 16 bp, H. sapiens
gaggctgcagtgggct

SEQ ID NO: 102672 - DNA, 16 bp, H. sapiens
gaggctgcagttagcc

SEQ ID NO: 102673 - DNA, 16 bp, H. sapiens
gaggctgcattgagct

SEQ ID NO: 102674 - DNA, 16 bp, H. sapiens
gaggctgcctaccaca

SEQ ID NO: 102675 - DNA, 16 bp, H. sapiens
gaggctgcgatgagcc

SEQ ID NO: 102676 - DNA, 16 bp, H. sapiens
gaggctgcggaacagc

SEQ ID NO: 102677 - DNA, 16 bp, H. sapiens
gaggctgcggcaagag

SEQ ID NO: 102678 - DNA, 16 bp, H. sapiens
gaggctgcggcaggag

SEQ ID NO: 102679 - DNA, 16 bp, H. sapiens
gaggctgcggtgaacc

SEQ ID NO: 102680 - DNA, 16 bp, H. sapiens
gaggctgcggtgagct

SEQ ID NO: 102681 - DNA, 16 bp, H. sapiens
gaggctgctataacaa

SEQ ID NO: 102682 - DNA, 16 bp, H. sapiens
gaggctgctctggaga

SEQ ID NO: 102683 - DNA, 16 bp, H. sapiens
gaggctgctgcaggag

SEQ ID NO: 102684 - DNA, 16 bp, H. sapiens
gaggctgctgctgagg

SEQ ID NO: 102685 - DNA, 16 bp, H. sapiens
gaggctgctgtgagct

SEQ ID NO: 102686 - DNA, 16 bp, H. sapiens
gaggctggaagagttt

SEQ ID NO: 102687 - DNA, 16 bp, H. sapiens
gaggctggaagtcaga

SEQ ID NO: 102688 - DNA, 16 bp, H. sapiens
gaggctggaagtgcaa

SEQ ID NO: 102689 - DNA, 16 bp, H. sapiens
gaggctggaagttcaa

SEQ ID NO: 102690 - DNA, 16 bp, H. sapiens
gaggctggacgcggtg

SEQ ID NO: 102691 - DNA, 16 bp, H. sapiens
gaggctggactttgga

SEQ ID NO: 102692 - DNA, 16 bp, H. sapiens
gaggctggagaaagag

SEQ ID NO: 102693 - DNA, 16 bp, H. sapiens
gaggctggagaagagg

SEQ ID NO: 102694 - DNA, 16 bp, H. sapiens
gaggctggagaaggag

SEQ ID NO: 102695 - DNA, 16 bp, H. sapiens
gaggctggagaggaag

SEQ ID NO: 102696 - DNA, 16 bp, H. sapiens
gaggctggagaggagg

SEQ ID NO: 102697 - DNA, 16 bp, H. sapiens
gaggctggagctgcag

SEQ ID NO: 102698 - DNA, 16 bp, H. sapiens
gaggctggagggctgg

SEQ ID NO: 102699 - DNA, 20 bp, H. sapiens
gaggctggagtgcaatggcg

SEQ ID NO: 102700 - DNA, 17 bp, H. sapiens
gaggctggagtgcagtg

SEQ ID NO: 102701 - DNA, 16 bp, H. sapiens
gaggctggatggccct

SEQ ID NO: 102702 - DNA, 16 bp, H. sapiens
gaggctggcagagggg

SEQ ID NO: 102703 - DNA, 16 bp, H. sapiens
gaggctggcagcattt

SEQ ID NO: 102704 - DNA, 16 bp, H. sapiens
gaggctggctgcagtg

SEQ ID NO: 102705 - DNA, 16 bp, H. sapiens
gaggctgggaaggagg

SEQ ID NO: 102706 - DNA, 16 bp, H. sapiens
gaggctgggaagggga

SEQ ID NO: 102707 - DNA, 16 bp, H. sapiens
gaggctgggaagtccg

SEQ ID NO: 102708 - DNA, 16 bp, H. sapiens
gaggctgggaagtcct

SEQ ID NO: 102709 - DNA, 16 bp, H. sapiens
gaggctgggacaggag

SEQ ID NO: 102710 - DNA, 16 bp, H. sapiens
gaggctgggagaggct

SEQ ID NO: 102711 - DNA, 16 bp, H. sapiens
gaggctgggagcaggg

SEQ ID NO: 102712 - DNA, 16 bp, H. sapiens
gaggctgggaggagag

SEQ ID NO: 102713 - DNA, 16 bp, H. sapiens
gaggctgggaggcagg

SEQ ID NO: 102714 - DNA, 16 bp, H. sapiens
gaggctgggaggtgga

SEQ ID NO: 102715 - DNA, 16 bp, H. sapiens
gaggctgggatcccgc

SEQ ID NO: 102716 - DNA, 16 bp, H. sapiens
gaggctgggcccagtg

SEQ ID NO: 102717 - DNA, 16 bp, H. sapiens
gaggctgggcccttcc

SEQ ID NO: 102718 - DNA, 16 bp, H. sapiens
gaggctgggctgggct

SEQ ID NO: 102719 - DNA, 16 bp, H. sapiens
gaggctggggaatcac

SEQ ID NO: 102720 - DNA, 16 bp, H. sapiens
gaggctggggaggatg

SEQ ID NO: 102721 - DNA, 16 bp, H. sapiens
gaggctggggaggctg

SEQ ID NO: 102722 - DNA, 16 bp, H. sapiens
gaggctggggagggca

SEQ ID NO: 102723 - DNA, 16 bp, H. sapiens
gaggctggggatggtg

SEQ ID NO: 102724 - DNA, 16 bp, H. sapiens
gaggctggggcagaga

SEQ ID NO: 102725 - DNA, 16 bp, H. sapiens
gaggctggggcagagg

SEQ ID NO: 102726 - DNA, 16 bp, H. sapiens
gaggctggggcagcag

SEQ ID NO: 102727 - DNA, 16 bp, H. sapiens
gaggctggggctgagg

SEQ ID NO: 102728 - DNA, 16 bp, H. sapiens
gaggctggggctgcac

SEQ ID NO: 102729 - DNA, 16 bp, H. sapiens
gaggctggggctggtg

SEQ ID NO: 102730 - DNA, 16 bp, H. sapiens
gaggctgggggcagtg

SEQ ID NO: 102731 - DNA, 16 bp, H. sapiens
gaggctgggggcctgg

SEQ ID NO: 102732 - DNA, 16 bp, H. sapiens
gaggctggggtgagag

SEQ ID NO: 102733 - DNA, 16 bp, H. sapiens
gaggctggggtgggca

SEQ ID NO: 102734 - DNA, 16 bp, H. sapiens
gaggctggggttgcag

SEQ ID NO: 102735 - DNA, 16 bp, H. sapiens
gaggctgggtaattta

SEQ ID NO: 102736 - DNA, 16 bp, H. sapiens
gaggctgggtcaggag

SEQ ID NO: 102737 - DNA, 16 bp, H. sapiens
gaggctgggtgtagtg

SEQ ID NO: 102738 - DNA, 17 bp, H. sapiens
gaggctggtctcaaact

SEQ ID NO: 102739 - DNA, 17 bp, H. sapiens
gaggctggtcttgaact

SEQ ID NO: 102740 - DNA, 16 bp, H. sapiens
gaggctggtgcaggag

SEQ ID NO: 102741 - DNA, 16 bp, H. sapiens
gaggctgtagtgggct

SEQ ID NO: 102742 - DNA, 16 bp, H. sapiens
gaggctgtgctgtgtg

SEQ ID NO: 102743 - DNA, 16 bp, H. sapiens
gaggctgtggaaaaat

SEQ ID NO: 102744 - DNA, 16 bp, H. sapiens
gaggctgtggcagaga

SEQ ID NO: 102745 - DNA, 16 bp, H. sapiens
gaggctgtggcagcag

SEQ ID NO: 102746 - DNA, 16 bp, H. sapiens
gaggctgtggctgcag

SEQ ID NO: 102747 - DNA, 16 bp, H. sapiens
gaggctgtggggaaaa

SEQ ID NO: 102748 - DNA, 16 bp, H. sapiens
gaggctgtggtgagcc

SEQ ID NO: 102749 - DNA, 16 bp, H. sapiens
gaggctgtggtgagct

SEQ ID NO: 102750 - DNA, 16 bp, H. sapiens
gaggctgttttttttt

SEQ ID NO: 102751 - DNA, 16 bp, H. sapiens
gaggcttaggcaggag

SEQ ID NO: 102752 - DNA, 16 bp, H. sapiens
gaggcttccccagcaa

SEQ ID NO: 102753 - DNA, 16 bp, H. sapiens
gaggcttcctgagtcc

SEQ ID NO: 102754 - DNA, 16 bp, H. sapiens
gaggcttctgaactgg

SEQ ID NO: 102755 - DNA, 18 bp, H. sapiens
gaggcttggactgcttct

SEQ ID NO: 102756 - DNA, 20 bp, H. sapiens
gaggctttaacaccccactg

SEQ ID NO: 102757 - DNA, 16 bp, H. sapiens
gagggaaaaaagacta

SEQ ID NO: 102758 - DNA, 16 bp, H. sapiens
gagggaaaaacattca

SEQ ID NO: 102759 - DNA, 16 bp, H. sapiens
gagggaaaaatggttt

SEQ ID NO: 102760 - DNA, 16 bp, H. sapiens
gagggaaaaattattt

SEQ ID NO: 102761 - DNA, 16 bp, H. sapiens
gagggaaaccctgtct

SEQ ID NO: 102762 - DNA, 16 bp, H. sapiens
gagggaaactgcccag

SEQ ID NO: 102763 - DNA, 16 bp, H. sapiens
gagggaaagaggtctg

SEQ ID NO: 102764 - DNA, 16 bp, H. sapiens
gagggaaatgggaaat

SEQ ID NO: 102765 - DNA, 16 bp, H. sapiens
gagggaaatgtggggt

SEQ ID NO: 102766 - DNA, 16 bp, H. sapiens
gagggaacagcaaggg

SEQ ID NO: 102767 - DNA, 16 bp, H. sapiens
gagggaacagcatgag

SEQ ID NO: 102768 - DNA, 16 bp, H. sapiens
gagggaaccagtggga

SEQ ID NO: 102769 - DNA, 16 bp, H. sapiens
gagggaagagcaaatg

SEQ ID NO: 102770 - DNA, 17 bp, H. sapiens
gagggaaggtcagcaga

SEQ ID NO: 102771 - DNA, 16 bp, H. sapiens
gagggaatcctcccca

SEQ ID NO: 102772 - DNA, 16 bp, H. sapiens
gagggaatctcctgat

SEQ ID NO: 102773 - DNA, 16 bp, H. sapiens
gagggaatggtaccag

SEQ ID NO: 102774 - DNA, 16 bp, H. sapiens
gagggacatggtggga

SEQ ID NO: 102775 - DNA, 16 bp, H. sapiens
gagggaccggctgaag

SEQ ID NO: 102776 - DNA, 17 bp, H. sapiens
gagggaccggctgaagc

SEQ ID NO: 102777 - DNA, 16 bp, H. sapiens
gagggacctgccccca

SEQ ID NO: 102778 - DNA, 16 bp, H. sapiens
gagggacctggaggga

SEQ ID NO: 102779 - DNA, 16 bp, H. sapiens
gagggactcctcccta

SEQ ID NO: 102780 - DNA, 16 bp, H. sapiens
gagggactggctgaag

SEQ ID NO: 102781 - DNA, 16 bp, H. sapiens
gagggagaccatgggg

SEQ ID NO: 102782 - DNA, 16 bp, H. sapiens
gagggagagcattaga

SEQ ID NO: 102783 - DNA, 16 bp, H. sapiens
gagggagaggctgcag

SEQ ID NO: 102784 - DNA, 16 bp, H. sapiens
gagggagagggtcaga

SEQ ID NO: 102785 - DNA, 16 bp, H. sapiens
gagggagccccaggag

SEQ ID NO: 102786 - DNA, 20 bp, H. sapiens
gagggagccggctccggcct

SEQ ID NO: 102787 - DNA, 16 bp, H. sapiens
gagggagctggaggcc

SEQ ID NO: 102788 - DNA, 16 bp, H. sapiens
gagggagctggggctg

SEQ ID NO: 102789 - DNA, 16 bp, H. sapiens
gagggaggaaggggct

SEQ ID NO: 102790 - DNA, 16 bp, H. sapiens
gagggaggagaatccc

SEQ ID NO: 102791 - DNA, 16 bp, H. sapiens
gagggaggagctgggc

SEQ ID NO: 102792 - DNA, 16 bp, H. sapiens
gagggaggaggagctg

SEQ ID NO: 102793 - DNA, 16 bp, H. sapiens
gagggaggcagtgggc

SEQ ID NO: 102794 - DNA, 16 bp, H. sapiens
gagggaggtcagagca

SEQ ID NO: 102795 - DNA, 16 bp, H. sapiens
gagggaggtggaggct

SEQ ID NO: 102796 - DNA, 16 bp, H. sapiens
gagggagtgtgcgaat

SEQ ID NO: 102797 - DNA, 17 bp, H. sapiens
gagggcaagctgaagca

SEQ ID NO: 102798 - DNA, 16 bp, H. sapiens
gagggcaaggcaggcg

SEQ ID NO: 102799 - DNA, 16 bp, H. sapiens
gagggcacagaagctc

SEQ ID NO: 102800 - DNA, 16 bp, H. sapiens
gagggcacctggaaaa

SEQ ID NO: 102801 - DNA, 16 bp, H. sapiens
gagggcagagcccttg

SEQ ID NO: 102802 - DNA, 16 bp, H. sapiens
gagggcagaggctgca

SEQ ID NO: 102803 - DNA, 16 bp, H. sapiens
gagggcagcagggcag

SEQ ID NO: 102804 - DNA, 16 bp, H. sapiens
gagggcagcctgggca

SEQ ID NO: 102805 - DNA, 16 bp, H. sapiens
gagggcagggaccaca

SEQ ID NO: 102806 - DNA, 16 bp, H. sapiens
gagggcagggaccata

SEQ ID NO: 102807 - DNA, 16 bp, H. sapiens
gagggcagggactgtg

SEQ ID NO: 102808 - DNA, 16 bp, H. sapiens
gagggcagggactttg

SEQ ID NO: 102809 - DNA, 16 bp, H. sapiens
gagggcagggctcctg

SEQ ID NO: 102810 - DNA, 16 bp, H. sapiens
gagggcaggggctgcc

SEQ ID NO: 102811 - DNA, 17 bp, H. sapiens
gagggcagtggtgcaat

SEQ ID NO: 102812 - DNA, 16 bp, H. sapiens
gagggcatggaagctc

SEQ ID NO: 102813 - DNA, 16 bp, H. sapiens
gagggccacctggagg

SEQ ID NO: 102814 - DNA, 16 bp, H. sapiens
gagggccactgtcctc

SEQ ID NO: 102815 - DNA, 16 bp, H. sapiens
gagggccattgtcctc

SEQ ID NO: 102816 - DNA, 16 bp, H. sapiens
gagggccccaccctca

SEQ ID NO: 102817 - DNA, 16 bp, H. sapiens
gagggccgggcgcggt

SEQ ID NO: 102818 - DNA, 16 bp, H. sapiens
gagggcctgctttctg

SEQ ID NO: 102819 - DNA, 16 bp, H. sapiens
gagggctcactctctg

SEQ ID NO: 102820 - DNA, 16 bp, H. sapiens
gagggctcaggaagct

SEQ ID NO: 102821 - DNA, 16 bp, H. sapiens
gagggctctattctgt

SEQ ID NO: 102822 - DNA, 16 bp, H. sapiens
gagggctctgcccctg

SEQ ID NO: 102823 - DNA, 16 bp, H. sapiens
gagggctgagatggga

SEQ ID NO: 102824 - DNA, 16 bp, H. sapiens
gagggctgaggagagg

SEQ ID NO: 102825 - DNA, 16 bp, H. sapiens
gagggctgaggcagga

SEQ ID NO: 102826 - DNA, 16 bp, H. sapiens
gagggctgcaagggct

SEQ ID NO: 102827 - DNA, 16 bp, H. sapiens
gagggctgcctggagg

SEQ ID NO: 102828 - DNA, 16 bp, H. sapiens
gagggctgcttgaggc

SEQ ID NO: 102829 - DNA, 16 bp, H. sapiens
gagggctggaatttaa

SEQ ID NO: 102830 - DNA, 16 bp, H. sapiens
gagggctgggctccca

SEQ ID NO: 102831 - DNA, 16 bp, H. sapiens
gagggctgggtgtggt

SEQ ID NO: 102832 - DNA, 16 bp, H. sapiens
gagggctgtgaggaag

SEQ ID NO: 102833 - DNA, 16 bp, H. sapiens
gagggcttcatggagg

SEQ ID NO: 102834 - DNA, 16 bp, H. sapiens
gagggcttcctgaagg

SEQ ID NO: 102835 - DNA, 16 bp, H. sapiens
gagggcttcctggagg

SEQ ID NO: 102836 - DNA, 16 bp, H. sapiens
gagggcttgtgcaggg

SEQ ID NO: 102837 - DNA, 16 bp, H. sapiens
gaggggaaactgaggc

SEQ ID NO: 102838 - DNA, 16 bp, H. sapiens
gaggggactacacaag

SEQ ID NO: 102839 - DNA, 16 bp, H. sapiens
gaggggaggaacactg

SEQ ID NO: 102840 - DNA, 16 bp, H. sapiens
gaggggaggaggtgcc

SEQ ID NO: 102841 - DNA, 16 bp, H. sapiens
gaggggcaagaacccc

SEQ ID NO: 102842 - DNA, 16 bp, H. sapiens
gaggggcactggggaa

SEQ ID NO: 102843 - DNA, 16 bp, H. sapiens
gaggggcagcaggcag

SEQ ID NO: 102844 - DNA, 16 bp, H. sapiens
gaggggcaggccacca

SEQ ID NO: 102845 - DNA, 16 bp, H. sapiens
gaggggcagggcctgg

SEQ ID NO: 102846 - DNA, 16 bp, H. sapiens
gaggggccacatctgg

SEQ ID NO: 102847 - DNA, 16 bp, H. sapiens
gaggggccaggtgcag

SEQ ID NO: 102848 - DNA, 16 bp, H. sapiens
gaggggcccttcagcc

SEQ ID NO: 102849 - DNA, 16 bp, H. sapiens
gaggggcctggggcag

SEQ ID NO: 102850 - DNA, 20 bp, H. sapiens
gaggggcgcctctgcccggc

SEQ ID NO: 102851 - DNA, 16 bp, H. sapiens
gaggggcgcttctgcc

SEQ ID NO: 102852 - DNA, 16 bp, H. sapiens
gaggggctaccatgaa

SEQ ID NO: 102853 - DNA, 16 bp, H. sapiens
gaggggctgaggctgg

SEQ ID NO: 102854 - DNA, 16 bp, H. sapiens
gaggggctgcaggagg

SEQ ID NO: 102855 - DNA, 16 bp, H. sapiens
gaggggctgcagtgaa

SEQ ID NO: 102856 - DNA, 16 bp, H. sapiens
gaggggctgccacaaa

SEQ ID NO: 102857 - DNA, 16 bp, H. sapiens
gaggggctggactcag

SEQ ID NO: 102858 - DNA, 16 bp, H. sapiens
gaggggctgggtgcag

SEQ ID NO: 102859 - DNA, 26 bp, H. sapiens
gaggggcttagcacctgggccagcag

SEQ ID NO: 102860 - DNA, 16 bp, H. sapiens
gaggggcttctggcca

SEQ ID NO: 102861 - DNA, 16 bp, H. sapiens
gagggggaaactgagg

SEQ ID NO: 102862 - DNA, 16 bp, H. sapiens
gagggggagcacgcag

SEQ ID NO: 102863 - DNA, 16 bp, H. sapiens
gagggggagcttgcag

SEQ ID NO: 102864 - DNA, 16 bp, H. sapiens
gagggggcggctggcc

SEQ ID NO: 102865 - DNA, 16 bp, H. sapiens
gagggtagatcttaag

SEQ ID NO: 102866 - DNA, 16 bp, H. sapiens
gagggtatttctggaa

SEQ ID NO: 102867 - DNA, 16 bp, H. sapiens
gagggtcatctgcttt

SEQ ID NO: 102868 - DNA, 16 bp, H. sapiens
gagggtcccagtggga

SEQ ID NO: 102869 - DNA, 16 bp, H. sapiens
gagggtcccatgccca

SEQ ID NO: 102870 - DNA, 16 bp, H. sapiens
gagggtcctacgccca

SEQ ID NO: 102871 - DNA, 16 bp, H. sapiens
gagggtcctgcccctg

SEQ ID NO: 102872 - DNA, 16 bp, H. sapiens
gagggtcctggtggga

SEQ ID NO: 102873 - DNA, 16 bp, H. sapiens
gagggtctgcggcttc

SEQ ID NO: 102874 - DNA, 16 bp, H. sapiens
gagggtcttgctctgt

SEQ ID NO: 102875 - DNA, 16 bp, H. sapiens
gagggtgagctgggag

SEQ ID NO: 102876 - DNA, 16 bp, H. sapiens
gagggtgaggctgagg

SEQ ID NO: 102877 - DNA, 16 bp, H. sapiens
gagggtgaggctgcag

SEQ ID NO: 102878 - DNA, 16 bp, H. sapiens
gagggtgaggctggag

SEQ ID NO: 102879 - DNA, 16 bp, H. sapiens
gagggtgcaagcccaa

SEQ ID NO: 102880 - DNA, 16 bp, H. sapiens
gagggtgcggtgagct

SEQ ID NO: 102881 - DNA, 16 bp, H. sapiens
gagggtggagccccca

SEQ ID NO: 102882 - DNA, 16 bp, H. sapiens
gagggtggatcatttg

SEQ ID NO: 102883 - DNA, 16 bp, H. sapiens
gagggtgggaggacag

SEQ ID NO: 102884 - DNA, 16 bp, H. sapiens
gagggtggggccccca

SEQ ID NO: 102885 - DNA, 16 bp, H. sapiens
gagggtggtgcacccc

SEQ ID NO: 102886 - DNA, 16 bp, H. sapiens
gagggtgtgtgcaggg

SEQ ID NO: 102887 - DNA, 16 bp, H. sapiens
gagggttaggacttca

SEQ ID NO: 102888 - DNA, 16 bp, H. sapiens
gagggttccaatttct

SEQ ID NO: 102889 - DNA, 16 bp, H. sapiens
gagggttttttctttt

SEQ ID NO: 102890 - DNA, 16 bp, H. sapiens
gaggtaagcagatcac

SEQ ID NO: 102891 - DNA, 16 bp, H. sapiens
gaggtaatacatatgt

SEQ ID NO: 102892 - DNA, 17 bp, H. sapiens
gaggtagagcttgcagt

SEQ ID NO: 102893 - DNA, 16 bp, H. sapiens
gaggtagaggctgcag

SEQ ID NO: 102894 - DNA, 16 bp, H. sapiens
gaggtagaggtggcag

SEQ ID NO: 102895 - DNA, 16 bp, H. sapiens
gaggtagcagtgagcc

SEQ ID NO: 102896 - DNA, 16 bp, H. sapiens
gaggtagcagtgagct

SEQ ID NO: 102897 - DNA, 16 bp, H. sapiens
gaggtaggaggattgc

SEQ ID NO: 102898 - DNA, 16 bp, H. sapiens
gaggtaggagggttgc

SEQ ID NO: 102899 - DNA, 16 bp, H. sapiens
gaggtaggataattgc

SEQ ID NO: 102900 - DNA, 17 bp, H. sapiens
gaggtaggcagatcacc

SEQ ID NO: 102901 - DNA, 16 bp, H. sapiens
gaggtagtttgacttc

SEQ ID NO: 102902 - DNA, 16 bp, H. sapiens
gaggtatgcctgtact

SEQ ID NO: 102903 - DNA, 16 bp, H. sapiens
gaggtattttgataca

SEQ ID NO: 102904 - DNA, 16 bp, H. sapiens
gaggtcaaagtgggag

SEQ ID NO: 102905 - DNA, 16 bp, H. sapiens
gaggtcaagcctgcag

SEQ ID NO: 102906 - DNA, 16 bp, H. sapiens
gaggtcaaggaaggag

SEQ ID NO: 102907 - DNA, 16 bp, H. sapiens
gaggtcaaggcaggag

SEQ ID NO: 102908 - DNA, 16 bp, H. sapiens
gaggtcaaggctgaag

SEQ ID NO: 102909 - DNA, 16 bp, H. sapiens
gaggtcaaggctggca

SEQ ID NO: 102910 - DNA, 16 bp, H. sapiens
gaggtcacagtgagct

SEQ ID NO: 102911 - DNA, 16 bp, H. sapiens
gaggtcagaggtcagg

SEQ ID NO: 102912 - DNA, 16 bp, H. sapiens
gaggtcagcagatgga

SEQ ID NO: 102913 - DNA, 16 bp, H. sapiens
gaggtcaggaatttaa

SEQ ID NO: 102914 - DNA, 16 bp, H. sapiens
gaggtcaggaggtgga

SEQ ID NO: 102915 - DNA, 16 bp, H. sapiens
gaggtcaggagtcaga

SEQ ID NO: 102916 - DNA, 16 bp, H. sapiens
gaggtcagggcacaga

SEQ ID NO: 102917 - DNA, 16 bp, H. sapiens
gaggtcagggtttgag

SEQ ID NO: 102918 - DNA, 17 bp, H. sapiens
gaggtcagtgtgagccc

SEQ ID NO: 102919 - DNA, 16 bp, H. sapiens
gaggtccagagaggtt

SEQ ID NO: 102920 - DNA, 16 bp, H. sapiens
gaggtccccaaccccc

SEQ ID NO: 102921 - DNA, 16 bp, H. sapiens
gaggtccctgtggcct

SEQ ID NO: 102922 - DNA, 16 bp, H. sapiens
gaggtcgcagtgagcc

SEQ ID NO: 102923 - DNA, 16 bp, H. sapiens
gaggtcgggagatgga

SEQ ID NO: 102924 - DNA, 16 bp, H. sapiens
gaggtctccccagcca

SEQ ID NO: 102925 - DNA, 16 bp, H. sapiens
gaggtctctcttcctg

SEQ ID NO: 102926 - DNA, 16 bp, H. sapiens
gaggtctgcagcttca

SEQ ID NO: 102927 - DNA, 16 bp, H. sapiens
gaggtctgtgccagga

SEQ ID NO: 102928 - DNA, 16 bp, H. sapiens
gaggtcttactatatt

SEQ ID NO: 102929 - DNA, 16 bp, H. sapiens
gaggtgaacctggagg

SEQ ID NO: 102930 - DNA, 16 bp, H. sapiens
gaggtgaagaagctgc

SEQ ID NO: 102931 - DNA, 16 bp, H. sapiens
gaggtgaagatggaga

SEQ ID NO: 102932 - DNA, 16 bp, H. sapiens
gaggtgaagattgcag

SEQ ID NO: 102933 - DNA, 16 bp, H. sapiens
gaggtgaagcctacag

SEQ ID NO: 102934 - DNA, 16 bp, H. sapiens
gaggtgaagcctttgg

SEQ ID NO: 102935 - DNA, 16 bp, H. sapiens
gaggtgacacctgcag

SEQ ID NO: 102936 - DNA, 16 bp, H. sapiens
gaggtgagaggcctgg

SEQ ID NO: 102937 - DNA, 16 bp, H. sapiens
gaggtgaggcaggagg

SEQ ID NO: 102938 - DNA, 16 bp, H. sapiens
gaggtgaggctgcagt

SEQ ID NO: 102939 - DNA, 16 bp, H. sapiens
gaggtgagtggtgggc

SEQ ID NO: 102940 - DNA, 16 bp, H. sapiens
gaggtgatggaaatgt

SEQ ID NO: 102941 - DNA, 16 bp, H. sapiens
gaggtgatggatactc

SEQ ID NO: 102942 - DNA, 16 bp, H. sapiens
gaggtgatggatgtgt

SEQ ID NO: 102943 - DNA, 16 bp, H. sapiens
gaggtgatggtgatgg

SEQ ID NO: 102944 - DNA, 16 bp, H. sapiens
gaggtgcagagagaga

SEQ ID NO: 102945 - DNA, 16 bp, H. sapiens
gaggtgcagagaggtt

SEQ ID NO: 102946 - DNA, 16 bp, H. sapiens
gaggtgcagtgagctg

SEQ ID NO: 102947 - DNA, 16 bp, H. sapiens
gaggtgccaagagcga

SEQ ID NO: 102948 - DNA, 16 bp, H. sapiens
gaggtgccatacactt

SEQ ID NO: 102949 - DNA, 16 bp, H. sapiens
gaggtggaagacaatg

SEQ ID NO: 102950 - DNA, 16 bp, H. sapiens
gaggtggaagttacag

SEQ ID NO: 102951 - DNA, 16 bp, H. sapiens
gaggtggaatccttta

SEQ ID NO: 102952 - DNA, 16 bp, H. sapiens
gaggtggaatctatag

SEQ ID NO: 102953 - DNA, 16 bp, H. sapiens
gaggtggagacaggag

SEQ ID NO: 102954 - DNA, 16 bp, H. sapiens
gaggtggagaccatcc

SEQ ID NO: 102955 - DNA, 16 bp, H. sapiens
gaggtggagattggag

SEQ ID NO: 102956 - DNA, 16 bp, H. sapiens
gaggtggagattgtgg

SEQ ID NO: 102957 - DNA, 16 bp, H. sapiens
gaggtggagctcaggt

SEQ ID NO: 102958 - DNA, 16 bp, H. sapiens
gaggtggagcttaatt

SEQ ID NO: 102959 - DNA, 16 bp, H. sapiens
gaggtggaggagcaga

SEQ ID NO: 102960 - DNA, 16 bp, H. sapiens
gaggtggaggaggcag

SEQ ID NO: 102961 - DNA, 16 bp, H. sapiens
gaggtggaggcagagg

SEQ ID NO: 102962 - DNA, 16 bp, H. sapiens
gaggtggaggccgcag

SEQ ID NO: 102963 - DNA, 16 bp, H. sapiens
gaggtggaggcggcag

SEQ ID NO: 102964 - DNA, 16 bp, H. sapiens
gaggtggaggctgaag

SEQ ID NO: 102965 - DNA, 16 bp, H. sapiens
gaggtggaggctgcag

SEQ ID NO: 102966 - DNA, 16 bp, H. sapiens
gaggtggaggctgctg

SEQ ID NO: 102967 - DNA, 16 bp, H. sapiens
gaggtggaggctttgg

SEQ ID NO: 102968 - DNA, 16 bp, H. sapiens
gaggtggaggttgcac

SEQ ID NO: 102969 - DNA, 16 bp, H. sapiens
gaggtggaggtttgca

SEQ ID NO: 102970 - DNA, 16 bp, H. sapiens
gaggtggagtctctgt

SEQ ID NO: 102971 - DNA, 16 bp, H. sapiens
gaggtggagtcttact

SEQ ID NO: 102972 - DNA, 16 bp, H. sapiens
gaggtggatagatcac

SEQ ID NO: 102973 - DNA, 16 bp, H. sapiens
gaggtggcagaggcag

SEQ ID NO: 102974 - DNA, 16 bp, H. sapiens
gaggtggcagaggtgg

SEQ ID NO: 102975 - DNA, 16 bp, H. sapiens
gaggtggcagggagcc

SEQ ID NO: 102976 - DNA, 16 bp, H. sapiens
gaggtggcagtgagcc

SEQ ID NO: 102977 - DNA, 16 bp, H. sapiens
gaggtggcagtggcag

SEQ ID NO: 102978 - DNA, 16 bp, H. sapiens
gaggtggcggctgcag

SEQ ID NO: 102979 - DNA, 16 bp, H. sapiens
gaggtgggagacttgc

SEQ ID NO: 102980 - DNA, 16 bp, H. sapiens
gaggtgggagcaggga

SEQ ID NO: 102981 - DNA, 16 bp, H. sapiens
gaggtgggaggacagc

SEQ ID NO: 102982 - DNA, 16 bp, H. sapiens
gaggtgggaggagagc

SEQ ID NO: 102983 - DNA, 16 bp, H. sapiens
gaggtgggaggagttc

SEQ ID NO: 102984 - DNA, 22 bp, H. sapiens
gaggtgggaggatcacttgagg

SEQ ID NO: 102985 - DNA, 16 bp, H. sapiens
gaggtgggaggatcag

SEQ ID NO: 102986 - DNA, 16 bp, H. sapiens
gaggtgggattgctgg

SEQ ID NO: 102987 - DNA, 16 bp, H. sapiens
gaggtgggcagatcaa

SEQ ID NO: 102988 - DNA, 16 bp, H. sapiens
gaggtgggcagatcac

SEQ ID NO: 102989 - DNA, 16 bp, H. sapiens
gaggtgggcagggctg

SEQ ID NO: 102990 - DNA, 16 bp, H. sapiens
gaggtgggcggatcac

SEQ ID NO: 102991 - DNA, 16 bp, H. sapiens
gaggtgggcggatcat

SEQ ID NO: 102992 - DNA, 16 bp, H. sapiens
gaggtgggcggatcgc

SEQ ID NO: 102993 - DNA, 16 bp, H. sapiens
gaggtgggcggatctc

SEQ ID NO: 102994 - DNA, 16 bp, H. sapiens
gaggtgggcggctcac

SEQ ID NO: 102995 - DNA, 16 bp, H. sapiens
gaggtgggctccaccc

SEQ ID NO: 102996 - DNA, 16 bp, H. sapiens
gaggtggggagaggca

SEQ ID NO: 102997 - DNA, 16 bp, H. sapiens
gaggtggggagatcac

SEQ ID NO: 102998 - DNA, 16 bp, H. sapiens
gaggtggggcccttgg

SEQ ID NO: 102999 - DNA, 16 bp, H. sapiens
gaggtggggcctggag

SEQ ID NO: 103000 - DNA, 16 bp, H. sapiens
gaggtggggcctggca

SEQ ID NO: 103001 - DNA, 16 bp, H. sapiens
gaggtggggggaatca

SEQ ID NO: 103002 - DNA, 16 bp, H. sapiens
gaggtggggggatccc

SEQ ID NO: 103003 - DNA, 16 bp, H. sapiens
gaggtggggggcagcc

SEQ ID NO: 103004 - DNA, 16 bp, H. sapiens
gaggtgggggtgtcag

SEQ ID NO: 103005 - DNA, 16 bp, H. sapiens
gaggtggggtttcacc

SEQ ID NO: 103006 - DNA, 16 bp, H. sapiens
gaggtgggtagatcac

SEQ ID NO: 103007 - DNA, 16 bp, H. sapiens
gaggtgggtggaccac

SEQ ID NO: 103008 - DNA, 16 bp, H. sapiens
gaggtgggtggatcac

SEQ ID NO: 103009 - DNA, 16 bp, H. sapiens
gaggtggtatcagatg

SEQ ID NO: 103010 - DNA, 16 bp, H. sapiens
gaggtggtcaccagga

SEQ ID NO: 103011 - DNA, 16 bp, H. sapiens
gaggtggtcagatcac

SEQ ID NO: 103012 - DNA, 16 bp, H. sapiens
gaggtggtgcagggca

SEQ ID NO: 103013 - DNA, 16 bp, H. sapiens
gaggtggtgctggagg

SEQ ID NO: 103014 - DNA, 16 bp, H. sapiens
gaggtggtttcagatg

SEQ ID NO: 103015 - DNA, 16 bp, H. sapiens
gaggtgtccaatcttt

SEQ ID NO: 103016 - DNA, 16 bp, H. sapiens
gaggtgtgagcccctg

SEQ ID NO: 103017 - DNA, 16 bp, H. sapiens
gaggtgtggataaggc

SEQ ID NO: 103018 - DNA, 16 bp, H. sapiens
gaggttaaatgacttg

SEQ ID NO: 103019 - DNA, 16 bp, H. sapiens
gaggttaagtaactgg

SEQ ID NO: 103020 - DNA, 16 bp, H. sapiens
gaggttaagtgacttg

SEQ ID NO: 103021 - DNA, 16 bp, H. sapiens
gaggttaagtgatttg

SEQ ID NO: 103022 - DNA, 16 bp, H. sapiens
gaggttacagcgagcc

SEQ ID NO: 103023 - DNA, 16 bp, H. sapiens
gaggttacagtaagct

SEQ ID NO: 103024 - DNA, 16 bp, H. sapiens
gaggttacagtgagcc

SEQ ID NO: 103025 - DNA, 16 bp, H. sapiens
gaggttacagtgagcg

SEQ ID NO: 103026 - DNA, 16 bp, H. sapiens
gaggttacagtgagct

SEQ ID NO: 103027 - DNA, 16 bp, H. sapiens
gaggttacagtgatcc

SEQ ID NO: 103028 - DNA, 16 bp, H. sapiens
gaggttattatgttaa

SEQ ID NO: 103029 - DNA, 16 bp, H. sapiens
gaggttcagagaggtt

SEQ ID NO: 103030 - DNA, 16 bp, H. sapiens
gaggttcatccatgtt

SEQ ID NO: 103031 - DNA, 16 bp, H. sapiens
gaggttccagtgagcc

SEQ ID NO: 103032 - DNA, 16 bp, H. sapiens
gaggttcctcaaaaag

SEQ ID NO: 103033 - DNA, 16 bp, H. sapiens
gaggttctccaagagg

SEQ ID NO: 103034 - DNA, 16 bp, H. sapiens
gaggttctgagaacat

SEQ ID NO: 103035 - DNA, 16 bp, H. sapiens
gaggttctttgaaacc

SEQ ID NO: 103036 - DNA, 16 bp, H. sapiens
gaggttgaagtgagcc

SEQ ID NO: 103037 - DNA, 16 bp, H. sapiens
gaggttgaagtgggag

SEQ ID NO: 103038 - DNA, 16 bp, H. sapiens
gaggttgagacagaag

SEQ ID NO: 103039 - DNA, 16 bp, H. sapiens
gaggttgagacaggag

SEQ ID NO: 103040 - DNA, 16 bp, H. sapiens
gaggttgaggcaagag

SEQ ID NO: 103041 - DNA, 16 bp, H. sapiens
gaggttgaggcaggag

SEQ ID NO: 103042 - DNA, 16 bp, H. sapiens
gaggttgaggtaggag

SEQ ID NO: 103043 - DNA, 16 bp, H. sapiens
gaggttgaggtgagag

SEQ ID NO: 103044 - DNA, 16 bp, H. sapiens
gaggttgcaataagcc

SEQ ID NO: 103045 - DNA, 16 bp, H. sapiens
gaggttgcaatgagcc

SEQ ID NO: 103046 - DNA, 16 bp, H. sapiens
gaggttgcactgagcc

SEQ ID NO: 103047 - DNA, 16 bp, H. sapiens
gaggttgcagaggaaa

SEQ ID NO: 103048 - DNA, 16 bp, H. sapiens
gaggttgcagcgagcc

SEQ ID NO: 103049 - DNA, 16 bp, H. sapiens
gaggttgcagggagca

SEQ ID NO: 103050 - DNA, 16 bp, H. sapiens
gaggttgcagggagcc

SEQ ID NO: 103051 - DNA, 16 bp, H. sapiens
gaggttgcaggttgca

SEQ ID NO: 103052 - DNA, 16 bp, H. sapiens
gaggttgcagtaagcc

SEQ ID NO: 103053 - DNA, 16 bp, H. sapiens
gaggttgcagtcagcc

SEQ ID NO: 103054 - DNA, 16 bp, H. sapiens
gaggttgcagtgaacc

SEQ ID NO: 103055 - DNA, 16 bp, H. sapiens
gaggttgcagtgaccc

SEQ ID NO: 103056 - DNA, 16 bp, H. sapiens
gaggttgcagtgagcc

SEQ ID NO: 103057 - DNA, 16 bp, H. sapiens
gaggttgcagtgaggt

SEQ ID NO: 103058 - DNA, 16 bp, H. sapiens
gaggttgcagtgatcc

SEQ ID NO: 103059 - DNA, 16 bp, H. sapiens
gaggttgcagtgattg

SEQ ID NO: 103060 - DNA, 16 bp, H. sapiens
gaggttgcagtgcacc

SEQ ID NO: 103061 - DNA, 16 bp, H. sapiens
gaggttgcagtgggcc

SEQ ID NO: 103062 - DNA, 16 bp, H. sapiens
gaggttgcagtgtgcc

SEQ ID NO: 103063 - DNA, 16 bp, H. sapiens
gaggttgcagttagcc

SEQ ID NO: 103064 - DNA, 16 bp, H. sapiens
gaggttgcattgagcc

SEQ ID NO: 103065 - DNA, 16 bp, H. sapiens
gaggttgccgtgagcc

SEQ ID NO: 103066 - DNA, 16 bp, H. sapiens
gaggttgcggtaagcc

SEQ ID NO: 103067 - DNA, 16 bp, H. sapiens
gaggttgcggtgagcc

SEQ ID NO: 103068 - DNA, 16 bp, H. sapiens
gaggttgctgtgagcc

SEQ ID NO: 103069 - DNA, 16 bp, H. sapiens
gaggttggagtgagcc

SEQ ID NO: 103070 - DNA, 16 bp, H. sapiens
gaggttggggtgagcc

SEQ ID NO: 103071 - DNA, 16 bp, H. sapiens
gaggttgtagtgagcc

SEQ ID NO: 103072 - DNA, 16 bp, H. sapiens
gaggttgtagtgagtc

SEQ ID NO: 103073 - DNA, 16 bp, H. sapiens
gaggttgtgatgagcc

SEQ ID NO: 103074 - DNA, 16 bp, H. sapiens
gaggttgtgctgagcc

SEQ ID NO: 103075 - DNA, 16 bp, H. sapiens
gaggttgtggagaaaa

SEQ ID NO: 103076 - DNA, 16 bp, H. sapiens
gaggttgtggagaaat

SEQ ID NO: 103077 - DNA, 16 bp, H. sapiens
gaggttgtggtgagcc

SEQ ID NO: 103078 - DNA, 16 bp, H. sapiens
gaggttgtggtgagcg

SEQ ID NO: 103079 - DNA, 21 bp, H. sapiens
gaggttgtggtgagctgagat

SEQ ID NO: 103080 - DNA, 16 bp, H. sapiens
gaggtttaggaacctc

SEQ ID NO: 103081 - DNA, 16 bp, H. sapiens
gaggtttcactgtgtt

SEQ ID NO: 103082 - DNA, 16 bp, H. sapiens
gaggtttcagtgagcc

SEQ ID NO: 103083 - DNA, 16 bp, H. sapiens
gaggtttccccagcca

SEQ ID NO: 103084 - DNA, 16 bp, H. sapiens
gaggtttctcaaagaa

SEQ ID NO: 103085 - DNA, 16 bp, H. sapiens
gaggtttgaggagaga

SEQ ID NO: 103086 - DNA, 16 bp, H. sapiens
gaggttttgttcattt

SEQ ID NO: 103087 - DNA, 16 bp, H. sapiens
gagtaaaaggatggtt

SEQ ID NO: 103088 - DNA, 16 bp, H. sapiens
gagtaaaatggtagtt

SEQ ID NO: 103089 - DNA, 16 bp, H. sapiens
gagtaaatatttgcaa

SEQ ID NO: 103090 - DNA, 16 bp, H. sapiens
gagtaaattttaagtg

SEQ ID NO: 103091 - DNA, 16 bp, H. sapiens
gagtaagagccagccc

SEQ ID NO: 103092 - DNA, 16 bp, H. sapiens
gagtaatatcatcatc

SEQ ID NO: 103093 - DNA, 16 bp, H. sapiens
gagtaatatcccacaa

SEQ ID NO: 103094 - DNA, 16 bp, H. sapiens
gagtacaaaaattagc

SEQ ID NO: 103095 - DNA, 16 bp, H. sapiens
gagtacagatacctct

SEQ ID NO: 103096 - DNA, 16 bp, H. sapiens
gagtacaggcacatgc

SEQ ID NO: 103097 - DNA, 16 bp, H. sapiens
gagtacaggtgcccac

SEQ ID NO: 103098 - DNA, 16 bp, H. sapiens
gagtacagtgccatga

SEQ ID NO: 103099 - DNA, 16 bp, H. sapiens
gagtacagtggcacca

SEQ ID NO: 103100 - DNA, 16 bp, H. sapiens
gagtacagtggtgtca

SEQ ID NO: 103101 - DNA, 16 bp, H. sapiens
gagtacatactatgtg

SEQ ID NO: 103102 - DNA, 16 bp, H. sapiens
gagtacctaatgttta

SEQ ID NO: 103103 - DNA, 16 bp, H. sapiens
gagtacctgggactac

SEQ ID NO: 103104 - DNA, 16 bp, H. sapiens
gagtactattcggcca

SEQ ID NO: 103105 - DNA, 16 bp, H. sapiens
gagtactcttaaagca

SEQ ID NO: 103106 - DNA, 17 bp, H. sapiens
gagtactgagattacag

SEQ ID NO: 103107 - DNA, 16 bp, H. sapiens
gagtactgggattaca

SEQ ID NO: 103108 - DNA, 16 bp, H. sapiens
gagtagaattgctgaa

SEQ ID NO: 103109 - DNA, 16 bp, H. sapiens
gagtagatttttaaaa

SEQ ID NO: 103110 - DNA, 16 bp, H. sapiens
gagtagcagagattac

SEQ ID NO: 103111 - DNA, 16 bp, H. sapiens
gagtagcagggactat

SEQ ID NO: 103112 - DNA, 16 bp, H. sapiens
gagtagcagggattac

SEQ ID NO: 103113 - DNA, 16 bp, H. sapiens
gagtagccgggaccac

SEQ ID NO: 103114 - DNA, 16 bp, H. sapiens
gagtagctgagattat

SEQ ID NO: 103115 - DNA, 16 bp, H. sapiens
gagtagctgggataac

SEQ ID NO: 103116 - DNA, 16 bp, H. sapiens
gagtagctgggataat

SEQ ID NO: 103117 - DNA, 16 bp, H. sapiens
gagtagctgggattaa

SEQ ID NO: 103118 - DNA, 16 bp, H. sapiens
gagtagctgggattca

SEQ ID NO: 103119 - DNA, 16 bp, H. sapiens
gagtaggactctgtct

SEQ ID NO: 103120 - DNA, 16 bp, H. sapiens
gagtaggcaaagattt

SEQ ID NO: 103121 - DNA, 16 bp, H. sapiens
gagtagttgggacaac

SEQ ID NO: 103122 - DNA, 16 bp, H. sapiens
gagtagttgtgacaga

SEQ ID NO: 103123 - DNA, 16 bp, H. sapiens
gagtatacaaggaact

SEQ ID NO: 103124 - DNA, 16 bp, H. sapiens
gagtatatacccaaaa

SEQ ID NO: 103125 - DNA, 21 bp, H. sapiens
gagtatctgggattacaggca

SEQ ID NO: 103126 - DNA, 16 bp, H. sapiens
gagtatggtggctcac

SEQ ID NO: 103127 - DNA, 16 bp, H. sapiens
gagtatgtggagaaat

SEQ ID NO: 103128 - DNA, 16 bp, H. sapiens
gagtatgtgtgtgtgt

SEQ ID NO: 103129 - DNA, 16 bp, H. sapiens
gagtattttaagccca

SEQ ID NO: 103130 - DNA, 16 bp, H. sapiens
gagtattttttaaatg

SEQ ID NO: 103131 - DNA, 16 bp, H. sapiens
gagtcaagatcctgcc

SEQ ID NO: 103132 - DNA, 16 bp, H. sapiens
gagtcaaggtcttgct

SEQ ID NO: 103133 - DNA, 16 bp, H. sapiens
gagtcaatgaaaaaat

SEQ ID NO: 103134 - DNA, 16 bp, H. sapiens
gagtcactgtgccagg

SEQ ID NO: 103135 - DNA, 16 bp, H. sapiens
gagtcagaatttgaat

SEQ ID NO: 103136 - DNA, 16 bp, H. sapiens
gagtcagacagacctg

SEQ ID NO: 103137 - DNA, 16 bp, H. sapiens
gagtcagacagatctg

SEQ ID NO: 103138 - DNA, 16 bp, H. sapiens
gagtcagaggttacag

SEQ ID NO: 103139 - DNA, 16 bp, H. sapiens
gagtcagagtcagaga

SEQ ID NO: 103140 - DNA, 16 bp, H. sapiens
gagtcaggagacctgg

SEQ ID NO: 103141 - DNA, 16 bp, H. sapiens
gagtcaggaggcctgg

SEQ ID NO: 103142 - DNA, 16 bp, H. sapiens
gagtcaggatttgaac

SEQ ID NO: 103143 - DNA, 16 bp, H. sapiens
gagtcagtgaactggg

SEQ ID NO: 103144 - DNA, 16 bp, H. sapiens
gagtcatgggggtgga

SEQ ID NO: 103145 - DNA, 16 bp, H. sapiens
gagtcatgtggccaga

SEQ ID NO: 103146 - DNA, 16 bp, H. sapiens
gagtccaaggcaggag

SEQ ID NO: 103147 - DNA, 16 bp, H. sapiens
gagtccagcaagctaa

SEQ ID NO: 103148 - DNA, 16 bp, H. sapiens
gagtccagcctggcca

SEQ ID NO: 103149 - DNA, 16 bp, H. sapiens
gagtccagcctgggaa

SEQ ID NO: 103150 - DNA, 16 bp, H. sapiens
gagtccagcctgggca

SEQ ID NO: 103151 - DNA, 16 bp, H. sapiens
gagtccaggagctgga

SEQ ID NO: 103152 - DNA, 16 bp, H. sapiens
gagtccaggagctggt

SEQ ID NO: 103153 - DNA, 16 bp, H. sapiens
gagtccaggaggtcca

SEQ ID NO: 103154 - DNA, 16 bp, H. sapiens
gagtccaggagtctga

SEQ ID NO: 103155 - DNA, 16 bp, H. sapiens
gagtccagggatgctg

SEQ ID NO: 103156 - DNA, 16 bp, H. sapiens
gagtcccagaagaaga

SEQ ID NO: 103157 - DNA, 16 bp, H. sapiens
gagtcccagctactca

SEQ ID NO: 103158 - DNA, 16 bp, H. sapiens
gagtccccaaaatcca

SEQ ID NO: 103159 - DNA, 16 bp, H. sapiens
gagtccctgctggggc

SEQ ID NO: 103160 - DNA, 16 bp, H. sapiens
gagtcctcatctctac

SEQ ID NO: 103161 - DNA, 16 bp, H. sapiens
gagtcctgccttgggg

SEQ ID NO: 103162 - DNA, 17 bp, H. sapiens
gagtcctgggattacag

SEQ ID NO: 103163 - DNA, 16 bp, H. sapiens
gagtctacagaagcag

SEQ ID NO: 103164 - DNA, 16 bp, H. sapiens
gagtctcaccctgtca

SEQ ID NO: 103165 - DNA, 16 bp, H. sapiens
gagtctcactatgtca

SEQ ID NO: 103166 - DNA, 16 bp, H. sapiens
gagtctcactctgtag

SEQ ID NO: 103167 - DNA, 16 bp, H. sapiens
gagtctcactctgtca

SEQ ID NO: 103168 - DNA, 16 bp, H. sapiens
gagtctcactctgtcc

SEQ ID NO: 103169 - DNA, 16 bp, H. sapiens
gagtctcactctgtgg

SEQ ID NO: 103170 - DNA, 19 bp, H. sapiens
gagtctcactctgttgcct

SEQ ID NO: 103171 - DNA, 16 bp, H. sapiens
gagtctcactctgttt

SEQ ID NO: 103172 - DNA, 16 bp, H. sapiens
gagtctcactcttgtc

SEQ ID NO: 103173 - DNA, 16 bp, H. sapiens
gagtctcactgtgctg

SEQ ID NO: 103174 - DNA, 16 bp, H. sapiens
gagtctcaggcctggc

SEQ ID NO: 103175 - DNA, 16 bp, H. sapiens
gagtctcattctgtca

SEQ ID NO: 103176 - DNA, 16 bp, H. sapiens
gagtctccagaaggaa

SEQ ID NO: 103177 - DNA, 16 bp, H. sapiens
gagtctccctctgtca

SEQ ID NO: 103178 - DNA, 16 bp, H. sapiens
gagtctcctctgtcac

SEQ ID NO: 103179 - DNA, 16 bp, H. sapiens
gagtctcctgcctcag

SEQ ID NO: 103180 - DNA, 16 bp, H. sapiens
gagtctcgccctgtcg

SEQ ID NO: 103181 - DNA, 16 bp, H. sapiens
gagtctcgctctgtta

SEQ ID NO: 103182 - DNA, 16 bp, H. sapiens
gagtctcgctctgttg

SEQ ID NO: 103183 - DNA, 16 bp, H. sapiens
gagtctcgctgtattg

SEQ ID NO: 103184 - DNA, 16 bp, H. sapiens
gagtctcgttctgttg

SEQ ID NO: 103185 - DNA, 16 bp, H. sapiens
gagtctctccttttca

SEQ ID NO: 103186 - DNA, 16 bp, H. sapiens
gagtctctctctctca

SEQ ID NO: 103187 - DNA, 16 bp, H. sapiens
gagtctctctgtctcc

SEQ ID NO: 103188 - DNA, 16 bp, H. sapiens
gagtctctctgtgttg

SEQ ID NO: 103189 - DNA, 16 bp, H. sapiens
gagtctctgtctgtca

SEQ ID NO: 103190 - DNA, 16 bp, H. sapiens
gagtctgaagcaggag

SEQ ID NO: 103191 - DNA, 16 bp, H. sapiens
gagtctgaggcaggag

SEQ ID NO: 103192 - DNA, 16 bp, H. sapiens
gagtctgcagcagcag

SEQ ID NO: 103193 - DNA, 16 bp, H. sapiens
gagtctggcttatttc

SEQ ID NO: 103194 - DNA, 16 bp, H. sapiens
gagtctgggtctcact

SEQ ID NO: 103195 - DNA, 16 bp, H. sapiens
gagtctgggtttcacc

SEQ ID NO: 103196 - DNA, 16 bp, H. sapiens
gagtctgtctctgtca

SEQ ID NO: 103197 - DNA, 16 bp, H. sapiens
gagtcttacatttaag

SEQ ID NO: 103198 - DNA, 16 bp, H. sapiens
gagtcttactctgtca

SEQ ID NO: 103199 - DNA, 16 bp, H. sapiens
gagtcttactctgtcc

SEQ ID NO: 103200 - DNA, 16 bp, H. sapiens
gagtcttactgtgtca

SEQ ID NO: 103201 - DNA, 16 bp, H. sapiens
gagtcttctggcctcc

SEQ ID NO: 103202 - DNA, 16 bp, H. sapiens
gagtcttgccctgtca

SEQ ID NO: 103203 - DNA, 16 bp, H. sapiens
gagtcttgctacattg

SEQ ID NO: 103204 - DNA, 16 bp, H. sapiens
gagtcttgctatgtca

SEQ ID NO: 103205 - DNA, 16 bp, H. sapiens
gagtcttgctctgcag

SEQ ID NO: 103206 - DNA, 16 bp, H. sapiens
gagtcttgctctgcca

SEQ ID NO: 103207 - DNA, 16 bp, H. sapiens
gagtcttgctctgttg

SEQ ID NO: 103208 - DNA, 16 bp, H. sapiens
gagtcttgctgtgtca

SEQ ID NO: 103209 - DNA, 16 bp, H. sapiens
gagtcttgctgttgtc

SEQ ID NO: 103210 - DNA, 16 bp, H. sapiens
gagtcttgcttggttg

SEQ ID NO: 103211 - DNA, 16 bp, H. sapiens
gagtcttgctttgtca

SEQ ID NO: 103212 - DNA, 16 bp, H. sapiens
gagtcttgctttgtgg

SEQ ID NO: 103213 - DNA, 16 bp, H. sapiens
gagtcttggttttctc

SEQ ID NO: 103214 - DNA, 16 bp, H. sapiens
gagtctttctatgttg

SEQ ID NO: 103215 - DNA, 16 bp, H. sapiens
gagtctttctctgtca

SEQ ID NO: 103216 - DNA, 16 bp, H. sapiens
gagtcttttcaataaa

SEQ ID NO: 103217 - DNA, 16 bp, H. sapiens
gagtgaaactctgtcc

SEQ ID NO: 103218 - DNA, 16 bp, H. sapiens
gagtgaaactctgttt

SEQ ID NO: 103219 - DNA, 16 bp, H. sapiens
gagtgaaactgcatct

SEQ ID NO: 103220 - DNA, 16 bp, H. sapiens
gagtgaaattggaatg

SEQ ID NO: 103221 - DNA, 16 bp, H. sapiens
gagtgaagctgcagaa

SEQ ID NO: 103222 - DNA, 18 bp, H. sapiens
gagtgaagctgcagatct

SEQ ID NO: 103223 - DNA, 16 bp, H. sapiens
gagtgaaggagactcc

SEQ ID NO: 103224 - DNA, 16 bp, H. sapiens
gagtgaaggaggcttg

SEQ ID NO: 103225 - DNA, 16 bp, H. sapiens
gagtgacaacatgtgg

SEQ ID NO: 103226 - DNA, 16 bp, H. sapiens
gagtgacacaagcact

SEQ ID NO: 103227 - DNA, 16 bp, H. sapiens
gagtgacatgatctga

SEQ ID NO: 103228 - DNA, 16 bp, H. sapiens
gagtgacatggtcaga

SEQ ID NO: 103229 - DNA, 16 bp, H. sapiens
gagtgactgctgatgg

SEQ ID NO: 103230 - DNA, 16 bp, H. sapiens
gagtgagaacgtgcag

SEQ ID NO: 103231 - DNA, 16 bp, H. sapiens
gagtgagaacttgcgg

SEQ ID NO: 103232 - DNA, 16 bp, H. sapiens
gagtgagaccagccct

SEQ ID NO: 103233 - DNA, 16 bp, H. sapiens
gagtgagacccagtct

SEQ ID NO: 103234 - DNA, 16 bp, H. sapiens
gagtgagaccctgtcc

SEQ ID NO: 103235 - DNA, 16 bp, H. sapiens
gagtgagactcctgtc

SEQ ID NO: 103236 - DNA, 16 bp, H. sapiens
gagtgagactctgtcc

SEQ ID NO: 103237 - DNA, 16 bp, H. sapiens
gagtgagactgtttct

SEQ ID NO: 103238 - DNA, 16 bp, H. sapiens
gagtgagagagtgaga

SEQ ID NO: 103239 - DNA, 16 bp, H. sapiens
gagtgagatgatattt

SEQ ID NO: 103240 - DNA, 16 bp, H. sapiens
gagtgagatggagtga

SEQ ID NO: 103241 - DNA, 16 bp, H. sapiens
gagtgagcagcagcag

SEQ ID NO: 103242 - DNA, 16 bp, H. sapiens
gagtgagccctcacca

SEQ ID NO: 103243 - DNA, 16 bp, H. sapiens
gagtgaggagggggcc

SEQ ID NO: 103244 - DNA, 16 bp, H. sapiens
gagtgaggcagggaag

SEQ ID NO: 103245 - DNA, 16 bp, H. sapiens
gagtgaggccctatct

SEQ ID NO: 103246 - DNA, 16 bp, H. sapiens
gagtgaggccctgtct

SEQ ID NO: 103247 - DNA, 16 bp, H. sapiens
gagtgaggctgtgtct

SEQ ID NO: 103248 - DNA, 16 bp, H. sapiens
gagtgagggttgaaaa

SEQ ID NO: 103249 - DNA, 16 bp, H. sapiens
gagtgagtgagtgagt

SEQ ID NO: 103250 - DNA, 16 bp, H. sapiens
gagtgagttctcatga

SEQ ID NO: 103251 - DNA, 16 bp, H. sapiens
gagtgagtttcttagt

SEQ ID NO: 103252 - DNA, 16 bp, H. sapiens
gagtgataaaaatatt

SEQ ID NO: 103253 - DNA, 16 bp, H. sapiens
gagtgataaaaatgtt

SEQ ID NO: 103254 - DNA, 16 bp, H. sapiens
gagtgatcatagctca

SEQ ID NO: 103255 - DNA, 16 bp, H. sapiens
gagtgatgagagtgga

SEQ ID NO: 103256 - DNA, 16 bp, H. sapiens
gagtgatggggagcag

SEQ ID NO: 103257 - DNA, 16 bp, H. sapiens
gagtgattgaaagagg

SEQ ID NO: 103258 - DNA, 16 bp, H. sapiens
gagtgcaaacagctca

SEQ ID NO: 103259 - DNA, 16 bp, H. sapiens
gagtgcaagccccaag

SEQ ID NO: 103260 - DNA, 16 bp, H. sapiens
gagtgcaatgacacta

SEQ ID NO: 103261 - DNA, 16 bp, H. sapiens
gagtgcaatgatacaa

SEQ ID NO: 103262 - DNA, 16 bp, H. sapiens
gagtgcaatggaacaa

SEQ ID NO: 103263 - DNA, 16 bp, H. sapiens
gagtgcaatggcaaaa

SEQ ID NO: 103264 - DNA, 16 bp, H. sapiens
gagtgcactggcagga

SEQ ID NO: 103265 - DNA, 16 bp, H. sapiens
gagtgcagaaatctct

SEQ ID NO: 103266 - DNA, 16 bp, H. sapiens
gagtgcagcagtgcag

SEQ ID NO: 103267 - DNA, 16 bp, H. sapiens
gagtgcagggagggag

SEQ ID NO: 103268 - DNA, 16 bp, H. sapiens
gagtgcagtgattgtg

SEQ ID NO: 103269 - DNA, 16 bp, H. sapiens
gagtgcagtggagcaa

SEQ ID NO: 103270 - DNA, 16 bp, H. sapiens
gagtgcagtggcgtgg

SEQ ID NO: 103271 - DNA, 16 bp, H. sapiens
gagtgcagtggtggct

SEQ ID NO: 103272 - DNA, 16 bp, H. sapiens
gagtgcagtgtggcaa

SEQ ID NO: 103273 - DNA, 16 bp, H. sapiens
gagtgccccctggtgg

SEQ ID NO: 103274 - DNA, 16 bp, H. sapiens
gagtgcctactgcatg

SEQ ID NO: 103275 - DNA, 16 bp, H. sapiens
gagtgcctgctctgtg

SEQ ID NO: 103276 - DNA, 16 bp, H. sapiens
gagtgcctgtgtgtct

SEQ ID NO: 103277 - DNA, 16 bp, H. sapiens
gagtgcgactccatct

SEQ ID NO: 103278 - DNA, 16 bp, H. sapiens
gagtgctcctgtattg

SEQ ID NO: 103279 - DNA, 16 bp, H. sapiens
gagtgctgaggaggaa

SEQ ID NO: 103280 - DNA, 16 bp, H. sapiens
gagtgctgctgtaaag

SEQ ID NO: 103281 - DNA, 20 bp, H. sapiens
gagtgctgggattacaggca

SEQ ID NO: 103282 - DNA, 16 bp, H. sapiens
gagtgcttgagcctgg

SEQ ID NO: 103283 - DNA, 16 bp, H. sapiens
gagtgcttgctatgtg

SEQ ID NO: 103284 - DNA, 16 bp, H. sapiens
gagtggaaaaagatat

SEQ ID NO: 103285 - DNA, 16 bp, H. sapiens
gagtggaaaggacttt

SEQ ID NO: 103286 - DNA, 16 bp, H. sapiens
gagtggaaataaatga

SEQ ID NO: 103287 - DNA, 16 bp, H. sapiens
gagtggaagcagcttg

SEQ ID NO: 103288 - DNA, 16 bp, H. sapiens
gagtggaattcctggg

SEQ ID NO: 103289 - DNA, 16 bp, H. sapiens
gagtggacatttggga

SEQ ID NO: 103290 - DNA, 16 bp, H. sapiens
gagtggagccctgctg

SEQ ID NO: 103291 - DNA, 16 bp, H. sapiens
gagtggaggagtgagt

SEQ ID NO: 103292 - DNA, 16 bp, H. sapiens
gagtggatgaagaaac

SEQ ID NO: 103293 - DNA, 16 bp, H. sapiens
gagtggcagagctggg

SEQ ID NO: 103294 - DNA, 16 bp, H. sapiens
gagtggctcacacctg

SEQ ID NO: 103295 - DNA, 16 bp, H. sapiens
gagtggctcatgcctg

SEQ ID NO: 103296 - DNA, 16 bp, H. sapiens
gagtggctgaggcagg

SEQ ID NO: 103297 - DNA, 16 bp, H. sapiens
gagtggctgctgccat

SEQ ID NO: 103298 - DNA, 16 bp, H. sapiens
gagtggctgtggcagt

SEQ ID NO: 103299 - DNA, 16 bp, H. sapiens
gagtggctgttgagaa

SEQ ID NO: 103300 - DNA, 16 bp, H. sapiens
gagtggcttagctggg

SEQ ID NO: 103301 - DNA, 16 bp, H. sapiens
gagtggctttgagtga

SEQ ID NO: 103302 - DNA, 16 bp, H. sapiens
gagtgggaaggactgt

SEQ ID NO: 103303 - DNA, 16 bp, H. sapiens
gagtgggagaagatat

SEQ ID NO: 103304 - DNA, 16 bp, H. sapiens
gagtggggagcaggag

SEQ ID NO: 103305 - DNA, 16 bp, H. sapiens
gagtggggcagggaag

SEQ ID NO: 103306 - DNA, 27 bp, H. sapiens
gagtggtcattccttcctcacagtaca

SEQ ID NO: 103307 - DNA, 16 bp, H. sapiens
gagtggtggagctggg

SEQ ID NO: 103308 - DNA, 16 bp, H. sapiens
gagtggtggaggtggc

SEQ ID NO: 103309 - DNA, 16 bp, H. sapiens
gagtggtggcaggcac

SEQ ID NO: 103310 - DNA, 16 bp, H. sapiens
gagtggtggcatgtgc

SEQ ID NO: 103311 - DNA, 16 bp, H. sapiens
gagtggttaaaaaaaa

SEQ ID NO: 103312 - DNA, 16 bp, H. sapiens
gagtgtagtggcacaa

SEQ ID NO: 103313 - DNA, 16 bp, H. sapiens
gagtgtcaatcagcca

SEQ ID NO: 103314 - DNA, 16 bp, H. sapiens
gagtgtcactctgtca

SEQ ID NO: 103315 - DNA, 16 bp, H. sapiens
gagtgtctctctgtcg

SEQ ID NO: 103316 - DNA, 16 bp, H. sapiens
gagtgtctctgcctgg

SEQ ID NO: 103317 - DNA, 16 bp, H. sapiens
gagtgtctcttagcat

SEQ ID NO: 103318 - DNA, 16 bp, H. sapiens
gagtgtgaatgtgtgt

SEQ ID NO: 103319 - DNA, 16 bp, H. sapiens
gagtgtgactgtgtgt

SEQ ID NO: 103320 - DNA, 16 bp, H. sapiens
gagtgtgagaccctgt

SEQ ID NO: 103321 - DNA, 16 bp, H. sapiens
gagtgtgaggcaggag

SEQ ID NO: 103322 - DNA, 16 bp, H. sapiens
gagtgtgaggcctccc

SEQ ID NO: 103323 - DNA, 16 bp, H. sapiens
gagtgtgaggctgcag

SEQ ID NO: 103324 - DNA, 16 bp, H. sapiens
gagtgtgatgctcccc

SEQ ID NO: 103325 - DNA, 16 bp, H. sapiens
gagtgtgcgtgtgtgc

SEQ ID NO: 103326 - DNA, 16 bp, H. sapiens
gagtgtggctgcagtg

SEQ ID NO: 103327 - DNA, 16 bp, H. sapiens
gagtgtggggcctgcc

SEQ ID NO: 103328 - DNA, 16 bp, H. sapiens
gagtgtggtggcaggc

SEQ ID NO: 103329 - DNA, 16 bp, H. sapiens
gagtgtgtctgtgtgt

SEQ ID NO: 103330 - DNA, 16 bp, H. sapiens
gagtgtgtgagtgtga

SEQ ID NO: 103331 - DNA, 16 bp, H. sapiens
gagtgtgtgagtgtgt

SEQ ID NO: 103332 - DNA, 16 bp, H. sapiens
gagtgtgtgccatgtg

SEQ ID NO: 103333 - DNA, 16 bp, H. sapiens
gagtgtgtgtgagaga

SEQ ID NO: 103334 - DNA, 16 bp, H. sapiens
gagtgtgtgtgtgcgc

SEQ ID NO: 103335 - DNA, 16 bp, H. sapiens
gagtgttgctctgtca

SEQ ID NO: 103336 - DNA, 16 bp, H. sapiens
gagtgtttgaaaactg

SEQ ID NO: 103337 - DNA, 16 bp, H. sapiens
gagtgttttccaactt

SEQ ID NO: 103338 - DNA, 16 bp, H. sapiens
gagttaaataaaatct

SEQ ID NO: 103339 - DNA, 16 bp, H. sapiens
gagttaaatctttgtt

SEQ ID NO: 103340 - DNA, 16 bp, H. sapiens
gagttaccacacccag

SEQ ID NO: 103341 - DNA, 16 bp, H. sapiens
gagttcaaaatgggtc

SEQ ID NO: 103342 - DNA, 16 bp, H. sapiens
gagttcaagacaggcc

SEQ ID NO: 103343 - DNA, 16 bp, H. sapiens
gagttcaaggtcacag

SEQ ID NO: 103344 - DNA, 16 bp, H. sapiens
gagttcaagtccagtc

SEQ ID NO: 103345 - DNA, 16 bp, H. sapiens
gagttcaagtggttct

SEQ ID NO: 103346 - DNA, 16 bp, H. sapiens
gagttcacagtctagt

SEQ ID NO: 103347 - DNA, 16 bp, H. sapiens
gagttcactcttgttg

SEQ ID NO: 103348 - DNA, 16 bp, H. sapiens
gagttcagagagcttc

SEQ ID NO: 103349 - DNA, 16 bp, H. sapiens
gagttcagcaaggtca

SEQ ID NO: 103350 - DNA, 16 bp, H. sapiens
gagttccactcttgtt

SEQ ID NO: 103351 - DNA, 16 bp, H. sapiens
gagttccagaaggaga

SEQ ID NO: 103352 - DNA, 16 bp, H. sapiens
gagttccagacctgcc

SEQ ID NO: 103353 - DNA, 16 bp, H. sapiens
gagttcctcatctcca

SEQ ID NO: 103354 - DNA, 16 bp, H. sapiens
gagttcctgaccagcc

SEQ ID NO: 103355 - DNA, 16 bp, H. sapiens
gagttcctgctgctcc

SEQ ID NO: 103356 - DNA, 16 bp, H. sapiens
gagttccttcctcagg

SEQ ID NO: 103357 - DNA, 20 bp, H. sapiens
gagttcgagacaagcctggt

SEQ ID NO: 103358 - DNA, 16 bp, H. sapiens
gagttctagagctggg

SEQ ID NO: 103359 - DNA, 16 bp, H. sapiens
gagttctcactatgtt

SEQ ID NO: 103360 - DNA, 17 bp, H. sapiens
gagttctcatgagatct

SEQ ID NO: 103361 - DNA, 16 bp, H. sapiens
gagttctccaactttg

SEQ ID NO: 103362 - DNA, 16 bp, H. sapiens
gagttctgtccctgag

SEQ ID NO: 103363 - DNA, 16 bp, H. sapiens
gagttcttcatatatt

SEQ ID NO: 103364 - DNA, 16 bp, H. sapiens
gagttcttggtcatga

SEQ ID NO: 103365 - DNA, 16 bp, H. sapiens
gagttctttacatatt

SEQ ID NO: 103366 - DNA, 16 bp, H. sapiens
gagttctttatatgtt

SEQ ID NO: 103367 - DNA, 16 bp, H. sapiens
gagttctttatgtatt

SEQ ID NO: 103368 - DNA, 16 bp, H. sapiens
gagttgaaaaatgcaa

SEQ ID NO: 103369 - DNA, 16 bp, H. sapiens
gagttgaaaacttaca

SEQ ID NO: 103370 - DNA, 16 bp, H. sapiens
gagttgaagctgtctt

SEQ ID NO: 103371 - DNA, 16 bp, H. sapiens
gagttgaatgcaagca

SEQ ID NO: 103372 - DNA, 16 bp, H. sapiens
gagttgagactttggg

SEQ ID NO: 103373 - DNA, 16 bp, H. sapiens
gagttgcttcacttag

SEQ ID NO: 103374 - DNA, 16 bp, H. sapiens
gagttggaatttgaac

SEQ ID NO: 103375 - DNA, 16 bp, H. sapiens
gagttggcaaactatg

SEQ ID NO: 103376 - DNA, 16 bp, H. sapiens
gagttgggaagagatg

SEQ ID NO: 103377 - DNA, 16 bp, H. sapiens
gagttgggaggatcac

SEQ ID NO: 103378 - DNA, 16 bp, H. sapiens
gagttggggaggagtc

SEQ ID NO: 103379 - DNA, 16 bp, H. sapiens
gagttgtcatgaggat

SEQ ID NO: 103380 - DNA, 17 bp, H. sapiens
gagttgttcattcctcc

SEQ ID NO: 103381 - DNA, 18 bp, H. sapiens
gagttgttcattcctcct

SEQ ID NO: 103382 - DNA, 16 bp, H. sapiens
gagttgtttccttgat

SEQ ID NO: 103383 - DNA, 16 bp, H. sapiens
gagttgtttttcagtt

SEQ ID NO: 103384 - DNA, 16 bp, H. sapiens
gagtttaagagcagcc

SEQ ID NO: 103385 - DNA, 16 bp, H. sapiens
gagtttaattgagcaa

SEQ ID NO: 103386 - DNA, 16 bp, H. sapiens
gagtttacagtgagct

SEQ ID NO: 103387 - DNA, 16 bp, H. sapiens
gagtttacattctaat

SEQ ID NO: 103388 - DNA, 16 bp, H. sapiens
gagtttatgaccagcc

SEQ ID NO: 103389 - DNA, 16 bp, H. sapiens
gagtttatgctaatga

SEQ ID NO: 103390 - DNA, 16 bp, H. sapiens
gagtttattgtagatt

SEQ ID NO: 103391 - DNA, 16 bp, H. sapiens
gagtttcaccacgttg

SEQ ID NO: 103392 - DNA, 16 bp, H. sapiens
gagtttcaccatatta

SEQ ID NO: 103393 - DNA, 16 bp, H. sapiens
gagtttcactctgtca

SEQ ID NO: 103394 - DNA, 16 bp, H. sapiens
gagtttcactcttggt

SEQ ID NO: 103395 - DNA, 16 bp, H. sapiens
gagtttcactcttgtc

SEQ ID NO: 103396 - DNA, 16 bp, H. sapiens
gagtttcagaacagcc

SEQ ID NO: 103397 - DNA, 16 bp, H. sapiens
gagtttcagtttgaga

SEQ ID NO: 103398 - DNA, 16 bp, H. sapiens
gagtttccccatgttg

SEQ ID NO: 103399 - DNA, 16 bp, H. sapiens
gagtttccctctgtcg

SEQ ID NO: 103400 - DNA, 16 bp, H. sapiens
gagtttcgctcttggt

SEQ ID NO: 103401 - DNA, 16 bp, H. sapiens
gagtttcgctcttgtc

SEQ ID NO: 103402 - DNA, 21 bp, H. sapiens
gagtttcgctcttgttgccca

SEQ ID NO: 103403 - DNA, 16 bp, H. sapiens
gagtttcgctgttgtt

SEQ ID NO: 103404 - DNA, 16 bp, H. sapiens
gagtttctatttcttc

SEQ ID NO: 103405 - DNA, 16 bp, H. sapiens
gagtttctgaatcctg

SEQ ID NO: 103406 - DNA, 16 bp, H. sapiens
gagtttcttccatctg

SEQ ID NO: 103407 - DNA, 17 bp, H. sapiens
gagtttcttccttctgg

SEQ ID NO: 103408 - DNA, 16 bp, H. sapiens
gagtttctttttcctt

SEQ ID NO: 103409 - DNA, 16 bp, H. sapiens
gagtttgaaaccaccc

SEQ ID NO: 103410 - DNA, 16 bp, H. sapiens
gagtttgaaactggcc

SEQ ID NO: 103411 - DNA, 16 bp, H. sapiens
gagtttgaatcttggc

SEQ ID NO: 103412 - DNA, 16 bp, H. sapiens
gagtttgacagcagcc

SEQ ID NO: 103413 - DNA, 16 bp, H. sapiens
gagtttgaccagcctg

SEQ ID NO: 103414 - DNA, 16 bp, H. sapiens
gagtttgagaaaaatt

SEQ ID NO: 103415 - DNA, 16 bp, H. sapiens
gagtttgagaagaatt

SEQ ID NO: 103416 - DNA, 17 bp, H. sapiens
gagtttgagaccagcca

SEQ ID NO: 103417 - DNA, 16 bp, H. sapiens
gagtttgagaccagct

SEQ ID NO: 103418 - DNA, 16 bp, H. sapiens
gagtttgagacccagc

SEQ ID NO: 103419 - DNA, 17 bp, H. sapiens
gagtttgagacgagcct

SEQ ID NO: 103420 - DNA, 16 bp, H. sapiens
gagtttgagatcagcc

SEQ ID NO: 103421 - DNA, 16 bp, H. sapiens
gagtttgagttcagcc

SEQ ID NO: 103422 - DNA, 16 bp, H. sapiens
gagtttgcagccagcc

SEQ ID NO: 103423 - DNA, 16 bp, H. sapiens
gagtttgcagtcagcc

SEQ ID NO: 103424 - DNA, 16 bp, H. sapiens
gagtttgcagtgagcc

SEQ ID NO: 103425 - DNA, 16 bp, H. sapiens
gagtttggctctgtca

SEQ ID NO: 103426 - DNA, 16 bp, H. sapiens
gagtttgtcaccacca

SEQ ID NO: 103427 - DNA, 16 bp, H. sapiens
gagtttgtgcagagaa

SEQ ID NO: 103428 - DNA, 21 bp, H. sapiens
gagtttgttccttctgatgtt

SEQ ID NO: 103429 - DNA, 16 bp, H. sapiens
gagttttaaaatttga

SEQ ID NO: 103430 - DNA, 16 bp, H. sapiens
gagttttaccatgtta

SEQ ID NO: 103431 - DNA, 16 bp, H. sapiens
gagttttagtttgatt

SEQ ID NO: 103432 - DNA, 16 bp, H. sapiens
gagttttattttaaaa

SEQ ID NO: 103433 - DNA, 16 bp, H. sapiens
gagttttgaaggatga

SEQ ID NO: 103434 - DNA, 16 bp, H. sapiens
gagttttgatgggaaa

SEQ ID NO: 103435 - DNA, 16 bp, H. sapiens
gagttttgccatgttg

SEQ ID NO: 103436 - DNA, 16 bp, H. sapiens
gagttttgccattttg

SEQ ID NO: 103437 - DNA, 16 bp, H. sapiens
gagttttgcccaggcc

SEQ ID NO: 103438 - DNA, 16 bp, H. sapiens
gagttttgctatgttg

SEQ ID NO: 103439 - DNA, 16 bp, H. sapiens
gagttttgctcttgta

SEQ ID NO: 103440 - DNA, 16 bp, H. sapiens
gagttttgctcttgtc

SEQ ID NO: 103441 - DNA, 16 bp, H. sapiens
gagttttggaggagac

SEQ ID NO: 103442 - DNA, 23 bp, H. sapiens
gagttttgggtccatggataaaa

SEQ ID NO: 103443 - DNA, 16 bp, H. sapiens
gagtttttaaaataaa

SEQ ID NO: 103444 - DNA, 16 bp, H. sapiens
gagtttttaatatgaa

SEQ ID NO: 103445 - DNA, 16 bp, H. sapiens
gagtttttatcaggaa

SEQ ID NO: 103446 - DNA, 16 bp, H. sapiens
gagtttttctcttgtt

SEQ ID NO: 103447 - DNA, 16 bp, H. sapiens
gagtttttgctcttgt

SEQ ID NO: 103448 - DNA, 16 bp, H. sapiens
gataaaaaactacata

SEQ ID NO: 103449 - DNA, 16 bp, H. sapiens
gataaaaactacaaag

SEQ ID NO: 103450 - DNA, 16 bp, H. sapiens
gataaaaagtatagta

SEQ ID NO: 103451 - DNA, 16 bp, H. sapiens
gataaaaatggcactt

SEQ ID NO: 103452 - DNA, 16 bp, H. sapiens
gataaaaatgttctat

SEQ ID NO: 103453 - DNA, 16 bp, H. sapiens
gataaaacaaatgtaa

SEQ ID NO: 103454 - DNA, 16 bp, H. sapiens
gataaaacaagttgca

SEQ ID NO: 103455 - DNA, 16 bp, H. sapiens
gataaaacagagttta

SEQ ID NO: 103456 - DNA, 22 bp, H. sapiens
gataaaaccacaaagatgggga

SEQ ID NO: 103457 - DNA, 16 bp, H. sapiens
gataaaagcaaaggca

SEQ ID NO: 103458 - DNA, 16 bp, H. sapiens
gataaaagccattcta

SEQ ID NO: 103459 - DNA, 16 bp, H. sapiens
gataaaatacagaaca

SEQ ID NO: 103460 - DNA, 17 bp, H. sapiens
gataaaatactggcaaa

SEQ ID NO: 103461 - DNA, 16 bp, H. sapiens
gataaaatattttgat

SEQ ID NO: 103462 - DNA, 16 bp, H. sapiens
gataaaatgacacaga

SEQ ID NO: 103463 - DNA, 16 bp, H. sapiens
gataaaattcaacagc

SEQ ID NO: 103464 - DNA, 16 bp, H. sapiens
gataaaattgcacaga

SEQ ID NO: 103465 - DNA, 16 bp, H. sapiens
gataaaattttattac

SEQ ID NO: 103466 - DNA, 16 bp, H. sapiens
gataaacaaaactgat

SEQ ID NO: 103467 - DNA, 16 bp, H. sapiens
gataaacaaaatcaat

SEQ ID NO: 103468 - DNA, 16 bp, H. sapiens
gataaacaacttcagt

SEQ ID NO: 103469 - DNA, 16 bp, H. sapiens
gataaacacagatgca

SEQ ID NO: 103470 - DNA, 16 bp, H. sapiens
gataaacccaaagaaa

SEQ ID NO: 103471 - DNA, 16 bp, H. sapiens
gataaagaaaaatgtg

SEQ ID NO: 103472 - DNA, 16 bp, H. sapiens
gataaagaaaatgtat

SEQ ID NO: 103473 - DNA, 16 bp, H. sapiens
gataaagaaaatgtca

SEQ ID NO: 103474 - DNA, 16 bp, H. sapiens
gataaagaaaatgtgt

SEQ ID NO: 103475 - DNA, 16 bp, H. sapiens
gataaagaaaatgttg

SEQ ID NO: 103476 - DNA, 16 bp, H. sapiens
gataaagaaaatttgg

SEQ ID NO: 103477 - DNA, 16 bp, H. sapiens
gataaagaaggacatt

SEQ ID NO: 103478 - DNA, 16 bp, H. sapiens
gataaagagttaatat

SEQ ID NO: 103479 - DNA, 16 bp, H. sapiens
gataaataaagcaaat

SEQ ID NO: 103480 - DNA, 16 bp, H. sapiens
gataaatatctttaaa

SEQ ID NO: 103481 - DNA, 16 bp, H. sapiens
gataaatatttattga

SEQ ID NO: 103482 - DNA, 16 bp, H. sapiens
gataaatatttgaata

SEQ ID NO: 103483 - DNA, 16 bp, H. sapiens
gataaatatttgttga

SEQ ID NO: 103484 - DNA, 16 bp, H. sapiens
gataaatggatgaaca

SEQ ID NO: 103485 - DNA, 16 bp, H. sapiens
gataaatgtttgaggt

SEQ ID NO: 103486 - DNA, 16 bp, H. sapiens
gataaattcatggaaa

SEQ ID NO: 103487 - DNA, 16 bp, H. sapiens
gataacagccatccta

SEQ ID NO: 103488 - DNA, 16 bp, H. sapiens
gataacataagagaaa

SEQ ID NO: 103489 - DNA, 17 bp, H. sapiens
gataactagaataacca

SEQ ID NO: 103490 - DNA, 16 bp, H. sapiens
gataagaaattactta

SEQ ID NO: 103491 - DNA, 16 bp, H. sapiens
gataagaacacatgga

SEQ ID NO: 103492 - DNA, 16 bp, H. sapiens
gataagaactcatgaa

SEQ ID NO: 103493 - DNA, 16 bp, H. sapiens
gataaggaaactgaga

SEQ ID NO: 103494 - DNA, 16 bp, H. sapiens
gataaggaaattgaga

SEQ ID NO: 103495 - DNA, 16 bp, H. sapiens
gataaggaagctgaag

SEQ ID NO: 103496 - DNA, 16 bp, H. sapiens
gataagggatgaaata

SEQ ID NO: 103497 - DNA, 16 bp, H. sapiens
gataagtgaaatgaat

SEQ ID NO: 103498 - DNA, 16 bp, H. sapiens
gataagtggaaaagag

SEQ ID NO: 103499 - DNA, 16 bp, H. sapiens
gataatacataaatga

SEQ ID NO: 103500 - DNA, 16 bp, H. sapiens
gataatacatgtaaag

SEQ ID NO: 103501 - DNA, 16 bp, H. sapiens
gataatatgattttat

SEQ ID NO: 103502 - DNA, 16 bp, H. sapiens
gataatcatgttgttt

SEQ ID NO: 103503 - DNA, 16 bp, H. sapiens
gataatcgcttgaacc

SEQ ID NO: 103504 - DNA, 16 bp, H. sapiens
gataatgataataatg

SEQ ID NO: 103505 - DNA, 16 bp, H. sapiens
gataatgatgatgaca

SEQ ID NO: 103506 - DNA, 16 bp, H. sapiens
gataatgatgtgtcaa

SEQ ID NO: 103507 - DNA, 16 bp, H. sapiens
gataatggcttccaga

SEQ ID NO: 103508 - DNA, 16 bp, H. sapiens
gataatggggaaaatg

SEQ ID NO: 103509 - DNA, 16 bp, H. sapiens
gataatgtatgtaaag

SEQ ID NO: 103510 - DNA, 16 bp, H. sapiens
gataattctttgttgt

SEQ ID NO: 103511 - DNA, 16 bp, H. sapiens
gataatttgacttctt

SEQ ID NO: 103512 - DNA, 16 bp, H. sapiens
gataatttgttatggc

SEQ ID NO: 103513 - DNA, 16 bp, H. sapiens
gataatttttaaaact

SEQ ID NO: 103514 - DNA, 16 bp, H. sapiens
gatacaaaaacagaca

SEQ ID NO: 103515 - DNA, 16 bp, H. sapiens
gatacaaaatcaacat

SEQ ID NO: 103516 - DNA, 16 bp, H. sapiens
gatacaaaatcattgt

SEQ ID NO: 103517 - DNA, 16 bp, H. sapiens
gatacaaaattttagt

SEQ ID NO: 103518 - DNA, 16 bp, H. sapiens
gatacaaacacatgga

SEQ ID NO: 103519 - DNA, 16 bp, H. sapiens
gatacaacaaaagcag

SEQ ID NO: 103520 - DNA, 16 bp, H. sapiens
gatacaacaattataa

SEQ ID NO: 103521 - DNA, 16 bp, H. sapiens
gatacaacggactttg

SEQ ID NO: 103522 - DNA, 16 bp, H. sapiens
gatacaagataaatat

SEQ ID NO: 103523 - DNA, 16 bp, H. sapiens
gatacaagttccttat

SEQ ID NO: 103524 - DNA, 16 bp, H. sapiens
gatacacaaatggtca

SEQ ID NO: 103525 - DNA, 16 bp, H. sapiens
gatacacagatagata

SEQ ID NO: 103526 - DNA, 16 bp, H. sapiens
gatacacatacacaca

SEQ ID NO: 103527 - DNA, 16 bp, H. sapiens
gatacaccaatcagac

SEQ ID NO: 103528 - DNA, 16 bp, H. sapiens
gatacagaaactgagg

SEQ ID NO: 103529 - DNA, 16 bp, H. sapiens
gatacagagtttccac

SEQ ID NO: 103530 - DNA, 16 bp, H. sapiens
gatacagatacagata

SEQ ID NO: 103531 - DNA, 16 bp, H. sapiens
gatacagtgagaaggc

SEQ ID NO: 103532 - DNA, 16 bp, H. sapiens
gatacagtttggatat

SEQ ID NO: 103533 - DNA, 16 bp, H. sapiens
gatacagttttggatg

SEQ ID NO: 103534 - DNA, 16 bp, H. sapiens
gatacatttaaagcag

SEQ ID NO: 103535 - DNA, 16 bp, H. sapiens
gatacattttgagaaa

SEQ ID NO: 103536 - DNA, 16 bp, H. sapiens
gataccaaaaaatgtg

SEQ ID NO: 103537 - DNA, 16 bp, H. sapiens
gataccaaaggatgac

SEQ ID NO: 103538 - DNA, 16 bp, H. sapiens
gataccaagggatgac

SEQ ID NO: 103539 - DNA, 16 bp, H. sapiens
gataccagctcagcca

SEQ ID NO: 103540 - DNA, 16 bp, H. sapiens
gataccattccttctg

SEQ ID NO: 103541 - DNA, 16 bp, H. sapiens
gatacctccagatttg

SEQ ID NO: 103542 - DNA, 16 bp, H. sapiens
gatacggtttggattt

SEQ ID NO: 103543 - DNA, 16 bp, H. sapiens
gatactatctgagact

SEQ ID NO: 103544 - DNA, 16 bp, H. sapiens
gatactatgcttttct

SEQ ID NO: 103545 - DNA, 16 bp, H. sapiens
gatactctttcttcca

SEQ ID NO: 103546 - DNA, 16 bp, H. sapiens
gatactgattctttct

SEQ ID NO: 103547 - DNA, 16 bp, H. sapiens
gatagaaatagagata

SEQ ID NO: 103548 - DNA, 16 bp, H. sapiens
gatagaagattcattc

SEQ ID NO: 103549 - DNA, 16 bp, H. sapiens
gatagaaggaaaacta

SEQ ID NO: 103550 - DNA, 16 bp, H. sapiens
gatagaaggaacatac

SEQ ID NO: 103551 - DNA, 16 bp, H. sapiens
gatagacttgattaag

SEQ ID NO: 103552 - DNA, 16 bp, H. sapiens
gatagagatatggaca

SEQ ID NO: 103553 - DNA, 16 bp, H. sapiens
gatagagcaagactcc

SEQ ID NO: 103554 - DNA, 16 bp, H. sapiens
gatagagtgagaccct

SEQ ID NO: 103555 - DNA, 16 bp, H. sapiens
gatagagtgagactcc

SEQ ID NO: 103556 - DNA, 18 bp, H. sapiens
gatagatagatagataga

SEQ ID NO: 103557 - DNA, 16 bp, H. sapiens
gatagataggtagatg

SEQ ID NO: 103558 - DNA, 16 bp, H. sapiens
gatagatgaatgaatg

SEQ ID NO: 103559 - DNA, 16 bp, H. sapiens
gatagatggatgcatg

SEQ ID NO: 103560 - DNA, 16 bp, H. sapiens
gatagcattgaatctg

SEQ ID NO: 103561 - DNA, 16 bp, H. sapiens
gatagctcatttcatt

SEQ ID NO: 103562 - DNA, 16 bp, H. sapiens
gataggaaagaaaaac

SEQ ID NO: 103563 - DNA, 16 bp, H. sapiens
gataggaagaataagt

SEQ ID NO: 103564 - DNA, 16 bp, H. sapiens
gatagggtctcgcttt

SEQ ID NO: 103565 - DNA, 16 bp, H. sapiens
gatagggtcttgctct

SEQ ID NO: 103566 - DNA, 16 bp, H. sapiens
gataggtgcagcaaaa

SEQ ID NO: 103567 - DNA, 16 bp, H. sapiens
gatagtactgaaccct

SEQ ID NO: 103568 - DNA, 16 bp, H. sapiens
gatagttcaacataca

SEQ ID NO: 103569 - DNA, 16 bp, H. sapiens
gatagttgtacatatg

SEQ ID NO: 103570 - DNA, 16 bp, H. sapiens
gatagtttataaagaa

SEQ ID NO: 103571 - DNA, 16 bp, H. sapiens
gatagtttctattgct

SEQ ID NO: 103572 - DNA, 16 bp, H. sapiens
gatagtttcttttgtg

SEQ ID NO: 103573 - DNA, 16 bp, H. sapiens
gatagtttgaaaatat

SEQ ID NO: 103574 - DNA, 16 bp, H. sapiens
gatagtttgacttcct

SEQ ID NO: 103575 - DNA, 16 bp, H. sapiens
gatatacacacacaca

SEQ ID NO: 103576 - DNA, 16 bp, H. sapiens
gatatacaccaatgga

SEQ ID NO: 103577 - DNA, 16 bp, H. sapiens
gatatacatatataca

SEQ ID NO: 103578 - DNA, 16 bp, H. sapiens
gatatacccatgtaac

SEQ ID NO: 103579 - DNA, 16 bp, H. sapiens
gatatactttggatat

SEQ ID NO: 103580 - DNA, 16 bp, H. sapiens
gatatagaaaatgtgg

SEQ ID NO: 103581 - DNA, 16 bp, H. sapiens
gatatagatagataca

SEQ ID NO: 103582 - DNA, 16 bp, H. sapiens
gatatagatatatata

SEQ ID NO: 103583 - DNA, 16 bp, H. sapiens
gatatatacaaatata

SEQ ID NO: 103584 - DNA, 16 bp, H. sapiens
gatatatacatatata

SEQ ID NO: 103585 - DNA, 16 bp, H. sapiens
gatatatatacacaca

SEQ ID NO: 103586 - DNA, 16 bp, H. sapiens
gatatatcattgtggt

SEQ ID NO: 103587 - DNA, 16 bp, H. sapiens
gatatatgctacaata

SEQ ID NO: 103588 - DNA, 16 bp, H. sapiens
gatatatttttcattt

SEQ ID NO: 103589 - DNA, 16 bp, H. sapiens
gatatcacctcacact

SEQ ID NO: 103590 - DNA, 16 bp, H. sapiens
gatatccatcacttca

SEQ ID NO: 103591 - DNA, 16 bp, H. sapiens
gatatcccctttatct

SEQ ID NO: 103592 - DNA, 16 bp, H. sapiens
gatatcctttcttttg

SEQ ID NO: 103593 - DNA, 16 bp, H. sapiens
gatatctatctatcta

SEQ ID NO: 103594 - DNA, 16 bp, H. sapiens
gatatctcaaagaact

SEQ ID NO: 103595 - DNA, 16 bp, H. sapiens
gatatctcattatata

SEQ ID NO: 103596 - DNA, 16 bp, H. sapiens
gatatctgcattctca

SEQ ID NO: 103597 - DNA, 16 bp, H. sapiens
gatatctttctaactt

SEQ ID NO: 103598 - DNA, 16 bp, H. sapiens
gatatgaagaaaaggg

SEQ ID NO: 103599 - DNA, 16 bp, H. sapiens
gatatgaagaaagttt

SEQ ID NO: 103600 - DNA, 16 bp, H. sapiens
gatatgaatatatata

SEQ ID NO: 103601 - DNA, 16 bp, H. sapiens
gatatgactgaattgc

SEQ ID NO: 103602 - DNA, 16 bp, H. sapiens
gatatgccaaagagaa

SEQ ID NO: 103603 - DNA, 16 bp, H. sapiens
gatatgcctgctcccc

SEQ ID NO: 103604 - DNA, 16 bp, H. sapiens
gatatgcctttcacct

SEQ ID NO: 103605 - DNA, 16 bp, H. sapiens
gatatgctaaacaagg

SEQ ID NO: 103606 - DNA, 16 bp, H. sapiens
gatatgctactgattt

SEQ ID NO: 103607 - DNA, 16 bp, H. sapiens
gatatggagaaattga

SEQ ID NO: 103608 - DNA, 16 bp, H. sapiens
gatatggagaaggttt

SEQ ID NO: 103609 - DNA, 16 bp, H. sapiens
gatatggggtcttgct

SEQ ID NO: 103610 - DNA, 16 bp, H. sapiens
gatatggggtttcacc

SEQ ID NO: 103611 - DNA, 16 bp, H. sapiens
gatatggtttgaatat

SEQ ID NO: 103612 - DNA, 16 bp, H. sapiens
gatatgtattttcatt

SEQ ID NO: 103613 - DNA, 16 bp, H. sapiens
gatatgtgtatataca

SEQ ID NO: 103614 - DNA, 16 bp, H. sapiens
gatattaaacattttt

SEQ ID NO: 103615 - DNA, 16 bp, H. sapiens
gatattaaaccagaaa

SEQ ID NO: 103616 - DNA, 16 bp, H. sapiens
gatattaaagagattt

SEQ ID NO: 103617 - DNA, 16 bp, H. sapiens
gatattaatgtagcca

SEQ ID NO: 103618 - DNA, 16 bp, H. sapiens
gatattagactttttt

SEQ ID NO: 103619 - DNA, 16 bp, H. sapiens
gatattagcaacaata

SEQ ID NO: 103620 - DNA, 16 bp, H. sapiens
gatattatcaaggaga

SEQ ID NO: 103621 - DNA, 16 bp, H. sapiens
gatattcaacatttta

SEQ ID NO: 103622 - DNA, 16 bp, H. sapiens
gatattcgatttttca

SEQ ID NO: 103623 - DNA, 16 bp, H. sapiens
gatattcttctttgat

SEQ ID NO: 103624 - DNA, 16 bp, H. sapiens
gatattgaagccaaaa

SEQ ID NO: 103625 - DNA, 16 bp, H. sapiens
gatattgacaaactga

SEQ ID NO: 103626 - DNA, 16 bp, H. sapiens
gatattgacattgata

SEQ ID NO: 103627 - DNA, 16 bp, H. sapiens
gatattgataagatgt

SEQ ID NO: 103628 - DNA, 16 bp, H. sapiens
gatattgatatggttt

SEQ ID NO: 103629 - DNA, 16 bp, H. sapiens
gatattgatattgata

SEQ ID NO: 103630 - DNA, 16 bp, H. sapiens
gatattgtcagtcttt

SEQ ID NO: 103631 - DNA, 16 bp, H. sapiens
gatattgtctcaaaaa

SEQ ID NO: 103632 - DNA, 16 bp, H. sapiens
gatattgtgaatagtg

SEQ ID NO: 103633 - DNA, 16 bp, H. sapiens
gatatttaaacaatat

SEQ ID NO: 103634 - DNA, 16 bp, H. sapiens
gatatttacatagtct

SEQ ID NO: 103635 - DNA, 16 bp, H. sapiens
gatatttagagaacat

SEQ ID NO: 103636 - DNA, 16 bp, H. sapiens
gatatttcactgaaga

SEQ ID NO: 103637 - DNA, 16 bp, H. sapiens
gatatttcagttgaag

SEQ ID NO: 103638 - DNA, 16 bp, H. sapiens
gatatttgctgtgggt

SEQ ID NO: 103639 - DNA, 16 bp, H. sapiens
gatatttgcttttcta

SEQ ID NO: 103640 - DNA, 16 bp, H. sapiens
gatatttggcagaaga

SEQ ID NO: 103641 - DNA, 16 bp, H. sapiens
gatatttgtgagcgct

SEQ ID NO: 103642 - DNA, 16 bp, H. sapiens
gatattttaaagattt

SEQ ID NO: 103643 - DNA, 16 bp, H. sapiens
gatattttcatacatg

SEQ ID NO: 103644 - DNA, 16 bp, H. sapiens
gatattttcttttcta

SEQ ID NO: 103645 - DNA, 16 bp, H. sapiens
gatattttgagaaaaa

SEQ ID NO: 103646 - DNA, 16 bp, H. sapiens
gatattttgataaatg

SEQ ID NO: 103647 - DNA, 16 bp, H. sapiens
gatattttgatacaag

SEQ ID NO: 103648 - DNA, 16 bp, H. sapiens
gatattttgatgggga

SEQ ID NO: 103649 - DNA, 16 bp, H. sapiens
gatattttgttatggc

SEQ ID NO: 103650 - DNA, 16 bp, H. sapiens
gatatttttaaagcca

SEQ ID NO: 103651 - DNA, 16 bp, H. sapiens
gatatttttcacagaa

SEQ ID NO: 103652 - DNA, 16 bp, H. sapiens
gatcaaaaacctaaat

SEQ ID NO: 103653 - DNA, 16 bp, H. sapiens
gatcaaaaccattcaa

SEQ ID NO: 103654 - DNA, 16 bp, H. sapiens
gatcaaaaggtcaaga

SEQ ID NO: 103655 - DNA, 29 bp, H. sapiens
gatcaaacagcaaactgtttatcatgaat

SEQ ID NO: 103656 - DNA, 17 bp, H. sapiens
gatcaaactagaactca

SEQ ID NO: 103657 - DNA, 16 bp, H. sapiens
gatcaaactgcaaagc

SEQ ID NO: 103658 - DNA, 16 bp, H. sapiens
gatcaacaaaactgat

SEQ ID NO: 103659 - DNA, 20 bp, H. sapiens
gatcaacaaaattgatagac

SEQ ID NO: 103660 - DNA, 16 bp, H. sapiens
gatcaactgaaagaaa

SEQ ID NO: 103661 - DNA, 16 bp, H. sapiens
gatcaactgagatcag

SEQ ID NO: 103662 - DNA, 16 bp, H. sapiens
gatcaactgagcccag

SEQ ID NO: 103663 - DNA, 16 bp, H. sapiens
gatcaagaagaagaaa

SEQ ID NO: 103664 - DNA, 16 bp, H. sapiens
gatcaagaagctgtca

SEQ ID NO: 103665 - DNA, 16 bp, H. sapiens
gatcaagagatcaaga

SEQ ID NO: 103666 - DNA, 17 bp, H. sapiens
gatcaagaggtcaggag

SEQ ID NO: 103667 - DNA, 16 bp, H. sapiens
gatcaagatacagaac

SEQ ID NO: 103668 - DNA, 16 bp, H. sapiens
gatcaagcccagcagg

SEQ ID NO: 103669 - DNA, 16 bp, H. sapiens
gatcaagcgattctcc

SEQ ID NO: 103670 - DNA, 16 bp, H. sapiens
gatcaagcggaagaaa

SEQ ID NO: 103671 - DNA, 16 bp, H. sapiens
gatcaagctcactgca

SEQ ID NO: 103672 - DNA, 16 bp, H. sapiens
gatcaaggctctggca

SEQ ID NO: 103673 - DNA, 16 bp, H. sapiens
gatcaaggtgctggcc

SEQ ID NO: 103674 - DNA, 16 bp, H. sapiens
gatcaatcaaaagaaa

SEQ ID NO: 103675 - DNA, 16 bp, H. sapiens
gatcaatggaatagaa

SEQ ID NO: 103676 - DNA, 16 bp, H. sapiens
gatcaattcagcaaga

SEQ ID NO: 103677 - DNA, 17 bp, H. sapiens
gatcacaaagtcaggag

SEQ ID NO: 103678 - DNA, 17 bp, H. sapiens
gatcacaagatcaggag

SEQ ID NO: 103679 - DNA, 17 bp, H. sapiens
gatcacaaggtcaagag

SEQ ID NO: 103680 - DNA, 17 bp, H. sapiens
gatcacaaggtcagcag

SEQ ID NO: 103681 - DNA, 17 bp, H. sapiens
gatcacaaggtcaggaa

SEQ ID NO: 103682 - DNA, 17 bp, H. sapiens
gatcacaaggtcaggag

SEQ ID NO: 103683 - DNA, 16 bp, H. sapiens
gatcacaaggtccaga

SEQ ID NO: 103684 - DNA, 16 bp, H. sapiens
gatcacaattcaacat

SEQ ID NO: 103685 - DNA, 16 bp, H. sapiens
gatcacaccaatgcac

SEQ ID NO: 103686 - DNA, 16 bp, H. sapiens
gatcacaggcctgagc

SEQ ID NO: 103687 - DNA, 16 bp, H. sapiens
gatcacagggaaggag

SEQ ID NO: 103688 - DNA, 16 bp, H. sapiens
gatcacattttgagaa

SEQ ID NO: 103689 - DNA, 17 bp, H. sapiens
gatcaccaggtcaggag

SEQ ID NO: 103690 - DNA, 16 bp, H. sapiens
gatcaccccactgcac

SEQ ID NO: 103691 - DNA, 18 bp, H. sapiens
gatcacctgacgtcagga

SEQ ID NO: 103692 - DNA, 16 bp, H. sapiens
gatcacctgaggccaa

SEQ ID NO: 103693 - DNA, 18 bp, H. sapiens
gatcacctgagggcagga

SEQ ID NO: 103694 - DNA, 17 bp, H. sapiens
gatcacctgaggtcaat

SEQ ID NO: 103695 - DNA, 16 bp, H. sapiens
gatcacctgaggtcac

SEQ ID NO: 103696 - DNA, 20 bp, H. sapiens
gatcacctgaggtcaggagg

SEQ ID NO: 103697 - DNA, 20 bp, H. sapiens
gatcacctgaggtcgggagg

SEQ ID NO: 103698 - DNA, 21 bp, H. sapiens
gatcacctgaggtgaggagtt

SEQ ID NO: 103699 - DNA, 16 bp, H. sapiens
gatcacctgaggtggg

SEQ ID NO: 103700 - DNA, 21 bp, H. sapiens
gatcacctggggtcaggagtt

SEQ ID NO: 103701 - DNA, 17 bp, H. sapiens
gatcacgaagtcaggag

SEQ ID NO: 103702 - DNA, 16 bp, H. sapiens
gatcacgaccctctca

SEQ ID NO: 103703 - DNA, 17 bp, H. sapiens
gatcacgagatcaggag

SEQ ID NO: 103704 - DNA, 17 bp, H. sapiens
gatcacgaggccaggag

SEQ ID NO: 103705 - DNA, 16 bp, H. sapiens
gatcacgaggtcaaaa

SEQ ID NO: 103706 - DNA, 17 bp, H. sapiens
gatcacgaggtcaagag

SEQ ID NO: 103707 - DNA, 17 bp, H. sapiens
gatcacgaggtcagaag

SEQ ID NO: 103708 - DNA, 16 bp, H. sapiens
gatcacgaggtcagca

SEQ ID NO: 103709 - DNA, 17 bp, H. sapiens
gatcacgaggtcaggaa

SEQ ID NO: 103710 - DNA, 17 bp, H. sapiens
gatcacgaggtcaggag

SEQ ID NO: 103711 - DNA, 19 bp, H. sapiens
gatcacgaggtcaggagat

SEQ ID NO: 103712 - DNA, 17 bp, H. sapiens
gatcacgaggtcaggat

SEQ ID NO: 103713 - DNA, 17 bp, H. sapiens
gatcacgaggtcaggcg

SEQ ID NO: 103714 - DNA, 16 bp, H. sapiens
gatcacgaggtcaggg

SEQ ID NO: 103715 - DNA, 17 bp, H. sapiens
gatcacgaggtcagggg

SEQ ID NO: 103716 - DNA, 16 bp, H. sapiens
gatcacgaggtcagta

SEQ ID NO: 103717 - DNA, 17 bp, H. sapiens
gatcacgaggttaggag

SEQ ID NO: 103718 - DNA, 17 bp, H. sapiens
gatcacgagttcaggag

SEQ ID NO: 103719 - DNA, 17 bp, H. sapiens
gatcacgatgtcaggag

SEQ ID NO: 103720 - DNA, 17 bp, H. sapiens
gatcacgccactgcaat

SEQ ID NO: 103721 - DNA, 17 bp, H. sapiens
gatcacgccactgtact

SEQ ID NO: 103722 - DNA, 17 bp, H. sapiens
gatcacggggtcaggag

SEQ ID NO: 103723 - DNA, 16 bp, H. sapiens
gatcactacaacctcc

SEQ ID NO: 103724 - DNA, 16 bp, H. sapiens
gatcactgaagcccag

SEQ ID NO: 103725 - DNA, 16 bp, H. sapiens
gatcactgaggccagg

SEQ ID NO: 103726 - DNA, 16 bp, H. sapiens
gatcacttgagccagg

SEQ ID NO: 103727 - DNA, 16 bp, H. sapiens
gatcacttgatatcag

SEQ ID NO: 103728 - DNA, 16 bp, H. sapiens
gatcacttggggtcag

SEQ ID NO: 103729 - DNA, 16 bp, H. sapiens
gatcagaaggtcaaga

SEQ ID NO: 103730 - DNA, 16 bp, H. sapiens
gatcagaagtgttttg

SEQ ID NO: 103731 - DNA, 16 bp, H. sapiens
gatcagatggatgaat

SEQ ID NO: 103732 - DNA, 16 bp, H. sapiens
gatcagcctggccaag

SEQ ID NO: 103733 - DNA, 16 bp, H. sapiens
gatcaggaattcaaga

SEQ ID NO: 103734 - DNA, 17 bp, H. sapiens
gatcaggaggtcaggag

SEQ ID NO: 103735 - DNA, 16 bp, H. sapiens
gatcaggcatggtggc

SEQ ID NO: 103736 - DNA, 16 bp, H. sapiens
gatcagtagttctcaa

SEQ ID NO: 103737 - DNA, 16 bp, H. sapiens
gatcagtgatgttcag

SEQ ID NO: 103738 - DNA, 16 bp, H. sapiens
gatcagtgcctggcac

SEQ ID NO: 103739 - DNA, 16 bp, H. sapiens
gatcagtggtggccag

SEQ ID NO: 103740 - DNA, 16 bp, H. sapiens
gatcagttcatctttt

SEQ ID NO: 103741 - DNA, 17 bp, H. sapiens
gatcataaggtcaggag

SEQ ID NO: 103742 - DNA, 16 bp, H. sapiens
gatcatagctcactga

SEQ ID NO: 103743 - DNA, 18 bp, H. sapiens
gatcatagctcactgcaa

SEQ ID NO: 103744 - DNA, 16 bp, H. sapiens
gatcatcctggccaat

SEQ ID NO: 103745 - DNA, 16 bp, H. sapiens
gatcatctgaaacctt

SEQ ID NO: 103746 - DNA, 16 bp, H. sapiens
gatcatgaagatttac

SEQ ID NO: 103747 - DNA, 17 bp, H. sapiens
gatcatgaagtcaggag

SEQ ID NO: 103748 - DNA, 17 bp, H. sapiens
gatcatgaggtcaagag

SEQ ID NO: 103749 - DNA, 16 bp, H. sapiens
gatcatgaggtcagaa

SEQ ID NO: 103750 - DNA, 17 bp, H. sapiens
gatcatgaggtcaggaa

SEQ ID NO: 103751 - DNA, 17 bp, H. sapiens
gatcatgaggtcaggag

SEQ ID NO: 103752 - DNA, 17 bp, H. sapiens
gatcatgaggttaggag

SEQ ID NO: 103753 - DNA, 16 bp, H. sapiens
gatcatgatgtcaaga

SEQ ID NO: 103754 - DNA, 16 bp, H. sapiens
gatcatgcagaagaaa

SEQ ID NO: 103755 - DNA, 16 bp, H. sapiens
gatcatgcagctgcac

SEQ ID NO: 103756 - DNA, 19 bp, H. sapiens
gatcatggctcactgcagt

SEQ ID NO: 103757 - DNA, 16 bp, H. sapiens
gatcatggtttactgc

SEQ ID NO: 103758 - DNA, 16 bp, H. sapiens
gatcatgtcatcagca

SEQ ID NO: 103759 - DNA, 16 bp, H. sapiens
gatcatgtccctgcac

SEQ ID NO: 103760 - DNA, 16 bp, H. sapiens
gatcattaaaaagcca

SEQ ID NO: 103761 - DNA, 29 bp, H. sapiens
gatcattaaaaagtcaggaaacaacagat

SEQ ID NO: 103762 - DNA, 17 bp, H. sapiens
gatcatttgaggtcaga

SEQ ID NO: 103763 - DNA, 16 bp, H. sapiens
gatcatttgtattttt

SEQ ID NO: 103764 - DNA, 16 bp, H. sapiens
gatcattttatttaaa

SEQ ID NO: 103765 - DNA, 16 bp, H. sapiens
gatcattttgaaactt

SEQ ID NO: 103766 - DNA, 16 bp, H. sapiens
gatcattttggacctt

SEQ ID NO: 103767 - DNA, 16 bp, H. sapiens
gatccaaatcaagaag

SEQ ID NO: 103768 - DNA, 16 bp, H. sapiens
gatccaagaagagaaa

SEQ ID NO: 103769 - DNA, 16 bp, H. sapiens
gatccaatcagattga

SEQ ID NO: 103770 - DNA, 16 bp, H. sapiens
gatccaccagcttcgg

SEQ ID NO: 103771 - DNA, 16 bp, H. sapiens
gatccacccaccttga

SEQ ID NO: 103772 - DNA, 16 bp, H. sapiens
gatccacccacttcag

SEQ ID NO: 103773 - DNA, 16 bp, H. sapiens
gatccacccactttgg

SEQ ID NO: 103774 - DNA, 16 bp, H. sapiens
gatccacctacctagg

SEQ ID NO: 103775 - DNA, 17 bp, H. sapiens
gatccagaactgcagcc

SEQ ID NO: 103776 - DNA, 16 bp, H. sapiens
gatccagcttcagctt

SEQ ID NO: 103777 - DNA, 16 bp, H. sapiens
gatccaggaagctcaa

SEQ ID NO: 103778 - DNA, 18 bp, H. sapiens
gatccaggagctggtttt

SEQ ID NO: 103779 - DNA, 16 bp, H. sapiens
gatccaggagtccagg

SEQ ID NO: 103780 - DNA, 16 bp, H. sapiens
gatccagggtctgaac

SEQ ID NO: 103781 - DNA, 16 bp, H. sapiens
gatccaggttttgtgg

SEQ ID NO: 103782 - DNA, 16 bp, H. sapiens
gatccagtgctgtgct

SEQ ID NO: 103783 - DNA, 18 bp, H. sapiens
gatcccaacaacagcaag

SEQ ID NO: 103784 - DNA, 16 bp, H. sapiens
gatcccacacctgcca

SEQ ID NO: 103785 - DNA, 16 bp, H. sapiens
gatcccacagaaacac

SEQ ID NO: 103786 - DNA, 16 bp, H. sapiens
gatcccacagagaaga

SEQ ID NO: 103787 - DNA, 16 bp, H. sapiens
gatcccacatttccct

SEQ ID NO: 103788 - DNA, 18 bp, H. sapiens
gatcccagcactttggga

SEQ ID NO: 103789 - DNA, 16 bp, H. sapiens
gatcccagcctcaggc

SEQ ID NO: 103790 - DNA, 16 bp, H. sapiens
gatcccaggactcaca

SEQ ID NO: 103791 - DNA, 16 bp, H. sapiens
gatcccaggagttgga

SEQ ID NO: 103792 - DNA, 16 bp, H. sapiens
gatcccatctccaaaa

SEQ ID NO: 103793 - DNA, 16 bp, H. sapiens
gatcccctcatgagcc

SEQ ID NO: 103794 - DNA, 17 bp, H. sapiens
gatccctgaggaatcac

SEQ ID NO: 103795 - DNA, 16 bp, H. sapiens
gatccctgcctcctag

SEQ ID NO: 103796 - DNA, 16 bp, H. sapiens
gatcccttccctccct

SEQ ID NO: 103797 - DNA, 16 bp, H. sapiens
gatccgcctgactcag

SEQ ID NO: 103798 - DNA, 18 bp, H. sapiens
gatccgtccgcctcagcc

SEQ ID NO: 103799 - DNA, 16 bp, H. sapiens
gatcctaaatatatat

SEQ ID NO: 103800 - DNA, 16 bp, H. sapiens
gatcctaagcaaaaag

SEQ ID NO: 103801 - DNA, 16 bp, H. sapiens
gatcctacagaaatac

SEQ ID NO: 103802 - DNA, 18 bp, H. sapiens
gatcctagcactttggga

SEQ ID NO: 103803 - DNA, 16 bp, H. sapiens
gatcctcacacttcag

SEQ ID NO: 103804 - DNA, 16 bp, H. sapiens
gatcctcagcctcctg

SEQ ID NO: 103805 - DNA, 16 bp, H. sapiens
gatcctcccaccccag

SEQ ID NO: 103806 - DNA, 16 bp, H. sapiens
gatcctcccacctcaa

SEQ ID NO: 103807 - DNA, 16 bp, H. sapiens
gatcctcctcctcagc

SEQ ID NO: 103808 - DNA, 16 bp, H. sapiens
gatcctcctgcctctg

SEQ ID NO: 103809 - DNA, 16 bp, H. sapiens
gatcctcctgccttgg

SEQ ID NO: 103810 - DNA, 16 bp, H. sapiens
gatcctcctgctgcag

SEQ ID NO: 103811 - DNA, 16 bp, H. sapiens
gatcctctcgccttag

SEQ ID NO: 103812 - DNA, 16 bp, H. sapiens
gatcctctctccttgg

SEQ ID NO: 103813 - DNA, 16 bp, H. sapiens
gatcctctgcctcctc

SEQ ID NO: 103814 - DNA, 16 bp, H. sapiens
gatcctgaaacagaaa

SEQ ID NO: 103815 - DNA, 16 bp, H. sapiens
gatcctgccacttcac

SEQ ID NO: 103816 - DNA, 16 bp, H. sapiens
gatcctggaagagaaa

SEQ ID NO: 103817 - DNA, 16 bp, H. sapiens
gatcctggctcaccac

SEQ ID NO: 103818 - DNA, 16 bp, H. sapiens
gatcctggttcactgc

SEQ ID NO: 103819 - DNA, 16 bp, H. sapiens
gatcctgtctctaaaa

SEQ ID NO: 103820 - DNA, 16 bp, H. sapiens
gatccttcaccttcct

SEQ ID NO: 103821 - DNA, 16 bp, H. sapiens
gatccttcatgaatgg

SEQ ID NO: 103822 - DNA, 16 bp, H. sapiens
gatccttctgtctcag

SEQ ID NO: 103823 - DNA, 16 bp, H. sapiens
gatcctttgagtccag

SEQ ID NO: 103824 - DNA, 16 bp, H. sapiens
gatcctttggagaaga

SEQ ID NO: 103825 - DNA, 16 bp, H. sapiens
gatcgagaccatccag

SEQ ID NO: 103826 - DNA, 17 bp, H. sapiens
gatcgagatcgtcctgg

SEQ ID NO: 103827 - DNA, 16 bp, H. sapiens
gatcgagtccatcctg

SEQ ID NO: 103828 - DNA, 16 bp, H. sapiens
gatcgctagagcccag

SEQ ID NO: 103829 - DNA, 16 bp, H. sapiens
gatcgtctgaaggctt

SEQ ID NO: 103830 - DNA, 17 bp, H. sapiens
gatcgtgccactgaact

SEQ ID NO: 103831 - DNA, 17 bp, H. sapiens
gatcgtgccactgtact

SEQ ID NO: 103832 - DNA, 16 bp, H. sapiens
gatctaaataaattga

SEQ ID NO: 103833 - DNA, 16 bp, H. sapiens
gatctaataatatttg

SEQ ID NO: 103834 - DNA, 16 bp, H. sapiens
gatctagaaacagaaa

SEQ ID NO: 103835 - DNA, 19 bp, H. sapiens
gatctagaactagaaatac

SEQ ID NO: 103836 - DNA, 16 bp, H. sapiens
gatctagaagcagaaa

SEQ ID NO: 103837 - DNA, 16 bp, H. sapiens
gatctagacattcaaa

SEQ ID NO: 103838 - DNA, 16 bp, H. sapiens
gatctataaaagaaaa

SEQ ID NO: 103839 - DNA, 16 bp, H. sapiens
gatctatgtgtctgtc

SEQ ID NO: 103840 - DNA, 16 bp, H. sapiens
gatctcaaagagatat

SEQ ID NO: 103841 - DNA, 16 bp, H. sapiens
gatctcactctgtcac

SEQ ID NO: 103842 - DNA, 16 bp, H. sapiens
gatctcagactgccgt

SEQ ID NO: 103843 - DNA, 16 bp, H. sapiens
gatctcagctcactct

SEQ ID NO: 103844 - DNA, 16 bp, H. sapiens
gatctcagctcactgg

SEQ ID NO: 103845 - DNA, 16 bp, H. sapiens
gatctcagctcatggc

SEQ ID NO: 103846 - DNA, 16 bp, H. sapiens
gatctcagctcattgc

SEQ ID NO: 103847 - DNA, 16 bp, H. sapiens
gatctcaggagttggg

SEQ ID NO: 103848 - DNA, 16 bp, H. sapiens
gatctcatctcactgc

SEQ ID NO: 103849 - DNA, 16 bp, H. sapiens
gatctcatgggactta

SEQ ID NO: 103850 - DNA, 16 bp, H. sapiens
gatctcattctttttt

SEQ ID NO: 103851 - DNA, 16 bp, H. sapiens
gatctcattgaggcca

SEQ ID NO: 103852 - DNA, 16 bp, H. sapiens
gatctccccacctcag

SEQ ID NO: 103853 - DNA, 16 bp, H. sapiens
gatctccgctcactgc

SEQ ID NO: 103854 - DNA, 16 bp, H. sapiens
gatctcctgaccccat

SEQ ID NO: 103855 - DNA, 19 bp, H. sapiens
gatctcctgacctcctgat

SEQ ID NO: 103856 - DNA, 16 bp, H. sapiens
gatctcctgaccttga

SEQ ID NO: 103857 - DNA, 16 bp, H. sapiens
gatctcctggcagaaa

SEQ ID NO: 103858 - DNA, 16 bp, H. sapiens
gatctcctggcctcaa

SEQ ID NO: 103859 - DNA, 16 bp, H. sapiens
gatctcctttgacccc

SEQ ID NO: 103860 - DNA, 16 bp, H. sapiens
gatctcgaactcccaa

SEQ ID NO: 103861 - DNA, 16 bp, H. sapiens
gatctcgaacttctgg

SEQ ID NO: 103862 - DNA, 22 bp, H. sapiens
gatctcggctcactgcaagctc

SEQ ID NO: 103863 - DNA, 18 bp, H. sapiens
gatctcggctcactgcat

SEQ ID NO: 103864 - DNA, 17 bp, H. sapiens
gatctcggctcactgcg

SEQ ID NO: 103865 - DNA, 16 bp, H. sapiens
gatctcgtgatccgcc

SEQ ID NO: 103866 - DNA, 17 bp, H. sapiens
gatctctcagcagaaac

SEQ ID NO: 103867 - DNA, 22 bp, H. sapiens
gatctctcggcagaaaccctac

SEQ ID NO: 103868 - DNA, 16 bp, H. sapiens
gatctctctctctctc

SEQ ID NO: 103869 - DNA, 16 bp, H. sapiens
gatctctctgcagaaa

SEQ ID NO: 103870 - DNA, 16 bp, H. sapiens
gatctctggagcccag

SEQ ID NO: 103871 - DNA, 16 bp, H. sapiens
gatctcttgaagtcag

SEQ ID NO: 103872 - DNA, 16 bp, H. sapiens
gatctcttgagaactt

SEQ ID NO: 103873 - DNA, 16 bp, H. sapiens
gatctcttggcctcat

SEQ ID NO: 103874 - DNA, 16 bp, H. sapiens
gatctgaccaccttgg

SEQ ID NO: 103875 - DNA, 16 bp, H. sapiens
gatctgagatcatgcc

SEQ ID NO: 103876 - DNA, 16 bp, H. sapiens
gatctgagtagacatt

SEQ ID NO: 103877 - DNA, 16 bp, H. sapiens
gatctgcccacttcag

SEQ ID NO: 103878 - DNA, 16 bp, H. sapiens
gatctgcccttctcgg

SEQ ID NO: 103879 - DNA, 19 bp, H. sapiens
gatctgcctgcttcagcct

SEQ ID NO: 103880 - DNA, 16 bp, H. sapiens
gatctgcctggctcag

SEQ ID NO: 103881 - DNA, 16 bp, H. sapiens
gatctgcttgccttgg

SEQ ID NO: 103882 - DNA, 16 bp, H. sapiens
gatctggaaccagaaa

SEQ ID NO: 103883 - DNA, 16 bp, H. sapiens
gatctgggaaggaagg

SEQ ID NO: 103884 - DNA, 16 bp, H. sapiens
gatctgggctcgctgc

SEQ ID NO: 103885 - DNA, 16 bp, H. sapiens
gatctgggtggagaca

SEQ ID NO: 103886 - DNA, 16 bp, H. sapiens
gatctgtctgatattg

SEQ ID NO: 103887 - DNA, 16 bp, H. sapiens
gatctgtgccttaagg

SEQ ID NO: 103888 - DNA, 16 bp, H. sapiens
gatctgtggaaatttg

SEQ ID NO: 103889 - DNA, 16 bp, H. sapiens
gatctgtgtccccaac

SEQ ID NO: 103890 - DNA, 16 bp, H. sapiens
gatctgtgttttagaa

SEQ ID NO: 103891 - DNA, 16 bp, H. sapiens
gatctgttgcacagca

SEQ ID NO: 103892 - DNA, 16 bp, H. sapiens
gatcttatttttaaaa

SEQ ID NO: 103893 - DNA, 16 bp, H. sapiens
gatcttcccacctcac

SEQ ID NO: 103894 - DNA, 16 bp, H. sapiens
gatcttcccacctcag

SEQ ID NO: 103895 - DNA, 16 bp, H. sapiens
gatcttcctgccttag

SEQ ID NO: 103896 - DNA, 16 bp, H. sapiens
gatcttccttcctcag

SEQ ID NO: 103897 - DNA, 16 bp, H. sapiens
gatcttctctcttgtt

SEQ ID NO: 103898 - DNA, 16 bp, H. sapiens
gatcttgaacaagtca

SEQ ID NO: 103899 - DNA, 16 bp, H. sapiens
gatcttgaactactga

SEQ ID NO: 103900 - DNA, 16 bp, H. sapiens
gatcttgatcactttt

SEQ ID NO: 103901 - DNA, 16 bp, H. sapiens
gatcttgctatgttgc

SEQ ID NO: 103902 - DNA, 16 bp, H. sapiens
gatcttggacaaatta

SEQ ID NO: 103903 - DNA, 17 bp, H. sapiens
gatcttggagaaattca

SEQ ID NO: 103904 - DNA, 20 bp, H. sapiens
gatcttggctcactgcaact

SEQ ID NO: 103905 - DNA, 18 bp, H. sapiens
gatcttggctcactgcac

SEQ ID NO: 103906 - DNA, 16 bp, H. sapiens
gatcttggctcacttc

SEQ ID NO: 103907 - DNA, 17 bp, H. sapiens
gatcttggctcgctgca

SEQ ID NO: 103908 - DNA, 16 bp, H. sapiens
gatcttggctgggtgc

SEQ ID NO: 103909 - DNA, 17 bp, H. sapiens
gatcttggcttactaca

SEQ ID NO: 103910 - DNA, 17 bp, H. sapiens
gatcttggcttactgca

SEQ ID NO: 103911 - DNA, 17 bp, H. sapiens
gatcttggttcactgca

SEQ ID NO: 103912 - DNA, 16 bp, H. sapiens
gatcttgtctcactgc

SEQ ID NO: 103913 - DNA, 16 bp, H. sapiens
gatcttgtctttaaaa

SEQ ID NO: 103914 - DNA, 16 bp, H. sapiens
gatctttccactgaaa

SEQ ID NO: 103915 - DNA, 16 bp, H. sapiens
gatctttctaatgtgt

SEQ ID NO: 103916 - DNA, 16 bp, H. sapiens
gatcttttaaaaaaaa

SEQ ID NO: 103917 - DNA, 16 bp, H. sapiens
gatcttttgtacttct

SEQ ID NO: 103918 - DNA, 16 bp, H. sapiens
gatctttttaaagaac

SEQ ID NO: 103919 - DNA, 16 bp, H. sapiens
gatgaaaaaactaagg

SEQ ID NO: 103920 - DNA, 16 bp, H. sapiens
gatgaaaaaactgaga

SEQ ID NO: 103921 - DNA, 16 bp, H. sapiens
gatgaaaaaggaaaca

SEQ ID NO: 103922 - DNA, 16 bp, H. sapiens
gatgaaaaattactaa

SEQ ID NO: 103923 - DNA, 16 bp, H. sapiens
gatgaaaacaatagac

SEQ ID NO: 103924 - DNA, 16 bp, H. sapiens
gatgaaaactagaaac

SEQ ID NO: 103925 - DNA, 16 bp, H. sapiens
gatgaaaagacaagcc

SEQ ID NO: 103926 - DNA, 16 bp, H. sapiens
gatgaaaatatttttt

SEQ ID NO: 103927 - DNA, 16 bp, H. sapiens
gatgaaaatgacactt

SEQ ID NO: 103928 - DNA, 16 bp, H. sapiens
gatgaaaatgccaaaa

SEQ ID NO: 103929 - DNA, 16 bp, H. sapiens
gatgaaaatgtcaaaa

SEQ ID NO: 103930 - DNA, 16 bp, H. sapiens
gatgaaacaccatctc

SEQ ID NO: 103931 - DNA, 16 bp, H. sapiens
gatgaaactgaggctt

SEQ ID NO: 103932 - DNA, 16 bp, H. sapiens
gatgaaactggaaaac

SEQ ID NO: 103933 - DNA, 16 bp, H. sapiens
gatgaaactggaggat

SEQ ID NO: 103934 - DNA, 16 bp, H. sapiens
gatgaaactggaggcc

SEQ ID NO: 103935 - DNA, 16 bp, H. sapiens
gatgaaagaaaccaaa

SEQ ID NO: 103936 - DNA, 16 bp, H. sapiens
gatgaaataaagacat

SEQ ID NO: 103937 - DNA, 16 bp, H. sapiens
gatgaaataaagattt

SEQ ID NO: 103938 - DNA, 16 bp, H. sapiens
gatgaaatatgccctg

SEQ ID NO: 103939 - DNA, 16 bp, H. sapiens
gatgaaatgaaacaga

SEQ ID NO: 103940 - DNA, 16 bp, H. sapiens
gatgaaatgaagaaat

SEQ ID NO: 103941 - DNA, 16 bp, H. sapiens
gatgaaattgccaaaa

SEQ ID NO: 103942 - DNA, 16 bp, H. sapiens
gatgaaattggaaatt

SEQ ID NO: 103943 - DNA, 16 bp, H. sapiens
gatgaacatagacaca

SEQ ID NO: 103944 - DNA, 16 bp, H. sapiens
gatgaacctgaaagac

SEQ ID NO: 103945 - DNA, 16 bp, H. sapiens
gatgaactcttggaaa

SEQ ID NO: 103946 - DNA, 16 bp, H. sapiens
gatgaactttttttca

SEQ ID NO: 103947 - DNA, 16 bp, H. sapiens
gatgaagaaaaaccag

SEQ ID NO: 103948 - DNA, 16 bp, H. sapiens
gatgaagaaaaagcat

SEQ ID NO: 103949 - DNA, 16 bp, H. sapiens
gatgaagaaaagaatc

SEQ ID NO: 103950 - DNA, 16 bp, H. sapiens
gatgaagaaaatgagg

SEQ ID NO: 103951 - DNA, 16 bp, H. sapiens
gatgaagaaacagact

SEQ ID NO: 103952 - DNA, 16 bp, H. sapiens
gatgaagaaacagatt

SEQ ID NO: 103953 - DNA, 16 bp, H. sapiens
gatgaagaaatggaag

SEQ ID NO: 103954 - DNA, 16 bp, H. sapiens
gatgaagaaatggaga

SEQ ID NO: 103955 - DNA, 16 bp, H. sapiens
gatgaagaaattgaaa

SEQ ID NO: 103956 - DNA, 16 bp, H. sapiens
gatgaagaaattgtgg

SEQ ID NO: 103957 - DNA, 16 bp, H. sapiens
gatgaagaagctgaag

SEQ ID NO: 103958 - DNA, 16 bp, H. sapiens
gatgaagacactgagg

SEQ ID NO: 103959 - DNA, 16 bp, H. sapiens
gatgaagacagcagat

SEQ ID NO: 103960 - DNA, 16 bp, H. sapiens
gatgaagacatcaaaa

SEQ ID NO: 103961 - DNA, 16 bp, H. sapiens
gatgaagacttcaaaa

SEQ ID NO: 103962 - DNA, 16 bp, H. sapiens
gatgaagagttctgga

SEQ ID NO: 103963 - DNA, 16 bp, H. sapiens
gatgaagagttgcttc

SEQ ID NO: 103964 - DNA, 16 bp, H. sapiens
gatgaagataccaaaa

SEQ ID NO: 103965 - DNA, 16 bp, H. sapiens
gatgaagatgatggtg

SEQ ID NO: 103966 - DNA, 16 bp, H. sapiens
gatgaagcaaatgtgg

SEQ ID NO: 103967 - DNA, 16 bp, H. sapiens
gatgaagccaacttga

SEQ ID NO: 103968 - DNA, 16 bp, H. sapiens
gatgaagccatcttga

SEQ ID NO: 103969 - DNA, 16 bp, H. sapiens
gatgaagcctacttga

SEQ ID NO: 103970 - DNA, 16 bp, H. sapiens
gatgaagcctccagat

SEQ ID NO: 103971 - DNA, 16 bp, H. sapiens
gatgaagctagaagcc

SEQ ID NO: 103972 - DNA, 16 bp, H. sapiens
gatgaagctcccagag

SEQ ID NO: 103973 - DNA, 16 bp, H. sapiens
gatgaagctgaggaca

SEQ ID NO: 103974 - DNA, 16 bp, H. sapiens
gatgaagctggaggct

SEQ ID NO: 103975 - DNA, 16 bp, H. sapiens
gatgaaggaagagcaa

SEQ ID NO: 103976 - DNA, 16 bp, H. sapiens
gatgaaggcagagatg

SEQ ID NO: 103977 - DNA, 16 bp, H. sapiens
gatgaaggggaagcag

SEQ ID NO: 103978 - DNA, 16 bp, H. sapiens
gatgaaggggatatca

SEQ ID NO: 103979 - DNA, 16 bp, H. sapiens
gatgaaggtgccagca

SEQ ID NO: 103980 - DNA, 16 bp, H. sapiens
gatgaaggtggctata

SEQ ID NO: 103981 - DNA, 16 bp, H. sapiens
gatgaagtaactgagg

SEQ ID NO: 103982 - DNA, 16 bp, H. sapiens
gatgaagtcagagagg

SEQ ID NO: 103983 - DNA, 16 bp, H. sapiens
gatgaagtgagaccct

SEQ ID NO: 103984 - DNA, 16 bp, H. sapiens
gatgaagtttcaacat

SEQ ID NO: 103985 - DNA, 16 bp, H. sapiens
gatgaagtttccagag

SEQ ID NO: 103986 - DNA, 16 bp, H. sapiens
gatgaagttttgctct

SEQ ID NO: 103987 - DNA, 16 bp, H. sapiens
gatgaatacagtaaat

SEQ ID NO: 103988 - DNA, 16 bp, H. sapiens
gatgaatatagataca

SEQ ID NO: 103989 - DNA, 16 bp, H. sapiens
gatgaatcccaatgtg

SEQ ID NO: 103990 - DNA, 16 bp, H. sapiens
gatgaatgaatgaatt

SEQ ID NO: 103991 - DNA, 16 bp, H. sapiens
gatgaatgaattaaaa

SEQ ID NO: 103992 - DNA, 16 bp, H. sapiens
gatgaatgaatttaaa

SEQ ID NO: 103993 - DNA, 16 bp, H. sapiens
gatgaatggattaaaa

SEQ ID NO: 103994 - DNA, 16 bp, H. sapiens
gatgaatggttggatg

SEQ ID NO: 103995 - DNA, 16 bp, H. sapiens
gatgaatttttaaaag

SEQ ID NO: 103996 - DNA, 16 bp, H. sapiens
gatgacaaacccacag

SEQ ID NO: 103997 - DNA, 16 bp, H. sapiens
gatgacaacagaggaa

SEQ ID NO: 103998 - DNA, 16 bp, H. sapiens
gatgacaaggtcaaga

SEQ ID NO: 103999 - DNA, 16 bp, H. sapiens
gatgacaagttttttt

SEQ ID NO: 104000 - DNA, 16 bp, H. sapiens
gatgacaatgacaatg

SEQ ID NO: 104001 - DNA, 16 bp, H. sapiens
gatgacaatgataatg

SEQ ID NO: 104002 - DNA, 16 bp, H. sapiens
gatgacaatgatgata

SEQ ID NO: 104003 - DNA, 30 bp, H. sapiens
gatgacaatggcggttttgtggaatagaaa

SEQ ID NO: 104004 - DNA, 16 bp, H. sapiens
gatgacaatggtgatg

SEQ ID NO: 104005 - DNA, 16 bp, H. sapiens
gatgacagaacaagat

SEQ ID NO: 104006 - DNA, 17 bp, H. sapiens
gatgacaggcgtgagcc

SEQ ID NO: 104007 - DNA, 16 bp, H. sapiens
gatgacaggtatgagc

SEQ ID NO: 104008 - DNA, 16 bp, H. sapiens
gatgacattccaccac

SEQ ID NO: 104009 - DNA, 16 bp, H. sapiens
gatgacgatgatgata

SEQ ID NO: 104010 - DNA, 16 bp, H. sapiens
gatgacggtgatgatg

SEQ ID NO: 104011 - DNA, 16 bp, H. sapiens
gatgactgcagccctg

SEQ ID NO: 104012 - DNA, 16 bp, H. sapiens
gatgactggtgatgtt

SEQ ID NO: 104013 - DNA, 16 bp, H. sapiens
gatgagaaaaccaaag

SEQ ID NO: 104014 - DNA, 16 bp, H. sapiens
gatgagaaaactaaga

SEQ ID NO: 104015 - DNA, 16 bp, H. sapiens
gatgagaaaactgggg

SEQ ID NO: 104016 - DNA, 16 bp, H. sapiens
gatgagaaaatggaag

SEQ ID NO: 104017 - DNA, 16 bp, H. sapiens
gatgagaaaattaaag

SEQ ID NO: 104018 - DNA, 16 bp, H. sapiens
gatgagaaaattgaaa

SEQ ID NO: 104019 - DNA, 16 bp, H. sapiens
gatgagaaagctgaag

SEQ ID NO: 104020 - DNA, 16 bp, H. sapiens
gatgagaaagttgagg

SEQ ID NO: 104021 - DNA, 16 bp, H. sapiens
gatgagaagaaatgat

SEQ ID NO: 104022 - DNA, 16 bp, H. sapiens
gatgagaagaagccag

SEQ ID NO: 104023 - DNA, 16 bp, H. sapiens
gatgagaagaatatat

SEQ ID NO: 104024 - DNA, 16 bp, H. sapiens
gatgagaatgatggtt

SEQ ID NO: 104025 - DNA, 16 bp, H. sapiens
gatgagaatgttctgg

SEQ ID NO: 104026 - DNA, 16 bp, H. sapiens
gatgagaccctgtctc

SEQ ID NO: 104027 - DNA, 16 bp, H. sapiens
gatgagaccttggact

SEQ ID NO: 104028 - DNA, 16 bp, H. sapiens
gatgagactatggact

SEQ ID NO: 104029 - DNA, 16 bp, H. sapiens
gatgagagagacagag

SEQ ID NO: 104030 - DNA, 16 bp, H. sapiens
gatgagaggggctgcc

SEQ ID NO: 104031 - DNA, 16 bp, H. sapiens
gatgagagtggacatc

SEQ ID NO: 104032 - DNA, 16 bp, H. sapiens
gatgagatttcaccac

SEQ ID NO: 104033 - DNA, 16 bp, H. sapiens
gatgagcagaagtttt

SEQ ID NO: 104034 - DNA, 16 bp, H. sapiens
gatgagcatttttttc

SEQ ID NO: 104035 - DNA, 16 bp, H. sapiens
gatgagcctggagaac

SEQ ID NO: 104036 - DNA, 16 bp, H. sapiens
gatgagctgagatcac

SEQ ID NO: 104037 - DNA, 16 bp, H. sapiens
gatgagcttggaggac

SEQ ID NO: 104038 - DNA, 16 bp, H. sapiens
gatgagcttttttcat

SEQ ID NO: 104039 - DNA, 16 bp, H. sapiens
gatgaggaaaaggcag

SEQ ID NO: 104040 - DNA, 16 bp, H. sapiens
gatgaggaaaatgaag

SEQ ID NO: 104041 - DNA, 16 bp, H. sapiens
gatgaggaaacaaggc

SEQ ID NO: 104042 - DNA, 16 bp, H. sapiens
gatgaggaaacaggca

SEQ ID NO: 104043 - DNA, 16 bp, H. sapiens
gatgaggaaactcaga

SEQ ID NO: 104044 - DNA, 16 bp, H. sapiens
gatgaggaaagtgaag

SEQ ID NO: 104045 - DNA, 16 bp, H. sapiens
gatgaggaaatagaag

SEQ ID NO: 104046 - DNA, 16 bp, H. sapiens
gatgaggaaatcaaga

SEQ ID NO: 104047 - DNA, 16 bp, H. sapiens
gatgaggaaatcaagg

SEQ ID NO: 104048 - DNA, 16 bp, H. sapiens
gatgaggaaatggagg

SEQ ID NO: 104049 - DNA, 16 bp, H. sapiens
gatgaggaaattaaga

SEQ ID NO: 104050 - DNA, 16 bp, H. sapiens
gatgaggaaattgaaa

SEQ ID NO: 104051 - DNA, 16 bp, H. sapiens
gatgaggaaattgaag

SEQ ID NO: 104052 - DNA, 16 bp, H. sapiens
gatgaggaaattgaga

SEQ ID NO: 104053 - DNA, 16 bp, H. sapiens
gatgaggaacctgaga

SEQ ID NO: 104054 - DNA, 16 bp, H. sapiens
gatgaggaactgaggc

SEQ ID NO: 104055 - DNA, 16 bp, H. sapiens
gatgaggaacttgagg

SEQ ID NO: 104056 - DNA, 16 bp, H. sapiens
gatgaggaagaaattt

SEQ ID NO: 104057 - DNA, 16 bp, H. sapiens
gatgaggaagctgaag

SEQ ID NO: 104058 - DNA, 16 bp, H. sapiens
gatgaggaatctgaga

SEQ ID NO: 104059 - DNA, 16 bp, H. sapiens
gatgaggacactgagg

SEQ ID NO: 104060 - DNA, 16 bp, H. sapiens
gatgaggacgctgagg

SEQ ID NO: 104061 - DNA, 16 bp, H. sapiens
gatgaggatgaggatg

SEQ ID NO: 104062 - DNA, 16 bp, H. sapiens
gatgaggatgatggtg

SEQ ID NO: 104063 - DNA, 16 bp, H. sapiens
gatgaggatggtgatg

SEQ ID NO: 104064 - DNA, 16 bp, H. sapiens
gatgaggatgtggaaa

SEQ ID NO: 104065 - DNA, 16 bp, H. sapiens
gatgaggcaactgaag

SEQ ID NO: 104066 - DNA, 16 bp, H. sapiens
gatgaggcaggcagat

SEQ ID NO: 104067 - DNA, 16 bp, H. sapiens
gatgaggcttcaccat

SEQ ID NO: 104068 - DNA, 16 bp, H. sapiens
gatgaggctttggact

SEQ ID NO: 104069 - DNA, 16 bp, H. sapiens
gatgagggaactgaag

SEQ ID NO: 104070 - DNA, 16 bp, H. sapiens
gatgagggtgatgatg

SEQ ID NO: 104071 - DNA, 16 bp, H. sapiens
gatgagggtgccagca

SEQ ID NO: 104072 - DNA, 16 bp, H. sapiens
gatgagggtgctgggg

SEQ ID NO: 104073 - DNA, 16 bp, H. sapiens
gatgaggtgggaggat

SEQ ID NO: 104074 - DNA, 16 bp, H. sapiens
gatgagtctggggacc

SEQ ID NO: 104075 - DNA, 16 bp, H. sapiens
gatgagtgcaccaaaa

SEQ ID NO: 104076 - DNA, 16 bp, H. sapiens
gatgagtggatggatg

SEQ ID NO: 104077 - DNA, 28 bp, H. sapiens
gatgagttcatgtcctttgtagggacac

SEQ ID NO: 104078 - DNA, 35 bp, H. sapiens
gatgagttcatgtcctttgtagggacatggatgaa

SEQ ID NO: 104079 - DNA, 27 bp, H. sapiens
gatgagttcatgtcctttgtagggacg

SEQ ID NO: 104080 - DNA, 16 bp, H. sapiens
gatgagttcttgtcct

SEQ ID NO: 104081 - DNA, 16 bp, H. sapiens
gatgagtttgtgtcct

SEQ ID NO: 104082 - DNA, 16 bp, H. sapiens
gatgatatcctcaaat

SEQ ID NO: 104083 - DNA, 16 bp, H. sapiens
gatgatatcctgaaga

SEQ ID NO: 104084 - DNA, 16 bp, H. sapiens
gatgatattactcccc

SEQ ID NO: 104085 - DNA, 16 bp, H. sapiens
gatgatattaggagat

SEQ ID NO: 104086 - DNA, 16 bp, H. sapiens
gatgatattgattctt

SEQ ID NO: 104087 - DNA, 16 bp, H. sapiens
gatgatcattaaaaag

SEQ ID NO: 104088 - DNA, 16 bp, H. sapiens
gatgatcctggattat

SEQ ID NO: 104089 - DNA, 16 bp, H. sapiens
gatgatcttgaccctg

SEQ ID NO: 104090 - DNA, 16 bp, H. sapiens
gatgatgaaactgaag

SEQ ID NO: 104091 - DNA, 16 bp, H. sapiens
gatgatgaaagtgttc

SEQ ID NO: 104092 - DNA, 16 bp, H. sapiens
gatgatgaagatgatg

SEQ ID NO: 104093 - DNA, 16 bp, H. sapiens
gatgatgaagatggtg

SEQ ID NO: 104094 - DNA, 16 bp, H. sapiens
gatgatgacagtgata

SEQ ID NO: 104095 - DNA, 16 bp, H. sapiens
gatgatgacgatgata

SEQ ID NO: 104096 - DNA, 16 bp, H. sapiens
gatgatgacggtgatg

SEQ ID NO: 104097 - DNA, 16 bp, H. sapiens
gatgatgaggaagaag

SEQ ID NO: 104098 - DNA, 16 bp, H. sapiens
gatgatgaggatgatg

SEQ ID NO: 104099 - DNA, 16 bp, H. sapiens
gatgatgataataata

SEQ ID NO: 104100 - DNA, 16 bp, H. sapiens
gatgatgataatagca

SEQ ID NO: 104101 - DNA, 16 bp, H. sapiens
gatgatgatgaaaata

SEQ ID NO: 104102 - DNA, 16 bp, H. sapiens
gatgatgatgaagata

SEQ ID NO: 104103 - DNA, 16 bp, H. sapiens
gatgatgatgatacta

SEQ ID NO: 104104 - DNA, 16 bp, H. sapiens
gatgatgatgatagct

SEQ ID NO: 104105 - DNA, 16 bp, H. sapiens
gatgatgatgatattg

SEQ ID NO: 104106 - DNA, 16 bp, H. sapiens
gatgatgatgatgaat

SEQ ID NO: 104107 - DNA, 16 bp, H. sapiens
gatgatgatgatgacc

SEQ ID NO: 104108 - DNA, 16 bp, H. sapiens
gatgatgatgatgaga

SEQ ID NO: 104109 - DNA, 16 bp, H. sapiens
gatgatgatgatggag

SEQ ID NO: 104110 - DNA, 16 bp, H. sapiens
gatgatgatgatggca

SEQ ID NO: 104111 - DNA, 16 bp, H. sapiens
gatgatgatgatggtg

SEQ ID NO: 104112 - DNA, 16 bp, H. sapiens
gatgatgatgatggtt

SEQ ID NO: 104113 - DNA, 16 bp, H. sapiens
gatgatgatgatgtta

SEQ ID NO: 104114 - DNA, 16 bp, H. sapiens
gatgatgatgattgtt

SEQ ID NO: 104115 - DNA, 16 bp, H. sapiens
gatgatgatggagatg

SEQ ID NO: 104116 - DNA, 16 bp, H. sapiens
gatgatgatggaggtg

SEQ ID NO: 104117 - DNA, 16 bp, H. sapiens
gatgatgatggcttgg

SEQ ID NO: 104118 - DNA, 16 bp, H. sapiens
gatgatgatgttgatg

SEQ ID NO: 104119 - DNA, 16 bp, H. sapiens
gatgatgattccattt

SEQ ID NO: 104120 - DNA, 16 bp, H. sapiens
gatgatgcaacagaaa

SEQ ID NO: 104121 - DNA, 16 bp, H. sapiens
gatgatgctgatgctg

SEQ ID NO: 104122 - DNA, 16 bp, H. sapiens
gatgatgctggtgatg

SEQ ID NO: 104123 - DNA, 16 bp, H. sapiens
gatgatggcgatgatg

SEQ ID NO: 104124 - DNA, 16 bp, H. sapiens
gatgatggcttccaac

SEQ ID NO: 104125 - DNA, 16 bp, H. sapiens
gatgatgggatgatgg

SEQ ID NO: 104126 - DNA, 16 bp, H. sapiens
gatgatggggaaggat

SEQ ID NO: 104127 - DNA, 16 bp, H. sapiens
gatgatggtgatggta

SEQ ID NO: 104128 - DNA, 16 bp, H. sapiens
gatgatggtgctggtg

SEQ ID NO: 104129 - DNA, 16 bp, H. sapiens
gatgatgttggtgatg

SEQ ID NO: 104130 - DNA, 16 bp, H. sapiens
gatgattaaataagat

SEQ ID NO: 104131 - DNA, 16 bp, H. sapiens
gatgattaaatgaatt

SEQ ID NO: 104132 - DNA, 16 bp, H. sapiens
gatgattatgatgatg

SEQ ID NO: 104133 - DNA, 16 bp, H. sapiens
gatgattatttgtctt

SEQ ID NO: 104134 - DNA, 16 bp, H. sapiens
gatgattctaaaattt

SEQ ID NO: 104135 - DNA, 16 bp, H. sapiens
gatgattctgatgatt

SEQ ID NO: 104136 - DNA, 16 bp, H. sapiens
gatgattctgatgcat

SEQ ID NO: 104137 - DNA, 16 bp, H. sapiens
gatgattttaaaaata

SEQ ID NO: 104138 - DNA, 16 bp, H. sapiens
gatgattttataaaag

SEQ ID NO: 104139 - DNA, 16 bp, H. sapiens
gatgattttttaaaaa

SEQ ID NO: 104140 - DNA, 16 bp, H. sapiens
gatgatttttttaaaa

SEQ ID NO: 104141 - DNA, 16 bp, H. sapiens
gatgcaactaaagcag

SEQ ID NO: 104142 - DNA, 16 bp, H. sapiens
gatgcaagaccccaga

SEQ ID NO: 104143 - DNA, 16 bp, H. sapiens
gatgcacagctgaatt

SEQ ID NO: 104144 - DNA, 16 bp, H. sapiens
gatgcagaaaagtctt

SEQ ID NO: 104145 - DNA, 16 bp, H. sapiens
gatgcagagattgcag

SEQ ID NO: 104146 - DNA, 16 bp, H. sapiens
gatgcagaggttgcag

SEQ ID NO: 104147 - DNA, 16 bp, H. sapiens
gatgcagatgctgctg

SEQ ID NO: 104148 - DNA, 16 bp, H. sapiens
gatgcagatggaggcc

SEQ ID NO: 104149 - DNA, 16 bp, H. sapiens
gatgcagcccacggag

SEQ ID NO: 104150 - DNA, 16 bp, H. sapiens
gatgcagctggaagcc

SEQ ID NO: 104151 - DNA, 16 bp, H. sapiens
gatgcagctggaggcc

SEQ ID NO: 104152 - DNA, 16 bp, H. sapiens
gatgcagctgggggcc

SEQ ID NO: 104153 - DNA, 16 bp, H. sapiens
gatgcagggagtgagg

SEQ ID NO: 104154 - DNA, 16 bp, H. sapiens
gatgcagtgaaaaggg

SEQ ID NO: 104155 - DNA, 16 bp, H. sapiens
gatgcagtttctccat

SEQ ID NO: 104156 - DNA, 16 bp, H. sapiens
gatgcagtttcttcct

SEQ ID NO: 104157 - DNA, 16 bp, H. sapiens
gatgcagttttgccat

SEQ ID NO: 104158 - DNA, 16 bp, H. sapiens
gatgcagttttttcct

SEQ ID NO: 104159 - DNA, 16 bp, H. sapiens
gatgcatatctgattt

SEQ ID NO: 104160 - DNA, 16 bp, H. sapiens
gatgcatattgtaatc

SEQ ID NO: 104161 - DNA, 16 bp, H. sapiens
gatgcatccacaagcc

SEQ ID NO: 104162 - DNA, 16 bp, H. sapiens
gatgcatctacaaacc

SEQ ID NO: 104163 - DNA, 16 bp, H. sapiens
gatgcatgctacaaca

SEQ ID NO: 104164 - DNA, 16 bp, H. sapiens
gatgcatgtgcagaat

SEQ ID NO: 104165 - DNA, 16 bp, H. sapiens
gatgcattctgagaaa

SEQ ID NO: 104166 - DNA, 16 bp, H. sapiens
gatgcattgtttgcaa

SEQ ID NO: 104167 - DNA, 16 bp, H. sapiens
gatgcatttctcagga

SEQ ID NO: 104168 - DNA, 16 bp, H. sapiens
gatgccaagaacctgg

SEQ ID NO: 104169 - DNA, 16 bp, H. sapiens
gatgccaccatgcttc

SEQ ID NO: 104170 - DNA, 16 bp, H. sapiens
gatgccacctggagaa

SEQ ID NO: 104171 - DNA, 16 bp, H. sapiens
gatgccagcaccatgt

SEQ ID NO: 104172 - DNA, 16 bp, H. sapiens
gatgccagcacttcct

SEQ ID NO: 104173 - DNA, 16 bp, H. sapiens
gatgccagcagcaccc

SEQ ID NO: 104174 - DNA, 16 bp, H. sapiens
gatgccagctggagct

SEQ ID NO: 104175 - DNA, 16 bp, H. sapiens
gatgccagtagcactc

SEQ ID NO: 104176 - DNA, 16 bp, H. sapiens
gatgccatcttctccc

SEQ ID NO: 104177 - DNA, 16 bp, H. sapiens
gatgcccagactggag

SEQ ID NO: 104178 - DNA, 16 bp, H. sapiens
gatgcccagagagctg

SEQ ID NO: 104179 - DNA, 16 bp, H. sapiens
gatgccccaccctgct

SEQ ID NO: 104180 - DNA, 16 bp, H. sapiens
gatgcctccagctttc

SEQ ID NO: 104181 - DNA, 17 bp, H. sapiens
gatgcctgggtggaggg

SEQ ID NO: 104182 - DNA, 16 bp, H. sapiens
gatgcctgtaatccta

SEQ ID NO: 104183 - DNA, 16 bp, H. sapiens
gatgcctgtggaatgt

SEQ ID NO: 104184 - DNA, 16 bp, H. sapiens
gatgccttcagcttta

SEQ ID NO: 104185 - DNA, 16 bp, H. sapiens
gatgctcaacctcact

SEQ ID NO: 104186 - DNA, 16 bp, H. sapiens
gatgctcaacctgtat

SEQ ID NO: 104187 - DNA, 16 bp, H. sapiens
gatgctcaataaatgt

SEQ ID NO: 104188 - DNA, 16 bp, H. sapiens
gatgctccagcttggt

SEQ ID NO: 104189 - DNA, 16 bp, H. sapiens
gatgctcccgcctcag

SEQ ID NO: 104190 - DNA, 16 bp, H. sapiens
gatgctcctcaattta

SEQ ID NO: 104191 - DNA, 16 bp, H. sapiens
gatgctccttgactta

SEQ ID NO: 104192 - DNA, 16 bp, H. sapiens
gatgctctcccttctc

SEQ ID NO: 104193 - DNA, 16 bp, H. sapiens
gatgctgacatctgct

SEQ ID NO: 104194 - DNA, 17 bp, H. sapiens
gatgctgaggcacgaga

SEQ ID NO: 104195 - DNA, 16 bp, H. sapiens
gatgctgaggcagaag

SEQ ID NO: 104196 - DNA, 16 bp, H. sapiens
gatgctgaggcaggaa

SEQ ID NO: 104197 - DNA, 16 bp, H. sapiens
gatgctgaggcaggag

SEQ ID NO: 104198 - DNA, 16 bp, H. sapiens
gatgctgaggtgggtg

SEQ ID NO: 104199 - DNA, 16 bp, H. sapiens
gatgctgaggttgcag

SEQ ID NO: 104200 - DNA, 16 bp, H. sapiens
gatgctgatgaggatg

SEQ ID NO: 104201 - DNA, 16 bp, H. sapiens
gatgctgatgatgctg

SEQ ID NO: 104202 - DNA, 16 bp, H. sapiens
gatgctgatgctgatg

SEQ ID NO: 104203 - DNA, 16 bp, H. sapiens
gatgctgatgctgctg

SEQ ID NO: 104204 - DNA, 16 bp, H. sapiens
gatgctgatggtgatg

SEQ ID NO: 104205 - DNA, 16 bp, H. sapiens
gatgctgctgcagggc

SEQ ID NO: 104206 - DNA, 16 bp, H. sapiens
gatgctgctgctgctg

SEQ ID NO: 104207 - DNA, 16 bp, H. sapiens
gatgctgctggcctgg

SEQ ID NO: 104208 - DNA, 16 bp, H. sapiens
gatgctggaaaccatc

SEQ ID NO: 104209 - DNA, 16 bp, H. sapiens
gatgctggacaagaac

SEQ ID NO: 104210 - DNA, 16 bp, H. sapiens
gatgctggattttatc

SEQ ID NO: 104211 - DNA, 16 bp, H. sapiens
gatgctggcagaagac

SEQ ID NO: 104212 - DNA, 16 bp, H. sapiens
gatgctggcttcacag

SEQ ID NO: 104213 - DNA, 16 bp, H. sapiens
gatgctggggaggatg

SEQ ID NO: 104214 - DNA, 16 bp, H. sapiens
gatgctggggtgggag

SEQ ID NO: 104215 - DNA, 16 bp, H. sapiens
gatgctggtgaagatg

SEQ ID NO: 104216 - DNA, 16 bp, H. sapiens
gatgctggtgaggatg

SEQ ID NO: 104217 - DNA, 16 bp, H. sapiens
gatgctggtgatgctg

SEQ ID NO: 104218 - DNA, 16 bp, H. sapiens
gatgctggtgctgctg

SEQ ID NO: 104219 - DNA, 16 bp, H. sapiens
gatgctggtggtggtg

SEQ ID NO: 104220 - DNA, 16 bp, H. sapiens
gatgctgttcagctgc

SEQ ID NO: 104221 - DNA, 16 bp, H. sapiens
gatgcttcaggggccc

SEQ ID NO: 104222 - DNA, 16 bp, H. sapiens
gatgcttgtgattttt

SEQ ID NO: 104223 - DNA, 16 bp, H. sapiens
gatggaaaaatatatt

SEQ ID NO: 104224 - DNA, 16 bp, H. sapiens
gatggaaaataaacat

SEQ ID NO: 104225 - DNA, 16 bp, H. sapiens
gatggaaaattgaaag

SEQ ID NO: 104226 - DNA, 16 bp, H. sapiens
gatggaaatgaggaaa

SEQ ID NO: 104227 - DNA, 16 bp, H. sapiens
gatggaactagagatc

SEQ ID NO: 104228 - DNA, 16 bp, H. sapiens
gatggaactttgttcc

SEQ ID NO: 104229 - DNA, 16 bp, H. sapiens
gatggaagaaaatatt

SEQ ID NO: 104230 - DNA, 16 bp, H. sapiens
gatggaagacagtgat

SEQ ID NO: 104231 - DNA, 16 bp, H. sapiens
gatggaagagatggag

SEQ ID NO: 104232 - DNA, 16 bp, H. sapiens
gatggaagtggaagtg

SEQ ID NO: 104233 - DNA, 16 bp, H. sapiens
gatggaagttcatttg

SEQ ID NO: 104234 - DNA, 16 bp, H. sapiens
gatggaattaaagttg

SEQ ID NO: 104235 - DNA, 16 bp, H. sapiens
gatggacacttaggtt

SEQ ID NO: 104236 - DNA, 16 bp, H. sapiens
gatggacagatggatg

SEQ ID NO: 104237 - DNA, 16 bp, H. sapiens
gatggacagttgggtt

SEQ ID NO: 104238 - DNA, 16 bp, H. sapiens
gatggacatggtggag

SEQ ID NO: 104239 - DNA, 16 bp, H. sapiens
gatggaccttgaaaac

SEQ ID NO: 104240 - DNA, 16 bp, H. sapiens
gatggagaaaaatcta

SEQ ID NO: 104241 - DNA, 16 bp, H. sapiens
gatggagaaacagagg

SEQ ID NO: 104242 - DNA, 16 bp, H. sapiens
gatggagaaactgcag

SEQ ID NO: 104243 - DNA, 16 bp, H. sapiens
gatggagaagaggaac

SEQ ID NO: 104244 - DNA, 16 bp, H. sapiens
gatggagacagagaga

SEQ ID NO: 104245 - DNA, 16 bp, H. sapiens
gatggagaccctcctg

SEQ ID NO: 104246 - DNA, 16 bp, H. sapiens
gatggagaccttcctg

SEQ ID NO: 104247 - DNA, 16 bp, H. sapiens
gatggagagatggaga

SEQ ID NO: 104248 - DNA, 16 bp, H. sapiens
gatggagagcatcctg

SEQ ID NO: 104249 - DNA, 16 bp, H. sapiens
gatggagaggaaagca

SEQ ID NO: 104250 - DNA, 16 bp, H. sapiens
gatggagataaggaac

SEQ ID NO: 104251 - DNA, 16 bp, H. sapiens
gatggagatgagaaac

SEQ ID NO: 104252 - DNA, 16 bp, H. sapiens
gatggagatgaggaaa

SEQ ID NO: 104253 - DNA, 16 bp, H. sapiens
gatggagatgatgatg

SEQ ID NO: 104254 - DNA, 16 bp, H. sapiens
gatggagcaatggcaa

SEQ ID NO: 104255 - DNA, 16 bp, H. sapiens
gatggagctgaaaaca

SEQ ID NO: 104256 - DNA, 16 bp, H. sapiens
gatggagctggagggc

SEQ ID NO: 104257 - DNA, 16 bp, H. sapiens
gatggaggcaggagga

SEQ ID NO: 104258 - DNA, 16 bp, H. sapiens
gatggaggctggaaga

SEQ ID NO: 104259 - DNA, 16 bp, H. sapiens
gatggagtcctgctct

SEQ ID NO: 104260 - DNA, 16 bp, H. sapiens
gatggagtctcactgt

SEQ ID NO: 104261 - DNA, 16 bp, H. sapiens
gatggagtctcatgct

SEQ ID NO: 104262 - DNA, 16 bp, H. sapiens
gatggagtctccctcc

SEQ ID NO: 104263 - DNA, 16 bp, H. sapiens
gatggagtctcctctg

SEQ ID NO: 104264 - DNA, 16 bp, H. sapiens
gatggagtctctgtca

SEQ ID NO: 104265 - DNA, 16 bp, H. sapiens
gatggagtcttaccct

SEQ ID NO: 104266 - DNA, 16 bp, H. sapiens
gatggagtgcaatggc

SEQ ID NO: 104267 - DNA, 16 bp, H. sapiens
gatggagttggaggcc

SEQ ID NO: 104268 - DNA, 16 bp, H. sapiens
gatggagtttccctct

SEQ ID NO: 104269 - DNA, 16 bp, H. sapiens
gatggataaatgaata

SEQ ID NO: 104270 - DNA, 16 bp, H. sapiens
gatggatatcccattt

SEQ ID NO: 104271 - DNA, 16 bp, H. sapiens
gatggatatgttaatt

SEQ ID NO: 104272 - DNA, 16 bp, H. sapiens
gatggatcactggagg

SEQ ID NO: 104273 - DNA, 16 bp, H. sapiens
gatggatgaataggtg

SEQ ID NO: 104274 - DNA, 16 bp, H. sapiens
gatggatgaatggaag

SEQ ID NO: 104275 - DNA, 16 bp, H. sapiens
gatggatgaatgggtg

SEQ ID NO: 104276 - DNA, 16 bp, H. sapiens
gatggatggatgaaca

SEQ ID NO: 104277 - DNA, 16 bp, H. sapiens
gatggatggatgatgg

SEQ ID NO: 104278 - DNA, 16 bp, H. sapiens
gatggatgtttggatg

SEQ ID NO: 104279 - DNA, 16 bp, H. sapiens
gatggattctcgctct

SEQ ID NO: 104280 - DNA, 16 bp, H. sapiens
gatggattgcttgagc

SEQ ID NO: 104281 - DNA, 16 bp, H. sapiens
gatggcaacactgcac

SEQ ID NO: 104282 - DNA, 16 bp, H. sapiens
gatggcaccactgcag

SEQ ID NO: 104283 - DNA, 16 bp, H. sapiens
gatggcaccactgctc

SEQ ID NO: 104284 - DNA, 17 bp, H. sapiens
gatggcaccattgcacc

SEQ ID NO: 104285 - DNA, 20 bp, H. sapiens
gatggcaccattgcactcca

SEQ ID NO: 104286 - DNA, 16 bp, H. sapiens
gatggcaccttcttgc

SEQ ID NO: 104287 - DNA, 16 bp, H. sapiens
gatggcagaacagaaa

SEQ ID NO: 104288 - DNA, 17 bp, H. sapiens
gatggcagctggacttt

SEQ ID NO: 104289 - DNA, 16 bp, H. sapiens
gatggcaggagagaga

SEQ ID NO: 104290 - DNA, 16 bp, H. sapiens
gatggcaggaggggtg

SEQ ID NO: 104291 - DNA, 16 bp, H. sapiens
gatggcattgaatgtg

SEQ ID NO: 104292 - DNA, 16 bp, H. sapiens
gatggccaacccacct

SEQ ID NO: 104293 - DNA, 16 bp, H. sapiens
gatggccagtgatgag

SEQ ID NO: 104294 - DNA, 16 bp, H. sapiens
gatggccattctaact

SEQ ID NO: 104295 - DNA, 16 bp, H. sapiens
gatggccgggtcaaat

SEQ ID NO: 104296 - DNA, 16 bp, H. sapiens
gatggccttctttgtc

SEQ ID NO: 104297 - DNA, 18 bp, H. sapiens
gatggcgccactgcactt

SEQ ID NO: 104298 - DNA, 16 bp, H. sapiens
gatggcgctgctgcac

SEQ ID NO: 104299 - DNA, 16 bp, H. sapiens
gatggcggccaggcag

SEQ ID NO: 104300 - DNA, 16 bp, H. sapiens
gatggctaaactaaaa

SEQ ID NO: 104301 - DNA, 16 bp, H. sapiens
gatggctattaaaaaa

SEQ ID NO: 104302 - DNA, 17 bp, H. sapiens
gatggctcacatctgta

SEQ ID NO: 104303 - DNA, 18 bp, H. sapiens
gatggctcacgcctgtaa

SEQ ID NO: 104304 - DNA, 16 bp, H. sapiens
gatggctgaggcagga

SEQ ID NO: 104305 - DNA, 16 bp, H. sapiens
gatggctgcacaactc

SEQ ID NO: 104306 - DNA, 16 bp, H. sapiens
gatggctgcagcagct

SEQ ID NO: 104307 - DNA, 16 bp, H. sapiens
gatggctgccgggaag

SEQ ID NO: 104308 - DNA, 16 bp, H. sapiens
gatggctgctgcagct

SEQ ID NO: 104309 - DNA, 16 bp, H. sapiens
gatggctgggccccac

SEQ ID NO: 104310 - DNA, 16 bp, H. sapiens
gatggctgtgtgtgtg

SEQ ID NO: 104311 - DNA, 16 bp, H. sapiens
gatggctgttatcaaa

SEQ ID NO: 104312 - DNA, 16 bp, H. sapiens
gatggcttatttcctt

SEQ ID NO: 104313 - DNA, 16 bp, H. sapiens
gatggcttgaggccag

SEQ ID NO: 104314 - DNA, 16 bp, H. sapiens
gatggctttttctttt

SEQ ID NO: 104315 - DNA, 16 bp, H. sapiens
gatgggaagaatggaa

SEQ ID NO: 104316 - DNA, 16 bp, H. sapiens
gatgggaagggggagc

SEQ ID NO: 104317 - DNA, 16 bp, H. sapiens
gatgggacccaagtct

SEQ ID NO: 104318 - DNA, 16 bp, H. sapiens
gatgggactacaggta

SEQ ID NO: 104319 - DNA, 16 bp, H. sapiens
gatgggaggagaccct

SEQ ID NO: 104320 - DNA, 16 bp, H. sapiens
gatgggaggagctgcc

SEQ ID NO: 104321 - DNA, 16 bp, H. sapiens
gatgggattacaagtg

SEQ ID NO: 104322 - DNA, 16 bp, H. sapiens
gatgggattagtgccc

SEQ ID NO: 104323 - DNA, 16 bp, H. sapiens
gatgggatttcaccgt

SEQ ID NO: 104324 - DNA, 16 bp, H. sapiens
gatgggatttcagcat

SEQ ID NO: 104325 - DNA, 16 bp, H. sapiens
gatgggcacggtggct

SEQ ID NO: 104326 - DNA, 16 bp, H. sapiens
gatgggcagatcacaa

SEQ ID NO: 104327 - DNA, 16 bp, H. sapiens
gatgggcagatcacca

SEQ ID NO: 104328 - DNA, 16 bp, H. sapiens
gatggggaaaaaacaa

SEQ ID NO: 104329 - DNA, 16 bp, H. sapiens
gatggggaaaatgagg

SEQ ID NO: 104330 - DNA, 16 bp, H. sapiens
gatggggaaaccgagg

SEQ ID NO: 104331 - DNA, 17 bp, H. sapiens
gatggggaaccaatcga

SEQ ID NO: 104332 - DNA, 16 bp, H. sapiens
gatggggagaaatcag

SEQ ID NO: 104333 - DNA, 16 bp, H. sapiens
gatggggagccagaag

SEQ ID NO: 104334 - DNA, 16 bp, H. sapiens
gatggggatacattct

SEQ ID NO: 104335 - DNA, 17 bp, H. sapiens
gatggggatggcactga

SEQ ID NO: 104336 - DNA, 17 bp, H. sapiens
gatggggccactgcact

SEQ ID NO: 104337 - DNA, 16 bp, H. sapiens
gatggggtggctgcca

SEQ ID NO: 104338 - DNA, 16 bp, H. sapiens
gatggggtggggccgt

SEQ ID NO: 104339 - DNA, 16 bp, H. sapiens
gatggggttacatccc

SEQ ID NO: 104340 - DNA, 16 bp, H. sapiens
gatggggttgttcttt

SEQ ID NO: 104341 - DNA, 16 bp, H. sapiens
gatggggtttcaccca

SEQ ID NO: 104342 - DNA, 16 bp, H. sapiens
gatggggttttcccat

SEQ ID NO: 104343 - DNA, 16 bp, H. sapiens
gatggggttttgccct

SEQ ID NO: 104344 - DNA, 16 bp, H. sapiens
gatggggttttggcat

SEQ ID NO: 104345 - DNA, 16 bp, H. sapiens
gatgggtccccagtga

SEQ ID NO: 104346 - DNA, 16 bp, H. sapiens
gatgggtgcagcgaac

SEQ ID NO: 104347 - DNA, 16 bp, H. sapiens
gatgggtgcctataat

SEQ ID NO: 104348 - DNA, 16 bp, H. sapiens
gatgggtggatggatg

SEQ ID NO: 104349 - DNA, 16 bp, H. sapiens
gatgggtttcctaaat

SEQ ID NO: 104350 - DNA, 16 bp, H. sapiens
gatgggttttgactct

SEQ ID NO: 104351 - DNA, 16 bp, H. sapiens
gatggtaaaaccctgt

SEQ ID NO: 104352 - DNA, 16 bp, H. sapiens
gatggtaacagacctt

SEQ ID NO: 104353 - DNA, 16 bp, H. sapiens
gatggtaatgatgatg

SEQ ID NO: 104354 - DNA, 16 bp, H. sapiens
gatggtagatttaaat

SEQ ID NO: 104355 - DNA, 16 bp, H. sapiens
gatggtattttctttt

SEQ ID NO: 104356 - DNA, 16 bp, H. sapiens
gatggtcacatgggga

SEQ ID NO: 104357 - DNA, 19 bp, H. sapiens
gatggtctcgattttctga

SEQ ID NO: 104358 - DNA, 16 bp, H. sapiens
gatggtcttgatgctt

SEQ ID NO: 104359 - DNA, 16 bp, H. sapiens
gatggtcttgatgtct

SEQ ID NO: 104360 - DNA, 30 bp, H. sapiens
gatggtgaaaccccgtctctactaaaaata

SEQ ID NO: 104361 - DNA, 16 bp, H. sapiens
gatggtgaaacccctt

SEQ ID NO: 104362 - DNA, 17 bp, H. sapiens
gatggtgaaactctgtc

SEQ ID NO: 104363 - DNA, 18 bp, H. sapiens
gatggtgaaatcctgtct

SEQ ID NO: 104364 - DNA, 16 bp, H. sapiens
gatggtgaaggcagag

SEQ ID NO: 104365 - DNA, 16 bp, H. sapiens
gatggtgaaggtggag

SEQ ID NO: 104366 - DNA, 16 bp, H. sapiens
gatggtgatgaagatg

SEQ ID NO: 104367 - DNA, 16 bp, H. sapiens
gatggtgatgacaatg

SEQ ID NO: 104368 - DNA, 16 bp, H. sapiens
gatggtgatgatcatg

SEQ ID NO: 104369 - DNA, 16 bp, H. sapiens
gatggtgatgattgtg

SEQ ID NO: 104370 - DNA, 16 bp, H. sapiens
gatggtgatggtgatg

SEQ ID NO: 104371 - DNA, 16 bp, H. sapiens
gatggtgcaaaagtga

SEQ ID NO: 104372 - DNA, 16 bp, H. sapiens
gatggtgccactgtac

SEQ ID NO: 104373 - DNA, 16 bp, H. sapiens
gatggtggatgcctgt

SEQ ID NO: 104374 - DNA, 16 bp, H. sapiens
gatggtggcagcagag

SEQ ID NO: 104375 - DNA, 16 bp, H. sapiens
gatggtggcagtggtg

SEQ ID NO: 104376 - DNA, 16 bp, H. sapiens
gatggtggcattttga

SEQ ID NO: 104377 - DNA, 19 bp, H. sapiens
gatggtggctcacacctgt

SEQ ID NO: 104378 - DNA, 16 bp, H. sapiens
gatggtggtagatgtg

SEQ ID NO: 104379 - DNA, 16 bp, H. sapiens
gatggtggtggtgaag

SEQ ID NO: 104380 - DNA, 16 bp, H. sapiens
gatggtgtcttttgaa

SEQ ID NO: 104381 - DNA, 16 bp, H. sapiens
gatggtgttgatgatg

SEQ ID NO: 104382 - DNA, 16 bp, H. sapiens
gatggttatcttctcc

SEQ ID NO: 104383 - DNA, 16 bp, H. sapiens
gatggtttccagcttt

SEQ ID NO: 104384 - DNA, 16 bp, H. sapiens
gatggtttggaggaaa

SEQ ID NO: 104385 - DNA, 16 bp, H. sapiens
gatggtttggggatga

SEQ ID NO: 104386 - DNA, 16 bp, H. sapiens
gatggttttatcagag

SEQ ID NO: 104387 - DNA, 16 bp, H. sapiens
gatggttttgagatga

SEQ ID NO: 104388 - DNA, 16 bp, H. sapiens
gatggttttgggatga

SEQ ID NO: 104389 - DNA, 16 bp, H. sapiens
gatgtaaaagaacaga

SEQ ID NO: 104390 - DNA, 16 bp, H. sapiens
gatgtaacaattctaa

SEQ ID NO: 104391 - DNA, 16 bp, H. sapiens
gatgtaatgcatgtct

SEQ ID NO: 104392 - DNA, 16 bp, H. sapiens
gatgtacacccactgc

SEQ ID NO: 104393 - DNA, 16 bp, H. sapiens
gatgtatattcctttg

SEQ ID NO: 104394 - DNA, 16 bp, H. sapiens
gatgtcagaggatgtt

SEQ ID NO: 104395 - DNA, 26 bp, H. sapiens
gatgtcatgctactgttagatcaaac

SEQ ID NO: 104396 - DNA, 16 bp, H. sapiens
gatgtccaggcagatg

SEQ ID NO: 104397 - DNA, 16 bp, H. sapiens
gatgtcccagctcaaa

SEQ ID NO: 104398 - DNA, 16 bp, H. sapiens
gatgtcccagctccag

SEQ ID NO: 104399 - DNA, 16 bp, H. sapiens
gatgtcctttctgctt

SEQ ID NO: 104400 - DNA, 17 bp, H. sapiens
gatgtcctttgcaggga

SEQ ID NO: 104401 - DNA, 16 bp, H. sapiens
gatgtctggggcctca

SEQ ID NO: 104402 - DNA, 16 bp, H. sapiens
gatgtctgtaatccca

SEQ ID NO: 104403 - DNA, 16 bp, H. sapiens
gatgtcttatgtctcc

SEQ ID NO: 104404 - DNA, 16 bp, H. sapiens
gatgtcttgacctcat

SEQ ID NO: 104405 - DNA, 16 bp, H. sapiens
gatgtcttttatttct

SEQ ID NO: 104406 - DNA, 16 bp, H. sapiens
gatgtcttttctttct

SEQ ID NO: 104407 - DNA, 16 bp, H. sapiens
gatgtgaaaactgagg

SEQ ID NO: 104408 - DNA, 16 bp, H. sapiens
gatgtgaaggagaaaa

SEQ ID NO: 104409 - DNA, 16 bp, H. sapiens
gatgtgacttgctcct

SEQ ID NO: 104410 - DNA, 18 bp, H. sapiens
gatgtgatagaaaagaaa

SEQ ID NO: 104411 - DNA, 16 bp, H. sapiens
gatgtgatgaaaaggg

SEQ ID NO: 104412 - DNA, 16 bp, H. sapiens
gatgtgatggctcacg

SEQ ID NO: 104413 - DNA, 16 bp, H. sapiens
gatgtgcaggtttttt

SEQ ID NO: 104414 - DNA, 16 bp, H. sapiens
gatgtgccaccatgcc

SEQ ID NO: 104415 - DNA, 16 bp, H. sapiens
gatgtgcctgctttcc

SEQ ID NO: 104416 - DNA, 16 bp, H. sapiens
gatgtgcctttgctct

SEQ ID NO: 104417 - DNA, 16 bp, H. sapiens
gatgtgctgctggatt

SEQ ID NO: 104418 - DNA, 16 bp, H. sapiens
gatgtgctgtcaccca

SEQ ID NO: 104419 - DNA, 16 bp, H. sapiens
gatgtggaacccatgg

SEQ ID NO: 104420 - DNA, 16 bp, H. sapiens
gatgtggagaaaatgg

SEQ ID NO: 104421 - DNA, 16 bp, H. sapiens
gatgtggagaaagtgg

SEQ ID NO: 104422 - DNA, 16 bp, H. sapiens
gatgtggagaaatatg

SEQ ID NO: 104423 - DNA, 16 bp, H. sapiens
gatgtggagaaattgg

SEQ ID NO: 104424 - DNA, 16 bp, H. sapiens
gatgtggagacatagg

SEQ ID NO: 104425 - DNA, 16 bp, H. sapiens
gatgtggagatgcagg

SEQ ID NO: 104426 - DNA, 16 bp, H. sapiens
gatgtggagcaacaag

SEQ ID NO: 104427 - DNA, 16 bp, H. sapiens
gatgtggagcagcagg

SEQ ID NO: 104428 - DNA, 16 bp, H. sapiens
gatgtggaggtggaaa

SEQ ID NO: 104429 - DNA, 16 bp, H. sapiens
gatgtggcagctgcag

SEQ ID NO: 104430 - DNA, 16 bp, H. sapiens
gatgtggctcacacct

SEQ ID NO: 104431 - DNA, 16 bp, H. sapiens
gatgtggctggggttt

SEQ ID NO: 104432 - DNA, 16 bp, H. sapiens
gatgtgggaggattgc

SEQ ID NO: 104433 - DNA, 16 bp, H. sapiens
gatgtggtgactcatg

SEQ ID NO: 104434 - DNA, 16 bp, H. sapiens
gatgtggtggtgcacg

SEQ ID NO: 104435 - DNA, 16 bp, H. sapiens
gatgtggttctcttaa

SEQ ID NO: 104436 - DNA, 16 bp, H. sapiens
gatgtggtttcatcat

SEQ ID NO: 104437 - DNA, 16 bp, H. sapiens
gatgtgtatgtgcagg

SEQ ID NO: 104438 - DNA, 16 bp, H. sapiens
gatgtgtccagaattt

SEQ ID NO: 104439 - DNA, 17 bp, H. sapiens
gatgtgtggtctgtggg

SEQ ID NO: 104440 - DNA, 16 bp, H. sapiens
gatgtgtgtcccctcc

SEQ ID NO: 104441 - DNA, 16 bp, H. sapiens
gatgtgtgtgcatgtg

SEQ ID NO: 104442 - DNA, 16 bp, H. sapiens
gatgtgtgtgtgtgcg

SEQ ID NO: 104443 - DNA, 16 bp, H. sapiens
gatgtgttcatgtcct

SEQ ID NO: 104444 - DNA, 16 bp, H. sapiens
gatgttacaaaatcat

SEQ ID NO: 104445 - DNA, 16 bp, H. sapiens
gatgttcaattttatc

SEQ ID NO: 104446 - DNA, 16 bp, H. sapiens
gatgttcacacagtga

SEQ ID NO: 104447 - DNA, 16 bp, H. sapiens
gatgttccccaccctg

SEQ ID NO: 104448 - DNA, 16 bp, H. sapiens
gatgttccctgccctg

SEQ ID NO: 104449 - DNA, 16 bp, H. sapiens
gatgttccttggcttg

SEQ ID NO: 104450 - DNA, 16 bp, H. sapiens
gatgttcttcagtgtc

SEQ ID NO: 104451 - DNA, 16 bp, H. sapiens
gatgttgaagatgaag

SEQ ID NO: 104452 - DNA, 16 bp, H. sapiens
gatgttgacatggatg

SEQ ID NO: 104453 - DNA, 16 bp, H. sapiens
gatgttgagcagtttt

SEQ ID NO: 104454 - DNA, 16 bp, H. sapiens
gatgttgagcttgttt

SEQ ID NO: 104455 - DNA, 16 bp, H. sapiens
gatgttgagcttttgt

SEQ ID NO: 104456 - DNA, 16 bp, H. sapiens
gatgttgaggctacag

SEQ ID NO: 104457 - DNA, 16 bp, H. sapiens
gatgttgaggtgggag

SEQ ID NO: 104458 - DNA, 16 bp, H. sapiens
gatgttgatgatgatg

SEQ ID NO: 104459 - DNA, 16 bp, H. sapiens
gatgttgatggtgatg

SEQ ID NO: 104460 - DNA, 16 bp, H. sapiens
gatgttgcagtgaacc

SEQ ID NO: 104461 - DNA, 16 bp, H. sapiens
gatgttgcagtgagcc

SEQ ID NO: 104462 - DNA, 16 bp, H. sapiens
gatgttggctgtggct

SEQ ID NO: 104463 - DNA, 16 bp, H. sapiens
gatgttggtgctattc

SEQ ID NO: 104464 - DNA, 16 bp, H. sapiens
gatgttgtcaccacca

SEQ ID NO: 104465 - DNA, 16 bp, H. sapiens
gatgtttaatgacata

SEQ ID NO: 104466 - DNA, 16 bp, H. sapiens
gatgtttatttaaaaa

SEQ ID NO: 104467 - DNA, 16 bp, H. sapiens
gatgtttcagtgagct

SEQ ID NO: 104468 - DNA, 16 bp, H. sapiens
gatgtttcatttattt

SEQ ID NO: 104469 - DNA, 16 bp, H. sapiens
gatgtttgctgtgggt

SEQ ID NO: 104470 - DNA, 16 bp, H. sapiens
gatgtttgtacaatga

SEQ ID NO: 104471 - DNA, 16 bp, H. sapiens
gatgtttgttgaatga

SEQ ID NO: 104472 - DNA, 16 bp, H. sapiens
gatgtttttctttctg

SEQ ID NO: 104473 - DNA, 16 bp, H. sapiens
gattaaaaaacaaatt

SEQ ID NO: 104474 - DNA, 16 bp, H. sapiens
gattaaaacaagacaa

SEQ ID NO: 104475 - DNA, 16 bp, H. sapiens
gattaaacagacttta

SEQ ID NO: 104476 - DNA, 16 bp, H. sapiens
gattaaataaggtaat

SEQ ID NO: 104477 - DNA, 16 bp, H. sapiens
gattaaatgagaacat

SEQ ID NO: 104478 - DNA, 16 bp, H. sapiens
gattaaatgagataat

SEQ ID NO: 104479 - DNA, 16 bp, H. sapiens
gattaaatgagctaat

SEQ ID NO: 104480 - DNA, 16 bp, H. sapiens
gattaaattctccaat

SEQ ID NO: 104481 - DNA, 16 bp, H. sapiens
gattaacaggcatgag

SEQ ID NO: 104482 - DNA, 16 bp, H. sapiens
gattaacatccaaagg

SEQ ID NO: 104483 - DNA, 16 bp, H. sapiens
gattaacttggcaatg

SEQ ID NO: 104484 - DNA, 16 bp, H. sapiens
gattaagaaactcaaa

SEQ ID NO: 104485 - DNA, 16 bp, H. sapiens
gattaaggaaatgtgg

SEQ ID NO: 104486 - DNA, 16 bp, H. sapiens
gattaaggatgctcaa

SEQ ID NO: 104487 - DNA, 16 bp, H. sapiens
gattaagtttcaacat

SEQ ID NO: 104488 - DNA, 16 bp, H. sapiens
gattaatatacaaaaa

SEQ ID NO: 104489 - DNA, 16 bp, H. sapiens
gattaatgaaaatgaa

SEQ ID NO: 104490 - DNA, 16 bp, H. sapiens
gattaatgtcattatc

SEQ ID NO: 104491 - DNA, 16 bp, H. sapiens
gattaattatgttgag

SEQ ID NO: 104492 - DNA, 16 bp, H. sapiens
gattacagcactgcac

SEQ ID NO: 104493 - DNA, 16 bp, H. sapiens
gattacaggaatgcac

SEQ ID NO: 104494 - DNA, 16 bp, H. sapiens
gattacaggcaccagt

SEQ ID NO: 104495 - DNA, 16 bp, H. sapiens
gattacaggcatgagg

SEQ ID NO: 104496 - DNA, 19 bp, H. sapiens
gattacaggcctcagccac

SEQ ID NO: 104497 - DNA, 20 bp, H. sapiens
gattacaggcgtgagcctcc

SEQ ID NO: 104498 - DNA, 16 bp, H. sapiens
gattacaggcgtgagg

SEQ ID NO: 104499 - DNA, 16 bp, H. sapiens
gattacagggatgagc

SEQ ID NO: 104500 - DNA, 16 bp, H. sapiens
gattacaggtatgagc

SEQ ID NO: 104501 - DNA, 17 bp, H. sapiens
gattacaggtggctgcc

SEQ ID NO: 104502 - DNA, 16 bp, H. sapiens
gattacatcaaactga

SEQ ID NO: 104503 - DNA, 16 bp, H. sapiens
gattacatcaagctaa

SEQ ID NO: 104504 - DNA, 16 bp, H. sapiens
gattacattccattca

SEQ ID NO: 104505 - DNA, 16 bp, H. sapiens
gattacctgagatcag

SEQ ID NO: 104506 - DNA, 16 bp, H. sapiens
gattacgtgtcttggg

SEQ ID NO: 104507 - DNA, 16 bp, H. sapiens
gattactattttcact

SEQ ID NO: 104508 - DNA, 16 bp, H. sapiens
gattactggatcatat

SEQ ID NO: 104509 - DNA, 16 bp, H. sapiens
gattagaggcacccgc

SEQ ID NO: 104510 - DNA, 16 bp, H. sapiens
gattagttatttattc

SEQ ID NO: 104511 - DNA, 16 bp, H. sapiens
gattataatccaaagt

SEQ ID NO: 104512 - DNA, 16 bp, H. sapiens
gattatacagtatttg

SEQ ID NO: 104513 - DNA, 16 bp, H. sapiens
gattatatggtttttg

SEQ ID NO: 104514 - DNA, 16 bp, H. sapiens
gattatatttcaatat

SEQ ID NO: 104515 - DNA, 16 bp, H. sapiens
gattatgggaactata

SEQ ID NO: 104516 - DNA, 16 bp, H. sapiens
gattatggtgatgatg

SEQ ID NO: 104517 - DNA, 16 bp, H. sapiens
gattattaaaaagtca

SEQ ID NO: 104518 - DNA, 16 bp, H. sapiens
gattattaaaatcttc

SEQ ID NO: 104519 - DNA, 16 bp, H. sapiens
gattatttctttggca

SEQ ID NO: 104520 - DNA, 16 bp, H. sapiens
gattattttcagtttt

SEQ ID NO: 104521 - DNA, 16 bp, H. sapiens
gattattttggagcct

SEQ ID NO: 104522 - DNA, 16 bp, H. sapiens
gattcaaagccaggca

SEQ ID NO: 104523 - DNA, 16 bp, H. sapiens
gattcaacattcaaaa

SEQ ID NO: 104524 - DNA, 16 bp, H. sapiens
gattcaagcgattctc

SEQ ID NO: 104525 - DNA, 16 bp, H. sapiens
gattcaagctattctc

SEQ ID NO: 104526 - DNA, 16 bp, H. sapiens
gattcaagtgattctt

SEQ ID NO: 104527 - DNA, 16 bp, H. sapiens
gattcacagcagaatt

SEQ ID NO: 104528 - DNA, 16 bp, H. sapiens
gattcacagctgattt

SEQ ID NO: 104529 - DNA, 16 bp, H. sapiens
gattcactattctaga

SEQ ID NO: 104530 - DNA, 16 bp, H. sapiens
gattcactgcaacctc

SEQ ID NO: 104531 - DNA, 16 bp, H. sapiens
gattcactgccatccc

SEQ ID NO: 104532 - DNA, 16 bp, H. sapiens
gattcagaaagcaagt

SEQ ID NO: 104533 - DNA, 16 bp, H. sapiens
gattcagaaagctgta

SEQ ID NO: 104534 - DNA, 16 bp, H. sapiens
gattcagcattttgga

SEQ ID NO: 104535 - DNA, 16 bp, H. sapiens
gattcagtgtctggca

SEQ ID NO: 104536 - DNA, 16 bp, H. sapiens
gattcatcacataaat

SEQ ID NO: 104537 - DNA, 16 bp, H. sapiens
gattcatcagtttgga

SEQ ID NO: 104538 - DNA, 16 bp, H. sapiens
gattcatctcacagtg

SEQ ID NO: 104539 - DNA, 16 bp, H. sapiens
gattcattcattcatt

SEQ ID NO: 104540 - DNA, 16 bp, H. sapiens
gattccagaagaaggc

SEQ ID NO: 104541 - DNA, 16 bp, H. sapiens
gattccaggtatgagc

SEQ ID NO: 104542 - DNA, 16 bp, H. sapiens
gattccatgtctttct

SEQ ID NO: 104543 - DNA, 16 bp, H. sapiens
gattccatgtgtttgc

SEQ ID NO: 104544 - DNA, 16 bp, H. sapiens
gattccattgaactgg

SEQ ID NO: 104545 - DNA, 16 bp, H. sapiens
gattccatttatgtaa

SEQ ID NO: 104546 - DNA, 16 bp, H. sapiens
gattccatttgatgat

SEQ ID NO: 104547 - DNA, 16 bp, H. sapiens
gattcccaggaatatg

SEQ ID NO: 104548 - DNA, 16 bp, H. sapiens
gattcccaggttcaag

SEQ ID NO: 104549 - DNA, 16 bp, H. sapiens
gattccccttcctcag

SEQ ID NO: 104550 - DNA, 16 bp, H. sapiens
gattccctctctttct

SEQ ID NO: 104551 - DNA, 16 bp, H. sapiens
gattcccttttctcta

SEQ ID NO: 104552 - DNA, 16 bp, H. sapiens
gattcccttttcttca

SEQ ID NO: 104553 - DNA, 16 bp, H. sapiens
gattcctaaggtttcc

SEQ ID NO: 104554 - DNA, 16 bp, H. sapiens
gattcctcaagaatct

SEQ ID NO: 104555 - DNA, 16 bp, H. sapiens
gattcctgggccccac

SEQ ID NO: 104556 - DNA, 16 bp, H. sapiens
gattcctgggccccat

SEQ ID NO: 104557 - DNA, 16 bp, H. sapiens
gattccttgaagaact

SEQ ID NO: 104558 - DNA, 16 bp, H. sapiens
gattccttgagatttt

SEQ ID NO: 104559 - DNA, 16 bp, H. sapiens
gattcctttcaaaatg

SEQ ID NO: 104560 - DNA, 16 bp, H. sapiens
gattccttttatttct

SEQ ID NO: 104561 - DNA, 16 bp, H. sapiens
gattctaaatatgcct

SEQ ID NO: 104562 - DNA, 16 bp, H. sapiens
gattctacaaaaaaag

SEQ ID NO: 104563 - DNA, 16 bp, H. sapiens
gattctacacaagaag

SEQ ID NO: 104564 - DNA, 16 bp, H. sapiens
gattctacaggccagg

SEQ ID NO: 104565 - DNA, 16 bp, H. sapiens
gattctacataaacag

SEQ ID NO: 104566 - DNA, 16 bp, H. sapiens
gattctacttcttcct

SEQ ID NO: 104567 - DNA, 16 bp, H. sapiens
gattctattttgtaat

SEQ ID NO: 104568 - DNA, 16 bp, H. sapiens
gattctcacaaggagc

SEQ ID NO: 104569 - DNA, 16 bp, H. sapiens
gattctcactctgtca

SEQ ID NO: 104570 - DNA, 17 bp, H. sapiens
gattctcataaggagcg

SEQ ID NO: 104571 - DNA, 16 bp, H. sapiens
gattctccagccccag

SEQ ID NO: 104572 - DNA, 16 bp, H. sapiens
gattctcccaccttgg

SEQ ID NO: 104573 - DNA, 16 bp, H. sapiens
gattctcccctggagc

SEQ ID NO: 104574 - DNA, 16 bp, H. sapiens
gattctcccgtctcag

SEQ ID NO: 104575 - DNA, 19 bp, H. sapiens
gattctcctacctcagcct

SEQ ID NO: 104576 - DNA, 18 bp, H. sapiens
gattctcctacctcagct

SEQ ID NO: 104577 - DNA, 18 bp, H. sapiens
gattctcctgcctcagct

SEQ ID NO: 104578 - DNA, 16 bp, H. sapiens
gattctcctgcctcct

SEQ ID NO: 104579 - DNA, 16 bp, H. sapiens
gattctcctgctttag

SEQ ID NO: 104580 - DNA, 16 bp, H. sapiens
gattctcctgtttcag

SEQ ID NO: 104581 - DNA, 16 bp, H. sapiens
gattctcgagcctcag

SEQ ID NO: 104582 - DNA, 18 bp, H. sapiens
gattctctgcctcagcct

SEQ ID NO: 104583 - DNA, 16 bp, H. sapiens
gattctgaaatctttc

SEQ ID NO: 104584 - DNA, 16 bp, H. sapiens
gattctgagtggaggt

SEQ ID NO: 104585 - DNA, 16 bp, H. sapiens
gattctgatgctgctg

SEQ ID NO: 104586 - DNA, 16 bp, H. sapiens
gattctgattcaggag

SEQ ID NO: 104587 - DNA, 16 bp, H. sapiens
gattctgattctgatt

SEQ ID NO: 104588 - DNA, 16 bp, H. sapiens
gattctgcatgtctaa

SEQ ID NO: 104589 - DNA, 16 bp, H. sapiens
gattctggattttttt

SEQ ID NO: 104590 - DNA, 16 bp, H. sapiens
gattctgtatcttggc

SEQ ID NO: 104591 - DNA, 16 bp, H. sapiens
gattctgttaatgtga

SEQ ID NO: 104592 - DNA, 16 bp, H. sapiens
gattcttaggtatttt

SEQ ID NO: 104593 - DNA, 16 bp, H. sapiens
gattcttatgcctcag

SEQ ID NO: 104594 - DNA, 16 bp, H. sapiens
gattcttccacctcgg

SEQ ID NO: 104595 - DNA, 16 bp, H. sapiens
gattcttctctctttt

SEQ ID NO: 104596 - DNA, 16 bp, H. sapiens
gattcttctgccttag

SEQ ID NO: 104597 - DNA, 16 bp, H. sapiens
gattcttgtgtctcag

SEQ ID NO: 104598 - DNA, 16 bp, H. sapiens
gattctttccttcctc

SEQ ID NO: 104599 - DNA, 16 bp, H. sapiens
gattctttccttggct

SEQ ID NO: 104600 - DNA, 16 bp, H. sapiens
gattctttgaaaaaaa

SEQ ID NO: 104601 - DNA, 16 bp, H. sapiens
gattgaaaggagaaag

SEQ ID NO: 104602 - DNA, 16 bp, H. sapiens
gattgaaggatgcaaa

SEQ ID NO: 104603 - DNA, 16 bp, H. sapiens
gattgaaggctgcact

SEQ ID NO: 104604 - DNA, 19 bp, H. sapiens
gattgacaaatgggatcta

SEQ ID NO: 104605 - DNA, 16 bp, H. sapiens
gattgacttcttgatt

SEQ ID NO: 104606 - DNA, 16 bp, H. sapiens
gattgagaaagagaga

SEQ ID NO: 104607 - DNA, 16 bp, H. sapiens
gattgagaacatgcgg

SEQ ID NO: 104608 - DNA, 16 bp, H. sapiens
gattgagaacatgtgg

SEQ ID NO: 104609 - DNA, 16 bp, H. sapiens
gattgagaccatcctg

SEQ ID NO: 104610 - DNA, 16 bp, H. sapiens
gattgagatggagtct

SEQ ID NO: 104611 - DNA, 16 bp, H. sapiens
gattgagcccctgcac

SEQ ID NO: 104612 - DNA, 16 bp, H. sapiens
gattgaggcagaagaa

SEQ ID NO: 104613 - DNA, 16 bp, H. sapiens
gattgaggctgctgtg

SEQ ID NO: 104614 - DNA, 16 bp, H. sapiens
gattgagtcttgctct

SEQ ID NO: 104615 - DNA, 16 bp, H. sapiens
gattgataaagcaagt

SEQ ID NO: 104616 - DNA, 16 bp, H. sapiens
gattgatgcagaagac

SEQ ID NO: 104617 - DNA, 16 bp, H. sapiens
gattgatgcagaagat

SEQ ID NO: 104618 - DNA, 16 bp, H. sapiens
gattgcaaaaaccatg

SEQ ID NO: 104619 - DNA, 16 bp, H. sapiens
gattgcaacacctgct

SEQ ID NO: 104620 - DNA, 16 bp, H. sapiens
gattgcaccacggcac

SEQ ID NO: 104621 - DNA, 16 bp, H. sapiens
gattgcaccactgcag

SEQ ID NO: 104622 - DNA, 16 bp, H. sapiens
gattgcaccattgccc

SEQ ID NO: 104623 - DNA, 16 bp, H. sapiens
gattgcaggcatgtgc

SEQ ID NO: 104624 - DNA, 16 bp, H. sapiens
gattgcagtgggctga

SEQ ID NO: 104625 - DNA, 17 bp, H. sapiens
gattgcatcagctcctg

SEQ ID NO: 104626 - DNA, 16 bp, H. sapiens
gattgcattggctcct

SEQ ID NO: 104627 - DNA, 16 bp, H. sapiens
gattgcctcctcaagt

SEQ ID NO: 104628 - DNA, 16 bp, H. sapiens
gattgcctcctttgga

SEQ ID NO: 104629 - DNA, 16 bp, H. sapiens
gattgcctctttttct

SEQ ID NO: 104630 - DNA, 16 bp, H. sapiens
gattgcctgagctcag

SEQ ID NO: 104631 - DNA, 26 bp, H. sapiens
gattgcgccactgcactccagcctga

SEQ ID NO: 104632 - DNA, 19 bp, H. sapiens
gattgcgccactgcactct

SEQ ID NO: 104633 - DNA, 16 bp, H. sapiens
gattgctcaagctcag

SEQ ID NO: 104634 - DNA, 16 bp, H. sapiens
gattgctcatgcctgt

SEQ ID NO: 104635 - DNA, 16 bp, H. sapiens
gattgctcgaggccag

SEQ ID NO: 104636 - DNA, 16 bp, H. sapiens
gattgctctattgttt

SEQ ID NO: 104637 - DNA, 16 bp, H. sapiens
gattgctctggctatt

SEQ ID NO: 104638 - DNA, 16 bp, H. sapiens
gattgctggaggccag

SEQ ID NO: 104639 - DNA, 16 bp, H. sapiens
gattgcttcagcccaa

SEQ ID NO: 104640 - DNA, 16 bp, H. sapiens
gattgcttcagcccag

SEQ ID NO: 104641 - DNA, 16 bp, H. sapiens
gattgcttgagaccag

SEQ ID NO: 104642 - DNA, 16 bp, H. sapiens
gattgcttgaggtcaa

SEQ ID NO: 104643 - DNA, 16 bp, H. sapiens
gattggaaacttcctg

SEQ ID NO: 104644 - DNA, 16 bp, H. sapiens
gattggaaatgaagaa

SEQ ID NO: 104645 - DNA, 16 bp, H. sapiens
gattggaagaattagt

SEQ ID NO: 104646 - DNA, 16 bp, H. sapiens
gattggaggattgctt

SEQ ID NO: 104647 - DNA, 16 bp, H. sapiens
gattggattatggagg

SEQ ID NO: 104648 - DNA, 16 bp, H. sapiens
gattggcacaaaagta

SEQ ID NO: 104649 - DNA, 16 bp, H. sapiens
gattgggtgaggccca

SEQ ID NO: 104650 - DNA, 16 bp, H. sapiens
gattggtattagtttt

SEQ ID NO: 104651 - DNA, 16 bp, H. sapiens
gattggtgaacctgaa

SEQ ID NO: 104652 - DNA, 16 bp, H. sapiens
gattggtgtgtttgca

SEQ ID NO: 104653 - DNA, 16 bp, H. sapiens
gattggtgttcctgaa

SEQ ID NO: 104654 - DNA, 16 bp, H. sapiens
gattggttggtttgta

SEQ ID NO: 104655 - DNA, 16 bp, H. sapiens
gattgtaaatatttta

SEQ ID NO: 104656 - DNA, 22 bp, H. sapiens
gattgtatatttagaaaaccct

SEQ ID NO: 104657 - DNA, 16 bp, H. sapiens
gattgtgatgatgatg

SEQ ID NO: 104658 - DNA, 16 bp, H. sapiens
gattgtgatggtgatg

SEQ ID NO: 104659 - DNA, 16 bp, H. sapiens
gattgtgcactccagc

SEQ ID NO: 104660 - DNA, 16 bp, H. sapiens
gattgtgccactgcat

SEQ ID NO: 104661 - DNA, 16 bp, H. sapiens
gattgtgctgatggtt

SEQ ID NO: 104662 - DNA, 16 bp, H. sapiens
gattgtggtaatcatt

SEQ ID NO: 104663 - DNA, 16 bp, H. sapiens
gattgtggtgacagtt

SEQ ID NO: 104664 - DNA, 16 bp, H. sapiens
gattgtggtgatggtt

SEQ ID NO: 104665 - DNA, 16 bp, H. sapiens
gattgtgtgccactgc

SEQ ID NO: 104666 - DNA, 16 bp, H. sapiens
gattgtgtttattgat

SEQ ID NO: 104667 - DNA, 16 bp, H. sapiens
gattgtttactttgct

SEQ ID NO: 104668 - DNA, 16 bp, H. sapiens
gattgtttgtaacaaa

SEQ ID NO: 104669 - DNA, 16 bp, H. sapiens
gattgttttggctatt

SEQ ID NO: 104670 - DNA, 16 bp, H. sapiens
gatttaatgacaaagg

SEQ ID NO: 104671 - DNA, 16 bp, H. sapiens
gatttataaagaaaag

SEQ ID NO: 104672 - DNA, 16 bp, H. sapiens
gatttataaagcaaat

SEQ ID NO: 104673 - DNA, 16 bp, H. sapiens
gatttatattcttctg

SEQ ID NO: 104674 - DNA, 16 bp, H. sapiens
gatttatgaacagaaa

SEQ ID NO: 104675 - DNA, 16 bp, H. sapiens
gatttatgtttctctt

SEQ ID NO: 104676 - DNA, 16 bp, H. sapiens
gatttattgacttcat

SEQ ID NO: 104677 - DNA, 16 bp, H. sapiens
gatttatttgttcatt

SEQ ID NO: 104678 - DNA, 16 bp, H. sapiens
gatttcaattcttttg

SEQ ID NO: 104679 - DNA, 16 bp, H. sapiens
gatttcacacacacac

SEQ ID NO: 104680 - DNA, 16 bp, H. sapiens
gatttcaccagttttt

SEQ ID NO: 104681 - DNA, 16 bp, H. sapiens
gatttcactatgttgc

SEQ ID NO: 104682 - DNA, 16 bp, H. sapiens
gatttcaggcacccac

SEQ ID NO: 104683 - DNA, 16 bp, H. sapiens
gatttcatggacactt

SEQ ID NO: 104684 - DNA, 16 bp, H. sapiens
gatttcattcattttt

SEQ ID NO: 104685 - DNA, 16 bp, H. sapiens
gatttcattcttattt

SEQ ID NO: 104686 - DNA, 16 bp, H. sapiens
gatttcattctttgtt

SEQ ID NO: 104687 - DNA, 16 bp, H. sapiens
gatttcattgagcttc

SEQ ID NO: 104688 - DNA, 16 bp, H. sapiens
gatttcatttgcattt

SEQ ID NO: 104689 - DNA, 16 bp, H. sapiens
gatttccagcttcatc

SEQ ID NO: 104690 - DNA, 16 bp, H. sapiens
gatttccattcctttg

SEQ ID NO: 104691 - DNA, 16 bp, H. sapiens
gatttcccaggctcaa

SEQ ID NO: 104692 - DNA, 16 bp, H. sapiens
gatttcctcagtggct

SEQ ID NO: 104693 - DNA, 16 bp, H. sapiens
gatttcctctcttctt

SEQ ID NO: 104694 - DNA, 16 bp, H. sapiens
gatttcctcttttcca

SEQ ID NO: 104695 - DNA, 16 bp, H. sapiens
gatttccttttcctag

SEQ ID NO: 104696 - DNA, 16 bp, H. sapiens
gatttctcaaagaact

SEQ ID NO: 104697 - DNA, 16 bp, H. sapiens
gatttctcagattttg

SEQ ID NO: 104698 - DNA, 16 bp, H. sapiens
gatttctcagcagaaa

SEQ ID NO: 104699 - DNA, 16 bp, H. sapiens
gatttctcatcagaaa

SEQ ID NO: 104700 - DNA, 16 bp, H. sapiens
gatttctcatctataa

SEQ ID NO: 104701 - DNA, 16 bp, H. sapiens
gatttctcatctgaaa

SEQ ID NO: 104702 - DNA, 16 bp, H. sapiens
gatttctctgtaacat

SEQ ID NO: 104703 - DNA, 16 bp, H. sapiens
gatttctcttctctgg

SEQ ID NO: 104704 - DNA, 16 bp, H. sapiens
gatttctcttcttcct

SEQ ID NO: 104705 - DNA, 16 bp, H. sapiens
gatttctgatattttg

SEQ ID NO: 104706 - DNA, 16 bp, H. sapiens
gatttctgcctcaatt

SEQ ID NO: 104707 - DNA, 16 bp, H. sapiens
gatttctggccaggca

SEQ ID NO: 104708 - DNA, 16 bp, H. sapiens
gatttcttatcagaaa

SEQ ID NO: 104709 - DNA, 16 bp, H. sapiens
gatttcttcttgattt

SEQ ID NO: 104710 - DNA, 16 bp, H. sapiens
gatttcttcttgctca

SEQ ID NO: 104711 - DNA, 16 bp, H. sapiens
gatttgaaaccaggca

SEQ ID NO: 104712 - DNA, 16 bp, H. sapiens
gatttgaaatattccc

SEQ ID NO: 104713 - DNA, 16 bp, H. sapiens
gatttgaagacaaaaa

SEQ ID NO: 104714 - DNA, 16 bp, H. sapiens
gatttgaatccaggcc

SEQ ID NO: 104715 - DNA, 16 bp, H. sapiens
gatttgaattccagct

SEQ ID NO: 104716 - DNA, 16 bp, H. sapiens
gatttgaatttttaaa

SEQ ID NO: 104717 - DNA, 16 bp, H. sapiens
gatttgataaacaaat

SEQ ID NO: 104718 - DNA, 16 bp, H. sapiens
gatttgatcaagtcag

SEQ ID NO: 104719 - DNA, 16 bp, H. sapiens
gatttgatttcatttt

SEQ ID NO: 104720 - DNA, 16 bp, H. sapiens
gatttgcatttcagaa

SEQ ID NO: 104721 - DNA, 16 bp, H. sapiens
gatttgcatttttaaa

SEQ ID NO: 104722 - DNA, 16 bp, H. sapiens
gatttgcctattctgt

SEQ ID NO: 104723 - DNA, 16 bp, H. sapiens
gatttgcctgttctgg

SEQ ID NO: 104724 - DNA, 16 bp, H. sapiens
gatttgctaatatttt

SEQ ID NO: 104725 - DNA, 16 bp, H. sapiens
gatttgctgagcatac

SEQ ID NO: 104726 - DNA, 16 bp, H. sapiens
gatttgcttattctgg

SEQ ID NO: 104727 - DNA, 16 bp, H. sapiens
gatttgctttaaaata

SEQ ID NO: 104728 - DNA, 16 bp, H. sapiens
gatttgctttatgaat

SEQ ID NO: 104729 - DNA, 16 bp, H. sapiens
gatttggagtcagaag

SEQ ID NO: 104730 - DNA, 16 bp, H. sapiens
gatttggagtcagaca

SEQ ID NO: 104731 - DNA, 16 bp, H. sapiens
gatttggccagtggaa

SEQ ID NO: 104732 - DNA, 16 bp, H. sapiens
gatttggctttctgtc

SEQ ID NO: 104733 - DNA, 16 bp, H. sapiens
gatttgggagggtcca

SEQ ID NO: 104734 - DNA, 16 bp, H. sapiens
gatttgggatgctcaa

SEQ ID NO: 104735 - DNA, 16 bp, H. sapiens
gatttggggaggagag

SEQ ID NO: 104736 - DNA, 16 bp, H. sapiens
gatttgggtgggaaca

SEQ ID NO: 104737 - DNA, 16 bp, H. sapiens
gatttggtgtctgctg

SEQ ID NO: 104738 - DNA, 16 bp, H. sapiens
gatttggttgtttaaa

SEQ ID NO: 104739 - DNA, 16 bp, H. sapiens
gatttgtaagagttct

SEQ ID NO: 104740 - DNA, 16 bp, H. sapiens
gatttgtatccagaat

SEQ ID NO: 104741 - DNA, 16 bp, H. sapiens
gatttgtatttcttta

SEQ ID NO: 104742 - DNA, 16 bp, H. sapiens
gatttgtctgtttctt

SEQ ID NO: 104743 - DNA, 16 bp, H. sapiens
gatttgtggaacttta

SEQ ID NO: 104744 - DNA, 16 bp, H. sapiens
gatttgttttaatcag

SEQ ID NO: 104745 - DNA, 16 bp, H. sapiens
gattttaaaaatgtgt

SEQ ID NO: 104746 - DNA, 16 bp, H. sapiens
gattttaaaacaaatt

SEQ ID NO: 104747 - DNA, 16 bp, H. sapiens
gattttaaaggcaaag

SEQ ID NO: 104748 - DNA, 16 bp, H. sapiens
gattttaaattacaca

SEQ ID NO: 104749 - DNA, 16 bp, H. sapiens
gattttaagttttaaa

SEQ ID NO: 104750 - DNA, 16 bp, H. sapiens
gattttagatttttct

SEQ ID NO: 104751 - DNA, 16 bp, H. sapiens
gattttagctgttctt

SEQ ID NO: 104752 - DNA, 16 bp, H. sapiens
gattttataggatggt

SEQ ID NO: 104753 - DNA, 16 bp, H. sapiens
gattttatatttagaa

SEQ ID NO: 104754 - DNA, 16 bp, H. sapiens
gattttatggctaaga

SEQ ID NO: 104755 - DNA, 16 bp, H. sapiens
gattttattctaagta

SEQ ID NO: 104756 - DNA, 16 bp, H. sapiens
gattttattcttcctt

SEQ ID NO: 104757 - DNA, 16 bp, H. sapiens
gattttatttatctgg

SEQ ID NO: 104758 - DNA, 16 bp, H. sapiens
gattttcaaaaattaa

SEQ ID NO: 104759 - DNA, 16 bp, H. sapiens
gattttcaaattattt

SEQ ID NO: 104760 - DNA, 16 bp, H. sapiens
gattttcagatgttaa

SEQ ID NO: 104761 - DNA, 16 bp, H. sapiens
gattttcatttaaaaa

SEQ ID NO: 104762 - DNA, 16 bp, H. sapiens
gattttctaatattaa

SEQ ID NO: 104763 - DNA, 16 bp, H. sapiens
gattttctaatgttga

SEQ ID NO: 104764 - DNA, 16 bp, H. sapiens
gattttcttctacctc

SEQ ID NO: 104765 - DNA, 16 bp, H. sapiens
gattttcttctgtctc

SEQ ID NO: 104766 - DNA, 16 bp, H. sapiens
gattttctttctgaaa

SEQ ID NO: 104767 - DNA, 16 bp, H. sapiens
gattttgaaaagaaaa

SEQ ID NO: 104768 - DNA, 16 bp, H. sapiens
gattttgaacttccag

SEQ ID NO: 104769 - DNA, 16 bp, H. sapiens
gattttgaagacttgg

SEQ ID NO: 104770 - DNA, 16 bp, H. sapiens
gattttgaagcatttc

SEQ ID NO: 104771 - DNA, 16 bp, H. sapiens
gattttgagcattttt

SEQ ID NO: 104772 - DNA, 16 bp, H. sapiens
gattttgattaaaatt

SEQ ID NO: 104773 - DNA, 16 bp, H. sapiens
gattttgattcttcct

SEQ ID NO: 104774 - DNA, 16 bp, H. sapiens
gattttgattgggatt

SEQ ID NO: 104775 - DNA, 16 bp, H. sapiens
gattttgatttggatt

SEQ ID NO: 104776 - DNA, 16 bp, H. sapiens
gattttgcagatgtaa

SEQ ID NO: 104777 - DNA, 16 bp, H. sapiens
gattttgcagtttatt

SEQ ID NO: 104778 - DNA, 16 bp, H. sapiens
gattttggaatacttg

SEQ ID NO: 104779 - DNA, 16 bp, H. sapiens
gattttggaatatttg

SEQ ID NO: 104780 - DNA, 16 bp, H. sapiens
gattttggacttgcca

SEQ ID NO: 104781 - DNA, 16 bp, H. sapiens
gattttggagcatttc

SEQ ID NO: 104782 - DNA, 16 bp, H. sapiens
gattttggggaaaaaa

SEQ ID NO: 104783 - DNA, 16 bp, H. sapiens
gattttggggggcttg

SEQ ID NO: 104784 - DNA, 16 bp, H. sapiens
gattttgtatcctgat

SEQ ID NO: 104785 - DNA, 16 bp, H. sapiens
gattttgtcaaatatt

SEQ ID NO: 104786 - DNA, 24 bp, H. sapiens
gattttgtcaccagcaggcctgcc

SEQ ID NO: 104787 - DNA, 22 bp, H. sapiens
gattttgtcaccatcaggcctg

SEQ ID NO: 104788 - DNA, 16 bp, H. sapiens
gattttgtcttggttt

SEQ ID NO: 104789 - DNA, 16 bp, H. sapiens
gattttgtgggccagg

SEQ ID NO: 104790 - DNA, 16 bp, H. sapiens
gatttttaaaaaatca

SEQ ID NO: 104791 - DNA, 16 bp, H. sapiens
gatttttaaaatgtta

SEQ ID NO: 104792 - DNA, 16 bp, H. sapiens
gatttttaaatatctt

SEQ ID NO: 104793 - DNA, 16 bp, H. sapiens
gatttttaatgttctc

SEQ ID NO: 104794 - DNA, 18 bp, H. sapiens
gatttttagtagagacgg

SEQ ID NO: 104795 - DNA, 16 bp, H. sapiens
gatttttcagtggaaa

SEQ ID NO: 104796 - DNA, 16 bp, H. sapiens
gatttttcatggtgcc

SEQ ID NO: 104797 - DNA, 16 bp, H. sapiens
gatttttccacctcag

SEQ ID NO: 104798 - DNA, 16 bp, H. sapiens
gatttttctatgttga

SEQ ID NO: 104799 - DNA, 16 bp, H. sapiens
gatttttctccatcct

SEQ ID NO: 104800 - DNA, 16 bp, H. sapiens
gatttttgaaaaatga

SEQ ID NO: 104801 - DNA, 16 bp, H. sapiens
gatttttgacaaagat

SEQ ID NO: 104802 - DNA, 16 bp, H. sapiens
gatttttgcacattaa

SEQ ID NO: 104803 - DNA, 16 bp, H. sapiens
gatttttgcatatatg

SEQ ID NO: 104804 - DNA, 16 bp, H. sapiens
gatttttgcgtctatg

SEQ ID NO: 104805 - DNA, 16 bp, H. sapiens
gatttttgctcttgtc

SEQ ID NO: 104806 - DNA, 16 bp, H. sapiens
gatttttggttcttat

SEQ ID NO: 104807 - DNA, 16 bp, H. sapiens
gatttttgttaaataa

SEQ ID NO: 104808 - DNA, 16 bp, H. sapiens
gattttttaaaaatcc

SEQ ID NO: 104809 - DNA, 16 bp, H. sapiens
gattttttaaaaatgt

SEQ ID NO: 104810 - DNA, 16 bp, H. sapiens
gattttttaaaatgca

SEQ ID NO: 104811 - DNA, 16 bp, H. sapiens
gattttttcccccttt

SEQ ID NO: 104812 - DNA, 16 bp, H. sapiens
gatttttttcccctaa

SEQ ID NO: 104813 - DNA, 16 bp, H. sapiens
gatttttttcctgtaa

SEQ ID NO: 104814 - DNA, 16 bp, H. sapiens
gattttttttccccca

SEQ ID NO: 104815 - DNA, 16 bp, H. sapiens
gatttttttttaaact

SEQ ID NO: 104816 - DNA, 16 bp, H. sapiens
gatttttttttaacac

SEQ ID NO: 104817 - DNA, 16 bp, H. sapiens
gcaaaaaaaatttttt

SEQ ID NO: 104818 - DNA, 16 bp, H. sapiens
gcaaaaaagagcaggg

SEQ ID NO: 104819 - DNA, 16 bp, H. sapiens
gcaaaaaagcaaatat

SEQ ID NO: 104820 - DNA, 16 bp, H. sapiens
gcaaaaactgaaagaa

SEQ ID NO: 104821 - DNA, 16 bp, H. sapiens
gcaaaaactgtgggaa

SEQ ID NO: 104822 - DNA, 16 bp, H. sapiens
gcaaaaagaacaaggc

SEQ ID NO: 104823 - DNA, 16 bp, H. sapiens
gcaaaaagaataaagc

SEQ ID NO: 104824 - DNA, 16 bp, H. sapiens
gcaaaaagcaattgca

SEQ ID NO: 104825 - DNA, 16 bp, H. sapiens
gcaaaaagcagaacca

SEQ ID NO: 104826 - DNA, 16 bp, H. sapiens
gcaaaaagccgcggcg

SEQ ID NO: 104827 - DNA, 16 bp, H. sapiens
gcaaaaaggcagaggg

SEQ ID NO: 104828 - DNA, 16 bp, H. sapiens
gcaaaaataaatgaat

SEQ ID NO: 104829 - DNA, 16 bp, H. sapiens
gcaaaaataatacaga

SEQ ID NO: 104830 - DNA, 16 bp, H. sapiens
gcaaaaataattttaa

SEQ ID NO: 104831 - DNA, 16 bp, H. sapiens
gcaaaaatagcaaaac

SEQ ID NO: 104832 - DNA, 16 bp, H. sapiens
gcaaaaatcatcaata

SEQ ID NO: 104833 - DNA, 16 bp, H. sapiens
gcaaaaatcctctaca

SEQ ID NO: 104834 - DNA, 16 bp, H. sapiens
gcaaaaattaacaaat

SEQ ID NO: 104835 - DNA, 16 bp, H. sapiens
gcaaaacatgtttttc

SEQ ID NO: 104836 - DNA, 16 bp, H. sapiens
gcaaaacattcaagat

SEQ ID NO: 104837 - DNA, 16 bp, H. sapiens
gcaaaacccccatctc

SEQ ID NO: 104838 - DNA, 16 bp, H. sapiens
gcaaaaccccgactct

SEQ ID NO: 104839 - DNA, 25 bp, H. sapiens
gcaaaaccccgtctctactaaaaaa

SEQ ID NO: 104840 - DNA, 16 bp, H. sapiens
gcaaaactaataaaga

SEQ ID NO: 104841 - DNA, 16 bp, H. sapiens
gcaaaagaaaagacct

SEQ ID NO: 104842 - DNA, 16 bp, H. sapiens
gcaaaagaaacagcag

SEQ ID NO: 104843 - DNA, 16 bp, H. sapiens
gcaaaagaaactttca

SEQ ID NO: 104844 - DNA, 16 bp, H. sapiens
gcaaaagaaatgacca

SEQ ID NO: 104845 - DNA, 16 bp, H. sapiens
gcaaaagacttgaata

SEQ ID NO: 104846 - DNA, 16 bp, H. sapiens
gcaaaagatttgagta

SEQ ID NO: 104847 - DNA, 16 bp, H. sapiens
gcaaaagcacatctta

SEQ ID NO: 104848 - DNA, 16 bp, H. sapiens
gcaaaagcagaaaggg

SEQ ID NO: 104849 - DNA, 16 bp, H. sapiens
gcaaaagcagaagcaa

SEQ ID NO: 104850 - DNA, 16 bp, H. sapiens
gcaaaagctggaagaa

SEQ ID NO: 104851 - DNA, 16 bp, H. sapiens
gcaaaagctggaggca

SEQ ID NO: 104852 - DNA, 16 bp, H. sapiens
gcaaaaggaagaaaat

SEQ ID NO: 104853 - DNA, 16 bp, H. sapiens
gcaaaaggcaaagggg

SEQ ID NO: 104854 - DNA, 16 bp, H. sapiens
gcaaaaggtttgaata

SEQ ID NO: 104855 - DNA, 16 bp, H. sapiens
gcaaaagtaactatca

SEQ ID NO: 104856 - DNA, 16 bp, H. sapiens
gcaaaataaccaacta

SEQ ID NO: 104857 - DNA, 16 bp, H. sapiens
gcaaaataaccagcta

SEQ ID NO: 104858 - DNA, 16 bp, H. sapiens
gcaaaatagtgaaacc

SEQ ID NO: 104859 - DNA, 16 bp, H. sapiens
gcaaaatccagtctct

SEQ ID NO: 104860 - DNA, 16 bp, H. sapiens
gcaaaatctaaataat

SEQ ID NO: 104861 - DNA, 16 bp, H. sapiens
gcaaaatgagaaaaat

SEQ ID NO: 104862 - DNA, 16 bp, H. sapiens
gcaaaatgcaaatcaa

SEQ ID NO: 104863 - DNA, 16 bp, H. sapiens
gcaaaatgcataaaca

SEQ ID NO: 104864 - DNA, 17 bp, H. sapiens
gcaaaatgctgggatta

SEQ ID NO: 104865 - DNA, 16 bp, H. sapiens
gcaaaattagacaaat

SEQ ID NO: 104866 - DNA, 16 bp, H. sapiens
gcaaaattgaaactct

SEQ ID NO: 104867 - DNA, 16 bp, H. sapiens
gcaaaattgagagaaa

SEQ ID NO: 104868 - DNA, 16 bp, H. sapiens
gcaaaatttacatctc

SEQ ID NO: 104869 - DNA, 26 bp, H. sapiens
gcaaacaaattcaaaagctagcagaa

SEQ ID NO: 104870 - DNA, 16 bp, H. sapiens
gcaaacagcaaactgt

SEQ ID NO: 104871 - DNA, 16 bp, H. sapiens
gcaaacagcaatagtt

SEQ ID NO: 104872 - DNA, 16 bp, H. sapiens
gcaaacattgacaaat

SEQ ID NO: 104873 - DNA, 16 bp, H. sapiens
gcaaacattttttgag

SEQ ID NO: 104874 - DNA, 16 bp, H. sapiens
gcaaaccaggacagtt

SEQ ID NO: 104875 - DNA, 16 bp, H. sapiens
gcaaaccagtcctacc

SEQ ID NO: 104876 - DNA, 16 bp, H. sapiens
gcaaacctcctgcctt

SEQ ID NO: 104877 - DNA, 16 bp, H. sapiens
gcaaacctgagaaaaa

SEQ ID NO: 104878 - DNA, 16 bp, H. sapiens
gcaaactgacacctca

SEQ ID NO: 104879 - DNA, 16 bp, H. sapiens
gcaaactttttctgga

SEQ ID NO: 104880 - DNA, 16 bp, H. sapiens
gcaaagaaacattgga

SEQ ID NO: 104881 - DNA, 16 bp, H. sapiens
gcaaagaaactggcag

SEQ ID NO: 104882 - DNA, 16 bp, H. sapiens
gcaaagaagttaaaag

SEQ ID NO: 104883 - DNA, 16 bp, H. sapiens
gcaaagacagatcccc

SEQ ID NO: 104884 - DNA, 24 bp, H. sapiens
gcaaagacccactggaattcccct

SEQ ID NO: 104885 - DNA, 16 bp, H. sapiens
gcaaagactgtgggaa

SEQ ID NO: 104886 - DNA, 16 bp, H. sapiens
gcaaagacttcatggc

SEQ ID NO: 104887 - DNA, 16 bp, H. sapiens
gcaaagagactggtga

SEQ ID NO: 104888 - DNA, 16 bp, H. sapiens
gcaaagatgtgaagaa

SEQ ID NO: 104889 - DNA, 16 bp, H. sapiens
gcaaagattggagtga

SEQ ID NO: 104890 - DNA, 16 bp, H. sapiens
gcaaagatttcttagg

SEQ ID NO: 104891 - DNA, 16 bp, H. sapiens
gcaaagcaaaagcaag

SEQ ID NO: 104892 - DNA, 16 bp, H. sapiens
gcaaagcaaatccagc

SEQ ID NO: 104893 - DNA, 16 bp, H. sapiens
gcaaagcagctgtgct

SEQ ID NO: 104894 - DNA, 16 bp, H. sapiens
gcaaagcattcaagac

SEQ ID NO: 104895 - DNA, 16 bp, H. sapiens
gcaaagcattcaagag

SEQ ID NO: 104896 - DNA, 16 bp, H. sapiens
gcaaagcctaaaatat

SEQ ID NO: 104897 - DNA, 16 bp, H. sapiens
gcaaagctaaaagagc

SEQ ID NO: 104898 - DNA, 16 bp, H. sapiens
gcaaagcttttaacca

SEQ ID NO: 104899 - DNA, 16 bp, H. sapiens
gcaaaggaaaaagaat

SEQ ID NO: 104900 - DNA, 16 bp, H. sapiens
gcaaaggaaaaatatt

SEQ ID NO: 104901 - DNA, 16 bp, H. sapiens
gcaaaggaaaagcagg

SEQ ID NO: 104902 - DNA, 16 bp, H. sapiens
gcaaaggaaatgaaca

SEQ ID NO: 104903 - DNA, 16 bp, H. sapiens
gcaaaggaatgaagtt

SEQ ID NO: 104904 - DNA, 16 bp, H. sapiens
gcaaaggcaggaggat

SEQ ID NO: 104905 - DNA, 16 bp, H. sapiens
gcaaaggcagtttcag

SEQ ID NO: 104906 - DNA, 16 bp, H. sapiens
gcaaaggccctggggc

SEQ ID NO: 104907 - DNA, 16 bp, H. sapiens
gcaaaggctggaagca

SEQ ID NO: 104908 - DNA, 16 bp, H. sapiens
gcaaagggacatctta

SEQ ID NO: 104909 - DNA, 16 bp, H. sapiens
gcaaagggcatgaact

SEQ ID NO: 104910 - DNA, 16 bp, H. sapiens
gcaaaggggagctggc

SEQ ID NO: 104911 - DNA, 19 bp, H. sapiens
gcaaaggtattggggatca

SEQ ID NO: 104912 - DNA, 20 bp, H. sapiens
gcaaaggtattggggatcac

SEQ ID NO: 104913 - DNA, 16 bp, H. sapiens
gcaaaggtctgtggct

SEQ ID NO: 104914 - DNA, 16 bp, H. sapiens
gcaaagtctcagaata

SEQ ID NO: 104915 - DNA, 16 bp, H. sapiens
gcaaagtgaaagaagc

SEQ ID NO: 104916 - DNA, 17 bp, H. sapiens
gcaaagtgctgggatta

SEQ ID NO: 104917 - DNA, 16 bp, H. sapiens
gcaaagtgtgtgtgtg

SEQ ID NO: 104918 - DNA, 16 bp, H. sapiens
gcaaagtgttcaagaa

SEQ ID NO: 104919 - DNA, 16 bp, H. sapiens
gcaaataaaaatggaa

SEQ ID NO: 104920 - DNA, 16 bp, H. sapiens
gcaaataaataaacat

SEQ ID NO: 104921 - DNA, 16 bp, H. sapiens
gcaaataaattagaaa

SEQ ID NO: 104922 - DNA, 16 bp, H. sapiens
gcaaataacaacaaca

SEQ ID NO: 104923 - DNA, 16 bp, H. sapiens
gcaaataagaactttg

SEQ ID NO: 104924 - DNA, 16 bp, H. sapiens
gcaaataatttgtttt

SEQ ID NO: 104925 - DNA, 16 bp, H. sapiens
gcaaatatatatatat

SEQ ID NO: 104926 - DNA, 16 bp, H. sapiens
gcaaatatcacaataa

SEQ ID NO: 104927 - DNA, 16 bp, H. sapiens
gcaaatatgtgtgtgt

SEQ ID NO: 104928 - DNA, 16 bp, H. sapiens
gcaaatattaataaaa

SEQ ID NO: 104929 - DNA, 16 bp, H. sapiens
gcaaatattccaaatt

SEQ ID NO: 104930 - DNA, 16 bp, H. sapiens
gcaaatattgcagaac

SEQ ID NO: 104931 - DNA, 16 bp, H. sapiens
gcaaatatttacaaat

SEQ ID NO: 104932 - DNA, 16 bp, H. sapiens
gcaaatatttcatgat

SEQ ID NO: 104933 - DNA, 16 bp, H. sapiens
gcaaatatttttccag

SEQ ID NO: 104934 - DNA, 16 bp, H. sapiens
gcaaatatttttttaa

SEQ ID NO: 104935 - DNA, 16 bp, H. sapiens
gcaaatcaacaaacgt

SEQ ID NO: 104936 - DNA, 16 bp, H. sapiens
gcaaatcatttatctg

SEQ ID NO: 104937 - DNA, 16 bp, H. sapiens
gcaaatgagaagaatg

SEQ ID NO: 104938 - DNA, 16 bp, H. sapiens
gcaaatgcaaaagagc

SEQ ID NO: 104939 - DNA, 16 bp, H. sapiens
gcaaatgcaaaggaac

SEQ ID NO: 104940 - DNA, 16 bp, H. sapiens
gcaaatgcaaatgcaa

SEQ ID NO: 104941 - DNA, 16 bp, H. sapiens
gcaaatgcaacaaaat

SEQ ID NO: 104942 - DNA, 16 bp, H. sapiens
gcaaatgcaacagaaa

SEQ ID NO: 104943 - DNA, 16 bp, H. sapiens
gcaaatggaaaacagg

SEQ ID NO: 104944 - DNA, 16 bp, H. sapiens
gcaaatggaagacaaa

SEQ ID NO: 104945 - DNA, 16 bp, H. sapiens
gcaaatggactttcca

SEQ ID NO: 104946 - DNA, 16 bp, H. sapiens
gcaaatggagtgaaat

SEQ ID NO: 104947 - DNA, 16 bp, H. sapiens
gcaaatgtaattgtgg

SEQ ID NO: 104948 - DNA, 16 bp, H. sapiens
gcaaatgttcattgca

SEQ ID NO: 104949 - DNA, 16 bp, H. sapiens
gcaaattaaaacaaga

SEQ ID NO: 104950 - DNA, 16 bp, H. sapiens
gcaaattaaagccaca

SEQ ID NO: 104951 - DNA, 16 bp, H. sapiens
gcaaattaaatccaaa

SEQ ID NO: 104952 - DNA, 16 bp, H. sapiens
gcaaattcaaaaaatt

SEQ ID NO: 104953 - DNA, 16 bp, H. sapiens
gcaaattctcctgcct

SEQ ID NO: 104954 - DNA, 16 bp, H. sapiens
gcaaattctttttttt

SEQ ID NO: 104955 - DNA, 16 bp, H. sapiens
gcaaattgcttgagct

SEQ ID NO: 104956 - DNA, 16 bp, H. sapiens
gcaaattggaaaaaga

SEQ ID NO: 104957 - DNA, 16 bp, H. sapiens
gcaaattggatagaga

SEQ ID NO: 104958 - DNA, 16 bp, H. sapiens
gcaaattttccaatct

SEQ ID NO: 104959 - DNA, 16 bp, H. sapiens
gcaaatttttaaattt

SEQ ID NO: 104960 - DNA, 16 bp, H. sapiens
gcaaatttttcaaatt

SEQ ID NO: 104961 - DNA, 16 bp, H. sapiens
gcaacaaaatgagact

SEQ ID NO: 104962 - DNA, 16 bp, H. sapiens
gcaacaaagaattatc

SEQ ID NO: 104963 - DNA, 16 bp, H. sapiens
gcaacaaagcaatacc

SEQ ID NO: 104964 - DNA, 16 bp, H. sapiens
gcaacaaagtgagact

SEQ ID NO: 104965 - DNA, 16 bp, H. sapiens
gcaacaagaagaacta

SEQ ID NO: 104966 - DNA, 16 bp, H. sapiens
gcaacaagagcaagac

SEQ ID NO: 104967 - DNA, 16 bp, H. sapiens
gcaacaagagcgaaat

SEQ ID NO: 104968 - DNA, 16 bp, H. sapiens
gcaacaatattcacaa

SEQ ID NO: 104969 - DNA, 16 bp, H. sapiens
gcaacaatgttgagag

SEQ ID NO: 104970 - DNA, 16 bp, H. sapiens
gcaacacaaatgtcca

SEQ ID NO: 104971 - DNA, 16 bp, H. sapiens
gcaacacaacaagact

SEQ ID NO: 104972 - DNA, 16 bp, H. sapiens
gcaacacagcaagaca

SEQ ID NO: 104973 - DNA, 16 bp, H. sapiens
gcaacacagcaagact

SEQ ID NO: 104974 - DNA, 16 bp, H. sapiens
gcaacacggcaagacc

SEQ ID NO: 104975 - DNA, 16 bp, H. sapiens
gcaacactccgtctca

SEQ ID NO: 104976 - DNA, 16 bp, H. sapiens
gcaacactgctctcca

SEQ ID NO: 104977 - DNA, 16 bp, H. sapiens
gcaacactgtctcaaa

SEQ ID NO: 104978 - DNA, 16 bp, H. sapiens
gcaacagacttctcaa

SEQ ID NO: 104979 - DNA, 16 bp, H. sapiens
gcaacagagaaaaact

SEQ ID NO: 104980 - DNA, 16 bp, H. sapiens
gcaacagagaaagact

SEQ ID NO: 104981 - DNA, 16 bp, H. sapiens
gcaacagagcaagaaa

SEQ ID NO: 104982 - DNA, 16 bp, H. sapiens
gcaacagagggagacc

SEQ ID NO: 104983 - DNA, 16 bp, H. sapiens
gcaacagagtgtgact

SEQ ID NO: 104984 - DNA, 16 bp, H. sapiens
gcaacagcaacagcaa

SEQ ID NO: 104985 - DNA, 16 bp, H. sapiens
gcaacagcatgatctc

SEQ ID NO: 104986 - DNA, 16 bp, H. sapiens
gcaacagtgccttttt

SEQ ID NO: 104987 - DNA, 16 bp, H. sapiens
gcaacataacaagact

SEQ ID NO: 104988 - DNA, 16 bp, H. sapiens
gcaacataatgagact

SEQ ID NO: 104989 - DNA, 16 bp, H. sapiens
gcaacatagcaagacc

SEQ ID NO: 104990 - DNA, 17 bp, H. sapiens
gcaacatagcaagacct

SEQ ID NO: 104991 - DNA, 16 bp, H. sapiens
gcaacatagtaaggcc

SEQ ID NO: 104992 - DNA, 16 bp, H. sapiens
gcaacatcagcatcac

SEQ ID NO: 104993 - DNA, 19 bp, H. sapiens
gcaacatgatgaaacccca

SEQ ID NO: 104994 - DNA, 16 bp, H. sapiens
gcaacatggtaaaacc

SEQ ID NO: 104995 - DNA, 18 bp, H. sapiens
gcaacatggtgaaacctc

SEQ ID NO: 104996 - DNA, 18 bp, H. sapiens
gcaacatggtgaaacctt

SEQ ID NO: 104997 - DNA, 16 bp, H. sapiens
gcaacattttcttttt

SEQ ID NO: 104998 - DNA, 16 bp, H. sapiens
gcaaccacccttctac

SEQ ID NO: 104999 - DNA, 16 bp, H. sapiens
gcaaccacttgctaga

SEQ ID NO: 105000 - DNA, 16 bp, H. sapiens
gcaacccactcgggtc

SEQ ID NO: 105001 - DNA, 16 bp, H. sapiens
gcaaccccaagacaca

SEQ ID NO: 105002 - DNA, 16 bp, H. sapiens
gcaacccctccttttt

SEQ ID NO: 105003 - DNA, 16 bp, H. sapiens
gcaacccctgtctccc

SEQ ID NO: 105004 - DNA, 16 bp, H. sapiens
gcaaccctcccacctt

SEQ ID NO: 105005 - DNA, 16 bp, H. sapiens
gcaacctagatccctc

SEQ ID NO: 105006 - DNA, 16 bp, H. sapiens
gcaacctccacattcc

SEQ ID NO: 105007 - DNA, 16 bp, H. sapiens
gcaacctccacccccg

SEQ ID NO: 105008 - DNA, 16 bp, H. sapiens
gcaacctccacttgcc

SEQ ID NO: 105009 - DNA, 16 bp, H. sapiens
gcaacctccgccacct

SEQ ID NO: 105010 - DNA, 16 bp, H. sapiens
gcaacctccttctccc

SEQ ID NO: 105011 - DNA, 16 bp, H. sapiens
gcaacctcggcctccc

SEQ ID NO: 105012 - DNA, 16 bp, H. sapiens
gcaacctctctctccc

SEQ ID NO: 105013 - DNA, 16 bp, H. sapiens
gcaacctctgccactc

SEQ ID NO: 105014 - DNA, 16 bp, H. sapiens
gcaacctctgccttct

SEQ ID NO: 105015 - DNA, 16 bp, H. sapiens
gcaacctctgcttccc

SEQ ID NO: 105016 - DNA, 16 bp, H. sapiens
gcaaccttactgaatt

SEQ ID NO: 105017 - DNA, 16 bp, H. sapiens
gcaaccttgctaaatt

SEQ ID NO: 105018 - DNA, 16 bp, H. sapiens
gcaaccttggcctcct

SEQ ID NO: 105019 - DNA, 16 bp, H. sapiens
gcaacctttgccttct

SEQ ID NO: 105020 - DNA, 16 bp, H. sapiens
gcaactccagcaaagt

SEQ ID NO: 105021 - DNA, 16 bp, H. sapiens
gcaactccccattttc

SEQ ID NO: 105022 - DNA, 16 bp, H. sapiens
gcaactctgtctctac

SEQ ID NO: 105023 - DNA, 16 bp, H. sapiens
gcaactgagaaactga

SEQ ID NO: 105024 - DNA, 16 bp, H. sapiens
gcaactgcagtcccag

SEQ ID NO: 105025 - DNA, 16 bp, H. sapiens
gcaactgccaccatgc

SEQ ID NO: 105026 - DNA, 16 bp, H. sapiens
gcaactgccacctcct

SEQ ID NO: 105027 - DNA, 16 bp, H. sapiens
gcaactgccgcctcct

SEQ ID NO: 105028 - DNA, 16 bp, H. sapiens
gcaactgtactccagc

SEQ ID NO: 105029 - DNA, 16 bp, H. sapiens
gcaactgtgcctggct

SEQ ID NO: 105030 - DNA, 16 bp, H. sapiens
gcaacttccgtctccc

SEQ ID NO: 105031 - DNA, 16 bp, H. sapiens
gcaacttcggcctccc

SEQ ID NO: 105032 - DNA, 16 bp, H. sapiens
gcaacttctgcttcct

SEQ ID NO: 105033 - DNA, 16 bp, H. sapiens
gcaacttgtcccaaat

SEQ ID NO: 105034 - DNA, 16 bp, H. sapiens
gcaactttggagctgg

SEQ ID NO: 105035 - DNA, 16 bp, H. sapiens
gcaagaaaatatgaca

SEQ ID NO: 105036 - DNA, 16 bp, H. sapiens
gcaagaaactaaatta

SEQ ID NO: 105037 - DNA, 16 bp, H. sapiens
gcaagaaagagaaata

SEQ ID NO: 105038 - DNA, 16 bp, H. sapiens
gcaagaaagctaagaa

SEQ ID NO: 105039 - DNA, 16 bp, H. sapiens
gcaagaaaggattctc

SEQ ID NO: 105040 - DNA, 16 bp, H. sapiens
gcaagaaattaaaaca

SEQ ID NO: 105041 - DNA, 16 bp, H. sapiens
gcaagaagacagctgt

SEQ ID NO: 105042 - DNA, 16 bp, H. sapiens
gcaagaatggccaaaa

SEQ ID NO: 105043 - DNA, 16 bp, H. sapiens
gcaagacacacacaca

SEQ ID NO: 105044 - DNA, 16 bp, H. sapiens
gcaagaccccatctaa

SEQ ID NO: 105045 - DNA, 16 bp, H. sapiens
gcaagaccccgtctct

SEQ ID NO: 105046 - DNA, 16 bp, H. sapiens
gcaagaccctgtcact

SEQ ID NO: 105047 - DNA, 16 bp, H. sapiens
gcaagaccctgtcttt

SEQ ID NO: 105048 - DNA, 16 bp, H. sapiens
gcaagacctcatctca

SEQ ID NO: 105049 - DNA, 16 bp, H. sapiens
gcaagactctgtctcc

SEQ ID NO: 105050 - DNA, 16 bp, H. sapiens
gcaagactctgtgtct

SEQ ID NO: 105051 - DNA, 16 bp, H. sapiens
gcaagagaaaataaac

SEQ ID NO: 105052 - DNA, 16 bp, H. sapiens
gcaagagaactggaat

SEQ ID NO: 105053 - DNA, 16 bp, H. sapiens
gcaagagaagagagct

SEQ ID NO: 105054 - DNA, 16 bp, H. sapiens
gcaagagagaaaaata

SEQ ID NO: 105055 - DNA, 16 bp, H. sapiens
gcaagagagaagcaac

SEQ ID NO: 105056 - DNA, 16 bp, H. sapiens
gcaagatcatggctca

SEQ ID NO: 105057 - DNA, 16 bp, H. sapiens
gcaagatcctgtctca

SEQ ID NO: 105058 - DNA, 16 bp, H. sapiens
gcaagatcctgtttca

SEQ ID NO: 105059 - DNA, 16 bp, H. sapiens
gcaagatggaatcagt

SEQ ID NO: 105060 - DNA, 16 bp, H. sapiens
gcaagattcatcacct

SEQ ID NO: 105061 - DNA, 16 bp, H. sapiens
gcaagcaaagagagag

SEQ ID NO: 105062 - DNA, 16 bp, H. sapiens
gcaagcaacagaaaca

SEQ ID NO: 105063 - DNA, 16 bp, H. sapiens
gcaagcaagcaaacaa

SEQ ID NO: 105064 - DNA, 16 bp, H. sapiens
gcaagcaccaccatgc

SEQ ID NO: 105065 - DNA, 16 bp, H. sapiens
gcaagcaggcaggcag

SEQ ID NO: 105066 - DNA, 16 bp, H. sapiens
gcaagccaaggaaaga

SEQ ID NO: 105067 - DNA, 17 bp, H. sapiens
gcaagccacccaggtgc

SEQ ID NO: 105068 - DNA, 16 bp, H. sapiens
gcaagccaggaaggga

SEQ ID NO: 105069 - DNA, 16 bp, H. sapiens
gcaagccccaagactt

SEQ ID NO: 105070 - DNA, 16 bp, H. sapiens
gcaagccccaggttgt

SEQ ID NO: 105071 - DNA, 16 bp, H. sapiens
gcaagccccttccacc

SEQ ID NO: 105072 - DNA, 16 bp, H. sapiens
gcaagccctaagcctt

SEQ ID NO: 105073 - DNA, 16 bp, H. sapiens
gcaagccctgcctcag

SEQ ID NO: 105074 - DNA, 16 bp, H. sapiens
gcaagcctggctgctg

SEQ ID NO: 105075 - DNA, 16 bp, H. sapiens
gcaagcgattctcctg

SEQ ID NO: 105076 - DNA, 16 bp, H. sapiens
gcaagctccacatccc

SEQ ID NO: 105077 - DNA, 16 bp, H. sapiens
gcaagctccccctccc

SEQ ID NO: 105078 - DNA, 16 bp, H. sapiens
gcaagctcttcctccc

SEQ ID NO: 105079 - DNA, 16 bp, H. sapiens
gcaagctcttcctcct

SEQ ID NO: 105080 - DNA, 16 bp, H. sapiens
gcaagctgagatcgcg

SEQ ID NO: 105081 - DNA, 16 bp, H. sapiens
gcaagctggaggccca

SEQ ID NO: 105082 - DNA, 16 bp, H. sapiens
gcaagctggataaaga

SEQ ID NO: 105083 - DNA, 16 bp, H. sapiens
gcaagctgggtctcca

SEQ ID NO: 105084 - DNA, 16 bp, H. sapiens
gcaagctgtcagtgga

SEQ ID NO: 105085 - DNA, 16 bp, H. sapiens
gcaagcttcgcctcct

SEQ ID NO: 105086 - DNA, 16 bp, H. sapiens
gcaaggaaaaaattaa

SEQ ID NO: 105087 - DNA, 16 bp, H. sapiens
gcaaggaaacatgaca

SEQ ID NO: 105088 - DNA, 16 bp, H. sapiens
gcaaggaaccagtgac

SEQ ID NO: 105089 - DNA, 16 bp, H. sapiens
gcaaggaactgaggcc

SEQ ID NO: 105090 - DNA, 16 bp, H. sapiens
gcaaggaaggctggga

SEQ ID NO: 105091 - DNA, 16 bp, H. sapiens
gcaaggaatggattct

SEQ ID NO: 105092 - DNA, 16 bp, H. sapiens
gcaaggaggagcaggt

SEQ ID NO: 105093 - DNA, 16 bp, H. sapiens
gcaaggaggagctggt

SEQ ID NO: 105094 - DNA, 16 bp, H. sapiens
gcaaggatatccagga

SEQ ID NO: 105095 - DNA, 16 bp, H. sapiens
gcaaggcatctctgaa

SEQ ID NO: 105096 - DNA, 16 bp, H. sapiens
gcaaggcatgtcttac

SEQ ID NO: 105097 - DNA, 16 bp, H. sapiens
gcaaggccctgggcct

SEQ ID NO: 105098 - DNA, 17 bp, H. sapiens
gcaaggctgggggaggg

SEQ ID NO: 105099 - DNA, 16 bp, H. sapiens
gcaaggctgtggaaaa

SEQ ID NO: 105100 - DNA, 16 bp, H. sapiens
gcaaggctttgtctca

SEQ ID NO: 105101 - DNA, 16 bp, H. sapiens
gcaaggctttgtttag

SEQ ID NO: 105102 - DNA, 16 bp, H. sapiens
gcaagggaggctggga

SEQ ID NO: 105103 - DNA, 16 bp, H. sapiens
gcaaggggtcagggga

SEQ ID NO: 105104 - DNA, 16 bp, H. sapiens
gcaagggtttcctttt

SEQ ID NO: 105105 - DNA, 16 bp, H. sapiens
gcaaggtgaagaggag

SEQ ID NO: 105106 - DNA, 16 bp, H. sapiens
gcaaggtgaagcagca

SEQ ID NO: 105107 - DNA, 16 bp, H. sapiens
gcaaggtgggtggatc

SEQ ID NO: 105108 - DNA, 16 bp, H. sapiens
gcaaggtggtgtgcac

SEQ ID NO: 105109 - DNA, 16 bp, H. sapiens
gcaagtaaatacagca

SEQ ID NO: 105110 - DNA, 16 bp, H. sapiens
gcaagtaatagcaaga

SEQ ID NO: 105111 - DNA, 16 bp, H. sapiens
gcaagtacttcatgac

SEQ ID NO: 105112 - DNA, 16 bp, H. sapiens
gcaagtagacatttgg

SEQ ID NO: 105113 - DNA, 16 bp, H. sapiens
gcaagtattttctctc

SEQ ID NO: 105114 - DNA, 16 bp, H. sapiens
gcaagtcaggaagaga

SEQ ID NO: 105115 - DNA, 16 bp, H. sapiens
gcaagtccaaaatcca

SEQ ID NO: 105116 - DNA, 16 bp, H. sapiens
gcaagtccttagagat

SEQ ID NO: 105117 - DNA, 16 bp, H. sapiens
gcaagtctgaaatcca

SEQ ID NO: 105118 - DNA, 16 bp, H. sapiens
gcaagtgaatcctgca

SEQ ID NO: 105119 - DNA, 16 bp, H. sapiens
gcaagtgacaggattt

SEQ ID NO: 105120 - DNA, 17 bp, H. sapiens
gcaagtgatccgcctgc

SEQ ID NO: 105121 - DNA, 16 bp, H. sapiens
gcaagtgctgggatta

SEQ ID NO: 105122 - DNA, 16 bp, H. sapiens
gcaagtggaaatttgg

SEQ ID NO: 105123 - DNA, 16 bp, H. sapiens
gcaagtggactttgga

SEQ ID NO: 105124 - DNA, 16 bp, H. sapiens
gcaagtggcagagctg

SEQ ID NO: 105125 - DNA, 16 bp, H. sapiens
gcaagtggttgctcca

SEQ ID NO: 105126 - DNA, 16 bp, H. sapiens
gcaagtgtgtgtgcat

SEQ ID NO: 105127 - DNA, 16 bp, H. sapiens
gcaagtgtgtgtgtgt

SEQ ID NO: 105128 - DNA, 16 bp, H. sapiens
gcaagttacctaacct

SEQ ID NO: 105129 - DNA, 16 bp, H. sapiens
gcaagttacttcactt

SEQ ID NO: 105130 - DNA, 16 bp, H. sapiens
gcaagttactttatct

SEQ ID NO: 105131 - DNA, 16 bp, H. sapiens
gcaagttttaaaactg

SEQ ID NO: 105132 - DNA, 16 bp, H. sapiens
gcaataaaaaatgaca

SEQ ID NO: 105133 - DNA, 16 bp, H. sapiens
gcaataaaaggaacaa

SEQ ID NO: 105134 - DNA, 16 bp, H. sapiens
gcaataaacatgggag

SEQ ID NO: 105135 - DNA, 16 bp, H. sapiens
gcaataaacatttatt

SEQ ID NO: 105136 - DNA, 16 bp, H. sapiens
gcaataagaatctgtt

SEQ ID NO: 105137 - DNA, 16 bp, H. sapiens
gcaataataatgggag

SEQ ID NO: 105138 - DNA, 16 bp, H. sapiens
gcaatagaaaatgaac

SEQ ID NO: 105139 - DNA, 16 bp, H. sapiens
gcaatagtcttgaata

SEQ ID NO: 105140 - DNA, 16 bp, H. sapiens
gcaatatgacaaaaca

SEQ ID NO: 105141 - DNA, 16 bp, H. sapiens
gcaatatgcatttaag

SEQ ID NO: 105142 - DNA, 16 bp, H. sapiens
gcaatatggcaaaacc

SEQ ID NO: 105143 - DNA, 16 bp, H. sapiens
gcaatcaagcaagaaa

SEQ ID NO: 105144 - DNA, 16 bp, H. sapiens
gcaatcatagctcacc

SEQ ID NO: 105145 - DNA, 16 bp, H. sapiens
gcaatcatagctcact

SEQ ID NO: 105146 - DNA, 16 bp, H. sapiens
gcaatccacccacatc

SEQ ID NO: 105147 - DNA, 16 bp, H. sapiens
gcaatccacccacctg

SEQ ID NO: 105148 - DNA, 16 bp, H. sapiens
gcaatccacctgcctt

SEQ ID NO: 105149 - DNA, 16 bp, H. sapiens
gcaatccaccttcctc

SEQ ID NO: 105150 - DNA, 16 bp, H. sapiens
gcaatccagcctggat

SEQ ID NO: 105151 - DNA, 16 bp, H. sapiens
gcaatccagcctgggc

SEQ ID NO: 105152 - DNA, 16 bp, H. sapiens
gcaatcctcacacctt

SEQ ID NO: 105153 - DNA, 16 bp, H. sapiens
gcaatcctcccatctc

SEQ ID NO: 105154 - DNA, 16 bp, H. sapiens
gcaatctcatcactgg

SEQ ID NO: 105155 - DNA, 16 bp, H. sapiens
gcaatctctgcccccc

SEQ ID NO: 105156 - DNA, 16 bp, H. sapiens
gcaatctctgcctctg

SEQ ID NO: 105157 - DNA, 16 bp, H. sapiens
gcaatctctgccttcc

SEQ ID NO: 105158 - DNA, 16 bp, H. sapiens
gcaatcttcctgcctc

SEQ ID NO: 105159 - DNA, 16 bp, H. sapiens
gcaatgaaaagaaaca

SEQ ID NO: 105160 - DNA, 16 bp, H. sapiens
gcaatgaacaatctga

SEQ ID NO: 105161 - DNA, 16 bp, H. sapiens
gcaatgaacatgggag

SEQ ID NO: 105162 - DNA, 16 bp, H. sapiens
gcaatgatttcttgaa

SEQ ID NO: 105163 - DNA, 16 bp, H. sapiens
gcaatgcccaggctgg

SEQ ID NO: 105164 - DNA, 16 bp, H. sapiens
gcaatggaacaaaact

SEQ ID NO: 105165 - DNA, 16 bp, H. sapiens
gcaatggaattgctgg

SEQ ID NO: 105166 - DNA, 16 bp, H. sapiens
gcaatggcacagtcat

SEQ ID NO: 105167 - DNA, 16 bp, H. sapiens
gcaatggcacagtctc

SEQ ID NO: 105168 - DNA, 16 bp, H. sapiens
gcaatggcaccgtctc

SEQ ID NO: 105169 - DNA, 16 bp, H. sapiens
gcaatggctccatctc

SEQ ID NO: 105170 - DNA, 16 bp, H. sapiens
gcaatgggaacaaaag

SEQ ID NO: 105171 - DNA, 16 bp, H. sapiens
gcaatgggaagccatt

SEQ ID NO: 105172 - DNA, 16 bp, H. sapiens
gcaatggggaaatgac

SEQ ID NO: 105173 - DNA, 16 bp, H. sapiens
gcaatggtgccatcat

SEQ ID NO: 105174 - DNA, 16 bp, H. sapiens
gcaatggtggatgccc

SEQ ID NO: 105175 - DNA, 16 bp, H. sapiens
gcaatggtgtgatcac

SEQ ID NO: 105176 - DNA, 16 bp, H. sapiens
gcaatgtctggaaaca

SEQ ID NO: 105177 - DNA, 16 bp, H. sapiens
gcaatgtctttttttt

SEQ ID NO: 105178 - DNA, 16 bp, H. sapiens
gcaatgtgactttgca

SEQ ID NO: 105179 - DNA, 16 bp, H. sapiens
gcaatgtggcaaaact

SEQ ID NO: 105180 - DNA, 16 bp, H. sapiens
gcaatgttcacaatag

SEQ ID NO: 105181 - DNA, 16 bp, H. sapiens
gcaattcaatgaggaa

SEQ ID NO: 105182 - DNA, 16 bp, H. sapiens
gcaattccacttctag

SEQ ID NO: 105183 - DNA, 16 bp, H. sapiens
gcaattccatttctgg

SEQ ID NO: 105184 - DNA, 16 bp, H. sapiens
gcaattcctcaaaaag

SEQ ID NO: 105185 - DNA, 16 bp, H. sapiens
gcaattcctctgtctt

SEQ ID NO: 105186 - DNA, 16 bp, H. sapiens
gcaattctctaatgac

SEQ ID NO: 105187 - DNA, 16 bp, H. sapiens
gcaattgcaaattttg

SEQ ID NO: 105188 - DNA, 16 bp, H. sapiens
gcaattgtaacacagt

SEQ ID NO: 105189 - DNA, 16 bp, H. sapiens
gcaatttaccaaagaa

SEQ ID NO: 105190 - DNA, 16 bp, H. sapiens
gcaatttgagaggctg

SEQ ID NO: 105191 - DNA, 16 bp, H. sapiens
gcaatttgcctgcctt

SEQ ID NO: 105192 - DNA, 16 bp, H. sapiens
gcaattttaacaatat

SEQ ID NO: 105193 - DNA, 16 bp, H. sapiens
gcaattttggcctcag

SEQ ID NO: 105194 - DNA, 16 bp, H. sapiens
gcaatttttttaaaaa

SEQ ID NO: 105195 - DNA, 16 bp, H. sapiens
gcacaaaagctgtgag

SEQ ID NO: 105196 - DNA, 16 bp, H. sapiens
gcacaaactttttttt

SEQ ID NO: 105197 - DNA, 16 bp, H. sapiens
gcacaaataaatgaaa

SEQ ID NO: 105198 - DNA, 16 bp, H. sapiens
gcacaaattctctctt

SEQ ID NO: 105199 - DNA, 16 bp, H. sapiens
gcacaaatttcttttt

SEQ ID NO: 105200 - DNA, 16 bp, H. sapiens
gcacaacagtctgaag

SEQ ID NO: 105201 - DNA, 25 bp, H. sapiens
gcacaacataccagaatctctggga

SEQ ID NO: 105202 - DNA, 16 bp, H. sapiens
gcacaacgtgcaggtt

SEQ ID NO: 105203 - DNA, 16 bp, H. sapiens
gcacaactaaatgaaa

SEQ ID NO: 105204 - DNA, 16 bp, H. sapiens
gcacaactacatggaa

SEQ ID NO: 105205 - DNA, 16 bp, H. sapiens
gcacaactccagtaaa

SEQ ID NO: 105206 - DNA, 16 bp, H. sapiens
gcacaagaacttcatg

SEQ ID NO: 105207 - DNA, 21 bp, H. sapiens
gcacaagaatcacttgaacct

SEQ ID NO: 105208 - DNA, 16 bp, H. sapiens
gcacaagacaaagatg

SEQ ID NO: 105209 - DNA, 16 bp, H. sapiens
gcacaagacaaggatg

SEQ ID NO: 105210 - DNA, 16 bp, H. sapiens
gcacaagaccctgtct

SEQ ID NO: 105211 - DNA, 16 bp, H. sapiens
gcacaagactctgtct

SEQ ID NO: 105212 - DNA, 18 bp, H. sapiens
gcacaagccttatttacc

SEQ ID NO: 105213 - DNA, 16 bp, H. sapiens
gcacaatcatagctca

SEQ ID NO: 105214 - DNA, 16 bp, H. sapiens
gcacaatgcctggctc

SEQ ID NO: 105215 - DNA, 16 bp, H. sapiens
gcacaatgcctggtac

SEQ ID NO: 105216 - DNA, 18 bp, H. sapiens
gcacacaaacatggcaca

SEQ ID NO: 105217 - DNA, 16 bp, H. sapiens
gcacacaaactggaaa

SEQ ID NO: 105218 - DNA, 16 bp, H. sapiens
gcacacacacacacag

SEQ ID NO: 105219 - DNA, 16 bp, H. sapiens
gcacacacacacactc

SEQ ID NO: 105220 - DNA, 16 bp, H. sapiens
gcacacacacacagag

SEQ ID NO: 105221 - DNA, 16 bp, H. sapiens
gcacacacacacatac

SEQ ID NO: 105222 - DNA, 18 bp, H. sapiens
gcacacacacacatgcac

SEQ ID NO: 105223 - DNA, 16 bp, H. sapiens
gcacacacacacgtgc

SEQ ID NO: 105224 - DNA, 16 bp, H. sapiens
gcacacacacagacac

SEQ ID NO: 105225 - DNA, 16 bp, H. sapiens
gcacacacacaggcat

SEQ ID NO: 105226 - DNA, 16 bp, H. sapiens
gcacacacacatacat

SEQ ID NO: 105227 - DNA, 16 bp, H. sapiens
gcacacacacatccac

SEQ ID NO: 105228 - DNA, 16 bp, H. sapiens
gcacacacacgcacac

SEQ ID NO: 105229 - DNA, 16 bp, H. sapiens
gcacacacacgcacgc

SEQ ID NO: 105230 - DNA, 16 bp, H. sapiens
gcacacacagacacac

SEQ ID NO: 105231 - DNA, 16 bp, H. sapiens
gcacacacatacacac

SEQ ID NO: 105232 - DNA, 16 bp, H. sapiens
gcacacacatacacat

SEQ ID NO: 105233 - DNA, 16 bp, H. sapiens
gcacacacatacatac

SEQ ID NO: 105234 - DNA, 16 bp, H. sapiens
gcacacacatgcacac

SEQ ID NO: 105235 - DNA, 18 bp, H. sapiens
gcacacacatgcacacac

SEQ ID NO: 105236 - DNA, 16 bp, H. sapiens
gcacacacatgcatgc

SEQ ID NO: 105237 - DNA, 16 bp, H. sapiens
gcacacacgtgcacac

SEQ ID NO: 105238 - DNA, 16 bp, H. sapiens
gcacacagacacacac

SEQ ID NO: 105239 - DNA, 16 bp, H. sapiens
gcacacagaggaaagg

SEQ ID NO: 105240 - DNA, 16 bp, H. sapiens
gcacacagcacaagca

SEQ ID NO: 105241 - DNA, 16 bp, H. sapiens
gcacacagcacagaga

SEQ ID NO: 105242 - DNA, 16 bp, H. sapiens
gcacacagcagggagg

SEQ ID NO: 105243 - DNA, 16 bp, H. sapiens
gcacacagcctggcac

SEQ ID NO: 105244 - DNA, 16 bp, H. sapiens
gcacacagtaggcatt

SEQ ID NO: 105245 - DNA, 16 bp, H. sapiens
gcacacagtaggtact

SEQ ID NO: 105246 - DNA, 16 bp, H. sapiens
gcacacagtaggtgct

SEQ ID NO: 105247 - DNA, 16 bp, H. sapiens
gcacacagtaggtgtt

SEQ ID NO: 105248 - DNA, 16 bp, H. sapiens
gcacacatacacacac

SEQ ID NO: 105249 - DNA, 16 bp, H. sapiens
gcacacatacacacat

SEQ ID NO: 105250 - DNA, 19 bp, H. sapiens
gcacacatatgtttattgc

SEQ ID NO: 105251 - DNA, 16 bp, H. sapiens
gcacacatggacacag

SEQ ID NO: 105252 - DNA, 17 bp, H. sapiens
gcacacatgtacacaca

SEQ ID NO: 105253 - DNA, 16 bp, H. sapiens
gcacaccagcctggat

SEQ ID NO: 105254 - DNA, 16 bp, H. sapiens
gcacaccatcatgcct

SEQ ID NO: 105255 - DNA, 18 bp, H. sapiens
gcacacccggctaatttt

SEQ ID NO: 105256 - DNA, 17 bp, H. sapiens
gcacacctataatccca

SEQ ID NO: 105257 - DNA, 16 bp, H. sapiens
gcacacctcggcctcc

SEQ ID NO: 105258 - DNA, 16 bp, H. sapiens
gcacacctgaacaaag

SEQ ID NO: 105259 - DNA, 16 bp, H. sapiens
gcacacctgcacacac

SEQ ID NO: 105260 - DNA, 16 bp, H. sapiens
gcacacctgcaggccc

SEQ ID NO: 105261 - DNA, 18 bp, H. sapiens
gcacacctgtaatcccag

SEQ ID NO: 105262 - DNA, 17 bp, H. sapiens
gcacacctgtattccca

SEQ ID NO: 105263 - DNA, 16 bp, H. sapiens
gcacacgcacgcacac

SEQ ID NO: 105264 - DNA, 16 bp, H. sapiens
gcacacgccgccatgc

SEQ ID NO: 105265 - DNA, 16 bp, H. sapiens
gcacactcacatacac

SEQ ID NO: 105266 - DNA, 16 bp, H. sapiens
gcacactcctgcctca

SEQ ID NO: 105267 - DNA, 16 bp, H. sapiens
gcacactgcaacctcc

SEQ ID NO: 105268 - DNA, 16 bp, H. sapiens
gcacactgcagccttg

SEQ ID NO: 105269 - DNA, 16 bp, H. sapiens
gcacactttttttttt

SEQ ID NO: 105270 - DNA, 16 bp, H. sapiens
gcacagaccaccacac

SEQ ID NO: 105271 - DNA, 16 bp, H. sapiens
gcacagaccccacagg

SEQ ID NO: 105272 - DNA, 16 bp, H. sapiens
gcacagaccctggagc

SEQ ID NO: 105273 - DNA, 16 bp, H. sapiens
gcacagactctggagc

SEQ ID NO: 105274 - DNA, 16 bp, H. sapiens
gcacagagaaggtgct

SEQ ID NO: 105275 - DNA, 16 bp, H. sapiens
gcacagagaagttaag

SEQ ID NO: 105276 - DNA, 16 bp, H. sapiens
gcacagagaggataag

SEQ ID NO: 105277 - DNA, 16 bp, H. sapiens
gcacagagaggggaag

SEQ ID NO: 105278 - DNA, 16 bp, H. sapiens
gcacagagcagatgct

SEQ ID NO: 105279 - DNA, 16 bp, H. sapiens
gcacagagcagcaggg

SEQ ID NO: 105280 - DNA, 16 bp, H. sapiens
gcacagagcaggggct

SEQ ID NO: 105281 - DNA, 16 bp, H. sapiens
gcacagagcaggggga

SEQ ID NO: 105282 - DNA, 16 bp, H. sapiens
gcacagagcctggccc

SEQ ID NO: 105283 - DNA, 16 bp, H. sapiens
gcacagagcttccatg

SEQ ID NO: 105284 - DNA, 16 bp, H. sapiens
gcacagcacacacaca

SEQ ID NO: 105285 - DNA, 16 bp, H. sapiens
gcacagcagagtgact

SEQ ID NO: 105286 - DNA, 16 bp, H. sapiens
gcacagcagcctggac

SEQ ID NO: 105287 - DNA, 16 bp, H. sapiens
gcacagcagctcatgc

SEQ ID NO: 105288 - DNA, 16 bp, H. sapiens
gcacagcatcacttct

SEQ ID NO: 105289 - DNA, 16 bp, H. sapiens
gcacagccaaagaaat

SEQ ID NO: 105290 - DNA, 16 bp, H. sapiens
gcacagcccagcccag

SEQ ID NO: 105291 - DNA, 16 bp, H. sapiens
gcacagcctggccctg

SEQ ID NO: 105292 - DNA, 16 bp, H. sapiens
gcacagctaaagcagt

SEQ ID NO: 105293 - DNA, 16 bp, H. sapiens
gcacagctaatttttt

SEQ ID NO: 105294 - DNA, 16 bp, H. sapiens
gcacagctgcagccac

SEQ ID NO: 105295 - DNA, 16 bp, H. sapiens
gcacagcttagctggg

SEQ ID NO: 105296 - DNA, 16 bp, H. sapiens
gcacaggacagcccct

SEQ ID NO: 105297 - DNA, 16 bp, H. sapiens
gcacaggaggaagatg

SEQ ID NO: 105298 - DNA, 16 bp, H. sapiens
gcacaggaggcagagg

SEQ ID NO: 105299 - DNA, 16 bp, H. sapiens
gcacaggagggaggct

SEQ ID NO: 105300 - DNA, 16 bp, H. sapiens
gcacaggatgggggca

SEQ ID NO: 105301 - DNA, 16 bp, H. sapiens
gcacaggatgggggcg

SEQ ID NO: 105302 - DNA, 16 bp, H. sapiens
gcacaggcaatgaaag

SEQ ID NO: 105303 - DNA, 16 bp, H. sapiens
gcacaggcctggcaca

SEQ ID NO: 105304 - DNA, 16 bp, H. sapiens
gcacagggttttatag

SEQ ID NO: 105305 - DNA, 16 bp, H. sapiens
gcacaggtacagcttg

SEQ ID NO: 105306 - DNA, 16 bp, H. sapiens
gcacaggtgccagctc

SEQ ID NO: 105307 - DNA, 16 bp, H. sapiens
gcacagtgagccactc

SEQ ID NO: 105308 - DNA, 16 bp, H. sapiens
gcacagtgcccagcac

SEQ ID NO: 105309 - DNA, 16 bp, H. sapiens
gcacagtgcctcacac

SEQ ID NO: 105310 - DNA, 16 bp, H. sapiens
gcacagtgcctgccac

SEQ ID NO: 105311 - DNA, 16 bp, H. sapiens
gcacagtgcctggcag

SEQ ID NO: 105312 - DNA, 16 bp, H. sapiens
gcacagtgccttgcat

SEQ ID NO: 105313 - DNA, 16 bp, H. sapiens
gcacagtgctaagtgc

SEQ ID NO: 105314 - DNA, 16 bp, H. sapiens
gcacagtgctgggcac

SEQ ID NO: 105315 - DNA, 16 bp, H. sapiens
gcacagtgcttggtac

SEQ ID NO: 105316 - DNA, 16 bp, H. sapiens
gcacagtggcccatgc

SEQ ID NO: 105317 - DNA, 20 bp, H. sapiens
gcacagtggctcacacatgt

SEQ ID NO: 105318 - DNA, 16 bp, H. sapiens
gcacagtggctcaggc

SEQ ID NO: 105319 - DNA, 16 bp, H. sapiens
gcacataaaatatcat

SEQ ID NO: 105320 - DNA, 16 bp, H. sapiens
gcacatacacatgcat

SEQ ID NO: 105321 - DNA, 16 bp, H. sapiens
gcacatacagacacac

SEQ ID NO: 105322 - DNA, 16 bp, H. sapiens
gcacatagcaagtact

SEQ ID NO: 105323 - DNA, 16 bp, H. sapiens
gcacatagtaagaact

SEQ ID NO: 105324 - DNA, 16 bp, H. sapiens
gcacatagtcatcaag

SEQ ID NO: 105325 - DNA, 16 bp, H. sapiens
gcacatatatacatat

SEQ ID NO: 105326 - DNA, 16 bp, H. sapiens
gcacatccaggcacag

SEQ ID NO: 105327 - DNA, 16 bp, H. sapiens
gcacatcctctccagc

SEQ ID NO: 105328 - DNA, 16 bp, H. sapiens
gcacatcctgcacttg

SEQ ID NO: 105329 - DNA, 16 bp, H. sapiens
gcacatgaaaacatgc

SEQ ID NO: 105330 - DNA, 16 bp, H. sapiens
gcacatgacaccacac

SEQ ID NO: 105331 - DNA, 16 bp, H. sapiens
gcacatgcacacacac

SEQ ID NO: 105332 - DNA, 16 bp, H. sapiens
gcacatgcagacacac

SEQ ID NO: 105333 - DNA, 16 bp, H. sapiens
gcacatgcatgcacac

SEQ ID NO: 105334 - DNA, 16 bp, H. sapiens
gcacatgccaccaaac

SEQ ID NO: 105335 - DNA, 16 bp, H. sapiens
gcacatgccaccacgt

SEQ ID NO: 105336 - DNA, 16 bp, H. sapiens
gcacatgcctgtaacc

SEQ ID NO: 105337 - DNA, 16 bp, H. sapiens
gcacatgcctgtaata

SEQ ID NO: 105338 - DNA, 16 bp, H. sapiens
gcacatgcctgtaggc

SEQ ID NO: 105339 - DNA, 16 bp, H. sapiens
gcacatgcgtgcacac

SEQ ID NO: 105340 - DNA, 16 bp, H. sapiens
gcacatgtacccccga

SEQ ID NO: 105341 - DNA, 30 bp, H. sapiens
gcacatgtaggttgaatgaaactctagttc

SEQ ID NO: 105342 - DNA, 16 bp, H. sapiens
gcacatgtgcacacac

SEQ ID NO: 105343 - DNA, 16 bp, H. sapiens
gcacatgtgcacacat

SEQ ID NO: 105344 - DNA, 16 bp, H. sapiens
gcacatgtgcatgcac

SEQ ID NO: 105345 - DNA, 16 bp, H. sapiens
gcacatgttctcaggg

SEQ ID NO: 105346 - DNA, 16 bp, H. sapiens
gcacattcatgtttat

SEQ ID NO: 105347 - DNA, 16 bp, H. sapiens
gcacattctgcccatg

SEQ ID NO: 105348 - DNA, 16 bp, H. sapiens
gcacattgaggcttat

SEQ ID NO: 105349 - DNA, 16 bp, H. sapiens
gcacattgcactccag

SEQ ID NO: 105350 - DNA, 16 bp, H. sapiens
gcacatttaatagact

SEQ ID NO: 105351 - DNA, 16 bp, H. sapiens
gcaccaaaaactgcaa

SEQ ID NO: 105352 - DNA, 16 bp, H. sapiens
gcaccaaaatttcaga

SEQ ID NO: 105353 - DNA, 16 bp, H. sapiens
gcaccaacacgcccag

SEQ ID NO: 105354 - DNA, 16 bp, H. sapiens
gcaccaacctaacaga

SEQ ID NO: 105355 - DNA, 16 bp, H. sapiens
gcaccacagcactcca

SEQ ID NO: 105356 - DNA, 16 bp, H. sapiens
gcaccaccacaccctg

SEQ ID NO: 105357 - DNA, 16 bp, H. sapiens
gcaccaccacactggc

SEQ ID NO: 105358 - DNA, 16 bp, H. sapiens
gcaccaccaccatgcc

SEQ ID NO: 105359 - DNA, 16 bp, H. sapiens
gcaccaccacgtccag

SEQ ID NO: 105360 - DNA, 16 bp, H. sapiens
gcaccaccagccacag

SEQ ID NO: 105361 - DNA, 16 bp, H. sapiens
gcaccaccatatctgg

SEQ ID NO: 105362 - DNA, 16 bp, H. sapiens
gcaccaccatgactgg

SEQ ID NO: 105363 - DNA, 16 bp, H. sapiens
gcaccaccatgcctag

SEQ ID NO: 105364 - DNA, 16 bp, H. sapiens
gcaccaccatgtccag

SEQ ID NO: 105365 - DNA, 16 bp, H. sapiens
gcaccaccattcccag

SEQ ID NO: 105366 - DNA, 16 bp, H. sapiens
gcaccaccctgcctgg

SEQ ID NO: 105367 - DNA, 16 bp, H. sapiens
gcaccacctttgctgt

SEQ ID NO: 105368 - DNA, 16 bp, H. sapiens
gcaccactacacttgg

SEQ ID NO: 105369 - DNA, 16 bp, H. sapiens
gcaccactactcctgg

SEQ ID NO: 105370 - DNA, 16 bp, H. sapiens
gcaccactgaacttca

SEQ ID NO: 105371 - DNA, 16 bp, H. sapiens
gcaccactgcaccctg

SEQ ID NO: 105372 - DNA, 19 bp, H. sapiens
gcaccactgcactccagtg

SEQ ID NO: 105373 - DNA, 16 bp, H. sapiens
gcaccactgcactccg

SEQ ID NO: 105374 - DNA, 16 bp, H. sapiens
gcaccaggaactggtt

SEQ ID NO: 105375 - DNA, 16 bp, H. sapiens
gcaccagggagaggcc

SEQ ID NO: 105376 - DNA, 17 bp, H. sapiens
gcaccagtaatcccagc

SEQ ID NO: 105377 - DNA, 16 bp, H. sapiens
gcaccatatatgttgt

SEQ ID NO: 105378 - DNA, 16 bp, H. sapiens
gcaccatccctcatgg

SEQ ID NO: 105379 - DNA, 16 bp, H. sapiens
gcaccatcctataaaa

SEQ ID NO: 105380 - DNA, 16 bp, H. sapiens
gcaccatctcagctcc

SEQ ID NO: 105381 - DNA, 16 bp, H. sapiens
gcaccatgcctggcta

SEQ ID NO: 105382 - DNA, 16 bp, H. sapiens
gcaccatggctcaggc

SEQ ID NO: 105383 - DNA, 16 bp, H. sapiens
gcaccattgcacacca

SEQ ID NO: 105384 - DNA, 16 bp, H. sapiens
gcaccatttattgagt

SEQ ID NO: 105385 - DNA, 16 bp, H. sapiens
gcaccatttggagttt

SEQ ID NO: 105386 - DNA, 19 bp, H. sapiens
gcacccaccaccatgcccg

SEQ ID NO: 105387 - DNA, 16 bp, H. sapiens
gcacccacctccttct

SEQ ID NO: 105388 - DNA, 16 bp, H. sapiens
gcacccactgacctgc

SEQ ID NO: 105389 - DNA, 16 bp, H. sapiens
gcacccactgtcctga

SEQ ID NO: 105390 - DNA, 16 bp, H. sapiens
gcacccagagaaagag

SEQ ID NO: 105391 - DNA, 16 bp, H. sapiens
gcacccagcacccagc

SEQ ID NO: 105392 - DNA, 16 bp, H. sapiens
gcacccagccaagaga

SEQ ID NO: 105393 - DNA, 16 bp, H. sapiens
gcacccagcccagcct

SEQ ID NO: 105394 - DNA, 16 bp, H. sapiens
gcacccagcctccttc

SEQ ID NO: 105395 - DNA, 16 bp, H. sapiens
gcacccagcctgggca

SEQ ID NO: 105396 - DNA, 16 bp, H. sapiens
gcacccagcctgggcg

SEQ ID NO: 105397 - DNA, 16 bp, H. sapiens
gcacccagctaatttt

SEQ ID NO: 105398 - DNA, 16 bp, H. sapiens
gcacccaggtagtgag

SEQ ID NO: 105399 - DNA, 16 bp, H. sapiens
gcacccatcaccctag

SEQ ID NO: 105400 - DNA, 16 bp, H. sapiens
gcacccatcacctgag

SEQ ID NO: 105401 - DNA, 16 bp, H. sapiens
gcacccatggtcccag

SEQ ID NO: 105402 - DNA, 16 bp, H. sapiens
gcacccatttttcttc

SEQ ID NO: 105403 - DNA, 16 bp, H. sapiens
gcaccccaactccatg

SEQ ID NO: 105404 - DNA, 16 bp, H. sapiens
gcaccccagccagggc

SEQ ID NO: 105405 - DNA, 16 bp, H. sapiens
gcaccccagcctggat

SEQ ID NO: 105406 - DNA, 16 bp, H. sapiens
gcaccccatcctgggc

SEQ ID NO: 105407 - DNA, 16 bp, H. sapiens
gcacccccatgcccag

SEQ ID NO: 105408 - DNA, 16 bp, H. sapiens
gcacccctttccaggg

SEQ ID NO: 105409 - DNA, 17 bp, H. sapiens
gcacccgccaccatgcc

SEQ ID NO: 105410 - DNA, 17 bp, H. sapiens
gcacccgccaccattcc

SEQ ID NO: 105411 - DNA, 16 bp, H. sapiens
gcacccgccagcacac

SEQ ID NO: 105412 - DNA, 16 bp, H. sapiens
gcacccggccacattt

SEQ ID NO: 105413 - DNA, 16 bp, H. sapiens
gcaccctcaacctcct

SEQ ID NO: 105414 - DNA, 16 bp, H. sapiens
gcaccctcacagacac

SEQ ID NO: 105415 - DNA, 16 bp, H. sapiens
gcaccctctacctccc

SEQ ID NO: 105416 - DNA, 16 bp, H. sapiens
gcaccctgcagtgccc

SEQ ID NO: 105417 - DNA, 16 bp, H. sapiens
gcaccctgggaggcca

SEQ ID NO: 105418 - DNA, 16 bp, H. sapiens
gcaccctgggcctggt

SEQ ID NO: 105419 - DNA, 16 bp, H. sapiens
gcaccctgtgggtcag

SEQ ID NO: 105420 - DNA, 16 bp, H. sapiens
gcaccgatggcctcat

SEQ ID NO: 105421 - DNA, 16 bp, H. sapiens
gcaccgccccctgctc

SEQ ID NO: 105422 - DNA, 16 bp, H. sapiens
gcaccgtgcgcgagcc

SEQ ID NO: 105423 - DNA, 16 bp, H. sapiens
gcacctactatgtggc

SEQ ID NO: 105424 - DNA, 16 bp, H. sapiens
gcacctactgtgtgca

SEQ ID NO: 105425 - DNA, 16 bp, H. sapiens
gcacctagagtcccag

SEQ ID NO: 105426 - DNA, 16 bp, H. sapiens
gcacctagcacagtgc

SEQ ID NO: 105427 - DNA, 16 bp, H. sapiens
gcacctccacacccag

SEQ ID NO: 105428 - DNA, 16 bp, H. sapiens
gcacctccaccaccac

SEQ ID NO: 105429 - DNA, 16 bp, H. sapiens
gcacctccacctcctg

SEQ ID NO: 105430 - DNA, 16 bp, H. sapiens
gcacctcccctgcctg

SEQ ID NO: 105431 - DNA, 16 bp, H. sapiens
gcacctccctgctctc

SEQ ID NO: 105432 - DNA, 16 bp, H. sapiens
gcacctcctccctctc

SEQ ID NO: 105433 - DNA, 16 bp, H. sapiens
gcacctcctccttctc

SEQ ID NO: 105434 - DNA, 16 bp, H. sapiens
gcacctctgcccagcc

SEQ ID NO: 105435 - DNA, 16 bp, H. sapiens
gcacctctgcccggcc

SEQ ID NO: 105436 - DNA, 16 bp, H. sapiens
gcacctctgccctgcc

SEQ ID NO: 105437 - DNA, 16 bp, H. sapiens
gcacctcttcacaggg

SEQ ID NO: 105438 - DNA, 16 bp, H. sapiens
gcacctgaaaaagctg

SEQ ID NO: 105439 - DNA, 16 bp, H. sapiens
gcacctgcaattccag

SEQ ID NO: 105440 - DNA, 16 bp, H. sapiens
gcacctgcaggaccaa

SEQ ID NO: 105441 - DNA, 16 bp, H. sapiens
gcacctgccacaacac

SEQ ID NO: 105442 - DNA, 16 bp, H. sapiens
gcacctgccaccacag

SEQ ID NO: 105443 - DNA, 16 bp, H. sapiens
gcacctgccaccacgg

SEQ ID NO: 105444 - DNA, 16 bp, H. sapiens
gcacctgccaccccac

SEQ ID NO: 105445 - DNA, 16 bp, H. sapiens
gcacctgcccatctgc

SEQ ID NO: 105446 - DNA, 16 bp, H. sapiens
gcacctgcctcggcct

SEQ ID NO: 105447 - DNA, 16 bp, H. sapiens
gcacctgctgggcttg

SEQ ID NO: 105448 - DNA, 16 bp, H. sapiens
gcacctgctgttcttt

SEQ ID NO: 105449 - DNA, 16 bp, H. sapiens
gcacctggaaaatcag

SEQ ID NO: 105450 - DNA, 22 bp, H. sapiens
gcacctggaaaatcgggtcact

SEQ ID NO: 105451 - DNA, 16 bp, H. sapiens
gcacctggaacaccag

SEQ ID NO: 105452 - DNA, 16 bp, H. sapiens
gcacctggccaaaaac

SEQ ID NO: 105453 - DNA, 16 bp, H. sapiens
gcacctggccaccttt

SEQ ID NO: 105454 - DNA, 16 bp, H. sapiens
gcacctggcccagtgt

SEQ ID NO: 105455 - DNA, 16 bp, H. sapiens
gcacctggcccctccc

SEQ ID NO: 105456 - DNA, 16 bp, H. sapiens
gcacctggcctcaact

SEQ ID NO: 105457 - DNA, 16 bp, H. sapiens
gcacctggcctcattt

SEQ ID NO: 105458 - DNA, 16 bp, H. sapiens
gcacctggcctcttct

SEQ ID NO: 105459 - DNA, 16 bp, H. sapiens
gcacctggcctgattc

SEQ ID NO: 105460 - DNA, 16 bp, H. sapiens
gcacctggcctgctct

SEQ ID NO: 105461 - DNA, 16 bp, H. sapiens
gcacctggcctgttct

SEQ ID NO: 105462 - DNA, 16 bp, H. sapiens
gcacctggcctgtttc

SEQ ID NO: 105463 - DNA, 16 bp, H. sapiens
gcacctggctaatttt

SEQ ID NO: 105464 - DNA, 16 bp, H. sapiens
gcacctgggagggcag

SEQ ID NO: 105465 - DNA, 16 bp, H. sapiens
gcacctggtccagctg

SEQ ID NO: 105466 - DNA, 16 bp, H. sapiens
gcacctgtaatcgcag

SEQ ID NO: 105467 - DNA, 17 bp, H. sapiens
gcacctgtagtcccagg

SEQ ID NO: 105468 - DNA, 16 bp, H. sapiens
gcacctgtagtccgag

SEQ ID NO: 105469 - DNA, 16 bp, H. sapiens
gcacctgtagtttcag

SEQ ID NO: 105470 - DNA, 16 bp, H. sapiens
gcacctgtatcccagc

SEQ ID NO: 105471 - DNA, 16 bp, H. sapiens
gcacctgtattcccag

SEQ ID NO: 105472 - DNA, 16 bp, H. sapiens
gcacctgtggtcctgg

SEQ ID NO: 105473 - DNA, 16 bp, H. sapiens
gcacctgtggttccag

SEQ ID NO: 105474 - DNA, 16 bp, H. sapiens
gcacctgttatcccag

SEQ ID NO: 105475 - DNA, 16 bp, H. sapiens
gcaccttttcatgtac

SEQ ID NO: 105476 - DNA, 16 bp, H. sapiens
gcacgagccacagtgc

SEQ ID NO: 105477 - DNA, 16 bp, H. sapiens
gcacgatctcggctct

SEQ ID NO: 105478 - DNA, 16 bp, H. sapiens
gcacgcacacacagac

SEQ ID NO: 105479 - DNA, 16 bp, H. sapiens
gcacgcacgcacgcac

SEQ ID NO: 105480 - DNA, 16 bp, H. sapiens
gcacgccactacgccc

SEQ ID NO: 105481 - DNA, 18 bp, H. sapiens
gcacgcccagctaatttt

SEQ ID NO: 105482 - DNA, 16 bp, H. sapiens
gcacgcccatagtccc

SEQ ID NO: 105483 - DNA, 16 bp, H. sapiens
gcacgcgccaccactc

SEQ ID NO: 105484 - DNA, 18 bp, H. sapiens
gcacgcgcgcacacacac

SEQ ID NO: 105485 - DNA, 16 bp, H. sapiens
gcacgctggctcacac

SEQ ID NO: 105486 - DNA, 22 bp, H. sapiens
gcacgggactggcaggcagctc

SEQ ID NO: 105487 - DNA, 16 bp, H. sapiens
gcacggtggtgcatgc

SEQ ID NO: 105488 - DNA, 16 bp, H. sapiens
gcacgtgcaaaggccc

SEQ ID NO: 105489 - DNA, 16 bp, H. sapiens
gcacgtgccaccatgt

SEQ ID NO: 105490 - DNA, 16 bp, H. sapiens
gcacgtgcctgaaatc

SEQ ID NO: 105491 - DNA, 16 bp, H. sapiens
gcacgtggaacattct

SEQ ID NO: 105492 - DNA, 16 bp, H. sapiens
gcactaagaggcaaaa

SEQ ID NO: 105493 - DNA, 16 bp, H. sapiens
gcactacggcctgggc

SEQ ID NO: 105494 - DNA, 16 bp, H. sapiens
gcactactatgcccag

SEQ ID NO: 105495 - DNA, 16 bp, H. sapiens
gcactattcacaacag

SEQ ID NO: 105496 - DNA, 16 bp, H. sapiens
gcactattttacattt

SEQ ID NO: 105497 - DNA, 16 bp, H. sapiens
gcactcaataaatgtt

SEQ ID NO: 105498 - DNA, 16 bp, H. sapiens
gcactcacagtacctg

SEQ ID NO: 105499 - DNA, 16 bp, H. sapiens
gcactcaggaggctga

SEQ ID NO: 105500 - DNA, 16 bp, H. sapiens
gcactcaggcctgggt

SEQ ID NO: 105501 - DNA, 16 bp, H. sapiens
gcactcagggaggctg

SEQ ID NO: 105502 - DNA, 16 bp, H. sapiens
gcactcagtaaatgtt

SEQ ID NO: 105503 - DNA, 16 bp, H. sapiens
gcactccaccctgggc

SEQ ID NO: 105504 - DNA, 16 bp, H. sapiens
gcactccagccaaaaa

SEQ ID NO: 105505 - DNA, 16 bp, H. sapiens
gcactccagccccagc

SEQ ID NO: 105506 - DNA, 16 bp, H. sapiens
gcactccagccgaggc

SEQ ID NO: 105507 - DNA, 16 bp, H. sapiens
gcactccagctccagc

SEQ ID NO: 105508 - DNA, 16 bp, H. sapiens
gcactccagcttcggc

SEQ ID NO: 105509 - DNA, 16 bp, H. sapiens
gcactccatcctggtg

SEQ ID NO: 105510 - DNA, 16 bp, H. sapiens
gcactccccacatctc

SEQ ID NO: 105511 - DNA, 16 bp, H. sapiens
gcactcctgcctgggc

SEQ ID NO: 105512 - DNA, 16 bp, H. sapiens
gcactctagcccgggc

SEQ ID NO: 105513 - DNA, 16 bp, H. sapiens
gcactctggaaggctg

SEQ ID NO: 105514 - DNA, 16 bp, H. sapiens
gcactctggcctggac

SEQ ID NO: 105515 - DNA, 16 bp, H. sapiens
gcactctggctgggcc

SEQ ID NO: 105516 - DNA, 29 bp, H. sapiens
gcactctgtatctagctcaaggtttgtaa

SEQ ID NO: 105517 - DNA, 16 bp, H. sapiens
gcactcttcagcaaat

SEQ ID NO: 105518 - DNA, 16 bp, H. sapiens
gcactgagctgcagga

SEQ ID NO: 105519 - DNA, 17 bp, H. sapiens
gcactgcacccactgtc

SEQ ID NO: 105520 - DNA, 16 bp, H. sapiens
gcactgccatgcccgg

SEQ ID NO: 105521 - DNA, 17 bp, H. sapiens
gcactgccctccagcct

SEQ ID NO: 105522 - DNA, 18 bp, H. sapiens
gcactgcctttatgagct

SEQ ID NO: 105523 - DNA, 16 bp, H. sapiens
gcactgctgaaagaaa

SEQ ID NO: 105524 - DNA, 16 bp, H. sapiens
gcactgctgcactcca

SEQ ID NO: 105525 - DNA, 16 bp, H. sapiens
gcactgctgggggacc

SEQ ID NO: 105526 - DNA, 16 bp, H. sapiens
gcactgctggtgggaa

SEQ ID NO: 105527 - DNA, 16 bp, H. sapiens
gcactggacagaaccc

SEQ ID NO: 105528 - DNA, 16 bp, H. sapiens
gcactggcaggtttgg

SEQ ID NO: 105529 - DNA, 16 bp, H. sapiens
gcactgggaggatggg

SEQ ID NO: 105530 - DNA, 16 bp, H. sapiens
gcactgggcctggcac

SEQ ID NO: 105531 - DNA, 16 bp, H. sapiens
gcactggggaatggtg

SEQ ID NO: 105532 - DNA, 16 bp, H. sapiens
gcactggggatacaaa

SEQ ID NO: 105533 - DNA, 16 bp, H. sapiens
gcactggttacagaat

SEQ ID NO: 105534 - DNA, 16 bp, H. sapiens
gcactggttcagaagc

SEQ ID NO: 105535 - DNA, 16 bp, H. sapiens
gcactgtcccccaggc

SEQ ID NO: 105536 - DNA, 16 bp, H. sapiens
gcactgtgaaaatgga

SEQ ID NO: 105537 - DNA, 16 bp, H. sapiens
gcactgtggctcatgc

SEQ ID NO: 105538 - DNA, 16 bp, H. sapiens
gcactgtggtcagaga

SEQ ID NO: 105539 - DNA, 16 bp, H. sapiens
gcactgtggtgcatgc

SEQ ID NO: 105540 - DNA, 16 bp, H. sapiens
gcacttaataaatatt

SEQ ID NO: 105541 - DNA, 16 bp, H. sapiens
gcacttaccaccatgc

SEQ ID NO: 105542 - DNA, 16 bp, H. sapiens
gcacttactacatgcc

SEQ ID NO: 105543 - DNA, 16 bp, H. sapiens
gcacttactccaaaat

SEQ ID NO: 105544 - DNA, 16 bp, H. sapiens
gcacttataatcccag

SEQ ID NO: 105545 - DNA, 17 bp, H. sapiens
gcacttattccaaaatt

SEQ ID NO: 105546 - DNA, 16 bp, H. sapiens
gcacttcagcctgagc

SEQ ID NO: 105547 - DNA, 16 bp, H. sapiens
gcacttcagcctgggc

SEQ ID NO: 105548 - DNA, 16 bp, H. sapiens
gcacttctcctgcctc

SEQ ID NO: 105549 - DNA, 16 bp, H. sapiens
gcacttcttcttcctg

SEQ ID NO: 105550 - DNA, 16 bp, H. sapiens
gcacttgaaatgtgcc

SEQ ID NO: 105551 - DNA, 16 bp, H. sapiens
gcacttgctcttccct

SEQ ID NO: 105552 - DNA, 16 bp, H. sapiens
gcacttggatctctca

SEQ ID NO: 105553 - DNA, 16 bp, H. sapiens
gcacttgtggtcccag

SEQ ID NO: 105554 - DNA, 16 bp, H. sapiens
gcactttaaatatatt

SEQ ID NO: 105555 - DNA, 16 bp, H. sapiens
gcactttatatatatt

SEQ ID NO: 105556 - DNA, 16 bp, H. sapiens
gcactttgagagacca

SEQ ID NO: 105557 - DNA, 16 bp, H. sapiens
gcactttgagaggctg

SEQ ID NO: 105558 - DNA, 16 bp, H. sapiens
gcactttgggaagctg

SEQ ID NO: 105559 - DNA, 16 bp, H. sapiens
gcactttggtttttgt

SEQ ID NO: 105560 - DNA, 17 bp, H. sapiens
gcacttttccaatgggc

SEQ ID NO: 105561 - DNA, 16 bp, H. sapiens
gcagaaaaactggaaa

SEQ ID NO: 105562 - DNA, 16 bp, H. sapiens
gcagaaaaagcatctg

SEQ ID NO: 105563 - DNA, 16 bp, H. sapiens
gcagaaaaagtttgct

SEQ ID NO: 105564 - DNA, 16 bp, H. sapiens
gcagaaaaatgaaact

SEQ ID NO: 105565 - DNA, 16 bp, H. sapiens
gcagaaaacctgaaaa

SEQ ID NO: 105566 - DNA, 16 bp, H. sapiens
gcagaaaacctggaaa

SEQ ID NO: 105567 - DNA, 16 bp, H. sapiens
gcagaaaagctgaaaa

SEQ ID NO: 105568 - DNA, 16 bp, H. sapiens
gcagaaaatatttaca

SEQ ID NO: 105569 - DNA, 16 bp, H. sapiens
gcagaaaattgaaact

SEQ ID NO: 105570 - DNA, 16 bp, H. sapiens
gcagaaacacacacac

SEQ ID NO: 105571 - DNA, 16 bp, H. sapiens
gcagaaacatgccaaa

SEQ ID NO: 105572 - DNA, 16 bp, H. sapiens
gcagaaaccctacaaa

SEQ ID NO: 105573 - DNA, 16 bp, H. sapiens
gcagaaaccttacaaa

SEQ ID NO: 105574 - DNA, 16 bp, H. sapiens
gcagaaacttctgcag

SEQ ID NO: 105575 - DNA, 16 bp, H. sapiens
gcagaaagcaaaggag

SEQ ID NO: 105576 - DNA, 16 bp, H. sapiens
gcagaaaggctgaaaa

SEQ ID NO: 105577 - DNA, 16 bp, H. sapiens
gcagaaagtaaaactg

SEQ ID NO: 105578 - DNA, 16 bp, H. sapiens
gcagaaagtgaaggag

SEQ ID NO: 105579 - DNA, 16 bp, H. sapiens
gcagaaagttctattg

SEQ ID NO: 105580 - DNA, 16 bp, H. sapiens
gcagaaataaaaatgt

SEQ ID NO: 105581 - DNA, 16 bp, H. sapiens
gcagaaataaagatct

SEQ ID NO: 105582 - DNA, 16 bp, H. sapiens
gcagaaataaggatgt

SEQ ID NO: 105583 - DNA, 16 bp, H. sapiens
gcagaaatcaccatct

SEQ ID NO: 105584 - DNA, 16 bp, H. sapiens
gcagaaatcagtgaaa

SEQ ID NO: 105585 - DNA, 16 bp, H. sapiens
gcagaaatgaaggaaa

SEQ ID NO: 105586 - DNA, 16 bp, H. sapiens
gcagaaatttctgcag

SEQ ID NO: 105587 - DNA, 16 bp, H. sapiens
gcagaacaagaattaa

SEQ ID NO: 105588 - DNA, 16 bp, H. sapiens
gcagaacaagaccctg

SEQ ID NO: 105589 - DNA, 16 bp, H. sapiens
gcagaaccaggaccag

SEQ ID NO: 105590 - DNA, 16 bp, H. sapiens
gcagaaccagggccag

SEQ ID NO: 105591 - DNA, 16 bp, H. sapiens
gcagaaccatgaacca

SEQ ID NO: 105592 - DNA, 16 bp, H. sapiens
gcagaaccatgagccg

SEQ ID NO: 105593 - DNA, 16 bp, H. sapiens
gcagaactggaggaga

SEQ ID NO: 105594 - DNA, 16 bp, H. sapiens
gcagaactggatggag

SEQ ID NO: 105595 - DNA, 16 bp, H. sapiens
gcagaagaaaatctgt

SEQ ID NO: 105596 - DNA, 16 bp, H. sapiens
gcagaagaaatatttg

SEQ ID NO: 105597 - DNA, 16 bp, H. sapiens
gcagaagaagaagcag

SEQ ID NO: 105598 - DNA, 20 bp, H. sapiens
gcagaagaatggcgtgaacc

SEQ ID NO: 105599 - DNA, 16 bp, H. sapiens
gcagaagaatggtgtg

SEQ ID NO: 105600 - DNA, 16 bp, H. sapiens
gcagaagaatgtggat

SEQ ID NO: 105601 - DNA, 16 bp, H. sapiens
gcagaagaattccttg

SEQ ID NO: 105602 - DNA, 16 bp, H. sapiens
gcagaagaggaggctg

SEQ ID NO: 105603 - DNA, 16 bp, H. sapiens
gcagaagatggtgatt

SEQ ID NO: 105604 - DNA, 16 bp, H. sapiens
gcagaagattttaatt

SEQ ID NO: 105605 - DNA, 16 bp, H. sapiens
gcagaagcaggaaggt

SEQ ID NO: 105606 - DNA, 16 bp, H. sapiens
gcagaagcaggaggag

SEQ ID NO: 105607 - DNA, 16 bp, H. sapiens
gcagaagcagggcgag

SEQ ID NO: 105608 - DNA, 16 bp, H. sapiens
gcagaagctatttagt

SEQ ID NO: 105609 - DNA, 16 bp, H. sapiens
gcagaagctctacaag

SEQ ID NO: 105610 - DNA, 16 bp, H. sapiens
gcagaagctctgtagt

SEQ ID NO: 105611 - DNA, 16 bp, H. sapiens
gcagaagctgcaaggc

SEQ ID NO: 105612 - DNA, 16 bp, H. sapiens
gcagaagctgcagaac

SEQ ID NO: 105613 - DNA, 16 bp, H. sapiens
gcagaagctgcagcaa

SEQ ID NO: 105614 - DNA, 16 bp, H. sapiens
gcagaaggaagagcag

SEQ ID NO: 105615 - DNA, 16 bp, H. sapiens
gcagaaggagaagcag

SEQ ID NO: 105616 - DNA, 16 bp, H. sapiens
gcagaaggcaaaagag

SEQ ID NO: 105617 - DNA, 16 bp, H. sapiens
gcagaaggcaaaggag

SEQ ID NO: 105618 - DNA, 16 bp, H. sapiens
gcagaaggcaagggga

SEQ ID NO: 105619 - DNA, 16 bp, H. sapiens
gcagaaggcagaagag

SEQ ID NO: 105620 - DNA, 16 bp, H. sapiens
gcagaaggcagaggag

SEQ ID NO: 105621 - DNA, 16 bp, H. sapiens
gcagaagggaaagcag

SEQ ID NO: 105622 - DNA, 16 bp, H. sapiens
gcagaagggcaagaga

SEQ ID NO: 105623 - DNA, 16 bp, H. sapiens
gcagaaggggaagcag

SEQ ID NO: 105624 - DNA, 16 bp, H. sapiens
gcagaaggtgaaagac

SEQ ID NO: 105625 - DNA, 16 bp, H. sapiens
gcagaaggtgaagagg

SEQ ID NO: 105626 - DNA, 16 bp, H. sapiens
gcagaaggtgaagcag

SEQ ID NO: 105627 - DNA, 16 bp, H. sapiens
gcagaaggtgaagggc

SEQ ID NO: 105628 - DNA, 16 bp, H. sapiens
gcagaaggtgaaggtg

SEQ ID NO: 105629 - DNA, 16 bp, H. sapiens
gcagaaggtggagggg

SEQ ID NO: 105630 - DNA, 16 bp, H. sapiens
gcagaagtgatggtgt

SEQ ID NO: 105631 - DNA, 16 bp, H. sapiens
gcagaagtggaagaaa

SEQ ID NO: 105632 - DNA, 16 bp, H. sapiens
gcagaagttctccatg

SEQ ID NO: 105633 - DNA, 16 bp, H. sapiens
gcagaagtttgagacc

SEQ ID NO: 105634 - DNA, 16 bp, H. sapiens
gcagaatctcagctca

SEQ ID NO: 105635 - DNA, 16 bp, H. sapiens
gcagaatctgtctgat

SEQ ID NO: 105636 - DNA, 16 bp, H. sapiens
gcagaatctttttttt

SEQ ID NO: 105637 - DNA, 16 bp, H. sapiens
gcagaatgaaaatgga

SEQ ID NO: 105638 - DNA, 16 bp, H. sapiens
gcagaatgagcccagt

SEQ ID NO: 105639 - DNA, 16 bp, H. sapiens
gcagaatggataagaa

SEQ ID NO: 105640 - DNA, 16 bp, H. sapiens
gcagaatgggagaaaa

SEQ ID NO: 105641 - DNA, 16 bp, H. sapiens
gcagaatgtgcatgtt

SEQ ID NO: 105642 - DNA, 16 bp, H. sapiens
gcagaattcattttct

SEQ ID NO: 105643 - DNA, 16 bp, H. sapiens
gcagaatttcaggccc

SEQ ID NO: 105644 - DNA, 16 bp, H. sapiens
gcagaattttttcttt

SEQ ID NO: 105645 - DNA, 17 bp, H. sapiens
gcagacaaccagtctga

SEQ ID NO: 105646 - DNA, 16 bp, H. sapiens
gcagacaagaaagaat

SEQ ID NO: 105647 - DNA, 16 bp, H. sapiens
gcagacacacaggcag

SEQ ID NO: 105648 - DNA, 16 bp, H. sapiens
gcagacacagcacaga

SEQ ID NO: 105649 - DNA, 16 bp, H. sapiens
gcagacaccttcttca

SEQ ID NO: 105650 - DNA, 21 bp, H. sapiens
gcagacacttctcaaaagaag

SEQ ID NO: 105651 - DNA, 16 bp, H. sapiens
gcagacagacagacag

SEQ ID NO: 105652 - DNA, 16 bp, H. sapiens
gcagacagaggttgca

SEQ ID NO: 105653 - DNA, 16 bp, H. sapiens
gcagacagcagattgt

SEQ ID NO: 105654 - DNA, 16 bp, H. sapiens
gcagacagcagccctc

SEQ ID NO: 105655 - DNA, 16 bp, H. sapiens
gcagacagctgtcttc

SEQ ID NO: 105656 - DNA, 16 bp, H. sapiens
gcagacaggctcctgg

SEQ ID NO: 105657 - DNA, 16 bp, H. sapiens
gcagacatggggagaa

SEQ ID NO: 105658 - DNA, 16 bp, H. sapiens
gcagacccacccttaa

SEQ ID NO: 105659 - DNA, 16 bp, H. sapiens
gcagacccaggcatcc

SEQ ID NO: 105660 - DNA, 16 bp, H. sapiens
gcagaccctcccatca

SEQ ID NO: 105661 - DNA, 16 bp, H. sapiens
gcagaccttcgctgtg

SEQ ID NO: 105662 - DNA, 16 bp, H. sapiens
gcagacggccaccttc

SEQ ID NO: 105663 - DNA, 16 bp, H. sapiens
gcagactctgattcag

SEQ ID NO: 105664 - DNA, 16 bp, H. sapiens
gcagactggagtgcaa

SEQ ID NO: 105665 - DNA, 16 bp, H. sapiens
gcagactggagtgcag

SEQ ID NO: 105666 - DNA, 16 bp, H. sapiens
gcagagaaaacagcaa

SEQ ID NO: 105667 - DNA, 16 bp, H. sapiens
gcagagaaaagagaat

SEQ ID NO: 105668 - DNA, 16 bp, H. sapiens
gcagagaaaatggaac

SEQ ID NO: 105669 - DNA, 16 bp, H. sapiens
gcagagaaggggttgg

SEQ ID NO: 105670 - DNA, 16 bp, H. sapiens
gcagagacagaaaacc

SEQ ID NO: 105671 - DNA, 16 bp, H. sapiens
gcagagacagacacag

SEQ ID NO: 105672 - DNA, 16 bp, H. sapiens
gcagagacagggcttc

SEQ ID NO: 105673 - DNA, 16 bp, H. sapiens
gcagagactggaggga

SEQ ID NO: 105674 - DNA, 16 bp, H. sapiens
gcagagactggcagca

SEQ ID NO: 105675 - DNA, 16 bp, H. sapiens
gcagagagaaacagag

SEQ ID NO: 105676 - DNA, 16 bp, H. sapiens
gcagagagccaagatc

SEQ ID NO: 105677 - DNA, 16 bp, H. sapiens
gcagagataaataaaa

SEQ ID NO: 105678 - DNA, 16 bp, H. sapiens
gcagagatgggcagat

SEQ ID NO: 105679 - DNA, 16 bp, H. sapiens
gcagagatggggcttc

SEQ ID NO: 105680 - DNA, 16 bp, H. sapiens
gcagagattgcagaga

SEQ ID NO: 105681 - DNA, 16 bp, H. sapiens
gcagagattgcagtca

SEQ ID NO: 105682 - DNA, 16 bp, H. sapiens
gcagagattgtagtga

SEQ ID NO: 105683 - DNA, 16 bp, H. sapiens
gcagagcaaacagaca

SEQ ID NO: 105684 - DNA, 18 bp, H. sapiens
gcagagcaagactccatc

SEQ ID NO: 105685 - DNA, 16 bp, H. sapiens
gcagagcagatggcag

SEQ ID NO: 105686 - DNA, 16 bp, H. sapiens
gcagagcagggcaggg

SEQ ID NO: 105687 - DNA, 16 bp, H. sapiens
gcagagcagggccagg

SEQ ID NO: 105688 - DNA, 16 bp, H. sapiens
gcagagcagggcctgg

SEQ ID NO: 105689 - DNA, 16 bp, H. sapiens
gcagagcatgcagtga

SEQ ID NO: 105690 - DNA, 16 bp, H. sapiens
gcagagccaggattcc

SEQ ID NO: 105691 - DNA, 16 bp, H. sapiens
gcagagccaggcaggg

SEQ ID NO: 105692 - DNA, 16 bp, H. sapiens
gcagagccaggctggg

SEQ ID NO: 105693 - DNA, 16 bp, H. sapiens
gcagagccaggctttg

SEQ ID NO: 105694 - DNA, 16 bp, H. sapiens
gcagagccagggaagg

SEQ ID NO: 105695 - DNA, 16 bp, H. sapiens
gcagagccagggccag

SEQ ID NO: 105696 - DNA, 16 bp, H. sapiens
gcagagccaggtgtac

SEQ ID NO: 105697 - DNA, 16 bp, H. sapiens
gcagagccatgctccc

SEQ ID NO: 105698 - DNA, 16 bp, H. sapiens
gcagagcccaggccag

SEQ ID NO: 105699 - DNA, 16 bp, H. sapiens
gcagagccctcatgaa

SEQ ID NO: 105700 - DNA, 16 bp, H. sapiens
gcagagccctcatgat

SEQ ID NO: 105701 - DNA, 16 bp, H. sapiens
gcagagccctgggcag

SEQ ID NO: 105702 - DNA, 16 bp, H. sapiens
gcagagcctgaggcag

SEQ ID NO: 105703 - DNA, 16 bp, H. sapiens
gcagagctatagtaac

SEQ ID NO: 105704 - DNA, 16 bp, H. sapiens
gcagagctgaaggaga

SEQ ID NO: 105705 - DNA, 16 bp, H. sapiens
gcagagctgggacagg

SEQ ID NO: 105706 - DNA, 16 bp, H. sapiens
gcagagcttgaagtga

SEQ ID NO: 105707 - DNA, 18 bp, H. sapiens
gcagaggaacataaattg

SEQ ID NO: 105708 - DNA, 16 bp, H. sapiens
gcagaggaatcacttg

SEQ ID NO: 105709 - DNA, 16 bp, H. sapiens
gcagaggaatgaaact

SEQ ID NO: 105710 - DNA, 16 bp, H. sapiens
gcagaggacagagaga

SEQ ID NO: 105711 - DNA, 16 bp, H. sapiens
gcagaggagaaaactg

SEQ ID NO: 105712 - DNA, 17 bp, H. sapiens
gcagaggaggcgccgag

SEQ ID NO: 105713 - DNA, 16 bp, H. sapiens
gcagaggaggtgctga

SEQ ID NO: 105714 - DNA, 16 bp, H. sapiens
gcagaggatgtggtga

SEQ ID NO: 105715 - DNA, 16 bp, H. sapiens
gcagaggattgaaact

SEQ ID NO: 105716 - DNA, 16 bp, H. sapiens
gcagaggcactcctca

SEQ ID NO: 105717 - DNA, 16 bp, H. sapiens
gcagaggcagaaagag

SEQ ID NO: 105718 - DNA, 16 bp, H. sapiens
gcagaggcagaagagg

SEQ ID NO: 105719 - DNA, 16 bp, H. sapiens
gcagaggcagaaggaa

SEQ ID NO: 105720 - DNA, 16 bp, H. sapiens
gcagaggcagaggtgg

SEQ ID NO: 105721 - DNA, 16 bp, H. sapiens
gcagaggcaggaggat

SEQ ID NO: 105722 - DNA, 16 bp, H. sapiens
gcagaggcaggtgtgt

SEQ ID NO: 105723 - DNA, 16 bp, H. sapiens
gcagaggcagtggcag

SEQ ID NO: 105724 - DNA, 16 bp, H. sapiens
gcagaggccaaggatg

SEQ ID NO: 105725 - DNA, 16 bp, H. sapiens
gcagaggccaggcgtg

SEQ ID NO: 105726 - DNA, 16 bp, H. sapiens
gcagaggccctgaggc

SEQ ID NO: 105727 - DNA, 16 bp, H. sapiens
gcagaggcctcaggaa

SEQ ID NO: 105728 - DNA, 16 bp, H. sapiens
gcagaggctgcagaac

SEQ ID NO: 105729 - DNA, 16 bp, H. sapiens
gcagaggctgccatga

SEQ ID NO: 105730 - DNA, 16 bp, H. sapiens
gcagaggctggaagag

SEQ ID NO: 105731 - DNA, 16 bp, H. sapiens
gcagaggctggaggat

SEQ ID NO: 105732 - DNA, 16 bp, H. sapiens
gcagaggctggaggtg

SEQ ID NO: 105733 - DNA, 16 bp, H. sapiens
gcagaggctgggcctg

SEQ ID NO: 105734 - DNA, 16 bp, H. sapiens
gcagagggaacagcct

SEQ ID NO: 105735 - DNA, 16 bp, H. sapiens
gcagagggaagagcag

SEQ ID NO: 105736 - DNA, 16 bp, H. sapiens
gcagagggaggagaat

SEQ ID NO: 105737 - DNA, 16 bp, H. sapiens
gcagagggcaggcagg

SEQ ID NO: 105738 - DNA, 16 bp, H. sapiens
gcagagggtgcagtgg

SEQ ID NO: 105739 - DNA, 16 bp, H. sapiens
gcagaggtggaagaaa

SEQ ID NO: 105740 - DNA, 16 bp, H. sapiens
gcagaggtggaggagg

SEQ ID NO: 105741 - DNA, 16 bp, H. sapiens
gcagaggtggaggctg

SEQ ID NO: 105742 - DNA, 16 bp, H. sapiens
gcagaggtggcagtgg

SEQ ID NO: 105743 - DNA, 16 bp, H. sapiens
gcagaggtgggaagat

SEQ ID NO: 105744 - DNA, 16 bp, H. sapiens
gcagaggtgggggctg

SEQ ID NO: 105745 - DNA, 16 bp, H. sapiens
gcagaggtgggtgggt

SEQ ID NO: 105746 - DNA, 16 bp, H. sapiens
gcagaggtggtagtga

SEQ ID NO: 105747 - DNA, 16 bp, H. sapiens
gcagaggtggtggtga

SEQ ID NO: 105748 - DNA, 16 bp, H. sapiens
gcagaggttacaatga

SEQ ID NO: 105749 - DNA, 16 bp, H. sapiens
gcagaggttctcaatg

SEQ ID NO: 105750 - DNA, 16 bp, H. sapiens
gcagaggttgcagcaa

SEQ ID NO: 105751 - DNA, 16 bp, H. sapiens
gcagaggttggaacag

SEQ ID NO: 105752 - DNA, 16 bp, H. sapiens
gcagaggtttttgttt

SEQ ID NO: 105753 - DNA, 16 bp, H. sapiens
gcagagtctcaaagag

SEQ ID NO: 105754 - DNA, 16 bp, H. sapiens
gcagagtcttgccctg

SEQ ID NO: 105755 - DNA, 17 bp, H. sapiens
gcagagtcttgctctgt

SEQ ID NO: 105756 - DNA, 18 bp, H. sapiens
gcagagtcttgttctgtc

SEQ ID NO: 105757 - DNA, 16 bp, H. sapiens
gcagagtgaagagaca

SEQ ID NO: 105758 - DNA, 16 bp, H. sapiens
gcagagtgagggagag

SEQ ID NO: 105759 - DNA, 16 bp, H. sapiens
gcagagtgggagaaaa

SEQ ID NO: 105760 - DNA, 16 bp, H. sapiens
gcagagttgaatagtt

SEQ ID NO: 105761 - DNA, 16 bp, H. sapiens
gcagagttgagcagtt

SEQ ID NO: 105762 - DNA, 16 bp, H. sapiens
gcagagttgagtagtt

SEQ ID NO: 105763 - DNA, 16 bp, H. sapiens
gcagagttgccacaaa

SEQ ID NO: 105764 - DNA, 16 bp, H. sapiens
gcagagttgtaaactg

SEQ ID NO: 105765 - DNA, 16 bp, H. sapiens
gcagagtttacagtga

SEQ ID NO: 105766 - DNA, 16 bp, H. sapiens
gcagagtttggctggg

SEQ ID NO: 105767 - DNA, 16 bp, H. sapiens
gcagatagctgccttc

SEQ ID NO: 105768 - DNA, 16 bp, H. sapiens
gcagatattcaataaa

SEQ ID NO: 105769 - DNA, 16 bp, H. sapiens
gcagatcaaaaatatt

SEQ ID NO: 105770 - DNA, 16 bp, H. sapiens
gcagatcaagaccatc

SEQ ID NO: 105771 - DNA, 16 bp, H. sapiens
gcagatcaccagaggt

SEQ ID NO: 105772 - DNA, 16 bp, H. sapiens
gcagatcacgaggtga

SEQ ID NO: 105773 - DNA, 16 bp, H. sapiens
gcagatcacttgagct

SEQ ID NO: 105774 - DNA, 16 bp, H. sapiens
gcagatccttcaggag

SEQ ID NO: 105775 - DNA, 16 bp, H. sapiens
gcagatctttcccatg

SEQ ID NO: 105776 - DNA, 16 bp, H. sapiens
gcagatgaagcttcca

SEQ ID NO: 105777 - DNA, 16 bp, H. sapiens
gcagatgaggaagctg

SEQ ID NO: 105778 - DNA, 16 bp, H. sapiens
gcagatgatatgatta

SEQ ID NO: 105779 - DNA, 16 bp, H. sapiens
gcagatgatgaggtca

SEQ ID NO: 105780 - DNA, 16 bp, H. sapiens
gcagatgcagaaccca

SEQ ID NO: 105781 - DNA, 16 bp, H. sapiens
gcagatgccagcacca

SEQ ID NO: 105782 - DNA, 16 bp, H. sapiens
gcagatgctcaagtcc

SEQ ID NO: 105783 - DNA, 16 bp, H. sapiens
gcagatgctcaataaa

SEQ ID NO: 105784 - DNA, 16 bp, H. sapiens
gcagatgctgatgcca

SEQ ID NO: 105785 - DNA, 16 bp, H. sapiens
gcagatgctgctggtc

SEQ ID NO: 105786 - DNA, 16 bp, H. sapiens
gcagatgctggtgcca

SEQ ID NO: 105787 - DNA, 16 bp, H. sapiens
gcagatgcttaataaa

SEQ ID NO: 105788 - DNA, 16 bp, H. sapiens
gcagatggctgccttc

SEQ ID NO: 105789 - DNA, 16 bp, H. sapiens
gcagatgtggtggaaa

SEQ ID NO: 105790 - DNA, 16 bp, H. sapiens
gcagatgttcaataaa

SEQ ID NO: 105791 - DNA, 16 bp, H. sapiens
gcagattatattttcc

SEQ ID NO: 105792 - DNA, 16 bp, H. sapiens
gcagattcaaccaact

SEQ ID NO: 105793 - DNA, 16 bp, H. sapiens
gcagattcagtgtctg

SEQ ID NO: 105794 - DNA, 16 bp, H. sapiens
gcagattcctgggctc

SEQ ID NO: 105795 - DNA, 16 bp, H. sapiens
gcagattctacagaaa

SEQ ID NO: 105796 - DNA, 16 bp, H. sapiens
gcagattctgcaaaag

SEQ ID NO: 105797 - DNA, 16 bp, H. sapiens
gcagatttcttgagct

SEQ ID NO: 105798 - DNA, 16 bp, H. sapiens
gcagcaaaagcagtac

SEQ ID NO: 105799 - DNA, 16 bp, H. sapiens
gcagcaaaagcagtgt

SEQ ID NO: 105800 - DNA, 16 bp, H. sapiens
gcagcaaacagcagtg

SEQ ID NO: 105801 - DNA, 16 bp, H. sapiens
gcagcaaacttctacc

SEQ ID NO: 105802 - DNA, 16 bp, H. sapiens
gcagcaaacttttcag

SEQ ID NO: 105803 - DNA, 16 bp, H. sapiens
gcagcaaagagaagtg

SEQ ID NO: 105804 - DNA, 16 bp, H. sapiens
gcagcaaaggaaacaa

SEQ ID NO: 105805 - DNA, 16 bp, H. sapiens
gcagcaaagtttgtta

SEQ ID NO: 105806 - DNA, 16 bp, H. sapiens
gcagcaacaaggagaa

SEQ ID NO: 105807 - DNA, 16 bp, H. sapiens
gcagcaacaaggatgg

SEQ ID NO: 105808 - DNA, 16 bp, H. sapiens
gcagcaacatgaatga

SEQ ID NO: 105809 - DNA, 16 bp, H. sapiens
gcagcaacctggatgc

SEQ ID NO: 105810 - DNA, 16 bp, H. sapiens
gcagcaagaaggccct

SEQ ID NO: 105811 - DNA, 16 bp, H. sapiens
gcagcaagccaagatg

SEQ ID NO: 105812 - DNA, 16 bp, H. sapiens
gcagcaagctgagatc

SEQ ID NO: 105813 - DNA, 16 bp, H. sapiens
gcagcaatgggtgcct

SEQ ID NO: 105814 - DNA, 16 bp, H. sapiens
gcagcacatcaaacag

SEQ ID NO: 105815 - DNA, 16 bp, H. sapiens
gcagcacatgactgta

SEQ ID NO: 105816 - DNA, 16 bp, H. sapiens
gcagcaccacacccag

SEQ ID NO: 105817 - DNA, 16 bp, H. sapiens
gcagcaccagctcctc

SEQ ID NO: 105818 - DNA, 16 bp, H. sapiens
gcagcacctctgcctg

SEQ ID NO: 105819 - DNA, 16 bp, H. sapiens
gcagcacctgcatctt

SEQ ID NO: 105820 - DNA, 16 bp, H. sapiens
gcagcacctgggagct

SEQ ID NO: 105821 - DNA, 16 bp, H. sapiens
gcagcactattcacag

SEQ ID NO: 105822 - DNA, 23 bp, H. sapiens
gcagcactttgggaggccaaggt

SEQ ID NO: 105823 - DNA, 16 bp, H. sapiens
gcagcagaagagagaa

SEQ ID NO: 105824 - DNA, 16 bp, H. sapiens
gcagcagaagagagag

SEQ ID NO: 105825 - DNA, 16 bp, H. sapiens
gcagcagaatcccttg

SEQ ID NO: 105826 - DNA, 16 bp, H. sapiens
gcagcagacaagacag

SEQ ID NO: 105827 - DNA, 16 bp, H. sapiens
gcagcagagcgagact

SEQ ID NO: 105828 - DNA, 16 bp, H. sapiens
gcagcagagctgggat

SEQ ID NO: 105829 - DNA, 16 bp, H. sapiens
gcagcagaggcagcca

SEQ ID NO: 105830 - DNA, 16 bp, H. sapiens
gcagcagaggctgcag

SEQ ID NO: 105831 - DNA, 16 bp, H. sapiens
gcagcagagggacctg

SEQ ID NO: 105832 - DNA, 16 bp, H. sapiens
gcagcagcaaagagaa

SEQ ID NO: 105833 - DNA, 16 bp, H. sapiens
gcagcagcaacaacaa

SEQ ID NO: 105834 - DNA, 16 bp, H. sapiens
gcagcagcaacagcaa

SEQ ID NO: 105835 - DNA, 16 bp, H. sapiens
gcagcagcaagaagtg

SEQ ID NO: 105836 - DNA, 16 bp, H. sapiens
gcagcagcaagagaaa

SEQ ID NO: 105837 - DNA, 23 bp, H. sapiens
gcagcagcaagatttattgtgaa

SEQ ID NO: 105838 - DNA, 16 bp, H. sapiens
gcagcagcaaggagaa

SEQ ID NO: 105839 - DNA, 16 bp, H. sapiens
gcagcagcagcaagaa

SEQ ID NO: 105840 - DNA, 16 bp, H. sapiens
gcagcagcagcaccag

SEQ ID NO: 105841 - DNA, 16 bp, H. sapiens
gcagcagcagcagaag

SEQ ID NO: 105842 - DNA, 16 bp, H. sapiens
gcagcagcagcagagg

SEQ ID NO: 105843 - DNA, 16 bp, H. sapiens
gcagcagcagcagctc

SEQ ID NO: 105844 - DNA, 16 bp, H. sapiens
gcagcagcagcagctg

SEQ ID NO: 105845 - DNA, 16 bp, H. sapiens
gcagcagcagcaggaa

SEQ ID NO: 105846 - DNA, 16 bp, H. sapiens
gcagcagcagcagtgc

SEQ ID NO: 105847 - DNA, 16 bp, H. sapiens
gcagcagcagcagtgt

SEQ ID NO: 105848 - DNA, 16 bp, H. sapiens
gcagcagcagccgctg

SEQ ID NO: 105849 - DNA, 16 bp, H. sapiens
gcagcagcagcggcgg

SEQ ID NO: 105850 - DNA, 16 bp, H. sapiens
gcagcagcagctgctg

SEQ ID NO: 105851 - DNA, 16 bp, H. sapiens
gcagcagcaggaagag

SEQ ID NO: 105852 - DNA, 16 bp, H. sapiens
gcagcagcaggagctg

SEQ ID NO: 105853 - DNA, 16 bp, H. sapiens
gcagcagcaggaggag

SEQ ID NO: 105854 - DNA, 16 bp, H. sapiens
gcagcagcaggggcag

SEQ ID NO: 105855 - DNA, 16 bp, H. sapiens
gcagcagcagtggtgg

SEQ ID NO: 105856 - DNA, 16 bp, H. sapiens
gcagcagccacagtca

SEQ ID NO: 105857 - DNA, 16 bp, H. sapiens
gcagcagccactgcac

SEQ ID NO: 105858 - DNA, 16 bp, H. sapiens
gcagcagccagccctg

SEQ ID NO: 105859 - DNA, 16 bp, H. sapiens
gcagcagccaggctgg

SEQ ID NO: 105860 - DNA, 17 bp, H. sapiens
gcagcagcggcagcagc

SEQ ID NO: 105861 - DNA, 16 bp, H. sapiens
gcagcagctcacacct

SEQ ID NO: 105862 - DNA, 16 bp, H. sapiens
gcagcagctcatgcct

SEQ ID NO: 105863 - DNA, 16 bp, H. sapiens
gcagcagctccaggca

SEQ ID NO: 105864 - DNA, 16 bp, H. sapiens
gcagcagctccagtca

SEQ ID NO: 105865 - DNA, 16 bp, H. sapiens
gcagcagctgcagcag

SEQ ID NO: 105866 - DNA, 16 bp, H. sapiens
gcagcagctgcagctg

SEQ ID NO: 105867 - DNA, 16 bp, H. sapiens
gcagcagctgccgctg

SEQ ID NO: 105868 - DNA, 16 bp, H. sapiens
gcagcagctgcctggg

SEQ ID NO: 105869 - DNA, 16 bp, H. sapiens
gcagcagctgctccag

SEQ ID NO: 105870 - DNA, 16 bp, H. sapiens
gcagcagctgctgcac

SEQ ID NO: 105871 - DNA, 16 bp, H. sapiens
gcagcagctgctgcca

SEQ ID NO: 105872 - DNA, 16 bp, H. sapiens
gcagcagctggggagg

SEQ ID NO: 105873 - DNA, 16 bp, H. sapiens
gcagcagcttgggctg

SEQ ID NO: 105874 - DNA, 16 bp, H. sapiens
gcagcaggaaagagag

SEQ ID NO: 105875 - DNA, 16 bp, H. sapiens
gcagcaggaaggaagg

SEQ ID NO: 105876 - DNA, 16 bp, H. sapiens
gcagcaggaaggagga

SEQ ID NO: 105877 - DNA, 16 bp, H. sapiens
gcagcaggaccctggg

SEQ ID NO: 105878 - DNA, 16 bp, H. sapiens
gcagcaggagaaagga

SEQ ID NO: 105879 - DNA, 16 bp, H. sapiens
gcagcaggagaatggc

SEQ ID NO: 105880 - DNA, 16 bp, H. sapiens
gcagcaggagagaaag

SEQ ID NO: 105881 - DNA, 16 bp, H. sapiens
gcagcaggagagagag

SEQ ID NO: 105882 - DNA, 16 bp, H. sapiens
gcagcaggagcatgtc

SEQ ID NO: 105883 - DNA, 16 bp, H. sapiens
gcagcaggaggcagag

SEQ ID NO: 105884 - DNA, 16 bp, H. sapiens
gcagcaggcaacagag

SEQ ID NO: 105885 - DNA, 16 bp, H. sapiens
gcagcaggcaagagtg

SEQ ID NO: 105886 - DNA, 16 bp, H. sapiens
gcagcaggcacctgta

SEQ ID NO: 105887 - DNA, 16 bp, H. sapiens
gcagcaggcaggagag

SEQ ID NO: 105888 - DNA, 16 bp, H. sapiens
gcagcaggcttcagag

SEQ ID NO: 105889 - DNA, 16 bp, H. sapiens
gcagcagggcagaggc

SEQ ID NO: 105890 - DNA, 16 bp, H. sapiens
gcagcagggccctctc

SEQ ID NO: 105891 - DNA, 16 bp, H. sapiens
gcagcaggggcagcag

SEQ ID NO: 105892 - DNA, 16 bp, H. sapiens
gcagcaggggctgggg

SEQ ID NO: 105893 - DNA, 16 bp, H. sapiens
gcagcaggtaaagaga

SEQ ID NO: 105894 - DNA, 16 bp, H. sapiens
gcagcagtggcagcag

SEQ ID NO: 105895 - DNA, 16 bp, H. sapiens
gcagcagtgggagtag

SEQ ID NO: 105896 - DNA, 16 bp, H. sapiens
gcagcagtgggccagg

SEQ ID NO: 105897 - DNA, 16 bp, H. sapiens
gcagcagttctcaaag

SEQ ID NO: 105898 - DNA, 16 bp, H. sapiens
gcagcatcagcagcac

SEQ ID NO: 105899 - DNA, 16 bp, H. sapiens
gcagcatcagcagcat

SEQ ID NO: 105900 - DNA, 16 bp, H. sapiens
gcagcatccttggcct

SEQ ID NO: 105901 - DNA, 16 bp, H. sapiens
gcagcatctctggcct

SEQ ID NO: 105902 - DNA, 16 bp, H. sapiens
gcagcatctgctcagc

SEQ ID NO: 105903 - DNA, 16 bp, H. sapiens
gcagcatgagaacaga

SEQ ID NO: 105904 - DNA, 16 bp, H. sapiens
gcagccaacaaacgtg

SEQ ID NO: 105905 - DNA, 16 bp, H. sapiens
gcagccaactccagaa

SEQ ID NO: 105906 - DNA, 16 bp, H. sapiens
gcagccaagctctttg

SEQ ID NO: 105907 - DNA, 16 bp, H. sapiens
gcagccacagacaaca

SEQ ID NO: 105908 - DNA, 16 bp, H. sapiens
gcagccacagagaaag

SEQ ID NO: 105909 - DNA, 16 bp, H. sapiens
gcagccaccaccatgc

SEQ ID NO: 105910 - DNA, 16 bp, H. sapiens
gcagccaccacctccc

SEQ ID NO: 105911 - DNA, 16 bp, H. sapiens
gcagccaccccgtccg

SEQ ID NO: 105912 - DNA, 16 bp, H. sapiens
gcagccaccgctgctg

SEQ ID NO: 105913 - DNA, 16 bp, H. sapiens
gcagccactcaggctg

SEQ ID NO: 105914 - DNA, 16 bp, H. sapiens
gcagccactccccatt

SEQ ID NO: 105915 - DNA, 16 bp, H. sapiens
gcagccactcctagag

SEQ ID NO: 105916 - DNA, 16 bp, H. sapiens
gcagccactgccatca

SEQ ID NO: 105917 - DNA, 16 bp, H. sapiens
gcagccactttgggaa

SEQ ID NO: 105918 - DNA, 16 bp, H. sapiens
gcagccagaggctgca

SEQ ID NO: 105919 - DNA, 16 bp, H. sapiens
gcagccagagggagcc

SEQ ID NO: 105920 - DNA, 16 bp, H. sapiens
gcagccaggaccacag

SEQ ID NO: 105921 - DNA, 16 bp, H. sapiens
gcagccaggagagagg

SEQ ID NO: 105922 - DNA, 16 bp, H. sapiens
gcagccaggagggagg

SEQ ID NO: 105923 - DNA, 16 bp, H. sapiens
gcagccaggcgcagtg

SEQ ID NO: 105924 - DNA, 16 bp, H. sapiens
gcagccagggccagct

SEQ ID NO: 105925 - DNA, 18 bp, H. sapiens
gcagccataaaaaatgat

SEQ ID NO: 105926 - DNA, 16 bp, H. sapiens
gcagccatagaaagga

SEQ ID NO: 105927 - DNA, 16 bp, H. sapiens
gcagccatagcaaact

SEQ ID NO: 105928 - DNA, 16 bp, H. sapiens
gcagccatcaccacag

SEQ ID NO: 105929 - DNA, 16 bp, H. sapiens
gcagccatcaccactg

SEQ ID NO: 105930 - DNA, 16 bp, H. sapiens
gcagccatcttggacc

SEQ ID NO: 105931 - DNA, 16 bp, H. sapiens
gcagccatgaaaaaga

SEQ ID NO: 105932 - DNA, 16 bp, H. sapiens
gcagccattaaaaaaa

SEQ ID NO: 105933 - DNA, 16 bp, H. sapiens
gcagccattccaaatg

SEQ ID NO: 105934 - DNA, 16 bp, H. sapiens
gcagcccaccatgccc

SEQ ID NO: 105935 - DNA, 16 bp, H. sapiens
gcagcccagcccagcc

SEQ ID NO: 105936 - DNA, 16 bp, H. sapiens
gcagcccagcccccag

SEQ ID NO: 105937 - DNA, 16 bp, H. sapiens
gcagcccagctcccag

SEQ ID NO: 105938 - DNA, 16 bp, H. sapiens
gcagcccaggatggct

SEQ ID NO: 105939 - DNA, 16 bp, H. sapiens
gcagcccaggcagagg

SEQ ID NO: 105940 - DNA, 16 bp, H. sapiens
gcagcccagggctgct

SEQ ID NO: 105941 - DNA, 16 bp, H. sapiens
gcagcccaggtgacag

SEQ ID NO: 105942 - DNA, 16 bp, H. sapiens
gcagcccatctggagc

SEQ ID NO: 105943 - DNA, 16 bp, H. sapiens
gcagccccaacttcct

SEQ ID NO: 105944 - DNA, 16 bp, H. sapiens
gcagccccagccacac

SEQ ID NO: 105945 - DNA, 16 bp, H. sapiens
gcagccccagccatgc

SEQ ID NO: 105946 - DNA, 16 bp, H. sapiens
gcagcccccaaatcat

SEQ ID NO: 105947 - DNA, 16 bp, H. sapiens
gcagcccctgcctccc

SEQ ID NO: 105948 - DNA, 16 bp, H. sapiens
gcagcccctgcctgcc

SEQ ID NO: 105949 - DNA, 16 bp, H. sapiens
gcagcccctgcctttt

SEQ ID NO: 105950 - DNA, 16 bp, H. sapiens
gcagcccctggtgagg

SEQ ID NO: 105951 - DNA, 16 bp, H. sapiens
gcagcccctttccctg

SEQ ID NO: 105952 - DNA, 16 bp, H. sapiens
gcagccctcagaaaga

SEQ ID NO: 105953 - DNA, 16 bp, H. sapiens
gcagccctcagaatca

SEQ ID NO: 105954 - DNA, 16 bp, H. sapiens
gcagccctcccacctc

SEQ ID NO: 105955 - DNA, 16 bp, H. sapiens
gcagccctgacctcct

SEQ ID NO: 105956 - DNA, 16 bp, H. sapiens
gcagccctgagggctg

SEQ ID NO: 105957 - DNA, 16 bp, H. sapiens
gcagccctgccctgcc

SEQ ID NO: 105958 - DNA, 16 bp, H. sapiens
gcagccctggcccctg

SEQ ID NO: 105959 - DNA, 16 bp, H. sapiens
gcagccctgggctgca

SEQ ID NO: 105960 - DNA, 16 bp, H. sapiens
gcagccctgtggagag

SEQ ID NO: 105961 - DNA, 16 bp, H. sapiens
gcagccgcagcaagac

SEQ ID NO: 105962 - DNA, 16 bp, H. sapiens
gcagccgccaccacgc

SEQ ID NO: 105963 - DNA, 16 bp, H. sapiens
gcagccgccccatctg

SEQ ID NO: 105964 - DNA, 16 bp, H. sapiens
gcagccgggcagaggc

SEQ ID NO: 105965 - DNA, 16 bp, H. sapiens
gcagcctcaaactccc

SEQ ID NO: 105966 - DNA, 16 bp, H. sapiens
gcagcctcaacatccc

SEQ ID NO: 105967 - DNA, 16 bp, H. sapiens
gcagcctcaaccccct

SEQ ID NO: 105968 - DNA, 16 bp, H. sapiens
gcagcctcaccctcct

SEQ ID NO: 105969 - DNA, 16 bp, H. sapiens
gcagcctccaactcct

SEQ ID NO: 105970 - DNA, 16 bp, H. sapiens
gcagcctccaccttct

SEQ ID NO: 105971 - DNA, 16 bp, H. sapiens
gcagcctccctgcctg

SEQ ID NO: 105972 - DNA, 16 bp, H. sapiens
gcagcctccctggcct

SEQ ID NO: 105973 - DNA, 16 bp, H. sapiens
gcagcctccgcctccc

SEQ ID NO: 105974 - DNA, 16 bp, H. sapiens
gcagcctccgcctctc

SEQ ID NO: 105975 - DNA, 16 bp, H. sapiens
gcagcctcctcctcct

SEQ ID NO: 105976 - DNA, 16 bp, H. sapiens
gcagcctcctgggacc

SEQ ID NO: 105977 - DNA, 16 bp, H. sapiens
gcagcctctaccttcc

SEQ ID NO: 105978 - DNA, 16 bp, H. sapiens
gcagcctctccaggcc

SEQ ID NO: 105979 - DNA, 16 bp, H. sapiens
gcagcctctgccacct

SEQ ID NO: 105980 - DNA, 16 bp, H. sapiens
gcagcctctgcccccc

SEQ ID NO: 105981 - DNA, 16 bp, H. sapiens
gcagcctctgccccct

SEQ ID NO: 105982 - DNA, 16 bp, H. sapiens
gcagcctctgccctcc

SEQ ID NO: 105983 - DNA, 16 bp, H. sapiens
gcagcctctgcctacc

SEQ ID NO: 105984 - DNA, 16 bp, H. sapiens
gcagcctctgcctcca

SEQ ID NO: 105985 - DNA, 16 bp, H. sapiens
gcagcctctgcctccg

SEQ ID NO: 105986 - DNA, 16 bp, H. sapiens
gcagcctctgcctctc

SEQ ID NO: 105987 - DNA, 16 bp, H. sapiens
gcagcctctgctgccc

SEQ ID NO: 105988 - DNA, 16 bp, H. sapiens
gcagcctctgcttccc

SEQ ID NO: 105989 - DNA, 16 bp, H. sapiens
gcagcctcttcctcct

SEQ ID NO: 105990 - DNA, 16 bp, H. sapiens
gcagcctgacaatgag

SEQ ID NO: 105991 - DNA, 16 bp, H. sapiens
gcagcctgaccaacat

SEQ ID NO: 105992 - DNA, 16 bp, H. sapiens
gcagcctgagctgccc

SEQ ID NO: 105993 - DNA, 16 bp, H. sapiens
gcagcctgcaggctgg

SEQ ID NO: 105994 - DNA, 16 bp, H. sapiens
gcagcctgctgggcca

SEQ ID NO: 105995 - DNA, 17 bp, H. sapiens
gcagcctgcttttattc

SEQ ID NO: 105996 - DNA, 16 bp, H. sapiens
gcagcctggacaacat

SEQ ID NO: 105997 - DNA, 16 bp, H. sapiens
gcagcctggacctctt

SEQ ID NO: 105998 - DNA, 16 bp, H. sapiens
gcagcctggagaccca

SEQ ID NO: 105999 - DNA, 16 bp, H. sapiens
gcagcctggagctcct

SEQ ID NO: 106000 - DNA, 16 bp, H. sapiens
gcagcctggccaacat

SEQ ID NO: 106001 - DNA, 19 bp, H. sapiens
gcagcctggccaacatggc

SEQ ID NO: 106002 - DNA, 16 bp, H. sapiens
gcagcctggcccccag

SEQ ID NO: 106003 - DNA, 16 bp, H. sapiens
gcagcctggcctggga

SEQ ID NO: 106004 - DNA, 16 bp, H. sapiens
gcagcctgggaaacat

SEQ ID NO: 106005 - DNA, 16 bp, H. sapiens
gcagcctgggcagcag

SEQ ID NO: 106006 - DNA, 16 bp, H. sapiens
gcagcctggggacttg

SEQ ID NO: 106007 - DNA, 16 bp, H. sapiens
gcagcctgggggacag

SEQ ID NO: 106008 - DNA, 16 bp, H. sapiens
gcagcctggtgacaga

SEQ ID NO: 106009 - DNA, 16 bp, H. sapiens
gcagcctgtacaggaa

SEQ ID NO: 106010 - DNA, 16 bp, H. sapiens
gcagccttaacttccc

SEQ ID NO: 106011 - DNA, 16 bp, H. sapiens
gcagccttcacctccc

SEQ ID NO: 106012 - DNA, 16 bp, H. sapiens
gcagccttcacctctt

SEQ ID NO: 106013 - DNA, 16 bp, H. sapiens
gcagccttgatctcca

SEQ ID NO: 106014 - DNA, 16 bp, H. sapiens
gcagccttgatttccc

SEQ ID NO: 106015 - DNA, 16 bp, H. sapiens
gcagcgagcccagatc

SEQ ID NO: 106016 - DNA, 16 bp, H. sapiens
gcagcgaggccctgcc

SEQ ID NO: 106017 - DNA, 16 bp, H. sapiens
gcagcgcactgagcat

SEQ ID NO: 106018 - DNA, 16 bp, H. sapiens
gcagcgccagtgggcc

SEQ ID NO: 106019 - DNA, 16 bp, H. sapiens
gcagcgcccccaggct

SEQ ID NO: 106020 - DNA, 16 bp, H. sapiens
gcagcgctggtgggcc

SEQ ID NO: 106021 - DNA, 16 bp, H. sapiens
gcagcgctggtgggct

SEQ ID NO: 106022 - DNA, 16 bp, H. sapiens
gcagcggcagcggcag

SEQ ID NO: 106023 - DNA, 16 bp, H. sapiens
gcagcggcagctgctg

SEQ ID NO: 106024 - DNA, 17 bp, H. sapiens
gcagcggctgctgccgc

SEQ ID NO: 106025 - DNA, 16 bp, H. sapiens
gcagcggctgctgctg

SEQ ID NO: 106026 - DNA, 16 bp, H. sapiens
gcagcggctggaggag

SEQ ID NO: 106027 - DNA, 16 bp, H. sapiens
gcagctaacagacaca

SEQ ID NO: 106028 - DNA, 16 bp, H. sapiens
gcagctactccagagg

SEQ ID NO: 106029 - DNA, 16 bp, H. sapiens
gcagctactctggagg

SEQ ID NO: 106030 - DNA, 16 bp, H. sapiens
gcagctcagcacagag

SEQ ID NO: 106031 - DNA, 16 bp, H. sapiens
gcagctcaggaggctg

SEQ ID NO: 106032 - DNA, 16 bp, H. sapiens
gcagctccaggcactg

SEQ ID NO: 106033 - DNA, 16 bp, H. sapiens
gcagctcccagagaga

SEQ ID NO: 106034 - DNA, 16 bp, H. sapiens
gcagctcccagcgaga

SEQ ID NO: 106035 - DNA, 16 bp, H. sapiens
gcagctcccagtgtga

SEQ ID NO: 106036 - DNA, 16 bp, H. sapiens
gcagctcctctctgca

SEQ ID NO: 106037 - DNA, 16 bp, H. sapiens
gcagctccttcaagca

SEQ ID NO: 106038 - DNA, 16 bp, H. sapiens
gcagctccttgccagc

SEQ ID NO: 106039 - DNA, 16 bp, H. sapiens
gcagctcctttctgca

SEQ ID NO: 106040 - DNA, 16 bp, H. sapiens
gcagctctagaagctg

SEQ ID NO: 106041 - DNA, 16 bp, H. sapiens
gcagctctcagcagag

SEQ ID NO: 106042 - DNA, 16 bp, H. sapiens
gcagctctcagtggag

SEQ ID NO: 106043 - DNA, 16 bp, H. sapiens
gcagctctctgaagcc

SEQ ID NO: 106044 - DNA, 16 bp, H. sapiens
gcagctctgccctgtg

SEQ ID NO: 106045 - DNA, 16 bp, H. sapiens
gcagctctggacagag

SEQ ID NO: 106046 - DNA, 16 bp, H. sapiens
gcagctctgttcacaa

SEQ ID NO: 106047 - DNA, 16 bp, H. sapiens
gcagctgaacagcatc

SEQ ID NO: 106048 - DNA, 16 bp, H. sapiens
gcagctgaagcaggag

SEQ ID NO: 106049 - DNA, 16 bp, H. sapiens
gcagctgaaggaggag

SEQ ID NO: 106050 - DNA, 16 bp, H. sapiens
gcagctgagacacagg

SEQ ID NO: 106051 - DNA, 16 bp, H. sapiens
gcagctgagactgcag

SEQ ID NO: 106052 - DNA, 16 bp, H. sapiens
gcagctgaggatcctg

SEQ ID NO: 106053 - DNA, 16 bp, H. sapiens
gcagctgaggcagaag

SEQ ID NO: 106054 - DNA, 16 bp, H. sapiens
gcagctgaggctgcag

SEQ ID NO: 106055 - DNA, 16 bp, H. sapiens
gcagctgagggtgctg

SEQ ID NO: 106056 - DNA, 16 bp, H. sapiens
gcagctgaggtgggag

SEQ ID NO: 106057 - DNA, 16 bp, H. sapiens
gcagctgatctgggca

SEQ ID NO: 106058 - DNA, 16 bp, H. sapiens
gcagctgcacccaggg

SEQ ID NO: 106059 - DNA, 16 bp, H. sapiens
gcagctgcagcagagt

SEQ ID NO: 106060 - DNA, 16 bp, H. sapiens
gcagctgcagcagcag

SEQ ID NO: 106061 - DNA, 16 bp, H. sapiens
gcagctgcagccaccc

SEQ ID NO: 106062 - DNA, 16 bp, H. sapiens
gcagctgcagctgcac

SEQ ID NO: 106063 - DNA, 16 bp, H. sapiens
gcagctgcaggggctg

SEQ ID NO: 106064 - DNA, 16 bp, H. sapiens
gcagctgcagtggtac

SEQ ID NO: 106065 - DNA, 16 bp, H. sapiens
gcagctgccctctgcc

SEQ ID NO: 106066 - DNA, 16 bp, H. sapiens
gcagctgctatagaaa

SEQ ID NO: 106067 - DNA, 16 bp, H. sapiens
gcagctgctcctgcag

SEQ ID NO: 106068 - DNA, 16 bp, H. sapiens
gcagctgctgctgggg

SEQ ID NO: 106069 - DNA, 16 bp, H. sapiens
gcagctgctggcccgg

SEQ ID NO: 106070 - DNA, 16 bp, H. sapiens
gcagctgctggcctgg

SEQ ID NO: 106071 - DNA, 16 bp, H. sapiens
gcagctgctgtggaag

SEQ ID NO: 106072 - DNA, 16 bp, H. sapiens
gcagctgctgtggggg

SEQ ID NO: 106073 - DNA, 16 bp, H. sapiens
gcagctggaagaatgg

SEQ ID NO: 106074 - DNA, 16 bp, H. sapiens
gcagctggaagaggca

SEQ ID NO: 106075 - DNA, 16 bp, H. sapiens
gcagctggaccaggtg

SEQ ID NO: 106076 - DNA, 16 bp, H. sapiens
gcagctggaggccact

SEQ ID NO: 106077 - DNA, 16 bp, H. sapiens
gcagctggaggccatt

SEQ ID NO: 106078 - DNA, 16 bp, H. sapiens
gcagctggagggcagg

SEQ ID NO: 106079 - DNA, 16 bp, H. sapiens
gcagctggcagaatcc

SEQ ID NO: 106080 - DNA, 16 bp, H. sapiens
gcagctggccgggcag

SEQ ID NO: 106081 - DNA, 16 bp, H. sapiens
gcagctgggaagcagg

SEQ ID NO: 106082 - DNA, 16 bp, H. sapiens
gcagctgggaagcttg

SEQ ID NO: 106083 - DNA, 16 bp, H. sapiens
gcagctgggaaggagg

SEQ ID NO: 106084 - DNA, 16 bp, H. sapiens
gcagctgggaggggag

SEQ ID NO: 106085 - DNA, 16 bp, H. sapiens
gcagctgggatgcagg

SEQ ID NO: 106086 - DNA, 16 bp, H. sapiens
gcagctgggcacggtg

SEQ ID NO: 106087 - DNA, 16 bp, H. sapiens
gcagctgggccctggg

SEQ ID NO: 106088 - DNA, 16 bp, H. sapiens
gcagctgggcctgggg

SEQ ID NO: 106089 - DNA, 16 bp, H. sapiens
gcagctgggcgcggtg

SEQ ID NO: 106090 - DNA, 16 bp, H. sapiens
gcagctggggcaggag

SEQ ID NO: 106091 - DNA, 16 bp, H. sapiens
gcagctggggctgcag

SEQ ID NO: 106092 - DNA, 16 bp, H. sapiens
gcagctggggctggag

SEQ ID NO: 106093 - DNA, 16 bp, H. sapiens
gcagctggggctgggg

SEQ ID NO: 106094 - DNA, 16 bp, H. sapiens
gcagctggtgccaggg

SEQ ID NO: 106095 - DNA, 16 bp, H. sapiens
gcagctgtgccaatag

SEQ ID NO: 106096 - DNA, 16 bp, H. sapiens
gcagctgtgcctggga

SEQ ID NO: 106097 - DNA, 16 bp, H. sapiens
gcagctgtggtgctgg

SEQ ID NO: 106098 - DNA, 16 bp, H. sapiens
gcagctgttatttttt

SEQ ID NO: 106099 - DNA, 16 bp, H. sapiens
gcagctgttccacctg

SEQ ID NO: 106100 - DNA, 16 bp, H. sapiens
gcagcttcaaattcct

SEQ ID NO: 106101 - DNA, 16 bp, H. sapiens
gcagcttcactcccga

SEQ ID NO: 106102 - DNA, 16 bp, H. sapiens
gcagcttcaggggctg

SEQ ID NO: 106103 - DNA, 16 bp, H. sapiens
gcagcttccctggcct

SEQ ID NO: 106104 - DNA, 16 bp, H. sapiens
gcagcttcttcatcag

SEQ ID NO: 106105 - DNA, 16 bp, H. sapiens
gcagcttgcttcatca

SEQ ID NO: 106106 - DNA, 16 bp, H. sapiens
gcagcttggcaaagcc

SEQ ID NO: 106107 - DNA, 16 bp, H. sapiens
gcagcttggctcacag

SEQ ID NO: 106108 - DNA, 16 bp, H. sapiens
gcagcttgggctgctg

SEQ ID NO: 106109 - DNA, 16 bp, H. sapiens
gcagcttggggtgggg

SEQ ID NO: 106110 - DNA, 16 bp, H. sapiens
gcagctttgaagagag

SEQ ID NO: 106111 - DNA, 16 bp, H. sapiens
gcagctttggaactgg

SEQ ID NO: 106112 - DNA, 16 bp, H. sapiens
gcagcttttccaggag

SEQ ID NO: 106113 - DNA, 16 bp, H. sapiens
gcaggaaaaagaaata

SEQ ID NO: 106114 - DNA, 16 bp, H. sapiens
gcaggaaaccaacatg

SEQ ID NO: 106115 - DNA, 16 bp, H. sapiens
gcaggaaagcaagctc

SEQ ID NO: 106116 - DNA, 16 bp, H. sapiens
gcaggaacagaaaact

SEQ ID NO: 106117 - DNA, 16 bp, H. sapiens
gcaggaacagaaatcc

SEQ ID NO: 106118 - DNA, 16 bp, H. sapiens
gcaggaactacaggca

SEQ ID NO: 106119 - DNA, 16 bp, H. sapiens
gcaggaagaagttgaa

SEQ ID NO: 106120 - DNA, 16 bp, H. sapiens
gcaggaagaccctggg

SEQ ID NO: 106121 - DNA, 16 bp, H. sapiens
gcaggaagactggaag

SEQ ID NO: 106122 - DNA, 16 bp, H. sapiens
gcaggaagagagctgg

SEQ ID NO: 106123 - DNA, 16 bp, H. sapiens
gcaggaagaggccagg

SEQ ID NO: 106124 - DNA, 16 bp, H. sapiens
gcaggaaggaaaagtg

SEQ ID NO: 106125 - DNA, 16 bp, H. sapiens
gcaggaaggaaggcag

SEQ ID NO: 106126 - DNA, 16 bp, H. sapiens
gcaggaatgaaaggaa

SEQ ID NO: 106127 - DNA, 16 bp, H. sapiens
gcaggacaagctcact

SEQ ID NO: 106128 - DNA, 16 bp, H. sapiens
gcaggacaatggcatg

SEQ ID NO: 106129 - DNA, 16 bp, H. sapiens
gcaggacctggtggga

SEQ ID NO: 106130 - DNA, 16 bp, H. sapiens
gcaggactggaagctg

SEQ ID NO: 106131 - DNA, 16 bp, H. sapiens
gcaggactggggaggc

SEQ ID NO: 106132 - DNA, 16 bp, H. sapiens
gcaggacttggtgtcc

SEQ ID NO: 106133 - DNA, 16 bp, H. sapiens
gcaggagaaactcttg

SEQ ID NO: 106134 - DNA, 16 bp, H. sapiens
gcaggagaaatgccag

SEQ ID NO: 106135 - DNA, 16 bp, H. sapiens
gcaggagaagcaggca

SEQ ID NO: 106136 - DNA, 28 bp, H. sapiens
gcaggagaatcaggcagggaggttgcag

SEQ ID NO: 106137 - DNA, 16 bp, H. sapiens
gcaggagaatccctta

SEQ ID NO: 106138 - DNA, 16 bp, H. sapiens
gcaggagaatgtcatg

SEQ ID NO: 106139 - DNA, 16 bp, H. sapiens
gcaggagaattactgg

SEQ ID NO: 106140 - DNA, 24 bp, H. sapiens
gcaggagacagatgccttcctctt

SEQ ID NO: 106141 - DNA, 17 bp, H. sapiens
gcaggagaccagggcat

SEQ ID NO: 106142 - DNA, 16 bp, H. sapiens
gcaggagagaaagagt

SEQ ID NO: 106143 - DNA, 16 bp, H. sapiens
gcaggagagacagtga

SEQ ID NO: 106144 - DNA, 16 bp, H. sapiens
gcaggagagagacagc

SEQ ID NO: 106145 - DNA, 16 bp, H. sapiens
gcaggagaggatgtgg

SEQ ID NO: 106146 - DNA, 16 bp, H. sapiens
gcaggagagggctccc

SEQ ID NO: 106147 - DNA, 16 bp, H. sapiens
gcaggagatgaggctg

SEQ ID NO: 106148 - DNA, 16 bp, H. sapiens
gcaggagatgagtggc

SEQ ID NO: 106149 - DNA, 16 bp, H. sapiens
gcaggagatggcacca

SEQ ID NO: 106150 - DNA, 16 bp, H. sapiens
gcaggagatggtatct

SEQ ID NO: 106151 - DNA, 16 bp, H. sapiens
gcaggagattgagacc

SEQ ID NO: 106152 - DNA, 16 bp, H. sapiens
gcaggagcaaaatgcc

SEQ ID NO: 106153 - DNA, 16 bp, H. sapiens
gcaggagcagctgcag

SEQ ID NO: 106154 - DNA, 16 bp, H. sapiens
gcaggagcagctggga

SEQ ID NO: 106155 - DNA, 16 bp, H. sapiens
gcaggagcaggaggaa

SEQ ID NO: 106156 - DNA, 16 bp, H. sapiens
gcaggagccaagaagt

SEQ ID NO: 106157 - DNA, 16 bp, H. sapiens
gcaggagccaggaaca

SEQ ID NO: 106158 - DNA, 16 bp, H. sapiens
gcaggagccagggcaa

SEQ ID NO: 106159 - DNA, 16 bp, H. sapiens
gcaggagccctgcccc

SEQ ID NO: 106160 - DNA, 16 bp, H. sapiens
gcaggagctggagcag

SEQ ID NO: 106161 - DNA, 16 bp, H. sapiens
gcaggagctgggcctg

SEQ ID NO: 106162 - DNA, 16 bp, H. sapiens
gcaggagctggggaca

SEQ ID NO: 106163 - DNA, 16 bp, H. sapiens
gcaggagctgtccctg

SEQ ID NO: 106164 - DNA, 16 bp, H. sapiens
gcaggaggaacagaag

SEQ ID NO: 106165 - DNA, 16 bp, H. sapiens
gcaggaggaagtgggg

SEQ ID NO: 106166 - DNA, 16 bp, H. sapiens
gcaggaggactgctgg

SEQ ID NO: 106167 - DNA, 16 bp, H. sapiens
gcaggaggagagctgc

SEQ ID NO: 106168 - DNA, 16 bp, H. sapiens
gcaggaggagatgatg

SEQ ID NO: 106169 - DNA, 16 bp, H. sapiens
gcaggaggagcagaag

SEQ ID NO: 106170 - DNA, 16 bp, H. sapiens
gcaggaggagcaggtg

SEQ ID NO: 106171 - DNA, 16 bp, H. sapiens
gcaggaggagccaggg

SEQ ID NO: 106172 - DNA, 16 bp, H. sapiens
gcaggaggagggtgag

SEQ ID NO: 106173 - DNA, 16 bp, H. sapiens
gcaggaggaggtgagg

SEQ ID NO: 106174 - DNA, 16 bp, H. sapiens
gcaggaggagtgcttg

SEQ ID NO: 106175 - DNA, 16 bp, H. sapiens
gcaggaggatgtggca

SEQ ID NO: 106176 - DNA, 16 bp, H. sapiens
gcaggaggattctttg

SEQ ID NO: 106177 - DNA, 16 bp, H. sapiens
gcaggaggattttttg

SEQ ID NO: 106178 - DNA, 16 bp, H. sapiens
gcaggaggcagccaaa

SEQ ID NO: 106179 - DNA, 16 bp, H. sapiens
gcaggaggcaggagaa

SEQ ID NO: 106180 - DNA, 16 bp, H. sapiens
gcaggaggcggagctc

SEQ ID NO: 106181 - DNA, 16 bp, H. sapiens
gcaggaggctgggctg

SEQ ID NO: 106182 - DNA, 16 bp, H. sapiens
gcaggaggtggaggtt

SEQ ID NO: 106183 - DNA, 16 bp, H. sapiens
gcaggagtggaggcag

SEQ ID NO: 106184 - DNA, 16 bp, H. sapiens
gcaggagtttgagatc

SEQ ID NO: 106185 - DNA, 16 bp, H. sapiens
gcaggatacaaaatta

SEQ ID NO: 106186 - DNA, 16 bp, H. sapiens
gcaggatcagaaaacc

SEQ ID NO: 106187 - DNA, 16 bp, H. sapiens
gcaggatggatgggga

SEQ ID NO: 106188 - DNA, 16 bp, H. sapiens
gcaggatggggagctg

SEQ ID NO: 106189 - DNA, 16 bp, H. sapiens
gcaggatggtctcgat

SEQ ID NO: 106190 - DNA, 16 bp, H. sapiens
gcaggatgtgcagatt

SEQ ID NO: 106191 - DNA, 16 bp, H. sapiens
gcaggcaagagaagag

SEQ ID NO: 106192 - DNA, 16 bp, H. sapiens
gcaggcacagctggaa

SEQ ID NO: 106193 - DNA, 16 bp, H. sapiens
gcaggcaccttcctca

SEQ ID NO: 106194 - DNA, 16 bp, H. sapiens
gcaggcagactgcctg

SEQ ID NO: 106195 - DNA, 16 bp, H. sapiens
gcaggcagaggagaga

SEQ ID NO: 106196 - DNA, 16 bp, H. sapiens
gcaggcagatcacatg

SEQ ID NO: 106197 - DNA, 16 bp, H. sapiens
gcaggcagatcaggag

SEQ ID NO: 106198 - DNA, 16 bp, H. sapiens
gcaggcagatgacctg

SEQ ID NO: 106199 - DNA, 16 bp, H. sapiens
gcaggcagatggcttg

SEQ ID NO: 106200 - DNA, 16 bp, H. sapiens
gcaggcagcctccaga

SEQ ID NO: 106201 - DNA, 16 bp, H. sapiens
gcaggcagctggagat

SEQ ID NO: 106202 - DNA, 16 bp, H. sapiens
gcaggcaggagccagg

SEQ ID NO: 106203 - DNA, 16 bp, H. sapiens
gcaggcaggagctgga

SEQ ID NO: 106204 - DNA, 16 bp, H. sapiens
gcaggcaggagtgggg

SEQ ID NO: 106205 - DNA, 16 bp, H. sapiens
gcaggcaggcaagaag

SEQ ID NO: 106206 - DNA, 16 bp, H. sapiens
gcaggcaggcaagcag

SEQ ID NO: 106207 - DNA, 16 bp, H. sapiens
gcaggcaggcagacag

SEQ ID NO: 106208 - DNA, 16 bp, H. sapiens
gcaggcaggcaggagg

SEQ ID NO: 106209 - DNA, 16 bp, H. sapiens
gcaggcagggctgggg

SEQ ID NO: 106210 - DNA, 16 bp, H. sapiens
gcaggcagggtgggga

SEQ ID NO: 106211 - DNA, 16 bp, H. sapiens
gcaggcatggtggcac

SEQ ID NO: 106212 - DNA, 16 bp, H. sapiens
gcaggcatggtggctc

SEQ ID NO: 106213 - DNA, 16 bp, H. sapiens
gcaggccaagcccagg

SEQ ID NO: 106214 - DNA, 16 bp, H. sapiens
gcaggccaccatcttt

SEQ ID NO: 106215 - DNA, 16 bp, H. sapiens
gcaggccagtgtgtgc

SEQ ID NO: 106216 - DNA, 16 bp, H. sapiens
gcaggcccaggccctg

SEQ ID NO: 106217 - DNA, 16 bp, H. sapiens
gcaggccccagtgtgt

SEQ ID NO: 106218 - DNA, 16 bp, H. sapiens
gcaggcccctgtagtc

SEQ ID NO: 106219 - DNA, 16 bp, H. sapiens
gcaggcctgagactgc

SEQ ID NO: 106220 - DNA, 16 bp, H. sapiens
gcaggccttgggcaag

SEQ ID NO: 106221 - DNA, 16 bp, H. sapiens
gcaggcgccaccacgc

SEQ ID NO: 106222 - DNA, 16 bp, H. sapiens
gcaggcgcctgtaatg

SEQ ID NO: 106223 - DNA, 16 bp, H. sapiens
gcaggctcaggagcag

SEQ ID NO: 106224 - DNA, 17 bp, H. sapiens
gcaggctggagtgcagt

SEQ ID NO: 106225 - DNA, 16 bp, H. sapiens
gcaggctgggggagag

SEQ ID NO: 106226 - DNA, 18 bp, H. sapiens
gcaggctggtcttgaact

SEQ ID NO: 106227 - DNA, 16 bp, H. sapiens
gcaggctgtacaggag

SEQ ID NO: 106228 - DNA, 16 bp, H. sapiens
gcaggctgtggagcaa

SEQ ID NO: 106229 - DNA, 16 bp, H. sapiens
gcaggcttccttgagc

SEQ ID NO: 106230 - DNA, 16 bp, H. sapiens
gcaggcttctgcctgg

SEQ ID NO: 106231 - DNA, 18 bp, H. sapiens
gcaggcttggtggtgaca

SEQ ID NO: 106232 - DNA, 16 bp, H. sapiens
gcagggacacagagcc

SEQ ID NO: 106233 - DNA, 16 bp, H. sapiens
gcagggacatggttgg

SEQ ID NO: 106234 - DNA, 16 bp, H. sapiens
gcagggacctctgccc

SEQ ID NO: 106235 - DNA, 16 bp, H. sapiens
gcagggactacaggca

SEQ ID NO: 106236 - DNA, 16 bp, H. sapiens
gcagggactacaggcg

SEQ ID NO: 106237 - DNA, 16 bp, H. sapiens
gcagggactatgtctt

SEQ ID NO: 106238 - DNA, 16 bp, H. sapiens
gcagggagagcacgtg

SEQ ID NO: 106239 - DNA, 16 bp, H. sapiens
gcagggagaggccagg

SEQ ID NO: 106240 - DNA, 16 bp, H. sapiens
gcagggaggcctcctt

SEQ ID NO: 106241 - DNA, 16 bp, H. sapiens
gcagggagggaggctg

SEQ ID NO: 106242 - DNA, 16 bp, H. sapiens
gcagggagggcttcct

SEQ ID NO: 106243 - DNA, 16 bp, H. sapiens
gcagggaggggctggc

SEQ ID NO: 106244 - DNA, 16 bp, H. sapiens
gcagggaggtggaggt

SEQ ID NO: 106245 - DNA, 16 bp, H. sapiens
gcagggagtttcacag

SEQ ID NO: 106246 - DNA, 16 bp, H. sapiens
gcagggcacagccaaa

SEQ ID NO: 106247 - DNA, 16 bp, H. sapiens
gcagggcagaggatgg

SEQ ID NO: 106248 - DNA, 16 bp, H. sapiens
gcagggcagaggccag

SEQ ID NO: 106249 - DNA, 16 bp, H. sapiens
gcagggcagccagggt

SEQ ID NO: 106250 - DNA, 16 bp, H. sapiens
gcagggcaggaggtgg

SEQ ID NO: 106251 - DNA, 16 bp, H. sapiens
gcagggcagggcaggc

SEQ ID NO: 106252 - DNA, 16 bp, H. sapiens
gcagggcagggccagg

SEQ ID NO: 106253 - DNA, 16 bp, H. sapiens
gcagggcagggctggg

SEQ ID NO: 106254 - DNA, 16 bp, H. sapiens
gcagggcatgatggct

SEQ ID NO: 106255 - DNA, 16 bp, H. sapiens
gcagggcatggtggcc

SEQ ID NO: 106256 - DNA, 16 bp, H. sapiens
gcagggccagcccagg

SEQ ID NO: 106257 - DNA, 16 bp, H. sapiens
gcagggccaggcacag

SEQ ID NO: 106258 - DNA, 16 bp, H. sapiens
gcagggccaggctggg

SEQ ID NO: 106259 - DNA, 16 bp, H. sapiens
gcagggcccagggcag

SEQ ID NO: 106260 - DNA, 16 bp, H. sapiens
gcagggcctcctcaaa

SEQ ID NO: 106261 - DNA, 16 bp, H. sapiens
gcagggcctgggcctg

SEQ ID NO: 106262 - DNA, 16 bp, H. sapiens
gcagggcctggggagg

SEQ ID NO: 106263 - DNA, 16 bp, H. sapiens
gcagggcctggtggca

SEQ ID NO: 106264 - DNA, 16 bp, H. sapiens
gcagggcctggtggtg

SEQ ID NO: 106265 - DNA, 16 bp, H. sapiens
gcagggcgtggtgatg

SEQ ID NO: 106266 - DNA, 16 bp, H. sapiens
gcagggcgtggtggtg

SEQ ID NO: 106267 - DNA, 16 bp, H. sapiens
gcagggctcagcaggg

SEQ ID NO: 106268 - DNA, 16 bp, H. sapiens
gcagggctgaggcagg

SEQ ID NO: 106269 - DNA, 16 bp, H. sapiens
gcagggctgcagtgag

SEQ ID NO: 106270 - DNA, 16 bp, H. sapiens
gcagggctgggactgg

SEQ ID NO: 106271 - DNA, 16 bp, H. sapiens
gcagggctgggggctg

SEQ ID NO: 106272 - DNA, 16 bp, H. sapiens
gcagggctggggtgag

SEQ ID NO: 106273 - DNA, 16 bp, H. sapiens
gcagggctgtgtttct

SEQ ID NO: 106274 - DNA, 16 bp, H. sapiens
gcaggggcacaatctc

SEQ ID NO: 106275 - DNA, 16 bp, H. sapiens
gcaggggcagaggcag

SEQ ID NO: 106276 - DNA, 16 bp, H. sapiens
gcaggggcagcagtgg

SEQ ID NO: 106277 - DNA, 16 bp, H. sapiens
gcaggggcagggcctg

SEQ ID NO: 106278 - DNA, 16 bp, H. sapiens
gcaggggcagggctgg

SEQ ID NO: 106279 - DNA, 16 bp, H. sapiens
gcaggggcaggggctg

SEQ ID NO: 106280 - DNA, 16 bp, H. sapiens
gcaggggccaggggtg

SEQ ID NO: 106281 - DNA, 16 bp, H. sapiens
gcaggggctgcaggag

SEQ ID NO: 106282 - DNA, 16 bp, H. sapiens
gcaggggctgctggga

SEQ ID NO: 106283 - DNA, 16 bp, H. sapiens
gcaggggctgggcagg

SEQ ID NO: 106284 - DNA, 16 bp, H. sapiens
gcaggggctggggctg

SEQ ID NO: 106285 - DNA, 16 bp, H. sapiens
gcaggggtgaggcagg

SEQ ID NO: 106286 - DNA, 16 bp, H. sapiens
gcaggggtggtgattc

SEQ ID NO: 106287 - DNA, 16 bp, H. sapiens
gcaggggttccccagg

SEQ ID NO: 106288 - DNA, 23 bp, H. sapiens
gcaggggttgcaatcctagtctc

SEQ ID NO: 106289 - DNA, 16 bp, H. sapiens
gcagggtaagcaggct

SEQ ID NO: 106290 - DNA, 16 bp, H. sapiens
gcagggtagggcaggg

SEQ ID NO: 106291 - DNA, 16 bp, H. sapiens
gcagggtccaggcagg

SEQ ID NO: 106292 - DNA, 16 bp, H. sapiens
gcagggtgcagtggct

SEQ ID NO: 106293 - DNA, 16 bp, H. sapiens
gcagggtgtggtggca

SEQ ID NO: 106294 - DNA, 16 bp, H. sapiens
gcagggtttgagagga

SEQ ID NO: 106295 - DNA, 16 bp, H. sapiens
gcagggttttttgttt

SEQ ID NO: 106296 - DNA, 16 bp, H. sapiens
gcaggtatgtgtgtgt

SEQ ID NO: 106297 - DNA, 16 bp, H. sapiens
gcaggtattgggagat

SEQ ID NO: 106298 - DNA, 16 bp, H. sapiens
gcaggtcaaatatcta

SEQ ID NO: 106299 - DNA, 16 bp, H. sapiens
gcaggtccaggtggag

SEQ ID NO: 106300 - DNA, 16 bp, H. sapiens
gcaggtgaaattaatt

SEQ ID NO: 106301 - DNA, 16 bp, H. sapiens
gcaggtgaaccagctg

SEQ ID NO: 106302 - DNA, 16 bp, H. sapiens
gcaggtgagcagcagg

SEQ ID NO: 106303 - DNA, 16 bp, H. sapiens
gcaggtgatccaccca

SEQ ID NO: 106304 - DNA, 16 bp, H. sapiens
gcaggtgatggagctg

SEQ ID NO: 106305 - DNA, 16 bp, H. sapiens
gcaggtgcagagggag

SEQ ID NO: 106306 - DNA, 16 bp, H. sapiens
gcaggtgcaggagctg

SEQ ID NO: 106307 - DNA, 16 bp, H. sapiens
gcaggtgcatcacctg

SEQ ID NO: 106308 - DNA, 16 bp, H. sapiens
gcaggtgcctgtccag

SEQ ID NO: 106309 - DNA, 16 bp, H. sapiens
gcaggtgcctgttgtc

SEQ ID NO: 106310 - DNA, 16 bp, H. sapiens
gcaggtgcgcgccgcc

SEQ ID NO: 106311 - DNA, 16 bp, H. sapiens
gcaggtgcgggagcag

SEQ ID NO: 106312 - DNA, 16 bp, H. sapiens
gcaggtgctgcagcag

SEQ ID NO: 106313 - DNA, 16 bp, H. sapiens
gcaggtggaccagcca

SEQ ID NO: 106314 - DNA, 17 bp, H. sapiens
gcaggtggagctgcctg

SEQ ID NO: 106315 - DNA, 16 bp, H. sapiens
gcaggtggatcaccag

SEQ ID NO: 106316 - DNA, 17 bp, H. sapiens
gcaggtggatctcttga

SEQ ID NO: 106317 - DNA, 16 bp, H. sapiens
gcaggtggatgacctg

SEQ ID NO: 106318 - DNA, 16 bp, H. sapiens
gcaggtggatgacgag

SEQ ID NO: 106319 - DNA, 16 bp, H. sapiens
gcaggtggatttcttg

SEQ ID NO: 106320 - DNA, 16 bp, H. sapiens
gcaggtgggcggggcc

SEQ ID NO: 106321 - DNA, 16 bp, H. sapiens
gcaggtggtgaagcca

SEQ ID NO: 106322 - DNA, 16 bp, H. sapiens
gcaggtgtggggacag

SEQ ID NO: 106323 - DNA, 16 bp, H. sapiens
gcaggtgtgggtgtgg

SEQ ID NO: 106324 - DNA, 16 bp, H. sapiens
gcaggtgtgtgcaggg

SEQ ID NO: 106325 - DNA, 16 bp, H. sapiens
gcaggttgcttaacct

SEQ ID NO: 106326 - DNA, 16 bp, H. sapiens
gcaggtttaaaaaaaa

SEQ ID NO: 106327 - DNA, 16 bp, H. sapiens
gcaggtttgccctgag

SEQ ID NO: 106328 - DNA, 16 bp, H. sapiens
gcaggttttatattgg

SEQ ID NO: 106329 - DNA, 16 bp, H. sapiens
gcaggttttttgtttt

SEQ ID NO: 106330 - DNA, 16 bp, H. sapiens
gcagtaacagcagcag

SEQ ID NO: 106331 - DNA, 16 bp, H. sapiens
gcagtaaccaaaacaa

SEQ ID NO: 106332 - DNA, 16 bp, H. sapiens
gcagtaccccactcta

SEQ ID NO: 106333 - DNA, 16 bp, H. sapiens
gcagtagaaaagaaaa

SEQ ID NO: 106334 - DNA, 16 bp, H. sapiens
gcagtagaatcacttg

SEQ ID NO: 106335 - DNA, 16 bp, H. sapiens
gcagtagctcatgctt

SEQ ID NO: 106336 - DNA, 16 bp, H. sapiens
gcagtatctgcaaagc

SEQ ID NO: 106337 - DNA, 16 bp, H. sapiens
gcagtattgtcatttt

SEQ ID NO: 106338 - DNA, 16 bp, H. sapiens
gcagtatttgggcaga

SEQ ID NO: 106339 - DNA, 17 bp, H. sapiens
gcagtatttggttttct

SEQ ID NO: 106340 - DNA, 16 bp, H. sapiens
gcagtcacaggcctca

SEQ ID NO: 106341 - DNA, 16 bp, H. sapiens
gcagtcaccctgaagt

SEQ ID NO: 106342 - DNA, 16 bp, H. sapiens
gcagtcagccatgatc

SEQ ID NO: 106343 - DNA, 16 bp, H. sapiens
gcagtcatcctgcctc

SEQ ID NO: 106344 - DNA, 16 bp, H. sapiens
gcagtcatctgaaagc

SEQ ID NO: 106345 - DNA, 16 bp, H. sapiens
gcagtcccagctactt

SEQ ID NO: 106346 - DNA, 16 bp, H. sapiens
gcagtcccagctcctc

SEQ ID NO: 106347 - DNA, 16 bp, H. sapiens
gcagtcccagctcctt

SEQ ID NO: 106348 - DNA, 16 bp, H. sapiens
gcagtcccagctgctt

SEQ ID NO: 106349 - DNA, 16 bp, H. sapiens
gcagtccgcccacctc

SEQ ID NO: 106350 - DNA, 16 bp, H. sapiens
gcagtcctccagcctt

SEQ ID NO: 106351 - DNA, 16 bp, H. sapiens
gcagtcctcccagctc

SEQ ID NO: 106352 - DNA, 16 bp, H. sapiens
gcagtccttctgcctt

SEQ ID NO: 106353 - DNA, 16 bp, H. sapiens
gcagtccttggcattc

SEQ ID NO: 106354 - DNA, 16 bp, H. sapiens
gcagtctcactctgtc

SEQ ID NO: 106355 - DNA, 16 bp, H. sapiens
gcagtctcagcctccc

SEQ ID NO: 106356 - DNA, 16 bp, H. sapiens
gcagtcttcacctccc

SEQ ID NO: 106357 - DNA, 16 bp, H. sapiens
gcagtcttgctctgtt

SEQ ID NO: 106358 - DNA, 16 bp, H. sapiens
gcagtcttgtgagact

SEQ ID NO: 106359 - DNA, 16 bp, H. sapiens
gcagtgaaaccatcag

SEQ ID NO: 106360 - DNA, 16 bp, H. sapiens
gcagtgagagggaggc

SEQ ID NO: 106361 - DNA, 16 bp, H. sapiens
gcagtgagagtgaaag

SEQ ID NO: 106362 - DNA, 16 bp, H. sapiens
gcagtgagcaatgatc

SEQ ID NO: 106363 - DNA, 16 bp, H. sapiens
gcagtgagcagagctc

SEQ ID NO: 106364 - DNA, 16 bp, H. sapiens
gcagtgagcagtgagc

SEQ ID NO: 106365 - DNA, 16 bp, H. sapiens
gcagtgagccagcctg

SEQ ID NO: 106366 - DNA, 16 bp, H. sapiens
gcagtgagccagggtc

SEQ ID NO: 106367 - DNA, 16 bp, H. sapiens
gcagtgagctaaaatc

SEQ ID NO: 106368 - DNA, 16 bp, H. sapiens
gcagtgagctatggta

SEQ ID NO: 106369 - DNA, 16 bp, H. sapiens
gcagtgagctctgatc

SEQ ID NO: 106370 - DNA, 16 bp, H. sapiens
gcagtgagctggagat

SEQ ID NO: 106371 - DNA, 16 bp, H. sapiens
gcagtgaggctgaggg

SEQ ID NO: 106372 - DNA, 16 bp, H. sapiens
gcagtgaggctgggag

SEQ ID NO: 106373 - DNA, 16 bp, H. sapiens
gcagtgagtcaaaatc

SEQ ID NO: 106374 - DNA, 16 bp, H. sapiens
gcagtgagtgaagatc

SEQ ID NO: 106375 - DNA, 16 bp, H. sapiens
gcagtgagtggaaatc

SEQ ID NO: 106376 - DNA, 16 bp, H. sapiens
gcagtgatattgatga

SEQ ID NO: 106377 - DNA, 16 bp, H. sapiens
gcagtgatccgagatc

SEQ ID NO: 106378 - DNA, 16 bp, H. sapiens
gcagtgcagtgagctg

SEQ ID NO: 106379 - DNA, 16 bp, H. sapiens
gcagtgcagtggggtg

SEQ ID NO: 106380 - DNA, 16 bp, H. sapiens
gcagtgccagctactc

SEQ ID NO: 106381 - DNA, 16 bp, H. sapiens
gcagtgcccaggacgg

SEQ ID NO: 106382 - DNA, 16 bp, H. sapiens
gcagtgcctcacacct

SEQ ID NO: 106383 - DNA, 16 bp, H. sapiens
gcagtgctaagaggaa

SEQ ID NO: 106384 - DNA, 16 bp, H. sapiens
gcagtgctctggaatc

SEQ ID NO: 106385 - DNA, 16 bp, H. sapiens
gcagtgctgagaggga

SEQ ID NO: 106386 - DNA, 16 bp, H. sapiens
gcagtgctgggggacc

SEQ ID NO: 106387 - DNA, 16 bp, H. sapiens
gcagtgcttcccaaac

SEQ ID NO: 106388 - DNA, 16 bp, H. sapiens
gcagtgcttctcaaat

SEQ ID NO: 106389 - DNA, 16 bp, H. sapiens
gcagtggagatggaaa

SEQ ID NO: 106390 - DNA, 16 bp, H. sapiens
gcagtggagatggaga

SEQ ID NO: 106391 - DNA, 16 bp, H. sapiens
gcagtggcaaaatctc

SEQ ID NO: 106392 - DNA, 16 bp, H. sapiens
gcagtggcaagatctc

SEQ ID NO: 106393 - DNA, 16 bp, H. sapiens
gcagtggcaagatttc

SEQ ID NO: 106394 - DNA, 16 bp, H. sapiens
gcagtggcaatggcag

SEQ ID NO: 106395 - DNA, 16 bp, H. sapiens
gcagtggcacaaccat

SEQ ID NO: 106396 - DNA, 16 bp, H. sapiens
gcagtggcacagtcct

SEQ ID NO: 106397 - DNA, 16 bp, H. sapiens
gcagtggcaccatcac

SEQ ID NO: 106398 - DNA, 16 bp, H. sapiens
gcagtggcaccgtcat

SEQ ID NO: 106399 - DNA, 16 bp, H. sapiens
gcagtggcactgtctt

SEQ ID NO: 106400 - DNA, 16 bp, H. sapiens
gcagtggcagccgctg

SEQ ID NO: 106401 - DNA, 17 bp, H. sapiens
gcagtggcaggatctca

SEQ ID NO: 106402 - DNA, 16 bp, H. sapiens
gcagtggcaggcacct

SEQ ID NO: 106403 - DNA, 16 bp, H. sapiens
gcagtggcagtggcag

SEQ ID NO: 106404 - DNA, 16 bp, H. sapiens
gcagtggcagtggcat

SEQ ID NO: 106405 - DNA, 16 bp, H. sapiens
gcagtggcagtggtag

SEQ ID NO: 106406 - DNA, 16 bp, H. sapiens
gcagtggcagtggtgg

SEQ ID NO: 106407 - DNA, 16 bp, H. sapiens
gcagtggcatgagctc

SEQ ID NO: 106408 - DNA, 16 bp, H. sapiens
gcagtggcatgatatc

SEQ ID NO: 106409 - DNA, 16 bp, H. sapiens
gcagtggcatgatgtc

SEQ ID NO: 106410 - DNA, 16 bp, H. sapiens
gcagtggcgtgatcat

SEQ ID NO: 106411 - DNA, 16 bp, H. sapiens
gcagtggcgtgatgat

SEQ ID NO: 106412 - DNA, 16 bp, H. sapiens
gcagtggcgtgatttc

SEQ ID NO: 106413 - DNA, 17 bp, H. sapiens
gcagtggctcacaccta

SEQ ID NO: 106414 - DNA, 16 bp, H. sapiens
gcagtggctcacgcca

SEQ ID NO: 106415 - DNA, 16 bp, H. sapiens
gcagtggctcagacct

SEQ ID NO: 106416 - DNA, 16 bp, H. sapiens
gcagtggctcagcctg

SEQ ID NO: 106417 - DNA, 16 bp, H. sapiens
gcagtggctcatgcct

SEQ ID NO: 106418 - DNA, 16 bp, H. sapiens
gcagtggctgaacacc

SEQ ID NO: 106419 - DNA, 16 bp, H. sapiens
gcagtggctgccactg

SEQ ID NO: 106420 - DNA, 16 bp, H. sapiens
gcagtggctggtacca

SEQ ID NO: 106421 - DNA, 16 bp, H. sapiens
gcagtgggagtggaga

SEQ ID NO: 106422 - DNA, 16 bp, H. sapiens
gcagtgggatgatata

SEQ ID NO: 106423 - DNA, 16 bp, H. sapiens
gcagtggggatggaga

SEQ ID NO: 106424 - DNA, 16 bp, H. sapiens
gcagtggtatgtgcct

SEQ ID NO: 106425 - DNA, 16 bp, H. sapiens
gcagtggtccccaacc

SEQ ID NO: 106426 - DNA, 16 bp, H. sapiens
gcagtggtgcactctt

SEQ ID NO: 106427 - DNA, 16 bp, H. sapiens
gcagtggtgcagttat

SEQ ID NO: 106428 - DNA, 16 bp, H. sapiens
gcagtggtgccatttc

SEQ ID NO: 106429 - DNA, 16 bp, H. sapiens
gcagtggtgcgatctc

SEQ ID NO: 106430 - DNA, 16 bp, H. sapiens
gcagtggttctcccaa

SEQ ID NO: 106431 - DNA, 16 bp, H. sapiens
gcagtgtgaggatgga

SEQ ID NO: 106432 - DNA, 16 bp, H. sapiens
gcagtgtgatcacagc

SEQ ID NO: 106433 - DNA, 16 bp, H. sapiens
gcagtgtgcagaggga

SEQ ID NO: 106434 - DNA, 16 bp, H. sapiens
gcagtgtggctccaga

SEQ ID NO: 106435 - DNA, 16 bp, H. sapiens
gcagtgtggtgtggtg

SEQ ID NO: 106436 - DNA, 16 bp, H. sapiens
gcagtgttaagaagga

SEQ ID NO: 106437 - DNA, 16 bp, H. sapiens
gcagtgttgccatctc

SEQ ID NO: 106438 - DNA, 16 bp, H. sapiens
gcagtgttttgtaatt

SEQ ID NO: 106439 - DNA, 16 bp, H. sapiens
gcagttcccctgcctc

SEQ ID NO: 106440 - DNA, 16 bp, H. sapiens
gcagttcctggcatct

SEQ ID NO: 106441 - DNA, 17 bp, H. sapiens
gcagttctgagtgagtt

SEQ ID NO: 106442 - DNA, 16 bp, H. sapiens
gcagttgcaacagaga

SEQ ID NO: 106443 - DNA, 16 bp, H. sapiens
gcagttgcaccatttt

SEQ ID NO: 106444 - DNA, 16 bp, H. sapiens
gcagttgcagtgagcc

SEQ ID NO: 106445 - DNA, 16 bp, H. sapiens
gcagttggagaccagc

SEQ ID NO: 106446 - DNA, 16 bp, H. sapiens
gcagttggagttttaa

SEQ ID NO: 106447 - DNA, 16 bp, H. sapiens
gcagttgtaagaaata

SEQ ID NO: 106448 - DNA, 16 bp, H. sapiens
gcagttgtcagctaaa

SEQ ID NO: 106449 - DNA, 16 bp, H. sapiens
gcagtttcactcctga

SEQ ID NO: 106450 - DNA, 16 bp, H. sapiens
gcagtttcagcagcca

SEQ ID NO: 106451 - DNA, 16 bp, H. sapiens
gcagtttcagtgtctg

SEQ ID NO: 106452 - DNA, 16 bp, H. sapiens
gcagtttcatatggtt

SEQ ID NO: 106453 - DNA, 16 bp, H. sapiens
gcagtttcctcatctg

SEQ ID NO: 106454 - DNA, 16 bp, H. sapiens
gcagtttctcacaaaa

SEQ ID NO: 106455 - DNA, 16 bp, H. sapiens
gcagtttgactatgat

SEQ ID NO: 106456 - DNA, 16 bp, H. sapiens
gcagtttgtcagaaag

SEQ ID NO: 106457 - DNA, 16 bp, H. sapiens
gcagtttgtgtgtgtg

SEQ ID NO: 106458 - DNA, 16 bp, H. sapiens
gcagtttgtttctttt

SEQ ID NO: 106459 - DNA, 16 bp, H. sapiens
gcataaaaatggacag

SEQ ID NO: 106460 - DNA, 16 bp, H. sapiens
gcataaaagcagacat

SEQ ID NO: 106461 - DNA, 16 bp, H. sapiens
gcataaaagttttgaa

SEQ ID NO: 106462 - DNA, 16 bp, H. sapiens
gcataaacacagacac

SEQ ID NO: 106463 - DNA, 16 bp, H. sapiens
gcataaacccgggagg

SEQ ID NO: 106464 - DNA, 16 bp, H. sapiens
gcataagaataataca

SEQ ID NO: 106465 - DNA, 16 bp, H. sapiens
gcataagtaaagagga

SEQ ID NO: 106466 - DNA, 16 bp, H. sapiens
gcataataatcagcta

SEQ ID NO: 106467 - DNA, 16 bp, H. sapiens
gcataataattgtaca

SEQ ID NO: 106468 - DNA, 16 bp, H. sapiens
gcataatcatagctca

SEQ ID NO: 106469 - DNA, 16 bp, H. sapiens
gcataatgttttgaag

SEQ ID NO: 106470 - DNA, 16 bp, H. sapiens
gcataatgtttttgag

SEQ ID NO: 106471 - DNA, 16 bp, H. sapiens
gcatacaagggacata

SEQ ID NO: 106472 - DNA, 16 bp, H. sapiens
gcataccaccatgccc

SEQ ID NO: 106473 - DNA, 16 bp, H. sapiens
gcatacctcagagata

SEQ ID NO: 106474 - DNA, 16 bp, H. sapiens
gcatagagttgttcat

SEQ ID NO: 106475 - DNA, 16 bp, H. sapiens
gcatagggagaccctg

SEQ ID NO: 106476 - DNA, 16 bp, H. sapiens
gcatagtgacttcctt

SEQ ID NO: 106477 - DNA, 16 bp, H. sapiens
gcatataatgtgtaat

SEQ ID NO: 106478 - DNA, 16 bp, H. sapiens
gcatatagaaaacaaa

SEQ ID NO: 106479 - DNA, 16 bp, H. sapiens
gcatatatacatgtgt

SEQ ID NO: 106480 - DNA, 16 bp, H. sapiens
gcatatatatatacac

SEQ ID NO: 106481 - DNA, 16 bp, H. sapiens
gcatatatgtgtacat

SEQ ID NO: 106482 - DNA, 16 bp, H. sapiens
gcatatattaattagc

SEQ ID NO: 106483 - DNA, 16 bp, H. sapiens
gcatatattgagatga

SEQ ID NO: 106484 - DNA, 16 bp, H. sapiens
gcatatccatgctgta

SEQ ID NO: 106485 - DNA, 16 bp, H. sapiens
gcatatgaaaaaaaat

SEQ ID NO: 106486 - DNA, 16 bp, H. sapiens
gcatatgaaaaaaagc

SEQ ID NO: 106487 - DNA, 16 bp, H. sapiens
gcatattaaaggctct

SEQ ID NO: 106488 - DNA, 16 bp, H. sapiens
gcatatttaagctgaa

SEQ ID NO: 106489 - DNA, 16 bp, H. sapiens
gcatcaacaaaaaagt

SEQ ID NO: 106490 - DNA, 16 bp, H. sapiens
gcatcaacaggctcac

SEQ ID NO: 106491 - DNA, 17 bp, H. sapiens
gcatcacaattaaaaga

SEQ ID NO: 106492 - DNA, 16 bp, H. sapiens
gcatcacctggaagct

SEQ ID NO: 106493 - DNA, 16 bp, H. sapiens
gcatcacttaatgaca

SEQ ID NO: 106494 - DNA, 16 bp, H. sapiens
gcatcagaatcacctg

SEQ ID NO: 106495 - DNA, 16 bp, H. sapiens
gcatcagcatcaccag

SEQ ID NO: 106496 - DNA, 16 bp, H. sapiens
gcatcagcttcctgag

SEQ ID NO: 106497 - DNA, 16 bp, H. sapiens
gcatcatctcatttaa

SEQ ID NO: 106498 - DNA, 16 bp, H. sapiens
gcatcatgcaatatat

SEQ ID NO: 106499 - DNA, 16 bp, H. sapiens
gcatcatgcagtatac

SEQ ID NO: 106500 - DNA, 16 bp, H. sapiens
gcatcatttattgaac

SEQ ID NO: 106501 - DNA, 16 bp, H. sapiens
gcatcattttgcattc

SEQ ID NO: 106502 - DNA, 16 bp, H. sapiens
gcatccaaataagaaa

SEQ ID NO: 106503 - DNA, 16 bp, H. sapiens
gcatccaaatcagaaa

SEQ ID NO: 106504 - DNA, 16 bp, H. sapiens
gcatccaaatcggtaa

SEQ ID NO: 106505 - DNA, 16 bp, H. sapiens
gcatccaagatggagt

SEQ ID NO: 106506 - DNA, 16 bp, H. sapiens
gcatccaatttggaaa

SEQ ID NO: 106507 - DNA, 16 bp, H. sapiens
gcatccagagagaaag

SEQ ID NO: 106508 - DNA, 16 bp, H. sapiens
gcatccagcctgggtg

SEQ ID NO: 106509 - DNA, 16 bp, H. sapiens
gcatccaggcagaggg

SEQ ID NO: 106510 - DNA, 17 bp, H. sapiens
gcatccatccatccatt

SEQ ID NO: 106511 - DNA, 16 bp, H. sapiens
gcatccatgctgctgc

SEQ ID NO: 106512 - DNA, 16 bp, H. sapiens
gcatcccagaggtttt

SEQ ID NO: 106513 - DNA, 16 bp, H. sapiens
gcatcccagcctgggc

SEQ ID NO: 106514 - DNA, 16 bp, H. sapiens
gcatccccaaccaatc

SEQ ID NO: 106515 - DNA, 16 bp, H. sapiens
gcatccctgagatgaa

SEQ ID NO: 106516 - DNA, 16 bp, H. sapiens
gcatcctcaagtgggt

SEQ ID NO: 106517 - DNA, 16 bp, H. sapiens
gcatcctctgaagcag

SEQ ID NO: 106518 - DNA, 23 bp, H. sapiens
gcatcctggccaacatggtgaaa

SEQ ID NO: 106519 - DNA, 16 bp, H. sapiens
gcatccttgtctcatt

SEQ ID NO: 106520 - DNA, 16 bp, H. sapiens
gcatccttttcttgtg

SEQ ID NO: 106521 - DNA, 16 bp, H. sapiens
gcatctagcacaggag

SEQ ID NO: 106522 - DNA, 16 bp, H. sapiens
gcatctatggagatga

SEQ ID NO: 106523 - DNA, 16 bp, H. sapiens
gcatctatgtctgcag

SEQ ID NO: 106524 - DNA, 16 bp, H. sapiens
gcatctcaaaacaaac

SEQ ID NO: 106525 - DNA, 16 bp, H. sapiens
gcatctcactctgtca

SEQ ID NO: 106526 - DNA, 16 bp, H. sapiens
gcatctcattgtctgg

SEQ ID NO: 106527 - DNA, 16 bp, H. sapiens
gcatctcccagaattc

SEQ ID NO: 106528 - DNA, 16 bp, H. sapiens
gcatctcctctcctgc

SEQ ID NO: 106529 - DNA, 16 bp, H. sapiens
gcatctgacagcctgg

SEQ ID NO: 106530 - DNA, 16 bp, H. sapiens
gcatctgaggtcagga

SEQ ID NO: 106531 - DNA, 16 bp, H. sapiens
gcatctgccaccatgc

SEQ ID NO: 106532 - DNA, 16 bp, H. sapiens
gcatctgctgcagagg

SEQ ID NO: 106533 - DNA, 16 bp, H. sapiens
gcatctgctgtttctt

SEQ ID NO: 106534 - DNA, 16 bp, H. sapiens
gcatctggacaatgag

SEQ ID NO: 106535 - DNA, 16 bp, H. sapiens
gcatctggtgggtgga

SEQ ID NO: 106536 - DNA, 16 bp, H. sapiens
gcatctgtctcctgct

SEQ ID NO: 106537 - DNA, 16 bp, H. sapiens
gcatctgtgatcccag

SEQ ID NO: 106538 - DNA, 16 bp, H. sapiens
gcatctgtggttccag

SEQ ID NO: 106539 - DNA, 16 bp, H. sapiens
gcatctgttatttttc

SEQ ID NO: 106540 - DNA, 16 bp, H. sapiens
gcatcttcaccaagag

SEQ ID NO: 106541 - DNA, 16 bp, H. sapiens
gcatcttcctcatttt

SEQ ID NO: 106542 - DNA, 16 bp, H. sapiens
gcatcttgacaacttt

SEQ ID NO: 106543 - DNA, 16 bp, H. sapiens
gcatcttgctacctga

SEQ ID NO: 106544 - DNA, 16 bp, H. sapiens
gcatctttgtcttgtg

SEQ ID NO: 106545 - DNA, 16 bp, H. sapiens
gcatctttgtggtgtt

SEQ ID NO: 106546 - DNA, 16 bp, H. sapiens
gcatgaacagacactt

SEQ ID NO: 106547 - DNA, 16 bp, H. sapiens
gcatgaacatggttca

SEQ ID NO: 106548 - DNA, 16 bp, H. sapiens
gcatgaaccaccgcac

SEQ ID NO: 106549 - DNA, 16 bp, H. sapiens
gcatgaacccaggagg

SEQ ID NO: 106550 - DNA, 16 bp, H. sapiens
gcatgaacccggaagg

SEQ ID NO: 106551 - DNA, 16 bp, H. sapiens
gcatgaacccgggaag

SEQ ID NO: 106552 - DNA, 16 bp, H. sapiens
gcatgaacccgggagg

SEQ ID NO: 106553 - DNA, 16 bp, H. sapiens
gcatgaacctaggagg

SEQ ID NO: 106554 - DNA, 16 bp, H. sapiens
gcatgaacctgggagg

SEQ ID NO: 106555 - DNA, 16 bp, H. sapiens
gcatgaagcagtgttg

SEQ ID NO: 106556 - DNA, 16 bp, H. sapiens
gcatgacatctctcca

SEQ ID NO: 106557 - DNA, 16 bp, H. sapiens
gcatgaccgcctgagc

SEQ ID NO: 106558 - DNA, 16 bp, H. sapiens
gcatgactgggaggcc

SEQ ID NO: 106559 - DNA, 16 bp, H. sapiens
gcatgactgtgtttca

SEQ ID NO: 106560 - DNA, 16 bp, H. sapiens
gcatgacttaaccctt

SEQ ID NO: 106561 - DNA, 16 bp, H. sapiens
gcatgacttggatgtg

SEQ ID NO: 106562 - DNA, 16 bp, H. sapiens
gcatgagaaaactcat

SEQ ID NO: 106563 - DNA, 16 bp, H. sapiens
gcatgagaacttcgtg

SEQ ID NO: 106564 - DNA, 16 bp, H. sapiens
gcatgagccaccgcac

SEQ ID NO: 106565 - DNA, 16 bp, H. sapiens
gcatgagccaccgtgc

SEQ ID NO: 106566 - DNA, 16 bp, H. sapiens
gcatgagccacctccc

SEQ ID NO: 106567 - DNA, 16 bp, H. sapiens
gcatgagccacctggc

SEQ ID NO: 106568 - DNA, 16 bp, H. sapiens
gcatgagccactgtcc

SEQ ID NO: 106569 - DNA, 16 bp, H. sapiens
gcatgagccatcacac

SEQ ID NO: 106570 - DNA, 16 bp, H. sapiens
gcatgagcctatagtc

SEQ ID NO: 106571 - DNA, 16 bp, H. sapiens
gcatgagctaccacgt

SEQ ID NO: 106572 - DNA, 16 bp, H. sapiens
gcatgagctgccatgc

SEQ ID NO: 106573 - DNA, 16 bp, H. sapiens
gcatgagctgggctgg

SEQ ID NO: 106574 - DNA, 16 bp, H. sapiens
gcatgagtcaccacac

SEQ ID NO: 106575 - DNA, 16 bp, H. sapiens
gcatgatcttagctca

SEQ ID NO: 106576 - DNA, 16 bp, H. sapiens
gcatgatgctgaggtt

SEQ ID NO: 106577 - DNA, 16 bp, H. sapiens
gcatgattgtgttttg

SEQ ID NO: 106578 - DNA, 16 bp, H. sapiens
gcatgcacacacacac

SEQ ID NO: 106579 - DNA, 16 bp, H. sapiens
gcatgcaccaccatga

SEQ ID NO: 106580 - DNA, 16 bp, H. sapiens
gcatgcaccaccatgc

SEQ ID NO: 106581 - DNA, 16 bp, H. sapiens
gcatgcactgccatgc

SEQ ID NO: 106582 - DNA, 16 bp, H. sapiens
gcatgcagcctgcagg

SEQ ID NO: 106583 - DNA, 16 bp, H. sapiens
gcatgcaggtgtcttt

SEQ ID NO: 106584 - DNA, 16 bp, H. sapiens
gcatgcatgcactcac

SEQ ID NO: 106585 - DNA, 16 bp, H. sapiens
gcatgcatgcctgtgt

SEQ ID NO: 106586 - DNA, 16 bp, H. sapiens
gcatgcattatttcat

SEQ ID NO: 106587 - DNA, 16 bp, H. sapiens
gcatgccaccacaccc

SEQ ID NO: 106588 - DNA, 16 bp, H. sapiens
gcatgccaccacgccc

SEQ ID NO: 106589 - DNA, 16 bp, H. sapiens
gcatgccaccaggcct

SEQ ID NO: 106590 - DNA, 17 bp, H. sapiens
gcatgccaccatgcccg

SEQ ID NO: 106591 - DNA, 18 bp, H. sapiens
gcatgcccagctaatttt

SEQ ID NO: 106592 - DNA, 16 bp, H. sapiens
gcatgcctgtaatcca

SEQ ID NO: 106593 - DNA, 16 bp, H. sapiens
gcatgcctgtggtcct

SEQ ID NO: 106594 - DNA, 16 bp, H. sapiens
gcatgcgtcaccacac

SEQ ID NO: 106595 - DNA, 16 bp, H. sapiens
gcatggaagctccaca

SEQ ID NO: 106596 - DNA, 16 bp, H. sapiens
gcatggacaaggactt

SEQ ID NO: 106597 - DNA, 16 bp, H. sapiens
gcatggagcagagagg

SEQ ID NO: 106598 - DNA, 16 bp, H. sapiens
gcatggaggaaaccac

SEQ ID NO: 106599 - DNA, 16 bp, H. sapiens
gcatggaggttcctca

SEQ ID NO: 106600 - DNA, 16 bp, H. sapiens
gcatggatgaaccttg

SEQ ID NO: 106601 - DNA, 16 bp, H. sapiens
gcatggatgagatgga

SEQ ID NO: 106602 - DNA, 16 bp, H. sapiens
gcatggatgcagctgg

SEQ ID NO: 106603 - DNA, 16 bp, H. sapiens
gcatggatttatatct

SEQ ID NO: 106604 - DNA, 16 bp, H. sapiens
gcatggctcatgcctg

SEQ ID NO: 106605 - DNA, 16 bp, H. sapiens
gcatggctggaaggcc

SEQ ID NO: 106606 - DNA, 16 bp, H. sapiens
gcatggctggagaggc

SEQ ID NO: 106607 - DNA, 16 bp, H. sapiens
gcatggctgtgctcca

SEQ ID NO: 106608 - DNA, 16 bp, H. sapiens
gcatggctgtggtccc

SEQ ID NO: 106609 - DNA, 16 bp, H. sapiens
gcatggctttcctctc

SEQ ID NO: 106610 - DNA, 16 bp, H. sapiens
gcatgggagaaagagg

SEQ ID NO: 106611 - DNA, 16 bp, H. sapiens
gcatgggcatggagga

SEQ ID NO: 106612 - DNA, 16 bp, H. sapiens
gcatgggccaccgcgc

SEQ ID NO: 106613 - DNA, 16 bp, H. sapiens
gcatgggccactgcac

SEQ ID NO: 106614 - DNA, 16 bp, H. sapiens
gcatgggctctggagc

SEQ ID NO: 106615 - DNA, 16 bp, H. sapiens
gcatgggggcacacac

SEQ ID NO: 106616 - DNA, 16 bp, H. sapiens
gcatggtgcaagctgt

SEQ ID NO: 106617 - DNA, 16 bp, H. sapiens
gcatggtgcacatgcc

SEQ ID NO: 106618 - DNA, 16 bp, H. sapiens
gcatggtgccaggtgc

SEQ ID NO: 106619 - DNA, 16 bp, H. sapiens
gcatggtgctgctgaa

SEQ ID NO: 106620 - DNA, 16 bp, H. sapiens
gcatggtgcttggcac

SEQ ID NO: 106621 - DNA, 16 bp, H. sapiens
gcatggtggcccacgc

SEQ ID NO: 106622 - DNA, 16 bp, H. sapiens
gcatggtggcccatgt

SEQ ID NO: 106623 - DNA, 16 bp, H. sapiens
gcatggtggcctcagg

SEQ ID NO: 106624 - DNA, 16 bp, H. sapiens
gcatggtggcgaatgc

SEQ ID NO: 106625 - DNA, 16 bp, H. sapiens
gcatggtggtgcatgc

SEQ ID NO: 106626 - DNA, 16 bp, H. sapiens
gcatggtggtgcatgt

SEQ ID NO: 106627 - DNA, 16 bp, H. sapiens
gcatggtggtggcatg

SEQ ID NO: 106628 - DNA, 16 bp, H. sapiens
gcatggtggtgggtgg

SEQ ID NO: 106629 - DNA, 16 bp, H. sapiens
gcatggtggtgtatgc

SEQ ID NO: 106630 - DNA, 16 bp, H. sapiens
gcatggtttgtggtgc

SEQ ID NO: 106631 - DNA, 16 bp, H. sapiens
gcatggttttttgttt

SEQ ID NO: 106632 - DNA, 16 bp, H. sapiens
gcatgtaccacatttt

SEQ ID NO: 106633 - DNA, 16 bp, H. sapiens
gcatgtaccatcacac

SEQ ID NO: 106634 - DNA, 16 bp, H. sapiens
gcatgtatcattactt

SEQ ID NO: 106635 - DNA, 16 bp, H. sapiens
gcatgtcagagacctt

SEQ ID NO: 106636 - DNA, 16 bp, H. sapiens
gcatgtcatggggatt

SEQ ID NO: 106637 - DNA, 16 bp, H. sapiens
gcatgtgcacacacac

SEQ ID NO: 106638 - DNA, 16 bp, H. sapiens
gcatgtgcagttcaca

SEQ ID NO: 106639 - DNA, 16 bp, H. sapiens
gcatgtgccaccatac

SEQ ID NO: 106640 - DNA, 16 bp, H. sapiens
gcatgtgccaccatgc

SEQ ID NO: 106641 - DNA, 16 bp, H. sapiens
gcatgtgccaccatgt

SEQ ID NO: 106642 - DNA, 16 bp, H. sapiens
gcatgtgccatcatgg

SEQ ID NO: 106643 - DNA, 16 bp, H. sapiens
gcatgtgcgtgtgtgc

SEQ ID NO: 106644 - DNA, 16 bp, H. sapiens
gcatgtggacatccag

SEQ ID NO: 106645 - DNA, 16 bp, H. sapiens
gcatgtggcccaggat

SEQ ID NO: 106646 - DNA, 16 bp, H. sapiens
gcatgtggtaggtgct

SEQ ID NO: 106647 - DNA, 16 bp, H. sapiens
gcatgtgtacacacac

SEQ ID NO: 106648 - DNA, 16 bp, H. sapiens
gcatgtgtatgtatgt

SEQ ID NO: 106649 - DNA, 16 bp, H. sapiens
gcatgtgtatgtgtct

SEQ ID NO: 106650 - DNA, 16 bp, H. sapiens
gcatgtgtcttttttg

SEQ ID NO: 106651 - DNA, 16 bp, H. sapiens
gcatgtgtgcatgtgc

SEQ ID NO: 106652 - DNA, 16 bp, H. sapiens
gcatgtgtgtatatat

SEQ ID NO: 106653 - DNA, 16 bp, H. sapiens
gcatgtgtgtgggtgt

SEQ ID NO: 106654 - DNA, 16 bp, H. sapiens
gcatgtgtgtgtgtga

SEQ ID NO: 106655 - DNA, 16 bp, H. sapiens
gcatgtgtgtgtgtgg

SEQ ID NO: 106656 - DNA, 16 bp, H. sapiens
gcatgtgtgtgtgtgt

SEQ ID NO: 106657 - DNA, 16 bp, H. sapiens
gcatgtgtgttgtgtg

SEQ ID NO: 106658 - DNA, 16 bp, H. sapiens
gcatgttcaaaatggc

SEQ ID NO: 106659 - DNA, 17 bp, H. sapiens
gcatgttctcactcata

SEQ ID NO: 106660 - DNA, 16 bp, H. sapiens
gcatgttctctctcat

SEQ ID NO: 106661 - DNA, 16 bp, H. sapiens
gcatgttggcatgcac

SEQ ID NO: 106662 - DNA, 16 bp, H. sapiens
gcatgttgggaggctg

SEQ ID NO: 106663 - DNA, 16 bp, H. sapiens
gcatgttggtgcacgc

SEQ ID NO: 106664 - DNA, 16 bp, H. sapiens
gcatgttgtttaattt

SEQ ID NO: 106665 - DNA, 16 bp, H. sapiens
gcatgtttatttattt

SEQ ID NO: 106666 - DNA, 16 bp, H. sapiens
gcatgtttgccaggct

SEQ ID NO: 106667 - DNA, 16 bp, H. sapiens
gcattaaaaaattttt

SEQ ID NO: 106668 - DNA, 16 bp, H. sapiens
gcattaaaattatttt

SEQ ID NO: 106669 - DNA, 16 bp, H. sapiens
gcattacacacacaca

SEQ ID NO: 106670 - DNA, 16 bp, H. sapiens
gcattacactccagcc

SEQ ID NO: 106671 - DNA, 16 bp, H. sapiens
gcattacataatgaca

SEQ ID NO: 106672 - DNA, 16 bp, H. sapiens
gcattagagtctcata

SEQ ID NO: 106673 - DNA, 16 bp, H. sapiens
gcattagattctcata

SEQ ID NO: 106674 - DNA, 16 bp, H. sapiens
gcattaggagaaacac

SEQ ID NO: 106675 - DNA, 16 bp, H. sapiens
gcattatatttttaaa

SEQ ID NO: 106676 - DNA, 16 bp, H. sapiens
gcattattattattat

SEQ ID NO: 106677 - DNA, 16 bp, H. sapiens
gcattcaataaatatg

SEQ ID NO: 106678 - DNA, 16 bp, H. sapiens
gcattcacaaagagat

SEQ ID NO: 106679 - DNA, 16 bp, H. sapiens
gcattcagttttaaaa

SEQ ID NO: 106680 - DNA, 16 bp, H. sapiens
gcattcattcagcaaa

SEQ ID NO: 106681 - DNA, 16 bp, H. sapiens
gcattccagcctgcat

SEQ ID NO: 106682 - DNA, 16 bp, H. sapiens
gcattccaggcagaga

SEQ ID NO: 106683 - DNA, 16 bp, H. sapiens
gcattccagtctgggc

SEQ ID NO: 106684 - DNA, 16 bp, H. sapiens
gcattcccaccaacaa

SEQ ID NO: 106685 - DNA, 16 bp, H. sapiens
gcattcctagcctcta

SEQ ID NO: 106686 - DNA, 16 bp, H. sapiens
gcattcctctgatgat

SEQ ID NO: 106687 - DNA, 16 bp, H. sapiens
gcattccttccttcct

SEQ ID NO: 106688 - DNA, 17 bp, H. sapiens
gcattccttggcccagt

SEQ ID NO: 106689 - DNA, 16 bp, H. sapiens
gcattctcatcagcaa

SEQ ID NO: 106690 - DNA, 16 bp, H. sapiens
gcattctgcccacctc

SEQ ID NO: 106691 - DNA, 16 bp, H. sapiens
gcattctgtgaaactt

SEQ ID NO: 106692 - DNA, 16 bp, H. sapiens
gcattcttggaataaa

SEQ ID NO: 106693 - DNA, 16 bp, H. sapiens
gcattgaaactataaa

SEQ ID NO: 106694 - DNA, 16 bp, H. sapiens
gcattgaaataaaagc

SEQ ID NO: 106695 - DNA, 16 bp, H. sapiens
gcattgaatctctaaa

SEQ ID NO: 106696 - DNA, 16 bp, H. sapiens
gcattgaatctgtagt

SEQ ID NO: 106697 - DNA, 16 bp, H. sapiens
gcattgctccagagag

SEQ ID NO: 106698 - DNA, 16 bp, H. sapiens
gcattgggttagaaca

SEQ ID NO: 106699 - DNA, 16 bp, H. sapiens
gcattggtgggagtgt

SEQ ID NO: 106700 - DNA, 16 bp, H. sapiens
gcattgtccaatatca

SEQ ID NO: 106701 - DNA, 16 bp, H. sapiens
gcattgtggcacatgc

SEQ ID NO: 106702 - DNA, 16 bp, H. sapiens
gcattgttatacacca

SEQ ID NO: 106703 - DNA, 16 bp, H. sapiens
gcatttaaattttatt

SEQ ID NO: 106704 - DNA, 16 bp, H. sapiens
gcatttacattgtatt

SEQ ID NO: 106705 - DNA, 16 bp, H. sapiens
gcatttacttttgggt

SEQ ID NO: 106706 - DNA, 16 bp, H. sapiens
gcatttagatcattta

SEQ ID NO: 106707 - DNA, 16 bp, H. sapiens
gcatttatcccagaga

SEQ ID NO: 106708 - DNA, 16 bp, H. sapiens
gcatttattcaacaaa

SEQ ID NO: 106709 - DNA, 16 bp, H. sapiens
gcatttattgagcact

SEQ ID NO: 106710 - DNA, 16 bp, H. sapiens
gcatttcagagacctt

SEQ ID NO: 106711 - DNA, 16 bp, H. sapiens
gcatttcagagacttt

SEQ ID NO: 106712 - DNA, 16 bp, H. sapiens
gcatttcatcaaccag

SEQ ID NO: 106713 - DNA, 16 bp, H. sapiens
gcatttcatcttttat

SEQ ID NO: 106714 - DNA, 16 bp, H. sapiens
gcatttcattttattt

SEQ ID NO: 106715 - DNA, 16 bp, H. sapiens
gcatttccctgatgat

SEQ ID NO: 106716 - DNA, 16 bp, H. sapiens
gcatttcctctgctgg

SEQ ID NO: 106717 - DNA, 16 bp, H. sapiens
gcatttctatacacca

SEQ ID NO: 106718 - DNA, 16 bp, H. sapiens
gcatttctatgatgat

SEQ ID NO: 106719 - DNA, 16 bp, H. sapiens
gcatttctatgtgcca

SEQ ID NO: 106720 - DNA, 16 bp, H. sapiens
gcatttctcctaatgc

SEQ ID NO: 106721 - DNA, 16 bp, H. sapiens
gcatttcttcatgtgt

SEQ ID NO: 106722 - DNA, 16 bp, H. sapiens
gcatttcttgtaggaa

SEQ ID NO: 106723 - DNA, 16 bp, H. sapiens
gcatttcttttattat

SEQ ID NO: 106724 - DNA, 16 bp, H. sapiens
gcatttgaaaaaaatc

SEQ ID NO: 106725 - DNA, 16 bp, H. sapiens
gcatttgaaaaaatcc

SEQ ID NO: 106726 - DNA, 20 bp, H. sapiens
gcatttgaggagcccttcag

SEQ ID NO: 106727 - DNA, 16 bp, H. sapiens
gcatttgagtttgcaa

SEQ ID NO: 106728 - DNA, 16 bp, H. sapiens
gcatttgatattgtca

SEQ ID NO: 106729 - DNA, 16 bp, H. sapiens
gcatttgattttctgt

SEQ ID NO: 106730 - DNA, 16 bp, H. sapiens
gcatttgccagtttcc

SEQ ID NO: 106731 - DNA, 16 bp, H. sapiens
gcatttgctgttctct

SEQ ID NO: 106732 - DNA, 16 bp, H. sapiens
gcatttgctgtttcct

SEQ ID NO: 106733 - DNA, 16 bp, H. sapiens
gcatttgctgttttct

SEQ ID NO: 106734 - DNA, 16 bp, H. sapiens
gcatttggggaggctg

SEQ ID NO: 106735 - DNA, 28 bp, H. sapiens
gcatttgggttggttccaagtctttgct

SEQ ID NO: 106736 - DNA, 16 bp, H. sapiens
gcatttgtatatgcca

SEQ ID NO: 106737 - DNA, 16 bp, H. sapiens
gcatttgtgtatctaa

SEQ ID NO: 106738 - DNA, 16 bp, H. sapiens
gcattttaaaatgctt

SEQ ID NO: 106739 - DNA, 16 bp, H. sapiens
gcattttaaagtattt

SEQ ID NO: 106740 - DNA, 16 bp, H. sapiens
gcattttaacaagatc

SEQ ID NO: 106741 - DNA, 16 bp, H. sapiens
gcattttaacaagatt

SEQ ID NO: 106742 - DNA, 16 bp, H. sapiens
gcattttaattaaaaa

SEQ ID NO: 106743 - DNA, 16 bp, H. sapiens
gcattttacatttcca

SEQ ID NO: 106744 - DNA, 16 bp, H. sapiens
gcattttatagatgag

SEQ ID NO: 106745 - DNA, 16 bp, H. sapiens
gcattttatatgattc

SEQ ID NO: 106746 - DNA, 16 bp, H. sapiens
gcattttattaaataa

SEQ ID NO: 106747 - DNA, 16 bp, H. sapiens
gcattttccatgaact

SEQ ID NO: 106748 - DNA, 16 bp, H. sapiens
gcattttcctgataac

SEQ ID NO: 106749 - DNA, 16 bp, H. sapiens
gcattttcctgatgat

SEQ ID NO: 106750 - DNA, 16 bp, H. sapiens
gcattttcttgatgac

SEQ ID NO: 106751 - DNA, 16 bp, H. sapiens
gcattttgaatttcag

SEQ ID NO: 106752 - DNA, 16 bp, H. sapiens
gcattttgagaaactt

SEQ ID NO: 106753 - DNA, 16 bp, H. sapiens
gcattttgagtagaga

SEQ ID NO: 106754 - DNA, 16 bp, H. sapiens
gcattttggacaaagc

SEQ ID NO: 106755 - DNA, 16 bp, H. sapiens
gcattttggattttga

SEQ ID NO: 106756 - DNA, 16 bp, H. sapiens
gcattttgttgttgtt

SEQ ID NO: 106757 - DNA, 16 bp, H. sapiens
gcatttttaaaaaaat

SEQ ID NO: 106758 - DNA, 16 bp, H. sapiens
gcatttttattaatat

SEQ ID NO: 106759 - DNA, 16 bp, H. sapiens
gcatttttattttgca

SEQ ID NO: 106760 - DNA, 16 bp, H. sapiens
gcatttttcaactcca

SEQ ID NO: 106761 - DNA, 16 bp, H. sapiens
gcatttttcataatag

SEQ ID NO: 106762 - DNA, 16 bp, H. sapiens
gcatttttgcagaaat

SEQ ID NO: 106763 - DNA, 16 bp, H. sapiens
gcattttttaaagttt

SEQ ID NO: 106764 - DNA, 16 bp, H. sapiens
gcattttttcacatac

SEQ ID NO: 106765 - DNA, 16 bp, H. sapiens
gcattttttgtagaaa

SEQ ID NO: 106766 - DNA, 16 bp, H. sapiens
gcatttttttcatgta

SEQ ID NO: 106767 - DNA, 16 bp, H. sapiens
gcatttttttttagca

SEQ ID NO: 106768 - DNA, 16 bp, H. sapiens
gccaaaaaggctgggg

SEQ ID NO: 106769 - DNA, 16 bp, H. sapiens
gccaaaacaatattga

SEQ ID NO: 106770 - DNA, 16 bp, H. sapiens
gccaaaacctaccaaa

SEQ ID NO: 106771 - DNA, 16 bp, H. sapiens
gccaaaacggtgaaac

SEQ ID NO: 106772 - DNA, 16 bp, H. sapiens
gccaaaagaagaaagc

SEQ ID NO: 106773 - DNA, 16 bp, H. sapiens
gccaaaagaataaagc

SEQ ID NO: 106774 - DNA, 16 bp, H. sapiens
gccaaaatcatgccat

SEQ ID NO: 106775 - DNA, 16 bp, H. sapiens
gccaaaatggtgaaat

SEQ ID NO: 106776 - DNA, 16 bp, H. sapiens
gccaaacatcctacaa

SEQ ID NO: 106777 - DNA, 16 bp, H. sapiens
gccaaactaagctgca

SEQ ID NO: 106778 - DNA, 16 bp, H. sapiens
gccaaactatatcaat

SEQ ID NO: 106779 - DNA, 16 bp, H. sapiens
gccaaactcttttcca

SEQ ID NO: 106780 - DNA, 16 bp, H. sapiens
gccaaagaaatcctga

SEQ ID NO: 106781 - DNA, 16 bp, H. sapiens
gccaaagcaggtggat

SEQ ID NO: 106782 - DNA, 16 bp, H. sapiens
gccaaagccattcaac

SEQ ID NO: 106783 - DNA, 16 bp, H. sapiens
gccaaagcgggtggat

SEQ ID NO: 106784 - DNA, 16 bp, H. sapiens
gccaaagggaaaagtt

SEQ ID NO: 106785 - DNA, 18 bp, H. sapiens
gccaaagtgctgggatta

SEQ ID NO: 106786 - DNA, 16 bp, H. sapiens
gccaaagtgggcagat

SEQ ID NO: 106787 - DNA, 16 bp, H. sapiens
gccaaagtgggtggat

SEQ ID NO: 106788 - DNA, 16 bp, H. sapiens
gccaaatcacaaatga

SEQ ID NO: 106789 - DNA, 16 bp, H. sapiens
gccaaatcattattta

SEQ ID NO: 106790 - DNA, 16 bp, H. sapiens
gccaaatctagcccac

SEQ ID NO: 106791 - DNA, 16 bp, H. sapiens
gccaaatctggcccac

SEQ ID NO: 106792 - DNA, 16 bp, H. sapiens
gccaaatctgggacaa

SEQ ID NO: 106793 - DNA, 16 bp, H. sapiens
gccaaatgctttttct

SEQ ID NO: 106794 - DNA, 16 bp, H. sapiens
gccaaatggacctaat

SEQ ID NO: 106795 - DNA, 16 bp, H. sapiens
gccaaattccaccaga

SEQ ID NO: 106796 - DNA, 16 bp, H. sapiens
gccaaattctactaga

SEQ ID NO: 106797 - DNA, 16 bp, H. sapiens
gccaaattctcccaga

SEQ ID NO: 106798 - DNA, 16 bp, H. sapiens
gccaaattgtccctgt

SEQ ID NO: 106799 - DNA, 16 bp, H. sapiens
gccaacaaatgtgaaa

SEQ ID NO: 106800 - DNA, 16 bp, H. sapiens
gccaacaatggtgaaa

SEQ ID NO: 106801 - DNA, 22 bp, H. sapiens
gccaacacacccggctaatttt

SEQ ID NO: 106802 - DNA, 16 bp, H. sapiens
gccaacacagtgaaaa

SEQ ID NO: 106803 - DNA, 16 bp, H. sapiens
gccaacaccttgactg

SEQ ID NO: 106804 - DNA, 16 bp, H. sapiens
gccaacacggcaaaac

SEQ ID NO: 106805 - DNA, 16 bp, H. sapiens
gccaacactttgatct

SEQ ID NO: 106806 - DNA, 16 bp, H. sapiens
gccaacagatcaggag

SEQ ID NO: 106807 - DNA, 16 bp, H. sapiens
gccaacagggtgaagc

SEQ ID NO: 106808 - DNA, 16 bp, H. sapiens
gccaacatagtaagac

SEQ ID NO: 106809 - DNA, 16 bp, H. sapiens
gccaacatcatgaaac

SEQ ID NO: 106810 - DNA, 21 bp, H. sapiens
gccaacatggcacatgtatac

SEQ ID NO: 106811 - DNA, 16 bp, H. sapiens
gccaaccaactcaggc

SEQ ID NO: 106812 - DNA, 16 bp, H. sapiens
gccaacctcagcctcc

SEQ ID NO: 106813 - DNA, 16 bp, H. sapiens
gccaacgaggtgaaac

SEQ ID NO: 106814 - DNA, 16 bp, H. sapiens
gccaagagaagaggcc

SEQ ID NO: 106815 - DNA, 16 bp, H. sapiens
gccaagagcgagcgag

SEQ ID NO: 106816 - DNA, 16 bp, H. sapiens
gccaagaggaccccag

SEQ ID NO: 106817 - DNA, 16 bp, H. sapiens
gccaagaggagcctaa

SEQ ID NO: 106818 - DNA, 16 bp, H. sapiens
gccaagagggaggctg

SEQ ID NO: 106819 - DNA, 16 bp, H. sapiens
gccaagagtgagcgag

SEQ ID NO: 106820 - DNA, 16 bp, H. sapiens
gccaagataatgccac

SEQ ID NO: 106821 - DNA, 16 bp, H. sapiens
gccaagatcacaccac

SEQ ID NO: 106822 - DNA, 18 bp, H. sapiens
gccaagatcacgccactg

SEQ ID NO: 106823 - DNA, 16 bp, H. sapiens
gccaagatcccatccc

SEQ ID NO: 106824 - DNA, 16 bp, H. sapiens
gccaagatcgtgccct

SEQ ID NO: 106825 - DNA, 16 bp, H. sapiens
gccaagatctcaccac

SEQ ID NO: 106826 - DNA, 16 bp, H. sapiens
gccaagatgatgccac

SEQ ID NO: 106827 - DNA, 16 bp, H. sapiens
gccaagatggagccat

SEQ ID NO: 106828 - DNA, 16 bp, H. sapiens
gccaagatggcagcag

SEQ ID NO: 106829 - DNA, 16 bp, H. sapiens
gccaagatgggcagat

SEQ ID NO: 106830 - DNA, 16 bp, H. sapiens
gccaagatgggtggat

SEQ ID NO: 106831 - DNA, 16 bp, H. sapiens
gccaagatttgccaga

SEQ ID NO: 106832 - DNA, 16 bp, H. sapiens
gccaagcacaagctca

SEQ ID NO: 106833 - DNA, 16 bp, H. sapiens
gccaagcacggtggca

SEQ ID NO: 106834 - DNA, 16 bp, H. sapiens
gccaagcagatgccag

SEQ ID NO: 106835 - DNA, 16 bp, H. sapiens
gccaagcagatgctga

SEQ ID NO: 106836 - DNA, 16 bp, H. sapiens
gccaagcagtttttca

SEQ ID NO: 106837 - DNA, 16 bp, H. sapiens
gccaagccatccagcc

SEQ ID NO: 106838 - DNA, 16 bp, H. sapiens
gccaagctctttgcta

SEQ ID NO: 106839 - DNA, 16 bp, H. sapiens
gccaagctggagtaca

SEQ ID NO: 106840 - DNA, 16 bp, H. sapiens
gccaagcttggtggtg

SEQ ID NO: 106841 - DNA, 16 bp, H. sapiens
gccaaggaacacctgg

SEQ ID NO: 106842 - DNA, 16 bp, H. sapiens
gccaaggaatgcaggc

SEQ ID NO: 106843 - DNA, 16 bp, H. sapiens
gccaaggacattccaa

SEQ ID NO: 106844 - DNA, 16 bp, H. sapiens
gccaaggagacaggcc

SEQ ID NO: 106845 - DNA, 16 bp, H. sapiens
gccaaggagagaagcc

SEQ ID NO: 106846 - DNA, 16 bp, H. sapiens
gccaaggagagaggct

SEQ ID NO: 106847 - DNA, 16 bp, H. sapiens
gccaaggagaggggcc

SEQ ID NO: 106848 - DNA, 16 bp, H. sapiens
gccaaggagggcagat

SEQ ID NO: 106849 - DNA, 16 bp, H. sapiens
gccaaggagttcaaga

SEQ ID NO: 106850 - DNA, 16 bp, H. sapiens
gccaaggcaagcagat

SEQ ID NO: 106851 - DNA, 16 bp, H. sapiens
gccaaggcaagcggat

SEQ ID NO: 106852 - DNA, 16 bp, H. sapiens
gccaaggcaagtggat

SEQ ID NO: 106853 - DNA, 16 bp, H. sapiens
gccaaggcagaaagat

SEQ ID NO: 106854 - DNA, 16 bp, H. sapiens
gccaaggcagaaggat

SEQ ID NO: 106855 - DNA, 16 bp, H. sapiens
gccaaggcagatggat

SEQ ID NO: 106856 - DNA, 16 bp, H. sapiens
gccaaggcaggaagac

SEQ ID NO: 106857 - DNA, 16 bp, H. sapiens
gccaaggcaggaggat

SEQ ID NO: 106858 - DNA, 16 bp, H. sapiens
gccaaggcaggctgat

SEQ ID NO: 106859 - DNA, 16 bp, H. sapiens
gccaaggcagtaggat

SEQ ID NO: 106860 - DNA, 16 bp, H. sapiens
gccaaggccaaggagg

SEQ ID NO: 106861 - DNA, 16 bp, H. sapiens
gccaaggccagagctg

SEQ ID NO: 106862 - DNA, 16 bp, H. sapiens
gccaaggccagcggat

SEQ ID NO: 106863 - DNA, 16 bp, H. sapiens
gccaaggccagtggat

SEQ ID NO: 106864 - DNA, 16 bp, H. sapiens
gccaaggcgagtggat

SEQ ID NO: 106865 - DNA, 16 bp, H. sapiens
gccaaggcggacggat

SEQ ID NO: 106866 - DNA, 20 bp, H. sapiens
gccaaggcgggcggatcaca

SEQ ID NO: 106867 - DNA, 17 bp, H. sapiens
gccaaggcgggcggatt

SEQ ID NO: 106868 - DNA, 17 bp, H. sapiens
gccaaggcgggtggatt

SEQ ID NO: 106869 - DNA, 16 bp, H. sapiens
gccaaggcgggttgat

SEQ ID NO: 106870 - DNA, 16 bp, H. sapiens
gccaaggctcaagaac

SEQ ID NO: 106871 - DNA, 16 bp, H. sapiens
gccaaggctgaggagg

SEQ ID NO: 106872 - DNA, 16 bp, H. sapiens
gccaaggctggagtgc

SEQ ID NO: 106873 - DNA, 16 bp, H. sapiens
gccaaggctggggtgc

SEQ ID NO: 106874 - DNA, 16 bp, H. sapiens
gccaaggctggtctcg

SEQ ID NO: 106875 - DNA, 16 bp, H. sapiens
gccaagggtggtggca

SEQ ID NO: 106876 - DNA, 16 bp, H. sapiens
gccaaggtaggaagat

SEQ ID NO: 106877 - DNA, 16 bp, H. sapiens
gccaaggtaggtggat

SEQ ID NO: 106878 - DNA, 16 bp, H. sapiens
gccaaggtggaaggat

SEQ ID NO: 106879 - DNA, 16 bp, H. sapiens
gccaaggtggagaaac

SEQ ID NO: 106880 - DNA, 16 bp, H. sapiens
gccaaggtggccagat

SEQ ID NO: 106881 - DNA, 16 bp, H. sapiens
gccaaggtgggaggag

SEQ ID NO: 106882 - DNA, 16 bp, H. sapiens
gccaaggtgggaggat

SEQ ID NO: 106883 - DNA, 16 bp, H. sapiens
gccaaggtgggcacat

SEQ ID NO: 106884 - DNA, 16 bp, H. sapiens
gccaaggtgggctgat

SEQ ID NO: 106885 - DNA, 16 bp, H. sapiens
gccaaggtgggtaaat

SEQ ID NO: 106886 - DNA, 16 bp, H. sapiens
gccaagtcaatcccaa

SEQ ID NO: 106887 - DNA, 16 bp, H. sapiens
gccaagtcttcatttg

SEQ ID NO: 106888 - DNA, 16 bp, H. sapiens
gccaagtggaactgtg

SEQ ID NO: 106889 - DNA, 16 bp, H. sapiens
gccaagtggaagccac

SEQ ID NO: 106890 - DNA, 16 bp, H. sapiens
gccaataaacatatga

SEQ ID NO: 106891 - DNA, 18 bp, H. sapiens
gccaatatccctgatgaa

SEQ ID NO: 106892 - DNA, 16 bp, H. sapiens
gccaatatggcaaaat

SEQ ID NO: 106893 - DNA, 16 bp, H. sapiens
gccaatcaaacctctt

SEQ ID NO: 106894 - DNA, 16 bp, H. sapiens
gccaatcactgagttt

SEQ ID NO: 106895 - DNA, 16 bp, H. sapiens
gccaatgcaggtggat

SEQ ID NO: 106896 - DNA, 16 bp, H. sapiens
gccaatggaaaccaga

SEQ ID NO: 106897 - DNA, 16 bp, H. sapiens
gccaatggaaactgga

SEQ ID NO: 106898 - DNA, 16 bp, H. sapiens
gccaatggtggaaaag

SEQ ID NO: 106899 - DNA, 16 bp, H. sapiens
gccaatgtcaagaagg

SEQ ID NO: 106900 - DNA, 16 bp, H. sapiens
gccaatgtgcctggcc

SEQ ID NO: 106901 - DNA, 16 bp, H. sapiens
gccaattaaactatga

SEQ ID NO: 106902 - DNA, 16 bp, H. sapiens
gccaattatcccagca

SEQ ID NO: 106903 - DNA, 16 bp, H. sapiens
gccaattcttgggcct

SEQ ID NO: 106904 - DNA, 16 bp, H. sapiens
gccaattttttggaat

SEQ ID NO: 106905 - DNA, 16 bp, H. sapiens
gccacaaaaagaaatg

SEQ ID NO: 106906 - DNA, 16 bp, H. sapiens
gccacaaaaaggaaca

SEQ ID NO: 106907 - DNA, 16 bp, H. sapiens
gccacaaagcaagact

SEQ ID NO: 106908 - DNA, 16 bp, H. sapiens
gccacaaatcttcaat

SEQ ID NO: 106909 - DNA, 16 bp, H. sapiens
gccacaacagtcccca

SEQ ID NO: 106910 - DNA, 16 bp, H. sapiens
gccacaaccactacta

SEQ ID NO: 106911 - DNA, 16 bp, H. sapiens
gccacaacctcccaaa

SEQ ID NO: 106912 - DNA, 16 bp, H. sapiens
gccacaacctctgcct

SEQ ID NO: 106913 - DNA, 16 bp, H. sapiens
gccacaagagtgacct

SEQ ID NO: 106914 - DNA, 16 bp, H. sapiens
gccacaagccaaggaa

SEQ ID NO: 106915 - DNA, 16 bp, H. sapiens
gccacaagcccaggga

SEQ ID NO: 106916 - DNA, 16 bp, H. sapiens
gccacaaggactgcaa

SEQ ID NO: 106917 - DNA, 16 bp, H. sapiens
gccacaaggggtttta

SEQ ID NO: 106918 - DNA, 16 bp, H. sapiens
gccacaatcacagctc

SEQ ID NO: 106919 - DNA, 16 bp, H. sapiens
gccacaatcatagctc

SEQ ID NO: 106920 - DNA, 16 bp, H. sapiens
gccacaatgcccagat

SEQ ID NO: 106921 - DNA, 16 bp, H. sapiens
gccacaatgtccagct

SEQ ID NO: 106922 - DNA, 16 bp, H. sapiens
gccacacacacacact

SEQ ID NO: 106923 - DNA, 18 bp, H. sapiens
gccacacccagctaattt

SEQ ID NO: 106924 - DNA, 19 bp, H. sapiens
gccacacccggctaatttt

SEQ ID NO: 106925 - DNA, 16 bp, H. sapiens
gccacacctagctgca

SEQ ID NO: 106926 - DNA, 16 bp, H. sapiens
gccacactattcacaa

SEQ ID NO: 106927 - DNA, 16 bp, H. sapiens
gccacactccctccag

SEQ ID NO: 106928 - DNA, 16 bp, H. sapiens
gccacactgacttcca

SEQ ID NO: 106929 - DNA, 16 bp, H. sapiens
gccacactggtcttct

SEQ ID NO: 106930 - DNA, 16 bp, H. sapiens
gccacactgtattcca

SEQ ID NO: 106931 - DNA, 16 bp, H. sapiens
gccacactgtcttctg

SEQ ID NO: 106932 - DNA, 16 bp, H. sapiens
gccacagaagcagagc

SEQ ID NO: 106933 - DNA, 16 bp, H. sapiens
gccacagaagtggagc

SEQ ID NO: 106934 - DNA, 16 bp, H. sapiens
gccacagaagtttctg

SEQ ID NO: 106935 - DNA, 16 bp, H. sapiens
gccacagagcccagcc

SEQ ID NO: 106936 - DNA, 16 bp, H. sapiens
gccacagcaatcaggc

SEQ ID NO: 106937 - DNA, 16 bp, H. sapiens
gccacagcacccagca

SEQ ID NO: 106938 - DNA, 16 bp, H. sapiens
gccacagcatctggcc

SEQ ID NO: 106939 - DNA, 16 bp, H. sapiens
gccacagccaacatca

SEQ ID NO: 106940 - DNA, 16 bp, H. sapiens
gccacagccagctctg

SEQ ID NO: 106941 - DNA, 16 bp, H. sapiens
gccacagcccctggcc

SEQ ID NO: 106942 - DNA, 16 bp, H. sapiens
gccacagccctccagc

SEQ ID NO: 106943 - DNA, 16 bp, H. sapiens
gccacagcgcctggcc

SEQ ID NO: 106944 - DNA, 16 bp, H. sapiens
gccacagctcccagcc

SEQ ID NO: 106945 - DNA, 16 bp, H. sapiens
gccacagctcctggcc

SEQ ID NO: 106946 - DNA, 16 bp, H. sapiens
gccacagctcttctct

SEQ ID NO: 106947 - DNA, 16 bp, H. sapiens
gccacaggggcagagt

SEQ ID NO: 106948 - DNA, 16 bp, H. sapiens
gccacaggggtggggc

SEQ ID NO: 106949 - DNA, 16 bp, H. sapiens
gccacaggtggagctg

SEQ ID NO: 106950 - DNA, 16 bp, H. sapiens
gccacagtccccacca

SEQ ID NO: 106951 - DNA, 16 bp, H. sapiens
gccacagtgacttcca

SEQ ID NO: 106952 - DNA, 16 bp, H. sapiens
gccacagtggaaagca

SEQ ID NO: 106953 - DNA, 16 bp, H. sapiens
gccacatatctataac

SEQ ID NO: 106954 - DNA, 16 bp, H. sapiens
gccacatccattcatt

SEQ ID NO: 106955 - DNA, 16 bp, H. sapiens
gccacatgacttgctt

SEQ ID NO: 106956 - DNA, 16 bp, H. sapiens
gccacatggtctctgt

SEQ ID NO: 106957 - DNA, 16 bp, H. sapiens
gccacatggtgagacc

SEQ ID NO: 106958 - DNA, 16 bp, H. sapiens
gccacatgtagctact

SEQ ID NO: 106959 - DNA, 16 bp, H. sapiens
gccacatgtggctatt

SEQ ID NO: 106960 - DNA, 16 bp, H. sapiens
gccacattcacaggta

SEQ ID NO: 106961 - DNA, 18 bp, H. sapiens
gccacattggaagaagaa

SEQ ID NO: 106962 - DNA, 16 bp, H. sapiens
gccacatttctttttt

SEQ ID NO: 106963 - DNA, 16 bp, H. sapiens
gccaccaagcccagct

SEQ ID NO: 106964 - DNA, 16 bp, H. sapiens
gccaccaagccctgcc

SEQ ID NO: 106965 - DNA, 16 bp, H. sapiens
gccaccacaatcagct

SEQ ID NO: 106966 - DNA, 16 bp, H. sapiens
gccaccacacacggcc

SEQ ID NO: 106967 - DNA, 16 bp, H. sapiens
gccaccacaccaggct

SEQ ID NO: 106968 - DNA, 16 bp, H. sapiens
gccaccacacccaatt

SEQ ID NO: 106969 - DNA, 16 bp, H. sapiens
gccaccacacccggct

SEQ ID NO: 106970 - DNA, 16 bp, H. sapiens
gccaccacaccctggc

SEQ ID NO: 106971 - DNA, 16 bp, H. sapiens
gccaccacaccggcct

SEQ ID NO: 106972 - DNA, 16 bp, H. sapiens
gccaccacacctgcta

SEQ ID NO: 106973 - DNA, 16 bp, H. sapiens
gccaccacacctggct

SEQ ID NO: 106974 - DNA, 22 bp, H. sapiens
gccaccacacctggctaattct

SEQ ID NO: 106975 - DNA, 18 bp, H. sapiens
gccaccacacctggctat

SEQ ID NO: 106976 - DNA, 16 bp, H. sapiens
gccaccacactccagc

SEQ ID NO: 106977 - DNA, 16 bp, H. sapiens
gccaccacactcggct

SEQ ID NO: 106978 - DNA, 16 bp, H. sapiens
gccaccacagccagct

SEQ ID NO: 106979 - DNA, 16 bp, H. sapiens
gccaccacagctggcc

SEQ ID NO: 106980 - DNA, 16 bp, H. sapiens
gccaccacatgcagct

SEQ ID NO: 106981 - DNA, 16 bp, H. sapiens
gccaccaccaccatca

SEQ ID NO: 106982 - DNA, 16 bp, H. sapiens
gccaccaccactatga

SEQ ID NO: 106983 - DNA, 16 bp, H. sapiens
gccaccaccagaagct

SEQ ID NO: 106984 - DNA, 16 bp, H. sapiens
gccaccaccatgcctg

SEQ ID NO: 106985 - DNA, 16 bp, H. sapiens
gccaccaccccctgct

SEQ ID NO: 106986 - DNA, 16 bp, H. sapiens
gccaccacccctggct

SEQ ID NO: 106987 - DNA, 16 bp, H. sapiens
gccaccaccctcagct

SEQ ID NO: 106988 - DNA, 16 bp, H. sapiens
gccaccacctccagcc

SEQ ID NO: 106989 - DNA, 16 bp, H. sapiens
gccaccacctcccagg

SEQ ID NO: 106990 - DNA, 16 bp, H. sapiens
gccaccacgcacggct

SEQ ID NO: 106991 - DNA, 16 bp, H. sapiens
gccaccacgccagcct

SEQ ID NO: 106992 - DNA, 16 bp, H. sapiens
gccaccacgcccaggc

SEQ ID NO: 106993 - DNA, 16 bp, H. sapiens
gccaccacgcctagcc

SEQ ID NO: 106994 - DNA, 16 bp, H. sapiens
gccaccacgcctagct

SEQ ID NO: 106995 - DNA, 16 bp, H. sapiens
gccaccacgcctcgct

SEQ ID NO: 106996 - DNA, 18 bp, H. sapiens
gccaccacgcctggctag

SEQ ID NO: 106997 - DNA, 16 bp, H. sapiens
gccaccacgcgcagcc

SEQ ID NO: 106998 - DNA, 16 bp, H. sapiens
gccaccacgctgggcc

SEQ ID NO: 106999 - DNA, 21 bp, H. sapiens
gccaccacgcttggctaattt

SEQ ID NO: 107000 - DNA, 16 bp, H. sapiens
gccaccacgtctggct

SEQ ID NO: 107001 - DNA, 16 bp, H. sapiens
gccaccactccaggcc

SEQ ID NO: 107002 - DNA, 16 bp, H. sapiens
gccaccactcccaact

SEQ ID NO: 107003 - DNA, 16 bp, H. sapiens
gccaccactgctgctg

SEQ ID NO: 107004 - DNA, 16 bp, H. sapiens
gccaccagaaactgga

SEQ ID NO: 107005 - DNA, 16 bp, H. sapiens
gccaccagaagctgaa

SEQ ID NO: 107006 - DNA, 16 bp, H. sapiens
gccaccagacctggct

SEQ ID NO: 107007 - DNA, 16 bp, H. sapiens
gccaccagagggcgcc

SEQ ID NO: 107008 - DNA, 16 bp, H. sapiens
gccaccagccacatgg

SEQ ID NO: 107009 - DNA, 16 bp, H. sapiens
gccaccaggcccggct

SEQ ID NO: 107010 - DNA, 16 bp, H. sapiens
gccaccagtctcttta

SEQ ID NO: 107011 - DNA, 16 bp, H. sapiens
gccaccatacccagtt

SEQ ID NO: 107012 - DNA, 16 bp, H. sapiens
gccaccatatctggct

SEQ ID NO: 107013 - DNA, 16 bp, H. sapiens
gccaccatcatcacca

SEQ ID NO: 107014 - DNA, 16 bp, H. sapiens
gccaccatccccagcc

SEQ ID NO: 107015 - DNA, 16 bp, H. sapiens
gccaccatccccagct

SEQ ID NO: 107016 - DNA, 17 bp, H. sapiens
gccaccatccctggccc

SEQ ID NO: 107017 - DNA, 16 bp, H. sapiens
gccaccatcctccaga

SEQ ID NO: 107018 - DNA, 16 bp, H. sapiens
gccaccatgacaggct

SEQ ID NO: 107019 - DNA, 16 bp, H. sapiens
gccaccatgaccaact

SEQ ID NO: 107020 - DNA, 16 bp, H. sapiens
gccaccatgaccagcc

SEQ ID NO: 107021 - DNA, 16 bp, H. sapiens
gccaccatgccagacc

SEQ ID NO: 107022 - DNA, 16 bp, H. sapiens
gccaccatgccagtct

SEQ ID NO: 107023 - DNA, 16 bp, H. sapiens
gccaccatgcccagat

SEQ ID NO: 107024 - DNA, 16 bp, H. sapiens
gccaccatgccccacc

SEQ ID NO: 107025 - DNA, 17 bp, H. sapiens
gccaccatgcccgacta

SEQ ID NO: 107026 - DNA, 16 bp, H. sapiens
gccaccatgcccgcct

SEQ ID NO: 107027 - DNA, 16 bp, H. sapiens
gccaccatgcccggca

SEQ ID NO: 107028 - DNA, 16 bp, H. sapiens
gccaccatgcctggcc

SEQ ID NO: 107029 - DNA, 22 bp, H. sapiens
gccaccatgcctggctaatttc

SEQ ID NO: 107030 - DNA, 21 bp, H. sapiens
gccaccatgcctggctagttt

SEQ ID NO: 107031 - DNA, 18 bp, H. sapiens
gccaccatgcctggctgg

SEQ ID NO: 107032 - DNA, 16 bp, H. sapiens
gccaccatgctcaact

SEQ ID NO: 107033 - DNA, 16 bp, H. sapiens
gccaccatgctcagtc

SEQ ID NO: 107034 - DNA, 16 bp, H. sapiens
gccaccatgctggcct

SEQ ID NO: 107035 - DNA, 16 bp, H. sapiens
gccaccatgctgggcc

SEQ ID NO: 107036 - DNA, 16 bp, H. sapiens
gccaccatgcttgcct

SEQ ID NO: 107037 - DNA, 16 bp, H. sapiens
gccaccatgtcccgct

SEQ ID NO: 107038 - DNA, 16 bp, H. sapiens
gccaccatgtctgcct

SEQ ID NO: 107039 - DNA, 16 bp, H. sapiens
gccaccatgtgaagag

SEQ ID NO: 107040 - DNA, 16 bp, H. sapiens
gccaccatgtttggcc

SEQ ID NO: 107041 - DNA, 16 bp, H. sapiens
gccaccattctccaga

SEQ ID NO: 107042 - DNA, 16 bp, H. sapiens
gccacccaccttggcc

SEQ ID NO: 107043 - DNA, 16 bp, H. sapiens
gccacccagactgtgg

SEQ ID NO: 107044 - DNA, 16 bp, H. sapiens
gccacccagcctgtgg

SEQ ID NO: 107045 - DNA, 16 bp, H. sapiens
gccacccagctgagcc

SEQ ID NO: 107046 - DNA, 16 bp, H. sapiens
gccacccaggctgtgg

SEQ ID NO: 107047 - DNA, 16 bp, H. sapiens
gccaccccacccagct

SEQ ID NO: 107048 - DNA, 16 bp, H. sapiens
gccaccccacctggct

SEQ ID NO: 107049 - DNA, 16 bp, H. sapiens
gccaccccgcctggcc

SEQ ID NO: 107050 - DNA, 16 bp, H. sapiens
gccacccctgaaacag

SEQ ID NO: 107051 - DNA, 16 bp, H. sapiens
gccacccctttcccca

SEQ ID NO: 107052 - DNA, 16 bp, H. sapiens
gccacccgggttcaag

SEQ ID NO: 107053 - DNA, 16 bp, H. sapiens
gccaccctgccctgcc

SEQ ID NO: 107054 - DNA, 16 bp, H. sapiens
gccaccctgtgaagaa

SEQ ID NO: 107055 - DNA, 16 bp, H. sapiens
gccaccctgtgaagag

SEQ ID NO: 107056 - DNA, 16 bp, H. sapiens
gccacccttcttccca

SEQ ID NO: 107057 - DNA, 16 bp, H. sapiens
gccaccgcaccctgct

SEQ ID NO: 107058 - DNA, 16 bp, H. sapiens
gccaccgcccctggcc

SEQ ID NO: 107059 - DNA, 16 bp, H. sapiens
gccaccgcgcccagct

SEQ ID NO: 107060 - DNA, 16 bp, H. sapiens
gccaccgcgctccagc

SEQ ID NO: 107061 - DNA, 16 bp, H. sapiens
gccaccgcgtccagct

SEQ ID NO: 107062 - DNA, 16 bp, H. sapiens
gccaccgctcccggcc

SEQ ID NO: 107063 - DNA, 16 bp, H. sapiens
gccaccgcttccagcc

SEQ ID NO: 107064 - DNA, 16 bp, H. sapiens
gccaccggcctcagcc

SEQ ID NO: 107065 - DNA, 16 bp, H. sapiens
gccaccgggcccagct

SEQ ID NO: 107066 - DNA, 16 bp, H. sapiens
gccaccgggcctggct

SEQ ID NO: 107067 - DNA, 16 bp, H. sapiens
gccaccgtacccggct

SEQ ID NO: 107068 - DNA, 16 bp, H. sapiens
gccaccgtacctggct

SEQ ID NO: 107069 - DNA, 16 bp, H. sapiens
gccaccgtccctggcc

SEQ ID NO: 107070 - DNA, 16 bp, H. sapiens
gccaccgtgccaagcc

SEQ ID NO: 107071 - DNA, 16 bp, H. sapiens
gccaccgtgccctgcc

SEQ ID NO: 107072 - DNA, 16 bp, H. sapiens
gccaccgtgcctgact

SEQ ID NO: 107073 - DNA, 16 bp, H. sapiens
gccaccgtgcctggac

SEQ ID NO: 107074 - DNA, 16 bp, H. sapiens
gccaccgtgctggcca

SEQ ID NO: 107075 - DNA, 16 bp, H. sapiens
gccaccgtgctggcct

SEQ ID NO: 107076 - DNA, 16 bp, H. sapiens
gccaccgtgctgggct

SEQ ID NO: 107077 - DNA, 16 bp, H. sapiens
gccaccgtggccagcc

SEQ ID NO: 107078 - DNA, 17 bp, H. sapiens
gccaccgtgtccagcca

SEQ ID NO: 107079 - DNA, 16 bp, H. sapiens
gccaccgtgtccagct

SEQ ID NO: 107080 - DNA, 16 bp, H. sapiens
gccacctacaagccaa

SEQ ID NO: 107081 - DNA, 16 bp, H. sapiens
gccacctaggctggag

SEQ ID NO: 107082 - DNA, 16 bp, H. sapiens
gccacctaggttcaag

SEQ ID NO: 107083 - DNA, 16 bp, H. sapiens
gccacctccacctcca

SEQ ID NO: 107084 - DNA, 16 bp, H. sapiens
gccacctccacctcct

SEQ ID NO: 107085 - DNA, 16 bp, H. sapiens
gccacctcccaccagg

SEQ ID NO: 107086 - DNA, 16 bp, H. sapiens
gccacctccgcctcct

SEQ ID NO: 107087 - DNA, 16 bp, H. sapiens
gccacctcctccaaga

SEQ ID NO: 107088 - DNA, 16 bp, H. sapiens
gccacctcctctgaga

SEQ ID NO: 107089 - DNA, 16 bp, H. sapiens
gccacctcgcccagcc

SEQ ID NO: 107090 - DNA, 16 bp, H. sapiens
gccacctcgcccggcc

SEQ ID NO: 107091 - DNA, 16 bp, H. sapiens
gccacctcgcctggcc

SEQ ID NO: 107092 - DNA, 16 bp, H. sapiens
gccacctctgcctcca

SEQ ID NO: 107093 - DNA, 16 bp, H. sapiens
gccacctctgcctctg

SEQ ID NO: 107094 - DNA, 18 bp, H. sapiens
gccacctgcctcggcctc

SEQ ID NO: 107095 - DNA, 16 bp, H. sapiens
gccacctgcctggcct

SEQ ID NO: 107096 - DNA, 16 bp, H. sapiens
gccacctgctgattat

SEQ ID NO: 107097 - DNA, 16 bp, H. sapiens
gccacctggaggcttc

SEQ ID NO: 107098 - DNA, 16 bp, H. sapiens
gccacctgggttcaag

SEQ ID NO: 107099 - DNA, 16 bp, H. sapiens
gccaccttcacctgga

SEQ ID NO: 107100 - DNA, 16 bp, H. sapiens
gccaccttcatcaatg

SEQ ID NO: 107101 - DNA, 16 bp, H. sapiens
gccaccttgcccagcc

SEQ ID NO: 107102 - DNA, 16 bp, H. sapiens
gccaccttggcacaaa

SEQ ID NO: 107103 - DNA, 16 bp, H. sapiens
gccacgcccagctaat

SEQ ID NO: 107104 - DNA, 17 bp, H. sapiens
gccacgcctggctaatt

SEQ ID NO: 107105 - DNA, 16 bp, H. sapiens
gccacggcactccagc

SEQ ID NO: 107106 - DNA, 16 bp, H. sapiens
gccacggcgccctgcc

SEQ ID NO: 107107 - DNA, 16 bp, H. sapiens
gccacggtgcccagca

SEQ ID NO: 107108 - DNA, 16 bp, H. sapiens
gccactaagtttgtga

SEQ ID NO: 107109 - DNA, 16 bp, H. sapiens
gccactacaccaggct

SEQ ID NO: 107110 - DNA, 16 bp, H. sapiens
gccactacacccagct

SEQ ID NO: 107111 - DNA, 16 bp, H. sapiens
gccactacattccagc

SEQ ID NO: 107112 - DNA, 16 bp, H. sapiens
gccactacccccggct

SEQ ID NO: 107113 - DNA, 16 bp, H. sapiens
gccactactcccagcc

SEQ ID NO: 107114 - DNA, 16 bp, H. sapiens
gccactagccacatga

SEQ ID NO: 107115 - DNA, 16 bp, H. sapiens
gccactatgcccggct

SEQ ID NO: 107116 - DNA, 16 bp, H. sapiens
gccactatgccctgcc

SEQ ID NO: 107117 - DNA, 16 bp, H. sapiens
gccactccacctggcc

SEQ ID NO: 107118 - DNA, 16 bp, H. sapiens
gccactgaaccccagc

SEQ ID NO: 107119 - DNA, 16 bp, H. sapiens
gccactgagcccggcc

SEQ ID NO: 107120 - DNA, 16 bp, H. sapiens
gccactgagctcagcc

SEQ ID NO: 107121 - DNA, 16 bp, H. sapiens
gccactgaggaggctg

SEQ ID NO: 107122 - DNA, 16 bp, H. sapiens
gccactgcaaccagcc

SEQ ID NO: 107123 - DNA, 16 bp, H. sapiens
gccactgcacactcca

SEQ ID NO: 107124 - DNA, 16 bp, H. sapiens
gccactgcacccggcc

SEQ ID NO: 107125 - DNA, 16 bp, H. sapiens
gccactgcaccctagc

SEQ ID NO: 107126 - DNA, 16 bp, H. sapiens
gccactgcacctgggc

SEQ ID NO: 107127 - DNA, 16 bp, H. sapiens
gccactgcacgtggcc

SEQ ID NO: 107128 - DNA, 18 bp, H. sapiens
gccactgcactacagcct

SEQ ID NO: 107129 - DNA, 16 bp, H. sapiens
gccactgcactcagcc

SEQ ID NO: 107130 - DNA, 19 bp, H. sapiens
gccactgcactccagccta

SEQ ID NO: 107131 - DNA, 18 bp, H. sapiens
gccactgcactccagctc

SEQ ID NO: 107132 - DNA, 17 bp, H. sapiens
gccactgcactccagtg

SEQ ID NO: 107133 - DNA, 16 bp, H. sapiens
gccactgcactctggt

SEQ ID NO: 107134 - DNA, 16 bp, H. sapiens
gccactgcactggagc

SEQ ID NO: 107135 - DNA, 16 bp, H. sapiens
gccactgcactgggct

SEQ ID NO: 107136 - DNA, 16 bp, H. sapiens
gccactgcacttggca

SEQ ID NO: 107137 - DNA, 16 bp, H. sapiens
gccactgcagcctggg

SEQ ID NO: 107138 - DNA, 16 bp, H. sapiens
gccactgcagttcagc

SEQ ID NO: 107139 - DNA, 21 bp, H. sapiens
gccactgcattccagcctgga

SEQ ID NO: 107140 - DNA, 16 bp, H. sapiens
gccactgccaccccag

SEQ ID NO: 107141 - DNA, 16 bp, H. sapiens
gccactgccactccag

SEQ ID NO: 107142 - DNA, 16 bp, H. sapiens
gccactgcccagcctg

SEQ ID NO: 107143 - DNA, 16 bp, H. sapiens
gccactgcccccggcc

SEQ ID NO: 107144 - DNA, 16 bp, H. sapiens
gccactgcctctggcc

SEQ ID NO: 107145 - DNA, 16 bp, H. sapiens
gccactgcgcccagct

SEQ ID NO: 107146 - DNA, 16 bp, H. sapiens
gccactgcgcccaggc

SEQ ID NO: 107147 - DNA, 16 bp, H. sapiens
gccactgcgcccatcc

SEQ ID NO: 107148 - DNA, 16 bp, H. sapiens
gccactgcgcccggct

SEQ ID NO: 107149 - DNA, 16 bp, H. sapiens
gccactgcgcctgacc

SEQ ID NO: 107150 - DNA, 17 bp, H. sapiens
gccactgcgcctggcct

SEQ ID NO: 107151 - DNA, 16 bp, H. sapiens
gccactgcgtctggca

SEQ ID NO: 107152 - DNA, 16 bp, H. sapiens
gccactgctcccagtc

SEQ ID NO: 107153 - DNA, 16 bp, H. sapiens
gccactgctcctggcc

SEQ ID NO: 107154 - DNA, 16 bp, H. sapiens
gccactgctctcttca

SEQ ID NO: 107155 - DNA, 16 bp, H. sapiens
gccactgctcttcagc

SEQ ID NO: 107156 - DNA, 16 bp, H. sapiens
gccactgctgcactcc

SEQ ID NO: 107157 - DNA, 16 bp, H. sapiens
gccactgctgcagccc

SEQ ID NO: 107158 - DNA, 16 bp, H. sapiens
gccactgctgccatca

SEQ ID NO: 107159 - DNA, 16 bp, H. sapiens
gccactgctgctgcca

SEQ ID NO: 107160 - DNA, 16 bp, H. sapiens
gccactgctgctggca

SEQ ID NO: 107161 - DNA, 16 bp, H. sapiens
gccactgctggcctca

SEQ ID NO: 107162 - DNA, 16 bp, H. sapiens
gccactggcactccag

SEQ ID NO: 107163 - DNA, 16 bp, H. sapiens
gccactggcctccagc

SEQ ID NO: 107164 - DNA, 16 bp, H. sapiens
gccactgggccctgcc

SEQ ID NO: 107165 - DNA, 16 bp, H. sapiens
gccactgggctcagcc

SEQ ID NO: 107166 - DNA, 16 bp, H. sapiens
gccactggtgtaagtc

SEQ ID NO: 107167 - DNA, 16 bp, H. sapiens
gccactgtacctgacc

SEQ ID NO: 107168 - DNA, 20 bp, H. sapiens
gccactgtactccagcctga

SEQ ID NO: 107169 - DNA, 16 bp, H. sapiens
gccactgtccccagcc

SEQ ID NO: 107170 - DNA, 16 bp, H. sapiens
gccactgtccccggcc

SEQ ID NO: 107171 - DNA, 16 bp, H. sapiens
gccactgtccctggcc

SEQ ID NO: 107172 - DNA, 16 bp, H. sapiens
gccactgtcctccaga

SEQ ID NO: 107173 - DNA, 16 bp, H. sapiens
gccactgtgcccaccc

SEQ ID NO: 107174 - DNA, 16 bp, H. sapiens
gccactgtgcccagct

SEQ ID NO: 107175 - DNA, 16 bp, H. sapiens
gccactgtgcccatcc

SEQ ID NO: 107176 - DNA, 16 bp, H. sapiens
gccactgtgccccacc

SEQ ID NO: 107177 - DNA, 16 bp, H. sapiens
gccactgtgccctacc

SEQ ID NO: 107178 - DNA, 16 bp, H. sapiens
gccactgtgctggcca

SEQ ID NO: 107179 - DNA, 16 bp, H. sapiens
gccactgtgctggctg

SEQ ID NO: 107180 - DNA, 16 bp, H. sapiens
gccactgtggaaacag

SEQ ID NO: 107181 - DNA, 16 bp, H. sapiens
gccactgtggccagct

SEQ ID NO: 107182 - DNA, 16 bp, H. sapiens
gccactgtggctggcc

SEQ ID NO: 107183 - DNA, 16 bp, H. sapiens
gccactgttcccagcc

SEQ ID NO: 107184 - DNA, 16 bp, H. sapiens
gccactgttcctggcc

SEQ ID NO: 107185 - DNA, 16 bp, H. sapiens
gccacttaccagctgt

SEQ ID NO: 107186 - DNA, 16 bp, H. sapiens
gccacttactacctgt

SEQ ID NO: 107187 - DNA, 16 bp, H. sapiens
gccacttcacccagcc

SEQ ID NO: 107188 - DNA, 16 bp, H. sapiens
gccacttcattccagc

SEQ ID NO: 107189 - DNA, 16 bp, H. sapiens
gccactttcatcagca

SEQ ID NO: 107190 - DNA, 16 bp, H. sapiens
gccactttcctcttct

SEQ ID NO: 107191 - DNA, 16 bp, H. sapiens
gccagaaaaggcaagg

SEQ ID NO: 107192 - DNA, 16 bp, H. sapiens
gccagaagaatcactt

SEQ ID NO: 107193 - DNA, 16 bp, H. sapiens
gccagaagacagaaac

SEQ ID NO: 107194 - DNA, 16 bp, H. sapiens
gccagaagagaacctg

SEQ ID NO: 107195 - DNA, 16 bp, H. sapiens
gccagaagcccctctc

SEQ ID NO: 107196 - DNA, 16 bp, H. sapiens
gccagaatgcactgtt

SEQ ID NO: 107197 - DNA, 16 bp, H. sapiens
gccagacatggtggct

SEQ ID NO: 107198 - DNA, 16 bp, H. sapiens
gccagacattgtgcta

SEQ ID NO: 107199 - DNA, 16 bp, H. sapiens
gccagacccagggccc

SEQ ID NO: 107200 - DNA, 16 bp, H. sapiens
gccagaccccatctct

SEQ ID NO: 107201 - DNA, 16 bp, H. sapiens
gccagactgcctgggc

SEQ ID NO: 107202 - DNA, 16 bp, H. sapiens
gccagactgcctgggt

SEQ ID NO: 107203 - DNA, 16 bp, H. sapiens
gccagactggcctcaa

SEQ ID NO: 107204 - DNA, 16 bp, H. sapiens
gccagagaaggagaaa

SEQ ID NO: 107205 - DNA, 16 bp, H. sapiens
gccagagagagagaga

SEQ ID NO: 107206 - DNA, 16 bp, H. sapiens
gccagagcagaaggaa

SEQ ID NO: 107207 - DNA, 16 bp, H. sapiens
gccagagcagctggga

SEQ ID NO: 107208 - DNA, 16 bp, H. sapiens
gccagagcagggctgg

SEQ ID NO: 107209 - DNA, 16 bp, H. sapiens
gccagagcatcaagaa

SEQ ID NO: 107210 - DNA, 16 bp, H. sapiens
gccagagccagagcca

SEQ ID NO: 107211 - DNA, 16 bp, H. sapiens
gccagagcccaggcag

SEQ ID NO: 107212 - DNA, 16 bp, H. sapiens
gccagagctgggcctg

SEQ ID NO: 107213 - DNA, 16 bp, H. sapiens
gccagaggagcagggg

SEQ ID NO: 107214 - DNA, 16 bp, H. sapiens
gccagaggctatgctt

SEQ ID NO: 107215 - DNA, 16 bp, H. sapiens
gccagaggctggggag

SEQ ID NO: 107216 - DNA, 16 bp, H. sapiens
gccagagggaagccca

SEQ ID NO: 107217 - DNA, 16 bp, H. sapiens
gccagaggtgagagct

SEQ ID NO: 107218 - DNA, 16 bp, H. sapiens
gccagaggtggtggtg

SEQ ID NO: 107219 - DNA, 16 bp, H. sapiens
gccagagtgacagagc

SEQ ID NO: 107220 - DNA, 16 bp, H. sapiens
gccagagtgagactcc

SEQ ID NO: 107221 - DNA, 16 bp, H. sapiens
gccagatatggtggtg

SEQ ID NO: 107222 - DNA, 16 bp, H. sapiens
gccagatcacctgagg

SEQ ID NO: 107223 - DNA, 16 bp, H. sapiens
gccagatgcggtggct

SEQ ID NO: 107224 - DNA, 16 bp, H. sapiens
gccagatgtcccctgg

SEQ ID NO: 107225 - DNA, 16 bp, H. sapiens
gccagatttagcaaaa

SEQ ID NO: 107226 - DNA, 16 bp, H. sapiens
gccagatttatgtttc

SEQ ID NO: 107227 - DNA, 16 bp, H. sapiens
gccagcaagggcaaag

SEQ ID NO: 107228 - DNA, 16 bp, H. sapiens
gccagcaagttttatt

SEQ ID NO: 107229 - DNA, 16 bp, H. sapiens
gccagcacacctggct

SEQ ID NO: 107230 - DNA, 16 bp, H. sapiens
gccagcacagcagcag

SEQ ID NO: 107231 - DNA, 16 bp, H. sapiens
gccagcacagtgctgg

SEQ ID NO: 107232 - DNA, 17 bp, H. sapiens
gccagcactctgggagg

SEQ ID NO: 107233 - DNA, 16 bp, H. sapiens
gccagcactgtgcttc

SEQ ID NO: 107234 - DNA, 16 bp, H. sapiens
gccagcactttgggaa

SEQ ID NO: 107235 - DNA, 16 bp, H. sapiens
gccagcactttgggag

SEQ ID NO: 107236 - DNA, 16 bp, H. sapiens
gccagcagaagcaggg

SEQ ID NO: 107237 - DNA, 16 bp, H. sapiens
gccagcagcagcagca

SEQ ID NO: 107238 - DNA, 16 bp, H. sapiens
gccagcagccaccaga

SEQ ID NO: 107239 - DNA, 16 bp, H. sapiens
gccagcagccagcagc

SEQ ID NO: 107240 - DNA, 16 bp, H. sapiens
gccagcagtgctgggg

SEQ ID NO: 107241 - DNA, 16 bp, H. sapiens
gccagcagtggcagtg

SEQ ID NO: 107242 - DNA, 16 bp, H. sapiens
gccagcatcatcatga

SEQ ID NO: 107243 - DNA, 16 bp, H. sapiens
gccagcatctgttact

SEQ ID NO: 107244 - DNA, 16 bp, H. sapiens
gccagcattatcttga

SEQ ID NO: 107245 - DNA, 16 bp, H. sapiens
gccagcatttgctatt

SEQ ID NO: 107246 - DNA, 16 bp, H. sapiens
gccagccacccagcca

SEQ ID NO: 107247 - DNA, 16 bp, H. sapiens
gccagccagccagcca

SEQ ID NO: 107248 - DNA, 16 bp, H. sapiens
gccagccagccaggca

SEQ ID NO: 107249 - DNA, 16 bp, H. sapiens
gccagccagggcaaca

SEQ ID NO: 107250 - DNA, 16 bp, H. sapiens
gccagccatgaaagca

SEQ ID NO: 107251 - DNA, 16 bp, H. sapiens
gccagccatggtggtg

SEQ ID NO: 107252 - DNA, 16 bp, H. sapiens
gccagcccagcccagc

SEQ ID NO: 107253 - DNA, 16 bp, H. sapiens
gccagccccaggctct

SEQ ID NO: 107254 - DNA, 16 bp, H. sapiens
gccagccccctgccac

SEQ ID NO: 107255 - DNA, 16 bp, H. sapiens
gccagcccctccacac

SEQ ID NO: 107256 - DNA, 22 bp, H. sapiens
gccagccgccccgtccgggagg

SEQ ID NO: 107257 - DNA, 16 bp, H. sapiens
gccagccgccccttcc

SEQ ID NO: 107258 - DNA, 22 bp, H. sapiens
gccagccgccctgtccgggagg

SEQ ID NO: 107259 - DNA, 16 bp, H. sapiens
gccagcctaggcaaca

SEQ ID NO: 107260 - DNA, 16 bp, H. sapiens
gccagcctcagcctcc

SEQ ID NO: 107261 - DNA, 16 bp, H. sapiens
gccagcctcagcctct

SEQ ID NO: 107262 - DNA, 16 bp, H. sapiens
gccagcctccaagatg

SEQ ID NO: 107263 - DNA, 24 bp, H. sapiens
gccagcctgaccaacatggtgaaa

SEQ ID NO: 107264 - DNA, 18 bp, H. sapiens
gccagcctgagcaacata

SEQ ID NO: 107265 - DNA, 16 bp, H. sapiens
gccagcctgcctctgt

SEQ ID NO: 107266 - DNA, 16 bp, H. sapiens
gccagcctggacaaca

SEQ ID NO: 107267 - DNA, 28 bp, H. sapiens
gccagcctggccaacatggtgaaacccc

SEQ ID NO: 107268 - DNA, 16 bp, H. sapiens
gccagcctgggccaca

SEQ ID NO: 107269 - DNA, 16 bp, H. sapiens
gccagccttggtctcc

SEQ ID NO: 107270 - DNA, 16 bp, H. sapiens
gccagcgtggtggctc

SEQ ID NO: 107271 - DNA, 16 bp, H. sapiens
gccagctatctcagca

SEQ ID NO: 107272 - DNA, 16 bp, H. sapiens
gccagctctcttcctg

SEQ ID NO: 107273 - DNA, 16 bp, H. sapiens
gccagctctgcgtgaa

SEQ ID NO: 107274 - DNA, 16 bp, H. sapiens
gccagctgccctgtcc

SEQ ID NO: 107275 - DNA, 16 bp, H. sapiens
gccagctggacttcct

SEQ ID NO: 107276 - DNA, 16 bp, H. sapiens
gccagctgggcgtggt

SEQ ID NO: 107277 - DNA, 16 bp, H. sapiens
gccagctgtgtggcct

SEQ ID NO: 107278 - DNA, 16 bp, H. sapiens
gccagcttggtccaca

SEQ ID NO: 107279 - DNA, 16 bp, H. sapiens
gccaggaaaagcttcc

SEQ ID NO: 107280 - DNA, 16 bp, H. sapiens
gccaggaaagcatgca

SEQ ID NO: 107281 - DNA, 16 bp, H. sapiens
gccaggaaccacagag

SEQ ID NO: 107282 - DNA, 16 bp, H. sapiens
gccaggaaggttgagg

SEQ ID NO: 107283 - DNA, 16 bp, H. sapiens
gccaggaattcaagaa

SEQ ID NO: 107284 - DNA, 16 bp, H. sapiens
gccaggactcaaaccc

SEQ ID NO: 107285 - DNA, 16 bp, H. sapiens
gccaggactgggttct

SEQ ID NO: 107286 - DNA, 16 bp, H. sapiens
gccaggagagcagcag

SEQ ID NO: 107287 - DNA, 16 bp, H. sapiens
gccaggagcagtggct

SEQ ID NO: 107288 - DNA, 16 bp, H. sapiens
gccaggagctggagga

SEQ ID NO: 107289 - DNA, 16 bp, H. sapiens
gccaggaggagggctg

SEQ ID NO: 107290 - DNA, 16 bp, H. sapiens
gccaggaggcagaggc

SEQ ID NO: 107291 - DNA, 16 bp, H. sapiens
gccaggaggcggaggt

SEQ ID NO: 107292 - DNA, 16 bp, H. sapiens
gccaggaggctggagc

SEQ ID NO: 107293 - DNA, 16 bp, H. sapiens
gccaggagggaggctg

SEQ ID NO: 107294 - DNA, 16 bp, H. sapiens
gccaggagggtctcca

SEQ ID NO: 107295 - DNA, 16 bp, H. sapiens
gccaggaggtggaggt

SEQ ID NO: 107296 - DNA, 16 bp, H. sapiens
gccaggagtagtggct

SEQ ID NO: 107297 - DNA, 16 bp, H. sapiens
gccaggagtggtgaca

SEQ ID NO: 107298 - DNA, 16 bp, H. sapiens
gccaggagtggtgact

SEQ ID NO: 107299 - DNA, 19 bp, H. sapiens
gccaggagtttgagaccat

SEQ ID NO: 107300 - DNA, 17 bp, H. sapiens
gccaggatagtctcgat

SEQ ID NO: 107301 - DNA, 16 bp, H. sapiens
gccaggatcacaggca

SEQ ID NO: 107302 - DNA, 16 bp, H. sapiens
gccaggatggcctcaa

SEQ ID NO: 107303 - DNA, 16 bp, H. sapiens
gccaggatggctttga

SEQ ID NO: 107304 - DNA, 16 bp, H. sapiens
gccaggatttgaactt

SEQ ID NO: 107305 - DNA, 16 bp, H. sapiens
gccaggcacagtggct

SEQ ID NO: 107306 - DNA, 16 bp, H. sapiens
gccaggcactgaggat

SEQ ID NO: 107307 - DNA, 16 bp, H. sapiens
gccaggcactgcactg

SEQ ID NO: 107308 - DNA, 16 bp, H. sapiens
gccaggcactgccctg

SEQ ID NO: 107309 - DNA, 16 bp, H. sapiens
gccaggcactgctcca

SEQ ID NO: 107310 - DNA, 16 bp, H. sapiens
gccaggcactgggcca

SEQ ID NO: 107311 - DNA, 16 bp, H. sapiens
gccaggcactgtggct

SEQ ID NO: 107312 - DNA, 16 bp, H. sapiens
gccaggcagagagaga

SEQ ID NO: 107313 - DNA, 16 bp, H. sapiens
gccaggcaggacagag

SEQ ID NO: 107314 - DNA, 16 bp, H. sapiens
gccaggcaggagccag

SEQ ID NO: 107315 - DNA, 16 bp, H. sapiens
gccaggcaggaggcag

SEQ ID NO: 107316 - DNA, 16 bp, H. sapiens
gccaggcaggcccagg

SEQ ID NO: 107317 - DNA, 16 bp, H. sapiens
gccaggcaggcctggg

SEQ ID NO: 107318 - DNA, 16 bp, H. sapiens
gccaggcaggtggctc

SEQ ID NO: 107319 - DNA, 16 bp, H. sapiens
gccaggcatgctggct

SEQ ID NO: 107320 - DNA, 16 bp, H. sapiens
gccaggcatggcggca

SEQ ID NO: 107321 - DNA, 16 bp, H. sapiens
gccaggcatggtgctg

SEQ ID NO: 107322 - DNA, 16 bp, H. sapiens
gccaggccaagccagg

SEQ ID NO: 107323 - DNA, 16 bp, H. sapiens
gccaggccagccaccc

SEQ ID NO: 107324 - DNA, 16 bp, H. sapiens
gccaggccaggcaggg

SEQ ID NO: 107325 - DNA, 16 bp, H. sapiens
gccaggccaggcatgg

SEQ ID NO: 107326 - DNA, 16 bp, H. sapiens
gccaggccaggccagg

SEQ ID NO: 107327 - DNA, 16 bp, H. sapiens
gccaggccaggcgcag

SEQ ID NO: 107328 - DNA, 16 bp, H. sapiens
gccaggcccagccctg

SEQ ID NO: 107329 - DNA, 16 bp, H. sapiens
gccaggcccaggctgg

SEQ ID NO: 107330 - DNA, 16 bp, H. sapiens
gccaggcccagggcct

SEQ ID NO: 107331 - DNA, 16 bp, H. sapiens
gccaggcccagggctc

SEQ ID NO: 107332 - DNA, 16 bp, H. sapiens
gccaggccctgcccct

SEQ ID NO: 107333 - DNA, 16 bp, H. sapiens
gccaggccctgccctc

SEQ ID NO: 107334 - DNA, 16 bp, H. sapiens
gccaggccctgtgctg

SEQ ID NO: 107335 - DNA, 16 bp, H. sapiens
gccaggccctgtggct

SEQ ID NO: 107336 - DNA, 16 bp, H. sapiens
gccaggcctcctcttc

SEQ ID NO: 107337 - DNA, 16 bp, H. sapiens
gccaggcctggccctg

SEQ ID NO: 107338 - DNA, 16 bp, H. sapiens
gccaggcctggggccc

SEQ ID NO: 107339 - DNA, 16 bp, H. sapiens
gccaggcctggggctg

SEQ ID NO: 107340 - DNA, 16 bp, H. sapiens
gccaggcctggtgatg

SEQ ID NO: 107341 - DNA, 16 bp, H. sapiens
gccaggcctggtgcca

SEQ ID NO: 107342 - DNA, 16 bp, H. sapiens
gccaggcctggtgctg

SEQ ID NO: 107343 - DNA, 16 bp, H. sapiens
gccaggcctggtggct

SEQ ID NO: 107344 - DNA, 16 bp, H. sapiens
gccaggcctggtggtg

SEQ ID NO: 107345 - DNA, 16 bp, H. sapiens
gccaggcctgtcttga

SEQ ID NO: 107346 - DNA, 16 bp, H. sapiens
gccaggcctgtgtcct

SEQ ID NO: 107347 - DNA, 16 bp, H. sapiens
gccaggcgcagtgact

SEQ ID NO: 107348 - DNA, 18 bp, H. sapiens
gccaggcgcggtgactca

SEQ ID NO: 107349 - DNA, 16 bp, H. sapiens
gccaggcgtagtggct

SEQ ID NO: 107350 - DNA, 16 bp, H. sapiens
gccaggcgtggtggct

SEQ ID NO: 107351 - DNA, 16 bp, H. sapiens
gccaggctaatgtttt

SEQ ID NO: 107352 - DNA, 16 bp, H. sapiens
gccaggctagagtgca

SEQ ID NO: 107353 - DNA, 16 bp, H. sapiens
gccaggctccatctca

SEQ ID NO: 107354 - DNA, 16 bp, H. sapiens
gccaggctcctgggga

SEQ ID NO: 107355 - DNA, 16 bp, H. sapiens
gccaggctctgtgctg

SEQ ID NO: 107356 - DNA, 16 bp, H. sapiens
gccaggctctgtgctt

SEQ ID NO: 107357 - DNA, 16 bp, H. sapiens
gccaggctctgtggct

SEQ ID NO: 107358 - DNA, 16 bp, H. sapiens
gccaggctgacctcag

SEQ ID NO: 107359 - DNA, 16 bp, H. sapiens
gccaggctgagaattt

SEQ ID NO: 107360 - DNA, 17 bp, H. sapiens
gccaggctgatctcaag

SEQ ID NO: 107361 - DNA, 16 bp, H. sapiens
gccaggctgatgtcga

SEQ ID NO: 107362 - DNA, 16 bp, H. sapiens
gccaggctggagtaca

SEQ ID NO: 107363 - DNA, 16 bp, H. sapiens
gccaggctggagtcca

SEQ ID NO: 107364 - DNA, 16 bp, H. sapiens
gccaggctggagtgca

SEQ ID NO: 107365 - DNA, 36 bp, H. sapiens
gccaggctggagtgcagtggcgcgatctcggctcac

SEQ ID NO: 107366 - DNA, 21 bp, H. sapiens
gccaggctggagtgcagtggt

SEQ ID NO: 107367 - DNA, 16 bp, H. sapiens
gccaggctgggcaaca

SEQ ID NO: 107368 - DNA, 16 bp, H. sapiens
gccaggctgggcacgg

SEQ ID NO: 107369 - DNA, 16 bp, H. sapiens
gccaggctgggccagg

SEQ ID NO: 107370 - DNA, 16 bp, H. sapiens
gccaggctggggaggg

SEQ ID NO: 107371 - DNA, 16 bp, H. sapiens
gccaggctggggcccc

SEQ ID NO: 107372 - DNA, 16 bp, H. sapiens
gccaggctgggggagg

SEQ ID NO: 107373 - DNA, 16 bp, H. sapiens
gccaggctggggtgca

SEQ ID NO: 107374 - DNA, 16 bp, H. sapiens
gccaggctggggtggg

SEQ ID NO: 107375 - DNA, 17 bp, H. sapiens
gccaggctggtctcaag

SEQ ID NO: 107376 - DNA, 16 bp, H. sapiens
gccaggctggtttcca

SEQ ID NO: 107377 - DNA, 16 bp, H. sapiens
gccagggaagcagagg

SEQ ID NO: 107378 - DNA, 16 bp, H. sapiens
gccagggaccccaccc

SEQ ID NO: 107379 - DNA, 16 bp, H. sapiens
gccagggaccctgccc

SEQ ID NO: 107380 - DNA, 16 bp, H. sapiens
gccagggagacagagc

SEQ ID NO: 107381 - DNA, 16 bp, H. sapiens
gccagggagacagagt

SEQ ID NO: 107382 - DNA, 16 bp, H. sapiens
gccagggaggggctgg

SEQ ID NO: 107383 - DNA, 16 bp, H. sapiens
gccagggaggtggaag

SEQ ID NO: 107384 - DNA, 16 bp, H. sapiens
gccagggagtcaagtg

SEQ ID NO: 107385 - DNA, 16 bp, H. sapiens
gccagggagttcaagg

SEQ ID NO: 107386 - DNA, 16 bp, H. sapiens
gccagggagttgctgg

SEQ ID NO: 107387 - DNA, 16 bp, H. sapiens
gccagggatgctgctg

SEQ ID NO: 107388 - DNA, 16 bp, H. sapiens
gccagggatggtggct

SEQ ID NO: 107389 - DNA, 16 bp, H. sapiens
gccagggcagggcagg

SEQ ID NO: 107390 - DNA, 16 bp, H. sapiens
gccagggccagggcag

SEQ ID NO: 107391 - DNA, 16 bp, H. sapiens
gccagggccagggcct

SEQ ID NO: 107392 - DNA, 16 bp, H. sapiens
gccagggccagggtcc

SEQ ID NO: 107393 - DNA, 16 bp, H. sapiens
gccagggcctggtgcc

SEQ ID NO: 107394 - DNA, 16 bp, H. sapiens
gccagggctctgacac

SEQ ID NO: 107395 - DNA, 16 bp, H. sapiens
gccagggctggggagg

SEQ ID NO: 107396 - DNA, 16 bp, H. sapiens
gccagggctggtctca

SEQ ID NO: 107397 - DNA, 16 bp, H. sapiens
gccaggggcagtggct

SEQ ID NO: 107398 - DNA, 16 bp, H. sapiens
gccaggggctgcaggg

SEQ ID NO: 107399 - DNA, 16 bp, H. sapiens
gccaggggctggaggg

SEQ ID NO: 107400 - DNA, 16 bp, H. sapiens
gccaggggctggggga

SEQ ID NO: 107401 - DNA, 16 bp, H. sapiens
gccaggggctgggggc

SEQ ID NO: 107402 - DNA, 16 bp, H. sapiens
gccaggggctgggtgg

SEQ ID NO: 107403 - DNA, 16 bp, H. sapiens
gccaggggctgtgggg

SEQ ID NO: 107404 - DNA, 16 bp, H. sapiens
gccagggtgacagtgc

SEQ ID NO: 107405 - DNA, 16 bp, H. sapiens
gccagggtggtcttga

SEQ ID NO: 107406 - DNA, 16 bp, H. sapiens
gccaggtaaaatacag

SEQ ID NO: 107407 - DNA, 16 bp, H. sapiens
gccaggtatagtggct

SEQ ID NO: 107408 - DNA, 16 bp, H. sapiens
gccaggtatggtggct

SEQ ID NO: 107409 - DNA, 16 bp, H. sapiens
gccaggtattatgcta

SEQ ID NO: 107410 - DNA, 16 bp, H. sapiens
gccaggtcctgtgcta

SEQ ID NO: 107411 - DNA, 16 bp, H. sapiens
gccaggtgaggccagg

SEQ ID NO: 107412 - DNA, 16 bp, H. sapiens
gccaggtgcagtagct

SEQ ID NO: 107413 - DNA, 16 bp, H. sapiens
gccaggtgcagtggtg

SEQ ID NO: 107414 - DNA, 16 bp, H. sapiens
gccaggtgccatggct

SEQ ID NO: 107415 - DNA, 16 bp, H. sapiens
gccaggtgccctggct

SEQ ID NO: 107416 - DNA, 16 bp, H. sapiens
gccaggtgcctgtagt

SEQ ID NO: 107417 - DNA, 16 bp, H. sapiens
gccaggtgcggcagct

SEQ ID NO: 107418 - DNA, 16 bp, H. sapiens
gccaggtgcggcggct

SEQ ID NO: 107419 - DNA, 16 bp, H. sapiens
gccaggtgctgtggct

SEQ ID NO: 107420 - DNA, 16 bp, H. sapiens
gccaggtggtggctca

SEQ ID NO: 107421 - DNA, 16 bp, H. sapiens
gccaggtgtgatagca

SEQ ID NO: 107422 - DNA, 16 bp, H. sapiens
gccaggtgtggctggg

SEQ ID NO: 107423 - DNA, 16 bp, H. sapiens
gccaggtgtggtgggg

SEQ ID NO: 107424 - DNA, 16 bp, H. sapiens
gccaggtgtgtggtgg

SEQ ID NO: 107425 - DNA, 16 bp, H. sapiens
gccaggtgtgtgtgtg

SEQ ID NO: 107426 - DNA, 16 bp, H. sapiens
gccaggttggtcttga

SEQ ID NO: 107427 - DNA, 16 bp, H. sapiens
gccaggtttcccagca

SEQ ID NO: 107428 - DNA, 16 bp, H. sapiens
gccagtaatcccagct

SEQ ID NO: 107429 - DNA, 16 bp, H. sapiens
gccagtccgagtccca

SEQ ID NO: 107430 - DNA, 16 bp, H. sapiens
gccagtcgtggtggct

SEQ ID NO: 107431 - DNA, 16 bp, H. sapiens
gccagtcttcccagca

SEQ ID NO: 107432 - DNA, 16 bp, H. sapiens
gccagtgcactccaac

SEQ ID NO: 107433 - DNA, 16 bp, H. sapiens
gccagtgcccctctgg

SEQ ID NO: 107434 - DNA, 16 bp, H. sapiens
gccagtgcctgtagtc

SEQ ID NO: 107435 - DNA, 16 bp, H. sapiens
gccagtgcgcatgcgc

SEQ ID NO: 107436 - DNA, 16 bp, H. sapiens
gccagtgctctccagc

SEQ ID NO: 107437 - DNA, 16 bp, H. sapiens
gccagtgctgcgactg

SEQ ID NO: 107438 - DNA, 16 bp, H. sapiens
gccagtggactgggaa

SEQ ID NO: 107439 - DNA, 16 bp, H. sapiens
gccagtggctgcagag

SEQ ID NO: 107440 - DNA, 16 bp, H. sapiens
gccagtgggagccagg

SEQ ID NO: 107441 - DNA, 16 bp, H. sapiens
gccagtgggtgcgcgc

SEQ ID NO: 107442 - DNA, 16 bp, H. sapiens
gccagtgtagctggag

SEQ ID NO: 107443 - DNA, 16 bp, H. sapiens
gccagttagaatgggg

SEQ ID NO: 107444 - DNA, 16 bp, H. sapiens
gccagttattccagca

SEQ ID NO: 107445 - DNA, 16 bp, H. sapiens
gccagttcttccagca

SEQ ID NO: 107446 - DNA, 16 bp, H. sapiens
gccagtttatcaatct

SEQ ID NO: 107447 - DNA, 16 bp, H. sapiens
gccagttttacaaccc

SEQ ID NO: 107448 - DNA, 16 bp, H. sapiens
gccagttttcccaagg

SEQ ID NO: 107449 - DNA, 16 bp, H. sapiens
gccagttttcccagcc

SEQ ID NO: 107450 - DNA, 16 bp, H. sapiens
gccataccaccctgaa

SEQ ID NO: 107451 - DNA, 16 bp, H. sapiens
gccatacccaaggtca

SEQ ID NO: 107452 - DNA, 16 bp, H. sapiens
gccatactcccacctc

SEQ ID NO: 107453 - DNA, 16 bp, H. sapiens
gccatagaaagaatga

SEQ ID NO: 107454 - DNA, 16 bp, H. sapiens
gccatatgacccagca

SEQ ID NO: 107455 - DNA, 16 bp, H. sapiens
gccatatgaggacaca

SEQ ID NO: 107456 - DNA, 16 bp, H. sapiens
gccatattgcccaggc

SEQ ID NO: 107457 - DNA, 16 bp, H. sapiens
gccatcaagtttgtgg

SEQ ID NO: 107458 - DNA, 16 bp, H. sapiens
gccatcacacctggat

SEQ ID NO: 107459 - DNA, 16 bp, H. sapiens
gccatcaccctcacag

SEQ ID NO: 107460 - DNA, 16 bp, H. sapiens
gccatcaccttgatct

SEQ ID NO: 107461 - DNA, 16 bp, H. sapiens
gccatcaggcagggac

SEQ ID NO: 107462 - DNA, 16 bp, H. sapiens
gccatcaggcctggct

SEQ ID NO: 107463 - DNA, 16 bp, H. sapiens
gccatcataactcact

SEQ ID NO: 107464 - DNA, 16 bp, H. sapiens
gccatcatcatcatca

SEQ ID NO: 107465 - DNA, 16 bp, H. sapiens
gccatcatcctcaaca

SEQ ID NO: 107466 - DNA, 16 bp, H. sapiens
gccatcatcttcagca

SEQ ID NO: 107467 - DNA, 16 bp, H. sapiens
gccatcatgctgggct

SEQ ID NO: 107468 - DNA, 16 bp, H. sapiens
gccatcatgcttggct

SEQ ID NO: 107469 - DNA, 16 bp, H. sapiens
gccatccatctccaga

SEQ ID NO: 107470 - DNA, 16 bp, H. sapiens
gccatcccagctccag

SEQ ID NO: 107471 - DNA, 16 bp, H. sapiens
gccatccccactgcca

SEQ ID NO: 107472 - DNA, 16 bp, H. sapiens
gccatccccatcaaac

SEQ ID NO: 107473 - DNA, 16 bp, H. sapiens
gccatccccatcaagc

SEQ ID NO: 107474 - DNA, 16 bp, H. sapiens
gccatcctcccatctt

SEQ ID NO: 107475 - DNA, 16 bp, H. sapiens
gccatcctcctacctt

SEQ ID NO: 107476 - DNA, 16 bp, H. sapiens
gccatcctcttgcctt

SEQ ID NO: 107477 - DNA, 16 bp, H. sapiens
gccatcctgcctggcc

SEQ ID NO: 107478 - DNA, 16 bp, H. sapiens
gccatcctggctaaca

SEQ ID NO: 107479 - DNA, 16 bp, H. sapiens
gccatcctgggctgca

SEQ ID NO: 107480 - DNA, 16 bp, H. sapiens
gccatcgtgcctggct

SEQ ID NO: 107481 - DNA, 16 bp, H. sapiens
gccatctccataacat

SEQ ID NO: 107482 - DNA, 16 bp, H. sapiens
gccatctccctctgca

SEQ ID NO: 107483 - DNA, 16 bp, H. sapiens
gccatctcgcccagcc

SEQ ID NO: 107484 - DNA, 16 bp, H. sapiens
gccatctgcaaaccaa

SEQ ID NO: 107485 - DNA, 17 bp, H. sapiens
gccatctgtcacccctt

SEQ ID NO: 107486 - DNA, 16 bp, H. sapiens
gccatctgtgttttaa

SEQ ID NO: 107487 - DNA, 16 bp, H. sapiens
gccatcttcccacctc

SEQ ID NO: 107488 - DNA, 16 bp, H. sapiens
gccatcttcccatctc

SEQ ID NO: 107489 - DNA, 16 bp, H. sapiens
gccatcttgctgatgt

SEQ ID NO: 107490 - DNA, 16 bp, H. sapiens
gccatcttggctcctc

SEQ ID NO: 107491 - DNA, 18 bp, H. sapiens
gccatcttggctcctccg

SEQ ID NO: 107492 - DNA, 16 bp, H. sapiens
gccatcttggctcctg

SEQ ID NO: 107493 - DNA, 16 bp, H. sapiens
gccatcttggctgcca

SEQ ID NO: 107494 - DNA, 16 bp, H. sapiens
gccatcttggttttag

SEQ ID NO: 107495 - DNA, 16 bp, H. sapiens
gccatctttaagagct

SEQ ID NO: 107496 - DNA, 16 bp, H. sapiens
gccatctttgctgttc

SEQ ID NO: 107497 - DNA, 16 bp, H. sapiens
gccatgaacatgccac

SEQ ID NO: 107498 - DNA, 16 bp, H. sapiens
gccatgacagaagaac

SEQ ID NO: 107499 - DNA, 16 bp, H. sapiens
gccatgacaggaagtg

SEQ ID NO: 107500 - DNA, 16 bp, H. sapiens
gccatgatgatgccac

SEQ ID NO: 107501 - DNA, 16 bp, H. sapiens
gccatgatgcccaggc

SEQ ID NO: 107502 - DNA, 16 bp, H. sapiens
gccatgcagagctgtg

SEQ ID NO: 107503 - DNA, 16 bp, H. sapiens
gccatgcccagctaat

SEQ ID NO: 107504 - DNA, 19 bp, H. sapiens
gccatgcccagctaatttt

SEQ ID NO: 107505 - DNA, 16 bp, H. sapiens
gccatgcccgagcctc

SEQ ID NO: 107506 - DNA, 16 bp, H. sapiens
gccatgcccggctaat

SEQ ID NO: 107507 - DNA, 16 bp, H. sapiens
gccatgcctggctaat

SEQ ID NO: 107508 - DNA, 16 bp, H. sapiens
gccatgctgctgtgct

SEQ ID NO: 107509 - DNA, 16 bp, H. sapiens
gccatgcttcctatac

SEQ ID NO: 107510 - DNA, 16 bp, H. sapiens
gccatggaagtggggc

SEQ ID NO: 107511 - DNA, 16 bp, H. sapiens
gccatggataccagca

SEQ ID NO: 107512 - DNA, 16 bp, H. sapiens
gccatggcaatgtcca

SEQ ID NO: 107513 - DNA, 16 bp, H. sapiens
gccatggctgggatgc

SEQ ID NO: 107514 - DNA, 16 bp, H. sapiens
gccatggcttcagaga

SEQ ID NO: 107515 - DNA, 16 bp, H. sapiens
gccatggcttctgtgc

SEQ ID NO: 107516 - DNA, 16 bp, H. sapiens
gccatgggtggttttg

SEQ ID NO: 107517 - DNA, 16 bp, H. sapiens
gccatggtgcccagcc

SEQ ID NO: 107518 - DNA, 16 bp, H. sapiens
gccatggtgcccggcc

SEQ ID NO: 107519 - DNA, 16 bp, H. sapiens
gccatggtggtgcatg

SEQ ID NO: 107520 - DNA, 16 bp, H. sapiens
gccatgtagcccaggc

SEQ ID NO: 107521 - DNA, 16 bp, H. sapiens
gccatgtcggccaggc

SEQ ID NO: 107522 - DNA, 16 bp, H. sapiens
gccatgtgaagacaga

SEQ ID NO: 107523 - DNA, 16 bp, H. sapiens
gccatgtgaagatgtg

SEQ ID NO: 107524 - DNA, 16 bp, H. sapiens
gccatgtgaagtgcct

SEQ ID NO: 107525 - DNA, 16 bp, H. sapiens
gccatgtgcagtggct

SEQ ID NO: 107526 - DNA, 16 bp, H. sapiens
gccatgtggaaatgtg

SEQ ID NO: 107527 - DNA, 16 bp, H. sapiens
gccatgtggaactgag

SEQ ID NO: 107528 - DNA, 16 bp, H. sapiens
gccatgttccaataaa

SEQ ID NO: 107529 - DNA, 16 bp, H. sapiens
gccatgttgcacaggc

SEQ ID NO: 107530 - DNA, 16 bp, H. sapiens
gccatgttgcctgttc

SEQ ID NO: 107531 - DNA, 16 bp, H. sapiens
gccatgttggcccagc

SEQ ID NO: 107532 - DNA, 16 bp, H. sapiens
gccatgttggccgggc

SEQ ID NO: 107533 - DNA, 16 bp, H. sapiens
gccattaaaaggaaag

SEQ ID NO: 107534 - DNA, 16 bp, H. sapiens
gccattaagaaaatca

SEQ ID NO: 107535 - DNA, 16 bp, H. sapiens
gccattatgaaaaaca

SEQ ID NO: 107536 - DNA, 16 bp, H. sapiens
gccattatgaaaagca

SEQ ID NO: 107537 - DNA, 16 bp, H. sapiens
gccattattacttcaa

SEQ ID NO: 107538 - DNA, 16 bp, H. sapiens
gccattctggtgggtg

SEQ ID NO: 107539 - DNA, 16 bp, H. sapiens
gccattctttcaggag

SEQ ID NO: 107540 - DNA, 16 bp, H. sapiens
gccattgagcccagcc

SEQ ID NO: 107541 - DNA, 16 bp, H. sapiens
gccattgattttggtg

SEQ ID NO: 107542 - DNA, 18 bp, H. sapiens
gccattgcacgccagcct

SEQ ID NO: 107543 - DNA, 16 bp, H. sapiens
gccattgcactccacc

SEQ ID NO: 107544 - DNA, 16 bp, H. sapiens
gccattgccctctagc

SEQ ID NO: 107545 - DNA, 16 bp, H. sapiens
gccattggtattttga

SEQ ID NO: 107546 - DNA, 16 bp, H. sapiens
gccatttatatatctt

SEQ ID NO: 107547 - DNA, 16 bp, H. sapiens
gccatttccctgcctc

SEQ ID NO: 107548 - DNA, 16 bp, H. sapiens
gccatttctgacttta

SEQ ID NO: 107549 - DNA, 16 bp, H. sapiens
gccatttctttttctt

SEQ ID NO: 107550 - DNA, 16 bp, H. sapiens
gccatttgattccctg

SEQ ID NO: 107551 - DNA, 16 bp, H. sapiens
gccatttgcaagctga

SEQ ID NO: 107552 - DNA, 16 bp, H. sapiens
gccatttgcaataaca

SEQ ID NO: 107553 - DNA, 16 bp, H. sapiens
gccatttgctaagact

SEQ ID NO: 107554 - DNA, 16 bp, H. sapiens
gccatttgggcagaca

SEQ ID NO: 107555 - DNA, 16 bp, H. sapiens
gccatttgtgtgtctt

SEQ ID NO: 107556 - DNA, 16 bp, H. sapiens
gccattttcctgcttc

SEQ ID NO: 107557 - DNA, 16 bp, H. sapiens
gccattttctctttct

SEQ ID NO: 107558 - DNA, 16 bp, H. sapiens
gccattttgaaatatg

SEQ ID NO: 107559 - DNA, 16 bp, H. sapiens
gccattttggaaagca

SEQ ID NO: 107560 - DNA, 16 bp, H. sapiens
gccatttttccaacag

SEQ ID NO: 107561 - DNA, 16 bp, H. sapiens
gccattttttaaaggg

SEQ ID NO: 107562 - DNA, 16 bp, H. sapiens
gcccaaaataaaggga

SEQ ID NO: 107563 - DNA, 16 bp, H. sapiens
gcccaaaatatttact

SEQ ID NO: 107564 - DNA, 16 bp, H. sapiens
gcccaaaatcacacag

SEQ ID NO: 107565 - DNA, 18 bp, H. sapiens
gcccaaaatctcctcaag

SEQ ID NO: 107566 - DNA, 16 bp, H. sapiens
gcccaaaatggtgaaa

SEQ ID NO: 107567 - DNA, 16 bp, H. sapiens
gcccaaagattggttg

SEQ ID NO: 107568 - DNA, 16 bp, H. sapiens
gcccaaagtcacccag

SEQ ID NO: 107569 - DNA, 17 bp, H. sapiens
gcccaactaattttttg

SEQ ID NO: 107570 - DNA, 16 bp, H. sapiens
gcccaagaatgtgcat

SEQ ID NO: 107571 - DNA, 16 bp, H. sapiens
gcccaagactgtggga

SEQ ID NO: 107572 - DNA, 16 bp, H. sapiens
gcccaagctgactaat

SEQ ID NO: 107573 - DNA, 16 bp, H. sapiens
gcccaagctggagcac

SEQ ID NO: 107574 - DNA, 16 bp, H. sapiens
gcccaaggcaggagga

SEQ ID NO: 107575 - DNA, 16 bp, H. sapiens
gcccaaggccttggga

SEQ ID NO: 107576 - DNA, 16 bp, H. sapiens
gcccaagggagcttgt

SEQ ID NO: 107577 - DNA, 16 bp, H. sapiens
gcccaagggcacacag

SEQ ID NO: 107578 - DNA, 16 bp, H. sapiens
gcccaaggggtcaggg

SEQ ID NO: 107579 - DNA, 16 bp, H. sapiens
gcccaaggggttcacc

SEQ ID NO: 107580 - DNA, 16 bp, H. sapiens
gcccaaggtcacccag

SEQ ID NO: 107581 - DNA, 16 bp, H. sapiens
gcccaaggtctcccag

SEQ ID NO: 107582 - DNA, 16 bp, H. sapiens
gcccaaggtgacacag

SEQ ID NO: 107583 - DNA, 16 bp, H. sapiens
gcccaaggtggtctca

SEQ ID NO: 107584 - DNA, 16 bp, H. sapiens
gcccaagtgatcctcc

SEQ ID NO: 107585 - DNA, 16 bp, H. sapiens
gcccaagtgggcagat

SEQ ID NO: 107586 - DNA, 16 bp, H. sapiens
gcccacagaggatgag

SEQ ID NO: 107587 - DNA, 16 bp, H. sapiens
gcccacagctgcacag

SEQ ID NO: 107588 - DNA, 16 bp, H. sapiens
gcccacagctgcccct

SEQ ID NO: 107589 - DNA, 16 bp, H. sapiens
gcccacaggcagccag

SEQ ID NO: 107590 - DNA, 16 bp, H. sapiens
gcccacagttctgcag

SEQ ID NO: 107591 - DNA, 16 bp, H. sapiens
gcccaccaagcccatg

SEQ ID NO: 107592 - DNA, 16 bp, H. sapiens
gcccaccaccacacat

SEQ ID NO: 107593 - DNA, 16 bp, H. sapiens
gcccaccaccacagct

SEQ ID NO: 107594 - DNA, 16 bp, H. sapiens
gcccaccaccatgccc

SEQ ID NO: 107595 - DNA, 16 bp, H. sapiens
gcccaccaccgtgccc

SEQ ID NO: 107596 - DNA, 16 bp, H. sapiens
gcccacccaggttaag

SEQ ID NO: 107597 - DNA, 16 bp, H. sapiens
gcccacccatggccac

SEQ ID NO: 107598 - DNA, 16 bp, H. sapiens
gcccaccccaatgacc

SEQ ID NO: 107599 - DNA, 16 bp, H. sapiens
gcccacccggaactct

SEQ ID NO: 107600 - DNA, 16 bp, H. sapiens
gcccaccctcaggggc

SEQ ID NO: 107601 - DNA, 16 bp, H. sapiens
gcccacctcagcctct

SEQ ID NO: 107602 - DNA, 16 bp, H. sapiens
gcccacctcagcctgc

SEQ ID NO: 107603 - DNA, 16 bp, H. sapiens
gcccacctcatcctcc

SEQ ID NO: 107604 - DNA, 16 bp, H. sapiens
gcccacctcggccttc

SEQ ID NO: 107605 - DNA, 16 bp, H. sapiens
gcccacctcggcgtcc

SEQ ID NO: 107606 - DNA, 16 bp, H. sapiens
gcccacctcggctccc

SEQ ID NO: 107607 - DNA, 16 bp, H. sapiens
gcccacctctgcctcc

SEQ ID NO: 107608 - DNA, 16 bp, H. sapiens
gcccacctctgccttc

SEQ ID NO: 107609 - DNA, 16 bp, H. sapiens
gcccacctctgcttcc

SEQ ID NO: 107610 - DNA, 16 bp, H. sapiens
gcccacctctgtctcc

SEQ ID NO: 107611 - DNA, 16 bp, H. sapiens
gcccacctgacccgcc

SEQ ID NO: 107612 - DNA, 16 bp, H. sapiens
gcccacctggaacttg

SEQ ID NO: 107613 - DNA, 16 bp, H. sapiens
gcccacctggacctcc

SEQ ID NO: 107614 - DNA, 16 bp, H. sapiens
gcccacctggcctccc

SEQ ID NO: 107615 - DNA, 16 bp, H. sapiens
gcccaccttggccccc

SEQ ID NO: 107616 - DNA, 16 bp, H. sapiens
gcccaccttggccctc

SEQ ID NO: 107617 - DNA, 16 bp, H. sapiens
gcccaccttggccttc

SEQ ID NO: 107618 - DNA, 17 bp, H. sapiens
gcccactaatttttgta

SEQ ID NO: 107619 - DNA, 16 bp, H. sapiens
gcccactcggcctggc

SEQ ID NO: 107620 - DNA, 16 bp, H. sapiens
gcccactgcaacctcc

SEQ ID NO: 107621 - DNA, 16 bp, H. sapiens
gcccactgcactccag

SEQ ID NO: 107622 - DNA, 16 bp, H. sapiens
gcccactgcagccttg

SEQ ID NO: 107623 - DNA, 16 bp, H. sapiens
gcccactgcagctctg

SEQ ID NO: 107624 - DNA, 16 bp, H. sapiens
gcccactgccacctct

SEQ ID NO: 107625 - DNA, 16 bp, H. sapiens
gcccactgcccagaaa

SEQ ID NO: 107626 - DNA, 16 bp, H. sapiens
gcccactgcctggaaa

SEQ ID NO: 107627 - DNA, 16 bp, H. sapiens
gcccacttcaacctcc

SEQ ID NO: 107628 - DNA, 16 bp, H. sapiens
gcccacttcggcctct

SEQ ID NO: 107629 - DNA, 16 bp, H. sapiens
gcccagaaacaaatcc

SEQ ID NO: 107630 - DNA, 16 bp, H. sapiens
gcccagaaattccaga

SEQ ID NO: 107631 - DNA, 16 bp, H. sapiens
gcccagaacctgatgg

SEQ ID NO: 107632 - DNA, 16 bp, H. sapiens
gcccagaagatggagg

SEQ ID NO: 107633 - DNA, 16 bp, H. sapiens
gcccagaaggctgagg

SEQ ID NO: 107634 - DNA, 16 bp, H. sapiens
gcccagaaggtcaaag

SEQ ID NO: 107635 - DNA, 16 bp, H. sapiens
gcccagaaggtcaagg

SEQ ID NO: 107636 - DNA, 16 bp, H. sapiens
gcccagaagtgacaca

SEQ ID NO: 107637 - DNA, 16 bp, H. sapiens
gcccagaagttcaaga

SEQ ID NO: 107638 - DNA, 16 bp, H. sapiens
gcccagaccaatatcc

SEQ ID NO: 107639 - DNA, 16 bp, H. sapiens
gcccagacctgggcag

SEQ ID NO: 107640 - DNA, 16 bp, H. sapiens
gcccagactcttcagg

SEQ ID NO: 107641 - DNA, 16 bp, H. sapiens
gcccagactgatcttg

SEQ ID NO: 107642 - DNA, 16 bp, H. sapiens
gcccagactggggtgc

SEQ ID NO: 107643 - DNA, 16 bp, H. sapiens
gcccagagaaagagag

SEQ ID NO: 107644 - DNA, 16 bp, H. sapiens
gcccagagaagaggaa

SEQ ID NO: 107645 - DNA, 16 bp, H. sapiens
gcccagagaaggggag

SEQ ID NO: 107646 - DNA, 16 bp, H. sapiens
gcccagagagaaggaa

SEQ ID NO: 107647 - DNA, 16 bp, H. sapiens
gcccagagaggccagg

SEQ ID NO: 107648 - DNA, 16 bp, H. sapiens
gcccagagagggaaag

SEQ ID NO: 107649 - DNA, 16 bp, H. sapiens
gcccagagagggcaag

SEQ ID NO: 107650 - DNA, 16 bp, H. sapiens
gcccagagaggggaaa

SEQ ID NO: 107651 - DNA, 16 bp, H. sapiens
gcccagagaggggcag

SEQ ID NO: 107652 - DNA, 16 bp, H. sapiens
gcccagagaggtggag

SEQ ID NO: 107653 - DNA, 16 bp, H. sapiens
gcccagagaggttaag

SEQ ID NO: 107654 - DNA, 16 bp, H. sapiens
gcccagagcagtggct

SEQ ID NO: 107655 - DNA, 16 bp, H. sapiens
gcccagagcccagagc

SEQ ID NO: 107656 - DNA, 16 bp, H. sapiens
gcccagcacagcccca

SEQ ID NO: 107657 - DNA, 16 bp, H. sapiens
gcccagcactgtggct

SEQ ID NO: 107658 - DNA, 16 bp, H. sapiens
gcccagcactttggga

SEQ ID NO: 107659 - DNA, 16 bp, H. sapiens
gcccagcagctgcccc

SEQ ID NO: 107660 - DNA, 16 bp, H. sapiens
gcccagcaggtggagg

SEQ ID NO: 107661 - DNA, 16 bp, H. sapiens
gcccagcatggtagca

SEQ ID NO: 107662 - DNA, 16 bp, H. sapiens
gcccagccaacacagc

SEQ ID NO: 107663 - DNA, 16 bp, H. sapiens
gcccagccaatttttt

SEQ ID NO: 107664 - DNA, 16 bp, H. sapiens
gcccagccaccccatc

SEQ ID NO: 107665 - DNA, 16 bp, H. sapiens
gcccagccagaaaaca

SEQ ID NO: 107666 - DNA, 16 bp, H. sapiens
gcccagccagctgccc

SEQ ID NO: 107667 - DNA, 16 bp, H. sapiens
gcccagccaggagccc

SEQ ID NO: 107668 - DNA, 16 bp, H. sapiens
gcccagcccagagcca

SEQ ID NO: 107669 - DNA, 16 bp, H. sapiens
gcccagcccagcctgg

SEQ ID NO: 107670 - DNA, 16 bp, H. sapiens
gcccagcccagctcat

SEQ ID NO: 107671 - DNA, 16 bp, H. sapiens
gcccagcccaggctgg

SEQ ID NO: 107672 - DNA, 16 bp, H. sapiens
gcccagcccagggcag

SEQ ID NO: 107673 - DNA, 16 bp, H. sapiens
gcccagccccagcctg

SEQ ID NO: 107674 - DNA, 16 bp, H. sapiens
gcccagcccctgccag

SEQ ID NO: 107675 - DNA, 16 bp, H. sapiens
gcccagcccctgcctg

SEQ ID NO: 107676 - DNA, 16 bp, H. sapiens
gcccagccctgcccct

SEQ ID NO: 107677 - DNA, 16 bp, H. sapiens
gcccagccctgcctcc

SEQ ID NO: 107678 - DNA, 16 bp, H. sapiens
gcccagccctggcccc

SEQ ID NO: 107679 - DNA, 16 bp, H. sapiens
gcccagccctgtcccc

SEQ ID NO: 107680 - DNA, 16 bp, H. sapiens
gcccagccgccccatc

SEQ ID NO: 107681 - DNA, 16 bp, H. sapiens
gcccagcctaattttt

SEQ ID NO: 107682 - DNA, 16 bp, H. sapiens
gcccagcctagcccag

SEQ ID NO: 107683 - DNA, 16 bp, H. sapiens
gcccagcctatttgtc

SEQ ID NO: 107684 - DNA, 16 bp, H. sapiens
gcccagcctcattctt

SEQ ID NO: 107685 - DNA, 16 bp, H. sapiens
gcccagcctctgtggc

SEQ ID NO: 107686 - DNA, 16 bp, H. sapiens
gcccagcctctttttt

SEQ ID NO: 107687 - DNA, 16 bp, H. sapiens
gcccagcctgcttttt

SEQ ID NO: 107688 - DNA, 16 bp, H. sapiens
gcccagcctggcccca

SEQ ID NO: 107689 - DNA, 16 bp, H. sapiens
gcccagcctgggcagc

SEQ ID NO: 107690 - DNA, 16 bp, H. sapiens
gcccagcctggggtgc

SEQ ID NO: 107691 - DNA, 16 bp, H. sapiens
gcccagccttttttct

SEQ ID NO: 107692 - DNA, 16 bp, H. sapiens
gcccagctaatctttt

SEQ ID NO: 107693 - DNA, 16 bp, H. sapiens
gcccagctaattttct

SEQ ID NO: 107694 - DNA, 16 bp, H. sapiens
gcccagctagtttttt

SEQ ID NO: 107695 - DNA, 16 bp, H. sapiens
gcccagctcatgcctc

SEQ ID NO: 107696 - DNA, 16 bp, H. sapiens
gcccagctcccagccc

SEQ ID NO: 107697 - DNA, 16 bp, H. sapiens
gcccagctcctacctc

SEQ ID NO: 107698 - DNA, 16 bp, H. sapiens
gcccagctcctgccta

SEQ ID NO: 107699 - DNA, 16 bp, H. sapiens
gcccagctcctgcctg

SEQ ID NO: 107700 - DNA, 16 bp, H. sapiens
gcccagctgagttttg

SEQ ID NO: 107701 - DNA, 16 bp, H. sapiens
gcccagctgcccactg

SEQ ID NO: 107702 - DNA, 16 bp, H. sapiens
gcccagctgccccatc

SEQ ID NO: 107703 - DNA, 16 bp, H. sapiens
gcccagctgctgcttc

SEQ ID NO: 107704 - DNA, 17 bp, H. sapiens
gcccagctggcttcacc

SEQ ID NO: 107705 - DNA, 16 bp, H. sapiens
gcccagctgtaaaatt

SEQ ID NO: 107706 - DNA, 16 bp, H. sapiens
gcccagcttggagtgc

SEQ ID NO: 107707 - DNA, 16 bp, H. sapiens
gcccagcttgggcaac

SEQ ID NO: 107708 - DNA, 16 bp, H. sapiens
gcccaggaaagccaaa

SEQ ID NO: 107709 - DNA, 16 bp, H. sapiens
gcccaggaaggagaaa

SEQ ID NO: 107710 - DNA, 16 bp, H. sapiens
gcccaggaatgagcaa

SEQ ID NO: 107711 - DNA, 16 bp, H. sapiens
gcccaggaattagaga

SEQ ID NO: 107712 - DNA, 16 bp, H. sapiens
gcccaggaattcaagt

SEQ ID NO: 107713 - DNA, 16 bp, H. sapiens
gcccaggaatttgtgg

SEQ ID NO: 107714 - DNA, 16 bp, H. sapiens
gcccaggaccagatgg

SEQ ID NO: 107715 - DNA, 16 bp, H. sapiens
gcccaggacccagtgg

SEQ ID NO: 107716 - DNA, 16 bp, H. sapiens
gcccaggactttgagg

SEQ ID NO: 107717 - DNA, 16 bp, H. sapiens
gcccaggagacagagc

SEQ ID NO: 107718 - DNA, 16 bp, H. sapiens
gcccaggagagaggcc

SEQ ID NO: 107719 - DNA, 16 bp, H. sapiens
gcccaggagaggggcc

SEQ ID NO: 107720 - DNA, 16 bp, H. sapiens
gcccaggagatgaagg

SEQ ID NO: 107721 - DNA, 16 bp, H. sapiens
gcccaggagatggaag

SEQ ID NO: 107722 - DNA, 16 bp, H. sapiens
gcccaggagatggaga

SEQ ID NO: 107723 - DNA, 16 bp, H. sapiens
gcccaggagccagagg

SEQ ID NO: 107724 - DNA, 16 bp, H. sapiens
gcccaggagcctgtct

SEQ ID NO: 107725 - DNA, 16 bp, H. sapiens
gcccaggagctgaaga

SEQ ID NO: 107726 - DNA, 16 bp, H. sapiens
gcccaggagctggagg

SEQ ID NO: 107727 - DNA, 16 bp, H. sapiens
gcccaggaggaagagg

SEQ ID NO: 107728 - DNA, 16 bp, H. sapiens
gcccaggaggaggaag

SEQ ID NO: 107729 - DNA, 16 bp, H. sapiens
gcccaggaggaggagg

SEQ ID NO: 107730 - DNA, 16 bp, H. sapiens
gcccaggaggcagaag

SEQ ID NO: 107731 - DNA, 16 bp, H. sapiens
gcccaggaggcagagg

SEQ ID NO: 107732 - DNA, 28 bp, H. sapiens
gcccaggaggcagaggttgcagtgagct

SEQ ID NO: 107733 - DNA, 16 bp, H. sapiens
gcccaggaggcagtgg

SEQ ID NO: 107734 - DNA, 16 bp, H. sapiens
gcccaggaggctgaag

SEQ ID NO: 107735 - DNA, 16 bp, H. sapiens
gcccaggaggctgagg

SEQ ID NO: 107736 - DNA, 16 bp, H. sapiens
gcccaggaggctggag

SEQ ID NO: 107737 - DNA, 16 bp, H. sapiens
gcccaggagggtgggg

SEQ ID NO: 107738 - DNA, 16 bp, H. sapiens
gcccaggaggtggtgg

SEQ ID NO: 107739 - DNA, 16 bp, H. sapiens
gcccaggaggttgatg

SEQ ID NO: 107740 - DNA, 16 bp, H. sapiens
gcccaggaggttgggg

SEQ ID NO: 107741 - DNA, 16 bp, H. sapiens
gcccaggagtacaagg

SEQ ID NO: 107742 - DNA, 16 bp, H. sapiens
gcccaggagtatgagg

SEQ ID NO: 107743 - DNA, 16 bp, H. sapiens
gcccaggagtcagagg

SEQ ID NO: 107744 - DNA, 16 bp, H. sapiens
gcccaggagttcatgg

SEQ ID NO: 107745 - DNA, 16 bp, H. sapiens
gcccaggagttccaga

SEQ ID NO: 107746 - DNA, 16 bp, H. sapiens
gcccaggagttcgaca

SEQ ID NO: 107747 - DNA, 16 bp, H. sapiens
gcccaggagttgggga

SEQ ID NO: 107748 - DNA, 16 bp, H. sapiens
gcccaggagtttgaag

SEQ ID NO: 107749 - DNA, 16 bp, H. sapiens
gcccaggagtttgaca

SEQ ID NO: 107750 - DNA, 16 bp, H. sapiens
gcccaggagtttggga

SEQ ID NO: 107751 - DNA, 16 bp, H. sapiens
gcccaggatgatctca

SEQ ID NO: 107752 - DNA, 16 bp, H. sapiens
gcccaggatttggaga

SEQ ID NO: 107753 - DNA, 16 bp, H. sapiens
gcccaggcagatggat

SEQ ID NO: 107754 - DNA, 16 bp, H. sapiens
gcccaggcagcctggc

SEQ ID NO: 107755 - DNA, 16 bp, H. sapiens
gcccaggcaggggagg

SEQ ID NO: 107756 - DNA, 16 bp, H. sapiens
gcccaggcatggtggc

SEQ ID NO: 107757 - DNA, 16 bp, H. sapiens
gcccaggccagactgc

SEQ ID NO: 107758 - DNA, 16 bp, H. sapiens
gcccaggccagagtgc

SEQ ID NO: 107759 - DNA, 16 bp, H. sapiens
gcccaggccgcagtgc

SEQ ID NO: 107760 - DNA, 16 bp, H. sapiens
gcccaggcgcagtggc

SEQ ID NO: 107761 - DNA, 17 bp, H. sapiens
gcccaggctagagtgca

SEQ ID NO: 107762 - DNA, 16 bp, H. sapiens
gcccaggctctggagt

SEQ ID NO: 107763 - DNA, 16 bp, H. sapiens
gcccaggctgaagagc

SEQ ID NO: 107764 - DNA, 16 bp, H. sapiens
gcccaggctgaagtcc

SEQ ID NO: 107765 - DNA, 16 bp, H. sapiens
gcccaggctgacctca

SEQ ID NO: 107766 - DNA, 16 bp, H. sapiens
gcccaggctgaggtgg

SEQ ID NO: 107767 - DNA, 16 bp, H. sapiens
gcccaggctgcagagc

SEQ ID NO: 107768 - DNA, 16 bp, H. sapiens
gcccaggctgcaggct

SEQ ID NO: 107769 - DNA, 16 bp, H. sapiens
gcccaggctgccaggc

SEQ ID NO: 107770 - DNA, 16 bp, H. sapiens
gcccaggctggactcc

SEQ ID NO: 107771 - DNA, 16 bp, H. sapiens
gcccaggctggagatc

SEQ ID NO: 107772 - DNA, 16 bp, H. sapiens
gcccaggctggagcag

SEQ ID NO: 107773 - DNA, 16 bp, H. sapiens
gcccaggctggaggac

SEQ ID NO: 107774 - DNA, 16 bp, H. sapiens
gcccaggctggaggtc

SEQ ID NO: 107775 - DNA, 17 bp, H. sapiens
gcccaggctggagttca

SEQ ID NO: 107776 - DNA, 16 bp, H. sapiens
gcccaggctggccttc

SEQ ID NO: 107777 - DNA, 16 bp, H. sapiens
gcccaggctggtcacg

SEQ ID NO: 107778 - DNA, 16 bp, H. sapiens
gcccaggctggtgcag

SEQ ID NO: 107779 - DNA, 16 bp, H. sapiens
gcccaggctggttttg

SEQ ID NO: 107780 - DNA, 16 bp, H. sapiens
gcccaggcttgtcttg

SEQ ID NO: 107781 - DNA, 16 bp, H. sapiens
gcccagggaagctaaa

SEQ ID NO: 107782 - DNA, 16 bp, H. sapiens
gcccagggaggaggaa

SEQ ID NO: 107783 - DNA, 16 bp, H. sapiens
gcccagggaggctgag

SEQ ID NO: 107784 - DNA, 16 bp, H. sapiens
gcccagggaggggcag

SEQ ID NO: 107785 - DNA, 16 bp, H. sapiens
gcccagggcaggcagg

SEQ ID NO: 107786 - DNA, 16 bp, H. sapiens
gcccagggcagggagg

SEQ ID NO: 107787 - DNA, 16 bp, H. sapiens
gcccagggcagtgagg

SEQ ID NO: 107788 - DNA, 16 bp, H. sapiens
gcccagggccaggcac

SEQ ID NO: 107789 - DNA, 16 bp, H. sapiens
gcccagggccccctgc

SEQ ID NO: 107790 - DNA, 16 bp, H. sapiens
gcccagggcctggcac

SEQ ID NO: 107791 - DNA, 16 bp, H. sapiens
gcccagggcctggccc

SEQ ID NO: 107792 - DNA, 16 bp, H. sapiens
gcccagggctgcccag

SEQ ID NO: 107793 - DNA, 16 bp, H. sapiens
gcccagggctgggagg

SEQ ID NO: 107794 - DNA, 16 bp, H. sapiens
gcccaggggacctgtg

SEQ ID NO: 107795 - DNA, 16 bp, H. sapiens
gcccaggggattggtt

SEQ ID NO: 107796 - DNA, 16 bp, H. sapiens
gcccagggtcacacag

SEQ ID NO: 107797 - DNA, 16 bp, H. sapiens
gcccagggtggtctgg

SEQ ID NO: 107798 - DNA, 16 bp, H. sapiens
gcccagggtgtcagcc

SEQ ID NO: 107799 - DNA, 16 bp, H. sapiens
gcccaggtaatttttt

SEQ ID NO: 107800 - DNA, 16 bp, H. sapiens
gcccaggtctgcagcc

SEQ ID NO: 107801 - DNA, 16 bp, H. sapiens
gcccaggtgatcctcc

SEQ ID NO: 107802 - DNA, 16 bp, H. sapiens
gcccaggtggtctcaa

SEQ ID NO: 107803 - DNA, 16 bp, H. sapiens
gcccaggtggtggagg

SEQ ID NO: 107804 - DNA, 16 bp, H. sapiens
gcccaggttgctcttg

SEQ ID NO: 107805 - DNA, 16 bp, H. sapiens
gcccagtcagtttctc

SEQ ID NO: 107806 - DNA, 16 bp, H. sapiens
gcccagtgcaaaatga

SEQ ID NO: 107807 - DNA, 16 bp, H. sapiens
gcccagtgcccagcac

SEQ ID NO: 107808 - DNA, 16 bp, H. sapiens
gcccagttaacttttg

SEQ ID NO: 107809 - DNA, 16 bp, H. sapiens
gcccagttcatgactc

SEQ ID NO: 107810 - DNA, 16 bp, H. sapiens
gcccagttcatggccc

SEQ ID NO: 107811 - DNA, 16 bp, H. sapiens
gcccagtttgagcttc

SEQ ID NO: 107812 - DNA, 16 bp, H. sapiens
gcccatcaattataga

SEQ ID NO: 107813 - DNA, 16 bp, H. sapiens
gcccatcagggaactg

SEQ ID NO: 107814 - DNA, 16 bp, H. sapiens
gcccatcccccagcct

SEQ ID NO: 107815 - DNA, 16 bp, H. sapiens
gcccatcttggcctcc

SEQ ID NO: 107816 - DNA, 16 bp, H. sapiens
gcccatgaggcagagg

SEQ ID NO: 107817 - DNA, 16 bp, H. sapiens
gcccatgcccacccag

SEQ ID NO: 107818 - DNA, 16 bp, H. sapiens
gcccatgcctatgccc

SEQ ID NO: 107819 - DNA, 17 bp, H. sapiens
gcccatgcctatggcct

SEQ ID NO: 107820 - DNA, 16 bp, H. sapiens
gcccatgcctgtcatc

SEQ ID NO: 107821 - DNA, 16 bp, H. sapiens
gcccatgctgatcttg

SEQ ID NO: 107822 - DNA, 16 bp, H. sapiens
gcccatgctggtcttg

SEQ ID NO: 107823 - DNA, 16 bp, H. sapiens
gcccatggaccaaatc

SEQ ID NO: 107824 - DNA, 16 bp, H. sapiens
gcccatggtagaaaag

SEQ ID NO: 107825 - DNA, 16 bp, H. sapiens
gcccatgtggctggag

SEQ ID NO: 107826 - DNA, 16 bp, H. sapiens
gcccattcctgcctgg

SEQ ID NO: 107827 - DNA, 16 bp, H. sapiens
gcccattgtatgaggg

SEQ ID NO: 107828 - DNA, 16 bp, H. sapiens
gcccatttttaattgt

SEQ ID NO: 107829 - DNA, 16 bp, H. sapiens
gcccatttttcagatg

SEQ ID NO: 107830 - DNA, 16 bp, H. sapiens
gccccaaactggaaat

SEQ ID NO: 107831 - DNA, 16 bp, H. sapiens
gccccaactccaacac

SEQ ID NO: 107832 - DNA, 16 bp, H. sapiens
gccccaacttcctggg

SEQ ID NO: 107833 - DNA, 16 bp, H. sapiens
gccccaagcattggca

SEQ ID NO: 107834 - DNA, 16 bp, H. sapiens
gccccacagcagcatc

SEQ ID NO: 107835 - DNA, 16 bp, H. sapiens
gccccacagcctgccc

SEQ ID NO: 107836 - DNA, 16 bp, H. sapiens
gccccacccatcacag

SEQ ID NO: 107837 - DNA, 16 bp, H. sapiens
gccccacccatcacct

SEQ ID NO: 107838 - DNA, 16 bp, H. sapiens
gccccaccccagagaa

SEQ ID NO: 107839 - DNA, 16 bp, H. sapiens
gccccaccctcccagg

SEQ ID NO: 107840 - DNA, 16 bp, H. sapiens
gccccacctccagcat

SEQ ID NO: 107841 - DNA, 16 bp, H. sapiens
gccccacctcggcctc

SEQ ID NO: 107842 - DNA, 16 bp, H. sapiens
gccccactaatttttt

SEQ ID NO: 107843 - DNA, 16 bp, H. sapiens
gccccactcccagtac

SEQ ID NO: 107844 - DNA, 16 bp, H. sapiens
gccccactcctggctg

SEQ ID NO: 107845 - DNA, 16 bp, H. sapiens
gccccactgccctgca

SEQ ID NO: 107846 - DNA, 16 bp, H. sapiens
gccccagagagctccc

SEQ ID NO: 107847 - DNA, 16 bp, H. sapiens
gccccagaggacaaag

SEQ ID NO: 107848 - DNA, 16 bp, H. sapiens
gccccagcccagacct

SEQ ID NO: 107849 - DNA, 16 bp, H. sapiens
gccccagcccagccct

SEQ ID NO: 107850 - DNA, 16 bp, H. sapiens
gccccagcccagcctg

SEQ ID NO: 107851 - DNA, 16 bp, H. sapiens
gccccagccccagcct

SEQ ID NO: 107852 - DNA, 16 bp, H. sapiens
gccccagccctgcagc

SEQ ID NO: 107853 - DNA, 16 bp, H. sapiens
gccccagccctggccc

SEQ ID NO: 107854 - DNA, 16 bp, H. sapiens
gccccagccctgggcc

SEQ ID NO: 107855 - DNA, 16 bp, H. sapiens
gccccagccctggggc

SEQ ID NO: 107856 - DNA, 16 bp, H. sapiens
gccccagcctctcctc

SEQ ID NO: 107857 - DNA, 16 bp, H. sapiens
gccccagcctctcgag

SEQ ID NO: 107858 - DNA, 16 bp, H. sapiens
gccccagcctctggag

SEQ ID NO: 107859 - DNA, 16 bp, H. sapiens
gccccagccttctgag

SEQ ID NO: 107860 - DNA, 16 bp, H. sapiens
gccccagctactcagg

SEQ ID NO: 107861 - DNA, 16 bp, H. sapiens
gccccagctcctcagg

SEQ ID NO: 107862 - DNA, 16 bp, H. sapiens
gccccagctcctgcac

SEQ ID NO: 107863 - DNA, 16 bp, H. sapiens
gccccagctctgcctc

SEQ ID NO: 107864 - DNA, 16 bp, H. sapiens
gccccaggcaggtcca

SEQ ID NO: 107865 - DNA, 16 bp, H. sapiens
gccccaggccacacag

SEQ ID NO: 107866 - DNA, 16 bp, H. sapiens
gccccaggccaggcag

SEQ ID NO: 107867 - DNA, 16 bp, H. sapiens
gccccaggcccacagc

SEQ ID NO: 107868 - DNA, 16 bp, H. sapiens
gccccaggccctgccc

SEQ ID NO: 107869 - DNA, 16 bp, H. sapiens
gccccaggcttccctg

SEQ ID NO: 107870 - DNA, 16 bp, H. sapiens
gccccagggagggagg

SEQ ID NO: 107871 - DNA, 16 bp, H. sapiens
gccccagggccttggc

SEQ ID NO: 107872 - DNA, 16 bp, H. sapiens
gccccagtctcccgag

SEQ ID NO: 107873 - DNA, 16 bp, H. sapiens
gccccagtgtctgatg

SEQ ID NO: 107874 - DNA, 16 bp, H. sapiens
gccccagttcccgccc

SEQ ID NO: 107875 - DNA, 16 bp, H. sapiens
gccccagttttctcat

SEQ ID NO: 107876 - DNA, 16 bp, H. sapiens
gccccataagattata

SEQ ID NO: 107877 - DNA, 16 bp, H. sapiens
gccccatcccagatct

SEQ ID NO: 107878 - DNA, 16 bp, H. sapiens
gccccatccctagggg

SEQ ID NO: 107879 - DNA, 16 bp, H. sapiens
gccccatccgggaggg

SEQ ID NO: 107880 - DNA, 16 bp, H. sapiens
gccccatcctgaagct

SEQ ID NO: 107881 - DNA, 16 bp, H. sapiens
gccccatctctctctc

SEQ ID NO: 107882 - DNA, 16 bp, H. sapiens
gccccatctgggaggg

SEQ ID NO: 107883 - DNA, 16 bp, H. sapiens
gccccatggagaggcc

SEQ ID NO: 107884 - DNA, 16 bp, H. sapiens
gcccccaagcccagct

SEQ ID NO: 107885 - DNA, 16 bp, H. sapiens
gcccccacccagcctg

SEQ ID NO: 107886 - DNA, 16 bp, H. sapiens
gcccccacctcccaaa

SEQ ID NO: 107887 - DNA, 16 bp, H. sapiens
gcccccacctcctggg

SEQ ID NO: 107888 - DNA, 16 bp, H. sapiens
gcccccacgcccagct

SEQ ID NO: 107889 - DNA, 16 bp, H. sapiens
gcccccactcctggct

SEQ ID NO: 107890 - DNA, 16 bp, H. sapiens
gcccccagcacacggg

SEQ ID NO: 107891 - DNA, 16 bp, H. sapiens
gcccccagcccagcct

SEQ ID NO: 107892 - DNA, 16 bp, H. sapiens
gcccccagccctgctc

SEQ ID NO: 107893 - DNA, 16 bp, H. sapiens
gcccccagccctgtgc

SEQ ID NO: 107894 - DNA, 16 bp, H. sapiens
gcccccagcctcagcc

SEQ ID NO: 107895 - DNA, 16 bp, H. sapiens
gcccccatcccttcac

SEQ ID NO: 107896 - DNA, 16 bp, H. sapiens
gcccccatcctgggcc

SEQ ID NO: 107897 - DNA, 16 bp, H. sapiens
gcccccatgcccagct

SEQ ID NO: 107898 - DNA, 16 bp, H. sapiens
gcccccatgcctggcc

SEQ ID NO: 107899 - DNA, 16 bp, H. sapiens
gccccccaagtacctg

SEQ ID NO: 107900 - DNA, 16 bp, H. sapiens
gccccccaagttcaag

SEQ ID NO: 107901 - DNA, 16 bp, H. sapiens
gccccccagcccctga

SEQ ID NO: 107902 - DNA, 16 bp, H. sapiens
gccccccaggttcaag

SEQ ID NO: 107903 - DNA, 16 bp, H. sapiens
gccccccgagttcaag

SEQ ID NO: 107904 - DNA, 16 bp, H. sapiens
gcccccctgctctgtg

SEQ ID NO: 107905 - DNA, 16 bp, H. sapiens
gcccccgagggccatc

SEQ ID NO: 107906 - DNA, 16 bp, H. sapiens
gcccccgcacctggcc

SEQ ID NO: 107907 - DNA, 16 bp, H. sapiens
gcccccgcctcccagg

SEQ ID NO: 107908 - DNA, 16 bp, H. sapiens
gcccccgcctggccag

SEQ ID NO: 107909 - DNA, 16 bp, H. sapiens
gccccctccaaaaaaa

SEQ ID NO: 107910 - DNA, 16 bp, H. sapiens
gccccctccagacttt

SEQ ID NO: 107911 - DNA, 16 bp, H. sapiens
gccccctcccactctt

SEQ ID NO: 107912 - DNA, 16 bp, H. sapiens
gccccctccccagggc

SEQ ID NO: 107913 - DNA, 16 bp, H. sapiens
gccccctgaggagctg

SEQ ID NO: 107914 - DNA, 16 bp, H. sapiens
gccccctgggttcaag

SEQ ID NO: 107915 - DNA, 16 bp, H. sapiens
gccccgagaggtggag

SEQ ID NO: 107916 - DNA, 16 bp, H. sapiens
gccccgaggaaggggc

SEQ ID NO: 107917 - DNA, 16 bp, H. sapiens
gccccgctaatttttt

SEQ ID NO: 107918 - DNA, 16 bp, H. sapiens
gccccgctgcactcca

SEQ ID NO: 107919 - DNA, 19 bp, H. sapiens
gccccggctggagtgcagt

SEQ ID NO: 107920 - DNA, 16 bp, H. sapiens
gcccctaatcccgctt

SEQ ID NO: 107921 - DNA, 16 bp, H. sapiens
gcccctaatcctgctc

SEQ ID NO: 107922 - DNA, 16 bp, H. sapiens
gcccctactgtgtgcc

SEQ ID NO: 107923 - DNA, 16 bp, H. sapiens
gcccctatgattcaat

SEQ ID NO: 107924 - DNA, 16 bp, H. sapiens
gcccctattttttttt

SEQ ID NO: 107925 - DNA, 16 bp, H. sapiens
gcccctcactgccctg

SEQ ID NO: 107926 - DNA, 16 bp, H. sapiens
gcccctcagcccggcc

SEQ ID NO: 107927 - DNA, 19 bp, H. sapiens
gcccctccacacctgtggg

SEQ ID NO: 107928 - DNA, 16 bp, H. sapiens
gcccctccagcctggg

SEQ ID NO: 107929 - DNA, 16 bp, H. sapiens
gcccctccccaagcct

SEQ ID NO: 107930 - DNA, 16 bp, H. sapiens
gcccctcccccaagga

SEQ ID NO: 107931 - DNA, 16 bp, H. sapiens
gcccctccctctggga

SEQ ID NO: 107932 - DNA, 16 bp, H. sapiens
gcccctccctgggcct

SEQ ID NO: 107933 - DNA, 16 bp, H. sapiens
gcccctccctgggctg

SEQ ID NO: 107934 - DNA, 16 bp, H. sapiens
gcccctcctgcagccc

SEQ ID NO: 107935 - DNA, 16 bp, H. sapiens
gcccctctagtagctg

SEQ ID NO: 107936 - DNA, 16 bp, H. sapiens
gcccctctatactcta

SEQ ID NO: 107937 - DNA, 16 bp, H. sapiens
gcccctctgcccagct

SEQ ID NO: 107938 - DNA, 16 bp, H. sapiens
gcccctctgcctggcc

SEQ ID NO: 107939 - DNA, 16 bp, H. sapiens
gcccctcttggcctcc

SEQ ID NO: 107940 - DNA, 16 bp, H. sapiens
gcccctcttttccagg

SEQ ID NO: 107941 - DNA, 16 bp, H. sapiens
gcccctgaagaccttc

SEQ ID NO: 107942 - DNA, 16 bp, H. sapiens
gcccctgagaggcaga

SEQ ID NO: 107943 - DNA, 16 bp, H. sapiens
gcccctgagggccatc

SEQ ID NO: 107944 - DNA, 16 bp, H. sapiens
gcccctgcacacacac

SEQ ID NO: 107945 - DNA, 16 bp, H. sapiens
gcccctgcacccagcc

SEQ ID NO: 107946 - DNA, 16 bp, H. sapiens
gcccctgcactccagc

SEQ ID NO: 107947 - DNA, 16 bp, H. sapiens
gcccctgcccaccaaa

SEQ ID NO: 107948 - DNA, 18 bp, H. sapiens
gcccctgccccaggaaag

SEQ ID NO: 107949 - DNA, 16 bp, H. sapiens
gcccctgccctggaga

SEQ ID NO: 107950 - DNA, 16 bp, H. sapiens
gcccctgcctacctct

SEQ ID NO: 107951 - DNA, 16 bp, H. sapiens
gcccctgcctcccaaa

SEQ ID NO: 107952 - DNA, 16 bp, H. sapiens
gcccctgcctctgcct

SEQ ID NO: 107953 - DNA, 16 bp, H. sapiens
gcccctgcctgccaga

SEQ ID NO: 107954 - DNA, 16 bp, H. sapiens
gcccctgcctgcctct

SEQ ID NO: 107955 - DNA, 16 bp, H. sapiens
gcccctgcgcccagcc

SEQ ID NO: 107956 - DNA, 16 bp, H. sapiens
gcccctgctctgccct

SEQ ID NO: 107957 - DNA, 16 bp, H. sapiens
gcccctgctgctgccc

SEQ ID NO: 107958 - DNA, 16 bp, H. sapiens
gcccctggaaaagcca

SEQ ID NO: 107959 - DNA, 16 bp, H. sapiens
gcccctggcaaacact

SEQ ID NO: 107960 - DNA, 16 bp, H. sapiens
gcccctggcaactacc

SEQ ID NO: 107961 - DNA, 16 bp, H. sapiens
gcccctgggcctggcc

SEQ ID NO: 107962 - DNA, 16 bp, H. sapiens
gcccctgggctgctct

SEQ ID NO: 107963 - DNA, 16 bp, H. sapiens
gcccctgtgatcccag

SEQ ID NO: 107964 - DNA, 16 bp, H. sapiens
gcccctgtgcctggct

SEQ ID NO: 107965 - DNA, 16 bp, H. sapiens
gcccctgtggctctgc

SEQ ID NO: 107966 - DNA, 16 bp, H. sapiens
gccccttccccagcct

SEQ ID NO: 107967 - DNA, 16 bp, H. sapiens
gcccgagcctccccga

SEQ ID NO: 107968 - DNA, 16 bp, H. sapiens
gcccgcattgccaagg

SEQ ID NO: 107969 - DNA, 16 bp, H. sapiens
gcccgccaccataccc

SEQ ID NO: 107970 - DNA, 16 bp, H. sapiens
gcccgccaccgcgcct

SEQ ID NO: 107971 - DNA, 16 bp, H. sapiens
gcccgccacgatgccc

SEQ ID NO: 107972 - DNA, 16 bp, H. sapiens
gcccgccagcatgccc

SEQ ID NO: 107973 - DNA, 16 bp, H. sapiens
gcccgccgcagcctcc

SEQ ID NO: 107974 - DNA, 16 bp, H. sapiens
gcccgcctaatttttt

SEQ ID NO: 107975 - DNA, 17 bp, H. sapiens
gcccgcctcagcctcct

SEQ ID NO: 107976 - DNA, 20 bp, H. sapiens
gcccgcctcagtctcccaaa

SEQ ID NO: 107977 - DNA, 16 bp, H. sapiens
gcccgcctcgacttcc

SEQ ID NO: 107978 - DNA, 16 bp, H. sapiens
gcccgcctgggtctcc

SEQ ID NO: 107979 - DNA, 18 bp, H. sapiens
gcccgccttagcctccca

SEQ ID NO: 107980 - DNA, 17 bp, H. sapiens
gcccgccttggccaccc

SEQ ID NO: 107981 - DNA, 16 bp, H. sapiens
gcccgccttgggctcc

SEQ ID NO: 107982 - DNA, 16 bp, H. sapiens
gcccgctaccgcgccc

SEQ ID NO: 107983 - DNA, 16 bp, H. sapiens
gcccggcacggtggct

SEQ ID NO: 107984 - DNA, 16 bp, H. sapiens
gcccggccaagaattt

SEQ ID NO: 107985 - DNA, 16 bp, H. sapiens
gcccggccaatttttg

SEQ ID NO: 107986 - DNA, 17 bp, H. sapiens
gcccggccaccccgtct

SEQ ID NO: 107987 - DNA, 16 bp, H. sapiens
gcccggccagccgctc

SEQ ID NO: 107988 - DNA, 16 bp, H. sapiens
gcccggcccttcctct

SEQ ID NO: 107989 - DNA, 16 bp, H. sapiens
gcccggcctcctgcct

SEQ ID NO: 107990 - DNA, 16 bp, H. sapiens
gcccggcgtggtggtg

SEQ ID NO: 107991 - DNA, 16 bp, H. sapiens
gcccggctaaattttt

SEQ ID NO: 107992 - DNA, 16 bp, H. sapiens
gcccggctaactttgt

SEQ ID NO: 107993 - DNA, 16 bp, H. sapiens
gcccggctaatgtttt

SEQ ID NO: 107994 - DNA, 16 bp, H. sapiens
gcccggctaatttttc

SEQ ID NO: 107995 - DNA, 16 bp, H. sapiens
gcccggctaatttttt

SEQ ID NO: 107996 - DNA, 16 bp, H. sapiens
gcccggctattttttt

SEQ ID NO: 107997 - DNA, 18 bp, H. sapiens
gcccgggctggagtgcag

SEQ ID NO: 107998 - DNA, 16 bp, H. sapiens
gcccgggctggtgtgc

SEQ ID NO: 107999 - DNA, 16 bp, H. sapiens
gcccggggaggttgag

SEQ ID NO: 108000 - DNA, 17 bp, H. sapiens
gcccgggtaatttttgt

SEQ ID NO: 108001 - DNA, 16 bp, H. sapiens
gcccgggtaatttttt

SEQ ID NO: 108002 - DNA, 16 bp, H. sapiens
gcccgggtgtgtgatg

SEQ ID NO: 108003 - DNA, 16 bp, H. sapiens
gcccggtgtggtggtg

SEQ ID NO: 108004 - DNA, 16 bp, H. sapiens
gcccgtaatcccagca

SEQ ID NO: 108005 - DNA, 16 bp, H. sapiens
gccctaatccaatttg

SEQ ID NO: 108006 - DNA, 16 bp, H. sapiens
gccctaatgaatggga

SEQ ID NO: 108007 - DNA, 16 bp, H. sapiens
gccctagaaatctgtg

SEQ ID NO: 108008 - DNA, 16 bp, H. sapiens
gccctagcagaggctc

SEQ ID NO: 108009 - DNA, 16 bp, H. sapiens
gccctcaaggagttca

SEQ ID NO: 108010 - DNA, 16 bp, H. sapiens
gccctcaataaatgct

SEQ ID NO: 108011 - DNA, 16 bp, H. sapiens
gccctcacagccctca

SEQ ID NO: 108012 - DNA, 16 bp, H. sapiens
gccctcaccaatgtgg

SEQ ID NO: 108013 - DNA, 16 bp, H. sapiens
gccctcaccagaagct

SEQ ID NO: 108014 - DNA, 16 bp, H. sapiens
gccctcaccagacacc

SEQ ID NO: 108015 - DNA, 17 bp, H. sapiens
gccctcactcttgcaaa

SEQ ID NO: 108016 - DNA, 16 bp, H. sapiens
gccctcagcccctcct

SEQ ID NO: 108017 - DNA, 16 bp, H. sapiens
gccctcagggagctca

SEQ ID NO: 108018 - DNA, 16 bp, H. sapiens
gccctcataagaagag

SEQ ID NO: 108019 - DNA, 16 bp, H. sapiens
gccctcatcagaaacc

SEQ ID NO: 108020 - DNA, 16 bp, H. sapiens
gccctccagaccccag

SEQ ID NO: 108021 - DNA, 16 bp, H. sapiens
gccctccagcctggcc

SEQ ID NO: 108022 - DNA, 16 bp, H. sapiens
gccctccagcctgggc

SEQ ID NO: 108023 - DNA, 16 bp, H. sapiens
gccctccagcctgggg

SEQ ID NO: 108024 - DNA, 16 bp, H. sapiens
gccctccaggtgatgc

SEQ ID NO: 108025 - DNA, 16 bp, H. sapiens
gccctccatatctgca

SEQ ID NO: 108026 - DNA, 16 bp, H. sapiens
gccctcccagagtgct

SEQ ID NO: 108027 - DNA, 16 bp, H. sapiens
gccctcccaggtgcag

SEQ ID NO: 108028 - DNA, 16 bp, H. sapiens
gccctcccctacctgc

SEQ ID NO: 108029 - DNA, 16 bp, H. sapiens
gccctccctgcctcca

SEQ ID NO: 108030 - DNA, 16 bp, H. sapiens
gccctcctcaacctcc

SEQ ID NO: 108031 - DNA, 16 bp, H. sapiens
gccctcctccctcaga

SEQ ID NO: 108032 - DNA, 16 bp, H. sapiens
gccctcctgcctcagc

SEQ ID NO: 108033 - DNA, 16 bp, H. sapiens
gccctcctgcctgggt

SEQ ID NO: 108034 - DNA, 16 bp, H. sapiens
gccctcctgctgtgtg

SEQ ID NO: 108035 - DNA, 16 bp, H. sapiens
gccctccttggtctcc

SEQ ID NO: 108036 - DNA, 16 bp, H. sapiens
gccctctcctgcccca

SEQ ID NO: 108037 - DNA, 16 bp, H. sapiens
gccctctcctgctctg

SEQ ID NO: 108038 - DNA, 16 bp, H. sapiens
gccctctctgggcagc

SEQ ID NO: 108039 - DNA, 16 bp, H. sapiens
gccctctctgggcctc

SEQ ID NO: 108040 - DNA, 16 bp, H. sapiens
gccctctgcctgtttt

SEQ ID NO: 108041 - DNA, 16 bp, H. sapiens
gccctctgctgcaggt

SEQ ID NO: 108042 - DNA, 16 bp, H. sapiens
gccctctggcttctgg

SEQ ID NO: 108043 - DNA, 16 bp, H. sapiens
gccctctggggctcca

SEQ ID NO: 108044 - DNA, 16 bp, H. sapiens
gccctctgtcagatgg

SEQ ID NO: 108045 - DNA, 16 bp, H. sapiens
gccctcttcccacagc

SEQ ID NO: 108046 - DNA, 16 bp, H. sapiens
gccctcttctcacagt

SEQ ID NO: 108047 - DNA, 16 bp, H. sapiens
gccctcttctctctgg

SEQ ID NO: 108048 - DNA, 16 bp, H. sapiens
gccctgaaggatgagt

SEQ ID NO: 108049 - DNA, 16 bp, H. sapiens
gccctgagctcctggg

SEQ ID NO: 108050 - DNA, 16 bp, H. sapiens
gccctgaggcaggaaa

SEQ ID NO: 108051 - DNA, 16 bp, H. sapiens
gccctgcaaagccaca

SEQ ID NO: 108052 - DNA, 16 bp, H. sapiens
gccctgcacacagtag

SEQ ID NO: 108053 - DNA, 16 bp, H. sapiens
gccctgcagagccaca

SEQ ID NO: 108054 - DNA, 16 bp, H. sapiens
gccctgcagcctgggt

SEQ ID NO: 108055 - DNA, 16 bp, H. sapiens
gccctgcatcccagct

SEQ ID NO: 108056 - DNA, 16 bp, H. sapiens
gccctgccacccaggc

SEQ ID NO: 108057 - DNA, 16 bp, H. sapiens
gccctgccagccccag

SEQ ID NO: 108058 - DNA, 16 bp, H. sapiens
gccctgcccacaccct

SEQ ID NO: 108059 - DNA, 16 bp, H. sapiens
gccctgcccaccacct

SEQ ID NO: 108060 - DNA, 16 bp, H. sapiens
gccctgcccagcccag

SEQ ID NO: 108061 - DNA, 16 bp, H. sapiens
gccctgccccagacct

SEQ ID NO: 108062 - DNA, 16 bp, H. sapiens
gccctgccccagccca

SEQ ID NO: 108063 - DNA, 16 bp, H. sapiens
gccctgccccatgggg

SEQ ID NO: 108064 - DNA, 16 bp, H. sapiens
gccctgcccccaaagg

SEQ ID NO: 108065 - DNA, 16 bp, H. sapiens
gccctgcccccacctg

SEQ ID NO: 108066 - DNA, 16 bp, H. sapiens
gccctgcccccagagg

SEQ ID NO: 108067 - DNA, 16 bp, H. sapiens
gccctgccctcaggga

SEQ ID NO: 108068 - DNA, 16 bp, H. sapiens
gccctgccctgcaggg

SEQ ID NO: 108069 - DNA, 16 bp, H. sapiens
gccctgccctgcctta

SEQ ID NO: 108070 - DNA, 16 bp, H. sapiens
gccctgcccttccctg

SEQ ID NO: 108071 - DNA, 16 bp, H. sapiens
gccctgcctccaacat

SEQ ID NO: 108072 - DNA, 16 bp, H. sapiens
gccctgcctgccccag

SEQ ID NO: 108073 - DNA, 16 bp, H. sapiens
gccctgcctgcctctg

SEQ ID NO: 108074 - DNA, 16 bp, H. sapiens
gccctgcctggcactg

SEQ ID NO: 108075 - DNA, 16 bp, H. sapiens
gccctgctaatttttt

SEQ ID NO: 108076 - DNA, 16 bp, H. sapiens
gccctgctagattttg

SEQ ID NO: 108077 - DNA, 16 bp, H. sapiens
gccctgctcctgcagc

SEQ ID NO: 108078 - DNA, 16 bp, H. sapiens
gccctgctctgccttg

SEQ ID NO: 108079 - DNA, 16 bp, H. sapiens
gccctgctgcactcca

SEQ ID NO: 108080 - DNA, 16 bp, H. sapiens
gccctgctgccctgtg

SEQ ID NO: 108081 - DNA, 16 bp, H. sapiens
gccctgctgctctgtg

SEQ ID NO: 108082 - DNA, 16 bp, H. sapiens
gccctgctgctgcttc

SEQ ID NO: 108083 - DNA, 19 bp, H. sapiens
gccctgctggccccgggca

SEQ ID NO: 108084 - DNA, 16 bp, H. sapiens
gccctgcttcagctgg

SEQ ID NO: 108085 - DNA, 16 bp, H. sapiens
gccctggaaagccggg

SEQ ID NO: 108086 - DNA, 16 bp, H. sapiens
gccctggacccagcca

SEQ ID NO: 108087 - DNA, 16 bp, H. sapiens
gccctggacctggccc

SEQ ID NO: 108088 - DNA, 16 bp, H. sapiens
gccctggagattgagg

SEQ ID NO: 108089 - DNA, 16 bp, H. sapiens
gccctggaggtggagg

SEQ ID NO: 108090 - DNA, 16 bp, H. sapiens
gccctggagttggagg

SEQ ID NO: 108091 - DNA, 16 bp, H. sapiens
gccctggcagcagcag

SEQ ID NO: 108092 - DNA, 16 bp, H. sapiens
gccctggccagccctg

SEQ ID NO: 108093 - DNA, 16 bp, H. sapiens
gccctggcccaggccc

SEQ ID NO: 108094 - DNA, 16 bp, H. sapiens
gccctggccccagccc

SEQ ID NO: 108095 - DNA, 16 bp, H. sapiens
gccctggccctgccct

SEQ ID NO: 108096 - DNA, 16 bp, H. sapiens
gccctggccctggctc

SEQ ID NO: 108097 - DNA, 16 bp, H. sapiens
gccctggcctcccact

SEQ ID NO: 108098 - DNA, 16 bp, H. sapiens
gccctggctcagggag

SEQ ID NO: 108099 - DNA, 16 bp, H. sapiens
gccctggctctgccac

SEQ ID NO: 108100 - DNA, 16 bp, H. sapiens
gccctggctgaggagg

SEQ ID NO: 108101 - DNA, 16 bp, H. sapiens
gccctggctggagtgc

SEQ ID NO: 108102 - DNA, 16 bp, H. sapiens
gccctgggaggggagg

SEQ ID NO: 108103 - DNA, 16 bp, H. sapiens
gccctgggcaccctca

SEQ ID NO: 108104 - DNA, 16 bp, H. sapiens
gccctgggccaggccc

SEQ ID NO: 108105 - DNA, 16 bp, H. sapiens
gccctgggcctcagtt

SEQ ID NO: 108106 - DNA, 16 bp, H. sapiens
gccctgggcctggcca

SEQ ID NO: 108107 - DNA, 16 bp, H. sapiens
gccctgggcctggccc

SEQ ID NO: 108108 - DNA, 16 bp, H. sapiens
gccctgggcctgggcc

SEQ ID NO: 108109 - DNA, 16 bp, H. sapiens
gccctgggctgggcac

SEQ ID NO: 108110 - DNA, 16 bp, H. sapiens
gccctggggagggggc

SEQ ID NO: 108111 - DNA, 16 bp, H. sapiens
gccctggggatctgtg

SEQ ID NO: 108112 - DNA, 16 bp, H. sapiens
gccctggggcaggagg

SEQ ID NO: 108113 - DNA, 16 bp, H. sapiens
gccctggggcaggagt

SEQ ID NO: 108114 - DNA, 16 bp, H. sapiens
gccctgggggcttctg

SEQ ID NO: 108115 - DNA, 16 bp, H. sapiens
gccctgggtcccagcc

SEQ ID NO: 108116 - DNA, 16 bp, H. sapiens
gccctggtcctggccc

SEQ ID NO: 108117 - DNA, 16 bp, H. sapiens
gccctggtttctttta

SEQ ID NO: 108118 - DNA, 16 bp, H. sapiens
gccctgtcacccaagc

SEQ ID NO: 108119 - DNA, 16 bp, H. sapiens
gccctgtcctgccctg

SEQ ID NO: 108120 - DNA, 16 bp, H. sapiens
gccctgtctccaaaca

SEQ ID NO: 108121 - DNA, 16 bp, H. sapiens
gccctgtctgggaggg

SEQ ID NO: 108122 - DNA, 16 bp, H. sapiens
gccctgtgaagaaggt

SEQ ID NO: 108123 - DNA, 17 bp, H. sapiens
gccctgtgcaaatcaga

SEQ ID NO: 108124 - DNA, 16 bp, H. sapiens
gccctgtgctcagaag

SEQ ID NO: 108125 - DNA, 16 bp, H. sapiens
gccctgtggcaccctc

SEQ ID NO: 108126 - DNA, 16 bp, H. sapiens
gccctgtggctggagg

SEQ ID NO: 108127 - DNA, 16 bp, H. sapiens
gccctgtggtgctggg

SEQ ID NO: 108128 - DNA, 16 bp, H. sapiens
gccctgtgtccccacc

SEQ ID NO: 108129 - DNA, 16 bp, H. sapiens
gccctgtgtctcagct

SEQ ID NO: 108130 - DNA, 16 bp, H. sapiens
gccctgttgctcaggc

SEQ ID NO: 108131 - DNA, 16 bp, H. sapiens
gccctgttggccaggc

SEQ ID NO: 108132 - DNA, 16 bp, H. sapiens
gcccttaacatttctt

SEQ ID NO: 108133 - DNA, 16 bp, H. sapiens
gcccttaatatttttt

SEQ ID NO: 108134 - DNA, 16 bp, H. sapiens
gcccttcacatttttt

SEQ ID NO: 108135 - DNA, 17 bp, H. sapiens
gcccttcagcccaccac

SEQ ID NO: 108136 - DNA, 16 bp, H. sapiens
gcccttcagcctgctg

SEQ ID NO: 108137 - DNA, 16 bp, H. sapiens
gcccttcctccaacac

SEQ ID NO: 108138 - DNA, 16 bp, H. sapiens
gcccttctcagcctct

SEQ ID NO: 108139 - DNA, 16 bp, H. sapiens
gcccttgagctgctgc

SEQ ID NO: 108140 - DNA, 16 bp, H. sapiens
gcccttgcccttgccc

SEQ ID NO: 108141 - DNA, 16 bp, H. sapiens
gccctttaaaaaaaaa

SEQ ID NO: 108142 - DNA, 16 bp, H. sapiens
gccctttacagagaaa

SEQ ID NO: 108143 - DNA, 16 bp, H. sapiens
gccctttatttattta

SEQ ID NO: 108144 - DNA, 16 bp, H. sapiens
gccctttatttcttcc

SEQ ID NO: 108145 - DNA, 16 bp, H. sapiens
gccctttgtcttcagt

SEQ ID NO: 108146 - DNA, 16 bp, H. sapiens
gccgaagtgggtggat

SEQ ID NO: 108147 - DNA, 16 bp, H. sapiens
gccgagagtgcagcct

SEQ ID NO: 108148 - DNA, 16 bp, H. sapiens
gccgagatagcgccat

SEQ ID NO: 108149 - DNA, 16 bp, H. sapiens
gccgagatcgtgctgc

SEQ ID NO: 108150 - DNA, 16 bp, H. sapiens
gccgagatgggaggat

SEQ ID NO: 108151 - DNA, 16 bp, H. sapiens
gccgagcatggtggca

SEQ ID NO: 108152 - DNA, 16 bp, H. sapiens
gccgagcatggtggtg

SEQ ID NO: 108153 - DNA, 16 bp, H. sapiens
gccgaggagggaggat

SEQ ID NO: 108154 - DNA, 16 bp, H. sapiens
gccgaggcagaaggat

SEQ ID NO: 108155 - DNA, 16 bp, H. sapiens
gccgaggcaggaagac

SEQ ID NO: 108156 - DNA, 16 bp, H. sapiens
gccgaggcaggaggac

SEQ ID NO: 108157 - DNA, 17 bp, H. sapiens
gccgaggcaggtggatt

SEQ ID NO: 108158 - DNA, 16 bp, H. sapiens
gccgaggcgggtggaa

SEQ ID NO: 108159 - DNA, 23 bp, H. sapiens
gccgaggcgggtggatcacctaa

SEQ ID NO: 108160 - DNA, 18 bp, H. sapiens
gccgaggcgggtggatct

SEQ ID NO: 108161 - DNA, 16 bp, H. sapiens
gccgaggctggaagat

SEQ ID NO: 108162 - DNA, 16 bp, H. sapiens
gccgaggtaggaggat

SEQ ID NO: 108163 - DNA, 16 bp, H. sapiens
gccgaggtgaaaggat

SEQ ID NO: 108164 - DNA, 16 bp, H. sapiens
gccgaggtgggaggag

SEQ ID NO: 108165 - DNA, 16 bp, H. sapiens
gccgaggtgggaggat

SEQ ID NO: 108166 - DNA, 16 bp, H. sapiens
gccgaggtgggcaggt

SEQ ID NO: 108167 - DNA, 16 bp, H. sapiens
gccgaggtggggggat

SEQ ID NO: 108168 - DNA, 16 bp, H. sapiens
gccgaggtgggtggaa

SEQ ID NO: 108169 - DNA, 16 bp, H. sapiens
gccgaggtgggtgggt

SEQ ID NO: 108170 - DNA, 16 bp, H. sapiens
gccgcactgacttcca

SEQ ID NO: 108171 - DNA, 16 bp, H. sapiens
gccgcagccgcagccg

SEQ ID NO: 108172 - DNA, 16 bp, H. sapiens
gccgcatatctacaac

SEQ ID NO: 108173 - DNA, 16 bp, H. sapiens
gccgcatgtctacaac

SEQ ID NO: 108174 - DNA, 16 bp, H. sapiens
gccgccacgcccagct

SEQ ID NO: 108175 - DNA, 16 bp, H. sapiens
gccgccacgcctgact

SEQ ID NO: 108176 - DNA, 16 bp, H. sapiens
gccgcccaggctggaa

SEQ ID NO: 108177 - DNA, 16 bp, H. sapiens
gccgccccctgctcca

SEQ ID NO: 108178 - DNA, 16 bp, H. sapiens
gccgcccgggttcaag

SEQ ID NO: 108179 - DNA, 16 bp, H. sapiens
gccgccgtgcccagcc

SEQ ID NO: 108180 - DNA, 16 bp, H. sapiens
gccgcctcagcctccc

SEQ ID NO: 108181 - DNA, 16 bp, H. sapiens
gccgcgcaggagccca

SEQ ID NO: 108182 - DNA, 16 bp, H. sapiens
gccgctaagctgagaa

SEQ ID NO: 108183 - DNA, 16 bp, H. sapiens
gccgctgaactccagc

SEQ ID NO: 108184 - DNA, 16 bp, H. sapiens
gccgctgcaccccagc

SEQ ID NO: 108185 - DNA, 16 bp, H. sapiens
gccgctgcacctggct

SEQ ID NO: 108186 - DNA, 16 bp, H. sapiens
gccgctgcctcccggg

SEQ ID NO: 108187 - DNA, 24 bp, H. sapiens
gccgcttcggcaggcccagctccc

SEQ ID NO: 108188 - DNA, 17 bp, H. sapiens
gccgctttacttccaaa

SEQ ID NO: 108189 - DNA, 16 bp, H. sapiens
gccggacatggtggtg

SEQ ID NO: 108190 - DNA, 16 bp, H. sapiens
gccggcagtgctgggg

SEQ ID NO: 108191 - DNA, 16 bp, H. sapiens
gccggccaggtgcggt

SEQ ID NO: 108192 - DNA, 16 bp, H. sapiens
gccggccctgctggcc

SEQ ID NO: 108193 - DNA, 17 bp, H. sapiens
gccggccggccctgctg

SEQ ID NO: 108194 - DNA, 16 bp, H. sapiens
gccggctgcggtggct

SEQ ID NO: 108195 - DNA, 16 bp, H. sapiens
gccgggacatggatga

SEQ ID NO: 108196 - DNA, 16 bp, H. sapiens
gccgggaccacaggcg

SEQ ID NO: 108197 - DNA, 16 bp, H. sapiens
gccgggaggcagaggt

SEQ ID NO: 108198 - DNA, 16 bp, H. sapiens
gccgggcaaggtggtg

SEQ ID NO: 108199 - DNA, 16 bp, H. sapiens
gccgggcacagtggtt

SEQ ID NO: 108200 - DNA, 16 bp, H. sapiens
gccgggcaccgtggct

SEQ ID NO: 108201 - DNA, 16 bp, H. sapiens
gccgggcagagacact

SEQ ID NO: 108202 - DNA, 16 bp, H. sapiens
gccgggcagaggagct

SEQ ID NO: 108203 - DNA, 17 bp, H. sapiens
gccgggcaggggggctg

SEQ ID NO: 108204 - DNA, 16 bp, H. sapiens
gccgggcatggcagtg

SEQ ID NO: 108205 - DNA, 16 bp, H. sapiens
gccgggccctgtggct

SEQ ID NO: 108206 - DNA, 16 bp, H. sapiens
gccgggcctggtggtg

SEQ ID NO: 108207 - DNA, 16 bp, H. sapiens
gccgggcgaggtggca

SEQ ID NO: 108208 - DNA, 16 bp, H. sapiens
gccgggcgcagcggct

SEQ ID NO: 108209 - DNA, 16 bp, H. sapiens
gccgggcgcaggggct

SEQ ID NO: 108210 - DNA, 16 bp, H. sapiens
gccgggcgcggtggca

SEQ ID NO: 108211 - DNA, 18 bp, H. sapiens
gccgggcgctgtggctca

SEQ ID NO: 108212 - DNA, 16 bp, H. sapiens
gccgggcggagtggct

SEQ ID NO: 108213 - DNA, 16 bp, H. sapiens
gccgggcgggaggctg

SEQ ID NO: 108214 - DNA, 16 bp, H. sapiens
gccgggcgtgctggca

SEQ ID NO: 108215 - DNA, 16 bp, H. sapiens
gccgggcgtgggggca

SEQ ID NO: 108216 - DNA, 16 bp, H. sapiens
gccgggcgtggtgact

SEQ ID NO: 108217 - DNA, 16 bp, H. sapiens
gccgggcgtggtgtcg

SEQ ID NO: 108218 - DNA, 16 bp, H. sapiens
gccgggcgtggttgca

SEQ ID NO: 108219 - DNA, 16 bp, H. sapiens
gccgggctcacgcctg

SEQ ID NO: 108220 - DNA, 16 bp, H. sapiens
gccggggtgcagtggc

SEQ ID NO: 108221 - DNA, 16 bp, H. sapiens
gccggggtgggtggat

SEQ ID NO: 108222 - DNA, 16 bp, H. sapiens
gccgggtgcggaggct

SEQ ID NO: 108223 - DNA, 16 bp, H. sapiens
gccggtcacggtggct

SEQ ID NO: 108224 - DNA, 16 bp, H. sapiens
gccgtgatggcaccac

SEQ ID NO: 108225 - DNA, 16 bp, H. sapiens
gccgtgattgtgaggc

SEQ ID NO: 108226 - DNA, 16 bp, H. sapiens
gccgtggctcacacct

SEQ ID NO: 108227 - DNA, 16 bp, H. sapiens
gccgtggtgtgatctc

SEQ ID NO: 108228 - DNA, 16 bp, H. sapiens
gcctaagcccaggagg

SEQ ID NO: 108229 - DNA, 16 bp, H. sapiens
gcctaagtaacaaaag

SEQ ID NO: 108230 - DNA, 16 bp, H. sapiens
gcctaatccttcctct

SEQ ID NO: 108231 - DNA, 16 bp, H. sapiens
gcctaatttcattctt

SEQ ID NO: 108232 - DNA, 16 bp, H. sapiens
gcctacaagaaataca

SEQ ID NO: 108233 - DNA, 16 bp, H. sapiens
gcctacaccacaaggg

SEQ ID NO: 108234 - DNA, 16 bp, H. sapiens
gcctacagaggcagga

SEQ ID NO: 108235 - DNA, 16 bp, H. sapiens
gcctaccaaagtgttg

SEQ ID NO: 108236 - DNA, 16 bp, H. sapiens
gcctacctcagcctcc

SEQ ID NO: 108237 - DNA, 16 bp, H. sapiens
gcctacctcatagggt

SEQ ID NO: 108238 - DNA, 16 bp, H. sapiens
gcctacctcggcctcc

SEQ ID NO: 108239 - DNA, 16 bp, H. sapiens
gcctaccttggtctcc

SEQ ID NO: 108240 - DNA, 16 bp, H. sapiens
gcctactaaagtgctg

SEQ ID NO: 108241 - DNA, 16 bp, H. sapiens
gcctactatgagccag

SEQ ID NO: 108242 - DNA, 16 bp, H. sapiens
gcctactatgtgtcag

SEQ ID NO: 108243 - DNA, 16 bp, H. sapiens
gcctactcactaaaat

SEQ ID NO: 108244 - DNA, 16 bp, H. sapiens
gcctactcctgactaa

SEQ ID NO: 108245 - DNA, 16 bp, H. sapiens
gcctactgaatcagaa

SEQ ID NO: 108246 - DNA, 16 bp, H. sapiens
gcctactgcaacctcc

SEQ ID NO: 108247 - DNA, 16 bp, H. sapiens
gcctactgtgtgctag

SEQ ID NO: 108248 - DNA, 16 bp, H. sapiens
gcctacttccccttcc

SEQ ID NO: 108249 - DNA, 16 bp, H. sapiens
gcctacttgagggtga

SEQ ID NO: 108250 - DNA, 16 bp, H. sapiens
gcctagacatccaggt

SEQ ID NO: 108251 - DNA, 16 bp, H. sapiens
gcctagatgggtggat

SEQ ID NO: 108252 - DNA, 16 bp, H. sapiens
gcctaggaaccagacc

SEQ ID NO: 108253 - DNA, 16 bp, H. sapiens
gcctaggcaacagagc

SEQ ID NO: 108254 - DNA, 16 bp, H. sapiens
gcctaggcaggtggat

SEQ ID NO: 108255 - DNA, 21 bp, H. sapiens
gcctaggcctcccaaagtgct

SEQ ID NO: 108256 - DNA, 16 bp, H. sapiens
gcctaggcgacagagc

SEQ ID NO: 108257 - DNA, 16 bp, H. sapiens
gcctaggctggagcgc

SEQ ID NO: 108258 - DNA, 17 bp, H. sapiens
gcctaggctggagtaca

SEQ ID NO: 108259 - DNA, 16 bp, H. sapiens
gcctaggtgacagagg

SEQ ID NO: 108260 - DNA, 16 bp, H. sapiens
gcctaggtgggcggat

SEQ ID NO: 108261 - DNA, 16 bp, H. sapiens
gcctagtggagctttg

SEQ ID NO: 108262 - DNA, 16 bp, H. sapiens
gcctataatcccagcc

SEQ ID NO: 108263 - DNA, 16 bp, H. sapiens
gcctataatcctggca

SEQ ID NO: 108264 - DNA, 16 bp, H. sapiens
gcctatagtcctaact

SEQ ID NO: 108265 - DNA, 16 bp, H. sapiens
gcctatagtctcaact

SEQ ID NO: 108266 - DNA, 16 bp, H. sapiens
gcctatatctttctcc

SEQ ID NO: 108267 - DNA, 16 bp, H. sapiens
gcctatcaacccatca

SEQ ID NO: 108268 - DNA, 16 bp, H. sapiens
gcctatcccaaaccta

SEQ ID NO: 108269 - DNA, 16 bp, H. sapiens
gcctattgtggaacct

SEQ ID NO: 108270 - DNA, 16 bp, H. sapiens
gcctcaaaaaaaaaag

SEQ ID NO: 108271 - DNA, 16 bp, H. sapiens
gcctcaaaaaaaataa

SEQ ID NO: 108272 - DNA, 16 bp, H. sapiens
gcctcaaaaaagaaaa

SEQ ID NO: 108273 - DNA, 16 bp, H. sapiens
gcctcaaactcctgca

SEQ ID NO: 108274 - DNA, 16 bp, H. sapiens
gcctcaaactcctgcc

SEQ ID NO: 108275 - DNA, 16 bp, H. sapiens
gcctcaaagtgctccc

SEQ ID NO: 108276 - DNA, 16 bp, H. sapiens
gcctcaaagtgctgca

SEQ ID NO: 108277 - DNA, 16 bp, H. sapiens
gcctcaaccccccagg

SEQ ID NO: 108278 - DNA, 16 bp, H. sapiens
gcctcaacctccagaa

SEQ ID NO: 108279 - DNA, 16 bp, H. sapiens
gcctcaacctccccag

SEQ ID NO: 108280 - DNA, 16 bp, H. sapiens
gcctcaacctcctgat

SEQ ID NO: 108281 - DNA, 16 bp, H. sapiens
gcctcaacctctcagg

SEQ ID NO: 108282 - DNA, 16 bp, H. sapiens
gcctcaacctctccag

SEQ ID NO: 108283 - DNA, 16 bp, H. sapiens
gcctcaacctctctgg

SEQ ID NO: 108284 - DNA, 16 bp, H. sapiens
gcctcaactgatcctc

SEQ ID NO: 108285 - DNA, 16 bp, H. sapiens
gcctcaactgcccagg

SEQ ID NO: 108286 - DNA, 16 bp, H. sapiens
gcctcaactgcctggg

SEQ ID NO: 108287 - DNA, 16 bp, H. sapiens
gcctcaagcaatcctc

SEQ ID NO: 108288 - DNA, 16 bp, H. sapiens
gcctcaagcagttctt

SEQ ID NO: 108289 - DNA, 16 bp, H. sapiens
gcctcaagtgatctcc

SEQ ID NO: 108290 - DNA, 16 bp, H. sapiens
gcctcaatctccctgg

SEQ ID NO: 108291 - DNA, 16 bp, H. sapiens
gcctcaatgagctctc

SEQ ID NO: 108292 - DNA, 16 bp, H. sapiens
gcctcaatgggctctg

SEQ ID NO: 108293 - DNA, 16 bp, H. sapiens
gcctcaatttctccat

SEQ ID NO: 108294 - DNA, 16 bp, H. sapiens
gcctcacactacctga

SEQ ID NO: 108295 - DNA, 16 bp, H. sapiens
gcctcacactcctgag

SEQ ID NO: 108296 - DNA, 29 bp, H. sapiens
gcctcacagcggactctccacgcccagct

SEQ ID NO: 108297 - DNA, 16 bp, H. sapiens
gcctcacccagctccc

SEQ ID NO: 108298 - DNA, 16 bp, H. sapiens
gcctcacccagctcct

SEQ ID NO: 108299 - DNA, 16 bp, H. sapiens
gcctcacccagcttct

SEQ ID NO: 108300 - DNA, 16 bp, H. sapiens
gcctcaccctcctggg

SEQ ID NO: 108301 - DNA, 16 bp, H. sapiens
gcctcacgcctgtaat

SEQ ID NO: 108302 - DNA, 16 bp, H. sapiens
gcctcacgggttcaag

SEQ ID NO: 108303 - DNA, 22 bp, H. sapiens
gcctcacggtggcctctccagg

SEQ ID NO: 108304 - DNA, 16 bp, H. sapiens
gcctcactatattgcc

SEQ ID NO: 108305 - DNA, 16 bp, H. sapiens
gcctcactttgtcacc

SEQ ID NO: 108306 - DNA, 16 bp, H. sapiens
gcctcagaaccaggga

SEQ ID NO: 108307 - DNA, 16 bp, H. sapiens
gcctcagaactgtgag

SEQ ID NO: 108308 - DNA, 16 bp, H. sapiens
gcctcagaaggagcca

SEQ ID NO: 108309 - DNA, 16 bp, H. sapiens
gcctcagagaagagag

SEQ ID NO: 108310 - DNA, 16 bp, H. sapiens
gcctcagatatttctt

SEQ ID NO: 108311 - DNA, 16 bp, H. sapiens
gcctcagccacccagg

SEQ ID NO: 108312 - DNA, 16 bp, H. sapiens
gcctcagccacctccc

SEQ ID NO: 108313 - DNA, 16 bp, H. sapiens
gcctcagccagcccag

SEQ ID NO: 108314 - DNA, 16 bp, H. sapiens
gcctcagcccccaaag

SEQ ID NO: 108315 - DNA, 16 bp, H. sapiens
gcctcagccccctctg

SEQ ID NO: 108316 - DNA, 16 bp, H. sapiens
gcctcagcccgcctgc

SEQ ID NO: 108317 - DNA, 16 bp, H. sapiens
gcctcagccgccccag

SEQ ID NO: 108318 - DNA, 16 bp, H. sapiens
gcctcagcctaccagg

SEQ ID NO: 108319 - DNA, 16 bp, H. sapiens
gcctcagcctcagccc

SEQ ID NO: 108320 - DNA, 16 bp, H. sapiens
gcctcagcctcagctg

SEQ ID NO: 108321 - DNA, 16 bp, H. sapiens
gcctcagcctccacag

SEQ ID NO: 108322 - DNA, 21 bp, H. sapiens
gcctcagcctcccaagcagct

SEQ ID NO: 108323 - DNA, 16 bp, H. sapiens
gcctcagcctcccacc

SEQ ID NO: 108324 - DNA, 16 bp, H. sapiens
gcctcagcctccgagt

SEQ ID NO: 108325 - DNA, 16 bp, H. sapiens
gcctcagcctcctaga

SEQ ID NO: 108326 - DNA, 16 bp, H. sapiens
gcctcagcctcctgaa

SEQ ID NO: 108327 - DNA, 16 bp, H. sapiens
gcctcagcctctccca

SEQ ID NO: 108328 - DNA, 16 bp, H. sapiens
gcctcagcctctgaaa

SEQ ID NO: 108329 - DNA, 23 bp, H. sapiens
gcctcagcctctggagtagctgg

SEQ ID NO: 108330 - DNA, 16 bp, H. sapiens
gcctcagcctttggag

SEQ ID NO: 108331 - DNA, 16 bp, H. sapiens
gcctcagcgtccccag

SEQ ID NO: 108332 - DNA, 16 bp, H. sapiens
gcctcagctcccaaag

SEQ ID NO: 108333 - DNA, 16 bp, H. sapiens
gcctcagctccctgag

SEQ ID NO: 108334 - DNA, 16 bp, H. sapiens
gcctcagctgcctgag

SEQ ID NO: 108335 - DNA, 16 bp, H. sapiens
gcctcagcttccaaag

SEQ ID NO: 108336 - DNA, 16 bp, H. sapiens
gcctcagcttccccat

SEQ ID NO: 108337 - DNA, 16 bp, H. sapiens
gcctcagcttcctcat

SEQ ID NO: 108338 - DNA, 16 bp, H. sapiens
gcctcagcttctcaaa

SEQ ID NO: 108339 - DNA, 16 bp, H. sapiens
gcctcaggaagtttcc

SEQ ID NO: 108340 - DNA, 16 bp, H. sapiens
gcctcaggactctgcc

SEQ ID NO: 108341 - DNA, 16 bp, H. sapiens
gcctcaggcaggccct

SEQ ID NO: 108342 - DNA, 16 bp, H. sapiens
gcctcaggcagtcctc

SEQ ID NO: 108343 - DNA, 16 bp, H. sapiens
gcctcaggcccccaag

SEQ ID NO: 108344 - DNA, 16 bp, H. sapiens
gcctcaggctccctag

SEQ ID NO: 108345 - DNA, 16 bp, H. sapiens
gcctcagggcccttgc

SEQ ID NO: 108346 - DNA, 16 bp, H. sapiens
gcctcagggcctttgc

SEQ ID NO: 108347 - DNA, 18 bp, H. sapiens
gcctcaggtgatccaccc

SEQ ID NO: 108348 - DNA, 16 bp, H. sapiens
gcctcagttccctcat

SEQ ID NO: 108349 - DNA, 16 bp, H. sapiens
gcctcagttccctcct

SEQ ID NO: 108350 - DNA, 16 bp, H. sapiens
gcctcagttccctctt

SEQ ID NO: 108351 - DNA, 16 bp, H. sapiens
gcctcagtttccacct

SEQ ID NO: 108352 - DNA, 16 bp, H. sapiens
gcctcagtttccccaa

SEQ ID NO: 108353 - DNA, 16 bp, H. sapiens
gcctcagtttccccag

SEQ ID NO: 108354 - DNA, 16 bp, H. sapiens
gcctcagtttccccat

SEQ ID NO: 108355 - DNA, 16 bp, H. sapiens
gcctcagtttccctgt

SEQ ID NO: 108356 - DNA, 16 bp, H. sapiens
gcctcagtttcctcac

SEQ ID NO: 108357 - DNA, 16 bp, H. sapiens
gcctcagtttcctcct

SEQ ID NO: 108358 - DNA, 16 bp, H. sapiens
gcctcagtttcctctt

SEQ ID NO: 108359 - DNA, 16 bp, H. sapiens
gcctcagtttcctgtc

SEQ ID NO: 108360 - DNA, 16 bp, H. sapiens
gcctcagtttcctttt

SEQ ID NO: 108361 - DNA, 16 bp, H. sapiens
gcctcagtttctccat

SEQ ID NO: 108362 - DNA, 16 bp, H. sapiens
gcctcagtttctcctc

SEQ ID NO: 108363 - DNA, 16 bp, H. sapiens
gcctcagtttctctgt

SEQ ID NO: 108364 - DNA, 16 bp, H. sapiens
gcctcagttttatcat

SEQ ID NO: 108365 - DNA, 16 bp, H. sapiens
gcctcagttttctcat

SEQ ID NO: 108366 - DNA, 16 bp, H. sapiens
gcctcagttttcttat

SEQ ID NO: 108367 - DNA, 16 bp, H. sapiens
gcctcatcctccccag

SEQ ID NO: 108368 - DNA, 16 bp, H. sapiens
gcctcatgaatgggat

SEQ ID NO: 108369 - DNA, 17 bp, H. sapiens
gcctcatgccagcaggc

SEQ ID NO: 108370 - DNA, 16 bp, H. sapiens
gcctcattgctctggc

SEQ ID NO: 108371 - DNA, 16 bp, H. sapiens
gcctcatttatttatt

SEQ ID NO: 108372 - DNA, 16 bp, H. sapiens
gcctcattttaattta

SEQ ID NO: 108373 - DNA, 16 bp, H. sapiens
gcctcattttatttta

SEQ ID NO: 108374 - DNA, 16 bp, H. sapiens
gcctcattttccacat

SEQ ID NO: 108375 - DNA, 16 bp, H. sapiens
gcctccaaaaatgttg

SEQ ID NO: 108376 - DNA, 16 bp, H. sapiens
gcctccaaagtttctg

SEQ ID NO: 108377 - DNA, 16 bp, H. sapiens
gcctccaaggttcaag

SEQ ID NO: 108378 - DNA, 16 bp, H. sapiens
gcctccaagtgctggg

SEQ ID NO: 108379 - DNA, 16 bp, H. sapiens
gcctccacaactgtga

SEQ ID NO: 108380 - DNA, 16 bp, H. sapiens
gcctccacagaagcca

SEQ ID NO: 108381 - DNA, 16 bp, H. sapiens
gcctccaccacccagg

SEQ ID NO: 108382 - DNA, 16 bp, H. sapiens
gcctccaccctcaagt

SEQ ID NO: 108383 - DNA, 16 bp, H. sapiens
gcctccacctcccaga

SEQ ID NO: 108384 - DNA, 16 bp, H. sapiens
gcctccacctccccag

SEQ ID NO: 108385 - DNA, 16 bp, H. sapiens
gcctccacctcctgag

SEQ ID NO: 108386 - DNA, 16 bp, H. sapiens
gcctccacctgcatcc

SEQ ID NO: 108387 - DNA, 16 bp, H. sapiens
gcctccacgcccagct

SEQ ID NO: 108388 - DNA, 16 bp, H. sapiens
gcctccactgatctga

SEQ ID NO: 108389 - DNA, 16 bp, H. sapiens
gcctccacttcccggg

SEQ ID NO: 108390 - DNA, 16 bp, H. sapiens
gcctccagaactgtga

SEQ ID NO: 108391 - DNA, 16 bp, H. sapiens
gcctccagaactttga

SEQ ID NO: 108392 - DNA, 16 bp, H. sapiens
gcctccagaagctgga

SEQ ID NO: 108393 - DNA, 16 bp, H. sapiens
gcctccagaagtgttg

SEQ ID NO: 108394 - DNA, 16 bp, H. sapiens
gcctccagaatagcta

SEQ ID NO: 108395 - DNA, 16 bp, H. sapiens
gcctccagagctgaga

SEQ ID NO: 108396 - DNA, 16 bp, H. sapiens
gcctccagagtagatg

SEQ ID NO: 108397 - DNA, 16 bp, H. sapiens
gcctccagatttgctc

SEQ ID NO: 108398 - DNA, 16 bp, H. sapiens
gcctccagccaggagg

SEQ ID NO: 108399 - DNA, 16 bp, H. sapiens
gcctccagcccagccc

SEQ ID NO: 108400 - DNA, 16 bp, H. sapiens
gcctccagcctccagc

SEQ ID NO: 108401 - DNA, 16 bp, H. sapiens
gcctccagctccacct

SEQ ID NO: 108402 - DNA, 16 bp, H. sapiens
gcctccagctcctggg

SEQ ID NO: 108403 - DNA, 16 bp, H. sapiens
gcctccagctctgtcc

SEQ ID NO: 108404 - DNA, 16 bp, H. sapiens
gcctccagcttcaccc

SEQ ID NO: 108405 - DNA, 16 bp, H. sapiens
gcctccagggttcaag

SEQ ID NO: 108406 - DNA, 16 bp, H. sapiens
gcctccatccctgcca

SEQ ID NO: 108407 - DNA, 16 bp, H. sapiens
gcctccatctcaaaaa

SEQ ID NO: 108408 - DNA, 16 bp, H. sapiens
gcctccatctccctgg

SEQ ID NO: 108409 - DNA, 16 bp, H. sapiens
gcctccatctcctgga

SEQ ID NO: 108410 - DNA, 16 bp, H. sapiens
gcctccatctcctggg

SEQ ID NO: 108411 - DNA, 16 bp, H. sapiens
gcctccatcttcccat

SEQ ID NO: 108412 - DNA, 16 bp, H. sapiens
gcctccatgacccaaa

SEQ ID NO: 108413 - DNA, 16 bp, H. sapiens
gcctccatttcctggg

SEQ ID NO: 108414 - DNA, 16 bp, H. sapiens
gcctccatttccttct

SEQ ID NO: 108415 - DNA, 16 bp, H. sapiens
gcctcccaaaaatgtt

SEQ ID NO: 108416 - DNA, 16 bp, H. sapiens
gcctcccaaaacactg

SEQ ID NO: 108417 - DNA, 16 bp, H. sapiens
gcctcccaaaacgctg

SEQ ID NO: 108418 - DNA, 16 bp, H. sapiens
gcctcccaaaatattg

SEQ ID NO: 108419 - DNA, 16 bp, H. sapiens
gcctcccaaaatgctg

SEQ ID NO: 108420 - DNA, 16 bp, H. sapiens
gcctcccaaaatggtg

SEQ ID NO: 108421 - DNA, 16 bp, H. sapiens
gcctcccaaaatgttg

SEQ ID NO: 108422 - DNA, 16 bp, H. sapiens
gcctcccaaagagctg

SEQ ID NO: 108423 - DNA, 16 bp, H. sapiens
gcctcccaaagcactg

SEQ ID NO: 108424 - DNA, 16 bp, H. sapiens
gcctcccaaagtgaaa

SEQ ID NO: 108425 - DNA, 16 bp, H. sapiens
gcctcccaaagtgagc

SEQ ID NO: 108426 - DNA, 16 bp, H. sapiens
gcctcccaaagtgagg

SEQ ID NO: 108427 - DNA, 16 bp, H. sapiens
gcctcccaaagtgatg

SEQ ID NO: 108428 - DNA, 16 bp, H. sapiens
gcctcccaaagtgcag

SEQ ID NO: 108429 - DNA, 16 bp, H. sapiens
gcctcccaaagtgcgg

SEQ ID NO: 108430 - DNA, 16 bp, H. sapiens
gcctcccaaagtgctc

SEQ ID NO: 108431 - DNA, 16 bp, H. sapiens
gcctcccaaagtggtg

SEQ ID NO: 108432 - DNA, 16 bp, H. sapiens
gcctcccaaagtgtgg

SEQ ID NO: 108433 - DNA, 16 bp, H. sapiens
gcctcccaaagttcag

SEQ ID NO: 108434 - DNA, 16 bp, H. sapiens
gcctcccaacatgttg

SEQ ID NO: 108435 - DNA, 16 bp, H. sapiens
gcctcccaacctgctg

SEQ ID NO: 108436 - DNA, 16 bp, H. sapiens
gcctcccaagaggctg

SEQ ID NO: 108437 - DNA, 16 bp, H. sapiens
gcctcccaagcagccg

SEQ ID NO: 108438 - DNA, 16 bp, H. sapiens
gcctcccaaggttctg

SEQ ID NO: 108439 - DNA, 16 bp, H. sapiens
gcctcccaagtaggtg

SEQ ID NO: 108440 - DNA, 16 bp, H. sapiens
gcctcccaagtcctgg

SEQ ID NO: 108441 - DNA, 16 bp, H. sapiens
gcctcccaagttcaac

SEQ ID NO: 108442 - DNA, 16 bp, H. sapiens
gcctcccaagttcaag

SEQ ID NO: 108443 - DNA, 16 bp, H. sapiens
gcctcccacactgctg

SEQ ID NO: 108444 - DNA, 16 bp, H. sapiens
gcctcccacagtcctg

SEQ ID NO: 108445 - DNA, 16 bp, H. sapiens
gcctcccacattcaag

SEQ ID NO: 108446 - DNA, 16 bp, H. sapiens
gcctcccaccatgccc

SEQ ID NO: 108447 - DNA, 16 bp, H. sapiens
gcctcccacctctgcc

SEQ ID NO: 108448 - DNA, 16 bp, H. sapiens
gcctcccacgttcaag

SEQ ID NO: 108449 - DNA, 16 bp, H. sapiens
gcctcccagagggctg

SEQ ID NO: 108450 - DNA, 16 bp, H. sapiens
gcctcccagattaaag

SEQ ID NO: 108451 - DNA, 16 bp, H. sapiens
gcctcccagattcaag

SEQ ID NO: 108452 - DNA, 16 bp, H. sapiens
gcctcccagattcagg

SEQ ID NO: 108453 - DNA, 16 bp, H. sapiens
gcctcccagcactttg

SEQ ID NO: 108454 - DNA, 16 bp, H. sapiens
gcctcccagcctccca

SEQ ID NO: 108455 - DNA, 16 bp, H. sapiens
gcctcccagcctgcat

SEQ ID NO: 108456 - DNA, 16 bp, H. sapiens
gcctcccaggatcaag

SEQ ID NO: 108457 - DNA, 16 bp, H. sapiens
gcctcccaggctcaag

SEQ ID NO: 108458 - DNA, 16 bp, H. sapiens
gcctcccaggctcatg

SEQ ID NO: 108459 - DNA, 16 bp, H. sapiens
gcctcccaggtacaag

SEQ ID NO: 108460 - DNA, 16 bp, H. sapiens
gcctcccaggttcaaa

SEQ ID NO: 108461 - DNA, 16 bp, H. sapiens
gcctcccaggttcaac

SEQ ID NO: 108462 - DNA, 16 bp, H. sapiens
gcctcccaggttcaag

SEQ ID NO: 108463 - DNA, 16 bp, H. sapiens
gcctcccaggttcaat

SEQ ID NO: 108464 - DNA, 16 bp, H. sapiens
gcctcccaggttcagg

SEQ ID NO: 108465 - DNA, 16 bp, H. sapiens
gcctcccaggttccag

SEQ ID NO: 108466 - DNA, 16 bp, H. sapiens
gcctcccaggttgaag

SEQ ID NO: 108467 - DNA, 16 bp, H. sapiens
gcctcccaggtttcag

SEQ ID NO: 108468 - DNA, 16 bp, H. sapiens
gcctcccagtgctggg

SEQ ID NO: 108469 - DNA, 16 bp, H. sapiens
gcctcccagtttcaag

SEQ ID NO: 108470 - DNA, 16 bp, H. sapiens
gcctcccatactgctg

SEQ ID NO: 108471 - DNA, 16 bp, H. sapiens
gcctcccatattcaag

SEQ ID NO: 108472 - DNA, 16 bp, H. sapiens
gcctcccatgtagctg

SEQ ID NO: 108473 - DNA, 16 bp, H. sapiens
gcctccccaagtggtg

SEQ ID NO: 108474 - DNA, 16 bp, H. sapiens
gcctccccagcagctg

SEQ ID NO: 108475 - DNA, 16 bp, H. sapiens
gcctccccagcagttg

SEQ ID NO: 108476 - DNA, 16 bp, H. sapiens
gcctccccagccctga

SEQ ID NO: 108477 - DNA, 16 bp, H. sapiens
gcctccccagccttgc

SEQ ID NO: 108478 - DNA, 16 bp, H. sapiens
gcctccccaggagctg

SEQ ID NO: 108479 - DNA, 16 bp, H. sapiens
gcctccccagtaactg

SEQ ID NO: 108480 - DNA, 16 bp, H. sapiens
gcctccccagttcaaa

SEQ ID NO: 108481 - DNA, 16 bp, H. sapiens
gcctccccagttcaag

SEQ ID NO: 108482 - DNA, 16 bp, H. sapiens
gcctcccccaaagtgc

SEQ ID NO: 108483 - DNA, 16 bp, H. sapiens
gcctcccccaggagct

SEQ ID NO: 108484 - DNA, 16 bp, H. sapiens
gcctcccctgctgcag

SEQ ID NO: 108485 - DNA, 16 bp, H. sapiens
gcctcccgaagtcctg

SEQ ID NO: 108486 - DNA, 16 bp, H. sapiens
gcctcccgaagtgccg

SEQ ID NO: 108487 - DNA, 16 bp, H. sapiens
gcctcccgaattcaag

SEQ ID NO: 108488 - DNA, 16 bp, H. sapiens
gcctcccgagtagcaa

SEQ ID NO: 108489 - DNA, 16 bp, H. sapiens
gcctcccgagttcaaa

SEQ ID NO: 108490 - DNA, 16 bp, H. sapiens
gcctcccgagttcaag

SEQ ID NO: 108491 - DNA, 16 bp, H. sapiens
gcctcccgagttccag

SEQ ID NO: 108492 - DNA, 16 bp, H. sapiens
gcctcccgcgttcaag

SEQ ID NO: 108493 - DNA, 16 bp, H. sapiens
gcctcccggattcaag

SEQ ID NO: 108494 - DNA, 16 bp, H. sapiens
gcctcccggattcacg

SEQ ID NO: 108495 - DNA, 16 bp, H. sapiens
gcctcccggcttcaag

SEQ ID NO: 108496 - DNA, 16 bp, H. sapiens
gcctcccgggatcaag

SEQ ID NO: 108497 - DNA, 16 bp, H. sapiens
gcctcccggggtcaag

SEQ ID NO: 108498 - DNA, 16 bp, H. sapiens
gcctcccgggtccaag

SEQ ID NO: 108499 - DNA, 16 bp, H. sapiens
gcctcccgggttcaaa

SEQ ID NO: 108500 - DNA, 16 bp, H. sapiens
gcctcccgggttcaag

SEQ ID NO: 108501 - DNA, 16 bp, H. sapiens
gcctcccgggttcagg

SEQ ID NO: 108502 - DNA, 16 bp, H. sapiens
gcctcccgggttccag

SEQ ID NO: 108503 - DNA, 16 bp, H. sapiens
gcctcccgggtttaag

SEQ ID NO: 108504 - DNA, 16 bp, H. sapiens
gcctcccgggtttgag

SEQ ID NO: 108505 - DNA, 16 bp, H. sapiens
gcctcccgtattcaag

SEQ ID NO: 108506 - DNA, 16 bp, H. sapiens
gcctccctagttcaag

SEQ ID NO: 108507 - DNA, 16 bp, H. sapiens
gcctccctatgttgcc

SEQ ID NO: 108508 - DNA, 16 bp, H. sapiens
gcctccctccaggctg

SEQ ID NO: 108509 - DNA, 16 bp, H. sapiens
gcctccctgcaggaat

SEQ ID NO: 108510 - DNA, 16 bp, H. sapiens
gcctccctgctgagaa

SEQ ID NO: 108511 - DNA, 16 bp, H. sapiens
gcctccctgctgcagc

SEQ ID NO: 108512 - DNA, 16 bp, H. sapiens
gcctccctggatatga

SEQ ID NO: 108513 - DNA, 16 bp, H. sapiens
gcctccctggtccaag

SEQ ID NO: 108514 - DNA, 16 bp, H. sapiens
gcctccctggttgaag

SEQ ID NO: 108515 - DNA, 16 bp, H. sapiens
gcctcccttccagctg

SEQ ID NO: 108516 - DNA, 16 bp, H. sapiens
gcctcccttgttcaag

SEQ ID NO: 108517 - DNA, 16 bp, H. sapiens
gcctccgcctccagag

SEQ ID NO: 108518 - DNA, 16 bp, H. sapiens
gcctccgcctcccagg

SEQ ID NO: 108519 - DNA, 16 bp, H. sapiens
gcctccgcctcccgga

SEQ ID NO: 108520 - DNA, 16 bp, H. sapiens
gcctccgcctcctgga

SEQ ID NO: 108521 - DNA, 16 bp, H. sapiens
gcctccgcttcccggg

SEQ ID NO: 108522 - DNA, 17 bp, H. sapiens
gcctccggagtagctga

SEQ ID NO: 108523 - DNA, 16 bp, H. sapiens
gcctccggggttcaag

SEQ ID NO: 108524 - DNA, 16 bp, H. sapiens
gcctccggggttcagg

SEQ ID NO: 108525 - DNA, 16 bp, H. sapiens
gcctccgtttcctcat

SEQ ID NO: 108526 - DNA, 16 bp, H. sapiens
gcctcctaggttcaag

SEQ ID NO: 108527 - DNA, 16 bp, H. sapiens
gcctcctcagccacgt

SEQ ID NO: 108528 - DNA, 16 bp, H. sapiens
gcctcctcagcctcag

SEQ ID NO: 108529 - DNA, 16 bp, H. sapiens
gcctcctcagcctccc

SEQ ID NO: 108530 - DNA, 16 bp, H. sapiens
gcctcctcagcctcgg

SEQ ID NO: 108531 - DNA, 16 bp, H. sapiens
gcctcctcagttcaag

SEQ ID NO: 108532 - DNA, 16 bp, H. sapiens
gcctcctcctcccggg

SEQ ID NO: 108533 - DNA, 16 bp, H. sapiens
gcctcctcctccctgg

SEQ ID NO: 108534 - DNA, 16 bp, H. sapiens
gcctcctcctcctcag

SEQ ID NO: 108535 - DNA, 16 bp, H. sapiens
gcctcctcctcctgag

SEQ ID NO: 108536 - DNA, 16 bp, H. sapiens
gcctcctcctcctggg

SEQ ID NO: 108537 - DNA, 16 bp, H. sapiens
gcctcctcctctgtgt

SEQ ID NO: 108538 - DNA, 16 bp, H. sapiens
gcctcctcggcctcgg

SEQ ID NO: 108539 - DNA, 16 bp, H. sapiens
gcctcctcggccttgg

SEQ ID NO: 108540 - DNA, 16 bp, H. sapiens
gcctcctctgcctgga

SEQ ID NO: 108541 - DNA, 16 bp, H. sapiens
gcctcctctgcctggg

SEQ ID NO: 108542 - DNA, 16 bp, H. sapiens
gcctcctgaagtagct

SEQ ID NO: 108543 - DNA, 16 bp, H. sapiens
gcctcctgaattcaag

SEQ ID NO: 108544 - DNA, 16 bp, H. sapiens
gcctcctgagaagcag

SEQ ID NO: 108545 - DNA, 16 bp, H. sapiens
gcctcctgagaagttg

SEQ ID NO: 108546 - DNA, 16 bp, H. sapiens
gcctcctgagctcaag

SEQ ID NO: 108547 - DNA, 16 bp, H. sapiens
gcctcctgagttcaag

SEQ ID NO: 108548 - DNA, 16 bp, H. sapiens
gcctcctgagttcagg

SEQ ID NO: 108549 - DNA, 16 bp, H. sapiens
gcctcctgccaccatc

SEQ ID NO: 108550 - DNA, 16 bp, H. sapiens
gcctcctgccccagcc

SEQ ID NO: 108551 - DNA, 16 bp, H. sapiens
gcctcctgcctcagcc

SEQ ID NO: 108552 - DNA, 16 bp, H. sapiens
gcctcctgcctgcctg

SEQ ID NO: 108553 - DNA, 16 bp, H. sapiens
gcctcctgctccatcc

SEQ ID NO: 108554 - DNA, 16 bp, H. sapiens
gcctcctggaatcaag

SEQ ID NO: 108555 - DNA, 16 bp, H. sapiens
gcctcctggattcaaa

SEQ ID NO: 108556 - DNA, 16 bp, H. sapiens
gcctcctggattcaag

SEQ ID NO: 108557 - DNA, 16 bp, H. sapiens
gcctcctggattccag

SEQ ID NO: 108558 - DNA, 16 bp, H. sapiens
gcctcctggcctcctg

SEQ ID NO: 108559 - DNA, 16 bp, H. sapiens
gcctcctggctagctg

SEQ ID NO: 108560 - DNA, 16 bp, H. sapiens
gcctcctgggatcaag

SEQ ID NO: 108561 - DNA, 16 bp, H. sapiens
gcctcctgggcctcag

SEQ ID NO: 108562 - DNA, 16 bp, H. sapiens
gcctcctgggctcaac

SEQ ID NO: 108563 - DNA, 16 bp, H. sapiens
gcctcctgggctcaag

SEQ ID NO: 108564 - DNA, 16 bp, H. sapiens
gcctcctgggtcctgg

SEQ ID NO: 108565 - DNA, 16 bp, H. sapiens
gcctcctgggttaaag

SEQ ID NO: 108566 - DNA, 16 bp, H. sapiens
gcctcctgggttcaaa

SEQ ID NO: 108567 - DNA, 16 bp, H. sapiens
gcctcctgggttcaag

SEQ ID NO: 108568 - DNA, 16 bp, H. sapiens
gcctcctgggttcaat

SEQ ID NO: 108569 - DNA, 16 bp, H. sapiens
gcctcctgggttcaca

SEQ ID NO: 108570 - DNA, 16 bp, H. sapiens
gcctcctgggttcagg

SEQ ID NO: 108571 - DNA, 16 bp, H. sapiens
gcctcctgggttccag

SEQ ID NO: 108572 - DNA, 16 bp, H. sapiens
gcctcctggttagctg

SEQ ID NO: 108573 - DNA, 16 bp, H. sapiens
gcctcctgtcagatga

SEQ ID NO: 108574 - DNA, 16 bp, H. sapiens
gcctcctgtgttcaag

SEQ ID NO: 108575 - DNA, 16 bp, H. sapiens
gcctcctgtgttccag

SEQ ID NO: 108576 - DNA, 16 bp, H. sapiens
gcctcgacctcctagg

SEQ ID NO: 108577 - DNA, 16 bp, H. sapiens
gcctcgacttcctgga

SEQ ID NO: 108578 - DNA, 16 bp, H. sapiens
gcctcgcaaagtgctg

SEQ ID NO: 108579 - DNA, 16 bp, H. sapiens
gcctcgccctgcttca

SEQ ID NO: 108580 - DNA, 16 bp, H. sapiens
gcctcgcgcatgcgca

SEQ ID NO: 108581 - DNA, 16 bp, H. sapiens
gcctcgctgccgcctt

SEQ ID NO: 108582 - DNA, 20 bp, H. sapiens
gcctcgctttgggacaactc

SEQ ID NO: 108583 - DNA, 17 bp, H. sapiens
gcctcggcctcccaaac

SEQ ID NO: 108584 - DNA, 16 bp, H. sapiens
gcctcggcctcccata

SEQ ID NO: 108585 - DNA, 16 bp, H. sapiens
gcctcggcctccccaa

SEQ ID NO: 108586 - DNA, 16 bp, H. sapiens
gcctcggcctcccgag

SEQ ID NO: 108587 - DNA, 16 bp, H. sapiens
gcctcggcctccgaaa

SEQ ID NO: 108588 - DNA, 16 bp, H. sapiens
gcctcggcctgccaaa

SEQ ID NO: 108589 - DNA, 16 bp, H. sapiens
gcctcggtctcctaaa

SEQ ID NO: 108590 - DNA, 16 bp, H. sapiens
gcctcggtttccccat

SEQ ID NO: 108591 - DNA, 16 bp, H. sapiens
gcctctaaaactgtga

SEQ ID NO: 108592 - DNA, 16 bp, H. sapiens
gcctctaagaaatatg

SEQ ID NO: 108593 - DNA, 16 bp, H. sapiens
gcctctacctcctgga

SEQ ID NO: 108594 - DNA, 16 bp, H. sapiens
gcctctacttcctggg

SEQ ID NO: 108595 - DNA, 16 bp, H. sapiens
gcctctagaactatga

SEQ ID NO: 108596 - DNA, 16 bp, H. sapiens
gcctctagaactgtga

SEQ ID NO: 108597 - DNA, 16 bp, H. sapiens
gcctctatagattcca

SEQ ID NO: 108598 - DNA, 16 bp, H. sapiens
gcctctcaaagcgctg

SEQ ID NO: 108599 - DNA, 16 bp, H. sapiens
gcctctcagagggtgg

SEQ ID NO: 108600 - DNA, 16 bp, H. sapiens
gcctctcagagtgctg

SEQ ID NO: 108601 - DNA, 16 bp, H. sapiens
gcctctcagggggaca

SEQ ID NO: 108602 - DNA, 16 bp, H. sapiens
gcctctcaggttcaag

SEQ ID NO: 108603 - DNA, 16 bp, H. sapiens
gcctctcatcccagca

SEQ ID NO: 108604 - DNA, 16 bp, H. sapiens
gcctctccagaagctg

SEQ ID NO: 108605 - DNA, 16 bp, H. sapiens
gcctctcccagggtcc

SEQ ID NO: 108606 - DNA, 16 bp, H. sapiens
gcctctccctcctggg

SEQ ID NO: 108607 - DNA, 16 bp, H. sapiens
gcctctcgggttcaag

SEQ ID NO: 108608 - DNA, 16 bp, H. sapiens
gcctctcgggttcagg

SEQ ID NO: 108609 - DNA, 16 bp, H. sapiens
gcctctcgggttccag

SEQ ID NO: 108610 - DNA, 16 bp, H. sapiens
gcctctcgggtttaag

SEQ ID NO: 108611 - DNA, 16 bp, H. sapiens
gcctctctcaccactc

SEQ ID NO: 108612 - DNA, 16 bp, H. sapiens
gcctctctctgctcct

SEQ ID NO: 108613 - DNA, 16 bp, H. sapiens
gcctctctctttctca

SEQ ID NO: 108614 - DNA, 16 bp, H. sapiens
gcctctctgggcctca

SEQ ID NO: 108615 - DNA, 16 bp, H. sapiens
gcctctctggtagctg

SEQ ID NO: 108616 - DNA, 16 bp, H. sapiens
gcctctgagacactgt

SEQ ID NO: 108617 - DNA, 16 bp, H. sapiens
gcctctgagcccaggc

SEQ ID NO: 108618 - DNA, 16 bp, H. sapiens
gcctctgagctgctgc

SEQ ID NO: 108619 - DNA, 16 bp, H. sapiens
gcctctgaggaggaaa

SEQ ID NO: 108620 - DNA, 16 bp, H. sapiens
gcctctgcacccagcc

SEQ ID NO: 108621 - DNA, 16 bp, H. sapiens
gcctctgcaccttccc

SEQ ID NO: 108622 - DNA, 16 bp, H. sapiens
gcctctgcagcaaact

SEQ ID NO: 108623 - DNA, 16 bp, H. sapiens
gcctctgcaggaggct

SEQ ID NO: 108624 - DNA, 16 bp, H. sapiens
gcctctgccactcctg

SEQ ID NO: 108625 - DNA, 16 bp, H. sapiens
gcctctgccagccact

SEQ ID NO: 108626 - DNA, 16 bp, H. sapiens
gcctctgccccccagg

SEQ ID NO: 108627 - DNA, 16 bp, H. sapiens
gcctctgcccggccac

SEQ ID NO: 108628 - DNA, 17 bp, H. sapiens
gcctctgccctgtcgcc

SEQ ID NO: 108629 - DNA, 16 bp, H. sapiens
gcctctgcctccccag

SEQ ID NO: 108630 - DNA, 16 bp, H. sapiens
gcctctgcctcccgag

SEQ ID NO: 108631 - DNA, 16 bp, H. sapiens
gcctctgcctcccgga

SEQ ID NO: 108632 - DNA, 16 bp, H. sapiens
gcctctgcctccggag

SEQ ID NO: 108633 - DNA, 16 bp, H. sapiens
gcctctgcctccgggg

SEQ ID NO: 108634 - DNA, 16 bp, H. sapiens
gcctctgcctcctaaa

SEQ ID NO: 108635 - DNA, 16 bp, H. sapiens
gcctctgcctcctagg

SEQ ID NO: 108636 - DNA, 16 bp, H. sapiens
gcctctgcctctgccc

SEQ ID NO: 108637 - DNA, 16 bp, H. sapiens
gcctctgcctgctggg

SEQ ID NO: 108638 - DNA, 16 bp, H. sapiens
gcctctgcctggccac

SEQ ID NO: 108639 - DNA, 16 bp, H. sapiens
gcctctgcctggccgc

SEQ ID NO: 108640 - DNA, 16 bp, H. sapiens
gcctctgctcccccac

SEQ ID NO: 108641 - DNA, 16 bp, H. sapiens
gcctctgcttcccaag

SEQ ID NO: 108642 - DNA, 16 bp, H. sapiens
gcctctgcttctgggg

SEQ ID NO: 108643 - DNA, 16 bp, H. sapiens
gcctctggaggagctg

SEQ ID NO: 108644 - DNA, 16 bp, H. sapiens
gcctctggagtggctg

SEQ ID NO: 108645 - DNA, 16 bp, H. sapiens
gcctctgggcctttgc

SEQ ID NO: 108646 - DNA, 16 bp, H. sapiens
gcctctggggttcaag

SEQ ID NO: 108647 - DNA, 16 bp, H. sapiens
gcctctggtaatcatt

SEQ ID NO: 108648 - DNA, 16 bp, H. sapiens
gcctctggtcccagct

SEQ ID NO: 108649 - DNA, 16 bp, H. sapiens
gcctctggttcccatt

SEQ ID NO: 108650 - DNA, 16 bp, H. sapiens
gcctctgtctcccagg

SEQ ID NO: 108651 - DNA, 16 bp, H. sapiens
gcctctgtctcccggg

SEQ ID NO: 108652 - DNA, 16 bp, H. sapiens
gcctctgtctcctcat

SEQ ID NO: 108653 - DNA, 16 bp, H. sapiens
gcctctgttgcaacta

SEQ ID NO: 108654 - DNA, 16 bp, H. sapiens
gcctctgttgtgttcc

SEQ ID NO: 108655 - DNA, 16 bp, H. sapiens
gcctctgtttccccat

SEQ ID NO: 108656 - DNA, 16 bp, H. sapiens
gcctctgttttcccat

SEQ ID NO: 108657 - DNA, 16 bp, H. sapiens
gcctcttctcctacaa

SEQ ID NO: 108658 - DNA, 17 bp, H. sapiens
gcctcttgcagttgaga

SEQ ID NO: 108659 - DNA, 16 bp, H. sapiens
gcctcttgggttcaag

SEQ ID NO: 108660 - DNA, 16 bp, H. sapiens
gcctctttctagtttt

SEQ ID NO: 108661 - DNA, 16 bp, H. sapiens
gcctcttttaaaaagt

SEQ ID NO: 108662 - DNA, 16 bp, H. sapiens
gcctcttttctaggat

SEQ ID NO: 108663 - DNA, 16 bp, H. sapiens
gcctgaaaatggacta

SEQ ID NO: 108664 - DNA, 16 bp, H. sapiens
gcctgaaagccctgct

SEQ ID NO: 108665 - DNA, 16 bp, H. sapiens
gcctgaaccccagagg

SEQ ID NO: 108666 - DNA, 17 bp, H. sapiens
gcctgaacctgggaggt

SEQ ID NO: 108667 - DNA, 16 bp, H. sapiens
gcctgaacttttcttt

SEQ ID NO: 108668 - DNA, 16 bp, H. sapiens
gcctgaagaaacatca

SEQ ID NO: 108669 - DNA, 16 bp, H. sapiens
gcctgaagaacttcct

SEQ ID NO: 108670 - DNA, 16 bp, H. sapiens
gcctgaagacattttt

SEQ ID NO: 108671 - DNA, 39 bp, H. sapiens
gcctgaagtcttgcaggactcactggatagatgttattc

SEQ ID NO: 108672 - DNA, 16 bp, H. sapiens
gcctgaagtgggagga

SEQ ID NO: 108673 - DNA, 16 bp, H. sapiens
gcctgaatagaagaaa

SEQ ID NO: 108674 - DNA, 16 bp, H. sapiens
gcctgacaaagtgctg

SEQ ID NO: 108675 - DNA, 16 bp, H. sapiens
gcctgacatcagtcag

SEQ ID NO: 108676 - DNA, 16 bp, H. sapiens
gcctgaccaacgtgaa

SEQ ID NO: 108677 - DNA, 16 bp, H. sapiens
gcctgaccaccttggg

SEQ ID NO: 108678 - DNA, 16 bp, H. sapiens
gcctgaccagcatagt

SEQ ID NO: 108679 - DNA, 16 bp, H. sapiens
gcctgaccccgcaggc

SEQ ID NO: 108680 - DNA, 25 bp, H. sapiens
gcctgacctaagcctggtagttaaa

SEQ ID NO: 108681 - DNA, 17 bp, H. sapiens
gcctgacctcaagtgat

SEQ ID NO: 108682 - DNA, 18 bp, H. sapiens
gcctgacctcaggtgatc

SEQ ID NO: 108683 - DNA, 16 bp, H. sapiens
gcctgactggttgtca

SEQ ID NO: 108684 - DNA, 16 bp, H. sapiens
gcctgactgtcccttg

SEQ ID NO: 108685 - DNA, 16 bp, H. sapiens
gcctgagaaacagccc

SEQ ID NO: 108686 - DNA, 16 bp, H. sapiens
gcctgagaaactgctt

SEQ ID NO: 108687 - DNA, 16 bp, H. sapiens
gcctgagaggagctgt

SEQ ID NO: 108688 - DNA, 16 bp, H. sapiens
gcctgagcaactggaa

SEQ ID NO: 108689 - DNA, 16 bp, H. sapiens
gcctgagcaagagagc

SEQ ID NO: 108690 - DNA, 16 bp, H. sapiens
gcctgagcagcaagag

SEQ ID NO: 108691 - DNA, 16 bp, H. sapiens
gcctgagccacagagt

SEQ ID NO: 108692 - DNA, 16 bp, H. sapiens
gcctgagccaccatgt

SEQ ID NO: 108693 - DNA, 16 bp, H. sapiens
gcctgagccactgcgt

SEQ ID NO: 108694 - DNA, 16 bp, H. sapiens
gcctgagccagggagg

SEQ ID NO: 108695 - DNA, 16 bp, H. sapiens
gcctgagcccagcagg

SEQ ID NO: 108696 - DNA, 16 bp, H. sapiens
gcctgagcccaggaag

SEQ ID NO: 108697 - DNA, 16 bp, H. sapiens
gcctgagcccaggagg

SEQ ID NO: 108698 - DNA, 16 bp, H. sapiens
gcctgagcccaggatt

SEQ ID NO: 108699 - DNA, 16 bp, H. sapiens
gcctgagcccagggag

SEQ ID NO: 108700 - DNA, 16 bp, H. sapiens
gcctgagccccacctc

SEQ ID NO: 108701 - DNA, 16 bp, H. sapiens
gcctgagccctggagg

SEQ ID NO: 108702 - DNA, 16 bp, H. sapiens
gcctgagcctccccaa

SEQ ID NO: 108703 - DNA, 16 bp, H. sapiens
gcctgagctacagagc

SEQ ID NO: 108704 - DNA, 16 bp, H. sapiens
gcctgagctcaagcaa

SEQ ID NO: 108705 - DNA, 16 bp, H. sapiens
gcctgagctcctcctc

SEQ ID NO: 108706 - DNA, 16 bp, H. sapiens
gcctgagctctggagt

SEQ ID NO: 108707 - DNA, 16 bp, H. sapiens
gcctgagctgcaggag

SEQ ID NO: 108708 - DNA, 16 bp, H. sapiens
gcctgaggaaaagcag

SEQ ID NO: 108709 - DNA, 16 bp, H. sapiens
gcctgaggaccaggag

SEQ ID NO: 108710 - DNA, 16 bp, H. sapiens
gcctgaggagagggag

SEQ ID NO: 108711 - DNA, 16 bp, H. sapiens
gcctgaggagggagga

SEQ ID NO: 108712 - DNA, 16 bp, H. sapiens
gcctgaggcaggaaga

SEQ ID NO: 108713 - DNA, 16 bp, H. sapiens
gcctgaggcaggagaa

SEQ ID NO: 108714 - DNA, 16 bp, H. sapiens
gcctgaggcctggggg

SEQ ID NO: 108715 - DNA, 16 bp, H. sapiens
gcctgaggctggagga

SEQ ID NO: 108716 - DNA, 16 bp, H. sapiens
gcctgaggctgggatc

SEQ ID NO: 108717 - DNA, 17 bp, H. sapiens
gcctgaggtcagaagtt

SEQ ID NO: 108718 - DNA, 17 bp, H. sapiens
gcctgaggtcaggagtt

SEQ ID NO: 108719 - DNA, 16 bp, H. sapiens
gcctgaggtcgcccag

SEQ ID NO: 108720 - DNA, 16 bp, H. sapiens
gcctgaggtgggcaga

SEQ ID NO: 108721 - DNA, 16 bp, H. sapiens
gcctgagtgcagtggc

SEQ ID NO: 108722 - DNA, 16 bp, H. sapiens
gcctgagttccacctc

SEQ ID NO: 108723 - DNA, 16 bp, H. sapiens
gcctgagtttcctcat

SEQ ID NO: 108724 - DNA, 16 bp, H. sapiens
gcctgatcccaggagg

SEQ ID NO: 108725 - DNA, 16 bp, H. sapiens
gcctgatctgggctca

SEQ ID NO: 108726 - DNA, 16 bp, H. sapiens
gcctgatgacctgagg

SEQ ID NO: 108727 - DNA, 16 bp, H. sapiens
gcctgatgtggtggca

SEQ ID NO: 108728 - DNA, 16 bp, H. sapiens
gcctgattgacctggc

SEQ ID NO: 108729 - DNA, 16 bp, H. sapiens
gcctgcaaattaaact

SEQ ID NO: 108730 - DNA, 16 bp, H. sapiens
gcctgcaattgcaggc

SEQ ID NO: 108731 - DNA, 22 bp, H. sapiens
gcctgcacccaggtgattaaaa

SEQ ID NO: 108732 - DNA, 16 bp, H. sapiens
gcctgcagaaatgtga

SEQ ID NO: 108733 - DNA, 16 bp, H. sapiens
gcctgcagatggccta

SEQ ID NO: 108734 - DNA, 16 bp, H. sapiens
gcctgcagctgcagaa

SEQ ID NO: 108735 - DNA, 16 bp, H. sapiens
gcctgcagctgcagga

SEQ ID NO: 108736 - DNA, 16 bp, H. sapiens
gcctgcagctggaggc

SEQ ID NO: 108737 - DNA, 16 bp, H. sapiens
gcctgcaggcccagct

SEQ ID NO: 108738 - DNA, 16 bp, H. sapiens
gcctgcagttccagct

SEQ ID NO: 108739 - DNA, 16 bp, H. sapiens
gcctgcatcaccaagt

SEQ ID NO: 108740 - DNA, 16 bp, H. sapiens
gcctgcatccctgcag

SEQ ID NO: 108741 - DNA, 16 bp, H. sapiens
gcctgccacagtgctg

SEQ ID NO: 108742 - DNA, 18 bp, H. sapiens
gcctgccaccacgcccgg

SEQ ID NO: 108743 - DNA, 16 bp, H. sapiens
gcctgccaccctgccc

SEQ ID NO: 108744 - DNA, 16 bp, H. sapiens
gcctgccactgcaccc

SEQ ID NO: 108745 - DNA, 16 bp, H. sapiens
gcctgccactgtgccc

SEQ ID NO: 108746 - DNA, 16 bp, H. sapiens
gcctgccagagtgctg

SEQ ID NO: 108747 - DNA, 16 bp, H. sapiens
gcctgccagcacgccc

SEQ ID NO: 108748 - DNA, 16 bp, H. sapiens
gcctgccagcatgcct

SEQ ID NO: 108749 - DNA, 16 bp, H. sapiens
gcctgccagcctgccc

SEQ ID NO: 108750 - DNA, 16 bp, H. sapiens
gcctgccaggaagtga

SEQ ID NO: 108751 - DNA, 16 bp, H. sapiens
gcctgccaggttcaag

SEQ ID NO: 108752 - DNA, 16 bp, H. sapiens
gcctgccaggttcaca

SEQ ID NO: 108753 - DNA, 16 bp, H. sapiens
gcctgcccagccctgc

SEQ ID NO: 108754 - DNA, 16 bp, H. sapiens
gcctgccccagcctcc

SEQ ID NO: 108755 - DNA, 16 bp, H. sapiens
gcctgccctgaaagag

SEQ ID NO: 108756 - DNA, 16 bp, H. sapiens
gcctgccctggcctcc

SEQ ID NO: 108757 - DNA, 16 bp, H. sapiens
gcctgcctcagcctca

SEQ ID NO: 108758 - DNA, 20 bp, H. sapiens
gcctgcctcagcctcccaag

SEQ ID NO: 108759 - DNA, 16 bp, H. sapiens
gcctgcctcagcctgc

SEQ ID NO: 108760 - DNA, 16 bp, H. sapiens
gcctgcctcagccttc

SEQ ID NO: 108761 - DNA, 16 bp, H. sapiens
gcctgcctcagtctcc

SEQ ID NO: 108762 - DNA, 16 bp, H. sapiens
gcctgcctccacgccc

SEQ ID NO: 108763 - DNA, 16 bp, H. sapiens
gcctgcctccctgcag

SEQ ID NO: 108764 - DNA, 16 bp, H. sapiens
gcctgcctcctgggtt

SEQ ID NO: 108765 - DNA, 16 bp, H. sapiens
gcctgcctcggtctcc

SEQ ID NO: 108766 - DNA, 16 bp, H. sapiens
gcctgcctctgcttcc

SEQ ID NO: 108767 - DNA, 16 bp, H. sapiens
gcctgcctgcctccct

SEQ ID NO: 108768 - DNA, 16 bp, H. sapiens
gcctgcctgcctccgt

SEQ ID NO: 108769 - DNA, 16 bp, H. sapiens
gcctgcctgcctctct

SEQ ID NO: 108770 - DNA, 16 bp, H. sapiens
gcctgcctgcctctgt

SEQ ID NO: 108771 - DNA, 16 bp, H. sapiens
gcctgcctgcctgcct

SEQ ID NO: 108772 - DNA, 16 bp, H. sapiens
gcctgcctgccttctt

SEQ ID NO: 108773 - DNA, 16 bp, H. sapiens
gcctgcctggttcaag

SEQ ID NO: 108774 - DNA, 16 bp, H. sapiens
gcctgccttcgcctcc

SEQ ID NO: 108775 - DNA, 16 bp, H. sapiens
gcctgccttggccttc

SEQ ID NO: 108776 - DNA, 20 bp, H. sapiens
gcctgccttggcttcccaaa

SEQ ID NO: 108777 - DNA, 17 bp, H. sapiens
gcctgctagcccatgct

SEQ ID NO: 108778 - DNA, 16 bp, H. sapiens
gcctgctcccacactg

SEQ ID NO: 108779 - DNA, 16 bp, H. sapiens
gcctgctcccactctg

SEQ ID NO: 108780 - DNA, 16 bp, H. sapiens
gcctgctcctgctccc

SEQ ID NO: 108781 - DNA, 16 bp, H. sapiens
gcctgctggcctgtgg

SEQ ID NO: 108782 - DNA, 16 bp, H. sapiens
gcctgctgggacttga

SEQ ID NO: 108783 - DNA, 16 bp, H. sapiens
gcctgctgggaggtgt

SEQ ID NO: 108784 - DNA, 16 bp, H. sapiens
gcctgctgggttttgg

SEQ ID NO: 108785 - DNA, 16 bp, H. sapiens
gcctgctgtgtgccag

SEQ ID NO: 108786 - DNA, 16 bp, H. sapiens
gcctgcttcctcttca

SEQ ID NO: 108787 - DNA, 16 bp, H. sapiens
gcctgcttcctggttc

SEQ ID NO: 108788 - DNA, 18 bp, H. sapiens
gcctgcttcggcctccca

SEQ ID NO: 108789 - DNA, 16 bp, H. sapiens
gcctgcttgaatttct

SEQ ID NO: 108790 - DNA, 16 bp, H. sapiens
gcctggaactcctgac

SEQ ID NO: 108791 - DNA, 16 bp, H. sapiens
gcctggaagacagaga

SEQ ID NO: 108792 - DNA, 16 bp, H. sapiens
gcctggaagcccctgc

SEQ ID NO: 108793 - DNA, 16 bp, H. sapiens
gcctggaatcccagga

SEQ ID NO: 108794 - DNA, 16 bp, H. sapiens
gcctggaatgcccttt

SEQ ID NO: 108795 - DNA, 16 bp, H. sapiens
gcctggacaacagtga

SEQ ID NO: 108796 - DNA, 16 bp, H. sapiens
gcctggacaacatatt

SEQ ID NO: 108797 - DNA, 16 bp, H. sapiens
gcctggacaacatgat

SEQ ID NO: 108798 - DNA, 16 bp, H. sapiens
gcctggacaatatggc

SEQ ID NO: 108799 - DNA, 16 bp, H. sapiens
gcctggacaatggagc

SEQ ID NO: 108800 - DNA, 16 bp, H. sapiens
gcctggaccccagctc

SEQ ID NO: 108801 - DNA, 16 bp, H. sapiens
gcctggactcagggac

SEQ ID NO: 108802 - DNA, 16 bp, H. sapiens
gcctggactgcagtgg

SEQ ID NO: 108803 - DNA, 16 bp, H. sapiens
gcctggagaaacacaa

SEQ ID NO: 108804 - DNA, 16 bp, H. sapiens
gcctggagaacagagt

SEQ ID NO: 108805 - DNA, 16 bp, H. sapiens
gcctggagacatttct

SEQ ID NO: 108806 - DNA, 16 bp, H. sapiens
gcctggagacattttc

SEQ ID NO: 108807 - DNA, 16 bp, H. sapiens
gcctggagagcagtgg

SEQ ID NO: 108808 - DNA, 16 bp, H. sapiens
gcctggagcagtggct

SEQ ID NO: 108809 - DNA, 16 bp, H. sapiens
gcctggagccaccagg

SEQ ID NO: 108810 - DNA, 16 bp, H. sapiens
gcctggagcccagtag

SEQ ID NO: 108811 - DNA, 16 bp, H. sapiens
gcctggagtccagtgg

SEQ ID NO: 108812 - DNA, 16 bp, H. sapiens
gcctggagtctcagct

SEQ ID NO: 108813 - DNA, 16 bp, H. sapiens
gcctggagtgcagtgg

SEQ ID NO: 108814 - DNA, 16 bp, H. sapiens
gcctggagtttgagac

SEQ ID NO: 108815 - DNA, 16 bp, H. sapiens
gcctggatccctgaat

SEQ ID NO: 108816 - DNA, 16 bp, H. sapiens
gcctggatgaaagagc

SEQ ID NO: 108817 - DNA, 16 bp, H. sapiens
gcctggatttcagagg

SEQ ID NO: 108818 - DNA, 16 bp, H. sapiens
gcctggatttcttttt

SEQ ID NO: 108819 - DNA, 16 bp, H. sapiens
gcctggcaaatttttt

SEQ ID NO: 108820 - DNA, 16 bp, H. sapiens
gcctggcaacaagagc

SEQ ID NO: 108821 - DNA, 22 bp, H. sapiens
gcctggcaaccgccccgtctga

SEQ ID NO: 108822 - DNA, 16 bp, H. sapiens
gcctggcacagagcaa

SEQ ID NO: 108823 - DNA, 16 bp, H. sapiens
gcctggcacagagtag

SEQ ID NO: 108824 - DNA, 16 bp, H. sapiens
gcctggcacagagtgg

SEQ ID NO: 108825 - DNA, 16 bp, H. sapiens
gcctggcacagggcag

SEQ ID NO: 108826 - DNA, 16 bp, H. sapiens
gcctggcacagtgtct

SEQ ID NO: 108827 - DNA, 16 bp, H. sapiens
gcctggcagagaaaca

SEQ ID NO: 108828 - DNA, 16 bp, H. sapiens
gcctggcagagacaga

SEQ ID NO: 108829 - DNA, 16 bp, H. sapiens
gcctggcagccacccc

SEQ ID NO: 108830 - DNA, 16 bp, H. sapiens
gcctggcagggctggg

SEQ ID NO: 108831 - DNA, 16 bp, H. sapiens
gcctggcagggggagg

SEQ ID NO: 108832 - DNA, 16 bp, H. sapiens
gcctggcataaagtaa

SEQ ID NO: 108833 - DNA, 16 bp, H. sapiens
gcctggcattcaaggc

SEQ ID NO: 108834 - DNA, 16 bp, H. sapiens
gcctggccaaacatgg

SEQ ID NO: 108835 - DNA, 16 bp, H. sapiens
gcctggccaacctggc

SEQ ID NO: 108836 - DNA, 16 bp, H. sapiens
gcctggccaagaaatt

SEQ ID NO: 108837 - DNA, 16 bp, H. sapiens
gcctggccaagagacc

SEQ ID NO: 108838 - DNA, 16 bp, H. sapiens
gcctggccaatcagag

SEQ ID NO: 108839 - DNA, 16 bp, H. sapiens
gcctggccaatgtgtt

SEQ ID NO: 108840 - DNA, 16 bp, H. sapiens
gcctggccactgggcc

SEQ ID NO: 108841 - DNA, 16 bp, H. sapiens
gcctggccagagctgg

SEQ ID NO: 108842 - DNA, 16 bp, H. sapiens
gcctggccagccgccc

SEQ ID NO: 108843 - DNA, 16 bp, H. sapiens
gcctggccagcctggg

SEQ ID NO: 108844 - DNA, 16 bp, H. sapiens
gcctggccagcctggt

SEQ ID NO: 108845 - DNA, 16 bp, H. sapiens
gcctggccagctgccc

SEQ ID NO: 108846 - DNA, 16 bp, H. sapiens
gcctggccaggttttt

SEQ ID NO: 108847 - DNA, 16 bp, H. sapiens
gcctggccatgcctgc

SEQ ID NO: 108848 - DNA, 16 bp, H. sapiens
gcctggccatttttct

SEQ ID NO: 108849 - DNA, 16 bp, H. sapiens
gcctggcccaagcctt

SEQ ID NO: 108850 - DNA, 16 bp, H. sapiens
gcctggcccacagcag

SEQ ID NO: 108851 - DNA, 16 bp, H. sapiens
gcctggcccagaattt

SEQ ID NO: 108852 - DNA, 16 bp, H. sapiens
gcctggcccagcctcc

SEQ ID NO: 108853 - DNA, 16 bp, H. sapiens
gcctggcccagcctgg

SEQ ID NO: 108854 - DNA, 16 bp, H. sapiens
gcctggcccagctctg

SEQ ID NO: 108855 - DNA, 16 bp, H. sapiens
gcctggcccaggccca

SEQ ID NO: 108856 - DNA, 16 bp, H. sapiens
gcctggcccagggccc

SEQ ID NO: 108857 - DNA, 16 bp, H. sapiens
gcctggcccattttat

SEQ ID NO: 108858 - DNA, 16 bp, H. sapiens
gcctggccccagccct

SEQ ID NO: 108859 - DNA, 16 bp, H. sapiens
gcctggccctcttttt

SEQ ID NO: 108860 - DNA, 16 bp, H. sapiens
gcctggccctgcctct

SEQ ID NO: 108861 - DNA, 16 bp, H. sapiens
gcctggccgccacccc

SEQ ID NO: 108862 - DNA, 16 bp, H. sapiens
gcctggccgccatccc

SEQ ID NO: 108863 - DNA, 16 bp, H. sapiens
gcctggccgctgcagt

SEQ ID NO: 108864 - DNA, 16 bp, H. sapiens
gcctggcctacatttt

SEQ ID NO: 108865 - DNA, 16 bp, H. sapiens
gcctggcctactttta

SEQ ID NO: 108866 - DNA, 16 bp, H. sapiens
gcctggcctattattt

SEQ ID NO: 108867 - DNA, 16 bp, H. sapiens
gcctggcctcaaactt

SEQ ID NO: 108868 - DNA, 16 bp, H. sapiens
gcctggcctcaagtaa

SEQ ID NO: 108869 - DNA, 16 bp, H. sapiens
gcctggcctcattttt

SEQ ID NO: 108870 - DNA, 16 bp, H. sapiens
gcctggcctccttcct

SEQ ID NO: 108871 - DNA, 16 bp, H. sapiens
gcctggcctctcccag

SEQ ID NO: 108872 - DNA, 16 bp, H. sapiens
gcctggcctgattttt

SEQ ID NO: 108873 - DNA, 16 bp, H. sapiens
gcctggcctgcctggc

SEQ ID NO: 108874 - DNA, 16 bp, H. sapiens
gcctggcctggcctga

SEQ ID NO: 108875 - DNA, 16 bp, H. sapiens
gcctggcctggtggct

SEQ ID NO: 108876 - DNA, 16 bp, H. sapiens
gcctggcctgttgttt

SEQ ID NO: 108877 - DNA, 16 bp, H. sapiens
gcctggcctgttttat

SEQ ID NO: 108878 - DNA, 16 bp, H. sapiens
gcctggcctttaggaa

SEQ ID NO: 108879 - DNA, 16 bp, H. sapiens
gcctggccttttttgt

SEQ ID NO: 108880 - DNA, 16 bp, H. sapiens
gcctggcctttttttt

SEQ ID NO: 108881 - DNA, 16 bp, H. sapiens
gcctggcgcgatggct

SEQ ID NO: 108882 - DNA, 16 bp, H. sapiens
gcctggctaacttttt

SEQ ID NO: 108883 - DNA, 16 bp, H. sapiens
gcctggctaatatttt

SEQ ID NO: 108884 - DNA, 16 bp, H. sapiens
gcctggctaattcttt

SEQ ID NO: 108885 - DNA, 16 bp, H. sapiens
gcctggctactttttt

SEQ ID NO: 108886 - DNA, 16 bp, H. sapiens
gcctggctcagtggct

SEQ ID NO: 108887 - DNA, 16 bp, H. sapiens
gcctggctcatttttt

SEQ ID NO: 108888 - DNA, 16 bp, H. sapiens
gcctggctccagaatc

SEQ ID NO: 108889 - DNA, 16 bp, H. sapiens
gcctggctccctgccc

SEQ ID NO: 108890 - DNA, 16 bp, H. sapiens
gcctggctctgtcacc

SEQ ID NO: 108891 - DNA, 16 bp, H. sapiens
gcctggctctgtgctg

SEQ ID NO: 108892 - DNA, 16 bp, H. sapiens
gcctggctggggaagg

SEQ ID NO: 108893 - DNA, 16 bp, H. sapiens
gcctggctggggaggc

SEQ ID NO: 108894 - DNA, 16 bp, H. sapiens
gcctggcttatttttt

SEQ ID NO: 108895 - DNA, 16 bp, H. sapiens
gcctggctttgtccct

SEQ ID NO: 108896 - DNA, 16 bp, H. sapiens
gcctggcttttctttt

SEQ ID NO: 108897 - DNA, 16 bp, H. sapiens
gcctgggaaatatagt

SEQ ID NO: 108898 - DNA, 16 bp, H. sapiens
gcctgggaacatggtg

SEQ ID NO: 108899 - DNA, 16 bp, H. sapiens
gcctgggaagaggagg

SEQ ID NO: 108900 - DNA, 16 bp, H. sapiens
gcctgggaagcagaga

SEQ ID NO: 108901 - DNA, 17 bp, H. sapiens
gcctgggaagttgaggt

SEQ ID NO: 108902 - DNA, 16 bp, H. sapiens
gcctgggactcctggg

SEQ ID NO: 108903 - DNA, 16 bp, H. sapiens
gcctgggagaaaatat

SEQ ID NO: 108904 - DNA, 16 bp, H. sapiens
gcctgggagaaggagg

SEQ ID NO: 108905 - DNA, 16 bp, H. sapiens
gcctgggagacagagt

SEQ ID NO: 108906 - DNA, 16 bp, H. sapiens
gcctgggagacaggga

SEQ ID NO: 108907 - DNA, 16 bp, H. sapiens
gcctgggagacggagg

SEQ ID NO: 108908 - DNA, 16 bp, H. sapiens
gcctgggagagacaca

SEQ ID NO: 108909 - DNA, 16 bp, H. sapiens
gcctgggagatcaagg

SEQ ID NO: 108910 - DNA, 16 bp, H. sapiens
gcctgggagatccagg

SEQ ID NO: 108911 - DNA, 16 bp, H. sapiens
gcctgggagcactcct

SEQ ID NO: 108912 - DNA, 16 bp, H. sapiens
gcctgggaggatgagg

SEQ ID NO: 108913 - DNA, 16 bp, H. sapiens
gcctgggaggcagatg

SEQ ID NO: 108914 - DNA, 16 bp, H. sapiens
gcctgggagggcaagg

SEQ ID NO: 108915 - DNA, 16 bp, H. sapiens
gcctgggagggtggag

SEQ ID NO: 108916 - DNA, 16 bp, H. sapiens
gcctgggaggtgaagg

SEQ ID NO: 108917 - DNA, 16 bp, H. sapiens
gcctgggaggttgtgg

SEQ ID NO: 108918 - DNA, 16 bp, H. sapiens
gcctgggagtgggagg

SEQ ID NO: 108919 - DNA, 16 bp, H. sapiens
gcctgggcaacaagtg

SEQ ID NO: 108920 - DNA, 16 bp, H. sapiens
gcctgggcaacatggg

SEQ ID NO: 108921 - DNA, 16 bp, H. sapiens
gcctgggcaacatgta

SEQ ID NO: 108922 - DNA, 16 bp, H. sapiens
gcctgggcaacccagt

SEQ ID NO: 108923 - DNA, 16 bp, H. sapiens
gcctgggcaacggagg

SEQ ID NO: 108924 - DNA, 16 bp, H. sapiens
gcctgggcaacggagt

SEQ ID NO: 108925 - DNA, 16 bp, H. sapiens
gcctgggcaacttagc

SEQ ID NO: 108926 - DNA, 16 bp, H. sapiens
gcctgggcaatgagag

SEQ ID NO: 108927 - DNA, 16 bp, H. sapiens
gcctgggcagcagaat

SEQ ID NO: 108928 - DNA, 16 bp, H. sapiens
gcctgggcagcagggc

SEQ ID NO: 108929 - DNA, 16 bp, H. sapiens
gcctgggcagcatgat

SEQ ID NO: 108930 - DNA, 16 bp, H. sapiens
gcctgggcagcatgga

SEQ ID NO: 108931 - DNA, 16 bp, H. sapiens
gcctgggcatcaccag

SEQ ID NO: 108932 - DNA, 16 bp, H. sapiens
gcctgggcatccaggc

SEQ ID NO: 108933 - DNA, 16 bp, H. sapiens
gcctgggcatctcctc

SEQ ID NO: 108934 - DNA, 16 bp, H. sapiens
gcctgggcatggtggc

SEQ ID NO: 108935 - DNA, 16 bp, H. sapiens
gcctgggccacagtga

SEQ ID NO: 108936 - DNA, 16 bp, H. sapiens
gcctgggccacatagt

SEQ ID NO: 108937 - DNA, 16 bp, H. sapiens
gcctgggccccagagc

SEQ ID NO: 108938 - DNA, 16 bp, H. sapiens
gcctgggccccccaaa

SEQ ID NO: 108939 - DNA, 16 bp, H. sapiens
gcctgggccctgccca

SEQ ID NO: 108940 - DNA, 16 bp, H. sapiens
gcctgggcctccagcc

SEQ ID NO: 108941 - DNA, 16 bp, H. sapiens
gcctgggcctgggcct

SEQ ID NO: 108942 - DNA, 16 bp, H. sapiens
gcctgggcggcagagc

SEQ ID NO: 108943 - DNA, 16 bp, H. sapiens
gcctgggctcaagcaa

SEQ ID NO: 108944 - DNA, 18 bp, H. sapiens
gcctgggctcaagtgatc

SEQ ID NO: 108945 - DNA, 16 bp, H. sapiens
gcctgggctcccactt

SEQ ID NO: 108946 - DNA, 16 bp, H. sapiens
gcctgggctctcctcc

SEQ ID NO: 108947 - DNA, 16 bp, H. sapiens
gcctgggctctgcctc

SEQ ID NO: 108948 - DNA, 16 bp, H. sapiens
gcctgggctgcagaga

SEQ ID NO: 108949 - DNA, 16 bp, H. sapiens
gcctgggctggagtgc

SEQ ID NO: 108950 - DNA, 16 bp, H. sapiens
gcctgggctggccttg

SEQ ID NO: 108951 - DNA, 16 bp, H. sapiens
gcctggggaacacagt

SEQ ID NO: 108952 - DNA, 16 bp, H. sapiens
gcctggggaacagggc

SEQ ID NO: 108953 - DNA, 16 bp, H. sapiens
gcctggggaacccctg

SEQ ID NO: 108954 - DNA, 16 bp, H. sapiens
gcctggggactgggga

SEQ ID NO: 108955 - DNA, 16 bp, H. sapiens
gcctggggattgggga

SEQ ID NO: 108956 - DNA, 16 bp, H. sapiens
gcctggggcaggggct

SEQ ID NO: 108957 - DNA, 16 bp, H. sapiens
gcctggggctgcagga

SEQ ID NO: 108958 - DNA, 16 bp, H. sapiens
gcctggggctggcagg

SEQ ID NO: 108959 - DNA, 16 bp, H. sapiens
gcctgggggacgagag

SEQ ID NO: 108960 - DNA, 16 bp, H. sapiens
gcctgggggcaggagg

SEQ ID NO: 108961 - DNA, 16 bp, H. sapiens
gcctgggggctgggct

SEQ ID NO: 108962 - DNA, 16 bp, H. sapiens
gcctggggttggggga

SEQ ID NO: 108963 - DNA, 16 bp, H. sapiens
gcctgggtaatttttt

SEQ ID NO: 108964 - DNA, 16 bp, H. sapiens
gcctgggtcacagagg

SEQ ID NO: 108965 - DNA, 16 bp, H. sapiens
gcctgggtccacagcc

SEQ ID NO: 108966 - DNA, 16 bp, H. sapiens
gcctgggtctgcagct

SEQ ID NO: 108967 - DNA, 16 bp, H. sapiens
gcctgggtgaaagagc

SEQ ID NO: 108968 - DNA, 16 bp, H. sapiens
gcctgggtgaaggagt

SEQ ID NO: 108969 - DNA, 16 bp, H. sapiens
gcctgggtgacagaag

SEQ ID NO: 108970 - DNA, 16 bp, H. sapiens
gcctgggtgacagagg

SEQ ID NO: 108971 - DNA, 16 bp, H. sapiens
gcctgggtgacagatg

SEQ ID NO: 108972 - DNA, 16 bp, H. sapiens
gcctgggtgacagcac

SEQ ID NO: 108973 - DNA, 16 bp, H. sapiens
gcctgggtgagagagg

SEQ ID NO: 108974 - DNA, 16 bp, H. sapiens
gcctgggtgagtgaga

SEQ ID NO: 108975 - DNA, 16 bp, H. sapiens
gcctgggtgatgggtg

SEQ ID NO: 108976 - DNA, 16 bp, H. sapiens
gcctgggtgcccaggc

SEQ ID NO: 108977 - DNA, 16 bp, H. sapiens
gcctgggtggaagagc

SEQ ID NO: 108978 - DNA, 16 bp, H. sapiens
gcctgggtggcagagg

SEQ ID NO: 108979 - DNA, 16 bp, H. sapiens
gcctgggtggggcctg

SEQ ID NO: 108980 - DNA, 16 bp, H. sapiens
gcctgggtgtcacagc

SEQ ID NO: 108981 - DNA, 16 bp, H. sapiens
gcctggtacagtggct

SEQ ID NO: 108982 - DNA, 16 bp, H. sapiens
gcctggtagctccagg

SEQ ID NO: 108983 - DNA, 16 bp, H. sapiens
gcctggtgacagagaa

SEQ ID NO: 108984 - DNA, 16 bp, H. sapiens
gcctggtgaggagcag

SEQ ID NO: 108985 - DNA, 16 bp, H. sapiens
gcctggtgaggagggg

SEQ ID NO: 108986 - DNA, 16 bp, H. sapiens
gcctggtgcagtggca

SEQ ID NO: 108987 - DNA, 16 bp, H. sapiens
gcctggtgcagtggtt

SEQ ID NO: 108988 - DNA, 16 bp, H. sapiens
gcctggtgccctgaga

SEQ ID NO: 108989 - DNA, 16 bp, H. sapiens
gcctggtgggaggtgt

SEQ ID NO: 108990 - DNA, 16 bp, H. sapiens
gcctggtggggtggct

SEQ ID NO: 108991 - DNA, 16 bp, H. sapiens
gcctggtggtgggtgc

SEQ ID NO: 108992 - DNA, 16 bp, H. sapiens
gcctggtgtggtggtt

SEQ ID NO: 108993 - DNA, 16 bp, H. sapiens
gcctggttaatttatt

SEQ ID NO: 108994 - DNA, 16 bp, H. sapiens
gcctggttttgctttc

SEQ ID NO: 108995 - DNA, 16 bp, H. sapiens
gcctgtaaggtttcca

SEQ ID NO: 108996 - DNA, 16 bp, H. sapiens
gcctgtaataccaaca

SEQ ID NO: 108997 - DNA, 16 bp, H. sapiens
gcctgtaatccagcat

SEQ ID NO: 108998 - DNA, 16 bp, H. sapiens
gcctgtaatcccaata

SEQ ID NO: 108999 - DNA, 16 bp, H. sapiens
gcctgtaatcccagta

SEQ ID NO: 109000 - DNA, 16 bp, H. sapiens
gcctgtaatcccggct

SEQ ID NO: 109001 - DNA, 16 bp, H. sapiens
gcctgtaatccctgcc

SEQ ID NO: 109002 - DNA, 16 bp, H. sapiens
gcctgtaatcctagaa

SEQ ID NO: 109003 - DNA, 16 bp, H. sapiens
gcctgtaatcctagcc

SEQ ID NO: 109004 - DNA, 16 bp, H. sapiens
gcctgtaatcctagct

SEQ ID NO: 109005 - DNA, 18 bp, H. sapiens
gcctgtaatcctagctat

SEQ ID NO: 109006 - DNA, 16 bp, H. sapiens
gcctgtaatctcagcc

SEQ ID NO: 109007 - DNA, 16 bp, H. sapiens
gcctgtaatgccacca

SEQ ID NO: 109008 - DNA, 16 bp, H. sapiens
gcctgtaggtcccagc

SEQ ID NO: 109009 - DNA, 16 bp, H. sapiens
gcctgtagtaccagct

SEQ ID NO: 109010 - DNA, 16 bp, H. sapiens
gcctgtagtattcagt

SEQ ID NO: 109011 - DNA, 16 bp, H. sapiens
gcctgtagtccctact

SEQ ID NO: 109012 - DNA, 16 bp, H. sapiens
gcctgtatagccaaga

SEQ ID NO: 109013 - DNA, 16 bp, H. sapiens
gcctgtcaaagtgctg

SEQ ID NO: 109014 - DNA, 16 bp, H. sapiens
gcctgtcatgggaggg

SEQ ID NO: 109015 - DNA, 16 bp, H. sapiens
gcctgtcctcccagct

SEQ ID NO: 109016 - DNA, 16 bp, H. sapiens
gcctgtcctggggtgg

SEQ ID NO: 109017 - DNA, 16 bp, H. sapiens
gcctgtcggggagtgg

SEQ ID NO: 109018 - DNA, 16 bp, H. sapiens
gcctgtctctgcctcc

SEQ ID NO: 109019 - DNA, 16 bp, H. sapiens
gcctgtcttggcctcc

SEQ ID NO: 109020 - DNA, 16 bp, H. sapiens
gcctgtctttactgca

SEQ ID NO: 109021 - DNA, 16 bp, H. sapiens
gcctgtgaatagccac

SEQ ID NO: 109022 - DNA, 16 bp, H. sapiens
gcctgtgagacagagc

SEQ ID NO: 109023 - DNA, 16 bp, H. sapiens
gcctgtgatcctggca

SEQ ID NO: 109024 - DNA, 16 bp, H. sapiens
gcctgtgatgggaggg

SEQ ID NO: 109025 - DNA, 16 bp, H. sapiens
gcctgtgcaacaagag

SEQ ID NO: 109026 - DNA, 16 bp, H. sapiens
gcctgtgcatgatggg

SEQ ID NO: 109027 - DNA, 16 bp, H. sapiens
gcctgtgcctatagtc

SEQ ID NO: 109028 - DNA, 16 bp, H. sapiens
gcctgtgcctctccct

SEQ ID NO: 109029 - DNA, 16 bp, H. sapiens
gcctgtggacagccag

SEQ ID NO: 109030 - DNA, 16 bp, H. sapiens
gcctgtgggcccagct

SEQ ID NO: 109031 - DNA, 16 bp, H. sapiens
gcctgtgggtgcccag

SEQ ID NO: 109032 - DNA, 16 bp, H. sapiens
gcctgtggtaccagct

SEQ ID NO: 109033 - DNA, 16 bp, H. sapiens
gcctgtgtaacagagc

SEQ ID NO: 109034 - DNA, 16 bp, H. sapiens
gcctgtgtcctcatct

SEQ ID NO: 109035 - DNA, 16 bp, H. sapiens
gcctgtgtgtgtcttt

SEQ ID NO: 109036 - DNA, 16 bp, H. sapiens
gcctgtgttcccagct

SEQ ID NO: 109037 - DNA, 16 bp, H. sapiens
gcctgtgttctgttcc

SEQ ID NO: 109038 - DNA, 16 bp, H. sapiens
gcctgttacccaggtc

SEQ ID NO: 109039 - DNA, 16 bp, H. sapiens
gcctgttatctcagca

SEQ ID NO: 109040 - DNA, 16 bp, H. sapiens
gcctgttattggtata

SEQ ID NO: 109041 - DNA, 16 bp, H. sapiens
gcctgttcatatcctt

SEQ ID NO: 109042 - DNA, 16 bp, H. sapiens
gcctgttcattctgat

SEQ ID NO: 109043 - DNA, 16 bp, H. sapiens
gcctgttgctcctagg

SEQ ID NO: 109044 - DNA, 16 bp, H. sapiens
gcctgttggccaggct

SEQ ID NO: 109045 - DNA, 16 bp, H. sapiens
gcctgttgtcccagct

SEQ ID NO: 109046 - DNA, 16 bp, H. sapiens
gcctgtttcctcattt

SEQ ID NO: 109047 - DNA, 16 bp, H. sapiens
gcctgtttcctcttct

SEQ ID NO: 109048 - DNA, 16 bp, H. sapiens
gccttaaaaaggaaaa

SEQ ID NO: 109049 - DNA, 16 bp, H. sapiens
gccttaaaaaggaaga

SEQ ID NO: 109050 - DNA, 16 bp, H. sapiens
gccttaaccttctggg

SEQ ID NO: 109051 - DNA, 16 bp, H. sapiens
gccttaagatttaatg

SEQ ID NO: 109052 - DNA, 16 bp, H. sapiens
gccttaatttgcattt

SEQ ID NO: 109053 - DNA, 16 bp, H. sapiens
gccttaatttttaaaa

SEQ ID NO: 109054 - DNA, 16 bp, H. sapiens
gccttacaggttagtt

SEQ ID NO: 109055 - DNA, 16 bp, H. sapiens
gccttacccagctccc

SEQ ID NO: 109056 - DNA, 16 bp, H. sapiens
gccttactcactctct

SEQ ID NO: 109057 - DNA, 17 bp, H. sapiens
gccttagaactcagtga

SEQ ID NO: 109058 - DNA, 16 bp, H. sapiens
gccttagctgccttcc

SEQ ID NO: 109059 - DNA, 16 bp, H. sapiens
gccttagtttccccat

SEQ ID NO: 109060 - DNA, 16 bp, H. sapiens
gccttatggagaaaat

SEQ ID NO: 109061 - DNA, 16 bp, H. sapiens
gccttcaactttgttc

SEQ ID NO: 109062 - DNA, 16 bp, H. sapiens
gccttcacagcctcca

SEQ ID NO: 109063 - DNA, 16 bp, H. sapiens
gccttcacttcctgct

SEQ ID NO: 109064 - DNA, 16 bp, H. sapiens
gccttcagaactgtga

SEQ ID NO: 109065 - DNA, 16 bp, H. sapiens
gccttcagagggagca

SEQ ID NO: 109066 - DNA, 16 bp, H. sapiens
gccttcagccaaatct

SEQ ID NO: 109067 - DNA, 16 bp, H. sapiens
gccttcatcaagaagt

SEQ ID NO: 109068 - DNA, 16 bp, H. sapiens
gccttcatggaattga

SEQ ID NO: 109069 - DNA, 16 bp, H. sapiens
gccttccaaaatgctg

SEQ ID NO: 109070 - DNA, 16 bp, H. sapiens
gccttccaaaattctg

SEQ ID NO: 109071 - DNA, 16 bp, H. sapiens
gccttccaagtgctgg

SEQ ID NO: 109072 - DNA, 16 bp, H. sapiens
gccttccaagttcaag

SEQ ID NO: 109073 - DNA, 16 bp, H. sapiens
gccttccacctccaca

SEQ ID NO: 109074 - DNA, 16 bp, H. sapiens
gccttccagattcaag

SEQ ID NO: 109075 - DNA, 16 bp, H. sapiens
gccttccagctgtgcc

SEQ ID NO: 109076 - DNA, 16 bp, H. sapiens
gccttccaggttcaag

SEQ ID NO: 109077 - DNA, 16 bp, H. sapiens
gccttccaggttccag

SEQ ID NO: 109078 - DNA, 16 bp, H. sapiens
gccttccaggttgaag

SEQ ID NO: 109079 - DNA, 16 bp, H. sapiens
gccttccatcatgatt

SEQ ID NO: 109080 - DNA, 16 bp, H. sapiens
gccttcccacaggaca

SEQ ID NO: 109081 - DNA, 16 bp, H. sapiens
gccttcccagcagccc

SEQ ID NO: 109082 - DNA, 16 bp, H. sapiens
gccttcccagcagctg

SEQ ID NO: 109083 - DNA, 16 bp, H. sapiens
gccttccccagcccag

SEQ ID NO: 109084 - DNA, 16 bp, H. sapiens
gccttccccatctcag

SEQ ID NO: 109085 - DNA, 16 bp, H. sapiens
gccttccctgaccacc

SEQ ID NO: 109086 - DNA, 16 bp, H. sapiens
gccttccctgaccccc

SEQ ID NO: 109087 - DNA, 16 bp, H. sapiens
gccttccgggttcaag

SEQ ID NO: 109088 - DNA, 16 bp, H. sapiens
gccttccgggttccag

SEQ ID NO: 109089 - DNA, 16 bp, H. sapiens
gccttcctggaggaag

SEQ ID NO: 109090 - DNA, 16 bp, H. sapiens
gccttcctggaggagg

SEQ ID NO: 109091 - DNA, 16 bp, H. sapiens
gccttccttctggagg

SEQ ID NO: 109092 - DNA, 16 bp, H. sapiens
gccttccttggcctcc

SEQ ID NO: 109093 - DNA, 16 bp, H. sapiens
gccttcctttggagga

SEQ ID NO: 109094 - DNA, 16 bp, H. sapiens
gccttcgaaagtgctg

SEQ ID NO: 109095 - DNA, 16 bp, H. sapiens
gccttctactggaaga

SEQ ID NO: 109096 - DNA, 16 bp, H. sapiens
gccttctcagagcctt

SEQ ID NO: 109097 - DNA, 16 bp, H. sapiens
gccttctctcagatga

SEQ ID NO: 109098 - DNA, 16 bp, H. sapiens
gccttctctctcccag

SEQ ID NO: 109099 - DNA, 16 bp, H. sapiens
gccttctctgacacca

SEQ ID NO: 109100 - DNA, 16 bp, H. sapiens
gccttctctgtcttgc

SEQ ID NO: 109101 - DNA, 16 bp, H. sapiens
gccttctgaggagctg

SEQ ID NO: 109102 - DNA, 16 bp, H. sapiens
gccttctgagttcaag

SEQ ID NO: 109103 - DNA, 16 bp, H. sapiens
gccttctgccatgatc

SEQ ID NO: 109104 - DNA, 16 bp, H. sapiens
gccttctgccatgatt

SEQ ID NO: 109105 - DNA, 16 bp, H. sapiens
gccttctgcctgggga

SEQ ID NO: 109106 - DNA, 16 bp, H. sapiens
gccttctggattcaag

SEQ ID NO: 109107 - DNA, 16 bp, H. sapiens
gccttctgggttcaag

SEQ ID NO: 109108 - DNA, 16 bp, H. sapiens
gccttctgggttcacg

SEQ ID NO: 109109 - DNA, 16 bp, H. sapiens
gccttctgggttcatg

SEQ ID NO: 109110 - DNA, 16 bp, H. sapiens
gccttctgggttgaag

SEQ ID NO: 109111 - DNA, 16 bp, H. sapiens
gccttctggtttcaag

SEQ ID NO: 109112 - DNA, 16 bp, H. sapiens
gccttcttcctgtgtc

SEQ ID NO: 109113 - DNA, 16 bp, H. sapiens
gccttcttgctgcctc

SEQ ID NO: 109114 - DNA, 16 bp, H. sapiens
gccttcttggttttgg

SEQ ID NO: 109115 - DNA, 16 bp, H. sapiens
gccttgaagtcctggg

SEQ ID NO: 109116 - DNA, 16 bp, H. sapiens
gccttgaatctataaa

SEQ ID NO: 109117 - DNA, 16 bp, H. sapiens
gccttgacctgctggg

SEQ ID NO: 109118 - DNA, 16 bp, H. sapiens
gccttgactgcctggg

SEQ ID NO: 109119 - DNA, 16 bp, H. sapiens
gccttgagcagagttt

SEQ ID NO: 109120 - DNA, 16 bp, H. sapiens
gccttgagtgaacatt

SEQ ID NO: 109121 - DNA, 16 bp, H. sapiens
gccttgatcttccagg

SEQ ID NO: 109122 - DNA, 16 bp, H. sapiens
gccttgattttggact

SEQ ID NO: 109123 - DNA, 16 bp, H. sapiens
gccttgcagcttctgc

SEQ ID NO: 109124 - DNA, 16 bp, H. sapiens
gccttgcccaaggtca

SEQ ID NO: 109125 - DNA, 16 bp, H. sapiens
gccttgcccccagagg

SEQ ID NO: 109126 - DNA, 16 bp, H. sapiens
gccttgctcattgcta

SEQ ID NO: 109127 - DNA, 16 bp, H. sapiens
gccttgctctggatta

SEQ ID NO: 109128 - DNA, 16 bp, H. sapiens
gccttgctctgtcacc

SEQ ID NO: 109129 - DNA, 16 bp, H. sapiens
gccttgctctgttgcc

SEQ ID NO: 109130 - DNA, 16 bp, H. sapiens
gccttgctgccgcctt

SEQ ID NO: 109131 - DNA, 16 bp, H. sapiens
gccttgctgggtttca

SEQ ID NO: 109132 - DNA, 16 bp, H. sapiens
gccttgctttcccttc

SEQ ID NO: 109133 - DNA, 16 bp, H. sapiens
gccttggaggtggagg

SEQ ID NO: 109134 - DNA, 16 bp, H. sapiens
gccttggcaacaaagc

SEQ ID NO: 109135 - DNA, 16 bp, H. sapiens
gccttggcaacttcca

SEQ ID NO: 109136 - DNA, 16 bp, H. sapiens
gccttggcagcctcca

SEQ ID NO: 109137 - DNA, 16 bp, H. sapiens
gccttggccagcccag

SEQ ID NO: 109138 - DNA, 17 bp, H. sapiens
gccttggccagcccaga

SEQ ID NO: 109139 - DNA, 16 bp, H. sapiens
gccttggccccccaga

SEQ ID NO: 109140 - DNA, 16 bp, H. sapiens
gccttggccccctgaa

SEQ ID NO: 109141 - DNA, 16 bp, H. sapiens
gccttggccctggccc

SEQ ID NO: 109142 - DNA, 17 bp, H. sapiens
gccttggcctcccaaaa

SEQ ID NO: 109143 - DNA, 17 bp, H. sapiens
gccttggcctcccaaac

SEQ ID NO: 109144 - DNA, 16 bp, H. sapiens
gccttggcctcccatg

SEQ ID NO: 109145 - DNA, 18 bp, H. sapiens
gccttggcctccgaaagt

SEQ ID NO: 109146 - DNA, 16 bp, H. sapiens
gccttggcctcctgaa

SEQ ID NO: 109147 - DNA, 16 bp, H. sapiens
gccttggcctcctgga

SEQ ID NO: 109148 - DNA, 16 bp, H. sapiens
gccttgggcaactctg

SEQ ID NO: 109149 - DNA, 16 bp, H. sapiens
gccttgggcagctcag

SEQ ID NO: 109150 - DNA, 16 bp, H. sapiens
gccttgggcctcccaa

SEQ ID NO: 109151 - DNA, 16 bp, H. sapiens
gccttggggacaagag

SEQ ID NO: 109152 - DNA, 16 bp, H. sapiens
gccttggtggcttcca

SEQ ID NO: 109153 - DNA, 16 bp, H. sapiens
gccttgtaatatattt

SEQ ID NO: 109154 - DNA, 16 bp, H. sapiens
gccttgtagagtttct

SEQ ID NO: 109155 - DNA, 16 bp, H. sapiens
gccttgtcacccaggc

SEQ ID NO: 109156 - DNA, 16 bp, H. sapiens
gccttgttctgtcacc

SEQ ID NO: 109157 - DNA, 16 bp, H. sapiens
gcctttaaagaggtga

SEQ ID NO: 109158 - DNA, 16 bp, H. sapiens
gcctttatcaaaacat

SEQ ID NO: 109159 - DNA, 16 bp, H. sapiens
gcctttatttcttcaa

SEQ ID NO: 109160 - DNA, 16 bp, H. sapiens
gcctttcaccttcctc

SEQ ID NO: 109161 - DNA, 16 bp, H. sapiens
gcctttcaccttctgt

SEQ ID NO: 109162 - DNA, 16 bp, H. sapiens
gcctttccctccacac

SEQ ID NO: 109163 - DNA, 16 bp, H. sapiens
gcctttctatataaat

SEQ ID NO: 109164 - DNA, 16 bp, H. sapiens
gcctttctgcaggtgt

SEQ ID NO: 109165 - DNA, 16 bp, H. sapiens
gcctttctggaccaaa

SEQ ID NO: 109166 - DNA, 16 bp, H. sapiens
gcctttgacagaattc

SEQ ID NO: 109167 - DNA, 16 bp, H. sapiens
gcctttgagagacaga

SEQ ID NO: 109168 - DNA, 16 bp, H. sapiens
gcctttgcaaaattat

SEQ ID NO: 109169 - DNA, 16 bp, H. sapiens
gcctttgcacaggctg

SEQ ID NO: 109170 - DNA, 16 bp, H. sapiens
gcctttgccccgccgc

SEQ ID NO: 109171 - DNA, 16 bp, H. sapiens
gcctttgccttatttg

SEQ ID NO: 109172 - DNA, 16 bp, H. sapiens
gcctttgctcttgctg

SEQ ID NO: 109173 - DNA, 16 bp, H. sapiens
gcctttgctgtgtccc

SEQ ID NO: 109174 - DNA, 16 bp, H. sapiens
gcctttgcttttggtg

SEQ ID NO: 109175 - DNA, 16 bp, H. sapiens
gcctttggaaagtgat

SEQ ID NO: 109176 - DNA, 16 bp, H. sapiens
gcctttggatacctgg

SEQ ID NO: 109177 - DNA, 16 bp, H. sapiens
gcctttggccatgatt

SEQ ID NO: 109178 - DNA, 16 bp, H. sapiens
gcctttggggttcaag

SEQ ID NO: 109179 - DNA, 16 bp, H. sapiens
gcctttgtgagctgta

SEQ ID NO: 109180 - DNA, 16 bp, H. sapiens
gcctttgtggagctta

SEQ ID NO: 109181 - DNA, 16 bp, H. sapiens
gcctttgtgtgtctct

SEQ ID NO: 109182 - DNA, 16 bp, H. sapiens
gccttttaaaaatata

SEQ ID NO: 109183 - DNA, 16 bp, H. sapiens
gccttttattggaaga

SEQ ID NO: 109184 - DNA, 16 bp, H. sapiens
gccttttcaaattggc

SEQ ID NO: 109185 - DNA, 16 bp, H. sapiens
gccttttcagataatt

SEQ ID NO: 109186 - DNA, 16 bp, H. sapiens
gccttttcattttgtt

SEQ ID NO: 109187 - DNA, 16 bp, H. sapiens
gccttttccagaaagt

SEQ ID NO: 109188 - DNA, 16 bp, H. sapiens
gccttttccagaatgc

SEQ ID NO: 109189 - DNA, 16 bp, H. sapiens
gccttttccagcttct

SEQ ID NO: 109190 - DNA, 16 bp, H. sapiens
gccttttccgcatcta

SEQ ID NO: 109191 - DNA, 16 bp, H. sapiens
gccttttctcctatta

SEQ ID NO: 109192 - DNA, 16 bp, H. sapiens
gccttttgagtctggc

SEQ ID NO: 109193 - DNA, 16 bp, H. sapiens
gccttttgcctcccac

SEQ ID NO: 109194 - DNA, 16 bp, H. sapiens
gccttttgggttcaag

SEQ ID NO: 109195 - DNA, 16 bp, H. sapiens
gccttttgtcccagct

SEQ ID NO: 109196 - DNA, 16 bp, H. sapiens
gccttttgtggtttta

SEQ ID NO: 109197 - DNA, 18 bp, H. sapiens
gcgaaaccccgtctccac

SEQ ID NO: 109198 - DNA, 16 bp, H. sapiens
gcgaaaccccgtctgt

SEQ ID NO: 109199 - DNA, 16 bp, H. sapiens
gcgaacccgggaggcg

SEQ ID NO: 109200 - DNA, 16 bp, H. sapiens
gcgacagtttgctcag

SEQ ID NO: 109201 - DNA, 16 bp, H. sapiens
gcgaccagcctgggca

SEQ ID NO: 109202 - DNA, 16 bp, H. sapiens
gcgaccccgtctggga

SEQ ID NO: 109203 - DNA, 16 bp, H. sapiens
gcgacgagagagtgta

SEQ ID NO: 109204 - DNA, 16 bp, H. sapiens
gcgagaccctcatctc

SEQ ID NO: 109205 - DNA, 17 bp, H. sapiens
gcgagactctacctcaa

SEQ ID NO: 109206 - DNA, 16 bp, H. sapiens
gcgagagagagagaca

SEQ ID NO: 109207 - DNA, 16 bp, H. sapiens
gcgagagagtgagacc

SEQ ID NO: 109208 - DNA, 16 bp, H. sapiens
gcgagagccaccacac

SEQ ID NO: 109209 - DNA, 16 bp, H. sapiens
gcgagatcaacacaga

SEQ ID NO: 109210 - DNA, 16 bp, H. sapiens
gcgagccaccatgccc

SEQ ID NO: 109211 - DNA, 16 bp, H. sapiens
gcgaggctgaggtggg

SEQ ID NO: 109212 - DNA, 19 bp, H. sapiens
gcgagggcggagctgcgtt

SEQ ID NO: 109213 - DNA, 17 bp, H. sapiens
gcgaggtgggcggatca

SEQ ID NO: 109214 - DNA, 16 bp, H. sapiens
gcgagtccataaagtg

SEQ ID NO: 109215 - DNA, 16 bp, H. sapiens
gcgagtgagttctcac

SEQ ID NO: 109216 - DNA, 16 bp, H. sapiens
gcgatcacagcttact

SEQ ID NO: 109217 - DNA, 16 bp, H. sapiens
gcgatcatggctcact

SEQ ID NO: 109218 - DNA, 16 bp, H. sapiens
gcgatccacctgcttt

SEQ ID NO: 109219 - DNA, 16 bp, H. sapiens
gcgatccgcccgcctc

SEQ ID NO: 109220 - DNA, 16 bp, H. sapiens
gcgatctcggctcacc

SEQ ID NO: 109221 - DNA, 16 bp, H. sapiens
gcgatctgccctcctc

SEQ ID NO: 109222 - DNA, 20 bp, H. sapiens
gcgatcttggcttactgcaa

SEQ ID NO: 109223 - DNA, 23 bp, H. sapiens
gcgatgccctgggcggcgtcctc

SEQ ID NO: 109224 - DNA, 17 bp, H. sapiens
gcgatgggggtcctaag

SEQ ID NO: 109225 - DNA, 16 bp, H. sapiens
gcgattaacatttggc

SEQ ID NO: 109226 - DNA, 16 bp, H. sapiens
gcgattttggaggaaa

SEQ ID NO: 109227 - DNA, 16 bp, H. sapiens
gcgcaatggcatgatc

SEQ ID NO: 109228 - DNA, 16 bp, H. sapiens
gcgcacacgcacacac

SEQ ID NO: 109229 - DNA, 16 bp, H. sapiens
gcgcacctcagcctcc

SEQ ID NO: 109230 - DNA, 16 bp, H. sapiens
gcgcacgcgcacacac

SEQ ID NO: 109231 - DNA, 16 bp, H. sapiens
gcgcaggcgcagagag

SEQ ID NO: 109232 - DNA, 16 bp, H. sapiens
gcgcagtggcgggcac

SEQ ID NO: 109233 - DNA, 16 bp, H. sapiens
gcgcagtggctcatcc

SEQ ID NO: 109234 - DNA, 16 bp, H. sapiens
gcgcagtggctcatgt

SEQ ID NO: 109235 - DNA, 16 bp, H. sapiens
gcgcagtggctcccac

SEQ ID NO: 109236 - DNA, 16 bp, H. sapiens
gcgcatgccaccacac

SEQ ID NO: 109237 - DNA, 16 bp, H. sapiens
gcgcatgcgcactggc

SEQ ID NO: 109238 - DNA, 16 bp, H. sapiens
gcgccaccacaaccag

SEQ ID NO: 109239 - DNA, 16 bp, H. sapiens
gcgccaccacacccag

SEQ ID NO: 109240 - DNA, 16 bp, H. sapiens
gcgccaccacagccag

SEQ ID NO: 109241 - DNA, 19 bp, H. sapiens
gcgccaccacgcctggcta

SEQ ID NO: 109242 - DNA, 21 bp, H. sapiens
gcgccaccatgcccggctaat

SEQ ID NO: 109243 - DNA, 16 bp, H. sapiens
gcgccactacgcctgg

SEQ ID NO: 109244 - DNA, 16 bp, H. sapiens
gcgccactgcacacca

SEQ ID NO: 109245 - DNA, 20 bp, H. sapiens
gcgccactgcactccggcct

SEQ ID NO: 109246 - DNA, 16 bp, H. sapiens
gcgccactgcactcct

SEQ ID NO: 109247 - DNA, 16 bp, H. sapiens
gcgccactgcagtcca

SEQ ID NO: 109248 - DNA, 16 bp, H. sapiens
gcgccactgcgcccgg

SEQ ID NO: 109249 - DNA, 16 bp, H. sapiens
gcgccatcttggctcc

SEQ ID NO: 109250 - DNA, 18 bp, H. sapiens
gcgcccaccaccatgcct

SEQ ID NO: 109251 - DNA, 16 bp, H. sapiens
gcgcccagccaatgtt

SEQ ID NO: 109252 - DNA, 16 bp, H. sapiens
gcgcccagcccaattt

SEQ ID NO: 109253 - DNA, 16 bp, H. sapiens
gcgcccagcccacatt

SEQ ID NO: 109254 - DNA, 16 bp, H. sapiens
gcgcccagcccagact

SEQ ID NO: 109255 - DNA, 16 bp, H. sapiens
gcgcccagcctatttt

SEQ ID NO: 109256 - DNA, 19 bp, H. sapiens
gcgcccagctaattttttg

SEQ ID NO: 109257 - DNA, 17 bp, H. sapiens
gcgcccagtcccattga

SEQ ID NO: 109258 - DNA, 16 bp, H. sapiens
gcgcccctcctccagc

SEQ ID NO: 109259 - DNA, 18 bp, H. sapiens
gcgcccctgcactccagc

SEQ ID NO: 109260 - DNA, 16 bp, H. sapiens
gcgcccgccaccatgc

SEQ ID NO: 109261 - DNA, 17 bp, H. sapiens
gcgcccgccaccgtgcc

SEQ ID NO: 109262 - DNA, 16 bp, H. sapiens
gcgcccggcctgattt

SEQ ID NO: 109263 - DNA, 16 bp, H. sapiens
gcgccctccaccacac

SEQ ID NO: 109264 - DNA, 16 bp, H. sapiens
gcgccctctgctggcc

SEQ ID NO: 109265 - DNA, 17 bp, H. sapiens
gcgccgttttttaagcc

SEQ ID NO: 109266 - DNA, 18 bp, H. sapiens
gcgcctatagtcccagct

SEQ ID NO: 109267 - DNA, 16 bp, H. sapiens
gcgcctctgctgggcc

SEQ ID NO: 109268 - DNA, 18 bp, H. sapiens
gcgcctgccaccatgcct

SEQ ID NO: 109269 - DNA, 16 bp, H. sapiens
gcgcctgccactgcgc

SEQ ID NO: 109270 - DNA, 16 bp, H. sapiens
gcgcctggcccagaat

SEQ ID NO: 109271 - DNA, 16 bp, H. sapiens
gcgcctggcccatttt

SEQ ID NO: 109272 - DNA, 18 bp, H. sapiens
gcgcctgtagtcccagca

SEQ ID NO: 109273 - DNA, 16 bp, H. sapiens
gcgcctgttgtcccag

SEQ ID NO: 109274 - DNA, 16 bp, H. sapiens
gcgcgcacccactggc

SEQ ID NO: 109275 - DNA, 16 bp, H. sapiens
gcgcgcgcgcgcacac

SEQ ID NO: 109276 - DNA, 18 bp, H. sapiens
gcgcggtggctcacgtct

SEQ ID NO: 109277 - DNA, 16 bp, H. sapiens
gcgcgtgccaccatgc

SEQ ID NO: 109278 - DNA, 16 bp, H. sapiens
gcgcgtgtgtgtgtgt

SEQ ID NO: 109279 - DNA, 16 bp, H. sapiens
gcgctactgcactcca

SEQ ID NO: 109280 - DNA, 16 bp, H. sapiens
gcgctatctgggctca

SEQ ID NO: 109281 - DNA, 16 bp, H. sapiens
gcgctccagcctggac

SEQ ID NO: 109282 - DNA, 16 bp, H. sapiens
gcgctcggtgggtggt

SEQ ID NO: 109283 - DNA, 16 bp, H. sapiens
gcgctctgggaggccg

SEQ ID NO: 109284 - DNA, 16 bp, H. sapiens
gcgctgccacacccag

SEQ ID NO: 109285 - DNA, 16 bp, H. sapiens
gcggaaataagggatc

SEQ ID NO: 109286 - DNA, 16 bp, H. sapiens
gcggaagcaggagaat

SEQ ID NO: 109287 - DNA, 16 bp, H. sapiens
gcggacccttgcggtg

SEQ ID NO: 109288 - DNA, 16 bp, H. sapiens
gcggagctgcccaagg

SEQ ID NO: 109289 - DNA, 16 bp, H. sapiens
gcggagcttgcagtgg

SEQ ID NO: 109290 - DNA, 16 bp, H. sapiens
gcggaggcaggtggat

SEQ ID NO: 109291 - DNA, 16 bp, H. sapiens
gcggaggctgcaggga

SEQ ID NO: 109292 - DNA, 16 bp, H. sapiens
gcggaggttgcggtga

SEQ ID NO: 109293 - DNA, 16 bp, H. sapiens
gcggatcgcttgaggc

SEQ ID NO: 109294 - DNA, 16 bp, H. sapiens
gcggcagaggttgcag

SEQ ID NO: 109295 - DNA, 16 bp, H. sapiens
gcggcagcccctccca

SEQ ID NO: 109296 - DNA, 16 bp, H. sapiens
gcggcaggaaggagaa

SEQ ID NO: 109297 - DNA, 16 bp, H. sapiens
gcggccacctgtagtc

SEQ ID NO: 109298 - DNA, 16 bp, H. sapiens
gcggcctcaacctccc

SEQ ID NO: 109299 - DNA, 16 bp, H. sapiens
gcggcctctgcaggcc

SEQ ID NO: 109300 - DNA, 16 bp, H. sapiens
gcggccttcccaggcc

SEQ ID NO: 109301 - DNA, 16 bp, H. sapiens
gcggcgctgcaggaga

SEQ ID NO: 109302 - DNA, 16 bp, H. sapiens
gcggcggctcacgcct

SEQ ID NO: 109303 - DNA, 16 bp, H. sapiens
gcggctgaggtgggag

SEQ ID NO: 109304 - DNA, 16 bp, H. sapiens
gcggctgcagagggtg

SEQ ID NO: 109305 - DNA, 16 bp, H. sapiens
gcggctgccgctgctt

SEQ ID NO: 109306 - DNA, 16 bp, H. sapiens
gcggctggcctggcag

SEQ ID NO: 109307 - DNA, 16 bp, H. sapiens
gcggctttccgcagtg

SEQ ID NO: 109308 - DNA, 16 bp, H. sapiens
gcgggaaccggggctg

SEQ ID NO: 109309 - DNA, 16 bp, H. sapiens
gcgggaccaggtggag

SEQ ID NO: 109310 - DNA, 16 bp, H. sapiens
gcgggagaatggcgtg

SEQ ID NO: 109311 - DNA, 16 bp, H. sapiens
gcgggagctgggcctg

SEQ ID NO: 109312 - DNA, 20 bp, H. sapiens
gcgggaggatcacttgaggc

SEQ ID NO: 109313 - DNA, 16 bp, H. sapiens
gcgggaggctgaggca

SEQ ID NO: 109314 - DNA, 31 bp, H. sapiens
gcgggatccactgggtgaagccagctgggct

SEQ ID NO: 109315 - DNA, 16 bp, H. sapiens
gcgggcagatcatgtg

SEQ ID NO: 109316 - DNA, 16 bp, H. sapiens
gcgggcagatgacttg

SEQ ID NO: 109317 - DNA, 16 bp, H. sapiens
gcgggcgagcctgact

SEQ ID NO: 109318 - DNA, 16 bp, H. sapiens
gcggggaggagcctgg

SEQ ID NO: 109319 - DNA, 16 bp, H. sapiens
gcggggcagaggggct

SEQ ID NO: 109320 - DNA, 27 bp, H. sapiens
gcggggcagggctcgggacctgcagcc

SEQ ID NO: 109321 - DNA, 16 bp, H. sapiens
gcggggccaagatggc

SEQ ID NO: 109322 - DNA, 16 bp, H. sapiens
gcggggcctgcagagg

SEQ ID NO: 109323 - DNA, 16 bp, H. sapiens
gcgggtggatcacagg

SEQ ID NO: 109324 - DNA, 16 bp, H. sapiens
gcggtgacccccctgg

SEQ ID NO: 109325 - DNA, 16 bp, H. sapiens
gcggtgagtgttacag

SEQ ID NO: 109326 - DNA, 17 bp, H. sapiens
gcggtggctcacaccta

SEQ ID NO: 109327 - DNA, 16 bp, H. sapiens
gcggtggctcatgtct

SEQ ID NO: 109328 - DNA, 16 bp, H. sapiens
gcggtggctgcagtga

SEQ ID NO: 109329 - DNA, 16 bp, H. sapiens
gcggtggggcagaggc

SEQ ID NO: 109330 - DNA, 16 bp, H. sapiens
gcggtggttcatgcct

SEQ ID NO: 109331 - DNA, 16 bp, H. sapiens
gcggttgcagtgagca

SEQ ID NO: 109332 - DNA, 16 bp, H. sapiens
gcgtaaacccaggagg

SEQ ID NO: 109333 - DNA, 16 bp, H. sapiens
gcgtagtggtgcatgc

SEQ ID NO: 109334 - DNA, 16 bp, H. sapiens
gcgtcagagcgagact

SEQ ID NO: 109335 - DNA, 17 bp, H. sapiens
gcgtccctagtagctgg

SEQ ID NO: 109336 - DNA, 16 bp, H. sapiens
gcgtcctgtagccttt

SEQ ID NO: 109337 - DNA, 16 bp, H. sapiens
gcgtccttgtcttgtg

SEQ ID NO: 109338 - DNA, 16 bp, H. sapiens
gcgtctcactctgtca

SEQ ID NO: 109339 - DNA, 16 bp, H. sapiens
gcgtctgccaccacgc

SEQ ID NO: 109340 - DNA, 16 bp, H. sapiens
gcgtctggagttgttc

SEQ ID NO: 109341 - DNA, 16 bp, H. sapiens
gcgtctggctaatttt

SEQ ID NO: 109342 - DNA, 16 bp, H. sapiens
gcgtcttgctctgttg

SEQ ID NO: 109343 - DNA, 16 bp, H. sapiens
gcgtgaacccaggagt

SEQ ID NO: 109344 - DNA, 16 bp, H. sapiens
gcgtgaccacagctca

SEQ ID NO: 109345 - DNA, 16 bp, H. sapiens
gcgtgagactccgtct

SEQ ID NO: 109346 - DNA, 17 bp, H. sapiens
gcgtgagccaccgcacc

SEQ ID NO: 109347 - DNA, 17 bp, H. sapiens
gcgtgagccaccgcgca

SEQ ID NO: 109348 - DNA, 16 bp, H. sapiens
gcgtgcacgcacacac

SEQ ID NO: 109349 - DNA, 16 bp, H. sapiens
gcgtgcactaccacac

SEQ ID NO: 109350 - DNA, 21 bp, H. sapiens
gcgtgccaccacgcccggcta

SEQ ID NO: 109351 - DNA, 16 bp, H. sapiens
gcgtgcgcgtgtgtgt

SEQ ID NO: 109352 - DNA, 16 bp, H. sapiens
gcgtgcgtgcgcgcgc

SEQ ID NO: 109353 - DNA, 16 bp, H. sapiens
gcgtgcgtgtgtgtgc

SEQ ID NO: 109354 - DNA, 16 bp, H. sapiens
gcgtgctaccacgccc

SEQ ID NO: 109355 - DNA, 16 bp, H. sapiens
gcgtgctggcaggcgc

SEQ ID NO: 109356 - DNA, 16 bp, H. sapiens
gcgtggcagtgggcac

SEQ ID NO: 109357 - DNA, 16 bp, H. sapiens
gcgtggcagtgggtgc

SEQ ID NO: 109358 - DNA, 16 bp, H. sapiens
gcgtggcggcatgtgc

SEQ ID NO: 109359 - DNA, 16 bp, H. sapiens
gcgtggctggggaggc

SEQ ID NO: 109360 - DNA, 16 bp, H. sapiens
gcgtggctgtgttcca

SEQ ID NO: 109361 - DNA, 22 bp, H. sapiens
gcgtgggaacgagaagacactc

SEQ ID NO: 109362 - DNA, 16 bp, H. sapiens
gcgtgggcatggagga

SEQ ID NO: 109363 - DNA, 16 bp, H. sapiens
gcgtggtgatgcatgc

SEQ ID NO: 109364 - DNA, 16 bp, H. sapiens
gcgtggtgatgggcac

SEQ ID NO: 109365 - DNA, 16 bp, H. sapiens
gcgtggtggcacatgc

SEQ ID NO: 109366 - DNA, 16 bp, H. sapiens
gcgtggtggcatgtac

SEQ ID NO: 109367 - DNA, 17 bp, H. sapiens
gcgtggtggcgggcacc

SEQ ID NO: 109368 - DNA, 16 bp, H. sapiens
gcgtggtggtggacac

SEQ ID NO: 109369 - DNA, 16 bp, H. sapiens
gcgtggtggtgtgccc

SEQ ID NO: 109370 - DNA, 16 bp, H. sapiens
gcgtgtacacacacac

SEQ ID NO: 109371 - DNA, 16 bp, H. sapiens
gcgtgtatgtgtgtgt

SEQ ID NO: 109372 - DNA, 16 bp, H. sapiens
gcgtgtgccactacac

SEQ ID NO: 109373 - DNA, 16 bp, H. sapiens
gcgtgtgcctgtgtgt

SEQ ID NO: 109374 - DNA, 16 bp, H. sapiens
gcgtgtgtgcgtgtgc

SEQ ID NO: 109375 - DNA, 16 bp, H. sapiens
gcgtgtgtgtatatat

SEQ ID NO: 109376 - DNA, 16 bp, H. sapiens
gcgtgtgtgtatgcgt

SEQ ID NO: 109377 - DNA, 16 bp, H. sapiens
gcgtgtgtgtgcatgt

SEQ ID NO: 109378 - DNA, 16 bp, H. sapiens
gcgtgttggctcacgc

SEQ ID NO: 109379 - DNA, 16 bp, H. sapiens
gctaaaaatacaaaag

SEQ ID NO: 109380 - DNA, 16 bp, H. sapiens
gctaaaaatacaaaga

SEQ ID NO: 109381 - DNA, 16 bp, H. sapiens
gctaaaaatacaagaa

SEQ ID NO: 109382 - DNA, 16 bp, H. sapiens
gctaaaaatacgaaaa

SEQ ID NO: 109383 - DNA, 16 bp, H. sapiens
gctaaaactacaaaaa

SEQ ID NO: 109384 - DNA, 16 bp, H. sapiens
gctaaaactggcctgt

SEQ ID NO: 109385 - DNA, 16 bp, H. sapiens
gctaaaagagcatgtt

SEQ ID NO: 109386 - DNA, 16 bp, H. sapiens
gctaaaagtttgtcaa

SEQ ID NO: 109387 - DNA, 16 bp, H. sapiens
gctaaaatgaaaaata

SEQ ID NO: 109388 - DNA, 16 bp, H. sapiens
gctaaacaaattatcc

SEQ ID NO: 109389 - DNA, 16 bp, H. sapiens
gctaaacattgggcac

SEQ ID NO: 109390 - DNA, 16 bp, H. sapiens
gctaaactaagaaaaa

SEQ ID NO: 109391 - DNA, 16 bp, H. sapiens
gctaaactaatttaca

SEQ ID NO: 109392 - DNA, 16 bp, H. sapiens
gctaaagtctcttatg

SEQ ID NO: 109393 - DNA, 16 bp, H. sapiens
gctaaataatattcca

SEQ ID NO: 109394 - DNA, 16 bp, H. sapiens
gctaaatgccccactt

SEQ ID NO: 109395 - DNA, 16 bp, H. sapiens
gctaacacaatatcca

SEQ ID NO: 109396 - DNA, 16 bp, H. sapiens
gctaacatagtgaaat

SEQ ID NO: 109397 - DNA, 17 bp, H. sapiens
gctaactagaataaaca

SEQ ID NO: 109398 - DNA, 17 bp, H. sapiens
gctaactagaataacca

SEQ ID NO: 109399 - DNA, 16 bp, H. sapiens
gctaactgggcactgg

SEQ ID NO: 109400 - DNA, 16 bp, H. sapiens
gctaagaaaggagaga

SEQ ID NO: 109401 - DNA, 16 bp, H. sapiens
gctaagaactttgaaa

SEQ ID NO: 109402 - DNA, 16 bp, H. sapiens
gctaagatgggtggat

SEQ ID NO: 109403 - DNA, 16 bp, H. sapiens
gctaagccaagaagga

SEQ ID NO: 109404 - DNA, 16 bp, H. sapiens
gctaaggcacgagaat

SEQ ID NO: 109405 - DNA, 16 bp, H. sapiens
gctaaggcaggtggat

SEQ ID NO: 109406 - DNA, 16 bp, H. sapiens
gctaaggcgggaggat

SEQ ID NO: 109407 - DNA, 16 bp, H. sapiens
gctaagtgtggtggtg

SEQ ID NO: 109408 - DNA, 16 bp, H. sapiens
gctaagtttttatatt

SEQ ID NO: 109409 - DNA, 16 bp, H. sapiens
gctaatatggcaaaac

SEQ ID NO: 109410 - DNA, 16 bp, H. sapiens
gctaatattgtatttt

SEQ ID NO: 109411 - DNA, 17 bp, H. sapiens
gctaatatttgtatttt

SEQ ID NO: 109412 - DNA, 16 bp, H. sapiens
gctaatgattatctga

SEQ ID NO: 109413 - DNA, 16 bp, H. sapiens
gctaatgtttaatttt

SEQ ID NO: 109414 - DNA, 16 bp, H. sapiens
gctaatgtttttgttt

SEQ ID NO: 109415 - DNA, 16 bp, H. sapiens
gctaatgttttttgta

SEQ ID NO: 109416 - DNA, 16 bp, H. sapiens
gctaattaaaaaaaat

SEQ ID NO: 109417 - DNA, 16 bp, H. sapiens
gctaattattttaatt

SEQ ID NO: 109418 - DNA, 16 bp, H. sapiens
gctaatttcttgattt

SEQ ID NO: 109419 - DNA, 16 bp, H. sapiens
gctaatttttaattta

SEQ ID NO: 109420 - DNA, 16 bp, H. sapiens
gctaatttttctatgt

SEQ ID NO: 109421 - DNA, 16 bp, H. sapiens
gctaatttttggcatt

SEQ ID NO: 109422 - DNA, 16 bp, H. sapiens
gctaattttttaattt

SEQ ID NO: 109423 - DNA, 16 bp, H. sapiens
gctaattttttccatt

SEQ ID NO: 109424 - DNA, 16 bp, H. sapiens
gctacaaataaaataa

SEQ ID NO: 109425 - DNA, 16 bp, H. sapiens
gctacaagatggatga

SEQ ID NO: 109426 - DNA, 16 bp, H. sapiens
gctacaatgagctatg

SEQ ID NO: 109427 - DNA, 17 bp, H. sapiens
gctacaccggaggctga

SEQ ID NO: 109428 - DNA, 16 bp, H. sapiens
gctacactccagcctg

SEQ ID NO: 109429 - DNA, 16 bp, H. sapiens
gctacagaaaccaaaa

SEQ ID NO: 109430 - DNA, 16 bp, H. sapiens
gctacagagaggagct

SEQ ID NO: 109431 - DNA, 16 bp, H. sapiens
gctacagctgcagttt

SEQ ID NO: 109432 - DNA, 16 bp, H. sapiens
gctacaggggtggggc

SEQ ID NO: 109433 - DNA, 16 bp, H. sapiens
gctacatgccccatgc

SEQ ID NO: 109434 - DNA, 16 bp, H. sapiens
gctacattaaatttat

SEQ ID NO: 109435 - DNA, 16 bp, H. sapiens
gctaccaacatgacat

SEQ ID NO: 109436 - DNA, 16 bp, H. sapiens
gctaccaacatgatgt

SEQ ID NO: 109437 - DNA, 16 bp, H. sapiens
gctaccaagcccggct

SEQ ID NO: 109438 - DNA, 16 bp, H. sapiens
gctaccaccaccacca

SEQ ID NO: 109439 - DNA, 16 bp, H. sapiens
gctaccagcctcccag

SEQ ID NO: 109440 - DNA, 16 bp, H. sapiens
gctaccagggaagctg

SEQ ID NO: 109441 - DNA, 16 bp, H. sapiens
gctacctgccttcaaa

SEQ ID NO: 109442 - DNA, 16 bp, H. sapiens
gctaccttgtgaagaa

SEQ ID NO: 109443 - DNA, 16 bp, H. sapiens
gctacggccactgctg

SEQ ID NO: 109444 - DNA, 16 bp, H. sapiens
gctactaaaaaataca

SEQ ID NO: 109445 - DNA, 16 bp, H. sapiens
gctactaagtgactaa

SEQ ID NO: 109446 - DNA, 16 bp, H. sapiens
gctactaagtgactca

SEQ ID NO: 109447 - DNA, 16 bp, H. sapiens
gctactatgcctggcc

SEQ ID NO: 109448 - DNA, 16 bp, H. sapiens
gctactcaaaggctga

SEQ ID NO: 109449 - DNA, 16 bp, H. sapiens
gctactcagaagactg

SEQ ID NO: 109450 - DNA, 16 bp, H. sapiens
gctactcagaaggcta

SEQ ID NO: 109451 - DNA, 16 bp, H. sapiens
gctactcagagactga

SEQ ID NO: 109452 - DNA, 16 bp, H. sapiens
gctactcagctggctg

SEQ ID NO: 109453 - DNA, 16 bp, H. sapiens
gctactcaggagcttg

SEQ ID NO: 109454 - DNA, 16 bp, H. sapiens
gctactcaggggcctg

SEQ ID NO: 109455 - DNA, 16 bp, H. sapiens
gctactcagtgggctg

SEQ ID NO: 109456 - DNA, 16 bp, H. sapiens
gctactccacagacag

SEQ ID NO: 109457 - DNA, 16 bp, H. sapiens
gctactcgggacgctg

SEQ ID NO: 109458 - DNA, 16 bp, H. sapiens
gctactgatttttgtg

SEQ ID NO: 109459 - DNA, 16 bp, H. sapiens
gctactgcacagcaaa

SEQ ID NO: 109460 - DNA, 16 bp, H. sapiens
gctactgctctgcccc

SEQ ID NO: 109461 - DNA, 16 bp, H. sapiens
gctactgctgctactg

SEQ ID NO: 109462 - DNA, 16 bp, H. sapiens
gctactgctgctgctg

SEQ ID NO: 109463 - DNA, 16 bp, H. sapiens
gctactgctttatcaa

SEQ ID NO: 109464 - DNA, 16 bp, H. sapiens
gctactgtgttggaca

SEQ ID NO: 109465 - DNA, 17 bp, H. sapiens
gctacttgagataatgg

SEQ ID NO: 109466 - DNA, 16 bp, H. sapiens
gctacttgggaggagg

SEQ ID NO: 109467 - DNA, 16 bp, H. sapiens
gctactttgggaggcc

SEQ ID NO: 109468 - DNA, 16 bp, H. sapiens
gctacttttaaaattt

SEQ ID NO: 109469 - DNA, 16 bp, H. sapiens
gctagaacccgggagg

SEQ ID NO: 109470 - DNA, 16 bp, H. sapiens
gctagaagtttgaaat

SEQ ID NO: 109471 - DNA, 17 bp, H. sapiens
gctagacaagcagctag

SEQ ID NO: 109472 - DNA, 16 bp, H. sapiens
gctagagaaaaaaata

SEQ ID NO: 109473 - DNA, 16 bp, H. sapiens
gctagagaaggaaaag

SEQ ID NO: 109474 - DNA, 16 bp, H. sapiens
gctagatataaagact

SEQ ID NO: 109475 - DNA, 16 bp, H. sapiens
gctagatctcctggat

SEQ ID NO: 109476 - DNA, 16 bp, H. sapiens
gctagcaaatggcaga

SEQ ID NO: 109477 - DNA, 16 bp, H. sapiens
gctagcactttgggag

SEQ ID NO: 109478 - DNA, 16 bp, H. sapiens
gctagcatatagaaat

SEQ ID NO: 109479 - DNA, 16 bp, H. sapiens
gctagcatcacaatga

SEQ ID NO: 109480 - DNA, 16 bp, H. sapiens
gctagcatcaccctga

SEQ ID NO: 109481 - DNA, 16 bp, H. sapiens
gctagcctcagcctcc

SEQ ID NO: 109482 - DNA, 16 bp, H. sapiens
gctagctcgggcagcc

SEQ ID NO: 109483 - DNA, 16 bp, H. sapiens
gctaggacatccagta

SEQ ID NO: 109484 - DNA, 16 bp, H. sapiens
gctaggatcacaggca

SEQ ID NO: 109485 - DNA, 16 bp, H. sapiens
gctaggattaaaggtg

SEQ ID NO: 109486 - DNA, 16 bp, H. sapiens
gctaggattacagaca

SEQ ID NO: 109487 - DNA, 16 bp, H. sapiens
gctaggattacaggca

SEQ ID NO: 109488 - DNA, 16 bp, H. sapiens
gctaggattactggca

SEQ ID NO: 109489 - DNA, 16 bp, H. sapiens
gctaggcgcgatggct

SEQ ID NO: 109490 - DNA, 16 bp, H. sapiens
gctaggcgtggtggtg

SEQ ID NO: 109491 - DNA, 16 bp, H. sapiens
gctaggctgggctggg

SEQ ID NO: 109492 - DNA, 16 bp, H. sapiens
gctagggcctggaaca

SEQ ID NO: 109493 - DNA, 16 bp, H. sapiens
gctaggtgaccttggg

SEQ ID NO: 109494 - DNA, 17 bp, H. sapiens
gctaggttgcccaggct

SEQ ID NO: 109495 - DNA, 16 bp, H. sapiens
gctagtaagtagtaga

SEQ ID NO: 109496 - DNA, 16 bp, H. sapiens
gctagtcccttctgcc

SEQ ID NO: 109497 - DNA, 16 bp, H. sapiens
gctataaagacatatg

SEQ ID NO: 109498 - DNA, 16 bp, H. sapiens
gctataacaaagtact

SEQ ID NO: 109499 - DNA, 16 bp, H. sapiens
gctataataaaatatc

SEQ ID NO: 109500 - DNA, 16 bp, H. sapiens
gctatagtgcaatggt

SEQ ID NO: 109501 - DNA, 16 bp, H. sapiens
gctatattttgtattt

SEQ ID NO: 109502 - DNA, 16 bp, H. sapiens
gctatccctccccact

SEQ ID NO: 109503 - DNA, 16 bp, H. sapiens
gctatcctgagcaaaa

SEQ ID NO: 109504 - DNA, 22 bp, H. sapiens
gctatctcggctcactgcaacc

SEQ ID NO: 109505 - DNA, 16 bp, H. sapiens
gctatctgcactccca

SEQ ID NO: 109506 - DNA, 17 bp, H. sapiens
gctatctgtgaaaatgc

SEQ ID NO: 109507 - DNA, 16 bp, H. sapiens
gctatctgtgaaattg

SEQ ID NO: 109508 - DNA, 16 bp, H. sapiens
gctatgaaaaaatacc

SEQ ID NO: 109509 - DNA, 16 bp, H. sapiens
gctatgaagaaatgcc

SEQ ID NO: 109510 - DNA, 16 bp, H. sapiens
gctatgaatattcatg

SEQ ID NO: 109511 - DNA, 16 bp, H. sapiens
gctatgacatggatga

SEQ ID NO: 109512 - DNA, 24 bp, H. sapiens
gctatgacctaatgcttgcttgga

SEQ ID NO: 109513 - DNA, 16 bp, H. sapiens
gctatgatcatggcac

SEQ ID NO: 109514 - DNA, 16 bp, H. sapiens
gctatgatggcaccac

SEQ ID NO: 109515 - DNA, 16 bp, H. sapiens
gctatgattacaggca

SEQ ID NO: 109516 - DNA, 16 bp, H. sapiens
gctatgattgtgcctg

SEQ ID NO: 109517 - DNA, 19 bp, H. sapiens
gctatgcccggctaatttt

SEQ ID NO: 109518 - DNA, 18 bp, H. sapiens
gctatggaacaggctggg

SEQ ID NO: 109519 - DNA, 16 bp, H. sapiens
gctatggagaaaataa

SEQ ID NO: 109520 - DNA, 16 bp, H. sapiens
gctatgggagactggg

SEQ ID NO: 109521 - DNA, 16 bp, H. sapiens
gctatggtggctatgg

SEQ ID NO: 109522 - DNA, 16 bp, H. sapiens
gctatgtaaatagttg

SEQ ID NO: 109523 - DNA, 19 bp, H. sapiens
gctatgttgcccaggctga

SEQ ID NO: 109524 - DNA, 17 bp, H. sapiens
gctatgttgtccaggct

SEQ ID NO: 109525 - DNA, 16 bp, H. sapiens
gctattacaaataaag

SEQ ID NO: 109526 - DNA, 16 bp, H. sapiens
gctattacaaatagtg

SEQ ID NO: 109527 - DNA, 16 bp, H. sapiens
gctattactttcaatg

SEQ ID NO: 109528 - DNA, 16 bp, H. sapiens
gctattagaaaattta

SEQ ID NO: 109529 - DNA, 16 bp, H. sapiens
gctattataaataatg

SEQ ID NO: 109530 - DNA, 16 bp, H. sapiens
gctattattattattt

SEQ ID NO: 109531 - DNA, 16 bp, H. sapiens
gctattattcttagca

SEQ ID NO: 109532 - DNA, 16 bp, H. sapiens
gctattcctcccctag

SEQ ID NO: 109533 - DNA, 16 bp, H. sapiens
gctattctagtgatag

SEQ ID NO: 109534 - DNA, 16 bp, H. sapiens
gctattctttctgatg

SEQ ID NO: 109535 - DNA, 16 bp, H. sapiens
gctattgaaataaaat

SEQ ID NO: 109536 - DNA, 16 bp, H. sapiens
gctattggtgggaatg

SEQ ID NO: 109537 - DNA, 16 bp, H. sapiens
gctattgtaaatagtg

SEQ ID NO: 109538 - DNA, 16 bp, H. sapiens
gctattgtgaacactg

SEQ ID NO: 109539 - DNA, 16 bp, H. sapiens
gctattgtgaatggaa

SEQ ID NO: 109540 - DNA, 16 bp, H. sapiens
gctattgttgccattg

SEQ ID NO: 109541 - DNA, 16 bp, H. sapiens
gctatttaaattaatt

SEQ ID NO: 109542 - DNA, 16 bp, H. sapiens
gctatttatggcaaac

SEQ ID NO: 109543 - DNA, 16 bp, H. sapiens
gctatttggagtcttt

SEQ ID NO: 109544 - DNA, 16 bp, H. sapiens
gctatttgggaggcag

SEQ ID NO: 109545 - DNA, 16 bp, H. sapiens
gctattttaaaaaaaa

SEQ ID NO: 109546 - DNA, 16 bp, H. sapiens
gctattttttaaaaaa

SEQ ID NO: 109547 - DNA, 16 bp, H. sapiens
gctattttttaatata

SEQ ID NO: 109548 - DNA, 16 bp, H. sapiens
gctcaaaaataaataa

SEQ ID NO: 109549 - DNA, 16 bp, H. sapiens
gctcaaaagaaaacaa

SEQ ID NO: 109550 - DNA, 16 bp, H. sapiens
gctcaaacaactctat

SEQ ID NO: 109551 - DNA, 16 bp, H. sapiens
gctcaaagaactaaag

SEQ ID NO: 109552 - DNA, 16 bp, H. sapiens
gctcaaagaagtcaga

SEQ ID NO: 109553 - DNA, 16 bp, H. sapiens
gctcaacatggtgaaa

SEQ ID NO: 109554 - DNA, 16 bp, H. sapiens
gctcaagaaatcctct

SEQ ID NO: 109555 - DNA, 16 bp, H. sapiens
gctcaagaaatctgcc

SEQ ID NO: 109556 - DNA, 16 bp, H. sapiens
gctcaagaactacatg

SEQ ID NO: 109557 - DNA, 16 bp, H. sapiens
gctcaagacatcctcc

SEQ ID NO: 109558 - DNA, 16 bp, H. sapiens
gctcaagagatcctcc

SEQ ID NO: 109559 - DNA, 16 bp, H. sapiens
gctcaagcaatcctcc

SEQ ID NO: 109560 - DNA, 16 bp, H. sapiens
gctcaagcaatctgcc

SEQ ID NO: 109561 - DNA, 16 bp, H. sapiens
gctcaagcaattctcc

SEQ ID NO: 109562 - DNA, 16 bp, H. sapiens
gctcaagcaggagaat

SEQ ID NO: 109563 - DNA, 16 bp, H. sapiens
gctcaagcaggtcctg

SEQ ID NO: 109564 - DNA, 16 bp, H. sapiens
gctcaagcagtcctct

SEQ ID NO: 109565 - DNA, 16 bp, H. sapiens
gctcaagcagtcgtcc

SEQ ID NO: 109566 - DNA, 16 bp, H. sapiens
gctcaagcagttcacc

SEQ ID NO: 109567 - DNA, 16 bp, H. sapiens
gctcaagcccaggagg

SEQ ID NO: 109568 - DNA, 16 bp, H. sapiens
gctcaagcctgaaatc

SEQ ID NO: 109569 - DNA, 16 bp, H. sapiens
gctcaagcctgggagg

SEQ ID NO: 109570 - DNA, 16 bp, H. sapiens
gctcaagcgatccgcc

SEQ ID NO: 109571 - DNA, 16 bp, H. sapiens
gctcaagcgatcttcc

SEQ ID NO: 109572 - DNA, 16 bp, H. sapiens
gctcaagctatcctcc

SEQ ID NO: 109573 - DNA, 16 bp, H. sapiens
gctcaagctatctgcc

SEQ ID NO: 109574 - DNA, 16 bp, H. sapiens
gctcaagctgtccacc

SEQ ID NO: 109575 - DNA, 16 bp, H. sapiens
gctcaaggaatcctct

SEQ ID NO: 109576 - DNA, 16 bp, H. sapiens
gctcaaggccaggagt

SEQ ID NO: 109577 - DNA, 16 bp, H. sapiens
gctcaagtaatcctcc

SEQ ID NO: 109578 - DNA, 18 bp, H. sapiens
gctcaagtgatcctctgg

SEQ ID NO: 109579 - DNA, 16 bp, H. sapiens
gctcaagtgatctacc

SEQ ID NO: 109580 - DNA, 19 bp, H. sapiens
gctcaagtgatctgcccac

SEQ ID NO: 109581 - DNA, 16 bp, H. sapiens
gctcaagtgtttctcc

SEQ ID NO: 109582 - DNA, 16 bp, H. sapiens
gctcaataaacatctg

SEQ ID NO: 109583 - DNA, 16 bp, H. sapiens
gctcaataaatactca

SEQ ID NO: 109584 - DNA, 16 bp, H. sapiens
gctcaataaatgtgtt

SEQ ID NO: 109585 - DNA, 16 bp, H. sapiens
gctcaatatcactaat

SEQ ID NO: 109586 - DNA, 16 bp, H. sapiens
gctcaatgcagcctcg

SEQ ID NO: 109587 - DNA, 16 bp, H. sapiens
gctcaatttttgtttt

SEQ ID NO: 109588 - DNA, 16 bp, H. sapiens
gctcacagaactcagg

SEQ ID NO: 109589 - DNA, 16 bp, H. sapiens
gctcacaggaagccac

SEQ ID NO: 109590 - DNA, 16 bp, H. sapiens
gctcacaggatcctcc

SEQ ID NO: 109591 - DNA, 16 bp, H. sapiens
gctcaccacatcctcc

SEQ ID NO: 109592 - DNA, 16 bp, H. sapiens
gctcaccaccacctcc

SEQ ID NO: 109593 - DNA, 16 bp, H. sapiens
gctcaccaccacctct

SEQ ID NO: 109594 - DNA, 16 bp, H. sapiens
gctcaccagctgtgtg

SEQ ID NO: 109595 - DNA, 16 bp, H. sapiens
gctcaccctttgggtc

SEQ ID NO: 109596 - DNA, 16 bp, H. sapiens
gctcaccgcaagctcc

SEQ ID NO: 109597 - DNA, 16 bp, H. sapiens
gctcaccgcagcctca

SEQ ID NO: 109598 - DNA, 16 bp, H. sapiens
gctcaccggcggtcag

SEQ ID NO: 109599 - DNA, 16 bp, H. sapiens
gctcacctcaacctcc

SEQ ID NO: 109600 - DNA, 16 bp, H. sapiens
gctcacctcagcctcc

SEQ ID NO: 109601 - DNA, 16 bp, H. sapiens
gctcacctccacctcc

SEQ ID NO: 109602 - DNA, 16 bp, H. sapiens
gctcacctcctactgt

SEQ ID NO: 109603 - DNA, 16 bp, H. sapiens
gctcacctgctgctca

SEQ ID NO: 109604 - DNA, 16 bp, H. sapiens
gctcacctgtggtccc

SEQ ID NO: 109605 - DNA, 16 bp, H. sapiens
gctcacggcaacctcc

SEQ ID NO: 109606 - DNA, 16 bp, H. sapiens
gctcactacaacctcc

SEQ ID NO: 109607 - DNA, 16 bp, H. sapiens
gctcactacaacctct

SEQ ID NO: 109608 - DNA, 16 bp, H. sapiens
gctcactacaagctcc

SEQ ID NO: 109609 - DNA, 16 bp, H. sapiens
gctcactacagcctcc

SEQ ID NO: 109610 - DNA, 16 bp, H. sapiens
gctcactacagcctgg

SEQ ID NO: 109611 - DNA, 16 bp, H. sapiens
gctcactataagctcc

SEQ ID NO: 109612 - DNA, 16 bp, H. sapiens
gctcactcacccacca

SEQ ID NO: 109613 - DNA, 16 bp, H. sapiens
gctcactctgcctccc

SEQ ID NO: 109614 - DNA, 16 bp, H. sapiens
gctcactgaaagctcc

SEQ ID NO: 109615 - DNA, 16 bp, H. sapiens
gctcactgaagcctgg

SEQ ID NO: 109616 - DNA, 16 bp, H. sapiens
gctcactgcaaacttc

SEQ ID NO: 109617 - DNA, 16 bp, H. sapiens
gctcactgcaacccct

SEQ ID NO: 109618 - DNA, 18 bp, H. sapiens
gctcactgcaacctctga

SEQ ID NO: 109619 - DNA, 16 bp, H. sapiens
gctcactgcaagcact

SEQ ID NO: 109620 - DNA, 16 bp, H. sapiens
gctcactgcaagctcc

SEQ ID NO: 109621 - DNA, 16 bp, H. sapiens
gctcactgcaccctca

SEQ ID NO: 109622 - DNA, 16 bp, H. sapiens
gctcactgcagccccc

SEQ ID NO: 109623 - DNA, 16 bp, H. sapiens
gctcactgcagcctgt

SEQ ID NO: 109624 - DNA, 16 bp, H. sapiens
gctcactgcagctctg

SEQ ID NO: 109625 - DNA, 16 bp, H. sapiens
gctcactgcaggcttg

SEQ ID NO: 109626 - DNA, 16 bp, H. sapiens
gctcactgcagttttg

SEQ ID NO: 109627 - DNA, 16 bp, H. sapiens
gctcactgccacctcc

SEQ ID NO: 109628 - DNA, 16 bp, H. sapiens
gctcactgccagctcc

SEQ ID NO: 109629 - DNA, 16 bp, H. sapiens
gctcactgcgacttcc

SEQ ID NO: 109630 - DNA, 16 bp, H. sapiens
gctcactgcggccttg

SEQ ID NO: 109631 - DNA, 16 bp, H. sapiens
gctcactgctgcctca

SEQ ID NO: 109632 - DNA, 16 bp, H. sapiens
gctcactggcttcccc

SEQ ID NO: 109633 - DNA, 16 bp, H. sapiens
gctcactgtaacctcg

SEQ ID NO: 109634 - DNA, 16 bp, H. sapiens
gctcactgtagcctcc

SEQ ID NO: 109635 - DNA, 16 bp, H. sapiens
gctcactgtagccttg

SEQ ID NO: 109636 - DNA, 16 bp, H. sapiens
gctcagaaaagttaaa

SEQ ID NO: 109637 - DNA, 16 bp, H. sapiens
gctcagaagaaaagat

SEQ ID NO: 109638 - DNA, 16 bp, H. sapiens
gctcagaagaaacaag

SEQ ID NO: 109639 - DNA, 16 bp, H. sapiens
gctcagaagaagaaag

SEQ ID NO: 109640 - DNA, 16 bp, H. sapiens
gctcagagaaatcaga

SEQ ID NO: 109641 - DNA, 16 bp, H. sapiens
gctcagagaaggaaaa

SEQ ID NO: 109642 - DNA, 16 bp, H. sapiens
gctcagagaagtttgt

SEQ ID NO: 109643 - DNA, 16 bp, H. sapiens
gctcagagaggagaag

SEQ ID NO: 109644 - DNA, 16 bp, H. sapiens
gctcagagagggcagg

SEQ ID NO: 109645 - DNA, 16 bp, H. sapiens
gctcagagaggtgaag

SEQ ID NO: 109646 - DNA, 16 bp, H. sapiens
gctcagagaggtggaa

SEQ ID NO: 109647 - DNA, 16 bp, H. sapiens
gctcagagcaggtgct

SEQ ID NO: 109648 - DNA, 16 bp, H. sapiens
gctcagagcccagctc

SEQ ID NO: 109649 - DNA, 16 bp, H. sapiens
gctcagaggaatttgt

SEQ ID NO: 109650 - DNA, 16 bp, H. sapiens
gctcagagttctgcag

SEQ ID NO: 109651 - DNA, 16 bp, H. sapiens
gctcagcaaaagaaat

SEQ ID NO: 109652 - DNA, 16 bp, H. sapiens
gctcagcaaggcctac

SEQ ID NO: 109653 - DNA, 16 bp, H. sapiens
gctcagcacagaaaga

SEQ ID NO: 109654 - DNA, 16 bp, H. sapiens
gctcagccacagcaag

SEQ ID NO: 109655 - DNA, 16 bp, H. sapiens
gctcagccacagcagg

SEQ ID NO: 109656 - DNA, 16 bp, H. sapiens
gctcagcccagcccag

SEQ ID NO: 109657 - DNA, 16 bp, H. sapiens
gctcagccccagcccc

SEQ ID NO: 109658 - DNA, 16 bp, H. sapiens
gctcagcctcctgggt

SEQ ID NO: 109659 - DNA, 16 bp, H. sapiens
gctcagcctgcagctg

SEQ ID NO: 109660 - DNA, 16 bp, H. sapiens
gctcagccttctgagt

SEQ ID NO: 109661 - DNA, 16 bp, H. sapiens
gctcagctcagcactc

SEQ ID NO: 109662 - DNA, 16 bp, H. sapiens
gctcagctcagctcag

SEQ ID NO: 109663 - DNA, 16 bp, H. sapiens
gctcagctctcaggaa

SEQ ID NO: 109664 - DNA, 16 bp, H. sapiens
gctcagctctgcacca

SEQ ID NO: 109665 - DNA, 16 bp, H. sapiens
gctcagcttctggaga

SEQ ID NO: 109666 - DNA, 16 bp, H. sapiens
gctcagcttcttggga

SEQ ID NO: 109667 - DNA, 16 bp, H. sapiens
gctcaggaaagctgcc

SEQ ID NO: 109668 - DNA, 16 bp, H. sapiens
gctcaggaatttgaaa

SEQ ID NO: 109669 - DNA, 16 bp, H. sapiens
gctcaggacagctttg

SEQ ID NO: 109670 - DNA, 16 bp, H. sapiens
gctcaggagctcaagg

SEQ ID NO: 109671 - DNA, 16 bp, H. sapiens
gctcaggaggcagagg

SEQ ID NO: 109672 - DNA, 16 bp, H. sapiens
gctcaggagttcaata

SEQ ID NO: 109673 - DNA, 16 bp, H. sapiens
gctcaggagttgaaga

SEQ ID NO: 109674 - DNA, 16 bp, H. sapiens
gctcaggcagtcctcc

SEQ ID NO: 109675 - DNA, 16 bp, H. sapiens
gctcaggcagtccttc

SEQ ID NO: 109676 - DNA, 16 bp, H. sapiens
gctcaggcccactggg

SEQ ID NO: 109677 - DNA, 16 bp, H. sapiens
gctcaggctgaagtgc

SEQ ID NO: 109678 - DNA, 24 bp, H. sapiens
gctcaggctggagtacagtggcac

SEQ ID NO: 109679 - DNA, 16 bp, H. sapiens
gctcaggctgggctca

SEQ ID NO: 109680 - DNA, 16 bp, H. sapiens
gctcaggctggggtgc

SEQ ID NO: 109681 - DNA, 16 bp, H. sapiens
gctcagggagccccta

SEQ ID NO: 109682 - DNA, 16 bp, H. sapiens
gctcagggaggctgag

SEQ ID NO: 109683 - DNA, 16 bp, H. sapiens
gctcagggaggttgag

SEQ ID NO: 109684 - DNA, 18 bp, H. sapiens
gctcagggattgtaaaca

SEQ ID NO: 109685 - DNA, 16 bp, H. sapiens
gctcaggtaatttttg

SEQ ID NO: 109686 - DNA, 16 bp, H. sapiens
gctcaggtgatcatcc

SEQ ID NO: 109687 - DNA, 17 bp, H. sapiens
gctcaggtgatccacct

SEQ ID NO: 109688 - DNA, 16 bp, H. sapiens
gctcaggtgatcctcc

SEQ ID NO: 109689 - DNA, 16 bp, H. sapiens
gctcaggtggctgagg

SEQ ID NO: 109690 - DNA, 16 bp, H. sapiens
gctcaggtgggcatca

SEQ ID NO: 109691 - DNA, 16 bp, H. sapiens
gctcaggttggaatgc

SEQ ID NO: 109692 - DNA, 16 bp, H. sapiens
gctcagtgcgctgcac

SEQ ID NO: 109693 - DNA, 16 bp, H. sapiens
gctcagtgctgggcac

SEQ ID NO: 109694 - DNA, 16 bp, H. sapiens
gctcagtgggcaggag

SEQ ID NO: 109695 - DNA, 16 bp, H. sapiens
gctcagtgtggtggca

SEQ ID NO: 109696 - DNA, 16 bp, H. sapiens
gctcagttttctcatc

SEQ ID NO: 109697 - DNA, 16 bp, H. sapiens
gctcataaaagcagtg

SEQ ID NO: 109698 - DNA, 16 bp, H. sapiens
gctcatagcttagctc

SEQ ID NO: 109699 - DNA, 16 bp, H. sapiens
gctcatcagctatcgt

SEQ ID NO: 109700 - DNA, 16 bp, H. sapiens
gctcatcatcactgat

SEQ ID NO: 109701 - DNA, 16 bp, H. sapiens
gctcatgcctccaatc

SEQ ID NO: 109702 - DNA, 16 bp, H. sapiens
gctcatgcctgtattt

SEQ ID NO: 109703 - DNA, 16 bp, H. sapiens
gctcatgctggagtgc

SEQ ID NO: 109704 - DNA, 16 bp, H. sapiens
gctcatggttctagag

SEQ ID NO: 109705 - DNA, 16 bp, H. sapiens
gctcatggttctgcag

SEQ ID NO: 109706 - DNA, 16 bp, H. sapiens
gctcatggttctgtgg

SEQ ID NO: 109707 - DNA, 16 bp, H. sapiens
gctcatgtgattgtgg

SEQ ID NO: 109708 - DNA, 16 bp, H. sapiens
gctcattttgtatttt

SEQ ID NO: 109709 - DNA, 16 bp, H. sapiens
gctcatttttatattt

SEQ ID NO: 109710 - DNA, 16 bp, H. sapiens
gctccaaaatgatttc

SEQ ID NO: 109711 - DNA, 16 bp, H. sapiens
gctccaaggaaggaga

SEQ ID NO: 109712 - DNA, 16 bp, H. sapiens
gctccaatttctccac

SEQ ID NO: 109713 - DNA, 16 bp, H. sapiens
gctccaccccaaatca

SEQ ID NO: 109714 - DNA, 16 bp, H. sapiens
gctccacctcagatca

SEQ ID NO: 109715 - DNA, 16 bp, H. sapiens
gctccacctcccatgt

SEQ ID NO: 109716 - DNA, 16 bp, H. sapiens
gctccacctccccagt

SEQ ID NO: 109717 - DNA, 16 bp, H. sapiens
gctccacctctgggag

SEQ ID NO: 109718 - DNA, 16 bp, H. sapiens
gctccacctgcagctc

SEQ ID NO: 109719 - DNA, 16 bp, H. sapiens
gctccacggcgcccag

SEQ ID NO: 109720 - DNA, 16 bp, H. sapiens
gctccagaatttctgc

SEQ ID NO: 109721 - DNA, 16 bp, H. sapiens
gctccagaatttttgc

SEQ ID NO: 109722 - DNA, 16 bp, H. sapiens
gctccagagatcctcc

SEQ ID NO: 109723 - DNA, 16 bp, H. sapiens
gctccagagctccctg

SEQ ID NO: 109724 - DNA, 16 bp, H. sapiens
gctccagagtttgaga

SEQ ID NO: 109725 - DNA, 16 bp, H. sapiens
gctccagccagtccct

SEQ ID NO: 109726 - DNA, 22 bp, H. sapiens
gctccagcctgggcgacagagt

SEQ ID NO: 109727 - DNA, 16 bp, H. sapiens
gctccagccttggcca

SEQ ID NO: 109728 - DNA, 17 bp, H. sapiens
gctccagccttggccag

SEQ ID NO: 109729 - DNA, 16 bp, H. sapiens
gctccagctccagcct

SEQ ID NO: 109730 - DNA, 16 bp, H. sapiens
gctccagctccagctc

SEQ ID NO: 109731 - DNA, 16 bp, H. sapiens
gctccagctccagctg

SEQ ID NO: 109732 - DNA, 16 bp, H. sapiens
gctccagctgtgacta

SEQ ID NO: 109733 - DNA, 16 bp, H. sapiens
gctccagctgtggcta

SEQ ID NO: 109734 - DNA, 16 bp, H. sapiens
gctccaggagggcaga

SEQ ID NO: 109735 - DNA, 16 bp, H. sapiens
gctccaggcaccagca

SEQ ID NO: 109736 - DNA, 16 bp, H. sapiens
gctccagggaagaatc

SEQ ID NO: 109737 - DNA, 16 bp, H. sapiens
gctccagttttctcat

SEQ ID NO: 109738 - DNA, 16 bp, H. sapiens
gctccatcgcccaggc

SEQ ID NO: 109739 - DNA, 16 bp, H. sapiens
gctccatctcccaggc

SEQ ID NO: 109740 - DNA, 16 bp, H. sapiens
gctccatgagggcaag

SEQ ID NO: 109741 - DNA, 16 bp, H. sapiens
gctccatgagggtggg

SEQ ID NO: 109742 - DNA, 16 bp, H. sapiens
gctccatggagcaggc

SEQ ID NO: 109743 - DNA, 16 bp, H. sapiens
gctccatggagtgtgc

SEQ ID NO: 109744 - DNA, 16 bp, H. sapiens
gctccatgggcatggg

SEQ ID NO: 109745 - DNA, 17 bp, H. sapiens
gctccattgcccaggct

SEQ ID NO: 109746 - DNA, 16 bp, H. sapiens
gctccatttgaagaac

SEQ ID NO: 109747 - DNA, 16 bp, H. sapiens
gctcccaaactgctgg

SEQ ID NO: 109748 - DNA, 21 bp, H. sapiens
gctcccaaagtgctgtgatta

SEQ ID NO: 109749 - DNA, 16 bp, H. sapiens
gctcccaccatgtgag

SEQ ID NO: 109750 - DNA, 16 bp, H. sapiens
gctcccacctctgcct

SEQ ID NO: 109751 - DNA, 16 bp, H. sapiens
gctcccactggccaaa

SEQ ID NO: 109752 - DNA, 18 bp, H. sapiens
gctcccactttggcggca

SEQ ID NO: 109753 - DNA, 16 bp, H. sapiens
gctcccagagcttggg

SEQ ID NO: 109754 - DNA, 16 bp, H. sapiens
gctcccagaggtggag

SEQ ID NO: 109755 - DNA, 16 bp, H. sapiens
gctcccaggtccttga

SEQ ID NO: 109756 - DNA, 16 bp, H. sapiens
gctcccaggttcaagc

SEQ ID NO: 109757 - DNA, 16 bp, H. sapiens
gctccccaaagggcca

SEQ ID NO: 109758 - DNA, 16 bp, H. sapiens
gctccccaaagtgttg

SEQ ID NO: 109759 - DNA, 16 bp, H. sapiens
gctccccaagggcagg

SEQ ID NO: 109760 - DNA, 16 bp, H. sapiens
gctcccctccctgcag

SEQ ID NO: 109761 - DNA, 16 bp, H. sapiens
gctcccctctggccta

SEQ ID NO: 109762 - DNA, 16 bp, H. sapiens
gctcccctctttctag

SEQ ID NO: 109763 - DNA, 16 bp, H. sapiens
gctccccttcctgctg

SEQ ID NO: 109764 - DNA, 16 bp, H. sapiens
gctcccgacctcaggt

SEQ ID NO: 109765 - DNA, 16 bp, H. sapiens
gctccctcacccaggc

SEQ ID NO: 109766 - DNA, 16 bp, H. sapiens
gctccctccagaggct

SEQ ID NO: 109767 - DNA, 16 bp, H. sapiens
gctccctcccacaagg

SEQ ID NO: 109768 - DNA, 16 bp, H. sapiens
gctccctctgaaacct

SEQ ID NO: 109769 - DNA, 16 bp, H. sapiens
gctccctctggaggct

SEQ ID NO: 109770 - DNA, 16 bp, H. sapiens
gctccctgaggacagg

SEQ ID NO: 109771 - DNA, 16 bp, H. sapiens
gctccctgcaagctcc

SEQ ID NO: 109772 - DNA, 19 bp, H. sapiens
gctccctgcaagctctgcc

SEQ ID NO: 109773 - DNA, 16 bp, H. sapiens
gctccctgcagcctgg

SEQ ID NO: 109774 - DNA, 16 bp, H. sapiens
gctccctggcttcagc

SEQ ID NO: 109775 - DNA, 16 bp, H. sapiens
gctccgcccctgcagc

SEQ ID NO: 109776 - DNA, 16 bp, H. sapiens
gctccgcctccccggt

SEQ ID NO: 109777 - DNA, 18 bp, H. sapiens
gctccgcctcctgtgttc

SEQ ID NO: 109778 - DNA, 16 bp, H. sapiens
gctccggccttggcca

SEQ ID NO: 109779 - DNA, 16 bp, H. sapiens
gctccggctccggctc

SEQ ID NO: 109780 - DNA, 16 bp, H. sapiens
gctccgtggcccaggc

SEQ ID NO: 109781 - DNA, 16 bp, H. sapiens
gctcctaagatcagtg

SEQ ID NO: 109782 - DNA, 16 bp, H. sapiens
gctcctaggctacaaa

SEQ ID NO: 109783 - DNA, 16 bp, H. sapiens
gctcctaggtctgggc

SEQ ID NO: 109784 - DNA, 16 bp, H. sapiens
gctcctatgagaatct

SEQ ID NO: 109785 - DNA, 16 bp, H. sapiens
gctcctcaagcacagc

SEQ ID NO: 109786 - DNA, 16 bp, H. sapiens
gctcctcacatcccag

SEQ ID NO: 109787 - DNA, 16 bp, H. sapiens
gctcctcacttcccag

SEQ ID NO: 109788 - DNA, 16 bp, H. sapiens
gctcctcacttcctag

SEQ ID NO: 109789 - DNA, 16 bp, H. sapiens
gctcctcagcctccag

SEQ ID NO: 109790 - DNA, 16 bp, H. sapiens
gctcctcagcctgcag

SEQ ID NO: 109791 - DNA, 16 bp, H. sapiens
gctcctcatcactggc

SEQ ID NO: 109792 - DNA, 16 bp, H. sapiens
gctcctccacctcttg

SEQ ID NO: 109793 - DNA, 16 bp, H. sapiens
gctcctccccagctgc

SEQ ID NO: 109794 - DNA, 16 bp, H. sapiens
gctcctccccgctgca

SEQ ID NO: 109795 - DNA, 16 bp, H. sapiens
gctcctcctccctcag

SEQ ID NO: 109796 - DNA, 16 bp, H. sapiens
gctcctctcccagagc

SEQ ID NO: 109797 - DNA, 16 bp, H. sapiens
gctcctctctaccctg

SEQ ID NO: 109798 - DNA, 17 bp, H. sapiens
gctcctgaaggaagtgc

SEQ ID NO: 109799 - DNA, 16 bp, H. sapiens
gctcctgaaggaatca

SEQ ID NO: 109800 - DNA, 16 bp, H. sapiens
gctcctgaaggaggca

SEQ ID NO: 109801 - DNA, 16 bp, H. sapiens
gctcctgagcctgctg

SEQ ID NO: 109802 - DNA, 16 bp, H. sapiens
gctcctgagtgactac

SEQ ID NO: 109803 - DNA, 16 bp, H. sapiens
gctcctgcaggaccca

SEQ ID NO: 109804 - DNA, 16 bp, H. sapiens
gctcctgcaggacctg

SEQ ID NO: 109805 - DNA, 19 bp, H. sapiens
gctcctgcctcagcctccc

SEQ ID NO: 109806 - DNA, 16 bp, H. sapiens
gctcctgctccctggc

SEQ ID NO: 109807 - DNA, 16 bp, H. sapiens
gctcctgctggctcca

SEQ ID NO: 109808 - DNA, 16 bp, H. sapiens
gctcctggaaggcagg

SEQ ID NO: 109809 - DNA, 16 bp, H. sapiens
gctcctggactcattg

SEQ ID NO: 109810 - DNA, 16 bp, H. sapiens
gctcctggactttttt

SEQ ID NO: 109811 - DNA, 16 bp, H. sapiens
gctcctggagggcagg

SEQ ID NO: 109812 - DNA, 16 bp, H. sapiens
gctcctggcccctcca

SEQ ID NO: 109813 - DNA, 17 bp, H. sapiens
gctcctggccgaataaa

SEQ ID NO: 109814 - DNA, 16 bp, H. sapiens
gctcctgggttcaagt

SEQ ID NO: 109815 - DNA, 16 bp, H. sapiens
gctcctgtactcccag

SEQ ID NO: 109816 - DNA, 16 bp, H. sapiens
gctcctgtattggttg

SEQ ID NO: 109817 - DNA, 16 bp, H. sapiens
gctcctgtctgtcctt

SEQ ID NO: 109818 - DNA, 16 bp, H. sapiens
gctccttgagagcaga

SEQ ID NO: 109819 - DNA, 16 bp, H. sapiens
gctccttgagggcagg

SEQ ID NO: 109820 - DNA, 17 bp, H. sapiens
gctccttgaggttatct

SEQ ID NO: 109821 - DNA, 16 bp, H. sapiens
gctccttgcagagcag

SEQ ID NO: 109822 - DNA, 16 bp, H. sapiens
gctccttgctctccca

SEQ ID NO: 109823 - DNA, 16 bp, H. sapiens
gctcctttctagtttt

SEQ ID NO: 109824 - DNA, 16 bp, H. sapiens
gctcctttttctccac

SEQ ID NO: 109825 - DNA, 16 bp, H. sapiens
gctcgctcgctcgctc

SEQ ID NO: 109826 - DNA, 16 bp, H. sapiens
gctcgctcgctctctc

SEQ ID NO: 109827 - DNA, 16 bp, H. sapiens
gctcgctctgggcgcc

SEQ ID NO: 109828 - DNA, 16 bp, H. sapiens
gctcgctgcaacctcc

SEQ ID NO: 109829 - DNA, 16 bp, H. sapiens
gctcggctaatttttt

SEQ ID NO: 109830 - DNA, 16 bp, H. sapiens
gctcgggggtcaggag

SEQ ID NO: 109831 - DNA, 17 bp, H. sapiens
gctcgggtccccttcca

SEQ ID NO: 109832 - DNA, 24 bp, H. sapiens
gctcggtggctcacgcctgtaatc

SEQ ID NO: 109833 - DNA, 16 bp, H. sapiens
gctctaaaaaataaag

SEQ ID NO: 109834 - DNA, 16 bp, H. sapiens
gctctaattaaatata

SEQ ID NO: 109835 - DNA, 16 bp, H. sapiens
gctctacaaaaaaaat

SEQ ID NO: 109836 - DNA, 18 bp, H. sapiens
gctctactaaaaatacaa

SEQ ID NO: 109837 - DNA, 16 bp, H. sapiens
gctctagctgtggcta

SEQ ID NO: 109838 - DNA, 16 bp, H. sapiens
gctctatcacttacta

SEQ ID NO: 109839 - DNA, 16 bp, H. sapiens
gctctcaaactcttgg

SEQ ID NO: 109840 - DNA, 16 bp, H. sapiens
gctctcaagaagctta

SEQ ID NO: 109841 - DNA, 16 bp, H. sapiens
gctctcaaggccttgg

SEQ ID NO: 109842 - DNA, 16 bp, H. sapiens
gctctcacccaggctg

SEQ ID NO: 109843 - DNA, 16 bp, H. sapiens
gctctcagaaataatg

SEQ ID NO: 109844 - DNA, 16 bp, H. sapiens
gctctcagcaggaagg

SEQ ID NO: 109845 - DNA, 16 bp, H. sapiens
gctctcaggccttcag

SEQ ID NO: 109846 - DNA, 16 bp, H. sapiens
gctctcagtccccacc

SEQ ID NO: 109847 - DNA, 16 bp, H. sapiens
gctctcataatcccca

SEQ ID NO: 109848 - DNA, 16 bp, H. sapiens
gctctcattctcttct

SEQ ID NO: 109849 - DNA, 16 bp, H. sapiens
gctctccagcctggca

SEQ ID NO: 109850 - DNA, 16 bp, H. sapiens
gctctcctctgactgc

SEQ ID NO: 109851 - DNA, 16 bp, H. sapiens
gctctcctgcctcagc

SEQ ID NO: 109852 - DNA, 16 bp, H. sapiens
gctctcctggctctgc

SEQ ID NO: 109853 - DNA, 16 bp, H. sapiens
gctctcgctctgttgc

SEQ ID NO: 109854 - DNA, 16 bp, H. sapiens
gctctctaaatttgtc

SEQ ID NO: 109855 - DNA, 16 bp, H. sapiens
gctctctgcagcctca

SEQ ID NO: 109856 - DNA, 16 bp, H. sapiens
gctctctgcagcctcc

SEQ ID NO: 109857 - DNA, 16 bp, H. sapiens
gctctctgcagccttg

SEQ ID NO: 109858 - DNA, 16 bp, H. sapiens
gctctctggcttcagc

SEQ ID NO: 109859 - DNA, 16 bp, H. sapiens
gctctctgggaaaggc

SEQ ID NO: 109860 - DNA, 25 bp, H. sapiens
gctctctgtaaaatggaccaatcag

SEQ ID NO: 109861 - DNA, 16 bp, H. sapiens
gctctctgtttctctg

SEQ ID NO: 109862 - DNA, 16 bp, H. sapiens
gctctgaagagagcag

SEQ ID NO: 109863 - DNA, 16 bp, H. sapiens
gctctgaccccacggc

SEQ ID NO: 109864 - DNA, 16 bp, H. sapiens
gctctgagccactatt

SEQ ID NO: 109865 - DNA, 16 bp, H. sapiens
gctctgaggatgcaaa

SEQ ID NO: 109866 - DNA, 16 bp, H. sapiens
gctctgcagaagctct

SEQ ID NO: 109867 - DNA, 16 bp, H. sapiens
gctctgcagcctccac

SEQ ID NO: 109868 - DNA, 16 bp, H. sapiens
gctctgcagcctgggc

SEQ ID NO: 109869 - DNA, 16 bp, H. sapiens
gctctgccacccaagc

SEQ ID NO: 109870 - DNA, 16 bp, H. sapiens
gctctgccacttccta

SEQ ID NO: 109871 - DNA, 16 bp, H. sapiens
gctctgccatctgcag

SEQ ID NO: 109872 - DNA, 16 bp, H. sapiens
gctctgccatttacca

SEQ ID NO: 109873 - DNA, 16 bp, H. sapiens
gctctgccccactcct

SEQ ID NO: 109874 - DNA, 16 bp, H. sapiens
gctctgccccagcccc

SEQ ID NO: 109875 - DNA, 16 bp, H. sapiens
gctctgcccccagagg

SEQ ID NO: 109876 - DNA, 16 bp, H. sapiens
gctctgcctcccaggc

SEQ ID NO: 109877 - DNA, 16 bp, H. sapiens
gctctgcctcccgggc

SEQ ID NO: 109878 - DNA, 16 bp, H. sapiens
gctctgcctcctgcct

SEQ ID NO: 109879 - DNA, 16 bp, H. sapiens
gctctgcctcctgcgt

SEQ ID NO: 109880 - DNA, 16 bp, H. sapiens
gctctgcctcctgggg

SEQ ID NO: 109881 - DNA, 16 bp, H. sapiens
gctctgcctctgcagc

SEQ ID NO: 109882 - DNA, 16 bp, H. sapiens
gctctgcggcccaggc

SEQ ID NO: 109883 - DNA, 16 bp, H. sapiens
gctctgctgcccaggc

SEQ ID NO: 109884 - DNA, 16 bp, H. sapiens
gctctgctggcctaga

SEQ ID NO: 109885 - DNA, 16 bp, H. sapiens
gctctgctgtcccctt

SEQ ID NO: 109886 - DNA, 16 bp, H. sapiens
gctctgcttcctgggt

SEQ ID NO: 109887 - DNA, 16 bp, H. sapiens
gctctgcttcctgttt

SEQ ID NO: 109888 - DNA, 16 bp, H. sapiens
gctctgcttttcagag

SEQ ID NO: 109889 - DNA, 16 bp, H. sapiens
gctctggaggcagagg

SEQ ID NO: 109890 - DNA, 16 bp, H. sapiens
gctctggcagggggtg

SEQ ID NO: 109891 - DNA, 16 bp, H. sapiens
gctctggccctgcccc

SEQ ID NO: 109892 - DNA, 16 bp, H. sapiens
gctctggccctgccct

SEQ ID NO: 109893 - DNA, 16 bp, H. sapiens
gctctggctgacatct

SEQ ID NO: 109894 - DNA, 16 bp, H. sapiens
gctctggctggagtgc

SEQ ID NO: 109895 - DNA, 16 bp, H. sapiens
gctctggctggcatct

SEQ ID NO: 109896 - DNA, 16 bp, H. sapiens
gctctgggagaggagc

SEQ ID NO: 109897 - DNA, 16 bp, H. sapiens
gctctgggctcatgaa

SEQ ID NO: 109898 - DNA, 16 bp, H. sapiens
gctctggggcccaggc

SEQ ID NO: 109899 - DNA, 16 bp, H. sapiens
gctctggtgcccaggc

SEQ ID NO: 109900 - DNA, 16 bp, H. sapiens
gctctggtttttggaa

SEQ ID NO: 109901 - DNA, 16 bp, H. sapiens
gctctgtaaaaacgca

SEQ ID NO: 109902 - DNA, 16 bp, H. sapiens
gctctgtaaatatctg

SEQ ID NO: 109903 - DNA, 16 bp, H. sapiens
gctctgtagcccaggc

SEQ ID NO: 109904 - DNA, 16 bp, H. sapiens
gctctgtcaccctggc

SEQ ID NO: 109905 - DNA, 16 bp, H. sapiens
gctctgtcatgcaggc

SEQ ID NO: 109906 - DNA, 16 bp, H. sapiens
gctctgtccctgtggc

SEQ ID NO: 109907 - DNA, 16 bp, H. sapiens
gctctgtcctcatgaa

SEQ ID NO: 109908 - DNA, 16 bp, H. sapiens
gctctgtctcacccag

SEQ ID NO: 109909 - DNA, 16 bp, H. sapiens
gctctgtctgccctgg

SEQ ID NO: 109910 - DNA, 16 bp, H. sapiens
gctctgtgccagaaac

SEQ ID NO: 109911 - DNA, 16 bp, H. sapiens
gctctgtgcccccacc

SEQ ID NO: 109912 - DNA, 16 bp, H. sapiens
gctctgtgcctcagtt

SEQ ID NO: 109913 - DNA, 16 bp, H. sapiens
gctctgtgctgggtgc

SEQ ID NO: 109914 - DNA, 16 bp, H. sapiens
gctctgtggcccagcc

SEQ ID NO: 109915 - DNA, 16 bp, H. sapiens
gctctgtggccctggc

SEQ ID NO: 109916 - DNA, 16 bp, H. sapiens
gctctgtggccctgtg

SEQ ID NO: 109917 - DNA, 16 bp, H. sapiens
gctctgtggctcacac

SEQ ID NO: 109918 - DNA, 16 bp, H. sapiens
gctctgtgggctgcac

SEQ ID NO: 109919 - DNA, 16 bp, H. sapiens
gctctgtgtcccaggc

SEQ ID NO: 109920 - DNA, 16 bp, H. sapiens
gctctgtgtttccacc

SEQ ID NO: 109921 - DNA, 16 bp, H. sapiens
gctctgttctgcccgg

SEQ ID NO: 109922 - DNA, 16 bp, H. sapiens
gctctgttgacaggct

SEQ ID NO: 109923 - DNA, 16 bp, H. sapiens
gctctgtttccccacc

SEQ ID NO: 109924 - DNA, 16 bp, H. sapiens
gctctgttttggtacc

SEQ ID NO: 109925 - DNA, 16 bp, H. sapiens
gctcttaaaaataaag

SEQ ID NO: 109926 - DNA, 16 bp, H. sapiens
gctcttaatttttaaa

SEQ ID NO: 109927 - DNA, 16 bp, H. sapiens
gctcttactattttga

SEQ ID NO: 109928 - DNA, 16 bp, H. sapiens
gctcttagaattcttt

SEQ ID NO: 109929 - DNA, 16 bp, H. sapiens
gctcttagcagagagg

SEQ ID NO: 109930 - DNA, 16 bp, H. sapiens
gctcttatcattttga

SEQ ID NO: 109931 - DNA, 16 bp, H. sapiens
gctcttattattttta

SEQ ID NO: 109932 - DNA, 16 bp, H. sapiens
gctcttcaggatatta

SEQ ID NO: 109933 - DNA, 16 bp, H. sapiens
gctcttcagtcagctt

SEQ ID NO: 109934 - DNA, 16 bp, H. sapiens
gctcttcatgagtcct

SEQ ID NO: 109935 - DNA, 16 bp, H. sapiens
gctcttcatttctttg

SEQ ID NO: 109936 - DNA, 16 bp, H. sapiens
gctcttcattttcttt

SEQ ID NO: 109937 - DNA, 16 bp, H. sapiens
gctcttcctcctccca

SEQ ID NO: 109938 - DNA, 16 bp, H. sapiens
gctcttcctggctgtg

SEQ ID NO: 109939 - DNA, 16 bp, H. sapiens
gctcttctcagcaaat

SEQ ID NO: 109940 - DNA, 16 bp, H. sapiens
gctcttctgggtctcc

SEQ ID NO: 109941 - DNA, 16 bp, H. sapiens
gctcttgccacccagg

SEQ ID NO: 109942 - DNA, 16 bp, H. sapiens
gctcttgctatgttgc

SEQ ID NO: 109943 - DNA, 16 bp, H. sapiens
gctcttggcgcctcct

SEQ ID NO: 109944 - DNA, 16 bp, H. sapiens
gctctttaaaaaaaaa

SEQ ID NO: 109945 - DNA, 16 bp, H. sapiens
gctctttagcccaggc

SEQ ID NO: 109946 - DNA, 16 bp, H. sapiens
gctctttagtttagat

SEQ ID NO: 109947 - DNA, 16 bp, H. sapiens
gctctttattctgttc

SEQ ID NO: 109948 - DNA, 16 bp, H. sapiens
gctctttctcatgatt

SEQ ID NO: 109949 - DNA, 16 bp, H. sapiens
gctctttgaagaatca

SEQ ID NO: 109950 - DNA, 22 bp, H. sapiens
gctctttgctgctaaagttacc

SEQ ID NO: 109951 - DNA, 16 bp, H. sapiens
gctcttttcagagcca

SEQ ID NO: 109952 - DNA, 16 bp, H. sapiens
gctctttttcctaatg

SEQ ID NO: 109953 - DNA, 16 bp, H. sapiens
gctctttttgcccagg

SEQ ID NO: 109954 - DNA, 16 bp, H. sapiens
gctgaaaaagaaatca

SEQ ID NO: 109955 - DNA, 16 bp, H. sapiens
gctgaaaaccatgaca

SEQ ID NO: 109956 - DNA, 16 bp, H. sapiens
gctgaaaactccccaa

SEQ ID NO: 109957 - DNA, 16 bp, H. sapiens
gctgaaaactctaaaa

SEQ ID NO: 109958 - DNA, 16 bp, H. sapiens
gctgaaaagtattcca

SEQ ID NO: 109959 - DNA, 16 bp, H. sapiens
gctgaaaataaaagga

SEQ ID NO: 109960 - DNA, 16 bp, H. sapiens
gctgaaaatgatggct

SEQ ID NO: 109961 - DNA, 16 bp, H. sapiens
gctgaaaatttcccaa

SEQ ID NO: 109962 - DNA, 16 bp, H. sapiens
gctgaaacaggcagat

SEQ ID NO: 109963 - DNA, 16 bp, H. sapiens
gctgaaacctcatctc

SEQ ID NO: 109964 - DNA, 16 bp, H. sapiens
gctgaaactacaggca

SEQ ID NO: 109965 - DNA, 16 bp, H. sapiens
gctgaaagaaattaag

SEQ ID NO: 109966 - DNA, 16 bp, H. sapiens
gctgaaagaaattaca

SEQ ID NO: 109967 - DNA, 16 bp, H. sapiens
gctgaaagacaaaata

SEQ ID NO: 109968 - DNA, 16 bp, H. sapiens
gctgaaagatctgctg

SEQ ID NO: 109969 - DNA, 16 bp, H. sapiens
gctgaaatggcaccac

SEQ ID NO: 109970 - DNA, 16 bp, H. sapiens
gctgaacaaactgaaa

SEQ ID NO: 109971 - DNA, 16 bp, H. sapiens
gctgaaccagttgaga

SEQ ID NO: 109972 - DNA, 16 bp, H. sapiens
gctgaacccaaagaaa

SEQ ID NO: 109973 - DNA, 16 bp, H. sapiens
gctgaacccccttggg

SEQ ID NO: 109974 - DNA, 16 bp, H. sapiens
gctgaacgtggtggtg

SEQ ID NO: 109975 - DNA, 16 bp, H. sapiens
gctgaactaatttaca

SEQ ID NO: 109976 - DNA, 16 bp, H. sapiens
gctgaagaaataaaaa

SEQ ID NO: 109977 - DNA, 16 bp, H. sapiens
gctgaagaacatggag

SEQ ID NO: 109978 - DNA, 16 bp, H. sapiens
gctgaagaacttggaa

SEQ ID NO: 109979 - DNA, 16 bp, H. sapiens
gctgaagaagaaaaat

SEQ ID NO: 109980 - DNA, 16 bp, H. sapiens
gctgaagaatcacttg

SEQ ID NO: 109981 - DNA, 16 bp, H. sapiens
gctgaagacaaaggac

SEQ ID NO: 109982 - DNA, 16 bp, H. sapiens
gctgaagagccaagag

SEQ ID NO: 109983 - DNA, 16 bp, H. sapiens
gctgaagagggctttg

SEQ ID NO: 109984 - DNA, 16 bp, H. sapiens
gctgaagagtattcca

SEQ ID NO: 109985 - DNA, 16 bp, H. sapiens
gctgaagatttttgca

SEQ ID NO: 109986 - DNA, 16 bp, H. sapiens
gctgaagcaagaggat

SEQ ID NO: 109987 - DNA, 16 bp, H. sapiens
gctgaagcaaggagaa

SEQ ID NO: 109988 - DNA, 16 bp, H. sapiens
gctgaagcacaagaat

SEQ ID NO: 109989 - DNA, 16 bp, H. sapiens
gctgaagcagaaaaat

SEQ ID NO: 109990 - DNA, 16 bp, H. sapiens
gctgaagcagctggaa

SEQ ID NO: 109991 - DNA, 16 bp, H. sapiens
gctgaagcaggagaac

SEQ ID NO: 109992 - DNA, 16 bp, H. sapiens
gctgaagcaggaggtt

SEQ ID NO: 109993 - DNA, 16 bp, H. sapiens
gctgaagcaggagtat

SEQ ID NO: 109994 - DNA, 16 bp, H. sapiens
gctgaagcaggatgat

SEQ ID NO: 109995 - DNA, 16 bp, H. sapiens
gctgaagcagggcaag

SEQ ID NO: 109996 - DNA, 17 bp, H. sapiens
gctgaagcagggcgagg

SEQ ID NO: 109997 - DNA, 16 bp, H. sapiens
gctgaagcagggtgag

SEQ ID NO: 109998 - DNA, 16 bp, H. sapiens
gctgaagcaggtggac

SEQ ID NO: 109999 - DNA, 16 bp, H. sapiens
gctgaagcaggtggat

SEQ ID NO: 110000 - DNA, 16 bp, H. sapiens
gctgaagccagagagc

SEQ ID NO: 110001 - DNA, 16 bp, H. sapiens
gctgaagctatcctcc

SEQ ID NO: 110002 - DNA, 16 bp, H. sapiens
gctgaagctggagtgc

SEQ ID NO: 110003 - DNA, 16 bp, H. sapiens
gctgaaggactcctca

SEQ ID NO: 110004 - DNA, 16 bp, H. sapiens
gctgaaggacttggag

SEQ ID NO: 110005 - DNA, 16 bp, H. sapiens
gctgaaggagcagaag

SEQ ID NO: 110006 - DNA, 16 bp, H. sapiens
gctgaaggaggaagag

SEQ ID NO: 110007 - DNA, 16 bp, H. sapiens
gctgaaggcaaaggga

SEQ ID NO: 110008 - DNA, 16 bp, H. sapiens
gctgaaggctcagatg

SEQ ID NO: 110009 - DNA, 16 bp, H. sapiens
gctgaagtatgagaat

SEQ ID NO: 110010 - DNA, 16 bp, H. sapiens
gctgaagtgcagtggc

SEQ ID NO: 110011 - DNA, 17 bp, H. sapiens
gctgaagtgcagtggcg

SEQ ID NO: 110012 - DNA, 16 bp, H. sapiens
gctgaagtgccctggg

SEQ ID NO: 110013 - DNA, 16 bp, H. sapiens
gctgaagtgggcagat

SEQ ID NO: 110014 - DNA, 16 bp, H. sapiens
gctgaagtgggtggat

SEQ ID NO: 110015 - DNA, 16 bp, H. sapiens
gctgaatcatattcca

SEQ ID NO: 110016 - DNA, 16 bp, H. sapiens
gctgaatctttttttt

SEQ ID NO: 110017 - DNA, 16 bp, H. sapiens
gctgaatgaaaataaa

SEQ ID NO: 110018 - DNA, 16 bp, H. sapiens
gctgaatgaagagaaa

SEQ ID NO: 110019 - DNA, 16 bp, H. sapiens
gctgaatggaaagaaa

SEQ ID NO: 110020 - DNA, 16 bp, H. sapiens
gctgaatgtaaagaaa

SEQ ID NO: 110021 - DNA, 16 bp, H. sapiens
gctgaattcctgcctg

SEQ ID NO: 110022 - DNA, 16 bp, H. sapiens
gctgaattctaccaaa

SEQ ID NO: 110023 - DNA, 32 bp, H. sapiens
gctgacaaagggctaatatccagaatctacaa

SEQ ID NO: 110024 - DNA, 16 bp, H. sapiens
gctgacacaccagccc

SEQ ID NO: 110025 - DNA, 16 bp, H. sapiens
gctgacacctggattt

SEQ ID NO: 110026 - DNA, 16 bp, H. sapiens
gctgacagccaaatca

SEQ ID NO: 110027 - DNA, 16 bp, H. sapiens
gctgacaggcaacttc

SEQ ID NO: 110028 - DNA, 16 bp, H. sapiens
gctgacatgggaggat

SEQ ID NO: 110029 - DNA, 16 bp, H. sapiens
gctgaccccttcttcc

SEQ ID NO: 110030 - DNA, 16 bp, H. sapiens
gctgaccctggaggga

SEQ ID NO: 110031 - DNA, 16 bp, H. sapiens
gctgacgcctataatc

SEQ ID NO: 110032 - DNA, 16 bp, H. sapiens
gctgactcttttcaga

SEQ ID NO: 110033 - DNA, 16 bp, H. sapiens
gctgagaaaaatcctg

SEQ ID NO: 110034 - DNA, 16 bp, H. sapiens
gctgagaaaccaaaga

SEQ ID NO: 110035 - DNA, 16 bp, H. sapiens
gctgagaaagcatttg

SEQ ID NO: 110036 - DNA, 16 bp, H. sapiens
gctgagaacaaaatca

SEQ ID NO: 110037 - DNA, 16 bp, H. sapiens
gctgagaagtttgctg

SEQ ID NO: 110038 - DNA, 16 bp, H. sapiens
gctgagaatgacagtt

SEQ ID NO: 110039 - DNA, 16 bp, H. sapiens
gctgagacacagggca

SEQ ID NO: 110040 - DNA, 16 bp, H. sapiens
gctgagacacgagaat

SEQ ID NO: 110041 - DNA, 16 bp, H. sapiens
gctgagacaggagact

SEQ ID NO: 110042 - DNA, 16 bp, H. sapiens
gctgagacaggataat

SEQ ID NO: 110043 - DNA, 16 bp, H. sapiens
gctgagacaggcagat

SEQ ID NO: 110044 - DNA, 16 bp, H. sapiens
gctgagacagggggat

SEQ ID NO: 110045 - DNA, 16 bp, H. sapiens
gctgagacggaaggat

SEQ ID NO: 110046 - DNA, 16 bp, H. sapiens
gctgagactacaggca

SEQ ID NO: 110047 - DNA, 16 bp, H. sapiens
gctgagactacaggct

SEQ ID NO: 110048 - DNA, 16 bp, H. sapiens
gctgagacttcaggtg

SEQ ID NO: 110049 - DNA, 16 bp, H. sapiens
gctgagagaaaatatt

SEQ ID NO: 110050 - DNA, 16 bp, H. sapiens
gctgagagccttgaac

SEQ ID NO: 110051 - DNA, 16 bp, H. sapiens
gctgagaggcaggagg

SEQ ID NO: 110052 - DNA, 16 bp, H. sapiens
gctgagaggcctcagg

SEQ ID NO: 110053 - DNA, 16 bp, H. sapiens
gctgagaggctgggag

SEQ ID NO: 110054 - DNA, 16 bp, H. sapiens
gctgagagtctagcac

SEQ ID NO: 110055 - DNA, 16 bp, H. sapiens
gctgagatagaagaat

SEQ ID NO: 110056 - DNA, 16 bp, H. sapiens
gctgagatcacactgc

SEQ ID NO: 110057 - DNA, 16 bp, H. sapiens
gctgagatcccgccac

SEQ ID NO: 110058 - DNA, 16 bp, H. sapiens
gctgagatgacaggtg

SEQ ID NO: 110059 - DNA, 16 bp, H. sapiens
gctgagatggatgaac

SEQ ID NO: 110060 - DNA, 16 bp, H. sapiens
gctgagatggcaggat

SEQ ID NO: 110061 - DNA, 16 bp, H. sapiens
gctgagatgggagaat

SEQ ID NO: 110062 - DNA, 16 bp, H. sapiens
gctgagatgggaggac

SEQ ID NO: 110063 - DNA, 16 bp, H. sapiens
gctgagatgggaggat

SEQ ID NO: 110064 - DNA, 16 bp, H. sapiens
gctgagatgggcagat

SEQ ID NO: 110065 - DNA, 16 bp, H. sapiens
gctgagatggtgctac

SEQ ID NO: 110066 - DNA, 16 bp, H. sapiens
gctgagatgtgagaat

SEQ ID NO: 110067 - DNA, 16 bp, H. sapiens
gctgagattaaaggtg

SEQ ID NO: 110068 - DNA, 16 bp, H. sapiens
gctgagattacagctg

SEQ ID NO: 110069 - DNA, 16 bp, H. sapiens
gctgagattacaggca

SEQ ID NO: 110070 - DNA, 16 bp, H. sapiens
gctgagattacaggcc

SEQ ID NO: 110071 - DNA, 16 bp, H. sapiens
gctgagattacaggta

SEQ ID NO: 110072 - DNA, 18 bp, H. sapiens
gctgagattacaggtgtg

SEQ ID NO: 110073 - DNA, 16 bp, H. sapiens
gctgagattacagttg

SEQ ID NO: 110074 - DNA, 16 bp, H. sapiens
gctgagattacgggtg

SEQ ID NO: 110075 - DNA, 16 bp, H. sapiens
gctgagattatagatg

SEQ ID NO: 110076 - DNA, 16 bp, H. sapiens
gctgagattataggca

SEQ ID NO: 110077 - DNA, 16 bp, H. sapiens
gctgagattgctgaaa

SEQ ID NO: 110078 - DNA, 16 bp, H. sapiens
gctgagattttgtcac

SEQ ID NO: 110079 - DNA, 16 bp, H. sapiens
gctgagcaaaggggga

SEQ ID NO: 110080 - DNA, 16 bp, H. sapiens
gctgagcaaggtggct

SEQ ID NO: 110081 - DNA, 16 bp, H. sapiens
gctgagcagatgccaa

SEQ ID NO: 110082 - DNA, 16 bp, H. sapiens
gctgagccacctggaa

SEQ ID NO: 110083 - DNA, 16 bp, H. sapiens
gctgagccaggatttg

SEQ ID NO: 110084 - DNA, 16 bp, H. sapiens
gctgagcccagcctgg

SEQ ID NO: 110085 - DNA, 16 bp, H. sapiens
gctgagcccaggcact

SEQ ID NO: 110086 - DNA, 16 bp, H. sapiens
gctgagcgtgatggtg

SEQ ID NO: 110087 - DNA, 16 bp, H. sapiens
gctgagcgtggtggca

SEQ ID NO: 110088 - DNA, 16 bp, H. sapiens
gctgagcgtggtggtg

SEQ ID NO: 110089 - DNA, 16 bp, H. sapiens
gctgagctctttgcca

SEQ ID NO: 110090 - DNA, 16 bp, H. sapiens
gctgagctgagctggg

SEQ ID NO: 110091 - DNA, 16 bp, H. sapiens
gctgagctgaggggtg

SEQ ID NO: 110092 - DNA, 16 bp, H. sapiens
gctgagctgccctcag

SEQ ID NO: 110093 - DNA, 16 bp, H. sapiens
gctgagctgggctgag

SEQ ID NO: 110094 - DNA, 16 bp, H. sapiens
gctgaggaagaggaag

SEQ ID NO: 110095 - DNA, 16 bp, H. sapiens
gctgaggaaggagact

SEQ ID NO: 110096 - DNA, 16 bp, H. sapiens
gctgaggaaggaggat

SEQ ID NO: 110097 - DNA, 16 bp, H. sapiens
gctgaggaaggagggt

SEQ ID NO: 110098 - DNA, 16 bp, H. sapiens
gctgaggaatttcatc

SEQ ID NO: 110099 - DNA, 16 bp, H. sapiens
gctgaggagaaaggag

SEQ ID NO: 110100 - DNA, 16 bp, H. sapiens
gctgaggagaaggagg

SEQ ID NO: 110101 - DNA, 16 bp, H. sapiens
gctgaggagcaagaaa

SEQ ID NO: 110102 - DNA, 16 bp, H. sapiens
gctgaggaggagaatg

SEQ ID NO: 110103 - DNA, 16 bp, H. sapiens
gctgaggaggaggctg

SEQ ID NO: 110104 - DNA, 16 bp, H. sapiens
gctgaggaggctgagg

SEQ ID NO: 110105 - DNA, 16 bp, H. sapiens
gctgaggaggtgggag

SEQ ID NO: 110106 - DNA, 16 bp, H. sapiens
gctgaggagtgtgggc

SEQ ID NO: 110107 - DNA, 16 bp, H. sapiens
gctgaggcaagaagaa

SEQ ID NO: 110108 - DNA, 16 bp, H. sapiens
gctgaggcaagagaat

SEQ ID NO: 110109 - DNA, 16 bp, H. sapiens
gctgaggcaaggggat

SEQ ID NO: 110110 - DNA, 16 bp, H. sapiens
gctgaggcaagtggat

SEQ ID NO: 110111 - DNA, 16 bp, H. sapiens
gctgaggcacaagaaa

SEQ ID NO: 110112 - DNA, 16 bp, H. sapiens
gctgaggcacaagaat

SEQ ID NO: 110113 - DNA, 16 bp, H. sapiens
gctgaggcacagaaag

SEQ ID NO: 110114 - DNA, 16 bp, H. sapiens
gctgaggcacgagaat

SEQ ID NO: 110115 - DNA, 16 bp, H. sapiens
gctgaggcagaagaac

SEQ ID NO: 110116 - DNA, 16 bp, H. sapiens
gctgaggcagaaggat

SEQ ID NO: 110117 - DNA, 16 bp, H. sapiens
gctgaggcagcagaac

SEQ ID NO: 110118 - DNA, 16 bp, H. sapiens
gctgaggcaggaagaa

SEQ ID NO: 110119 - DNA, 16 bp, H. sapiens
gctgaggcaggaagct

SEQ ID NO: 110120 - DNA, 16 bp, H. sapiens
gctgaggcaggaggac

SEQ ID NO: 110121 - DNA, 16 bp, H. sapiens
gctgaggcaggaggat

SEQ ID NO: 110122 - DNA, 16 bp, H. sapiens
gctgaggcaggcagaa

SEQ ID NO: 110123 - DNA, 16 bp, H. sapiens
gctgaggcaggcgaat

SEQ ID NO: 110124 - DNA, 16 bp, H. sapiens
gctgaggcagggctgg

SEQ ID NO: 110125 - DNA, 16 bp, H. sapiens
gctgaggcatgaaaat

SEQ ID NO: 110126 - DNA, 16 bp, H. sapiens
gctgaggcatgagaat

SEQ ID NO: 110127 - DNA, 16 bp, H. sapiens
gctgaggcccagtgag

SEQ ID NO: 110128 - DNA, 18 bp, H. sapiens
gctgaggcccggcgagaa

SEQ ID NO: 110129 - DNA, 16 bp, H. sapiens
gctgaggccgaggagg

SEQ ID NO: 110130 - DNA, 16 bp, H. sapiens
gctgaggccggagccg

SEQ ID NO: 110131 - DNA, 16 bp, H. sapiens
gctgaggccggaggat

SEQ ID NO: 110132 - DNA, 16 bp, H. sapiens
gctgaggcctcaggaa

SEQ ID NO: 110133 - DNA, 16 bp, H. sapiens
gctgaggcctggtgag

SEQ ID NO: 110134 - DNA, 16 bp, H. sapiens
gctgaggcggacagat

SEQ ID NO: 110135 - DNA, 16 bp, H. sapiens
gctgaggcgggaagat

SEQ ID NO: 110136 - DNA, 16 bp, H. sapiens
gctgaggcgggagaat

SEQ ID NO: 110137 - DNA, 16 bp, H. sapiens
gctgaggcgggaggat

SEQ ID NO: 110138 - DNA, 16 bp, H. sapiens
gctgaggcgggaggct

SEQ ID NO: 110139 - DNA, 18 bp, H. sapiens
gctgaggcgggcagatcg

SEQ ID NO: 110140 - DNA, 24 bp, H. sapiens
gctgaggcgggtggatcacctgaa

SEQ ID NO: 110141 - DNA, 16 bp, H. sapiens
gctgaggctagtggat

SEQ ID NO: 110142 - DNA, 16 bp, H. sapiens
gctgaggctcagggag

SEQ ID NO: 110143 - DNA, 16 bp, H. sapiens
gctgaggctgaggctg

SEQ ID NO: 110144 - DNA, 16 bp, H. sapiens
gctgaggctggagaat

SEQ ID NO: 110145 - DNA, 16 bp, H. sapiens
gctgaggctggaggac

SEQ ID NO: 110146 - DNA, 16 bp, H. sapiens
gctgaggcttagagag

SEQ ID NO: 110147 - DNA, 16 bp, H. sapiens
gctgaggcttgaaccc

SEQ ID NO: 110148 - DNA, 16 bp, H. sapiens
gctgagggaggagaat

SEQ ID NO: 110149 - DNA, 16 bp, H. sapiens
gctgagggaggggcgc

SEQ ID NO: 110150 - DNA, 16 bp, H. sapiens
gctgaggggctgaggg

SEQ ID NO: 110151 - DNA, 16 bp, H. sapiens
gctgaggtacaagaat

SEQ ID NO: 110152 - DNA, 16 bp, H. sapiens
gctgaggtaggaggac

SEQ ID NO: 110153 - DNA, 16 bp, H. sapiens
gctgaggtaggaggat

SEQ ID NO: 110154 - DNA, 16 bp, H. sapiens
gctgaggtagtaggat

SEQ ID NO: 110155 - DNA, 16 bp, H. sapiens
gctgaggtatgagaat

SEQ ID NO: 110156 - DNA, 16 bp, H. sapiens
gctgaggtcacaccac

SEQ ID NO: 110157 - DNA, 16 bp, H. sapiens
gctgaggtcaggagtt

SEQ ID NO: 110158 - DNA, 16 bp, H. sapiens
gctgaggtgagaagac

SEQ ID NO: 110159 - DNA, 16 bp, H. sapiens
gctgaggtgagaagat

SEQ ID NO: 110160 - DNA, 16 bp, H. sapiens
gctgaggtgagaggat

SEQ ID NO: 110161 - DNA, 16 bp, H. sapiens
gctgaggtgcagtggt

SEQ ID NO: 110162 - DNA, 16 bp, H. sapiens
gctgaggtgctctcag

SEQ ID NO: 110163 - DNA, 16 bp, H. sapiens
gctgaggtggaaggac

SEQ ID NO: 110164 - DNA, 16 bp, H. sapiens
gctgaggtggaaggat

SEQ ID NO: 110165 - DNA, 16 bp, H. sapiens
gctgaggtggacggat

SEQ ID NO: 110166 - DNA, 16 bp, H. sapiens
gctgaggtggcaggat

SEQ ID NO: 110167 - DNA, 16 bp, H. sapiens
gctgaggtgggaggac

SEQ ID NO: 110168 - DNA, 17 bp, H. sapiens
gctgaggtgggcggatt

SEQ ID NO: 110169 - DNA, 17 bp, H. sapiens
gctgaggtgggtagatt

SEQ ID NO: 110170 - DNA, 16 bp, H. sapiens
gctgaggttgagaaat

SEQ ID NO: 110171 - DNA, 16 bp, H. sapiens
gctgaggttgcgccac

SEQ ID NO: 110172 - DNA, 16 bp, H. sapiens
gctgaggttttatttt

SEQ ID NO: 110173 - DNA, 16 bp, H. sapiens
gctgagtagtattcta

SEQ ID NO: 110174 - DNA, 16 bp, H. sapiens
gctgagtagtattgca

SEQ ID NO: 110175 - DNA, 16 bp, H. sapiens
gctgagtcagaagaat

SEQ ID NO: 110176 - DNA, 16 bp, H. sapiens
gctgagtcaggaagat

SEQ ID NO: 110177 - DNA, 16 bp, H. sapiens
gctgagtgaaggaagc

SEQ ID NO: 110178 - DNA, 16 bp, H. sapiens
gctgagtgaccctggg

SEQ ID NO: 110179 - DNA, 16 bp, H. sapiens
gctgagtgggcagaat

SEQ ID NO: 110180 - DNA, 16 bp, H. sapiens
gctgagtgttgggagg

SEQ ID NO: 110181 - DNA, 16 bp, H. sapiens
gctgagttcagcccag

SEQ ID NO: 110182 - DNA, 16 bp, H. sapiens
gctgagttccaataaa

SEQ ID NO: 110183 - DNA, 16 bp, H. sapiens
gctgagtttgggtttg

SEQ ID NO: 110184 - DNA, 16 bp, H. sapiens
gctgagttttgtattt

SEQ ID NO: 110185 - DNA, 16 bp, H. sapiens
gctgatattacaggcg

SEQ ID NO: 110186 - DNA, 16 bp, H. sapiens
gctgatattgcaccat

SEQ ID NO: 110187 - DNA, 16 bp, H. sapiens
gctgatatttattgga

SEQ ID NO: 110188 - DNA, 20 bp, H. sapiens
gctgatctcaaactcctggg

SEQ ID NO: 110189 - DNA, 16 bp, H. sapiens
gctgatctccagctcc

SEQ ID NO: 110190 - DNA, 16 bp, H. sapiens
gctgatctgcctgcct

SEQ ID NO: 110191 - DNA, 16 bp, H. sapiens
gctgatgaaaagaatg

SEQ ID NO: 110192 - DNA, 16 bp, H. sapiens
gctgatgaagaagctg

SEQ ID NO: 110193 - DNA, 16 bp, H. sapiens
gctgatgcatgagaat

SEQ ID NO: 110194 - DNA, 16 bp, H. sapiens
gctgatgctgctggtt

SEQ ID NO: 110195 - DNA, 16 bp, H. sapiens
gctgatggtgatggtg

SEQ ID NO: 110196 - DNA, 16 bp, H. sapiens
gctgatggttttaaag

SEQ ID NO: 110197 - DNA, 16 bp, H. sapiens
gctgatgtgcagtggc

SEQ ID NO: 110198 - DNA, 16 bp, H. sapiens
gctgatgtggaagctg

SEQ ID NO: 110199 - DNA, 16 bp, H. sapiens
gctgattaatattcca

SEQ ID NO: 110200 - DNA, 16 bp, H. sapiens
gctgattgaagagccc

SEQ ID NO: 110201 - DNA, 16 bp, H. sapiens
gctgattgggaggctg

SEQ ID NO: 110202 - DNA, 16 bp, H. sapiens
gctgattggtgcgttt

SEQ ID NO: 110203 - DNA, 16 bp, H. sapiens
gctgattttatttatt

SEQ ID NO: 110204 - DNA, 16 bp, H. sapiens
gctgattttctgtatt

SEQ ID NO: 110205 - DNA, 16 bp, H. sapiens
gctgcaaaaaaataaa

SEQ ID NO: 110206 - DNA, 16 bp, H. sapiens
gctgcaaaagaaaagg

SEQ ID NO: 110207 - DNA, 16 bp, H. sapiens
gctgcaaaagaaaagt

SEQ ID NO: 110208 - DNA, 16 bp, H. sapiens
gctgcaaacctcagtg

SEQ ID NO: 110209 - DNA, 16 bp, H. sapiens
gctgcaaactctgaca

SEQ ID NO: 110210 - DNA, 16 bp, H. sapiens
gctgcaaagagctatg

SEQ ID NO: 110211 - DNA, 16 bp, H. sapiens
gctgcaaaggccctga

SEQ ID NO: 110212 - DNA, 16 bp, H. sapiens
gctgcaaatttttcaa

SEQ ID NO: 110213 - DNA, 16 bp, H. sapiens
gctgcaagctctgcct

SEQ ID NO: 110214 - DNA, 16 bp, H. sapiens
gctgcaagtaacagaa

SEQ ID NO: 110215 - DNA, 16 bp, H. sapiens
gctgcaagtgacagaa

SEQ ID NO: 110216 - DNA, 16 bp, H. sapiens
gctgcaataacaaaca

SEQ ID NO: 110217 - DNA, 16 bp, H. sapiens
gctgcaatcttggctc

SEQ ID NO: 110218 - DNA, 16 bp, H. sapiens
gctgcaatgaatattc

SEQ ID NO: 110219 - DNA, 16 bp, H. sapiens
gctgcaatgaatgtac

SEQ ID NO: 110220 - DNA, 16 bp, H. sapiens
gctgcaattacaggca

SEQ ID NO: 110221 - DNA, 16 bp, H. sapiens
gctgcaattacaggtg

SEQ ID NO: 110222 - DNA, 16 bp, H. sapiens
gctgcacaccagcctg

SEQ ID NO: 110223 - DNA, 16 bp, H. sapiens
gctgcacagaagctct

SEQ ID NO: 110224 - DNA, 16 bp, H. sapiens
gctgcacagagcaggg

SEQ ID NO: 110225 - DNA, 16 bp, H. sapiens
gctgcacagcctgcaa

SEQ ID NO: 110226 - DNA, 16 bp, H. sapiens
gctgcacaggagccca

SEQ ID NO: 110227 - DNA, 16 bp, H. sapiens
gctgcacccagcaact

SEQ ID NO: 110228 - DNA, 16 bp, H. sapiens
gctgcacccatcagcc

SEQ ID NO: 110229 - DNA, 16 bp, H. sapiens
gctgcacctgctgttc

SEQ ID NO: 110230 - DNA, 16 bp, H. sapiens
gctgcactgcctggag

SEQ ID NO: 110231 - DNA, 16 bp, H. sapiens
gctgcagaaaggagct

SEQ ID NO: 110232 - DNA, 16 bp, H. sapiens
gctgcagaaatctgca

SEQ ID NO: 110233 - DNA, 16 bp, H. sapiens
gctgcagaaatttgca

SEQ ID NO: 110234 - DNA, 16 bp, H. sapiens
gctgcagaacagcaaa

SEQ ID NO: 110235 - DNA, 16 bp, H. sapiens
gctgcagaacagcaga

SEQ ID NO: 110236 - DNA, 16 bp, H. sapiens
gctgcagaagaaaagg

SEQ ID NO: 110237 - DNA, 16 bp, H. sapiens
gctgcagacaggagct

SEQ ID NO: 110238 - DNA, 16 bp, H. sapiens
gctgcagaccagagct

SEQ ID NO: 110239 - DNA, 16 bp, H. sapiens
gctgcagacccaggcc

SEQ ID NO: 110240 - DNA, 16 bp, H. sapiens
gctgcagaccttcctg

SEQ ID NO: 110241 - DNA, 16 bp, H. sapiens
gctgcagaccttcgag

SEQ ID NO: 110242 - DNA, 16 bp, H. sapiens
gctgcagaccttcgcg

SEQ ID NO: 110243 - DNA, 16 bp, H. sapiens
gctgcagactggagct

SEQ ID NO: 110244 - DNA, 16 bp, H. sapiens
gctgcagaggctgtgg

SEQ ID NO: 110245 - DNA, 18 bp, H. sapiens
gctgcagagggtgtactg

SEQ ID NO: 110246 - DNA, 16 bp, H. sapiens
gctgcagaggttgcag

SEQ ID NO: 110247 - DNA, 16 bp, H. sapiens
gctgcagatggagctg

SEQ ID NO: 110248 - DNA, 16 bp, H. sapiens
gctgcagcaagaccca

SEQ ID NO: 110249 - DNA, 16 bp, H. sapiens
gctgcagcagagtgag

SEQ ID NO: 110250 - DNA, 16 bp, H. sapiens
gctgcagcagcagcag

SEQ ID NO: 110251 - DNA, 16 bp, H. sapiens
gctgcagcagctccag

SEQ ID NO: 110252 - DNA, 16 bp, H. sapiens
gctgcagcaggaggat

SEQ ID NO: 110253 - DNA, 16 bp, H. sapiens
gctgcagcagggcagg

SEQ ID NO: 110254 - DNA, 16 bp, H. sapiens
gctgcagccaaggaga

SEQ ID NO: 110255 - DNA, 16 bp, H. sapiens
gctgcagccacccagc

SEQ ID NO: 110256 - DNA, 16 bp, H. sapiens
gctgcagcctcccgag

SEQ ID NO: 110257 - DNA, 16 bp, H. sapiens
gctgcagcctccctgc

SEQ ID NO: 110258 - DNA, 16 bp, H. sapiens
gctgcagcctccgcct

SEQ ID NO: 110259 - DNA, 16 bp, H. sapiens
gctgcagcctggcagg

SEQ ID NO: 110260 - DNA, 16 bp, H. sapiens
gctgcagctaaagcca

SEQ ID NO: 110261 - DNA, 16 bp, H. sapiens
gctgcagctcttctct

SEQ ID NO: 110262 - DNA, 16 bp, H. sapiens
gctgcagctgcaccca

SEQ ID NO: 110263 - DNA, 16 bp, H. sapiens
gctgcagctgcacctg

SEQ ID NO: 110264 - DNA, 16 bp, H. sapiens
gctgcagctgcagctg

SEQ ID NO: 110265 - DNA, 16 bp, H. sapiens
gctgcagctgcagtga

SEQ ID NO: 110266 - DNA, 16 bp, H. sapiens
gctgcagctgcccagc

SEQ ID NO: 110267 - DNA, 16 bp, H. sapiens
gctgcagctgctgcca

SEQ ID NO: 110268 - DNA, 16 bp, H. sapiens
gctgcagctgtggctg

SEQ ID NO: 110269 - DNA, 16 bp, H. sapiens
gctgcaggaaggagct

SEQ ID NO: 110270 - DNA, 16 bp, H. sapiens
gctgcaggacagcaaa

SEQ ID NO: 110271 - DNA, 16 bp, H. sapiens
gctgcaggagcagggc

SEQ ID NO: 110272 - DNA, 16 bp, H. sapiens
gctgcaggaggagctg

SEQ ID NO: 110273 - DNA, 16 bp, H. sapiens
gctgcaggaggaggag

SEQ ID NO: 110274 - DNA, 16 bp, H. sapiens
gctgcaggaggccagg

SEQ ID NO: 110275 - DNA, 16 bp, H. sapiens
gctgcaggagggcggg

SEQ ID NO: 110276 - DNA, 16 bp, H. sapiens
gctgcaggcctccatc

SEQ ID NO: 110277 - DNA, 16 bp, H. sapiens
gctgcagggagaggga

SEQ ID NO: 110278 - DNA, 16 bp, H. sapiens
gctgcagggagccctg

SEQ ID NO: 110279 - DNA, 16 bp, H. sapiens
gctgcagggagctgag

SEQ ID NO: 110280 - DNA, 16 bp, H. sapiens
gctgcagggatgcagg

SEQ ID NO: 110281 - DNA, 16 bp, H. sapiens
gctgcagggcagtggc

SEQ ID NO: 110282 - DNA, 16 bp, H. sapiens
gctgcaggggcggggc

SEQ ID NO: 110283 - DNA, 16 bp, H. sapiens
gctgcaggggctgggg

SEQ ID NO: 110284 - DNA, 16 bp, H. sapiens
gctgcaggggtggagt

SEQ ID NO: 110285 - DNA, 16 bp, H. sapiens
gctgcagggtcagggc

SEQ ID NO: 110286 - DNA, 16 bp, H. sapiens
gctgcaggtcccaagc

SEQ ID NO: 110287 - DNA, 16 bp, H. sapiens
gctgcaggtccccagc

SEQ ID NO: 110288 - DNA, 16 bp, H. sapiens
gctgcaggtcttttgg

SEQ ID NO: 110289 - DNA, 16 bp, H. sapiens
gctgcaggtggagctg

SEQ ID NO: 110290 - DNA, 20 bp, H. sapiens
gctgcagtaagccaagatca

SEQ ID NO: 110291 - DNA, 16 bp, H. sapiens
gctgcagtaagctgtg

SEQ ID NO: 110292 - DNA, 16 bp, H. sapiens
gctgcagtacagtggt

SEQ ID NO: 110293 - DNA, 16 bp, H. sapiens
gctgcagtccagcctg

SEQ ID NO: 110294 - DNA, 16 bp, H. sapiens
gctgcagtgaacatgc

SEQ ID NO: 110295 - DNA, 16 bp, H. sapiens
gctgcagtgagccata

SEQ ID NO: 110296 - DNA, 16 bp, H. sapiens
gctgcagtgagccctg

SEQ ID NO: 110297 - DNA, 16 bp, H. sapiens
gctgcagtgagctgtg

SEQ ID NO: 110298 - DNA, 16 bp, H. sapiens
gctgcagtgcaatggt

SEQ ID NO: 110299 - DNA, 16 bp, H. sapiens
gctgcagtgcagcagc

SEQ ID NO: 110300 - DNA, 16 bp, H. sapiens
gctgcagtgggccaag

SEQ ID NO: 110301 - DNA, 16 bp, H. sapiens
gctgcagtgggccgag

SEQ ID NO: 110302 - DNA, 16 bp, H. sapiens
gctgcagtgggctcca

SEQ ID NO: 110303 - DNA, 16 bp, H. sapiens
gctgcagtgtgccatg

SEQ ID NO: 110304 - DNA, 16 bp, H. sapiens
gctgcatcatcccatg

SEQ ID NO: 110305 - DNA, 16 bp, H. sapiens
gctgcatccatgtggc

SEQ ID NO: 110306 - DNA, 16 bp, H. sapiens
gctgcatccctggcct

SEQ ID NO: 110307 - DNA, 16 bp, H. sapiens
gctgcattcaggagac

SEQ ID NO: 110308 - DNA, 16 bp, H. sapiens
gctgcattcccagaag

SEQ ID NO: 110309 - DNA, 16 bp, H. sapiens
gctgccaaggcctggg

SEQ ID NO: 110310 - DNA, 16 bp, H. sapiens
gctgccaaggcttggg

SEQ ID NO: 110311 - DNA, 16 bp, H. sapiens
gctgccacatctggct

SEQ ID NO: 110312 - DNA, 16 bp, H. sapiens
gctgccaccaccacca

SEQ ID NO: 110313 - DNA, 16 bp, H. sapiens
gctgccaccactgcca

SEQ ID NO: 110314 - DNA, 16 bp, H. sapiens
gctgccacgcccggcc

SEQ ID NO: 110315 - DNA, 16 bp, H. sapiens
gctgccactgccacca

SEQ ID NO: 110316 - DNA, 16 bp, H. sapiens
gctgccagacatactg

SEQ ID NO: 110317 - DNA, 16 bp, H. sapiens
gctgccagaggaactg

SEQ ID NO: 110318 - DNA, 16 bp, H. sapiens
gctgccagcacagcag

SEQ ID NO: 110319 - DNA, 16 bp, H. sapiens
gctgccagcacagtag

SEQ ID NO: 110320 - DNA, 16 bp, H. sapiens
gctgccagcagtctag

SEQ ID NO: 110321 - DNA, 16 bp, H. sapiens
gctgccagcatggctg

SEQ ID NO: 110322 - DNA, 16 bp, H. sapiens
gctgccaggaagctca

SEQ ID NO: 110323 - DNA, 16 bp, H. sapiens
gctgccaggcagaggg

SEQ ID NO: 110324 - DNA, 16 bp, H. sapiens
gctgccaggcctggga

SEQ ID NO: 110325 - DNA, 16 bp, H. sapiens
gctgccaggcggaggg

SEQ ID NO: 110326 - DNA, 16 bp, H. sapiens
gctgccagggctgggg

SEQ ID NO: 110327 - DNA, 16 bp, H. sapiens
gctgccaggggctgga

SEQ ID NO: 110328 - DNA, 16 bp, H. sapiens
gctgccagtctccttg

SEQ ID NO: 110329 - DNA, 16 bp, H. sapiens
gctgccagtgcagcca

SEQ ID NO: 110330 - DNA, 16 bp, H. sapiens
gctgccagttttgaat

SEQ ID NO: 110331 - DNA, 16 bp, H. sapiens
gctgccataaaaaatg

SEQ ID NO: 110332 - DNA, 16 bp, H. sapiens
gctgccataaacattt

SEQ ID NO: 110333 - DNA, 16 bp, H. sapiens
gctgccatcttggaag

SEQ ID NO: 110334 - DNA, 16 bp, H. sapiens
gctgccatgaacattc

SEQ ID NO: 110335 - DNA, 16 bp, H. sapiens
gctgccatgtgaagac

SEQ ID NO: 110336 - DNA, 16 bp, H. sapiens
gctgcccaaggctttg

SEQ ID NO: 110337 - DNA, 16 bp, H. sapiens
gctgcccagcctggag

SEQ ID NO: 110338 - DNA, 16 bp, H. sapiens
gctgcccagctgtggc

SEQ ID NO: 110339 - DNA, 16 bp, H. sapiens
gctgcccaggccagag

SEQ ID NO: 110340 - DNA, 16 bp, H. sapiens
gctgcccaggctggcc

SEQ ID NO: 110341 - DNA, 16 bp, H. sapiens
gctgcccagtttgtgg

SEQ ID NO: 110342 - DNA, 16 bp, H. sapiens
gctgccccagccagca

SEQ ID NO: 110343 - DNA, 16 bp, H. sapiens
gctgcccccatgatcc

SEQ ID NO: 110344 - DNA, 16 bp, H. sapiens
gctgcccctgccctga

SEQ ID NO: 110345 - DNA, 16 bp, H. sapiens
gctgcccgcaggtccc

SEQ ID NO: 110346 - DNA, 16 bp, H. sapiens
gctgcccgccaccatg

SEQ ID NO: 110347 - DNA, 16 bp, H. sapiens
gctgcccgggaggctg

SEQ ID NO: 110348 - DNA, 16 bp, H. sapiens
gctgccctccccacac

SEQ ID NO: 110349 - DNA, 16 bp, H. sapiens
gctgccctgaagggaa

SEQ ID NO: 110350 - DNA, 16 bp, H. sapiens
gctgccctggctgccc

SEQ ID NO: 110351 - DNA, 16 bp, H. sapiens
gctgccctgggccctg

SEQ ID NO: 110352 - DNA, 16 bp, H. sapiens
gctgcccttgacattt

SEQ ID NO: 110353 - DNA, 16 bp, H. sapiens
gctgccgctgctgctg

SEQ ID NO: 110354 - DNA, 16 bp, H. sapiens
gctgccgggcagaggc

SEQ ID NO: 110355 - DNA, 16 bp, H. sapiens
gctgccgggcggaggg

SEQ ID NO: 110356 - DNA, 17 bp, H. sapiens
gctgcctcagcctccca

SEQ ID NO: 110357 - DNA, 16 bp, H. sapiens
gctgcctcattctttt

SEQ ID NO: 110358 - DNA, 16 bp, H. sapiens
gctgcctccctgcggg

SEQ ID NO: 110359 - DNA, 16 bp, H. sapiens
gctgcctcctcaagtg

SEQ ID NO: 110360 - DNA, 16 bp, H. sapiens
gctgcctcctctgcct

SEQ ID NO: 110361 - DNA, 16 bp, H. sapiens
gctgcctcctgtctct

SEQ ID NO: 110362 - DNA, 16 bp, H. sapiens
gctgcctctgctgctg

SEQ ID NO: 110363 - DNA, 16 bp, H. sapiens
gctgcctgagagccag

SEQ ID NO: 110364 - DNA, 16 bp, H. sapiens
gctgcctgcattcctt

SEQ ID NO: 110365 - DNA, 16 bp, H. sapiens
gctgcctgccccactg

SEQ ID NO: 110366 - DNA, 16 bp, H. sapiens
gctgcctgccctgctg

SEQ ID NO: 110367 - DNA, 16 bp, H. sapiens
gctgcctgcctgcctc

SEQ ID NO: 110368 - DNA, 16 bp, H. sapiens
gctgcctgcctgcctg

SEQ ID NO: 110369 - DNA, 16 bp, H. sapiens
gctgcctgctccttct

SEQ ID NO: 110370 - DNA, 16 bp, H. sapiens
gctgcctggaggagga

SEQ ID NO: 110371 - DNA, 16 bp, H. sapiens
gctgcctgggaggctg

SEQ ID NO: 110372 - DNA, 16 bp, H. sapiens
gctgcctggggctggg

SEQ ID NO: 110373 - DNA, 16 bp, H. sapiens
gctgcctgggttcaaa

SEQ ID NO: 110374 - DNA, 16 bp, H. sapiens
gctgcctgggtttgaa

SEQ ID NO: 110375 - DNA, 16 bp, H. sapiens
gctgcctgtgcttttg

SEQ ID NO: 110376 - DNA, 16 bp, H. sapiens
gctgcctgtttcttcc

SEQ ID NO: 110377 - DNA, 16 bp, H. sapiens
gctgcctgtttttata

SEQ ID NO: 110378 - DNA, 16 bp, H. sapiens
gctgccttatgaagaa

SEQ ID NO: 110379 - DNA, 16 bp, H. sapiens
gctgccttcccagtcc

SEQ ID NO: 110380 - DNA, 16 bp, H. sapiens
gctgccttctccctgt

SEQ ID NO: 110381 - DNA, 16 bp, H. sapiens
gctgccttgaagacct

SEQ ID NO: 110382 - DNA, 16 bp, H. sapiens
gctgccttttcatttt

SEQ ID NO: 110383 - DNA, 16 bp, H. sapiens
gctgcgattacagatg

SEQ ID NO: 110384 - DNA, 16 bp, H. sapiens
gctgcgcaggagccca

SEQ ID NO: 110385 - DNA, 16 bp, H. sapiens
gctgcgcgcggcgctt

SEQ ID NO: 110386 - DNA, 16 bp, H. sapiens
gctgcgcggactcctc

SEQ ID NO: 110387 - DNA, 16 bp, H. sapiens
gctgcgcgtggtggcg

SEQ ID NO: 110388 - DNA, 16 bp, H. sapiens
gctgcgctggcagctg

SEQ ID NO: 110389 - DNA, 18 bp, H. sapiens
gctgcggagggtgtactg

SEQ ID NO: 110390 - DNA, 16 bp, H. sapiens
gctgcggcaggcagat

SEQ ID NO: 110391 - DNA, 16 bp, H. sapiens
gctgcggcgggtggat

SEQ ID NO: 110392 - DNA, 16 bp, H. sapiens
gctgcggtggctcacg

SEQ ID NO: 110393 - DNA, 16 bp, H. sapiens
gctgcggtgggtggat

SEQ ID NO: 110394 - DNA, 16 bp, H. sapiens
gctgcggtggtggctg

SEQ ID NO: 110395 - DNA, 16 bp, H. sapiens
gctgcgtgcagtggct

SEQ ID NO: 110396 - DNA, 16 bp, H. sapiens
gctgcgtgggaggagg

SEQ ID NO: 110397 - DNA, 16 bp, H. sapiens
gctgcgtgggaggctg

SEQ ID NO: 110398 - DNA, 16 bp, H. sapiens
gctgcgtggtggtgac

SEQ ID NO: 110399 - DNA, 16 bp, H. sapiens
gctgctaagttttgga

SEQ ID NO: 110400 - DNA, 30 bp, H. sapiens
gctgctaatcttctcttgcctactccagat

SEQ ID NO: 110401 - DNA, 16 bp, H. sapiens
gctgctaggaacattc

SEQ ID NO: 110402 - DNA, 16 bp, H. sapiens
gctgctataaacatgg

SEQ ID NO: 110403 - DNA, 16 bp, H. sapiens
gctgctataacaaaat

SEQ ID NO: 110404 - DNA, 16 bp, H. sapiens
gctgctataatggaat

SEQ ID NO: 110405 - DNA, 16 bp, H. sapiens
gctgctattaaaaaaa

SEQ ID NO: 110406 - DNA, 16 bp, H. sapiens
gctgctcaacatcact

SEQ ID NO: 110407 - DNA, 16 bp, H. sapiens
gctgctcaagaggctg

SEQ ID NO: 110408 - DNA, 16 bp, H. sapiens
gctgctcagagaggcc

SEQ ID NO: 110409 - DNA, 16 bp, H. sapiens
gctgctcaggaggcag

SEQ ID NO: 110410 - DNA, 16 bp, H. sapiens
gctgctcaggatatag

SEQ ID NO: 110411 - DNA, 16 bp, H. sapiens
gctgctcaggtggctg

SEQ ID NO: 110412 - DNA, 17 bp, H. sapiens
gctgctccgagtgcggg

SEQ ID NO: 110413 - DNA, 16 bp, H. sapiens
gctgctccggaggctg

SEQ ID NO: 110414 - DNA, 16 bp, H. sapiens
gctgctcctgaggctg

SEQ ID NO: 110415 - DNA, 16 bp, H. sapiens
gctgctcctgctgctg

SEQ ID NO: 110416 - DNA, 16 bp, H. sapiens
gctgctcgggaagctg

SEQ ID NO: 110417 - DNA, 16 bp, H. sapiens
gctgctcgggaggctg

SEQ ID NO: 110418 - DNA, 16 bp, H. sapiens
gctgctctaacaaaat

SEQ ID NO: 110419 - DNA, 16 bp, H. sapiens
gctgctctccagcctg

SEQ ID NO: 110420 - DNA, 16 bp, H. sapiens
gctgctctcctctctc

SEQ ID NO: 110421 - DNA, 16 bp, H. sapiens
gctgctctctgcctcc

SEQ ID NO: 110422 - DNA, 16 bp, H. sapiens
gctgctgaagctccag

SEQ ID NO: 110423 - DNA, 16 bp, H. sapiens
gctgctgaatgactac

SEQ ID NO: 110424 - DNA, 16 bp, H. sapiens
gctgctgacacccagg

SEQ ID NO: 110425 - DNA, 16 bp, H. sapiens
gctgctgaggcaggag

SEQ ID NO: 110426 - DNA, 16 bp, H. sapiens
gctgctgagttctgag

SEQ ID NO: 110427 - DNA, 16 bp, H. sapiens
gctgctgcaaaagaca

SEQ ID NO: 110428 - DNA, 16 bp, H. sapiens
gctgctgcacccggcc

SEQ ID NO: 110429 - DNA, 16 bp, H. sapiens
gctgctgcacctggcc

SEQ ID NO: 110430 - DNA, 16 bp, H. sapiens
gctgctgcagcacctg

SEQ ID NO: 110431 - DNA, 16 bp, H. sapiens
gctgctgcattccagc

SEQ ID NO: 110432 - DNA, 16 bp, H. sapiens
gctgctgccactggag

SEQ ID NO: 110433 - DNA, 16 bp, H. sapiens
gctgctgccctggccc

SEQ ID NO: 110434 - DNA, 16 bp, H. sapiens
gctgctgccgctgccg

SEQ ID NO: 110435 - DNA, 16 bp, H. sapiens
gctgctgcctcccctg

SEQ ID NO: 110436 - DNA, 16 bp, H. sapiens
gctgctgcctcctcct

SEQ ID NO: 110437 - DNA, 16 bp, H. sapiens
gctgctgcgcctggcc

SEQ ID NO: 110438 - DNA, 16 bp, H. sapiens
gctgctgctactgcta

SEQ ID NO: 110439 - DNA, 16 bp, H. sapiens
gctgctgctactgctg

SEQ ID NO: 110440 - DNA, 16 bp, H. sapiens
gctgctgctcctgctg

SEQ ID NO: 110441 - DNA, 16 bp, H. sapiens
gctgctgctctcctgg

SEQ ID NO: 110442 - DNA, 16 bp, H. sapiens
gctgctgctgatggtg

SEQ ID NO: 110443 - DNA, 16 bp, H. sapiens
gctgctgctgcagctg

SEQ ID NO: 110444 - DNA, 16 bp, H. sapiens
gctgctgctgcccagc

SEQ ID NO: 110445 - DNA, 16 bp, H. sapiens
gctgctgctgctactg

SEQ ID NO: 110446 - DNA, 16 bp, H. sapiens
gctgctgctgctccag

SEQ ID NO: 110447 - DNA, 16 bp, H. sapiens
gctgctgctgctcctc

SEQ ID NO: 110448 - DNA, 16 bp, H. sapiens
gctgctgctgctgatc

SEQ ID NO: 110449 - DNA, 16 bp, H. sapiens
gctgctgctgctgcaa

SEQ ID NO: 110450 - DNA, 16 bp, H. sapiens
gctgctgctgctgcag

SEQ ID NO: 110451 - DNA, 16 bp, H. sapiens
gctgctgctgctgcct

SEQ ID NO: 110452 - DNA, 16 bp, H. sapiens
gctgctgctgctgctg

SEQ ID NO: 110453 - DNA, 16 bp, H. sapiens
gctgctgctgctggca

SEQ ID NO: 110454 - DNA, 16 bp, H. sapiens
gctgctgctgctggct

SEQ ID NO: 110455 - DNA, 16 bp, H. sapiens
gctgctgctgctgtgc

SEQ ID NO: 110456 - DNA, 16 bp, H. sapiens
gctgctgctgctgttt

SEQ ID NO: 110457 - DNA, 16 bp, H. sapiens
gctgctgctgcttctc

SEQ ID NO: 110458 - DNA, 16 bp, H. sapiens
gctgctgctggcccag

SEQ ID NO: 110459 - DNA, 16 bp, H. sapiens
gctgctgctggctcgg

SEQ ID NO: 110460 - DNA, 16 bp, H. sapiens
gctgctgctggctctg

SEQ ID NO: 110461 - DNA, 16 bp, H. sapiens
gctgctgctggctggg

SEQ ID NO: 110462 - DNA, 16 bp, H. sapiens
gctgctgctggcttgg

SEQ ID NO: 110463 - DNA, 16 bp, H. sapiens
gctgctgctggtctga

SEQ ID NO: 110464 - DNA, 16 bp, H. sapiens
gctgctgctggtggtg

SEQ ID NO: 110465 - DNA, 16 bp, H. sapiens
gctgctgctgttgttt

SEQ ID NO: 110466 - DNA, 16 bp, H. sapiens
gctgctgcttctattt

SEQ ID NO: 110467 - DNA, 16 bp, H. sapiens
gctgctgcttctccag

SEQ ID NO: 110468 - DNA, 16 bp, H. sapiens
gctgctgcttctccct

SEQ ID NO: 110469 - DNA, 16 bp, H. sapiens
gctgctgcttctgctt

SEQ ID NO: 110470 - DNA, 16 bp, H. sapiens
gctgctgcttctgttt

SEQ ID NO: 110471 - DNA, 16 bp, H. sapiens
gctgctgcttctttct

SEQ ID NO: 110472 - DNA, 16 bp, H. sapiens
gctgctggagaggctg

SEQ ID NO: 110473 - DNA, 16 bp, H. sapiens
gctgctggattcaatt

SEQ ID NO: 110474 - DNA, 16 bp, H. sapiens
gctgctggatttggct

SEQ ID NO: 110475 - DNA, 16 bp, H. sapiens
gctgctggcccaggga

SEQ ID NO: 110476 - DNA, 16 bp, H. sapiens
gctgctgggaggcagg

SEQ ID NO: 110477 - DNA, 16 bp, H. sapiens
gctgctgggctgtgtg

SEQ ID NO: 110478 - DNA, 16 bp, H. sapiens
gctgctggggaggctg

SEQ ID NO: 110479 - DNA, 16 bp, H. sapiens
gctgctggggcacgtg

SEQ ID NO: 110480 - DNA, 16 bp, H. sapiens
gctgctgggttctgtt

SEQ ID NO: 110481 - DNA, 16 bp, H. sapiens
gctgctggtacccagg

SEQ ID NO: 110482 - DNA, 16 bp, H. sapiens
gctgctggtccaggga

SEQ ID NO: 110483 - DNA, 16 bp, H. sapiens
gctgctggtgagaatg

SEQ ID NO: 110484 - DNA, 16 bp, H. sapiens
gctgctgtaataaaat

SEQ ID NO: 110485 - DNA, 16 bp, H. sapiens
gctgctgtgagctgtg

SEQ ID NO: 110486 - DNA, 16 bp, H. sapiens
gctgctgtgcccagct

SEQ ID NO: 110487 - DNA, 16 bp, H. sapiens
gctgctgtgcctggcc

SEQ ID NO: 110488 - DNA, 16 bp, H. sapiens
gctgctgtgcttcctg

SEQ ID NO: 110489 - DNA, 16 bp, H. sapiens
gctgctgtggaggctg

SEQ ID NO: 110490 - DNA, 16 bp, H. sapiens
gctgctgtggtatgct

SEQ ID NO: 110491 - DNA, 16 bp, H. sapiens
gctgctgtgtggagaa

SEQ ID NO: 110492 - DNA, 16 bp, H. sapiens
gctgcttcctcttcct

SEQ ID NO: 110493 - DNA, 16 bp, H. sapiens
gctgcttcctggagga

SEQ ID NO: 110494 - DNA, 16 bp, H. sapiens
gctgcttctcctctct

SEQ ID NO: 110495 - DNA, 16 bp, H. sapiens
gctgcttctcctcttc

SEQ ID NO: 110496 - DNA, 16 bp, H. sapiens
gctgctttcttgctac

SEQ ID NO: 110497 - DNA, 16 bp, H. sapiens
gctgctttgaagtctt

SEQ ID NO: 110498 - DNA, 16 bp, H. sapiens
gctgcttttaaaatat

SEQ ID NO: 110499 - DNA, 16 bp, H. sapiens
gctgcttttgtgctac

SEQ ID NO: 110500 - DNA, 16 bp, H. sapiens
gctggaaaaactggac

SEQ ID NO: 110501 - DNA, 16 bp, H. sapiens
gctggaaaacacagca

SEQ ID NO: 110502 - DNA, 16 bp, H. sapiens
gctggaaaagcatttg

SEQ ID NO: 110503 - DNA, 16 bp, H. sapiens
gctggaaaggcaagga

SEQ ID NO: 110504 - DNA, 16 bp, H. sapiens
gctggaaatgcagaat

SEQ ID NO: 110505 - DNA, 16 bp, H. sapiens
gctggaacagagtgag

SEQ ID NO: 110506 - DNA, 16 bp, H. sapiens
gctggaacccaggagg

SEQ ID NO: 110507 - DNA, 16 bp, H. sapiens
gctggaacgcagtggt

SEQ ID NO: 110508 - DNA, 16 bp, H. sapiens
gctggaactacgggca

SEQ ID NO: 110509 - DNA, 16 bp, H. sapiens
gctggaactcaggagg

SEQ ID NO: 110510 - DNA, 16 bp, H. sapiens
gctggaagaaccactg

SEQ ID NO: 110511 - DNA, 16 bp, H. sapiens
gctggaagaactggct

SEQ ID NO: 110512 - DNA, 16 bp, H. sapiens
gctggaagacattatc

SEQ ID NO: 110513 - DNA, 16 bp, H. sapiens
gctggaagaggcagga

SEQ ID NO: 110514 - DNA, 16 bp, H. sapiens
gctggaagaggccagg

SEQ ID NO: 110515 - DNA, 16 bp, H. sapiens
gctggaagccaggagg

SEQ ID NO: 110516 - DNA, 16 bp, H. sapiens
gctggaagctgcagac

SEQ ID NO: 110517 - DNA, 16 bp, H. sapiens
gctggaatgcaatggt

SEQ ID NO: 110518 - DNA, 16 bp, H. sapiens
gctggaatgcagtggc

SEQ ID NO: 110519 - DNA, 16 bp, H. sapiens
gctggaatgcagtggt

SEQ ID NO: 110520 - DNA, 16 bp, H. sapiens
gctggaatggaaagga

SEQ ID NO: 110521 - DNA, 16 bp, H. sapiens
gctggaattacaggcg

SEQ ID NO: 110522 - DNA, 16 bp, H. sapiens
gctggaattacaggta

SEQ ID NO: 110523 - DNA, 16 bp, H. sapiens
gctggaatttgaacct

SEQ ID NO: 110524 - DNA, 16 bp, H. sapiens
gctggacacggtggct

SEQ ID NO: 110525 - DNA, 16 bp, H. sapiens
gctggacacggtggtg

SEQ ID NO: 110526 - DNA, 16 bp, H. sapiens
gctggacagcagtggc

SEQ ID NO: 110527 - DNA, 16 bp, H. sapiens
gctggacatggtggtt

SEQ ID NO: 110528 - DNA, 16 bp, H. sapiens
gctggactacagtggt

SEQ ID NO: 110529 - DNA, 16 bp, H. sapiens
gctggactccaactcc

SEQ ID NO: 110530 - DNA, 16 bp, H. sapiens
gctggactccagcctg

SEQ ID NO: 110531 - DNA, 16 bp, H. sapiens
gctggactgcagtgac

SEQ ID NO: 110532 - DNA, 16 bp, H. sapiens
gctggagaaagaggct

SEQ ID NO: 110533 - DNA, 16 bp, H. sapiens
gctggagaacagtggc

SEQ ID NO: 110534 - DNA, 16 bp, H. sapiens
gctggagaacagtggt

SEQ ID NO: 110535 - DNA, 16 bp, H. sapiens
gctggagaaccaggaa

SEQ ID NO: 110536 - DNA, 16 bp, H. sapiens
gctggagaacctggag

SEQ ID NO: 110537 - DNA, 16 bp, H. sapiens
gctggagaacttggag

SEQ ID NO: 110538 - DNA, 16 bp, H. sapiens
gctggagaaggaggaa

SEQ ID NO: 110539 - DNA, 16 bp, H. sapiens
gctggagacccaggag

SEQ ID NO: 110540 - DNA, 16 bp, H. sapiens
gctggagacccaggga

SEQ ID NO: 110541 - DNA, 16 bp, H. sapiens
gctggagaccctggtt

SEQ ID NO: 110542 - DNA, 16 bp, H. sapiens
gctggagacttcaaca

SEQ ID NO: 110543 - DNA, 16 bp, H. sapiens
gctggagagaagcaga

SEQ ID NO: 110544 - DNA, 16 bp, H. sapiens
gctggagagcagcggc

SEQ ID NO: 110545 - DNA, 16 bp, H. sapiens
gctggagagcaggggc

SEQ ID NO: 110546 - DNA, 16 bp, H. sapiens
gctggagaggacatgg

SEQ ID NO: 110547 - DNA, 16 bp, H. sapiens
gctggagaggagctgc

SEQ ID NO: 110548 - DNA, 16 bp, H. sapiens
gctggagaggcctcag

SEQ ID NO: 110549 - DNA, 16 bp, H. sapiens
gctggagaggttgtgg

SEQ ID NO: 110550 - DNA, 16 bp, H. sapiens
gctggagatgaggctg

SEQ ID NO: 110551 - DNA, 16 bp, H. sapiens
gctggagatgtggctg

SEQ ID NO: 110552 - DNA, 16 bp, H. sapiens
gctggagcagagtgaa

SEQ ID NO: 110553 - DNA, 16 bp, H. sapiens
gctggagcagagtggg

SEQ ID NO: 110554 - DNA, 16 bp, H. sapiens
gctggagcaggagaaa

SEQ ID NO: 110555 - DNA, 16 bp, H. sapiens
gctggagcaggagaat

SEQ ID NO: 110556 - DNA, 16 bp, H. sapiens
gctggagccacagcag

SEQ ID NO: 110557 - DNA, 16 bp, H. sapiens
gctggagccactgcac

SEQ ID NO: 110558 - DNA, 16 bp, H. sapiens
gctggagccatggcag

SEQ ID NO: 110559 - DNA, 16 bp, H. sapiens
gctggagcccagaagg

SEQ ID NO: 110560 - DNA, 17 bp, H. sapiens
gctggagcgcaatggtg

SEQ ID NO: 110561 - DNA, 16 bp, H. sapiens
gctggagcgcagtggc

SEQ ID NO: 110562 - DNA, 16 bp, H. sapiens
gctggagctgaaggca

SEQ ID NO: 110563 - DNA, 16 bp, H. sapiens
gctggagctgaagtgg

SEQ ID NO: 110564 - DNA, 16 bp, H. sapiens
gctggagctgagactg

SEQ ID NO: 110565 - DNA, 16 bp, H. sapiens
gctggagctgcagcag

SEQ ID NO: 110566 - DNA, 16 bp, H. sapiens
gctggagctgctggga

SEQ ID NO: 110567 - DNA, 16 bp, H. sapiens
gctggagctggagctg

SEQ ID NO: 110568 - DNA, 16 bp, H. sapiens
gctggagctggggctg

SEQ ID NO: 110569 - DNA, 16 bp, H. sapiens
gctggagctggggtgg

SEQ ID NO: 110570 - DNA, 16 bp, H. sapiens
gctggagctgtggcag

SEQ ID NO: 110571 - DNA, 16 bp, H. sapiens
gctggaggaaggggag

SEQ ID NO: 110572 - DNA, 16 bp, H. sapiens
gctggaggacagtggt

SEQ ID NO: 110573 - DNA, 16 bp, H. sapiens
gctggaggaggaggtg

SEQ ID NO: 110574 - DNA, 16 bp, H. sapiens
gctggaggaggcaagg

SEQ ID NO: 110575 - DNA, 16 bp, H. sapiens
gctggaggaggcagtg

SEQ ID NO: 110576 - DNA, 16 bp, H. sapiens
gctggaggaggcggtg

SEQ ID NO: 110577 - DNA, 16 bp, H. sapiens
gctggaggaggggaag

SEQ ID NO: 110578 - DNA, 16 bp, H. sapiens
gctggaggaggtggtg

SEQ ID NO: 110579 - DNA, 16 bp, H. sapiens
gctggaggcacagact

SEQ ID NO: 110580 - DNA, 16 bp, H. sapiens
gctggaggcccactcc

SEQ ID NO: 110581 - DNA, 16 bp, H. sapiens
gctggaggcggtggct

SEQ ID NO: 110582 - DNA, 16 bp, H. sapiens
gctggaggctacaaga

SEQ ID NO: 110583 - DNA, 16 bp, H. sapiens
gctggaggctacagtg

SEQ ID NO: 110584 - DNA, 16 bp, H. sapiens
gctggaggctggaggc

SEQ ID NO: 110585 - DNA, 16 bp, H. sapiens
gctggagggaaggagg

SEQ ID NO: 110586 - DNA, 16 bp, H. sapiens
gctggagggcagcggc

SEQ ID NO: 110587 - DNA, 16 bp, H. sapiens
gctggagggctgtggc

SEQ ID NO: 110588 - DNA, 16 bp, H. sapiens
gctggaggtgcagtgg

SEQ ID NO: 110589 - DNA, 16 bp, H. sapiens
gctggaggtggtggtg

SEQ ID NO: 110590 - DNA, 16 bp, H. sapiens
gctggagtacagcagc

SEQ ID NO: 110591 - DNA, 16 bp, H. sapiens
gctggagtacagtagt

SEQ ID NO: 110592 - DNA, 16 bp, H. sapiens
gctggagtacagtgtg

SEQ ID NO: 110593 - DNA, 16 bp, H. sapiens
gctggagtatagtggt

SEQ ID NO: 110594 - DNA, 16 bp, H. sapiens
gctggagtgaagtggt

SEQ ID NO: 110595 - DNA, 16 bp, H. sapiens
gctggagtgactggga

SEQ ID NO: 110596 - DNA, 16 bp, H. sapiens
gctggagtgagctgag

SEQ ID NO: 110597 - DNA, 16 bp, H. sapiens
gctggagtgcaagtgc

SEQ ID NO: 110598 - DNA, 16 bp, H. sapiens
gctggagtgcagcagc

SEQ ID NO: 110599 - DNA, 16 bp, H. sapiens
gctggagtgcagcgcc

SEQ ID NO: 110600 - DNA, 16 bp, H. sapiens
gctggagtgcagtgac

SEQ ID NO: 110601 - DNA, 16 bp, H. sapiens
gctggagtggctggag

SEQ ID NO: 110602 - DNA, 16 bp, H. sapiens
gctggagtggctggga

SEQ ID NO: 110603 - DNA, 16 bp, H. sapiens
gctggagtgtctggga

SEQ ID NO: 110604 - DNA, 16 bp, H. sapiens
gctggagtgtgatggt

SEQ ID NO: 110605 - DNA, 16 bp, H. sapiens
gctggagtgtggtggt

SEQ ID NO: 110606 - DNA, 16 bp, H. sapiens
gctggagttacagatg

SEQ ID NO: 110607 - DNA, 16 bp, H. sapiens
gctggagtttgctaga

SEQ ID NO: 110608 - DNA, 16 bp, H. sapiens
gctggataaaatgagg

SEQ ID NO: 110609 - DNA, 16 bp, H. sapiens
gctggatacaaaattt

SEQ ID NO: 110610 - DNA, 16 bp, H. sapiens
gctggatgcaatggca

SEQ ID NO: 110611 - DNA, 16 bp, H. sapiens
gctggatgcggtgact

SEQ ID NO: 110612 - DNA, 16 bp, H. sapiens
gctggatgctccctgc

SEQ ID NO: 110613 - DNA, 16 bp, H. sapiens
gctggatgctgtggct

SEQ ID NO: 110614 - DNA, 16 bp, H. sapiens
gctggatggccaaact

SEQ ID NO: 110615 - DNA, 16 bp, H. sapiens
gctggatgtggtagct

SEQ ID NO: 110616 - DNA, 16 bp, H. sapiens
gctggatgtggtggct

SEQ ID NO: 110617 - DNA, 16 bp, H. sapiens
gctggattgatagaat

SEQ ID NO: 110618 - DNA, 16 bp, H. sapiens
gctggatttcagtggc

SEQ ID NO: 110619 - DNA, 16 bp, H. sapiens
gctggattttcttcat

SEQ ID NO: 110620 - DNA, 16 bp, H. sapiens
gctggcaaagagaagg

SEQ ID NO: 110621 - DNA, 16 bp, H. sapiens
gctggcaaggatgcag

SEQ ID NO: 110622 - DNA, 16 bp, H. sapiens
gctggcacacagtagg

SEQ ID NO: 110623 - DNA, 16 bp, H. sapiens
gctggcacatgcttgt

SEQ ID NO: 110624 - DNA, 16 bp, H. sapiens
gctggcactgagtgcc

SEQ ID NO: 110625 - DNA, 16 bp, H. sapiens
gctggcactgctgggg

SEQ ID NO: 110626 - DNA, 16 bp, H. sapiens
gctggcagaagacaag

SEQ ID NO: 110627 - DNA, 16 bp, H. sapiens
gctggcagagctggga

SEQ ID NO: 110628 - DNA, 16 bp, H. sapiens
gctggcagaggcaggg

SEQ ID NO: 110629 - DNA, 16 bp, H. sapiens
gctggcagcagctgga

SEQ ID NO: 110630 - DNA, 16 bp, H. sapiens
gctggcagccctcact

SEQ ID NO: 110631 - DNA, 16 bp, H. sapiens
gctggcaggagtgggg

SEQ ID NO: 110632 - DNA, 16 bp, H. sapiens
gctggcaggcaggcag

SEQ ID NO: 110633 - DNA, 16 bp, H. sapiens
gctggcatcacccaga

SEQ ID NO: 110634 - DNA, 16 bp, H. sapiens
gctggcatctgctggg

SEQ ID NO: 110635 - DNA, 16 bp, H. sapiens
gctggcatctggcggg

SEQ ID NO: 110636 - DNA, 16 bp, H. sapiens
gctggcatgagccact

SEQ ID NO: 110637 - DNA, 16 bp, H. sapiens
gctggcattacagaca

SEQ ID NO: 110638 - DNA, 16 bp, H. sapiens
gctggcattacagctg

SEQ ID NO: 110639 - DNA, 18 bp, H. sapiens
gctggccaacatggggaa

SEQ ID NO: 110640 - DNA, 16 bp, H. sapiens
gctggccaaggctgga

SEQ ID NO: 110641 - DNA, 16 bp, H. sapiens
gctggccaccccaccc

SEQ ID NO: 110642 - DNA, 16 bp, H. sapiens
gctggccatgatggtg

SEQ ID NO: 110643 - DNA, 16 bp, H. sapiens
gctggccatggtggca

SEQ ID NO: 110644 - DNA, 16 bp, H. sapiens
gctggccatggtggtg

SEQ ID NO: 110645 - DNA, 16 bp, H. sapiens
gctggcccagctgagc

SEQ ID NO: 110646 - DNA, 16 bp, H. sapiens
gctggcccccacctcc

SEQ ID NO: 110647 - DNA, 16 bp, H. sapiens
gctggcccgcaagtgc

SEQ ID NO: 110648 - DNA, 16 bp, H. sapiens
gctggccggctgctcc

SEQ ID NO: 110649 - DNA, 16 bp, H. sapiens
gctggccgggctggtc

SEQ ID NO: 110650 - DNA, 16 bp, H. sapiens
gctggccgtggtggcg

SEQ ID NO: 110651 - DNA, 16 bp, H. sapiens
gctggcctcaggagtg

SEQ ID NO: 110652 - DNA, 16 bp, H. sapiens
gctggcctccagccag

SEQ ID NO: 110653 - DNA, 16 bp, H. sapiens
gctggcctccttgctg

SEQ ID NO: 110654 - DNA, 16 bp, H. sapiens
gctggcctcggcctcc

SEQ ID NO: 110655 - DNA, 16 bp, H. sapiens
gctggcctctcctggg

SEQ ID NO: 110656 - DNA, 16 bp, H. sapiens
gctggcctctgcctcc

SEQ ID NO: 110657 - DNA, 16 bp, H. sapiens
gctggcctggcagggg

SEQ ID NO: 110658 - DNA, 16 bp, H. sapiens
gctggccttcctggcc

SEQ ID NO: 110659 - DNA, 16 bp, H. sapiens
gctggccttgaacttc

SEQ ID NO: 110660 - DNA, 16 bp, H. sapiens
gctggcgaggagctgc

SEQ ID NO: 110661 - DNA, 19 bp, H. sapiens
gctggctcacgcctgtaat

SEQ ID NO: 110662 - DNA, 16 bp, H. sapiens
gctggctccagcagcc

SEQ ID NO: 110663 - DNA, 16 bp, H. sapiens
gctggctccccctttg

SEQ ID NO: 110664 - DNA, 16 bp, H. sapiens
gctggctccctcagct

SEQ ID NO: 110665 - DNA, 16 bp, H. sapiens
gctggctctgaagatg

SEQ ID NO: 110666 - DNA, 16 bp, H. sapiens
gctggctgcagtggct

SEQ ID NO: 110667 - DNA, 16 bp, H. sapiens
gctggctgcagtgggg

SEQ ID NO: 110668 - DNA, 16 bp, H. sapiens
gctggctgctggctgg

SEQ ID NO: 110669 - DNA, 16 bp, H. sapiens
gctggctggagtcccc

SEQ ID NO: 110670 - DNA, 16 bp, H. sapiens
gctggctggctgctcc

SEQ ID NO: 110671 - DNA, 16 bp, H. sapiens
gctggctggctgggct

SEQ ID NO: 110672 - DNA, 16 bp, H. sapiens
gctggctggggtggcc

SEQ ID NO: 110673 - DNA, 16 bp, H. sapiens
gctggctgggtggctg

SEQ ID NO: 110674 - DNA, 16 bp, H. sapiens
gctggctgtacaggaa

SEQ ID NO: 110675 - DNA, 16 bp, H. sapiens
gctggctgttggctga

SEQ ID NO: 110676 - DNA, 16 bp, H. sapiens
gctggctgttggctgg

SEQ ID NO: 110677 - DNA, 16 bp, H. sapiens
gctggcttcaggagtg

SEQ ID NO: 110678 - DNA, 22 bp, H. sapiens
gctggcttcaggagtgaagctg

SEQ ID NO: 110679 - DNA, 16 bp, H. sapiens
gctggcttcccccaga

SEQ ID NO: 110680 - DNA, 16 bp, H. sapiens
gctggcttcctgggct

SEQ ID NO: 110681 - DNA, 16 bp, H. sapiens
gctggcttctttgcag

SEQ ID NO: 110682 - DNA, 16 bp, H. sapiens
gctggctttcccccac

SEQ ID NO: 110683 - DNA, 16 bp, H. sapiens
gctggctttgcatttc

SEQ ID NO: 110684 - DNA, 16 bp, H. sapiens
gctgggaaaactagct

SEQ ID NO: 110685 - DNA, 16 bp, H. sapiens
gctgggaaaactggca

SEQ ID NO: 110686 - DNA, 16 bp, H. sapiens
gctgggaactgcagac

SEQ ID NO: 110687 - DNA, 16 bp, H. sapiens
gctgggaactgctcag

SEQ ID NO: 110688 - DNA, 16 bp, H. sapiens
gctgggaagaatgtat

SEQ ID NO: 110689 - DNA, 16 bp, H. sapiens
gctgggaagacaggca

SEQ ID NO: 110690 - DNA, 16 bp, H. sapiens
gctgggaaggacaaca

SEQ ID NO: 110691 - DNA, 16 bp, H. sapiens
gctgggaaggccaaga

SEQ ID NO: 110692 - DNA, 16 bp, H. sapiens
gctgggaaggctgagg

SEQ ID NO: 110693 - DNA, 16 bp, H. sapiens
gctgggaagggaaggg

SEQ ID NO: 110694 - DNA, 16 bp, H. sapiens
gctgggaagggcaggg

SEQ ID NO: 110695 - DNA, 16 bp, H. sapiens
gctgggaagtgaggag

SEQ ID NO: 110696 - DNA, 16 bp, H. sapiens
gctgggaagttcaaga

SEQ ID NO: 110697 - DNA, 16 bp, H. sapiens
gctgggacacaggaca

SEQ ID NO: 110698 - DNA, 16 bp, H. sapiens
gctgggacagcaggtg

SEQ ID NO: 110699 - DNA, 16 bp, H. sapiens
gctgggaccacagaag

SEQ ID NO: 110700 - DNA, 16 bp, H. sapiens
gctgggaccacaggca

SEQ ID NO: 110701 - DNA, 16 bp, H. sapiens
gctgggaccacagggg

SEQ ID NO: 110702 - DNA, 16 bp, H. sapiens
gctgggaccataggca

SEQ ID NO: 110703 - DNA, 16 bp, H. sapiens
gctgggaccataggcg

SEQ ID NO: 110704 - DNA, 16 bp, H. sapiens
gctgggactacaggta

SEQ ID NO: 110705 - DNA, 16 bp, H. sapiens
gctgggactactggtg

SEQ ID NO: 110706 - DNA, 16 bp, H. sapiens
gctgggactatgggca

SEQ ID NO: 110707 - DNA, 16 bp, H. sapiens
gctgggagagctggct

SEQ ID NO: 110708 - DNA, 16 bp, H. sapiens
gctgggagaggagagg

SEQ ID NO: 110709 - DNA, 16 bp, H. sapiens
gctgggagaggccagg

SEQ ID NO: 110710 - DNA, 16 bp, H. sapiens
gctgggagctcagctg

SEQ ID NO: 110711 - DNA, 16 bp, H. sapiens
gctgggagctgcagac

SEQ ID NO: 110712 - DNA, 16 bp, H. sapiens
gctgggagctgcagat

SEQ ID NO: 110713 - DNA, 16 bp, H. sapiens
gctgggagctggagac

SEQ ID NO: 110714 - DNA, 16 bp, H. sapiens
gctgggagctgggagc

SEQ ID NO: 110715 - DNA, 16 bp, H. sapiens
gctgggagctgtagac

SEQ ID NO: 110716 - DNA, 16 bp, H. sapiens
gctgggagctgtggac

SEQ ID NO: 110717 - DNA, 16 bp, H. sapiens
gctgggagctgtggct

SEQ ID NO: 110718 - DNA, 16 bp, H. sapiens
gctgggaggaaggagg

SEQ ID NO: 110719 - DNA, 16 bp, H. sapiens
gctgggaggaggctgg

SEQ ID NO: 110720 - DNA, 16 bp, H. sapiens
gctgggaggcagaggg

SEQ ID NO: 110721 - DNA, 16 bp, H. sapiens
gctgggaggcagaggt

SEQ ID NO: 110722 - DNA, 16 bp, H. sapiens
gctgggaggcggaggt

SEQ ID NO: 110723 - DNA, 16 bp, H. sapiens
gctgggagtacaagtg

SEQ ID NO: 110724 - DNA, 16 bp, H. sapiens
gctgggagtacaggca

SEQ ID NO: 110725 - DNA, 16 bp, H. sapiens
gctgggagtggggctg

SEQ ID NO: 110726 - DNA, 16 bp, H. sapiens
gctgggagtggtggtg

SEQ ID NO: 110727 - DNA, 16 bp, H. sapiens
gctgggagttggagac

SEQ ID NO: 110728 - DNA, 16 bp, H. sapiens
gctgggataacaggca

SEQ ID NO: 110729 - DNA, 16 bp, H. sapiens
gctgggataacaggcg

SEQ ID NO: 110730 - DNA, 16 bp, H. sapiens
gctgggataactagct

SEQ ID NO: 110731 - DNA, 16 bp, H. sapiens
gctgggataataggtg

SEQ ID NO: 110732 - DNA, 16 bp, H. sapiens
gctgggatcacaggca

SEQ ID NO: 110733 - DNA, 16 bp, H. sapiens
gctgggatcacatgtg

SEQ ID NO: 110734 - DNA, 16 bp, H. sapiens
gctgggatcataggca

SEQ ID NO: 110735 - DNA, 16 bp, H. sapiens
gctgggatcataggtg

SEQ ID NO: 110736 - DNA, 16 bp, H. sapiens
gctgggatcgcaggca

SEQ ID NO: 110737 - DNA, 16 bp, H. sapiens
gctgggatgacagcca

SEQ ID NO: 110738 - DNA, 16 bp, H. sapiens
gctgggatgacaggcg

SEQ ID NO: 110739 - DNA, 22 bp, H. sapiens
gctgggatgcaaggctggttca

SEQ ID NO: 110740 - DNA, 17 bp, H. sapiens
gctgggattacagatgc

SEQ ID NO: 110741 - DNA, 16 bp, H. sapiens
gctgggattacagttg

SEQ ID NO: 110742 - DNA, 16 bp, H. sapiens
gctgggattacataca

SEQ ID NO: 110743 - DNA, 16 bp, H. sapiens
gctgggattacatatg

SEQ ID NO: 110744 - DNA, 19 bp, H. sapiens
gctgggattacatgcatgc

SEQ ID NO: 110745 - DNA, 16 bp, H. sapiens
gctgggattacctgca

SEQ ID NO: 110746 - DNA, 16 bp, H. sapiens
gctgggattactggtg

SEQ ID NO: 110747 - DNA, 16 bp, H. sapiens
gctgggattatgggtg

SEQ ID NO: 110748 - DNA, 16 bp, H. sapiens
gctgggattcaaaccc

SEQ ID NO: 110749 - DNA, 16 bp, H. sapiens
gctgggattccaagtg

SEQ ID NO: 110750 - DNA, 16 bp, H. sapiens
gctgggattccaggca

SEQ ID NO: 110751 - DNA, 16 bp, H. sapiens
gctgggattgcaggtg

SEQ ID NO: 110752 - DNA, 16 bp, H. sapiens
gctgggattgtaggtg

SEQ ID NO: 110753 - DNA, 16 bp, H. sapiens
gctgggatttgaacca

SEQ ID NO: 110754 - DNA, 17 bp, H. sapiens
gctgggcaacatggtga

SEQ ID NO: 110755 - DNA, 16 bp, H. sapiens
gctgggcaagatggct

SEQ ID NO: 110756 - DNA, 16 bp, H. sapiens
gctgggcaaggtggct

SEQ ID NO: 110757 - DNA, 16 bp, H. sapiens
gctgggcaaggtggtg

SEQ ID NO: 110758 - DNA, 16 bp, H. sapiens
gctgggcacagaggag

SEQ ID NO: 110759 - DNA, 16 bp, H. sapiens
gctgggcacagtggca

SEQ ID NO: 110760 - DNA, 16 bp, H. sapiens
gctgggcacagttgct

SEQ ID NO: 110761 - DNA, 16 bp, H. sapiens
gctgggcaccatggct

SEQ ID NO: 110762 - DNA, 16 bp, H. sapiens
gctgggcacggtagca

SEQ ID NO: 110763 - DNA, 16 bp, H. sapiens
gctgggcacggtggcc

SEQ ID NO: 110764 - DNA, 16 bp, H. sapiens
gctgggcacggtggtg

SEQ ID NO: 110765 - DNA, 16 bp, H. sapiens
gctgggcactgtggtg

SEQ ID NO: 110766 - DNA, 16 bp, H. sapiens
gctgggcactgttcta

SEQ ID NO: 110767 - DNA, 16 bp, H. sapiens
gctgggcagaggtgct

SEQ ID NO: 110768 - DNA, 16 bp, H. sapiens
gctgggcagagtggct

SEQ ID NO: 110769 - DNA, 16 bp, H. sapiens
gctgggcagcagagca

SEQ ID NO: 110770 - DNA, 16 bp, H. sapiens
gctgggcaggaggatg

SEQ ID NO: 110771 - DNA, 16 bp, H. sapiens
gctgggcaggctgggc

SEQ ID NO: 110772 - DNA, 16 bp, H. sapiens
gctgggcagggcctgg

SEQ ID NO: 110773 - DNA, 16 bp, H. sapiens
gctgggcagggctggg

SEQ ID NO: 110774 - DNA, 16 bp, H. sapiens
gctgggcagggggctg

SEQ ID NO: 110775 - DNA, 16 bp, H. sapiens
gctgggcatcatggcg

SEQ ID NO: 110776 - DNA, 16 bp, H. sapiens
gctgggcatgcctgta

SEQ ID NO: 110777 - DNA, 16 bp, H. sapiens
gctgggcatgctggcg

SEQ ID NO: 110778 - DNA, 16 bp, H. sapiens
gctgggcatggaggcg

SEQ ID NO: 110779 - DNA, 16 bp, H. sapiens
gctgggcatggcagca

SEQ ID NO: 110780 - DNA, 16 bp, H. sapiens
gctgggcatgggggtg

SEQ ID NO: 110781 - DNA, 16 bp, H. sapiens
gctgggcatggtggca

SEQ ID NO: 110782 - DNA, 16 bp, H. sapiens
gctgggcatggtggct

SEQ ID NO: 110783 - DNA, 16 bp, H. sapiens
gctgggcatggtgttg

SEQ ID NO: 110784 - DNA, 16 bp, H. sapiens
gctgggcattgtggct

SEQ ID NO: 110785 - DNA, 16 bp, H. sapiens
gctgggcattgtggtg

SEQ ID NO: 110786 - DNA, 16 bp, H. sapiens
gctgggccacagagca

SEQ ID NO: 110787 - DNA, 16 bp, H. sapiens
gctgggccaggctggg

SEQ ID NO: 110788 - DNA, 16 bp, H. sapiens
gctgggccatcttgaa

SEQ ID NO: 110789 - DNA, 16 bp, H. sapiens
gctgggcccagcaata

SEQ ID NO: 110790 - DNA, 16 bp, H. sapiens
gctgggcccaggctgg

SEQ ID NO: 110791 - DNA, 16 bp, H. sapiens
gctgggcccagggccc

SEQ ID NO: 110792 - DNA, 16 bp, H. sapiens
gctgggcccagtggct

SEQ ID NO: 110793 - DNA, 16 bp, H. sapiens
gctgggccccaccccc

SEQ ID NO: 110794 - DNA, 16 bp, H. sapiens
gctgggccccacctcc

SEQ ID NO: 110795 - DNA, 16 bp, H. sapiens
gctgggccgggcgcag

SEQ ID NO: 110796 - DNA, 16 bp, H. sapiens
gctgggcctgcagagg

SEQ ID NO: 110797 - DNA, 16 bp, H. sapiens
gctgggcctgcaggtg

SEQ ID NO: 110798 - DNA, 16 bp, H. sapiens
gctgggcctggactcc

SEQ ID NO: 110799 - DNA, 16 bp, H. sapiens
gctgggcctggagagg

SEQ ID NO: 110800 - DNA, 16 bp, H. sapiens
gctgggcctggggctg

SEQ ID NO: 110801 - DNA, 16 bp, H. sapiens
gctgggcctgggggac

SEQ ID NO: 110802 - DNA, 16 bp, H. sapiens
gctgggcctggtgatg

SEQ ID NO: 110803 - DNA, 16 bp, H. sapiens
gctgggcctggtggcc

SEQ ID NO: 110804 - DNA, 16 bp, H. sapiens
gctgggcctggtggtg

SEQ ID NO: 110805 - DNA, 16 bp, H. sapiens
gctgggcgaggtggca

SEQ ID NO: 110806 - DNA, 16 bp, H. sapiens
gctgggcgcagtggca

SEQ ID NO: 110807 - DNA, 16 bp, H. sapiens
gctgggcgcggtggca

SEQ ID NO: 110808 - DNA, 16 bp, H. sapiens
gctgggcgctgtggct

SEQ ID NO: 110809 - DNA, 16 bp, H. sapiens
gctgggcgtgctggca

SEQ ID NO: 110810 - DNA, 16 bp, H. sapiens
gctgggcgtggaggtg

SEQ ID NO: 110811 - DNA, 19 bp, H. sapiens
gctgggctcaagcaatcct

SEQ ID NO: 110812 - DNA, 16 bp, H. sapiens
gctgggctcagctggg

SEQ ID NO: 110813 - DNA, 16 bp, H. sapiens
gctgggctcagggtcc

SEQ ID NO: 110814 - DNA, 16 bp, H. sapiens
gctgggctcagtgggg

SEQ ID NO: 110815 - DNA, 16 bp, H. sapiens
gctgggctccatggct

SEQ ID NO: 110816 - DNA, 16 bp, H. sapiens
gctgggctccatggga

SEQ ID NO: 110817 - DNA, 16 bp, H. sapiens
gctgggctcctgagtg

SEQ ID NO: 110818 - DNA, 16 bp, H. sapiens
gctgggctctgtgctg

SEQ ID NO: 110819 - DNA, 16 bp, H. sapiens
gctgggctgctgggct

SEQ ID NO: 110820 - DNA, 16 bp, H. sapiens
gctgggctggaggagg

SEQ ID NO: 110821 - DNA, 16 bp, H. sapiens
gctgggctgggcacag

SEQ ID NO: 110822 - DNA, 16 bp, H. sapiens
gctgggctgggctcag

SEQ ID NO: 110823 - DNA, 16 bp, H. sapiens
gctgggctggtggtgc

SEQ ID NO: 110824 - DNA, 16 bp, H. sapiens
gctgggcttataggtg

SEQ ID NO: 110825 - DNA, 16 bp, H. sapiens
gctgggcttgaacttc

SEQ ID NO: 110826 - DNA, 16 bp, H. sapiens
gctgggcttggcttta

SEQ ID NO: 110827 - DNA, 16 bp, H. sapiens
gctgggcttggtggct

SEQ ID NO: 110828 - DNA, 16 bp, H. sapiens
gctggggaagcctcag

SEQ ID NO: 110829 - DNA, 16 bp, H. sapiens
gctggggaaggaggca

SEQ ID NO: 110830 - DNA, 16 bp, H. sapiens
gctggggaaggcagat

SEQ ID NO: 110831 - DNA, 16 bp, H. sapiens
gctggggacagagcag

SEQ ID NO: 110832 - DNA, 16 bp, H. sapiens
gctggggagacctcaa

SEQ ID NO: 110833 - DNA, 16 bp, H. sapiens
gctggggagacctcag

SEQ ID NO: 110834 - DNA, 16 bp, H. sapiens
gctggggagagaggga

SEQ ID NO: 110835 - DNA, 16 bp, H. sapiens
gctggggagctgggga

SEQ ID NO: 110836 - DNA, 16 bp, H. sapiens
gctggggaggagagga

SEQ ID NO: 110837 - DNA, 16 bp, H. sapiens
gctggggaggagctgg

SEQ ID NO: 110838 - DNA, 16 bp, H. sapiens
gctggggaggaggcag

SEQ ID NO: 110839 - DNA, 16 bp, H. sapiens
gctggggaggccacac

SEQ ID NO: 110840 - DNA, 16 bp, H. sapiens
gctggggaggccacag

SEQ ID NO: 110841 - DNA, 16 bp, H. sapiens
gctggggaggcctccg

SEQ ID NO: 110842 - DNA, 16 bp, H. sapiens
gctggggaggctgaag

SEQ ID NO: 110843 - DNA, 16 bp, H. sapiens
gctggggaggcttcac

SEQ ID NO: 110844 - DNA, 16 bp, H. sapiens
gctggggagggaagga

SEQ ID NO: 110845 - DNA, 16 bp, H. sapiens
gctggggagggagaga

SEQ ID NO: 110846 - DNA, 16 bp, H. sapiens
gctggggagggaggcc

SEQ ID NO: 110847 - DNA, 16 bp, H. sapiens
gctggggatggtggtg

SEQ ID NO: 110848 - DNA, 16 bp, H. sapiens
gctggggcagaaggat

SEQ ID NO: 110849 - DNA, 16 bp, H. sapiens
gctggggcagccaagg

SEQ ID NO: 110850 - DNA, 16 bp, H. sapiens
gctggggcaggagact

SEQ ID NO: 110851 - DNA, 16 bp, H. sapiens
gctggggcaggcagat

SEQ ID NO: 110852 - DNA, 16 bp, H. sapiens
gctggggccaggcatg

SEQ ID NO: 110853 - DNA, 16 bp, H. sapiens
gctggggccagggagg

SEQ ID NO: 110854 - DNA, 16 bp, H. sapiens
gctggggccagggctg

SEQ ID NO: 110855 - DNA, 16 bp, H. sapiens
gctggggctgcagcca

SEQ ID NO: 110856 - DNA, 16 bp, H. sapiens
gctggggctgcatgct

SEQ ID NO: 110857 - DNA, 16 bp, H. sapiens
gctggggctggagcag

SEQ ID NO: 110858 - DNA, 16 bp, H. sapiens
gctggggctggaggag

SEQ ID NO: 110859 - DNA, 16 bp, H. sapiens
gctggggctggggaag

SEQ ID NO: 110860 - DNA, 16 bp, H. sapiens
gctggggctggggcag

SEQ ID NO: 110861 - DNA, 16 bp, H. sapiens
gctgggggacccagtg

SEQ ID NO: 110862 - DNA, 16 bp, H. sapiens
gctgggggacctggtg

SEQ ID NO: 110863 - DNA, 16 bp, H. sapiens
gctgggggaggaggaa

SEQ ID NO: 110864 - DNA, 16 bp, H. sapiens
gctgggggagggataa

SEQ ID NO: 110865 - DNA, 16 bp, H. sapiens
gctgggggaggtggct

SEQ ID NO: 110866 - DNA, 16 bp, H. sapiens
gctgggggcaggggaa

SEQ ID NO: 110867 - DNA, 16 bp, H. sapiens
gctgggggccaggctg

SEQ ID NO: 110868 - DNA, 16 bp, H. sapiens
gctgggggctgacccc

SEQ ID NO: 110869 - DNA, 16 bp, H. sapiens
gctgggggctgggcag

SEQ ID NO: 110870 - DNA, 16 bp, H. sapiens
gctggggtcattcact

SEQ ID NO: 110871 - DNA, 16 bp, H. sapiens
gctggggtgacaggca

SEQ ID NO: 110872 - DNA, 16 bp, H. sapiens
gctggggtgattgacc

SEQ ID NO: 110873 - DNA, 16 bp, H. sapiens
gctggggtgcaggggt

SEQ ID NO: 110874 - DNA, 16 bp, H. sapiens
gctggggttccaggca

SEQ ID NO: 110875 - DNA, 16 bp, H. sapiens
gctgggtaaaatgagg

SEQ ID NO: 110876 - DNA, 16 bp, H. sapiens
gctgggtatggtgact

SEQ ID NO: 110877 - DNA, 16 bp, H. sapiens
gctgggtatggtggcg

SEQ ID NO: 110878 - DNA, 16 bp, H. sapiens
gctgggtcaagtgata

SEQ ID NO: 110879 - DNA, 16 bp, H. sapiens
gctgggtctacaggca

SEQ ID NO: 110880 - DNA, 16 bp, H. sapiens
gctgggtctggtggca

SEQ ID NO: 110881 - DNA, 16 bp, H. sapiens
gctgggtctggtggcg

SEQ ID NO: 110882 - DNA, 16 bp, H. sapiens
gctgggtgactttggg

SEQ ID NO: 110883 - DNA, 16 bp, H. sapiens
gctgggtgcagaggct

SEQ ID NO: 110884 - DNA, 16 bp, H. sapiens
gctgggtgcagtagct

SEQ ID NO: 110885 - DNA, 16 bp, H. sapiens
gctgggtgcagtgatt

SEQ ID NO: 110886 - DNA, 16 bp, H. sapiens
gctgggtgcctctggc

SEQ ID NO: 110887 - DNA, 16 bp, H. sapiens
gctgggtgcctgtaat

SEQ ID NO: 110888 - DNA, 16 bp, H. sapiens
gctgggtgcggcggct

SEQ ID NO: 110889 - DNA, 16 bp, H. sapiens
gctgggtgcggtggta

SEQ ID NO: 110890 - DNA, 16 bp, H. sapiens
gctgggtgctgggaga

SEQ ID NO: 110891 - DNA, 16 bp, H. sapiens
gctgggtggagaatga

SEQ ID NO: 110892 - DNA, 16 bp, H. sapiens
gctgggtggaggggct

SEQ ID NO: 110893 - DNA, 16 bp, H. sapiens
gctgggtggagtggct

SEQ ID NO: 110894 - DNA, 16 bp, H. sapiens
gctgggtggccctggg

SEQ ID NO: 110895 - DNA, 16 bp, H. sapiens
gctgggtggctgcagc

SEQ ID NO: 110896 - DNA, 16 bp, H. sapiens
gctgggtgtcatggca

SEQ ID NO: 110897 - DNA, 16 bp, H. sapiens
gctgggtgtgatggct

SEQ ID NO: 110898 - DNA, 16 bp, H. sapiens
gctgggtgtgcacaca

SEQ ID NO: 110899 - DNA, 16 bp, H. sapiens
gctgggtgtgctggct

SEQ ID NO: 110900 - DNA, 16 bp, H. sapiens
gctgggtgtggcggct

SEQ ID NO: 110901 - DNA, 16 bp, H. sapiens
gctgggtgtggtagct

SEQ ID NO: 110902 - DNA, 16 bp, H. sapiens
gctgggtgtggtggcc

SEQ ID NO: 110903 - DNA, 16 bp, H. sapiens
gctgggtgtggtgtca

SEQ ID NO: 110904 - DNA, 16 bp, H. sapiens
gctgggttaaatggta

SEQ ID NO: 110905 - DNA, 16 bp, H. sapiens
gctgggttgcccaggc

SEQ ID NO: 110906 - DNA, 16 bp, H. sapiens
gctgggtttacagaca

SEQ ID NO: 110907 - DNA, 16 bp, H. sapiens
gctggtacctgaagcc

SEQ ID NO: 110908 - DNA, 16 bp, H. sapiens
gctggtactacaggca

SEQ ID NO: 110909 - DNA, 16 bp, H. sapiens
gctggtataaaaacag

SEQ ID NO: 110910 - DNA, 16 bp, H. sapiens
gctggtattacaagca

SEQ ID NO: 110911 - DNA, 16 bp, H. sapiens
gctggtattgatgact

SEQ ID NO: 110912 - DNA, 16 bp, H. sapiens
gctggtcagctgtgcc

SEQ ID NO: 110913 - DNA, 16 bp, H. sapiens
gctggtcagtggcaga

SEQ ID NO: 110914 - DNA, 16 bp, H. sapiens
gctggtcatggtggcg

SEQ ID NO: 110915 - DNA, 16 bp, H. sapiens
gctggtcccctgggcc

SEQ ID NO: 110916 - DNA, 16 bp, H. sapiens
gctggtccctccattt

SEQ ID NO: 110917 - DNA, 16 bp, H. sapiens
gctggtcctggactcc

SEQ ID NO: 110918 - DNA, 16 bp, H. sapiens
gctggtctcatactcc

SEQ ID NO: 110919 - DNA, 16 bp, H. sapiens
gctggtctccaatttc

SEQ ID NO: 110920 - DNA, 16 bp, H. sapiens
gctggtctctctgctt

SEQ ID NO: 110921 - DNA, 16 bp, H. sapiens
gctggtcttgcactcc

SEQ ID NO: 110922 - DNA, 16 bp, H. sapiens
gctggtcttgggctcc

SEQ ID NO: 110923 - DNA, 16 bp, H. sapiens
gctggtgaaaaggaca

SEQ ID NO: 110924 - DNA, 16 bp, H. sapiens
gctggtgaagctgcag

SEQ ID NO: 110925 - DNA, 16 bp, H. sapiens
gctggtgagattgcag

SEQ ID NO: 110926 - DNA, 16 bp, H. sapiens
gctggtgaggacatgg

SEQ ID NO: 110927 - DNA, 16 bp, H. sapiens
gctggtgaggctgcag

SEQ ID NO: 110928 - DNA, 16 bp, H. sapiens
gctggtgagggtgtgg

SEQ ID NO: 110929 - DNA, 16 bp, H. sapiens
gctggtgatgaattct

SEQ ID NO: 110930 - DNA, 16 bp, H. sapiens
gctggtgccagggaga

SEQ ID NO: 110931 - DNA, 16 bp, H. sapiens
gctggtgcccctctgg

SEQ ID NO: 110932 - DNA, 16 bp, H. sapiens
gctggtggtggtgatg

SEQ ID NO: 110933 - DNA, 16 bp, H. sapiens
gctggtgtctgctgct

SEQ ID NO: 110934 - DNA, 16 bp, H. sapiens
gctggtgttgagtgtc

SEQ ID NO: 110935 - DNA, 16 bp, H. sapiens
gctggttatggtggtg

SEQ ID NO: 110936 - DNA, 16 bp, H. sapiens
gctggttcttcctcat

SEQ ID NO: 110937 - DNA, 16 bp, H. sapiens
gctgtaaagaaatgcc

SEQ ID NO: 110938 - DNA, 16 bp, H. sapiens
gctgtaaatttctctc

SEQ ID NO: 110939 - DNA, 16 bp, H. sapiens
gctgtaattttgtatc

SEQ ID NO: 110940 - DNA, 16 bp, H. sapiens
gctgtacaccctgtga

SEQ ID NO: 110941 - DNA, 16 bp, H. sapiens
gctgtaccttggctcc

SEQ ID NO: 110942 - DNA, 16 bp, H. sapiens
gctgtactggaagcat

SEQ ID NO: 110943 - DNA, 16 bp, H. sapiens
gctgtagctcacacct

SEQ ID NO: 110944 - DNA, 16 bp, H. sapiens
gctgtaggactgaggt

SEQ ID NO: 110945 - DNA, 16 bp, H. sapiens
gctgtagtgcaatggt

SEQ ID NO: 110946 - DNA, 16 bp, H. sapiens
gctgtagtgcagtggt

SEQ ID NO: 110947 - DNA, 16 bp, H. sapiens
gctgtcagagagggac

SEQ ID NO: 110948 - DNA, 16 bp, H. sapiens
gctgtcatgcttcctg

SEQ ID NO: 110949 - DNA, 16 bp, H. sapiens
gctgtccacatgcaca

SEQ ID NO: 110950 - DNA, 16 bp, H. sapiens
gctgtccatggacagc

SEQ ID NO: 110951 - DNA, 16 bp, H. sapiens
gctgtccgcggtgctg

SEQ ID NO: 110952 - DNA, 16 bp, H. sapiens
gctgtccgtggtgctg

SEQ ID NO: 110953 - DNA, 16 bp, H. sapiens
gctgtcctgggccaca

SEQ ID NO: 110954 - DNA, 16 bp, H. sapiens
gctgtcctttgtgggg

SEQ ID NO: 110955 - DNA, 16 bp, H. sapiens
gctgtctcaaaaaaaa

SEQ ID NO: 110956 - DNA, 16 bp, H. sapiens
gctgtctcagcctccc

SEQ ID NO: 110957 - DNA, 16 bp, H. sapiens
gctgtctgactccaga

SEQ ID NO: 110958 - DNA, 16 bp, H. sapiens
gctgtctgcaagccag

SEQ ID NO: 110959 - DNA, 16 bp, H. sapiens
gctgtctgcaagctaa

SEQ ID NO: 110960 - DNA, 16 bp, H. sapiens
gctgtctgggagccag

SEQ ID NO: 110961 - DNA, 16 bp, H. sapiens
gctgtctgtctgtctg

SEQ ID NO: 110962 - DNA, 16 bp, H. sapiens
gctgtcttctccctgt

SEQ ID NO: 110963 - DNA, 16 bp, H. sapiens
gctgtgaaaagagggc

SEQ ID NO: 110964 - DNA, 16 bp, H. sapiens
gctgtgaagaaactgc

SEQ ID NO: 110965 - DNA, 16 bp, H. sapiens
gctgtgaagaagctct

SEQ ID NO: 110966 - DNA, 16 bp, H. sapiens
gctgtgaaggccctga

SEQ ID NO: 110967 - DNA, 16 bp, H. sapiens
gctgtgaaggtatttt

SEQ ID NO: 110968 - DNA, 16 bp, H. sapiens
gctgtgaatacaggca

SEQ ID NO: 110969 - DNA, 16 bp, H. sapiens
gctgtgaatacatctg

SEQ ID NO: 110970 - DNA, 16 bp, H. sapiens
gctgtgaatatttgtg

SEQ ID NO: 110971 - DNA, 16 bp, H. sapiens
gctgtgaatccaactg

SEQ ID NO: 110972 - DNA, 16 bp, H. sapiens
gctgtgaatccagctg

SEQ ID NO: 110973 - DNA, 23 bp, H. sapiens
gctgtgaatccatctggtcctgg

SEQ ID NO: 110974 - DNA, 16 bp, H. sapiens
gctgtgaatgacagga

SEQ ID NO: 110975 - DNA, 16 bp, H. sapiens
gctgtgaatttgtcat

SEQ ID NO: 110976 - DNA, 16 bp, H. sapiens
gctgtgacagacagca

SEQ ID NO: 110977 - DNA, 16 bp, H. sapiens
gctgtgaccatgccac

SEQ ID NO: 110978 - DNA, 16 bp, H. sapiens
gctgtgactacaggtg

SEQ ID NO: 110979 - DNA, 16 bp, H. sapiens
gctgtgactgcatcac

SEQ ID NO: 110980 - DNA, 16 bp, H. sapiens
gctgtgagcccagatc

SEQ ID NO: 110981 - DNA, 16 bp, H. sapiens
gctgtgagtgttacag

SEQ ID NO: 110982 - DNA, 16 bp, H. sapiens
gctgtgataactggct

SEQ ID NO: 110983 - DNA, 16 bp, H. sapiens
gctgtgatcacagctc

SEQ ID NO: 110984 - DNA, 16 bp, H. sapiens
gctgtgatgaacacat

SEQ ID NO: 110985 - DNA, 16 bp, H. sapiens
gctgtgatggagccac

SEQ ID NO: 110986 - DNA, 16 bp, H. sapiens
gctgtgcaaccttggg

SEQ ID NO: 110987 - DNA, 16 bp, H. sapiens
gctgtgcacatattgt

SEQ ID NO: 110988 - DNA, 16 bp, H. sapiens
gctgtgcactgcacaa

SEQ ID NO: 110989 - DNA, 16 bp, H. sapiens
gctgtgcagaaactct

SEQ ID NO: 110990 - DNA, 16 bp, H. sapiens
gctgtgcagcccagtt

SEQ ID NO: 110991 - DNA, 16 bp, H. sapiens
gctgtgcagcctggag

SEQ ID NO: 110992 - DNA, 16 bp, H. sapiens
gctgtgcaggcagctg

SEQ ID NO: 110993 - DNA, 16 bp, H. sapiens
gctgtgctctccctct

SEQ ID NO: 110994 - DNA, 16 bp, H. sapiens
gctgtgctgcactgtg

SEQ ID NO: 110995 - DNA, 16 bp, H. sapiens
gctgtgctgcctgttg

SEQ ID NO: 110996 - DNA, 16 bp, H. sapiens
gctgtgctgctggcct

SEQ ID NO: 110997 - DNA, 16 bp, H. sapiens
gctgtgctggaggggc

SEQ ID NO: 110998 - DNA, 16 bp, H. sapiens
gctgtgctggatttct

SEQ ID NO: 110999 - DNA, 16 bp, H. sapiens
gctgtgctggcagcca

SEQ ID NO: 111000 - DNA, 16 bp, H. sapiens
gctgtgctggcagctg

SEQ ID NO: 111001 - DNA, 16 bp, H. sapiens
gctgtgctgggaggtc

SEQ ID NO: 111002 - DNA, 16 bp, H. sapiens
gctgtgctgggctcag

SEQ ID NO: 111003 - DNA, 16 bp, H. sapiens
gctgtgctgggctcca

SEQ ID NO: 111004 - DNA, 16 bp, H. sapiens
gctgtgctgggctggg

SEQ ID NO: 111005 - DNA, 16 bp, H. sapiens
gctgtgctgtgctgtg

SEQ ID NO: 111006 - DNA, 16 bp, H. sapiens
gctgtgcttcctgtac

SEQ ID NO: 111007 - DNA, 16 bp, H. sapiens
gctgtggaagctcagg

SEQ ID NO: 111008 - DNA, 16 bp, H. sapiens
gctgtggaagctttgt

SEQ ID NO: 111009 - DNA, 16 bp, H. sapiens
gctgtggaccagtacc

SEQ ID NO: 111010 - DNA, 16 bp, H. sapiens
gctgtggacctgggca

SEQ ID NO: 111011 - DNA, 16 bp, H. sapiens
gctgtggagaagctct

SEQ ID NO: 111012 - DNA, 16 bp, H. sapiens
gctgtggaggctgagg

SEQ ID NO: 111013 - DNA, 16 bp, H. sapiens
gctgtggagtgcagtg

SEQ ID NO: 111014 - DNA, 16 bp, H. sapiens
gctgtggcaggcagat

SEQ ID NO: 111015 - DNA, 16 bp, H. sapiens
gctgtggcagtttctc

SEQ ID NO: 111016 - DNA, 16 bp, H. sapiens
gctgtggcccatgcct

SEQ ID NO: 111017 - DNA, 16 bp, H. sapiens
gctgtggcccttcagg

SEQ ID NO: 111018 - DNA, 16 bp, H. sapiens
gctgtggcgggcgcct

SEQ ID NO: 111019 - DNA, 16 bp, H. sapiens
gctgtggctcctgcct

SEQ ID NO: 111020 - DNA, 16 bp, H. sapiens
gctgtggctgctgctg

SEQ ID NO: 111021 - DNA, 16 bp, H. sapiens
gctgtggctgctgtgg

SEQ ID NO: 111022 - DNA, 16 bp, H. sapiens
gctgtggctggagctg

SEQ ID NO: 111023 - DNA, 16 bp, H. sapiens
gctgtggcttcagagg

SEQ ID NO: 111024 - DNA, 16 bp, H. sapiens
gctgtgggaggcaggc

SEQ ID NO: 111025 - DNA, 16 bp, H. sapiens
gctgtgggaggccaag

SEQ ID NO: 111026 - DNA, 16 bp, H. sapiens
gctgtgggcagggctg

SEQ ID NO: 111027 - DNA, 16 bp, H. sapiens
gctgtgggcctggggc

SEQ ID NO: 111028 - DNA, 16 bp, H. sapiens
gctgtgggctgtgggc

SEQ ID NO: 111029 - DNA, 16 bp, H. sapiens
gctgtggtgactttaa

SEQ ID NO: 111030 - DNA, 16 bp, H. sapiens
gctgtggtggccatgg

SEQ ID NO: 111031 - DNA, 16 bp, H. sapiens
gctgtggtttcaatgt

SEQ ID NO: 111032 - DNA, 16 bp, H. sapiens
gctgtggtttcagagg

SEQ ID NO: 111033 - DNA, 16 bp, H. sapiens
gctgtgtaacaaatca

SEQ ID NO: 111034 - DNA, 16 bp, H. sapiens
gctgtgtaaccttggg

SEQ ID NO: 111035 - DNA, 16 bp, H. sapiens
gctgtgtaatattcca

SEQ ID NO: 111036 - DNA, 16 bp, H. sapiens
gctgtgtagaaacttt

SEQ ID NO: 111037 - DNA, 16 bp, H. sapiens
gctgtgtcaccaggct

SEQ ID NO: 111038 - DNA, 16 bp, H. sapiens
gctgtgtcccccaggc

SEQ ID NO: 111039 - DNA, 16 bp, H. sapiens
gctgtgtgacattggg

SEQ ID NO: 111040 - DNA, 16 bp, H. sapiens
gctgtgtgaccctgag

SEQ ID NO: 111041 - DNA, 16 bp, H. sapiens
gctgtgtgaccctggg

SEQ ID NO: 111042 - DNA, 16 bp, H. sapiens
gctgtgtgacctcaga

SEQ ID NO: 111043 - DNA, 16 bp, H. sapiens
gctgtgtgacctgggg

SEQ ID NO: 111044 - DNA, 16 bp, H. sapiens
gctgtgtgacctggtt

SEQ ID NO: 111045 - DNA, 16 bp, H. sapiens
gctgtgtgaccttcag

SEQ ID NO: 111046 - DNA, 16 bp, H. sapiens
gctgtgtgaccttgga

SEQ ID NO: 111047 - DNA, 16 bp, H. sapiens
gctgtgtgaccttggg

SEQ ID NO: 111048 - DNA, 16 bp, H. sapiens
gctgtgtgacctttga

SEQ ID NO: 111049 - DNA, 16 bp, H. sapiens
gctgtgtgactctgga

SEQ ID NO: 111050 - DNA, 16 bp, H. sapiens
gctgtgtgactttgag

SEQ ID NO: 111051 - DNA, 16 bp, H. sapiens
gctgtgtgactttgga

SEQ ID NO: 111052 - DNA, 16 bp, H. sapiens
gctgtgtgagcttggg

SEQ ID NO: 111053 - DNA, 16 bp, H. sapiens
gctgtgtgatcctgga

SEQ ID NO: 111054 - DNA, 16 bp, H. sapiens
gctgtgtgatcttgag

SEQ ID NO: 111055 - DNA, 16 bp, H. sapiens
gctgtgtgcagtggct

SEQ ID NO: 111056 - DNA, 16 bp, H. sapiens
gctgtgtgccaagcac

SEQ ID NO: 111057 - DNA, 16 bp, H. sapiens
gctgtgtgccaccaca

SEQ ID NO: 111058 - DNA, 16 bp, H. sapiens
gctgtgtgccaggcac

SEQ ID NO: 111059 - DNA, 16 bp, H. sapiens
gctgtgtgcctggggg

SEQ ID NO: 111060 - DNA, 16 bp, H. sapiens
gctgtgtgctgggcac

SEQ ID NO: 111061 - DNA, 16 bp, H. sapiens
gctgtgtggaactgtg

SEQ ID NO: 111062 - DNA, 16 bp, H. sapiens
gctgtgtggagaatgg

SEQ ID NO: 111063 - DNA, 16 bp, H. sapiens
gctgtgtggccctggg

SEQ ID NO: 111064 - DNA, 16 bp, H. sapiens
gctgtgtggcctcaga

SEQ ID NO: 111065 - DNA, 16 bp, H. sapiens
gctgtgtggccttggg

SEQ ID NO: 111066 - DNA, 16 bp, H. sapiens
gctgtgtgtccctggg

SEQ ID NO: 111067 - DNA, 16 bp, H. sapiens
gctgtgttagccagga

SEQ ID NO: 111068 - DNA, 16 bp, H. sapiens
gctgtgttccaacaaa

SEQ ID NO: 111069 - DNA, 16 bp, H. sapiens
gctgtgttccaatgaa

SEQ ID NO: 111070 - DNA, 16 bp, H. sapiens
gctgtgttgcacaggc

SEQ ID NO: 111071 - DNA, 16 bp, H. sapiens
gctgtgttgccagggc

SEQ ID NO: 111072 - DNA, 16 bp, H. sapiens
gctgtgttggctgggc

SEQ ID NO: 111073 - DNA, 16 bp, H. sapiens
gctgtgtttcccaggc

SEQ ID NO: 111074 - DNA, 16 bp, H. sapiens
gctgttatgaagaaat

SEQ ID NO: 111075 - DNA, 16 bp, H. sapiens
gctgttatgaggatta

SEQ ID NO: 111076 - DNA, 16 bp, H. sapiens
gctgttatttaaaaaa

SEQ ID NO: 111077 - DNA, 16 bp, H. sapiens
gctgttattttaaaaa

SEQ ID NO: 111078 - DNA, 16 bp, H. sapiens
gctgttcaggaagctg

SEQ ID NO: 111079 - DNA, 16 bp, H. sapiens
gctgttccagtctgtc

SEQ ID NO: 111080 - DNA, 16 bp, H. sapiens
gctgttccctctgcca

SEQ ID NO: 111081 - DNA, 16 bp, H. sapiens
gctgttccctttgcct

SEQ ID NO: 111082 - DNA, 16 bp, H. sapiens
gctgttctcaagctcc

SEQ ID NO: 111083 - DNA, 16 bp, H. sapiens
gctgttctcttgacag

SEQ ID NO: 111084 - DNA, 16 bp, H. sapiens
gctgttctgcagcctc

SEQ ID NO: 111085 - DNA, 16 bp, H. sapiens
gctgttctgcagtctc

SEQ ID NO: 111086 - DNA, 16 bp, H. sapiens
gctgttctggaggctg

SEQ ID NO: 111087 - DNA, 16 bp, H. sapiens
gctgttgaattttgtt

SEQ ID NO: 111088 - DNA, 16 bp, H. sapiens
gctgttgctgctgcta

SEQ ID NO: 111089 - DNA, 16 bp, H. sapiens
gctgttggctgtgctg

SEQ ID NO: 111090 - DNA, 16 bp, H. sapiens
gctgttgggcacacct

SEQ ID NO: 111091 - DNA, 16 bp, H. sapiens
gctgttggggaagagg

SEQ ID NO: 111092 - DNA, 16 bp, H. sapiens
gctgttgtgaagagtg

SEQ ID NO: 111093 - DNA, 16 bp, H. sapiens
gctgttgtgcagcctc

SEQ ID NO: 111094 - DNA, 16 bp, H. sapiens
gctgttgttgctgctg

SEQ ID NO: 111095 - DNA, 16 bp, H. sapiens
gctgttgttttaagct

SEQ ID NO: 111096 - DNA, 24 bp, H. sapiens
gctgtttatttcacctgggtgcag

SEQ ID NO: 111097 - DNA, 25 bp, H. sapiens
gctgtttatttcacctgggtgcagg

SEQ ID NO: 111098 - DNA, 16 bp, H. sapiens
gctgtttcctctgcct

SEQ ID NO: 111099 - DNA, 16 bp, H. sapiens
gctgtttcctcttcct

SEQ ID NO: 111100 - DNA, 16 bp, H. sapiens
gctgtttctacttttt

SEQ ID NO: 111101 - DNA, 16 bp, H. sapiens
gctgtttctagttttt

SEQ ID NO: 111102 - DNA, 16 bp, H. sapiens
gctgttttggttacag

SEQ ID NO: 111103 - DNA, 16 bp, H. sapiens
gctgttttttaaggaa

SEQ ID NO: 111104 - DNA, 16 bp, H. sapiens
gcttaaaacctaaatg

SEQ ID NO: 111105 - DNA, 16 bp, H. sapiens
gcttaaaatattcaat

SEQ ID NO: 111106 - DNA, 16 bp, H. sapiens
gcttaaacccaggagg

SEQ ID NO: 111107 - DNA, 16 bp, H. sapiens
gcttaaacctgggaga

SEQ ID NO: 111108 - DNA, 16 bp, H. sapiens
gcttaaacctgggagg

SEQ ID NO: 111109 - DNA, 16 bp, H. sapiens
gcttaaactcgggagg

SEQ ID NO: 111110 - DNA, 16 bp, H. sapiens
gcttaaatccaggagg

SEQ ID NO: 111111 - DNA, 16 bp, H. sapiens
gcttaaatctgggagg

SEQ ID NO: 111112 - DNA, 16 bp, H. sapiens
gcttaagattgtcttg

SEQ ID NO: 111113 - DNA, 16 bp, H. sapiens
gcttaagcccaggagg

SEQ ID NO: 111114 - DNA, 16 bp, H. sapiens
gcttaagcctgggagg

SEQ ID NO: 111115 - DNA, 16 bp, H. sapiens
gcttaaggaaataaaa

SEQ ID NO: 111116 - DNA, 16 bp, H. sapiens
gcttaatacctgggag

SEQ ID NO: 111117 - DNA, 16 bp, H. sapiens
gcttaatttttttaaa

SEQ ID NO: 111118 - DNA, 16 bp, H. sapiens
gcttacattccagtgg

SEQ ID NO: 111119 - DNA, 16 bp, H. sapiens
gcttaccaactaaaaa

SEQ ID NO: 111120 - DNA, 16 bp, H. sapiens
gcttaccacaacctct

SEQ ID NO: 111121 - DNA, 16 bp, H. sapiens
gcttactgcaacctct

SEQ ID NO: 111122 - DNA, 16 bp, H. sapiens
gcttactgcagccctg

SEQ ID NO: 111123 - DNA, 16 bp, H. sapiens
gcttactgtaacctct

SEQ ID NO: 111124 - DNA, 16 bp, H. sapiens
gcttactgtaattttt

SEQ ID NO: 111125 - DNA, 16 bp, H. sapiens
gcttactgtggcctca

SEQ ID NO: 111126 - DNA, 16 bp, H. sapiens
gcttagaaattttttc

SEQ ID NO: 111127 - DNA, 16 bp, H. sapiens
gcttagagaaaaaaga

SEQ ID NO: 111128 - DNA, 16 bp, H. sapiens
gcttagagaaattaag

SEQ ID NO: 111129 - DNA, 16 bp, H. sapiens
gcttaggcatgagaat

SEQ ID NO: 111130 - DNA, 16 bp, H. sapiens
gcttagggaatgagtc

SEQ ID NO: 111131 - DNA, 16 bp, H. sapiens
gcttaggttttcttct

SEQ ID NO: 111132 - DNA, 16 bp, H. sapiens
gcttatgaagtttagt

SEQ ID NO: 111133 - DNA, 17 bp, H. sapiens
gcttatgattgacttgg

SEQ ID NO: 111134 - DNA, 16 bp, H. sapiens
gcttatggagattttg

SEQ ID NO: 111135 - DNA, 16 bp, H. sapiens
gcttatgtctgtaata

SEQ ID NO: 111136 - DNA, 16 bp, H. sapiens
gcttatgttcaagtaa

SEQ ID NO: 111137 - DNA, 16 bp, H. sapiens
gcttattctctgctct

SEQ ID NO: 111138 - DNA, 16 bp, H. sapiens
gcttattggccatttg

SEQ ID NO: 111139 - DNA, 16 bp, H. sapiens
gcttatttttgtagtt

SEQ ID NO: 111140 - DNA, 16 bp, H. sapiens
gcttatttttgtcaag

SEQ ID NO: 111141 - DNA, 16 bp, H. sapiens
gcttcaaagcttcaaa

SEQ ID NO: 111142 - DNA, 16 bp, H. sapiens
gcttcaaagtttcaaa

SEQ ID NO: 111143 - DNA, 16 bp, H. sapiens
gcttcaacccaggagg

SEQ ID NO: 111144 - DNA, 16 bp, H. sapiens
gcttcaagcaatcctc

SEQ ID NO: 111145 - DNA, 16 bp, H. sapiens
gcttcaaggcccagga

SEQ ID NO: 111146 - DNA, 16 bp, H. sapiens
gcttcaatccaggagg

SEQ ID NO: 111147 - DNA, 16 bp, H. sapiens
gcttcacaaggtaata

SEQ ID NO: 111148 - DNA, 16 bp, H. sapiens
gcttcaccagaagcag

SEQ ID NO: 111149 - DNA, 16 bp, H. sapiens
gcttcacccctgtggc

SEQ ID NO: 111150 - DNA, 16 bp, H. sapiens
gcttcactcaggaaag

SEQ ID NO: 111151 - DNA, 16 bp, H. sapiens
gcttcagaaggtgcaa

SEQ ID NO: 111152 - DNA, 16 bp, H. sapiens
gcttcagagagaatag

SEQ ID NO: 111153 - DNA, 16 bp, H. sapiens
gcttcagagggtgcaa

SEQ ID NO: 111154 - DNA, 16 bp, H. sapiens
gcttcagcccaggagg

SEQ ID NO: 111155 - DNA, 16 bp, H. sapiens
gcttcagcctcccaag

SEQ ID NO: 111156 - DNA, 16 bp, H. sapiens
gcttcagcctcccggg

SEQ ID NO: 111157 - DNA, 16 bp, H. sapiens
gcttcagcctctccag

SEQ ID NO: 111158 - DNA, 16 bp, H. sapiens
gcttcagcctggaagg

SEQ ID NO: 111159 - DNA, 16 bp, H. sapiens
gcttcagcctgggagg

SEQ ID NO: 111160 - DNA, 16 bp, H. sapiens
gcttcagccttccaag

SEQ ID NO: 111161 - DNA, 16 bp, H. sapiens
gcttcaggaggccaag

SEQ ID NO: 111162 - DNA, 16 bp, H. sapiens
gcttcaggctcctgag

SEQ ID NO: 111163 - DNA, 16 bp, H. sapiens
gcttcaggtatttctt

SEQ ID NO: 111164 - DNA, 16 bp, H. sapiens
gcttcaggtgatccgc

SEQ ID NO: 111165 - DNA, 16 bp, H. sapiens
gcttcagtggaggaag

SEQ ID NO: 111166 - DNA, 16 bp, H. sapiens
gcttcagtgtcttcat

SEQ ID NO: 111167 - DNA, 16 bp, H. sapiens
gcttcataaaatgatt

SEQ ID NO: 111168 - DNA, 31 bp, H. sapiens
gcttcatccctgggatgcaaggctggttcaa

SEQ ID NO: 111169 - DNA, 16 bp, H. sapiens
gcttcatgaagttctc

SEQ ID NO: 111170 - DNA, 16 bp, H. sapiens
gcttcattcctgaagt

SEQ ID NO: 111171 - DNA, 16 bp, H. sapiens
gcttcattcttgaagt

SEQ ID NO: 111172 - DNA, 16 bp, H. sapiens
gcttcattgttgaagt

SEQ ID NO: 111173 - DNA, 16 bp, H. sapiens
gcttcattttaactta

SEQ ID NO: 111174 - DNA, 16 bp, H. sapiens
gcttccaactccatcc

SEQ ID NO: 111175 - DNA, 16 bp, H. sapiens
gcttccaatactaatg

SEQ ID NO: 111176 - DNA, 16 bp, H. sapiens
gcttccaatttttggc

SEQ ID NO: 111177 - DNA, 16 bp, H. sapiens
gcttccacagtgtgaa

SEQ ID NO: 111178 - DNA, 16 bp, H. sapiens
gcttccacctccatcc

SEQ ID NO: 111179 - DNA, 16 bp, H. sapiens
gcttccacctcccagg

SEQ ID NO: 111180 - DNA, 16 bp, H. sapiens
gcttccacctcctggg

SEQ ID NO: 111181 - DNA, 16 bp, H. sapiens
gcttccaccttaagaa

SEQ ID NO: 111182 - DNA, 16 bp, H. sapiens
gcttccacttggtgtt

SEQ ID NO: 111183 - DNA, 16 bp, H. sapiens
gcttccagaggaaaga

SEQ ID NO: 111184 - DNA, 16 bp, H. sapiens
gcttccagtttttctg

SEQ ID NO: 111185 - DNA, 16 bp, H. sapiens
gcttccatctcccaac

SEQ ID NO: 111186 - DNA, 16 bp, H. sapiens
gcttccatgtgatgtt

SEQ ID NO: 111187 - DNA, 16 bp, H. sapiens
gcttccatttataagt

SEQ ID NO: 111188 - DNA, 16 bp, H. sapiens
gcttccatttccaaca

SEQ ID NO: 111189 - DNA, 16 bp, H. sapiens
gcttcccaagttcaag

SEQ ID NO: 111190 - DNA, 16 bp, H. sapiens
gcttcccagagtgttg

SEQ ID NO: 111191 - DNA, 16 bp, H. sapiens
gcttcccagcctccag

SEQ ID NO: 111192 - DNA, 16 bp, H. sapiens
gcttcccaggtttaag

SEQ ID NO: 111193 - DNA, 16 bp, H. sapiens
gcttccccaaatcaaa

SEQ ID NO: 111194 - DNA, 16 bp, H. sapiens
gcttccccagcagctg

SEQ ID NO: 111195 - DNA, 16 bp, H. sapiens
gcttccccagccctgc

SEQ ID NO: 111196 - DNA, 16 bp, H. sapiens
gcttccccttcagcca

SEQ ID NO: 111197 - DNA, 16 bp, H. sapiens
gcttccccttctacca

SEQ ID NO: 111198 - DNA, 16 bp, H. sapiens
gcttcccctttgactt

SEQ ID NO: 111199 - DNA, 16 bp, H. sapiens
gcttccccttttgcca

SEQ ID NO: 111200 - DNA, 16 bp, H. sapiens
gcttcccgggtgaggc

SEQ ID NO: 111201 - DNA, 16 bp, H. sapiens
gcttccctggaccaca

SEQ ID NO: 111202 - DNA, 16 bp, H. sapiens
gcttccctggctggca

SEQ ID NO: 111203 - DNA, 16 bp, H. sapiens
gcttcccttggctagg

SEQ ID NO: 111204 - DNA, 16 bp, H. sapiens
gcttcctaaagtgttg

SEQ ID NO: 111205 - DNA, 16 bp, H. sapiens
gcttcctacacagcct

SEQ ID NO: 111206 - DNA, 16 bp, H. sapiens
gcttcctagggctgct

SEQ ID NO: 111207 - DNA, 16 bp, H. sapiens
gcttcctaggttcaag

SEQ ID NO: 111208 - DNA, 16 bp, H. sapiens
gcttcctcaatgcctc

SEQ ID NO: 111209 - DNA, 16 bp, H. sapiens
gcttcctcctcaacct

SEQ ID NO: 111210 - DNA, 16 bp, H. sapiens
gcttcctgaagtgctg

SEQ ID NO: 111211 - DNA, 16 bp, H. sapiens
gcttcctgcaggagct

SEQ ID NO: 111212 - DNA, 16 bp, H. sapiens
gcttcctgccctggaa

SEQ ID NO: 111213 - DNA, 16 bp, H. sapiens
gcttcctgctgctgca

SEQ ID NO: 111214 - DNA, 16 bp, H. sapiens
gcttcctgctgttgct

SEQ ID NO: 111215 - DNA, 16 bp, H. sapiens
gcttcctggaagaggc

SEQ ID NO: 111216 - DNA, 16 bp, H. sapiens
gcttcctggagaaagt

SEQ ID NO: 111217 - DNA, 16 bp, H. sapiens
gcttcctggccacttt

SEQ ID NO: 111218 - DNA, 16 bp, H. sapiens
gcttcctggctgtgtg

SEQ ID NO: 111219 - DNA, 16 bp, H. sapiens
gcttcctgggtgaggt

SEQ ID NO: 111220 - DNA, 16 bp, H. sapiens
gcttcctgggttcaaa

SEQ ID NO: 111221 - DNA, 16 bp, H. sapiens
gcttcctgggttcaag

SEQ ID NO: 111222 - DNA, 16 bp, H. sapiens
gcttccttactcctca

SEQ ID NO: 111223 - DNA, 16 bp, H. sapiens
gcttccttcaggagct

SEQ ID NO: 111224 - DNA, 16 bp, H. sapiens
gcttccttcaggagtt

SEQ ID NO: 111225 - DNA, 16 bp, H. sapiens
gcttccttgaggagct

SEQ ID NO: 111226 - DNA, 16 bp, H. sapiens
gcttccttgcattagg

SEQ ID NO: 111227 - DNA, 16 bp, H. sapiens
gcttcctttctcctca

SEQ ID NO: 111228 - DNA, 16 bp, H. sapiens
gcttctacactgttgg

SEQ ID NO: 111229 - DNA, 16 bp, H. sapiens
gcttctataaacattt

SEQ ID NO: 111230 - DNA, 16 bp, H. sapiens
gcttctatgtggtgtt

SEQ ID NO: 111231 - DNA, 16 bp, H. sapiens
gcttctattttctgaa

SEQ ID NO: 111232 - DNA, 16 bp, H. sapiens
gcttctcagaattcag

SEQ ID NO: 111233 - DNA, 16 bp, H. sapiens
gcttctcagaggaggt

SEQ ID NO: 111234 - DNA, 16 bp, H. sapiens
gcttctcagcctgcag

SEQ ID NO: 111235 - DNA, 16 bp, H. sapiens
gcttctcagggggctg

SEQ ID NO: 111236 - DNA, 16 bp, H. sapiens
gcttctcccaacactc

SEQ ID NO: 111237 - DNA, 16 bp, H. sapiens
gcttctcctcctccaa

SEQ ID NO: 111238 - DNA, 16 bp, H. sapiens
gcttctctctctgcct

SEQ ID NO: 111239 - DNA, 16 bp, H. sapiens
gcttctctgaggaggt

SEQ ID NO: 111240 - DNA, 16 bp, H. sapiens
gcttctctgcctcctg

SEQ ID NO: 111241 - DNA, 16 bp, H. sapiens
gcttctctgggtggag

SEQ ID NO: 111242 - DNA, 16 bp, H. sapiens
gcttctctgtagtttt

SEQ ID NO: 111243 - DNA, 16 bp, H. sapiens
gcttctcttggctgtg

SEQ ID NO: 111244 - DNA, 16 bp, H. sapiens
gcttctgagaatgctt

SEQ ID NO: 111245 - DNA, 16 bp, H. sapiens
gcttctgaggcttctg

SEQ ID NO: 111246 - DNA, 16 bp, H. sapiens
gcttctgcacagcaag

SEQ ID NO: 111247 - DNA, 16 bp, H. sapiens
gcttctgcctcctgag

SEQ ID NO: 111248 - DNA, 16 bp, H. sapiens
gcttctgctgctgctg

SEQ ID NO: 111249 - DNA, 16 bp, H. sapiens
gcttctgcttctggag

SEQ ID NO: 111250 - DNA, 16 bp, H. sapiens
gcttctggcttttgcc

SEQ ID NO: 111251 - DNA, 16 bp, H. sapiens
gcttctggggaggctg

SEQ ID NO: 111252 - DNA, 16 bp, H. sapiens
gcttctggggtggcct

SEQ ID NO: 111253 - DNA, 16 bp, H. sapiens
gcttctgtctagtttt

SEQ ID NO: 111254 - DNA, 16 bp, H. sapiens
gcttctgtttgtaagt

SEQ ID NO: 111255 - DNA, 16 bp, H. sapiens
gcttctgttttctcag

SEQ ID NO: 111256 - DNA, 16 bp, H. sapiens
gcttcttaatcctgag

SEQ ID NO: 111257 - DNA, 16 bp, H. sapiens
gcttcttcacagcaaa

SEQ ID NO: 111258 - DNA, 16 bp, H. sapiens
gcttcttcatctataa

SEQ ID NO: 111259 - DNA, 16 bp, H. sapiens
gcttcttccttatttt

SEQ ID NO: 111260 - DNA, 16 bp, H. sapiens
gcttctttcactcagt

SEQ ID NO: 111261 - DNA, 16 bp, H. sapiens
gcttctttctttccaa

SEQ ID NO: 111262 - DNA, 16 bp, H. sapiens
gcttctttgaaaagat

SEQ ID NO: 111263 - DNA, 16 bp, H. sapiens
gcttctttttgtcagg

SEQ ID NO: 111264 - DNA, 16 bp, H. sapiens
gcttgaaactaggagg

SEQ ID NO: 111265 - DNA, 16 bp, H. sapiens
gcttgaaactgagagg

SEQ ID NO: 111266 - DNA, 16 bp, H. sapiens
gcttgaaccaggaccc

SEQ ID NO: 111267 - DNA, 16 bp, H. sapiens
gcttgaaccagggagg

SEQ ID NO: 111268 - DNA, 16 bp, H. sapiens
gcttgaacccaagaag

SEQ ID NO: 111269 - DNA, 16 bp, H. sapiens
gcttgaacccagaggc

SEQ ID NO: 111270 - DNA, 16 bp, H. sapiens
gcttgaacccagcggg

SEQ ID NO: 111271 - DNA, 16 bp, H. sapiens
gcttgaacccaggaga

SEQ ID NO: 111272 - DNA, 16 bp, H. sapiens
gcttgaacccaggagt

SEQ ID NO: 111273 - DNA, 16 bp, H. sapiens
gcttgaacccaggcag

SEQ ID NO: 111274 - DNA, 16 bp, H. sapiens
gcttgaacccagtagg

SEQ ID NO: 111275 - DNA, 16 bp, H. sapiens
gcttgaacccatgagg

SEQ ID NO: 111276 - DNA, 16 bp, H. sapiens
gcttgaacccgagaga

SEQ ID NO: 111277 - DNA, 16 bp, H. sapiens
gcttgaacccgggaag

SEQ ID NO: 111278 - DNA, 16 bp, H. sapiens
gcttgaacccgggaga

SEQ ID NO: 111279 - DNA, 16 bp, H. sapiens
gcttgaacccgggggg

SEQ ID NO: 111280 - DNA, 16 bp, H. sapiens
gcttgaaccctggaga

SEQ ID NO: 111281 - DNA, 16 bp, H. sapiens
gcttgaaccgggaggc

SEQ ID NO: 111282 - DNA, 16 bp, H. sapiens
gcttgaaccggggaga

SEQ ID NO: 111283 - DNA, 16 bp, H. sapiens
gcttgaaccggggagg

SEQ ID NO: 111284 - DNA, 16 bp, H. sapiens
gcttgaacctaggagt

SEQ ID NO: 111285 - DNA, 16 bp, H. sapiens
gcttgaacctgagaag

SEQ ID NO: 111286 - DNA, 16 bp, H. sapiens
gcttgaacctgagaga

SEQ ID NO: 111287 - DNA, 16 bp, H. sapiens
gcttgaacctggaggc

SEQ ID NO: 111288 - DNA, 16 bp, H. sapiens
gcttgaacctgggaag

SEQ ID NO: 111289 - DNA, 16 bp, H. sapiens
gcttgaacctgggaga

SEQ ID NO: 111290 - DNA, 16 bp, H. sapiens
gcttgaacctgggagc

SEQ ID NO: 111291 - DNA, 16 bp, H. sapiens
gcttgaacctgggagt

SEQ ID NO: 111292 - DNA, 16 bp, H. sapiens
gcttgaacctgtgagg

SEQ ID NO: 111293 - DNA, 16 bp, H. sapiens
gcttgaactcaggaga

SEQ ID NO: 111294 - DNA, 16 bp, H. sapiens
gcttgaactcaggagg

SEQ ID NO: 111295 - DNA, 16 bp, H. sapiens
gcttgaactcaggagt

SEQ ID NO: 111296 - DNA, 16 bp, H. sapiens
gcttgaactcgggaga

SEQ ID NO: 111297 - DNA, 16 bp, H. sapiens
gcttgaacttgggagc

SEQ ID NO: 111298 - DNA, 16 bp, H. sapiens
gcttgaagctggaagg

SEQ ID NO: 111299 - DNA, 16 bp, H. sapiens
gcttgaatccaggaag

SEQ ID NO: 111300 - DNA, 16 bp, H. sapiens
gcttgaatccgggaag

SEQ ID NO: 111301 - DNA, 16 bp, H. sapiens
gcttgacccagggagg

SEQ ID NO: 111302 - DNA, 16 bp, H. sapiens
gcttgaccccgggagg

SEQ ID NO: 111303 - DNA, 16 bp, H. sapiens
gcttgacccgggaggc

SEQ ID NO: 111304 - DNA, 16 bp, H. sapiens
gcttgactccaggagt

SEQ ID NO: 111305 - DNA, 16 bp, H. sapiens
gcttgagaccagaagt

SEQ ID NO: 111306 - DNA, 16 bp, H. sapiens
gcttgagaccaggagg

SEQ ID NO: 111307 - DNA, 16 bp, H. sapiens
gcttgagactgggagg

SEQ ID NO: 111308 - DNA, 16 bp, H. sapiens
gcttgagccagggagg

SEQ ID NO: 111309 - DNA, 16 bp, H. sapiens
gcttgagcccaggaga

SEQ ID NO: 111310 - DNA, 16 bp, H. sapiens
gcttgagcccgggaag

SEQ ID NO: 111311 - DNA, 16 bp, H. sapiens
gcttgagcccgggaga

SEQ ID NO: 111312 - DNA, 16 bp, H. sapiens
gcttgagcccgggagg

SEQ ID NO: 111313 - DNA, 16 bp, H. sapiens
gcttgagccctggagt

SEQ ID NO: 111314 - DNA, 16 bp, H. sapiens
gcttgagcctgggagg

SEQ ID NO: 111315 - DNA, 16 bp, H. sapiens
gcttgagctcaggagg

SEQ ID NO: 111316 - DNA, 17 bp, H. sapiens
gcttgagctcgggagtt

SEQ ID NO: 111317 - DNA, 16 bp, H. sapiens
gcttgatcaattctgc

SEQ ID NO: 111318 - DNA, 16 bp, H. sapiens
gcttgatcagattcag

SEQ ID NO: 111319 - DNA, 16 bp, H. sapiens
gcttgatcctgggagg

SEQ ID NO: 111320 - DNA, 16 bp, H. sapiens
gcttgcaaaaaaaaaa

SEQ ID NO: 111321 - DNA, 16 bp, H. sapiens
gcttgcaaagtgacca

SEQ ID NO: 111322 - DNA, 16 bp, H. sapiens
gcttgcacccaggagg

SEQ ID NO: 111323 - DNA, 16 bp, H. sapiens
gcttgcagtcccagct

SEQ ID NO: 111324 - DNA, 16 bp, H. sapiens
gcttgcatgcagccat

SEQ ID NO: 111325 - DNA, 16 bp, H. sapiens
gcttgcatgtctgaca

SEQ ID NO: 111326 - DNA, 16 bp, H. sapiens
gcttgcccactgcctg

SEQ ID NO: 111327 - DNA, 16 bp, H. sapiens
gcttgcctgaggtcac

SEQ ID NO: 111328 - DNA, 16 bp, H. sapiens
gcttgccttggcctcc

SEQ ID NO: 111329 - DNA, 16 bp, H. sapiens
gcttgctattctgtcc

SEQ ID NO: 111330 - DNA, 16 bp, H. sapiens
gcttgctgcacagaaa

SEQ ID NO: 111331 - DNA, 16 bp, H. sapiens
gcttgctgtgtgccag

SEQ ID NO: 111332 - DNA, 16 bp, H. sapiens
gcttgctttctcaaca

SEQ ID NO: 111333 - DNA, 16 bp, H. sapiens
gcttggaaacagtctt

SEQ ID NO: 111334 - DNA, 16 bp, H. sapiens
gcttggaccctggagg

SEQ ID NO: 111335 - DNA, 16 bp, H. sapiens
gcttggacctgaaaga

SEQ ID NO: 111336 - DNA, 16 bp, H. sapiens
gcttggacctggaagg

SEQ ID NO: 111337 - DNA, 16 bp, H. sapiens
gcttggacctgggagg

SEQ ID NO: 111338 - DNA, 17 bp, H. sapiens
gcttggagaaccactac

SEQ ID NO: 111339 - DNA, 16 bp, H. sapiens
gcttggcacacagcag

SEQ ID NO: 111340 - DNA, 16 bp, H. sapiens
gcttggcacggtggct

SEQ ID NO: 111341 - DNA, 16 bp, H. sapiens
gcttggcaggccctgc

SEQ ID NO: 111342 - DNA, 16 bp, H. sapiens
gcttggcaggctgagg

SEQ ID NO: 111343 - DNA, 16 bp, H. sapiens
gcttggctgggcgcgg

SEQ ID NO: 111344 - DNA, 16 bp, H. sapiens
gcttggctggttggct

SEQ ID NO: 111345 - DNA, 16 bp, H. sapiens
gcttgggagaaagtaa

SEQ ID NO: 111346 - DNA, 16 bp, H. sapiens
gcttgggatcagaagt

SEQ ID NO: 111347 - DNA, 16 bp, H. sapiens
gcttgggcaacagtga

SEQ ID NO: 111348 - DNA, 16 bp, H. sapiens
gcttgggcagctgcag

SEQ ID NO: 111349 - DNA, 16 bp, H. sapiens
gcttgggcccaggagg

SEQ ID NO: 111350 - DNA, 20 bp, H. sapiens
gcttgggctcagaggcctga

SEQ ID NO: 111351 - DNA, 22 bp, H. sapiens
gcttgggctcagaggcctgaca

SEQ ID NO: 111352 - DNA, 16 bp, H. sapiens
gcttgggcttcctcac

SEQ ID NO: 111353 - DNA, 16 bp, H. sapiens
gcttggggacccagcg

SEQ ID NO: 111354 - DNA, 16 bp, H. sapiens
gcttggggcttgaacc

SEQ ID NO: 111355 - DNA, 16 bp, H. sapiens
gcttggtgcggggagg

SEQ ID NO: 111356 - DNA, 16 bp, H. sapiens
gcttggtgctgttctc

SEQ ID NO: 111357 - DNA, 16 bp, H. sapiens
gcttggtggagagctg

SEQ ID NO: 111358 - DNA, 16 bp, H. sapiens
gcttggtgtgtttgag

SEQ ID NO: 111359 - DNA, 16 bp, H. sapiens
gcttggtgtttgcctt

SEQ ID NO: 111360 - DNA, 16 bp, H. sapiens
gcttggtttaaaaaaa

SEQ ID NO: 111361 - DNA, 16 bp, H. sapiens
gcttgtaatcccaaca

SEQ ID NO: 111362 - DNA, 16 bp, H. sapiens
gcttgtacccaggagg

SEQ ID NO: 111363 - DNA, 16 bp, H. sapiens
gcttgtagctgcatca

SEQ ID NO: 111364 - DNA, 16 bp, H. sapiens
gcttgtcagtttctgc

SEQ ID NO: 111365 - DNA, 16 bp, H. sapiens
gcttgtctcaaactcc

SEQ ID NO: 111366 - DNA, 16 bp, H. sapiens
gcttgtctgggaaata

SEQ ID NO: 111367 - DNA, 16 bp, H. sapiens
gcttgtctgtaaaggg

SEQ ID NO: 111368 - DNA, 16 bp, H. sapiens
gcttgtcttctcattt

SEQ ID NO: 111369 - DNA, 16 bp, H. sapiens
gcttgtgatcccagca

SEQ ID NO: 111370 - DNA, 16 bp, H. sapiens
gcttgtgctcaggagt

SEQ ID NO: 111371 - DNA, 16 bp, H. sapiens
gcttgtggtcccagct

SEQ ID NO: 111372 - DNA, 16 bp, H. sapiens
gcttgttaaaaatgaa

SEQ ID NO: 111373 - DNA, 16 bp, H. sapiens
gcttgttatgcagcaa

SEQ ID NO: 111374 - DNA, 16 bp, H. sapiens
gcttgttgaatggctt

SEQ ID NO: 111375 - DNA, 16 bp, H. sapiens
gcttgtttaaattctt

SEQ ID NO: 111376 - DNA, 16 bp, H. sapiens
gcttgttttctcattc

SEQ ID NO: 111377 - DNA, 16 bp, H. sapiens
gctttaaaacaaaaca

SEQ ID NO: 111378 - DNA, 16 bp, H. sapiens
gctttaaagtctattt

SEQ ID NO: 111379 - DNA, 16 bp, H. sapiens
gctttaacctgggagg

SEQ ID NO: 111380 - DNA, 16 bp, H. sapiens
gctttaagaaaaaaaa

SEQ ID NO: 111381 - DNA, 19 bp, H. sapiens
gctttacttccaactatgt

SEQ ID NO: 111382 - DNA, 16 bp, H. sapiens
gctttagattctcata

SEQ ID NO: 111383 - DNA, 16 bp, H. sapiens
gctttagccaggatgg

SEQ ID NO: 111384 - DNA, 16 bp, H. sapiens
gctttaggccaggagt

SEQ ID NO: 111385 - DNA, 16 bp, H. sapiens
gctttataaatggaac

SEQ ID NO: 111386 - DNA, 16 bp, H. sapiens
gctttatcatttttat

SEQ ID NO: 111387 - DNA, 16 bp, H. sapiens
gctttatgtccccacc

SEQ ID NO: 111388 - DNA, 16 bp, H. sapiens
gctttattaaaaaaaa

SEQ ID NO: 111389 - DNA, 16 bp, H. sapiens
gctttatttttcttca

SEQ ID NO: 111390 - DNA, 16 bp, H. sapiens
gctttattttttgaaa

SEQ ID NO: 111391 - DNA, 16 bp, H. sapiens
gctttcagcagagagg

SEQ ID NO: 111392 - DNA, 16 bp, H. sapiens
gctttcaggcataatt

SEQ ID NO: 111393 - DNA, 16 bp, H. sapiens
gctttcagttctttgg

SEQ ID NO: 111394 - DNA, 16 bp, H. sapiens
gctttcattcacttta

SEQ ID NO: 111395 - DNA, 16 bp, H. sapiens
gctttccaaaatgctg

SEQ ID NO: 111396 - DNA, 16 bp, H. sapiens
gctttcctcctcagag

SEQ ID NO: 111397 - DNA, 16 bp, H. sapiens
gctttctattctgcca

SEQ ID NO: 111398 - DNA, 16 bp, H. sapiens
gctttctattctgttt

SEQ ID NO: 111399 - DNA, 16 bp, H. sapiens
gctttctcagctggga

SEQ ID NO: 111400 - DNA, 16 bp, H. sapiens
gctttctcagtgggga

SEQ ID NO: 111401 - DNA, 16 bp, H. sapiens
gctttctgtttgtctg

SEQ ID NO: 111402 - DNA, 16 bp, H. sapiens
gctttcttgcctgcca

SEQ ID NO: 111403 - DNA, 16 bp, H. sapiens
gctttcttgctgcatc

SEQ ID NO: 111404 - DNA, 16 bp, H. sapiens
gctttcttggggaaga

SEQ ID NO: 111405 - DNA, 16 bp, H. sapiens
gctttctttctgggtt

SEQ ID NO: 111406 - DNA, 16 bp, H. sapiens
gctttgaaaagagtag

SEQ ID NO: 111407 - DNA, 16 bp, H. sapiens
gctttgaaaatatttt

SEQ ID NO: 111408 - DNA, 16 bp, H. sapiens
gctttgaaactgggta

SEQ ID NO: 111409 - DNA, 16 bp, H. sapiens
gctttgaagagagtaa

SEQ ID NO: 111410 - DNA, 17 bp, H. sapiens
gctttgaatgtgtccca

SEQ ID NO: 111411 - DNA, 16 bp, H. sapiens
gctttgactggaatga

SEQ ID NO: 111412 - DNA, 16 bp, H. sapiens
gctttgaggcctttgg

SEQ ID NO: 111413 - DNA, 16 bp, H. sapiens
gctttgataaaattca

SEQ ID NO: 111414 - DNA, 16 bp, H. sapiens
gctttgcagaagcttt

SEQ ID NO: 111415 - DNA, 16 bp, H. sapiens
gctttgcagagctgtg

SEQ ID NO: 111416 - DNA, 16 bp, H. sapiens
gctttgcagatggagg

SEQ ID NO: 111417 - DNA, 16 bp, H. sapiens
gctttgcagggacatg

SEQ ID NO: 111418 - DNA, 16 bp, H. sapiens
gctttgcatttttaaa

SEQ ID NO: 111419 - DNA, 16 bp, H. sapiens
gctttgccaaagatca

SEQ ID NO: 111420 - DNA, 16 bp, H. sapiens
gctttgccctgagatg

SEQ ID NO: 111421 - DNA, 16 bp, H. sapiens
gctttggaaggctgaa

SEQ ID NO: 111422 - DNA, 16 bp, H. sapiens
gctttggaaggctgag

SEQ ID NO: 111423 - DNA, 16 bp, H. sapiens
gctttggaatcagaca

SEQ ID NO: 111424 - DNA, 16 bp, H. sapiens
gctttggagaaaaaaa

SEQ ID NO: 111425 - DNA, 16 bp, H. sapiens
gctttggagcccccct

SEQ ID NO: 111426 - DNA, 16 bp, H. sapiens
gctttggcaaagaatt

SEQ ID NO: 111427 - DNA, 16 bp, H. sapiens
gctttggcagcttcca

SEQ ID NO: 111428 - DNA, 16 bp, H. sapiens
gctttggccaatgaga

SEQ ID NO: 111429 - DNA, 16 bp, H. sapiens
gctttggcctcctggg

SEQ ID NO: 111430 - DNA, 16 bp, H. sapiens
gctttggctatgaggg

SEQ ID NO: 111431 - DNA, 16 bp, H. sapiens
gctttggcttaaggaa

SEQ ID NO: 111432 - DNA, 16 bp, H. sapiens
gctttgggaacctctg

SEQ ID NO: 111433 - DNA, 16 bp, H. sapiens
gctttgggaggacaag

SEQ ID NO: 111434 - DNA, 18 bp, H. sapiens
gctttgggaggccgaggt

SEQ ID NO: 111435 - DNA, 16 bp, H. sapiens
gctttggttgcctgtg

SEQ ID NO: 111436 - DNA, 16 bp, H. sapiens
gctttgtaagtgaagg

SEQ ID NO: 111437 - DNA, 16 bp, H. sapiens
gctttgtaataaattt

SEQ ID NO: 111438 - DNA, 16 bp, H. sapiens
gctttgtcacccatgc

SEQ ID NO: 111439 - DNA, 16 bp, H. sapiens
gctttgtcagagatca

SEQ ID NO: 111440 - DNA, 16 bp, H. sapiens
gctttgtccaaaatgc

SEQ ID NO: 111441 - DNA, 16 bp, H. sapiens
gctttgtcttcaggat

SEQ ID NO: 111442 - DNA, 16 bp, H. sapiens
gctttgtgaggctgag

SEQ ID NO: 111443 - DNA, 16 bp, H. sapiens
gctttgtgcagtactg

SEQ ID NO: 111444 - DNA, 16 bp, H. sapiens
gctttgtgcagtatgg

SEQ ID NO: 111445 - DNA, 16 bp, H. sapiens
gctttgttccactgct

SEQ ID NO: 111446 - DNA, 16 bp, H. sapiens
gctttgttcttttact

SEQ ID NO: 111447 - DNA, 16 bp, H. sapiens
gctttgttgaaaatca

SEQ ID NO: 111448 - DNA, 16 bp, H. sapiens
gctttgtttaaaaaaa

SEQ ID NO: 111449 - DNA, 16 bp, H. sapiens
gctttgtttaaaaatt

SEQ ID NO: 111450 - DNA, 16 bp, H. sapiens
gcttttaaaaagattt

SEQ ID NO: 111451 - DNA, 16 bp, H. sapiens
gcttttaaaaggaaaa

SEQ ID NO: 111452 - DNA, 16 bp, H. sapiens
gcttttaaaattttct

SEQ ID NO: 111453 - DNA, 16 bp, H. sapiens
gcttttaaagaaaatg

SEQ ID NO: 111454 - DNA, 16 bp, H. sapiens
gcttttaaattaaaaa

SEQ ID NO: 111455 - DNA, 16 bp, H. sapiens
gcttttaacaattaag

SEQ ID NO: 111456 - DNA, 16 bp, H. sapiens
gcttttatcaaaaaga

SEQ ID NO: 111457 - DNA, 16 bp, H. sapiens
gcttttattaccttaa

SEQ ID NO: 111458 - DNA, 16 bp, H. sapiens
gcttttattatgttga

SEQ ID NO: 111459 - DNA, 16 bp, H. sapiens
gcttttattcccttat

SEQ ID NO: 111460 - DNA, 16 bp, H. sapiens
gcttttcattagtttt

SEQ ID NO: 111461 - DNA, 16 bp, H. sapiens
gcttttccaggcccac

SEQ ID NO: 111462 - DNA, 16 bp, H. sapiens
gcttttccaggttcat

SEQ ID NO: 111463 - DNA, 16 bp, H. sapiens
gcttttcctctgagat

SEQ ID NO: 111464 - DNA, 16 bp, H. sapiens
gcttttctatatacca

SEQ ID NO: 111465 - DNA, 16 bp, H. sapiens
gcttttctcctgcctc

SEQ ID NO: 111466 - DNA, 16 bp, H. sapiens
gcttttctcctgtgtt

SEQ ID NO: 111467 - DNA, 16 bp, H. sapiens
gcttttctgtccttgt

SEQ ID NO: 111468 - DNA, 16 bp, H. sapiens
gcttttcttgccattg

SEQ ID NO: 111469 - DNA, 16 bp, H. sapiens
gcttttgaaaatgttt

SEQ ID NO: 111470 - DNA, 16 bp, H. sapiens
gcttttgaatgtgttc

SEQ ID NO: 111471 - DNA, 16 bp, H. sapiens
gcttttgaatttcttt

SEQ ID NO: 111472 - DNA, 16 bp, H. sapiens
gcttttgaggtctcag

SEQ ID NO: 111473 - DNA, 16 bp, H. sapiens
gcttttgctttaaaag

SEQ ID NO: 111474 - DNA, 16 bp, H. sapiens
gcttttggggtacaag

SEQ ID NO: 111475 - DNA, 16 bp, H. sapiens
gcttttggtgtcttat

SEQ ID NO: 111476 - DNA, 16 bp, H. sapiens
gcttttgtaaataaag

SEQ ID NO: 111477 - DNA, 16 bp, H. sapiens
gcttttgtacagcaaa

SEQ ID NO: 111478 - DNA, 16 bp, H. sapiens
gcttttgtgaggatta

SEQ ID NO: 111479 - DNA, 16 bp, H. sapiens
gcttttgtgattgaaa

SEQ ID NO: 111480 - DNA, 16 bp, H. sapiens
gctttttaaaagaaaa

SEQ ID NO: 111481 - DNA, 16 bp, H. sapiens
gctttttaaaagaaat

SEQ ID NO: 111482 - DNA, 16 bp, H. sapiens
gctttttaaaatatat

SEQ ID NO: 111483 - DNA, 16 bp, H. sapiens
gctttttaaaatgaaa

SEQ ID NO: 111484 - DNA, 16 bp, H. sapiens
gctttttaattttaat

SEQ ID NO: 111485 - DNA, 16 bp, H. sapiens
gctttttagtttaatg

SEQ ID NO: 111486 - DNA, 16 bp, H. sapiens
gctttttcatttctct

SEQ ID NO: 111487 - DNA, 16 bp, H. sapiens
gctttttccaaagagg

SEQ ID NO: 111488 - DNA, 16 bp, H. sapiens
gctttttggaaaaaaa

SEQ ID NO: 111489 - DNA, 16 bp, H. sapiens
gctttttgtatttgga

SEQ ID NO: 111490 - DNA, 16 bp, H. sapiens
gcttttttaaaaaatg

SEQ ID NO: 111491 - DNA, 16 bp, H. sapiens
gctttttttcctatgt

SEQ ID NO: 111492 - DNA, 16 bp, H. sapiens
gctttttttgtagaaa

SEQ ID NO: 111493 - DNA, 16 bp, H. sapiens
ggaaaaaaaaaacctt

SEQ ID NO: 111494 - DNA, 16 bp, H. sapiens
ggaaaaaaaaatcagg

SEQ ID NO: 111495 - DNA, 16 bp, H. sapiens
ggaaaaaaaaatcttt

SEQ ID NO: 111496 - DNA, 16 bp, H. sapiens
ggaaaaaaaatctaga

SEQ ID NO: 111497 - DNA, 16 bp, H. sapiens
ggaaaaaaaatctttt

SEQ ID NO: 111498 - DNA, 16 bp, H. sapiens
ggaaaaaaatattttt

SEQ ID NO: 111499 - DNA, 16 bp, H. sapiens
ggaaaaaaatcaacag

SEQ ID NO: 111500 - DNA, 16 bp, H. sapiens
ggaaaaaaatcattct

SEQ ID NO: 111501 - DNA, 16 bp, H. sapiens
ggaaaaaaatgtgtat

SEQ ID NO: 111502 - DNA, 16 bp, H. sapiens
ggaaaaaaatgtttta

SEQ ID NO: 111503 - DNA, 16 bp, H. sapiens
ggaaaaaaattttttt

SEQ ID NO: 111504 - DNA, 16 bp, H. sapiens
ggaaaaaacaaacttt

SEQ ID NO: 111505 - DNA, 16 bp, H. sapiens
ggaaaaaacccaaatg

SEQ ID NO: 111506 - DNA, 16 bp, H. sapiens
ggaaaaaactaaagtt

SEQ ID NO: 111507 - DNA, 16 bp, H. sapiens
ggaaaaaactactgta

SEQ ID NO: 111508 - DNA, 16 bp, H. sapiens
ggaaaaaactatttta

SEQ ID NO: 111509 - DNA, 16 bp, H. sapiens
ggaaaaaagaaagtca

SEQ ID NO: 111510 - DNA, 16 bp, H. sapiens
ggaaaaaagttttttt

SEQ ID NO: 111511 - DNA, 16 bp, H. sapiens
ggaaaaaatatatatg

SEQ ID NO: 111512 - DNA, 16 bp, H. sapiens
ggaaaaaatatccaaa

SEQ ID NO: 111513 - DNA, 16 bp, H. sapiens
ggaaaaaatattaagg

SEQ ID NO: 111514 - DNA, 16 bp, H. sapiens
ggaaaaaatattttca

SEQ ID NO: 111515 - DNA, 16 bp, H. sapiens
ggaaaaacaggacact

SEQ ID NO: 111516 - DNA, 16 bp, H. sapiens
ggaaaaacattcagac

SEQ ID NO: 111517 - DNA, 16 bp, H. sapiens
ggaaaaacatttttaa

SEQ ID NO: 111518 - DNA, 16 bp, H. sapiens
ggaaaaacctaaagaa

SEQ ID NO: 111519 - DNA, 16 bp, H. sapiens
ggaaaaactaaaagcc

SEQ ID NO: 111520 - DNA, 16 bp, H. sapiens
ggaaaaactaccattt

SEQ ID NO: 111521 - DNA, 16 bp, H. sapiens
ggaaaaagaaatattt

SEQ ID NO: 111522 - DNA, 16 bp, H. sapiens
ggaaaaagacaaggat

SEQ ID NO: 111523 - DNA, 16 bp, H. sapiens
ggaaaaagacagtctc

SEQ ID NO: 111524 - DNA, 16 bp, H. sapiens
ggaaaaagatatccca

SEQ ID NO: 111525 - DNA, 16 bp, H. sapiens
ggaaaaagattccatg

SEQ ID NO: 111526 - DNA, 16 bp, H. sapiens
ggaaaaagcaccatga

SEQ ID NO: 111527 - DNA, 16 bp, H. sapiens
ggaaaaataaagtctt

SEQ ID NO: 111528 - DNA, 16 bp, H. sapiens
ggaaaaatacttttgc

SEQ ID NO: 111529 - DNA, 16 bp, H. sapiens
ggaaaaatagacaaat

SEQ ID NO: 111530 - DNA, 16 bp, H. sapiens
ggaaaaatatttccaa

SEQ ID NO: 111531 - DNA, 16 bp, H. sapiens
ggaaaaatatttgtaa

SEQ ID NO: 111532 - DNA, 16 bp, H. sapiens
ggaaaaatcacaagca

SEQ ID NO: 111533 - DNA, 16 bp, H. sapiens
ggaaaaatcccacttg

SEQ ID NO: 111534 - DNA, 16 bp, H. sapiens
ggaaaaatctaaaatc

SEQ ID NO: 111535 - DNA, 16 bp, H. sapiens
ggaaaaattatttgca

SEQ ID NO: 111536 - DNA, 16 bp, H. sapiens
ggaaaaattcaaagtg

SEQ ID NO: 111537 - DNA, 16 bp, H. sapiens
ggaaaacaacatggag

SEQ ID NO: 111538 - DNA, 16 bp, H. sapiens
ggaaaacaatttggag

SEQ ID NO: 111539 - DNA, 16 bp, H. sapiens
ggaaaacacaaattaa

SEQ ID NO: 111540 - DNA, 16 bp, H. sapiens
ggaaaacacatttaaa

SEQ ID NO: 111541 - DNA, 16 bp, H. sapiens
ggaaaacagaaaccat

SEQ ID NO: 111542 - DNA, 16 bp, H. sapiens
ggaaaacagaatggaa

SEQ ID NO: 111543 - DNA, 16 bp, H. sapiens
ggaaaacagtgtgatg

SEQ ID NO: 111544 - DNA, 16 bp, H. sapiens
ggaaaacagtttgaag

SEQ ID NO: 111545 - DNA, 16 bp, H. sapiens
ggaaaacattgctttt

SEQ ID NO: 111546 - DNA, 16 bp, H. sapiens
ggaaaaccgccttagg

SEQ ID NO: 111547 - DNA, 16 bp, H. sapiens
ggaaaacctagagaaa

SEQ ID NO: 111548 - DNA, 16 bp, H. sapiens
ggaaaactgaaaaatt

SEQ ID NO: 111549 - DNA, 16 bp, H. sapiens
ggaaaactgaatatcc

SEQ ID NO: 111550 - DNA, 20 bp, H. sapiens
ggaaaactgatttggtggaa

SEQ ID NO: 111551 - DNA, 16 bp, H. sapiens
ggaaaactgcttggca

SEQ ID NO: 111552 - DNA, 16 bp, H. sapiens
ggaaaacttctctggc

SEQ ID NO: 111553 - DNA, 16 bp, H. sapiens
ggaaaacttgaaagca

SEQ ID NO: 111554 - DNA, 16 bp, H. sapiens
ggaaaagaacagagcc

SEQ ID NO: 111555 - DNA, 16 bp, H. sapiens
ggaaaagaagaattca

SEQ ID NO: 111556 - DNA, 16 bp, H. sapiens
ggaaaagacaatctct

SEQ ID NO: 111557 - DNA, 16 bp, H. sapiens
ggaaaagacctggaaa

SEQ ID NO: 111558 - DNA, 16 bp, H. sapiens
ggaaaagagaaagtca

SEQ ID NO: 111559 - DNA, 16 bp, H. sapiens
ggaaaagatcaggaaa

SEQ ID NO: 111560 - DNA, 16 bp, H. sapiens
ggaaaagcagaaatca

SEQ ID NO: 111561 - DNA, 16 bp, H. sapiens
ggaaaagcagaagctg

SEQ ID NO: 111562 - DNA, 16 bp, H. sapiens
ggaaaagcagcagaca

SEQ ID NO: 111563 - DNA, 16 bp, H. sapiens
ggaaaagccacagatg

SEQ ID NO: 111564 - DNA, 16 bp, H. sapiens
ggaaaagcctcaggca

SEQ ID NO: 111565 - DNA, 16 bp, H. sapiens
ggaaaagctccagtct

SEQ ID NO: 111566 - DNA, 16 bp, H. sapiens
ggaaaagctgaccagc

SEQ ID NO: 111567 - DNA, 16 bp, H. sapiens
ggaaaagctgcaggta

SEQ ID NO: 111568 - DNA, 16 bp, H. sapiens
ggaaaagctttcagtc

SEQ ID NO: 111569 - DNA, 16 bp, H. sapiens
ggaaaaggaaaaattt

SEQ ID NO: 111570 - DNA, 16 bp, H. sapiens
ggaaaaggcaaggaca

SEQ ID NO: 111571 - DNA, 16 bp, H. sapiens
ggaaaaggccttgaag

SEQ ID NO: 111572 - DNA, 16 bp, H. sapiens
ggaaaaggctacctgg

SEQ ID NO: 111573 - DNA, 16 bp, H. sapiens
ggaaaaggctcaaatg

SEQ ID NO: 111574 - DNA, 16 bp, H. sapiens
ggaaaaggggttctgg

SEQ ID NO: 111575 - DNA, 16 bp, H. sapiens
ggaaaaggtggcaatg

SEQ ID NO: 111576 - DNA, 16 bp, H. sapiens
ggaaaagtcaagctgg

SEQ ID NO: 111577 - DNA, 16 bp, H. sapiens
ggaaaagtgcaatatt

SEQ ID NO: 111578 - DNA, 16 bp, H. sapiens
ggaaaagtgcagtatt

SEQ ID NO: 111579 - DNA, 16 bp, H. sapiens
ggaaaagtggaagctg

SEQ ID NO: 111580 - DNA, 16 bp, H. sapiens
ggaaaagttaagcttg

SEQ ID NO: 111581 - DNA, 16 bp, H. sapiens
ggaaaagttgaaagcc

SEQ ID NO: 111582 - DNA, 16 bp, H. sapiens
ggaaaagtttggaggg

SEQ ID NO: 111583 - DNA, 16 bp, H. sapiens
ggaaaataaaatcaag

SEQ ID NO: 111584 - DNA, 16 bp, H. sapiens
ggaaaataaatacatt

SEQ ID NO: 111585 - DNA, 16 bp, H. sapiens
ggaaaataaattattt

SEQ ID NO: 111586 - DNA, 16 bp, H. sapiens
ggaaaataaattttga

SEQ ID NO: 111587 - DNA, 16 bp, H. sapiens
ggaaaataagaatttt

SEQ ID NO: 111588 - DNA, 16 bp, H. sapiens
ggaaaataatttgttt

SEQ ID NO: 111589 - DNA, 16 bp, H. sapiens
ggaaaatacatttctg

SEQ ID NO: 111590 - DNA, 16 bp, H. sapiens
ggaaaatatattttta

SEQ ID NO: 111591 - DNA, 16 bp, H. sapiens
ggaaaatccagaagaa

SEQ ID NO: 111592 - DNA, 16 bp, H. sapiens
ggaaaatcgcctgaac

SEQ ID NO: 111593 - DNA, 16 bp, H. sapiens
ggaaaatctcagcaat

SEQ ID NO: 111594 - DNA, 16 bp, H. sapiens
ggaaaatctgccccca

SEQ ID NO: 111595 - DNA, 16 bp, H. sapiens
ggaaaatctgttgttt

SEQ ID NO: 111596 - DNA, 16 bp, H. sapiens
ggaaaatcttcccagt

SEQ ID NO: 111597 - DNA, 16 bp, H. sapiens
ggaaaatgaaaaagtt

SEQ ID NO: 111598 - DNA, 16 bp, H. sapiens
ggaaaatgaaaagcaa

SEQ ID NO: 111599 - DNA, 16 bp, H. sapiens
ggaaaatgaaatgaat

SEQ ID NO: 111600 - DNA, 16 bp, H. sapiens
ggaaaatgacatttta

SEQ ID NO: 111601 - DNA, 16 bp, H. sapiens
ggaaaatgcaaattta

SEQ ID NO: 111602 - DNA, 16 bp, H. sapiens
ggaaaatgcctcaaag

SEQ ID NO: 111603 - DNA, 16 bp, H. sapiens
ggaaaatgcctccagg

SEQ ID NO: 111604 - DNA, 16 bp, H. sapiens
ggaaaatgggaataat

SEQ ID NO: 111605 - DNA, 16 bp, H. sapiens
ggaaaatgtctccagg

SEQ ID NO: 111606 - DNA, 16 bp, H. sapiens
ggaaaatgtgggacag

SEQ ID NO: 111607 - DNA, 16 bp, H. sapiens
ggaaaatgttataatt

SEQ ID NO: 111608 - DNA, 16 bp, H. sapiens
ggaaaatgttttcaaa

SEQ ID NO: 111609 - DNA, 16 bp, H. sapiens
ggaaaattaaatgaga

SEQ ID NO: 111610 - DNA, 16 bp, H. sapiens
ggaaaattattgtgtt

SEQ ID NO: 111611 - DNA, 16 bp, H. sapiens
ggaaaattgaaagtat

SEQ ID NO: 111612 - DNA, 16 bp, H. sapiens
ggaaaatttgcagcca

SEQ ID NO: 111613 - DNA, 16 bp, H. sapiens
ggaaacaaatgagaaa

SEQ ID NO: 111614 - DNA, 16 bp, H. sapiens
ggaaacaacaaaaagt

SEQ ID NO: 111615 - DNA, 16 bp, H. sapiens
ggaaacaacagatgtt

SEQ ID NO: 111616 - DNA, 16 bp, H. sapiens
ggaaacaagaatgaaa

SEQ ID NO: 111617 - DNA, 16 bp, H. sapiens
ggaaacactctgcagg

SEQ ID NO: 111618 - DNA, 16 bp, H. sapiens
ggaaacactgattttg

SEQ ID NO: 111619 - DNA, 16 bp, H. sapiens
ggaaacagactcagag

SEQ ID NO: 111620 - DNA, 16 bp, H. sapiens
ggaaacagagcaagat

SEQ ID NO: 111621 - DNA, 16 bp, H. sapiens
ggaaacagagccaaac

SEQ ID NO: 111622 - DNA, 16 bp, H. sapiens
ggaaacagagcgagat

SEQ ID NO: 111623 - DNA, 16 bp, H. sapiens
ggaaacagaggcccag

SEQ ID NO: 111624 - DNA, 16 bp, H. sapiens
ggaaacagcagaagca

SEQ ID NO: 111625 - DNA, 16 bp, H. sapiens
ggaaacaggtgctgga

SEQ ID NO: 111626 - DNA, 16 bp, H. sapiens
ggaaacagtcaacaaa

SEQ ID NO: 111627 - DNA, 16 bp, H. sapiens
ggaaacataactccat

SEQ ID NO: 111628 - DNA, 16 bp, H. sapiens
ggaaacatttgtcatc

SEQ ID NO: 111629 - DNA, 16 bp, H. sapiens
ggaaacatttttattt

SEQ ID NO: 111630 - DNA, 16 bp, H. sapiens
ggaaaccaaggcccag

SEQ ID NO: 111631 - DNA, 16 bp, H. sapiens
ggaaacccaaagacaa

SEQ ID NO: 111632 - DNA, 16 bp, H. sapiens
ggaaaccgaggctcag

SEQ ID NO: 111633 - DNA, 16 bp, H. sapiens
ggaaactaaacaactt

SEQ ID NO: 111634 - DNA, 16 bp, H. sapiens
ggaaactaatggaaga

SEQ ID NO: 111635 - DNA, 16 bp, H. sapiens
ggaaactgaagcccag

SEQ ID NO: 111636 - DNA, 16 bp, H. sapiens
ggaaactgaagctcag

SEQ ID NO: 111637 - DNA, 16 bp, H. sapiens
ggaaactgagcctcag

SEQ ID NO: 111638 - DNA, 16 bp, H. sapiens
ggaaactgaggaagag

SEQ ID NO: 111639 - DNA, 16 bp, H. sapiens
ggaaactgaggcacgg

SEQ ID NO: 111640 - DNA, 16 bp, H. sapiens
ggaaactgaggcagag

SEQ ID NO: 111641 - DNA, 16 bp, H. sapiens
ggaaactgaggcatgg

SEQ ID NO: 111642 - DNA, 16 bp, H. sapiens
ggaaactgaggcccag

SEQ ID NO: 111643 - DNA, 16 bp, H. sapiens
ggaaactgaggctcaa

SEQ ID NO: 111644 - DNA, 16 bp, H. sapiens
ggaaactgaggctcag

SEQ ID NO: 111645 - DNA, 16 bp, H. sapiens
ggaaactgaggctcgg

SEQ ID NO: 111646 - DNA, 16 bp, H. sapiens
ggaaactgaggcttaa

SEQ ID NO: 111647 - DNA, 16 bp, H. sapiens
ggaaactgaggcttag

SEQ ID NO: 111648 - DNA, 16 bp, H. sapiens
ggaaactgaggttcca

SEQ ID NO: 111649 - DNA, 16 bp, H. sapiens
ggaaactgagtcacag

SEQ ID NO: 111650 - DNA, 16 bp, H. sapiens
ggaaacttacaatcat

SEQ ID NO: 111651 - DNA, 16 bp, H. sapiens
ggaaacttacagtcgt

SEQ ID NO: 111652 - DNA, 16 bp, H. sapiens
ggaaacttacgatcat

SEQ ID NO: 111653 - DNA, 16 bp, H. sapiens
ggaaacttatttattg

SEQ ID NO: 111654 - DNA, 16 bp, H. sapiens
ggaaacttctcccaca

SEQ ID NO: 111655 - DNA, 16 bp, H. sapiens
ggaaacttctttgtga

SEQ ID NO: 111656 - DNA, 16 bp, H. sapiens
ggaaacttgttagaaa

SEQ ID NO: 111657 - DNA, 16 bp, H. sapiens
ggaaagaaaacatttt

SEQ ID NO: 111658 - DNA, 16 bp, H. sapiens
ggaaagaaaatatttt

SEQ ID NO: 111659 - DNA, 16 bp, H. sapiens
ggaaagaaaatcagtg

SEQ ID NO: 111660 - DNA, 16 bp, H. sapiens
ggaaagaaactcagct

SEQ ID NO: 111661 - DNA, 16 bp, H. sapiens
ggaaagaaattatttt

SEQ ID NO: 111662 - DNA, 16 bp, H. sapiens
ggaaagaagacactct

SEQ ID NO: 111663 - DNA, 16 bp, H. sapiens
ggaaagaagccatctc

SEQ ID NO: 111664 - DNA, 16 bp, H. sapiens
ggaaagaagctaaagc

SEQ ID NO: 111665 - DNA, 16 bp, H. sapiens
ggaaagaaggcaggca

SEQ ID NO: 111666 - DNA, 16 bp, H. sapiens
ggaaagaatgtatatt

SEQ ID NO: 111667 - DNA, 16 bp, H. sapiens
ggaaagaattcagtga

SEQ ID NO: 111668 - DNA, 16 bp, H. sapiens
ggaaagacaaatacca

SEQ ID NO: 111669 - DNA, 16 bp, H. sapiens
ggaaagacctgagaag

SEQ ID NO: 111670 - DNA, 16 bp, H. sapiens
ggaaagactccctatt

SEQ ID NO: 111671 - DNA, 16 bp, H. sapiens
ggaaagactggccccc

SEQ ID NO: 111672 - DNA, 16 bp, H. sapiens
ggaaagagacagacag

SEQ ID NO: 111673 - DNA, 16 bp, H. sapiens
ggaaagagccctggat

SEQ ID NO: 111674 - DNA, 16 bp, H. sapiens
ggaaagatctaaaatc

SEQ ID NO: 111675 - DNA, 16 bp, H. sapiens
ggaaagatctcaaatt

SEQ ID NO: 111676 - DNA, 16 bp, H. sapiens
ggaaagatttttttaa

SEQ ID NO: 111677 - DNA, 16 bp, H. sapiens
ggaaagcaatttgaca

SEQ ID NO: 111678 - DNA, 16 bp, H. sapiens
ggaaagcatcaggaaa

SEQ ID NO: 111679 - DNA, 16 bp, H. sapiens
ggaaagcattcagttt

SEQ ID NO: 111680 - DNA, 16 bp, H. sapiens
ggaaagccaatggtgt

SEQ ID NO: 111681 - DNA, 16 bp, H. sapiens
ggaaagcctttccaag

SEQ ID NO: 111682 - DNA, 16 bp, H. sapiens
ggaaagctgagagaat

SEQ ID NO: 111683 - DNA, 16 bp, H. sapiens
ggaaagcttcctggag

SEQ ID NO: 111684 - DNA, 16 bp, H. sapiens
ggaaagcttttataca

SEQ ID NO: 111685 - DNA, 16 bp, H. sapiens
ggaaaggaagaagtca

SEQ ID NO: 111686 - DNA, 16 bp, H. sapiens
ggaaaggaagatgtaa

SEQ ID NO: 111687 - DNA, 16 bp, H. sapiens
ggaaaggaaggaatca

SEQ ID NO: 111688 - DNA, 16 bp, H. sapiens
ggaaaggaccccagac

SEQ ID NO: 111689 - DNA, 16 bp, H. sapiens
ggaaaggagaaagtca

SEQ ID NO: 111690 - DNA, 16 bp, H. sapiens
ggaaaggagagtctct

SEQ ID NO: 111691 - DNA, 16 bp, H. sapiens
ggaaaggaggctgaag

SEQ ID NO: 111692 - DNA, 16 bp, H. sapiens
ggaaaggatccagttt

SEQ ID NO: 111693 - DNA, 16 bp, H. sapiens
ggaaaggattctctgt

SEQ ID NO: 111694 - DNA, 16 bp, H. sapiens
ggaaaggcaaaggaac

SEQ ID NO: 111695 - DNA, 16 bp, H. sapiens
ggaaaggccatatgag

SEQ ID NO: 111696 - DNA, 16 bp, H. sapiens
ggaaaggcctcaggaa

SEQ ID NO: 111697 - DNA, 16 bp, H. sapiens
ggaaaggcctgccccc

SEQ ID NO: 111698 - DNA, 16 bp, H. sapiens
ggaaaggctgcatatt

SEQ ID NO: 111699 - DNA, 16 bp, H. sapiens
ggaaaggctttcattt

SEQ ID NO: 111700 - DNA, 16 bp, H. sapiens
ggaaaggcttttagtt

SEQ ID NO: 111701 - DNA, 16 bp, H. sapiens
ggaaagggaaatgatc

SEQ ID NO: 111702 - DNA, 16 bp, H. sapiens
ggaaagggaacccaga

SEQ ID NO: 111703 - DNA, 16 bp, H. sapiens
ggaaaggggctgcagg

SEQ ID NO: 111704 - DNA, 16 bp, H. sapiens
ggaaagggggcctcat

SEQ ID NO: 111705 - DNA, 16 bp, H. sapiens
ggaaaggggtcagggc

SEQ ID NO: 111706 - DNA, 16 bp, H. sapiens
ggaaagtaaattgaaa

SEQ ID NO: 111707 - DNA, 16 bp, H. sapiens
ggaaagtctttgaaga

SEQ ID NO: 111708 - DNA, 16 bp, H. sapiens
ggaaagtgaaaccaca

SEQ ID NO: 111709 - DNA, 16 bp, H. sapiens
ggaaagtgaacaacct

SEQ ID NO: 111710 - DNA, 16 bp, H. sapiens
ggaaagtgaggagccc

SEQ ID NO: 111711 - DNA, 16 bp, H. sapiens
ggaaagtgaggcccag

SEQ ID NO: 111712 - DNA, 16 bp, H. sapiens
ggaaagtgattaagtc

SEQ ID NO: 111713 - DNA, 16 bp, H. sapiens
ggaaagtgggtgcagc

SEQ ID NO: 111714 - DNA, 16 bp, H. sapiens
ggaaagtgggtgcagg

SEQ ID NO: 111715 - DNA, 16 bp, H. sapiens
ggaaagtgtgtgtgtg

SEQ ID NO: 111716 - DNA, 16 bp, H. sapiens
ggaaagttagctcttc

SEQ ID NO: 111717 - DNA, 16 bp, H. sapiens
ggaaagttctcctgga

SEQ ID NO: 111718 - DNA, 16 bp, H. sapiens
ggaaagtttcaacaat

SEQ ID NO: 111719 - DNA, 16 bp, H. sapiens
ggaaagtttgaaactt

SEQ ID NO: 111720 - DNA, 16 bp, H. sapiens
ggaaagttttcagcca

SEQ ID NO: 111721 - DNA, 16 bp, H. sapiens
ggaaagttttcctcaa

SEQ ID NO: 111722 - DNA, 16 bp, H. sapiens
ggaaataaaatacaca

SEQ ID NO: 111723 - DNA, 16 bp, H. sapiens
ggaaataaacttttaa

SEQ ID NO: 111724 - DNA, 16 bp, H. sapiens
ggaaataaagcgtatt

SEQ ID NO: 111725 - DNA, 16 bp, H. sapiens
ggaaataaatcattct

SEQ ID NO: 111726 - DNA, 16 bp, H. sapiens
ggaaataaatttctgt

SEQ ID NO: 111727 - DNA, 16 bp, H. sapiens
ggaaataattcttttt

SEQ ID NO: 111728 - DNA, 16 bp, H. sapiens
ggaaataattttttaa

SEQ ID NO: 111729 - DNA, 16 bp, H. sapiens
ggaaatacaagtcaaa

SEQ ID NO: 111730 - DNA, 16 bp, H. sapiens
ggaaatattccaaaat

SEQ ID NO: 111731 - DNA, 16 bp, H. sapiens
ggaaatattctatatt

SEQ ID NO: 111732 - DNA, 16 bp, H. sapiens
ggaaatatttttttct

SEQ ID NO: 111733 - DNA, 20 bp, H. sapiens
ggaaatcacaagggtattga

SEQ ID NO: 111734 - DNA, 16 bp, H. sapiens
ggaaatcagaaaatat

SEQ ID NO: 111735 - DNA, 16 bp, H. sapiens
ggaaatcagtgtattg

SEQ ID NO: 111736 - DNA, 16 bp, H. sapiens
ggaaatcatagatgac

SEQ ID NO: 111737 - DNA, 16 bp, H. sapiens
ggaaatcattttggag

SEQ ID NO: 111738 - DNA, 16 bp, H. sapiens
ggaaatccaagatgaa

SEQ ID NO: 111739 - DNA, 16 bp, H. sapiens
ggaaatccaccctcat

SEQ ID NO: 111740 - DNA, 16 bp, H. sapiens
ggaaatgaacaaagcc

SEQ ID NO: 111741 - DNA, 16 bp, H. sapiens
ggaaatgaagaaatca

SEQ ID NO: 111742 - DNA, 16 bp, H. sapiens
ggaaatgactttggaa

SEQ ID NO: 111743 - DNA, 16 bp, H. sapiens
ggaaatgagagaggac

SEQ ID NO: 111744 - DNA, 16 bp, H. sapiens
ggaaatgcaaaccaaa

SEQ ID NO: 111745 - DNA, 16 bp, H. sapiens
ggaaatgcaaatccaa

SEQ ID NO: 111746 - DNA, 16 bp, H. sapiens
ggaaatgccccagttt

SEQ ID NO: 111747 - DNA, 16 bp, H. sapiens
ggaaatggaaaccaaa

SEQ ID NO: 111748 - DNA, 16 bp, H. sapiens
ggaaatggaaattaaa

SEQ ID NO: 111749 - DNA, 16 bp, H. sapiens
ggaaatggaagcccag

SEQ ID NO: 111750 - DNA, 16 bp, H. sapiens
ggaaatggagaaatca

SEQ ID NO: 111751 - DNA, 16 bp, H. sapiens
ggaaatggagtgaatg

SEQ ID NO: 111752 - DNA, 16 bp, H. sapiens
ggaaatggcagagctg

SEQ ID NO: 111753 - DNA, 16 bp, H. sapiens
ggaaatgtaaaatagt

SEQ ID NO: 111754 - DNA, 16 bp, H. sapiens
ggaaatgtaaattaat

SEQ ID NO: 111755 - DNA, 16 bp, H. sapiens
ggaaatgtggacacag

SEQ ID NO: 111756 - DNA, 16 bp, H. sapiens
ggaaatgttctatatt

SEQ ID NO: 111757 - DNA, 16 bp, H. sapiens
ggaaattaaaaagcaa

SEQ ID NO: 111758 - DNA, 16 bp, H. sapiens
ggaaattaaatttatg

SEQ ID NO: 111759 - DNA, 16 bp, H. sapiens
ggaaattccagcctgg

SEQ ID NO: 111760 - DNA, 16 bp, H. sapiens
ggaaattccctgagtt

SEQ ID NO: 111761 - DNA, 16 bp, H. sapiens
ggaaattctggagctg

SEQ ID NO: 111762 - DNA, 16 bp, H. sapiens
ggaaattgagactcaa

SEQ ID NO: 111763 - DNA, 16 bp, H. sapiens
ggaaattgaggctgag

SEQ ID NO: 111764 - DNA, 16 bp, H. sapiens
ggaaatttctttaaaa

SEQ ID NO: 111765 - DNA, 16 bp, H. sapiens
ggaaatttgttagaaa

SEQ ID NO: 111766 - DNA, 16 bp, H. sapiens
ggaacaaagctggagg

SEQ ID NO: 111767 - DNA, 16 bp, H. sapiens
ggaacaagagacactg

SEQ ID NO: 111768 - DNA, 16 bp, H. sapiens
ggaacaagataaggat

SEQ ID NO: 111769 - DNA, 16 bp, H. sapiens
ggaacaagcattctgt

SEQ ID NO: 111770 - DNA, 16 bp, H. sapiens
ggaacaaggaaaacat

SEQ ID NO: 111771 - DNA, 16 bp, H. sapiens
ggaacaagtcaaggat

SEQ ID NO: 111772 - DNA, 16 bp, H. sapiens
ggaacacagccacgcc

SEQ ID NO: 111773 - DNA, 16 bp, H. sapiens
ggaacacagccatgct

SEQ ID NO: 111774 - DNA, 16 bp, H. sapiens
ggaacacaggaaggaa

SEQ ID NO: 111775 - DNA, 16 bp, H. sapiens
ggaacacagtggtgcc

SEQ ID NO: 111776 - DNA, 16 bp, H. sapiens
ggaacacttgaggcca

SEQ ID NO: 111777 - DNA, 16 bp, H. sapiens
ggaacagaaaatcaaa

SEQ ID NO: 111778 - DNA, 16 bp, H. sapiens
ggaacagaacagacaa

SEQ ID NO: 111779 - DNA, 16 bp, H. sapiens
ggaacagaacagagca

SEQ ID NO: 111780 - DNA, 17 bp, H. sapiens
ggaacagaacagatccc

SEQ ID NO: 111781 - DNA, 16 bp, H. sapiens
ggaacagaagaaatat

SEQ ID NO: 111782 - DNA, 16 bp, H. sapiens
ggaacagaatggaaaa

SEQ ID NO: 111783 - DNA, 16 bp, H. sapiens
ggaacagagactagag

SEQ ID NO: 111784 - DNA, 17 bp, H. sapiens
ggaacagagccctcaga

SEQ ID NO: 111785 - DNA, 16 bp, H. sapiens
ggaacagctggtacca

SEQ ID NO: 111786 - DNA, 16 bp, H. sapiens
ggaacaggacagagcc

SEQ ID NO: 111787 - DNA, 16 bp, H. sapiens
ggaacaggagctggtg

SEQ ID NO: 111788 - DNA, 16 bp, H. sapiens
ggaacaggaggatttt

SEQ ID NO: 111789 - DNA, 16 bp, H. sapiens
ggaacagtgcattcca

SEQ ID NO: 111790 - DNA, 16 bp, H. sapiens
ggaacagtgcctggca

SEQ ID NO: 111791 - DNA, 16 bp, H. sapiens
ggaacatatctgaaaa

SEQ ID NO: 111792 - DNA, 17 bp, H. sapiens
ggaacatccctgagaaa

SEQ ID NO: 111793 - DNA, 16 bp, H. sapiens
ggaacatctcaccaat

SEQ ID NO: 111794 - DNA, 16 bp, H. sapiens
ggaacatctgagcccc

SEQ ID NO: 111795 - DNA, 16 bp, H. sapiens
ggaaccaaaaagaagc

SEQ ID NO: 111796 - DNA, 16 bp, H. sapiens
ggaaccacaaaagact

SEQ ID NO: 111797 - DNA, 16 bp, H. sapiens
ggaaccacccccatga

SEQ ID NO: 111798 - DNA, 16 bp, H. sapiens
ggaaccagaaaagcaa

SEQ ID NO: 111799 - DNA, 16 bp, H. sapiens
ggaaccagagaaacaa

SEQ ID NO: 111800 - DNA, 16 bp, H. sapiens
ggaaccagagcaactc

SEQ ID NO: 111801 - DNA, 16 bp, H. sapiens
ggaaccagcaaaggag

SEQ ID NO: 111802 - DNA, 16 bp, H. sapiens
ggaaccaggctgcaca

SEQ ID NO: 111803 - DNA, 16 bp, H. sapiens
ggaaccaggttggaaa

SEQ ID NO: 111804 - DNA, 16 bp, H. sapiens
ggaacccagaaggtgg

SEQ ID NO: 111805 - DNA, 16 bp, H. sapiens
ggaaccctgggcctgg

SEQ ID NO: 111806 - DNA, 16 bp, H. sapiens
ggaaccctgtctctac

SEQ ID NO: 111807 - DNA, 16 bp, H. sapiens
ggaaccggggctgcgc

SEQ ID NO: 111808 - DNA, 16 bp, H. sapiens
ggaacctccacctcct

SEQ ID NO: 111809 - DNA, 16 bp, H. sapiens
ggaacctgctgcactg

SEQ ID NO: 111810 - DNA, 16 bp, H. sapiens
ggaacctgctgccttg

SEQ ID NO: 111811 - DNA, 16 bp, H. sapiens
ggaacctgggaggcag

SEQ ID NO: 111812 - DNA, 16 bp, H. sapiens
ggaacgcttttacatt

SEQ ID NO: 111813 - DNA, 16 bp, H. sapiens
ggaactaatagagtga

SEQ ID NO: 111814 - DNA, 16 bp, H. sapiens
ggaactacaggtgtac

SEQ ID NO: 111815 - DNA, 16 bp, H. sapiens
ggaactcagaggccag

SEQ ID NO: 111816 - DNA, 16 bp, H. sapiens
ggaactcctaacctca

SEQ ID NO: 111817 - DNA, 16 bp, H. sapiens
ggaactcctctttata

SEQ ID NO: 111818 - DNA, 16 bp, H. sapiens
ggaactgaggtccaga

SEQ ID NO: 111819 - DNA, 16 bp, H. sapiens
ggaactgaggttcaga

SEQ ID NO: 111820 - DNA, 16 bp, H. sapiens
ggaactgcctgctggc

SEQ ID NO: 111821 - DNA, 16 bp, H. sapiens
ggaactgctgggctca

SEQ ID NO: 111822 - DNA, 16 bp, H. sapiens
ggaactggagatcact

SEQ ID NO: 111823 - DNA, 16 bp, H. sapiens
ggaactggagcaaaga

SEQ ID NO: 111824 - DNA, 16 bp, H. sapiens
ggaactggaggaggag

SEQ ID NO: 111825 - DNA, 16 bp, H. sapiens
ggaactggaggccact

SEQ ID NO: 111826 - DNA, 16 bp, H. sapiens
ggaactggaggttatt

SEQ ID NO: 111827 - DNA, 16 bp, H. sapiens
ggaactggagtaaaga

SEQ ID NO: 111828 - DNA, 16 bp, H. sapiens
ggaactggagtaaatg

SEQ ID NO: 111829 - DNA, 16 bp, H. sapiens
ggaactggcagcccag

SEQ ID NO: 111830 - DNA, 16 bp, H. sapiens
ggaactggcagcctgg

SEQ ID NO: 111831 - DNA, 16 bp, H. sapiens
ggaactgggaaacagg

SEQ ID NO: 111832 - DNA, 16 bp, H. sapiens
ggaactgggcctcaca

SEQ ID NO: 111833 - DNA, 16 bp, H. sapiens
ggaactgggtaatgag

SEQ ID NO: 111834 - DNA, 16 bp, H. sapiens
ggaactggtgggaggt

SEQ ID NO: 111835 - DNA, 16 bp, H. sapiens
ggaactgtgagtcaat

SEQ ID NO: 111836 - DNA, 16 bp, H. sapiens
ggaactgtgcaaccca

SEQ ID NO: 111837 - DNA, 16 bp, H. sapiens
ggaacttaaaaataaa

SEQ ID NO: 111838 - DNA, 16 bp, H. sapiens
ggaacttcctagagaa

SEQ ID NO: 111839 - DNA, 16 bp, H. sapiens
ggaacttgttggaaat

SEQ ID NO: 111840 - DNA, 16 bp, H. sapiens
ggaacttgttgggaat

SEQ ID NO: 111841 - DNA, 16 bp, H. sapiens
ggaacttttttctttt

SEQ ID NO: 111842 - DNA, 16 bp, H. sapiens
ggaagaaaaaatggtt

SEQ ID NO: 111843 - DNA, 16 bp, H. sapiens
ggaagaaaaaattcag

SEQ ID NO: 111844 - DNA, 16 bp, H. sapiens
ggaagaaaaacatttt

SEQ ID NO: 111845 - DNA, 16 bp, H. sapiens
ggaagaaaacaaggat

SEQ ID NO: 111846 - DNA, 16 bp, H. sapiens
ggaagaaaacatgtcc

SEQ ID NO: 111847 - DNA, 16 bp, H. sapiens
ggaagaaaactggaaa

SEQ ID NO: 111848 - DNA, 16 bp, H. sapiens
ggaagaaaactggcaa

SEQ ID NO: 111849 - DNA, 16 bp, H. sapiens
ggaagaaaatgaaagc

SEQ ID NO: 111850 - DNA, 16 bp, H. sapiens
ggaagaaacaggcagc

SEQ ID NO: 111851 - DNA, 16 bp, H. sapiens
ggaagaaactccaaac

SEQ ID NO: 111852 - DNA, 16 bp, H. sapiens
ggaagaaactttggaa

SEQ ID NO: 111853 - DNA, 16 bp, H. sapiens
ggaagaaagaaataca

SEQ ID NO: 111854 - DNA, 16 bp, H. sapiens
ggaagaaagaaattca

SEQ ID NO: 111855 - DNA, 16 bp, H. sapiens
ggaagaaagaattcag

SEQ ID NO: 111856 - DNA, 16 bp, H. sapiens
ggaagaaagaattgca

SEQ ID NO: 111857 - DNA, 16 bp, H. sapiens
ggaagaaagaatttca

SEQ ID NO: 111858 - DNA, 16 bp, H. sapiens
ggaagaaataaaaact

SEQ ID NO: 111859 - DNA, 16 bp, H. sapiens
ggaagaaatgactgca

SEQ ID NO: 111860 - DNA, 16 bp, H. sapiens
ggaagaaatttctaag

SEQ ID NO: 111861 - DNA, 16 bp, H. sapiens
ggaagaacaaatgccc

SEQ ID NO: 111862 - DNA, 16 bp, H. sapiens
ggaagaacattccagg

SEQ ID NO: 111863 - DNA, 16 bp, H. sapiens
ggaagaacccatcagg

SEQ ID NO: 111864 - DNA, 16 bp, H. sapiens
ggaagaactgatatct

SEQ ID NO: 111865 - DNA, 16 bp, H. sapiens
ggaagaagaaataatt

SEQ ID NO: 111866 - DNA, 16 bp, H. sapiens
ggaagaagacaagaat

SEQ ID NO: 111867 - DNA, 16 bp, H. sapiens
ggaagaagacatagaa

SEQ ID NO: 111868 - DNA, 16 bp, H. sapiens
ggaagaagatattcca

SEQ ID NO: 111869 - DNA, 16 bp, H. sapiens
ggaagaagatgccatg

SEQ ID NO: 111870 - DNA, 16 bp, H. sapiens
ggaagaagcaggcagc

SEQ ID NO: 111871 - DNA, 16 bp, H. sapiens
ggaagaagccagtcac

SEQ ID NO: 111872 - DNA, 16 bp, H. sapiens
ggaagaagctgaatcc

SEQ ID NO: 111873 - DNA, 16 bp, H. sapiens
ggaagaagggtggcaa

SEQ ID NO: 111874 - DNA, 16 bp, H. sapiens
ggaagaagtaaaacaa

SEQ ID NO: 111875 - DNA, 16 bp, H. sapiens
ggaagaagtaaaactg

SEQ ID NO: 111876 - DNA, 16 bp, H. sapiens
ggaagaatatcacagg

SEQ ID NO: 111877 - DNA, 16 bp, H. sapiens
ggaagaatctgttcca

SEQ ID NO: 111878 - DNA, 16 bp, H. sapiens
ggaagaatctgtttcc

SEQ ID NO: 111879 - DNA, 16 bp, H. sapiens
ggaagaattgacatct

SEQ ID NO: 111880 - DNA, 16 bp, H. sapiens
ggaagaatttcttaaa

SEQ ID NO: 111881 - DNA, 16 bp, H. sapiens
ggaagacaagattaga

SEQ ID NO: 111882 - DNA, 16 bp, H. sapiens
ggaagacacaaacatt

SEQ ID NO: 111883 - DNA, 16 bp, H. sapiens
ggaagacagacaataa

SEQ ID NO: 111884 - DNA, 16 bp, H. sapiens
ggaagacagcatggtg

SEQ ID NO: 111885 - DNA, 16 bp, H. sapiens
ggaagacagccatgtg

SEQ ID NO: 111886 - DNA, 16 bp, H. sapiens
ggaagacaggaagtca

SEQ ID NO: 111887 - DNA, 16 bp, H. sapiens
ggaagacagtgtggag

SEQ ID NO: 111888 - DNA, 16 bp, H. sapiens
ggaagaccacagaggt

SEQ ID NO: 111889 - DNA, 16 bp, H. sapiens
ggaagaccctgatgaa

SEQ ID NO: 111890 - DNA, 16 bp, H. sapiens
ggaagaccctgtctca

SEQ ID NO: 111891 - DNA, 16 bp, H. sapiens
ggaagagaaagtcaaa

SEQ ID NO: 111892 - DNA, 16 bp, H. sapiens
ggaagagaaatatatt

SEQ ID NO: 111893 - DNA, 16 bp, H. sapiens
ggaagagagaagctgg

SEQ ID NO: 111894 - DNA, 16 bp, H. sapiens
ggaagagaggaaatca

SEQ ID NO: 111895 - DNA, 16 bp, H. sapiens
ggaagagagtgtggtg

SEQ ID NO: 111896 - DNA, 16 bp, H. sapiens
ggaagagataccagag

SEQ ID NO: 111897 - DNA, 16 bp, H. sapiens
ggaagagattagcatt

SEQ ID NO: 111898 - DNA, 16 bp, H. sapiens
ggaagagattgcagtg

SEQ ID NO: 111899 - DNA, 16 bp, H. sapiens
ggaagagcattccagg

SEQ ID NO: 111900 - DNA, 16 bp, H. sapiens
ggaagagccaggattt

SEQ ID NO: 111901 - DNA, 16 bp, H. sapiens
ggaagagctttccagg

SEQ ID NO: 111902 - DNA, 16 bp, H. sapiens
ggaagaggaggctgag

SEQ ID NO: 111903 - DNA, 16 bp, H. sapiens
ggaagaggagggatta

SEQ ID NO: 111904 - DNA, 16 bp, H. sapiens
ggaagaggcgctcctc

SEQ ID NO: 111905 - DNA, 16 bp, H. sapiens
ggaagaggggctgaag

SEQ ID NO: 111906 - DNA, 16 bp, H. sapiens
ggaagaggggctggag

SEQ ID NO: 111907 - DNA, 16 bp, H. sapiens
ggaagaggtaaaatta

SEQ ID NO: 111908 - DNA, 16 bp, H. sapiens
ggaagaggtggtgtgt

SEQ ID NO: 111909 - DNA, 16 bp, H. sapiens
ggaagagtgtcccagg

SEQ ID NO: 111910 - DNA, 16 bp, H. sapiens
ggaagagtttgagaag

SEQ ID NO: 111911 - DNA, 16 bp, H. sapiens
ggaagataacctaggc

SEQ ID NO: 111912 - DNA, 16 bp, H. sapiens
ggaagatctaaataaa

SEQ ID NO: 111913 - DNA, 16 bp, H. sapiens
ggaagatgaaaaaatt

SEQ ID NO: 111914 - DNA, 16 bp, H. sapiens
ggaagatgaggctgca

SEQ ID NO: 111915 - DNA, 16 bp, H. sapiens
ggaagatggcagagta

SEQ ID NO: 111916 - DNA, 16 bp, H. sapiens
ggaagatggccatgtg

SEQ ID NO: 111917 - DNA, 16 bp, H. sapiens
ggaagatgggagtttt

SEQ ID NO: 111918 - DNA, 16 bp, H. sapiens
ggaagatgttggtcaa

SEQ ID NO: 111919 - DNA, 16 bp, H. sapiens
ggaagattgctggagc

SEQ ID NO: 111920 - DNA, 16 bp, H. sapiens
ggaagcaaacacgtcc

SEQ ID NO: 111921 - DNA, 16 bp, H. sapiens
ggaagcaaaggttgca

SEQ ID NO: 111922 - DNA, 16 bp, H. sapiens
ggaagcactgaatatg

SEQ ID NO: 111923 - DNA, 16 bp, H. sapiens
ggaagcagaagcagga

SEQ ID NO: 111924 - DNA, 16 bp, H. sapiens
ggaagcagacagcagc

SEQ ID NO: 111925 - DNA, 16 bp, H. sapiens
ggaagcagagacagga

SEQ ID NO: 111926 - DNA, 16 bp, H. sapiens
ggaagcagagactggg

SEQ ID NO: 111927 - DNA, 16 bp, H. sapiens
ggaagcagagagcaga

SEQ ID NO: 111928 - DNA, 16 bp, H. sapiens
ggaagcagaggataaa

SEQ ID NO: 111929 - DNA, 16 bp, H. sapiens
ggaagcagagtataaa

SEQ ID NO: 111930 - DNA, 16 bp, H. sapiens
ggaagcagcaggaaaa

SEQ ID NO: 111931 - DNA, 16 bp, H. sapiens
ggaagcaggaacatct

SEQ ID NO: 111932 - DNA, 16 bp, H. sapiens
ggaagcaggaagacca

SEQ ID NO: 111933 - DNA, 16 bp, H. sapiens
ggaagcaggagacaga

SEQ ID NO: 111934 - DNA, 16 bp, H. sapiens
ggaagcaggagaggca

SEQ ID NO: 111935 - DNA, 16 bp, H. sapiens
ggaagcaggaggagca

SEQ ID NO: 111936 - DNA, 16 bp, H. sapiens
ggaagcaggaggctgg

SEQ ID NO: 111937 - DNA, 16 bp, H. sapiens
ggaagcagtttggaga

SEQ ID NO: 111938 - DNA, 16 bp, H. sapiens
ggaagcatctagcatg

SEQ ID NO: 111939 - DNA, 16 bp, H. sapiens
ggaagcatggtactgg

SEQ ID NO: 111940 - DNA, 16 bp, H. sapiens
ggaagcattccccctt

SEQ ID NO: 111941 - DNA, 32 bp, H. sapiens
ggaagcattccctttgaaaactggcacaagag

SEQ ID NO: 111942 - DNA, 16 bp, H. sapiens
ggaagccaaagcagaa

SEQ ID NO: 111943 - DNA, 16 bp, H. sapiens
ggaagccaaggcgggc

SEQ ID NO: 111944 - DNA, 16 bp, H. sapiens
ggaagccaaggtggaa

SEQ ID NO: 111945 - DNA, 16 bp, H. sapiens
ggaagccaaggtggga

SEQ ID NO: 111946 - DNA, 16 bp, H. sapiens
ggaagccagctgtcat

SEQ ID NO: 111947 - DNA, 16 bp, H. sapiens
ggaagccaggagtttg

SEQ ID NO: 111948 - DNA, 16 bp, H. sapiens
ggaagccccgtctcta

SEQ ID NO: 111949 - DNA, 16 bp, H. sapiens
ggaagccgaagcagga

SEQ ID NO: 111950 - DNA, 16 bp, H. sapiens
ggaagccgaggcagac

SEQ ID NO: 111951 - DNA, 16 bp, H. sapiens
ggaagccgaggcggga

SEQ ID NO: 111952 - DNA, 16 bp, H. sapiens
ggaagcctagaaatgg

SEQ ID NO: 111953 - DNA, 16 bp, H. sapiens
ggaagccttcctggag

SEQ ID NO: 111954 - DNA, 16 bp, H. sapiens
ggaagccttctctgac

SEQ ID NO: 111955 - DNA, 21 bp, H. sapiens
ggaagcgcaaggggtcaggga

SEQ ID NO: 111956 - DNA, 16 bp, H. sapiens
ggaagctaaacattgg

SEQ ID NO: 111957 - DNA, 16 bp, H. sapiens
ggaagctacaggttac

SEQ ID NO: 111958 - DNA, 16 bp, H. sapiens
ggaagctaggaagtcc

SEQ ID NO: 111959 - DNA, 16 bp, H. sapiens
ggaagctcaacaaaat

SEQ ID NO: 111960 - DNA, 16 bp, H. sapiens
ggaagctcagagaggt

SEQ ID NO: 111961 - DNA, 16 bp, H. sapiens
ggaagctcaggtggga

SEQ ID NO: 111962 - DNA, 22 bp, H. sapiens
ggaagctcgaactgggtggagc

SEQ ID NO: 111963 - DNA, 16 bp, H. sapiens
ggaagctctctgaacc

SEQ ID NO: 111964 - DNA, 16 bp, H. sapiens
ggaagctgaagaagga

SEQ ID NO: 111965 - DNA, 16 bp, H. sapiens
ggaagctgaagtgaga

SEQ ID NO: 111966 - DNA, 16 bp, H. sapiens
ggaagctgagaaggga

SEQ ID NO: 111967 - DNA, 16 bp, H. sapiens
ggaagctgagacacag

SEQ ID NO: 111968 - DNA, 16 bp, H. sapiens
ggaagctgagacagga

SEQ ID NO: 111969 - DNA, 16 bp, H. sapiens
ggaagctgagaggcca

SEQ ID NO: 111970 - DNA, 16 bp, H. sapiens
ggaagctgagcagatg

SEQ ID NO: 111971 - DNA, 16 bp, H. sapiens
ggaagctgaggaagga

SEQ ID NO: 111972 - DNA, 16 bp, H. sapiens
ggaagctgaggcaaga

SEQ ID NO: 111973 - DNA, 16 bp, H. sapiens
ggaagctgaggcagaa

SEQ ID NO: 111974 - DNA, 16 bp, H. sapiens
ggaagctgaggcaggt

SEQ ID NO: 111975 - DNA, 16 bp, H. sapiens
ggaagctgaggcagta

SEQ ID NO: 111976 - DNA, 16 bp, H. sapiens
ggaagctgaggccaag

SEQ ID NO: 111977 - DNA, 16 bp, H. sapiens
ggaagctgaggctgga

SEQ ID NO: 111978 - DNA, 16 bp, H. sapiens
ggaagctgaggctggc

SEQ ID NO: 111979 - DNA, 16 bp, H. sapiens
ggaagctgaggtagga

SEQ ID NO: 111980 - DNA, 16 bp, H. sapiens
ggaagctgaggtgggg

SEQ ID NO: 111981 - DNA, 16 bp, H. sapiens
ggaagctgcagagaaa

SEQ ID NO: 111982 - DNA, 16 bp, H. sapiens
ggaagctgcagaggaa

SEQ ID NO: 111983 - DNA, 16 bp, H. sapiens
ggaagctgcagcagga

SEQ ID NO: 111984 - DNA, 16 bp, H. sapiens
ggaagctgcaggagaa

SEQ ID NO: 111985 - DNA, 16 bp, H. sapiens
ggaagctgggaaccct

SEQ ID NO: 111986 - DNA, 16 bp, H. sapiens
ggaagctgggtgaagg

SEQ ID NO: 111987 - DNA, 16 bp, H. sapiens
ggaagctgtggcagga

SEQ ID NO: 111988 - DNA, 16 bp, H. sapiens
ggaagctttaaaaaat

SEQ ID NO: 111989 - DNA, 16 bp, H. sapiens
ggaagctttattcttt

SEQ ID NO: 111990 - DNA, 16 bp, H. sapiens
ggaagctttgttccag

SEQ ID NO: 111991 - DNA, 16 bp, H. sapiens
ggaagcttttcctggc

SEQ ID NO: 111992 - DNA, 16 bp, H. sapiens
ggaagctttttttttt

SEQ ID NO: 111993 - DNA, 16 bp, H. sapiens
ggaaggaaatatttgc

SEQ ID NO: 111994 - DNA, 16 bp, H. sapiens
ggaaggaagaaactcc

SEQ ID NO: 111995 - DNA, 16 bp, H. sapiens
ggaaggaagaggcagc

SEQ ID NO: 111996 - DNA, 16 bp, H. sapiens
ggaaggaaggaaggcc

SEQ ID NO: 111997 - DNA, 16 bp, H. sapiens
ggaaggaataaattcc

SEQ ID NO: 111998 - DNA, 16 bp, H. sapiens
ggaaggaatgcattcc

SEQ ID NO: 111999 - DNA, 16 bp, H. sapiens
ggaaggacaagtgatg

SEQ ID NO: 112000 - DNA, 16 bp, H. sapiens
ggaaggacagggagat

SEQ ID NO: 112001 - DNA, 16 bp, H. sapiens
ggaaggaccccactat

SEQ ID NO: 112002 - DNA, 16 bp, H. sapiens
ggaaggagaaatgctg

SEQ ID NO: 112003 - DNA, 16 bp, H. sapiens
ggaaggagaagccaga

SEQ ID NO: 112004 - DNA, 16 bp, H. sapiens
ggaaggagaatggcat

SEQ ID NO: 112005 - DNA, 16 bp, H. sapiens
ggaaggagacagacag

SEQ ID NO: 112006 - DNA, 16 bp, H. sapiens
ggaaggagagcatcag

SEQ ID NO: 112007 - DNA, 16 bp, H. sapiens
ggaaggagcaaggcag

SEQ ID NO: 112008 - DNA, 16 bp, H. sapiens
ggaaggagctggagag

SEQ ID NO: 112009 - DNA, 16 bp, H. sapiens
ggaaggagctggaggc

SEQ ID NO: 112010 - DNA, 16 bp, H. sapiens
ggaaggatcatctgag

SEQ ID NO: 112011 - DNA, 16 bp, H. sapiens
ggaaggatcctcccct

SEQ ID NO: 112012 - DNA, 16 bp, H. sapiens
ggaaggcagctatgct

SEQ ID NO: 112013 - DNA, 16 bp, H. sapiens
ggaaggcatggaagct

SEQ ID NO: 112014 - DNA, 16 bp, H. sapiens
ggaaggccaaggtggg

SEQ ID NO: 112015 - DNA, 16 bp, H. sapiens
ggaaggccaggcgtgg

SEQ ID NO: 112016 - DNA, 16 bp, H. sapiens
ggaaggccatgaagag

SEQ ID NO: 112017 - DNA, 16 bp, H. sapiens
ggaaggcccaggcagg

SEQ ID NO: 112018 - DNA, 16 bp, H. sapiens
ggaaggcccccacaag

SEQ ID NO: 112019 - DNA, 17 bp, H. sapiens
ggaaggccgaggcagga

SEQ ID NO: 112020 - DNA, 16 bp, H. sapiens
ggaaggcctccaggaa

SEQ ID NO: 112021 - DNA, 16 bp, H. sapiens
ggaaggcctgagagtt

SEQ ID NO: 112022 - DNA, 16 bp, H. sapiens
ggaaggctgaggagga

SEQ ID NO: 112023 - DNA, 22 bp, H. sapiens
ggaaggctgaggtgggaggatt

SEQ ID NO: 112024 - DNA, 16 bp, H. sapiens
ggaaggctgggaggag

SEQ ID NO: 112025 - DNA, 16 bp, H. sapiens
ggaaggcttcctagag

SEQ ID NO: 112026 - DNA, 16 bp, H. sapiens
ggaaggctttgtggag

SEQ ID NO: 112027 - DNA, 16 bp, H. sapiens
ggaaggcttttatttg

SEQ ID NO: 112028 - DNA, 16 bp, H. sapiens
ggaagggaagagcatg

SEQ ID NO: 112029 - DNA, 16 bp, H. sapiens
ggaagggaaggcagcc

SEQ ID NO: 112030 - DNA, 16 bp, H. sapiens
ggaagggcatcccagg

SEQ ID NO: 112031 - DNA, 16 bp, H. sapiens
ggaagggccaggggca

SEQ ID NO: 112032 - DNA, 16 bp, H. sapiens
ggaaggggacccaagc

SEQ ID NO: 112033 - DNA, 16 bp, H. sapiens
ggaaggggaccccagc

SEQ ID NO: 112034 - DNA, 16 bp, H. sapiens
ggaaggggagctggaa

SEQ ID NO: 112035 - DNA, 16 bp, H. sapiens
ggaaggggaggcagcc

SEQ ID NO: 112036 - DNA, 16 bp, H. sapiens
ggaaggggcaaacaag

SEQ ID NO: 112037 - DNA, 16 bp, H. sapiens
ggaaggggcctggtgg

SEQ ID NO: 112038 - DNA, 16 bp, H. sapiens
ggaaggggcggctggc

SEQ ID NO: 112039 - DNA, 16 bp, H. sapiens
ggaaggggctgccatg

SEQ ID NO: 112040 - DNA, 16 bp, H. sapiens
ggaaggggtcctgttt

SEQ ID NO: 112041 - DNA, 16 bp, H. sapiens
ggaaggtccaggctgc

SEQ ID NO: 112042 - DNA, 16 bp, H. sapiens
ggaaggtggaggctgc

SEQ ID NO: 112043 - DNA, 16 bp, H. sapiens
ggaaggtggagggtgc

SEQ ID NO: 112044 - DNA, 16 bp, H. sapiens
ggaagtaaagcacacc

SEQ ID NO: 112045 - DNA, 52 bp, H. sapiens
ggaagtaaagctctcctcagcaaatgtaaaagaacagagattataacaaact

SEQ ID NO: 112046 - DNA, 16 bp, H. sapiens
ggaagtaactaacttg

SEQ ID NO: 112047 - DNA, 16 bp, H. sapiens
ggaagtaactttggaa

SEQ ID NO: 112048 - DNA, 16 bp, H. sapiens
ggaagtaattggatca

SEQ ID NO: 112049 - DNA, 16 bp, H. sapiens
ggaagtaggcttcaga

SEQ ID NO: 112050 - DNA, 16 bp, H. sapiens
ggaagtataaattata

SEQ ID NO: 112051 - DNA, 16 bp, H. sapiens
ggaagtattcccttct

SEQ ID NO: 112052 - DNA, 16 bp, H. sapiens
ggaagtcaggaacccc

SEQ ID NO: 112053 - DNA, 16 bp, H. sapiens
ggaagtcagggacccc

SEQ ID NO: 112054 - DNA, 16 bp, H. sapiens
ggaagtcagtgccctt

SEQ ID NO: 112055 - DNA, 16 bp, H. sapiens
ggaagtcattatgtta

SEQ ID NO: 112056 - DNA, 16 bp, H. sapiens
ggaagtgaaggctaag

SEQ ID NO: 112057 - DNA, 16 bp, H. sapiens
ggaagtgactttgaaa

SEQ ID NO: 112058 - DNA, 16 bp, H. sapiens
ggaagtgatgtttgag

SEQ ID NO: 112059 - DNA, 16 bp, H. sapiens
ggaagtgattttggaa

SEQ ID NO: 112060 - DNA, 16 bp, H. sapiens
ggaagtgcaaggggtc

SEQ ID NO: 112061 - DNA, 16 bp, H. sapiens
ggaagtgctgggatta

SEQ ID NO: 112062 - DNA, 16 bp, H. sapiens
ggaagtggaattgttg

SEQ ID NO: 112063 - DNA, 16 bp, H. sapiens
ggaagtggagtttgca

SEQ ID NO: 112064 - DNA, 16 bp, H. sapiens
ggaagtggggcaggga

SEQ ID NO: 112065 - DNA, 16 bp, H. sapiens
ggaagtgggtgtggct

SEQ ID NO: 112066 - DNA, 16 bp, H. sapiens
ggaagtgtgatgcttc

SEQ ID NO: 112067 - DNA, 16 bp, H. sapiens
ggaagtgttctgagca

SEQ ID NO: 112068 - DNA, 16 bp, H. sapiens
ggaagtgtttggatca

SEQ ID NO: 112069 - DNA, 16 bp, H. sapiens
ggaagttaggaattcc

SEQ ID NO: 112070 - DNA, 16 bp, H. sapiens
ggaagttcaagggcat

SEQ ID NO: 112071 - DNA, 16 bp, H. sapiens
ggaagttcattcatga

SEQ ID NO: 112072 - DNA, 16 bp, H. sapiens
ggaagttgaggcagga

SEQ ID NO: 112073 - DNA, 16 bp, H. sapiens
ggaagttgcagtgagt

SEQ ID NO: 112074 - DNA, 16 bp, H. sapiens
ggaagttgccctgggt

SEQ ID NO: 112075 - DNA, 16 bp, H. sapiens
ggaagtttgagaccag

SEQ ID NO: 112076 - DNA, 16 bp, H. sapiens
ggaataaactactgat

SEQ ID NO: 112077 - DNA, 16 bp, H. sapiens
ggaataaagatgttct

SEQ ID NO: 112078 - DNA, 16 bp, H. sapiens
ggaataaatgtttgca

SEQ ID NO: 112079 - DNA, 16 bp, H. sapiens
ggaataattcaggaaa

SEQ ID NO: 112080 - DNA, 16 bp, H. sapiens
ggaataatttttttaa

SEQ ID NO: 112081 - DNA, 16 bp, H. sapiens
ggaatacctgaaactg

SEQ ID NO: 112082 - DNA, 16 bp, H. sapiens
ggaatactacacagca

SEQ ID NO: 112083 - DNA, 16 bp, H. sapiens
ggaatactatgcagct

SEQ ID NO: 112084 - DNA, 16 bp, H. sapiens
ggaatactgctcagca

SEQ ID NO: 112085 - DNA, 16 bp, H. sapiens
ggaatagtttcaggag

SEQ ID NO: 112086 - DNA, 16 bp, H. sapiens
ggaatatagttataat

SEQ ID NO: 112087 - DNA, 16 bp, H. sapiens
ggaatatcattcagca

SEQ ID NO: 112088 - DNA, 16 bp, H. sapiens
ggaatatgcaagtgga

SEQ ID NO: 112089 - DNA, 16 bp, H. sapiens
ggaatattatttagcc

SEQ ID NO: 112090 - DNA, 16 bp, H. sapiens
ggaatatttcaaatat

SEQ ID NO: 112091 - DNA, 16 bp, H. sapiens
ggaatatttgcattta

SEQ ID NO: 112092 - DNA, 16 bp, H. sapiens
ggaatcaattcaacaa

SEQ ID NO: 112093 - DNA, 16 bp, H. sapiens
ggaatcaatttctttc

SEQ ID NO: 112094 - DNA, 16 bp, H. sapiens
ggaatcatggctcact

SEQ ID NO: 112095 - DNA, 16 bp, H. sapiens
ggaatcccagcacttc

SEQ ID NO: 112096 - DNA, 16 bp, H. sapiens
ggaatcctatgtgaag

SEQ ID NO: 112097 - DNA, 17 bp, H. sapiens
ggaatccttcccccatt

SEQ ID NO: 112098 - DNA, 16 bp, H. sapiens
ggaatctagagaagca

SEQ ID NO: 112099 - DNA, 16 bp, H. sapiens
ggaatctcactcttgt

SEQ ID NO: 112100 - DNA, 16 bp, H. sapiens
ggaatctccatactat

SEQ ID NO: 112101 - DNA, 17 bp, H. sapiens
ggaatctcgctctgtcg

SEQ ID NO: 112102 - DNA, 16 bp, H. sapiens
ggaatctgcattttaa

SEQ ID NO: 112103 - DNA, 16 bp, H. sapiens
ggaatctttaaaaaaa

SEQ ID NO: 112104 - DNA, 16 bp, H. sapiens
ggaatgaaactgtaag

SEQ ID NO: 112105 - DNA, 16 bp, H. sapiens
ggaatgaaatggaaag

SEQ ID NO: 112106 - DNA, 16 bp, H. sapiens
ggaatgaaattctgac

SEQ ID NO: 112107 - DNA, 16 bp, H. sapiens
ggaatgaagctgcaga

SEQ ID NO: 112108 - DNA, 16 bp, H. sapiens
ggaatgagaaattact

SEQ ID NO: 112109 - DNA, 16 bp, H. sapiens
ggaatgagagtcaaaa

SEQ ID NO: 112110 - DNA, 16 bp, H. sapiens
ggaatgatatggtttg

SEQ ID NO: 112111 - DNA, 16 bp, H. sapiens
ggaatgcaaggaggag

SEQ ID NO: 112112 - DNA, 16 bp, H. sapiens
ggaatgcagcccagca

SEQ ID NO: 112113 - DNA, 16 bp, H. sapiens
ggaatgcagtagcatg

SEQ ID NO: 112114 - DNA, 16 bp, H. sapiens
ggaatgcagtggccca

SEQ ID NO: 112115 - DNA, 16 bp, H. sapiens
ggaatgcagtggtgca

SEQ ID NO: 112116 - DNA, 16 bp, H. sapiens
ggaatgcagtggtgcc

SEQ ID NO: 112117 - DNA, 16 bp, H. sapiens
ggaatgcagtggtgtc

SEQ ID NO: 112118 - DNA, 16 bp, H. sapiens
ggaatgcatccagctt

SEQ ID NO: 112119 - DNA, 16 bp, H. sapiens
ggaatgccaaggactg

SEQ ID NO: 112120 - DNA, 16 bp, H. sapiens
ggaatgctgtgtcctc

SEQ ID NO: 112121 - DNA, 16 bp, H. sapiens
ggaatgcttatatact

SEQ ID NO: 112122 - DNA, 16 bp, H. sapiens
ggaatgcttccagttg

SEQ ID NO: 112123 - DNA, 16 bp, H. sapiens
ggaatggaaagtgtgg

SEQ ID NO: 112124 - DNA, 16 bp, H. sapiens
ggaatggaataaaatg

SEQ ID NO: 112125 - DNA, 16 bp, H. sapiens
ggaatggaatggacag

SEQ ID NO: 112126 - DNA, 16 bp, H. sapiens
ggaatggaatttaatg

SEQ ID NO: 112127 - DNA, 16 bp, H. sapiens
ggaatggagtgcagtg

SEQ ID NO: 112128 - DNA, 16 bp, H. sapiens
ggaatggagtggcatg

SEQ ID NO: 112129 - DNA, 16 bp, H. sapiens
ggaatgggaagatgat

SEQ ID NO: 112130 - DNA, 16 bp, H. sapiens
ggaatgggagaaaaca

SEQ ID NO: 112131 - DNA, 16 bp, H. sapiens
ggaatgtaaaatggta

SEQ ID NO: 112132 - DNA, 16 bp, H. sapiens
ggaatgtctttctcaa

SEQ ID NO: 112133 - DNA, 16 bp, H. sapiens
ggaatgttcagctctg

SEQ ID NO: 112134 - DNA, 16 bp, H. sapiens
ggaatgttcccaacat

SEQ ID NO: 112135 - DNA, 16 bp, H. sapiens
ggaatgtttttccatc

SEQ ID NO: 112136 - DNA, 16 bp, H. sapiens
ggaattaaagtagaaa

SEQ ID NO: 112137 - DNA, 16 bp, H. sapiens
ggaattacaggcacca

SEQ ID NO: 112138 - DNA, 16 bp, H. sapiens
ggaattagaaaaaact

SEQ ID NO: 112139 - DNA, 16 bp, H. sapiens
ggaattatacagtatt

SEQ ID NO: 112140 - DNA, 16 bp, H. sapiens
ggaattattttgataa

SEQ ID NO: 112141 - DNA, 16 bp, H. sapiens
ggaattatttttaaaa

SEQ ID NO: 112142 - DNA, 16 bp, H. sapiens
ggaattcaaattgtcc

SEQ ID NO: 112143 - DNA, 16 bp, H. sapiens
ggaattcagtttttca

SEQ ID NO: 112144 - DNA, 16 bp, H. sapiens
ggaattccagccagct

SEQ ID NO: 112145 - DNA, 16 bp, H. sapiens
ggaattcgagaccagc

SEQ ID NO: 112146 - DNA, 16 bp, H. sapiens
ggaattctggaagata

SEQ ID NO: 112147 - DNA, 16 bp, H. sapiens
ggaattctgggagata

SEQ ID NO: 112148 - DNA, 16 bp, H. sapiens
ggaattcttccagttt

SEQ ID NO: 112149 - DNA, 16 bp, H. sapiens
ggaattctttgtacta

SEQ ID NO: 112150 - DNA, 16 bp, H. sapiens
ggaattgactccaatg

SEQ ID NO: 112151 - DNA, 16 bp, H. sapiens
ggaattgctaggtcat

SEQ ID NO: 112152 - DNA, 16 bp, H. sapiens
ggaattgctgagtcac

SEQ ID NO: 112153 - DNA, 16 bp, H. sapiens
ggaattggttccagga

SEQ ID NO: 112154 - DNA, 16 bp, H. sapiens
ggaattgttttttaaa

SEQ ID NO: 112155 - DNA, 16 bp, H. sapiens
ggaatttacattttag

SEQ ID NO: 112156 - DNA, 16 bp, H. sapiens
ggaatttatcagaaag

SEQ ID NO: 112157 - DNA, 16 bp, H. sapiens
ggaatttatccacttc

SEQ ID NO: 112158 - DNA, 16 bp, H. sapiens
ggaatttatccattta

SEQ ID NO: 112159 - DNA, 16 bp, H. sapiens
ggaatttcactcttgt

SEQ ID NO: 112160 - DNA, 16 bp, H. sapiens
ggaatttgaactcagg

SEQ ID NO: 112161 - DNA, 16 bp, H. sapiens
ggaatttggaagaagt

SEQ ID NO: 112162 - DNA, 16 bp, H. sapiens
ggaatttggctgatga

SEQ ID NO: 112163 - DNA, 16 bp, H. sapiens
ggaatttgggcaagat

SEQ ID NO: 112164 - DNA, 16 bp, H. sapiens
ggaattttaaaaagtt

SEQ ID NO: 112165 - DNA, 16 bp, H. sapiens
ggaattttaaaaattt

SEQ ID NO: 112166 - DNA, 16 bp, H. sapiens
ggaattttcttccttt

SEQ ID NO: 112167 - DNA, 16 bp, H. sapiens
ggaattttctttcttt

SEQ ID NO: 112168 - DNA, 16 bp, H. sapiens
ggaattttgcagatgt

SEQ ID NO: 112169 - DNA, 16 bp, H. sapiens
ggaattttgctcttgt

SEQ ID NO: 112170 - DNA, 16 bp, H. sapiens
ggaattttgggagata

SEQ ID NO: 112171 - DNA, 16 bp, H. sapiens
ggaatttttaaaatgt

SEQ ID NO: 112172 - DNA, 16 bp, H. sapiens
ggaattttttttaaaa

SEQ ID NO: 112173 - DNA, 16 bp, H. sapiens
ggacaaaaatccaaac

SEQ ID NO: 112174 - DNA, 16 bp, H. sapiens
ggacaaacactcagaa

SEQ ID NO: 112175 - DNA, 16 bp, H. sapiens
ggacaaacattcagac

SEQ ID NO: 112176 - DNA, 16 bp, H. sapiens
ggacaaatactatatg

SEQ ID NO: 112177 - DNA, 16 bp, H. sapiens
ggacaacacagcgaga

SEQ ID NO: 112178 - DNA, 16 bp, H. sapiens
ggacaaccagaggtca

SEQ ID NO: 112179 - DNA, 16 bp, H. sapiens
ggacaacctgaggtca

SEQ ID NO: 112180 - DNA, 16 bp, H. sapiens
ggacaactggaagcag

SEQ ID NO: 112181 - DNA, 16 bp, H. sapiens
ggacaagagctcagga

SEQ ID NO: 112182 - DNA, 16 bp, H. sapiens
ggacaagcaggagaca

SEQ ID NO: 112183 - DNA, 16 bp, H. sapiens
ggacaaggatgaagct

SEQ ID NO: 112184 - DNA, 16 bp, H. sapiens
ggacaaggcaggtgga

SEQ ID NO: 112185 - DNA, 16 bp, H. sapiens
ggacaaggtggctcac

SEQ ID NO: 112186 - DNA, 16 bp, H. sapiens
ggacacaaacaaacag

SEQ ID NO: 112187 - DNA, 16 bp, H. sapiens
ggacacaatgcagcca

SEQ ID NO: 112188 - DNA, 16 bp, H. sapiens
ggacacacacgcacac

SEQ ID NO: 112189 - DNA, 16 bp, H. sapiens
ggacacacccaaacca

SEQ ID NO: 112190 - DNA, 16 bp, H. sapiens
ggacacagacacagag

SEQ ID NO: 112191 - DNA, 16 bp, H. sapiens
ggacacagacattcag

SEQ ID NO: 112192 - DNA, 16 bp, H. sapiens
ggacacagatccaaac

SEQ ID NO: 112193 - DNA, 16 bp, H. sapiens
ggacacagcccaacca

SEQ ID NO: 112194 - DNA, 16 bp, H. sapiens
ggacacagggacacag

SEQ ID NO: 112195 - DNA, 16 bp, H. sapiens
ggacacagggagagga

SEQ ID NO: 112196 - DNA, 16 bp, H. sapiens
ggacacagggagcaga

SEQ ID NO: 112197 - DNA, 16 bp, H. sapiens
ggacacagtgaaaagg

SEQ ID NO: 112198 - DNA, 16 bp, H. sapiens
ggacacagtgagaagg

SEQ ID NO: 112199 - DNA, 16 bp, H. sapiens
ggacacatacagggga

SEQ ID NO: 112200 - DNA, 16 bp, H. sapiens
ggacacatggacacac

SEQ ID NO: 112201 - DNA, 16 bp, H. sapiens
ggacacattcaaacca

SEQ ID NO: 112202 - DNA, 16 bp, H. sapiens
ggacaccagcctggcc

SEQ ID NO: 112203 - DNA, 16 bp, H. sapiens
ggacaccagggggcgc

SEQ ID NO: 112204 - DNA, 16 bp, H. sapiens
ggacaccatcaagcag

SEQ ID NO: 112205 - DNA, 16 bp, H. sapiens
ggacacccaggctttt

SEQ ID NO: 112206 - DNA, 16 bp, H. sapiens
ggacacccagttggtg

SEQ ID NO: 112207 - DNA, 16 bp, H. sapiens
ggacacccctgctcta

SEQ ID NO: 112208 - DNA, 16 bp, H. sapiens
ggacactccagcttgg

SEQ ID NO: 112209 - DNA, 16 bp, H. sapiens
ggacactgaggcttgg

SEQ ID NO: 112210 - DNA, 16 bp, H. sapiens
ggacagaacatctcca

SEQ ID NO: 112211 - DNA, 16 bp, H. sapiens
ggacagaagttggaga

SEQ ID NO: 112212 - DNA, 16 bp, H. sapiens
ggacagaatgagaccc

SEQ ID NO: 112213 - DNA, 16 bp, H. sapiens
ggacagacacttttca

SEQ ID NO: 112214 - DNA, 16 bp, H. sapiens
ggacagactgcctctt

SEQ ID NO: 112215 - DNA, 16 bp, H. sapiens
ggacagagacccagag

SEQ ID NO: 112216 - DNA, 16 bp, H. sapiens
ggacagagggacagag

SEQ ID NO: 112217 - DNA, 16 bp, H. sapiens
ggacagagggagaccc

SEQ ID NO: 112218 - DNA, 16 bp, H. sapiens
ggacagagtctcactg

SEQ ID NO: 112219 - DNA, 16 bp, H. sapiens
ggacagcaccaagaca

SEQ ID NO: 112220 - DNA, 16 bp, H. sapiens
ggacagcaccaagcca

SEQ ID NO: 112221 - DNA, 16 bp, H. sapiens
ggacagcagcagcagc

SEQ ID NO: 112222 - DNA, 16 bp, H. sapiens
ggacagcatcatcctg

SEQ ID NO: 112223 - DNA, 16 bp, H. sapiens
ggacagccagcctaat

SEQ ID NO: 112224 - DNA, 16 bp, H. sapiens
ggacaggaagaagcag

SEQ ID NO: 112225 - DNA, 16 bp, H. sapiens
ggacaggagttccaga

SEQ ID NO: 112226 - DNA, 16 bp, H. sapiens
ggacaggcagcagcag

SEQ ID NO: 112227 - DNA, 16 bp, H. sapiens
ggacaggctggtctca

SEQ ID NO: 112228 - DNA, 16 bp, H. sapiens
ggacagggagatgggg

SEQ ID NO: 112229 - DNA, 16 bp, H. sapiens
ggacagggcacagaca

SEQ ID NO: 112230 - DNA, 16 bp, H. sapiens
ggacagggcagggcag

SEQ ID NO: 112231 - DNA, 16 bp, H. sapiens
ggacagggcggctggc

SEQ ID NO: 112232 - DNA, 16 bp, H. sapiens
ggacagggtggctggc

SEQ ID NO: 112233 - DNA, 16 bp, H. sapiens
ggacaggtacaaacaa

SEQ ID NO: 112234 - DNA, 16 bp, H. sapiens
ggacaggtcccagaga

SEQ ID NO: 112235 - DNA, 16 bp, H. sapiens
ggacagtacttttacc

SEQ ID NO: 112236 - DNA, 16 bp, H. sapiens
ggacataaaaatggaa

SEQ ID NO: 112237 - DNA, 16 bp, H. sapiens
ggacataagtttttaa

SEQ ID NO: 112238 - DNA, 16 bp, H. sapiens
ggacatagcaagaagg

SEQ ID NO: 112239 - DNA, 28 bp, H. sapiens
ggacataggcatgggcaaggacttcatg

SEQ ID NO: 112240 - DNA, 16 bp, H. sapiens
ggacataggcctgggc

SEQ ID NO: 112241 - DNA, 16 bp, H. sapiens
ggacatatgttttcag

SEQ ID NO: 112242 - DNA, 16 bp, H. sapiens
ggacatcaagaccatc

SEQ ID NO: 112243 - DNA, 16 bp, H. sapiens
ggacatccaggtgttt

SEQ ID NO: 112244 - DNA, 16 bp, H. sapiens
ggacatctgtggttgt

SEQ ID NO: 112245 - DNA, 16 bp, H. sapiens
ggacatctttggggag

SEQ ID NO: 112246 - DNA, 16 bp, H. sapiens
ggacatgaagagacac

SEQ ID NO: 112247 - DNA, 16 bp, H. sapiens
ggacatgcacaccaaa

SEQ ID NO: 112248 - DNA, 16 bp, H. sapiens
ggacatggatgaaatt

SEQ ID NO: 112249 - DNA, 16 bp, H. sapiens
ggacatggatggagct

SEQ ID NO: 112250 - DNA, 16 bp, H. sapiens
ggacatgtgggttgtt

SEQ ID NO: 112251 - DNA, 16 bp, H. sapiens
ggacattaccaccaac

SEQ ID NO: 112252 - DNA, 16 bp, H. sapiens
ggacattgatgaagct

SEQ ID NO: 112253 - DNA, 16 bp, H. sapiens
ggacatttaaaaaaat

SEQ ID NO: 112254 - DNA, 16 bp, H. sapiens
ggacattttacaaaat

SEQ ID NO: 112255 - DNA, 16 bp, H. sapiens
ggaccaaatggattca

SEQ ID NO: 112256 - DNA, 16 bp, H. sapiens
ggaccaaatttcaaca

SEQ ID NO: 112257 - DNA, 18 bp, H. sapiens
ggaccaacatggtgaaac

SEQ ID NO: 112258 - DNA, 16 bp, H. sapiens
ggaccaatcagcaccc

SEQ ID NO: 112259 - DNA, 16 bp, H. sapiens
ggaccacaggcacaca

SEQ ID NO: 112260 - DNA, 16 bp, H. sapiens
ggaccacaggtgtgag

SEQ ID NO: 112261 - DNA, 16 bp, H. sapiens
ggaccacaggtgtgcc

SEQ ID NO: 112262 - DNA, 16 bp, H. sapiens
ggaccagacagattta

SEQ ID NO: 112263 - DNA, 16 bp, H. sapiens
ggaccagaggtgcaca

SEQ ID NO: 112264 - DNA, 16 bp, H. sapiens
ggaccagccccacagg

SEQ ID NO: 112265 - DNA, 16 bp, H. sapiens
ggaccagcctgaccaa

SEQ ID NO: 112266 - DNA, 16 bp, H. sapiens
ggaccagcctggcaaa

SEQ ID NO: 112267 - DNA, 16 bp, H. sapiens
ggaccagcctggccaa

SEQ ID NO: 112268 - DNA, 16 bp, H. sapiens
ggaccagcctgggcaa

SEQ ID NO: 112269 - DNA, 16 bp, H. sapiens
ggaccagctggagctg

SEQ ID NO: 112270 - DNA, 16 bp, H. sapiens
ggaccagggcagggca

SEQ ID NO: 112271 - DNA, 16 bp, H. sapiens
ggaccagggccctcag

SEQ ID NO: 112272 - DNA, 16 bp, H. sapiens
ggaccaggtggaggtg

SEQ ID NO: 112273 - DNA, 16 bp, H. sapiens
ggaccaggtgggaggt

SEQ ID NO: 112274 - DNA, 16 bp, H. sapiens
ggaccatcacagacac

SEQ ID NO: 112275 - DNA, 18 bp, H. sapiens
ggaccatcctggctaaca

SEQ ID NO: 112276 - DNA, 16 bp, H. sapiens
ggaccatgccctcctc

SEQ ID NO: 112277 - DNA, 16 bp, H. sapiens
ggacccaaagagtgag

SEQ ID NO: 112278 - DNA, 16 bp, H. sapiens
ggacccagggagggga

SEQ ID NO: 112279 - DNA, 16 bp, H. sapiens
ggacccagggggaggt

SEQ ID NO: 112280 - DNA, 16 bp, H. sapiens
ggacccagtggaagat

SEQ ID NO: 112281 - DNA, 16 bp, H. sapiens
ggacccatgaatcctg

SEQ ID NO: 112282 - DNA, 16 bp, H. sapiens
ggaccccacactcact

SEQ ID NO: 112283 - DNA, 16 bp, H. sapiens
ggacccccagcaaacc

SEQ ID NO: 112284 - DNA, 16 bp, H. sapiens
ggaccccctgcagcag

SEQ ID NO: 112285 - DNA, 20 bp, H. sapiens
ggaccccggacatgttccaa

SEQ ID NO: 112286 - DNA, 16 bp, H. sapiens
ggaccccttccatgct

SEQ ID NO: 112287 - DNA, 16 bp, H. sapiens
ggaccccttcctcaca

SEQ ID NO: 112288 - DNA, 16 bp, H. sapiens
ggacccgggaggcaga

SEQ ID NO: 112289 - DNA, 16 bp, H. sapiens
ggaccctaaatccaat

SEQ ID NO: 112290 - DNA, 16 bp, H. sapiens
ggaccctcagctgcag

SEQ ID NO: 112291 - DNA, 16 bp, H. sapiens
ggaccctcccacctca

SEQ ID NO: 112292 - DNA, 16 bp, H. sapiens
ggaccctgagcccagc

SEQ ID NO: 112293 - DNA, 16 bp, H. sapiens
ggaccctgagctgcag

SEQ ID NO: 112294 - DNA, 16 bp, H. sapiens
ggaccctgaggccttc

SEQ ID NO: 112295 - DNA, 16 bp, H. sapiens
ggaccctggacccagc

SEQ ID NO: 112296 - DNA, 16 bp, H. sapiens
ggaccctgggcccagc

SEQ ID NO: 112297 - DNA, 16 bp, H. sapiens
ggaccggctggagctg

SEQ ID NO: 112298 - DNA, 16 bp, H. sapiens
ggacctagttaaacta

SEQ ID NO: 112299 - DNA, 16 bp, H. sapiens
ggacctcaggtgatcc

SEQ ID NO: 112300 - DNA, 16 bp, H. sapiens
ggacctctcagcagaa

SEQ ID NO: 112301 - DNA, 16 bp, H. sapiens
ggacctcttcaagaag

SEQ ID NO: 112302 - DNA, 16 bp, H. sapiens
ggacctcttttataag

SEQ ID NO: 112303 - DNA, 16 bp, H. sapiens
ggacctgactattgaa

SEQ ID NO: 112304 - DNA, 16 bp, H. sapiens
ggacctgagtgggttg

SEQ ID NO: 112305 - DNA, 16 bp, H. sapiens
ggacctgatgaagctg

SEQ ID NO: 112306 - DNA, 16 bp, H. sapiens
ggacctgatgacttca

SEQ ID NO: 112307 - DNA, 16 bp, H. sapiens
ggacctgcactggcac

SEQ ID NO: 112308 - DNA, 21 bp, H. sapiens
ggacctgcagcccgccatgcc

SEQ ID NO: 112309 - DNA, 16 bp, H. sapiens
ggacctgcagctgagg

SEQ ID NO: 112310 - DNA, 16 bp, H. sapiens
ggacctgcccccttct

SEQ ID NO: 112311 - DNA, 16 bp, H. sapiens
ggacctggatgaagct

SEQ ID NO: 112312 - DNA, 16 bp, H. sapiens
ggacctggtgggaaat

SEQ ID NO: 112313 - DNA, 16 bp, H. sapiens
ggacctggtgggtggt

SEQ ID NO: 112314 - DNA, 16 bp, H. sapiens
ggacctgttagaagga

SEQ ID NO: 112315 - DNA, 16 bp, H. sapiens
ggaccttcaggttccc

SEQ ID NO: 112316 - DNA, 16 bp, H. sapiens
ggaccttgtatcttcc

SEQ ID NO: 112317 - DNA, 16 bp, H. sapiens
ggacgagttcatgtcc

SEQ ID NO: 112318 - DNA, 16 bp, H. sapiens
ggacggacggacggac

SEQ ID NO: 112319 - DNA, 16 bp, H. sapiens
ggacggagtctctctc

SEQ ID NO: 112320 - DNA, 16 bp, H. sapiens
ggacggatggatggat

SEQ ID NO: 112321 - DNA, 16 bp, H. sapiens
ggacgtggtggtgggc

SEQ ID NO: 112322 - DNA, 16 bp, H. sapiens
ggacgtgtttgcttcc

SEQ ID NO: 112323 - DNA, 16 bp, H. sapiens
ggactaaatgttccaa

SEQ ID NO: 112324 - DNA, 16 bp, H. sapiens
ggactacaactcccag

SEQ ID NO: 112325 - DNA, 16 bp, H. sapiens
ggactacaagcacgtg

SEQ ID NO: 112326 - DNA, 16 bp, H. sapiens
ggactacagacatgta

SEQ ID NO: 112327 - DNA, 16 bp, H. sapiens
ggactacaggcacgag

SEQ ID NO: 112328 - DNA, 16 bp, H. sapiens
ggactacaggtgggca

SEQ ID NO: 112329 - DNA, 16 bp, H. sapiens
ggactacagttgcatg

SEQ ID NO: 112330 - DNA, 16 bp, H. sapiens
ggactactggtgcctg

SEQ ID NO: 112331 - DNA, 16 bp, H. sapiens
ggactagatgatctct

SEQ ID NO: 112332 - DNA, 16 bp, H. sapiens
ggactataggtgtgca

SEQ ID NO: 112333 - DNA, 34 bp, H. sapiens
ggactatgctgaatctccttaggcactctctaat

SEQ ID NO: 112334 - DNA, 16 bp, H. sapiens
ggactcaagccatcct

SEQ ID NO: 112335 - DNA, 16 bp, H. sapiens
ggactcagaagaagat

SEQ ID NO: 112336 - DNA, 16 bp, H. sapiens
ggactcagaggaaagg

SEQ ID NO: 112337 - DNA, 16 bp, H. sapiens
ggactcaggaggaaag

SEQ ID NO: 112338 - DNA, 16 bp, H. sapiens
ggactcagggggaaag

SEQ ID NO: 112339 - DNA, 16 bp, H. sapiens
ggactcagtgagaaag

SEQ ID NO: 112340 - DNA, 16 bp, H. sapiens
ggactccatctcaaaa

SEQ ID NO: 112341 - DNA, 16 bp, H. sapiens
ggactcctgggctcaa

SEQ ID NO: 112342 - DNA, 16 bp, H. sapiens
ggactccttggagaaa

SEQ ID NO: 112343 - DNA, 16 bp, H. sapiens
ggactctcgctctgtc

SEQ ID NO: 112344 - DNA, 16 bp, H. sapiens
ggactctgaagccaga

SEQ ID NO: 112345 - DNA, 16 bp, H. sapiens
ggactctggagccaaa

SEQ ID NO: 112346 - DNA, 16 bp, H. sapiens
ggactctggagccaga

SEQ ID NO: 112347 - DNA, 16 bp, H. sapiens
ggactctgggacttac

SEQ ID NO: 112348 - DNA, 16 bp, H. sapiens
ggactctgggaggctg

SEQ ID NO: 112349 - DNA, 16 bp, H. sapiens
ggactctgtgtgtggg

SEQ ID NO: 112350 - DNA, 16 bp, H. sapiens
ggactgagaagaagct

SEQ ID NO: 112351 - DNA, 16 bp, H. sapiens
ggactgagagttacac

SEQ ID NO: 112352 - DNA, 16 bp, H. sapiens
ggactgaggcaggaaa

SEQ ID NO: 112353 - DNA, 16 bp, H. sapiens
ggactgatgggtgtca

SEQ ID NO: 112354 - DNA, 16 bp, H. sapiens
ggactgcagactgcag

SEQ ID NO: 112355 - DNA, 16 bp, H. sapiens
ggactgcaggcacgca

SEQ ID NO: 112356 - DNA, 16 bp, H. sapiens
ggactgcaggtgtgca

SEQ ID NO: 112357 - DNA, 16 bp, H. sapiens
ggactgcagtggtgtg

SEQ ID NO: 112358 - DNA, 16 bp, H. sapiens
ggactgctgcatttcc

SEQ ID NO: 112359 - DNA, 16 bp, H. sapiens
ggactgctggagccca

SEQ ID NO: 112360 - DNA, 16 bp, H. sapiens
ggactgctgtgaagac

SEQ ID NO: 112361 - DNA, 16 bp, H. sapiens
ggactggcaaaacaga

SEQ ID NO: 112362 - DNA, 23 bp, H. sapiens
ggactggcaggcagctccacctg

SEQ ID NO: 112363 - DNA, 16 bp, H. sapiens
ggactggctggagcca

SEQ ID NO: 112364 - DNA, 16 bp, H. sapiens
ggactgggcaccatgg

SEQ ID NO: 112365 - DNA, 16 bp, H. sapiens
ggactgggcagaggga

SEQ ID NO: 112366 - DNA, 16 bp, H. sapiens
ggactgggtttggaga

SEQ ID NO: 112367 - DNA, 16 bp, H. sapiens
ggactggttgagccca

SEQ ID NO: 112368 - DNA, 16 bp, H. sapiens
ggactgtactgctgcc

SEQ ID NO: 112369 - DNA, 17 bp, H. sapiens
ggactgttcccagtgta

SEQ ID NO: 112370 - DNA, 16 bp, H. sapiens
ggacttcaacatgaat

SEQ ID NO: 112371 - DNA, 16 bp, H. sapiens
ggacttcaactcagct

SEQ ID NO: 112372 - DNA, 16 bp, H. sapiens
ggacttcaggcatgca

SEQ ID NO: 112373 - DNA, 16 bp, H. sapiens
ggacttcagttaataa

SEQ ID NO: 112374 - DNA, 16 bp, H. sapiens
ggacttcatttctaaa

SEQ ID NO: 112375 - DNA, 16 bp, H. sapiens
ggacttccagccccca

SEQ ID NO: 112376 - DNA, 17 bp, H. sapiens
ggacttccagcctccag

SEQ ID NO: 112377 - DNA, 16 bp, H. sapiens
ggacttcccagtttcc

SEQ ID NO: 112378 - DNA, 16 bp, H. sapiens
ggacttccctgcctcc

SEQ ID NO: 112379 - DNA, 16 bp, H. sapiens
ggacttcctgggtcga

SEQ ID NO: 112380 - DNA, 16 bp, H. sapiens
ggacttctcagcctcc

SEQ ID NO: 112381 - DNA, 16 bp, H. sapiens
ggacttctcagcttct

SEQ ID NO: 112382 - DNA, 16 bp, H. sapiens
ggacttctctgcattg

SEQ ID NO: 112383 - DNA, 16 bp, H. sapiens
ggacttcttgagccca

SEQ ID NO: 112384 - DNA, 16 bp, H. sapiens
ggacttgaagaacttt

SEQ ID NO: 112385 - DNA, 16 bp, H. sapiens
ggacttgacagcacca

SEQ ID NO: 112386 - DNA, 16 bp, H. sapiens
ggacttgctttgtgaa

SEQ ID NO: 112387 - DNA, 17 bp, H. sapiens
ggacttgctttttgaat

SEQ ID NO: 112388 - DNA, 16 bp, H. sapiens
ggacttggagtcagaa

SEQ ID NO: 112389 - DNA, 16 bp, H. sapiens
ggacttgggaggaaga

SEQ ID NO: 112390 - DNA, 16 bp, H. sapiens
ggacttgggggaaaga

SEQ ID NO: 112391 - DNA, 16 bp, H. sapiens
ggacttggtgccttgc

SEQ ID NO: 112392 - DNA, 17 bp, H. sapiens
ggactttaaaccaacaa

SEQ ID NO: 112393 - DNA, 16 bp, H. sapiens
ggactttattttcatg

SEQ ID NO: 112394 - DNA, 16 bp, H. sapiens
ggactttctgaggctg

SEQ ID NO: 112395 - DNA, 16 bp, H. sapiens
ggactttctggtttgt

SEQ ID NO: 112396 - DNA, 16 bp, H. sapiens
ggactttgcagtgagc

SEQ ID NO: 112397 - DNA, 16 bp, H. sapiens
ggactttgcggcacct

SEQ ID NO: 112398 - DNA, 16 bp, H. sapiens
ggagaaaaactggaaa

SEQ ID NO: 112399 - DNA, 16 bp, H. sapiens
ggagaaaaataacttt

SEQ ID NO: 112400 - DNA, 16 bp, H. sapiens
ggagaaaagacacaca

SEQ ID NO: 112401 - DNA, 16 bp, H. sapiens
ggagaaaagcaaggca

SEQ ID NO: 112402 - DNA, 16 bp, H. sapiens
ggagaaaagctgagtg

SEQ ID NO: 112403 - DNA, 16 bp, H. sapiens
ggagaaaagggaatcc

SEQ ID NO: 112404 - DNA, 16 bp, H. sapiens
ggagaaaagggagcac

SEQ ID NO: 112405 - DNA, 16 bp, H. sapiens
ggagaaaataattgca

SEQ ID NO: 112406 - DNA, 16 bp, H. sapiens
ggagaaaatacctgca

SEQ ID NO: 112407 - DNA, 16 bp, H. sapiens
ggagaaaatacttaca

SEQ ID NO: 112408 - DNA, 16 bp, H. sapiens
ggagaaaatattcaaa

SEQ ID NO: 112409 - DNA, 16 bp, H. sapiens
ggagaaaatattcatg

SEQ ID NO: 112410 - DNA, 16 bp, H. sapiens
ggagaaaatttggaaa

SEQ ID NO: 112411 - DNA, 16 bp, H. sapiens
ggagaaacaaaatcct

SEQ ID NO: 112412 - DNA, 16 bp, H. sapiens
ggagaaacagaaaaat

SEQ ID NO: 112413 - DNA, 16 bp, H. sapiens
ggagaaacaggtgaat

SEQ ID NO: 112414 - DNA, 16 bp, H. sapiens
ggagaaaccagcacaa

SEQ ID NO: 112415 - DNA, 16 bp, H. sapiens
ggagaaaccctacaag

SEQ ID NO: 112416 - DNA, 24 bp, H. sapiens
ggagaaaccctgtctctattaaaa

SEQ ID NO: 112417 - DNA, 16 bp, H. sapiens
ggagaaacctgtctct

SEQ ID NO: 112418 - DNA, 16 bp, H. sapiens
ggagaaactccgtctc

SEQ ID NO: 112419 - DNA, 16 bp, H. sapiens
ggagaaactctacaag

SEQ ID NO: 112420 - DNA, 16 bp, H. sapiens
ggagaaacttccctgg

SEQ ID NO: 112421 - DNA, 16 bp, H. sapiens
ggagaaagaatagtct

SEQ ID NO: 112422 - DNA, 16 bp, H. sapiens
ggagaaaggcctggaa

SEQ ID NO: 112423 - DNA, 16 bp, H. sapiens
ggagaaagtggcatga

SEQ ID NO: 112424 - DNA, 16 bp, H. sapiens
ggagaaataactaatg

SEQ ID NO: 112425 - DNA, 16 bp, H. sapiens
ggagaaatacaatcct

SEQ ID NO: 112426 - DNA, 16 bp, H. sapiens
ggagaaatacttgaac

SEQ ID NO: 112427 - DNA, 16 bp, H. sapiens
ggagaaatgaaatcct

SEQ ID NO: 112428 - DNA, 16 bp, H. sapiens
ggagaaatgcctaatg

SEQ ID NO: 112429 - DNA, 16 bp, H. sapiens
ggagaaattaaatact

SEQ ID NO: 112430 - DNA, 16 bp, H. sapiens
ggagaaattcaagcca

SEQ ID NO: 112431 - DNA, 16 bp, H. sapiens
ggagaaattgaagctg

SEQ ID NO: 112432 - DNA, 16 bp, H. sapiens
ggagaaatttaagcca

SEQ ID NO: 112433 - DNA, 16 bp, H. sapiens
ggagaacagcctgggc

SEQ ID NO: 112434 - DNA, 16 bp, H. sapiens
ggagaacaggtggtgt

SEQ ID NO: 112435 - DNA, 16 bp, H. sapiens
ggagaacagtgtggag

SEQ ID NO: 112436 - DNA, 16 bp, H. sapiens
ggagaacatcctggcc

SEQ ID NO: 112437 - DNA, 16 bp, H. sapiens
ggagaaccacaaacca

SEQ ID NO: 112438 - DNA, 16 bp, H. sapiens
ggagaacgactttgac

SEQ ID NO: 112439 - DNA, 16 bp, H. sapiens
ggagaactgcctgaac

SEQ ID NO: 112440 - DNA, 16 bp, H. sapiens
ggagaactgctggaac

SEQ ID NO: 112441 - DNA, 16 bp, H. sapiens
ggagaactgtttgagc

SEQ ID NO: 112442 - DNA, 16 bp, H. sapiens
ggagaagaatgaaact

SEQ ID NO: 112443 - DNA, 16 bp, H. sapiens
ggagaagaatgagcaa

SEQ ID NO: 112444 - DNA, 16 bp, H. sapiens
ggagaagacaagaaat

SEQ ID NO: 112445 - DNA, 16 bp, H. sapiens
ggagaagacacagaga

SEQ ID NO: 112446 - DNA, 16 bp, H. sapiens
ggagaagacagccatc

SEQ ID NO: 112447 - DNA, 16 bp, H. sapiens
ggagaagatgaatgtc

SEQ ID NO: 112448 - DNA, 16 bp, H. sapiens
ggagaagatgtggaga

SEQ ID NO: 112449 - DNA, 16 bp, H. sapiens
ggagaagcagcagcca

SEQ ID NO: 112450 - DNA, 16 bp, H. sapiens
ggagaagccacagaca

SEQ ID NO: 112451 - DNA, 16 bp, H. sapiens
ggagaagccaggcagc

SEQ ID NO: 112452 - DNA, 16 bp, H. sapiens
ggagaagctgggaagg

SEQ ID NO: 112453 - DNA, 16 bp, H. sapiens
ggagaagctgtagcaa

SEQ ID NO: 112454 - DNA, 16 bp, H. sapiens
ggagaaggaatttcac

SEQ ID NO: 112455 - DNA, 16 bp, H. sapiens
ggagaaggaggttgca

SEQ ID NO: 112456 - DNA, 16 bp, H. sapiens
ggagaaggcagccatc

SEQ ID NO: 112457 - DNA, 16 bp, H. sapiens
ggagaaggccagagag

SEQ ID NO: 112458 - DNA, 16 bp, H. sapiens
ggagaaggctctgcaa

SEQ ID NO: 112459 - DNA, 16 bp, H. sapiens
ggagaagggtgtgaac

SEQ ID NO: 112460 - DNA, 16 bp, H. sapiens
ggagaaggtcagcagg

SEQ ID NO: 112461 - DNA, 16 bp, H. sapiens
ggagaaggtggccatc

SEQ ID NO: 112462 - DNA, 16 bp, H. sapiens
ggagaagtcaatacct

SEQ ID NO: 112463 - DNA, 16 bp, H. sapiens
ggagaatagcttgagg

SEQ ID NO: 112464 - DNA, 19 bp, H. sapiens
ggagaatcacttgaaccca

SEQ ID NO: 112465 - DNA, 19 bp, H. sapiens
ggagaatcacttgaacctc

SEQ ID NO: 112466 - DNA, 16 bp, H. sapiens
ggagaatccctgtctc

SEQ ID NO: 112467 - DNA, 16 bp, H. sapiens
ggagaatcgcttaacc

SEQ ID NO: 112468 - DNA, 16 bp, H. sapiens
ggagaatctccaacct

SEQ ID NO: 112469 - DNA, 16 bp, H. sapiens
ggagaatctgcaaagg

SEQ ID NO: 112470 - DNA, 16 bp, H. sapiens
ggagaatgaaaagaca

SEQ ID NO: 112471 - DNA, 16 bp, H. sapiens
ggagaatgaaactgga

SEQ ID NO: 112472 - DNA, 16 bp, H. sapiens
ggagaatgaatgaatg

SEQ ID NO: 112473 - DNA, 16 bp, H. sapiens
ggagaatgacttgaac

SEQ ID NO: 112474 - DNA, 16 bp, H. sapiens
ggagaatgactttaac

SEQ ID NO: 112475 - DNA, 16 bp, H. sapiens
ggagaatgagtttgac

SEQ ID NO: 112476 - DNA, 16 bp, H. sapiens
ggagaatgccacatga

SEQ ID NO: 112477 - DNA, 16 bp, H. sapiens
ggagaatggaatcaag

SEQ ID NO: 112478 - DNA, 16 bp, H. sapiens
ggagaatggaatggaa

SEQ ID NO: 112479 - DNA, 16 bp, H. sapiens
ggagaatggattggag

SEQ ID NO: 112480 - DNA, 16 bp, H. sapiens
ggagaatggcaaaacc

SEQ ID NO: 112481 - DNA, 16 bp, H. sapiens
ggagaatggcttaaac

SEQ ID NO: 112482 - DNA, 16 bp, H. sapiens
ggagaatgggatacaa

SEQ ID NO: 112483 - DNA, 16 bp, H. sapiens
ggagaatggggtatct

SEQ ID NO: 112484 - DNA, 16 bp, H. sapiens
ggagaatggtggccct

SEQ ID NO: 112485 - DNA, 16 bp, H. sapiens
ggagaatggtgtgaaa

SEQ ID NO: 112486 - DNA, 16 bp, H. sapiens
ggagaatgtgtgtgtg

SEQ ID NO: 112487 - DNA, 16 bp, H. sapiens
ggagaattcggcccag

SEQ ID NO: 112488 - DNA, 16 bp, H. sapiens
ggagaattgacatctt

SEQ ID NO: 112489 - DNA, 16 bp, H. sapiens
ggagaattgcttgaaa

SEQ ID NO: 112490 - DNA, 16 bp, H. sapiens
ggagaattgtttgaat

SEQ ID NO: 112491 - DNA, 16 bp, H. sapiens
ggagaatttcagattt

SEQ ID NO: 112492 - DNA, 16 bp, H. sapiens
ggagaatttcttgaat

SEQ ID NO: 112493 - DNA, 16 bp, H. sapiens
ggagacaaggtcttgc

SEQ ID NO: 112494 - DNA, 16 bp, H. sapiens
ggagacacagagacaa

SEQ ID NO: 112495 - DNA, 16 bp, H. sapiens
ggagacagaaagcaga

SEQ ID NO: 112496 - DNA, 16 bp, H. sapiens
ggagacagacaacaaa

SEQ ID NO: 112497 - DNA, 16 bp, H. sapiens
ggagacagagactcca

SEQ ID NO: 112498 - DNA, 16 bp, H. sapiens
ggagacagagatggag

SEQ ID NO: 112499 - DNA, 16 bp, H. sapiens
ggagacagagcaagag

SEQ ID NO: 112500 - DNA, 16 bp, H. sapiens
ggagacagaggcacag

SEQ ID NO: 112501 - DNA, 16 bp, H. sapiens
ggagacagagggagac

SEQ ID NO: 112502 - DNA, 16 bp, H. sapiens
ggagacagcccaaata

SEQ ID NO: 112503 - DNA, 20 bp, H. sapiens
ggagacagggtttcaccata

SEQ ID NO: 112504 - DNA, 16 bp, H. sapiens
ggagacagtgtttcac

SEQ ID NO: 112505 - DNA, 16 bp, H. sapiens
ggagacattggagaag

SEQ ID NO: 112506 - DNA, 16 bp, H. sapiens
ggagacattttccctg

SEQ ID NO: 112507 - DNA, 16 bp, H. sapiens
ggagacatttttgatg

SEQ ID NO: 112508 - DNA, 16 bp, H. sapiens
ggagaccaaagtggga

SEQ ID NO: 112509 - DNA, 16 bp, H. sapiens
ggagaccaacctgggc

SEQ ID NO: 112510 - DNA, 16 bp, H. sapiens
ggagaccaaggcggga

SEQ ID NO: 112511 - DNA, 16 bp, H. sapiens
ggagaccaaggcgggc

SEQ ID NO: 112512 - DNA, 20 bp, H. sapiens
ggagaccaaggcgggcagat

SEQ ID NO: 112513 - DNA, 16 bp, H. sapiens
ggagaccaaggtgggc

SEQ ID NO: 112514 - DNA, 16 bp, H. sapiens
ggagaccagccaggcc

SEQ ID NO: 112515 - DNA, 16 bp, H. sapiens
ggagaccagcccggcc

SEQ ID NO: 112516 - DNA, 16 bp, H. sapiens
ggagaccagggcttat

SEQ ID NO: 112517 - DNA, 16 bp, H. sapiens
ggagacccaggagaac

SEQ ID NO: 112518 - DNA, 16 bp, H. sapiens
ggagacccaggagagc

SEQ ID NO: 112519 - DNA, 17 bp, H. sapiens
ggagaccccgtctctac

SEQ ID NO: 112520 - DNA, 16 bp, H. sapiens
ggagaccctaacccag

SEQ ID NO: 112521 - DNA, 16 bp, H. sapiens
ggagaccctggagtgg

SEQ ID NO: 112522 - DNA, 17 bp, H. sapiens
ggagaccctgtctctac

SEQ ID NO: 112523 - DNA, 16 bp, H. sapiens
ggagaccgagaccatc

SEQ ID NO: 112524 - DNA, 16 bp, H. sapiens
ggagaccgaggcgggc

SEQ ID NO: 112525 - DNA, 16 bp, H. sapiens
ggagaccgtggagagg

SEQ ID NO: 112526 - DNA, 16 bp, H. sapiens
ggagacctcacaatca

SEQ ID NO: 112527 - DNA, 16 bp, H. sapiens
ggagacctcagaaaac

SEQ ID NO: 112528 - DNA, 16 bp, H. sapiens
ggagacctccatctct

SEQ ID NO: 112529 - DNA, 16 bp, H. sapiens
ggagacctgggttcca

SEQ ID NO: 112530 - DNA, 16 bp, H. sapiens
ggagacctgggttcta

SEQ ID NO: 112531 - DNA, 16 bp, H. sapiens
ggagacgctgtctcaa

SEQ ID NO: 112532 - DNA, 18 bp, H. sapiens
ggagacggagcttgcagt

SEQ ID NO: 112533 - DNA, 16 bp, H. sapiens
ggagactaaggcagga

SEQ ID NO: 112534 - DNA, 18 bp, H. sapiens
ggagactccgtctcaaaa

SEQ ID NO: 112535 - DNA, 16 bp, H. sapiens
ggagactccgtctcta

SEQ ID NO: 112536 - DNA, 16 bp, H. sapiens
ggagactgacacagga

SEQ ID NO: 112537 - DNA, 16 bp, H. sapiens
ggagactgagagagga

SEQ ID NO: 112538 - DNA, 16 bp, H. sapiens
ggagactgagatggaa

SEQ ID NO: 112539 - DNA, 16 bp, H. sapiens
ggagactgaggcaaga

SEQ ID NO: 112540 - DNA, 16 bp, H. sapiens
ggagactgaggcagaa

SEQ ID NO: 112541 - DNA, 16 bp, H. sapiens
ggagactgaggcagag

SEQ ID NO: 112542 - DNA, 16 bp, H. sapiens
ggagactgaggcaggg

SEQ ID NO: 112543 - DNA, 16 bp, H. sapiens
ggagactgaggcaggt

SEQ ID NO: 112544 - DNA, 16 bp, H. sapiens
ggagactgggaagtct

SEQ ID NO: 112545 - DNA, 16 bp, H. sapiens
ggagactgtggggaga

SEQ ID NO: 112546 - DNA, 16 bp, H. sapiens
ggagactttttttttt

SEQ ID NO: 112547 - DNA, 16 bp, H. sapiens
ggagagaaaaatcaaa

SEQ ID NO: 112548 - DNA, 16 bp, H. sapiens
ggagagaaaccctaca

SEQ ID NO: 112549 - DNA, 16 bp, H. sapiens
ggagagaaattcaagc

SEQ ID NO: 112550 - DNA, 16 bp, H. sapiens
ggagagaagaatcaaa

SEQ ID NO: 112551 - DNA, 16 bp, H. sapiens
ggagagaagctgaggc

SEQ ID NO: 112552 - DNA, 16 bp, H. sapiens
ggagagaatcaccttg

SEQ ID NO: 112553 - DNA, 16 bp, H. sapiens
ggagagaatgagatga

SEQ ID NO: 112554 - DNA, 16 bp, H. sapiens
ggagagaatgatatta

SEQ ID NO: 112555 - DNA, 16 bp, H. sapiens
ggagagaccaggtgga

SEQ ID NO: 112556 - DNA, 16 bp, H. sapiens
ggagagactcctggcc

SEQ ID NO: 112557 - DNA, 16 bp, H. sapiens
ggagagagacaggcag

SEQ ID NO: 112558 - DNA, 16 bp, H. sapiens
ggagagagaggccaca

SEQ ID NO: 112559 - DNA, 16 bp, H. sapiens
ggagagagcagggctg

SEQ ID NO: 112560 - DNA, 16 bp, H. sapiens
ggagagagcatcagga

SEQ ID NO: 112561 - DNA, 16 bp, H. sapiens
ggagagaggacacagg

SEQ ID NO: 112562 - DNA, 16 bp, H. sapiens
ggagagaggcctggga

SEQ ID NO: 112563 - DNA, 16 bp, H. sapiens
ggagagaggctggaga

SEQ ID NO: 112564 - DNA, 16 bp, H. sapiens
ggagagaggcttcaga

SEQ ID NO: 112565 - DNA, 16 bp, H. sapiens
ggagagagtagaatgg

SEQ ID NO: 112566 - DNA, 16 bp, H. sapiens
ggagagcaagaccatc

SEQ ID NO: 112567 - DNA, 16 bp, H. sapiens
ggagagcaatggcacg

SEQ ID NO: 112568 - DNA, 16 bp, H. sapiens
ggagagcagcctggcc

SEQ ID NO: 112569 - DNA, 16 bp, H. sapiens
ggagagcatcaggaag

SEQ ID NO: 112570 - DNA, 16 bp, H. sapiens
ggagaggaagctggga

SEQ ID NO: 112571 - DNA, 16 bp, H. sapiens
ggagaggacacagaga

SEQ ID NO: 112572 - DNA, 16 bp, H. sapiens
ggagaggaccaggaaa

SEQ ID NO: 112573 - DNA, 16 bp, H. sapiens
ggagaggagagagctg

SEQ ID NO: 112574 - DNA, 16 bp, H. sapiens
ggagaggagccaagat

SEQ ID NO: 112575 - DNA, 16 bp, H. sapiens
ggagaggaggctgagg

SEQ ID NO: 112576 - DNA, 16 bp, H. sapiens
ggagaggaggctggag

SEQ ID NO: 112577 - DNA, 16 bp, H. sapiens
ggagaggatgcggaga

SEQ ID NO: 112578 - DNA, 17 bp, H. sapiens
ggagaggatgtggaaaa

SEQ ID NO: 112579 - DNA, 17 bp, H. sapiens
ggagaggcactctgctt

SEQ ID NO: 112580 - DNA, 16 bp, H. sapiens
ggagaggcagagacag

SEQ ID NO: 112581 - DNA, 16 bp, H. sapiens
ggagaggcagagccag

SEQ ID NO: 112582 - DNA, 16 bp, H. sapiens
ggagaggcagaggctg

SEQ ID NO: 112583 - DNA, 16 bp, H. sapiens
ggagaggcaggcacag

SEQ ID NO: 112584 - DNA, 16 bp, H. sapiens
ggagaggccaggcgtg

SEQ ID NO: 112585 - DNA, 16 bp, H. sapiens
ggagaggcccacatgg

SEQ ID NO: 112586 - DNA, 16 bp, H. sapiens
ggagaggcccatgtgg

SEQ ID NO: 112587 - DNA, 16 bp, H. sapiens
ggagaggccgggcacg

SEQ ID NO: 112588 - DNA, 16 bp, H. sapiens
ggagaggcctggtggg

SEQ ID NO: 112589 - DNA, 16 bp, H. sapiens
ggagaggcgcgagcag

SEQ ID NO: 112590 - DNA, 16 bp, H. sapiens
ggagaggctgggagag

SEQ ID NO: 112591 - DNA, 16 bp, H. sapiens
ggagaggctggggcag

SEQ ID NO: 112592 - DNA, 16 bp, H. sapiens
ggagagggactggcag

SEQ ID NO: 112593 - DNA, 16 bp, H. sapiens
ggagagggagaacaca

SEQ ID NO: 112594 - DNA, 16 bp, H. sapiens
ggagagggagaagctg

SEQ ID NO: 112595 - DNA, 16 bp, H. sapiens
ggagagggagaggctg

SEQ ID NO: 112596 - DNA, 16 bp, H. sapiens
ggagagggtgctggga

SEQ ID NO: 112597 - DNA, 16 bp, H. sapiens
ggagagggttttctga

SEQ ID NO: 112598 - DNA, 16 bp, H. sapiens
ggagaggtggaggctg

SEQ ID NO: 112599 - DNA, 16 bp, H. sapiens
ggagaggtgggcagag

SEQ ID NO: 112600 - DNA, 16 bp, H. sapiens
ggagagttctggctgg

SEQ ID NO: 112601 - DNA, 16 bp, H. sapiens
ggagataaacattgag

SEQ ID NO: 112602 - DNA, 16 bp, H. sapiens
ggagataaaccctgca

SEQ ID NO: 112603 - DNA, 16 bp, H. sapiens
ggagataaagaccatc

SEQ ID NO: 112604 - DNA, 16 bp, H. sapiens
ggagatacattccaag

SEQ ID NO: 112605 - DNA, 16 bp, H. sapiens
ggagatactggtcaaa

SEQ ID NO: 112606 - DNA, 16 bp, H. sapiens
ggagatatacctaatg

SEQ ID NO: 112607 - DNA, 16 bp, H. sapiens
ggagatattggtcaaa

SEQ ID NO: 112608 - DNA, 16 bp, H. sapiens
ggagatcaaggatgca

SEQ ID NO: 112609 - DNA, 16 bp, H. sapiens
ggagatcaatcccccg

SEQ ID NO: 112610 - DNA, 16 bp, H. sapiens
ggagatcacgccactg

SEQ ID NO: 112611 - DNA, 16 bp, H. sapiens
ggagatcactgaatca

SEQ ID NO: 112612 - DNA, 16 bp, H. sapiens
ggagatccaagaaccc

SEQ ID NO: 112613 - DNA, 16 bp, H. sapiens
ggagatcctgccactg

SEQ ID NO: 112614 - DNA, 16 bp, H. sapiens
ggagatcgagatcacc

SEQ ID NO: 112615 - DNA, 16 bp, H. sapiens
ggagatcgcaccactg

SEQ ID NO: 112616 - DNA, 16 bp, H. sapiens
ggagatctcaggaaac

SEQ ID NO: 112617 - DNA, 16 bp, H. sapiens
ggagatgaaatcacag

SEQ ID NO: 112618 - DNA, 16 bp, H. sapiens
ggagatgaagaaactg

SEQ ID NO: 112619 - DNA, 16 bp, H. sapiens
ggagatgaagaccatc

SEQ ID NO: 112620 - DNA, 16 bp, H. sapiens
ggagatgaatttgaga

SEQ ID NO: 112621 - DNA, 16 bp, H. sapiens
ggagatgacatttgag

SEQ ID NO: 112622 - DNA, 16 bp, H. sapiens
ggagatgagaccatcc

SEQ ID NO: 112623 - DNA, 16 bp, H. sapiens
ggagatgaggaacctg

SEQ ID NO: 112624 - DNA, 16 bp, H. sapiens
ggagatgaggcaggag

SEQ ID NO: 112625 - DNA, 16 bp, H. sapiens
ggagatgaggttggag

SEQ ID NO: 112626 - DNA, 16 bp, H. sapiens
ggagatgatttttttt

SEQ ID NO: 112627 - DNA, 16 bp, H. sapiens
ggagatgcagaaggag

SEQ ID NO: 112628 - DNA, 16 bp, H. sapiens
ggagatgccacacact

SEQ ID NO: 112629 - DNA, 16 bp, H. sapiens
ggagatgctgggaggg

SEQ ID NO: 112630 - DNA, 16 bp, H. sapiens
ggagatggaagctgca

SEQ ID NO: 112631 - DNA, 16 bp, H. sapiens
ggagatggagaccatt

SEQ ID NO: 112632 - DNA, 16 bp, H. sapiens
ggagatggaggatgca

SEQ ID NO: 112633 - DNA, 16 bp, H. sapiens
ggagatggaggcagag

SEQ ID NO: 112634 - DNA, 16 bp, H. sapiens
ggagatggaggctcag

SEQ ID NO: 112635 - DNA, 16 bp, H. sapiens
ggagatggaggtggca

SEQ ID NO: 112636 - DNA, 16 bp, H. sapiens
ggagatgggagtttta

SEQ ID NO: 112637 - DNA, 16 bp, H. sapiens
ggagatggggttttgc

SEQ ID NO: 112638 - DNA, 16 bp, H. sapiens
ggagatggtgccactg

SEQ ID NO: 112639 - DNA, 16 bp, H. sapiens
ggagatggtgctaaac

SEQ ID NO: 112640 - DNA, 16 bp, H. sapiens
ggagattctaaatctt

SEQ ID NO: 112641 - DNA, 16 bp, H. sapiens
ggagattctccaggga

SEQ ID NO: 112642 - DNA, 16 bp, H. sapiens
ggagattgaagctgca

SEQ ID NO: 112643 - DNA, 16 bp, H. sapiens
ggagattgagatcatc

SEQ ID NO: 112644 - DNA, 16 bp, H. sapiens
ggagatttctgaaaga

SEQ ID NO: 112645 - DNA, 16 bp, H. sapiens
ggagatttctgcattt

SEQ ID NO: 112646 - DNA, 16 bp, H. sapiens
ggagatttctgtagat

SEQ ID NO: 112647 - DNA, 16 bp, H. sapiens
ggagattttttttctt

SEQ ID NO: 112648 - DNA, 16 bp, H. sapiens
ggagcaaaacttagaa

SEQ ID NO: 112649 - DNA, 16 bp, H. sapiens
ggagcaaagacatgtc

SEQ ID NO: 112650 - DNA, 16 bp, H. sapiens
ggagcaagactccatc

SEQ ID NO: 112651 - DNA, 16 bp, H. sapiens
ggagcaagactctgtc

SEQ ID NO: 112652 - DNA, 16 bp, H. sapiens
ggagcaagagcaagag

SEQ ID NO: 112653 - DNA, 16 bp, H. sapiens
ggagcaagatcctgtc

SEQ ID NO: 112654 - DNA, 16 bp, H. sapiens
ggagcaagatggctga

SEQ ID NO: 112655 - DNA, 16 bp, H. sapiens
ggagcacactgaggcc

SEQ ID NO: 112656 - DNA, 16 bp, H. sapiens
ggagcacagtggcgcg

SEQ ID NO: 112657 - DNA, 16 bp, H. sapiens
ggagcacccagcttca

SEQ ID NO: 112658 - DNA, 16 bp, H. sapiens
ggagcactttgtggcc

SEQ ID NO: 112659 - DNA, 17 bp, H. sapiens
ggagcagaaagtatatg

SEQ ID NO: 112660 - DNA, 16 bp, H. sapiens
ggagcagaagaaatat

SEQ ID NO: 112661 - DNA, 16 bp, H. sapiens
ggagcagaagcaagag

SEQ ID NO: 112662 - DNA, 16 bp, H. sapiens
ggagcagaaggccagg

SEQ ID NO: 112663 - DNA, 16 bp, H. sapiens
ggagcagacatgtcac

SEQ ID NO: 112664 - DNA, 16 bp, H. sapiens
ggagcagacatttcaa

SEQ ID NO: 112665 - DNA, 16 bp, H. sapiens
ggagcagagacaagct

SEQ ID NO: 112666 - DNA, 16 bp, H. sapiens
ggagcagaggcagcag

SEQ ID NO: 112667 - DNA, 16 bp, H. sapiens
ggagcagaggcctgag

SEQ ID NO: 112668 - DNA, 16 bp, H. sapiens
ggagcagagtcttctc

SEQ ID NO: 112669 - DNA, 16 bp, H. sapiens
ggagcagcaagtgcaa

SEQ ID NO: 112670 - DNA, 16 bp, H. sapiens
ggagcagcaggaactc

SEQ ID NO: 112671 - DNA, 16 bp, H. sapiens
ggagcagccagccggc

SEQ ID NO: 112672 - DNA, 16 bp, H. sapiens
ggagcagctgctgcca

SEQ ID NO: 112673 - DNA, 16 bp, H. sapiens
ggagcagctggggagg

SEQ ID NO: 112674 - DNA, 16 bp, H. sapiens
ggagcagctggggcag

SEQ ID NO: 112675 - DNA, 16 bp, H. sapiens
ggagcagcttcttcaa

SEQ ID NO: 112676 - DNA, 16 bp, H. sapiens
ggagcaggagagagtg

SEQ ID NO: 112677 - DNA, 16 bp, H. sapiens
ggagcaggagcagcag

SEQ ID NO: 112678 - DNA, 16 bp, H. sapiens
ggagcaggagcaggca

SEQ ID NO: 112679 - DNA, 16 bp, H. sapiens
ggagcaggaggccatt

SEQ ID NO: 112680 - DNA, 16 bp, H. sapiens
ggagcaggaggcccag

SEQ ID NO: 112681 - DNA, 16 bp, H. sapiens
ggagcaggaggcctgg

SEQ ID NO: 112682 - DNA, 16 bp, H. sapiens
ggagcaggcagcagcc

SEQ ID NO: 112683 - DNA, 16 bp, H. sapiens
ggagcaggcatgtcac

SEQ ID NO: 112684 - DNA, 16 bp, H. sapiens
ggagcaggctctgtgc

SEQ ID NO: 112685 - DNA, 16 bp, H. sapiens
ggagcaggctgttcag

SEQ ID NO: 112686 - DNA, 16 bp, H. sapiens
ggagcagggggtggca

SEQ ID NO: 112687 - DNA, 16 bp, H. sapiens
ggagcagggtgaggga

SEQ ID NO: 112688 - DNA, 16 bp, H. sapiens
ggagcagggtgcctgt

SEQ ID NO: 112689 - DNA, 16 bp, H. sapiens
ggagcaggtggaccag

SEQ ID NO: 112690 - DNA, 16 bp, H. sapiens
ggagcaggtggaggag

SEQ ID NO: 112691 - DNA, 16 bp, H. sapiens
ggagcagtcacagagc

SEQ ID NO: 112692 - DNA, 16 bp, H. sapiens
ggagcagtctggggag

SEQ ID NO: 112693 - DNA, 16 bp, H. sapiens
ggagcagtggctcatg

SEQ ID NO: 112694 - DNA, 16 bp, H. sapiens
ggagcagtgggaagta

SEQ ID NO: 112695 - DNA, 16 bp, H. sapiens
ggagcatctttgtggt

SEQ ID NO: 112696 - DNA, 16 bp, H. sapiens
ggagcattctggattt

SEQ ID NO: 112697 - DNA, 16 bp, H. sapiens
ggagcattgccatctt

SEQ ID NO: 112698 - DNA, 16 bp, H. sapiens
ggagcatttcaggttt

SEQ ID NO: 112699 - DNA, 16 bp, H. sapiens
ggagcatttggaccag

SEQ ID NO: 112700 - DNA, 16 bp, H. sapiens
ggagcattttagattt

SEQ ID NO: 112701 - DNA, 16 bp, H. sapiens
ggagccaagaggaagt

SEQ ID NO: 112702 - DNA, 16 bp, H. sapiens
ggagccaagatcacgc

SEQ ID NO: 112703 - DNA, 18 bp, H. sapiens
ggagccaagatcgcacca

SEQ ID NO: 112704 - DNA, 18 bp, H. sapiens
ggagccaagattgcgcca

SEQ ID NO: 112705 - DNA, 16 bp, H. sapiens
ggagccaaggcaggag

SEQ ID NO: 112706 - DNA, 16 bp, H. sapiens
ggagccaccaggagct

SEQ ID NO: 112707 - DNA, 16 bp, H. sapiens
ggagccacctcagctc

SEQ ID NO: 112708 - DNA, 16 bp, H. sapiens
ggagccactgtgccca

SEQ ID NO: 112709 - DNA, 16 bp, H. sapiens
ggagccactgtgcctg

SEQ ID NO: 112710 - DNA, 16 bp, H. sapiens
ggagccagaggcagag

SEQ ID NO: 112711 - DNA, 16 bp, H. sapiens
ggagccagaggccatt

SEQ ID NO: 112712 - DNA, 16 bp, H. sapiens
ggagccagaggctgca

SEQ ID NO: 112713 - DNA, 16 bp, H. sapiens
ggagccagctccctct

SEQ ID NO: 112714 - DNA, 16 bp, H. sapiens
ggagccaggaagccag

SEQ ID NO: 112715 - DNA, 16 bp, H. sapiens
ggagccaggagacctg

SEQ ID NO: 112716 - DNA, 16 bp, H. sapiens
ggagccaggagccagg

SEQ ID NO: 112717 - DNA, 16 bp, H. sapiens
ggagccaggcacagtg

SEQ ID NO: 112718 - DNA, 16 bp, H. sapiens
ggagccagggagcaga

SEQ ID NO: 112719 - DNA, 16 bp, H. sapiens
ggagccagggccaggg

SEQ ID NO: 112720 - DNA, 16 bp, H. sapiens
ggagccagggggccag

SEQ ID NO: 112721 - DNA, 16 bp, H. sapiens
ggagccagggtgggca

SEQ ID NO: 112722 - DNA, 17 bp, H. sapiens
ggagccaggtgcggtgg

SEQ ID NO: 112723 - DNA, 16 bp, H. sapiens
ggagcccaaggtgggc

SEQ ID NO: 112724 - DNA, 16 bp, H. sapiens
ggagcccaccccagct

SEQ ID NO: 112725 - DNA, 16 bp, H. sapiens
ggagcccacgcccacc

SEQ ID NO: 112726 - DNA, 16 bp, H. sapiens
ggagcccactgtcctg

SEQ ID NO: 112727 - DNA, 16 bp, H. sapiens
ggagcccagagcccag

SEQ ID NO: 112728 - DNA, 16 bp, H. sapiens
ggagcccagcacagct

SEQ ID NO: 112729 - DNA, 16 bp, H. sapiens
ggagcccagcctgggc

SEQ ID NO: 112730 - DNA, 16 bp, H. sapiens
ggagcccaggaggcgg

SEQ ID NO: 112731 - DNA, 16 bp, H. sapiens
ggagcccaggaggtgg

SEQ ID NO: 112732 - DNA, 16 bp, H. sapiens
ggagcccaggccaggc

SEQ ID NO: 112733 - DNA, 16 bp, H. sapiens
ggagcccagtgggagg

SEQ ID NO: 112734 - DNA, 16 bp, H. sapiens
ggagccccagatgcag

SEQ ID NO: 112735 - DNA, 16 bp, H. sapiens
ggagccccaggagctg

SEQ ID NO: 112736 - DNA, 16 bp, H. sapiens
ggagcccctcctcctc

SEQ ID NO: 112737 - DNA, 17 bp, H. sapiens
ggagcccctctgcccag

SEQ ID NO: 112738 - DNA, 17 bp, H. sapiens
ggagcccctctgcctgg

SEQ ID NO: 112739 - DNA, 16 bp, H. sapiens
ggagcccctgccacct

SEQ ID NO: 112740 - DNA, 16 bp, H. sapiens
ggagccccttcctggg

SEQ ID NO: 112741 - DNA, 16 bp, H. sapiens
ggagcccgccaccatg

SEQ ID NO: 112742 - DNA, 16 bp, H. sapiens
ggagcccgggaggcag

SEQ ID NO: 112743 - DNA, 16 bp, H. sapiens
ggagccctcatgactt

SEQ ID NO: 112744 - DNA, 16 bp, H. sapiens
ggagccctggttcctt

SEQ ID NO: 112745 - DNA, 16 bp, H. sapiens
ggagcccttatgaatg

SEQ ID NO: 112746 - DNA, 17 bp, H. sapiens
ggagcccttcagcccgc

SEQ ID NO: 112747 - DNA, 16 bp, H. sapiens
ggagcccttcagcctg

SEQ ID NO: 112748 - DNA, 18 bp, H. sapiens
ggagccggctccctcagc

SEQ ID NO: 112749 - DNA, 16 bp, H. sapiens
ggagccgtggcagagg

SEQ ID NO: 112750 - DNA, 16 bp, H. sapiens
ggagcctcagcctcct

SEQ ID NO: 112751 - DNA, 16 bp, H. sapiens
ggagcctgaggcccag

SEQ ID NO: 112752 - DNA, 16 bp, H. sapiens
ggagcctgagtcagga

SEQ ID NO: 112753 - DNA, 16 bp, H. sapiens
ggagcctggactcctg

SEQ ID NO: 112754 - DNA, 16 bp, H. sapiens
ggagcctgggaggcgg

SEQ ID NO: 112755 - DNA, 16 bp, H. sapiens
ggagcctgggcaggtc

SEQ ID NO: 112756 - DNA, 16 bp, H. sapiens
ggagcctgggctgggg

SEQ ID NO: 112757 - DNA, 16 bp, H. sapiens
ggagcctggggctggg

SEQ ID NO: 112758 - DNA, 16 bp, H. sapiens
ggagcctggggtttgg

SEQ ID NO: 112759 - DNA, 16 bp, H. sapiens
ggagcctgggtccctg

SEQ ID NO: 112760 - DNA, 16 bp, H. sapiens
ggagcctggtgggaag

SEQ ID NO: 112761 - DNA, 16 bp, H. sapiens
ggagcgcaccaccatg

SEQ ID NO: 112762 - DNA, 16 bp, H. sapiens
ggagcgcattgaggcc

SEQ ID NO: 112763 - DNA, 16 bp, H. sapiens
ggagcgcctctgcccc

SEQ ID NO: 112764 - DNA, 16 bp, H. sapiens
ggagcgctttgtggcc

SEQ ID NO: 112765 - DNA, 16 bp, H. sapiens
ggagctaagctgtgag

SEQ ID NO: 112766 - DNA, 16 bp, H. sapiens
ggagctcaagaccagg

SEQ ID NO: 112767 - DNA, 16 bp, H. sapiens
ggagctcagaaggcca

SEQ ID NO: 112768 - DNA, 16 bp, H. sapiens
ggagctcagggaggcc

SEQ ID NO: 112769 - DNA, 16 bp, H. sapiens
ggagctcaggggaggg

SEQ ID NO: 112770 - DNA, 16 bp, H. sapiens
ggagctcattgaggcc

SEQ ID NO: 112771 - DNA, 16 bp, H. sapiens
ggagctccagcagcca

SEQ ID NO: 112772 - DNA, 16 bp, H. sapiens
ggagctcccagaggaa

SEQ ID NO: 112773 - DNA, 16 bp, H. sapiens
ggagctccccaggtgc

SEQ ID NO: 112774 - DNA, 16 bp, H. sapiens
ggagctccctgagggc

SEQ ID NO: 112775 - DNA, 17 bp, H. sapiens
ggagctcctgaaggaag

SEQ ID NO: 112776 - DNA, 16 bp, H. sapiens
ggagctcgaggctgca

SEQ ID NO: 112777 - DNA, 16 bp, H. sapiens
ggagctctatggcccc

SEQ ID NO: 112778 - DNA, 16 bp, H. sapiens
ggagctctcctgtatg

SEQ ID NO: 112779 - DNA, 16 bp, H. sapiens
ggagctctgtgccagg

SEQ ID NO: 112780 - DNA, 16 bp, H. sapiens
ggagctctgtgccttg

SEQ ID NO: 112781 - DNA, 16 bp, H. sapiens
ggagctgaaaaatttc

SEQ ID NO: 112782 - DNA, 17 bp, H. sapiens
ggagctgaaaaccacgg

SEQ ID NO: 112783 - DNA, 16 bp, H. sapiens
ggagctgaaaaccgtg

SEQ ID NO: 112784 - DNA, 16 bp, H. sapiens
ggagctgaaagacaaa

SEQ ID NO: 112785 - DNA, 16 bp, H. sapiens
ggagctgaacagtgag

SEQ ID NO: 112786 - DNA, 16 bp, H. sapiens
ggagctgaagcagctg

SEQ ID NO: 112787 - DNA, 16 bp, H. sapiens
ggagctgagcagggag

SEQ ID NO: 112788 - DNA, 16 bp, H. sapiens
ggagctgagcctggag

SEQ ID NO: 112789 - DNA, 16 bp, H. sapiens
ggagctgaggaaggag

SEQ ID NO: 112790 - DNA, 16 bp, H. sapiens
ggagctgaggcgggag

SEQ ID NO: 112791 - DNA, 16 bp, H. sapiens
ggagctgaggctgagg

SEQ ID NO: 112792 - DNA, 16 bp, H. sapiens
ggagctgaggctggag

SEQ ID NO: 112793 - DNA, 16 bp, H. sapiens
ggagctgaggctgggg

SEQ ID NO: 112794 - DNA, 16 bp, H. sapiens
ggagctgagggcagct

SEQ ID NO: 112795 - DNA, 16 bp, H. sapiens
ggagctgaggtgggtg

SEQ ID NO: 112796 - DNA, 16 bp, H. sapiens
ggagctgagtgaggcc

SEQ ID NO: 112797 - DNA, 16 bp, H. sapiens
ggagctgatagccaga

SEQ ID NO: 112798 - DNA, 16 bp, H. sapiens
ggagctgatgttccag

SEQ ID NO: 112799 - DNA, 16 bp, H. sapiens
ggagctgatgttctag

SEQ ID NO: 112800 - DNA, 16 bp, H. sapiens
ggagctgcaattcaag

SEQ ID NO: 112801 - DNA, 16 bp, H. sapiens
ggagctgcagaagaaa

SEQ ID NO: 112802 - DNA, 23 bp, H. sapiens
ggagctgcagttgtactggctgt

SEQ ID NO: 112803 - DNA, 16 bp, H. sapiens
ggagctgcccaagacc

SEQ ID NO: 112804 - DNA, 16 bp, H. sapiens
ggagctgcctgcccca

SEQ ID NO: 112805 - DNA, 16 bp, H. sapiens
ggagctgcctggagac

SEQ ID NO: 112806 - DNA, 16 bp, H. sapiens
ggagctgcggcagagg

SEQ ID NO: 112807 - DNA, 16 bp, H. sapiens
ggagctggaaaggaga

SEQ ID NO: 112808 - DNA, 16 bp, H. sapiens
ggagctggagaagggg

SEQ ID NO: 112809 - DNA, 16 bp, H. sapiens
ggagctggagacccag

SEQ ID NO: 112810 - DNA, 16 bp, H. sapiens
ggagctggagacctgg

SEQ ID NO: 112811 - DNA, 16 bp, H. sapiens
ggagctggagactagc

SEQ ID NO: 112812 - DNA, 16 bp, H. sapiens
ggagctggagaggatg

SEQ ID NO: 112813 - DNA, 16 bp, H. sapiens
ggagctggagcagctg

SEQ ID NO: 112814 - DNA, 16 bp, H. sapiens
ggagctggagctggag

SEQ ID NO: 112815 - DNA, 16 bp, H. sapiens
ggagctggaggccact

SEQ ID NO: 112816 - DNA, 16 bp, H. sapiens
ggagctggaggccttt

SEQ ID NO: 112817 - DNA, 16 bp, H. sapiens
ggagctggaggttatt

SEQ ID NO: 112818 - DNA, 16 bp, H. sapiens
ggagctggcaccattc

SEQ ID NO: 112819 - DNA, 16 bp, H. sapiens
ggagctggccaaggtg

SEQ ID NO: 112820 - DNA, 16 bp, H. sapiens
ggagctgggaagtcca

SEQ ID NO: 112821 - DNA, 16 bp, H. sapiens
ggagctgggagaagag

SEQ ID NO: 112822 - DNA, 16 bp, H. sapiens
ggagctgggagagagg

SEQ ID NO: 112823 - DNA, 16 bp, H. sapiens
ggagctgggagaggag

SEQ ID NO: 112824 - DNA, 16 bp, H. sapiens
ggagctgggagaggcc

SEQ ID NO: 112825 - DNA, 16 bp, H. sapiens
ggagctgggagctggg

SEQ ID NO: 112826 - DNA, 16 bp, H. sapiens
ggagctgggcaggtgg

SEQ ID NO: 112827 - DNA, 16 bp, H. sapiens
ggagctgggcccgggg

SEQ ID NO: 112828 - DNA, 16 bp, H. sapiens
ggagctgggcctggag

SEQ ID NO: 112829 - DNA, 16 bp, H. sapiens
ggagctggggagcagg

SEQ ID NO: 112830 - DNA, 16 bp, H. sapiens
ggagctggggcagagg

SEQ ID NO: 112831 - DNA, 16 bp, H. sapiens
ggagctggggctgcag

SEQ ID NO: 112832 - DNA, 16 bp, H. sapiens
ggagctggggtttgaa

SEQ ID NO: 112833 - DNA, 16 bp, H. sapiens
ggagctgggtgaggcc

SEQ ID NO: 112834 - DNA, 16 bp, H. sapiens
ggagctggtgctgctg

SEQ ID NO: 112835 - DNA, 16 bp, H. sapiens
ggagctggtttttttg

SEQ ID NO: 112836 - DNA, 16 bp, H. sapiens
ggagctgtcacctcct

SEQ ID NO: 112837 - DNA, 16 bp, H. sapiens
ggagctgtcatctcct

SEQ ID NO: 112838 - DNA, 16 bp, H. sapiens
ggagctgtgagaagaa

SEQ ID NO: 112839 - DNA, 16 bp, H. sapiens
ggagctgtgggaaggg

SEQ ID NO: 112840 - DNA, 16 bp, H. sapiens
ggagctgtggggtttt

SEQ ID NO: 112841 - DNA, 16 bp, H. sapiens
ggagcttacaatcatg

SEQ ID NO: 112842 - DNA, 16 bp, H. sapiens
ggagcttatattccag

SEQ ID NO: 112843 - DNA, 16 bp, H. sapiens
ggagcttctgagccag

SEQ ID NO: 112844 - DNA, 16 bp, H. sapiens
ggagcttgcagagagc

SEQ ID NO: 112845 - DNA, 16 bp, H. sapiens
ggagcttgcagcaagc

SEQ ID NO: 112846 - DNA, 16 bp, H. sapiens
ggagcttgcagcgagc

SEQ ID NO: 112847 - DNA, 16 bp, H. sapiens
ggagcttgcagggagc

SEQ ID NO: 112848 - DNA, 16 bp, H. sapiens
ggagcttgcagggctg

SEQ ID NO: 112849 - DNA, 16 bp, H. sapiens
ggagcttgcagtgagt

SEQ ID NO: 112850 - DNA, 16 bp, H. sapiens
ggagcttgcggtgagc

SEQ ID NO: 112851 - DNA, 16 bp, H. sapiens
ggagctttatgctgaa

SEQ ID NO: 112852 - DNA, 16 bp, H. sapiens
ggagcttttaaaaata

SEQ ID NO: 112853 - DNA, 16 bp, H. sapiens
ggagcttttaaaaatg

SEQ ID NO: 112854 - DNA, 16 bp, H. sapiens
ggaggaaaataaaaca

SEQ ID NO: 112855 - DNA, 16 bp, H. sapiens
ggaggaaaataaacaa

SEQ ID NO: 112856 - DNA, 16 bp, H. sapiens
ggaggaaataaaactg

SEQ ID NO: 112857 - DNA, 16 bp, H. sapiens
ggaggaaattgaatca

SEQ ID NO: 112858 - DNA, 16 bp, H. sapiens
ggaggaactttggaaa

SEQ ID NO: 112859 - DNA, 16 bp, H. sapiens
ggaggaagaaatgcta

SEQ ID NO: 112860 - DNA, 16 bp, H. sapiens
ggaggaagaaatttct

SEQ ID NO: 112861 - DNA, 16 bp, H. sapiens
ggaggaagaggctgca

SEQ ID NO: 112862 - DNA, 16 bp, H. sapiens
ggaggaagatcacaga

SEQ ID NO: 112863 - DNA, 16 bp, H. sapiens
ggaggaagccagctgc

SEQ ID NO: 112864 - DNA, 16 bp, H. sapiens
ggaggaagctgaggcc

SEQ ID NO: 112865 - DNA, 16 bp, H. sapiens
ggaggaaggaaggctg

SEQ ID NO: 112866 - DNA, 16 bp, H. sapiens
ggaggaaggaatgaat

SEQ ID NO: 112867 - DNA, 16 bp, H. sapiens
ggaggaaggaatgaca

SEQ ID NO: 112868 - DNA, 16 bp, H. sapiens
ggaggaaggactcctc

SEQ ID NO: 112869 - DNA, 16 bp, H. sapiens
ggaggaagggctggag

SEQ ID NO: 112870 - DNA, 16 bp, H. sapiens
ggaggaagggctgggc

SEQ ID NO: 112871 - DNA, 16 bp, H. sapiens
ggaggaaggtggctgg

SEQ ID NO: 112872 - DNA, 17 bp, H. sapiens
ggaggaatgaacaactc

SEQ ID NO: 112873 - DNA, 16 bp, H. sapiens
ggaggaattccagaag

SEQ ID NO: 112874 - DNA, 16 bp, H. sapiens
ggaggacagcaccaag

SEQ ID NO: 112875 - DNA, 16 bp, H. sapiens
ggaggacagcttgagg

SEQ ID NO: 112876 - DNA, 16 bp, H. sapiens
ggaggacagggtggga

SEQ ID NO: 112877 - DNA, 16 bp, H. sapiens
ggaggacagtggctct

SEQ ID NO: 112878 - DNA, 16 bp, H. sapiens
ggaggactcagaagaa

SEQ ID NO: 112879 - DNA, 16 bp, H. sapiens
ggaggactgcttgggg

SEQ ID NO: 112880 - DNA, 16 bp, H. sapiens
ggaggacttcctggag

SEQ ID NO: 112881 - DNA, 16 bp, H. sapiens
ggaggagaacatcaca

SEQ ID NO: 112882 - DNA, 16 bp, H. sapiens
ggaggagaagaagcat

SEQ ID NO: 112883 - DNA, 16 bp, H. sapiens
ggaggagaagaggcct

SEQ ID NO: 112884 - DNA, 16 bp, H. sapiens
ggaggagaagaggctc

SEQ ID NO: 112885 - DNA, 16 bp, H. sapiens
ggaggagaagaggctt

SEQ ID NO: 112886 - DNA, 16 bp, H. sapiens
ggaggagaagcagcag

SEQ ID NO: 112887 - DNA, 16 bp, H. sapiens
ggaggagaaggagctg

SEQ ID NO: 112888 - DNA, 16 bp, H. sapiens
ggaggagacattcaaa

SEQ ID NO: 112889 - DNA, 16 bp, H. sapiens
ggaggagagcctgcag

SEQ ID NO: 112890 - DNA, 16 bp, H. sapiens
ggaggagaggccctct

SEQ ID NO: 112891 - DNA, 16 bp, H. sapiens
ggaggagaggctgcag

SEQ ID NO: 112892 - DNA, 16 bp, H. sapiens
ggaggagcagagtctt

SEQ ID NO: 112893 - DNA, 16 bp, H. sapiens
ggaggagcagcagcag

SEQ ID NO: 112894 - DNA, 16 bp, H. sapiens
ggaggagcagggctgg

SEQ ID NO: 112895 - DNA, 16 bp, H. sapiens
ggaggagcaggtggaa

SEQ ID NO: 112896 - DNA, 16 bp, H. sapiens
ggaggagccacagaac

SEQ ID NO: 112897 - DNA, 16 bp, H. sapiens
ggaggagcggaggctg

SEQ ID NO: 112898 - DNA, 16 bp, H. sapiens
ggaggagctatgcata

SEQ ID NO: 112899 - DNA, 16 bp, H. sapiens
ggaggagctgaggctg

SEQ ID NO: 112900 - DNA, 16 bp, H. sapiens
ggaggagctgatgttg

SEQ ID NO: 112901 - DNA, 16 bp, H. sapiens
ggaggagctgcccaag

SEQ ID NO: 112902 - DNA, 16 bp, H. sapiens
ggaggagctggaggag

SEQ ID NO: 112903 - DNA, 16 bp, H. sapiens
ggaggagctggatgaa

SEQ ID NO: 112904 - DNA, 16 bp, H. sapiens
ggaggagctggatgga

SEQ ID NO: 112905 - DNA, 16 bp, H. sapiens
ggaggagctgggccgc

SEQ ID NO: 112906 - DNA, 16 bp, H. sapiens
ggaggagctgggcctg

SEQ ID NO: 112907 - DNA, 16 bp, H. sapiens
ggaggagctggtatca

SEQ ID NO: 112908 - DNA, 16 bp, H. sapiens
ggaggagctggtgctg

SEQ ID NO: 112909 - DNA, 16 bp, H. sapiens
ggaggaggaaaggcac

SEQ ID NO: 112910 - DNA, 16 bp, H. sapiens
ggaggaggagacacag

SEQ ID NO: 112911 - DNA, 16 bp, H. sapiens
ggaggaggagaggctc

SEQ ID NO: 112912 - DNA, 16 bp, H. sapiens
ggaggaggagccaggc

SEQ ID NO: 112913 - DNA, 16 bp, H. sapiens
ggaggaggagctgagg

SEQ ID NO: 112914 - DNA, 16 bp, H. sapiens
ggaggaggagctggag

SEQ ID NO: 112915 - DNA, 16 bp, H. sapiens
ggaggaggaggagtca

SEQ ID NO: 112916 - DNA, 16 bp, H. sapiens
ggaggaggaggcattt

SEQ ID NO: 112917 - DNA, 16 bp, H. sapiens
ggaggaggaggcctgg

SEQ ID NO: 112918 - DNA, 16 bp, H. sapiens
ggaggaggaggctgtg

SEQ ID NO: 112919 - DNA, 16 bp, H. sapiens
ggaggaggaggtggca

SEQ ID NO: 112920 - DNA, 16 bp, H. sapiens
ggaggaggcagagctg

SEQ ID NO: 112921 - DNA, 16 bp, H. sapiens
ggaggaggcaggggct

SEQ ID NO: 112922 - DNA, 16 bp, H. sapiens
ggaggaggctcagagg

SEQ ID NO: 112923 - DNA, 16 bp, H. sapiens
ggaggaggctgcagtg

SEQ ID NO: 112924 - DNA, 16 bp, H. sapiens
ggaggaggctggagag

SEQ ID NO: 112925 - DNA, 16 bp, H. sapiens
ggaggagggacttctc

SEQ ID NO: 112926 - DNA, 16 bp, H. sapiens
ggaggaggggctcctc

SEQ ID NO: 112927 - DNA, 16 bp, H. sapiens
ggaggaggggctgcag

SEQ ID NO: 112928 - DNA, 16 bp, H. sapiens
ggaggaggtcagagag

SEQ ID NO: 112929 - DNA, 16 bp, H. sapiens
ggaggaggtcctggag

SEQ ID NO: 112930 - DNA, 16 bp, H. sapiens
ggaggaggtgccacac

SEQ ID NO: 112931 - DNA, 16 bp, H. sapiens
ggaggaggtgccagac

SEQ ID NO: 112932 - DNA, 16 bp, H. sapiens
ggaggaggtggagcag

SEQ ID NO: 112933 - DNA, 16 bp, H. sapiens
ggaggaggtggcattg

SEQ ID NO: 112934 - DNA, 16 bp, H. sapiens
ggaggaggtggcctgg

SEQ ID NO: 112935 - DNA, 16 bp, H. sapiens
ggaggagtctctcctc

SEQ ID NO: 112936 - DNA, 16 bp, H. sapiens
ggaggagttcctcctc

SEQ ID NO: 112937 - DNA, 16 bp, H. sapiens
ggaggagtttgagacc

SEQ ID NO: 112938 - DNA, 16 bp, H. sapiens
ggaggatcaattgagc

SEQ ID NO: 112939 - DNA, 16 bp, H. sapiens
ggaggatcacctgagc

SEQ ID NO: 112940 - DNA, 16 bp, H. sapiens
ggaggatcacttgaac

SEQ ID NO: 112941 - DNA, 17 bp, H. sapiens
ggaggatcacttgagac

SEQ ID NO: 112942 - DNA, 16 bp, H. sapiens
ggaggatcacttggag

SEQ ID NO: 112943 - DNA, 16 bp, H. sapiens
ggaggatcatgtgagc

SEQ ID NO: 112944 - DNA, 16 bp, H. sapiens
ggaggatccacttcca

SEQ ID NO: 112945 - DNA, 16 bp, H. sapiens
ggaggatcccgtgagc

SEQ ID NO: 112946 - DNA, 16 bp, H. sapiens
ggaggatcgcatgagc

SEQ ID NO: 112947 - DNA, 16 bp, H. sapiens
ggaggatcgcttaagc

SEQ ID NO: 112948 - DNA, 16 bp, H. sapiens
ggaggatcgcttgagt

SEQ ID NO: 112949 - DNA, 16 bp, H. sapiens
ggaggatcgcttgatc

SEQ ID NO: 112950 - DNA, 16 bp, H. sapiens
ggaggatctcttgagt

SEQ ID NO: 112951 - DNA, 16 bp, H. sapiens
ggaggatctctttagc

SEQ ID NO: 112952 - DNA, 16 bp, H. sapiens
ggaggatgagaggggc

SEQ ID NO: 112953 - DNA, 16 bp, H. sapiens
ggaggatgaggagggc

SEQ ID NO: 112954 - DNA, 16 bp, H. sapiens
ggaggatgccttgagc

SEQ ID NO: 112955 - DNA, 16 bp, H. sapiens
ggaggatggcttgaac

SEQ ID NO: 112956 - DNA, 16 bp, H. sapiens
ggaggatgtggcagga

SEQ ID NO: 112957 - DNA, 16 bp, H. sapiens
ggaggatgttgataat

SEQ ID NO: 112958 - DNA, 16 bp, H. sapiens
ggaggattacttcagc

SEQ ID NO: 112959 - DNA, 16 bp, H. sapiens
ggaggattccctgagc

SEQ ID NO: 112960 - DNA, 16 bp, H. sapiens
ggaggattgcctcagc

SEQ ID NO: 112961 - DNA, 16 bp, H. sapiens
ggaggattgcttgaac

SEQ ID NO: 112962 - DNA, 16 bp, H. sapiens
ggaggattgtttcagc

SEQ ID NO: 112963 - DNA, 16 bp, H. sapiens
ggaggcaaaggaaaca

SEQ ID NO: 112964 - DNA, 16 bp, H. sapiens
ggaggcacagctgggg

SEQ ID NO: 112965 - DNA, 16 bp, H. sapiens
ggaggcagaaagtcct

SEQ ID NO: 112966 - DNA, 16 bp, H. sapiens
ggaggcagaaggatca

SEQ ID NO: 112967 - DNA, 16 bp, H. sapiens
ggaggcagacgttgtg

SEQ ID NO: 112968 - DNA, 16 bp, H. sapiens
ggaggcagagccagga

SEQ ID NO: 112969 - DNA, 16 bp, H. sapiens
ggaggcagagccaggg

SEQ ID NO: 112970 - DNA, 16 bp, H. sapiens
ggaggcagagctcaag

SEQ ID NO: 112971 - DNA, 16 bp, H. sapiens
ggaggcagagctcaca

SEQ ID NO: 112972 - DNA, 16 bp, H. sapiens
ggaggcagagctctgg

SEQ ID NO: 112973 - DNA, 16 bp, H. sapiens
ggaggcagagctgcag

SEQ ID NO: 112974 - DNA, 16 bp, H. sapiens
ggaggcagagctggaa

SEQ ID NO: 112975 - DNA, 16 bp, H. sapiens
ggaggcagagcttgga

SEQ ID NO: 112976 - DNA, 16 bp, H. sapiens
ggaggcagaggatgtg

SEQ ID NO: 112977 - DNA, 16 bp, H. sapiens
ggaggcagaggcagca

SEQ ID NO: 112978 - DNA, 16 bp, H. sapiens
ggaggcagaggcaggc

SEQ ID NO: 112979 - DNA, 16 bp, H. sapiens
ggaggcagaggcagtg

SEQ ID NO: 112980 - DNA, 16 bp, H. sapiens
ggaggcagaggccagg

SEQ ID NO: 112981 - DNA, 16 bp, H. sapiens
ggaggcagaggccgca

SEQ ID NO: 112982 - DNA, 16 bp, H. sapiens
ggaggcagaggtgaca

SEQ ID NO: 112983 - DNA, 16 bp, H. sapiens
ggaggcagaggtgcag

SEQ ID NO: 112984 - DNA, 16 bp, H. sapiens
ggaggcagaggtgggt

SEQ ID NO: 112985 - DNA, 16 bp, H. sapiens
ggaggcagaggtggtg

SEQ ID NO: 112986 - DNA, 16 bp, H. sapiens
ggaggcagagttgcag

SEQ ID NO: 112987 - DNA, 16 bp, H. sapiens
ggaggcagccagggct

SEQ ID NO: 112988 - DNA, 16 bp, H. sapiens
ggaggcaggagaattg

SEQ ID NO: 112989 - DNA, 16 bp, H. sapiens
ggaggcaggagctggg

SEQ ID NO: 112990 - DNA, 16 bp, H. sapiens
ggaggcaggaggtgga

SEQ ID NO: 112991 - DNA, 16 bp, H. sapiens
ggaggcagggaggctg

SEQ ID NO: 112992 - DNA, 16 bp, H. sapiens
ggaggcagggagggct

SEQ ID NO: 112993 - DNA, 16 bp, H. sapiens
ggaggcagggctggga

SEQ ID NO: 112994 - DNA, 16 bp, H. sapiens
ggaggcaggggcaggt

SEQ ID NO: 112995 - DNA, 16 bp, H. sapiens
ggaggcaggtgcctgt

SEQ ID NO: 112996 - DNA, 16 bp, H. sapiens
ggaggcaggtggatca

SEQ ID NO: 112997 - DNA, 16 bp, H. sapiens
ggaggcaggtttgcct

SEQ ID NO: 112998 - DNA, 16 bp, H. sapiens
ggaggcagtctgtcag

SEQ ID NO: 112999 - DNA, 16 bp, H. sapiens
ggaggccaaagaggaa

SEQ ID NO: 113000 - DNA, 16 bp, H. sapiens
ggaggccaagacagaa

SEQ ID NO: 113001 - DNA, 16 bp, H. sapiens
ggaggccaagacaggg

SEQ ID NO: 113002 - DNA, 16 bp, H. sapiens
ggaggccaagcaggtg

SEQ ID NO: 113003 - DNA, 16 bp, H. sapiens
ggaggccaagcgggga

SEQ ID NO: 113004 - DNA, 16 bp, H. sapiens
ggaggccaaggagggc

SEQ ID NO: 113005 - DNA, 16 bp, H. sapiens
ggaggccaaggcagtc

SEQ ID NO: 113006 - DNA, 16 bp, H. sapiens
ggaggccaaggccaag

SEQ ID NO: 113007 - DNA, 16 bp, H. sapiens
ggaggccaaggccagc

SEQ ID NO: 113008 - DNA, 16 bp, H. sapiens
ggaggccaaggccggg

SEQ ID NO: 113009 - DNA, 16 bp, H. sapiens
ggaggccaaggcggct

SEQ ID NO: 113010 - DNA, 16 bp, H. sapiens
ggaggccaaggcggga

SEQ ID NO: 113011 - DNA, 17 bp, H. sapiens
ggaggccaaggcgggcg

SEQ ID NO: 113012 - DNA, 20 bp, H. sapiens
ggaggccaaggcgggtggat

SEQ ID NO: 113013 - DNA, 16 bp, H. sapiens
ggaggccaaggcgtga

SEQ ID NO: 113014 - DNA, 16 bp, H. sapiens
ggaggccaagggaaga

SEQ ID NO: 113015 - DNA, 16 bp, H. sapiens
ggaggccaagggcagg

SEQ ID NO: 113016 - DNA, 16 bp, H. sapiens
ggaggccaaggtgagc

SEQ ID NO: 113017 - DNA, 16 bp, H. sapiens
ggaggccaaggtgcaa

SEQ ID NO: 113018 - DNA, 16 bp, H. sapiens
ggaggccaaggtggac

SEQ ID NO: 113019 - DNA, 16 bp, H. sapiens
ggaggccaaggtggat

SEQ ID NO: 113020 - DNA, 16 bp, H. sapiens
ggaggccacagtgagc

SEQ ID NO: 113021 - DNA, 16 bp, H. sapiens
ggaggccacatcccac

SEQ ID NO: 113022 - DNA, 16 bp, H. sapiens
ggaggccacggcagga

SEQ ID NO: 113023 - DNA, 16 bp, H. sapiens
ggaggccactgtggct

SEQ ID NO: 113024 - DNA, 16 bp, H. sapiens
ggaggccagattgaag

SEQ ID NO: 113025 - DNA, 16 bp, H. sapiens
ggaggccagcctggcc

SEQ ID NO: 113026 - DNA, 16 bp, H. sapiens
ggaggccaggaatttg

SEQ ID NO: 113027 - DNA, 16 bp, H. sapiens
ggaggccaggaggcag

SEQ ID NO: 113028 - DNA, 16 bp, H. sapiens
ggaggccaggaggctg

SEQ ID NO: 113029 - DNA, 16 bp, H. sapiens
ggaggccaggatggga

SEQ ID NO: 113030 - DNA, 16 bp, H. sapiens
ggaggccaggcacggt

SEQ ID NO: 113031 - DNA, 16 bp, H. sapiens
ggaggccaggcactgt

SEQ ID NO: 113032 - DNA, 16 bp, H. sapiens
ggaggccaggcaggca

SEQ ID NO: 113033 - DNA, 16 bp, H. sapiens
ggaggccaggctgggc

SEQ ID NO: 113034 - DNA, 16 bp, H. sapiens
ggaggccagggcaggc

SEQ ID NO: 113035 - DNA, 16 bp, H. sapiens
ggaggccagggtgggc

SEQ ID NO: 113036 - DNA, 16 bp, H. sapiens
ggaggccagtgtggcc

SEQ ID NO: 113037 - DNA, 16 bp, H. sapiens
ggaggcccaagcagga

SEQ ID NO: 113038 - DNA, 16 bp, H. sapiens
ggaggcccagatgggc

SEQ ID NO: 113039 - DNA, 16 bp, H. sapiens
ggaggcccagcctccc

SEQ ID NO: 113040 - DNA, 16 bp, H. sapiens
ggaggcccaggaggga

SEQ ID NO: 113041 - DNA, 16 bp, H. sapiens
ggaggcccaggagggc

SEQ ID NO: 113042 - DNA, 16 bp, H. sapiens
ggaggcccaggcaggc

SEQ ID NO: 113043 - DNA, 16 bp, H. sapiens
ggaggcccaggcctgg

SEQ ID NO: 113044 - DNA, 16 bp, H. sapiens
ggaggcccaggcggga

SEQ ID NO: 113045 - DNA, 16 bp, H. sapiens
ggaggcccaggctctg

SEQ ID NO: 113046 - DNA, 16 bp, H. sapiens
ggaggcccagggctgg

SEQ ID NO: 113047 - DNA, 16 bp, H. sapiens
ggaggcccaggtctgc

SEQ ID NO: 113048 - DNA, 16 bp, H. sapiens
ggaggcccaggtgggc

SEQ ID NO: 113049 - DNA, 18 bp, H. sapiens
ggaggccccggacaagga

SEQ ID NO: 113050 - DNA, 16 bp, H. sapiens
ggaggccctgcctggt

SEQ ID NO: 113051 - DNA, 16 bp, H. sapiens
ggaggccctggagagg

SEQ ID NO: 113052 - DNA, 16 bp, H. sapiens
ggaggccgaagcagga

SEQ ID NO: 113053 - DNA, 16 bp, H. sapiens
ggaggccgaagtgagc

SEQ ID NO: 113054 - DNA, 16 bp, H. sapiens
ggaggccgagaagtcc

SEQ ID NO: 113055 - DNA, 20 bp, H. sapiens
ggaggccgagacaggcagat

SEQ ID NO: 113056 - DNA, 16 bp, H. sapiens
ggaggccgagaccggc

SEQ ID NO: 113057 - DNA, 16 bp, H. sapiens
ggaggccgagaggggt

SEQ ID NO: 113058 - DNA, 16 bp, H. sapiens
ggaggccgagctgggc

SEQ ID NO: 113059 - DNA, 18 bp, H. sapiens
ggaggccgagctgggtgg

SEQ ID NO: 113060 - DNA, 16 bp, H. sapiens
ggaggccgaggagagt

SEQ ID NO: 113061 - DNA, 16 bp, H. sapiens
ggaggccgaggaggac

SEQ ID NO: 113062 - DNA, 16 bp, H. sapiens
ggaggccgaggaggcc

SEQ ID NO: 113063 - DNA, 16 bp, H. sapiens
ggaggccgaggaggtg

SEQ ID NO: 113064 - DNA, 16 bp, H. sapiens
ggaggccgaggcacaa

SEQ ID NO: 113065 - DNA, 16 bp, H. sapiens
ggaggccgaggcagac

SEQ ID NO: 113066 - DNA, 16 bp, H. sapiens
ggaggccgaggcgagc

SEQ ID NO: 113067 - DNA, 16 bp, H. sapiens
ggaggccgaggcggtg

SEQ ID NO: 113068 - DNA, 16 bp, H. sapiens
ggaggccgaggctagt

SEQ ID NO: 113069 - DNA, 16 bp, H. sapiens
ggaggccgaggctgag

SEQ ID NO: 113070 - DNA, 16 bp, H. sapiens
ggaggccgaggctggc

SEQ ID NO: 113071 - DNA, 16 bp, H. sapiens
ggaggccgaggtagac

SEQ ID NO: 113072 - DNA, 16 bp, H. sapiens
ggaggccgaggtgaga

SEQ ID NO: 113073 - DNA, 16 bp, H. sapiens
ggaggccgaggtgcgc

SEQ ID NO: 113074 - DNA, 16 bp, H. sapiens
ggaggccgaggtggac

SEQ ID NO: 113075 - DNA, 16 bp, H. sapiens
ggaggccgaggtggat

SEQ ID NO: 113076 - DNA, 16 bp, H. sapiens
ggaggccgaggtggtc

SEQ ID NO: 113077 - DNA, 17 bp, H. sapiens
ggaggccgaggtggtgg

SEQ ID NO: 113078 - DNA, 16 bp, H. sapiens
ggaggccgagtcaggc

SEQ ID NO: 113079 - DNA, 16 bp, H. sapiens
ggaggcctaggcggga

SEQ ID NO: 113080 - DNA, 16 bp, H. sapiens
ggaggcctcaagaaac

SEQ ID NO: 113081 - DNA, 16 bp, H. sapiens
ggaggcctcagagtca

SEQ ID NO: 113082 - DNA, 16 bp, H. sapiens
ggaggcctcaggaggc

SEQ ID NO: 113083 - DNA, 16 bp, H. sapiens
ggaggcctcaggatca

SEQ ID NO: 113084 - DNA, 16 bp, H. sapiens
ggaggcctgaggtggg

SEQ ID NO: 113085 - DNA, 16 bp, H. sapiens
ggaggcctgcctgctt

SEQ ID NO: 113086 - DNA, 16 bp, H. sapiens
ggaggcctggcctggg

SEQ ID NO: 113087 - DNA, 16 bp, H. sapiens
ggaggcctggggctgg

SEQ ID NO: 113088 - DNA, 16 bp, H. sapiens
ggaggccttcctggag

SEQ ID NO: 113089 - DNA, 16 bp, H. sapiens
ggaggccttgggaaac

SEQ ID NO: 113090 - DNA, 16 bp, H. sapiens
ggaggcgagacatgtt

SEQ ID NO: 113091 - DNA, 16 bp, H. sapiens
ggaggcggagctcagg

SEQ ID NO: 113092 - DNA, 17 bp, H. sapiens
ggaggcggagcttgcaa

SEQ ID NO: 113093 - DNA, 22 bp, H. sapiens
ggaggcggagcttgcagtaagc

SEQ ID NO: 113094 - DNA, 20 bp, H. sapiens
ggaggcggagcttgcagtga

SEQ ID NO: 113095 - DNA, 16 bp, H. sapiens
ggaggcggagcttgct

SEQ ID NO: 113096 - DNA, 16 bp, H. sapiens
ggaggcggaggctgcg

SEQ ID NO: 113097 - DNA, 16 bp, H. sapiens
ggaggcggaggtgcag

SEQ ID NO: 113098 - DNA, 16 bp, H. sapiens
ggaggctaagaagtcc

SEQ ID NO: 113099 - DNA, 16 bp, H. sapiens
ggaggctaagatagga

SEQ ID NO: 113100 - DNA, 16 bp, H. sapiens
ggaggctaaggagaga

SEQ ID NO: 113101 - DNA, 16 bp, H. sapiens
ggaggctaaggcagaa

SEQ ID NO: 113102 - DNA, 16 bp, H. sapiens
ggaggctaaggcaggg

SEQ ID NO: 113103 - DNA, 16 bp, H. sapiens
ggaggctaaggtagga

SEQ ID NO: 113104 - DNA, 16 bp, H. sapiens
ggaggctaatgtggga

SEQ ID NO: 113105 - DNA, 16 bp, H. sapiens
ggaggctacggcagga

SEQ ID NO: 113106 - DNA, 16 bp, H. sapiens
ggaggctcaggcgggt

SEQ ID NO: 113107 - DNA, 16 bp, H. sapiens
ggaggctccaggggag

SEQ ID NO: 113108 - DNA, 16 bp, H. sapiens
ggaggctctgagggga

SEQ ID NO: 113109 - DNA, 16 bp, H. sapiens
ggaggctctggggaga

SEQ ID NO: 113110 - DNA, 16 bp, H. sapiens
ggaggctgaaatggaa

SEQ ID NO: 113111 - DNA, 16 bp, H. sapiens
ggaggctgaaatggga

SEQ ID NO: 113112 - DNA, 16 bp, H. sapiens
ggaggctgaacaggag

SEQ ID NO: 113113 - DNA, 16 bp, H. sapiens
ggaggctgaagacagg

SEQ ID NO: 113114 - DNA, 16 bp, H. sapiens
ggaggctgaagaggga

SEQ ID NO: 113115 - DNA, 16 bp, H. sapiens
ggaggctgaagagggc

SEQ ID NO: 113116 - DNA, 16 bp, H. sapiens
ggaggctgaagcagaa

SEQ ID NO: 113117 - DNA, 16 bp, H. sapiens
ggaggctgaagcagga

SEQ ID NO: 113118 - DNA, 16 bp, H. sapiens
ggaggctgaagcaggc

SEQ ID NO: 113119 - DNA, 16 bp, H. sapiens
ggaggctgaagcaggt

SEQ ID NO: 113120 - DNA, 16 bp, H. sapiens
ggaggctgaagccagg

SEQ ID NO: 113121 - DNA, 16 bp, H. sapiens
ggaggctgaagcggga

SEQ ID NO: 113122 - DNA, 16 bp, H. sapiens
ggaggctgaaggcagg

SEQ ID NO: 113123 - DNA, 16 bp, H. sapiens
ggaggctgaagggggc

SEQ ID NO: 113124 - DNA, 16 bp, H. sapiens
ggaggctgacccagga

SEQ ID NO: 113125 - DNA, 16 bp, H. sapiens
ggaggctgacgcagga

SEQ ID NO: 113126 - DNA, 16 bp, H. sapiens
ggaggctgagaagagg

SEQ ID NO: 113127 - DNA, 16 bp, H. sapiens
ggaggctgagaaggaa

SEQ ID NO: 113128 - DNA, 16 bp, H. sapiens
ggaggctgagacaaga

SEQ ID NO: 113129 - DNA, 16 bp, H. sapiens
ggaggctgagacagaa

SEQ ID NO: 113130 - DNA, 16 bp, H. sapiens
ggaggctgagacagag

SEQ ID NO: 113131 - DNA, 16 bp, H. sapiens
ggaggctgagacaggg

SEQ ID NO: 113132 - DNA, 16 bp, H. sapiens
ggaggctgagagagaa

SEQ ID NO: 113133 - DNA, 16 bp, H. sapiens
ggaggctgagaggcag

SEQ ID NO: 113134 - DNA, 16 bp, H. sapiens
ggaggctgagaggctg

SEQ ID NO: 113135 - DNA, 16 bp, H. sapiens
ggaggctgagagggag

SEQ ID NO: 113136 - DNA, 16 bp, H. sapiens
ggaggctgagatgaaa

SEQ ID NO: 113137 - DNA, 16 bp, H. sapiens
ggaggctgagatgaga

SEQ ID NO: 113138 - DNA, 16 bp, H. sapiens
ggaggctgagattgca

SEQ ID NO: 113139 - DNA, 16 bp, H. sapiens
ggaggctgagcagaag

SEQ ID NO: 113140 - DNA, 16 bp, H. sapiens
ggaggctgagcaggaa

SEQ ID NO: 113141 - DNA, 16 bp, H. sapiens
ggaggctgagcaggag

SEQ ID NO: 113142 - DNA, 16 bp, H. sapiens
ggaggctgagcaggga

SEQ ID NO: 113143 - DNA, 16 bp, H. sapiens
ggaggctgagccagga

SEQ ID NO: 113144 - DNA, 16 bp, H. sapiens
ggaggctgagccaggc

SEQ ID NO: 113145 - DNA, 16 bp, H. sapiens
ggaggctgagccggga

SEQ ID NO: 113146 - DNA, 16 bp, H. sapiens
ggaggctgagctgaga

SEQ ID NO: 113147 - DNA, 16 bp, H. sapiens
ggaggctgaggaaggc

SEQ ID NO: 113148 - DNA, 16 bp, H. sapiens
ggaggctgaggagaaa

SEQ ID NO: 113149 - DNA, 16 bp, H. sapiens
ggaggctgaggagaat

SEQ ID NO: 113150 - DNA, 16 bp, H. sapiens
ggaggctgaggagaga

SEQ ID NO: 113151 - DNA, 16 bp, H. sapiens
ggaggctgaggaggaa

SEQ ID NO: 113152 - DNA, 16 bp, H. sapiens
ggaggctgaggaggag

SEQ ID NO: 113153 - DNA, 16 bp, H. sapiens
ggaggctgaggaggcc

SEQ ID NO: 113154 - DNA, 16 bp, H. sapiens
ggaggctgaggaggct

SEQ ID NO: 113155 - DNA, 16 bp, H. sapiens
ggaggctgaggagggc

SEQ ID NO: 113156 - DNA, 16 bp, H. sapiens
ggaggctgaggcaagc

SEQ ID NO: 113157 - DNA, 16 bp, H. sapiens
ggaggctgaggcacaa

SEQ ID NO: 113158 - DNA, 17 bp, H. sapiens
ggaggctgaggcacaac

SEQ ID NO: 113159 - DNA, 16 bp, H. sapiens
ggaggctgaggcacca

SEQ ID NO: 113160 - DNA, 16 bp, H. sapiens
ggaggctgaggcagag

SEQ ID NO: 113161 - DNA, 16 bp, H. sapiens
ggaggctgaggcagca

SEQ ID NO: 113162 - DNA, 20 bp, H. sapiens
ggaggctgaggcaggagaag

SEQ ID NO: 113163 - DNA, 16 bp, H. sapiens
ggaggctgaggcagta

SEQ ID NO: 113164 - DNA, 16 bp, H. sapiens
ggaggctgaggcagtg

SEQ ID NO: 113165 - DNA, 16 bp, H. sapiens
ggaggctgaggcatgg

SEQ ID NO: 113166 - DNA, 16 bp, H. sapiens
ggaggctgaggccaag

SEQ ID NO: 113167 - DNA, 16 bp, H. sapiens
ggaggctgaggccagc

SEQ ID NO: 113168 - DNA, 16 bp, H. sapiens
ggaggctgaggccagg

SEQ ID NO: 113169 - DNA, 16 bp, H. sapiens
ggaggctgaggcggaa

SEQ ID NO: 113170 - DNA, 16 bp, H. sapiens
ggaggctgaggcggag

SEQ ID NO: 113171 - DNA, 17 bp, H. sapiens
ggaggctgaggcggcag

SEQ ID NO: 113172 - DNA, 16 bp, H. sapiens
ggaggctgaggcggga

SEQ ID NO: 113173 - DNA, 18 bp, H. sapiens
ggaggctgaggcgggcag

SEQ ID NO: 113174 - DNA, 16 bp, H. sapiens
ggaggctgaggcggtg

SEQ ID NO: 113175 - DNA, 16 bp, H. sapiens
ggaggctgaggctgag

SEQ ID NO: 113176 - DNA, 16 bp, H. sapiens
ggaggctgaggctgat

SEQ ID NO: 113177 - DNA, 16 bp, H. sapiens
ggaggctgaggctggt

SEQ ID NO: 113178 - DNA, 16 bp, H. sapiens
ggaggctgagggagaa

SEQ ID NO: 113179 - DNA, 16 bp, H. sapiens
ggaggctgagggcagg

SEQ ID NO: 113180 - DNA, 16 bp, H. sapiens
ggaggctgaggggctg

SEQ ID NO: 113181 - DNA, 16 bp, H. sapiens
ggaggctgaggtagaa

SEQ ID NO: 113182 - DNA, 16 bp, H. sapiens
ggaggctgaggtcagt

SEQ ID NO: 113183 - DNA, 16 bp, H. sapiens
ggaggctgaggtgaga

SEQ ID NO: 113184 - DNA, 16 bp, H. sapiens
ggaggctgaggtggag

SEQ ID NO: 113185 - DNA, 16 bp, H. sapiens
ggaggctgaggtggct

SEQ ID NO: 113186 - DNA, 21 bp, H. sapiens
ggaggctgaggtgggaagatc

SEQ ID NO: 113187 - DNA, 16 bp, H. sapiens
ggaggctgaggtggtg

SEQ ID NO: 113188 - DNA, 16 bp, H. sapiens
ggaggctgaggttgga

SEQ ID NO: 113189 - DNA, 16 bp, H. sapiens
ggaggctgaggttgta

SEQ ID NO: 113190 - DNA, 16 bp, H. sapiens
ggaggctgagtgggga

SEQ ID NO: 113191 - DNA, 16 bp, H. sapiens
ggaggctgatgaagga

SEQ ID NO: 113192 - DNA, 17 bp, H. sapiens
ggaggctgcactgagcc

SEQ ID NO: 113193 - DNA, 16 bp, H. sapiens
ggaggctgcagagggg

SEQ ID NO: 113194 - DNA, 16 bp, H. sapiens
ggaggctgcagcagga

SEQ ID NO: 113195 - DNA, 16 bp, H. sapiens
ggaggctgcagtgagt

SEQ ID NO: 113196 - DNA, 16 bp, H. sapiens
ggaggctgcggcagga

SEQ ID NO: 113197 - DNA, 16 bp, H. sapiens
ggaggctgcggcgggc

SEQ ID NO: 113198 - DNA, 16 bp, H. sapiens
ggaggctgctgcagtg

SEQ ID NO: 113199 - DNA, 16 bp, H. sapiens
ggaggctggaacagga

SEQ ID NO: 113200 - DNA, 16 bp, H. sapiens
ggaggctggaaggcca

SEQ ID NO: 113201 - DNA, 16 bp, H. sapiens
ggaggctggagagtcc

SEQ ID NO: 113202 - DNA, 16 bp, H. sapiens
ggaggctggagcagag

SEQ ID NO: 113203 - DNA, 16 bp, H. sapiens
ggaggctggagctcca

SEQ ID NO: 113204 - DNA, 16 bp, H. sapiens
ggaggctggaggcagg

SEQ ID NO: 113205 - DNA, 16 bp, H. sapiens
ggaggctggagggcag

SEQ ID NO: 113206 - DNA, 16 bp, H. sapiens
ggaggctggatggctt

SEQ ID NO: 113207 - DNA, 16 bp, H. sapiens
ggaggctgggaggctg

SEQ ID NO: 113208 - DNA, 16 bp, H. sapiens
ggaggctgggccagga

SEQ ID NO: 113209 - DNA, 16 bp, H. sapiens
ggaggctgggctgggc

SEQ ID NO: 113210 - DNA, 16 bp, H. sapiens
ggaggctggggaagga

SEQ ID NO: 113211 - DNA, 16 bp, H. sapiens
ggaggctggggagaga

SEQ ID NO: 113212 - DNA, 16 bp, H. sapiens
ggaggctggggagcag

SEQ ID NO: 113213 - DNA, 16 bp, H. sapiens
ggaggctggggcagga

SEQ ID NO: 113214 - DNA, 16 bp, H. sapiens
ggaggctggggcaggt

SEQ ID NO: 113215 - DNA, 16 bp, H. sapiens
ggaggctggggctgca

SEQ ID NO: 113216 - DNA, 16 bp, H. sapiens
ggaggctgggggtgct

SEQ ID NO: 113217 - DNA, 16 bp, H. sapiens
ggaggctggtgcagga

SEQ ID NO: 113218 - DNA, 16 bp, H. sapiens
ggaggctgtaccctgt

SEQ ID NO: 113219 - DNA, 16 bp, H. sapiens
ggaggctgtggagaaa

SEQ ID NO: 113220 - DNA, 16 bp, H. sapiens
ggaggctgtggcagga

SEQ ID NO: 113221 - DNA, 16 bp, H. sapiens
ggaggctgtggtgaga

SEQ ID NO: 113222 - DNA, 16 bp, H. sapiens
ggaggctgtggtggga

SEQ ID NO: 113223 - DNA, 16 bp, H. sapiens
ggaggcttcagggagc

SEQ ID NO: 113224 - DNA, 16 bp, H. sapiens
ggaggctttatctgca

SEQ ID NO: 113225 - DNA, 16 bp, H. sapiens
ggagggaaaacattag

SEQ ID NO: 113226 - DNA, 16 bp, H. sapiens
ggagggaaactgaggc

SEQ ID NO: 113227 - DNA, 16 bp, H. sapiens
ggagggaagctgtacc

SEQ ID NO: 113228 - DNA, 16 bp, H. sapiens
ggagggacccgatggg

SEQ ID NO: 113229 - DNA, 16 bp, H. sapiens
ggagggacctgctggg

SEQ ID NO: 113230 - DNA, 16 bp, H. sapiens
ggagggagagtgcagc

SEQ ID NO: 113231 - DNA, 16 bp, H. sapiens
ggagggagccaggcag

SEQ ID NO: 113232 - DNA, 16 bp, H. sapiens
ggagggaggattgcct

SEQ ID NO: 113233 - DNA, 16 bp, H. sapiens
ggagggagggtggcct

SEQ ID NO: 113234 - DNA, 16 bp, H. sapiens
ggagggatccagtggg

SEQ ID NO: 113235 - DNA, 16 bp, H. sapiens
ggagggcaccaagcca

SEQ ID NO: 113236 - DNA, 16 bp, H. sapiens
ggagggcagaggctgc

SEQ ID NO: 113237 - DNA, 16 bp, H. sapiens
ggagggcaggcaggca

SEQ ID NO: 113238 - DNA, 16 bp, H. sapiens
ggagggcagggcctgg

SEQ ID NO: 113239 - DNA, 16 bp, H. sapiens
ggagggcagtgggcag

SEQ ID NO: 113240 - DNA, 16 bp, H. sapiens
ggagggcagtggtatg

SEQ ID NO: 113241 - DNA, 16 bp, H. sapiens
ggagggccaaggtggg

SEQ ID NO: 113242 - DNA, 16 bp, H. sapiens
ggagggccaggagcag

SEQ ID NO: 113243 - DNA, 16 bp, H. sapiens
ggagggccaggcacag

SEQ ID NO: 113244 - DNA, 16 bp, H. sapiens
ggagggcggggctcct

SEQ ID NO: 113245 - DNA, 16 bp, H. sapiens
ggagggctgggtgcag

SEQ ID NO: 113246 - DNA, 16 bp, H. sapiens
ggaggggaacaataca

SEQ ID NO: 113247 - DNA, 16 bp, H. sapiens
ggaggggaacagcaca

SEQ ID NO: 113248 - DNA, 16 bp, H. sapiens
ggaggggaacattaca

SEQ ID NO: 113249 - DNA, 16 bp, H. sapiens
ggaggggagaggtcag

SEQ ID NO: 113250 - DNA, 16 bp, H. sapiens
ggaggggaggttgcag

SEQ ID NO: 113251 - DNA, 16 bp, H. sapiens
ggaggggcacctgcca

SEQ ID NO: 113252 - DNA, 16 bp, H. sapiens
ggaggggcagacacag

SEQ ID NO: 113253 - DNA, 16 bp, H. sapiens
ggaggggcaggccacc

SEQ ID NO: 113254 - DNA, 16 bp, H. sapiens
ggaggggcagggcctg

SEQ ID NO: 113255 - DNA, 16 bp, H. sapiens
ggaggggccaggagca

SEQ ID NO: 113256 - DNA, 16 bp, H. sapiens
ggaggggccagggctg

SEQ ID NO: 113257 - DNA, 16 bp, H. sapiens
ggaggggcccagggtg

SEQ ID NO: 113258 - DNA, 16 bp, H. sapiens
ggaggggcccagtggg

SEQ ID NO: 113259 - DNA, 16 bp, H. sapiens
ggaggggcctggcagg

SEQ ID NO: 113260 - DNA, 16 bp, H. sapiens
ggaggggcctgggcag

SEQ ID NO: 113261 - DNA, 16 bp, H. sapiens
ggaggggcctgttggg

SEQ ID NO: 113262 - DNA, 16 bp, H. sapiens
ggaggggctgccgtga

SEQ ID NO: 113263 - DNA, 16 bp, H. sapiens
ggaggggctgctctga

SEQ ID NO: 113264 - DNA, 16 bp, H. sapiens
ggaggggctgctgcaa

SEQ ID NO: 113265 - DNA, 16 bp, H. sapiens
ggaggggctggccccc

SEQ ID NO: 113266 - DNA, 16 bp, H. sapiens
ggaggggctgggcctg

SEQ ID NO: 113267 - DNA, 16 bp, H. sapiens
ggaggggctggggcct

SEQ ID NO: 113268 - DNA, 16 bp, H. sapiens
ggagggggagcacaca

SEQ ID NO: 113269 - DNA, 16 bp, H. sapiens
ggagggggagcatgca

SEQ ID NO: 113270 - DNA, 16 bp, H. sapiens
ggagggggtatgtgtc

SEQ ID NO: 113271 - DNA, 16 bp, H. sapiens
ggagggggtttcacca

SEQ ID NO: 113272 - DNA, 16 bp, H. sapiens
ggaggggtgggcagca

SEQ ID NO: 113273 - DNA, 16 bp, H. sapiens
ggagggtcctggtggg

SEQ ID NO: 113274 - DNA, 16 bp, H. sapiens
ggagggtgaggctgga

SEQ ID NO: 113275 - DNA, 16 bp, H. sapiens
ggaggtacaagtgcag

SEQ ID NO: 113276 - DNA, 16 bp, H. sapiens
ggaggtactatgcctg

SEQ ID NO: 113277 - DNA, 16 bp, H. sapiens
ggaggtagagctcagg

SEQ ID NO: 113278 - DNA, 16 bp, H. sapiens
ggaggtagaggttgct

SEQ ID NO: 113279 - DNA, 16 bp, H. sapiens
ggaggtatccagaaga

SEQ ID NO: 113280 - DNA, 16 bp, H. sapiens
ggaggtcaagacagga

SEQ ID NO: 113281 - DNA, 16 bp, H. sapiens
ggaggtcaaggcagga

SEQ ID NO: 113282 - DNA, 16 bp, H. sapiens
ggaggtcaaggctgtg

SEQ ID NO: 113283 - DNA, 16 bp, H. sapiens
ggaggtcaaggtagga

SEQ ID NO: 113284 - DNA, 16 bp, H. sapiens
ggaggtcaaggtgagc

SEQ ID NO: 113285 - DNA, 16 bp, H. sapiens
ggaggtcactgaatca

SEQ ID NO: 113286 - DNA, 16 bp, H. sapiens
ggaggtcactggtgac

SEQ ID NO: 113287 - DNA, 16 bp, H. sapiens
ggaggtcaggggtcag

SEQ ID NO: 113288 - DNA, 16 bp, H. sapiens
ggaggtcccccaatcc

SEQ ID NO: 113289 - DNA, 16 bp, H. sapiens
ggaggtcgagactgca

SEQ ID NO: 113290 - DNA, 16 bp, H. sapiens
ggaggtcgaggcagga

SEQ ID NO: 113291 - DNA, 16 bp, H. sapiens
ggaggtcgaggctgta

SEQ ID NO: 113292 - DNA, 16 bp, H. sapiens
ggaggtgaaagacctg

SEQ ID NO: 113293 - DNA, 16 bp, H. sapiens
ggaggtgaaagatgtc

SEQ ID NO: 113294 - DNA, 16 bp, H. sapiens
ggaggtgaacatcaca

SEQ ID NO: 113295 - DNA, 16 bp, H. sapiens
ggaggtgacatttgaa

SEQ ID NO: 113296 - DNA, 16 bp, H. sapiens
ggaggtgagcagaggg

SEQ ID NO: 113297 - DNA, 16 bp, H. sapiens
ggaggtgaggctgcag

SEQ ID NO: 113298 - DNA, 16 bp, H. sapiens
ggaggtgaggctggag

SEQ ID NO: 113299 - DNA, 16 bp, H. sapiens
ggaggtgaggctggga

SEQ ID NO: 113300 - DNA, 16 bp, H. sapiens
ggaggtgaggggcacc

SEQ ID NO: 113301 - DNA, 16 bp, H. sapiens
ggaggtgagtagcagg

SEQ ID NO: 113302 - DNA, 16 bp, H. sapiens
ggaggtgatggatatg

SEQ ID NO: 113303 - DNA, 16 bp, H. sapiens
ggaggtgatgtttgag

SEQ ID NO: 113304 - DNA, 16 bp, H. sapiens
ggaggtgattggatca

SEQ ID NO: 113305 - DNA, 16 bp, H. sapiens
ggaggtgccacactct

SEQ ID NO: 113306 - DNA, 16 bp, H. sapiens
ggaggtggaagtggca

SEQ ID NO: 113307 - DNA, 16 bp, H. sapiens
ggaggtggaagttgaa

SEQ ID NO: 113308 - DNA, 16 bp, H. sapiens
ggaggtggacattgca

SEQ ID NO: 113309 - DNA, 16 bp, H. sapiens
ggaggtggagaccagc

SEQ ID NO: 113310 - DNA, 16 bp, H. sapiens
ggaggtggagattgtg

SEQ ID NO: 113311 - DNA, 16 bp, H. sapiens
ggaggtggagcaggag

SEQ ID NO: 113312 - DNA, 16 bp, H. sapiens
ggaggtggagctcaag

SEQ ID NO: 113313 - DNA, 18 bp, H. sapiens
ggaggtggagctggcagt

SEQ ID NO: 113314 - DNA, 16 bp, H. sapiens
ggaggtggaggagcag

SEQ ID NO: 113315 - DNA, 16 bp, H. sapiens
ggaggtggaggagctg

SEQ ID NO: 113316 - DNA, 16 bp, H. sapiens
ggaggtggaggatgca

SEQ ID NO: 113317 - DNA, 16 bp, H. sapiens
ggaggtggaggcagaa

SEQ ID NO: 113318 - DNA, 16 bp, H. sapiens
ggaggtggaggcaggc

SEQ ID NO: 113319 - DNA, 16 bp, H. sapiens
ggaggtggaggctgtg

SEQ ID NO: 113320 - DNA, 16 bp, H. sapiens
ggaggtggaggtgcag

SEQ ID NO: 113321 - DNA, 16 bp, H. sapiens
ggaggtggagtctgca

SEQ ID NO: 113322 - DNA, 16 bp, H. sapiens
ggaggtggagttcagg

SEQ ID NO: 113323 - DNA, 16 bp, H. sapiens
ggaggtggcagagctg

SEQ ID NO: 113324 - DNA, 16 bp, H. sapiens
ggaggtggcagagggt

SEQ ID NO: 113325 - DNA, 16 bp, H. sapiens
ggaggtggcagctgag

SEQ ID NO: 113326 - DNA, 16 bp, H. sapiens
ggaggtggcagggaag

SEQ ID NO: 113327 - DNA, 16 bp, H. sapiens
ggaggtggcagtgagc

SEQ ID NO: 113328 - DNA, 16 bp, H. sapiens
ggaggtggcatctgag

SEQ ID NO: 113329 - DNA, 16 bp, H. sapiens
ggaggtggctgaggcc

SEQ ID NO: 113330 - DNA, 16 bp, H. sapiens
ggaggtgggacctgcg

SEQ ID NO: 113331 - DNA, 16 bp, H. sapiens
ggaggtgggactgagg

SEQ ID NO: 113332 - DNA, 16 bp, H. sapiens
ggaggtgggagaatca

SEQ ID NO: 113333 - DNA, 16 bp, H. sapiens
ggaggtgggaggcaga

SEQ ID NO: 113334 - DNA, 16 bp, H. sapiens
ggaggtggggacagag

SEQ ID NO: 113335 - DNA, 16 bp, H. sapiens
ggaggtggggcctaat

SEQ ID NO: 113336 - DNA, 16 bp, H. sapiens
ggaggtggggcctggc

SEQ ID NO: 113337 - DNA, 16 bp, H. sapiens
ggaggtggggcctggt

SEQ ID NO: 113338 - DNA, 16 bp, H. sapiens
ggaggtggggcctgtg

SEQ ID NO: 113339 - DNA, 16 bp, H. sapiens
ggaggtggggctgcag

SEQ ID NO: 113340 - DNA, 17 bp, H. sapiens
ggaggtggggcttgcag

SEQ ID NO: 113341 - DNA, 16 bp, H. sapiens
ggaggtggggctttgg

SEQ ID NO: 113342 - DNA, 17 bp, H. sapiens
ggaggtgggggtgtcag

SEQ ID NO: 113343 - DNA, 16 bp, H. sapiens
ggaggtggtgattgca

SEQ ID NO: 113344 - DNA, 16 bp, H. sapiens
ggaggtggtggtggca

SEQ ID NO: 113345 - DNA, 16 bp, H. sapiens
ggaggtggtgttggct

SEQ ID NO: 113346 - DNA, 16 bp, H. sapiens
ggaggtggtgtttgca

SEQ ID NO: 113347 - DNA, 16 bp, H. sapiens
ggaggtgtctgtgtga

SEQ ID NO: 113348 - DNA, 16 bp, H. sapiens
ggaggttgaagcttca

SEQ ID NO: 113349 - DNA, 16 bp, H. sapiens
ggaggttgagccagga

SEQ ID NO: 113350 - DNA, 16 bp, H. sapiens
ggaggttgaggcagtg

SEQ ID NO: 113351 - DNA, 16 bp, H. sapiens
ggaggttgaggctgaa

SEQ ID NO: 113352 - DNA, 16 bp, H. sapiens
ggaggttgaggtgagc

SEQ ID NO: 113353 - DNA, 16 bp, H. sapiens
ggaggttgagtgagcc

SEQ ID NO: 113354 - DNA, 16 bp, H. sapiens
ggaggttgcaatgagt

SEQ ID NO: 113355 - DNA, 16 bp, H. sapiens
ggaggttgcagcaagc

SEQ ID NO: 113356 - DNA, 19 bp, H. sapiens
ggaggttgcagcgagctga

SEQ ID NO: 113357 - DNA, 16 bp, H. sapiens
ggaggttgcagggagc

SEQ ID NO: 113358 - DNA, 16 bp, H. sapiens
ggaggttgcagggagg

SEQ ID NO: 113359 - DNA, 16 bp, H. sapiens
ggaggttgcagtaagc

SEQ ID NO: 113360 - DNA, 16 bp, H. sapiens
ggaggttgcagtgaga

SEQ ID NO: 113361 - DNA, 16 bp, H. sapiens
ggaggttgcagtgagt

SEQ ID NO: 113362 - DNA, 16 bp, H. sapiens
ggaggttgccctgagc

SEQ ID NO: 113363 - DNA, 16 bp, H. sapiens
ggaggttgcgatgagc

SEQ ID NO: 113364 - DNA, 16 bp, H. sapiens
ggaggttgcggtcagc

SEQ ID NO: 113365 - DNA, 16 bp, H. sapiens
ggaggttgcggtgagc

SEQ ID NO: 113366 - DNA, 16 bp, H. sapiens
ggaggttgctgtgagc

SEQ ID NO: 113367 - DNA, 16 bp, H. sapiens
ggaggttgtagtgacc

SEQ ID NO: 113368 - DNA, 16 bp, H. sapiens
ggaggttgtagtgagg

SEQ ID NO: 113369 - DNA, 16 bp, H. sapiens
ggaggtttggccttta

SEQ ID NO: 113370 - DNA, 16 bp, H. sapiens
ggagtaaaagagctgt

SEQ ID NO: 113371 - DNA, 16 bp, H. sapiens
ggagtaaatgaatgaa

SEQ ID NO: 113372 - DNA, 16 bp, H. sapiens
ggagtacaggtgcgca

SEQ ID NO: 113373 - DNA, 16 bp, H. sapiens
ggagtacaggtgtgag

SEQ ID NO: 113374 - DNA, 16 bp, H. sapiens
ggagtacagtggagca

SEQ ID NO: 113375 - DNA, 16 bp, H. sapiens
ggagtacagtggcaca

SEQ ID NO: 113376 - DNA, 16 bp, H. sapiens
ggagtacccggctgtg

SEQ ID NO: 113377 - DNA, 16 bp, H. sapiens
ggagtaggtacaaggg

SEQ ID NO: 113378 - DNA, 16 bp, H. sapiens
ggagtagtgcctggta

SEQ ID NO: 113379 - DNA, 16 bp, H. sapiens
ggagtatcgctctgtc

SEQ ID NO: 113380 - DNA, 16 bp, H. sapiens
ggagtatgtttgtggc

SEQ ID NO: 113381 - DNA, 16 bp, H. sapiens
ggagtattgctctgtc

SEQ ID NO: 113382 - DNA, 16 bp, H. sapiens
ggagtatttacaccat

SEQ ID NO: 113383 - DNA, 16 bp, H. sapiens
ggagtatttttccatt

SEQ ID NO: 113384 - DNA, 16 bp, H. sapiens
ggagtcacagccctgg

SEQ ID NO: 113385 - DNA, 16 bp, H. sapiens
ggagtcaggaaacctg

SEQ ID NO: 113386 - DNA, 16 bp, H. sapiens
ggagtcagggcagagc

SEQ ID NO: 113387 - DNA, 16 bp, H. sapiens
ggagtcatgctctgtt

SEQ ID NO: 113388 - DNA, 16 bp, H. sapiens
ggagtcattcttgact

SEQ ID NO: 113389 - DNA, 16 bp, H. sapiens
ggagtccaaggcgggc

SEQ ID NO: 113390 - DNA, 16 bp, H. sapiens
ggagtccaggtcccca

SEQ ID NO: 113391 - DNA, 16 bp, H. sapiens
ggagtccccactgggg

SEQ ID NO: 113392 - DNA, 16 bp, H. sapiens
ggagtccccagtgtct

SEQ ID NO: 113393 - DNA, 17 bp, H. sapiens
ggagtccgaggtgggtg

SEQ ID NO: 113394 - DNA, 16 bp, H. sapiens
ggagtcctggaaccaa

SEQ ID NO: 113395 - DNA, 16 bp, H. sapiens
ggagtctagctctgtc

SEQ ID NO: 113396 - DNA, 16 bp, H. sapiens
ggagtctcactctgcc

SEQ ID NO: 113397 - DNA, 16 bp, H. sapiens
ggagtctcactctgta

SEQ ID NO: 113398 - DNA, 16 bp, H. sapiens
ggagtctcactctgtc

SEQ ID NO: 113399 - DNA, 17 bp, H. sapiens
ggagtctcactctgtcg

SEQ ID NO: 113400 - DNA, 16 bp, H. sapiens
ggagtctcactctgtt

SEQ ID NO: 113401 - DNA, 16 bp, H. sapiens
ggagtctcactcttgt

SEQ ID NO: 113402 - DNA, 16 bp, H. sapiens
ggagtctcactgtgtc

SEQ ID NO: 113403 - DNA, 16 bp, H. sapiens
ggagtctcactttgtc

SEQ ID NO: 113404 - DNA, 17 bp, H. sapiens
ggagtctcactttgtca

SEQ ID NO: 113405 - DNA, 16 bp, H. sapiens
ggagtctcagtctgtc

SEQ ID NO: 113406 - DNA, 16 bp, H. sapiens
ggagtctcccactgtc

SEQ ID NO: 113407 - DNA, 16 bp, H. sapiens
ggagtctccctctgtc

SEQ ID NO: 113408 - DNA, 16 bp, H. sapiens
ggagtctccttctgtc

SEQ ID NO: 113409 - DNA, 16 bp, H. sapiens
ggagtctcgccctgtc

SEQ ID NO: 113410 - DNA, 16 bp, H. sapiens
ggagtctcgctccgtc

SEQ ID NO: 113411 - DNA, 16 bp, H. sapiens
ggagtctcgctctatc

SEQ ID NO: 113412 - DNA, 16 bp, H. sapiens
ggagtctcgctctgac

SEQ ID NO: 113413 - DNA, 16 bp, H. sapiens
ggagtctcgctctggc

SEQ ID NO: 113414 - DNA, 16 bp, H. sapiens
ggagtctcgctctgtc

SEQ ID NO: 113415 - DNA, 17 bp, H. sapiens
ggagtctcgctctgtcg

SEQ ID NO: 113416 - DNA, 16 bp, H. sapiens
ggagtctcgctctgtg

SEQ ID NO: 113417 - DNA, 16 bp, H. sapiens
ggagtctcgctctgtt

SEQ ID NO: 113418 - DNA, 16 bp, H. sapiens
ggagtctcgctctttc

SEQ ID NO: 113419 - DNA, 16 bp, H. sapiens
ggagtctcgctgtgtc

SEQ ID NO: 113420 - DNA, 16 bp, H. sapiens
ggagtctcgctttgtc

SEQ ID NO: 113421 - DNA, 16 bp, H. sapiens
ggagtctcgctttgtt

SEQ ID NO: 113422 - DNA, 16 bp, H. sapiens
ggagtctcggtctgtc

SEQ ID NO: 113423 - DNA, 16 bp, H. sapiens
ggagtctcgttctgtc

SEQ ID NO: 113424 - DNA, 16 bp, H. sapiens
ggagtctctctctgtc

SEQ ID NO: 113425 - DNA, 16 bp, H. sapiens
ggagtctcttgctctg

SEQ ID NO: 113426 - DNA, 16 bp, H. sapiens
ggagtctgagactagc

SEQ ID NO: 113427 - DNA, 16 bp, H. sapiens
ggagtctgcattttaa

SEQ ID NO: 113428 - DNA, 16 bp, H. sapiens
ggagtctggctctgtc

SEQ ID NO: 113429 - DNA, 16 bp, H. sapiens
ggagtctggggtggga

SEQ ID NO: 113430 - DNA, 16 bp, H. sapiens
ggagtcttgcactgtc

SEQ ID NO: 113431 - DNA, 16 bp, H. sapiens
ggagtcttgctcagtc

SEQ ID NO: 113432 - DNA, 16 bp, H. sapiens
ggagtcttgctccgtc

SEQ ID NO: 113433 - DNA, 16 bp, H. sapiens
ggagtcttgctctgtc

SEQ ID NO: 113434 - DNA, 16 bp, H. sapiens
ggagtcttgctctgtt

SEQ ID NO: 113435 - DNA, 16 bp, H. sapiens
ggagtcttgctcttgt

SEQ ID NO: 113436 - DNA, 16 bp, H. sapiens
ggagtcttgctttgtc

SEQ ID NO: 113437 - DNA, 16 bp, H. sapiens
ggagtcttgttctgtc

SEQ ID NO: 113438 - DNA, 16 bp, H. sapiens
ggagtgaagccacaga

SEQ ID NO: 113439 - DNA, 16 bp, H. sapiens
ggagtgactgctaatg

SEQ ID NO: 113440 - DNA, 16 bp, H. sapiens
ggagtgactgcttaat

SEQ ID NO: 113441 - DNA, 16 bp, H. sapiens
ggagtgagactccatc

SEQ ID NO: 113442 - DNA, 17 bp, H. sapiens
ggagtgagactccgtct

SEQ ID NO: 113443 - DNA, 16 bp, H. sapiens
ggagtgagacttcatc

SEQ ID NO: 113444 - DNA, 16 bp, H. sapiens
ggagtgagtgagtgag

SEQ ID NO: 113445 - DNA, 16 bp, H. sapiens
ggagtgatatggtttg

SEQ ID NO: 113446 - DNA, 16 bp, H. sapiens
ggagtgcagcagcgcc

SEQ ID NO: 113447 - DNA, 16 bp, H. sapiens
ggagtgcagcagtatg

SEQ ID NO: 113448 - DNA, 16 bp, H. sapiens
ggagtgcagctgtgca

SEQ ID NO: 113449 - DNA, 16 bp, H. sapiens
ggagtgcagtgatgtc

SEQ ID NO: 113450 - DNA, 16 bp, H. sapiens
ggagtgcagtgctgct

SEQ ID NO: 113451 - DNA, 16 bp, H. sapiens
ggagtgcagtggctcg

SEQ ID NO: 113452 - DNA, 16 bp, H. sapiens
ggagtgcagtggtgga

SEQ ID NO: 113453 - DNA, 16 bp, H. sapiens
ggagtgccgtggcgca

SEQ ID NO: 113454 - DNA, 16 bp, H. sapiens
ggagtggaatggagtg

SEQ ID NO: 113455 - DNA, 16 bp, H. sapiens
ggagtggagagaggcc

SEQ ID NO: 113456 - DNA, 16 bp, H. sapiens
ggagtggagctgctgg

SEQ ID NO: 113457 - DNA, 16 bp, H. sapiens
ggagtggagtgcagtg

SEQ ID NO: 113458 - DNA, 16 bp, H. sapiens
ggagtggccaacccag

SEQ ID NO: 113459 - DNA, 16 bp, H. sapiens
ggagtggctgccgggc

SEQ ID NO: 113460 - DNA, 16 bp, H. sapiens
ggagtggctgctgggc

SEQ ID NO: 113461 - DNA, 16 bp, H. sapiens
ggagtggctgtaaata

SEQ ID NO: 113462 - DNA, 16 bp, H. sapiens
ggagtgggttcctgat

SEQ ID NO: 113463 - DNA, 16 bp, H. sapiens
ggagtgggttccttat

SEQ ID NO: 113464 - DNA, 16 bp, H. sapiens
ggagtggtcattcctt

SEQ ID NO: 113465 - DNA, 16 bp, H. sapiens
ggagtggtgagagtga

SEQ ID NO: 113466 - DNA, 16 bp, H. sapiens
ggagtgtgaggctgca

SEQ ID NO: 113467 - DNA, 16 bp, H. sapiens
ggagttaaggctgcag

SEQ ID NO: 113468 - DNA, 16 bp, H. sapiens
ggagttacaggcaaag

SEQ ID NO: 113469 - DNA, 16 bp, H. sapiens
ggagttagaggctgta

SEQ ID NO: 113470 - DNA, 16 bp, H. sapiens
ggagttcaaattcata

SEQ ID NO: 113471 - DNA, 16 bp, H. sapiens
ggagttcaagaccatg

SEQ ID NO: 113472 - DNA, 16 bp, H. sapiens
ggagttcaagatcaag

SEQ ID NO: 113473 - DNA, 16 bp, H. sapiens
ggagttcaaggatgca

SEQ ID NO: 113474 - DNA, 16 bp, H. sapiens
ggagttcatggccagc

SEQ ID NO: 113475 - DNA, 16 bp, H. sapiens
ggagttccaggccagc

SEQ ID NO: 113476 - DNA, 16 bp, H. sapiens
ggagttccgagaccag

SEQ ID NO: 113477 - DNA, 16 bp, H. sapiens
ggagttcgagatcggc

SEQ ID NO: 113478 - DNA, 16 bp, H. sapiens
ggagttctttgtagat

SEQ ID NO: 113479 - DNA, 16 bp, H. sapiens
ggagttgaacaattag

SEQ ID NO: 113480 - DNA, 16 bp, H. sapiens
ggagttgaattgctgg

SEQ ID NO: 113481 - DNA, 16 bp, H. sapiens
ggagttgcagtgagcc

SEQ ID NO: 113482 - DNA, 16 bp, H. sapiens
ggagttggagagcagc

SEQ ID NO: 113483 - DNA, 16 bp, H. sapiens
ggagttggagatcagc

SEQ ID NO: 113484 - DNA, 16 bp, H. sapiens
ggagtttacattccag

SEQ ID NO: 113485 - DNA, 16 bp, H. sapiens
ggagtttacattttag

SEQ ID NO: 113486 - DNA, 16 bp, H. sapiens
ggagtttcactctgtg

SEQ ID NO: 113487 - DNA, 16 bp, H. sapiens
ggagtttcagaaggag

SEQ ID NO: 113488 - DNA, 16 bp, H. sapiens
ggagtttcagaccagt

SEQ ID NO: 113489 - DNA, 16 bp, H. sapiens
ggagtttcagagcagc

SEQ ID NO: 113490 - DNA, 16 bp, H. sapiens
ggagtttcagttttgc

SEQ ID NO: 113491 - DNA, 16 bp, H. sapiens
ggagtttccctgcaca

SEQ ID NO: 113492 - DNA, 17 bp, H. sapiens
ggagtttctctcttgtc

SEQ ID NO: 113493 - DNA, 16 bp, H. sapiens
ggagtttgacaccaac

SEQ ID NO: 113494 - DNA, 16 bp, H. sapiens
ggagtttgacaccagc

SEQ ID NO: 113495 - DNA, 16 bp, H. sapiens
ggagtttgagaaccag

SEQ ID NO: 113496 - DNA, 16 bp, H. sapiens
ggagtttgagcctggg

SEQ ID NO: 113497 - DNA, 16 bp, H. sapiens
ggagtttgagctgcag

SEQ ID NO: 113498 - DNA, 16 bp, H. sapiens
ggagtttgaggccagc

SEQ ID NO: 113499 - DNA, 16 bp, H. sapiens
ggagtttgaggttgca

SEQ ID NO: 113500 - DNA, 16 bp, H. sapiens
ggagtttgggaacagc

SEQ ID NO: 113501 - DNA, 16 bp, H. sapiens
ggagttttcactcttg

SEQ ID NO: 113502 - DNA, 16 bp, H. sapiens
ggagttttcttttctt

SEQ ID NO: 113503 - DNA, 16 bp, H. sapiens
ggagttttgctctgtc

SEQ ID NO: 113504 - DNA, 16 bp, H. sapiens
ggagttttgctctgtt

SEQ ID NO: 113505 - DNA, 16 bp, H. sapiens
ggagtttttaaaaata

SEQ ID NO: 113506 - DNA, 16 bp, H. sapiens
ggagtttttatttctg

SEQ ID NO: 113507 - DNA, 16 bp, H. sapiens
ggataaacaaaatgtg

SEQ ID NO: 113508 - DNA, 16 bp, H. sapiens
ggataaagaaaacgtg

SEQ ID NO: 113509 - DNA, 16 bp, H. sapiens
ggataaagaaaatgtg

SEQ ID NO: 113510 - DNA, 16 bp, H. sapiens
ggataaagagccaaga

SEQ ID NO: 113511 - DNA, 16 bp, H. sapiens
ggataaatctggagga

SEQ ID NO: 113512 - DNA, 16 bp, H. sapiens
ggataaattcctagaa

SEQ ID NO: 113513 - DNA, 16 bp, H. sapiens
ggataaattcttagaa

SEQ ID NO: 113514 - DNA, 24 bp, H. sapiens
ggataagcaacttcagcaaagtct

SEQ ID NO: 113515 - DNA, 16 bp, H. sapiens
ggataagtatgaaatt

SEQ ID NO: 113516 - DNA, 16 bp, H. sapiens
ggataatcacttgaat

SEQ ID NO: 113517 - DNA, 16 bp, H. sapiens
ggataatgcagctggt

SEQ ID NO: 113518 - DNA, 16 bp, H. sapiens
ggataatggcatccag

SEQ ID NO: 113519 - DNA, 16 bp, H. sapiens
ggatacaaagaaggga

SEQ ID NO: 113520 - DNA, 16 bp, H. sapiens
ggatacaatatcaaca

SEQ ID NO: 113521 - DNA, 16 bp, H. sapiens
ggatacacaagaaact

SEQ ID NO: 113522 - DNA, 16 bp, H. sapiens
ggatacagggagaagg

SEQ ID NO: 113523 - DNA, 16 bp, H. sapiens
ggatacagggtctcac

SEQ ID NO: 113524 - DNA, 16 bp, H. sapiens
ggatagaaatgaagat

SEQ ID NO: 113525 - DNA, 16 bp, H. sapiens
ggatagaactggagga

SEQ ID NO: 113526 - DNA, 16 bp, H. sapiens
ggatagagaaaaatct

SEQ ID NO: 113527 - DNA, 18 bp, H. sapiens
ggatataatctcgtggtg

SEQ ID NO: 113528 - DNA, 16 bp, H. sapiens
ggatatatatatatat

SEQ ID NO: 113529 - DNA, 16 bp, H. sapiens
ggatatatatctatat

SEQ ID NO: 113530 - DNA, 16 bp, H. sapiens
ggatatcaacactgat

SEQ ID NO: 113531 - DNA, 16 bp, H. sapiens
ggatatcgagaccatc

SEQ ID NO: 113532 - DNA, 16 bp, H. sapiens
ggatatgaatttgatg

SEQ ID NO: 113533 - DNA, 16 bp, H. sapiens
ggatatggatatagat

SEQ ID NO: 113534 - DNA, 16 bp, H. sapiens
ggatatggcaaaaaaa

SEQ ID NO: 113535 - DNA, 16 bp, H. sapiens
ggatatgtgtgtgtgt

SEQ ID NO: 113536 - DNA, 16 bp, H. sapiens
ggatattcaacctgta

SEQ ID NO: 113537 - DNA, 16 bp, H. sapiens
ggatattccatgcaaa

SEQ ID NO: 113538 - DNA, 16 bp, H. sapiens
ggatatttcatataaa

SEQ ID NO: 113539 - DNA, 16 bp, H. sapiens
ggatatttgcctgaag

SEQ ID NO: 113540 - DNA, 16 bp, H. sapiens
ggatatttggagcaaa

SEQ ID NO: 113541 - DNA, 17 bp, H. sapiens
ggatcaactgaggtcag

SEQ ID NO: 113542 - DNA, 16 bp, H. sapiens
ggatcaatattttgca

SEQ ID NO: 113543 - DNA, 17 bp, H. sapiens
ggatcacaaagtcagga

SEQ ID NO: 113544 - DNA, 16 bp, H. sapiens
ggatcacaactcctca

SEQ ID NO: 113545 - DNA, 16 bp, H. sapiens
ggatcacaaggccagg

SEQ ID NO: 113546 - DNA, 16 bp, H. sapiens
ggatcacagctcactg

SEQ ID NO: 113547 - DNA, 16 bp, H. sapiens
ggatcacatcacagga

SEQ ID NO: 113548 - DNA, 17 bp, H. sapiens
ggatcaccggaggtcag

SEQ ID NO: 113549 - DNA, 16 bp, H. sapiens
ggatcacctgacgtca

SEQ ID NO: 113550 - DNA, 19 bp, H. sapiens
ggatcacctgaggtcaggt

SEQ ID NO: 113551 - DNA, 16 bp, H. sapiens
ggatcacctgagttcg

SEQ ID NO: 113552 - DNA, 16 bp, H. sapiens
ggatcacctgtggtca

SEQ ID NO: 113553 - DNA, 16 bp, H. sapiens
ggatcactgcaacctc

SEQ ID NO: 113554 - DNA, 16 bp, H. sapiens
ggatcacttgaatgca

SEQ ID NO: 113555 - DNA, 16 bp, H. sapiens
ggatcacttgagcctg

SEQ ID NO: 113556 - DNA, 16 bp, H. sapiens
ggatcacttgagctca

SEQ ID NO: 113557 - DNA, 16 bp, H. sapiens
ggatcacttgaggctg

SEQ ID NO: 113558 - DNA, 22 bp, H. sapiens
ggatcacttgaggtcagaagtt

SEQ ID NO: 113559 - DNA, 19 bp, H. sapiens
ggatcacttgatgccagga

SEQ ID NO: 113560 - DNA, 16 bp, H. sapiens
ggatcagcctggccaa

SEQ ID NO: 113561 - DNA, 16 bp, H. sapiens
ggatcagtcaagggaa

SEQ ID NO: 113562 - DNA, 16 bp, H. sapiens
ggatcataggggtgga

SEQ ID NO: 113563 - DNA, 16 bp, H. sapiens
ggatcattctttgttg

SEQ ID NO: 113564 - DNA, 16 bp, H. sapiens
ggatcatttgagctta

SEQ ID NO: 113565 - DNA, 19 bp, H. sapiens
ggatccacccgccttggcc

SEQ ID NO: 113566 - DNA, 16 bp, H. sapiens
ggatccagccatgcct

SEQ ID NO: 113567 - DNA, 16 bp, H. sapiens
ggatccagcttcattc

SEQ ID NO: 113568 - DNA, 16 bp, H. sapiens
ggatccatactgggga

SEQ ID NO: 113569 - DNA, 16 bp, H. sapiens
ggatcccagcctcctc

SEQ ID NO: 113570 - DNA, 16 bp, H. sapiens
ggatcccaggctcatc

SEQ ID NO: 113571 - DNA, 16 bp, H. sapiens
ggatcccatctctaca

SEQ ID NO: 113572 - DNA, 16 bp, H. sapiens
ggatcccgccagcctc

SEQ ID NO: 113573 - DNA, 16 bp, H. sapiens
ggatcccttccttatg

SEQ ID NO: 113574 - DNA, 16 bp, H. sapiens
ggatcccttgagcctg

SEQ ID NO: 113575 - DNA, 16 bp, H. sapiens
ggatcctccagcccca

SEQ ID NO: 113576 - DNA, 16 bp, H. sapiens
ggatcctcctgtcttg

SEQ ID NO: 113577 - DNA, 16 bp, H. sapiens
ggatcctctcacctca

SEQ ID NO: 113578 - DNA, 16 bp, H. sapiens
ggatcctgggcccagc

SEQ ID NO: 113579 - DNA, 16 bp, H. sapiens
ggatcctgttgatctg

SEQ ID NO: 113580 - DNA, 16 bp, H. sapiens
ggatccttcctgcctc

SEQ ID NO: 113581 - DNA, 16 bp, H. sapiens
ggatcctttaagccca

SEQ ID NO: 113582 - DNA, 16 bp, H. sapiens
ggatcctttccccatt

SEQ ID NO: 113583 - DNA, 16 bp, H. sapiens
ggatcgcaccactgca

SEQ ID NO: 113584 - DNA, 16 bp, H. sapiens
ggatctagctatgttg

SEQ ID NO: 113585 - DNA, 16 bp, H. sapiens
ggatctcactctgttg

SEQ ID NO: 113586 - DNA, 16 bp, H. sapiens
ggatctcactgttgcc

SEQ ID NO: 113587 - DNA, 16 bp, H. sapiens
ggatctccagcaaact

SEQ ID NO: 113588 - DNA, 16 bp, H. sapiens
ggatctctccgcagaa

SEQ ID NO: 113589 - DNA, 16 bp, H. sapiens
ggatctctctggggtc

SEQ ID NO: 113590 - DNA, 16 bp, H. sapiens
ggatctcttgagcctg

SEQ ID NO: 113591 - DNA, 16 bp, H. sapiens
ggatctgaataaacat

SEQ ID NO: 113592 - DNA, 20 bp, H. sapiens
ggatctgcccgcctcagcct

SEQ ID NO: 113593 - DNA, 16 bp, H. sapiens
ggatctggctctgttg

SEQ ID NO: 113594 - DNA, 16 bp, H. sapiens
ggatctgggaaaagta

SEQ ID NO: 113595 - DNA, 17 bp, H. sapiens
ggatcttcagttgcttc

SEQ ID NO: 113596 - DNA, 16 bp, H. sapiens
ggatcttgctctgtta

SEQ ID NO: 113597 - DNA, 16 bp, H. sapiens
ggatcttgctctgttg

SEQ ID NO: 113598 - DNA, 16 bp, H. sapiens
ggatcttgctgtattg

SEQ ID NO: 113599 - DNA, 16 bp, H. sapiens
ggatcttggttcactg

SEQ ID NO: 113600 - DNA, 16 bp, H. sapiens
ggatctttcatgaatg

SEQ ID NO: 113601 - DNA, 16 bp, H. sapiens
ggatgaaaaagcaaga

SEQ ID NO: 113602 - DNA, 16 bp, H. sapiens
ggatgaaactggaagc

SEQ ID NO: 113603 - DNA, 16 bp, H. sapiens
ggatgaaatgagacaa

SEQ ID NO: 113604 - DNA, 16 bp, H. sapiens
ggatgaaattggaaag

SEQ ID NO: 113605 - DNA, 17 bp, H. sapiens
ggatgaacaagggctga

SEQ ID NO: 113606 - DNA, 16 bp, H. sapiens
ggatgaagaaactgag

SEQ ID NO: 113607 - DNA, 16 bp, H. sapiens
ggatgaagccaacctg

SEQ ID NO: 113608 - DNA, 16 bp, H. sapiens
ggatgaagctggaagt

SEQ ID NO: 113609 - DNA, 16 bp, H. sapiens
ggatgaagctggaggt

SEQ ID NO: 113610 - DNA, 16 bp, H. sapiens
ggatgaaggtggaaac

SEQ ID NO: 113611 - DNA, 16 bp, H. sapiens
ggatgaagttaaagtg

SEQ ID NO: 113612 - DNA, 16 bp, H. sapiens
ggatgaatctggaaac

SEQ ID NO: 113613 - DNA, 16 bp, H. sapiens
ggatgaatttcaaaat

SEQ ID NO: 113614 - DNA, 16 bp, H. sapiens
ggatgacacagcaaaa

SEQ ID NO: 113615 - DNA, 16 bp, H. sapiens
ggatgacagtggtttt

SEQ ID NO: 113616 - DNA, 16 bp, H. sapiens
ggatgacctcatctta

SEQ ID NO: 113617 - DNA, 16 bp, H. sapiens
ggatgacttggagggg

SEQ ID NO: 113618 - DNA, 16 bp, H. sapiens
ggatgagaaggacctc

SEQ ID NO: 113619 - DNA, 16 bp, H. sapiens
ggatgagatggatgaa

SEQ ID NO: 113620 - DNA, 16 bp, H. sapiens
ggatgagcctggagga

SEQ ID NO: 113621 - DNA, 16 bp, H. sapiens
ggatgagctcagggat

SEQ ID NO: 113622 - DNA, 16 bp, H. sapiens
ggatgaggagactgag

SEQ ID NO: 113623 - DNA, 16 bp, H. sapiens
ggatgaggaggtggcg

SEQ ID NO: 113624 - DNA, 16 bp, H. sapiens
ggatgaggcagaagga

SEQ ID NO: 113625 - DNA, 16 bp, H. sapiens
ggatgaggctggcctc

SEQ ID NO: 113626 - DNA, 16 bp, H. sapiens
ggatgaggtgctggtg

SEQ ID NO: 113627 - DNA, 16 bp, H. sapiens
ggatgatctcaatctc

SEQ ID NO: 113628 - DNA, 17 bp, H. sapiens
ggatgatgatgatgatt

SEQ ID NO: 113629 - DNA, 16 bp, H. sapiens
ggatgatgctggcttc

SEQ ID NO: 113630 - DNA, 16 bp, H. sapiens
ggatgatgggatcatt

SEQ ID NO: 113631 - DNA, 16 bp, H. sapiens
ggatgattcacatccc

SEQ ID NO: 113632 - DNA, 16 bp, H. sapiens
ggatgcaaagatgaat

SEQ ID NO: 113633 - DNA, 16 bp, H. sapiens
ggatgcagagcaactg

SEQ ID NO: 113634 - DNA, 16 bp, H. sapiens
ggatgcagcccacaga

SEQ ID NO: 113635 - DNA, 16 bp, H. sapiens
ggatgcagtgatctgg

SEQ ID NO: 113636 - DNA, 16 bp, H. sapiens
ggatgcatctcaaaat

SEQ ID NO: 113637 - DNA, 16 bp, H. sapiens
ggatgcatgtgtgtgt

SEQ ID NO: 113638 - DNA, 16 bp, H. sapiens
ggatgcatttccattt

SEQ ID NO: 113639 - DNA, 16 bp, H. sapiens
ggatgccagctgcagc

SEQ ID NO: 113640 - DNA, 16 bp, H. sapiens
ggatgcccagatttca

SEQ ID NO: 113641 - DNA, 16 bp, H. sapiens
ggatgctataacaaaa

SEQ ID NO: 113642 - DNA, 16 bp, H. sapiens
ggatgctcaagtccct

SEQ ID NO: 113643 - DNA, 16 bp, H. sapiens
ggatgctcaagtctct

SEQ ID NO: 113644 - DNA, 16 bp, H. sapiens
ggatgctggacaagag

SEQ ID NO: 113645 - DNA, 16 bp, H. sapiens
ggatggaaaaagacat

SEQ ID NO: 113646 - DNA, 16 bp, H. sapiens
ggatggaaatggagga

SEQ ID NO: 113647 - DNA, 16 bp, H. sapiens
ggatggaactgaagga

SEQ ID NO: 113648 - DNA, 16 bp, H. sapiens
ggatggaattagagac

SEQ ID NO: 113649 - DNA, 16 bp, H. sapiens
ggatggagaaaaatct

SEQ ID NO: 113650 - DNA, 16 bp, H. sapiens
ggatggagcaggaagg

SEQ ID NO: 113651 - DNA, 16 bp, H. sapiens
ggatggagctgaaaaa

SEQ ID NO: 113652 - DNA, 16 bp, H. sapiens
ggatggagctgaaagc

SEQ ID NO: 113653 - DNA, 16 bp, H. sapiens
ggatggagctggatgc

SEQ ID NO: 113654 - DNA, 16 bp, H. sapiens
ggatggaggaagaact

SEQ ID NO: 113655 - DNA, 23 bp, H. sapiens
ggatggaggaagatccaccaagc

SEQ ID NO: 113656 - DNA, 32 bp, H. sapiens
ggatggaggaagatctaccaagcaaatggaaa

SEQ ID NO: 113657 - DNA, 16 bp, H. sapiens
ggatggaggaaggggc

SEQ ID NO: 113658 - DNA, 16 bp, H. sapiens
ggatggagtgcaatgg

SEQ ID NO: 113659 - DNA, 16 bp, H. sapiens
ggatggagtgcagtgg

SEQ ID NO: 113660 - DNA, 16 bp, H. sapiens
ggatggagttggaaac

SEQ ID NO: 113661 - DNA, 16 bp, H. sapiens
ggatggataccccatt

SEQ ID NO: 113662 - DNA, 16 bp, H. sapiens
ggatggatgaatgaag

SEQ ID NO: 113663 - DNA, 16 bp, H. sapiens
ggatggatggaatgga

SEQ ID NO: 113664 - DNA, 16 bp, H. sapiens
ggatggatggttggat

SEQ ID NO: 113665 - DNA, 16 bp, H. sapiens
ggatggcagaactggt

SEQ ID NO: 113666 - DNA, 16 bp, H. sapiens
ggatggcagagcgaga

SEQ ID NO: 113667 - DNA, 16 bp, H. sapiens
ggatggcagcagacaa

SEQ ID NO: 113668 - DNA, 16 bp, H. sapiens
ggatggctcacgcctg

SEQ ID NO: 113669 - DNA, 16 bp, H. sapiens
ggatggctcatgcctg

SEQ ID NO: 113670 - DNA, 16 bp, H. sapiens
ggatggctggttcaaa

SEQ ID NO: 113671 - DNA, 16 bp, H. sapiens
ggatggcttaagcctg

SEQ ID NO: 113672 - DNA, 16 bp, H. sapiens
ggatggcttccctggg

SEQ ID NO: 113673 - DNA, 16 bp, H. sapiens
ggatgggggcccaggg

SEQ ID NO: 113674 - DNA, 17 bp, H. sapiens
ggatgggtcagtgagca

SEQ ID NO: 113675 - DNA, 16 bp, H. sapiens
ggatggtaccagctcc

SEQ ID NO: 113676 - DNA, 16 bp, H. sapiens
ggatggtattgaatct

SEQ ID NO: 113677 - DNA, 16 bp, H. sapiens
ggatggtctcaaatct

SEQ ID NO: 113678 - DNA, 16 bp, H. sapiens
ggatggtctcaatatc

SEQ ID NO: 113679 - DNA, 16 bp, H. sapiens
ggatggtgctggaggc

SEQ ID NO: 113680 - DNA, 16 bp, H. sapiens
ggatggtgctggcctc

SEQ ID NO: 113681 - DNA, 16 bp, H. sapiens
ggatggtggcacatgc

SEQ ID NO: 113682 - DNA, 16 bp, H. sapiens
ggatgtaccagagttt

SEQ ID NO: 113683 - DNA, 16 bp, H. sapiens
ggatgtagagaaaaag

SEQ ID NO: 113684 - DNA, 16 bp, H. sapiens
ggatgtagagaaatgg

SEQ ID NO: 113685 - DNA, 16 bp, H. sapiens
ggatgtcacttctgag

SEQ ID NO: 113686 - DNA, 16 bp, H. sapiens
ggatgtcattgaatct

SEQ ID NO: 113687 - DNA, 16 bp, H. sapiens
ggatgtgaaggacttc

SEQ ID NO: 113688 - DNA, 16 bp, H. sapiens
ggatgtgagtggggcc

SEQ ID NO: 113689 - DNA, 16 bp, H. sapiens
ggatgtggaaaaaagg

SEQ ID NO: 113690 - DNA, 16 bp, H. sapiens
ggatgtggacatttgg

SEQ ID NO: 113691 - DNA, 16 bp, H. sapiens
ggatgtggagaaatat

SEQ ID NO: 113692 - DNA, 16 bp, H. sapiens
ggatgtggagaagctg

SEQ ID NO: 113693 - DNA, 16 bp, H. sapiens
ggatgtggaggttgca

SEQ ID NO: 113694 - DNA, 16 bp, H. sapiens
ggatgtggatgaagct

SEQ ID NO: 113695 - DNA, 16 bp, H. sapiens
ggatgtggctgtgttc

SEQ ID NO: 113696 - DNA, 16 bp, H. sapiens
ggatgtgggtggggac

SEQ ID NO: 113697 - DNA, 16 bp, H. sapiens
ggatgtggtgaaaaga

SEQ ID NO: 113698 - DNA, 16 bp, H. sapiens
ggatgtggtggctcat

SEQ ID NO: 113699 - DNA, 16 bp, H. sapiens
ggatgttcaagtccct

SEQ ID NO: 113700 - DNA, 16 bp, H. sapiens
ggatgttgattttaga

SEQ ID NO: 113701 - DNA, 16 bp, H. sapiens
ggatgttggattttgt

SEQ ID NO: 113702 - DNA, 16 bp, H. sapiens
ggatgtttctggaaga

SEQ ID NO: 113703 - DNA, 16 bp, H. sapiens
ggattaaaaaaacaag

SEQ ID NO: 113704 - DNA, 16 bp, H. sapiens
ggattaaaaacctaaa

SEQ ID NO: 113705 - DNA, 16 bp, H. sapiens
ggattaaagaagaaat

SEQ ID NO: 113706 - DNA, 16 bp, H. sapiens
ggattaaagatttaaa

SEQ ID NO: 113707 - DNA, 16 bp, H. sapiens
ggattaaaggatacaa

SEQ ID NO: 113708 - DNA, 16 bp, H. sapiens
ggattaagtgagatga

SEQ ID NO: 113709 - DNA, 16 bp, H. sapiens
ggattaattcaacaag

SEQ ID NO: 113710 - DNA, 16 bp, H. sapiens
ggattacaaatgtaag

SEQ ID NO: 113711 - DNA, 16 bp, H. sapiens
ggattacaattcagat

SEQ ID NO: 113712 - DNA, 16 bp, H. sapiens
ggattacagaaatgag

SEQ ID NO: 113713 - DNA, 21 bp, H. sapiens
ggattacagacgtgagccact

SEQ ID NO: 113714 - DNA, 16 bp, H. sapiens
ggattacagccactgc

SEQ ID NO: 113715 - DNA, 16 bp, H. sapiens
ggattacaggcaccag

SEQ ID NO: 113716 - DNA, 16 bp, H. sapiens
ggattacaggcattga

SEQ ID NO: 113717 - DNA, 16 bp, H. sapiens
ggattacaggcgtgaa

SEQ ID NO: 113718 - DNA, 16 bp, H. sapiens
ggattacagtcacctg

SEQ ID NO: 113719 - DNA, 16 bp, H. sapiens
ggattacagtgagcca

SEQ ID NO: 113720 - DNA, 16 bp, H. sapiens
ggattacatgcacgtg

SEQ ID NO: 113721 - DNA, 16 bp, H. sapiens
ggattacatttcagca

SEQ ID NO: 113722 - DNA, 16 bp, H. sapiens
ggattaccaggcagaa

SEQ ID NO: 113723 - DNA, 22 bp, H. sapiens
ggattacgggtgtgagccacca

SEQ ID NO: 113724 - DNA, 16 bp, H. sapiens
ggattagatgaggtca

SEQ ID NO: 113725 - DNA, 16 bp, H. sapiens
ggattagtgccattat

SEQ ID NO: 113726 - DNA, 16 bp, H. sapiens
ggattatagacataag

SEQ ID NO: 113727 - DNA, 16 bp, H. sapiens
ggattatagacttaaa

SEQ ID NO: 113728 - DNA, 21 bp, H. sapiens
ggattataggcgtgagccact

SEQ ID NO: 113729 - DNA, 19 bp, H. sapiens
ggattatcattagttctta

SEQ ID NO: 113730 - DNA, 16 bp, H. sapiens
ggattatcttggctat

SEQ ID NO: 113731 - DNA, 16 bp, H. sapiens
ggattattacaattta

SEQ ID NO: 113732 - DNA, 16 bp, H. sapiens
ggattcaaatccaggc

SEQ ID NO: 113733 - DNA, 16 bp, H. sapiens
ggattcaaattcaggt

SEQ ID NO: 113734 - DNA, 16 bp, H. sapiens
ggattcaagttcttcc

SEQ ID NO: 113735 - DNA, 16 bp, H. sapiens
ggattcaatgattttt

SEQ ID NO: 113736 - DNA, 16 bp, H. sapiens
ggattcattcattcat

SEQ ID NO: 113737 - DNA, 16 bp, H. sapiens
ggattccaggcaccca

SEQ ID NO: 113738 - DNA, 16 bp, H. sapiens
ggattccttctacctt

SEQ ID NO: 113739 - DNA, 16 bp, H. sapiens
ggattctatttctcct

SEQ ID NO: 113740 - DNA, 16 bp, H. sapiens
ggattctccatgttgg

SEQ ID NO: 113741 - DNA, 16 bp, H. sapiens
ggattctcctctagag

SEQ ID NO: 113742 - DNA, 16 bp, H. sapiens
ggattctgcatttcta

SEQ ID NO: 113743 - DNA, 16 bp, H. sapiens
ggattctggatatatt

SEQ ID NO: 113744 - DNA, 16 bp, H. sapiens
ggattctgggaagatg

SEQ ID NO: 113745 - DNA, 16 bp, H. sapiens
ggattcttttttaaaa

SEQ ID NO: 113746 - DNA, 16 bp, H. sapiens
ggattgaataaagaaa

SEQ ID NO: 113747 - DNA, 16 bp, H. sapiens
ggattgaggtttggga

SEQ ID NO: 113748 - DNA, 16 bp, H. sapiens
ggattgcaatggtgtg

SEQ ID NO: 113749 - DNA, 16 bp, H. sapiens
ggattgcaggcatgca

SEQ ID NO: 113750 - DNA, 16 bp, H. sapiens
ggattgcaggtgcctg

SEQ ID NO: 113751 - DNA, 16 bp, H. sapiens
ggattgctggatggaa

SEQ ID NO: 113752 - DNA, 16 bp, H. sapiens
ggattggaatcaactt

SEQ ID NO: 113753 - DNA, 16 bp, H. sapiens
ggattggctccaggac

SEQ ID NO: 113754 - DNA, 16 bp, H. sapiens
ggattggggtgcagag

SEQ ID NO: 113755 - DNA, 16 bp, H. sapiens
ggattggtccttggtg

SEQ ID NO: 113756 - DNA, 17 bp, H. sapiens
ggattgtaaaatgcacc

SEQ ID NO: 113757 - DNA, 16 bp, H. sapiens
ggattgtaaaatggtg

SEQ ID NO: 113758 - DNA, 22 bp, H. sapiens
ggattgtaaatacaccaatcgg

SEQ ID NO: 113759 - DNA, 16 bp, H. sapiens
ggattgtcttggctat

SEQ ID NO: 113760 - DNA, 16 bp, H. sapiens
ggattgtgatattttc

SEQ ID NO: 113761 - DNA, 16 bp, H. sapiens
ggattgtttccacctt

SEQ ID NO: 113762 - DNA, 16 bp, H. sapiens
ggattgtttgcttttt

SEQ ID NO: 113763 - DNA, 16 bp, H. sapiens
ggatttaaacatattt

SEQ ID NO: 113764 - DNA, 16 bp, H. sapiens
ggatttaagtcaatat

SEQ ID NO: 113765 - DNA, 16 bp, H. sapiens
ggatttaattaaacta

SEQ ID NO: 113766 - DNA, 16 bp, H. sapiens
ggatttcatcaccacc

SEQ ID NO: 113767 - DNA, 16 bp, H. sapiens
ggatttccagtactgt

SEQ ID NO: 113768 - DNA, 16 bp, H. sapiens
ggatttcccttcacca

SEQ ID NO: 113769 - DNA, 16 bp, H. sapiens
ggatttctaaaattct

SEQ ID NO: 113770 - DNA, 16 bp, H. sapiens
ggatttctcagcaagg

SEQ ID NO: 113771 - DNA, 16 bp, H. sapiens
ggatttgaacccagct

SEQ ID NO: 113772 - DNA, 16 bp, H. sapiens
ggatttgaacccaggt

SEQ ID NO: 113773 - DNA, 16 bp, H. sapiens
ggatttgaagaatcaa

SEQ ID NO: 113774 - DNA, 16 bp, H. sapiens
ggatttgaagccaggt

SEQ ID NO: 113775 - DNA, 16 bp, H. sapiens
ggatttgaatccaagc

SEQ ID NO: 113776 - DNA, 16 bp, H. sapiens
ggatttgagaaatatt

SEQ ID NO: 113777 - DNA, 16 bp, H. sapiens
ggatttgcctattcta

SEQ ID NO: 113778 - DNA, 16 bp, H. sapiens
ggatttgcctgttctg

SEQ ID NO: 113779 - DNA, 16 bp, H. sapiens
ggatttggaatcagaa

SEQ ID NO: 113780 - DNA, 16 bp, H. sapiens
ggatttggctgaaggc

SEQ ID NO: 113781 - DNA, 16 bp, H. sapiens
ggattttaaaatattt

SEQ ID NO: 113782 - DNA, 16 bp, H. sapiens
ggattttaccatgttg

SEQ ID NO: 113783 - DNA, 16 bp, H. sapiens
ggattttattgccaat

SEQ ID NO: 113784 - DNA, 16 bp, H. sapiens
ggattttcagaatggc

SEQ ID NO: 113785 - DNA, 16 bp, H. sapiens
ggattttcagtttttc

SEQ ID NO: 113786 - DNA, 16 bp, H. sapiens
ggattttcgctcttgt

SEQ ID NO: 113787 - DNA, 16 bp, H. sapiens
ggattttcttggcaat

SEQ ID NO: 113788 - DNA, 16 bp, H. sapiens
ggattttcttttctat

SEQ ID NO: 113789 - DNA, 16 bp, H. sapiens
ggattttgaattttat

SEQ ID NO: 113790 - DNA, 16 bp, H. sapiens
ggattttggaatattt

SEQ ID NO: 113791 - DNA, 16 bp, H. sapiens
ggattttggaattgca

SEQ ID NO: 113792 - DNA, 16 bp, H. sapiens
ggattttggagtattt

SEQ ID NO: 113793 - DNA, 16 bp, H. sapiens
ggattttgggaggccg

SEQ ID NO: 113794 - DNA, 16 bp, H. sapiens
ggatttttaaaaatta

SEQ ID NO: 113795 - DNA, 16 bp, H. sapiens
ggatttttccaatgtt

SEQ ID NO: 113796 - DNA, 16 bp, H. sapiens
ggatttttgcatcaat

SEQ ID NO: 113797 - DNA, 16 bp, H. sapiens
ggatttttgcatcagt

SEQ ID NO: 113798 - DNA, 16 bp, H. sapiens
ggatttttgcatgtat

SEQ ID NO: 113799 - DNA, 16 bp, H. sapiens
ggattttttccatttt

SEQ ID NO: 113800 - DNA, 16 bp, H. sapiens
ggattttttttaaaaa

SEQ ID NO: 113801 - DNA, 16 bp, H. sapiens
ggattttttttccatt

SEQ ID NO: 113802 - DNA, 16 bp, H. sapiens
ggattttttttcctct

SEQ ID NO: 113803 - DNA, 16 bp, H. sapiens
ggcaaaaacaggaagc

SEQ ID NO: 113804 - DNA, 16 bp, H. sapiens
ggcaaaaacttaaaaa

SEQ ID NO: 113805 - DNA, 16 bp, H. sapiens
ggcaaaagaaatttct

SEQ ID NO: 113806 - DNA, 16 bp, H. sapiens
ggcaaaagctggaaac

SEQ ID NO: 113807 - DNA, 16 bp, H. sapiens
ggcaaaaggcaaggag

SEQ ID NO: 113808 - DNA, 16 bp, H. sapiens
ggcaaaattgccccca

SEQ ID NO: 113809 - DNA, 16 bp, H. sapiens
ggcaaaccaggacagt

SEQ ID NO: 113810 - DNA, 16 bp, H. sapiens
ggcaaacttcattgtt

SEQ ID NO: 113811 - DNA, 16 bp, H. sapiens
ggcaaagaaggacatt

SEQ ID NO: 113812 - DNA, 16 bp, H. sapiens
ggcaaagaatctgaat

SEQ ID NO: 113813 - DNA, 16 bp, H. sapiens
ggcaaagacttcatga

SEQ ID NO: 113814 - DNA, 16 bp, H. sapiens
ggcaaagagctcagca

SEQ ID NO: 113815 - DNA, 16 bp, H. sapiens
ggcaaagatttcatga

SEQ ID NO: 113816 - DNA, 16 bp, H. sapiens
ggcaaagattttatga

SEQ ID NO: 113817 - DNA, 16 bp, H. sapiens
ggcaaagcagaatatc

SEQ ID NO: 113818 - DNA, 16 bp, H. sapiens
ggcaaagcagcaatca

SEQ ID NO: 113819 - DNA, 16 bp, H. sapiens
ggcaaagccactgtag

SEQ ID NO: 113820 - DNA, 16 bp, H. sapiens
ggcaaagctggaagca

SEQ ID NO: 113821 - DNA, 16 bp, H. sapiens
ggcaaagctgtggaga

SEQ ID NO: 113822 - DNA, 16 bp, H. sapiens
ggcaaaggaactagaa

SEQ ID NO: 113823 - DNA, 16 bp, H. sapiens
ggcaaaggagaagtaa

SEQ ID NO: 113824 - DNA, 16 bp, H. sapiens
ggcaaaggcatggagg

SEQ ID NO: 113825 - DNA, 16 bp, H. sapiens
ggcaaaggtgggagga

SEQ ID NO: 113826 - DNA, 16 bp, H. sapiens
ggcaaaggtgggcaga

SEQ ID NO: 113827 - DNA, 16 bp, H. sapiens
ggcaaagtctcaggat

SEQ ID NO: 113828 - DNA, 16 bp, H. sapiens
ggcaaagtcttcatga

SEQ ID NO: 113829 - DNA, 16 bp, H. sapiens
ggcaaataaataaata

SEQ ID NO: 113830 - DNA, 16 bp, H. sapiens
ggcaaatacttcatga

SEQ ID NO: 113831 - DNA, 16 bp, H. sapiens
ggcaaatatccagaat

SEQ ID NO: 113832 - DNA, 16 bp, H. sapiens
ggcaaatgactgttgg

SEQ ID NO: 113833 - DNA, 24 bp, H. sapiens
ggcaaatggagtgaagtgccatat

SEQ ID NO: 113834 - DNA, 16 bp, H. sapiens
ggcaaattggatcaag

SEQ ID NO: 113835 - DNA, 16 bp, H. sapiens
ggcaacaaaagaaaat

SEQ ID NO: 113836 - DNA, 16 bp, H. sapiens
ggcaacacagagagat

SEQ ID NO: 113837 - DNA, 16 bp, H. sapiens
ggcaacacagccagac

SEQ ID NO: 113838 - DNA, 17 bp, H. sapiens
ggcaacacagtgagacc

SEQ ID NO: 113839 - DNA, 16 bp, H. sapiens
ggcaacagagagaccc

SEQ ID NO: 113840 - DNA, 16 bp, H. sapiens
ggcaacagagcaagaa

SEQ ID NO: 113841 - DNA, 16 bp, H. sapiens
ggcaacagagcaagag

SEQ ID NO: 113842 - DNA, 17 bp, H. sapiens
ggcaacagagcgagact

SEQ ID NO: 113843 - DNA, 16 bp, H. sapiens
ggcaacagagctagac

SEQ ID NO: 113844 - DNA, 16 bp, H. sapiens
ggcaacagagtgagaa

SEQ ID NO: 113845 - DNA, 16 bp, H. sapiens
ggcaacagagtgaggc

SEQ ID NO: 113846 - DNA, 16 bp, H. sapiens
ggcaacagagtgatac

SEQ ID NO: 113847 - DNA, 16 bp, H. sapiens
ggcaacaggagcgaaa

SEQ ID NO: 113848 - DNA, 17 bp, H. sapiens
ggcaacagtgcaagact

SEQ ID NO: 113849 - DNA, 16 bp, H. sapiens
ggcaacataacaaggc

SEQ ID NO: 113850 - DNA, 16 bp, H. sapiens
ggcaacataatgagat

SEQ ID NO: 113851 - DNA, 16 bp, H. sapiens
ggcaacatacatcctc

SEQ ID NO: 113852 - DNA, 16 bp, H. sapiens
ggcaacatactgagaa

SEQ ID NO: 113853 - DNA, 16 bp, H. sapiens
ggcaacatagagaccc

SEQ ID NO: 113854 - DNA, 16 bp, H. sapiens
ggcaacatagcaagaa

SEQ ID NO: 113855 - DNA, 16 bp, H. sapiens
ggcaacatagtaagat

SEQ ID NO: 113856 - DNA, 16 bp, H. sapiens
ggcaacatctggagac

SEQ ID NO: 113857 - DNA, 16 bp, H. sapiens
ggcaacatgacaagac

SEQ ID NO: 113858 - DNA, 16 bp, H. sapiens
ggcaacatggcaaaat

SEQ ID NO: 113859 - DNA, 16 bp, H. sapiens
ggcaacatggcaaggc

SEQ ID NO: 113860 - DNA, 16 bp, H. sapiens
ggcaaccactattctg

SEQ ID NO: 113861 - DNA, 16 bp, H. sapiens
ggcaaccagcagccct

SEQ ID NO: 113862 - DNA, 16 bp, H. sapiens
ggcaacccactggggt

SEQ ID NO: 113863 - DNA, 16 bp, H. sapiens
ggcaacctccacctcc

SEQ ID NO: 113864 - DNA, 16 bp, H. sapiens
ggcaactgagcaagat

SEQ ID NO: 113865 - DNA, 16 bp, H. sapiens
ggcaagaaaaagaagt

SEQ ID NO: 113866 - DNA, 16 bp, H. sapiens
ggcaagaaatagctaa

SEQ ID NO: 113867 - DNA, 16 bp, H. sapiens
ggcaagaaatggaatc

SEQ ID NO: 113868 - DNA, 16 bp, H. sapiens
ggcaagaattgaggct

SEQ ID NO: 113869 - DNA, 16 bp, H. sapiens
ggcaagacagaaacca

SEQ ID NO: 113870 - DNA, 16 bp, H. sapiens
ggcaagaccccatctc

SEQ ID NO: 113871 - DNA, 16 bp, H. sapiens
ggcaagactccatctc

SEQ ID NO: 113872 - DNA, 16 bp, H. sapiens
ggcaagactctgtctc

SEQ ID NO: 113873 - DNA, 16 bp, H. sapiens
ggcaagagagaaagca

SEQ ID NO: 113874 - DNA, 16 bp, H. sapiens
ggcaagagcagctaaa

SEQ ID NO: 113875 - DNA, 16 bp, H. sapiens
ggcaagagtgagactc

SEQ ID NO: 113876 - DNA, 16 bp, H. sapiens
ggcaagataaaaaatc

SEQ ID NO: 113877 - DNA, 16 bp, H. sapiens
ggcaagatggctgact

SEQ ID NO: 113878 - DNA, 16 bp, H. sapiens
ggcaagcatcatcctg

SEQ ID NO: 113879 - DNA, 16 bp, H. sapiens
ggcaagccacccaggt

SEQ ID NO: 113880 - DNA, 16 bp, H. sapiens
ggcaagctgaagcagg

SEQ ID NO: 113881 - DNA, 16 bp, H. sapiens
ggcaaggaccatgtct

SEQ ID NO: 113882 - DNA, 16 bp, H. sapiens
ggcaaggagacaggag

SEQ ID NO: 113883 - DNA, 16 bp, H. sapiens
ggcaaggatatagaga

SEQ ID NO: 113884 - DNA, 16 bp, H. sapiens
ggcaaggatgtggagt

SEQ ID NO: 113885 - DNA, 16 bp, H. sapiens
ggcaaggatttcatga

SEQ ID NO: 113886 - DNA, 16 bp, H. sapiens
ggcaaggccaagctgg

SEQ ID NO: 113887 - DNA, 16 bp, H. sapiens
ggcaaggccagcaata

SEQ ID NO: 113888 - DNA, 16 bp, H. sapiens
ggcaaggccagggtag

SEQ ID NO: 113889 - DNA, 16 bp, H. sapiens
ggcaagggcaagaagg

SEQ ID NO: 113890 - DNA, 16 bp, H. sapiens
ggcaagggcaagggca

SEQ ID NO: 113891 - DNA, 16 bp, H. sapiens
ggcaaggggatggggc

SEQ ID NO: 113892 - DNA, 17 bp, H. sapiens
ggcaaggtggcaggcgc

SEQ ID NO: 113893 - DNA, 16 bp, H. sapiens
ggcaaggtggtgggtg

SEQ ID NO: 113894 - DNA, 16 bp, H. sapiens
ggcaaggtggtgtgca

SEQ ID NO: 113895 - DNA, 16 bp, H. sapiens
ggcaagtcaggtctca

SEQ ID NO: 113896 - DNA, 16 bp, H. sapiens
ggcaagtcatttaacc

SEQ ID NO: 113897 - DNA, 16 bp, H. sapiens
ggcaagtctgaaattt

SEQ ID NO: 113898 - DNA, 16 bp, H. sapiens
ggcaagtgaaagaaat

SEQ ID NO: 113899 - DNA, 16 bp, H. sapiens
ggcaagtggactttgg

SEQ ID NO: 113900 - DNA, 16 bp, H. sapiens
ggcaagtgtggaggcc

SEQ ID NO: 113901 - DNA, 16 bp, H. sapiens
ggcaagttacttaacc

SEQ ID NO: 113902 - DNA, 16 bp, H. sapiens
ggcaagttgaataaag

SEQ ID NO: 113903 - DNA, 16 bp, H. sapiens
ggcaagtttgcatcct

SEQ ID NO: 113904 - DNA, 16 bp, H. sapiens
ggcaatagagccagac

SEQ ID NO: 113905 - DNA, 16 bp, H. sapiens
ggcaatcagacaagag

SEQ ID NO: 113906 - DNA, 16 bp, H. sapiens
ggcaatctggctacag

SEQ ID NO: 113907 - DNA, 16 bp, H. sapiens
ggcaatcttggctcac

SEQ ID NO: 113908 - DNA, 16 bp, H. sapiens
ggcaatgagaaggaga

SEQ ID NO: 113909 - DNA, 21 bp, H. sapiens
ggcaatgagggacttagcacc

SEQ ID NO: 113910 - DNA, 16 bp, H. sapiens
ggcaatgatgatgatg

SEQ ID NO: 113911 - DNA, 16 bp, H. sapiens
ggcaatgccattcagg

SEQ ID NO: 113912 - DNA, 16 bp, H. sapiens
ggcaattaggtaggag

SEQ ID NO: 113913 - DNA, 16 bp, H. sapiens
ggcaattataaataaa

SEQ ID NO: 113914 - DNA, 16 bp, H. sapiens
ggcaattataacacag

SEQ ID NO: 113915 - DNA, 16 bp, H. sapiens
ggcaatttacaaatga

SEQ ID NO: 113916 - DNA, 16 bp, H. sapiens
ggcaatttcatcattg

SEQ ID NO: 113917 - DNA, 16 bp, H. sapiens
ggcaatttcttaaaat

SEQ ID NO: 113918 - DNA, 16 bp, H. sapiens
ggcaatttgtatatct

SEQ ID NO: 113919 - DNA, 16 bp, H. sapiens
ggcaatttttccatgg

SEQ ID NO: 113920 - DNA, 16 bp, H. sapiens
ggcacaaaaacaggca

SEQ ID NO: 113921 - DNA, 16 bp, H. sapiens
ggcacaaaatataatt

SEQ ID NO: 113922 - DNA, 16 bp, H. sapiens
ggcacaaacattcaga

SEQ ID NO: 113923 - DNA, 16 bp, H. sapiens
ggcacaaactgtttca

SEQ ID NO: 113924 - DNA, 16 bp, H. sapiens
ggcacaaagaggagct

SEQ ID NO: 113925 - DNA, 29 bp, H. sapiens
ggcacaagacagggatgccctctctcacc

SEQ ID NO: 113926 - DNA, 16 bp, H. sapiens
ggcacaagtgatcctc

SEQ ID NO: 113927 - DNA, 16 bp, H. sapiens
ggcacaagtgatcctt

SEQ ID NO: 113928 - DNA, 16 bp, H. sapiens
ggcacaatgcagccaa

SEQ ID NO: 113929 - DNA, 16 bp, H. sapiens
ggcacacacacacaca

SEQ ID NO: 113930 - DNA, 16 bp, H. sapiens
ggcacacagacctcag

SEQ ID NO: 113931 - DNA, 16 bp, H. sapiens
ggcacacaggaggcac

SEQ ID NO: 113932 - DNA, 16 bp, H. sapiens
ggcacactcacagctc

SEQ ID NO: 113933 - DNA, 16 bp, H. sapiens
ggcacagaggggttaa

SEQ ID NO: 113934 - DNA, 16 bp, H. sapiens
ggcacagcagctcacg

SEQ ID NO: 113935 - DNA, 16 bp, H. sapiens
ggcacagccactgtgg

SEQ ID NO: 113936 - DNA, 16 bp, H. sapiens
ggcacaggcagggcag

SEQ ID NO: 113937 - DNA, 16 bp, H. sapiens
ggcacaggctctggag

SEQ ID NO: 113938 - DNA, 16 bp, H. sapiens
ggcacagggagcagga

SEQ ID NO: 113939 - DNA, 16 bp, H. sapiens
ggcacagtgctcacgc

SEQ ID NO: 113940 - DNA, 16 bp, H. sapiens
ggcacagtggctcagg

SEQ ID NO: 113941 - DNA, 16 bp, H. sapiens
ggcacagtggtgggca

SEQ ID NO: 113942 - DNA, 16 bp, H. sapiens
ggcacagtgtctcatg

SEQ ID NO: 113943 - DNA, 20 bp, H. sapiens
ggcacatcaaaaagcttatc

SEQ ID NO: 113944 - DNA, 16 bp, H. sapiens
ggcacatgcctatact

SEQ ID NO: 113945 - DNA, 16 bp, H. sapiens
ggcacatgcctccaca

SEQ ID NO: 113946 - DNA, 16 bp, H. sapiens
ggcacatggatcactt

SEQ ID NO: 113947 - DNA, 16 bp, H. sapiens
ggcacatggggaggag

SEQ ID NO: 113948 - DNA, 31 bp, H. sapiens
ggcacatgtatacatatgtaactaacctgca

SEQ ID NO: 113949 - DNA, 16 bp, H. sapiens
ggcaccaagccactca

SEQ ID NO: 113950 - DNA, 16 bp, H. sapiens
ggcaccacacccggct

SEQ ID NO: 113951 - DNA, 16 bp, H. sapiens
ggcaccaccataccca

SEQ ID NO: 113952 - DNA, 16 bp, H. sapiens
ggcaccacctagtaga

SEQ ID NO: 113953 - DNA, 16 bp, H. sapiens
ggcaccacctccaaca

SEQ ID NO: 113954 - DNA, 16 bp, H. sapiens
ggcaccagcagatctg

SEQ ID NO: 113955 - DNA, 16 bp, H. sapiens
ggcaccagcaggttca

SEQ ID NO: 113956 - DNA, 16 bp, H. sapiens
ggcaccagcttttgag

SEQ ID NO: 113957 - DNA, 16 bp, H. sapiens
ggcaccatccaattgg

SEQ ID NO: 113958 - DNA, 16 bp, H. sapiens
ggcaccatcttggccc

SEQ ID NO: 113959 - DNA, 16 bp, H. sapiens
ggcaccatggagcagg

SEQ ID NO: 113960 - DNA, 16 bp, H. sapiens
ggcaccatttttccaa

SEQ ID NO: 113961 - DNA, 16 bp, H. sapiens
ggcacccaccactgca

SEQ ID NO: 113962 - DNA, 16 bp, H. sapiens
ggcacccacgaccacg

SEQ ID NO: 113963 - DNA, 16 bp, H. sapiens
ggcacccactctcttc

SEQ ID NO: 113964 - DNA, 16 bp, H. sapiens
ggcacccagcaccatg

SEQ ID NO: 113965 - DNA, 16 bp, H. sapiens
ggcacccatttttctt

SEQ ID NO: 113966 - DNA, 16 bp, H. sapiens
ggcacccctcccccag

SEQ ID NO: 113967 - DNA, 17 bp, H. sapiens
ggcaccctccaatactt

SEQ ID NO: 113968 - DNA, 16 bp, H. sapiens
ggcaccgagagtgagc

SEQ ID NO: 113969 - DNA, 16 bp, H. sapiens
ggcaccgcgcctggcc

SEQ ID NO: 113970 - DNA, 16 bp, H. sapiens
ggcacctcaatctcaa

SEQ ID NO: 113971 - DNA, 16 bp, H. sapiens
ggcacctcccaccatg

SEQ ID NO: 113972 - DNA, 16 bp, H. sapiens
ggcacctcgggaggcc

SEQ ID NO: 113973 - DNA, 20 bp, H. sapiens
ggcacctgcaatcccagcta

SEQ ID NO: 113974 - DNA, 16 bp, H. sapiens
ggcacctgccaacatg

SEQ ID NO: 113975 - DNA, 16 bp, H. sapiens
ggcacctgccacaacg

SEQ ID NO: 113976 - DNA, 16 bp, H. sapiens
ggcacctgccaccaag

SEQ ID NO: 113977 - DNA, 17 bp, H. sapiens
ggcacctgccaccacat

SEQ ID NO: 113978 - DNA, 16 bp, H. sapiens
ggcacctgccaccctg

SEQ ID NO: 113979 - DNA, 16 bp, H. sapiens
ggcacctgccactgtg

SEQ ID NO: 113980 - DNA, 20 bp, H. sapiens
ggcacctgtaatcccagctg

SEQ ID NO: 113981 - DNA, 19 bp, H. sapiens
ggcacctgtagttccagct

SEQ ID NO: 113982 - DNA, 16 bp, H. sapiens
ggcacggtgactcaca

SEQ ID NO: 113983 - DNA, 16 bp, H. sapiens
ggcacggtgactcatg

SEQ ID NO: 113984 - DNA, 16 bp, H. sapiens
ggcacggtggctcacc

SEQ ID NO: 113985 - DNA, 19 bp, H. sapiens
ggcacggtggctcacgcct

SEQ ID NO: 113986 - DNA, 16 bp, H. sapiens
ggcacggtggcttgca

SEQ ID NO: 113987 - DNA, 16 bp, H. sapiens
ggcacggtggtgggcg

SEQ ID NO: 113988 - DNA, 16 bp, H. sapiens
ggcacgtgtgtgtgtg

SEQ ID NO: 113989 - DNA, 16 bp, H. sapiens
ggcactaccagctgtg

SEQ ID NO: 113990 - DNA, 16 bp, H. sapiens
ggcactccagcctggc

SEQ ID NO: 113991 - DNA, 16 bp, H. sapiens
ggcactccagcctggg

SEQ ID NO: 113992 - DNA, 16 bp, H. sapiens
ggcactgaagaagcaa

SEQ ID NO: 113993 - DNA, 16 bp, H. sapiens
ggcactgaagagatag

SEQ ID NO: 113994 - DNA, 16 bp, H. sapiens
ggcactgacctgatgc

SEQ ID NO: 113995 - DNA, 16 bp, H. sapiens
ggcactgctgggggac

SEQ ID NO: 113996 - DNA, 16 bp, H. sapiens
ggcactggcctgatgc

SEQ ID NO: 113997 - DNA, 16 bp, H. sapiens
ggcactgggaaaactg

SEQ ID NO: 113998 - DNA, 16 bp, H. sapiens
ggcactgggattacag

SEQ ID NO: 113999 - DNA, 16 bp, H. sapiens
ggcactgtcctaggtg

SEQ ID NO: 114000 - DNA, 16 bp, H. sapiens
ggcactgtgccaagca

SEQ ID NO: 114001 - DNA, 16 bp, H. sapiens
ggcactgtgctaggta

SEQ ID NO: 114002 - DNA, 16 bp, H. sapiens
ggcactgtgctgggtg

SEQ ID NO: 114003 - DNA, 16 bp, H. sapiens
ggcactgtggcccagc

SEQ ID NO: 114004 - DNA, 16 bp, H. sapiens
ggcactgtggggctct

SEQ ID NO: 114005 - DNA, 16 bp, H. sapiens
ggcactgttctaagtg

SEQ ID NO: 114006 - DNA, 16 bp, H. sapiens
ggcacttcagcccaga

SEQ ID NO: 114007 - DNA, 16 bp, H. sapiens
ggcacttcctcccctc

SEQ ID NO: 114008 - DNA, 16 bp, H. sapiens
ggcactttacctctgt

SEQ ID NO: 114009 - DNA, 16 bp, H. sapiens
ggcactttgggaggcc

SEQ ID NO: 114010 - DNA, 18 bp, H. sapiens
ggcactttgggaggctga

SEQ ID NO: 114011 - DNA, 16 bp, H. sapiens
ggcagaaaaaaatgga

SEQ ID NO: 114012 - DNA, 16 bp, H. sapiens
ggcagaaaaagagacc

SEQ ID NO: 114013 - DNA, 16 bp, H. sapiens
ggcagaaaagaaaata

SEQ ID NO: 114014 - DNA, 16 bp, H. sapiens
ggcagaaaaggccttt

SEQ ID NO: 114015 - DNA, 16 bp, H. sapiens
ggcagaaaatcagcaa

SEQ ID NO: 114016 - DNA, 16 bp, H. sapiens
ggcagaaacacaacca

SEQ ID NO: 114017 - DNA, 16 bp, H. sapiens
ggcagaaacagccttc

SEQ ID NO: 114018 - DNA, 16 bp, H. sapiens
ggcagaaaccctataa

SEQ ID NO: 114019 - DNA, 25 bp, H. sapiens
ggcagaaactctacaagccagaaga

SEQ ID NO: 114020 - DNA, 16 bp, H. sapiens
ggcagaaagaaaaatg

SEQ ID NO: 114021 - DNA, 16 bp, H. sapiens
ggcagaaagaacagca

SEQ ID NO: 114022 - DNA, 16 bp, H. sapiens
ggcagaaagactgctt

SEQ ID NO: 114023 - DNA, 16 bp, H. sapiens
ggcagaaaggcaagag

SEQ ID NO: 114024 - DNA, 16 bp, H. sapiens
ggcagaaagggaagca

SEQ ID NO: 114025 - DNA, 16 bp, H. sapiens
ggcagaaagtgaaggg

SEQ ID NO: 114026 - DNA, 16 bp, H. sapiens
ggcagaaatctgctgc

SEQ ID NO: 114027 - DNA, 16 bp, H. sapiens
ggcagaaatgaagatg

SEQ ID NO: 114028 - DNA, 16 bp, H. sapiens
ggcagaactgggattt

SEQ ID NO: 114029 - DNA, 16 bp, H. sapiens
ggcagaagaattactt

SEQ ID NO: 114030 - DNA, 16 bp, H. sapiens
ggcagaagacagaagg

SEQ ID NO: 114031 - DNA, 16 bp, H. sapiens
ggcagaagaggaagca

SEQ ID NO: 114032 - DNA, 16 bp, H. sapiens
ggcagaagaggtggag

SEQ ID NO: 114033 - DNA, 16 bp, H. sapiens
ggcagaagagtggaag

SEQ ID NO: 114034 - DNA, 16 bp, H. sapiens
ggcagaagatgaagga

SEQ ID NO: 114035 - DNA, 16 bp, H. sapiens
ggcagaagcaggagaa

SEQ ID NO: 114036 - DNA, 16 bp, H. sapiens
ggcagaagcaggagga

SEQ ID NO: 114037 - DNA, 16 bp, H. sapiens
ggcagaaggattgctt

SEQ ID NO: 114038 - DNA, 16 bp, H. sapiens
ggcagaagggatggaa

SEQ ID NO: 114039 - DNA, 16 bp, H. sapiens
ggcagaaggtgaaagg

SEQ ID NO: 114040 - DNA, 16 bp, H. sapiens
ggcagaaggtgaagaa

SEQ ID NO: 114041 - DNA, 16 bp, H. sapiens
ggcagaaggtgaagca

SEQ ID NO: 114042 - DNA, 16 bp, H. sapiens
ggcagaaggtggagga

SEQ ID NO: 114043 - DNA, 16 bp, H. sapiens
ggcagaagtaaagatg

SEQ ID NO: 114044 - DNA, 16 bp, H. sapiens
ggcagaagtcaagaag

SEQ ID NO: 114045 - DNA, 16 bp, H. sapiens
ggcagaagtctgctgt

SEQ ID NO: 114046 - DNA, 16 bp, H. sapiens
ggcagaagtggaagca

SEQ ID NO: 114047 - DNA, 16 bp, H. sapiens
ggcagaagtgggtgga

SEQ ID NO: 114048 - DNA, 16 bp, H. sapiens
ggcagaagttggaaca

SEQ ID NO: 114049 - DNA, 16 bp, H. sapiens
ggcagaatgagcccag

SEQ ID NO: 114050 - DNA, 16 bp, H. sapiens
ggcagaatggaaccaa

SEQ ID NO: 114051 - DNA, 16 bp, H. sapiens
ggcagaatggtgtgaa

SEQ ID NO: 114052 - DNA, 16 bp, H. sapiens
ggcagaattccctctt

SEQ ID NO: 114053 - DNA, 16 bp, H. sapiens
ggcagacagacacctc

SEQ ID NO: 114054 - DNA, 16 bp, H. sapiens
ggcagacagattcctg

SEQ ID NO: 114055 - DNA, 16 bp, H. sapiens
ggcagacatccaggcc

SEQ ID NO: 114056 - DNA, 16 bp, H. sapiens
ggcagacattgctaat

SEQ ID NO: 114057 - DNA, 16 bp, H. sapiens
ggcagaccacttgaag

SEQ ID NO: 114058 - DNA, 16 bp, H. sapiens
ggcagacctggtggtg

SEQ ID NO: 114059 - DNA, 16 bp, H. sapiens
ggcagagacagaagaa

SEQ ID NO: 114060 - DNA, 16 bp, H. sapiens
ggcagagacagaggag

SEQ ID NO: 114061 - DNA, 16 bp, H. sapiens
ggcagagacgctgctc

SEQ ID NO: 114062 - DNA, 16 bp, H. sapiens
ggcagagactggaatg

SEQ ID NO: 114063 - DNA, 16 bp, H. sapiens
ggcagagaggctgggg

SEQ ID NO: 114064 - DNA, 16 bp, H. sapiens
ggcagagatgggattt

SEQ ID NO: 114065 - DNA, 16 bp, H. sapiens
ggcagagattggaatg

SEQ ID NO: 114066 - DNA, 16 bp, H. sapiens
ggcagagcacagagga

SEQ ID NO: 114067 - DNA, 16 bp, H. sapiens
ggcagagcaggaggaa

SEQ ID NO: 114068 - DNA, 16 bp, H. sapiens
ggcagagcaggcacag

SEQ ID NO: 114069 - DNA, 49 bp, H. sapiens
ggcagagcaggcagaccaaggagttcatcttctcagagctgctgtccaa

SEQ ID NO: 114070 - DNA, 16 bp, H. sapiens
ggcagagcaggggctg

SEQ ID NO: 114071 - DNA, 16 bp, H. sapiens
ggcagagccagactcc

SEQ ID NO: 114072 - DNA, 16 bp, H. sapiens
ggcagagccaggaggg

SEQ ID NO: 114073 - DNA, 16 bp, H. sapiens
ggcagagccaggattt

SEQ ID NO: 114074 - DNA, 16 bp, H. sapiens
ggcagagcccacactg

SEQ ID NO: 114075 - DNA, 16 bp, H. sapiens
ggcagagcgagactcc

SEQ ID NO: 114076 - DNA, 16 bp, H. sapiens
ggcagagctcaggcag

SEQ ID NO: 114077 - DNA, 16 bp, H. sapiens
ggcagagctgcccaag

SEQ ID NO: 114078 - DNA, 16 bp, H. sapiens
ggcagagctggattca

SEQ ID NO: 114079 - DNA, 16 bp, H. sapiens
ggcagagctgggatta

SEQ ID NO: 114080 - DNA, 16 bp, H. sapiens
ggcagagctgggcagg

SEQ ID NO: 114081 - DNA, 16 bp, H. sapiens
ggcagagctgggcctg

SEQ ID NO: 114082 - DNA, 16 bp, H. sapiens
ggcagagctggggcca

SEQ ID NO: 114083 - DNA, 16 bp, H. sapiens
ggcagagctggttcct

SEQ ID NO: 114084 - DNA, 16 bp, H. sapiens
ggcagagctgtccaag

SEQ ID NO: 114085 - DNA, 16 bp, H. sapiens
ggcagaggaaaaatgc

SEQ ID NO: 114086 - DNA, 16 bp, H. sapiens
ggcagaggaagcagct

SEQ ID NO: 114087 - DNA, 16 bp, H. sapiens
ggcagaggaagggtga

SEQ ID NO: 114088 - DNA, 16 bp, H. sapiens
ggcagaggagcctcac

SEQ ID NO: 114089 - DNA, 16 bp, H. sapiens
ggcagaggaggtgctg

SEQ ID NO: 114090 - DNA, 16 bp, H. sapiens
ggcagaggatcaggaa

SEQ ID NO: 114091 - DNA, 17 bp, H. sapiens
ggcagaggatgtagtga

SEQ ID NO: 114092 - DNA, 16 bp, H. sapiens
ggcagaggcagaaaag

SEQ ID NO: 114093 - DNA, 16 bp, H. sapiens
ggcagaggcagaaaga

SEQ ID NO: 114094 - DNA, 16 bp, H. sapiens
ggcagaggcagagaca

SEQ ID NO: 114095 - DNA, 16 bp, H. sapiens
ggcagaggcagagaga

SEQ ID NO: 114096 - DNA, 16 bp, H. sapiens
ggcagaggcagagcca

SEQ ID NO: 114097 - DNA, 16 bp, H. sapiens
ggcagaggcagaggaa

SEQ ID NO: 114098 - DNA, 16 bp, H. sapiens
ggcagaggcaggaaaa

SEQ ID NO: 114099 - DNA, 16 bp, H. sapiens
ggcagaggcaggcaga

SEQ ID NO: 114100 - DNA, 16 bp, H. sapiens
ggcagaggcagggcca

SEQ ID NO: 114101 - DNA, 16 bp, H. sapiens
ggcagaggcagggctg

SEQ ID NO: 114102 - DNA, 16 bp, H. sapiens
ggcagaggcatgagaa

SEQ ID NO: 114103 - DNA, 17 bp, H. sapiens
ggcagaggcgggcagat

SEQ ID NO: 114104 - DNA, 16 bp, H. sapiens
ggcagaggctgaggtg

SEQ ID NO: 114105 - DNA, 17 bp, H. sapiens
ggcagaggctgcaatct

SEQ ID NO: 114106 - DNA, 16 bp, H. sapiens
ggcagaggctgcagtc

SEQ ID NO: 114107 - DNA, 16 bp, H. sapiens
ggcagaggctgccgtg

SEQ ID NO: 114108 - DNA, 16 bp, H. sapiens
ggcagaggctgctgtg

SEQ ID NO: 114109 - DNA, 16 bp, H. sapiens
ggcagaggctggaaga

SEQ ID NO: 114110 - DNA, 16 bp, H. sapiens
ggcagaggctggagga

SEQ ID NO: 114111 - DNA, 16 bp, H. sapiens
ggcagaggcttcagtg

SEQ ID NO: 114112 - DNA, 16 bp, H. sapiens
ggcagagggaacagcc

SEQ ID NO: 114113 - DNA, 16 bp, H. sapiens
ggcagagggagcagca

SEQ ID NO: 114114 - DNA, 16 bp, H. sapiens
ggcagagggcagggca

SEQ ID NO: 114115 - DNA, 16 bp, H. sapiens
ggcagaggggcttctc

SEQ ID NO: 114116 - DNA, 16 bp, H. sapiens
ggcagagggtgcagtg

SEQ ID NO: 114117 - DNA, 16 bp, H. sapiens
ggcagaggtcccagcc

SEQ ID NO: 114118 - DNA, 16 bp, H. sapiens
ggcagaggtgagggga

SEQ ID NO: 114119 - DNA, 16 bp, H. sapiens
ggcagaggtgggtgaa

SEQ ID NO: 114120 - DNA, 16 bp, H. sapiens
ggcagaggttagaaca

SEQ ID NO: 114121 - DNA, 16 bp, H. sapiens
ggcagaggttgcagat

SEQ ID NO: 114122 - DNA, 16 bp, H. sapiens
ggcagagtatgacctt

SEQ ID NO: 114123 - DNA, 16 bp, H. sapiens
ggcagagtcctcatga

SEQ ID NO: 114124 - DNA, 16 bp, H. sapiens
ggcagagtcctgaggc

SEQ ID NO: 114125 - DNA, 16 bp, H. sapiens
ggcagagtgagactct

SEQ ID NO: 114126 - DNA, 16 bp, H. sapiens
ggcagagtgtggtggc

SEQ ID NO: 114127 - DNA, 16 bp, H. sapiens
ggcagataggggtggg

SEQ ID NO: 114128 - DNA, 17 bp, H. sapiens
ggcagatcaccggaggt

SEQ ID NO: 114129 - DNA, 16 bp, H. sapiens
ggcagatcacctgagc

SEQ ID NO: 114130 - DNA, 18 bp, H. sapiens
ggcagatcacctgaggct

SEQ ID NO: 114131 - DNA, 17 bp, H. sapiens
ggcagatcacctgaggt

SEQ ID NO: 114132 - DNA, 16 bp, H. sapiens
ggcagatcacctgggg

SEQ ID NO: 114133 - DNA, 19 bp, H. sapiens
ggcagatcacgaggtcaga

SEQ ID NO: 114134 - DNA, 16 bp, H. sapiens
ggcagatcacttgagt

SEQ ID NO: 114135 - DNA, 17 bp, H. sapiens
ggcagatcagctgaggt

SEQ ID NO: 114136 - DNA, 17 bp, H. sapiens
ggcagatcatgaggtcg

SEQ ID NO: 114137 - DNA, 16 bp, H. sapiens
ggcagatcttttgagg

SEQ ID NO: 114138 - DNA, 16 bp, H. sapiens
ggcagatgacctgagg

SEQ ID NO: 114139 - DNA, 16 bp, H. sapiens
ggcagatgaggcaaaa

SEQ ID NO: 114140 - DNA, 16 bp, H. sapiens
ggcagatgggaaattg

SEQ ID NO: 114141 - DNA, 16 bp, H. sapiens
ggcagatgggaagctg

SEQ ID NO: 114142 - DNA, 16 bp, H. sapiens
ggcagattccccaggt

SEQ ID NO: 114143 - DNA, 16 bp, H. sapiens
ggcagcaagaaggatg

SEQ ID NO: 114144 - DNA, 16 bp, H. sapiens
ggcagcaagagagaaa

SEQ ID NO: 114145 - DNA, 16 bp, H. sapiens
ggcagcaatactgctc

SEQ ID NO: 114146 - DNA, 67 bp, H. sapiens
ggcagcaatactgctttgtaaagcattgagatgtttatgtgtatgcatatctaaaagcacagcactt

SEQ ID NO: 114147 - DNA, 16 bp, H. sapiens
ggcagcacagcccagg

SEQ ID NO: 114148 - DNA, 16 bp, H. sapiens
ggcagcaccaagccat

SEQ ID NO: 114149 - DNA, 16 bp, H. sapiens
ggcagcagaaaggaga

SEQ ID NO: 114150 - DNA, 16 bp, H. sapiens
ggcagcagaacgagac

SEQ ID NO: 114151 - DNA, 16 bp, H. sapiens
ggcagcagagggagac

SEQ ID NO: 114152 - DNA, 16 bp, H. sapiens
ggcagcagcaacagca

SEQ ID NO: 114153 - DNA, 16 bp, H. sapiens
ggcagcagcacagtcc

SEQ ID NO: 114154 - DNA, 16 bp, H. sapiens
ggcagcagcagcaaca

SEQ ID NO: 114155 - DNA, 16 bp, H. sapiens
ggcagcagcaggagaa

SEQ ID NO: 114156 - DNA, 16 bp, H. sapiens
ggcagcagccagcact

SEQ ID NO: 114157 - DNA, 16 bp, H. sapiens
ggcagcagccatctct

SEQ ID NO: 114158 - DNA, 16 bp, H. sapiens
ggcagcagccctagtc

SEQ ID NO: 114159 - DNA, 16 bp, H. sapiens
ggcagcagctgcagcc

SEQ ID NO: 114160 - DNA, 16 bp, H. sapiens
ggcagcagctgcctgg

SEQ ID NO: 114161 - DNA, 16 bp, H. sapiens
ggcagcagctgctgca

SEQ ID NO: 114162 - DNA, 16 bp, H. sapiens
ggcagcaggaacagca

SEQ ID NO: 114163 - DNA, 16 bp, H. sapiens
ggcagcaggaagcaga

SEQ ID NO: 114164 - DNA, 16 bp, H. sapiens
ggcagcaggaaggaga

SEQ ID NO: 114165 - DNA, 16 bp, H. sapiens
ggcagcaggaggtggg

SEQ ID NO: 114166 - DNA, 16 bp, H. sapiens
ggcagcaggcaaagtg

SEQ ID NO: 114167 - DNA, 16 bp, H. sapiens
ggcagcaggctggaca

SEQ ID NO: 114168 - DNA, 16 bp, H. sapiens
ggcagcagggcagagg

SEQ ID NO: 114169 - DNA, 16 bp, H. sapiens
ggcagcagggccctgg

SEQ ID NO: 114170 - DNA, 16 bp, H. sapiens
ggcagcagtccccaac

SEQ ID NO: 114171 - DNA, 16 bp, H. sapiens
ggcagcatccctggcc

SEQ ID NO: 114172 - DNA, 16 bp, H. sapiens
ggcagcatgggcagga

SEQ ID NO: 114173 - DNA, 16 bp, H. sapiens
ggcagcattcaccaca

SEQ ID NO: 114174 - DNA, 16 bp, H. sapiens
ggcagccaaggcagag

SEQ ID NO: 114175 - DNA, 16 bp, H. sapiens
ggcagccatgaggact

SEQ ID NO: 114176 - DNA, 16 bp, H. sapiens
ggcagcccagagggag

SEQ ID NO: 114177 - DNA, 16 bp, H. sapiens
ggcagccccagccctg

SEQ ID NO: 114178 - DNA, 16 bp, H. sapiens
ggcagcccctcccagc

SEQ ID NO: 114179 - DNA, 16 bp, H. sapiens
ggcagcccctccccag

SEQ ID NO: 114180 - DNA, 16 bp, H. sapiens
ggcagcccctgccctg

SEQ ID NO: 114181 - DNA, 16 bp, H. sapiens
ggcagccccttcctca

SEQ ID NO: 114182 - DNA, 16 bp, H. sapiens
ggcagccctgcccctg

SEQ ID NO: 114183 - DNA, 16 bp, H. sapiens
ggcagccctgctctgc

SEQ ID NO: 114184 - DNA, 16 bp, H. sapiens
ggcagccctgggaaac

SEQ ID NO: 114185 - DNA, 16 bp, H. sapiens
ggcagccgccccatcc

SEQ ID NO: 114186 - DNA, 16 bp, H. sapiens
ggcagccgggaagagg

SEQ ID NO: 114187 - DNA, 16 bp, H. sapiens
ggcagcctcaggaaac

SEQ ID NO: 114188 - DNA, 16 bp, H. sapiens
ggcagcctgccccttc

SEQ ID NO: 114189 - DNA, 16 bp, H. sapiens
ggcagcctggccccag

SEQ ID NO: 114190 - DNA, 16 bp, H. sapiens
ggcagcctggctctgg

SEQ ID NO: 114191 - DNA, 16 bp, H. sapiens
ggcagcggcagcggca

SEQ ID NO: 114192 - DNA, 16 bp, H. sapiens
ggcagcgtgtgcctgt

SEQ ID NO: 114193 - DNA, 16 bp, H. sapiens
ggcagctatgctcacc

SEQ ID NO: 114194 - DNA, 16 bp, H. sapiens
ggcagctccactcctg

SEQ ID NO: 114195 - DNA, 16 bp, H. sapiens
ggcagctcctctctgt

SEQ ID NO: 114196 - DNA, 16 bp, H. sapiens
ggcagctctgctcctg

SEQ ID NO: 114197 - DNA, 16 bp, H. sapiens
ggcagctctggccctg

SEQ ID NO: 114198 - DNA, 16 bp, H. sapiens
ggcagctgaggcagga

SEQ ID NO: 114199 - DNA, 16 bp, H. sapiens
ggcagctgaggcccgg

SEQ ID NO: 114200 - DNA, 16 bp, H. sapiens
ggcagctgcagctgca

SEQ ID NO: 114201 - DNA, 16 bp, H. sapiens
ggcagctgcagtgatg

SEQ ID NO: 114202 - DNA, 16 bp, H. sapiens
ggcagctgcatctggt

SEQ ID NO: 114203 - DNA, 16 bp, H. sapiens
ggcagctgctgggcag

SEQ ID NO: 114204 - DNA, 16 bp, H. sapiens
ggcagctggccgggcg

SEQ ID NO: 114205 - DNA, 17 bp, H. sapiens
ggcagctggccgggcgg

SEQ ID NO: 114206 - DNA, 16 bp, H. sapiens
ggcagctgggcagagg

SEQ ID NO: 114207 - DNA, 16 bp, H. sapiens
ggcagctgggcctggg

SEQ ID NO: 114208 - DNA, 16 bp, H. sapiens
ggcagctggtgaccag

SEQ ID NO: 114209 - DNA, 16 bp, H. sapiens
ggcagctgtggctgtg

SEQ ID NO: 114210 - DNA, 16 bp, H. sapiens
ggcagctgtggtgatc

SEQ ID NO: 114211 - DNA, 16 bp, H. sapiens
ggcaggaaaacaggaa

SEQ ID NO: 114212 - DNA, 16 bp, H. sapiens
ggcaggaaaagaccaa

SEQ ID NO: 114213 - DNA, 16 bp, H. sapiens
ggcaggaaatgtacaa

SEQ ID NO: 114214 - DNA, 16 bp, H. sapiens
ggcaggaagaacctca

SEQ ID NO: 114215 - DNA, 16 bp, H. sapiens
ggcaggagaaagaatg

SEQ ID NO: 114216 - DNA, 16 bp, H. sapiens
ggcaggagaaccactt

SEQ ID NO: 114217 - DNA, 16 bp, H. sapiens
ggcaggagaagatgaa

SEQ ID NO: 114218 - DNA, 16 bp, H. sapiens
ggcaggagaagatgga

SEQ ID NO: 114219 - DNA, 16 bp, H. sapiens
ggcaggagaagctctt

SEQ ID NO: 114220 - DNA, 16 bp, H. sapiens
ggcaggagagagagca

SEQ ID NO: 114221 - DNA, 16 bp, H. sapiens
ggcaggagaggccagg

SEQ ID NO: 114222 - DNA, 16 bp, H. sapiens
ggcaggagaggctggg

SEQ ID NO: 114223 - DNA, 16 bp, H. sapiens
ggcaggagcagctggg

SEQ ID NO: 114224 - DNA, 16 bp, H. sapiens
ggcaggagcaggaaca

SEQ ID NO: 114225 - DNA, 16 bp, H. sapiens
ggcaggagcaggagaa

SEQ ID NO: 114226 - DNA, 16 bp, H. sapiens
ggcaggagccactgcg

SEQ ID NO: 114227 - DNA, 16 bp, H. sapiens
ggcaggagccactgtg

SEQ ID NO: 114228 - DNA, 16 bp, H. sapiens
ggcaggagccccgccc

SEQ ID NO: 114229 - DNA, 16 bp, H. sapiens
ggcaggagctgagcct

SEQ ID NO: 114230 - DNA, 16 bp, H. sapiens
ggcaggagctgggcct

SEQ ID NO: 114231 - DNA, 16 bp, H. sapiens
ggcaggagctgggtct

SEQ ID NO: 114232 - DNA, 16 bp, H. sapiens
ggcaggaggactactt

SEQ ID NO: 114233 - DNA, 16 bp, H. sapiens
ggcaggaggagcctgg

SEQ ID NO: 114234 - DNA, 16 bp, H. sapiens
ggcaggaggagctggg

SEQ ID NO: 114235 - DNA, 16 bp, H. sapiens
ggcaggaggatcactt

SEQ ID NO: 114236 - DNA, 16 bp, H. sapiens
ggcaggaggcaaagag

SEQ ID NO: 114237 - DNA, 16 bp, H. sapiens
ggcaggaggcctcagt

SEQ ID NO: 114238 - DNA, 16 bp, H. sapiens
ggcaggaggcttgctt

SEQ ID NO: 114239 - DNA, 16 bp, H. sapiens
ggcaggagggcagtgg

SEQ ID NO: 114240 - DNA, 16 bp, H. sapiens
ggcaggaggtgaagga

SEQ ID NO: 114241 - DNA, 16 bp, H. sapiens
ggcaggaggtggagct

SEQ ID NO: 114242 - DNA, 16 bp, H. sapiens
ggcaggaggttgcagt

SEQ ID NO: 114243 - DNA, 16 bp, H. sapiens
ggcaggagttcaagac

SEQ ID NO: 114244 - DNA, 17 bp, H. sapiens
ggcaggatctcggctca

SEQ ID NO: 114245 - DNA, 16 bp, H. sapiens
ggcaggatggtctcca

SEQ ID NO: 114246 - DNA, 16 bp, H. sapiens
ggcaggattccctctt

SEQ ID NO: 114247 - DNA, 16 bp, H. sapiens
ggcaggattttttttt

SEQ ID NO: 114248 - DNA, 16 bp, H. sapiens
ggcaggcaaagagaga

SEQ ID NO: 114249 - DNA, 16 bp, H. sapiens
ggcaggcaagacagca

SEQ ID NO: 114250 - DNA, 16 bp, H. sapiens
ggcaggcaagagagag

SEQ ID NO: 114251 - DNA, 16 bp, H. sapiens
ggcaggcaagagtgtg

SEQ ID NO: 114252 - DNA, 16 bp, H. sapiens
ggcaggcacggtggct

SEQ ID NO: 114253 - DNA, 16 bp, H. sapiens
ggcaggcagaggctgc

SEQ ID NO: 114254 - DNA, 16 bp, H. sapiens
ggcaggcagaggtggg

SEQ ID NO: 114255 - DNA, 16 bp, H. sapiens
ggcaggcagctccagg

SEQ ID NO: 114256 - DNA, 16 bp, H. sapiens
ggcaggcagctccatc

SEQ ID NO: 114257 - DNA, 16 bp, H. sapiens
ggcaggcagctgggag

SEQ ID NO: 114258 - DNA, 16 bp, H. sapiens
ggcaggcagctgtgca

SEQ ID NO: 114259 - DNA, 16 bp, H. sapiens
ggcaggcaggagcagg

SEQ ID NO: 114260 - DNA, 16 bp, H. sapiens
ggcaggcaggcagaga

SEQ ID NO: 114261 - DNA, 16 bp, H. sapiens
ggcaggcaggcaggag

SEQ ID NO: 114262 - DNA, 16 bp, H. sapiens
ggcaggcaggcaggcc

SEQ ID NO: 114263 - DNA, 16 bp, H. sapiens
ggcaggcaggcaggct

SEQ ID NO: 114264 - DNA, 16 bp, H. sapiens
ggcaggcaggcctggg

SEQ ID NO: 114265 - DNA, 16 bp, H. sapiens
ggcaggcaggggctgg

SEQ ID NO: 114266 - DNA, 16 bp, H. sapiens
ggcaggccaggcatgg

SEQ ID NO: 114267 - DNA, 16 bp, H. sapiens
ggcaggccaggcgcag

SEQ ID NO: 114268 - DNA, 16 bp, H. sapiens
ggcaggcccagaaaag

SEQ ID NO: 114269 - DNA, 16 bp, H. sapiens
ggcaggcccagctccc

SEQ ID NO: 114270 - DNA, 16 bp, H. sapiens
ggcaggcccagggctg

SEQ ID NO: 114271 - DNA, 16 bp, H. sapiens
ggcaggccccagtgtg

SEQ ID NO: 114272 - DNA, 16 bp, H. sapiens
ggcaggcccctgctcc

SEQ ID NO: 114273 - DNA, 16 bp, H. sapiens
ggcaggcctggcagtg

SEQ ID NO: 114274 - DNA, 16 bp, H. sapiens
ggcaggcctgggggtg

SEQ ID NO: 114275 - DNA, 16 bp, H. sapiens
ggcaggcctggtgctg

SEQ ID NO: 114276 - DNA, 16 bp, H. sapiens
ggcaggcggagcttgc

SEQ ID NO: 114277 - DNA, 16 bp, H. sapiens
ggcaggcggaggctgc

SEQ ID NO: 114278 - DNA, 16 bp, H. sapiens
ggcaggcgtccctgca

SEQ ID NO: 114279 - DNA, 16 bp, H. sapiens
ggcaggctgggcgtgg

SEQ ID NO: 114280 - DNA, 16 bp, H. sapiens
ggcagggaagtgggga

SEQ ID NO: 114281 - DNA, 16 bp, H. sapiens
ggcagggacacagcca

SEQ ID NO: 114282 - DNA, 16 bp, H. sapiens
ggcagggaccaggcag

SEQ ID NO: 114283 - DNA, 16 bp, H. sapiens
ggcagggactgtgtct

SEQ ID NO: 114284 - DNA, 16 bp, H. sapiens
ggcagggagagctgct

SEQ ID NO: 114285 - DNA, 16 bp, H. sapiens
ggcagggaggctgcag

SEQ ID NO: 114286 - DNA, 16 bp, H. sapiens
ggcagggaggctggag

SEQ ID NO: 114287 - DNA, 16 bp, H. sapiens
ggcagggaggtggcag

SEQ ID NO: 114288 - DNA, 16 bp, H. sapiens
ggcagggcaaggcagg

SEQ ID NO: 114289 - DNA, 16 bp, H. sapiens
ggcagggcacaggcag

SEQ ID NO: 114290 - DNA, 16 bp, H. sapiens
ggcagggcacggtggc

SEQ ID NO: 114291 - DNA, 16 bp, H. sapiens
ggcagggcagaggcac

SEQ ID NO: 114292 - DNA, 16 bp, H. sapiens
ggcagggcagccaggg

SEQ ID NO: 114293 - DNA, 16 bp, H. sapiens
ggcagggcaggcagag

SEQ ID NO: 114294 - DNA, 16 bp, H. sapiens
ggcagggcagggcagc

SEQ ID NO: 114295 - DNA, 16 bp, H. sapiens
ggcagggcagggccag

SEQ ID NO: 114296 - DNA, 16 bp, H. sapiens
ggcagggcagggtggc

SEQ ID NO: 114297 - DNA, 16 bp, H. sapiens
ggcagggccagctggc

SEQ ID NO: 114298 - DNA, 16 bp, H. sapiens
ggcagggccaggcagg

SEQ ID NO: 114299 - DNA, 16 bp, H. sapiens
ggcagggccaggctgg

SEQ ID NO: 114300 - DNA, 16 bp, H. sapiens
ggcagggccagggtgg

SEQ ID NO: 114301 - DNA, 16 bp, H. sapiens
ggcagggcccaggcag

SEQ ID NO: 114302 - DNA, 16 bp, H. sapiens
ggcagggcccagggcc

SEQ ID NO: 114303 - DNA, 16 bp, H. sapiens
ggcagggcccagggtc

SEQ ID NO: 114304 - DNA, 16 bp, H. sapiens
ggcagggcctgagctg

SEQ ID NO: 114305 - DNA, 16 bp, H. sapiens
ggcagggcctggaggg

SEQ ID NO: 114306 - DNA, 16 bp, H. sapiens
ggcagggcctgggcag

SEQ ID NO: 114307 - DNA, 16 bp, H. sapiens
ggcagggctcagcagg

SEQ ID NO: 114308 - DNA, 21 bp, H. sapiens
ggcagggctcaggacctgcag

SEQ ID NO: 114309 - DNA, 16 bp, H. sapiens
ggcagggctgggcagg

SEQ ID NO: 114310 - DNA, 16 bp, H. sapiens
ggcagggctgggcctc

SEQ ID NO: 114311 - DNA, 16 bp, H. sapiens
ggcagggctgggcctg

SEQ ID NO: 114312 - DNA, 16 bp, H. sapiens
ggcagggctggtggtg

SEQ ID NO: 114313 - DNA, 16 bp, H. sapiens
ggcagggcttgctgtg

SEQ ID NO: 114314 - DNA, 16 bp, H. sapiens
ggcagggcttgggacc

SEQ ID NO: 114315 - DNA, 16 bp, H. sapiens
ggcaggggaatggctt

SEQ ID NO: 114316 - DNA, 16 bp, H. sapiens
ggcaggggagtgggaa

SEQ ID NO: 114317 - DNA, 16 bp, H. sapiens
ggcaggggcagcagtg

SEQ ID NO: 114318 - DNA, 16 bp, H. sapiens
ggcaggggctgcagtg

SEQ ID NO: 114319 - DNA, 16 bp, H. sapiens
ggcaggggctgggctg

SEQ ID NO: 114320 - DNA, 16 bp, H. sapiens
ggcagggggcagtggc

SEQ ID NO: 114321 - DNA, 16 bp, H. sapiens
ggcagggggctgcagg

SEQ ID NO: 114322 - DNA, 16 bp, H. sapiens
ggcagggggctggcat

SEQ ID NO: 114323 - DNA, 16 bp, H. sapiens
ggcaggggtgtccaat

SEQ ID NO: 114324 - DNA, 16 bp, H. sapiens
ggcagggtacagtggc

SEQ ID NO: 114325 - DNA, 16 bp, H. sapiens
ggcagggtctccttct

SEQ ID NO: 114326 - DNA, 16 bp, H. sapiens
ggcagggtggctcagg

SEQ ID NO: 114327 - DNA, 16 bp, H. sapiens
ggcagggtggctcatg

SEQ ID NO: 114328 - DNA, 16 bp, H. sapiens
ggcagggtgggcagct

SEQ ID NO: 114329 - DNA, 16 bp, H. sapiens
ggcagggtggtgtgca

SEQ ID NO: 114330 - DNA, 16 bp, H. sapiens
ggcagggtttgcagtg

SEQ ID NO: 114331 - DNA, 16 bp, H. sapiens
ggcaggtgaattacct

SEQ ID NO: 114332 - DNA, 16 bp, H. sapiens
ggcaggtgcagaggcc

SEQ ID NO: 114333 - DNA, 16 bp, H. sapiens
ggcaggtggaggctgc

SEQ ID NO: 114334 - DNA, 16 bp, H. sapiens
ggcaggtggatcacat

SEQ ID NO: 114335 - DNA, 16 bp, H. sapiens
ggcaggtggatctttt

SEQ ID NO: 114336 - DNA, 16 bp, H. sapiens
ggcaggtggattacat

SEQ ID NO: 114337 - DNA, 16 bp, H. sapiens
ggcaggtggctccagg

SEQ ID NO: 114338 - DNA, 16 bp, H. sapiens
ggcaggtgtccctgca

SEQ ID NO: 114339 - DNA, 16 bp, H. sapiens
ggcaggtgtgtgcagg

SEQ ID NO: 114340 - DNA, 16 bp, H. sapiens
ggcaggtgtgtgtgtg

SEQ ID NO: 114341 - DNA, 16 bp, H. sapiens
ggcaggttcttgctct

SEQ ID NO: 114342 - DNA, 16 bp, H. sapiens
ggcagtaacttctggg

SEQ ID NO: 114343 - DNA, 16 bp, H. sapiens
ggcagtagcagtggtg

SEQ ID NO: 114344 - DNA, 16 bp, H. sapiens
ggcagtaggcaaagag

SEQ ID NO: 114345 - DNA, 16 bp, H. sapiens
ggcagtcagagagaaa

SEQ ID NO: 114346 - DNA, 16 bp, H. sapiens
ggcagtccagctccag

SEQ ID NO: 114347 - DNA, 16 bp, H. sapiens
ggcagtcctcagagcc

SEQ ID NO: 114348 - DNA, 16 bp, H. sapiens
ggcagtcctggtggtg

SEQ ID NO: 114349 - DNA, 16 bp, H. sapiens
ggcagtctgactccag

SEQ ID NO: 114350 - DNA, 16 bp, H. sapiens
ggcagtgacatgatca

SEQ ID NO: 114351 - DNA, 16 bp, H. sapiens
ggcagtgagccaagat

SEQ ID NO: 114352 - DNA, 16 bp, H. sapiens
ggcagtgagctgagat

SEQ ID NO: 114353 - DNA, 16 bp, H. sapiens
ggcagtgagctgtgat

SEQ ID NO: 114354 - DNA, 16 bp, H. sapiens
ggcagtgaggcaggag

SEQ ID NO: 114355 - DNA, 16 bp, H. sapiens
ggcagtgaggctgggg

SEQ ID NO: 114356 - DNA, 16 bp, H. sapiens
ggcagtgatgatgagc

SEQ ID NO: 114357 - DNA, 16 bp, H. sapiens
ggcagtgatgatggtg

SEQ ID NO: 114358 - DNA, 16 bp, H. sapiens
ggcagtgcagagggga

SEQ ID NO: 114359 - DNA, 16 bp, H. sapiens
ggcagtgcagaggtca

SEQ ID NO: 114360 - DNA, 16 bp, H. sapiens
ggcagtgccccactgg

SEQ ID NO: 114361 - DNA, 16 bp, H. sapiens
ggcagtgcctagtgga

SEQ ID NO: 114362 - DNA, 16 bp, H. sapiens
ggcagtgctccagtgg

SEQ ID NO: 114363 - DNA, 16 bp, H. sapiens
ggcagtgctgacatgc

SEQ ID NO: 114364 - DNA, 16 bp, H. sapiens
ggcagtggcagagggg

SEQ ID NO: 114365 - DNA, 16 bp, H. sapiens
ggcagtggcagcagca

SEQ ID NO: 114366 - DNA, 16 bp, H. sapiens
ggcagtggcagtgggg

SEQ ID NO: 114367 - DNA, 16 bp, H. sapiens
ggcagtggctgctcca

SEQ ID NO: 114368 - DNA, 16 bp, H. sapiens
ggcagtgggaacagca

SEQ ID NO: 114369 - DNA, 16 bp, H. sapiens
ggcagtgggcagggcc

SEQ ID NO: 114370 - DNA, 16 bp, H. sapiens
ggcagtggggaggaag

SEQ ID NO: 114371 - DNA, 16 bp, H. sapiens
ggcagtggggccctgg

SEQ ID NO: 114372 - DNA, 16 bp, H. sapiens
ggcagtggtgatggtg

SEQ ID NO: 114373 - DNA, 16 bp, H. sapiens
ggcagtgtcccagtgg

SEQ ID NO: 114374 - DNA, 16 bp, H. sapiens
ggcagtgtccccaccc

SEQ ID NO: 114375 - DNA, 16 bp, H. sapiens
ggcagtgtgctgagag

SEQ ID NO: 114376 - DNA, 16 bp, H. sapiens
ggcagtgtggaaggaa

SEQ ID NO: 114377 - DNA, 16 bp, H. sapiens
ggcagtgtgggctctt

SEQ ID NO: 114378 - DNA, 16 bp, H. sapiens
ggcagtttcccacatg

SEQ ID NO: 114379 - DNA, 16 bp, H. sapiens
ggcagtttccctcctc

SEQ ID NO: 114380 - DNA, 16 bp, H. sapiens
ggcagtttctcaaaag

SEQ ID NO: 114381 - DNA, 16 bp, H. sapiens
ggcagtttcttacaaa

SEQ ID NO: 114382 - DNA, 16 bp, H. sapiens
ggcagtttttaaaaat

SEQ ID NO: 114383 - DNA, 16 bp, H. sapiens
ggcataaaaacagaaa

SEQ ID NO: 114384 - DNA, 16 bp, H. sapiens
ggcataaaagtttgga

SEQ ID NO: 114385 - DNA, 16 bp, H. sapiens
ggcataacagaaggct

SEQ ID NO: 114386 - DNA, 16 bp, H. sapiens
ggcataatggcacaca

SEQ ID NO: 114387 - DNA, 16 bp, H. sapiens
ggcatcaaaagccaaa

SEQ ID NO: 114388 - DNA, 16 bp, H. sapiens
ggcatcacactacctc

SEQ ID NO: 114389 - DNA, 16 bp, H. sapiens
ggcatcaccattcagg

SEQ ID NO: 114390 - DNA, 16 bp, H. sapiens
ggcatcacccctcccc

SEQ ID NO: 114391 - DNA, 16 bp, H. sapiens
ggcatcacctgggagc

SEQ ID NO: 114392 - DNA, 16 bp, H. sapiens
ggcatcacggtcctac

SEQ ID NO: 114393 - DNA, 16 bp, H. sapiens
ggcatccagctccatc

SEQ ID NO: 114394 - DNA, 16 bp, H. sapiens
ggcatccaggaagaat

SEQ ID NO: 114395 - DNA, 16 bp, H. sapiens
ggcatccaggagtttc

SEQ ID NO: 114396 - DNA, 16 bp, H. sapiens
ggcatcccagagtgct

SEQ ID NO: 114397 - DNA, 16 bp, H. sapiens
ggcatccctggagtct

SEQ ID NO: 114398 - DNA, 16 bp, H. sapiens
ggcatccctgtgctct

SEQ ID NO: 114399 - DNA, 16 bp, H. sapiens
ggcatccttgtcttgt

SEQ ID NO: 114400 - DNA, 16 bp, H. sapiens
ggcatcgctaacgagg

SEQ ID NO: 114401 - DNA, 16 bp, H. sapiens
ggcatcgtggcaggca

SEQ ID NO: 114402 - DNA, 16 bp, H. sapiens
ggcatcgtggtgggtg

SEQ ID NO: 114403 - DNA, 16 bp, H. sapiens
ggcatctgctgggctt

SEQ ID NO: 114404 - DNA, 16 bp, H. sapiens
ggcatctggcaagggc

SEQ ID NO: 114405 - DNA, 16 bp, H. sapiens
ggcatgaacatgggag

SEQ ID NO: 114406 - DNA, 16 bp, H. sapiens
ggcatgaactaccatg

SEQ ID NO: 114407 - DNA, 16 bp, H. sapiens
ggcatgaactactgtg

SEQ ID NO: 114408 - DNA, 16 bp, H. sapiens
ggcatgagaaccactt

SEQ ID NO: 114409 - DNA, 16 bp, H. sapiens
ggcatgagccacctgc

SEQ ID NO: 114410 - DNA, 16 bp, H. sapiens
ggcatgagccactctg

SEQ ID NO: 114411 - DNA, 16 bp, H. sapiens
ggcatgagcctgtggt

SEQ ID NO: 114412 - DNA, 16 bp, H. sapiens
ggcatgaggcccagtc

SEQ ID NO: 114413 - DNA, 16 bp, H. sapiens
ggcatgagtgactgtg

SEQ ID NO: 114414 - DNA, 16 bp, H. sapiens
ggcatgagtgcagtgg

SEQ ID NO: 114415 - DNA, 16 bp, H. sapiens
ggcatgatggcaggtg

SEQ ID NO: 114416 - DNA, 16 bp, H. sapiens
ggcatgatggcgcatg

SEQ ID NO: 114417 - DNA, 16 bp, H. sapiens
ggcatgatggctcaca

SEQ ID NO: 114418 - DNA, 16 bp, H. sapiens
ggcatgcaccaccacc

SEQ ID NO: 114419 - DNA, 16 bp, H. sapiens
ggcatgcaccactacg

SEQ ID NO: 114420 - DNA, 16 bp, H. sapiens
ggcatgccagaggtct

SEQ ID NO: 114421 - DNA, 16 bp, H. sapiens
ggcatgcctggtggtg

SEQ ID NO: 114422 - DNA, 16 bp, H. sapiens
ggcatgcgccaccatc

SEQ ID NO: 114423 - DNA, 17 bp, H. sapiens
ggcatgcgcctatagtc

SEQ ID NO: 114424 - DNA, 16 bp, H. sapiens
ggcatggaggtgggtg

SEQ ID NO: 114425 - DNA, 16 bp, H. sapiens
ggcatggagtggggtg

SEQ ID NO: 114426 - DNA, 21 bp, H. sapiens
ggcatggcgggctgcaggtcc

SEQ ID NO: 114427 - DNA, 16 bp, H. sapiens
ggcatggctgtgtttc

SEQ ID NO: 114428 - DNA, 16 bp, H. sapiens
ggcatggtagcacaca

SEQ ID NO: 114429 - DNA, 16 bp, H. sapiens
ggcatggtagctcaca

SEQ ID NO: 114430 - DNA, 17 bp, H. sapiens
ggcatggtcaaagactt

SEQ ID NO: 114431 - DNA, 16 bp, H. sapiens
ggcatggtgaaacccc

SEQ ID NO: 114432 - DNA, 16 bp, H. sapiens
ggcatggtgacccatg

SEQ ID NO: 114433 - DNA, 16 bp, H. sapiens
ggcatggtgctgggca

SEQ ID NO: 114434 - DNA, 16 bp, H. sapiens
ggcatggtggagcaca

SEQ ID NO: 114435 - DNA, 16 bp, H. sapiens
ggcatggtggcagctg

SEQ ID NO: 114436 - DNA, 16 bp, H. sapiens
ggcatggtggcatgtg

SEQ ID NO: 114437 - DNA, 16 bp, H. sapiens
ggcatggtggcccaca

SEQ ID NO: 114438 - DNA, 16 bp, H. sapiens
ggcatggtggcctgta

SEQ ID NO: 114439 - DNA, 16 bp, H. sapiens
ggcatggtggtaggtg

SEQ ID NO: 114440 - DNA, 16 bp, H. sapiens
ggcatggtggtgctca

SEQ ID NO: 114441 - DNA, 18 bp, H. sapiens
ggcatggtgtcaggtgcc

SEQ ID NO: 114442 - DNA, 16 bp, H. sapiens
ggcatgtatctgtagt

SEQ ID NO: 114443 - DNA, 16 bp, H. sapiens
ggcatgtgccaccaat

SEQ ID NO: 114444 - DNA, 16 bp, H. sapiens
ggcatgtgcctttagt

SEQ ID NO: 114445 - DNA, 16 bp, H. sapiens
ggcatgtggcaccaca

SEQ ID NO: 114446 - DNA, 16 bp, H. sapiens
ggcatgttcctgctgc

SEQ ID NO: 114447 - DNA, 16 bp, H. sapiens
ggcatgttggtgggtg

SEQ ID NO: 114448 - DNA, 16 bp, H. sapiens
ggcattaattagattc

SEQ ID NO: 114449 - DNA, 16 bp, H. sapiens
ggcattaccattcaag

SEQ ID NO: 114450 - DNA, 16 bp, H. sapiens
ggcattcagtaaatgt

SEQ ID NO: 114451 - DNA, 16 bp, H. sapiens
ggcattccagcctggg

SEQ ID NO: 114452 - DNA, 16 bp, H. sapiens
ggcattcccaattcag

SEQ ID NO: 114453 - DNA, 16 bp, H. sapiens
ggcattcctccaggac

SEQ ID NO: 114454 - DNA, 16 bp, H. sapiens
ggcattcctgagaaag

SEQ ID NO: 114455 - DNA, 16 bp, H. sapiens
ggcattctggttttgg

SEQ ID NO: 114456 - DNA, 16 bp, H. sapiens
ggcattgctggatcat

SEQ ID NO: 114457 - DNA, 16 bp, H. sapiens
ggcattgtaattgtga

SEQ ID NO: 114458 - DNA, 16 bp, H. sapiens
ggcattgtggcaggcg

SEQ ID NO: 114459 - DNA, 16 bp, H. sapiens
ggcattgtggctcacg

SEQ ID NO: 114460 - DNA, 16 bp, H. sapiens
ggcattgtggtgggtg

SEQ ID NO: 114461 - DNA, 16 bp, H. sapiens
ggcattgtggttcatg

SEQ ID NO: 114462 - DNA, 16 bp, H. sapiens
ggcattgttgtaaaca

SEQ ID NO: 114463 - DNA, 16 bp, H. sapiens
ggcatttcagagatct

SEQ ID NO: 114464 - DNA, 16 bp, H. sapiens
ggcatttccaaacatc

SEQ ID NO: 114465 - DNA, 16 bp, H. sapiens
ggcatttcccctgctc

SEQ ID NO: 114466 - DNA, 16 bp, H. sapiens
ggcatttgccttattt

SEQ ID NO: 114467 - DNA, 16 bp, H. sapiens
ggcattttaagcagat

SEQ ID NO: 114468 - DNA, 16 bp, H. sapiens
ggcattttattttatt

SEQ ID NO: 114469 - DNA, 16 bp, H. sapiens
ggcattttgtttgttt

SEQ ID NO: 114470 - DNA, 16 bp, H. sapiens
ggcatttttatacatc

SEQ ID NO: 114471 - DNA, 16 bp, H. sapiens
ggccaaaaagcatatg

SEQ ID NO: 114472 - DNA, 16 bp, H. sapiens
ggccaaaatcaacagc

SEQ ID NO: 114473 - DNA, 16 bp, H. sapiens
ggccaaaatgaagagg

SEQ ID NO: 114474 - DNA, 16 bp, H. sapiens
ggccaaagcaggcaga

SEQ ID NO: 114475 - DNA, 16 bp, H. sapiens
ggccaaaggaacaact

SEQ ID NO: 114476 - DNA, 16 bp, H. sapiens
ggccaaaggcctgaaa

SEQ ID NO: 114477 - DNA, 16 bp, H. sapiens
ggccaaatccagccca

SEQ ID NO: 114478 - DNA, 16 bp, H. sapiens
ggccaaatgggagagt

SEQ ID NO: 114479 - DNA, 16 bp, H. sapiens
ggccaacaaacgtatg

SEQ ID NO: 114480 - DNA, 16 bp, H. sapiens
ggccaacaaggtgaag

SEQ ID NO: 114481 - DNA, 16 bp, H. sapiens
ggccaacacggtgaag

SEQ ID NO: 114482 - DNA, 16 bp, H. sapiens
ggccaacaggcatatg

SEQ ID NO: 114483 - DNA, 16 bp, H. sapiens
ggccaacatcattctg

SEQ ID NO: 114484 - DNA, 17 bp, H. sapiens
ggccaacgcgggtggat

SEQ ID NO: 114485 - DNA, 16 bp, H. sapiens
ggccaacgtgatgaaa

SEQ ID NO: 114486 - DNA, 16 bp, H. sapiens
ggccaacgtggggaaa

SEQ ID NO: 114487 - DNA, 16 bp, H. sapiens
ggccaactttttgtat

SEQ ID NO: 114488 - DNA, 16 bp, H. sapiens
ggccaagaattttcca

SEQ ID NO: 114489 - DNA, 16 bp, H. sapiens
ggccaagacagatgga

SEQ ID NO: 114490 - DNA, 16 bp, H. sapiens
ggccaagacaggcgga

SEQ ID NO: 114491 - DNA, 16 bp, H. sapiens
ggccaagacaggtgga

SEQ ID NO: 114492 - DNA, 16 bp, H. sapiens
ggccaagacgggagga

SEQ ID NO: 114493 - DNA, 16 bp, H. sapiens
ggccaagagagaagac

SEQ ID NO: 114494 - DNA, 16 bp, H. sapiens
ggccaagaggcaaaat

SEQ ID NO: 114495 - DNA, 16 bp, H. sapiens
ggccaagagggtgaaa

SEQ ID NO: 114496 - DNA, 16 bp, H. sapiens
ggccaagatgatgaaa

SEQ ID NO: 114497 - DNA, 16 bp, H. sapiens
ggccaagatgatgaag

SEQ ID NO: 114498 - DNA, 16 bp, H. sapiens
ggccaagcaggcagat

SEQ ID NO: 114499 - DNA, 16 bp, H. sapiens
ggccaagcagggagga

SEQ ID NO: 114500 - DNA, 16 bp, H. sapiens
ggccaagcatggtggc

SEQ ID NO: 114501 - DNA, 16 bp, H. sapiens
ggccaagcgtggtggt

SEQ ID NO: 114502 - DNA, 16 bp, H. sapiens
ggccaagctggcctcg

SEQ ID NO: 114503 - DNA, 16 bp, H. sapiens
ggccaagctggtcttg

SEQ ID NO: 114504 - DNA, 16 bp, H. sapiens
ggccaagctgttcttg

SEQ ID NO: 114505 - DNA, 16 bp, H. sapiens
ggccaaggaaggaaga

SEQ ID NO: 114506 - DNA, 16 bp, H. sapiens
ggccaaggaaggagga

SEQ ID NO: 114507 - DNA, 16 bp, H. sapiens
ggccaaggagacccca

SEQ ID NO: 114508 - DNA, 16 bp, H. sapiens
ggccaaggagagtgga

SEQ ID NO: 114509 - DNA, 16 bp, H. sapiens
ggccaaggagggagaa

SEQ ID NO: 114510 - DNA, 16 bp, H. sapiens
ggccaaggcagaagaa

SEQ ID NO: 114511 - DNA, 16 bp, H. sapiens
ggccaaggcagaggga

SEQ ID NO: 114512 - DNA, 16 bp, H. sapiens
ggccaaggcaggaagg

SEQ ID NO: 114513 - DNA, 16 bp, H. sapiens
ggccaaggcaggaggg

SEQ ID NO: 114514 - DNA, 16 bp, H. sapiens
ggccaaggcaggcagc

SEQ ID NO: 114515 - DNA, 16 bp, H. sapiens
ggccaaggcaggggga

SEQ ID NO: 114516 - DNA, 16 bp, H. sapiens
ggccaaggccagagcc

SEQ ID NO: 114517 - DNA, 16 bp, H. sapiens
ggccaaggccagagct

SEQ ID NO: 114518 - DNA, 16 bp, H. sapiens
ggccaaggcggctgga

SEQ ID NO: 114519 - DNA, 18 bp, H. sapiens
ggccaaggcgggcagatg

SEQ ID NO: 114520 - DNA, 19 bp, H. sapiens
ggccaaggcgggcggatca

SEQ ID NO: 114521 - DNA, 17 bp, H. sapiens
ggccaaggcgtgtggat

SEQ ID NO: 114522 - DNA, 16 bp, H. sapiens
ggccaaggctggagga

SEQ ID NO: 114523 - DNA, 16 bp, H. sapiens
ggccaaggtgaaagga

SEQ ID NO: 114524 - DNA, 16 bp, H. sapiens
ggccaaggtgggagta

SEQ ID NO: 114525 - DNA, 16 bp, H. sapiens
ggccaaggtgggcagt

SEQ ID NO: 114526 - DNA, 16 bp, H. sapiens
ggccaaggtgggcggt

SEQ ID NO: 114527 - DNA, 16 bp, H. sapiens
ggccaaggtggggcag

SEQ ID NO: 114528 - DNA, 16 bp, H. sapiens
ggccaaggtgggggga

SEQ ID NO: 114529 - DNA, 16 bp, H. sapiens
ggccaaggtggggtgg

SEQ ID NO: 114530 - DNA, 21 bp, H. sapiens
ggccaatatcatactgaatgg

SEQ ID NO: 114531 - DNA, 16 bp, H. sapiens
ggccaatatggtgaca

SEQ ID NO: 114532 - DNA, 16 bp, H. sapiens
ggccaatggggttatg

SEQ ID NO: 114533 - DNA, 16 bp, H. sapiens
ggccaatgtggtgaag

SEQ ID NO: 114534 - DNA, 16 bp, H. sapiens
ggccaatgtggtgaga

SEQ ID NO: 114535 - DNA, 16 bp, H. sapiens
ggccaatgttttcttt

SEQ ID NO: 114536 - DNA, 16 bp, H. sapiens
ggccacaaggactgca

SEQ ID NO: 114537 - DNA, 16 bp, H. sapiens
ggccacaagggtgctt

SEQ ID NO: 114538 - DNA, 16 bp, H. sapiens
ggccacacagcaggag

SEQ ID NO: 114539 - DNA, 16 bp, H. sapiens
ggccacacagccagga

SEQ ID NO: 114540 - DNA, 16 bp, H. sapiens
ggccacacataaaata

SEQ ID NO: 114541 - DNA, 16 bp, H. sapiens
ggccacactggaagaa

SEQ ID NO: 114542 - DNA, 16 bp, H. sapiens
ggccacagaccagtac

SEQ ID NO: 114543 - DNA, 16 bp, H. sapiens
ggccacagacctgtac

SEQ ID NO: 114544 - DNA, 16 bp, H. sapiens
ggccacagagtgaaac

SEQ ID NO: 114545 - DNA, 16 bp, H. sapiens
ggccacagggagggga

SEQ ID NO: 114546 - DNA, 16 bp, H. sapiens
ggccacagtgcccaga

SEQ ID NO: 114547 - DNA, 16 bp, H. sapiens
ggccacagtggaagaa

SEQ ID NO: 114548 - DNA, 16 bp, H. sapiens
ggccacagtgtgtgat

SEQ ID NO: 114549 - DNA, 16 bp, H. sapiens
ggccacatgactcctg

SEQ ID NO: 114550 - DNA, 16 bp, H. sapiens
ggccaccaccactggg

SEQ ID NO: 114551 - DNA, 16 bp, H. sapiens
ggccaccacgcccagc

SEQ ID NO: 114552 - DNA, 16 bp, H. sapiens
ggccaccactgccatc

SEQ ID NO: 114553 - DNA, 16 bp, H. sapiens
ggccaccagagggcag

SEQ ID NO: 114554 - DNA, 16 bp, H. sapiens
ggccaccatgtctggc

SEQ ID NO: 114555 - DNA, 16 bp, H. sapiens
ggccaccgtgcctggc

SEQ ID NO: 114556 - DNA, 16 bp, H. sapiens
ggccacctcggcctcc

SEQ ID NO: 114557 - DNA, 16 bp, H. sapiens
ggccacctggaggatg

SEQ ID NO: 114558 - DNA, 16 bp, H. sapiens
ggccaccttctccctg

SEQ ID NO: 114559 - DNA, 16 bp, H. sapiens
ggccacgctggtctca

SEQ ID NO: 114560 - DNA, 16 bp, H. sapiens
ggccacgttggaagaa

SEQ ID NO: 114561 - DNA, 16 bp, H. sapiens
ggccactccagccagc

SEQ ID NO: 114562 - DNA, 16 bp, H. sapiens
ggccactgctgcagcc

SEQ ID NO: 114563 - DNA, 16 bp, H. sapiens
ggccactgtcctccag

SEQ ID NO: 114564 - DNA, 17 bp, H. sapiens
ggccactgtgcatgtgg

SEQ ID NO: 114565 - DNA, 16 bp, H. sapiens
ggccactgtgcccagc

SEQ ID NO: 114566 - DNA, 16 bp, H. sapiens
ggccactgtggccaga

SEQ ID NO: 114567 - DNA, 16 bp, H. sapiens
ggccagaacttctaac

SEQ ID NO: 114568 - DNA, 16 bp, H. sapiens
ggccagaagactcagc

SEQ ID NO: 114569 - DNA, 16 bp, H. sapiens
ggccagaagcctgaaa

SEQ ID NO: 114570 - DNA, 16 bp, H. sapiens
ggccagaagtggtggc

SEQ ID NO: 114571 - DNA, 16 bp, H. sapiens
ggccagagagtaaata

SEQ ID NO: 114572 - DNA, 16 bp, H. sapiens
ggccagagataagaac

SEQ ID NO: 114573 - DNA, 16 bp, H. sapiens
ggccagagcaggaaga

SEQ ID NO: 114574 - DNA, 16 bp, H. sapiens
ggccagagccagctcc

SEQ ID NO: 114575 - DNA, 16 bp, H. sapiens
ggccagaggggagccc

SEQ ID NO: 114576 - DNA, 16 bp, H. sapiens
ggccagaggtgctggg

SEQ ID NO: 114577 - DNA, 16 bp, H. sapiens
ggccagagtgcagcgg

SEQ ID NO: 114578 - DNA, 16 bp, H. sapiens
ggccagagtgcagtgg

SEQ ID NO: 114579 - DNA, 16 bp, H. sapiens
ggccagagtggacgcc

SEQ ID NO: 114580 - DNA, 16 bp, H. sapiens
ggccagagttccaggg

SEQ ID NO: 114581 - DNA, 16 bp, H. sapiens
ggccagatggtctctg

SEQ ID NO: 114582 - DNA, 16 bp, H. sapiens
ggccagcagagggcgc

SEQ ID NO: 114583 - DNA, 16 bp, H. sapiens
ggccagcaggagagag

SEQ ID NO: 114584 - DNA, 16 bp, H. sapiens
ggccagcagggccagc

SEQ ID NO: 114585 - DNA, 16 bp, H. sapiens
ggccagcatcaacctg

SEQ ID NO: 114586 - DNA, 16 bp, H. sapiens
ggccagcatcctcctg

SEQ ID NO: 114587 - DNA, 16 bp, H. sapiens
ggccagcatcttcctg

SEQ ID NO: 114588 - DNA, 16 bp, H. sapiens
ggccagcatgagttcc

SEQ ID NO: 114589 - DNA, 16 bp, H. sapiens
ggccagcccagccctg

SEQ ID NO: 114590 - DNA, 16 bp, H. sapiens
ggccagcccaggagcc

SEQ ID NO: 114591 - DNA, 16 bp, H. sapiens
ggccagccgccccttc

SEQ ID NO: 114592 - DNA, 16 bp, H. sapiens
ggccagcctcaggccc

SEQ ID NO: 114593 - DNA, 16 bp, H. sapiens
ggccagcctcatcctg

SEQ ID NO: 114594 - DNA, 16 bp, H. sapiens
ggccagcctgcctctg

SEQ ID NO: 114595 - DNA, 16 bp, H. sapiens
ggccagcctggccagc

SEQ ID NO: 114596 - DNA, 16 bp, H. sapiens
ggccagcctgggcagc

SEQ ID NO: 114597 - DNA, 16 bp, H. sapiens
ggccagcctgggcatc

SEQ ID NO: 114598 - DNA, 16 bp, H. sapiens
ggccagcctggtctcc

SEQ ID NO: 114599 - DNA, 16 bp, H. sapiens
ggccagcctgtccaac

SEQ ID NO: 114600 - DNA, 16 bp, H. sapiens
ggccagcggctgcgga

SEQ ID NO: 114601 - DNA, 16 bp, H. sapiens
ggccagcgtgagttcc

SEQ ID NO: 114602 - DNA, 16 bp, H. sapiens
ggccagctgccccgtc

SEQ ID NO: 114603 - DNA, 16 bp, H. sapiens
ggccaggagaggtggc

SEQ ID NO: 114604 - DNA, 16 bp, H. sapiens
ggccaggagctgctgg

SEQ ID NO: 114605 - DNA, 16 bp, H. sapiens
ggccaggagctggaga

SEQ ID NO: 114606 - DNA, 16 bp, H. sapiens
ggccaggaggcctggg

SEQ ID NO: 114607 - DNA, 16 bp, H. sapiens
ggccaggagtctgaga

SEQ ID NO: 114608 - DNA, 16 bp, H. sapiens
ggccaggatgatctca

SEQ ID NO: 114609 - DNA, 16 bp, H. sapiens
ggccaggatgggagga

SEQ ID NO: 114610 - DNA, 16 bp, H. sapiens
ggccaggatggtccca

SEQ ID NO: 114611 - DNA, 16 bp, H. sapiens
ggccaggcaagatggc

SEQ ID NO: 114612 - DNA, 16 bp, H. sapiens
ggccaggcaccgtggc

SEQ ID NO: 114613 - DNA, 16 bp, H. sapiens
ggccaggcagaggctg

SEQ ID NO: 114614 - DNA, 20 bp, H. sapiens
ggccaggcagaggggctcct

SEQ ID NO: 114615 - DNA, 16 bp, H. sapiens
ggccaggcaggccagg

SEQ ID NO: 114616 - DNA, 16 bp, H. sapiens
ggccaggcaggtcttg

SEQ ID NO: 114617 - DNA, 16 bp, H. sapiens
ggccaggcatggtggc

SEQ ID NO: 114618 - DNA, 16 bp, H. sapiens
ggccaggccagcccag

SEQ ID NO: 114619 - DNA, 16 bp, H. sapiens
ggccaggccaggcctc

SEQ ID NO: 114620 - DNA, 16 bp, H. sapiens
ggccaggccagggcag

SEQ ID NO: 114621 - DNA, 16 bp, H. sapiens
ggccaggccagggctg

SEQ ID NO: 114622 - DNA, 16 bp, H. sapiens
ggccaggcccaggatc

SEQ ID NO: 114623 - DNA, 16 bp, H. sapiens
ggccaggcccagggcc

SEQ ID NO: 114624 - DNA, 16 bp, H. sapiens
ggccaggcccagggct

SEQ ID NO: 114625 - DNA, 16 bp, H. sapiens
ggccaggcctgggggc

SEQ ID NO: 114626 - DNA, 16 bp, H. sapiens
ggccaggcgcagaggc

SEQ ID NO: 114627 - DNA, 16 bp, H. sapiens
ggccaggctaatcttg

SEQ ID NO: 114628 - DNA, 16 bp, H. sapiens
ggccaggctcctcccc

SEQ ID NO: 114629 - DNA, 16 bp, H. sapiens
ggccaggctctgagct

SEQ ID NO: 114630 - DNA, 16 bp, H. sapiens
ggccaggctgcctggg

SEQ ID NO: 114631 - DNA, 16 bp, H. sapiens
ggccaggctgctcctg

SEQ ID NO: 114632 - DNA, 17 bp, H. sapiens
ggccaggctggagtgca

SEQ ID NO: 114633 - DNA, 16 bp, H. sapiens
ggccaggctggccagg

SEQ ID NO: 114634 - DNA, 16 bp, H. sapiens
ggccaggctggggcca

SEQ ID NO: 114635 - DNA, 16 bp, H. sapiens
ggccaggctggggtgg

SEQ ID NO: 114636 - DNA, 16 bp, H. sapiens
ggccaggctggtccct

SEQ ID NO: 114637 - DNA, 16 bp, H. sapiens
ggccaggctggtctgc

SEQ ID NO: 114638 - DNA, 16 bp, H. sapiens
ggccagggaggcagag

SEQ ID NO: 114639 - DNA, 16 bp, H. sapiens
ggccagggaggctgct

SEQ ID NO: 114640 - DNA, 16 bp, H. sapiens
ggccagggatactgct

SEQ ID NO: 114641 - DNA, 16 bp, H. sapiens
ggccagggatgctgct

SEQ ID NO: 114642 - DNA, 16 bp, H. sapiens
ggccagggattctgct

SEQ ID NO: 114643 - DNA, 16 bp, H. sapiens
ggccagggcagggcag

SEQ ID NO: 114644 - DNA, 16 bp, H. sapiens
ggccagggcagggcca

SEQ ID NO: 114645 - DNA, 16 bp, H. sapiens
ggccagggcagtggct

SEQ ID NO: 114646 - DNA, 16 bp, H. sapiens
ggccagggccagggca

SEQ ID NO: 114647 - DNA, 16 bp, H. sapiens
ggccagggccagggct

SEQ ID NO: 114648 - DNA, 16 bp, H. sapiens
ggccagggcgggcaga

SEQ ID NO: 114649 - DNA, 16 bp, H. sapiens
ggccaggggcctgggc

SEQ ID NO: 114650 - DNA, 16 bp, H. sapiens
ggccaggggctgtggc

SEQ ID NO: 114651 - DNA, 16 bp, H. sapiens
ggccagggtctgtggg

SEQ ID NO: 114652 - DNA, 16 bp, H. sapiens
ggccagggtggaatga

SEQ ID NO: 114653 - DNA, 16 bp, H. sapiens
ggccagggtgggaaga

SEQ ID NO: 114654 - DNA, 16 bp, H. sapiens
ggccagggtggtggct

SEQ ID NO: 114655 - DNA, 16 bp, H. sapiens
ggccaggtacagtggc

SEQ ID NO: 114656 - DNA, 16 bp, H. sapiens
ggccaggtaccagaca

SEQ ID NO: 114657 - DNA, 19 bp, H. sapiens
ggccaggtacggtggctca

SEQ ID NO: 114658 - DNA, 16 bp, H. sapiens
ggccaggtcacctaca

SEQ ID NO: 114659 - DNA, 16 bp, H. sapiens
ggccaggtgcagcggc

SEQ ID NO: 114660 - DNA, 16 bp, H. sapiens
ggccaggtggggtggc

SEQ ID NO: 114661 - DNA, 16 bp, H. sapiens
ggccaggtgtggcggc

SEQ ID NO: 114662 - DNA, 25 bp, H. sapiens
ggccaggtgttccttgccctcattc

SEQ ID NO: 114663 - DNA, 16 bp, H. sapiens
ggccagtctcactcct

SEQ ID NO: 114664 - DNA, 16 bp, H. sapiens
ggccagtctctctttt

SEQ ID NO: 114665 - DNA, 16 bp, H. sapiens
ggccagtgatgatgaa

SEQ ID NO: 114666 - DNA, 16 bp, H. sapiens
ggccagtgcaggacag

SEQ ID NO: 114667 - DNA, 16 bp, H. sapiens
ggccagtgcaggagga

SEQ ID NO: 114668 - DNA, 16 bp, H. sapiens
ggccagtgctgagctg

SEQ ID NO: 114669 - DNA, 16 bp, H. sapiens
ggccagtgtggctaga

SEQ ID NO: 114670 - DNA, 16 bp, H. sapiens
ggccagtgtggctgca

SEQ ID NO: 114671 - DNA, 16 bp, H. sapiens
ggccagtgtggtggct

SEQ ID NO: 114672 - DNA, 16 bp, H. sapiens
ggccagtgtgtgtgtg

SEQ ID NO: 114673 - DNA, 16 bp, H. sapiens
ggccatattcaaagcc

SEQ ID NO: 114674 - DNA, 16 bp, H. sapiens
ggccatcaggcaggag

SEQ ID NO: 114675 - DNA, 16 bp, H. sapiens
ggccatcagggaaatg

SEQ ID NO: 114676 - DNA, 16 bp, H. sapiens
ggccatcatcctaagc

SEQ ID NO: 114677 - DNA, 16 bp, H. sapiens
ggccatctgcaagcca

SEQ ID NO: 114678 - DNA, 16 bp, H. sapiens
ggccatgcaggagccc

SEQ ID NO: 114679 - DNA, 16 bp, H. sapiens
ggccatgctccctcca

SEQ ID NO: 114680 - DNA, 17 bp, H. sapiens
ggccatggcaggtggat

SEQ ID NO: 114681 - DNA, 16 bp, H. sapiens
ggccatggcttcagag

SEQ ID NO: 114682 - DNA, 16 bp, H. sapiens
ggccattacataatgg

SEQ ID NO: 114683 - DNA, 16 bp, H. sapiens
ggccattatggaaaac

SEQ ID NO: 114684 - DNA, 16 bp, H. sapiens
ggccattctgactggc

SEQ ID NO: 114685 - DNA, 16 bp, H. sapiens
ggccattcttctgcct

SEQ ID NO: 114686 - DNA, 16 bp, H. sapiens
ggccattgcttcagag

SEQ ID NO: 114687 - DNA, 16 bp, H. sapiens
ggccatttgggcagac

SEQ ID NO: 114688 - DNA, 16 bp, H. sapiens
ggccatttgtatgcct

SEQ ID NO: 114689 - DNA, 16 bp, H. sapiens
ggccattttctttctt

SEQ ID NO: 114690 - DNA, 16 bp, H. sapiens
ggcccaaaggtgagta

SEQ ID NO: 114691 - DNA, 16 bp, H. sapiens
ggcccaaatagaacaa

SEQ ID NO: 114692 - DNA, 16 bp, H. sapiens
ggcccaagacaattct

SEQ ID NO: 114693 - DNA, 16 bp, H. sapiens
ggcccaagagatcctc

SEQ ID NO: 114694 - DNA, 16 bp, H. sapiens
ggcccaagcctcccca

SEQ ID NO: 114695 - DNA, 16 bp, H. sapiens
ggcccaaggactcttc

SEQ ID NO: 114696 - DNA, 16 bp, H. sapiens
ggcccaaggtcacaca

SEQ ID NO: 114697 - DNA, 16 bp, H. sapiens
ggcccacaccaccatg

SEQ ID NO: 114698 - DNA, 16 bp, H. sapiens
ggcccacccagattat

SEQ ID NO: 114699 - DNA, 16 bp, H. sapiens
ggcccacctctgcctc

SEQ ID NO: 114700 - DNA, 16 bp, H. sapiens
ggcccacctggataat

SEQ ID NO: 114701 - DNA, 16 bp, H. sapiens
ggcccacctgggagcc

SEQ ID NO: 114702 - DNA, 16 bp, H. sapiens
ggcccaccttcctccc

SEQ ID NO: 114703 - DNA, 16 bp, H. sapiens
ggcccactgcaacctc

SEQ ID NO: 114704 - DNA, 16 bp, H. sapiens
ggcccagatggcttca

SEQ ID NO: 114705 - DNA, 16 bp, H. sapiens
ggcccagcccagccct

SEQ ID NO: 114706 - DNA, 16 bp, H. sapiens
ggcccagcccagctca

SEQ ID NO: 114707 - DNA, 16 bp, H. sapiens
ggcccagcccctcctc

SEQ ID NO: 114708 - DNA, 16 bp, H. sapiens
ggcccagcccctgccc

SEQ ID NO: 114709 - DNA, 16 bp, H. sapiens
ggcccagccctgctct

SEQ ID NO: 114710 - DNA, 16 bp, H. sapiens
ggcccagcctggcccc

SEQ ID NO: 114711 - DNA, 16 bp, H. sapiens
ggcccagctcaggcct

SEQ ID NO: 114712 - DNA, 16 bp, H. sapiens
ggcccagctggtctcg

SEQ ID NO: 114713 - DNA, 16 bp, H. sapiens
ggcccaggaaaccact

SEQ ID NO: 114714 - DNA, 16 bp, H. sapiens
ggcccaggagggagga

SEQ ID NO: 114715 - DNA, 17 bp, H. sapiens
ggcccaggaggtcaagg

SEQ ID NO: 114716 - DNA, 16 bp, H. sapiens
ggcccaggagttccag

SEQ ID NO: 114717 - DNA, 16 bp, H. sapiens
ggcccaggcagaagga

SEQ ID NO: 114718 - DNA, 16 bp, H. sapiens
ggcccaggcaggagga

SEQ ID NO: 114719 - DNA, 16 bp, H. sapiens
ggcccaggcaggggga

SEQ ID NO: 114720 - DNA, 16 bp, H. sapiens
ggcccaggcccagggc

SEQ ID NO: 114721 - DNA, 16 bp, H. sapiens
ggcccaggctgcagct

SEQ ID NO: 114722 - DNA, 16 bp, H. sapiens
ggcccaggctgcagtg

SEQ ID NO: 114723 - DNA, 16 bp, H. sapiens
ggcccaggctggagcg

SEQ ID NO: 114724 - DNA, 16 bp, H. sapiens
ggcccaggctggggtg

SEQ ID NO: 114725 - DNA, 16 bp, H. sapiens
ggcccagggaggggca

SEQ ID NO: 114726 - DNA, 16 bp, H. sapiens
ggcccagggcaggcag

SEQ ID NO: 114727 - DNA, 16 bp, H. sapiens
ggcccagggcccctct

SEQ ID NO: 114728 - DNA, 16 bp, H. sapiens
ggcccagggccctcct

SEQ ID NO: 114729 - DNA, 16 bp, H. sapiens
ggcccagggctcactt

SEQ ID NO: 114730 - DNA, 16 bp, H. sapiens
ggcccaggggaccctg

SEQ ID NO: 114731 - DNA, 16 bp, H. sapiens
ggcccaggggctgggg

SEQ ID NO: 114732 - DNA, 16 bp, H. sapiens
ggcccagggtgtggtg

SEQ ID NO: 114733 - DNA, 16 bp, H. sapiens
ggcccaggtaggtgga

SEQ ID NO: 114734 - DNA, 16 bp, H. sapiens
ggcccaggtgcccagc

SEQ ID NO: 114735 - DNA, 16 bp, H. sapiens
ggcccaggtgctaagt

SEQ ID NO: 114736 - DNA, 16 bp, H. sapiens
ggcccaggtgggctga

SEQ ID NO: 114737 - DNA, 16 bp, H. sapiens
ggcccagtgtctgttg

SEQ ID NO: 114738 - DNA, 16 bp, H. sapiens
ggcccatctggtcttg

SEQ ID NO: 114739 - DNA, 16 bp, H. sapiens
ggccccaagggaaggg

SEQ ID NO: 114740 - DNA, 16 bp, H. sapiens
ggccccacagtctggg

SEQ ID NO: 114741 - DNA, 16 bp, H. sapiens
ggccccacccccagag

SEQ ID NO: 114742 - DNA, 16 bp, H. sapiens
ggccccacccctgtct

SEQ ID NO: 114743 - DNA, 16 bp, H. sapiens
ggccccaccctcaagc

SEQ ID NO: 114744 - DNA, 16 bp, H. sapiens
ggccccacctccaaca

SEQ ID NO: 114745 - DNA, 16 bp, H. sapiens
ggccccacctcccaac

SEQ ID NO: 114746 - DNA, 16 bp, H. sapiens
ggccccacctctagca

SEQ ID NO: 114747 - DNA, 16 bp, H. sapiens
ggccccactccagacc

SEQ ID NO: 114748 - DNA, 16 bp, H. sapiens
ggccccacttccaaca

SEQ ID NO: 114749 - DNA, 16 bp, H. sapiens
ggccccagagagaccc

SEQ ID NO: 114750 - DNA, 16 bp, H. sapiens
ggccccagagagctcc

SEQ ID NO: 114751 - DNA, 16 bp, H. sapiens
ggccccagcccagacc

SEQ ID NO: 114752 - DNA, 16 bp, H. sapiens
ggccccagccccagag

SEQ ID NO: 114753 - DNA, 16 bp, H. sapiens
ggccccagcccctcct

SEQ ID NO: 114754 - DNA, 16 bp, H. sapiens
ggccccagcctccccg

SEQ ID NO: 114755 - DNA, 16 bp, H. sapiens
ggccccagcctggcca

SEQ ID NO: 114756 - DNA, 16 bp, H. sapiens
ggccccagctaatttt

SEQ ID NO: 114757 - DNA, 16 bp, H. sapiens
ggccccaggcaagtcc

SEQ ID NO: 114758 - DNA, 16 bp, H. sapiens
ggccccagtgtctgtc

SEQ ID NO: 114759 - DNA, 16 bp, H. sapiens
ggcccccacactcttc

SEQ ID NO: 114760 - DNA, 16 bp, H. sapiens
ggcccccacagcacag

SEQ ID NO: 114761 - DNA, 16 bp, H. sapiens
ggcccccagccttcag

SEQ ID NO: 114762 - DNA, 16 bp, H. sapiens
ggccccctggtcccac

SEQ ID NO: 114763 - DNA, 16 bp, H. sapiens
ggccccgcactcggag

SEQ ID NO: 114764 - DNA, 18 bp, H. sapiens
ggccccgggcagtgaggg

SEQ ID NO: 114765 - DNA, 16 bp, H. sapiens
ggcccctcagctgcag

SEQ ID NO: 114766 - DNA, 16 bp, H. sapiens
ggcccctcctccctca

SEQ ID NO: 114767 - DNA, 16 bp, H. sapiens
ggcccctctcctgggc

SEQ ID NO: 114768 - DNA, 16 bp, H. sapiens
ggcccctctgctgctg

SEQ ID NO: 114769 - DNA, 16 bp, H. sapiens
ggcccctgccacccag

SEQ ID NO: 114770 - DNA, 16 bp, H. sapiens
ggcccctgctcctgcc

SEQ ID NO: 114771 - DNA, 16 bp, H. sapiens
ggccccttccagctct

SEQ ID NO: 114772 - DNA, 16 bp, H. sapiens
ggcccggcccttcctc

SEQ ID NO: 114773 - DNA, 16 bp, H. sapiens
ggcccgggcatggtgg

SEQ ID NO: 114774 - DNA, 16 bp, H. sapiens
ggccctaggcctggcc

SEQ ID NO: 114775 - DNA, 16 bp, H. sapiens
ggccctcaccaaatgc

SEQ ID NO: 114776 - DNA, 16 bp, H. sapiens
ggccctcaccagagcc

SEQ ID NO: 114777 - DNA, 16 bp, H. sapiens
ggccctcagctgcagg

SEQ ID NO: 114778 - DNA, 16 bp, H. sapiens
ggccctcctgcctcag

SEQ ID NO: 114779 - DNA, 16 bp, H. sapiens
ggccctcgccagacac

SEQ ID NO: 114780 - DNA, 16 bp, H. sapiens
ggccctctcagtggac

SEQ ID NO: 114781 - DNA, 16 bp, H. sapiens
ggccctgagcccagcc

SEQ ID NO: 114782 - DNA, 16 bp, H. sapiens
ggccctgaggcagaaa

SEQ ID NO: 114783 - DNA, 16 bp, H. sapiens
ggccctgaggcagaag

SEQ ID NO: 114784 - DNA, 16 bp, H. sapiens
ggccctgaggcaggaa

SEQ ID NO: 114785 - DNA, 16 bp, H. sapiens
ggccctgaggcaggac

SEQ ID NO: 114786 - DNA, 16 bp, H. sapiens
ggccctgaggctggag

SEQ ID NO: 114787 - DNA, 16 bp, H. sapiens
ggccctgatccaatat

SEQ ID NO: 114788 - DNA, 16 bp, H. sapiens
ggccctgcagcagcat

SEQ ID NO: 114789 - DNA, 16 bp, H. sapiens
ggccctgccagcacct

SEQ ID NO: 114790 - DNA, 16 bp, H. sapiens
ggccctgcccacacct

SEQ ID NO: 114791 - DNA, 16 bp, H. sapiens
ggccctgcccacatcc

SEQ ID NO: 114792 - DNA, 16 bp, H. sapiens
ggccctgcccaccacc

SEQ ID NO: 114793 - DNA, 16 bp, H. sapiens
ggccctgcccactgcc

SEQ ID NO: 114794 - DNA, 16 bp, H. sapiens
ggccctgcccatcacc

SEQ ID NO: 114795 - DNA, 16 bp, H. sapiens
ggccctgcccctgctg

SEQ ID NO: 114796 - DNA, 16 bp, H. sapiens
ggccctgccctcaggg

SEQ ID NO: 114797 - DNA, 16 bp, H. sapiens
ggccctgccctgccct

SEQ ID NO: 114798 - DNA, 16 bp, H. sapiens
ggccctgccctgcctg

SEQ ID NO: 114799 - DNA, 16 bp, H. sapiens
ggccctgccctgcctt

SEQ ID NO: 114800 - DNA, 16 bp, H. sapiens
ggccctgcccttgccc

SEQ ID NO: 114801 - DNA, 16 bp, H. sapiens
ggccctgcctcccagc

SEQ ID NO: 114802 - DNA, 16 bp, H. sapiens
ggccctgcctctgcct

SEQ ID NO: 114803 - DNA, 16 bp, H. sapiens
ggccctgctccccacc

SEQ ID NO: 114804 - DNA, 16 bp, H. sapiens
ggccctgctggccctg

SEQ ID NO: 114805 - DNA, 16 bp, H. sapiens
ggccctggacctggcc

SEQ ID NO: 114806 - DNA, 16 bp, H. sapiens
ggccctggagaagctg

SEQ ID NO: 114807 - DNA, 16 bp, H. sapiens
ggccctggagccagac

SEQ ID NO: 114808 - DNA, 16 bp, H. sapiens
ggccctggagggaggg

SEQ ID NO: 114809 - DNA, 16 bp, H. sapiens
ggccctggagtcagac

SEQ ID NO: 114810 - DNA, 16 bp, H. sapiens
ggccctggccaaggcc

SEQ ID NO: 114811 - DNA, 16 bp, H. sapiens
ggccctggcccagccc

SEQ ID NO: 114812 - DNA, 16 bp, H. sapiens
ggccctggccctgcag

SEQ ID NO: 114813 - DNA, 16 bp, H. sapiens
ggccctggccctgcca

SEQ ID NO: 114814 - DNA, 16 bp, H. sapiens
ggccctggctctgcca

SEQ ID NO: 114815 - DNA, 16 bp, H. sapiens
ggccctggctctggcc

SEQ ID NO: 114816 - DNA, 16 bp, H. sapiens
ggccctggctgaggcc

SEQ ID NO: 114817 - DNA, 16 bp, H. sapiens
ggccctgggagcttgc

SEQ ID NO: 114818 - DNA, 16 bp, H. sapiens
ggccctgggcaagtca

SEQ ID NO: 114819 - DNA, 16 bp, H. sapiens
ggccctgggccaggca

SEQ ID NO: 114820 - DNA, 16 bp, H. sapiens
ggccctgggccaggcc

SEQ ID NO: 114821 - DNA, 16 bp, H. sapiens
ggccctgggccctggg

SEQ ID NO: 114822 - DNA, 16 bp, H. sapiens
ggccctgggctcagcc

SEQ ID NO: 114823 - DNA, 16 bp, H. sapiens
ggccctggggactggg

SEQ ID NO: 114824 - DNA, 16 bp, H. sapiens
ggccctggggaggagg

SEQ ID NO: 114825 - DNA, 16 bp, H. sapiens
ggccctggggcaggac

SEQ ID NO: 114826 - DNA, 16 bp, H. sapiens
ggccctggggcaggag

SEQ ID NO: 114827 - DNA, 16 bp, H. sapiens
ggccctggggctggag

SEQ ID NO: 114828 - DNA, 16 bp, H. sapiens
ggccctggtgtgtgac

SEQ ID NO: 114829 - DNA, 16 bp, H. sapiens
ggccctggtgtgtgct

SEQ ID NO: 114830 - DNA, 16 bp, H. sapiens
ggccctgtccctgcag

SEQ ID NO: 114831 - DNA, 16 bp, H. sapiens
ggccctgtctctgcct

SEQ ID NO: 114832 - DNA, 16 bp, H. sapiens
ggccctgtctgggcat

SEQ ID NO: 114833 - DNA, 16 bp, H. sapiens
ggccctgtgaccacag

SEQ ID NO: 114834 - DNA, 16 bp, H. sapiens
ggccctgtgctaggca

SEQ ID NO: 114835 - DNA, 16 bp, H. sapiens
ggcccttcagggagcc

SEQ ID NO: 114836 - DNA, 16 bp, H. sapiens
ggcccttcctgctggg

SEQ ID NO: 114837 - DNA, 16 bp, H. sapiens
ggccctttggggagcc

SEQ ID NO: 114838 - DNA, 16 bp, H. sapiens
ggccgaagcaggagga

SEQ ID NO: 114839 - DNA, 16 bp, H. sapiens
ggccgaagcaggggga

SEQ ID NO: 114840 - DNA, 16 bp, H. sapiens
ggccgagacgggagga

SEQ ID NO: 114841 - DNA, 16 bp, H. sapiens
ggccgagattgcacca

SEQ ID NO: 114842 - DNA, 16 bp, H. sapiens
ggccgaggaaggagaa

SEQ ID NO: 114843 - DNA, 16 bp, H. sapiens
ggccgaggaaggcaga

SEQ ID NO: 114844 - DNA, 16 bp, H. sapiens
ggccgaggagagtgga

SEQ ID NO: 114845 - DNA, 16 bp, H. sapiens
ggccgaggcagctgga

SEQ ID NO: 114846 - DNA, 17 bp, H. sapiens
ggccgaggcaggagaat

SEQ ID NO: 114847 - DNA, 16 bp, H. sapiens
ggccgaggcaggagac

SEQ ID NO: 114848 - DNA, 19 bp, H. sapiens
ggccgaggcaggcggatca

SEQ ID NO: 114849 - DNA, 17 bp, H. sapiens
ggccgaggcaggtgaat

SEQ ID NO: 114850 - DNA, 17 bp, H. sapiens
ggccgaggcagttggat

SEQ ID NO: 114851 - DNA, 16 bp, H. sapiens
ggccgaggccgaggcc

SEQ ID NO: 114852 - DNA, 17 bp, H. sapiens
ggccgaggcgagtggat

SEQ ID NO: 114853 - DNA, 16 bp, H. sapiens
ggccgaggcggaagga

SEQ ID NO: 114854 - DNA, 16 bp, H. sapiens
ggccgaggcggacgga

SEQ ID NO: 114855 - DNA, 17 bp, H. sapiens
ggccgaggcggatggat

SEQ ID NO: 114856 - DNA, 27 bp, H. sapiens
ggccgaggcgggcagatcacaaggtca

SEQ ID NO: 114857 - DNA, 20 bp, H. sapiens
ggccgaggcgggcagatcat

SEQ ID NO: 114858 - DNA, 18 bp, H. sapiens
ggccgaggcgggcagatg

SEQ ID NO: 114859 - DNA, 18 bp, H. sapiens
ggccgaggcgggcagatt

SEQ ID NO: 114860 - DNA, 19 bp, H. sapiens
ggccgaggcgggtggatca

SEQ ID NO: 114861 - DNA, 18 bp, H. sapiens
ggccgaggcgggtggatt

SEQ ID NO: 114862 - DNA, 16 bp, H. sapiens
ggccgaggctggcaga

SEQ ID NO: 114863 - DNA, 17 bp, H. sapiens
ggccgaggtaggtggat

SEQ ID NO: 114864 - DNA, 16 bp, H. sapiens
ggccgaggtggacgga

SEQ ID NO: 114865 - DNA, 16 bp, H. sapiens
ggccgaggtggaggat

SEQ ID NO: 114866 - DNA, 16 bp, H. sapiens
ggccgaggtggctgga

SEQ ID NO: 114867 - DNA, 18 bp, H. sapiens
ggccgaggtgggcagatt

SEQ ID NO: 114868 - DNA, 17 bp, H. sapiens
ggccgaggtgggtagat

SEQ ID NO: 114869 - DNA, 17 bp, H. sapiens
ggccgaggtgggtgaat

SEQ ID NO: 114870 - DNA, 17 bp, H. sapiens
ggccgaggtgggtgtat

SEQ ID NO: 114871 - DNA, 16 bp, H. sapiens
ggccgcagctcttctc

SEQ ID NO: 114872 - DNA, 16 bp, H. sapiens
ggccgccttctccctg

SEQ ID NO: 114873 - DNA, 19 bp, H. sapiens
ggccggacacggtggctca

SEQ ID NO: 114874 - DNA, 16 bp, H. sapiens
ggccggcagtgctggg

SEQ ID NO: 114875 - DNA, 16 bp, H. sapiens
ggccgggaacagtggc

SEQ ID NO: 114876 - DNA, 16 bp, H. sapiens
ggccgggagcggtggc

SEQ ID NO: 114877 - DNA, 16 bp, H. sapiens
ggccgggcagtggctc

SEQ ID NO: 114878 - DNA, 16 bp, H. sapiens
ggccgggcatggtagc

SEQ ID NO: 114879 - DNA, 18 bp, H. sapiens
ggccgggcatggtggcac

SEQ ID NO: 114880 - DNA, 16 bp, H. sapiens
ggccgggcgcagcagc

SEQ ID NO: 114881 - DNA, 16 bp, H. sapiens
ggccggggaggcctca

SEQ ID NO: 114882 - DNA, 16 bp, H. sapiens
ggccggggtgcagtgg

SEQ ID NO: 114883 - DNA, 16 bp, H. sapiens
ggcctaattttttaaa

SEQ ID NO: 114884 - DNA, 16 bp, H. sapiens
ggcctacacagagtca

SEQ ID NO: 114885 - DNA, 16 bp, H. sapiens
ggcctactgggaggtg

SEQ ID NO: 114886 - DNA, 16 bp, H. sapiens
ggcctatgatggaaaa

SEQ ID NO: 114887 - DNA, 16 bp, H. sapiens
ggcctatgcctgtaat

SEQ ID NO: 114888 - DNA, 16 bp, H. sapiens
ggcctattgtggaaaa

SEQ ID NO: 114889 - DNA, 16 bp, H. sapiens
ggcctatttatttatt

SEQ ID NO: 114890 - DNA, 16 bp, H. sapiens
ggcctattttatttat

SEQ ID NO: 114891 - DNA, 16 bp, H. sapiens
ggcctcaaggaatcct

SEQ ID NO: 114892 - DNA, 16 bp, H. sapiens
ggcctcaagtgactct

SEQ ID NO: 114893 - DNA, 16 bp, H. sapiens
ggcctcaatgagctcc

SEQ ID NO: 114894 - DNA, 16 bp, H. sapiens
ggcctcaatgccctcc

SEQ ID NO: 114895 - DNA, 16 bp, H. sapiens
ggcctcacagtcatgg

SEQ ID NO: 114896 - DNA, 16 bp, H. sapiens
ggcctcaccatcatgg

SEQ ID NO: 114897 - DNA, 23 bp, H. sapiens
ggcctcacggtggcctctccagg

SEQ ID NO: 114898 - DNA, 16 bp, H. sapiens
ggcctcagaggaaacc

SEQ ID NO: 114899 - DNA, 16 bp, H. sapiens
ggcctcagaggggagg

SEQ ID NO: 114900 - DNA, 16 bp, H. sapiens
ggcctcagcagcagcc

SEQ ID NO: 114901 - DNA, 16 bp, H. sapiens
ggcctcagccacctcc

SEQ ID NO: 114902 - DNA, 16 bp, H. sapiens
ggcctcagccagggcc

SEQ ID NO: 114903 - DNA, 16 bp, H. sapiens
ggcctcaggaagcttc

SEQ ID NO: 114904 - DNA, 16 bp, H. sapiens
ggcctcaggaaggagg

SEQ ID NO: 114905 - DNA, 16 bp, H. sapiens
ggcctcaggcccctcc

SEQ ID NO: 114906 - DNA, 16 bp, H. sapiens
ggcctcaggtgattca

SEQ ID NO: 114907 - DNA, 16 bp, H. sapiens
ggcctcagtttcctca

SEQ ID NO: 114908 - DNA, 16 bp, H. sapiens
ggcctcagtttcctct

SEQ ID NO: 114909 - DNA, 16 bp, H. sapiens
ggcctcatgtgatcct

SEQ ID NO: 114910 - DNA, 16 bp, H. sapiens
ggcctcattctgttgc

SEQ ID NO: 114911 - DNA, 16 bp, H. sapiens
ggcctccagaactctg

SEQ ID NO: 114912 - DNA, 16 bp, H. sapiens
ggcctccagctccagc

SEQ ID NO: 114913 - DNA, 16 bp, H. sapiens
ggcctccagctgcacc

SEQ ID NO: 114914 - DNA, 16 bp, H. sapiens
ggcctcccaaaatgtt

SEQ ID NO: 114915 - DNA, 16 bp, H. sapiens
ggcctcccaaacttct

SEQ ID NO: 114916 - DNA, 16 bp, H. sapiens
ggcctcccaaagagct

SEQ ID NO: 114917 - DNA, 16 bp, H. sapiens
ggcctcccaaagcttt

SEQ ID NO: 114918 - DNA, 16 bp, H. sapiens
ggcctcccaaaggcat

SEQ ID NO: 114919 - DNA, 16 bp, H. sapiens
ggcctcccaaagggat

SEQ ID NO: 114920 - DNA, 16 bp, H. sapiens
ggcctcccaaagtcct

SEQ ID NO: 114921 - DNA, 16 bp, H. sapiens
ggcctcccaaagtgcc

SEQ ID NO: 114922 - DNA, 16 bp, H. sapiens
ggcctcccaaagtgtc

SEQ ID NO: 114923 - DNA, 16 bp, H. sapiens
ggcctcccaagccctg

SEQ ID NO: 114924 - DNA, 16 bp, H. sapiens
ggcctcccaaggtgct

SEQ ID NO: 114925 - DNA, 16 bp, H. sapiens
ggcctcccactgtgct

SEQ ID NO: 114926 - DNA, 16 bp, H. sapiens
ggcctcccagaagtgc

SEQ ID NO: 114927 - DNA, 17 bp, H. sapiens
ggcctcccagagtgctg

SEQ ID NO: 114928 - DNA, 16 bp, H. sapiens
ggcctcccagccatgc

SEQ ID NO: 114929 - DNA, 16 bp, H. sapiens
ggcctcccagcctccc

SEQ ID NO: 114930 - DNA, 16 bp, H. sapiens
ggcctcccaggccctg

SEQ ID NO: 114931 - DNA, 16 bp, H. sapiens
ggcctccccagccaca

SEQ ID NO: 114932 - DNA, 16 bp, H. sapiens
ggcctccccagccacc

SEQ ID NO: 114933 - DNA, 16 bp, H. sapiens
ggcctccccagccatc

SEQ ID NO: 114934 - DNA, 16 bp, H. sapiens
ggcctccccagcccca

SEQ ID NO: 114935 - DNA, 16 bp, H. sapiens
ggcctccccagccctg

SEQ ID NO: 114936 - DNA, 16 bp, H. sapiens
ggcctccccagcctca

SEQ ID NO: 114937 - DNA, 16 bp, H. sapiens
ggcctccccaggcatg

SEQ ID NO: 114938 - DNA, 16 bp, H. sapiens
ggcctccctagccctg

SEQ ID NO: 114939 - DNA, 16 bp, H. sapiens
ggcctccctccccagc

SEQ ID NO: 114940 - DNA, 16 bp, H. sapiens
ggcctccctgaggagg

SEQ ID NO: 114941 - DNA, 16 bp, H. sapiens
ggcctccgcctcctgg

SEQ ID NO: 114942 - DNA, 16 bp, H. sapiens
ggcctcctcggcctcc

SEQ ID NO: 114943 - DNA, 16 bp, H. sapiens
ggcctcctctgcctgg

SEQ ID NO: 114944 - DNA, 16 bp, H. sapiens
ggcctcctgaagtact

SEQ ID NO: 114945 - DNA, 16 bp, H. sapiens
ggcctcctggaggagg

SEQ ID NO: 114946 - DNA, 16 bp, H. sapiens
ggcctccttagccatg

SEQ ID NO: 114947 - DNA, 16 bp, H. sapiens
ggcctccttgctgctc

SEQ ID NO: 114948 - DNA, 16 bp, H. sapiens
ggcctcgaactcctgg

SEQ ID NO: 114949 - DNA, 16 bp, H. sapiens
ggcctcgcagagtgct

SEQ ID NO: 114950 - DNA, 16 bp, H. sapiens
ggcctcgccagccatg

SEQ ID NO: 114951 - DNA, 16 bp, H. sapiens
ggcctctcaaagtgct

SEQ ID NO: 114952 - DNA, 16 bp, H. sapiens
ggcctctcaaagtgtt

SEQ ID NO: 114953 - DNA, 16 bp, H. sapiens
ggcctctcagaggagg

SEQ ID NO: 114954 - DNA, 16 bp, H. sapiens
ggcctctcagagtgct

SEQ ID NO: 114955 - DNA, 16 bp, H. sapiens
ggcctctccagccacg

SEQ ID NO: 114956 - DNA, 16 bp, H. sapiens
ggcctctccaggccca

SEQ ID NO: 114957 - DNA, 19 bp, H. sapiens
ggcctctccaggtgcaaaa

SEQ ID NO: 114958 - DNA, 16 bp, H. sapiens
ggcctctccctgctcc

SEQ ID NO: 114959 - DNA, 16 bp, H. sapiens
ggcctctcctggggcc

SEQ ID NO: 114960 - DNA, 16 bp, H. sapiens
ggcctctccttggctt

SEQ ID NO: 114961 - DNA, 16 bp, H. sapiens
ggcctctctccttgcc

SEQ ID NO: 114962 - DNA, 16 bp, H. sapiens
ggcctctctctctctc

SEQ ID NO: 114963 - DNA, 16 bp, H. sapiens
ggcctctctctgctcc

SEQ ID NO: 114964 - DNA, 16 bp, H. sapiens
ggcctctctggacaag

SEQ ID NO: 114965 - DNA, 16 bp, H. sapiens
ggcctctctgtgcagc

SEQ ID NO: 114966 - DNA, 16 bp, H. sapiens
ggcctctgagctcaag

SEQ ID NO: 114967 - DNA, 16 bp, H. sapiens
ggcctctggaacttct

SEQ ID NO: 114968 - DNA, 16 bp, H. sapiens
ggcctctggacctgtg

SEQ ID NO: 114969 - DNA, 16 bp, H. sapiens
ggcctctggccaacag

SEQ ID NO: 114970 - DNA, 16 bp, H. sapiens
ggcctctgggcctgtg

SEQ ID NO: 114971 - DNA, 16 bp, H. sapiens
ggcctctgtccttggc

SEQ ID NO: 114972 - DNA, 16 bp, H. sapiens
ggcctcttggaggagg

SEQ ID NO: 114973 - DNA, 16 bp, H. sapiens
ggcctctttagaccca

SEQ ID NO: 114974 - DNA, 16 bp, H. sapiens
ggcctgaaattttttt

SEQ ID NO: 114975 - DNA, 16 bp, H. sapiens
ggcctgaagcctgggg

SEQ ID NO: 114976 - DNA, 16 bp, H. sapiens
ggcctgaccaacatgg

SEQ ID NO: 114977 - DNA, 16 bp, H. sapiens
ggcctgagaaccagga

SEQ ID NO: 114978 - DNA, 16 bp, H. sapiens
ggcctgagaaccaggg

SEQ ID NO: 114979 - DNA, 16 bp, H. sapiens
ggcctgagcaacatag

SEQ ID NO: 114980 - DNA, 16 bp, H. sapiens
ggcctgagccaccacc

SEQ ID NO: 114981 - DNA, 16 bp, H. sapiens
ggcctgagccacctca

SEQ ID NO: 114982 - DNA, 16 bp, H. sapiens
ggcctgagcccctagg

SEQ ID NO: 114983 - DNA, 16 bp, H. sapiens
ggcctgagctactgca

SEQ ID NO: 114984 - DNA, 16 bp, H. sapiens
ggcctgagctctgcct

SEQ ID NO: 114985 - DNA, 16 bp, H. sapiens
ggcctgagctgggcct

SEQ ID NO: 114986 - DNA, 16 bp, H. sapiens
ggcctgaggcacccct

SEQ ID NO: 114987 - DNA, 16 bp, H. sapiens
ggcctgaggcaggaga

SEQ ID NO: 114988 - DNA, 16 bp, H. sapiens
ggcctgaggcctgggg

SEQ ID NO: 114989 - DNA, 16 bp, H. sapiens
ggcctgatcatggctc

SEQ ID NO: 114990 - DNA, 16 bp, H. sapiens
ggcctgatgggagatg

SEQ ID NO: 114991 - DNA, 16 bp, H. sapiens
ggcctgcaaagcctaa

SEQ ID NO: 114992 - DNA, 16 bp, H. sapiens
ggcctgcaccaccatg

SEQ ID NO: 114993 - DNA, 16 bp, H. sapiens
ggcctgcagaggccgc

SEQ ID NO: 114994 - DNA, 16 bp, H. sapiens
ggcctgcaggtgcccc

SEQ ID NO: 114995 - DNA, 17 bp, H. sapiens
ggcctgcccctccacac

SEQ ID NO: 114996 - DNA, 16 bp, H. sapiens
ggcctgcctgccactg

SEQ ID NO: 114997 - DNA, 16 bp, H. sapiens
ggcctgcctgcccctg

SEQ ID NO: 114998 - DNA, 16 bp, H. sapiens
ggcctgcgccaccaca

SEQ ID NO: 114999 - DNA, 16 bp, H. sapiens
ggcctgctgctcacct

SEQ ID NO: 115000 - DNA, 16 bp, H. sapiens
ggcctgctgggcttgt

SEQ ID NO: 115001 - DNA, 16 bp, H. sapiens
ggcctggaaaaagcac

SEQ ID NO: 115002 - DNA, 16 bp, H. sapiens
ggcctggaggcccagg

SEQ ID NO: 115003 - DNA, 16 bp, H. sapiens
ggcctggaggcctagg

SEQ ID NO: 115004 - DNA, 16 bp, H. sapiens
ggcctggaggcctggg

SEQ ID NO: 115005 - DNA, 16 bp, H. sapiens
ggcctggaggttgggg

SEQ ID NO: 115006 - DNA, 16 bp, H. sapiens
ggcctggagttcaaga

SEQ ID NO: 115007 - DNA, 16 bp, H. sapiens
ggcctggatatggttt

SEQ ID NO: 115008 - DNA, 16 bp, H. sapiens
ggcctggcacacagca

SEQ ID NO: 115009 - DNA, 16 bp, H. sapiens
ggcctggcagggctgg

SEQ ID NO: 115010 - DNA, 16 bp, H. sapiens
ggcctggcaggggctg

SEQ ID NO: 115011 - DNA, 16 bp, H. sapiens
ggcctggccaacatgg

SEQ ID NO: 115012 - DNA, 16 bp, H. sapiens
ggcctggccaacgtgg

SEQ ID NO: 115013 - DNA, 16 bp, H. sapiens
ggcctggccagagaag

SEQ ID NO: 115014 - DNA, 16 bp, H. sapiens
ggcctggccagggcag

SEQ ID NO: 115015 - DNA, 16 bp, H. sapiens
ggcctggcccagccca

SEQ ID NO: 115016 - DNA, 16 bp, H. sapiens
ggcctggcccagcccc

SEQ ID NO: 115017 - DNA, 16 bp, H. sapiens
ggcctggcccaggctg

SEQ ID NO: 115018 - DNA, 16 bp, H. sapiens
ggcctggcccagtggc

SEQ ID NO: 115019 - DNA, 16 bp, H. sapiens
ggcctggcccataaaa

SEQ ID NO: 115020 - DNA, 16 bp, H. sapiens
ggcctggcccctgcct

SEQ ID NO: 115021 - DNA, 16 bp, H. sapiens
ggcctggccctgccct

SEQ ID NO: 115022 - DNA, 16 bp, H. sapiens
ggcctggccctgcctc

SEQ ID NO: 115023 - DNA, 16 bp, H. sapiens
ggcctggccctggccc

SEQ ID NO: 115024 - DNA, 16 bp, H. sapiens
ggcctggcctcccagc

SEQ ID NO: 115025 - DNA, 16 bp, H. sapiens
ggcctggcctgggctc

SEQ ID NO: 115026 - DNA, 16 bp, H. sapiens
ggcctggctgggcctc

SEQ ID NO: 115027 - DNA, 16 bp, H. sapiens
ggcctggctggggctg

SEQ ID NO: 115028 - DNA, 16 bp, H. sapiens
ggcctgggactcactc

SEQ ID NO: 115029 - DNA, 16 bp, H. sapiens
ggcctgggagttgggg

SEQ ID NO: 115030 - DNA, 16 bp, H. sapiens
ggcctgggcaaaagag

SEQ ID NO: 115031 - DNA, 17 bp, H. sapiens
ggcctgggcaacatagc

SEQ ID NO: 115032 - DNA, 16 bp, H. sapiens
ggcctgggcacggtgg

SEQ ID NO: 115033 - DNA, 16 bp, H. sapiens
ggcctgggcctgcctg

SEQ ID NO: 115034 - DNA, 16 bp, H. sapiens
ggcctgggcctggctg

SEQ ID NO: 115035 - DNA, 16 bp, H. sapiens
ggcctgggctcagagg

SEQ ID NO: 115036 - DNA, 16 bp, H. sapiens
ggcctggggaagctgg

SEQ ID NO: 115037 - DNA, 16 bp, H. sapiens
ggcctggggagcttgg

SEQ ID NO: 115038 - DNA, 16 bp, H. sapiens
ggcctggggcagcagg

SEQ ID NO: 115039 - DNA, 16 bp, H. sapiens
ggcctggggcccagga

SEQ ID NO: 115040 - DNA, 16 bp, H. sapiens
ggcctgggggaccact

SEQ ID NO: 115041 - DNA, 16 bp, H. sapiens
ggcctggggttgggga

SEQ ID NO: 115042 - DNA, 16 bp, H. sapiens
ggcctgggtgggagaa

SEQ ID NO: 115043 - DNA, 17 bp, H. sapiens
ggcctggtgcagtggct

SEQ ID NO: 115044 - DNA, 16 bp, H. sapiens
ggcctggtggaagatg

SEQ ID NO: 115045 - DNA, 16 bp, H. sapiens
ggcctggtggcacacg

SEQ ID NO: 115046 - DNA, 17 bp, H. sapiens
ggcctggtggtgacaaa

SEQ ID NO: 115047 - DNA, 16 bp, H. sapiens
ggcctggtggtgacag

SEQ ID NO: 115048 - DNA, 16 bp, H. sapiens
ggcctgtaatcccagc

SEQ ID NO: 115049 - DNA, 16 bp, H. sapiens
ggcctgtaatcgcagc

SEQ ID NO: 115050 - DNA, 16 bp, H. sapiens
ggcctgtcagggggtc

SEQ ID NO: 115051 - DNA, 16 bp, H. sapiens
ggcctgtctccttggc

SEQ ID NO: 115052 - DNA, 16 bp, H. sapiens
ggcctgtggctgccag

SEQ ID NO: 115053 - DNA, 16 bp, H. sapiens
ggcctgtggctgctgg

SEQ ID NO: 115054 - DNA, 16 bp, H. sapiens
ggcctgtgggccacag

SEQ ID NO: 115055 - DNA, 16 bp, H. sapiens
ggcctgtgggctgtgg

SEQ ID NO: 115056 - DNA, 16 bp, H. sapiens
ggcctgttagtctgag

SEQ ID NO: 115057 - DNA, 16 bp, H. sapiens
ggccttactggggacc

SEQ ID NO: 115058 - DNA, 17 bp, H. sapiens
ggccttagctgcctccc

SEQ ID NO: 115059 - DNA, 16 bp, H. sapiens
ggccttcacagcctcc

SEQ ID NO: 115060 - DNA, 16 bp, H. sapiens
ggccttcatctttctc

SEQ ID NO: 115061 - DNA, 16 bp, H. sapiens
ggccttcccagccctg

SEQ ID NO: 115062 - DNA, 16 bp, H. sapiens
ggccttcccaggcccc

SEQ ID NO: 115063 - DNA, 16 bp, H. sapiens
ggccttcctgctgtgt

SEQ ID NO: 115064 - DNA, 16 bp, H. sapiens
ggccttccttcctctt

SEQ ID NO: 115065 - DNA, 16 bp, H. sapiens
ggccttccttgaccac

SEQ ID NO: 115066 - DNA, 16 bp, H. sapiens
ggccttctcagtctta

SEQ ID NO: 115067 - DNA, 16 bp, H. sapiens
ggccttcttcctggct

SEQ ID NO: 115068 - DNA, 16 bp, H. sapiens
ggccttcttgctgcat

SEQ ID NO: 115069 - DNA, 16 bp, H. sapiens
ggccttgcctggcatg

SEQ ID NO: 115070 - DNA, 16 bp, H. sapiens
ggccttgctgagctgc

SEQ ID NO: 115071 - DNA, 16 bp, H. sapiens
ggccttggagagccca

SEQ ID NO: 115072 - DNA, 23 bp, H. sapiens
ggccttggcagcaactgccctgc

SEQ ID NO: 115073 - DNA, 16 bp, H. sapiens
ggccttggcagcttcc

SEQ ID NO: 115074 - DNA, 16 bp, H. sapiens
ggccttggccttggcc

SEQ ID NO: 115075 - DNA, 16 bp, H. sapiens
ggccttggctgccttc

SEQ ID NO: 115076 - DNA, 16 bp, H. sapiens
ggccttgggagcccat

SEQ ID NO: 115077 - DNA, 16 bp, H. sapiens
ggccttgggctctgag

SEQ ID NO: 115078 - DNA, 25 bp, H. sapiens
ggccttggtcggcccacagcttcct

SEQ ID NO: 115079 - DNA, 16 bp, H. sapiens
ggccttggttttctca

SEQ ID NO: 115080 - DNA, 16 bp, H. sapiens
ggcctttccaggccca

SEQ ID NO: 115081 - DNA, 16 bp, H. sapiens
ggcctttgagccccta

SEQ ID NO: 115082 - DNA, 16 bp, H. sapiens
ggcctttgcagggaca

SEQ ID NO: 115083 - DNA, 16 bp, H. sapiens
ggcctttgcccttgct

SEQ ID NO: 115084 - DNA, 16 bp, H. sapiens
ggcctttgggaaataa

SEQ ID NO: 115085 - DNA, 16 bp, H. sapiens
ggccttttccttcctt

SEQ ID NO: 115086 - DNA, 18 bp, H. sapiens
ggcctttttttaaaaaaa

SEQ ID NO: 115087 - DNA, 16 bp, H. sapiens
ggcgaaaccccatctt

SEQ ID NO: 115088 - DNA, 17 bp, H. sapiens
ggcgaaggtttcagtga

SEQ ID NO: 115089 - DNA, 16 bp, H. sapiens
ggcgaccaccaccatg

SEQ ID NO: 115090 - DNA, 16 bp, H. sapiens
ggcgagactctgtctc

SEQ ID NO: 115091 - DNA, 16 bp, H. sapiens
ggcgagatctgggctc

SEQ ID NO: 115092 - DNA, 16 bp, H. sapiens
ggcgatcacgaggtca

SEQ ID NO: 115093 - DNA, 16 bp, H. sapiens
ggcgattcctcaaggg

SEQ ID NO: 115094 - DNA, 16 bp, H. sapiens
ggcgcacagggcacat

SEQ ID NO: 115095 - DNA, 18 bp, H. sapiens
ggcgcagtggcaggtgcc

SEQ ID NO: 115096 - DNA, 17 bp, H. sapiens
ggcgcagtggctcgcgc

SEQ ID NO: 115097 - DNA, 16 bp, H. sapiens
ggcgcagtggttcatg

SEQ ID NO: 115098 - DNA, 16 bp, H. sapiens
ggcgcatgccaccaca

SEQ ID NO: 115099 - DNA, 18 bp, H. sapiens
ggcgccactgcactccaa

SEQ ID NO: 115100 - DNA, 16 bp, H. sapiens
ggcgccatcctggctc

SEQ ID NO: 115101 - DNA, 16 bp, H. sapiens
ggcgccatggctcacg

SEQ ID NO: 115102 - DNA, 16 bp, H. sapiens
ggcgcccagcaccatg

SEQ ID NO: 115103 - DNA, 16 bp, H. sapiens
ggcgcctcctcggcct

SEQ ID NO: 115104 - DNA, 16 bp, H. sapiens
ggcgcctgccaccaaa

SEQ ID NO: 115105 - DNA, 16 bp, H. sapiens
ggcgcgggccaccacg

SEQ ID NO: 115106 - DNA, 16 bp, H. sapiens
ggcgcggtctcagctc

SEQ ID NO: 115107 - DNA, 19 bp, H. sapiens
ggcgcggtgactcacgcct

SEQ ID NO: 115108 - DNA, 19 bp, H. sapiens
ggcgcggtggctcacgcct

SEQ ID NO: 115109 - DNA, 16 bp, H. sapiens
ggcgctgcactccagc

SEQ ID NO: 115110 - DNA, 16 bp, H. sapiens
ggcgctgctccctggc

SEQ ID NO: 115111 - DNA, 16 bp, H. sapiens
ggcggaagcaggagaa

SEQ ID NO: 115112 - DNA, 16 bp, H. sapiens
ggcggaagtgcagtgg

SEQ ID NO: 115113 - DNA, 16 bp, H. sapiens
ggcggagactgcagtg

SEQ ID NO: 115114 - DNA, 16 bp, H. sapiens
ggcggaggcaggaaaa

SEQ ID NO: 115115 - DNA, 16 bp, H. sapiens
ggcggaggcaggtgga

SEQ ID NO: 115116 - DNA, 16 bp, H. sapiens
ggcggaggctgcggtg

SEQ ID NO: 115117 - DNA, 16 bp, H. sapiens
ggcggaggtgcagtga

SEQ ID NO: 115118 - DNA, 16 bp, H. sapiens
ggcggaggtggcagtg

SEQ ID NO: 115119 - DNA, 17 bp, H. sapiens
ggcggataacctgaggt

SEQ ID NO: 115120 - DNA, 17 bp, H. sapiens
ggcggatcaccagaggt

SEQ ID NO: 115121 - DNA, 16 bp, H. sapiens
ggcggatcaccggagg

SEQ ID NO: 115122 - DNA, 17 bp, H. sapiens
ggcggatcacctgaggt

SEQ ID NO: 115123 - DNA, 16 bp, H. sapiens
ggcggatcacctgagt

SEQ ID NO: 115124 - DNA, 16 bp, H. sapiens
ggcggatcacgaggta

SEQ ID NO: 115125 - DNA, 19 bp, H. sapiens
ggcggatcacgaggtcaga

SEQ ID NO: 115126 - DNA, 17 bp, H. sapiens
ggcggatcactaggtca

SEQ ID NO: 115127 - DNA, 16 bp, H. sapiens
ggcggatcatttgagg

SEQ ID NO: 115128 - DNA, 16 bp, H. sapiens
ggcggattacttgagg

SEQ ID NO: 115129 - DNA, 16 bp, H. sapiens
ggcggcagacaagaga

SEQ ID NO: 115130 - DNA, 16 bp, H. sapiens
ggcggcagagagagac

SEQ ID NO: 115131 - DNA, 16 bp, H. sapiens
ggcggcagccaggctg

SEQ ID NO: 115132 - DNA, 16 bp, H. sapiens
ggcggcaggtgcctgt

SEQ ID NO: 115133 - DNA, 16 bp, H. sapiens
ggcggccaccaccacg

SEQ ID NO: 115134 - DNA, 16 bp, H. sapiens
ggcggccaggaagagg

SEQ ID NO: 115135 - DNA, 16 bp, H. sapiens
ggcggcgcgcacctgc

SEQ ID NO: 115136 - DNA, 16 bp, H. sapiens
ggcggcggcggctgca

SEQ ID NO: 115137 - DNA, 16 bp, H. sapiens
ggcggcggtgctggag

SEQ ID NO: 115138 - DNA, 16 bp, H. sapiens
ggcggctgccgggcag

SEQ ID NO: 115139 - DNA, 18 bp, H. sapiens
ggcggctgctgggcagag

SEQ ID NO: 115140 - DNA, 17 bp, H. sapiens
ggcgggaacccgggagg

SEQ ID NO: 115141 - DNA, 16 bp, H. sapiens
ggcgggcagctccacc

SEQ ID NO: 115142 - DNA, 16 bp, H. sapiens
ggcgggcgcctgtcgt

SEQ ID NO: 115143 - DNA, 16 bp, H. sapiens
ggcgggctgaggcagg

SEQ ID NO: 115144 - DNA, 16 bp, H. sapiens
ggcggggacacagatc

SEQ ID NO: 115145 - DNA, 16 bp, H. sapiens
ggcgggggacagcctg

SEQ ID NO: 115146 - DNA, 16 bp, H. sapiens
ggcgggggctgcagtg

SEQ ID NO: 115147 - DNA, 16 bp, H. sapiens
ggcggggtttcaccat

SEQ ID NO: 115148 - DNA, 16 bp, H. sapiens
ggcgggtggatagctt

SEQ ID NO: 115149 - DNA, 17 bp, H. sapiens
ggcgggtggatcacgat

SEQ ID NO: 115150 - DNA, 17 bp, H. sapiens
ggcggtggctcacgcct

SEQ ID NO: 115151 - DNA, 16 bp, H. sapiens
ggcggtgggcgcctgt

SEQ ID NO: 115152 - DNA, 16 bp, H. sapiens
ggcgtagtggcgcatg

SEQ ID NO: 115153 - DNA, 17 bp, H. sapiens
ggcgtcaacccgggagg

SEQ ID NO: 115154 - DNA, 16 bp, H. sapiens
ggcgtgaaccaccaca

SEQ ID NO: 115155 - DNA, 17 bp, H. sapiens
ggcgtgaacccaggagg

SEQ ID NO: 115156 - DNA, 17 bp, H. sapiens
ggcgtgaacccgggaag

SEQ ID NO: 115157 - DNA, 17 bp, H. sapiens
ggcgtgaacccgggagg

SEQ ID NO: 115158 - DNA, 16 bp, H. sapiens
ggcgtgaacctggaag

SEQ ID NO: 115159 - DNA, 17 bp, H. sapiens
ggcgtgaacctgggagg

SEQ ID NO: 115160 - DNA, 17 bp, H. sapiens
ggcgtgaacttgggagg

SEQ ID NO: 115161 - DNA, 17 bp, H. sapiens
ggcgtgaatccgggagg

SEQ ID NO: 115162 - DNA, 16 bp, H. sapiens
ggcgtgagccaccaca

SEQ ID NO: 115163 - DNA, 16 bp, H. sapiens
ggcgtgagccaccatt

SEQ ID NO: 115164 - DNA, 16 bp, H. sapiens
ggcgtgagccactgct

SEQ ID NO: 115165 - DNA, 16 bp, H. sapiens
ggcgtgatcttggttc

SEQ ID NO: 115166 - DNA, 16 bp, H. sapiens
ggcgtgcaacaccaca

SEQ ID NO: 115167 - DNA, 16 bp, H. sapiens
ggcgtgctggcaggca

SEQ ID NO: 115168 - DNA, 18 bp, H. sapiens
ggcgtggcggcgcgcacc

SEQ ID NO: 115169 - DNA, 16 bp, H. sapiens
ggcgtggtagcacatg

SEQ ID NO: 115170 - DNA, 16 bp, H. sapiens
ggcgtggtgactcacg

SEQ ID NO: 115171 - DNA, 16 bp, H. sapiens
ggcgtggtggcacgtg

SEQ ID NO: 115172 - DNA, 16 bp, H. sapiens
ggcgtggtggcgcatg

SEQ ID NO: 115173 - DNA, 17 bp, H. sapiens
ggcgtggtggcgggcac

SEQ ID NO: 115174 - DNA, 16 bp, H. sapiens
ggcgtggtggctcaca

SEQ ID NO: 115175 - DNA, 16 bp, H. sapiens
ggcgtggtggctcacc

SEQ ID NO: 115176 - DNA, 17 bp, H. sapiens
ggcgtggtggctcatgt

SEQ ID NO: 115177 - DNA, 16 bp, H. sapiens
ggcgtggtggtgaaca

SEQ ID NO: 115178 - DNA, 16 bp, H. sapiens
ggcgtgtgccactgcg

SEQ ID NO: 115179 - DNA, 16 bp, H. sapiens
ggcgtgtgttacagtg

SEQ ID NO: 115180 - DNA, 16 bp, H. sapiens
ggcgtttcaccatatt

SEQ ID NO: 115181 - DNA, 16 bp, H. sapiens
ggcgtttcaccatgtt

SEQ ID NO: 115182 - DNA, 16 bp, H. sapiens
ggcgtttcgctcttgt

SEQ ID NO: 115183 - DNA, 16 bp, H. sapiens
ggctaaagagcaagac

SEQ ID NO: 115184 - DNA, 16 bp, H. sapiens
ggctaactgcaacctc

SEQ ID NO: 115185 - DNA, 16 bp, H. sapiens
ggctaactgcagcctc

SEQ ID NO: 115186 - DNA, 16 bp, H. sapiens
ggctaacttttgtgtt

SEQ ID NO: 115187 - DNA, 16 bp, H. sapiens
ggctaaggaaggagga

SEQ ID NO: 115188 - DNA, 16 bp, H. sapiens
ggctaaggcaagagaa

SEQ ID NO: 115189 - DNA, 17 bp, H. sapiens
ggctaaggcatgagaat

SEQ ID NO: 115190 - DNA, 16 bp, H. sapiens
ggctaaggctggtgga

SEQ ID NO: 115191 - DNA, 16 bp, H. sapiens
ggctaagggaggagga

SEQ ID NO: 115192 - DNA, 16 bp, H. sapiens
ggctaataaaggactc

SEQ ID NO: 115193 - DNA, 16 bp, H. sapiens
ggctaattaaaaaaat

SEQ ID NO: 115194 - DNA, 16 bp, H. sapiens
ggctaatttgtgtttt

SEQ ID NO: 115195 - DNA, 16 bp, H. sapiens
ggctaatttgttttgt

SEQ ID NO: 115196 - DNA, 16 bp, H. sapiens
ggctaattttataatt

SEQ ID NO: 115197 - DNA, 16 bp, H. sapiens
ggctaattttcatttt

SEQ ID NO: 115198 - DNA, 16 bp, H. sapiens
ggctaatttttgtatg

SEQ ID NO: 115199 - DNA, 16 bp, H. sapiens
ggctaattttttgtag

SEQ ID NO: 115200 - DNA, 16 bp, H. sapiens
ggctacaaacctgcac

SEQ ID NO: 115201 - DNA, 16 bp, H. sapiens
ggctacagccacacct

SEQ ID NO: 115202 - DNA, 16 bp, H. sapiens
ggctacatgtgcagaa

SEQ ID NO: 115203 - DNA, 16 bp, H. sapiens
ggctacccaggaggct

SEQ ID NO: 115204 - DNA, 16 bp, H. sapiens
ggctacctgggggcca

SEQ ID NO: 115205 - DNA, 16 bp, H. sapiens
ggctactgtattggat

SEQ ID NO: 115206 - DNA, 16 bp, H. sapiens
ggctacttgggaagct

SEQ ID NO: 115207 - DNA, 16 bp, H. sapiens
ggctactttttaaaaa

SEQ ID NO: 115208 - DNA, 16 bp, H. sapiens
ggctagagcaggagga

SEQ ID NO: 115209 - DNA, 16 bp, H. sapiens
ggctagcaaaggtggt

SEQ ID NO: 115210 - DNA, 16 bp, H. sapiens
ggctagccagttctct

SEQ ID NO: 115211 - DNA, 16 bp, H. sapiens
ggctagccatatttag

SEQ ID NO: 115212 - DNA, 16 bp, H. sapiens
ggctagctagaggttt

SEQ ID NO: 115213 - DNA, 16 bp, H. sapiens
ggctaggaaaggaaaa

SEQ ID NO: 115214 - DNA, 16 bp, H. sapiens
ggctatagtgagccaa

SEQ ID NO: 115215 - DNA, 16 bp, H. sapiens
ggctatatatatatat

SEQ ID NO: 115216 - DNA, 16 bp, H. sapiens
ggctatccaggagccc

SEQ ID NO: 115217 - DNA, 16 bp, H. sapiens
ggctatctgcaagcca

SEQ ID NO: 115218 - DNA, 16 bp, H. sapiens
ggctatgattatagag

SEQ ID NO: 115219 - DNA, 16 bp, H. sapiens
ggctatgccctgcccc

SEQ ID NO: 115220 - DNA, 16 bp, H. sapiens
ggctatggatttgtca

SEQ ID NO: 115221 - DNA, 16 bp, H. sapiens
ggctatgtgggctcct

SEQ ID NO: 115222 - DNA, 16 bp, H. sapiens
ggctattattgaaaag

SEQ ID NO: 115223 - DNA, 16 bp, H. sapiens
ggctcaaaacaacaca

SEQ ID NO: 115224 - DNA, 16 bp, H. sapiens
ggctcaaacaatcctc

SEQ ID NO: 115225 - DNA, 16 bp, H. sapiens
ggctcaaacaattctc

SEQ ID NO: 115226 - DNA, 16 bp, H. sapiens
ggctcaacatcactga

SEQ ID NO: 115227 - DNA, 16 bp, H. sapiens
ggctcaagacccagga

SEQ ID NO: 115228 - DNA, 16 bp, H. sapiens
ggctcaagcaatccac

SEQ ID NO: 115229 - DNA, 16 bp, H. sapiens
ggctcaagcaatcctt

SEQ ID NO: 115230 - DNA, 16 bp, H. sapiens
ggctcaagcaattctg

SEQ ID NO: 115231 - DNA, 16 bp, H. sapiens
ggctcaagcagtcttc

SEQ ID NO: 115232 - DNA, 18 bp, H. sapiens
ggctcaagcgatcctccc

SEQ ID NO: 115233 - DNA, 16 bp, H. sapiens
ggctcaagtaatcctc

SEQ ID NO: 115234 - DNA, 16 bp, H. sapiens
ggctcaagtctgggaa

SEQ ID NO: 115235 - DNA, 18 bp, H. sapiens
ggctcaagtgatcctcct

SEQ ID NO: 115236 - DNA, 16 bp, H. sapiens
ggctcaagtgatcctt

SEQ ID NO: 115237 - DNA, 16 bp, H. sapiens
ggctcaagtggtccac

SEQ ID NO: 115238 - DNA, 16 bp, H. sapiens
ggctcaatcgatcctc

SEQ ID NO: 115239 - DNA, 16 bp, H. sapiens
ggctcaatcttggctt

SEQ ID NO: 115240 - DNA, 16 bp, H. sapiens
ggctcaatgcaacctc

SEQ ID NO: 115241 - DNA, 16 bp, H. sapiens
ggctcaatgtaacctc

SEQ ID NO: 115242 - DNA, 16 bp, H. sapiens
ggctcacacacctgta

SEQ ID NO: 115243 - DNA, 16 bp, H. sapiens
ggctcacagcaacctc

SEQ ID NO: 115244 - DNA, 16 bp, H. sapiens
ggctcacagcaacctt

SEQ ID NO: 115245 - DNA, 16 bp, H. sapiens
ggctcacagctgtaat

SEQ ID NO: 115246 - DNA, 16 bp, H. sapiens
ggctcacagcttttgt

SEQ ID NO: 115247 - DNA, 16 bp, H. sapiens
ggctcaccacaacctc

SEQ ID NO: 115248 - DNA, 16 bp, H. sapiens
ggctcaccacaatctc

SEQ ID NO: 115249 - DNA, 16 bp, H. sapiens
ggctcaccacagcctc

SEQ ID NO: 115250 - DNA, 16 bp, H. sapiens
ggctcacccagataat

SEQ ID NO: 115251 - DNA, 16 bp, H. sapiens
ggctcacccctttaat

SEQ ID NO: 115252 - DNA, 16 bp, H. sapiens
ggctcaccgcaacctc

SEQ ID NO: 115253 - DNA, 16 bp, H. sapiens
ggctcaccgcagcctc

SEQ ID NO: 115254 - DNA, 16 bp, H. sapiens
ggctcacggcaacctc

SEQ ID NO: 115255 - DNA, 16 bp, H. sapiens
ggctcactacaacctc

SEQ ID NO: 115256 - DNA, 16 bp, H. sapiens
ggctcactataacctc

SEQ ID NO: 115257 - DNA, 16 bp, H. sapiens
ggctcactccagcctc

SEQ ID NO: 115258 - DNA, 16 bp, H. sapiens
ggctcactgaaacctc

SEQ ID NO: 115259 - DNA, 16 bp, H. sapiens
ggctcactgaacctct

SEQ ID NO: 115260 - DNA, 16 bp, H. sapiens
ggctcactgaagtctt

SEQ ID NO: 115261 - DNA, 16 bp, H. sapiens
ggctcactgcaaaatc

SEQ ID NO: 115262 - DNA, 16 bp, H. sapiens
ggctcactgcaaactc

SEQ ID NO: 115263 - DNA, 16 bp, H. sapiens
ggctcactgcaacatc

SEQ ID NO: 115264 - DNA, 16 bp, H. sapiens
ggctcactgcaacatt

SEQ ID NO: 115265 - DNA, 16 bp, H. sapiens
ggctcactgcaaccac

SEQ ID NO: 115266 - DNA, 16 bp, H. sapiens
ggctcactgcaacctc

SEQ ID NO: 115267 - DNA, 16 bp, H. sapiens
ggctcactgcaacctg

SEQ ID NO: 115268 - DNA, 16 bp, H. sapiens
ggctcactgcaacctt

SEQ ID NO: 115269 - DNA, 16 bp, H. sapiens
ggctcactgcaacgtc

SEQ ID NO: 115270 - DNA, 16 bp, H. sapiens
ggctcactgcaacttc

SEQ ID NO: 115271 - DNA, 16 bp, H. sapiens
ggctcactgcaagccc

SEQ ID NO: 115272 - DNA, 16 bp, H. sapiens
ggctcactgcaagctc

SEQ ID NO: 115273 - DNA, 16 bp, H. sapiens
ggctcactgcaagttc

SEQ ID NO: 115274 - DNA, 16 bp, H. sapiens
ggctcactgcaatctc

SEQ ID NO: 115275 - DNA, 16 bp, H. sapiens
ggctcactgcagactc

SEQ ID NO: 115276 - DNA, 16 bp, H. sapiens
ggctcactgcagcctc

SEQ ID NO: 115277 - DNA, 16 bp, H. sapiens
ggctcactgcagcctg

SEQ ID NO: 115278 - DNA, 16 bp, H. sapiens
ggctcactgcagcctt

SEQ ID NO: 115279 - DNA, 16 bp, H. sapiens
ggctcactgcagcttc

SEQ ID NO: 115280 - DNA, 16 bp, H. sapiens
ggctcactgcaggctc

SEQ ID NO: 115281 - DNA, 16 bp, H. sapiens
ggctcactgcaggctg

SEQ ID NO: 115282 - DNA, 16 bp, H. sapiens
ggctcactgcagtctc

SEQ ID NO: 115283 - DNA, 16 bp, H. sapiens
ggctcactgcatcctc

SEQ ID NO: 115284 - DNA, 16 bp, H. sapiens
ggctcactgccacctc

SEQ ID NO: 115285 - DNA, 16 bp, H. sapiens
ggctcactgcctcctg

SEQ ID NO: 115286 - DNA, 16 bp, H. sapiens
ggctcactgcgacctc

SEQ ID NO: 115287 - DNA, 16 bp, H. sapiens
ggctcactgctacctc

SEQ ID NO: 115288 - DNA, 16 bp, H. sapiens
ggctcactgtaacctc

SEQ ID NO: 115289 - DNA, 16 bp, H. sapiens
ggctcactgtaacttc

SEQ ID NO: 115290 - DNA, 16 bp, H. sapiens
ggctcactgtgacctc

SEQ ID NO: 115291 - DNA, 16 bp, H. sapiens
ggctcacttcaacctc

SEQ ID NO: 115292 - DNA, 25 bp, H. sapiens
ggctcagaaagctgtgaaactcact

SEQ ID NO: 115293 - DNA, 16 bp, H. sapiens
ggctcagaacagagag

SEQ ID NO: 115294 - DNA, 16 bp, H. sapiens
ggctcagaagaagagg

SEQ ID NO: 115295 - DNA, 16 bp, H. sapiens
ggctcagagagggaag

SEQ ID NO: 115296 - DNA, 16 bp, H. sapiens
ggctcagagagggcag

SEQ ID NO: 115297 - DNA, 16 bp, H. sapiens
ggctcagagaggttta

SEQ ID NO: 115298 - DNA, 16 bp, H. sapiens
ggctcagagcatggcc

SEQ ID NO: 115299 - DNA, 16 bp, H. sapiens
ggctcagaggagcctg

SEQ ID NO: 115300 - DNA, 16 bp, H. sapiens
ggctcagagggtccca

SEQ ID NO: 115301 - DNA, 16 bp, H. sapiens
ggctcagcctccccag

SEQ ID NO: 115302 - DNA, 16 bp, H. sapiens
ggctcagctgcagctg

SEQ ID NO: 115303 - DNA, 16 bp, H. sapiens
ggctcaggaggcctca

SEQ ID NO: 115304 - DNA, 16 bp, H. sapiens
ggctcaggaggtctgg

SEQ ID NO: 115305 - DNA, 16 bp, H. sapiens
ggctcaggcaggagga

SEQ ID NO: 115306 - DNA, 16 bp, H. sapiens
ggctcaggcgaccctc

SEQ ID NO: 115307 - DNA, 16 bp, H. sapiens
ggctcaggcgggagga

SEQ ID NO: 115308 - DNA, 16 bp, H. sapiens
ggctcaggctgtggct

SEQ ID NO: 115309 - DNA, 16 bp, H. sapiens
ggctcagggagggagg

SEQ ID NO: 115310 - DNA, 16 bp, H. sapiens
ggctcaggtgggtgga

SEQ ID NO: 115311 - DNA, 16 bp, H. sapiens
ggctcagtccccaaga

SEQ ID NO: 115312 - DNA, 16 bp, H. sapiens
ggctcagtgatcctcc

SEQ ID NO: 115313 - DNA, 16 bp, H. sapiens
ggctcagtgcaacctc

SEQ ID NO: 115314 - DNA, 16 bp, H. sapiens
ggctcagtgcaacctt

SEQ ID NO: 115315 - DNA, 16 bp, H. sapiens
ggctcatgcacggtgc

SEQ ID NO: 115316 - DNA, 16 bp, H. sapiens
ggctcatggcaacctc

SEQ ID NO: 115317 - DNA, 16 bp, H. sapiens
ggctcattgcaacctc

SEQ ID NO: 115318 - DNA, 16 bp, H. sapiens
ggctcattgcaatctc

SEQ ID NO: 115319 - DNA, 16 bp, H. sapiens
ggctcattgcagcctc

SEQ ID NO: 115320 - DNA, 16 bp, H. sapiens
ggctcattgcagcctt

SEQ ID NO: 115321 - DNA, 16 bp, H. sapiens
ggctcattgtaacctc

SEQ ID NO: 115322 - DNA, 16 bp, H. sapiens
ggctcattgtagcctc

SEQ ID NO: 115323 - DNA, 16 bp, H. sapiens
ggctcattgttctgca

SEQ ID NO: 115324 - DNA, 16 bp, H. sapiens
ggctcatttttgcatt

SEQ ID NO: 115325 - DNA, 16 bp, H. sapiens
ggctccacctcctggg

SEQ ID NO: 115326 - DNA, 16 bp, H. sapiens
ggctccaccttcaaca

SEQ ID NO: 115327 - DNA, 16 bp, H. sapiens
ggctccaccttcatga

SEQ ID NO: 115328 - DNA, 16 bp, H. sapiens
ggctccagagcccctg

SEQ ID NO: 115329 - DNA, 16 bp, H. sapiens
ggctccagcctcagcc

SEQ ID NO: 115330 - DNA, 16 bp, H. sapiens
ggctccaggctccagg

SEQ ID NO: 115331 - DNA, 16 bp, H. sapiens
ggctccagtgatcctc

SEQ ID NO: 115332 - DNA, 16 bp, H. sapiens
ggctccatccctggga

SEQ ID NO: 115333 - DNA, 16 bp, H. sapiens
ggctccatctccaaca

SEQ ID NO: 115334 - DNA, 16 bp, H. sapiens
ggctccatgtctcaca

SEQ ID NO: 115335 - DNA, 16 bp, H. sapiens
ggctcccaccaccaca

SEQ ID NO: 115336 - DNA, 16 bp, H. sapiens
ggctcccacctcacag

SEQ ID NO: 115337 - DNA, 16 bp, H. sapiens
ggctcccagagctcgg

SEQ ID NO: 115338 - DNA, 16 bp, H. sapiens
ggctcccaggaggagg

SEQ ID NO: 115339 - DNA, 16 bp, H. sapiens
ggctcccaggctggag

SEQ ID NO: 115340 - DNA, 16 bp, H. sapiens
ggctcccaggtagctg

SEQ ID NO: 115341 - DNA, 16 bp, H. sapiens
ggctcccatgaccttg

SEQ ID NO: 115342 - DNA, 16 bp, H. sapiens
ggctccccactgccca

SEQ ID NO: 115343 - DNA, 16 bp, H. sapiens
ggctcccctttctcca

SEQ ID NO: 115344 - DNA, 16 bp, H. sapiens
ggctccctcagcttgc

SEQ ID NO: 115345 - DNA, 16 bp, H. sapiens
ggctccctgaagggct

SEQ ID NO: 115346 - DNA, 16 bp, H. sapiens
ggctccctgaggacag

SEQ ID NO: 115347 - DNA, 16 bp, H. sapiens
ggctccctgcaacctc

SEQ ID NO: 115348 - DNA, 16 bp, H. sapiens
ggctccctgcagcctc

SEQ ID NO: 115349 - DNA, 16 bp, H. sapiens
ggctccctggaggagg

SEQ ID NO: 115350 - DNA, 16 bp, H. sapiens
ggctcctctctggccc

SEQ ID NO: 115351 - DNA, 16 bp, H. sapiens
ggctcctgaaggaagc

SEQ ID NO: 115352 - DNA, 16 bp, H. sapiens
ggctcctgaagtgctg

SEQ ID NO: 115353 - DNA, 16 bp, H. sapiens
ggctcctgcagccccc

SEQ ID NO: 115354 - DNA, 16 bp, H. sapiens
ggctcctgccaccaca

SEQ ID NO: 115355 - DNA, 16 bp, H. sapiens
ggctcctgcctgctcc

SEQ ID NO: 115356 - DNA, 16 bp, H. sapiens
ggctcctgcctggctc

SEQ ID NO: 115357 - DNA, 16 bp, H. sapiens
ggctcctgcctgtcat

SEQ ID NO: 115358 - DNA, 16 bp, H. sapiens
ggctcctgctgctctg

SEQ ID NO: 115359 - DNA, 16 bp, H. sapiens
ggctcctgggcccagt

SEQ ID NO: 115360 - DNA, 16 bp, H. sapiens
ggctcctgtgcggccc

SEQ ID NO: 115361 - DNA, 16 bp, H. sapiens
ggctcctgtgctgccc

SEQ ID NO: 115362 - DNA, 16 bp, H. sapiens
ggctcctgtgtggccc

SEQ ID NO: 115363 - DNA, 16 bp, H. sapiens
ggctccttctgggaag

SEQ ID NO: 115364 - DNA, 16 bp, H. sapiens
ggctccttgaagttat

SEQ ID NO: 115365 - DNA, 16 bp, H. sapiens
ggctccttgatcttgg

SEQ ID NO: 115366 - DNA, 16 bp, H. sapiens
ggctcgagcaattctc

SEQ ID NO: 115367 - DNA, 16 bp, H. sapiens
ggctcgctgcaacctc

SEQ ID NO: 115368 - DNA, 16 bp, H. sapiens
ggctcgggcatggcgg

SEQ ID NO: 115369 - DNA, 16 bp, H. sapiens
ggctcggtggctcaca

SEQ ID NO: 115370 - DNA, 16 bp, H. sapiens
ggctcgtcctgctaca

SEQ ID NO: 115371 - DNA, 16 bp, H. sapiens
ggctctaagcccagcc

SEQ ID NO: 115372 - DNA, 21 bp, H. sapiens
ggctctagtcaagaatgaatt

SEQ ID NO: 115373 - DNA, 16 bp, H. sapiens
ggctctcagcttgaat

SEQ ID NO: 115374 - DNA, 16 bp, H. sapiens
ggctctcctggttctc

SEQ ID NO: 115375 - DNA, 16 bp, H. sapiens
ggctctccttgctcct

SEQ ID NO: 115376 - DNA, 16 bp, H. sapiens
ggctctcgctctgttg

SEQ ID NO: 115377 - DNA, 16 bp, H. sapiens
ggctctctcctcttcc

SEQ ID NO: 115378 - DNA, 16 bp, H. sapiens
ggctctctccttggct

SEQ ID NO: 115379 - DNA, 16 bp, H. sapiens
ggctctctgcaacctc

SEQ ID NO: 115380 - DNA, 16 bp, H. sapiens
ggctctctgtccccac

SEQ ID NO: 115381 - DNA, 16 bp, H. sapiens
ggctctctttttgtct

SEQ ID NO: 115382 - DNA, 16 bp, H. sapiens
ggctctgaaatgtccc

SEQ ID NO: 115383 - DNA, 16 bp, H. sapiens
ggctctgaactggcac

SEQ ID NO: 115384 - DNA, 16 bp, H. sapiens
ggctctgaccccacag

SEQ ID NO: 115385 - DNA, 16 bp, H. sapiens
ggctctgagcccagca

SEQ ID NO: 115386 - DNA, 16 bp, H. sapiens
ggctctgcagtcagac

SEQ ID NO: 115387 - DNA, 16 bp, H. sapiens
ggctctgcccagtctg

SEQ ID NO: 115388 - DNA, 16 bp, H. sapiens
ggctctgccccccggg

SEQ ID NO: 115389 - DNA, 16 bp, H. sapiens
ggctctgcctcccagg

SEQ ID NO: 115390 - DNA, 16 bp, H. sapiens
ggctctgcgtccccac

SEQ ID NO: 115391 - DNA, 16 bp, H. sapiens
ggctctgcttctgggg

SEQ ID NO: 115392 - DNA, 16 bp, H. sapiens
ggctctggaagtggct

SEQ ID NO: 115393 - DNA, 16 bp, H. sapiens
ggctctggagccagac

SEQ ID NO: 115394 - DNA, 16 bp, H. sapiens
ggctctggaggacaga

SEQ ID NO: 115395 - DNA, 16 bp, H. sapiens
ggctctggcctcagcc

SEQ ID NO: 115396 - DNA, 16 bp, H. sapiens
ggctctggcctcggcc

SEQ ID NO: 115397 - DNA, 16 bp, H. sapiens
ggctctggcctctgct

SEQ ID NO: 115398 - DNA, 16 bp, H. sapiens
ggctctggggccaggc

SEQ ID NO: 115399 - DNA, 16 bp, H. sapiens
ggctctgtcctcatga

SEQ ID NO: 115400 - DNA, 16 bp, H. sapiens
ggctctgtggctcctg

SEQ ID NO: 115401 - DNA, 16 bp, H. sapiens
ggctctgtgggcatgg

SEQ ID NO: 115402 - DNA, 16 bp, H. sapiens
ggctctgtgtccccag

SEQ ID NO: 115403 - DNA, 16 bp, H. sapiens
ggctctgttctgtttc

SEQ ID NO: 115404 - DNA, 16 bp, H. sapiens
ggctcttccacttact

SEQ ID NO: 115405 - DNA, 16 bp, H. sapiens
ggctcttcccactgct

SEQ ID NO: 115406 - DNA, 16 bp, H. sapiens
ggctcttcctgctgct

SEQ ID NO: 115407 - DNA, 16 bp, H. sapiens
ggctcttgagacagga

SEQ ID NO: 115408 - DNA, 16 bp, H. sapiens
ggctctttccccttca

SEQ ID NO: 115409 - DNA, 16 bp, H. sapiens
ggctctttgcaacctc

SEQ ID NO: 115410 - DNA, 16 bp, H. sapiens
ggctcttttttggttc

SEQ ID NO: 115411 - DNA, 16 bp, H. sapiens
ggctgaaaaactacct

SEQ ID NO: 115412 - DNA, 16 bp, H. sapiens
ggctgaaacagaagaa

SEQ ID NO: 115413 - DNA, 16 bp, H. sapiens
ggctgaaagaggccaa

SEQ ID NO: 115414 - DNA, 16 bp, H. sapiens
ggctgaaaggggccaa

SEQ ID NO: 115415 - DNA, 16 bp, H. sapiens
ggctgaactcagctga

SEQ ID NO: 115416 - DNA, 16 bp, H. sapiens
ggctgaacttgaactc

SEQ ID NO: 115417 - DNA, 16 bp, H. sapiens
ggctgaagagagagga

SEQ ID NO: 115418 - DNA, 16 bp, H. sapiens
ggctgaagagggaaga

SEQ ID NO: 115419 - DNA, 16 bp, H. sapiens
ggctgaagcagcagaa

SEQ ID NO: 115420 - DNA, 16 bp, H. sapiens
ggctgaagccatcctc

SEQ ID NO: 115421 - DNA, 16 bp, H. sapiens
ggctgaagcgggagaa

SEQ ID NO: 115422 - DNA, 16 bp, H. sapiens
ggctgaagcgggagga

SEQ ID NO: 115423 - DNA, 16 bp, H. sapiens
ggctgaagcgggtgga

SEQ ID NO: 115424 - DNA, 16 bp, H. sapiens
ggctgaagctggagaa

SEQ ID NO: 115425 - DNA, 16 bp, H. sapiens
ggctgaagctggagga

SEQ ID NO: 115426 - DNA, 16 bp, H. sapiens
ggctgaaggaagagaa

SEQ ID NO: 115427 - DNA, 16 bp, H. sapiens
ggctgaaggaggagga

SEQ ID NO: 115428 - DNA, 16 bp, H. sapiens
ggctgaaggcagccag

SEQ ID NO: 115429 - DNA, 16 bp, H. sapiens
ggctgaagggctcctc

SEQ ID NO: 115430 - DNA, 18 bp, H. sapiens
ggctgaagggctcctcaa

SEQ ID NO: 115431 - DNA, 16 bp, H. sapiens
ggctgaaggtgaaggg

SEQ ID NO: 115432 - DNA, 16 bp, H. sapiens
ggctgaagtaggagga

SEQ ID NO: 115433 - DNA, 16 bp, H. sapiens
ggctgaagtgcagtag

SEQ ID NO: 115434 - DNA, 16 bp, H. sapiens
ggctgaagtgctctgg

SEQ ID NO: 115435 - DNA, 16 bp, H. sapiens
ggctgaagtggatgga

SEQ ID NO: 115436 - DNA, 16 bp, H. sapiens
ggctgaagttggagga

SEQ ID NO: 115437 - DNA, 16 bp, H. sapiens
ggctgaatggggagga

SEQ ID NO: 115438 - DNA, 16 bp, H. sapiens
ggctgacatgggagga

SEQ ID NO: 115439 - DNA, 17 bp, H. sapiens
ggctgacccccacctcc

SEQ ID NO: 115440 - DNA, 16 bp, H. sapiens
ggctgacctctctcag

SEQ ID NO: 115441 - DNA, 16 bp, H. sapiens
ggctgactgcaaactc

SEQ ID NO: 115442 - DNA, 16 bp, H. sapiens
ggctgactgcaacctc

SEQ ID NO: 115443 - DNA, 16 bp, H. sapiens
ggctgagaaaccctgg

SEQ ID NO: 115444 - DNA, 16 bp, H. sapiens
ggctgagaaccactgc

SEQ ID NO: 115445 - DNA, 16 bp, H. sapiens
ggctgagaagaagaca

SEQ ID NO: 115446 - DNA, 16 bp, H. sapiens
ggctgagaagcccaag

SEQ ID NO: 115447 - DNA, 16 bp, H. sapiens
ggctgagaagggaagg

SEQ ID NO: 115448 - DNA, 16 bp, H. sapiens
ggctgagaagggtgga

SEQ ID NO: 115449 - DNA, 16 bp, H. sapiens
ggctgagaagttcaag

SEQ ID NO: 115450 - DNA, 17 bp, H. sapiens
ggctgagacaggtagat

SEQ ID NO: 115451 - DNA, 17 bp, H. sapiens
ggctgagacaggtggat

SEQ ID NO: 115452 - DNA, 16 bp, H. sapiens
ggctgagaccagcctg

SEQ ID NO: 115453 - DNA, 16 bp, H. sapiens
ggctgagacgggtgaa

SEQ ID NO: 115454 - DNA, 16 bp, H. sapiens
ggctgagagaggaaga

SEQ ID NO: 115455 - DNA, 16 bp, H. sapiens
ggctgagaggtgggag

SEQ ID NO: 115456 - DNA, 16 bp, H. sapiens
ggctgagatgatggag

SEQ ID NO: 115457 - DNA, 16 bp, H. sapiens
ggctgagatgcagggc

SEQ ID NO: 115458 - DNA, 16 bp, H. sapiens
ggctgagatggacaga

SEQ ID NO: 115459 - DNA, 16 bp, H. sapiens
ggctgagatggaggat

SEQ ID NO: 115460 - DNA, 16 bp, H. sapiens
ggctgagatgggatga

SEQ ID NO: 115461 - DNA, 16 bp, H. sapiens
ggctgagattggagga

SEQ ID NO: 115462 - DNA, 16 bp, H. sapiens
ggctgagcctggagga

SEQ ID NO: 115463 - DNA, 16 bp, H. sapiens
ggctgagcctgggcac

SEQ ID NO: 115464 - DNA, 16 bp, H. sapiens
ggctgagcgaggtggc

SEQ ID NO: 115465 - DNA, 16 bp, H. sapiens
ggctgagcgcggtggc

SEQ ID NO: 115466 - DNA, 16 bp, H. sapiens
ggctgagcgtggtggc

SEQ ID NO: 115467 - DNA, 16 bp, H. sapiens
ggctgagctcagctgg

SEQ ID NO: 115468 - DNA, 16 bp, H. sapiens
ggctgagctgggtttt

SEQ ID NO: 115469 - DNA, 16 bp, H. sapiens
ggctgagcttggtgag

SEQ ID NO: 115470 - DNA, 16 bp, H. sapiens
ggctgaggaagaggag

SEQ ID NO: 115471 - DNA, 16 bp, H. sapiens
ggctgaggaaggagga

SEQ ID NO: 115472 - DNA, 16 bp, H. sapiens
ggctgaggaaggaggg

SEQ ID NO: 115473 - DNA, 16 bp, H. sapiens
ggctgaggaaggggaa

SEQ ID NO: 115474 - DNA, 16 bp, H. sapiens
ggctgaggaaggtgaa

SEQ ID NO: 115475 - DNA, 16 bp, H. sapiens
ggctgaggaaggtgga

SEQ ID NO: 115476 - DNA, 16 bp, H. sapiens
ggctgaggaatgagga

SEQ ID NO: 115477 - DNA, 16 bp, H. sapiens
ggctgaggacagagga

SEQ ID NO: 115478 - DNA, 16 bp, H. sapiens
ggctgaggagaaagga

SEQ ID NO: 115479 - DNA, 16 bp, H. sapiens
ggctgaggagagagaa

SEQ ID NO: 115480 - DNA, 16 bp, H. sapiens
ggctgaggagagagga

SEQ ID NO: 115481 - DNA, 16 bp, H. sapiens
ggctgaggagagaggg

SEQ ID NO: 115482 - DNA, 16 bp, H. sapiens
ggctgaggagagggag

SEQ ID NO: 115483 - DNA, 16 bp, H. sapiens
ggctgaggagagtgga

SEQ ID NO: 115484 - DNA, 16 bp, H. sapiens
ggctgaggaggaagag

SEQ ID NO: 115485 - DNA, 16 bp, H. sapiens
ggctgaggaggaagga

SEQ ID NO: 115486 - DNA, 16 bp, H. sapiens
ggctgaggaggaggag

SEQ ID NO: 115487 - DNA, 16 bp, H. sapiens
ggctgaggaggaggat

SEQ ID NO: 115488 - DNA, 16 bp, H. sapiens
ggctgaggaggctgag

SEQ ID NO: 115489 - DNA, 16 bp, H. sapiens
ggctgaggagggagga

SEQ ID NO: 115490 - DNA, 16 bp, H. sapiens
ggctgaggagggcaga

SEQ ID NO: 115491 - DNA, 16 bp, H. sapiens
ggctgaggagggcgga

SEQ ID NO: 115492 - DNA, 16 bp, H. sapiens
ggctgaggaggtgctg

SEQ ID NO: 115493 - DNA, 16 bp, H. sapiens
ggctgaggagtgcaag

SEQ ID NO: 115494 - DNA, 16 bp, H. sapiens
ggctgaggagtgctgg

SEQ ID NO: 115495 - DNA, 16 bp, H. sapiens
ggctgaggatggagaa

SEQ ID NO: 115496 - DNA, 16 bp, H. sapiens
ggctgaggcacgagat

SEQ ID NO: 115497 - DNA, 16 bp, H. sapiens
ggctgaggcagaactg

SEQ ID NO: 115498 - DNA, 16 bp, H. sapiens
ggctgaggcagaggag

SEQ ID NO: 115499 - DNA, 16 bp, H. sapiens
ggctgaggcaggaaat

SEQ ID NO: 115500 - DNA, 16 bp, H. sapiens
ggctgaggcaggaaca

SEQ ID NO: 115501 - DNA, 17 bp, H. sapiens
ggctgaggcaggagaat

SEQ ID NO: 115502 - DNA, 27 bp, H. sapiens
ggctgaggcaggagaatggcgtgaacc

SEQ ID NO: 115503 - DNA, 16 bp, H. sapiens
ggctgaggcaggaggg

SEQ ID NO: 115504 - DNA, 16 bp, H. sapiens
ggctgaggcaggaggt

SEQ ID NO: 115505 - DNA, 16 bp, H. sapiens
ggctgaggcaggagtt

SEQ ID NO: 115506 - DNA, 16 bp, H. sapiens
ggctgaggcaggcaat

SEQ ID NO: 115507 - DNA, 17 bp, H. sapiens
ggctgaggcaggcggat

SEQ ID NO: 115508 - DNA, 16 bp, H. sapiens
ggctgaggcaggcggg

SEQ ID NO: 115509 - DNA, 16 bp, H. sapiens
ggctgaggcaggggag

SEQ ID NO: 115510 - DNA, 16 bp, H. sapiens
ggctgaggcaggtggc

SEQ ID NO: 115511 - DNA, 16 bp, H. sapiens
ggctgaggcatgggaa

SEQ ID NO: 115512 - DNA, 16 bp, H. sapiens
ggctgaggccagagaa

SEQ ID NO: 115513 - DNA, 16 bp, H. sapiens
ggctgaggccagagga

SEQ ID NO: 115514 - DNA, 16 bp, H. sapiens
ggctgaggcccaggga

SEQ ID NO: 115515 - DNA, 16 bp, H. sapiens
ggctgaggcctgagga

SEQ ID NO: 115516 - DNA, 16 bp, H. sapiens
ggctgaggcggaagaa

SEQ ID NO: 115517 - DNA, 16 bp, H. sapiens
ggctgaggcggacgga

SEQ ID NO: 115518 - DNA, 16 bp, H. sapiens
ggctgaggcgggagac

SEQ ID NO: 115519 - DNA, 16 bp, H. sapiens
ggctgaggcgggcagc

SEQ ID NO: 115520 - DNA, 16 bp, H. sapiens
ggctgaggcgggcagg

SEQ ID NO: 115521 - DNA, 19 bp, H. sapiens
ggctgaggcgggcgaatca

SEQ ID NO: 115522 - DNA, 16 bp, H. sapiens
ggctgaggcgggcgga

SEQ ID NO: 115523 - DNA, 19 bp, H. sapiens
ggctgaggcgggcggatca

SEQ ID NO: 115524 - DNA, 17 bp, H. sapiens
ggctgaggcgggtggat

SEQ ID NO: 115525 - DNA, 16 bp, H. sapiens
ggctgaggctgaagga

SEQ ID NO: 115526 - DNA, 16 bp, H. sapiens
ggctgaggctgagatg

SEQ ID NO: 115527 - DNA, 16 bp, H. sapiens
ggctgaggctgaggca

SEQ ID NO: 115528 - DNA, 16 bp, H. sapiens
ggctgaggctgcagag

SEQ ID NO: 115529 - DNA, 16 bp, H. sapiens
ggctgaggctggagaa

SEQ ID NO: 115530 - DNA, 17 bp, H. sapiens
ggctgaggctggcagat

SEQ ID NO: 115531 - DNA, 16 bp, H. sapiens
ggctgaggctgggagg

SEQ ID NO: 115532 - DNA, 16 bp, H. sapiens
ggctgaggctggtgga

SEQ ID NO: 115533 - DNA, 16 bp, H. sapiens
ggctgaggcttcagtg

SEQ ID NO: 115534 - DNA, 16 bp, H. sapiens
ggctgagggaagagaa

SEQ ID NO: 115535 - DNA, 16 bp, H. sapiens
ggctgagggaaggagg

SEQ ID NO: 115536 - DNA, 16 bp, H. sapiens
ggctgagggagaagaa

SEQ ID NO: 115537 - DNA, 16 bp, H. sapiens
ggctgagggaggagga

SEQ ID NO: 115538 - DNA, 16 bp, H. sapiens
ggctgagggaggtgaa

SEQ ID NO: 115539 - DNA, 16 bp, H. sapiens
ggctgagggaggtgga

SEQ ID NO: 115540 - DNA, 16 bp, H. sapiens
ggctgaggggagagga

SEQ ID NO: 115541 - DNA, 16 bp, H. sapiens
ggctgaggtagaaaga

SEQ ID NO: 115542 - DNA, 16 bp, H. sapiens
ggctgaggtcagagaa

SEQ ID NO: 115543 - DNA, 16 bp, H. sapiens
ggctgaggtcaggagt

SEQ ID NO: 115544 - DNA, 16 bp, H. sapiens
ggctgaggtgagaggg

SEQ ID NO: 115545 - DNA, 16 bp, H. sapiens
ggctgaggtgcaagga

SEQ ID NO: 115546 - DNA, 16 bp, H. sapiens
ggctgaggtggaagaa

SEQ ID NO: 115547 - DNA, 16 bp, H. sapiens
ggctgaggtggagaat

SEQ ID NO: 115548 - DNA, 16 bp, H. sapiens
ggctgaggtggaggaa

SEQ ID NO: 115549 - DNA, 16 bp, H. sapiens
ggctgaggtggaggat

SEQ ID NO: 115550 - DNA, 16 bp, H. sapiens
ggctgaggtggaggtg

SEQ ID NO: 115551 - DNA, 16 bp, H. sapiens
ggctgaggtggatggg

SEQ ID NO: 115552 - DNA, 17 bp, H. sapiens
ggctgaggtgggaggag

SEQ ID NO: 115553 - DNA, 16 bp, H. sapiens
ggctgaggtgggaggc

SEQ ID NO: 115554 - DNA, 16 bp, H. sapiens
ggctgaggtgggcaaa

SEQ ID NO: 115555 - DNA, 16 bp, H. sapiens
ggctgaggtgggcagg

SEQ ID NO: 115556 - DNA, 17 bp, H. sapiens
ggctgaggtgggcgaat

SEQ ID NO: 115557 - DNA, 16 bp, H. sapiens
ggctgaggtgggcgca

SEQ ID NO: 115558 - DNA, 16 bp, H. sapiens
ggctgaggtgggtggc

SEQ ID NO: 115559 - DNA, 16 bp, H. sapiens
ggctgaggtggttgga

SEQ ID NO: 115560 - DNA, 16 bp, H. sapiens
ggctgaggttggagga

SEQ ID NO: 115561 - DNA, 16 bp, H. sapiens
ggctgagtgaggagaa

SEQ ID NO: 115562 - DNA, 17 bp, H. sapiens
ggctgatcccgaactcc

SEQ ID NO: 115563 - DNA, 16 bp, H. sapiens
ggctgatcttgagctc

SEQ ID NO: 115564 - DNA, 16 bp, H. sapiens
ggctgatgcaggagaa

SEQ ID NO: 115565 - DNA, 16 bp, H. sapiens
ggctgatggaggagaa

SEQ ID NO: 115566 - DNA, 16 bp, H. sapiens
ggctgatggcagcatg

SEQ ID NO: 115567 - DNA, 16 bp, H. sapiens
ggctgatgtgggaaga

SEQ ID NO: 115568 - DNA, 16 bp, H. sapiens
ggctgatgtgggagga

SEQ ID NO: 115569 - DNA, 17 bp, H. sapiens
ggctgatgtgggcggat

SEQ ID NO: 115570 - DNA, 16 bp, H. sapiens
ggctgatgtggtctca

SEQ ID NO: 115571 - DNA, 16 bp, H. sapiens
ggctgatttttttatt

SEQ ID NO: 115572 - DNA, 16 bp, H. sapiens
ggctgcaagacctgaa

SEQ ID NO: 115573 - DNA, 16 bp, H. sapiens
ggctgcacaagaagca

SEQ ID NO: 115574 - DNA, 16 bp, H. sapiens
ggctgcagagcagtgg

SEQ ID NO: 115575 - DNA, 16 bp, H. sapiens
ggctgcagagcgagac

SEQ ID NO: 115576 - DNA, 16 bp, H. sapiens
ggctgcagaggcctca

SEQ ID NO: 115577 - DNA, 16 bp, H. sapiens
ggctgcagcaaaccac

SEQ ID NO: 115578 - DNA, 16 bp, H. sapiens
ggctgcagcaagctga

SEQ ID NO: 115579 - DNA, 16 bp, H. sapiens
ggctgcagcagcagca

SEQ ID NO: 115580 - DNA, 16 bp, H. sapiens
ggctgcagcaggagga

SEQ ID NO: 115581 - DNA, 16 bp, H. sapiens
ggctgcagcaggggag

SEQ ID NO: 115582 - DNA, 16 bp, H. sapiens
ggctgcagcctggcag

SEQ ID NO: 115583 - DNA, 16 bp, H. sapiens
ggctgcagctgctgcc

SEQ ID NO: 115584 - DNA, 16 bp, H. sapiens
ggctgcaggaacacag

SEQ ID NO: 115585 - DNA, 16 bp, H. sapiens
ggctgcaggaagccat

SEQ ID NO: 115586 - DNA, 16 bp, H. sapiens
ggctgcaggaaggaga

SEQ ID NO: 115587 - DNA, 16 bp, H. sapiens
ggctgcaggagagaga

SEQ ID NO: 115588 - DNA, 16 bp, H. sapiens
ggctgcagggaggcag

SEQ ID NO: 115589 - DNA, 16 bp, H. sapiens
ggctgcaggggctggg

SEQ ID NO: 115590 - DNA, 16 bp, H. sapiens
ggctgcaggtccccag

SEQ ID NO: 115591 - DNA, 16 bp, H. sapiens
ggctgcaggtcctgag

SEQ ID NO: 115592 - DNA, 16 bp, H. sapiens
ggctgcaggtgcacac

SEQ ID NO: 115593 - DNA, 16 bp, H. sapiens
ggctgcagtacagtgg

SEQ ID NO: 115594 - DNA, 16 bp, H. sapiens
ggctgcagtgagcttt

SEQ ID NO: 115595 - DNA, 16 bp, H. sapiens
ggctgcagtgcagcgg

SEQ ID NO: 115596 - DNA, 16 bp, H. sapiens
ggctgcatgatattcc

SEQ ID NO: 115597 - DNA, 16 bp, H. sapiens
ggctgcatgcggtggc

SEQ ID NO: 115598 - DNA, 16 bp, H. sapiens
ggctgcattcccaaga

SEQ ID NO: 115599 - DNA, 16 bp, H. sapiens
ggctgcattcccagac

SEQ ID NO: 115600 - DNA, 16 bp, H. sapiens
ggctgccacctcacag

SEQ ID NO: 115601 - DNA, 16 bp, H. sapiens
ggctgccacctcgcag

SEQ ID NO: 115602 - DNA, 16 bp, H. sapiens
ggctgccactgccatc

SEQ ID NO: 115603 - DNA, 16 bp, H. sapiens
ggctgccagcattcct

SEQ ID NO: 115604 - DNA, 16 bp, H. sapiens
ggctgccaggcagagg

SEQ ID NO: 115605 - DNA, 16 bp, H. sapiens
ggctgccagggactgg

SEQ ID NO: 115606 - DNA, 16 bp, H. sapiens
ggctgccagggcctgg

SEQ ID NO: 115607 - DNA, 16 bp, H. sapiens
ggctgccataaaaaaa

SEQ ID NO: 115608 - DNA, 16 bp, H. sapiens
ggctgcccagattcct

SEQ ID NO: 115609 - DNA, 16 bp, H. sapiens
ggctgccccagctgct

SEQ ID NO: 115610 - DNA, 16 bp, H. sapiens
ggctgccccaggaagg

SEQ ID NO: 115611 - DNA, 16 bp, H. sapiens
ggctgccccccacctc

SEQ ID NO: 115612 - DNA, 17 bp, H. sapiens
ggctgcccgagccagca

SEQ ID NO: 115613 - DNA, 16 bp, H. sapiens
ggctgccgtgagctga

SEQ ID NO: 115614 - DNA, 16 bp, H. sapiens
ggctgcctcctgccac

SEQ ID NO: 115615 - DNA, 16 bp, H. sapiens
ggctgcctctgctgca

SEQ ID NO: 115616 - DNA, 16 bp, H. sapiens
ggctgcctctgctgct

SEQ ID NO: 115617 - DNA, 16 bp, H. sapiens
ggctgcctggaggaag

SEQ ID NO: 115618 - DNA, 16 bp, H. sapiens
ggctgcctggaggagg

SEQ ID NO: 115619 - DNA, 16 bp, H. sapiens
ggctgccttcatgggc

SEQ ID NO: 115620 - DNA, 16 bp, H. sapiens
ggctgccttccccaag

SEQ ID NO: 115621 - DNA, 16 bp, H. sapiens
ggctgccttcctgctg

SEQ ID NO: 115622 - DNA, 16 bp, H. sapiens
ggctgccttctctctg

SEQ ID NO: 115623 - DNA, 16 bp, H. sapiens
ggctgcgcgcggcgct

SEQ ID NO: 115624 - DNA, 16 bp, H. sapiens
ggctgcggcaggagaa

SEQ ID NO: 115625 - DNA, 16 bp, H. sapiens
ggctgcggtgcagtgg

SEQ ID NO: 115626 - DNA, 16 bp, H. sapiens
ggctgcggtgggagga

SEQ ID NO: 115627 - DNA, 16 bp, H. sapiens
ggctgctatgcaagct

SEQ ID NO: 115628 - DNA, 16 bp, H. sapiens
ggctgctccagctcca

SEQ ID NO: 115629 - DNA, 16 bp, H. sapiens
ggctgctccatagaca

SEQ ID NO: 115630 - DNA, 16 bp, H. sapiens
ggctgctccttctcag

SEQ ID NO: 115631 - DNA, 16 bp, H. sapiens
ggctgctctaacaaaa

SEQ ID NO: 115632 - DNA, 16 bp, H. sapiens
ggctgctctagaactc

SEQ ID NO: 115633 - DNA, 16 bp, H. sapiens
ggctgctctcaaactg

SEQ ID NO: 115634 - DNA, 17 bp, H. sapiens
ggctgctctcgaactcc

SEQ ID NO: 115635 - DNA, 16 bp, H. sapiens
ggctgctctcgatctc

SEQ ID NO: 115636 - DNA, 16 bp, H. sapiens
ggctgctctgcctatg

SEQ ID NO: 115637 - DNA, 16 bp, H. sapiens
ggctgctgacctttgg

SEQ ID NO: 115638 - DNA, 16 bp, H. sapiens
ggctgctgcctgctcc

SEQ ID NO: 115639 - DNA, 16 bp, H. sapiens
ggctgctgctgctgct

SEQ ID NO: 115640 - DNA, 16 bp, H. sapiens
ggctgctgctgctgtg

SEQ ID NO: 115641 - DNA, 16 bp, H. sapiens
ggctgctggagccagc

SEQ ID NO: 115642 - DNA, 16 bp, H. sapiens
ggctgctggcaggcag

SEQ ID NO: 115643 - DNA, 16 bp, H. sapiens
ggctgctggctggaga

SEQ ID NO: 115644 - DNA, 16 bp, H. sapiens
ggctgctgggaggtgg

SEQ ID NO: 115645 - DNA, 16 bp, H. sapiens
ggctgctgggctgctg

SEQ ID NO: 115646 - DNA, 16 bp, H. sapiens
ggctgctgggggtgac

SEQ ID NO: 115647 - DNA, 16 bp, H. sapiens
ggctgctgggtggaga

SEQ ID NO: 115648 - DNA, 16 bp, H. sapiens
ggctgctggtgggagg

SEQ ID NO: 115649 - DNA, 16 bp, H. sapiens
ggctgctgtgaagact

SEQ ID NO: 115650 - DNA, 16 bp, H. sapiens
ggctgctgtgagaatt

SEQ ID NO: 115651 - DNA, 16 bp, H. sapiens
ggctgctttctgcact

SEQ ID NO: 115652 - DNA, 16 bp, H. sapiens
ggctggaacagctggg

SEQ ID NO: 115653 - DNA, 16 bp, H. sapiens
ggctggaacaggagga

SEQ ID NO: 115654 - DNA, 16 bp, H. sapiens
ggctggaacctgggag

SEQ ID NO: 115655 - DNA, 16 bp, H. sapiens
ggctggaactcctgac

SEQ ID NO: 115656 - DNA, 16 bp, H. sapiens
ggctggaaggctgaga

SEQ ID NO: 115657 - DNA, 16 bp, H. sapiens
ggctggaagtgcaatg

SEQ ID NO: 115658 - DNA, 16 bp, H. sapiens
ggctggaatagagtgg

SEQ ID NO: 115659 - DNA, 19 bp, H. sapiens
ggctggaatgcaatggcgc

SEQ ID NO: 115660 - DNA, 16 bp, H. sapiens
ggctggaatggctgag

SEQ ID NO: 115661 - DNA, 16 bp, H. sapiens
ggctggacgcagtggc

SEQ ID NO: 115662 - DNA, 16 bp, H. sapiens
ggctggagaacagtgg

SEQ ID NO: 115663 - DNA, 16 bp, H. sapiens
ggctggagaaggaaat

SEQ ID NO: 115664 - DNA, 16 bp, H. sapiens
ggctggagaaggagga

SEQ ID NO: 115665 - DNA, 16 bp, H. sapiens
ggctggagaccagtgg

SEQ ID NO: 115666 - DNA, 16 bp, H. sapiens
ggctggagacccaggg

SEQ ID NO: 115667 - DNA, 16 bp, H. sapiens
ggctggagagagagga

SEQ ID NO: 115668 - DNA, 16 bp, H. sapiens
ggctggagagagggag

SEQ ID NO: 115669 - DNA, 16 bp, H. sapiens
ggctggagaggctggg

SEQ ID NO: 115670 - DNA, 16 bp, H. sapiens
ggctggagagggaggc

SEQ ID NO: 115671 - DNA, 16 bp, H. sapiens
ggctggagatgaggct

SEQ ID NO: 115672 - DNA, 16 bp, H. sapiens
ggctggagcagctgag

SEQ ID NO: 115673 - DNA, 16 bp, H. sapiens
ggctggagcagctgga

SEQ ID NO: 115674 - DNA, 16 bp, H. sapiens
ggctggagcagctggg

SEQ ID NO: 115675 - DNA, 16 bp, H. sapiens
ggctggagcaggagga

SEQ ID NO: 115676 - DNA, 16 bp, H. sapiens
ggctggagcaggtgga

SEQ ID NO: 115677 - DNA, 16 bp, H. sapiens
ggctggagcccaggag

SEQ ID NO: 115678 - DNA, 16 bp, H. sapiens
ggctggagccgtggca

SEQ ID NO: 115679 - DNA, 16 bp, H. sapiens
ggctggagctgagctt

SEQ ID NO: 115680 - DNA, 16 bp, H. sapiens
ggctggagctgctggg

SEQ ID NO: 115681 - DNA, 16 bp, H. sapiens
ggctggagctggaggc

SEQ ID NO: 115682 - DNA, 16 bp, H. sapiens
ggctggagctgttcct

SEQ ID NO: 115683 - DNA, 16 bp, H. sapiens
ggctggaggagagaga

SEQ ID NO: 115684 - DNA, 16 bp, H. sapiens
ggctggaggagagtgg

SEQ ID NO: 115685 - DNA, 16 bp, H. sapiens
ggctggaggaggagaa

SEQ ID NO: 115686 - DNA, 16 bp, H. sapiens
ggctggaggaggcagg

SEQ ID NO: 115687 - DNA, 16 bp, H. sapiens
ggctggaggagggcag

SEQ ID NO: 115688 - DNA, 16 bp, H. sapiens
ggctggaggaggtggt

SEQ ID NO: 115689 - DNA, 16 bp, H. sapiens
ggctggaggccaacca

SEQ ID NO: 115690 - DNA, 16 bp, H. sapiens
ggctggaggccagagg

SEQ ID NO: 115691 - DNA, 16 bp, H. sapiens
ggctggaggcccaggc

SEQ ID NO: 115692 - DNA, 16 bp, H. sapiens
ggctggagggaactag

SEQ ID NO: 115693 - DNA, 16 bp, H. sapiens
ggctggagggaaggag

SEQ ID NO: 115694 - DNA, 16 bp, H. sapiens
ggctggagggcaaagg

SEQ ID NO: 115695 - DNA, 16 bp, H. sapiens
ggctggagggcagagg

SEQ ID NO: 115696 - DNA, 16 bp, H. sapiens
ggctggagggcagcag

SEQ ID NO: 115697 - DNA, 16 bp, H. sapiens
ggctggaggtgggaag

SEQ ID NO: 115698 - DNA, 19 bp, H. sapiens
ggctggagtacaatggcat

SEQ ID NO: 115699 - DNA, 20 bp, H. sapiens
ggctggagtacaatggcgtg

SEQ ID NO: 115700 - DNA, 16 bp, H. sapiens
ggctggagtacagagg

SEQ ID NO: 115701 - DNA, 16 bp, H. sapiens
ggctggagtaccgtgg

SEQ ID NO: 115702 - DNA, 16 bp, H. sapiens
ggctggagtataatgg

SEQ ID NO: 115703 - DNA, 16 bp, H. sapiens
ggctggagtgaaatgg

SEQ ID NO: 115704 - DNA, 16 bp, H. sapiens
ggctggagtgaggtgg

SEQ ID NO: 115705 - DNA, 16 bp, H. sapiens
ggctggagtgcagaga

SEQ ID NO: 115706 - DNA, 17 bp, H. sapiens
ggctggagtgccgtggt

SEQ ID NO: 115707 - DNA, 16 bp, H. sapiens
ggctggagtgcggtgc

SEQ ID NO: 115708 - DNA, 16 bp, H. sapiens
ggctggagtggagtga

SEQ ID NO: 115709 - DNA, 16 bp, H. sapiens
ggctggagtggctggg

SEQ ID NO: 115710 - DNA, 16 bp, H. sapiens
ggctggagtgggaaga

SEQ ID NO: 115711 - DNA, 16 bp, H. sapiens
ggctggagtgggagga

SEQ ID NO: 115712 - DNA, 16 bp, H. sapiens
ggctggagtggtgcag

SEQ ID NO: 115713 - DNA, 16 bp, H. sapiens
ggctggagttgcagtg

SEQ ID NO: 115714 - DNA, 16 bp, H. sapiens
ggctggatgcagtggc

SEQ ID NO: 115715 - DNA, 16 bp, H. sapiens
ggctggatgcagtggt

SEQ ID NO: 115716 - DNA, 17 bp, H. sapiens
ggctggatgtggtggca

SEQ ID NO: 115717 - DNA, 16 bp, H. sapiens
ggctggattacagtgg

SEQ ID NO: 115718 - DNA, 16 bp, H. sapiens
ggctggcaagatggcc

SEQ ID NO: 115719 - DNA, 16 bp, H. sapiens
ggctggcaggctgggg

SEQ ID NO: 115720 - DNA, 16 bp, H. sapiens
ggctggcagggaggga

SEQ ID NO: 115721 - DNA, 16 bp, H. sapiens
ggctggcagggctggc

SEQ ID NO: 115722 - DNA, 16 bp, H. sapiens
ggctggcaggggccag

SEQ ID NO: 115723 - DNA, 16 bp, H. sapiens
ggctggccaaggccag

SEQ ID NO: 115724 - DNA, 16 bp, H. sapiens
ggctggccaaggctgg

SEQ ID NO: 115725 - DNA, 16 bp, H. sapiens
ggctggccaggcacgg

SEQ ID NO: 115726 - DNA, 16 bp, H. sapiens
ggctggccaggtgcag

SEQ ID NO: 115727 - DNA, 16 bp, H. sapiens
ggctggccgggcagag

SEQ ID NO: 115728 - DNA, 16 bp, H. sapiens
ggctggccgggcgcag

SEQ ID NO: 115729 - DNA, 16 bp, H. sapiens
ggctggcctcagactc

SEQ ID NO: 115730 - DNA, 16 bp, H. sapiens
ggctggcctggcctgg

SEQ ID NO: 115731 - DNA, 16 bp, H. sapiens
ggctggcctggctggc

SEQ ID NO: 115732 - DNA, 16 bp, H. sapiens
ggctggcctggtggtg

SEQ ID NO: 115733 - DNA, 16 bp, H. sapiens
ggctggctctcagtcc

SEQ ID NO: 115734 - DNA, 16 bp, H. sapiens
ggctggctgaggctgg

SEQ ID NO: 115735 - DNA, 16 bp, H. sapiens
ggctggctggctggct

SEQ ID NO: 115736 - DNA, 16 bp, H. sapiens
ggctggctgggcaggg

SEQ ID NO: 115737 - DNA, 16 bp, H. sapiens
ggctggctgggcatgg

SEQ ID NO: 115738 - DNA, 16 bp, H. sapiens
ggctggctgggtgcag

SEQ ID NO: 115739 - DNA, 16 bp, H. sapiens
ggctggcttcaaactc

SEQ ID NO: 115740 - DNA, 16 bp, H. sapiens
ggctggcttcatgggc

SEQ ID NO: 115741 - DNA, 16 bp, H. sapiens
ggctggctttggggct

SEQ ID NO: 115742 - DNA, 16 bp, H. sapiens
ggctgggaagcttgaa

SEQ ID NO: 115743 - DNA, 16 bp, H. sapiens
ggctgggaaggaggag

SEQ ID NO: 115744 - DNA, 16 bp, H. sapiens
ggctgggaagggaagg

SEQ ID NO: 115745 - DNA, 16 bp, H. sapiens
ggctgggaagggcagt

SEQ ID NO: 115746 - DNA, 16 bp, H. sapiens
ggctgggaccacaggt

SEQ ID NO: 115747 - DNA, 16 bp, H. sapiens
ggctgggacccagggc

SEQ ID NO: 115748 - DNA, 16 bp, H. sapiens
ggctgggactacaggt

SEQ ID NO: 115749 - DNA, 16 bp, H. sapiens
ggctgggagccaggag

SEQ ID NO: 115750 - DNA, 16 bp, H. sapiens
ggctgggagctggagg

SEQ ID NO: 115751 - DNA, 16 bp, H. sapiens
ggctgggagcttggag

SEQ ID NO: 115752 - DNA, 16 bp, H. sapiens
ggctgggaggagaagg

SEQ ID NO: 115753 - DNA, 16 bp, H. sapiens
ggctgggaggagagag

SEQ ID NO: 115754 - DNA, 16 bp, H. sapiens
ggctgggaggaggaag

SEQ ID NO: 115755 - DNA, 16 bp, H. sapiens
ggctgggaggggctgc

SEQ ID NO: 115756 - DNA, 16 bp, H. sapiens
ggctgggaggtctcag

SEQ ID NO: 115757 - DNA, 17 bp, H. sapiens
ggctgggatgaagggtg

SEQ ID NO: 115758 - DNA, 16 bp, H. sapiens
ggctgggatgcagggc

SEQ ID NO: 115759 - DNA, 16 bp, H. sapiens
ggctgggattacaggc

SEQ ID NO: 115760 - DNA, 16 bp, H. sapiens
ggctgggattataggc

SEQ ID NO: 115761 - DNA, 16 bp, H. sapiens
ggctgggcacaggggc

SEQ ID NO: 115762 - DNA, 18 bp, H. sapiens
ggctgggcacagtggctt

SEQ ID NO: 115763 - DNA, 16 bp, H. sapiens
ggctgggcacggtggc

SEQ ID NO: 115764 - DNA, 16 bp, H. sapiens
ggctgggcacgtggct

SEQ ID NO: 115765 - DNA, 16 bp, H. sapiens
ggctgggcagaggcac

SEQ ID NO: 115766 - DNA, 16 bp, H. sapiens
ggctgggcagctgcag

SEQ ID NO: 115767 - DNA, 16 bp, H. sapiens
ggctgggcaggggctg

SEQ ID NO: 115768 - DNA, 16 bp, H. sapiens
ggctgggcaggtggct

SEQ ID NO: 115769 - DNA, 16 bp, H. sapiens
ggctgggcatgctggc

SEQ ID NO: 115770 - DNA, 17 bp, H. sapiens
ggctgggcatggtggcg

SEQ ID NO: 115771 - DNA, 16 bp, H. sapiens
ggctgggcatgtggct

SEQ ID NO: 115772 - DNA, 16 bp, H. sapiens
ggctgggcattgtggc

SEQ ID NO: 115773 - DNA, 16 bp, H. sapiens
ggctgggccacagagc

SEQ ID NO: 115774 - DNA, 16 bp, H. sapiens
ggctgggcccaggatc

SEQ ID NO: 115775 - DNA, 16 bp, H. sapiens
ggctgggcccagggtc

SEQ ID NO: 115776 - DNA, 16 bp, H. sapiens
ggctgggcccagggtt

SEQ ID NO: 115777 - DNA, 16 bp, H. sapiens
ggctgggcccttcctg

SEQ ID NO: 115778 - DNA, 16 bp, H. sapiens
ggctgggcgcaggggc

SEQ ID NO: 115779 - DNA, 19 bp, H. sapiens
ggctgggcgcagtggctca

SEQ ID NO: 115780 - DNA, 16 bp, H. sapiens
ggctgggctcagggcc

SEQ ID NO: 115781 - DNA, 16 bp, H. sapiens
ggctgggctgggcctg

SEQ ID NO: 115782 - DNA, 16 bp, H. sapiens
ggctggggaaggcaga

SEQ ID NO: 115783 - DNA, 16 bp, H. sapiens
ggctggggaaggggaa

SEQ ID NO: 115784 - DNA, 16 bp, H. sapiens
ggctggggagagaagg

SEQ ID NO: 115785 - DNA, 16 bp, H. sapiens
ggctggggagcctggg

SEQ ID NO: 115786 - DNA, 16 bp, H. sapiens
ggctggggaggagccc

SEQ ID NO: 115787 - DNA, 16 bp, H. sapiens
ggctggggaggcctca

SEQ ID NO: 115788 - DNA, 16 bp, H. sapiens
ggctggggagtcctca

SEQ ID NO: 115789 - DNA, 16 bp, H. sapiens
ggctggggcagaatga

SEQ ID NO: 115790 - DNA, 16 bp, H. sapiens
ggctggggcagcctgc

SEQ ID NO: 115791 - DNA, 16 bp, H. sapiens
ggctggggcagctggg

SEQ ID NO: 115792 - DNA, 16 bp, H. sapiens
ggctggggcaggaaaa

SEQ ID NO: 115793 - DNA, 16 bp, H. sapiens
ggctggggcaggacaa

SEQ ID NO: 115794 - DNA, 16 bp, H. sapiens
ggctggggcaggagca

SEQ ID NO: 115795 - DNA, 16 bp, H. sapiens
ggctggggcaggagga

SEQ ID NO: 115796 - DNA, 16 bp, H. sapiens
ggctggggcaggggaa

SEQ ID NO: 115797 - DNA, 16 bp, H. sapiens
ggctggggcctgggag

SEQ ID NO: 115798 - DNA, 16 bp, H. sapiens
ggctggggctacaggt

SEQ ID NO: 115799 - DNA, 16 bp, H. sapiens
ggctggggctgctgcc

SEQ ID NO: 115800 - DNA, 16 bp, H. sapiens
ggctggggctggagaa

SEQ ID NO: 115801 - DNA, 16 bp, H. sapiens
ggctggggctggagga

SEQ ID NO: 115802 - DNA, 16 bp, H. sapiens
ggctggggctggcagg

SEQ ID NO: 115803 - DNA, 16 bp, H. sapiens
ggctggggctgggcag

SEQ ID NO: 115804 - DNA, 16 bp, H. sapiens
ggctgggggcctggac

SEQ ID NO: 115805 - DNA, 16 bp, H. sapiens
ggctgggggctgaccc

SEQ ID NO: 115806 - DNA, 16 bp, H. sapiens
ggctgggggtgcagtg

SEQ ID NO: 115807 - DNA, 16 bp, H. sapiens
ggctggggtaggagga

SEQ ID NO: 115808 - DNA, 16 bp, H. sapiens
ggctggggtggccagc

SEQ ID NO: 115809 - DNA, 16 bp, H. sapiens
ggctggggtggcctca

SEQ ID NO: 115810 - DNA, 16 bp, H. sapiens
ggctggggtgggcaga

SEQ ID NO: 115811 - DNA, 16 bp, H. sapiens
ggctgggtaacagagt

SEQ ID NO: 115812 - DNA, 16 bp, H. sapiens
ggctgggtccagggcc

SEQ ID NO: 115813 - DNA, 16 bp, H. sapiens
ggctgggtccccaccc

SEQ ID NO: 115814 - DNA, 16 bp, H. sapiens
ggctgggtgcgctggc

SEQ ID NO: 115815 - DNA, 16 bp, H. sapiens
ggctgggtttgaactc

SEQ ID NO: 115816 - DNA, 16 bp, H. sapiens
ggctggtcattggtgg

SEQ ID NO: 115817 - DNA, 16 bp, H. sapiens
ggctggtcccgaactt

SEQ ID NO: 115818 - DNA, 16 bp, H. sapiens
ggctggtccttgcctt

SEQ ID NO: 115819 - DNA, 16 bp, H. sapiens
ggctggtcttcagctc

SEQ ID NO: 115820 - DNA, 16 bp, H. sapiens
ggctggtcttgaaatc

SEQ ID NO: 115821 - DNA, 16 bp, H. sapiens
ggctggtggattactt

SEQ ID NO: 115822 - DNA, 16 bp, H. sapiens
ggctggtggctgccat

SEQ ID NO: 115823 - DNA, 16 bp, H. sapiens
ggctggtgggaacagg

SEQ ID NO: 115824 - DNA, 16 bp, H. sapiens
ggctggtgggcagtgg

SEQ ID NO: 115825 - DNA, 16 bp, H. sapiens
ggctggtgtgcagtgg

SEQ ID NO: 115826 - DNA, 16 bp, H. sapiens
ggctggttatgaactc

SEQ ID NO: 115827 - DNA, 16 bp, H. sapiens
ggctggttttgaactt

SEQ ID NO: 115828 - DNA, 16 bp, H. sapiens
ggctgtaatcccagtt

SEQ ID NO: 115829 - DNA, 16 bp, H. sapiens
ggctgtacaaacatgg

SEQ ID NO: 115830 - DNA, 16 bp, H. sapiens
ggctgtaggtgtgaag

SEQ ID NO: 115831 - DNA, 16 bp, H. sapiens
ggctgtattctgaagg

SEQ ID NO: 115832 - DNA, 16 bp, H. sapiens
ggctgtatttggagat

SEQ ID NO: 115833 - DNA, 16 bp, H. sapiens
ggctgtcctgtacatt

SEQ ID NO: 115834 - DNA, 16 bp, H. sapiens
ggctgtcttctcacag

SEQ ID NO: 115835 - DNA, 16 bp, H. sapiens
ggctgtgaagtccaag

SEQ ID NO: 115836 - DNA, 16 bp, H. sapiens
ggctgtgaatttgtct

SEQ ID NO: 115837 - DNA, 16 bp, H. sapiens
ggctgtgacttcagag

SEQ ID NO: 115838 - DNA, 16 bp, H. sapiens
ggctgtgagccaagga

SEQ ID NO: 115839 - DNA, 16 bp, H. sapiens
ggctgtgaggactgcc

SEQ ID NO: 115840 - DNA, 16 bp, H. sapiens
ggctgtgagggaggaa

SEQ ID NO: 115841 - DNA, 16 bp, H. sapiens
ggctgtgatgggagga

SEQ ID NO: 115842 - DNA, 16 bp, H. sapiens
ggctgtgcaagatgtg

SEQ ID NO: 115843 - DNA, 16 bp, H. sapiens
ggctgtgccctcatga

SEQ ID NO: 115844 - DNA, 16 bp, H. sapiens
ggctgtgccctggctc

SEQ ID NO: 115845 - DNA, 16 bp, H. sapiens
ggctgtgcgtttgtca

SEQ ID NO: 115846 - DNA, 16 bp, H. sapiens
ggctgtgctggagtct

SEQ ID NO: 115847 - DNA, 16 bp, H. sapiens
ggctgtggacccaggc

SEQ ID NO: 115848 - DNA, 16 bp, H. sapiens
ggctgtggcaggagga

SEQ ID NO: 115849 - DNA, 16 bp, H. sapiens
ggctgtggcaggaggg

SEQ ID NO: 115850 - DNA, 16 bp, H. sapiens
ggctgtggcaggcgga

SEQ ID NO: 115851 - DNA, 16 bp, H. sapiens
ggctgtggctgctgtg

SEQ ID NO: 115852 - DNA, 16 bp, H. sapiens
ggctgtggctgtggct

SEQ ID NO: 115853 - DNA, 16 bp, H. sapiens
ggctgtggcttcagag

SEQ ID NO: 115854 - DNA, 16 bp, H. sapiens
ggctgtgggagagagg

SEQ ID NO: 115855 - DNA, 16 bp, H. sapiens
ggctgtgggcaggagg

SEQ ID NO: 115856 - DNA, 16 bp, H. sapiens
ggctgtgggctgggga

SEQ ID NO: 115857 - DNA, 16 bp, H. sapiens
ggctgtgtcatgggtg

SEQ ID NO: 115858 - DNA, 16 bp, H. sapiens
ggctgtgtccccatct

SEQ ID NO: 115859 - DNA, 16 bp, H. sapiens
ggctgtgtcccccacc

SEQ ID NO: 115860 - DNA, 16 bp, H. sapiens
ggctgtgtgaccttgg

SEQ ID NO: 115861 - DNA, 16 bp, H. sapiens
ggctgtgtgccaataa

SEQ ID NO: 115862 - DNA, 16 bp, H. sapiens
ggctgtgtggccctgg

SEQ ID NO: 115863 - DNA, 16 bp, H. sapiens
ggctgtgtggcctggg

SEQ ID NO: 115864 - DNA, 16 bp, H. sapiens
ggctgtgtggctttgg

SEQ ID NO: 115865 - DNA, 16 bp, H. sapiens
ggctgtgttccaacaa

SEQ ID NO: 115866 - DNA, 16 bp, H. sapiens
ggctgttctagaactc

SEQ ID NO: 115867 - DNA, 16 bp, H. sapiens
ggctgttctcaaactt

SEQ ID NO: 115868 - DNA, 16 bp, H. sapiens
ggctgttgtgaggact

SEQ ID NO: 115869 - DNA, 16 bp, H. sapiens
ggctgtttttaatttt

SEQ ID NO: 115870 - DNA, 16 bp, H. sapiens
ggcttaaataacagaa

SEQ ID NO: 115871 - DNA, 16 bp, H. sapiens
ggcttaagcgattctc

SEQ ID NO: 115872 - DNA, 16 bp, H. sapiens
ggcttaatacctatgt

SEQ ID NO: 115873 - DNA, 16 bp, H. sapiens
ggcttaatacctgggt

SEQ ID NO: 115874 - DNA, 16 bp, H. sapiens
ggcttacacctgaaat

SEQ ID NO: 115875 - DNA, 16 bp, H. sapiens
ggcttacaggtatgag

SEQ ID NO: 115876 - DNA, 16 bp, H. sapiens
ggcttactgcaacctc

SEQ ID NO: 115877 - DNA, 16 bp, H. sapiens
ggcttactgcaagctc

SEQ ID NO: 115878 - DNA, 16 bp, H. sapiens
ggcttactgcaatctc

SEQ ID NO: 115879 - DNA, 16 bp, H. sapiens
ggcttactgcaccctc

SEQ ID NO: 115880 - DNA, 16 bp, H. sapiens
ggcttactgcagcctc

SEQ ID NO: 115881 - DNA, 16 bp, H. sapiens
ggcttataatcccagc

SEQ ID NO: 115882 - DNA, 16 bp, H. sapiens
ggcttatttgacttaa

SEQ ID NO: 115883 - DNA, 16 bp, H. sapiens
ggcttcaaatcttcaa

SEQ ID NO: 115884 - DNA, 16 bp, H. sapiens
ggcttcaacatgaatt

SEQ ID NO: 115885 - DNA, 16 bp, H. sapiens
ggcttcaagaaatcct

SEQ ID NO: 115886 - DNA, 16 bp, H. sapiens
ggcttcacctctcaat

SEQ ID NO: 115887 - DNA, 16 bp, H. sapiens
ggcttcactcctgaag

SEQ ID NO: 115888 - DNA, 16 bp, H. sapiens
ggcttcactggggacc

SEQ ID NO: 115889 - DNA, 16 bp, H. sapiens
ggcttcaggaatgaag

SEQ ID NO: 115890 - DNA, 16 bp, H. sapiens
ggcttcaggcacagct

SEQ ID NO: 115891 - DNA, 16 bp, H. sapiens
ggcttcagggaaagat

SEQ ID NO: 115892 - DNA, 16 bp, H. sapiens
ggcttcagggagcttc

SEQ ID NO: 115893 - DNA, 16 bp, H. sapiens
ggcttcaggtgagacc

SEQ ID NO: 115894 - DNA, 16 bp, H. sapiens
ggcttcagtgcagtgg

SEQ ID NO: 115895 - DNA, 16 bp, H. sapiens
ggcttcatccctgtga

SEQ ID NO: 115896 - DNA, 16 bp, H. sapiens
ggcttcatcttcaaca

SEQ ID NO: 115897 - DNA, 16 bp, H. sapiens
ggcttccaggaggagg

SEQ ID NO: 115898 - DNA, 16 bp, H. sapiens
ggcttcccaagtgctg

SEQ ID NO: 115899 - DNA, 16 bp, H. sapiens
ggcttcccagaggaag

SEQ ID NO: 115900 - DNA, 16 bp, H. sapiens
ggcttcccagagtgct

SEQ ID NO: 115901 - DNA, 16 bp, H. sapiens
ggcttccccagaagcc

SEQ ID NO: 115902 - DNA, 16 bp, H. sapiens
ggcttccccagccact

SEQ ID NO: 115903 - DNA, 16 bp, H. sapiens
ggcttccccagccagg

SEQ ID NO: 115904 - DNA, 16 bp, H. sapiens
ggcttcctaaagtgct

SEQ ID NO: 115905 - DNA, 16 bp, H. sapiens
ggcttcctgaaggagg

SEQ ID NO: 115906 - DNA, 16 bp, H. sapiens
ggcttcctgcaggagg

SEQ ID NO: 115907 - DNA, 16 bp, H. sapiens
ggcttcctggaagaag

SEQ ID NO: 115908 - DNA, 16 bp, H. sapiens
ggcttcctggaagagg

SEQ ID NO: 115909 - DNA, 16 bp, H. sapiens
ggcttcctggagaagg

SEQ ID NO: 115910 - DNA, 16 bp, H. sapiens
ggcttcctggaggaag

SEQ ID NO: 115911 - DNA, 16 bp, H. sapiens
ggcttcctggaggaga

SEQ ID NO: 115912 - DNA, 16 bp, H. sapiens
ggcttcctggaggagc

SEQ ID NO: 115913 - DNA, 16 bp, H. sapiens
ggcttcctggaggagg

SEQ ID NO: 115914 - DNA, 16 bp, H. sapiens
ggcttcctggaggagt

SEQ ID NO: 115915 - DNA, 16 bp, H. sapiens
ggcttcctgtaggagg

SEQ ID NO: 115916 - DNA, 16 bp, H. sapiens
ggcttctcagaggaag

SEQ ID NO: 115917 - DNA, 16 bp, H. sapiens
ggcttctcagaggagg

SEQ ID NO: 115918 - DNA, 16 bp, H. sapiens
ggcttctccaggccca

SEQ ID NO: 115919 - DNA, 16 bp, H. sapiens
ggcttctctgaggaag

SEQ ID NO: 115920 - DNA, 16 bp, H. sapiens
ggcttctctgaggagg

SEQ ID NO: 115921 - DNA, 16 bp, H. sapiens
ggcttctgaggagaat

SEQ ID NO: 115922 - DNA, 16 bp, H. sapiens
ggcttctgcctctggg

SEQ ID NO: 115923 - DNA, 16 bp, H. sapiens
ggcttctggcttccag

SEQ ID NO: 115924 - DNA, 16 bp, H. sapiens
ggcttctgggaaggcc

SEQ ID NO: 115925 - DNA, 16 bp, H. sapiens
ggcttctgggttccct

SEQ ID NO: 115926 - DNA, 16 bp, H. sapiens
ggcttctgtgctgtgt

SEQ ID NO: 115927 - DNA, 16 bp, H. sapiens
ggcttcttggaagagg

SEQ ID NO: 115928 - DNA, 16 bp, H. sapiens
ggcttgaaaccaggag

SEQ ID NO: 115929 - DNA, 16 bp, H. sapiens
ggcttgaatgtgtccc

SEQ ID NO: 115930 - DNA, 16 bp, H. sapiens
ggcttgaatttttccc

SEQ ID NO: 115931 - DNA, 16 bp, H. sapiens
ggcttgactgttgttg

SEQ ID NO: 115932 - DNA, 16 bp, H. sapiens
ggcttgagccacagtg

SEQ ID NO: 115933 - DNA, 16 bp, H. sapiens
ggcttgagccaccaca

SEQ ID NO: 115934 - DNA, 16 bp, H. sapiens
ggcttgagccaccacg

SEQ ID NO: 115935 - DNA, 16 bp, H. sapiens
ggcttgatacctgggt

SEQ ID NO: 115936 - DNA, 16 bp, H. sapiens
ggcttgatcacagctc

SEQ ID NO: 115937 - DNA, 16 bp, H. sapiens
ggcttgcagtgagccg

SEQ ID NO: 115938 - DNA, 16 bp, H. sapiens
ggcttgcccaaggcca

SEQ ID NO: 115939 - DNA, 16 bp, H. sapiens
ggcttgctgcaacctc

SEQ ID NO: 115940 - DNA, 16 bp, H. sapiens
ggcttggaagtgcctg

SEQ ID NO: 115941 - DNA, 16 bp, H. sapiens
ggcttggctgcctggc

SEQ ID NO: 115942 - DNA, 16 bp, H. sapiens
ggcttggctttggtta

SEQ ID NO: 115943 - DNA, 16 bp, H. sapiens
ggcttggggccaggag

SEQ ID NO: 115944 - DNA, 16 bp, H. sapiens
ggcttgggtgatcctc

SEQ ID NO: 115945 - DNA, 16 bp, H. sapiens
ggcttgggtgccagct

SEQ ID NO: 115946 - DNA, 16 bp, H. sapiens
ggcttggtggcttatg

SEQ ID NO: 115947 - DNA, 16 bp, H. sapiens
ggcttggtggtacatg

SEQ ID NO: 115948 - DNA, 16 bp, H. sapiens
ggctttacaggaagca

SEQ ID NO: 115949 - DNA, 16 bp, H. sapiens
ggctttcctggttctc

SEQ ID NO: 115950 - DNA, 16 bp, H. sapiens
ggctttctcaaatgcc

SEQ ID NO: 115951 - DNA, 16 bp, H. sapiens
ggctttctctgaggcc

SEQ ID NO: 115952 - DNA, 16 bp, H. sapiens
ggctttctgtgagcaa

SEQ ID NO: 115953 - DNA, 16 bp, H. sapiens
ggctttgaagatggaa

SEQ ID NO: 115954 - DNA, 16 bp, H. sapiens
ggctttgagcagagga

SEQ ID NO: 115955 - DNA, 16 bp, H. sapiens
ggctttgaggatggag

SEQ ID NO: 115956 - DNA, 16 bp, H. sapiens
ggctttgcaggccatg

SEQ ID NO: 115957 - DNA, 16 bp, H. sapiens
ggctttgctgagctgc

SEQ ID NO: 115958 - DNA, 16 bp, H. sapiens
ggctttggagacagac

SEQ ID NO: 115959 - DNA, 16 bp, H. sapiens
ggctttggagcccccc

SEQ ID NO: 115960 - DNA, 16 bp, H. sapiens
ggctttgggtttgtca

SEQ ID NO: 115961 - DNA, 16 bp, H. sapiens
ggcttttaaaagtcta

SEQ ID NO: 115962 - DNA, 16 bp, H. sapiens
ggcttttatttattta

SEQ ID NO: 115963 - DNA, 16 bp, H. sapiens
ggcttttccaagtgca

SEQ ID NO: 115964 - DNA, 16 bp, H. sapiens
ggcttttccaggcaaa

SEQ ID NO: 115965 - DNA, 16 bp, H. sapiens
ggcttttccaggtgca

SEQ ID NO: 115966 - DNA, 16 bp, H. sapiens
ggcttttctttcttgg

SEQ ID NO: 115967 - DNA, 16 bp, H. sapiens
ggcttttctttgtggg

SEQ ID NO: 115968 - DNA, 16 bp, H. sapiens
ggcttttgacaaaatt

SEQ ID NO: 115969 - DNA, 16 bp, H. sapiens
ggcttttggcttctct

SEQ ID NO: 115970 - DNA, 16 bp, H. sapiens
ggcttttgggtcctct

SEQ ID NO: 115971 - DNA, 16 bp, H. sapiens
ggctttttaaaaaaat

SEQ ID NO: 115972 - DNA, 16 bp, H. sapiens
ggctttttaacttgat

SEQ ID NO: 115973 - DNA, 16 bp, H. sapiens
ggctttttttaaattt

SEQ ID NO: 115974 - DNA, 16 bp, H. sapiens
gggaaaaaaattgcaa

SEQ ID NO: 115975 - DNA, 16 bp, H. sapiens
gggaaaaaatagaaca

SEQ ID NO: 115976 - DNA, 16 bp, H. sapiens
gggaaaaaatatttac

SEQ ID NO: 115977 - DNA, 16 bp, H. sapiens
gggaaaaactgaggca

SEQ ID NO: 115978 - DNA, 16 bp, H. sapiens
gggaaaaagaaataca

SEQ ID NO: 115979 - DNA, 16 bp, H. sapiens
gggaaaaatcatctaa

SEQ ID NO: 115980 - DNA, 16 bp, H. sapiens
gggaaaaattcaagcc

SEQ ID NO: 115981 - DNA, 16 bp, H. sapiens
gggaaaacacacacac

SEQ ID NO: 115982 - DNA, 16 bp, H. sapiens
gggaaaacaggaatta

SEQ ID NO: 115983 - DNA, 16 bp, H. sapiens
gggaaaacctgcctcc

SEQ ID NO: 115984 - DNA, 16 bp, H. sapiens
gggaaaactaaatatc

SEQ ID NO: 115985 - DNA, 16 bp, H. sapiens
gggaaaactgaggctc

SEQ ID NO: 115986 - DNA, 16 bp, H. sapiens
gggaaaagatatttca

SEQ ID NO: 115987 - DNA, 16 bp, H. sapiens
gggaaaagatgaaagc

SEQ ID NO: 115988 - DNA, 16 bp, H. sapiens
gggaaaagccccttat

SEQ ID NO: 115989 - DNA, 16 bp, H. sapiens
gggaaaaggcctcaaa

SEQ ID NO: 115990 - DNA, 16 bp, H. sapiens
gggaaaagttagggaa

SEQ ID NO: 115991 - DNA, 16 bp, H. sapiens
gggaaaataagaattt

SEQ ID NO: 115992 - DNA, 16 bp, H. sapiens
gggaaaatggcactga

SEQ ID NO: 115993 - DNA, 16 bp, H. sapiens
gggaaacacaattcag

SEQ ID NO: 115994 - DNA, 16 bp, H. sapiens
gggaaacatggtgaga

SEQ ID NO: 115995 - DNA, 16 bp, H. sapiens
gggaaaccatcattct

SEQ ID NO: 115996 - DNA, 16 bp, H. sapiens
gggaaaccccttctct

SEQ ID NO: 115997 - DNA, 16 bp, H. sapiens
gggaaaccgaggcagg

SEQ ID NO: 115998 - DNA, 16 bp, H. sapiens
gggaaacctcatctct

SEQ ID NO: 115999 - DNA, 16 bp, H. sapiens
gggaaactgaagcagg

SEQ ID NO: 116000 - DNA, 16 bp, H. sapiens
gggaaactgaagccca

SEQ ID NO: 116001 - DNA, 16 bp, H. sapiens
gggaaactgaggcaca

SEQ ID NO: 116002 - DNA, 16 bp, H. sapiens
gggaaactgaggccca

SEQ ID NO: 116003 - DNA, 16 bp, H. sapiens
gggaaactgaggcccc

SEQ ID NO: 116004 - DNA, 16 bp, H. sapiens
gggaaactgaggtcca

SEQ ID NO: 116005 - DNA, 16 bp, H. sapiens
gggaaactgagtcaca

SEQ ID NO: 116006 - DNA, 16 bp, H. sapiens
gggaaacttctggagg

SEQ ID NO: 116007 - DNA, 16 bp, H. sapiens
gggaaagacctgacca

SEQ ID NO: 116008 - DNA, 16 bp, H. sapiens
gggaaagatcaccttc

SEQ ID NO: 116009 - DNA, 16 bp, H. sapiens
gggaaagcattcagtc

SEQ ID NO: 116010 - DNA, 16 bp, H. sapiens
gggaaagcatttagtc

SEQ ID NO: 116011 - DNA, 16 bp, H. sapiens
gggaaagccctttata

SEQ ID NO: 116012 - DNA, 16 bp, H. sapiens
gggaaagctttcagtc

SEQ ID NO: 116013 - DNA, 16 bp, H. sapiens
gggaaaggacactcta

SEQ ID NO: 116014 - DNA, 16 bp, H. sapiens
gggaaaggcagtctct

SEQ ID NO: 116015 - DNA, 16 bp, H. sapiens
gggaaaggcattccag

SEQ ID NO: 116016 - DNA, 16 bp, H. sapiens
gggaaaggggattctc

SEQ ID NO: 116017 - DNA, 16 bp, H. sapiens
gggaaagtgctacaca

SEQ ID NO: 116018 - DNA, 16 bp, H. sapiens
gggaaagtttgcaact

SEQ ID NO: 116019 - DNA, 16 bp, H. sapiens
gggaaatacaaatgaa

SEQ ID NO: 116020 - DNA, 16 bp, H. sapiens
gggaaatagaaaatca

SEQ ID NO: 116021 - DNA, 16 bp, H. sapiens
gggaaatatggcaaaa

SEQ ID NO: 116022 - DNA, 16 bp, H. sapiens
gggaaatctggacaca

SEQ ID NO: 116023 - DNA, 16 bp, H. sapiens
gggaaatgaggagtta

SEQ ID NO: 116024 - DNA, 16 bp, H. sapiens
gggaaatgcaaattaa

SEQ ID NO: 116025 - DNA, 16 bp, H. sapiens
gggaaatgcagaaatc

SEQ ID NO: 116026 - DNA, 16 bp, H. sapiens
gggaaatgtagtttct

SEQ ID NO: 116027 - DNA, 16 bp, H. sapiens
gggaaatgtgaatcaa

SEQ ID NO: 116028 - DNA, 16 bp, H. sapiens
gggaaatgtgggaaag

SEQ ID NO: 116029 - DNA, 16 bp, H. sapiens
gggaaatgtgggtttg

SEQ ID NO: 116030 - DNA, 16 bp, H. sapiens
gggaaattttcagcta

SEQ ID NO: 116031 - DNA, 16 bp, H. sapiens
gggaacaaaacagaca

SEQ ID NO: 116032 - DNA, 16 bp, H. sapiens
gggaacaacacacatc

SEQ ID NO: 116033 - DNA, 16 bp, H. sapiens
gggaacaacaggtgct

SEQ ID NO: 116034 - DNA, 16 bp, H. sapiens
gggaacacaggcatga

SEQ ID NO: 116035 - DNA, 16 bp, H. sapiens
gggaacagagagagac

SEQ ID NO: 116036 - DNA, 18 bp, H. sapiens
gggaacaggccccccaaa

SEQ ID NO: 116037 - DNA, 18 bp, H. sapiens
gggaacatcacacaccag

SEQ ID NO: 116038 - DNA, 16 bp, H. sapiens
gggaaccagaggcaga

SEQ ID NO: 116039 - DNA, 19 bp, H. sapiens
gggaacccaggaggtggag

SEQ ID NO: 116040 - DNA, 16 bp, H. sapiens
gggaacctgaaaatcc

SEQ ID NO: 116041 - DNA, 16 bp, H. sapiens
gggaactcactgcctt

SEQ ID NO: 116042 - DNA, 16 bp, H. sapiens
gggaactcagagacca

SEQ ID NO: 116043 - DNA, 16 bp, H. sapiens
gggaactgaggactga

SEQ ID NO: 116044 - DNA, 16 bp, H. sapiens
gggaactgctcagggc

SEQ ID NO: 116045 - DNA, 16 bp, H. sapiens
gggaacttcctcaact

SEQ ID NO: 116046 - DNA, 16 bp, H. sapiens
gggaacttgcacaggg

SEQ ID NO: 116047 - DNA, 16 bp, H. sapiens
gggaacttgttagaaa

SEQ ID NO: 116048 - DNA, 16 bp, H. sapiens
gggaagaaaacacatc

SEQ ID NO: 116049 - DNA, 16 bp, H. sapiens
gggaagaaaagaggtt

SEQ ID NO: 116050 - DNA, 16 bp, H. sapiens
gggaagaaacagagca

SEQ ID NO: 116051 - DNA, 16 bp, H. sapiens
gggaagaaatgaccat

SEQ ID NO: 116052 - DNA, 16 bp, H. sapiens
gggaagaacattccag

SEQ ID NO: 116053 - DNA, 16 bp, H. sapiens
gggaagaacctggtgg

SEQ ID NO: 116054 - DNA, 16 bp, H. sapiens
gggaagaaggaaatat

SEQ ID NO: 116055 - DNA, 16 bp, H. sapiens
gggaagaaggtgatct

SEQ ID NO: 116056 - DNA, 16 bp, H. sapiens
gggaagaatccttcct

SEQ ID NO: 116057 - DNA, 16 bp, H. sapiens
gggaagaatctgcttc

SEQ ID NO: 116058 - DNA, 16 bp, H. sapiens
gggaagaatggaacca

SEQ ID NO: 116059 - DNA, 16 bp, H. sapiens
gggaagaggcactcct

SEQ ID NO: 116060 - DNA, 16 bp, H. sapiens
gggaagatgatcttcc

SEQ ID NO: 116061 - DNA, 16 bp, H. sapiens
gggaagatggaaaagt

SEQ ID NO: 116062 - DNA, 16 bp, H. sapiens
gggaagattatcttcc

SEQ ID NO: 116063 - DNA, 16 bp, H. sapiens
gggaagcaagcacttt

SEQ ID NO: 116064 - DNA, 16 bp, H. sapiens
gggaagcagagacagg

SEQ ID NO: 116065 - DNA, 16 bp, H. sapiens
gggaagcagagatggg

SEQ ID NO: 116066 - DNA, 16 bp, H. sapiens
gggaagcagagtgaga

SEQ ID NO: 116067 - DNA, 21 bp, H. sapiens
gggaagcattccctttgaaaa

SEQ ID NO: 116068 - DNA, 16 bp, H. sapiens
gggaagccaagacagg

SEQ ID NO: 116069 - DNA, 16 bp, H. sapiens
gggaagccaaggtagg

SEQ ID NO: 116070 - DNA, 16 bp, H. sapiens
gggaagccaagtcagg

SEQ ID NO: 116071 - DNA, 16 bp, H. sapiens
gggaagccaagttggg

SEQ ID NO: 116072 - DNA, 16 bp, H. sapiens
gggaagccactgaaga

SEQ ID NO: 116073 - DNA, 16 bp, H. sapiens
gggaagccatggtggg

SEQ ID NO: 116074 - DNA, 16 bp, H. sapiens
gggaagcccaggcggg

SEQ ID NO: 116075 - DNA, 16 bp, H. sapiens
gggaagcccatcaaac

SEQ ID NO: 116076 - DNA, 16 bp, H. sapiens
gggaagcctttcctga

SEQ ID NO: 116077 - DNA, 16 bp, H. sapiens
gggaagcggaggctgc

SEQ ID NO: 116078 - DNA, 16 bp, H. sapiens
gggaagctaaggcggg

SEQ ID NO: 116079 - DNA, 16 bp, H. sapiens
gggaagctgaggaggg

SEQ ID NO: 116080 - DNA, 16 bp, H. sapiens
gggaagctgaggcaaa

SEQ ID NO: 116081 - DNA, 16 bp, H. sapiens
gggaagctgaggctca

SEQ ID NO: 116082 - DNA, 16 bp, H. sapiens
gggaagctgcggcagg

SEQ ID NO: 116083 - DNA, 16 bp, H. sapiens
gggaagctggggcagg

SEQ ID NO: 116084 - DNA, 16 bp, H. sapiens
gggaagctgtgacaga

SEQ ID NO: 116085 - DNA, 16 bp, H. sapiens
gggaaggagacacagg

SEQ ID NO: 116086 - DNA, 16 bp, H. sapiens
gggaaggagcctgggg

SEQ ID NO: 116087 - DNA, 16 bp, H. sapiens
gggaaggagctcctgc

SEQ ID NO: 116088 - DNA, 17 bp, H. sapiens
gggaaggagctctcact

SEQ ID NO: 116089 - DNA, 16 bp, H. sapiens
gggaaggagggagctg

SEQ ID NO: 116090 - DNA, 16 bp, H. sapiens
gggaaggaggtgattg

SEQ ID NO: 116091 - DNA, 16 bp, H. sapiens
gggaaggcaagactgg

SEQ ID NO: 116092 - DNA, 16 bp, H. sapiens
gggaaggcagccttcc

SEQ ID NO: 116093 - DNA, 16 bp, H. sapiens
gggaaggcctcaggga

SEQ ID NO: 116094 - DNA, 16 bp, H. sapiens
gggaaggcggagcttg

SEQ ID NO: 116095 - DNA, 16 bp, H. sapiens
gggaaggctggagagg

SEQ ID NO: 116096 - DNA, 16 bp, H. sapiens
gggaaggcttctctga

SEQ ID NO: 116097 - DNA, 16 bp, H. sapiens
gggaaggggctgcagg

SEQ ID NO: 116098 - DNA, 16 bp, H. sapiens
gggaaggtgaggcagg

SEQ ID NO: 116099 - DNA, 16 bp, H. sapiens
gggaagtcaaattgtc

SEQ ID NO: 116100 - DNA, 16 bp, H. sapiens
gggaagtcagggaagg

SEQ ID NO: 116101 - DNA, 16 bp, H. sapiens
gggaagtggaggcagg

SEQ ID NO: 116102 - DNA, 16 bp, H. sapiens
gggaagtggaggtttc

SEQ ID NO: 116103 - DNA, 16 bp, H. sapiens
gggaagttaagtgact

SEQ ID NO: 116104 - DNA, 16 bp, H. sapiens
gggaagttcaagacca

SEQ ID NO: 116105 - DNA, 16 bp, H. sapiens
gggaagttctcccaga

SEQ ID NO: 116106 - DNA, 16 bp, H. sapiens
gggaagttttcctcga

SEQ ID NO: 116107 - DNA, 16 bp, H. sapiens
gggaatacaaagatga

SEQ ID NO: 116108 - DNA, 16 bp, H. sapiens
gggaatacaggcatga

SEQ ID NO: 116109 - DNA, 16 bp, H. sapiens
gggaatgcagtggcac

SEQ ID NO: 116110 - DNA, 16 bp, H. sapiens
gggaatgctcccagct

SEQ ID NO: 116111 - DNA, 16 bp, H. sapiens
gggaatgggacccaag

SEQ ID NO: 116112 - DNA, 16 bp, H. sapiens
gggaatggtggctcac

SEQ ID NO: 116113 - DNA, 16 bp, H. sapiens
gggaatgtctgcaaag

SEQ ID NO: 116114 - DNA, 16 bp, H. sapiens
gggaattaagtttcaa

SEQ ID NO: 116115 - DNA, 16 bp, H. sapiens
gggaattatgggaact

SEQ ID NO: 116116 - DNA, 16 bp, H. sapiens
gggaattatgggggct

SEQ ID NO: 116117 - DNA, 16 bp, H. sapiens
gggaattgcctgaacc

SEQ ID NO: 116118 - DNA, 16 bp, H. sapiens
gggaatttctttttct

SEQ ID NO: 116119 - DNA, 16 bp, H. sapiens
gggacaaaaatgtgtc

SEQ ID NO: 116120 - DNA, 16 bp, H. sapiens
gggacaaacacccaaa

SEQ ID NO: 116121 - DNA, 16 bp, H. sapiens
gggacaaacattcaga

SEQ ID NO: 116122 - DNA, 16 bp, H. sapiens
gggacaaagaaggcca

SEQ ID NO: 116123 - DNA, 16 bp, H. sapiens
gggacaaaggacagaa

SEQ ID NO: 116124 - DNA, 16 bp, H. sapiens
gggacaacttgaagca

SEQ ID NO: 116125 - DNA, 16 bp, H. sapiens
gggacacacacacaca

SEQ ID NO: 116126 - DNA, 16 bp, H. sapiens
gggacacagccagacc

SEQ ID NO: 116127 - DNA, 16 bp, H. sapiens
gggacacagggaacca

SEQ ID NO: 116128 - DNA, 16 bp, H. sapiens
gggacacatacattca

SEQ ID NO: 116129 - DNA, 16 bp, H. sapiens
gggacaccatcaagca

SEQ ID NO: 116130 - DNA, 16 bp, H. sapiens
gggacactgaggtggg

SEQ ID NO: 116131 - DNA, 16 bp, H. sapiens
gggacagaagctcctg

SEQ ID NO: 116132 - DNA, 16 bp, H. sapiens
gggacagaagttggag

SEQ ID NO: 116133 - DNA, 16 bp, H. sapiens
gggacagaattaatag

SEQ ID NO: 116134 - DNA, 16 bp, H. sapiens
gggacagacactcaga

SEQ ID NO: 116135 - DNA, 16 bp, H. sapiens
gggacagacattcaaa

SEQ ID NO: 116136 - DNA, 16 bp, H. sapiens
gggacagactgcctct

SEQ ID NO: 116137 - DNA, 16 bp, H. sapiens
gggacagagctgccca

SEQ ID NO: 116138 - DNA, 16 bp, H. sapiens
gggacaggaggatcac

SEQ ID NO: 116139 - DNA, 16 bp, H. sapiens
gggacaggcacagtgg

SEQ ID NO: 116140 - DNA, 16 bp, H. sapiens
gggacagggtctctct

SEQ ID NO: 116141 - DNA, 16 bp, H. sapiens
gggacagtttgacttc

SEQ ID NO: 116142 - DNA, 18 bp, H. sapiens
gggacatgaatgaagctg

SEQ ID NO: 116143 - DNA, 17 bp, H. sapiens
gggacatgctggcagca

SEQ ID NO: 116144 - DNA, 16 bp, H. sapiens
gggacatggataaagc

SEQ ID NO: 116145 - DNA, 16 bp, H. sapiens
gggacatggggagctt

SEQ ID NO: 116146 - DNA, 16 bp, H. sapiens
gggacatttggaaatg

SEQ ID NO: 116147 - DNA, 16 bp, H. sapiens
gggacatttggcaaag

SEQ ID NO: 116148 - DNA, 16 bp, H. sapiens
gggaccacagacacgt

SEQ ID NO: 116149 - DNA, 16 bp, H. sapiens
gggaccacaggcatac

SEQ ID NO: 116150 - DNA, 16 bp, H. sapiens
gggaccacaggctcac

SEQ ID NO: 116151 - DNA, 16 bp, H. sapiens
gggaccacaggtgtct

SEQ ID NO: 116152 - DNA, 16 bp, H. sapiens
gggaccaggtggagat

SEQ ID NO: 116153 - DNA, 16 bp, H. sapiens
gggaccatcctggcca

SEQ ID NO: 116154 - DNA, 16 bp, H. sapiens
gggaccatgccctcct

SEQ ID NO: 116155 - DNA, 16 bp, H. sapiens
gggacccactggagga

SEQ ID NO: 116156 - DNA, 16 bp, H. sapiens
gggacccaggaggagg

SEQ ID NO: 116157 - DNA, 16 bp, H. sapiens
gggacccagttggagg

SEQ ID NO: 116158 - DNA, 16 bp, H. sapiens
gggacccccatctcta

SEQ ID NO: 116159 - DNA, 16 bp, H. sapiens
gggacccctttcctgt

SEQ ID NO: 116160 - DNA, 16 bp, H. sapiens
gggaccctggagctga

SEQ ID NO: 116161 - DNA, 16 bp, H. sapiens
gggaccctgggcccag

SEQ ID NO: 116162 - DNA, 16 bp, H. sapiens
gggaccctgggcctgg

SEQ ID NO: 116163 - DNA, 16 bp, H. sapiens
gggaccctgggctcag

SEQ ID NO: 116164 - DNA, 16 bp, H. sapiens
gggaccggctgaagcc

SEQ ID NO: 116165 - DNA, 16 bp, H. sapiens
gggacctgagcaggtt

SEQ ID NO: 116166 - DNA, 16 bp, H. sapiens
gggacctgcagcctgc

SEQ ID NO: 116167 - DNA, 16 bp, H. sapiens
gggacctgctgggagg

SEQ ID NO: 116168 - DNA, 16 bp, H. sapiens
gggacctggagggagg

SEQ ID NO: 116169 - DNA, 16 bp, H. sapiens
gggacctggctcagcc

SEQ ID NO: 116170 - DNA, 16 bp, H. sapiens
gggacctggtgggaga

SEQ ID NO: 116171 - DNA, 16 bp, H. sapiens
gggaccttgtgggagg

SEQ ID NO: 116172 - DNA, 16 bp, H. sapiens
gggacgctgaggtggg

SEQ ID NO: 116173 - DNA, 16 bp, H. sapiens
gggacggagtcttgct

SEQ ID NO: 116174 - DNA, 16 bp, H. sapiens
gggactacaggcacac

SEQ ID NO: 116175 - DNA, 21 bp, H. sapiens
gggactacaggcacccgccac

SEQ ID NO: 116176 - DNA, 16 bp, H. sapiens
gggactacaggtaagt

SEQ ID NO: 116177 - DNA, 16 bp, H. sapiens
gggactacaggtgtcc

SEQ ID NO: 116178 - DNA, 16 bp, H. sapiens
gggactacaggttccc

SEQ ID NO: 116179 - DNA, 16 bp, H. sapiens
gggactacatttccca

SEQ ID NO: 116180 - DNA, 16 bp, H. sapiens
gggactacgggcaccc

SEQ ID NO: 116181 - DNA, 22 bp, H. sapiens
gggactatgtgaaaagaccaca

SEQ ID NO: 116182 - DNA, 16 bp, H. sapiens
gggactcaagggaaag

SEQ ID NO: 116183 - DNA, 16 bp, H. sapiens
gggactcactctgttg

SEQ ID NO: 116184 - DNA, 16 bp, H. sapiens
gggactcagactgagc

SEQ ID NO: 116185 - DNA, 16 bp, H. sapiens
gggactcagtttcccc

SEQ ID NO: 116186 - DNA, 16 bp, H. sapiens
gggactcctgggctca

SEQ ID NO: 116187 - DNA, 16 bp, H. sapiens
gggactcggccttctg

SEQ ID NO: 116188 - DNA, 16 bp, H. sapiens
gggactctgcagatgt

SEQ ID NO: 116189 - DNA, 16 bp, H. sapiens
gggactctgtgtgagg

SEQ ID NO: 116190 - DNA, 16 bp, H. sapiens
gggactctgtgtgggg

SEQ ID NO: 116191 - DNA, 16 bp, H. sapiens
gggactgaggcaagag

SEQ ID NO: 116192 - DNA, 16 bp, H. sapiens
gggactggctggagct

SEQ ID NO: 116193 - DNA, 16 bp, H. sapiens
gggactgggactggct

SEQ ID NO: 116194 - DNA, 16 bp, H. sapiens
gggactggttccagga

SEQ ID NO: 116195 - DNA, 16 bp, H. sapiens
gggactgttaggaagg

SEQ ID NO: 116196 - DNA, 16 bp, H. sapiens
gggactgttttggggt

SEQ ID NO: 116197 - DNA, 16 bp, H. sapiens
gggacttcgagaccag

SEQ ID NO: 116198 - DNA, 16 bp, H. sapiens
gggacttgagcatttg

SEQ ID NO: 116199 - DNA, 16 bp, H. sapiens
gggacttggaaaactt

SEQ ID NO: 116200 - DNA, 16 bp, H. sapiens
gggacttggaagaagc

SEQ ID NO: 116201 - DNA, 16 bp, H. sapiens
gggacttggactggct

SEQ ID NO: 116202 - DNA, 16 bp, H. sapiens
gggacttggagggaag

SEQ ID NO: 116203 - DNA, 16 bp, H. sapiens
gggacttgggcctggg

SEQ ID NO: 116204 - DNA, 16 bp, H. sapiens
gggacttggtgcccta

SEQ ID NO: 116205 - DNA, 16 bp, H. sapiens
gggacttggtgccctg

SEQ ID NO: 116206 - DNA, 16 bp, H. sapiens
gggactttaacacccc

SEQ ID NO: 116207 - DNA, 16 bp, H. sapiens
gggactttgagaccag

SEQ ID NO: 116208 - DNA, 16 bp, H. sapiens
gggactttgcagatgt

SEQ ID NO: 116209 - DNA, 16 bp, H. sapiens
gggagaaaaagaggtt

SEQ ID NO: 116210 - DNA, 16 bp, H. sapiens
gggagaaaatatgtgc

SEQ ID NO: 116211 - DNA, 16 bp, H. sapiens
gggagaaaccagagca

SEQ ID NO: 116212 - DNA, 16 bp, H. sapiens
gggagaaactgcctcc

SEQ ID NO: 116213 - DNA, 16 bp, H. sapiens
gggagaaagcaagcaa

SEQ ID NO: 116214 - DNA, 16 bp, H. sapiens
gggagaagagaagttt

SEQ ID NO: 116215 - DNA, 16 bp, H. sapiens
gggagaaggggacatg

SEQ ID NO: 116216 - DNA, 16 bp, H. sapiens
gggagaatggcttgaa

SEQ ID NO: 116217 - DNA, 16 bp, H. sapiens
gggagaattgagaaaa

SEQ ID NO: 116218 - DNA, 16 bp, H. sapiens
gggagaatttgacttc

SEQ ID NO: 116219 - DNA, 16 bp, H. sapiens
gggagacacctcccag

SEQ ID NO: 116220 - DNA, 16 bp, H. sapiens
gggagacagactggcc

SEQ ID NO: 116221 - DNA, 16 bp, H. sapiens
gggagacagaggtggg

SEQ ID NO: 116222 - DNA, 16 bp, H. sapiens
gggagacagaggtttc

SEQ ID NO: 116223 - DNA, 16 bp, H. sapiens
gggagacatgaaacat

SEQ ID NO: 116224 - DNA, 16 bp, H. sapiens
gggagaccagcctggg

SEQ ID NO: 116225 - DNA, 16 bp, H. sapiens
gggagacccccatctc

SEQ ID NO: 116226 - DNA, 16 bp, H. sapiens
gggagaccctgactct

SEQ ID NO: 116227 - DNA, 16 bp, H. sapiens
gggagaccgaggtggg

SEQ ID NO: 116228 - DNA, 16 bp, H. sapiens
gggagacctaggcagg

SEQ ID NO: 116229 - DNA, 16 bp, H. sapiens
gggagactcccatttt

SEQ ID NO: 116230 - DNA, 16 bp, H. sapiens
gggagactctgtcaca

SEQ ID NO: 116231 - DNA, 16 bp, H. sapiens
gggagactgaggaagg

SEQ ID NO: 116232 - DNA, 16 bp, H. sapiens
gggagactgatgcagg

SEQ ID NO: 116233 - DNA, 16 bp, H. sapiens
gggagactggggctta

SEQ ID NO: 116234 - DNA, 16 bp, H. sapiens
gggagactttaaaacc

SEQ ID NO: 116235 - DNA, 16 bp, H. sapiens
gggagactttttatta

SEQ ID NO: 116236 - DNA, 16 bp, H. sapiens
gggagagaatatttgc

SEQ ID NO: 116237 - DNA, 16 bp, H. sapiens
gggagagaatcacctt

SEQ ID NO: 116238 - DNA, 16 bp, H. sapiens
gggagagacagaccca

SEQ ID NO: 116239 - DNA, 16 bp, H. sapiens
gggagagagcgagact

SEQ ID NO: 116240 - DNA, 16 bp, H. sapiens
gggagagagtgtgtgt

SEQ ID NO: 116241 - DNA, 16 bp, H. sapiens
gggagagcaaggagca

SEQ ID NO: 116242 - DNA, 16 bp, H. sapiens
gggagaggaagaagct

SEQ ID NO: 116243 - DNA, 16 bp, H. sapiens
gggagaggagcccaca

SEQ ID NO: 116244 - DNA, 16 bp, H. sapiens
gggagaggagctggag

SEQ ID NO: 116245 - DNA, 16 bp, H. sapiens
gggagaggctgggctg

SEQ ID NO: 116246 - DNA, 16 bp, H. sapiens
gggagagggagaccat

SEQ ID NO: 116247 - DNA, 16 bp, H. sapiens
gggagaggtcagatgg

SEQ ID NO: 116248 - DNA, 16 bp, H. sapiens
gggagagtgtatatgt

SEQ ID NO: 116249 - DNA, 16 bp, H. sapiens
gggagataaaattcaa

SEQ ID NO: 116250 - DNA, 16 bp, H. sapiens
gggagatgaggcagga

SEQ ID NO: 116251 - DNA, 16 bp, H. sapiens
gggagatggaagtttt

SEQ ID NO: 116252 - DNA, 16 bp, H. sapiens
gggagatggaggtggc

SEQ ID NO: 116253 - DNA, 16 bp, H. sapiens
gggagatggcagagag

SEQ ID NO: 116254 - DNA, 16 bp, H. sapiens
gggagattattctgga

SEQ ID NO: 116255 - DNA, 16 bp, H. sapiens
gggagattctgtctca

SEQ ID NO: 116256 - DNA, 16 bp, H. sapiens
gggagcaagacagaga

SEQ ID NO: 116257 - DNA, 16 bp, H. sapiens
gggagcaagcccccca

SEQ ID NO: 116258 - DNA, 16 bp, H. sapiens
gggagcagcttcagca

SEQ ID NO: 116259 - DNA, 16 bp, H. sapiens
gggagcaggaggccaa

SEQ ID NO: 116260 - DNA, 16 bp, H. sapiens
gggagcaggtggtatt

SEQ ID NO: 116261 - DNA, 16 bp, H. sapiens
gggagcatttacccaa

SEQ ID NO: 116262 - DNA, 16 bp, H. sapiens
gggagccactgaaggt

SEQ ID NO: 116263 - DNA, 16 bp, H. sapiens
gggagccactggaggg

SEQ ID NO: 116264 - DNA, 16 bp, H. sapiens
gggagccagaaggaag

SEQ ID NO: 116265 - DNA, 16 bp, H. sapiens
gggagccagcatgtca

SEQ ID NO: 116266 - DNA, 16 bp, H. sapiens
gggagccaggcacagt

SEQ ID NO: 116267 - DNA, 16 bp, H. sapiens
gggagccagggcctgg

SEQ ID NO: 116268 - DNA, 16 bp, H. sapiens
gggagccatggaaggt

SEQ ID NO: 116269 - DNA, 16 bp, H. sapiens
gggagcccaaggaggg

SEQ ID NO: 116270 - DNA, 16 bp, H. sapiens
gggagcccaaggcagg

SEQ ID NO: 116271 - DNA, 16 bp, H. sapiens
gggagccccttcaagc

SEQ ID NO: 116272 - DNA, 16 bp, H. sapiens
gggagccgaggtgggc

SEQ ID NO: 116273 - DNA, 16 bp, H. sapiens
gggagccggggctgcg

SEQ ID NO: 116274 - DNA, 16 bp, H. sapiens
gggagcctcctgcctc

SEQ ID NO: 116275 - DNA, 16 bp, H. sapiens
gggagcctgaagtggg

SEQ ID NO: 116276 - DNA, 16 bp, H. sapiens
gggagcctgaggaggg

SEQ ID NO: 116277 - DNA, 16 bp, H. sapiens
gggagcctgaggcaga

SEQ ID NO: 116278 - DNA, 16 bp, H. sapiens
gggagcctgaggcagg

SEQ ID NO: 116279 - DNA, 16 bp, H. sapiens
gggagcctgaggcggg

SEQ ID NO: 116280 - DNA, 16 bp, H. sapiens
gggagcctgaggtggg

SEQ ID NO: 116281 - DNA, 16 bp, H. sapiens
gggagcctggccctgc

SEQ ID NO: 116282 - DNA, 16 bp, H. sapiens
gggagcctgtgactct

SEQ ID NO: 116283 - DNA, 16 bp, H. sapiens
gggagctaaaaaagtt

SEQ ID NO: 116284 - DNA, 16 bp, H. sapiens
gggagctaagccatga

SEQ ID NO: 116285 - DNA, 16 bp, H. sapiens
gggagctagggcctgg

SEQ ID NO: 116286 - DNA, 16 bp, H. sapiens
gggagctcactacctc

SEQ ID NO: 116287 - DNA, 16 bp, H. sapiens
gggagctccaccccag

SEQ ID NO: 116288 - DNA, 16 bp, H. sapiens
gggagctctgggagca

SEQ ID NO: 116289 - DNA, 16 bp, H. sapiens
gggagctgaagtggga

SEQ ID NO: 116290 - DNA, 16 bp, H. sapiens
gggagctgagctgagg

SEQ ID NO: 116291 - DNA, 16 bp, H. sapiens
gggagctgcagcctgg

SEQ ID NO: 116292 - DNA, 16 bp, H. sapiens
gggagctggaaagggg

SEQ ID NO: 116293 - DNA, 16 bp, H. sapiens
gggagctggaagaaca

SEQ ID NO: 116294 - DNA, 16 bp, H. sapiens
gggagctggagaggga

SEQ ID NO: 116295 - DNA, 16 bp, H. sapiens
gggagctggagcctgg

SEQ ID NO: 116296 - DNA, 16 bp, H. sapiens
gggagctggaggcagg

SEQ ID NO: 116297 - DNA, 16 bp, H. sapiens
gggagctggatgaggc

SEQ ID NO: 116298 - DNA, 16 bp, H. sapiens
gggagctgggagcagg

SEQ ID NO: 116299 - DNA, 16 bp, H. sapiens
gggagctggggcctgg

SEQ ID NO: 116300 - DNA, 16 bp, H. sapiens
gggagcttgaggagag

SEQ ID NO: 116301 - DNA, 16 bp, H. sapiens
gggaggaaactggagt

SEQ ID NO: 116302 - DNA, 16 bp, H. sapiens
gggaggaagaggctgc

SEQ ID NO: 116303 - DNA, 16 bp, H. sapiens
gggaggacccaggaca

SEQ ID NO: 116304 - DNA, 16 bp, H. sapiens
gggaggactgattgag

SEQ ID NO: 116305 - DNA, 16 bp, H. sapiens
gggaggactgcttgaa

SEQ ID NO: 116306 - DNA, 16 bp, H. sapiens
gggaggacttcctgga

SEQ ID NO: 116307 - DNA, 16 bp, H. sapiens
gggaggagcccagggc

SEQ ID NO: 116308 - DNA, 16 bp, H. sapiens
gggaggagctgccatg

SEQ ID NO: 116309 - DNA, 16 bp, H. sapiens
gggaggagctgctgtg

SEQ ID NO: 116310 - DNA, 16 bp, H. sapiens
gggaggaggactgctt

SEQ ID NO: 116311 - DNA, 16 bp, H. sapiens
gggaggagtgcagtgg

SEQ ID NO: 116312 - DNA, 17 bp, H. sapiens
gggaggatagcttgagc

SEQ ID NO: 116313 - DNA, 20 bp, H. sapiens
gggaggatcacttgagccta

SEQ ID NO: 116314 - DNA, 16 bp, H. sapiens
gggaggatcccttgat

SEQ ID NO: 116315 - DNA, 19 bp, H. sapiens
gggaggatcgcttgagcct

SEQ ID NO: 116316 - DNA, 16 bp, H. sapiens
gggaggatgaggcaca

SEQ ID NO: 116317 - DNA, 16 bp, H. sapiens
gggaggatgaggcatg

SEQ ID NO: 116318 - DNA, 16 bp, H. sapiens
gggaggattacctgaa

SEQ ID NO: 116319 - DNA, 16 bp, H. sapiens
gggaggattatttgag

SEQ ID NO: 116320 - DNA, 16 bp, H. sapiens
gggaggattgaaaaaa

SEQ ID NO: 116321 - DNA, 16 bp, H. sapiens
gggaggattgcttgag

SEQ ID NO: 116322 - DNA, 16 bp, H. sapiens
gggaggcaccacccag

SEQ ID NO: 116323 - DNA, 16 bp, H. sapiens
gggaggcaccccacag

SEQ ID NO: 116324 - DNA, 16 bp, H. sapiens
gggaggcacctcccag

SEQ ID NO: 116325 - DNA, 16 bp, H. sapiens
gggaggcagaagcaga

SEQ ID NO: 116326 - DNA, 16 bp, H. sapiens
gggaggcagaagctgc

SEQ ID NO: 116327 - DNA, 16 bp, H. sapiens
gggaggcagaagtgga

SEQ ID NO: 116328 - DNA, 16 bp, H. sapiens
gggaggcagagactgg

SEQ ID NO: 116329 - DNA, 16 bp, H. sapiens
gggaggcagagctgag

SEQ ID NO: 116330 - DNA, 16 bp, H. sapiens
gggaggcagagctggc

SEQ ID NO: 116331 - DNA, 16 bp, H. sapiens
gggaggcagaggccag

SEQ ID NO: 116332 - DNA, 16 bp, H. sapiens
gggaggcagaggctgg

SEQ ID NO: 116333 - DNA, 16 bp, H. sapiens
gggaggcagagggttg

SEQ ID NO: 116334 - DNA, 16 bp, H. sapiens
gggaggcagaggtggc

SEQ ID NO: 116335 - DNA, 16 bp, H. sapiens
gggaggcagaggtggt

SEQ ID NO: 116336 - DNA, 21 bp, H. sapiens
gggaggcagaggttgcaatga

SEQ ID NO: 116337 - DNA, 16 bp, H. sapiens
gggaggcagaggttgg

SEQ ID NO: 116338 - DNA, 16 bp, H. sapiens
gggaggcagatgcagg

SEQ ID NO: 116339 - DNA, 16 bp, H. sapiens
gggaggcagcccccag

SEQ ID NO: 116340 - DNA, 16 bp, H. sapiens
gggaggcaggagtgag

SEQ ID NO: 116341 - DNA, 16 bp, H. sapiens
gggaggcagggcctgg

SEQ ID NO: 116342 - DNA, 16 bp, H. sapiens
gggaggcatcaggaaa

SEQ ID NO: 116343 - DNA, 16 bp, H. sapiens
gggaggcatgagctgg

SEQ ID NO: 116344 - DNA, 16 bp, H. sapiens
gggaggccaaagtgaa

SEQ ID NO: 116345 - DNA, 16 bp, H. sapiens
gggaggccaacgtggg

SEQ ID NO: 116346 - DNA, 16 bp, H. sapiens
gggaggccaagagttc

SEQ ID NO: 116347 - DNA, 16 bp, H. sapiens
gggaggccaaggaggt

SEQ ID NO: 116348 - DNA, 16 bp, H. sapiens
gggaggccaaggcacg

SEQ ID NO: 116349 - DNA, 16 bp, H. sapiens
gggaggccaaggcagc

SEQ ID NO: 116350 - DNA, 18 bp, H. sapiens
gggaggccaaggcaggcg

SEQ ID NO: 116351 - DNA, 17 bp, H. sapiens
gggaggccaaggcaggt

SEQ ID NO: 116352 - DNA, 16 bp, H. sapiens
gggaggccaaggccag

SEQ ID NO: 116353 - DNA, 16 bp, H. sapiens
gggaggccaaggctgt

SEQ ID NO: 116354 - DNA, 16 bp, H. sapiens
gggaggccaaggtgga

SEQ ID NO: 116355 - DNA, 16 bp, H. sapiens
gggaggccacagcagg

SEQ ID NO: 116356 - DNA, 16 bp, H. sapiens
gggaggccacaggaaa

SEQ ID NO: 116357 - DNA, 16 bp, H. sapiens
gggaggccaggcaggc

SEQ ID NO: 116358 - DNA, 16 bp, H. sapiens
gggaggccaggctggg

SEQ ID NO: 116359 - DNA, 16 bp, H. sapiens
gggaggccaggtggga

SEQ ID NO: 116360 - DNA, 16 bp, H. sapiens
gggaggcccaaggaga

SEQ ID NO: 116361 - DNA, 16 bp, H. sapiens
gggaggcccaggaagg

SEQ ID NO: 116362 - DNA, 16 bp, H. sapiens
gggaggcccaggcgga

SEQ ID NO: 116363 - DNA, 16 bp, H. sapiens
gggaggcccaggtctg

SEQ ID NO: 116364 - DNA, 16 bp, H. sapiens
gggaggcccaggtgga

SEQ ID NO: 116365 - DNA, 16 bp, H. sapiens
gggaggccctgcccag

SEQ ID NO: 116366 - DNA, 16 bp, H. sapiens
gggaggccgagacgga

SEQ ID NO: 116367 - DNA, 16 bp, H. sapiens
gggaggccgagcaggc

SEQ ID NO: 116368 - DNA, 16 bp, H. sapiens
gggaggccgagcttgc

SEQ ID NO: 116369 - DNA, 16 bp, H. sapiens
gggaggccgaggcagc

SEQ ID NO: 116370 - DNA, 16 bp, H. sapiens
gggaggccgaggccga

SEQ ID NO: 116371 - DNA, 16 bp, H. sapiens
gggaggccgcagtggg

SEQ ID NO: 116372 - DNA, 16 bp, H. sapiens
gggaggcctaggaggg

SEQ ID NO: 116373 - DNA, 16 bp, H. sapiens
gggaggcctcacaaac

SEQ ID NO: 116374 - DNA, 16 bp, H. sapiens
gggaggcctcacaatt

SEQ ID NO: 116375 - DNA, 16 bp, H. sapiens
gggaggcctcaccatc

SEQ ID NO: 116376 - DNA, 16 bp, H. sapiens
gggaggcctggggcag

SEQ ID NO: 116377 - DNA, 16 bp, H. sapiens
gggaggcctggtggtg

SEQ ID NO: 116378 - DNA, 16 bp, H. sapiens
gggaggcggaggatgc

SEQ ID NO: 116379 - DNA, 16 bp, H. sapiens
gggaggcggaggctgt

SEQ ID NO: 116380 - DNA, 16 bp, H. sapiens
gggaggctaaggcagg

SEQ ID NO: 116381 - DNA, 16 bp, H. sapiens
gggaggctaaggcgag

SEQ ID NO: 116382 - DNA, 16 bp, H. sapiens
gggaggctaaggctgg

SEQ ID NO: 116383 - DNA, 16 bp, H. sapiens
gggaggctcaggctgc

SEQ ID NO: 116384 - DNA, 16 bp, H. sapiens
gggaggctcaggtgga

SEQ ID NO: 116385 - DNA, 16 bp, H. sapiens
gggaggctccatctca

SEQ ID NO: 116386 - DNA, 16 bp, H. sapiens
gggaggctcgggccac

SEQ ID NO: 116387 - DNA, 16 bp, H. sapiens
gggaggctgaaggcag

SEQ ID NO: 116388 - DNA, 16 bp, H. sapiens
gggaggctgaagtgga

SEQ ID NO: 116389 - DNA, 21 bp, H. sapiens
gggaggctgaagtgggaggat

SEQ ID NO: 116390 - DNA, 16 bp, H. sapiens
gggaggctgacgcagg

SEQ ID NO: 116391 - DNA, 17 bp, H. sapiens
gggaggctgagaaggag

SEQ ID NO: 116392 - DNA, 16 bp, H. sapiens
gggaggctgagaccgg

SEQ ID NO: 116393 - DNA, 16 bp, H. sapiens
gggaggctgagacgga

SEQ ID NO: 116394 - DNA, 16 bp, H. sapiens
gggaggctgagattgc

SEQ ID NO: 116395 - DNA, 16 bp, H. sapiens
gggaggctgagcccag

SEQ ID NO: 116396 - DNA, 16 bp, H. sapiens
gggaggctgaggagaa

SEQ ID NO: 116397 - DNA, 16 bp, H. sapiens
gggaggctgaggagca

SEQ ID NO: 116398 - DNA, 16 bp, H. sapiens
gggaggctgaggaggc

SEQ ID NO: 116399 - DNA, 16 bp, H. sapiens
gggaggctgaggcaga

SEQ ID NO: 116400 - DNA, 17 bp, H. sapiens
gggaggctgaggcatgc

SEQ ID NO: 116401 - DNA, 16 bp, H. sapiens
gggaggctgaggccga

SEQ ID NO: 116402 - DNA, 16 bp, H. sapiens
gggaggctgaggccgg

SEQ ID NO: 116403 - DNA, 16 bp, H. sapiens
gggaggctgaggcgag

SEQ ID NO: 116404 - DNA, 16 bp, H. sapiens
gggaggctgaggcgca

SEQ ID NO: 116405 - DNA, 16 bp, H. sapiens
gggaggctgaggctgc

SEQ ID NO: 116406 - DNA, 16 bp, H. sapiens
gggaggctgagggcag

SEQ ID NO: 116407 - DNA, 16 bp, H. sapiens
gggaggctgaggtgga

SEQ ID NO: 116408 - DNA, 16 bp, H. sapiens
gggaggctgaggttgg

SEQ ID NO: 116409 - DNA, 16 bp, H. sapiens
gggaggctgagtgagg

SEQ ID NO: 116410 - DNA, 16 bp, H. sapiens
gggaggctgagtgggc

SEQ ID NO: 116411 - DNA, 16 bp, H. sapiens
gggaggctgcagcagg

SEQ ID NO: 116412 - DNA, 16 bp, H. sapiens
gggaggctgcagtggg

SEQ ID NO: 116413 - DNA, 16 bp, H. sapiens
gggaggctgcggcagg

SEQ ID NO: 116414 - DNA, 16 bp, H. sapiens
gggaggctggagaagg

SEQ ID NO: 116415 - DNA, 16 bp, H. sapiens
gggaggctgggcctgg

SEQ ID NO: 116416 - DNA, 16 bp, H. sapiens
gggaggctggggcaag

SEQ ID NO: 116417 - DNA, 16 bp, H. sapiens
gggaggctggggccag

SEQ ID NO: 116418 - DNA, 16 bp, H. sapiens
gggaggctggggctgc

SEQ ID NO: 116419 - DNA, 16 bp, H. sapiens
gggaggctgggtcagg

SEQ ID NO: 116420 - DNA, 16 bp, H. sapiens
gggaggcttaggcagg

SEQ ID NO: 116421 - DNA, 16 bp, H. sapiens
gggaggcttaggtggg

SEQ ID NO: 116422 - DNA, 16 bp, H. sapiens
gggaggcttcaggaag

SEQ ID NO: 116423 - DNA, 16 bp, H. sapiens
gggagggaaactgagg

SEQ ID NO: 116424 - DNA, 16 bp, H. sapiens
gggagggacaaggtgg

SEQ ID NO: 116425 - DNA, 16 bp, H. sapiens
gggagggaccagagaa

SEQ ID NO: 116426 - DNA, 16 bp, H. sapiens
gggagggacccaggtg

SEQ ID NO: 116427 - DNA, 16 bp, H. sapiens
gggagggaggccctgg

SEQ ID NO: 116428 - DNA, 16 bp, H. sapiens
gggagggaggctcagg

SEQ ID NO: 116429 - DNA, 16 bp, H. sapiens
gggagggagggagtcc

SEQ ID NO: 116430 - DNA, 16 bp, H. sapiens
gggagggcagagctgg

SEQ ID NO: 116431 - DNA, 16 bp, H. sapiens
gggagggcagctgcag

SEQ ID NO: 116432 - DNA, 16 bp, H. sapiens
gggagggcttcctgga

SEQ ID NO: 116433 - DNA, 16 bp, H. sapiens
gggaggggcctgaggc

SEQ ID NO: 116434 - DNA, 16 bp, H. sapiens
gggaggggcgcccacc

SEQ ID NO: 116435 - DNA, 16 bp, H. sapiens
gggaggggctgccaag

SEQ ID NO: 116436 - DNA, 16 bp, H. sapiens
gggaggggctgccaca

SEQ ID NO: 116437 - DNA, 16 bp, H. sapiens
gggaggggctgccctg

SEQ ID NO: 116438 - DNA, 16 bp, H. sapiens
gggaggggctgcctca

SEQ ID NO: 116439 - DNA, 16 bp, H. sapiens
gggaggggctgctgag

SEQ ID NO: 116440 - DNA, 16 bp, H. sapiens
gggaggggctgctgcg

SEQ ID NO: 116441 - DNA, 16 bp, H. sapiens
gggaggggtgcccacc

SEQ ID NO: 116442 - DNA, 16 bp, H. sapiens
gggaggggtggccaca

SEQ ID NO: 116443 - DNA, 16 bp, H. sapiens
gggagggtaaattagt

SEQ ID NO: 116444 - DNA, 16 bp, H. sapiens
gggagggtccagaaga

SEQ ID NO: 116445 - DNA, 16 bp, H. sapiens
gggagggttcttggat

SEQ ID NO: 116446 - DNA, 16 bp, H. sapiens
gggaggtaaacattga

SEQ ID NO: 116447 - DNA, 16 bp, H. sapiens
gggaggtaactgaatt

SEQ ID NO: 116448 - DNA, 16 bp, H. sapiens
gggaggtaatttaatc

SEQ ID NO: 116449 - DNA, 16 bp, H. sapiens
gggaggtagaggcagg

SEQ ID NO: 116450 - DNA, 16 bp, H. sapiens
gggaggtcggggctgc

SEQ ID NO: 116451 - DNA, 16 bp, H. sapiens
gggaggtctcacccag

SEQ ID NO: 116452 - DNA, 16 bp, H. sapiens
gggaggtctggaaagt

SEQ ID NO: 116453 - DNA, 16 bp, H. sapiens
gggaggtgaaggacct

SEQ ID NO: 116454 - DNA, 16 bp, H. sapiens
gggaggtggagactgc

SEQ ID NO: 116455 - DNA, 16 bp, H. sapiens
gggaggtggagctcgc

SEQ ID NO: 116456 - DNA, 16 bp, H. sapiens
gggaggtggagctggc

SEQ ID NO: 116457 - DNA, 16 bp, H. sapiens
gggaggtggaggcaga

SEQ ID NO: 116458 - DNA, 16 bp, H. sapiens
gggaggtggaggccgc

SEQ ID NO: 116459 - DNA, 17 bp, H. sapiens
gggaggtggaggctgca

SEQ ID NO: 116460 - DNA, 16 bp, H. sapiens
gggaggtggaggtgac

SEQ ID NO: 116461 - DNA, 16 bp, H. sapiens
gggaggtggaggttgc

SEQ ID NO: 116462 - DNA, 21 bp, H. sapiens
gggaggtggagtttgcagtga

SEQ ID NO: 116463 - DNA, 16 bp, H. sapiens
gggaggtgtttgggcc

SEQ ID NO: 116464 - DNA, 16 bp, H. sapiens
gggaggttcacctgag

SEQ ID NO: 116465 - DNA, 16 bp, H. sapiens
gggaggttcaggctgc

SEQ ID NO: 116466 - DNA, 16 bp, H. sapiens
gggaggttgaggcagc

SEQ ID NO: 116467 - DNA, 17 bp, H. sapiens
gggaggttgaggctgca

SEQ ID NO: 116468 - DNA, 16 bp, H. sapiens
gggagtattgcttgag

SEQ ID NO: 116469 - DNA, 16 bp, H. sapiens
gggagtcagccaccat

SEQ ID NO: 116470 - DNA, 16 bp, H. sapiens
gggagtgcagatagct

SEQ ID NO: 116471 - DNA, 16 bp, H. sapiens
gggagtgcagtggcgc

SEQ ID NO: 116472 - DNA, 16 bp, H. sapiens
gggagtgcttgtgcca

SEQ ID NO: 116473 - DNA, 16 bp, H. sapiens
gggagtgctttgaggc

SEQ ID NO: 116474 - DNA, 20 bp, H. sapiens
gggagtggacctccagcaaa

SEQ ID NO: 116475 - DNA, 16 bp, H. sapiens
gggagtgtatattagt

SEQ ID NO: 116476 - DNA, 16 bp, H. sapiens
gggagttcaagactgc

SEQ ID NO: 116477 - DNA, 16 bp, H. sapiens
gggagttcactcatta

SEQ ID NO: 116478 - DNA, 16 bp, H. sapiens
gggagttccagaccag

SEQ ID NO: 116479 - DNA, 16 bp, H. sapiens
gggagttccctgcaca

SEQ ID NO: 116480 - DNA, 16 bp, H. sapiens
gggagtttaaaaaaaa

SEQ ID NO: 116481 - DNA, 16 bp, H. sapiens
gggatacaaaaatgaa

SEQ ID NO: 116482 - DNA, 16 bp, H. sapiens
gggatacagagatgaa

SEQ ID NO: 116483 - DNA, 16 bp, H. sapiens
gggatacatgtgcagg

SEQ ID NO: 116484 - DNA, 16 bp, H. sapiens
gggataccaaggcagg

SEQ ID NO: 116485 - DNA, 16 bp, H. sapiens
gggatagcattggaag

SEQ ID NO: 116486 - DNA, 16 bp, H. sapiens
gggatatagcagtgaa

SEQ ID NO: 116487 - DNA, 16 bp, H. sapiens
gggatatgatggctta

SEQ ID NO: 116488 - DNA, 16 bp, H. sapiens
gggatatgttccaaga

SEQ ID NO: 116489 - DNA, 16 bp, H. sapiens
gggatatgttctgaga

SEQ ID NO: 116490 - DNA, 16 bp, H. sapiens
gggatattaccactga

SEQ ID NO: 116491 - DNA, 16 bp, H. sapiens
gggatattatgaataa

SEQ ID NO: 116492 - DNA, 16 bp, H. sapiens
gggatattcatttttt

SEQ ID NO: 116493 - DNA, 23 bp, H. sapiens
gggatcaattcaacaagaagaac

SEQ ID NO: 116494 - DNA, 16 bp, H. sapiens
gggatcaggtgatcct

SEQ ID NO: 116495 - DNA, 16 bp, H. sapiens
gggatcattagaagcc

SEQ ID NO: 116496 - DNA, 19 bp, H. sapiens
gggatccactgggtgaagc

SEQ ID NO: 116497 - DNA, 16 bp, H. sapiens
gggatcctcctgcccc

SEQ ID NO: 116498 - DNA, 16 bp, H. sapiens
gggatcctgggcctgg

SEQ ID NO: 116499 - DNA, 16 bp, H. sapiens
gggatctgccccatga

SEQ ID NO: 116500 - DNA, 16 bp, H. sapiens
gggatctggtgggaag

SEQ ID NO: 116501 - DNA, 16 bp, H. sapiens
gggatcttgctatgtt

SEQ ID NO: 116502 - DNA, 16 bp, H. sapiens
gggatgacacagcaag

SEQ ID NO: 116503 - DNA, 16 bp, H. sapiens
gggatgagggataaaa

SEQ ID NO: 116504 - DNA, 16 bp, H. sapiens
gggatgatcacttgag

SEQ ID NO: 116505 - DNA, 16 bp, H. sapiens
gggatgatgaaaatat

SEQ ID NO: 116506 - DNA, 16 bp, H. sapiens
gggatgatgatgatga

SEQ ID NO: 116507 - DNA, 16 bp, H. sapiens
gggatgcaaagatgaa

SEQ ID NO: 116508 - DNA, 16 bp, H. sapiens
gggatgcaactaaagc

SEQ ID NO: 116509 - DNA, 16 bp, H. sapiens
gggatgcagaggcagg

SEQ ID NO: 116510 - DNA, 16 bp, H. sapiens
gggatgcagaggctgc

SEQ ID NO: 116511 - DNA, 16 bp, H. sapiens
gggatgcagctaaagt

SEQ ID NO: 116512 - DNA, 16 bp, H. sapiens
gggatgcatgtgcaga

SEQ ID NO: 116513 - DNA, 16 bp, H. sapiens
gggatgccaagacagg

SEQ ID NO: 116514 - DNA, 16 bp, H. sapiens
gggatgctgagacagg

SEQ ID NO: 116515 - DNA, 16 bp, H. sapiens
gggatgctgaggaggg

SEQ ID NO: 116516 - DNA, 16 bp, H. sapiens
gggatgctgaggcaga

SEQ ID NO: 116517 - DNA, 16 bp, H. sapiens
gggatgctgaggtggg

SEQ ID NO: 116518 - DNA, 16 bp, H. sapiens
gggatgctgctcaaca

SEQ ID NO: 116519 - DNA, 16 bp, H. sapiens
gggatgctgctgctgc

SEQ ID NO: 116520 - DNA, 16 bp, H. sapiens
gggatgctgttaaaca

SEQ ID NO: 116521 - DNA, 16 bp, H. sapiens
gggatgctgtttggag

SEQ ID NO: 116522 - DNA, 16 bp, H. sapiens
gggatggaggaagacc

SEQ ID NO: 116523 - DNA, 17 bp, H. sapiens
gggatgggaacatcaca

SEQ ID NO: 116524 - DNA, 16 bp, H. sapiens
gggatgggagaaaata

SEQ ID NO: 116525 - DNA, 16 bp, H. sapiens
gggatggggagctgga

SEQ ID NO: 116526 - DNA, 16 bp, H. sapiens
gggatggggcttcctg

SEQ ID NO: 116527 - DNA, 16 bp, H. sapiens
gggatgggtcagtgag

SEQ ID NO: 116528 - DNA, 16 bp, H. sapiens
gggatgtgctaatgca

SEQ ID NO: 116529 - DNA, 16 bp, H. sapiens
gggatgttaccactga

SEQ ID NO: 116530 - DNA, 16 bp, H. sapiens
gggatgttcaacctgt

SEQ ID NO: 116531 - DNA, 16 bp, H. sapiens
gggattaaaggcaccc

SEQ ID NO: 116532 - DNA, 16 bp, H. sapiens
gggattacagagccac

SEQ ID NO: 116533 - DNA, 16 bp, H. sapiens
gggattacagccgtgt

SEQ ID NO: 116534 - DNA, 16 bp, H. sapiens
gggattacagctgtaa

SEQ ID NO: 116535 - DNA, 16 bp, H. sapiens
gggattactggcgcct

SEQ ID NO: 116536 - DNA, 16 bp, H. sapiens
gggattaggacttgga

SEQ ID NO: 116537 - DNA, 16 bp, H. sapiens
gggattagggcatgga

SEQ ID NO: 116538 - DNA, 16 bp, H. sapiens
gggattataaatcatt

SEQ ID NO: 116539 - DNA, 16 bp, H. sapiens
gggattatagacaccc

SEQ ID NO: 116540 - DNA, 16 bp, H. sapiens
gggattataggcggga

SEQ ID NO: 116541 - DNA, 16 bp, H. sapiens
gggattattggtgtga

SEQ ID NO: 116542 - DNA, 16 bp, H. sapiens
gggattatttctgagg

SEQ ID NO: 116543 - DNA, 16 bp, H. sapiens
gggattcaccatgttg

SEQ ID NO: 116544 - DNA, 16 bp, H. sapiens
gggattcactgtgtta

SEQ ID NO: 116545 - DNA, 16 bp, H. sapiens
gggattcagcttcttc

SEQ ID NO: 116546 - DNA, 16 bp, H. sapiens
gggattctccagcctc

SEQ ID NO: 116547 - DNA, 16 bp, H. sapiens
gggattgctgggtcac

SEQ ID NO: 116548 - DNA, 16 bp, H. sapiens
gggattgggcttctag

SEQ ID NO: 116549 - DNA, 16 bp, H. sapiens
gggattggttccagga

SEQ ID NO: 116550 - DNA, 16 bp, H. sapiens
gggattggtttcagga

SEQ ID NO: 116551 - DNA, 16 bp, H. sapiens
gggattgtaaaatgca

SEQ ID NO: 116552 - DNA, 16 bp, H. sapiens
gggatttcaccttgtt

SEQ ID NO: 116553 - DNA, 17 bp, H. sapiens
gggatttctccatgttg

SEQ ID NO: 116554 - DNA, 16 bp, H. sapiens
gggatttgccttgtct

SEQ ID NO: 116555 - DNA, 16 bp, H. sapiens
gggattttcttttctg

SEQ ID NO: 116556 - DNA, 16 bp, H. sapiens
gggatttttaaaaagt

SEQ ID NO: 116557 - DNA, 16 bp, H. sapiens
gggatttttctctgat

SEQ ID NO: 116558 - DNA, 16 bp, H. sapiens
gggatttttttttaac

SEQ ID NO: 116559 - DNA, 16 bp, H. sapiens
gggcaaaaaatatgaa

SEQ ID NO: 116560 - DNA, 16 bp, H. sapiens
gggcaaaaagtagttg

SEQ ID NO: 116561 - DNA, 16 bp, H. sapiens
gggcaaaagttggaag

SEQ ID NO: 116562 - DNA, 16 bp, H. sapiens
gggcaaaatgccacca

SEQ ID NO: 116563 - DNA, 16 bp, H. sapiens
gggcaaagacttcatg

SEQ ID NO: 116564 - DNA, 16 bp, H. sapiens
gggcaaagccaagaac

SEQ ID NO: 116565 - DNA, 16 bp, H. sapiens
gggcaaaggacattaa

SEQ ID NO: 116566 - DNA, 16 bp, H. sapiens
gggcaaaggccatgaa

SEQ ID NO: 116567 - DNA, 16 bp, H. sapiens
gggcaaaggttatgaa

SEQ ID NO: 116568 - DNA, 16 bp, H. sapiens
gggcaaagtaaattga

SEQ ID NO: 116569 - DNA, 16 bp, H. sapiens
gggcaaatacctaatg

SEQ ID NO: 116570 - DNA, 16 bp, H. sapiens
gggcaacagaagaaga

SEQ ID NO: 116571 - DNA, 16 bp, H. sapiens
gggcaacagagacaga

SEQ ID NO: 116572 - DNA, 16 bp, H. sapiens
gggcaacagagagagg

SEQ ID NO: 116573 - DNA, 16 bp, H. sapiens
gggcaacagggcaaga

SEQ ID NO: 116574 - DNA, 16 bp, H. sapiens
gggcaacattgggaga

SEQ ID NO: 116575 - DNA, 16 bp, H. sapiens
gggcaaccagcagctc

SEQ ID NO: 116576 - DNA, 16 bp, H. sapiens
gggcaaccatcaccac

SEQ ID NO: 116577 - DNA, 17 bp, H. sapiens
gggcaagaccctgtctc

SEQ ID NO: 116578 - DNA, 17 bp, H. sapiens
gggcaagacttttcttt

SEQ ID NO: 116579 - DNA, 16 bp, H. sapiens
gggcaagagctcagga

SEQ ID NO: 116580 - DNA, 16 bp, H. sapiens
gggcaagcgccagctc

SEQ ID NO: 116581 - DNA, 16 bp, H. sapiens
gggcaaggcagctccc

SEQ ID NO: 116582 - DNA, 16 bp, H. sapiens
gggcaagggcaagaag

SEQ ID NO: 116583 - DNA, 16 bp, H. sapiens
gggcaaggtggctcac

SEQ ID NO: 116584 - DNA, 16 bp, H. sapiens
gggcaatataaggaga

SEQ ID NO: 116585 - DNA, 16 bp, H. sapiens
gggcacagaaaaacaa

SEQ ID NO: 116586 - DNA, 16 bp, H. sapiens
gggcacagcctccctc

SEQ ID NO: 116587 - DNA, 16 bp, H. sapiens
gggcacagcggctcac

SEQ ID NO: 116588 - DNA, 16 bp, H. sapiens
gggcacaggcagaggg

SEQ ID NO: 116589 - DNA, 16 bp, H. sapiens
gggcacaggcccaagg

SEQ ID NO: 116590 - DNA, 16 bp, H. sapiens
gggcacagtggctcac

SEQ ID NO: 116591 - DNA, 16 bp, H. sapiens
gggcacagtggtgcac

SEQ ID NO: 116592 - DNA, 16 bp, H. sapiens
gggcacagtggtgtgt

SEQ ID NO: 116593 - DNA, 16 bp, H. sapiens
gggcacagttgctcat

SEQ ID NO: 116594 - DNA, 16 bp, H. sapiens
gggcaccaggcagagt

SEQ ID NO: 116595 - DNA, 16 bp, H. sapiens
gggcaccctgtggccc

SEQ ID NO: 116596 - DNA, 16 bp, H. sapiens
gggcacctgcaggcca

SEQ ID NO: 116597 - DNA, 22 bp, H. sapiens
gggcacctgtgatcccagctac

SEQ ID NO: 116598 - DNA, 16 bp, H. sapiens
gggcacgccaccatgc

SEQ ID NO: 116599 - DNA, 16 bp, H. sapiens
gggcacggtggcatgc

SEQ ID NO: 116600 - DNA, 16 bp, H. sapiens
gggcacggtggcgcac

SEQ ID NO: 116601 - DNA, 16 bp, H. sapiens
gggcacggtggtgggc

SEQ ID NO: 116602 - DNA, 16 bp, H. sapiens
gggcactgcccagtgg

SEQ ID NO: 116603 - DNA, 16 bp, H. sapiens
gggcactgcctggtgg

SEQ ID NO: 116604 - DNA, 16 bp, H. sapiens
gggcactgctccaggc

SEQ ID NO: 116605 - DNA, 16 bp, H. sapiens
gggcacttttttggtt

SEQ ID NO: 116606 - DNA, 16 bp, H. sapiens
gggcactttttttttt

SEQ ID NO: 116607 - DNA, 16 bp, H. sapiens
gggcagaaagcatcca

SEQ ID NO: 116608 - DNA, 16 bp, H. sapiens
gggcagacacagagct

SEQ ID NO: 116609 - DNA, 16 bp, H. sapiens
gggcagagacacagcc

SEQ ID NO: 116610 - DNA, 16 bp, H. sapiens
gggcagagaggtggag

SEQ ID NO: 116611 - DNA, 16 bp, H. sapiens
gggcagagcaggtagc

SEQ ID NO: 116612 - DNA, 16 bp, H. sapiens
gggcagagcatctctg

SEQ ID NO: 116613 - DNA, 16 bp, H. sapiens
gggcagagccagggca

SEQ ID NO: 116614 - DNA, 16 bp, H. sapiens
gggcagagcgagactc

SEQ ID NO: 116615 - DNA, 16 bp, H. sapiens
gggcagagctggggag

SEQ ID NO: 116616 - DNA, 16 bp, H. sapiens
gggcagaggaagaagt

SEQ ID NO: 116617 - DNA, 16 bp, H. sapiens
gggcagaggcactccc

SEQ ID NO: 116618 - DNA, 16 bp, H. sapiens
gggcagaggccagagg

SEQ ID NO: 116619 - DNA, 16 bp, H. sapiens
gggcagaggccagcag

SEQ ID NO: 116620 - DNA, 16 bp, H. sapiens
gggcagaggccaggag

SEQ ID NO: 116621 - DNA, 27 bp, H. sapiens
gggcagaggcgctccccacatctcaga

SEQ ID NO: 116622 - DNA, 16 bp, H. sapiens
gggcagaggctgcact

SEQ ID NO: 116623 - DNA, 16 bp, H. sapiens
gggcagaggctgcagc

SEQ ID NO: 116624 - DNA, 16 bp, H. sapiens
gggcagaggctgggag

SEQ ID NO: 116625 - DNA, 16 bp, H. sapiens
gggcagaggtcaggag

SEQ ID NO: 116626 - DNA, 16 bp, H. sapiens
gggcagaggtccctgc

SEQ ID NO: 116627 - DNA, 16 bp, H. sapiens
gggcagaggtgggaga

SEQ ID NO: 116628 - DNA, 18 bp, H. sapiens
gggcagaggttgcagtga

SEQ ID NO: 116629 - DNA, 16 bp, H. sapiens
gggcagatcacgtgag

SEQ ID NO: 116630 - DNA, 16 bp, H. sapiens
gggcagatcacttaag

SEQ ID NO: 116631 - DNA, 16 bp, H. sapiens
gggcagatcacttgag

SEQ ID NO: 116632 - DNA, 16 bp, H. sapiens
gggcagatcatctgag

SEQ ID NO: 116633 - DNA, 16 bp, H. sapiens
gggcagcagagcgaga

SEQ ID NO: 116634 - DNA, 16 bp, H. sapiens
gggcagcagccatcac

SEQ ID NO: 116635 - DNA, 16 bp, H. sapiens
gggcagcaggcagcag

SEQ ID NO: 116636 - DNA, 16 bp, H. sapiens
gggcagcagggccagg

SEQ ID NO: 116637 - DNA, 16 bp, H. sapiens
gggcagcaggggctgg

SEQ ID NO: 116638 - DNA, 16 bp, H. sapiens
gggcagccaaggcagg

SEQ ID NO: 116639 - DNA, 16 bp, H. sapiens
gggcagccagagaaaa

SEQ ID NO: 116640 - DNA, 16 bp, H. sapiens
gggcagccagggcagc

SEQ ID NO: 116641 - DNA, 16 bp, H. sapiens
gggcagccccacccct

SEQ ID NO: 116642 - DNA, 16 bp, H. sapiens
gggcagcccctcccca

SEQ ID NO: 116643 - DNA, 16 bp, H. sapiens
gggcagccctgggagg

SEQ ID NO: 116644 - DNA, 16 bp, H. sapiens
gggcagccgaggcagg

SEQ ID NO: 116645 - DNA, 16 bp, H. sapiens
gggcagcctgctttta

SEQ ID NO: 116646 - DNA, 16 bp, H. sapiens
gggcagctgagcaaga

SEQ ID NO: 116647 - DNA, 16 bp, H. sapiens
gggcagctgcagcagc

SEQ ID NO: 116648 - DNA, 16 bp, H. sapiens
gggcagctgcagtggc

SEQ ID NO: 116649 - DNA, 19 bp, H. sapiens
gggcagctgccgggcggag

SEQ ID NO: 116650 - DNA, 16 bp, H. sapiens
gggcagctgggcagag

SEQ ID NO: 116651 - DNA, 16 bp, H. sapiens
gggcagcttggaggtt

SEQ ID NO: 116652 - DNA, 16 bp, H. sapiens
gggcaggaagcatcca

SEQ ID NO: 116653 - DNA, 16 bp, H. sapiens
gggcaggaggatgtgg

SEQ ID NO: 116654 - DNA, 16 bp, H. sapiens
gggcaggagtgtccca

SEQ ID NO: 116655 - DNA, 16 bp, H. sapiens
gggcaggagtttgagg

SEQ ID NO: 116656 - DNA, 16 bp, H. sapiens
gggcaggatggagagg

SEQ ID NO: 116657 - DNA, 16 bp, H. sapiens
gggcaggatggtctcg

SEQ ID NO: 116658 - DNA, 16 bp, H. sapiens
gggcaggatttgcaga

SEQ ID NO: 116659 - DNA, 16 bp, H. sapiens
gggcaggcagaggcca

SEQ ID NO: 116660 - DNA, 16 bp, H. sapiens
gggcaggcagatcacc

SEQ ID NO: 116661 - DNA, 16 bp, H. sapiens
gggcagggaatgggga

SEQ ID NO: 116662 - DNA, 16 bp, H. sapiens
gggcagggacagggca

SEQ ID NO: 116663 - DNA, 16 bp, H. sapiens
gggcagggagcagcag

SEQ ID NO: 116664 - DNA, 16 bp, H. sapiens
gggcagggatgcctga

SEQ ID NO: 116665 - DNA, 16 bp, H. sapiens
gggcagggctaggtgt

SEQ ID NO: 116666 - DNA, 16 bp, H. sapiens
gggcagggctcccacc

SEQ ID NO: 116667 - DNA, 24 bp, H. sapiens
gggcagggctcgggacctgcagcc

SEQ ID NO: 116668 - DNA, 16 bp, H. sapiens
gggcagggctgggcag

SEQ ID NO: 116669 - DNA, 16 bp, H. sapiens
gggcagggctgggccc

SEQ ID NO: 116670 - DNA, 16 bp, H. sapiens
gggcagggctgggctg

SEQ ID NO: 116671 - DNA, 16 bp, H. sapiens
gggcagggctggggac

SEQ ID NO: 116672 - DNA, 16 bp, H. sapiens
gggcagggctggtttc

SEQ ID NO: 116673 - DNA, 16 bp, H. sapiens
gggcaggggcagcagc

SEQ ID NO: 116674 - DNA, 16 bp, H. sapiens
gggcagggggctgacc

SEQ ID NO: 116675 - DNA, 16 bp, H. sapiens
gggcagggtagggcag

SEQ ID NO: 116676 - DNA, 16 bp, H. sapiens
gggcagggtccctggc

SEQ ID NO: 116677 - DNA, 16 bp, H. sapiens
gggcaggtgcggtggc

SEQ ID NO: 116678 - DNA, 16 bp, H. sapiens
gggcagtcttgtgaga

SEQ ID NO: 116679 - DNA, 16 bp, H. sapiens
gggcagtgctgagctc

SEQ ID NO: 116680 - DNA, 16 bp, H. sapiens
gggcagtggcagcagg

SEQ ID NO: 116681 - DNA, 16 bp, H. sapiens
gggcagtggcagtgag

SEQ ID NO: 116682 - DNA, 16 bp, H. sapiens
gggcagtgggcagagg

SEQ ID NO: 116683 - DNA, 16 bp, H. sapiens
gggcagtgggcagtgg

SEQ ID NO: 116684 - DNA, 16 bp, H. sapiens
gggcagtggggccagg

SEQ ID NO: 116685 - DNA, 16 bp, H. sapiens
gggcagtgtgtgtgtg

SEQ ID NO: 116686 - DNA, 16 bp, H. sapiens
gggcagtgtttctcaa

SEQ ID NO: 116687 - DNA, 16 bp, H. sapiens
gggcagtttctcatgg

SEQ ID NO: 116688 - DNA, 16 bp, H. sapiens
gggcataaaacccctc

SEQ ID NO: 116689 - DNA, 16 bp, H. sapiens
gggcatctttgtcttt

SEQ ID NO: 116690 - DNA, 16 bp, H. sapiens
gggcatgaataccagg

SEQ ID NO: 116691 - DNA, 16 bp, H. sapiens
gggcatgatggtgggc

SEQ ID NO: 116692 - DNA, 16 bp, H. sapiens
gggcatgccaccctcc

SEQ ID NO: 116693 - DNA, 16 bp, H. sapiens
gggcatggccctggct

SEQ ID NO: 116694 - DNA, 16 bp, H. sapiens
gggcatggtgacacat

SEQ ID NO: 116695 - DNA, 16 bp, H. sapiens
gggcatggtgctgggc

SEQ ID NO: 116696 - DNA, 18 bp, H. sapiens
gggcatggtggcacacac

SEQ ID NO: 116697 - DNA, 16 bp, H. sapiens
gggcatggtggcaggc

SEQ ID NO: 116698 - DNA, 18 bp, H. sapiens
gggcatggtggcatgcac

SEQ ID NO: 116699 - DNA, 16 bp, H. sapiens
gggcatggtggcccac

SEQ ID NO: 116700 - DNA, 16 bp, H. sapiens
gggcatggtggctcaa

SEQ ID NO: 116701 - DNA, 16 bp, H. sapiens
gggcatggtggctcac

SEQ ID NO: 116702 - DNA, 16 bp, H. sapiens
gggcatggtggctcag

SEQ ID NO: 116703 - DNA, 16 bp, H. sapiens
gggcatggtggctcat

SEQ ID NO: 116704 - DNA, 16 bp, H. sapiens
gggcatggtggcttac

SEQ ID NO: 116705 - DNA, 16 bp, H. sapiens
gggcatggtggggcac

SEQ ID NO: 116706 - DNA, 16 bp, H. sapiens
gggcatggtggtgccc

SEQ ID NO: 116707 - DNA, 16 bp, H. sapiens
gggcatggtggtggca

SEQ ID NO: 116708 - DNA, 16 bp, H. sapiens
gggcatggtggtggcg

SEQ ID NO: 116709 - DNA, 16 bp, H. sapiens
gggcatggtggtgggc

SEQ ID NO: 116710 - DNA, 25 bp, H. sapiens
gggcatggtggtgggcacctgtaat

SEQ ID NO: 116711 - DNA, 16 bp, H. sapiens
gggcatggtgttgggc

SEQ ID NO: 116712 - DNA, 16 bp, H. sapiens
gggcatgttcctgctg

SEQ ID NO: 116713 - DNA, 16 bp, H. sapiens
gggcatgttggtgcat

SEQ ID NO: 116714 - DNA, 16 bp, H. sapiens
gggcattgtggtgggc

SEQ ID NO: 116715 - DNA, 16 bp, H. sapiens
gggcatttattccaga

SEQ ID NO: 116716 - DNA, 16 bp, H. sapiens
gggcatttgggaggtg

SEQ ID NO: 116717 - DNA, 16 bp, H. sapiens
gggcattttttgccct

SEQ ID NO: 116718 - DNA, 16 bp, H. sapiens
gggccaaatgcagcaa

SEQ ID NO: 116719 - DNA, 16 bp, H. sapiens
gggccaacagacacct

SEQ ID NO: 116720 - DNA, 17 bp, H. sapiens
gggccaacatggtgaaa

SEQ ID NO: 116721 - DNA, 16 bp, H. sapiens
gggccaactgagctgc

SEQ ID NO: 116722 - DNA, 16 bp, H. sapiens
gggccaagcaggtgac

SEQ ID NO: 116723 - DNA, 16 bp, H. sapiens
gggccaaggcagcagg

SEQ ID NO: 116724 - DNA, 16 bp, H. sapiens
gggccaaggtacagct

SEQ ID NO: 116725 - DNA, 16 bp, H. sapiens
gggccaagtgcagtgg

SEQ ID NO: 116726 - DNA, 16 bp, H. sapiens
gggccacatggggaag

SEQ ID NO: 116727 - DNA, 16 bp, H. sapiens
gggccaccacacccgg

SEQ ID NO: 116728 - DNA, 16 bp, H. sapiens
gggccaccaccctcca

SEQ ID NO: 116729 - DNA, 17 bp, H. sapiens
gggccactaccagtctc

SEQ ID NO: 116730 - DNA, 17 bp, H. sapiens
gggccactaccggtctc

SEQ ID NO: 116731 - DNA, 17 bp, H. sapiens
gggccactactggtctc

SEQ ID NO: 116732 - DNA, 16 bp, H. sapiens
gggccagactgcctgg

SEQ ID NO: 116733 - DNA, 16 bp, H. sapiens
gggccagagccagggc

SEQ ID NO: 116734 - DNA, 16 bp, H. sapiens
gggccagagctgccca

SEQ ID NO: 116735 - DNA, 16 bp, H. sapiens
gggccagcagctgtgg

SEQ ID NO: 116736 - DNA, 16 bp, H. sapiens
gggccagcagggctgg

SEQ ID NO: 116737 - DNA, 16 bp, H. sapiens
gggccagcccctccac

SEQ ID NO: 116738 - DNA, 16 bp, H. sapiens
gggccagcggctgcgg

SEQ ID NO: 116739 - DNA, 16 bp, H. sapiens
gggccagctggagttc

SEQ ID NO: 116740 - DNA, 16 bp, H. sapiens
gggccaggagccaaga

SEQ ID NO: 116741 - DNA, 16 bp, H. sapiens
gggccaggcacggtgg

SEQ ID NO: 116742 - DNA, 16 bp, H. sapiens
gggccaggcagaacag

SEQ ID NO: 116743 - DNA, 16 bp, H. sapiens
gggccaggcagggtgg

SEQ ID NO: 116744 - DNA, 16 bp, H. sapiens
gggccaggcccaggac

SEQ ID NO: 116745 - DNA, 16 bp, H. sapiens
gggccaggcccaggcc

SEQ ID NO: 116746 - DNA, 16 bp, H. sapiens
gggccaggcccaggct

SEQ ID NO: 116747 - DNA, 16 bp, H. sapiens
gggccaggcccagggc

SEQ ID NO: 116748 - DNA, 16 bp, H. sapiens
gggccaggcctggagg

SEQ ID NO: 116749 - DNA, 16 bp, H. sapiens
gggccaggctgcctgg

SEQ ID NO: 116750 - DNA, 16 bp, H. sapiens
gggccagggcagcagc

SEQ ID NO: 116751 - DNA, 16 bp, H. sapiens
gggccagggcaggcag

SEQ ID NO: 116752 - DNA, 16 bp, H. sapiens
gggccagggccaaggc

SEQ ID NO: 116753 - DNA, 16 bp, H. sapiens
gggccagggccaggcc

SEQ ID NO: 116754 - DNA, 16 bp, H. sapiens
gggccagggccaggct

SEQ ID NO: 116755 - DNA, 16 bp, H. sapiens
gggccagggctgggcc

SEQ ID NO: 116756 - DNA, 16 bp, H. sapiens
gggccaggggcagaat

SEQ ID NO: 116757 - DNA, 16 bp, H. sapiens
gggccaggggcctggg

SEQ ID NO: 116758 - DNA, 16 bp, H. sapiens
gggccagggtcagggc

SEQ ID NO: 116759 - DNA, 16 bp, H. sapiens
gggccaggtgccatgg

SEQ ID NO: 116760 - DNA, 16 bp, H. sapiens
gggccaggtgctgtgg

SEQ ID NO: 116761 - DNA, 16 bp, H. sapiens
gggccaggtgggcagg

SEQ ID NO: 116762 - DNA, 16 bp, H. sapiens
gggccaggtgttcctt

SEQ ID NO: 116763 - DNA, 16 bp, H. sapiens
gggccatcacacccag

SEQ ID NO: 116764 - DNA, 16 bp, H. sapiens
gggccatggtggtttg

SEQ ID NO: 116765 - DNA, 16 bp, H. sapiens
gggccatggtgtggac

SEQ ID NO: 116766 - DNA, 16 bp, H. sapiens
gggccattttaaacag

SEQ ID NO: 116767 - DNA, 16 bp, H. sapiens
gggcccaagggctctt

SEQ ID NO: 116768 - DNA, 16 bp, H. sapiens
gggcccaagtgatcct

SEQ ID NO: 116769 - DNA, 16 bp, H. sapiens
gggcccacccatggct

SEQ ID NO: 116770 - DNA, 16 bp, H. sapiens
gggcccacttgaggag

SEQ ID NO: 116771 - DNA, 16 bp, H. sapiens
gggcccagagccagtg

SEQ ID NO: 116772 - DNA, 16 bp, H. sapiens
gggcccagcacccaga

SEQ ID NO: 116773 - DNA, 16 bp, H. sapiens
gggcccaggaatctgt

SEQ ID NO: 116774 - DNA, 16 bp, H. sapiens
gggcccaggcaggcag

SEQ ID NO: 116775 - DNA, 16 bp, H. sapiens
gggcccagggcccagg

SEQ ID NO: 116776 - DNA, 16 bp, H. sapiens
gggcccagggccctgc

SEQ ID NO: 116777 - DNA, 16 bp, H. sapiens
gggcccagggctgggg

SEQ ID NO: 116778 - DNA, 16 bp, H. sapiens
gggcccaggggaccag

SEQ ID NO: 116779 - DNA, 16 bp, H. sapiens
gggcccaggggactgg

SEQ ID NO: 116780 - DNA, 16 bp, H. sapiens
gggccccagcctggcc

SEQ ID NO: 116781 - DNA, 16 bp, H. sapiens
gggccccagctgcaga

SEQ ID NO: 116782 - DNA, 16 bp, H. sapiens
gggccccaggcctggc

SEQ ID NO: 116783 - DNA, 16 bp, H. sapiens
gggcccccaaatcact

SEQ ID NO: 116784 - DNA, 16 bp, H. sapiens
gggcccccagggaccc

SEQ ID NO: 116785 - DNA, 16 bp, H. sapiens
gggcccggcatggtgg

SEQ ID NO: 116786 - DNA, 16 bp, H. sapiens
gggccctctctgctcc

SEQ ID NO: 116787 - DNA, 16 bp, H. sapiens
gggccctcttcctggt

SEQ ID NO: 116788 - DNA, 16 bp, H. sapiens
gggccctgcactcaga

SEQ ID NO: 116789 - DNA, 16 bp, H. sapiens
gggccctgcccaccac

SEQ ID NO: 116790 - DNA, 16 bp, H. sapiens
gggccctggccgaggc

SEQ ID NO: 116791 - DNA, 16 bp, H. sapiens
gggccctgggccaggc

SEQ ID NO: 116792 - DNA, 16 bp, H. sapiens
gggccctgggcccagc

SEQ ID NO: 116793 - DNA, 16 bp, H. sapiens
gggccctgggccctga

SEQ ID NO: 116794 - DNA, 16 bp, H. sapiens
gggccctgggccctgc

SEQ ID NO: 116795 - DNA, 16 bp, H. sapiens
gggccctgggcctggc

SEQ ID NO: 116796 - DNA, 16 bp, H. sapiens
gggccctgggcctggt

SEQ ID NO: 116797 - DNA, 16 bp, H. sapiens
gggcccttagtctgag

SEQ ID NO: 116798 - DNA, 16 bp, H. sapiens
gggccgatcacctgag

SEQ ID NO: 116799 - DNA, 18 bp, H. sapiens
gggccgggcgcagtggct

SEQ ID NO: 116800 - DNA, 16 bp, H. sapiens
gggcctagcacagtgc

SEQ ID NO: 116801 - DNA, 16 bp, H. sapiens
gggcctatggtgaaaa

SEQ ID NO: 116802 - DNA, 16 bp, H. sapiens
gggcctcaccagggac

SEQ ID NO: 116803 - DNA, 16 bp, H. sapiens
gggcctcactctgttg

SEQ ID NO: 116804 - DNA, 16 bp, H. sapiens
gggcctcagcctccca

SEQ ID NO: 116805 - DNA, 16 bp, H. sapiens
gggcctcagcctcctg

SEQ ID NO: 116806 - DNA, 16 bp, H. sapiens
gggcctcagctgcctc

SEQ ID NO: 116807 - DNA, 16 bp, H. sapiens
gggcctcagcttcctt

SEQ ID NO: 116808 - DNA, 16 bp, H. sapiens
gggcctcaggaggaac

SEQ ID NO: 116809 - DNA, 16 bp, H. sapiens
gggcctcagggaggag

SEQ ID NO: 116810 - DNA, 16 bp, H. sapiens
gggcctcagtttcctt

SEQ ID NO: 116811 - DNA, 16 bp, H. sapiens
gggcctccagccaccc

SEQ ID NO: 116812 - DNA, 16 bp, H. sapiens
gggcctcctgaggctg

SEQ ID NO: 116813 - DNA, 16 bp, H. sapiens
gggcctgccaccacac

SEQ ID NO: 116814 - DNA, 16 bp, H. sapiens
gggcctgcctttccca

SEQ ID NO: 116815 - DNA, 16 bp, H. sapiens
gggcctgcgggtgcac

SEQ ID NO: 116816 - DNA, 16 bp, H. sapiens
gggcctgctgggactt

SEQ ID NO: 116817 - DNA, 16 bp, H. sapiens
gggcctggaaaggggg

SEQ ID NO: 116818 - DNA, 16 bp, H. sapiens
gggcctggaagaaaaa

SEQ ID NO: 116819 - DNA, 16 bp, H. sapiens
gggcctggacccctgg

SEQ ID NO: 116820 - DNA, 16 bp, H. sapiens
gggcctggactcctgg

SEQ ID NO: 116821 - DNA, 16 bp, H. sapiens
gggcctggagaagccc

SEQ ID NO: 116822 - DNA, 16 bp, H. sapiens
gggcctggagcagtgg

SEQ ID NO: 116823 - DNA, 16 bp, H. sapiens
gggcctggagccctgg

SEQ ID NO: 116824 - DNA, 16 bp, H. sapiens
gggcctggagcctggg

SEQ ID NO: 116825 - DNA, 16 bp, H. sapiens
gggcctggagctcagg

SEQ ID NO: 116826 - DNA, 16 bp, H. sapiens
gggcctggaggcaggg

SEQ ID NO: 116827 - DNA, 16 bp, H. sapiens
gggcctggaggtggag

SEQ ID NO: 116828 - DNA, 16 bp, H. sapiens
gggcctggcacacagt

SEQ ID NO: 116829 - DNA, 16 bp, H. sapiens
gggcctggcacagagc

SEQ ID NO: 116830 - DNA, 16 bp, H. sapiens
gggcctggcatggtgg

SEQ ID NO: 116831 - DNA, 16 bp, H. sapiens
gggcctggcccaggaa

SEQ ID NO: 116832 - DNA, 16 bp, H. sapiens
gggcctggcccagggc

SEQ ID NO: 116833 - DNA, 16 bp, H. sapiens
gggcctggcgggaggt

SEQ ID NO: 116834 - DNA, 16 bp, H. sapiens
gggcctgggcctcctg

SEQ ID NO: 116835 - DNA, 16 bp, H. sapiens
gggcctgggcctggcc

SEQ ID NO: 116836 - DNA, 16 bp, H. sapiens
gggcctgggctcctgg

SEQ ID NO: 116837 - DNA, 16 bp, H. sapiens
gggcctggggctgcag

SEQ ID NO: 116838 - DNA, 16 bp, H. sapiens
gggcctgggggaactc

SEQ ID NO: 116839 - DNA, 16 bp, H. sapiens
gggcctgggggacctc

SEQ ID NO: 116840 - DNA, 16 bp, H. sapiens
gggcctggtctctgct

SEQ ID NO: 116841 - DNA, 16 bp, H. sapiens
gggcctgtagcccctt

SEQ ID NO: 116842 - DNA, 16 bp, H. sapiens
gggcctgtagttccag

SEQ ID NO: 116843 - DNA, 16 bp, H. sapiens
gggcctgtcacggggt

SEQ ID NO: 116844 - DNA, 16 bp, H. sapiens
gggcctgtcatggggg

SEQ ID NO: 116845 - DNA, 16 bp, H. sapiens
gggcctgtcatggggt

SEQ ID NO: 116846 - DNA, 16 bp, H. sapiens
gggcctgttggggagc

SEQ ID NO: 116847 - DNA, 16 bp, H. sapiens
gggcctgttgtggagt

SEQ ID NO: 116848 - DNA, 16 bp, H. sapiens
gggcctgttttggggt

SEQ ID NO: 116849 - DNA, 16 bp, H. sapiens
gggccttagtttcccc

SEQ ID NO: 116850 - DNA, 16 bp, H. sapiens
gggccttcctgctgtg

SEQ ID NO: 116851 - DNA, 16 bp, H. sapiens
gggccttcctgggccc

SEQ ID NO: 116852 - DNA, 16 bp, H. sapiens
gggccttggctgcctt

SEQ ID NO: 116853 - DNA, 16 bp, H. sapiens
gggccttgggcaagac

SEQ ID NO: 116854 - DNA, 16 bp, H. sapiens
gggccttgggccacag

SEQ ID NO: 116855 - DNA, 16 bp, H. sapiens
gggcctttaagaagtg

SEQ ID NO: 116856 - DNA, 16 bp, H. sapiens
gggcctttgcacatgc

SEQ ID NO: 116857 - DNA, 16 bp, H. sapiens
gggcctttgcactggc

SEQ ID NO: 116858 - DNA, 16 bp, H. sapiens
gggcctttggggaggt

SEQ ID NO: 116859 - DNA, 16 bp, H. sapiens
gggcgacagagcaaga

SEQ ID NO: 116860 - DNA, 16 bp, H. sapiens
gggcgacagagtaaaa

SEQ ID NO: 116861 - DNA, 16 bp, H. sapiens
gggcgagggacatgaa

SEQ ID NO: 116862 - DNA, 18 bp, H. sapiens
gggcgcaatctcggctca

SEQ ID NO: 116863 - DNA, 16 bp, H. sapiens
gggcgcagtggctcac

SEQ ID NO: 116864 - DNA, 16 bp, H. sapiens
gggcgcagtggctgac

SEQ ID NO: 116865 - DNA, 16 bp, H. sapiens
gggcgccatggctcac

SEQ ID NO: 116866 - DNA, 16 bp, H. sapiens
gggcgccgtggagcag

SEQ ID NO: 116867 - DNA, 16 bp, H. sapiens
gggcgcggtggctaac

SEQ ID NO: 116868 - DNA, 16 bp, H. sapiens
gggcggctgggcagag

SEQ ID NO: 116869 - DNA, 16 bp, H. sapiens
gggcggtcgatgggac

SEQ ID NO: 116870 - DNA, 16 bp, H. sapiens
gggcggtttcccccat

SEQ ID NO: 116871 - DNA, 16 bp, H. sapiens
gggcgtgagccaccac

SEQ ID NO: 116872 - DNA, 16 bp, H. sapiens
gggcgtgatggtgggc

SEQ ID NO: 116873 - DNA, 16 bp, H. sapiens
gggcgtggcagcaggc

SEQ ID NO: 116874 - DNA, 16 bp, H. sapiens
gggcgtggtgacaggc

SEQ ID NO: 116875 - DNA, 16 bp, H. sapiens
gggcgtggtgacgggc

SEQ ID NO: 116876 - DNA, 16 bp, H. sapiens
gggcgtggtggagcac

SEQ ID NO: 116877 - DNA, 16 bp, H. sapiens
gggcgtggtggcggat

SEQ ID NO: 116878 - DNA, 16 bp, H. sapiens
gggcgtggtggtggca

SEQ ID NO: 116879 - DNA, 16 bp, H. sapiens
gggcgtggtggtgtac

SEQ ID NO: 116880 - DNA, 16 bp, H. sapiens
gggctacagagctaga

SEQ ID NO: 116881 - DNA, 16 bp, H. sapiens
gggctactatccagaa

SEQ ID NO: 116882 - DNA, 16 bp, H. sapiens
gggctagagtgcagtg

SEQ ID NO: 116883 - DNA, 16 bp, H. sapiens
gggctagcctgctgga

SEQ ID NO: 116884 - DNA, 16 bp, H. sapiens
gggctatctgcctgtg

SEQ ID NO: 116885 - DNA, 20 bp, H. sapiens
gggctcaagcgatcctcccg

SEQ ID NO: 116886 - DNA, 16 bp, H. sapiens
gggctcaagtatcctc

SEQ ID NO: 116887 - DNA, 16 bp, H. sapiens
gggctcactgcagcct

SEQ ID NO: 116888 - DNA, 16 bp, H. sapiens
gggctcagagaggtga

SEQ ID NO: 116889 - DNA, 16 bp, H. sapiens
gggctcagcctcctga

SEQ ID NO: 116890 - DNA, 16 bp, H. sapiens
gggctcaggcaggagg

SEQ ID NO: 116891 - DNA, 16 bp, H. sapiens
gggctcaggcccaggg

SEQ ID NO: 116892 - DNA, 16 bp, H. sapiens
gggctcagggaatcct

SEQ ID NO: 116893 - DNA, 16 bp, H. sapiens
gggctcaggggatcct

SEQ ID NO: 116894 - DNA, 16 bp, H. sapiens
gggctcaggtgaccct

SEQ ID NO: 116895 - DNA, 16 bp, H. sapiens
gggctcagtccccaag

SEQ ID NO: 116896 - DNA, 16 bp, H. sapiens
gggctcagtttcctca

SEQ ID NO: 116897 - DNA, 16 bp, H. sapiens
gggctccacccccagg

SEQ ID NO: 116898 - DNA, 16 bp, H. sapiens
gggctccagcagtcct

SEQ ID NO: 116899 - DNA, 16 bp, H. sapiens
gggctccaggcatccc

SEQ ID NO: 116900 - DNA, 16 bp, H. sapiens
gggctcccacttgtcc

SEQ ID NO: 116901 - DNA, 16 bp, H. sapiens
gggctcccctgccctg

SEQ ID NO: 116902 - DNA, 17 bp, H. sapiens
gggctcctacagtgcag

SEQ ID NO: 116903 - DNA, 16 bp, H. sapiens
gggctcctccccagcc

SEQ ID NO: 116904 - DNA, 16 bp, H. sapiens
gggctcctcctgcctc

SEQ ID NO: 116905 - DNA, 16 bp, H. sapiens
gggctcctgcctgctc

SEQ ID NO: 116906 - DNA, 16 bp, H. sapiens
gggctcctggggtccc

SEQ ID NO: 116907 - DNA, 16 bp, H. sapiens
gggctcgagaccagcc

SEQ ID NO: 116908 - DNA, 16 bp, H. sapiens
gggctcgagccatcct

SEQ ID NO: 116909 - DNA, 16 bp, H. sapiens
gggctctgaagtcaga

SEQ ID NO: 116910 - DNA, 16 bp, H. sapiens
gggctctggaatcaga

SEQ ID NO: 116911 - DNA, 16 bp, H. sapiens
gggctctggagacaga

SEQ ID NO: 116912 - DNA, 16 bp, H. sapiens
gggctctggagccaga

SEQ ID NO: 116913 - DNA, 17 bp, H. sapiens
gggctctggagccagac

SEQ ID NO: 116914 - DNA, 16 bp, H. sapiens
gggctctggagtcaga

SEQ ID NO: 116915 - DNA, 16 bp, H. sapiens
gggctctgggcctggc

SEQ ID NO: 116916 - DNA, 16 bp, H. sapiens
gggctctgggctctgg

SEQ ID NO: 116917 - DNA, 16 bp, H. sapiens
gggctctgggctggta

SEQ ID NO: 116918 - DNA, 16 bp, H. sapiens
gggctctggggccaga

SEQ ID NO: 116919 - DNA, 16 bp, H. sapiens
gggctctgttttgttc

SEQ ID NO: 116920 - DNA, 16 bp, H. sapiens
gggctcttcctgctgc

SEQ ID NO: 116921 - DNA, 16 bp, H. sapiens
gggctgaagtgctctg

SEQ ID NO: 116922 - DNA, 16 bp, H. sapiens
gggctgaccccccacc

SEQ ID NO: 116923 - DNA, 16 bp, H. sapiens
gggctgagacaggtgg

SEQ ID NO: 116924 - DNA, 16 bp, H. sapiens
gggctgagcatggtgg

SEQ ID NO: 116925 - DNA, 16 bp, H. sapiens
gggctgagccaggaga

SEQ ID NO: 116926 - DNA, 16 bp, H. sapiens
gggctgagctgggctg

SEQ ID NO: 116927 - DNA, 16 bp, H. sapiens
gggctgaggcagagaa

SEQ ID NO: 116928 - DNA, 16 bp, H. sapiens
gggctgaggtaggagg

SEQ ID NO: 116929 - DNA, 16 bp, H. sapiens
gggctgaggtgggcag

SEQ ID NO: 116930 - DNA, 16 bp, H. sapiens
gggctgagtctgaaaa

SEQ ID NO: 116931 - DNA, 16 bp, H. sapiens
gggctgatcacttgag

SEQ ID NO: 116932 - DNA, 16 bp, H. sapiens
gggctgcacagcctgc

SEQ ID NO: 116933 - DNA, 16 bp, H. sapiens
gggctgcacccactct

SEQ ID NO: 116934 - DNA, 16 bp, H. sapiens
gggctgcagcagtggc

SEQ ID NO: 116935 - DNA, 16 bp, H. sapiens
gggctgcagggctggg

SEQ ID NO: 116936 - DNA, 16 bp, H. sapiens
gggctgcaggggcagg

SEQ ID NO: 116937 - DNA, 16 bp, H. sapiens
gggctgcagtgagcca

SEQ ID NO: 116938 - DNA, 16 bp, H. sapiens
gggctgccagccacca

SEQ ID NO: 116939 - DNA, 16 bp, H. sapiens
gggctgccagggctgc

SEQ ID NO: 116940 - DNA, 16 bp, H. sapiens
gggctgccaggggctg

SEQ ID NO: 116941 - DNA, 16 bp, H. sapiens
gggctgccataacaaa

SEQ ID NO: 116942 - DNA, 16 bp, H. sapiens
gggctgccgggcagag

SEQ ID NO: 116943 - DNA, 16 bp, H. sapiens
gggctgcctggaggag

SEQ ID NO: 116944 - DNA, 16 bp, H. sapiens
gggctgcctggggagg

SEQ ID NO: 116945 - DNA, 16 bp, H. sapiens
gggctgcgagggctgc

SEQ ID NO: 116946 - DNA, 16 bp, H. sapiens
gggctgcgcaggagcc

SEQ ID NO: 116947 - DNA, 16 bp, H. sapiens
gggctgctacaacaaa

SEQ ID NO: 116948 - DNA, 16 bp, H. sapiens
gggctgctctctcacc

SEQ ID NO: 116949 - DNA, 17 bp, H. sapiens
gggctgctgcagtttgc

SEQ ID NO: 116950 - DNA, 16 bp, H. sapiens
gggctgctggctgccc

SEQ ID NO: 116951 - DNA, 16 bp, H. sapiens
gggctgctggttgccc

SEQ ID NO: 116952 - DNA, 16 bp, H. sapiens
gggctgcttgagtgtc

SEQ ID NO: 116953 - DNA, 16 bp, H. sapiens
gggctgctttttgtta

SEQ ID NO: 116954 - DNA, 16 bp, H. sapiens
gggctggagaaggcag

SEQ ID NO: 116955 - DNA, 16 bp, H. sapiens
gggctggagagcaggg

SEQ ID NO: 116956 - DNA, 16 bp, H. sapiens
gggctggaggaggcag

SEQ ID NO: 116957 - DNA, 16 bp, H. sapiens
gggctggagggcagga

SEQ ID NO: 116958 - DNA, 16 bp, H. sapiens
gggctggagggcagtg

SEQ ID NO: 116959 - DNA, 16 bp, H. sapiens
gggctggaggtgggac

SEQ ID NO: 116960 - DNA, 16 bp, H. sapiens
gggctggagtgcaatg

SEQ ID NO: 116961 - DNA, 16 bp, H. sapiens
gggctggagtgcagtg

SEQ ID NO: 116962 - DNA, 16 bp, H. sapiens
gggctggagtgcagtt

SEQ ID NO: 116963 - DNA, 16 bp, H. sapiens
gggctggattgcagtg

SEQ ID NO: 116964 - DNA, 19 bp, H. sapiens
gggctggcactgctggggg

SEQ ID NO: 116965 - DNA, 16 bp, H. sapiens
gggctggcagggccgg

SEQ ID NO: 116966 - DNA, 16 bp, H. sapiens
gggctggcagtgctgg

SEQ ID NO: 116967 - DNA, 17 bp, H. sapiens
gggctggccaaggccgg

SEQ ID NO: 116968 - DNA, 16 bp, H. sapiens
gggctggccatggtgg

SEQ ID NO: 116969 - DNA, 16 bp, H. sapiens
gggctgggaaaactgg

SEQ ID NO: 116970 - DNA, 16 bp, H. sapiens
gggctgggaacggtgg

SEQ ID NO: 116971 - DNA, 16 bp, H. sapiens
gggctgggaagtccaa

SEQ ID NO: 116972 - DNA, 16 bp, H. sapiens
gggctgggagcaggca

SEQ ID NO: 116973 - DNA, 16 bp, H. sapiens
gggctgggaggagaga

SEQ ID NO: 116974 - DNA, 16 bp, H. sapiens
gggctgggcacaggtg

SEQ ID NO: 116975 - DNA, 16 bp, H. sapiens
gggctgggcagaggtg

SEQ ID NO: 116976 - DNA, 16 bp, H. sapiens
gggctgggcagggcag

SEQ ID NO: 116977 - DNA, 16 bp, H. sapiens
gggctgggcatggtgg

SEQ ID NO: 116978 - DNA, 16 bp, H. sapiens
gggctgggcatgttgg

SEQ ID NO: 116979 - DNA, 16 bp, H. sapiens
gggctgggccagggcc

SEQ ID NO: 116980 - DNA, 16 bp, H. sapiens
gggctgggccaggtgg

SEQ ID NO: 116981 - DNA, 16 bp, H. sapiens
gggctgggcccagagc

SEQ ID NO: 116982 - DNA, 16 bp, H. sapiens
gggctgggcccagggc

SEQ ID NO: 116983 - DNA, 16 bp, H. sapiens
gggctgggccctggga

SEQ ID NO: 116984 - DNA, 18 bp, H. sapiens
gggctgggcgcagtggct

SEQ ID NO: 116985 - DNA, 16 bp, H. sapiens
gggctgggcgccatgg

SEQ ID NO: 116986 - DNA, 16 bp, H. sapiens
gggctgggctggcctg

SEQ ID NO: 116987 - DNA, 16 bp, H. sapiens
gggctgggctgggctc

SEQ ID NO: 116988 - DNA, 16 bp, H. sapiens
gggctggggaaaggag

SEQ ID NO: 116989 - DNA, 16 bp, H. sapiens
gggctggggaagagga

SEQ ID NO: 116990 - DNA, 16 bp, H. sapiens
gggctggggaagcagg

SEQ ID NO: 116991 - DNA, 16 bp, H. sapiens
gggctggggaccaggg

SEQ ID NO: 116992 - DNA, 16 bp, H. sapiens
gggctggggacccagg

SEQ ID NO: 116993 - DNA, 16 bp, H. sapiens
gggctggggaggcaga

SEQ ID NO: 116994 - DNA, 16 bp, H. sapiens
gggctggggcagggaa

SEQ ID NO: 116995 - DNA, 16 bp, H. sapiens
gggctggggccagggc

SEQ ID NO: 116996 - DNA, 16 bp, H. sapiens
gggctggggcccagca

SEQ ID NO: 116997 - DNA, 16 bp, H. sapiens
gggctggggcctgaga

SEQ ID NO: 116998 - DNA, 16 bp, H. sapiens
gggctggggctcaggg

SEQ ID NO: 116999 - DNA, 16 bp, H. sapiens
gggctggggctccagg

SEQ ID NO: 117000 - DNA, 16 bp, H. sapiens
gggctggggctgacat

SEQ ID NO: 117001 - DNA, 16 bp, H. sapiens
gggctggggctgagcc

SEQ ID NO: 117002 - DNA, 16 bp, H. sapiens
gggctggggctggagc

SEQ ID NO: 117003 - DNA, 16 bp, H. sapiens
gggctgggggcctgga

SEQ ID NO: 117004 - DNA, 16 bp, H. sapiens
gggctgggggctgcag

SEQ ID NO: 117005 - DNA, 16 bp, H. sapiens
gggctggtcatggtgg

SEQ ID NO: 117006 - DNA, 16 bp, H. sapiens
gggctggtcctgaact

SEQ ID NO: 117007 - DNA, 16 bp, H. sapiens
gggctggtctcaaact

SEQ ID NO: 117008 - DNA, 21 bp, H. sapiens
gggctggtctcaaactcctga

SEQ ID NO: 117009 - DNA, 16 bp, H. sapiens
gggctggtctcgaact

SEQ ID NO: 117010 - DNA, 16 bp, H. sapiens
gggctggtgttgagtg

SEQ ID NO: 117011 - DNA, 16 bp, H. sapiens
gggctgtagtgagcca

SEQ ID NO: 117012 - DNA, 16 bp, H. sapiens
gggctgtcatggagaa

SEQ ID NO: 117013 - DNA, 16 bp, H. sapiens
gggctgtcctgtgtgt

SEQ ID NO: 117014 - DNA, 16 bp, H. sapiens
gggctgtgctgtgctg

SEQ ID NO: 117015 - DNA, 16 bp, H. sapiens
gggctgttgtgaggac

SEQ ID NO: 117016 - DNA, 16 bp, H. sapiens
gggcttcatcatcttg

SEQ ID NO: 117017 - DNA, 16 bp, H. sapiens
gggcttcatcctcatg

SEQ ID NO: 117018 - DNA, 16 bp, H. sapiens
gggcttcatggaggag

SEQ ID NO: 117019 - DNA, 16 bp, H. sapiens
gggcttccagcctcca

SEQ ID NO: 117020 - DNA, 16 bp, H. sapiens
gggcttccataacaaa

SEQ ID NO: 117021 - DNA, 16 bp, H. sapiens
gggcttcccaggcccc

SEQ ID NO: 117022 - DNA, 16 bp, H. sapiens
gggcttcctgcaggag

SEQ ID NO: 117023 - DNA, 16 bp, H. sapiens
gggcttggctttgtga

SEQ ID NO: 117024 - DNA, 16 bp, H. sapiens
gggcttgggaagtggg

SEQ ID NO: 117025 - DNA, 16 bp, H. sapiens
gggcttgttatcagtg

SEQ ID NO: 117026 - DNA, 16 bp, H. sapiens
gggctttccagagaaa

SEQ ID NO: 117027 - DNA, 16 bp, H. sapiens
gggctttgaggaccat

SEQ ID NO: 117028 - DNA, 16 bp, H. sapiens
gggctttgcccctgca

SEQ ID NO: 117029 - DNA, 16 bp, H. sapiens
gggctttggggtcagg

SEQ ID NO: 117030 - DNA, 16 bp, H. sapiens
gggctttgtttacact

SEQ ID NO: 117031 - DNA, 16 bp, H. sapiens
ggggaaaaaaaaatca

SEQ ID NO: 117032 - DNA, 16 bp, H. sapiens
ggggaaaaaaaacact

SEQ ID NO: 117033 - DNA, 16 bp, H. sapiens
ggggaaaaaaatcaaa

SEQ ID NO: 117034 - DNA, 16 bp, H. sapiens
ggggaaaaaaatctct

SEQ ID NO: 117035 - DNA, 16 bp, H. sapiens
ggggaaaacattcagt

SEQ ID NO: 117036 - DNA, 16 bp, H. sapiens
ggggaaaagcccttta

SEQ ID NO: 117037 - DNA, 16 bp, H. sapiens
ggggaaaatatttgca

SEQ ID NO: 117038 - DNA, 16 bp, H. sapiens
ggggaaaatctgtttc

SEQ ID NO: 117039 - DNA, 16 bp, H. sapiens
ggggaaaatgtatcca

SEQ ID NO: 117040 - DNA, 16 bp, H. sapiens
ggggaaactcttcagg

SEQ ID NO: 117041 - DNA, 16 bp, H. sapiens
ggggaaactgaagctc

SEQ ID NO: 117042 - DNA, 16 bp, H. sapiens
ggggaaactgaggcaa

SEQ ID NO: 117043 - DNA, 16 bp, H. sapiens
ggggaaactgaggccc

SEQ ID NO: 117044 - DNA, 16 bp, H. sapiens
ggggaaactgaggcct

SEQ ID NO: 117045 - DNA, 19 bp, H. sapiens
ggggaaactgaggctcagg

SEQ ID NO: 117046 - DNA, 16 bp, H. sapiens
ggggaaactgaggctg

SEQ ID NO: 117047 - DNA, 16 bp, H. sapiens
ggggaaactgagtccc

SEQ ID NO: 117048 - DNA, 16 bp, H. sapiens
ggggaaaggacagtct

SEQ ID NO: 117049 - DNA, 16 bp, H. sapiens
ggggaaaggatagtct

SEQ ID NO: 117050 - DNA, 16 bp, H. sapiens
ggggaaaggctgggag

SEQ ID NO: 117051 - DNA, 16 bp, H. sapiens
ggggaaaggctttcag

SEQ ID NO: 117052 - DNA, 16 bp, H. sapiens
ggggaaatgattccct

SEQ ID NO: 117053 - DNA, 16 bp, H. sapiens
ggggaaatgccagatg

SEQ ID NO: 117054 - DNA, 16 bp, H. sapiens
ggggaaatttatagca

SEQ ID NO: 117055 - DNA, 16 bp, H. sapiens
ggggaacagagtgaga

SEQ ID NO: 117056 - DNA, 16 bp, H. sapiens
ggggaacatcacacac

SEQ ID NO: 117057 - DNA, 16 bp, H. sapiens
ggggaacatcactcac

SEQ ID NO: 117058 - DNA, 16 bp, H. sapiens
ggggaacatggtgaga

SEQ ID NO: 117059 - DNA, 16 bp, H. sapiens
ggggaacctgccccca

SEQ ID NO: 117060 - DNA, 16 bp, H. sapiens
ggggaacgacacacac

SEQ ID NO: 117061 - DNA, 16 bp, H. sapiens
ggggaactgccaaaca

SEQ ID NO: 117062 - DNA, 16 bp, H. sapiens
ggggaactgcccttta

SEQ ID NO: 117063 - DNA, 16 bp, H. sapiens
ggggaagaccaccttc

SEQ ID NO: 117064 - DNA, 16 bp, H. sapiens
ggggaagagggactgg

SEQ ID NO: 117065 - DNA, 16 bp, H. sapiens
ggggaagatcaccttc

SEQ ID NO: 117066 - DNA, 16 bp, H. sapiens
ggggaagcaaggcata

SEQ ID NO: 117067 - DNA, 16 bp, H. sapiens
ggggaagcaccagggt

SEQ ID NO: 117068 - DNA, 16 bp, H. sapiens
ggggaagccagtgagc

SEQ ID NO: 117069 - DNA, 16 bp, H. sapiens
ggggaaggatagcatt

SEQ ID NO: 117070 - DNA, 16 bp, H. sapiens
ggggaaggggctgctg

SEQ ID NO: 117071 - DNA, 16 bp, H. sapiens
ggggaagtttttaaat

SEQ ID NO: 117072 - DNA, 16 bp, H. sapiens
ggggaatacagaagaa

SEQ ID NO: 117073 - DNA, 16 bp, H. sapiens
ggggaatgcttccagc

SEQ ID NO: 117074 - DNA, 16 bp, H. sapiens
ggggacaagggaacct

SEQ ID NO: 117075 - DNA, 16 bp, H. sapiens
ggggacaatctgggcc

SEQ ID NO: 117076 - DNA, 16 bp, H. sapiens
ggggacacaaacattc

SEQ ID NO: 117077 - DNA, 16 bp, H. sapiens
ggggacacaattcaat

SEQ ID NO: 117078 - DNA, 16 bp, H. sapiens
ggggacacacacattc

SEQ ID NO: 117079 - DNA, 16 bp, H. sapiens
ggggacacagacaaat

SEQ ID NO: 117080 - DNA, 16 bp, H. sapiens
ggggacacagggccaa

SEQ ID NO: 117081 - DNA, 17 bp, H. sapiens
ggggacagcctggcagc

SEQ ID NO: 117082 - DNA, 18 bp, H. sapiens
ggggaccactaccaccaa

SEQ ID NO: 117083 - DNA, 16 bp, H. sapiens
ggggaccagggcagag

SEQ ID NO: 117084 - DNA, 16 bp, H. sapiens
ggggaccctgggccca

SEQ ID NO: 117085 - DNA, 16 bp, H. sapiens
ggggaccctgggggct

SEQ ID NO: 117086 - DNA, 27 bp, H. sapiens
ggggacctcccttgggagatcaatccc

SEQ ID NO: 117087 - DNA, 16 bp, H. sapiens
ggggacctgagcaggt

SEQ ID NO: 117088 - DNA, 16 bp, H. sapiens
ggggacgttctcctgg

SEQ ID NO: 117089 - DNA, 16 bp, H. sapiens
ggggactcaagggaaa

SEQ ID NO: 117090 - DNA, 16 bp, H. sapiens
ggggactgttgtgagg

SEQ ID NO: 117091 - DNA, 16 bp, H. sapiens
ggggactgtttggaag

SEQ ID NO: 117092 - DNA, 16 bp, H. sapiens
ggggacttccaggtca

SEQ ID NO: 117093 - DNA, 16 bp, H. sapiens
ggggacttggagaaca

SEQ ID NO: 117094 - DNA, 16 bp, H. sapiens
ggggacttggagaacc

SEQ ID NO: 117095 - DNA, 16 bp, H. sapiens
ggggagaaattggcca

SEQ ID NO: 117096 - DNA, 16 bp, H. sapiens
ggggagaagaggaatt

SEQ ID NO: 117097 - DNA, 16 bp, H. sapiens
ggggagaatggagcca

SEQ ID NO: 117098 - DNA, 16 bp, H. sapiens
ggggagaccccatctc

SEQ ID NO: 117099 - DNA, 16 bp, H. sapiens
ggggagactctgtctc

SEQ ID NO: 117100 - DNA, 16 bp, H. sapiens
ggggagactgaggcag

SEQ ID NO: 117101 - DNA, 16 bp, H. sapiens
ggggagagacctggtg

SEQ ID NO: 117102 - DNA, 16 bp, H. sapiens
ggggagagcattccag

SEQ ID NO: 117103 - DNA, 16 bp, H. sapiens
ggggagaggattccct

SEQ ID NO: 117104 - DNA, 16 bp, H. sapiens
ggggagatggaggctg

SEQ ID NO: 117105 - DNA, 16 bp, H. sapiens
ggggagatggatttga

SEQ ID NO: 117106 - DNA, 16 bp, H. sapiens
ggggagcagccctggg

SEQ ID NO: 117107 - DNA, 16 bp, H. sapiens
ggggagcctcaggaaa

SEQ ID NO: 117108 - DNA, 16 bp, H. sapiens
ggggagctgggctgga

SEQ ID NO: 117109 - DNA, 16 bp, H. sapiens
ggggagcttcctcaca

SEQ ID NO: 117110 - DNA, 17 bp, H. sapiens
ggggagcttctgagcca

SEQ ID NO: 117111 - DNA, 16 bp, H. sapiens
ggggagcttgcagtga

SEQ ID NO: 117112 - DNA, 17 bp, H. sapiens
ggggaggagccaagatg

SEQ ID NO: 117113 - DNA, 16 bp, H. sapiens
ggggaggagcctggcc

SEQ ID NO: 117114 - DNA, 16 bp, H. sapiens
ggggaggaggctgcag

SEQ ID NO: 117115 - DNA, 16 bp, H. sapiens
ggggaggcagatgttg

SEQ ID NO: 117116 - DNA, 16 bp, H. sapiens
ggggaggcagctgagg

SEQ ID NO: 117117 - DNA, 16 bp, H. sapiens
ggggaggccacaggaa

SEQ ID NO: 117118 - DNA, 16 bp, H. sapiens
ggggaggcctcaaaat

SEQ ID NO: 117119 - DNA, 16 bp, H. sapiens
ggggaggctgagccag

SEQ ID NO: 117120 - DNA, 17 bp, H. sapiens
ggggaggctgaggcagc

SEQ ID NO: 117121 - DNA, 16 bp, H. sapiens
ggggaggctgatgcag

SEQ ID NO: 117122 - DNA, 16 bp, H. sapiens
ggggaggctgcagtga

SEQ ID NO: 117123 - DNA, 16 bp, H. sapiens
ggggagggagagcatc

SEQ ID NO: 117124 - DNA, 16 bp, H. sapiens
ggggagggatagcatc

SEQ ID NO: 117125 - DNA, 16 bp, H. sapiens
ggggagggatagcatt

SEQ ID NO: 117126 - DNA, 16 bp, H. sapiens
ggggagggcatggaag

SEQ ID NO: 117127 - DNA, 16 bp, H. sapiens
ggggaggggcatctgc

SEQ ID NO: 117128 - DNA, 16 bp, H. sapiens
ggggaggggtgcctgc

SEQ ID NO: 117129 - DNA, 16 bp, H. sapiens
ggggaggtgtcacaca

SEQ ID NO: 117130 - DNA, 16 bp, H. sapiens
ggggagtgccagacag

SEQ ID NO: 117131 - DNA, 19 bp, H. sapiens
ggggagtttagagaagact

SEQ ID NO: 117132 - DNA, 16 bp, H. sapiens
ggggagtttgcagtga

SEQ ID NO: 117133 - DNA, 16 bp, H. sapiens
ggggataccaccactg

SEQ ID NO: 117134 - DNA, 16 bp, H. sapiens
ggggatcttttttttt

SEQ ID NO: 117135 - DNA, 16 bp, H. sapiens
ggggatgcagggagag

SEQ ID NO: 117136 - DNA, 16 bp, H. sapiens
ggggatgccctctctc

SEQ ID NO: 117137 - DNA, 16 bp, H. sapiens
ggggatgctgctgctg

SEQ ID NO: 117138 - DNA, 16 bp, H. sapiens
ggggatggggacagga

SEQ ID NO: 117139 - DNA, 16 bp, H. sapiens
ggggatgggggcccag

SEQ ID NO: 117140 - DNA, 16 bp, H. sapiens
ggggatggtgatgatg

SEQ ID NO: 117141 - DNA, 16 bp, H. sapiens
ggggatggtggtgcac

SEQ ID NO: 117142 - DNA, 16 bp, H. sapiens
ggggatgtacaccccc

SEQ ID NO: 117143 - DNA, 16 bp, H. sapiens
ggggattacatttcaa

SEQ ID NO: 117144 - DNA, 16 bp, H. sapiens
ggggattatggctgcc

SEQ ID NO: 117145 - DNA, 16 bp, H. sapiens
ggggattcctcaggga

SEQ ID NO: 117146 - DNA, 16 bp, H. sapiens
ggggattgcagtgagc

SEQ ID NO: 117147 - DNA, 16 bp, H. sapiens
ggggattgcttgagcc

SEQ ID NO: 117148 - DNA, 16 bp, H. sapiens
ggggattgttgggaag

SEQ ID NO: 117149 - DNA, 16 bp, H. sapiens
ggggcaacatagtgag

SEQ ID NO: 117150 - DNA, 17 bp, H. sapiens
ggggcaacatagtgaga

SEQ ID NO: 117151 - DNA, 16 bp, H. sapiens
ggggcaacccacccct

SEQ ID NO: 117152 - DNA, 16 bp, H. sapiens
ggggcaagacttttct

SEQ ID NO: 117153 - DNA, 16 bp, H. sapiens
ggggcaagcacctccc

SEQ ID NO: 117154 - DNA, 16 bp, H. sapiens
ggggcaaggtggggaa

SEQ ID NO: 117155 - DNA, 16 bp, H. sapiens
ggggcactgactgggg

SEQ ID NO: 117156 - DNA, 16 bp, H. sapiens
ggggcagagcctgcag

SEQ ID NO: 117157 - DNA, 16 bp, H. sapiens
ggggcagagctgctca

SEQ ID NO: 117158 - DNA, 16 bp, H. sapiens
ggggcagaggctgcag

SEQ ID NO: 117159 - DNA, 16 bp, H. sapiens
ggggcagaggtggcag

SEQ ID NO: 117160 - DNA, 16 bp, H. sapiens
ggggcagatctttcct

SEQ ID NO: 117161 - DNA, 16 bp, H. sapiens
ggggcagcagcagtgg

SEQ ID NO: 117162 - DNA, 16 bp, H. sapiens
ggggcagcaggggctg

SEQ ID NO: 117163 - DNA, 16 bp, H. sapiens
ggggcagccaagggag

SEQ ID NO: 117164 - DNA, 16 bp, H. sapiens
ggggcagccagggcag

SEQ ID NO: 117165 - DNA, 16 bp, H. sapiens
ggggcagctgccgggc

SEQ ID NO: 117166 - DNA, 16 bp, H. sapiens
ggggcagctgctgggc

SEQ ID NO: 117167 - DNA, 16 bp, H. sapiens
ggggcagctggaggag

SEQ ID NO: 117168 - DNA, 16 bp, H. sapiens
ggggcagctggctggg

SEQ ID NO: 117169 - DNA, 16 bp, H. sapiens
ggggcagctgtgggca

SEQ ID NO: 117170 - DNA, 16 bp, H. sapiens
ggggcaggagagggct

SEQ ID NO: 117171 - DNA, 16 bp, H. sapiens
ggggcaggaggcctgg

SEQ ID NO: 117172 - DNA, 16 bp, H. sapiens
ggggcagggagcctgg

SEQ ID NO: 117173 - DNA, 16 bp, H. sapiens
ggggcagggcacagaa

SEQ ID NO: 117174 - DNA, 16 bp, H. sapiens
ggggcagggcacagcc

SEQ ID NO: 117175 - DNA, 16 bp, H. sapiens
ggggcagggctcccac

SEQ ID NO: 117176 - DNA, 16 bp, H. sapiens
ggggcaggtgaaagga

SEQ ID NO: 117177 - DNA, 16 bp, H. sapiens
ggggcaggtgcagggc

SEQ ID NO: 117178 - DNA, 16 bp, H. sapiens
ggggcaggtgcagtgg

SEQ ID NO: 117179 - DNA, 16 bp, H. sapiens
ggggcagtccctccag

SEQ ID NO: 117180 - DNA, 16 bp, H. sapiens
ggggcagtgaggggct

SEQ ID NO: 117181 - DNA, 16 bp, H. sapiens
ggggcagtgctgagct

SEQ ID NO: 117182 - DNA, 16 bp, H. sapiens
ggggcagtggcagtgg

SEQ ID NO: 117183 - DNA, 16 bp, H. sapiens
ggggcagtggtggcca

SEQ ID NO: 117184 - DNA, 16 bp, H. sapiens
ggggcatggcgggcca

SEQ ID NO: 117185 - DNA, 16 bp, H. sapiens
ggggcatttaggccat

SEQ ID NO: 117186 - DNA, 16 bp, H. sapiens
ggggccaagatggcca

SEQ ID NO: 117187 - DNA, 16 bp, H. sapiens
ggggccaagatggctg

SEQ ID NO: 117188 - DNA, 16 bp, H. sapiens
ggggccacaggactgg

SEQ ID NO: 117189 - DNA, 16 bp, H. sapiens
ggggccagaggcagaa

SEQ ID NO: 117190 - DNA, 16 bp, H. sapiens
ggggccagcccaaggc

SEQ ID NO: 117191 - DNA, 16 bp, H. sapiens
ggggccagcctcatcc

SEQ ID NO: 117192 - DNA, 16 bp, H. sapiens
ggggccaggagcaggc

SEQ ID NO: 117193 - DNA, 16 bp, H. sapiens
ggggccaggagtggaa

SEQ ID NO: 117194 - DNA, 16 bp, H. sapiens
ggggccaggcacagtg

SEQ ID NO: 117195 - DNA, 21 bp, H. sapiens
ggggccaggcacgatggctca

SEQ ID NO: 117196 - DNA, 16 bp, H. sapiens
ggggccaggctgggcc

SEQ ID NO: 117197 - DNA, 16 bp, H. sapiens
ggggccagggaccctg

SEQ ID NO: 117198 - DNA, 16 bp, H. sapiens
ggggccagggatggaa

SEQ ID NO: 117199 - DNA, 16 bp, H. sapiens
ggggccaggggcctgg

SEQ ID NO: 117200 - DNA, 16 bp, H. sapiens
ggggccagtctttccc

SEQ ID NO: 117201 - DNA, 18 bp, H. sapiens
ggggccagttcagagacc

SEQ ID NO: 117202 - DNA, 16 bp, H. sapiens
ggggccatcttggctc

SEQ ID NO: 117203 - DNA, 16 bp, H. sapiens
ggggcccagaaatctg

SEQ ID NO: 117204 - DNA, 16 bp, H. sapiens
ggggcccaggaagccc

SEQ ID NO: 117205 - DNA, 16 bp, H. sapiens
ggggcccaggaaggcc

SEQ ID NO: 117206 - DNA, 16 bp, H. sapiens
ggggcccaggcccagg

SEQ ID NO: 117207 - DNA, 16 bp, H. sapiens
ggggcccagtttcaat

SEQ ID NO: 117208 - DNA, 16 bp, H. sapiens
ggggccccaggagagg

SEQ ID NO: 117209 - DNA, 16 bp, H. sapiens
ggggccccccacctcc

SEQ ID NO: 117210 - DNA, 16 bp, H. sapiens
ggggccctgcctggtg

SEQ ID NO: 117211 - DNA, 16 bp, H. sapiens
ggggccgcacaggagc

SEQ ID NO: 117212 - DNA, 16 bp, H. sapiens
ggggcctccagccacc

SEQ ID NO: 117213 - DNA, 16 bp, H. sapiens
ggggcctccccagaag

SEQ ID NO: 117214 - DNA, 16 bp, H. sapiens
ggggcctgccacacac

SEQ ID NO: 117215 - DNA, 16 bp, H. sapiens
ggggcctgccaggact

SEQ ID NO: 117216 - DNA, 16 bp, H. sapiens
ggggcctgctgggact

SEQ ID NO: 117217 - DNA, 16 bp, H. sapiens
ggggcctgggtccccc

SEQ ID NO: 117218 - DNA, 16 bp, H. sapiens
ggggcctgttggagga

SEQ ID NO: 117219 - DNA, 16 bp, H. sapiens
ggggccttcaggaggt

SEQ ID NO: 117220 - DNA, 16 bp, H. sapiens
ggggccttgtgggagg

SEQ ID NO: 117221 - DNA, 16 bp, H. sapiens
ggggcctttgcacctg

SEQ ID NO: 117222 - DNA, 16 bp, H. sapiens
ggggcctttggccaca

SEQ ID NO: 117223 - DNA, 17 bp, H. sapiens
ggggcgcctctgcctgg

SEQ ID NO: 117224 - DNA, 16 bp, H. sapiens
ggggcgctgaggcagg

SEQ ID NO: 117225 - DNA, 16 bp, H. sapiens
ggggcggagcctgcag

SEQ ID NO: 117226 - DNA, 16 bp, H. sapiens
ggggcggcgtgggaac

SEQ ID NO: 117227 - DNA, 16 bp, H. sapiens
ggggcggctgaggcag

SEQ ID NO: 117228 - DNA, 16 bp, H. sapiens
ggggcggctggccagg

SEQ ID NO: 117229 - DNA, 17 bp, H. sapiens
ggggcgtggtggctcat

SEQ ID NO: 117230 - DNA, 16 bp, H. sapiens
ggggctaaggtgggag

SEQ ID NO: 117231 - DNA, 16 bp, H. sapiens
ggggctacaggaccca

SEQ ID NO: 117232 - DNA, 16 bp, H. sapiens
ggggctagaggaggga

SEQ ID NO: 117233 - DNA, 16 bp, H. sapiens
ggggctcaagtgatcc

SEQ ID NO: 117234 - DNA, 16 bp, H. sapiens
ggggctcagggacaga

SEQ ID NO: 117235 - DNA, 16 bp, H. sapiens
ggggctcagtccccaa

SEQ ID NO: 117236 - DNA, 16 bp, H. sapiens
ggggctcatccaggat

SEQ ID NO: 117237 - DNA, 16 bp, H. sapiens
ggggctccaccccaga

SEQ ID NO: 117238 - DNA, 16 bp, H. sapiens
ggggctcccatcttct

SEQ ID NO: 117239 - DNA, 16 bp, H. sapiens
ggggctcccctgccct

SEQ ID NO: 117240 - DNA, 16 bp, H. sapiens
ggggctcctgccctgc

SEQ ID NO: 117241 - DNA, 17 bp, H. sapiens
ggggctcgaatccaggt

SEQ ID NO: 117242 - DNA, 16 bp, H. sapiens
ggggctcgggcatggc

SEQ ID NO: 117243 - DNA, 16 bp, H. sapiens
ggggctgaagccaggg

SEQ ID NO: 117244 - DNA, 16 bp, H. sapiens
ggggctgagacaggag

SEQ ID NO: 117245 - DNA, 16 bp, H. sapiens
ggggctgagcacagtg

SEQ ID NO: 117246 - DNA, 16 bp, H. sapiens
ggggctgagccaggag

SEQ ID NO: 117247 - DNA, 16 bp, H. sapiens
ggggctgagctgggag

SEQ ID NO: 117248 - DNA, 16 bp, H. sapiens
ggggctgaggaggcag

SEQ ID NO: 117249 - DNA, 16 bp, H. sapiens
ggggctgaggctgcag

SEQ ID NO: 117250 - DNA, 16 bp, H. sapiens
ggggctgaggctggag

SEQ ID NO: 117251 - DNA, 16 bp, H. sapiens
ggggctgagggcagct

SEQ ID NO: 117252 - DNA, 16 bp, H. sapiens
ggggctgagggtggct

SEQ ID NO: 117253 - DNA, 16 bp, H. sapiens
ggggctgcagaggctg

SEQ ID NO: 117254 - DNA, 16 bp, H. sapiens
ggggctgcaggcccca

SEQ ID NO: 117255 - DNA, 16 bp, H. sapiens
ggggctgcagggagct

SEQ ID NO: 117256 - DNA, 16 bp, H. sapiens
ggggctgcctcctctg

SEQ ID NO: 117257 - DNA, 16 bp, H. sapiens
ggggctgctgctgctg

SEQ ID NO: 117258 - DNA, 16 bp, H. sapiens
ggggctgctgggaagg

SEQ ID NO: 117259 - DNA, 16 bp, H. sapiens
ggggctgctgtgagga

SEQ ID NO: 117260 - DNA, 16 bp, H. sapiens
ggggctgctgtggctg

SEQ ID NO: 117261 - DNA, 16 bp, H. sapiens
ggggctgctttttatt

SEQ ID NO: 117262 - DNA, 16 bp, H. sapiens
ggggctggacgtggtg

SEQ ID NO: 117263 - DNA, 16 bp, H. sapiens
ggggctggagcccaaa

SEQ ID NO: 117264 - DNA, 16 bp, H. sapiens
ggggctggagccccca

SEQ ID NO: 117265 - DNA, 16 bp, H. sapiens
ggggctggcaagtctg

SEQ ID NO: 117266 - DNA, 16 bp, H. sapiens
ggggctggctcttact

SEQ ID NO: 117267 - DNA, 16 bp, H. sapiens
ggggctgggagaggaa

SEQ ID NO: 117268 - DNA, 16 bp, H. sapiens
ggggctgggaggagaa

SEQ ID NO: 117269 - DNA, 16 bp, H. sapiens
ggggctgggcaaggtg

SEQ ID NO: 117270 - DNA, 16 bp, H. sapiens
ggggctgggcaccgtg

SEQ ID NO: 117271 - DNA, 16 bp, H. sapiens
ggggctgggcatggag

SEQ ID NO: 117272 - DNA, 16 bp, H. sapiens
ggggctgggcatggtg

SEQ ID NO: 117273 - DNA, 16 bp, H. sapiens
ggggctgggccaggtg

SEQ ID NO: 117274 - DNA, 16 bp, H. sapiens
ggggctggggacacag

SEQ ID NO: 117275 - DNA, 16 bp, H. sapiens
ggggctggggcagagc

SEQ ID NO: 117276 - DNA, 16 bp, H. sapiens
ggggctggggcctgga

SEQ ID NO: 117277 - DNA, 16 bp, H. sapiens
ggggctggttccccca

SEQ ID NO: 117278 - DNA, 16 bp, H. sapiens
ggggctgtacacaccc

SEQ ID NO: 117279 - DNA, 16 bp, H. sapiens
ggggcttccccagcca

SEQ ID NO: 117280 - DNA, 16 bp, H. sapiens
ggggcttcccctttca

SEQ ID NO: 117281 - DNA, 16 bp, H. sapiens
ggggcttcctggagga

SEQ ID NO: 117282 - DNA, 16 bp, H. sapiens
ggggcttgcactctct

SEQ ID NO: 117283 - DNA, 16 bp, H. sapiens
gggggaaaaaaaccct

SEQ ID NO: 117284 - DNA, 16 bp, H. sapiens
gggggaaactgaggca

SEQ ID NO: 117285 - DNA, 16 bp, H. sapiens
gggggaaagcagctcc

SEQ ID NO: 117286 - DNA, 16 bp, H. sapiens
gggggaagggaagtgc

SEQ ID NO: 117287 - DNA, 16 bp, H. sapiens
gggggaatcacctgag

SEQ ID NO: 117288 - DNA, 16 bp, H. sapiens
gggggaatcctcccta

SEQ ID NO: 117289 - DNA, 16 bp, H. sapiens
gggggacagaggtggc

SEQ ID NO: 117290 - DNA, 16 bp, H. sapiens
gggggacctggtggga

SEQ ID NO: 117291 - DNA, 16 bp, H. sapiens
gggggactgagatggg

SEQ ID NO: 117292 - DNA, 16 bp, H. sapiens
gggggagacagagtct

SEQ ID NO: 117293 - DNA, 16 bp, H. sapiens
gggggagactcaggca

SEQ ID NO: 117294 - DNA, 16 bp, H. sapiens
gggggagagcatcagg

SEQ ID NO: 117295 - DNA, 16 bp, H. sapiens
gggggagggaggtccc

SEQ ID NO: 117296 - DNA, 16 bp, H. sapiens
gggggaggtctataaa

SEQ ID NO: 117297 - DNA, 16 bp, H. sapiens
gggggatacattcaaa

SEQ ID NO: 117298 - DNA, 16 bp, H. sapiens
gggggatggagtctca

SEQ ID NO: 117299 - DNA, 16 bp, H. sapiens
gggggcacacgcctgt

SEQ ID NO: 117300 - DNA, 16 bp, H. sapiens
gggggcagcccctgcc

SEQ ID NO: 117301 - DNA, 16 bp, H. sapiens
gggggcaggcctttcc

SEQ ID NO: 117302 - DNA, 16 bp, H. sapiens
gggggccaaggcagga

SEQ ID NO: 117303 - DNA, 16 bp, H. sapiens
gggggccgaggcaggt

SEQ ID NO: 117304 - DNA, 16 bp, H. sapiens
gggggcctttatattc

SEQ ID NO: 117305 - DNA, 16 bp, H. sapiens
gggggctccaagccca

SEQ ID NO: 117306 - DNA, 16 bp, H. sapiens
gggggctcttgggcct

SEQ ID NO: 117307 - DNA, 16 bp, H. sapiens
gggggctgacccctcc

SEQ ID NO: 117308 - DNA, 16 bp, H. sapiens
gggggctgagcatgct

SEQ ID NO: 117309 - DNA, 16 bp, H. sapiens
gggggctgagccagga

SEQ ID NO: 117310 - DNA, 16 bp, H. sapiens
gggggctgaggcagaa

SEQ ID NO: 117311 - DNA, 16 bp, H. sapiens
gggggctgcaggagcc

SEQ ID NO: 117312 - DNA, 16 bp, H. sapiens
gggggctgcaggtgga

SEQ ID NO: 117313 - DNA, 16 bp, H. sapiens
gggggctgcccaattc

SEQ ID NO: 117314 - DNA, 16 bp, H. sapiens
gggggctgggaagtcc

SEQ ID NO: 117315 - DNA, 16 bp, H. sapiens
gggggcttccaggtca

SEQ ID NO: 117316 - DNA, 16 bp, H. sapiens
gggggcttcctgggcc

SEQ ID NO: 117317 - DNA, 16 bp, H. sapiens
ggggggatcacctgag

SEQ ID NO: 117318 - DNA, 16 bp, H. sapiens
ggggggatcagccccc

SEQ ID NO: 117319 - DNA, 16 bp, H. sapiens
ggggggcaagaacccc

SEQ ID NO: 117320 - DNA, 16 bp, H. sapiens
ggggggcagagattgc

SEQ ID NO: 117321 - DNA, 16 bp, H. sapiens
ggggggcagaggctgc

SEQ ID NO: 117322 - DNA, 16 bp, H. sapiens
ggggggccaaagtggg

SEQ ID NO: 117323 - DNA, 16 bp, H. sapiens
ggggggccctgagtgt

SEQ ID NO: 117324 - DNA, 16 bp, H. sapiens
ggggggcctgttccca

SEQ ID NO: 117325 - DNA, 16 bp, H. sapiens
ggggggcggatcacct

SEQ ID NO: 117326 - DNA, 16 bp, H. sapiens
ggggggctgaggcacg

SEQ ID NO: 117327 - DNA, 16 bp, H. sapiens
ggggggtcagcccccc

SEQ ID NO: 117328 - DNA, 16 bp, H. sapiens
ggggggtctcactatg

SEQ ID NO: 117329 - DNA, 16 bp, H. sapiens
ggggggtctcactgtg

SEQ ID NO: 117330 - DNA, 16 bp, H. sapiens
gggggtcacaaggtac

SEQ ID NO: 117331 - DNA, 16 bp, H. sapiens
gggggtgcctccccct

SEQ ID NO: 117332 - DNA, 16 bp, H. sapiens
gggggtgctgcaggag

SEQ ID NO: 117333 - DNA, 16 bp, H. sapiens
gggggtggaggctgca

SEQ ID NO: 117334 - DNA, 16 bp, H. sapiens
gggggtggagttctca

SEQ ID NO: 117335 - DNA, 16 bp, H. sapiens
gggggtggcagtgagc

SEQ ID NO: 117336 - DNA, 16 bp, H. sapiens
gggggtggtttcagga

SEQ ID NO: 117337 - DNA, 16 bp, H. sapiens
gggggtgtacacaccc

SEQ ID NO: 117338 - DNA, 16 bp, H. sapiens
gggggtgtacactttc

SEQ ID NO: 117339 - DNA, 16 bp, H. sapiens
gggggttggggcttca

SEQ ID NO: 117340 - DNA, 16 bp, H. sapiens
gggggtttcaccgtgt

SEQ ID NO: 117341 - DNA, 16 bp, H. sapiens
ggggtacagagcaaga

SEQ ID NO: 117342 - DNA, 16 bp, H. sapiens
ggggtacatgtgaagg

SEQ ID NO: 117343 - DNA, 16 bp, H. sapiens
ggggtacatgtgcagg

SEQ ID NO: 117344 - DNA, 16 bp, H. sapiens
ggggtaggaggatcac

SEQ ID NO: 117345 - DNA, 16 bp, H. sapiens
ggggtatgtgtgcagg

SEQ ID NO: 117346 - DNA, 16 bp, H. sapiens
ggggtattcaattagg

SEQ ID NO: 117347 - DNA, 16 bp, H. sapiens
ggggtcacctgaggtc

SEQ ID NO: 117348 - DNA, 16 bp, H. sapiens
ggggtcagcaaacatt

SEQ ID NO: 117349 - DNA, 16 bp, H. sapiens
ggggtcagcaaactgt

SEQ ID NO: 117350 - DNA, 16 bp, H. sapiens
ggggtcagcagaaaag

SEQ ID NO: 117351 - DNA, 16 bp, H. sapiens
ggggtcaggcactgtg

SEQ ID NO: 117352 - DNA, 16 bp, H. sapiens
ggggtcaggcagaata

SEQ ID NO: 117353 - DNA, 16 bp, H. sapiens
ggggtcagggacccac

SEQ ID NO: 117354 - DNA, 16 bp, H. sapiens
ggggtcaggtgtcagg

SEQ ID NO: 117355 - DNA, 16 bp, H. sapiens
ggggtccagcaatctg

SEQ ID NO: 117356 - DNA, 16 bp, H. sapiens
ggggtccccaacccca

SEQ ID NO: 117357 - DNA, 16 bp, H. sapiens
ggggtccccaaccctc

SEQ ID NO: 117358 - DNA, 16 bp, H. sapiens
ggggtccccaatcccc

SEQ ID NO: 117359 - DNA, 16 bp, H. sapiens
ggggtccccagccccc

SEQ ID NO: 117360 - DNA, 16 bp, H. sapiens
ggggtccccagtcccc

SEQ ID NO: 117361 - DNA, 16 bp, H. sapiens
ggggtccctgacttcc

SEQ ID NO: 117362 - DNA, 16 bp, H. sapiens
ggggtccctggggagg

SEQ ID NO: 117363 - DNA, 16 bp, H. sapiens
ggggtcccttttataa

SEQ ID NO: 117364 - DNA, 16 bp, H. sapiens
ggggtcctcaacccct

SEQ ID NO: 117365 - DNA, 16 bp, H. sapiens
ggggtctcactaggtt

SEQ ID NO: 117366 - DNA, 16 bp, H. sapiens
ggggtctcactatatt

SEQ ID NO: 117367 - DNA, 16 bp, H. sapiens
ggggtctcactctgtc

SEQ ID NO: 117368 - DNA, 16 bp, H. sapiens
ggggtctggaggacgg

SEQ ID NO: 117369 - DNA, 16 bp, H. sapiens
ggggtctggctctgtc

SEQ ID NO: 117370 - DNA, 16 bp, H. sapiens
ggggtctgtcctgggg

SEQ ID NO: 117371 - DNA, 16 bp, H. sapiens
ggggtcttgccatgct

SEQ ID NO: 117372 - DNA, 16 bp, H. sapiens
ggggtcttgctatgtc

SEQ ID NO: 117373 - DNA, 17 bp, H. sapiens
ggggtcttgctctgtca

SEQ ID NO: 117374 - DNA, 16 bp, H. sapiens
ggggtcttgctctgtt

SEQ ID NO: 117375 - DNA, 16 bp, H. sapiens
ggggtctttgggaggt

SEQ ID NO: 117376 - DNA, 16 bp, H. sapiens
ggggtgaagaaggggc

SEQ ID NO: 117377 - DNA, 17 bp, H. sapiens
ggggtgacagagcaaga

SEQ ID NO: 117378 - DNA, 16 bp, H. sapiens
ggggtgactgtggcaa

SEQ ID NO: 117379 - DNA, 16 bp, H. sapiens
ggggtgagagagggca

SEQ ID NO: 117380 - DNA, 16 bp, H. sapiens
ggggtgcaatggcatg

SEQ ID NO: 117381 - DNA, 16 bp, H. sapiens
ggggtgcagaagggta

SEQ ID NO: 117382 - DNA, 16 bp, H. sapiens
ggggtgcagtggtatg

SEQ ID NO: 117383 - DNA, 16 bp, H. sapiens
ggggtgcatgtgcaga

SEQ ID NO: 117384 - DNA, 16 bp, H. sapiens
ggggtgcatgtgtgtg

SEQ ID NO: 117385 - DNA, 16 bp, H. sapiens
ggggtgctgaagtctc

SEQ ID NO: 117386 - DNA, 16 bp, H. sapiens
ggggtgctgctggcat

SEQ ID NO: 117387 - DNA, 16 bp, H. sapiens
ggggtggagcccccag

SEQ ID NO: 117388 - DNA, 16 bp, H. sapiens
ggggtggagctctcat

SEQ ID NO: 117389 - DNA, 16 bp, H. sapiens
ggggtggagtctcact

SEQ ID NO: 117390 - DNA, 16 bp, H. sapiens
ggggtggcagaagcag

SEQ ID NO: 117391 - DNA, 16 bp, H. sapiens
ggggtggcagccgggc

SEQ ID NO: 117392 - DNA, 16 bp, H. sapiens
ggggtggccagccttc

SEQ ID NO: 117393 - DNA, 16 bp, H. sapiens
ggggtggctcaggctg

SEQ ID NO: 117394 - DNA, 16 bp, H. sapiens
ggggtggctcctgagg

SEQ ID NO: 117395 - DNA, 16 bp, H. sapiens
ggggtggctgccctcc

SEQ ID NO: 117396 - DNA, 16 bp, H. sapiens
ggggtgggacccaggc

SEQ ID NO: 117397 - DNA, 16 bp, H. sapiens
ggggtggggagcagcc

SEQ ID NO: 117398 - DNA, 16 bp, H. sapiens
ggggtggggcaggaac

SEQ ID NO: 117399 - DNA, 16 bp, H. sapiens
ggggtggggctgactg

SEQ ID NO: 117400 - DNA, 16 bp, H. sapiens
ggggtggtcagggaag

SEQ ID NO: 117401 - DNA, 16 bp, H. sapiens
ggggtgtacacccccc

SEQ ID NO: 117402 - DNA, 16 bp, H. sapiens
ggggtgtcaccatatt

SEQ ID NO: 117403 - DNA, 16 bp, H. sapiens
ggggtgtcactgtgtt

SEQ ID NO: 117404 - DNA, 17 bp, H. sapiens
ggggtgtggtggctcat

SEQ ID NO: 117405 - DNA, 16 bp, H. sapiens
ggggtgtggtgggcca

SEQ ID NO: 117406 - DNA, 16 bp, H. sapiens
ggggttaggacttcaa

SEQ ID NO: 117407 - DNA, 17 bp, H. sapiens
ggggttcaagcgattct

SEQ ID NO: 117408 - DNA, 16 bp, H. sapiens
ggggttcagccccccg

SEQ ID NO: 117409 - DNA, 16 bp, H. sapiens
ggggttcctgggcctg

SEQ ID NO: 117410 - DNA, 16 bp, H. sapiens
ggggttcgtggtctcg

SEQ ID NO: 117411 - DNA, 16 bp, H. sapiens
ggggttctccatgttg

SEQ ID NO: 117412 - DNA, 16 bp, H. sapiens
ggggttgcagtgagcc

SEQ ID NO: 117413 - DNA, 16 bp, H. sapiens
ggggttgctcttctca

SEQ ID NO: 117414 - DNA, 17 bp, H. sapiens
ggggttgctgccagctg

SEQ ID NO: 117415 - DNA, 16 bp, H. sapiens
ggggttggagccccca

SEQ ID NO: 117416 - DNA, 16 bp, H. sapiens
ggggttgggcatggtg

SEQ ID NO: 117417 - DNA, 16 bp, H. sapiens
ggggtttattgtacag

SEQ ID NO: 117418 - DNA, 16 bp, H. sapiens
ggggtttcaacatgtt

SEQ ID NO: 117419 - DNA, 16 bp, H. sapiens
ggggtttcaccaggtt

SEQ ID NO: 117420 - DNA, 16 bp, H. sapiens
ggggtttcaccatatt

SEQ ID NO: 117421 - DNA, 18 bp, H. sapiens
ggggtttcaccatgttgc

SEQ ID NO: 117422 - DNA, 23 bp, H. sapiens
ggggtttcaccatgttggccaga

SEQ ID NO: 117423 - DNA, 24 bp, H. sapiens
ggggtttcaccatgttggccaggg

SEQ ID NO: 117424 - DNA, 16 bp, H. sapiens
ggggtttcaccctgtt

SEQ ID NO: 117425 - DNA, 16 bp, H. sapiens
ggggtttcactatgtt

SEQ ID NO: 117426 - DNA, 16 bp, H. sapiens
ggggtttcactgtggt

SEQ ID NO: 117427 - DNA, 18 bp, H. sapiens
ggggtttcactgtgttgc

SEQ ID NO: 117428 - DNA, 16 bp, H. sapiens
ggggtttcccatgttg

SEQ ID NO: 117429 - DNA, 16 bp, H. sapiens
ggggtttcttcatatt

SEQ ID NO: 117430 - DNA, 17 bp, H. sapiens
ggggtttcttcatgttg

SEQ ID NO: 117431 - DNA, 16 bp, H. sapiens
ggggtttgccatgttg

SEQ ID NO: 117432 - DNA, 16 bp, H. sapiens
ggggtttgttgcacag

SEQ ID NO: 117433 - DNA, 16 bp, H. sapiens
ggggtttgttgtgcag

SEQ ID NO: 117434 - DNA, 16 bp, H. sapiens
ggggttttatatgttg

SEQ ID NO: 117435 - DNA, 16 bp, H. sapiens
ggggttttgctatgtt

SEQ ID NO: 117436 - DNA, 16 bp, H. sapiens
gggtaaaagttttttt

SEQ ID NO: 117437 - DNA, 16 bp, H. sapiens
gggtaaaatgctgtca

SEQ ID NO: 117438 - DNA, 16 bp, H. sapiens
gggtaaactgaggctc

SEQ ID NO: 117439 - DNA, 16 bp, H. sapiens
gggtaacagcaagacc

SEQ ID NO: 117440 - DNA, 16 bp, H. sapiens
gggtaacctggggacc

SEQ ID NO: 117441 - DNA, 16 bp, H. sapiens
gggtaacttgctgcag

SEQ ID NO: 117442 - DNA, 16 bp, H. sapiens
gggtaaggcaggagga

SEQ ID NO: 117443 - DNA, 16 bp, H. sapiens
gggtaagtgccactag

SEQ ID NO: 117444 - DNA, 16 bp, H. sapiens
gggtaatagaatatca

SEQ ID NO: 117445 - DNA, 16 bp, H. sapiens
gggtacaagtggtttt

SEQ ID NO: 117446 - DNA, 16 bp, H. sapiens
gggtacagcccctctc

SEQ ID NO: 117447 - DNA, 16 bp, H. sapiens
gggtacaggggcagga

SEQ ID NO: 117448 - DNA, 16 bp, H. sapiens
gggtacatgtgcttgt

SEQ ID NO: 117449 - DNA, 16 bp, H. sapiens
gggtacctcatataag

SEQ ID NO: 117450 - DNA, 16 bp, H. sapiens
gggtacggtggctcac

SEQ ID NO: 117451 - DNA, 16 bp, H. sapiens
gggtagaggaagcagt

SEQ ID NO: 117452 - DNA, 16 bp, H. sapiens
gggtagaggagggcat

SEQ ID NO: 117453 - DNA, 16 bp, H. sapiens
gggtagctcctctctg

SEQ ID NO: 117454 - DNA, 17 bp, H. sapiens
gggtagctgggattaca

SEQ ID NO: 117455 - DNA, 16 bp, H. sapiens
gggtagggttacagat

SEQ ID NO: 117456 - DNA, 16 bp, H. sapiens
gggtatatactcagaa

SEQ ID NO: 117457 - DNA, 16 bp, H. sapiens
gggtatatcaactctc

SEQ ID NO: 117458 - DNA, 16 bp, H. sapiens
gggtatggtggtgtgc

SEQ ID NO: 117459 - DNA, 16 bp, H. sapiens
gggtatgtctttatca

SEQ ID NO: 117460 - DNA, 16 bp, H. sapiens
gggtattaaatgcatt

SEQ ID NO: 117461 - DNA, 19 bp, H. sapiens
gggtattgtccaaggtttc

SEQ ID NO: 117462 - DNA, 16 bp, H. sapiens
gggtatttcttcatag

SEQ ID NO: 117463 - DNA, 16 bp, H. sapiens
gggtcacattggaaga

SEQ ID NO: 117464 - DNA, 16 bp, H. sapiens
gggtcacctgagcctg

SEQ ID NO: 117465 - DNA, 16 bp, H. sapiens
gggtcactgcaacctc

SEQ ID NO: 117466 - DNA, 16 bp, H. sapiens
gggtcactgcaagctc

SEQ ID NO: 117467 - DNA, 16 bp, H. sapiens
gggtcaggagtccagg

SEQ ID NO: 117468 - DNA, 16 bp, H. sapiens
gggtcagggaaccact

SEQ ID NO: 117469 - DNA, 16 bp, H. sapiens
gggtcagggaaggctt

SEQ ID NO: 117470 - DNA, 16 bp, H. sapiens
gggtcagggaccctct

SEQ ID NO: 117471 - DNA, 16 bp, H. sapiens
gggtcaggggtcaggg

SEQ ID NO: 117472 - DNA, 16 bp, H. sapiens
gggtcagggtcaggcc

SEQ ID NO: 117473 - DNA, 16 bp, H. sapiens
gggtcatgcagcctct

SEQ ID NO: 117474 - DNA, 16 bp, H. sapiens
gggtcatgggggcagt

SEQ ID NO: 117475 - DNA, 16 bp, H. sapiens
gggtcattcttgtcat

SEQ ID NO: 117476 - DNA, 16 bp, H. sapiens
gggtccaagcagttct

SEQ ID NO: 117477 - DNA, 16 bp, H. sapiens
gggtcccagctactcg

SEQ ID NO: 117478 - DNA, 16 bp, H. sapiens
gggtccccaacccctg

SEQ ID NO: 117479 - DNA, 16 bp, H. sapiens
gggtccccagactcat

SEQ ID NO: 117480 - DNA, 16 bp, H. sapiens
gggtccccttccacac

SEQ ID NO: 117481 - DNA, 16 bp, H. sapiens
gggtccctcagctgtg

SEQ ID NO: 117482 - DNA, 16 bp, H. sapiens
gggtccctgaccccag

SEQ ID NO: 117483 - DNA, 16 bp, H. sapiens
gggtccctgctccatc

SEQ ID NO: 117484 - DNA, 16 bp, H. sapiens
gggtccctgggggccc

SEQ ID NO: 117485 - DNA, 16 bp, H. sapiens
gggtccctggtgaaac

SEQ ID NO: 117486 - DNA, 16 bp, H. sapiens
gggtccctgtagtccc

SEQ ID NO: 117487 - DNA, 16 bp, H. sapiens
gggtcctgaggtgaca

SEQ ID NO: 117488 - DNA, 16 bp, H. sapiens
gggtcctgccccaggg

SEQ ID NO: 117489 - DNA, 16 bp, H. sapiens
gggtcctgctttctgg

SEQ ID NO: 117490 - DNA, 16 bp, H. sapiens
gggtcctgggcctggc

SEQ ID NO: 117491 - DNA, 16 bp, H. sapiens
gggtctagagtggacc

SEQ ID NO: 117492 - DNA, 16 bp, H. sapiens
gggtctcacactgtca

SEQ ID NO: 117493 - DNA, 16 bp, H. sapiens
gggtctcactatgtca

SEQ ID NO: 117494 - DNA, 16 bp, H. sapiens
gggtctcactctcatc

SEQ ID NO: 117495 - DNA, 16 bp, H. sapiens
gggtctcactctcttg

SEQ ID NO: 117496 - DNA, 16 bp, H. sapiens
gggtctcactctgcca

SEQ ID NO: 117497 - DNA, 16 bp, H. sapiens
gggtctcactctgctg

SEQ ID NO: 117498 - DNA, 16 bp, H. sapiens
gggtctcactctgttg

SEQ ID NO: 117499 - DNA, 16 bp, H. sapiens
gggtctcattctgtca

SEQ ID NO: 117500 - DNA, 16 bp, H. sapiens
gggtctccagagaaac

SEQ ID NO: 117501 - DNA, 16 bp, H. sapiens
gggtctccagccacct

SEQ ID NO: 117502 - DNA, 16 bp, H. sapiens
gggtctccagctgcag

SEQ ID NO: 117503 - DNA, 16 bp, H. sapiens
gggtctccctctgtca

SEQ ID NO: 117504 - DNA, 16 bp, H. sapiens
gggtctccctctgttg

SEQ ID NO: 117505 - DNA, 16 bp, H. sapiens
gggtctcgctctgtcg

SEQ ID NO: 117506 - DNA, 16 bp, H. sapiens
gggtctctctggggcc

SEQ ID NO: 117507 - DNA, 16 bp, H. sapiens
gggtctctctgtgttg

SEQ ID NO: 117508 - DNA, 16 bp, H. sapiens
gggtctgagagaggag

SEQ ID NO: 117509 - DNA, 16 bp, H. sapiens
gggtctgagggaggag

SEQ ID NO: 117510 - DNA, 16 bp, H. sapiens
gggtctgcagccatgg

SEQ ID NO: 117511 - DNA, 16 bp, H. sapiens
gggtctgcaggacaga

SEQ ID NO: 117512 - DNA, 16 bp, H. sapiens
gggtctggaggactgt

SEQ ID NO: 117513 - DNA, 16 bp, H. sapiens
gggtctggagtggaac

SEQ ID NO: 117514 - DNA, 16 bp, H. sapiens
gggtctggctctgtca

SEQ ID NO: 117515 - DNA, 16 bp, H. sapiens
gggtctggcttctttt

SEQ ID NO: 117516 - DNA, 16 bp, H. sapiens
gggtctggttctgttg

SEQ ID NO: 117517 - DNA, 16 bp, H. sapiens
gggtctgtgaattctt

SEQ ID NO: 117518 - DNA, 16 bp, H. sapiens
gggtctgtgctgactc

SEQ ID NO: 117519 - DNA, 16 bp, H. sapiens
gggtctgtggcctgtt

SEQ ID NO: 117520 - DNA, 16 bp, H. sapiens
gggtcttactctgtca

SEQ ID NO: 117521 - DNA, 16 bp, H. sapiens
gggtcttcttgctgtg

SEQ ID NO: 117522 - DNA, 16 bp, H. sapiens
gggtcttgccatgtca

SEQ ID NO: 117523 - DNA, 25 bp, H. sapiens
gggtcttgctctgtcacccaggcta

SEQ ID NO: 117524 - DNA, 16 bp, H. sapiens
gggtcttgctctgtta

SEQ ID NO: 117525 - DNA, 16 bp, H. sapiens
gggtcttgctttttca

SEQ ID NO: 117526 - DNA, 16 bp, H. sapiens
gggtgaacccgggagg

SEQ ID NO: 117527 - DNA, 16 bp, H. sapiens
gggtgaagcctgtgac

SEQ ID NO: 117528 - DNA, 16 bp, H. sapiens
gggtgaattgtgtggt

SEQ ID NO: 117529 - DNA, 16 bp, H. sapiens
gggtgacaaattgaga

SEQ ID NO: 117530 - DNA, 16 bp, H. sapiens
gggtgacaacagtgag

SEQ ID NO: 117531 - DNA, 16 bp, H. sapiens
gggtgacagagactcc

SEQ ID NO: 117532 - DNA, 16 bp, H. sapiens
gggtgacagagccaaa

SEQ ID NO: 117533 - DNA, 16 bp, H. sapiens
gggtgacagaggaaga

SEQ ID NO: 117534 - DNA, 16 bp, H. sapiens
gggtgacagaggagac

SEQ ID NO: 117535 - DNA, 16 bp, H. sapiens
gggtgacagagggaca

SEQ ID NO: 117536 - DNA, 16 bp, H. sapiens
gggtgacagagtgtga

SEQ ID NO: 117537 - DNA, 16 bp, H. sapiens
gggtgacagggctaga

SEQ ID NO: 117538 - DNA, 16 bp, H. sapiens
gggtgaccaactcatc

SEQ ID NO: 117539 - DNA, 16 bp, H. sapiens
gggtgaccaacttgtc

SEQ ID NO: 117540 - DNA, 16 bp, H. sapiens
gggtgactacagtcaa

SEQ ID NO: 117541 - DNA, 16 bp, H. sapiens
gggtgactgagcgaga

SEQ ID NO: 117542 - DNA, 16 bp, H. sapiens
gggtgagatcctgtct

SEQ ID NO: 117543 - DNA, 16 bp, H. sapiens
gggtgagatgatattt

SEQ ID NO: 117544 - DNA, 16 bp, H. sapiens
gggtgaggcagggaga

SEQ ID NO: 117545 - DNA, 16 bp, H. sapiens
gggtgaggcaggtgga

SEQ ID NO: 117546 - DNA, 16 bp, H. sapiens
gggtgaggcctgtggc

SEQ ID NO: 117547 - DNA, 16 bp, H. sapiens
gggtgaggctggagag

SEQ ID NO: 117548 - DNA, 16 bp, H. sapiens
gggtgagggggcttat

SEQ ID NO: 117549 - DNA, 16 bp, H. sapiens
gggtgataaaatgttc

SEQ ID NO: 117550 - DNA, 16 bp, H. sapiens
gggtgatcccttgatg

SEQ ID NO: 117551 - DNA, 16 bp, H. sapiens
gggtgatgaaagtgtt

SEQ ID NO: 117552 - DNA, 16 bp, H. sapiens
gggtgatgaagtgaga

SEQ ID NO: 117553 - DNA, 16 bp, H. sapiens
gggtgatgggattatt

SEQ ID NO: 117554 - DNA, 16 bp, H. sapiens
gggtgattatgatgtg

SEQ ID NO: 117555 - DNA, 16 bp, H. sapiens
gggtgcactggctcac

SEQ ID NO: 117556 - DNA, 16 bp, H. sapiens
gggtgcagcggctcac

SEQ ID NO: 117557 - DNA, 16 bp, H. sapiens
gggtgcaggtatctct

SEQ ID NO: 117558 - DNA, 16 bp, H. sapiens
gggtgcagtgagccag

SEQ ID NO: 117559 - DNA, 16 bp, H. sapiens
gggtgcagtggctcct

SEQ ID NO: 117560 - DNA, 16 bp, H. sapiens
gggtgcatcacctgag

SEQ ID NO: 117561 - DNA, 16 bp, H. sapiens
gggtgccacagggctg

SEQ ID NO: 117562 - DNA, 16 bp, H. sapiens
gggtgcccaccattgc

SEQ ID NO: 117563 - DNA, 16 bp, H. sapiens
gggtgccctttcccca

SEQ ID NO: 117564 - DNA, 16 bp, H. sapiens
gggtgcctgcaggccc

SEQ ID NO: 117565 - DNA, 16 bp, H. sapiens
gggtgcctgccattgc

SEQ ID NO: 117566 - DNA, 17 bp, H. sapiens
gggtgcctgtaatcaca

SEQ ID NO: 117567 - DNA, 18 bp, H. sapiens
gggtgcctgtaattccag

SEQ ID NO: 117568 - DNA, 16 bp, H. sapiens
gggtgcggcggctcac

SEQ ID NO: 117569 - DNA, 16 bp, H. sapiens
gggtgctgagggcagc

SEQ ID NO: 117570 - DNA, 16 bp, H. sapiens
gggtgctgctgctgct

SEQ ID NO: 117571 - DNA, 16 bp, H. sapiens
gggtgcttgctgctga

SEQ ID NO: 117572 - DNA, 16 bp, H. sapiens
gggtggaattggcttg

SEQ ID NO: 117573 - DNA, 16 bp, H. sapiens
gggtggagacacagcc

SEQ ID NO: 117574 - DNA, 16 bp, H. sapiens
gggtggagaggatgat

SEQ ID NO: 117575 - DNA, 16 bp, H. sapiens
gggtggagagttctct

SEQ ID NO: 117576 - DNA, 16 bp, H. sapiens
gggtggagagttcttt

SEQ ID NO: 117577 - DNA, 16 bp, H. sapiens
gggtggagcaggctgg

SEQ ID NO: 117578 - DNA, 16 bp, H. sapiens
gggtggagccacagga

SEQ ID NO: 117579 - DNA, 16 bp, H. sapiens
gggtggagccaccagg

SEQ ID NO: 117580 - DNA, 16 bp, H. sapiens
gggtggagcctgcctg

SEQ ID NO: 117581 - DNA, 16 bp, H. sapiens
gggtggagctgcccat

SEQ ID NO: 117582 - DNA, 16 bp, H. sapiens
gggtggagctgggatg

SEQ ID NO: 117583 - DNA, 16 bp, H. sapiens
gggtggaggccaggga

SEQ ID NO: 117584 - DNA, 16 bp, H. sapiens
gggtggatcactggag

SEQ ID NO: 117585 - DNA, 16 bp, H. sapiens
gggtggatcacttgac

SEQ ID NO: 117586 - DNA, 20 bp, H. sapiens
gggtggatcacttgaggtcg

SEQ ID NO: 117587 - DNA, 16 bp, H. sapiens
gggtggatccctcatg

SEQ ID NO: 117588 - DNA, 16 bp, H. sapiens
gggtggatggatgggc

SEQ ID NO: 117589 - DNA, 16 bp, H. sapiens
gggtggatttctccct

SEQ ID NO: 117590 - DNA, 16 bp, H. sapiens
gggtggcacatgcctg

SEQ ID NO: 117591 - DNA, 16 bp, H. sapiens
gggtggcagagaaaga

SEQ ID NO: 117592 - DNA, 16 bp, H. sapiens
gggtggcaggacagag

SEQ ID NO: 117593 - DNA, 16 bp, H. sapiens
gggtggcagggcagag

SEQ ID NO: 117594 - DNA, 17 bp, H. sapiens
gggtggccaagcagaga

SEQ ID NO: 117595 - DNA, 16 bp, H. sapiens
gggtggccaggcagag

SEQ ID NO: 117596 - DNA, 16 bp, H. sapiens
gggtggccaggccccc

SEQ ID NO: 117597 - DNA, 16 bp, H. sapiens
gggtggctcacacctg

SEQ ID NO: 117598 - DNA, 16 bp, H. sapiens
gggtggctcacgcctg

SEQ ID NO: 117599 - DNA, 23 bp, H. sapiens
gggtggctcccccagatcccagg

SEQ ID NO: 117600 - DNA, 16 bp, H. sapiens
gggtggctgagtgaga

SEQ ID NO: 117601 - DNA, 16 bp, H. sapiens
gggtggctggaggccc

SEQ ID NO: 117602 - DNA, 16 bp, H. sapiens
gggtggctggggacag

SEQ ID NO: 117603 - DNA, 16 bp, H. sapiens
gggtggcttcaacaac

SEQ ID NO: 117604 - DNA, 16 bp, H. sapiens
gggtgggaggctcagg

SEQ ID NO: 117605 - DNA, 16 bp, H. sapiens
gggtgggcaattccca

SEQ ID NO: 117606 - DNA, 16 bp, H. sapiens
gggtgggcaggaagtg

SEQ ID NO: 117607 - DNA, 16 bp, H. sapiens
gggtgggcaggcagga

SEQ ID NO: 117608 - DNA, 16 bp, H. sapiens
gggtgggcatcagctg

SEQ ID NO: 117609 - DNA, 16 bp, H. sapiens
gggtgggccctgatcc

SEQ ID NO: 117610 - DNA, 16 bp, H. sapiens
gggtggggacccagag

SEQ ID NO: 117611 - DNA, 16 bp, H. sapiens
gggtggggccctcatg

SEQ ID NO: 117612 - DNA, 16 bp, H. sapiens
gggtggggccgtttta

SEQ ID NO: 117613 - DNA, 16 bp, H. sapiens
gggtgggggacacaga

SEQ ID NO: 117614 - DNA, 16 bp, H. sapiens
gggtgggggcagtctc

SEQ ID NO: 117615 - DNA, 16 bp, H. sapiens
gggtgggggctgcagc

SEQ ID NO: 117616 - DNA, 16 bp, H. sapiens
gggtggggtggccagc

SEQ ID NO: 117617 - DNA, 16 bp, H. sapiens
gggtggggtggctcac

SEQ ID NO: 117618 - DNA, 16 bp, H. sapiens
gggtgggttcccaagg

SEQ ID NO: 117619 - DNA, 16 bp, H. sapiens
gggtggtcttggggac

SEQ ID NO: 117620 - DNA, 16 bp, H. sapiens
gggtggtggcgcatgc

SEQ ID NO: 117621 - DNA, 16 bp, H. sapiens
gggtggtggcgtgcac

SEQ ID NO: 117622 - DNA, 16 bp, H. sapiens
gggtggttccctggca

SEQ ID NO: 117623 - DNA, 16 bp, H. sapiens
gggtgtcactatgttg

SEQ ID NO: 117624 - DNA, 16 bp, H. sapiens
gggtgtcttagtccat

SEQ ID NO: 117625 - DNA, 16 bp, H. sapiens
gggtgtgatcacagct

SEQ ID NO: 117626 - DNA, 16 bp, H. sapiens
gggtgtgccaccctcc

SEQ ID NO: 117627 - DNA, 16 bp, H. sapiens
gggtgtggtggagcac

SEQ ID NO: 117628 - DNA, 16 bp, H. sapiens
gggtgtggtggcactg

SEQ ID NO: 117629 - DNA, 16 bp, H. sapiens
gggtgtggtggcgcac

SEQ ID NO: 117630 - DNA, 16 bp, H. sapiens
gggtgtggtgtctcac

SEQ ID NO: 117631 - DNA, 16 bp, H. sapiens
gggtgtgtctgtgaga

SEQ ID NO: 117632 - DNA, 16 bp, H. sapiens
gggtgtgttggcacac

SEQ ID NO: 117633 - DNA, 16 bp, H. sapiens
gggtgtgttggctcac

SEQ ID NO: 117634 - DNA, 16 bp, H. sapiens
gggttaaagagaacat

SEQ ID NO: 117635 - DNA, 16 bp, H. sapiens
gggttaaatggtagtt

SEQ ID NO: 117636 - DNA, 16 bp, H. sapiens
gggttaggggcaccaa

SEQ ID NO: 117637 - DNA, 16 bp, H. sapiens
gggttattgtgaagat

SEQ ID NO: 117638 - DNA, 16 bp, H. sapiens
gggttatttgcttttt

SEQ ID NO: 117639 - DNA, 25 bp, H. sapiens
gggttcaagcaatcctcccacctca

SEQ ID NO: 117640 - DNA, 16 bp, H. sapiens
gggttcaagtgatcct

SEQ ID NO: 117641 - DNA, 16 bp, H. sapiens
gggttcaagtgattgt

SEQ ID NO: 117642 - DNA, 16 bp, H. sapiens
gggttcagagagcttc

SEQ ID NO: 117643 - DNA, 16 bp, H. sapiens
gggttcatctcactgg

SEQ ID NO: 117644 - DNA, 18 bp, H. sapiens
gggttcatgccattctcc

SEQ ID NO: 117645 - DNA, 16 bp, H. sapiens
gggttcatgctgttct

SEQ ID NO: 117646 - DNA, 16 bp, H. sapiens
gggttccaccatattg

SEQ ID NO: 117647 - DNA, 16 bp, H. sapiens
gggttccaccatgttg

SEQ ID NO: 117648 - DNA, 16 bp, H. sapiens
gggttccctttccctg

SEQ ID NO: 117649 - DNA, 16 bp, H. sapiens
gggttcccttttctct

SEQ ID NO: 117650 - DNA, 16 bp, H. sapiens
gggttcctgacccctg

SEQ ID NO: 117651 - DNA, 16 bp, H. sapiens
gggttcctggcagggg

SEQ ID NO: 117652 - DNA, 16 bp, H. sapiens
gggttcgaatcccagc

SEQ ID NO: 117653 - DNA, 18 bp, H. sapiens
gggttcgtggtctcgctg

SEQ ID NO: 117654 - DNA, 16 bp, H. sapiens
gggttcttggatctct

SEQ ID NO: 117655 - DNA, 16 bp, H. sapiens
gggttgaagccaggga

SEQ ID NO: 117656 - DNA, 16 bp, H. sapiens
gggttgaggttgcagt

SEQ ID NO: 117657 - DNA, 16 bp, H. sapiens
gggttgattttttctt

SEQ ID NO: 117658 - DNA, 23 bp, H. sapiens
gggttgcagtgagccgagatcat

SEQ ID NO: 117659 - DNA, 16 bp, H. sapiens
gggttgctcctctctg

SEQ ID NO: 117660 - DNA, 16 bp, H. sapiens
gggttggacaagcttg

SEQ ID NO: 117661 - DNA, 16 bp, H. sapiens
gggttgggacttcaac

SEQ ID NO: 117662 - DNA, 16 bp, H. sapiens
gggttggggaggcctc

SEQ ID NO: 117663 - DNA, 16 bp, H. sapiens
gggttggggataaggt

SEQ ID NO: 117664 - DNA, 16 bp, H. sapiens
gggttgggggcaaggt

SEQ ID NO: 117665 - DNA, 16 bp, H. sapiens
gggttggtcttgctat

SEQ ID NO: 117666 - DNA, 16 bp, H. sapiens
gggttggtcttgctgt

SEQ ID NO: 117667 - DNA, 16 bp, H. sapiens
gggttgtttccaagtc

SEQ ID NO: 117668 - DNA, 16 bp, H. sapiens
gggttgtttccagttt

SEQ ID NO: 117669 - DNA, 16 bp, H. sapiens
gggtttaagtgattct

SEQ ID NO: 117670 - DNA, 16 bp, H. sapiens
gggtttcaacatgttg

SEQ ID NO: 117671 - DNA, 16 bp, H. sapiens
gggtttcaaccatgtt

SEQ ID NO: 117672 - DNA, 16 bp, H. sapiens
gggtttcaatcctagt

SEQ ID NO: 117673 - DNA, 16 bp, H. sapiens
gggtttcacaatgctg

SEQ ID NO: 117674 - DNA, 16 bp, H. sapiens
gggtttcaccaagttg

SEQ ID NO: 117675 - DNA, 20 bp, H. sapiens
gggtttcaccacgttggcca

SEQ ID NO: 117676 - DNA, 16 bp, H. sapiens
gggtttcaccatatta

SEQ ID NO: 117677 - DNA, 16 bp, H. sapiens
gggtttcaccatcttg

SEQ ID NO: 117678 - DNA, 16 bp, H. sapiens
gggtttcaccatgatg

SEQ ID NO: 117679 - DNA, 16 bp, H. sapiens
gggtttcaccatgtag

SEQ ID NO: 117680 - DNA, 27 bp, H. sapiens
gggtttcaccatgttggccaggatggc

SEQ ID NO: 117681 - DNA, 16 bp, H. sapiens
gggtttcaccatgttt

SEQ ID NO: 117682 - DNA, 16 bp, H. sapiens
gggtttcaccgtcttg

SEQ ID NO: 117683 - DNA, 16 bp, H. sapiens
gggtttcaccgtgttc

SEQ ID NO: 117684 - DNA, 16 bp, H. sapiens
gggtttcaccgtgttt

SEQ ID NO: 117685 - DNA, 18 bp, H. sapiens
gggtttcaccttgttggt

SEQ ID NO: 117686 - DNA, 16 bp, H. sapiens
gggtttcactatgttg

SEQ ID NO: 117687 - DNA, 16 bp, H. sapiens
gggtttcactgtgttg

SEQ ID NO: 117688 - DNA, 16 bp, H. sapiens
gggtttcagcatgttg

SEQ ID NO: 117689 - DNA, 16 bp, H. sapiens
gggtttcatcatattg

SEQ ID NO: 117690 - DNA, 16 bp, H. sapiens
gggtttccacttttgc

SEQ ID NO: 117691 - DNA, 16 bp, H. sapiens
gggtttcgcaatgttg

SEQ ID NO: 117692 - DNA, 16 bp, H. sapiens
gggtttcgccacattg

SEQ ID NO: 117693 - DNA, 16 bp, H. sapiens
gggtttcgccatgtcg

SEQ ID NO: 117694 - DNA, 17 bp, H. sapiens
gggtttcgccatgttgc

SEQ ID NO: 117695 - DNA, 16 bp, H. sapiens
gggtttcgccatgttt

SEQ ID NO: 117696 - DNA, 16 bp, H. sapiens
gggtttctccatgctg

SEQ ID NO: 117697 - DNA, 16 bp, H. sapiens
gggtttctccatgttg

SEQ ID NO: 117698 - DNA, 16 bp, H. sapiens
gggtttctccatgttt

SEQ ID NO: 117699 - DNA, 16 bp, H. sapiens
gggtttctctgtgttg

SEQ ID NO: 117700 - DNA, 16 bp, H. sapiens
gggtttctgaaaaaca

SEQ ID NO: 117701 - DNA, 16 bp, H. sapiens
gggtttctttttgagg

SEQ ID NO: 117702 - DNA, 16 bp, H. sapiens
gggtttctttttggag

SEQ ID NO: 117703 - DNA, 16 bp, H. sapiens
gggtttgacatcaata

SEQ ID NO: 117704 - DNA, 18 bp, H. sapiens
gggtttgtaaatgcacca

SEQ ID NO: 117705 - DNA, 16 bp, H. sapiens
gggtttgtcttaaata

SEQ ID NO: 117706 - DNA, 16 bp, H. sapiens
gggtttgtggatgcac

SEQ ID NO: 117707 - DNA, 16 bp, H. sapiens
gggttttacatttaag

SEQ ID NO: 117708 - DNA, 16 bp, H. sapiens
gggttttaccatgctg

SEQ ID NO: 117709 - DNA, 16 bp, H. sapiens
gggttttaccatgttg

SEQ ID NO: 117710 - DNA, 16 bp, H. sapiens
gggttttcctgttgag

SEQ ID NO: 117711 - DNA, 16 bp, H. sapiens
gggttttctacataca

SEQ ID NO: 117712 - DNA, 16 bp, H. sapiens
gggttttctatgtata

SEQ ID NO: 117713 - DNA, 16 bp, H. sapiens
gggttttctccaggta

SEQ ID NO: 117714 - DNA, 16 bp, H. sapiens
gggttttgactcttta

SEQ ID NO: 117715 - DNA, 16 bp, H. sapiens
gggttttgatgtggat

SEQ ID NO: 117716 - DNA, 16 bp, H. sapiens
gggttttgccatgtgg

SEQ ID NO: 117717 - DNA, 16 bp, H. sapiens
gggttttgccatgttt

SEQ ID NO: 117718 - DNA, 16 bp, H. sapiens
gggttttgctatgttg

SEQ ID NO: 117719 - DNA, 16 bp, H. sapiens
gggtttttaaaatttt

SEQ ID NO: 117720 - DNA, 16 bp, H. sapiens
ggtaaaaccccatctg

SEQ ID NO: 117721 - DNA, 16 bp, H. sapiens
ggtaaaatgtgatgtt

SEQ ID NO: 117722 - DNA, 16 bp, H. sapiens
ggtaaaattaatttta

SEQ ID NO: 117723 - DNA, 16 bp, H. sapiens
ggtaaacaccattcta

SEQ ID NO: 117724 - DNA, 16 bp, H. sapiens
ggtaaacttttaaaaa

SEQ ID NO: 117725 - DNA, 16 bp, H. sapiens
ggtaaagaaaatgtag

SEQ ID NO: 117726 - DNA, 16 bp, H. sapiens
ggtaaagaaagacaaa

SEQ ID NO: 117727 - DNA, 16 bp, H. sapiens
ggtaaagaagttaaaa

SEQ ID NO: 117728 - DNA, 16 bp, H. sapiens
ggtaaaggctgcagtg

SEQ ID NO: 117729 - DNA, 16 bp, H. sapiens
ggtaaagtatactttt

SEQ ID NO: 117730 - DNA, 16 bp, H. sapiens
ggtaaataattatctt

SEQ ID NO: 117731 - DNA, 16 bp, H. sapiens
ggtaaataccaaagag

SEQ ID NO: 117732 - DNA, 16 bp, H. sapiens
ggtaaattaacttttt

SEQ ID NO: 117733 - DNA, 16 bp, H. sapiens
ggtaaccaaaacagca

SEQ ID NO: 117734 - DNA, 16 bp, H. sapiens
ggtaaccacctttcta

SEQ ID NO: 117735 - DNA, 16 bp, H. sapiens
ggtaaccactattctg

SEQ ID NO: 117736 - DNA, 16 bp, H. sapiens
ggtaaccccacctttc

SEQ ID NO: 117737 - DNA, 16 bp, H. sapiens
ggtaactaattttgtt

SEQ ID NO: 117738 - DNA, 17 bp, H. sapiens
ggtaacttttgtatttt

SEQ ID NO: 117739 - DNA, 16 bp, H. sapiens
ggtaagctgttaatta

SEQ ID NO: 117740 - DNA, 16 bp, H. sapiens
ggtaaggatttcaaca

SEQ ID NO: 117741 - DNA, 16 bp, H. sapiens
ggtaagtagctgaatt

SEQ ID NO: 117742 - DNA, 16 bp, H. sapiens
ggtaataaaatgtata

SEQ ID NO: 117743 - DNA, 16 bp, H. sapiens
ggtaataaaatgtatt

SEQ ID NO: 117744 - DNA, 16 bp, H. sapiens
ggtaataatgatgtgt

SEQ ID NO: 117745 - DNA, 23 bp, H. sapiens
ggtaatagaatatcacaaggcaa

SEQ ID NO: 117746 - DNA, 16 bp, H. sapiens
ggtaatagccattctg

SEQ ID NO: 117747 - DNA, 16 bp, H. sapiens
ggtaatcccagctact

SEQ ID NO: 117748 - DNA, 16 bp, H. sapiens
ggtaatgcaaatcaaa

SEQ ID NO: 117749 - DNA, 16 bp, H. sapiens
ggtaatgggatggctg

SEQ ID NO: 117750 - DNA, 16 bp, H. sapiens
ggtaatgtgatgcctc

SEQ ID NO: 117751 - DNA, 16 bp, H. sapiens
ggtaattgtgggactt

SEQ ID NO: 117752 - DNA, 16 bp, H. sapiens
ggtaatttcttttgct

SEQ ID NO: 117753 - DNA, 16 bp, H. sapiens
ggtaatttgtaatgaa

SEQ ID NO: 117754 - DNA, 22 bp, H. sapiens
ggtacaagacacccctttcagc

SEQ ID NO: 117755 - DNA, 16 bp, H. sapiens
ggtacaatcttggctc

SEQ ID NO: 117756 - DNA, 16 bp, H. sapiens
ggtacagattatttca

SEQ ID NO: 117757 - DNA, 16 bp, H. sapiens
ggtacagcctccttcc

SEQ ID NO: 117758 - DNA, 16 bp, H. sapiens
ggtacagtaaaaacac

SEQ ID NO: 117759 - DNA, 16 bp, H. sapiens
ggtacagtaaaaatac

SEQ ID NO: 117760 - DNA, 16 bp, H. sapiens
ggtacagtaaaaatat

SEQ ID NO: 117761 - DNA, 16 bp, H. sapiens
ggtacagtgtacattg

SEQ ID NO: 117762 - DNA, 16 bp, H. sapiens
ggtacatacccaaagg

SEQ ID NO: 117763 - DNA, 16 bp, H. sapiens
ggtacatagtaagtgt

SEQ ID NO: 117764 - DNA, 16 bp, H. sapiens
ggtacatgtgcagaaa

SEQ ID NO: 117765 - DNA, 16 bp, H. sapiens
ggtacatttatcaaaa

SEQ ID NO: 117766 - DNA, 16 bp, H. sapiens
ggtaccaagaagtggg

SEQ ID NO: 117767 - DNA, 16 bp, H. sapiens
ggtaccaatcctactg

SEQ ID NO: 117768 - DNA, 16 bp, H. sapiens
ggtaccagcaactgca

SEQ ID NO: 117769 - DNA, 16 bp, H. sapiens
ggtaccagcaccagct

SEQ ID NO: 117770 - DNA, 16 bp, H. sapiens
ggtaccagcagagtgg

SEQ ID NO: 117771 - DNA, 16 bp, H. sapiens
ggtaccagccactgga

SEQ ID NO: 117772 - DNA, 16 bp, H. sapiens
ggtaccaggagtgggg

SEQ ID NO: 117773 - DNA, 16 bp, H. sapiens
ggtaccatctcctcct

SEQ ID NO: 117774 - DNA, 16 bp, H. sapiens
ggtacgatctcagctt

SEQ ID NO: 117775 - DNA, 16 bp, H. sapiens
ggtactggcacaagaa

SEQ ID NO: 117776 - DNA, 16 bp, H. sapiens
ggtactttgtaatatc

SEQ ID NO: 117777 - DNA, 16 bp, H. sapiens
ggtagaaaaagacatt

SEQ ID NO: 117778 - DNA, 16 bp, H. sapiens
ggtagaatttagctgt

SEQ ID NO: 117779 - DNA, 16 bp, H. sapiens
ggtagacttttttttt

SEQ ID NO: 117780 - DNA, 16 bp, H. sapiens
ggtagagaaagagatg

SEQ ID NO: 117781 - DNA, 16 bp, H. sapiens
ggtagagacatggaga

SEQ ID NO: 117782 - DNA, 16 bp, H. sapiens
ggtagagacgggattt

SEQ ID NO: 117783 - DNA, 16 bp, H. sapiens
ggtagagatacaacaa

SEQ ID NO: 117784 - DNA, 16 bp, H. sapiens
ggtagagtgcagtggc

SEQ ID NO: 117785 - DNA, 16 bp, H. sapiens
ggtagataaaaccaaa

SEQ ID NO: 117786 - DNA, 16 bp, H. sapiens
ggtagcacatgtctgt

SEQ ID NO: 117787 - DNA, 16 bp, H. sapiens
ggtagcagctcctcct

SEQ ID NO: 117788 - DNA, 16 bp, H. sapiens
ggtagcatgatgcctc

SEQ ID NO: 117789 - DNA, 16 bp, H. sapiens
ggtagctattattatt

SEQ ID NO: 117790 - DNA, 16 bp, H. sapiens
ggtagctcaggcctgt

SEQ ID NO: 117791 - DNA, 16 bp, H. sapiens
ggtagctgggactaca

SEQ ID NO: 117792 - DNA, 16 bp, H. sapiens
ggtagctgggactata

SEQ ID NO: 117793 - DNA, 17 bp, H. sapiens
ggtagctgggattacag

SEQ ID NO: 117794 - DNA, 23 bp, H. sapiens
ggtagctgggattacaggcatgc

SEQ ID NO: 117795 - DNA, 20 bp, H. sapiens
ggtagctgggattacaggcg

SEQ ID NO: 117796 - DNA, 29 bp, H. sapiens
ggtagcttgatggggatggcattgaatct

SEQ ID NO: 117797 - DNA, 16 bp, H. sapiens
ggtagcttgcacctgt

SEQ ID NO: 117798 - DNA, 16 bp, H. sapiens
ggtaggaaaacctgaa

SEQ ID NO: 117799 - DNA, 16 bp, H. sapiens
ggtaggaagaaccaat

SEQ ID NO: 117800 - DNA, 16 bp, H. sapiens
ggtaggacttcaacat

SEQ ID NO: 117801 - DNA, 16 bp, H. sapiens
ggtagggtgagggcta

SEQ ID NO: 117802 - DNA, 16 bp, H. sapiens
ggtaggtgttcaataa

SEQ ID NO: 117803 - DNA, 16 bp, H. sapiens
ggtagtcccagctact

SEQ ID NO: 117804 - DNA, 16 bp, H. sapiens
ggtagtgcacgcctgt

SEQ ID NO: 117805 - DNA, 16 bp, H. sapiens
ggtagttcacacctgt

SEQ ID NO: 117806 - DNA, 16 bp, H. sapiens
ggtataatttacaaat

SEQ ID NO: 117807 - DNA, 16 bp, H. sapiens
ggtatagcctgttgct

SEQ ID NO: 117808 - DNA, 16 bp, H. sapiens
ggtatatatatatata

SEQ ID NO: 117809 - DNA, 16 bp, H. sapiens
ggtatatattttaaaa

SEQ ID NO: 117810 - DNA, 16 bp, H. sapiens
ggtatcaacttgactg

SEQ ID NO: 117811 - DNA, 17 bp, H. sapiens
ggtatcaccagcggagg

SEQ ID NO: 117812 - DNA, 16 bp, H. sapiens
ggtatctggttcatct

SEQ ID NO: 117813 - DNA, 16 bp, H. sapiens
ggtatctttgtcaaaa

SEQ ID NO: 117814 - DNA, 16 bp, H. sapiens
ggtatgaaccaccaca

SEQ ID NO: 117815 - DNA, 17 bp, H. sapiens
ggtatgaacccgggagg

SEQ ID NO: 117816 - DNA, 16 bp, H. sapiens
ggtatgaataccagga

SEQ ID NO: 117817 - DNA, 16 bp, H. sapiens
ggtatgaatgatcctg

SEQ ID NO: 117818 - DNA, 18 bp, H. sapiens
ggtatgcttgaccattga

SEQ ID NO: 117819 - DNA, 16 bp, H. sapiens
ggtatggaaaaacaaa

SEQ ID NO: 117820 - DNA, 16 bp, H. sapiens
ggtatggtggtacatg

SEQ ID NO: 117821 - DNA, 16 bp, H. sapiens
ggtatggtggtgcatg

SEQ ID NO: 117822 - DNA, 16 bp, H. sapiens
ggtatggtggtgcctg

SEQ ID NO: 117823 - DNA, 16 bp, H. sapiens
ggtatgtgccatcaca

SEQ ID NO: 117824 - DNA, 16 bp, H. sapiens
ggtatgtgtatgtgtg

SEQ ID NO: 117825 - DNA, 16 bp, H. sapiens
ggtatgtgtgtataca

SEQ ID NO: 117826 - DNA, 16 bp, H. sapiens
ggtatgtgtgtatata

SEQ ID NO: 117827 - DNA, 16 bp, H. sapiens
ggtatgtgtgtgtatg

SEQ ID NO: 117828 - DNA, 16 bp, H. sapiens
ggtatgttgtgtgatg

SEQ ID NO: 117829 - DNA, 16 bp, H. sapiens
ggtattacaagtaatc

SEQ ID NO: 117830 - DNA, 16 bp, H. sapiens
ggtattaccagcagag

SEQ ID NO: 117831 - DNA, 16 bp, H. sapiens
ggtattatgtttttaa

SEQ ID NO: 117832 - DNA, 16 bp, H. sapiens
ggtattcagttatagc

SEQ ID NO: 117833 - DNA, 16 bp, H. sapiens
ggtattggcaaaagaa

SEQ ID NO: 117834 - DNA, 47 bp, H. sapiens
ggtattgtccaaggtttctccccatgtgatagtctgaaatatggcct

SEQ ID NO: 117835 - DNA, 16 bp, H. sapiens
ggtatttacccaagat

SEQ ID NO: 117836 - DNA, 16 bp, H. sapiens
ggtatttacccagagg

SEQ ID NO: 117837 - DNA, 16 bp, H. sapiens
ggtatttctacatctc

SEQ ID NO: 117838 - DNA, 16 bp, H. sapiens
ggtatttgttctaatg

SEQ ID NO: 117839 - DNA, 16 bp, H. sapiens
ggtattttatttcatt

SEQ ID NO: 117840 - DNA, 16 bp, H. sapiens
ggtattttgatgagga

SEQ ID NO: 117841 - DNA, 16 bp, H. sapiens
ggtcaaaataaaagaa

SEQ ID NO: 117842 - DNA, 16 bp, H. sapiens
ggtcaaaggacatgaa

SEQ ID NO: 117843 - DNA, 16 bp, H. sapiens
ggtcaaagggtacaaa

SEQ ID NO: 117844 - DNA, 16 bp, H. sapiens
ggtcaaagggtataaa

SEQ ID NO: 117845 - DNA, 16 bp, H. sapiens
ggtcaaatcttaaagc

SEQ ID NO: 117846 - DNA, 16 bp, H. sapiens
ggtcaacatcactgat

SEQ ID NO: 117847 - DNA, 16 bp, H. sapiens
ggtcaaggaaggcttc

SEQ ID NO: 117848 - DNA, 16 bp, H. sapiens
ggtcaaggcaggagga

SEQ ID NO: 117849 - DNA, 16 bp, H. sapiens
ggtcaaggcttcagtg

SEQ ID NO: 117850 - DNA, 16 bp, H. sapiens
ggtcacacacacagtg

SEQ ID NO: 117851 - DNA, 16 bp, H. sapiens
ggtcacacacagtgga

SEQ ID NO: 117852 - DNA, 16 bp, H. sapiens
ggtcacacagctggga

SEQ ID NO: 117853 - DNA, 16 bp, H. sapiens
ggtcacagaagtgttc

SEQ ID NO: 117854 - DNA, 16 bp, H. sapiens
ggtcacagagatcatg

SEQ ID NO: 117855 - DNA, 16 bp, H. sapiens
ggtcacatcaagttaa

SEQ ID NO: 117856 - DNA, 16 bp, H. sapiens
ggtcacattgcctcct

SEQ ID NO: 117857 - DNA, 16 bp, H. sapiens
ggtcacattgccttct

SEQ ID NO: 117858 - DNA, 16 bp, H. sapiens
ggtcaccagaaagacc

SEQ ID NO: 117859 - DNA, 17 bp, H. sapiens
ggtcacgaggtcaggag

SEQ ID NO: 117860 - DNA, 16 bp, H. sapiens
ggtcactcttgctgtg

SEQ ID NO: 117861 - DNA, 16 bp, H. sapiens
ggtcactgcaaactcc

SEQ ID NO: 117862 - DNA, 16 bp, H. sapiens
ggtcacttatatttgg

SEQ ID NO: 117863 - DNA, 16 bp, H. sapiens
ggtcagagcagaggcc

SEQ ID NO: 117864 - DNA, 16 bp, H. sapiens
ggtcagagcaggagga

SEQ ID NO: 117865 - DNA, 16 bp, H. sapiens
ggtcagaggtcccaga

SEQ ID NO: 117866 - DNA, 16 bp, H. sapiens
ggtcagcaaactatgg

SEQ ID NO: 117867 - DNA, 16 bp, H. sapiens
ggtcagcaaactgtgg

SEQ ID NO: 117868 - DNA, 16 bp, H. sapiens
ggtcagcaggaaaaca

SEQ ID NO: 117869 - DNA, 16 bp, H. sapiens
ggtcagcattatcctg

SEQ ID NO: 117870 - DNA, 16 bp, H. sapiens
ggtcagcccccagccc

SEQ ID NO: 117871 - DNA, 16 bp, H. sapiens
ggtcagccccctgccc

SEQ ID NO: 117872 - DNA, 16 bp, H. sapiens
ggtcaggaaaggcttc

SEQ ID NO: 117873 - DNA, 16 bp, H. sapiens
ggtcaggaattcagaa

SEQ ID NO: 117874 - DNA, 16 bp, H. sapiens
ggtcaggacttcaaga

SEQ ID NO: 117875 - DNA, 16 bp, H. sapiens
ggtcaggagctccaga

SEQ ID NO: 117876 - DNA, 16 bp, H. sapiens
ggtcaggagtcaagac

SEQ ID NO: 117877 - DNA, 16 bp, H. sapiens
ggtcaggctggcctcg

SEQ ID NO: 117878 - DNA, 16 bp, H. sapiens
ggtcagggaaccaaga

SEQ ID NO: 117879 - DNA, 16 bp, H. sapiens
ggtcagggaaggcttc

SEQ ID NO: 117880 - DNA, 16 bp, H. sapiens
ggtcagggagttccct

SEQ ID NO: 117881 - DNA, 16 bp, H. sapiens
ggtcagggctgcagtg

SEQ ID NO: 117882 - DNA, 16 bp, H. sapiens
ggtcaggggtcagaga

SEQ ID NO: 117883 - DNA, 16 bp, H. sapiens
ggtcagtctttgttct

SEQ ID NO: 117884 - DNA, 16 bp, H. sapiens
ggtcagtgattctcaa

SEQ ID NO: 117885 - DNA, 16 bp, H. sapiens
ggtcatgaggactctg

SEQ ID NO: 117886 - DNA, 16 bp, H. sapiens
ggtcatgagggcagag

SEQ ID NO: 117887 - DNA, 16 bp, H. sapiens
ggtcatgagggtgggg

SEQ ID NO: 117888 - DNA, 16 bp, H. sapiens
ggtcatgcagtgtgtt

SEQ ID NO: 117889 - DNA, 16 bp, H. sapiens
ggtcatgctggtcttg

SEQ ID NO: 117890 - DNA, 16 bp, H. sapiens
ggtcatggtggtgggc

SEQ ID NO: 117891 - DNA, 16 bp, H. sapiens
ggtcatggtggtggtg

SEQ ID NO: 117892 - DNA, 16 bp, H. sapiens
ggtcatgtggtatttg

SEQ ID NO: 117893 - DNA, 16 bp, H. sapiens
ggtcattagacaaatg

SEQ ID NO: 117894 - DNA, 16 bp, H. sapiens
ggtcattcacatccct

SEQ ID NO: 117895 - DNA, 21 bp, H. sapiens
ggtcattttcacgatattgat

SEQ ID NO: 117896 - DNA, 16 bp, H. sapiens
ggtccaaagctgagtt

SEQ ID NO: 117897 - DNA, 16 bp, H. sapiens
ggtccaagggattctc

SEQ ID NO: 117898 - DNA, 16 bp, H. sapiens
ggtccacccgcctcag

SEQ ID NO: 117899 - DNA, 16 bp, H. sapiens
ggtccaggaatcaagg

SEQ ID NO: 117900 - DNA, 16 bp, H. sapiens
ggtccaggcccccagc

SEQ ID NO: 117901 - DNA, 16 bp, H. sapiens
ggtccagggcagggcc

SEQ ID NO: 117902 - DNA, 16 bp, H. sapiens
ggtccagtttcagttt

SEQ ID NO: 117903 - DNA, 16 bp, H. sapiens
ggtcccaatccagacc

SEQ ID NO: 117904 - DNA, 16 bp, H. sapiens
ggtcccaccccagacc

SEQ ID NO: 117905 - DNA, 16 bp, H. sapiens
ggtcccacctactcag

SEQ ID NO: 117906 - DNA, 16 bp, H. sapiens
ggtcccagaatggtgg

SEQ ID NO: 117907 - DNA, 16 bp, H. sapiens
ggtcccagatggagat

SEQ ID NO: 117908 - DNA, 17 bp, H. sapiens
ggtcccagcactttggg

SEQ ID NO: 117909 - DNA, 16 bp, H. sapiens
ggtcccagctacttag

SEQ ID NO: 117910 - DNA, 16 bp, H. sapiens
ggtcccagctcctcag

SEQ ID NO: 117911 - DNA, 16 bp, H. sapiens
ggtcccagctgctggg

SEQ ID NO: 117912 - DNA, 16 bp, H. sapiens
ggtccccagcccctgg

SEQ ID NO: 117913 - DNA, 16 bp, H. sapiens
ggtccccagggaagcc

SEQ ID NO: 117914 - DNA, 16 bp, H. sapiens
ggtccccagtgaggcc

SEQ ID NO: 117915 - DNA, 16 bp, H. sapiens
ggtcccccagcagtgc

SEQ ID NO: 117916 - DNA, 16 bp, H. sapiens
ggtcccccaggcccag

SEQ ID NO: 117917 - DNA, 16 bp, H. sapiens
ggtcccctcctgcaac

SEQ ID NO: 117918 - DNA, 16 bp, H. sapiens
ggtccccttccacact

SEQ ID NO: 117919 - DNA, 16 bp, H. sapiens
ggtccctcatgaatgg

SEQ ID NO: 117920 - DNA, 16 bp, H. sapiens
ggtccctcccacaaca

SEQ ID NO: 117921 - DNA, 16 bp, H. sapiens
ggtccctgacccccaa

SEQ ID NO: 117922 - DNA, 16 bp, H. sapiens
ggtccctgattccagg

SEQ ID NO: 117923 - DNA, 16 bp, H. sapiens
ggtccctggcgagggc

SEQ ID NO: 117924 - DNA, 16 bp, H. sapiens
ggtccctggtgaagcc

SEQ ID NO: 117925 - DNA, 16 bp, H. sapiens
ggtccctgtggccttc

SEQ ID NO: 117926 - DNA, 16 bp, H. sapiens
ggtcccttcctctgct

SEQ ID NO: 117927 - DNA, 19 bp, H. sapiens
ggtccgcagcttcattctt

SEQ ID NO: 117928 - DNA, 16 bp, H. sapiens
ggtcctaaaagcctca

SEQ ID NO: 117929 - DNA, 16 bp, H. sapiens
ggtcctcagccctgcc

SEQ ID NO: 117930 - DNA, 18 bp, H. sapiens
ggtcctcccaattcttag

SEQ ID NO: 117931 - DNA, 16 bp, H. sapiens
ggtcctcctgcttcag

SEQ ID NO: 117932 - DNA, 16 bp, H. sapiens
ggtcctctttagaagg

SEQ ID NO: 117933 - DNA, 16 bp, H. sapiens
ggtcctctttgtggtc

SEQ ID NO: 117934 - DNA, 16 bp, H. sapiens
ggtcctgaggcaggaa

SEQ ID NO: 117935 - DNA, 16 bp, H. sapiens
ggtcctgatccagacc

SEQ ID NO: 117936 - DNA, 16 bp, H. sapiens
ggtcctgcacagatgg

SEQ ID NO: 117937 - DNA, 16 bp, H. sapiens
ggtcctgccccaggga

SEQ ID NO: 117938 - DNA, 16 bp, H. sapiens
ggtcctgcccctgcag

SEQ ID NO: 117939 - DNA, 16 bp, H. sapiens
ggtcctgctgctcacc

SEQ ID NO: 117940 - DNA, 16 bp, H. sapiens
ggtcctggactccttt

SEQ ID NO: 117941 - DNA, 16 bp, H. sapiens
ggtcctggactttttt

SEQ ID NO: 117942 - DNA, 16 bp, H. sapiens
ggtcctggtgtctgtt

SEQ ID NO: 117943 - DNA, 16 bp, H. sapiens
ggtcctgtttataatt

SEQ ID NO: 117944 - DNA, 16 bp, H. sapiens
ggtccttctgcccagg

SEQ ID NO: 117945 - DNA, 16 bp, H. sapiens
ggtcgagatgggcaga

SEQ ID NO: 117946 - DNA, 17 bp, H. sapiens
ggtcgaggcgggcagat

SEQ ID NO: 117947 - DNA, 40 bp, H. sapiens
ggtcgggttaccctcaaaggaaagcccatcagactaacag

SEQ ID NO: 117948 - DNA, 16 bp, H. sapiens
ggtcgtgatctcctga

SEQ ID NO: 117949 - DNA, 16 bp, H. sapiens
ggtctaaaattctctt

SEQ ID NO: 117950 - DNA, 16 bp, H. sapiens
ggtctcacgctgttgc

SEQ ID NO: 117951 - DNA, 17 bp, H. sapiens
ggtctcactatgttgct

SEQ ID NO: 117952 - DNA, 16 bp, H. sapiens
ggtctcactctctcac

SEQ ID NO: 117953 - DNA, 16 bp, H. sapiens
ggtctcactctgtcac

SEQ ID NO: 117954 - DNA, 16 bp, H. sapiens
ggtctcactctgtctc

SEQ ID NO: 117955 - DNA, 16 bp, H. sapiens
ggtctcagactcttgg

SEQ ID NO: 117956 - DNA, 16 bp, H. sapiens
ggtctcagcttcattt

SEQ ID NO: 117957 - DNA, 16 bp, H. sapiens
ggtctcatgctgttgc

SEQ ID NO: 117958 - DNA, 16 bp, H. sapiens
ggtctcattctgtcgc

SEQ ID NO: 117959 - DNA, 16 bp, H. sapiens
ggtctcattctgttgc

SEQ ID NO: 117960 - DNA, 16 bp, H. sapiens
ggtctccaagtcctgg

SEQ ID NO: 117961 - DNA, 16 bp, H. sapiens
ggtctccagccacccc

SEQ ID NO: 117962 - DNA, 16 bp, H. sapiens
ggtctccagctccatc

SEQ ID NO: 117963 - DNA, 16 bp, H. sapiens
ggtctccagtggcccc

SEQ ID NO: 117964 - DNA, 16 bp, H. sapiens
ggtctcccaaaatgtt

SEQ ID NO: 117965 - DNA, 16 bp, H. sapiens
ggtctcccagctgtgg

SEQ ID NO: 117966 - DNA, 16 bp, H. sapiens
ggtctccccagccctg

SEQ ID NO: 117967 - DNA, 16 bp, H. sapiens
ggtctccctctcccca

SEQ ID NO: 117968 - DNA, 16 bp, H. sapiens
ggtctcctctctgcta

SEQ ID NO: 117969 - DNA, 16 bp, H. sapiens
ggtctcctgaagacag

SEQ ID NO: 117970 - DNA, 16 bp, H. sapiens
ggtctcctgcagtgcc

SEQ ID NO: 117971 - DNA, 16 bp, H. sapiens
ggtctcgctatgttgc

SEQ ID NO: 117972 - DNA, 16 bp, H. sapiens
ggtctcgctctgtcac

SEQ ID NO: 117973 - DNA, 16 bp, H. sapiens
ggtctcgctctgtccc

SEQ ID NO: 117974 - DNA, 16 bp, H. sapiens
ggtctcgctgtgtcgc

SEQ ID NO: 117975 - DNA, 16 bp, H. sapiens
ggtctctatctcctgg

SEQ ID NO: 117976 - DNA, 16 bp, H. sapiens
ggtctctcaaactcct

SEQ ID NO: 117977 - DNA, 16 bp, H. sapiens
ggtctctccctgtgtg

SEQ ID NO: 117978 - DNA, 16 bp, H. sapiens
ggtctctctcactctg

SEQ ID NO: 117979 - DNA, 16 bp, H. sapiens
ggtctctctgattcct

SEQ ID NO: 117980 - DNA, 16 bp, H. sapiens
ggtctctgatggagat

SEQ ID NO: 117981 - DNA, 16 bp, H. sapiens
ggtctctgttcaaatg

SEQ ID NO: 117982 - DNA, 16 bp, H. sapiens
ggtctgaaggatggtg

SEQ ID NO: 117983 - DNA, 16 bp, H. sapiens
ggtctgagggaggaag

SEQ ID NO: 117984 - DNA, 17 bp, H. sapiens
ggtctgcaggttgtgaa

SEQ ID NO: 117985 - DNA, 16 bp, H. sapiens
ggtctgcatctcccag

SEQ ID NO: 117986 - DNA, 16 bp, H. sapiens
ggtctgcctcttccag

SEQ ID NO: 117987 - DNA, 16 bp, H. sapiens
ggtctgctggagtttt

SEQ ID NO: 117988 - DNA, 16 bp, H. sapiens
ggtctggagacatttt

SEQ ID NO: 117989 - DNA, 16 bp, H. sapiens
ggtctggaggcaggga

SEQ ID NO: 117990 - DNA, 16 bp, H. sapiens
ggtctggagtggggcc

SEQ ID NO: 117991 - DNA, 16 bp, H. sapiens
ggtctggctctgctgc

SEQ ID NO: 117992 - DNA, 16 bp, H. sapiens
ggtctggctctgtcgc

SEQ ID NO: 117993 - DNA, 16 bp, H. sapiens
ggtctgggatccccaa

SEQ ID NO: 117994 - DNA, 16 bp, H. sapiens
ggtctgggcaaaaatt

SEQ ID NO: 117995 - DNA, 16 bp, H. sapiens
ggtctgggctgctgga

SEQ ID NO: 117996 - DNA, 16 bp, H. sapiens
ggtctgtcctggagaa

SEQ ID NO: 117997 - DNA, 16 bp, H. sapiens
ggtctgtgctgaggag

SEQ ID NO: 117998 - DNA, 16 bp, H. sapiens
ggtctgtggcccaggg

SEQ ID NO: 117999 - DNA, 16 bp, H. sapiens
ggtctgtgggacagac

SEQ ID NO: 118000 - DNA, 16 bp, H. sapiens
ggtctgtttctgggtt

SEQ ID NO: 118001 - DNA, 16 bp, H. sapiens
ggtcttaagacccaca

SEQ ID NO: 118002 - DNA, 16 bp, H. sapiens
ggtcttaatctcctga

SEQ ID NO: 118003 - DNA, 16 bp, H. sapiens
ggtcttactctgttgc

SEQ ID NO: 118004 - DNA, 16 bp, H. sapiens
ggtcttcctccccaaa

SEQ ID NO: 118005 - DNA, 16 bp, H. sapiens
ggtcttctttgattcc

SEQ ID NO: 118006 - DNA, 16 bp, H. sapiens
ggtcttctttgtctct

SEQ ID NO: 118007 - DNA, 16 bp, H. sapiens
ggtcttgaatacctgg

SEQ ID NO: 118008 - DNA, 16 bp, H. sapiens
ggtcttgctatgtggc

SEQ ID NO: 118009 - DNA, 17 bp, H. sapiens
ggtcttgctctgtcact

SEQ ID NO: 118010 - DNA, 18 bp, H. sapiens
ggtcttgctctgttgcca

SEQ ID NO: 118011 - DNA, 16 bp, H. sapiens
ggtcttgtgggactga

SEQ ID NO: 118012 - DNA, 16 bp, H. sapiens
ggtctttctctggcct

SEQ ID NO: 118013 - DNA, 16 bp, H. sapiens
ggtctttctctgtcac

SEQ ID NO: 118014 - DNA, 16 bp, H. sapiens
ggtctttgacaaagca

SEQ ID NO: 118015 - DNA, 16 bp, H. sapiens
ggtctttgagaaattg

SEQ ID NO: 118016 - DNA, 16 bp, H. sapiens
ggtctttgatcatggt

SEQ ID NO: 118017 - DNA, 16 bp, H. sapiens
ggtctttgatccattt

SEQ ID NO: 118018 - DNA, 16 bp, H. sapiens
ggtctttgcaacccac

SEQ ID NO: 118019 - DNA, 16 bp, H. sapiens
ggtctttgcagatgat

SEQ ID NO: 118020 - DNA, 16 bp, H. sapiens
ggtctttggcaccaaa

SEQ ID NO: 118021 - DNA, 16 bp, H. sapiens
ggtcttttcacatatt

SEQ ID NO: 118022 - DNA, 16 bp, H. sapiens
ggtcttttggagtttg

SEQ ID NO: 118023 - DNA, 16 bp, H. sapiens
ggtcttttgtgatttc

SEQ ID NO: 118024 - DNA, 16 bp, H. sapiens
ggtcttttgtgcttcc

SEQ ID NO: 118025 - DNA, 16 bp, H. sapiens
ggtgaaaaaccaaata

SEQ ID NO: 118026 - DNA, 16 bp, H. sapiens
ggtgaaaaaggaaaca

SEQ ID NO: 118027 - DNA, 16 bp, H. sapiens
ggtgaaaaaggaagta

SEQ ID NO: 118028 - DNA, 16 bp, H. sapiens
ggtgaaaacctgcctc

SEQ ID NO: 118029 - DNA, 16 bp, H. sapiens
ggtgaaaagcacatct

SEQ ID NO: 118030 - DNA, 18 bp, H. sapiens
ggtgaaacaccgtctcta

SEQ ID NO: 118031 - DNA, 16 bp, H. sapiens
ggtgaaaccatgtctc

SEQ ID NO: 118032 - DNA, 18 bp, H. sapiens
ggtgaaaccccatctcta

SEQ ID NO: 118033 - DNA, 16 bp, H. sapiens
ggtgaaaccccgtcta

SEQ ID NO: 118034 - DNA, 19 bp, H. sapiens
ggtgaaaccccgtctctat

SEQ ID NO: 118035 - DNA, 24 bp, H. sapiens
ggtgaaaccccgtctcttctaaaa

SEQ ID NO: 118036 - DNA, 17 bp, H. sapiens
ggtgaaaccccttctct

SEQ ID NO: 118037 - DNA, 18 bp, H. sapiens
ggtgaaaccctgtctcca

SEQ ID NO: 118038 - DNA, 28 bp, H. sapiens
ggtgaaaccctgtctctactaaaaaaat

SEQ ID NO: 118039 - DNA, 16 bp, H. sapiens
ggtgaaactacatctc

SEQ ID NO: 118040 - DNA, 16 bp, H. sapiens
ggtgaaagagagagac

SEQ ID NO: 118041 - DNA, 16 bp, H. sapiens
ggtgaaagattgaatg

SEQ ID NO: 118042 - DNA, 16 bp, H. sapiens
ggtgaaagccccaagc

SEQ ID NO: 118043 - DNA, 16 bp, H. sapiens
ggtgaaagctgcagtg

SEQ ID NO: 118044 - DNA, 16 bp, H. sapiens
ggtgaaaggaaagcaa

SEQ ID NO: 118045 - DNA, 16 bp, H. sapiens
ggtgaaaggcaaaggg

SEQ ID NO: 118046 - DNA, 16 bp, H. sapiens
ggtgaaatctgtctct

SEQ ID NO: 118047 - DNA, 16 bp, H. sapiens
ggtgaaatttggcttt

SEQ ID NO: 118048 - DNA, 16 bp, H. sapiens
ggtgaacctggaggac

SEQ ID NO: 118049 - DNA, 16 bp, H. sapiens
ggtgaacctggaggag

SEQ ID NO: 118050 - DNA, 20 bp, H. sapiens
ggtgaacctgggaggtggag

SEQ ID NO: 118051 - DNA, 16 bp, H. sapiens
ggtgaagaaaatgttc

SEQ ID NO: 118052 - DNA, 16 bp, H. sapiens
ggtgaagaaactgaag

SEQ ID NO: 118053 - DNA, 16 bp, H. sapiens
ggtgaagaaattgaga

SEQ ID NO: 118054 - DNA, 16 bp, H. sapiens
ggtgaagaagctgcag

SEQ ID NO: 118055 - DNA, 16 bp, H. sapiens
ggtgaagagcaagact

SEQ ID NO: 118056 - DNA, 16 bp, H. sapiens
ggtgaagcaggagaat

SEQ ID NO: 118057 - DNA, 16 bp, H. sapiens
ggtgaagcaggagcag

SEQ ID NO: 118058 - DNA, 16 bp, H. sapiens
ggtgaagccagttggg

SEQ ID NO: 118059 - DNA, 16 bp, H. sapiens
ggtgaagccccacctc

SEQ ID NO: 118060 - DNA, 16 bp, H. sapiens
ggtgaaggaaaagcaa

SEQ ID NO: 118061 - DNA, 16 bp, H. sapiens
ggtgaaggaggagcaa

SEQ ID NO: 118062 - DNA, 16 bp, H. sapiens
ggtgaaggaggagcag

SEQ ID NO: 118063 - DNA, 16 bp, H. sapiens
ggtgaaggataaaaga

SEQ ID NO: 118064 - DNA, 16 bp, H. sapiens
ggtgaaggggaagcag

SEQ ID NO: 118065 - DNA, 16 bp, H. sapiens
ggtgaagtcttgctct

SEQ ID NO: 118066 - DNA, 17 bp, H. sapiens
ggtgaagtgacttgccc

SEQ ID NO: 118067 - DNA, 16 bp, H. sapiens
ggtgaatgctgcctgg

SEQ ID NO: 118068 - DNA, 16 bp, H. sapiens
ggtgaattctaccaaa

SEQ ID NO: 118069 - DNA, 16 bp, H. sapiens
ggtgaatttggagctg

SEQ ID NO: 118070 - DNA, 16 bp, H. sapiens
ggtgaattttaccaaa

SEQ ID NO: 118071 - DNA, 16 bp, H. sapiens
ggtgaattttttgtat

SEQ ID NO: 118072 - DNA, 16 bp, H. sapiens
ggtgacaaagcaagat

SEQ ID NO: 118073 - DNA, 16 bp, H. sapiens
ggtgacaaagccagac

SEQ ID NO: 118074 - DNA, 16 bp, H. sapiens
ggtgacaacatgctgg

SEQ ID NO: 118075 - DNA, 16 bp, H. sapiens
ggtgacaagagcgaga

SEQ ID NO: 118076 - DNA, 16 bp, H. sapiens
ggtgacaagggtgaaa

SEQ ID NO: 118077 - DNA, 17 bp, H. sapiens
ggtgacagaacaagacc

SEQ ID NO: 118078 - DNA, 16 bp, H. sapiens
ggtgacagaagaagac

SEQ ID NO: 118079 - DNA, 16 bp, H. sapiens
ggtgacagagagaaac

SEQ ID NO: 118080 - DNA, 16 bp, H. sapiens
ggtgacagagatcctg

SEQ ID NO: 118081 - DNA, 16 bp, H. sapiens
ggtgacagagcaagac

SEQ ID NO: 118082 - DNA, 16 bp, H. sapiens
ggtgacagaggagact

SEQ ID NO: 118083 - DNA, 16 bp, H. sapiens
ggtgacagagggggac

SEQ ID NO: 118084 - DNA, 16 bp, H. sapiens
ggtgacagagtgagct

SEQ ID NO: 118085 - DNA, 16 bp, H. sapiens
ggtgacagatatccca

SEQ ID NO: 118086 - DNA, 16 bp, H. sapiens
ggtgacagatgagacc

SEQ ID NO: 118087 - DNA, 16 bp, H. sapiens
ggtgacagcaagaccc

SEQ ID NO: 118088 - DNA, 19 bp, H. sapiens
ggtgacagcgtgctggcag

SEQ ID NO: 118089 - DNA, 16 bp, H. sapiens
ggtgacaggcatgagc

SEQ ID NO: 118090 - DNA, 16 bp, H. sapiens
ggtgacagggaaagac

SEQ ID NO: 118091 - DNA, 16 bp, H. sapiens
ggtgacaggtacacta

SEQ ID NO: 118092 - DNA, 16 bp, H. sapiens
ggtgacagtgagacac

SEQ ID NO: 118093 - DNA, 16 bp, H. sapiens
ggtgacagtgagaccc

SEQ ID NO: 118094 - DNA, 16 bp, H. sapiens
ggtgacagtgatgatg

SEQ ID NO: 118095 - DNA, 17 bp, H. sapiens
ggtgacatacagatggg

SEQ ID NO: 118096 - DNA, 16 bp, H. sapiens
ggtgacatagtgagac

SEQ ID NO: 118097 - DNA, 16 bp, H. sapiens
ggtgacatgtacctgt

SEQ ID NO: 118098 - DNA, 16 bp, H. sapiens
ggtgacatttgagcca

SEQ ID NO: 118099 - DNA, 16 bp, H. sapiens
ggtgaccagccttccc

SEQ ID NO: 118100 - DNA, 16 bp, H. sapiens
ggtgaccattaaaaag

SEQ ID NO: 118101 - DNA, 16 bp, H. sapiens
ggtgaccttgggaaag

SEQ ID NO: 118102 - DNA, 18 bp, H. sapiens
ggtgaccttgggcaagtc

SEQ ID NO: 118103 - DNA, 16 bp, H. sapiens
ggtgactcaaattttt

SEQ ID NO: 118104 - DNA, 23 bp, H. sapiens
ggtgactcacacctgtaatccca

SEQ ID NO: 118105 - DNA, 16 bp, H. sapiens
ggtgactcacgcctgt

SEQ ID NO: 118106 - DNA, 16 bp, H. sapiens
ggtgactgcagtgagc

SEQ ID NO: 118107 - DNA, 16 bp, H. sapiens
ggtgactttatagaac

SEQ ID NO: 118108 - DNA, 16 bp, H. sapiens
ggtgagaaagcgagac

SEQ ID NO: 118109 - DNA, 16 bp, H. sapiens
ggtgagaaagggcatc

SEQ ID NO: 118110 - DNA, 16 bp, H. sapiens
ggtgagaaagtgagac

SEQ ID NO: 118111 - DNA, 16 bp, H. sapiens
ggtgagaagaaacatc

SEQ ID NO: 118112 - DNA, 16 bp, H. sapiens
ggtgagaagagcaaaa

SEQ ID NO: 118113 - DNA, 16 bp, H. sapiens
ggtgagaatgtaagtt

SEQ ID NO: 118114 - DNA, 16 bp, H. sapiens
ggtgagacactgtctc

SEQ ID NO: 118115 - DNA, 16 bp, H. sapiens
ggtgagaccccgtctc

SEQ ID NO: 118116 - DNA, 16 bp, H. sapiens
ggtgagactgtcaaca

SEQ ID NO: 118117 - DNA, 16 bp, H. sapiens
ggtgagactgtggaga

SEQ ID NO: 118118 - DNA, 16 bp, H. sapiens
ggtgagactttgtctc

SEQ ID NO: 118119 - DNA, 16 bp, H. sapiens
ggtgagagacagatgg

SEQ ID NO: 118120 - DNA, 16 bp, H. sapiens
ggtgagagagacagag

SEQ ID NO: 118121 - DNA, 16 bp, H. sapiens
ggtgagagagcagccc

SEQ ID NO: 118122 - DNA, 17 bp, H. sapiens
ggtgagagagggcatcc

SEQ ID NO: 118123 - DNA, 16 bp, H. sapiens
ggtgagcaaggtgaag

SEQ ID NO: 118124 - DNA, 16 bp, H. sapiens
ggtgagcacaactatt

SEQ ID NO: 118125 - DNA, 16 bp, H. sapiens
ggtgagcactcacagt

SEQ ID NO: 118126 - DNA, 19 bp, H. sapiens
ggtgagcagccaaagcagg

SEQ ID NO: 118127 - DNA, 21 bp, H. sapiens
ggtgagccaagatcatgccat

SEQ ID NO: 118128 - DNA, 16 bp, H. sapiens
ggtgagccaccacatc

SEQ ID NO: 118129 - DNA, 16 bp, H. sapiens
ggtgagccaccatgcc

SEQ ID NO: 118130 - DNA, 16 bp, H. sapiens
ggtgagccaccgtgcc

SEQ ID NO: 118131 - DNA, 16 bp, H. sapiens
ggtgagcccgggtgcc

SEQ ID NO: 118132 - DNA, 16 bp, H. sapiens
ggtgagccgagatcac

SEQ ID NO: 118133 - DNA, 17 bp, H. sapiens
ggtgagccgagatcgtg

SEQ ID NO: 118134 - DNA, 16 bp, H. sapiens
ggtgagctatgattgt

SEQ ID NO: 118135 - DNA, 20 bp, H. sapiens
ggtgagctgagatcgcgcca

SEQ ID NO: 118136 - DNA, 16 bp, H. sapiens
ggtgaggaacttgttg

SEQ ID NO: 118137 - DNA, 16 bp, H. sapiens
ggtgaggaagctgcag

SEQ ID NO: 118138 - DNA, 16 bp, H. sapiens
ggtgaggaagttgcag

SEQ ID NO: 118139 - DNA, 16 bp, H. sapiens
ggtgaggaattcaaga

SEQ ID NO: 118140 - DNA, 16 bp, H. sapiens
ggtgaggacactgagg

SEQ ID NO: 118141 - DNA, 16 bp, H. sapiens
ggtgaggacagcacca

SEQ ID NO: 118142 - DNA, 16 bp, H. sapiens
ggtgaggagttcgaga

SEQ ID NO: 118143 - DNA, 16 bp, H. sapiens
ggtgaggatgatgatg

SEQ ID NO: 118144 - DNA, 16 bp, H. sapiens
ggtgaggcagctctct

SEQ ID NO: 118145 - DNA, 16 bp, H. sapiens
ggtgaggcaggagaat

SEQ ID NO: 118146 - DNA, 16 bp, H. sapiens
ggtgaggcatgagaat

SEQ ID NO: 118147 - DNA, 16 bp, H. sapiens
ggtgaggcctcaggct

SEQ ID NO: 118148 - DNA, 16 bp, H. sapiens
ggtgaggctgtggaga

SEQ ID NO: 118149 - DNA, 16 bp, H. sapiens
ggtgagggcctcaggg

SEQ ID NO: 118150 - DNA, 16 bp, H. sapiens
ggtgagggccttctta

SEQ ID NO: 118151 - DNA, 16 bp, H. sapiens
ggtgagggctctctcc

SEQ ID NO: 118152 - DNA, 16 bp, H. sapiens
ggtgaggggatcactt

SEQ ID NO: 118153 - DNA, 16 bp, H. sapiens
ggtgagggggctgagc

SEQ ID NO: 118154 - DNA, 16 bp, H. sapiens
ggtgaggtgacttgcc

SEQ ID NO: 118155 - DNA, 16 bp, H. sapiens
ggtgaggtggcgcatg

SEQ ID NO: 118156 - DNA, 16 bp, H. sapiens
ggtgagtcacctgagg

SEQ ID NO: 118157 - DNA, 16 bp, H. sapiens
ggtgagtcctagagct

SEQ ID NO: 118158 - DNA, 16 bp, H. sapiens
ggtgagtggatcattt

SEQ ID NO: 118159 - DNA, 16 bp, H. sapiens
ggtgagtggatggatg

SEQ ID NO: 118160 - DNA, 16 bp, H. sapiens
ggtgagtggattgcct

SEQ ID NO: 118161 - DNA, 16 bp, H. sapiens
ggtgataaaaatgttc

SEQ ID NO: 118162 - DNA, 16 bp, H. sapiens
ggtgatactggcttta

SEQ ID NO: 118163 - DNA, 16 bp, H. sapiens
ggtgatatggcttggc

SEQ ID NO: 118164 - DNA, 18 bp, H. sapiens
ggtgatcctcccacctca

SEQ ID NO: 118165 - DNA, 17 bp, H. sapiens
ggtgatcctcccgcctc

SEQ ID NO: 118166 - DNA, 16 bp, H. sapiens
ggtgatcctccctcct

SEQ ID NO: 118167 - DNA, 16 bp, H. sapiens
ggtgatctgcctggct

SEQ ID NO: 118168 - DNA, 16 bp, H. sapiens
ggtgatgaaactgagg

SEQ ID NO: 118169 - DNA, 16 bp, H. sapiens
ggtgatgagtgcctgt

SEQ ID NO: 118170 - DNA, 16 bp, H. sapiens
ggtgatgatgacgatg

SEQ ID NO: 118171 - DNA, 16 bp, H. sapiens
ggtgatgatgatgaag

SEQ ID NO: 118172 - DNA, 16 bp, H. sapiens
ggtgatgatgatgaca

SEQ ID NO: 118173 - DNA, 16 bp, H. sapiens
ggtgatgatgatgtgt

SEQ ID NO: 118174 - DNA, 16 bp, H. sapiens
ggtgatgatgttgatg

SEQ ID NO: 118175 - DNA, 16 bp, H. sapiens
ggtgatgcagatgctg

SEQ ID NO: 118176 - DNA, 16 bp, H. sapiens
ggtgatgccagtgctg

SEQ ID NO: 118177 - DNA, 16 bp, H. sapiens
ggtgatgccccaccct

SEQ ID NO: 118178 - DNA, 16 bp, H. sapiens
ggtgatgctgttgctg

SEQ ID NO: 118179 - DNA, 16 bp, H. sapiens
ggtgatggagaggatg

SEQ ID NO: 118180 - DNA, 16 bp, H. sapiens
ggtgatggagctgaaa

SEQ ID NO: 118181 - DNA, 16 bp, H. sapiens
ggtgatggagggagac

SEQ ID NO: 118182 - DNA, 16 bp, H. sapiens
ggtgatggatgcctgt

SEQ ID NO: 118183 - DNA, 16 bp, H. sapiens
ggtgatggatttgtta

SEQ ID NO: 118184 - DNA, 16 bp, H. sapiens
ggtgatggcctggatg

SEQ ID NO: 118185 - DNA, 16 bp, H. sapiens
ggtgatgggtgcacca

SEQ ID NO: 118186 - DNA, 16 bp, H. sapiens
ggtgatggtgaagatg

SEQ ID NO: 118187 - DNA, 16 bp, H. sapiens
ggtgatggtgacggtg

SEQ ID NO: 118188 - DNA, 16 bp, H. sapiens
ggtgatggttgctgaa

SEQ ID NO: 118189 - DNA, 17 bp, H. sapiens
ggtgatgtacatcctca

SEQ ID NO: 118190 - DNA, 16 bp, H. sapiens
ggtgatgttggcttca

SEQ ID NO: 118191 - DNA, 16 bp, H. sapiens
ggtgatgtttgagctg

SEQ ID NO: 118192 - DNA, 16 bp, H. sapiens
ggtgattctcccacct

SEQ ID NO: 118193 - DNA, 16 bp, H. sapiens
ggtgattctgatgcag

SEQ ID NO: 118194 - DNA, 16 bp, H. sapiens
ggtgattcttctgcct

SEQ ID NO: 118195 - DNA, 16 bp, H. sapiens
ggtgatttcttcattt

SEQ ID NO: 118196 - DNA, 16 bp, H. sapiens
ggtgatttttattttc

SEQ ID NO: 118197 - DNA, 16 bp, H. sapiens
ggtgatttttctgttt

SEQ ID NO: 118198 - DNA, 16 bp, H. sapiens
ggtgattttttaaaaa

SEQ ID NO: 118199 - DNA, 16 bp, H. sapiens
ggtgcaaaccccaagc

SEQ ID NO: 118200 - DNA, 16 bp, H. sapiens
ggtgcaagacccaagc

SEQ ID NO: 118201 - DNA, 16 bp, H. sapiens
ggtgcaagccccaagc

SEQ ID NO: 118202 - DNA, 18 bp, H. sapiens
ggtgcaatggcgcaatct

SEQ ID NO: 118203 - DNA, 16 bp, H. sapiens
ggtgcaatggctcaag

SEQ ID NO: 118204 - DNA, 16 bp, H. sapiens
ggtgcacatctgtgat

SEQ ID NO: 118205 - DNA, 16 bp, H. sapiens
ggtgcacgctgccacg

SEQ ID NO: 118206 - DNA, 16 bp, H. sapiens
ggtgcagaaacagctg

SEQ ID NO: 118207 - DNA, 16 bp, H. sapiens
ggtgcagacccaaaga

SEQ ID NO: 118208 - DNA, 16 bp, H. sapiens
ggtgcagagatacgag

SEQ ID NO: 118209 - DNA, 17 bp, H. sapiens
ggtgcagagctgggttc

SEQ ID NO: 118210 - DNA, 16 bp, H. sapiens
ggtgcagatgaggttg

SEQ ID NO: 118211 - DNA, 16 bp, H. sapiens
ggtgcagcaaaccatc

SEQ ID NO: 118212 - DNA, 16 bp, H. sapiens
ggtgcagcagaccacc

SEQ ID NO: 118213 - DNA, 16 bp, H. sapiens
ggtgcagcagctcatg

SEQ ID NO: 118214 - DNA, 16 bp, H. sapiens
ggtgcagccactctgg

SEQ ID NO: 118215 - DNA, 16 bp, H. sapiens
ggtgcagctgcagcca

SEQ ID NO: 118216 - DNA, 16 bp, H. sapiens
ggtgcagctgctatgg

SEQ ID NO: 118217 - DNA, 16 bp, H. sapiens
ggtgcagctggaggcc

SEQ ID NO: 118218 - DNA, 16 bp, H. sapiens
ggtgcagtcatagctc

SEQ ID NO: 118219 - DNA, 16 bp, H. sapiens
ggtgcagtgcactgag

SEQ ID NO: 118220 - DNA, 16 bp, H. sapiens
ggtgcagtggcatgat

SEQ ID NO: 118221 - DNA, 16 bp, H. sapiens
ggtgcagtggctcaca

SEQ ID NO: 118222 - DNA, 17 bp, H. sapiens
ggtgcagtggctcacgt

SEQ ID NO: 118223 - DNA, 16 bp, H. sapiens
ggtgcagtggctctcg

SEQ ID NO: 118224 - DNA, 16 bp, H. sapiens
ggtgcagtggtgcaat

SEQ ID NO: 118225 - DNA, 16 bp, H. sapiens
ggtgcagtggtggctc

SEQ ID NO: 118226 - DNA, 16 bp, H. sapiens
ggtgcagtttcagttt

SEQ ID NO: 118227 - DNA, 16 bp, H. sapiens
ggtgcagtttccccca

SEQ ID NO: 118228 - DNA, 16 bp, H. sapiens
ggtgcatgccaccaca

SEQ ID NO: 118229 - DNA, 16 bp, H. sapiens
ggtgcatggcaccatg

SEQ ID NO: 118230 - DNA, 16 bp, H. sapiens
ggtgcatgtgcaggat

SEQ ID NO: 118231 - DNA, 16 bp, H. sapiens
ggtgccacatgcctgt

SEQ ID NO: 118232 - DNA, 16 bp, H. sapiens
ggtgccagcagggttg

SEQ ID NO: 118233 - DNA, 16 bp, H. sapiens
ggtgccaggggctggg

SEQ ID NO: 118234 - DNA, 16 bp, H. sapiens
ggtgccatcttggctt

SEQ ID NO: 118235 - DNA, 16 bp, H. sapiens
ggtgcccaccatgccc

SEQ ID NO: 118236 - DNA, 16 bp, H. sapiens
ggtgcccaggctgggg

SEQ ID NO: 118237 - DNA, 16 bp, H. sapiens
ggtgcccctctgggac

SEQ ID NO: 118238 - DNA, 16 bp, H. sapiens
ggtgccctgcattcca

SEQ ID NO: 118239 - DNA, 16 bp, H. sapiens
ggtgcctatgccacca

SEQ ID NO: 118240 - DNA, 16 bp, H. sapiens
ggtgcctcccaccatg

SEQ ID NO: 118241 - DNA, 16 bp, H. sapiens
ggtgcctgcctccctg

SEQ ID NO: 118242 - DNA, 16 bp, H. sapiens
ggtgcctgctgccatg

SEQ ID NO: 118243 - DNA, 16 bp, H. sapiens
ggtgcctggcacacag

SEQ ID NO: 118244 - DNA, 16 bp, H. sapiens
ggtgcctgtaatccaa

SEQ ID NO: 118245 - DNA, 17 bp, H. sapiens
ggtgcctgtaatcccaa

SEQ ID NO: 118246 - DNA, 16 bp, H. sapiens
ggtgcctgtcaccacg

SEQ ID NO: 118247 - DNA, 16 bp, H. sapiens
ggtgcctgtcatccca

SEQ ID NO: 118248 - DNA, 16 bp, H. sapiens
ggtgcgatctcggctg

SEQ ID NO: 118249 - DNA, 16 bp, H. sapiens
ggtgcgggagcaggag

SEQ ID NO: 118250 - DNA, 16 bp, H. sapiens
ggtgcggtggcttatg

SEQ ID NO: 118251 - DNA, 16 bp, H. sapiens
ggtgctaagcccctca

SEQ ID NO: 118252 - DNA, 16 bp, H. sapiens
ggtgctactggcatct

SEQ ID NO: 118253 - DNA, 16 bp, H. sapiens
ggtgctaggacaactg

SEQ ID NO: 118254 - DNA, 16 bp, H. sapiens
ggtgctaggagaactg

SEQ ID NO: 118255 - DNA, 16 bp, H. sapiens
ggtgctcaaaaagttt

SEQ ID NO: 118256 - DNA, 16 bp, H. sapiens
ggtgctcaccaccatg

SEQ ID NO: 118257 - DNA, 16 bp, H. sapiens
ggtgctcagtggggag

SEQ ID NO: 118258 - DNA, 16 bp, H. sapiens
ggtgctctcagatgga

SEQ ID NO: 118259 - DNA, 17 bp, H. sapiens
ggtgctgaacattcgct

SEQ ID NO: 118260 - DNA, 16 bp, H. sapiens
ggtgctgaggatacag

SEQ ID NO: 118261 - DNA, 16 bp, H. sapiens
ggtgctgcacgcctgt

SEQ ID NO: 118262 - DNA, 16 bp, H. sapiens
ggtgctgctgatgctg

SEQ ID NO: 118263 - DNA, 16 bp, H. sapiens
ggtgctgctgcagctg

SEQ ID NO: 118264 - DNA, 16 bp, H. sapiens
ggtgctgctgctgctg

SEQ ID NO: 118265 - DNA, 16 bp, H. sapiens
ggtgctggagaaactg

SEQ ID NO: 118266 - DNA, 16 bp, H. sapiens
ggtgctggagaagatg

SEQ ID NO: 118267 - DNA, 16 bp, H. sapiens
ggtgctggagaggagg

SEQ ID NO: 118268 - DNA, 16 bp, H. sapiens
ggtgctggagatgatg

SEQ ID NO: 118269 - DNA, 16 bp, H. sapiens
ggtgctggagcaactg

SEQ ID NO: 118270 - DNA, 16 bp, H. sapiens
ggtgctggaggggatg

SEQ ID NO: 118271 - DNA, 16 bp, H. sapiens
ggtgctggcaaggctg

SEQ ID NO: 118272 - DNA, 16 bp, H. sapiens
ggtgctggcatctggt

SEQ ID NO: 118273 - DNA, 16 bp, H. sapiens
ggtgctgggaaacctg

SEQ ID NO: 118274 - DNA, 16 bp, H. sapiens
ggtgctgggaacacag

SEQ ID NO: 118275 - DNA, 16 bp, H. sapiens
ggtgctgggattacag

SEQ ID NO: 118276 - DNA, 16 bp, H. sapiens
ggtgctgggcagggag

SEQ ID NO: 118277 - DNA, 16 bp, H. sapiens
ggtgctggggaggctg

SEQ ID NO: 118278 - DNA, 16 bp, H. sapiens
ggtgctggggattcag

SEQ ID NO: 118279 - DNA, 16 bp, H. sapiens
ggtgctggtaggagtg

SEQ ID NO: 118280 - DNA, 16 bp, H. sapiens
ggtgctgtccttgcag

SEQ ID NO: 118281 - DNA, 16 bp, H. sapiens
ggtgctgtggctcatg

SEQ ID NO: 118282 - DNA, 16 bp, H. sapiens
ggtgctgtgtgcctgt

SEQ ID NO: 118283 - DNA, 16 bp, H. sapiens
ggtgctgttaaaagca

SEQ ID NO: 118284 - DNA, 16 bp, H. sapiens
ggtgcttggtaccagc

SEQ ID NO: 118285 - DNA, 16 bp, H. sapiens
ggtgcttgtaatccca

SEQ ID NO: 118286 - DNA, 16 bp, H. sapiens
ggtggaaaaattgatg

SEQ ID NO: 118287 - DNA, 16 bp, H. sapiens
ggtggaaaaattgtct

SEQ ID NO: 118288 - DNA, 16 bp, H. sapiens
ggtggaaaaggaagca

SEQ ID NO: 118289 - DNA, 16 bp, H. sapiens
ggtggaaatagcaaaa

SEQ ID NO: 118290 - DNA, 16 bp, H. sapiens
ggtggaacatttgagg

SEQ ID NO: 118291 - DNA, 16 bp, H. sapiens
ggtggaactggagatc

SEQ ID NO: 118292 - DNA, 16 bp, H. sapiens
ggtggaagacaaggag

SEQ ID NO: 118293 - DNA, 16 bp, H. sapiens
ggtggaagagcaagag

SEQ ID NO: 118294 - DNA, 16 bp, H. sapiens
ggtggaagcaggaaga

SEQ ID NO: 118295 - DNA, 16 bp, H. sapiens
ggtggaaggagagctg

SEQ ID NO: 118296 - DNA, 16 bp, H. sapiens
ggtggaatgcagtggt

SEQ ID NO: 118297 - DNA, 16 bp, H. sapiens
ggtggagacacagagc

SEQ ID NO: 118298 - DNA, 16 bp, H. sapiens
ggtggagacacagatc

SEQ ID NO: 118299 - DNA, 16 bp, H. sapiens
ggtggagactttggga

SEQ ID NO: 118300 - DNA, 16 bp, H. sapiens
ggtggagaggagcttc

SEQ ID NO: 118301 - DNA, 16 bp, H. sapiens
ggtggagatgcccaag

SEQ ID NO: 118302 - DNA, 16 bp, H. sapiens
ggtggagattgcagcg

SEQ ID NO: 118303 - DNA, 16 bp, H. sapiens
ggtggagattgcggtg

SEQ ID NO: 118304 - DNA, 16 bp, H. sapiens
ggtggagcaggctggc

SEQ ID NO: 118305 - DNA, 16 bp, H. sapiens
ggtggagccttgggaa

SEQ ID NO: 118306 - DNA, 16 bp, H. sapiens
ggtggagctacccaag

SEQ ID NO: 118307 - DNA, 16 bp, H. sapiens
ggtggagctgcccaag

SEQ ID NO: 118308 - DNA, 16 bp, H. sapiens
ggtggagctgcccgcc

SEQ ID NO: 118309 - DNA, 16 bp, H. sapiens
ggtggagctgcctgct

SEQ ID NO: 118310 - DNA, 16 bp, H. sapiens
ggtggagctgctcaag

SEQ ID NO: 118311 - DNA, 16 bp, H. sapiens
ggtggagctggaagcc

SEQ ID NO: 118312 - DNA, 16 bp, H. sapiens
ggtggagctgtgagaa

SEQ ID NO: 118313 - DNA, 16 bp, H. sapiens
ggtggaggactgcttg

SEQ ID NO: 118314 - DNA, 16 bp, H. sapiens
ggtggaggagcagagt

SEQ ID NO: 118315 - DNA, 16 bp, H. sapiens
ggtggaggaggcagag

SEQ ID NO: 118316 - DNA, 16 bp, H. sapiens
ggtggaggagggcaga

SEQ ID NO: 118317 - DNA, 16 bp, H. sapiens
ggtggaggatgcggtg

SEQ ID NO: 118318 - DNA, 16 bp, H. sapiens
ggtggaggcagaggag

SEQ ID NO: 118319 - DNA, 16 bp, H. sapiens
ggtggaggccagagat

SEQ ID NO: 118320 - DNA, 16 bp, H. sapiens
ggtggaggccagggat

SEQ ID NO: 118321 - DNA, 16 bp, H. sapiens
ggtggaggctgcagaa

SEQ ID NO: 118322 - DNA, 16 bp, H. sapiens
ggtggaggctgctgtg

SEQ ID NO: 118323 - DNA, 16 bp, H. sapiens
ggtggaggctgtggtg

SEQ ID NO: 118324 - DNA, 19 bp, H. sapiens
ggtggaggcttatccaaca

SEQ ID NO: 118325 - DNA, 16 bp, H. sapiens
ggtggaggtggcagtg

SEQ ID NO: 118326 - DNA, 16 bp, H. sapiens
ggtggaggttgcatga

SEQ ID NO: 118327 - DNA, 16 bp, H. sapiens
ggtggaggttgcgctg

SEQ ID NO: 118328 - DNA, 16 bp, H. sapiens
ggtggagtagtcagaa

SEQ ID NO: 118329 - DNA, 16 bp, H. sapiens
ggtggagtattctgta

SEQ ID NO: 118330 - DNA, 16 bp, H. sapiens
ggtggagtcctcatgg

SEQ ID NO: 118331 - DNA, 16 bp, H. sapiens
ggtggagtttgcagtg

SEQ ID NO: 118332 - DNA, 16 bp, H. sapiens
ggtggatcacaaggtt

SEQ ID NO: 118333 - DNA, 16 bp, H. sapiens
ggtggatcacctgaat

SEQ ID NO: 118334 - DNA, 17 bp, H. sapiens
ggtggatcacgaagtca

SEQ ID NO: 118335 - DNA, 19 bp, H. sapiens
ggtggatcacgaggtcagt

SEQ ID NO: 118336 - DNA, 16 bp, H. sapiens
ggtggatcacttgaaa

SEQ ID NO: 118337 - DNA, 16 bp, H. sapiens
ggtggatcagctgagg

SEQ ID NO: 118338 - DNA, 16 bp, H. sapiens
ggtggatcatccgagg

SEQ ID NO: 118339 - DNA, 16 bp, H. sapiens
ggtggatgaatggatg

SEQ ID NO: 118340 - DNA, 16 bp, H. sapiens
ggtggatggacagaca

SEQ ID NO: 118341 - DNA, 16 bp, H. sapiens
ggtggatggcctgagg

SEQ ID NO: 118342 - DNA, 16 bp, H. sapiens
ggtggatggggaggcc

SEQ ID NO: 118343 - DNA, 16 bp, H. sapiens
ggtggatgggtgcagc

SEQ ID NO: 118344 - DNA, 16 bp, H. sapiens
ggtggcacacacttgc

SEQ ID NO: 118345 - DNA, 16 bp, H. sapiens
ggtggcacgtgcctgg

SEQ ID NO: 118346 - DNA, 16 bp, H. sapiens
ggtggcactgcactcc

SEQ ID NO: 118347 - DNA, 16 bp, H. sapiens
ggtggcagacaagaaa

SEQ ID NO: 118348 - DNA, 16 bp, H. sapiens
ggtggcagagccagaa

SEQ ID NO: 118349 - DNA, 16 bp, H. sapiens
ggtggcagaggtggga

SEQ ID NO: 118350 - DNA, 16 bp, H. sapiens
ggtggcagcaagaagt

SEQ ID NO: 118351 - DNA, 16 bp, H. sapiens
ggtggcagcagcagca

SEQ ID NO: 118352 - DNA, 16 bp, H. sapiens
ggtggcagcagtgggc

SEQ ID NO: 118353 - DNA, 16 bp, H. sapiens
ggtggcagctgggcag

SEQ ID NO: 118354 - DNA, 16 bp, H. sapiens
ggtggcaggaagagaa

SEQ ID NO: 118355 - DNA, 16 bp, H. sapiens
ggtggcaggaatggag

SEQ ID NO: 118356 - DNA, 16 bp, H. sapiens
ggtggcaggagagaga

SEQ ID NO: 118357 - DNA, 16 bp, H. sapiens
ggtggcagggaggaga

SEQ ID NO: 118358 - DNA, 16 bp, H. sapiens
ggtggcaggggccaag

SEQ ID NO: 118359 - DNA, 16 bp, H. sapiens
ggtggcaggggcctgt

SEQ ID NO: 118360 - DNA, 16 bp, H. sapiens
ggtggcagtcttacac

SEQ ID NO: 118361 - DNA, 16 bp, H. sapiens
ggtggcagtggaggtg

SEQ ID NO: 118362 - DNA, 16 bp, H. sapiens
ggtggcatggggagca

SEQ ID NO: 118363 - DNA, 16 bp, H. sapiens
ggtggccaaggcaggt

SEQ ID NO: 118364 - DNA, 16 bp, H. sapiens
ggtggccagaggagca

SEQ ID NO: 118365 - DNA, 16 bp, H. sapiens
ggtggccaggggctgg

SEQ ID NO: 118366 - DNA, 16 bp, H. sapiens
ggtggcccacacctgt

SEQ ID NO: 118367 - DNA, 16 bp, H. sapiens
ggtggcccctgcctgt

SEQ ID NO: 118368 - DNA, 16 bp, H. sapiens
ggtggccctgggccag

SEQ ID NO: 118369 - DNA, 16 bp, H. sapiens
ggtggccgaggcaggt

SEQ ID NO: 118370 - DNA, 16 bp, H. sapiens
ggtggccgaggtgggc

SEQ ID NO: 118371 - DNA, 16 bp, H. sapiens
ggtggccgggcagagg

SEQ ID NO: 118372 - DNA, 20 bp, H. sapiens
ggtggccgggtgcagtggct

SEQ ID NO: 118373 - DNA, 16 bp, H. sapiens
ggtggcctcagatgga

SEQ ID NO: 118374 - DNA, 16 bp, H. sapiens
ggtggcctcaggaaac

SEQ ID NO: 118375 - DNA, 16 bp, H. sapiens
ggtggcggccgggcag

SEQ ID NO: 118376 - DNA, 16 bp, H. sapiens
ggtggcgggagcctgt

SEQ ID NO: 118377 - DNA, 16 bp, H. sapiens
ggtggctaaggtggga

SEQ ID NO: 118378 - DNA, 16 bp, H. sapiens
ggtggctcaagactgt

SEQ ID NO: 118379 - DNA, 16 bp, H. sapiens
ggtggctcaagtctgt

SEQ ID NO: 118380 - DNA, 16 bp, H. sapiens
ggtggctcacccctgt

SEQ ID NO: 118381 - DNA, 17 bp, H. sapiens
ggtggctcacgcctata

SEQ ID NO: 118382 - DNA, 21 bp, H. sapiens
ggtggctcacgcctgtcatcc

SEQ ID NO: 118383 - DNA, 17 bp, H. sapiens
ggtggctcatgcctata

SEQ ID NO: 118384 - DNA, 17 bp, H. sapiens
ggtggctcccacctgta

SEQ ID NO: 118385 - DNA, 19 bp, H. sapiens
ggtggctcgcacctgtaat

SEQ ID NO: 118386 - DNA, 16 bp, H. sapiens
ggtggctgaggcaggc

SEQ ID NO: 118387 - DNA, 16 bp, H. sapiens
ggtggctgaggcgggc

SEQ ID NO: 118388 - DNA, 16 bp, H. sapiens
ggtggctgaggctgga

SEQ ID NO: 118389 - DNA, 16 bp, H. sapiens
ggtggctgcagctgca

SEQ ID NO: 118390 - DNA, 16 bp, H. sapiens
ggtggctgcagtgagc

SEQ ID NO: 118391 - DNA, 16 bp, H. sapiens
ggtggctgccaccatg

SEQ ID NO: 118392 - DNA, 16 bp, H. sapiens
ggtggctgccaggagc

SEQ ID NO: 118393 - DNA, 16 bp, H. sapiens
ggtggctgccaggggc

SEQ ID NO: 118394 - DNA, 17 bp, H. sapiens
ggtggctggagccaaag

SEQ ID NO: 118395 - DNA, 16 bp, H. sapiens
ggtggctggctggctg

SEQ ID NO: 118396 - DNA, 16 bp, H. sapiens
ggtggctgggggagct

SEQ ID NO: 118397 - DNA, 16 bp, H. sapiens
ggtggcttccacctgt

SEQ ID NO: 118398 - DNA, 16 bp, H. sapiens
ggtggcttctagaagc

SEQ ID NO: 118399 - DNA, 16 bp, H. sapiens
ggtggcttctgaggag

SEQ ID NO: 118400 - DNA, 16 bp, H. sapiens
ggtggcttctgcctgt

SEQ ID NO: 118401 - DNA, 16 bp, H. sapiens
ggtggctttcactgtg

SEQ ID NO: 118402 - DNA, 16 bp, H. sapiens
ggtgggaaaactggct

SEQ ID NO: 118403 - DNA, 17 bp, H. sapiens
ggtgggaacccgggagg

SEQ ID NO: 118404 - DNA, 16 bp, H. sapiens
ggtgggaactggagtg

SEQ ID NO: 118405 - DNA, 16 bp, H. sapiens
ggtgggaactttgtct

SEQ ID NO: 118406 - DNA, 16 bp, H. sapiens
ggtgggaatgcagtgg

SEQ ID NO: 118407 - DNA, 16 bp, H. sapiens
ggtgggacaattgctt

SEQ ID NO: 118408 - DNA, 16 bp, H. sapiens
ggtgggagagaacaga

SEQ ID NO: 118409 - DNA, 16 bp, H. sapiens
ggtgggagccaccaca

SEQ ID NO: 118410 - DNA, 16 bp, H. sapiens
ggtgggaggaaccctt

SEQ ID NO: 118411 - DNA, 16 bp, H. sapiens
ggtgggaggaggcaga

SEQ ID NO: 118412 - DNA, 16 bp, H. sapiens
ggtgggaggatcagct

SEQ ID NO: 118413 - DNA, 16 bp, H. sapiens
ggtgggaggatggatt

SEQ ID NO: 118414 - DNA, 16 bp, H. sapiens
ggtgggaggattactg

SEQ ID NO: 118415 - DNA, 16 bp, H. sapiens
ggtgggaggatttctt

SEQ ID NO: 118416 - DNA, 16 bp, H. sapiens
ggtgggaggccaggag

SEQ ID NO: 118417 - DNA, 16 bp, H. sapiens
ggtgggagggacctgg

SEQ ID NO: 118418 - DNA, 24 bp, H. sapiens
ggtgggagtgacccgattttccag

SEQ ID NO: 118419 - DNA, 27 bp, H. sapiens
ggtgggagtgacccgattttccaggtg

SEQ ID NO: 118420 - DNA, 16 bp, H. sapiens
ggtgggagtgtctttt

SEQ ID NO: 118421 - DNA, 16 bp, H. sapiens
ggtgggattataggca

SEQ ID NO: 118422 - DNA, 16 bp, H. sapiens
ggtgggcacagctgga

SEQ ID NO: 118423 - DNA, 16 bp, H. sapiens
ggtgggcacagtggct

SEQ ID NO: 118424 - DNA, 16 bp, H. sapiens
ggtgggcacctgtggt

SEQ ID NO: 118425 - DNA, 16 bp, H. sapiens
ggtgggcagatcatgg

SEQ ID NO: 118426 - DNA, 16 bp, H. sapiens
ggtgggcaggcaggag

SEQ ID NO: 118427 - DNA, 16 bp, H. sapiens
ggtgggcatgtgagat

SEQ ID NO: 118428 - DNA, 16 bp, H. sapiens
ggtgggcgccaccatg

SEQ ID NO: 118429 - DNA, 16 bp, H. sapiens
ggtgggcggatcagga

SEQ ID NO: 118430 - DNA, 16 bp, H. sapiens
ggtgggctccgcccag

SEQ ID NO: 118431 - DNA, 16 bp, H. sapiens
ggtgggctcctcccag

SEQ ID NO: 118432 - DNA, 16 bp, H. sapiens
ggtgggctgaggcagg

SEQ ID NO: 118433 - DNA, 16 bp, H. sapiens
ggtgggctggaggctg

SEQ ID NO: 118434 - DNA, 16 bp, H. sapiens
ggtgggctgggcccag

SEQ ID NO: 118435 - DNA, 16 bp, H. sapiens
ggtgggcttcacccag

SEQ ID NO: 118436 - DNA, 16 bp, H. sapiens
ggtggggaaactgagt

SEQ ID NO: 118437 - DNA, 16 bp, H. sapiens
ggtggggaaggcagag

SEQ ID NO: 118438 - DNA, 16 bp, H. sapiens
ggtggggacagaggag

SEQ ID NO: 118439 - DNA, 16 bp, H. sapiens
ggtggggacgcagagc

SEQ ID NO: 118440 - DNA, 16 bp, H. sapiens
ggtggggagactgagg

SEQ ID NO: 118441 - DNA, 16 bp, H. sapiens
ggtggggagcagggcc

SEQ ID NO: 118442 - DNA, 16 bp, H. sapiens
ggtggggagggcagca

SEQ ID NO: 118443 - DNA, 16 bp, H. sapiens
ggtggggcagaggttg

SEQ ID NO: 118444 - DNA, 16 bp, H. sapiens
ggtggggcaggcagag

SEQ ID NO: 118445 - DNA, 16 bp, H. sapiens
ggtggggccagataag

SEQ ID NO: 118446 - DNA, 16 bp, H. sapiens
ggtggggcctaatgag

SEQ ID NO: 118447 - DNA, 16 bp, H. sapiens
ggtggggcctgagaat

SEQ ID NO: 118448 - DNA, 16 bp, H. sapiens
ggtggggcctggcagg

SEQ ID NO: 118449 - DNA, 16 bp, H. sapiens
ggtggggctttgggga

SEQ ID NO: 118450 - DNA, 16 bp, H. sapiens
ggtgggggcaaaaagc

SEQ ID NO: 118451 - DNA, 16 bp, H. sapiens
ggtgggggctgtcctg

SEQ ID NO: 118452 - DNA, 16 bp, H. sapiens
ggtgggggggcacctg

SEQ ID NO: 118453 - DNA, 16 bp, H. sapiens
ggtggggtcttggaga

SEQ ID NO: 118454 - DNA, 16 bp, H. sapiens
ggtggggtggctcagg

SEQ ID NO: 118455 - DNA, 16 bp, H. sapiens
ggtgggtgcctgtgat

SEQ ID NO: 118456 - DNA, 16 bp, H. sapiens
ggtgggtggctcacac

SEQ ID NO: 118457 - DNA, 16 bp, H. sapiens
ggtgggttcgtggtct

SEQ ID NO: 118458 - DNA, 16 bp, H. sapiens
ggtgggttcttggtct

SEQ ID NO: 118459 - DNA, 16 bp, H. sapiens
ggtgggtttttcccat

SEQ ID NO: 118460 - DNA, 16 bp, H. sapiens
ggtggtagtgatgatg

SEQ ID NO: 118461 - DNA, 16 bp, H. sapiens
ggtggtcagggaaggc

SEQ ID NO: 118462 - DNA, 16 bp, H. sapiens
ggtggtcagggtgcag

SEQ ID NO: 118463 - DNA, 16 bp, H. sapiens
ggtggtcatggtggtg

SEQ ID NO: 118464 - DNA, 16 bp, H. sapiens
ggtggtctccaactcc

SEQ ID NO: 118465 - DNA, 16 bp, H. sapiens
ggtggtctgtgcttct

SEQ ID NO: 118466 - DNA, 16 bp, H. sapiens
ggtggtgacagtgatg

SEQ ID NO: 118467 - DNA, 16 bp, H. sapiens
ggtggtgataatgatg

SEQ ID NO: 118468 - DNA, 16 bp, H. sapiens
ggtggtgatagtgatg

SEQ ID NO: 118469 - DNA, 16 bp, H. sapiens
ggtggtgcacgactgt

SEQ ID NO: 118470 - DNA, 16 bp, H. sapiens
ggtggtgcccacccag

SEQ ID NO: 118471 - DNA, 16 bp, H. sapiens
ggtggtgctgctgctg

SEQ ID NO: 118472 - DNA, 16 bp, H. sapiens
ggtggtgctggaggtg

SEQ ID NO: 118473 - DNA, 17 bp, H. sapiens
ggtggtgctggaggtgg

SEQ ID NO: 118474 - DNA, 16 bp, H. sapiens
ggtggtggaagctaca

SEQ ID NO: 118475 - DNA, 16 bp, H. sapiens
ggtggtggagcagagt

SEQ ID NO: 118476 - DNA, 16 bp, H. sapiens
ggtggtggaggctgca

SEQ ID NO: 118477 - DNA, 16 bp, H. sapiens
ggtggtggcagcaggg

SEQ ID NO: 118478 - DNA, 16 bp, H. sapiens
ggtggtggcagcagtg

SEQ ID NO: 118479 - DNA, 16 bp, H. sapiens
ggtggtggcaggcacc

SEQ ID NO: 118480 - DNA, 16 bp, H. sapiens
ggtggtggcagtgatg

SEQ ID NO: 118481 - DNA, 16 bp, H. sapiens
ggtggtggcagtggag

SEQ ID NO: 118482 - DNA, 16 bp, H. sapiens
ggtggtggccaggggc

SEQ ID NO: 118483 - DNA, 16 bp, H. sapiens
ggtggtggcgatggtg

SEQ ID NO: 118484 - DNA, 16 bp, H. sapiens
ggtggtggcgtgcacc

SEQ ID NO: 118485 - DNA, 16 bp, H. sapiens
ggtggtggctcatacc

SEQ ID NO: 118486 - DNA, 17 bp, H. sapiens
ggtggtggctcatgcct

SEQ ID NO: 118487 - DNA, 16 bp, H. sapiens
ggtggtggctgcagtg

SEQ ID NO: 118488 - DNA, 16 bp, H. sapiens
ggtggtggctgggcag

SEQ ID NO: 118489 - DNA, 16 bp, H. sapiens
ggtggtgggaacctgt

SEQ ID NO: 118490 - DNA, 16 bp, H. sapiens
ggtggtgggcagggcc

SEQ ID NO: 118491 - DNA, 16 bp, H. sapiens
ggtggtgggctggatt

SEQ ID NO: 118492 - DNA, 16 bp, H. sapiens
ggtggtggtcatggtg

SEQ ID NO: 118493 - DNA, 16 bp, H. sapiens
ggtggtggtgacagtg

SEQ ID NO: 118494 - DNA, 16 bp, H. sapiens
ggtggtggtgacggtg

SEQ ID NO: 118495 - DNA, 16 bp, H. sapiens
ggtggtggtgatgatt

SEQ ID NO: 118496 - DNA, 16 bp, H. sapiens
ggtggtggtggtgaca

SEQ ID NO: 118497 - DNA, 16 bp, H. sapiens
ggtggtggtggttata

SEQ ID NO: 118498 - DNA, 16 bp, H. sapiens
ggtggtggtgtgcacc

SEQ ID NO: 118499 - DNA, 16 bp, H. sapiens
ggtggtgtcagatgga

SEQ ID NO: 118500 - DNA, 16 bp, H. sapiens
ggtggtgtgcacctac

SEQ ID NO: 118501 - DNA, 16 bp, H. sapiens
ggtggtgtgtacctgc

SEQ ID NO: 118502 - DNA, 16 bp, H. sapiens
ggtggtgtgtgcctgt

SEQ ID NO: 118503 - DNA, 19 bp, H. sapiens
ggtggttcacacctgtaat

SEQ ID NO: 118504 - DNA, 16 bp, H. sapiens
ggtggttcacagctgt

SEQ ID NO: 118505 - DNA, 16 bp, H. sapiens
ggtggttcacgcctct

SEQ ID NO: 118506 - DNA, 23 bp, H. sapiens
ggtggttcatgcctgtaatccca

SEQ ID NO: 118507 - DNA, 16 bp, H. sapiens
ggtggttcatgtctgt

SEQ ID NO: 118508 - DNA, 16 bp, H. sapiens
ggtggttccttaaaaa

SEQ ID NO: 118509 - DNA, 16 bp, H. sapiens
ggtggttctggctcag

SEQ ID NO: 118510 - DNA, 16 bp, H. sapiens
ggtggttgaggcagga

SEQ ID NO: 118511 - DNA, 16 bp, H. sapiens
ggtggttgccaagggc

SEQ ID NO: 118512 - DNA, 16 bp, H. sapiens
ggtggttgccaggggc

SEQ ID NO: 118513 - DNA, 16 bp, H. sapiens
ggtggttggatcatga

SEQ ID NO: 118514 - DNA, 16 bp, H. sapiens
ggtggttggggcacag

SEQ ID NO: 118515 - DNA, 16 bp, H. sapiens
ggtgtaaaagcattcc

SEQ ID NO: 118516 - DNA, 16 bp, H. sapiens
ggtgtaaacctgggag

SEQ ID NO: 118517 - DNA, 16 bp, H. sapiens
ggtgtaaagaaatgct

SEQ ID NO: 118518 - DNA, 16 bp, H. sapiens
ggtgtacattctatgg

SEQ ID NO: 118519 - DNA, 16 bp, H. sapiens
ggtgtagtgatgcatg

SEQ ID NO: 118520 - DNA, 16 bp, H. sapiens
ggtgtagtggcaggca

SEQ ID NO: 118521 - DNA, 16 bp, H. sapiens
ggtgtatacatttatg

SEQ ID NO: 118522 - DNA, 16 bp, H. sapiens
ggtgtatatatttttg

SEQ ID NO: 118523 - DNA, 16 bp, H. sapiens
ggtgtatgtgtgcagg

SEQ ID NO: 118524 - DNA, 16 bp, H. sapiens
ggtgtatgtttaactt

SEQ ID NO: 118525 - DNA, 16 bp, H. sapiens
ggtgtcagcatggttg

SEQ ID NO: 118526 - DNA, 16 bp, H. sapiens
ggtgtcagtgattgaa

SEQ ID NO: 118527 - DNA, 16 bp, H. sapiens
ggtgtccaaccttttg

SEQ ID NO: 118528 - DNA, 16 bp, H. sapiens
ggtgtccagtgtgagg

SEQ ID NO: 118529 - DNA, 16 bp, H. sapiens
ggtgtccgccaccatg

SEQ ID NO: 118530 - DNA, 16 bp, H. sapiens
ggtgtcctttctccac

SEQ ID NO: 118531 - DNA, 16 bp, H. sapiens
ggtgtctcacacaggg

SEQ ID NO: 118532 - DNA, 16 bp, H. sapiens
ggtgtctcaggcctgt

SEQ ID NO: 118533 - DNA, 16 bp, H. sapiens
ggtgtctctctctctc

SEQ ID NO: 118534 - DNA, 16 bp, H. sapiens
ggtgtctctgtgtgtg

SEQ ID NO: 118535 - DNA, 16 bp, H. sapiens
ggtgtctcttcctctt

SEQ ID NO: 118536 - DNA, 16 bp, H. sapiens
ggtgtgaaatggtatc

SEQ ID NO: 118537 - DNA, 16 bp, H. sapiens
ggtgtgaaccactgta

SEQ ID NO: 118538 - DNA, 17 bp, H. sapiens
ggtgtgaacccaggagg

SEQ ID NO: 118539 - DNA, 16 bp, H. sapiens
ggtgtgaacccggaag

SEQ ID NO: 118540 - DNA, 17 bp, H. sapiens
ggtgtgaacccgggagg

SEQ ID NO: 118541 - DNA, 16 bp, H. sapiens
ggtgtgaatcaccaca

SEQ ID NO: 118542 - DNA, 16 bp, H. sapiens
ggtgtgagagaaagag

SEQ ID NO: 118543 - DNA, 16 bp, H. sapiens
ggtgtgagccaccacc

SEQ ID NO: 118544 - DNA, 16 bp, H. sapiens
ggtgtgagccatcaca

SEQ ID NO: 118545 - DNA, 16 bp, H. sapiens
ggtgtgagccatcgta

SEQ ID NO: 118546 - DNA, 16 bp, H. sapiens
ggtgtgaggtagaggt

SEQ ID NO: 118547 - DNA, 16 bp, H. sapiens
ggtgtgagtgcatgtg

SEQ ID NO: 118548 - DNA, 16 bp, H. sapiens
ggtgtgatggcacaca

SEQ ID NO: 118549 - DNA, 16 bp, H. sapiens
ggtgtgcaatggtgtg

SEQ ID NO: 118550 - DNA, 16 bp, H. sapiens
ggtgtgcacctgtgat

SEQ ID NO: 118551 - DNA, 16 bp, H. sapiens
ggtgtgcactgccacg

SEQ ID NO: 118552 - DNA, 16 bp, H. sapiens
ggtgtgcagaagcttt

SEQ ID NO: 118553 - DNA, 16 bp, H. sapiens
ggtgtgcagtggcatg

SEQ ID NO: 118554 - DNA, 16 bp, H. sapiens
ggtgtgcatggtgtgt

SEQ ID NO: 118555 - DNA, 16 bp, H. sapiens
ggtgtgctgagtgccg

SEQ ID NO: 118556 - DNA, 16 bp, H. sapiens
ggtgtgctgcactcat

SEQ ID NO: 118557 - DNA, 16 bp, H. sapiens
ggtgtgctttcctctg

SEQ ID NO: 118558 - DNA, 16 bp, H. sapiens
ggtgtggaaagttggg

SEQ ID NO: 118559 - DNA, 16 bp, H. sapiens
ggtgtggatgtggaga

SEQ ID NO: 118560 - DNA, 16 bp, H. sapiens
ggtgtggcagtgggtg

SEQ ID NO: 118561 - DNA, 29 bp, H. sapiens
ggtgtggcgattcctcagggatctagaac

SEQ ID NO: 118562 - DNA, 16 bp, H. sapiens
ggtgtggcttagctgg

SEQ ID NO: 118563 - DNA, 16 bp, H. sapiens
ggtgtggtgacacatg

SEQ ID NO: 118564 - DNA, 16 bp, H. sapiens
ggtgtggtgacatatg

SEQ ID NO: 118565 - DNA, 16 bp, H. sapiens
ggtgtggtgacgtgtg

SEQ ID NO: 118566 - DNA, 16 bp, H. sapiens
ggtgtggtggcagcca

SEQ ID NO: 118567 - DNA, 16 bp, H. sapiens
ggtgtggtggccagtg

SEQ ID NO: 118568 - DNA, 16 bp, H. sapiens
ggtgtggtggtgcagg

SEQ ID NO: 118569 - DNA, 16 bp, H. sapiens
ggtgtggtgtctatta

SEQ ID NO: 118570 - DNA, 16 bp, H. sapiens
ggtgtggtgtgcacct

SEQ ID NO: 118571 - DNA, 16 bp, H. sapiens
ggtgtgtattttatac

SEQ ID NO: 118572 - DNA, 16 bp, H. sapiens
ggtgtgtgaaccagag

SEQ ID NO: 118573 - DNA, 16 bp, H. sapiens
ggtgtgtgccaccatt

SEQ ID NO: 118574 - DNA, 16 bp, H. sapiens
ggtgtgtgccactaca

SEQ ID NO: 118575 - DNA, 16 bp, H. sapiens
ggtgtgtggcaccacg

SEQ ID NO: 118576 - DNA, 16 bp, H. sapiens
ggtgtgttcctggtgg

SEQ ID NO: 118577 - DNA, 16 bp, H. sapiens
ggtgttaggtaagggt

SEQ ID NO: 118578 - DNA, 16 bp, H. sapiens
ggtgttcagccactgc

SEQ ID NO: 118579 - DNA, 16 bp, H. sapiens
ggtgttctgggctcag

SEQ ID NO: 118580 - DNA, 16 bp, H. sapiens
ggtgttgcagaagaaa

SEQ ID NO: 118581 - DNA, 16 bp, H. sapiens
ggtgttgcctcacccg

SEQ ID NO: 118582 - DNA, 16 bp, H. sapiens
ggtgttgctgatgctg

SEQ ID NO: 118583 - DNA, 16 bp, H. sapiens
ggtgttgcttcaccag

SEQ ID NO: 118584 - DNA, 16 bp, H. sapiens
ggtgttggcagggctg

SEQ ID NO: 118585 - DNA, 16 bp, H. sapiens
ggtgttgggaaaactg

SEQ ID NO: 118586 - DNA, 16 bp, H. sapiens
ggtgtttctggatgaa

SEQ ID NO: 118587 - DNA, 16 bp, H. sapiens
ggtgtttgccttattt

SEQ ID NO: 118588 - DNA, 16 bp, H. sapiens
ggtgttttctaaatat

SEQ ID NO: 118589 - DNA, 16 bp, H. sapiens
ggtgttttctgtattt

SEQ ID NO: 118590 - DNA, 16 bp, H. sapiens
ggttaaaaaaaatttt

SEQ ID NO: 118591 - DNA, 16 bp, H. sapiens
ggttaaataacttgtc

SEQ ID NO: 118592 - DNA, 16 bp, H. sapiens
ggttaaataatgaaat

SEQ ID NO: 118593 - DNA, 16 bp, H. sapiens
ggttaaatttgaattt

SEQ ID NO: 118594 - DNA, 16 bp, H. sapiens
ggttaagtaacttgct

SEQ ID NO: 118595 - DNA, 16 bp, H. sapiens
ggttaatgggtacaaa

SEQ ID NO: 118596 - DNA, 16 bp, H. sapiens
ggttaatgtttgtatt

SEQ ID NO: 118597 - DNA, 16 bp, H. sapiens
ggttaattgactcaca

SEQ ID NO: 118598 - DNA, 16 bp, H. sapiens
ggttaatttccaaaat

SEQ ID NO: 118599 - DNA, 16 bp, H. sapiens
ggttaatttctgtatt

SEQ ID NO: 118600 - DNA, 16 bp, H. sapiens
ggttacagtcccacca

SEQ ID NO: 118601 - DNA, 16 bp, H. sapiens
ggttacctgtgcttgt

SEQ ID NO: 118602 - DNA, 16 bp, H. sapiens
ggttactgtgaagatt

SEQ ID NO: 118603 - DNA, 16 bp, H. sapiens
ggttagaggatcactt

SEQ ID NO: 118604 - DNA, 16 bp, H. sapiens
ggttaggaaagggaaa

SEQ ID NO: 118605 - DNA, 17 bp, H. sapiens
ggttaggaagaatcaat

SEQ ID NO: 118606 - DNA, 16 bp, H. sapiens
ggttaggattttaaca

SEQ ID NO: 118607 - DNA, 16 bp, H. sapiens
ggttagttttgggaag

SEQ ID NO: 118608 - DNA, 16 bp, H. sapiens
ggttatacatttaagt

SEQ ID NO: 118609 - DNA, 16 bp, H. sapiens
ggttatctatttcttc

SEQ ID NO: 118610 - DNA, 16 bp, H. sapiens
ggttattcaggctctt

SEQ ID NO: 118611 - DNA, 16 bp, H. sapiens
ggttatttccagtttt

SEQ ID NO: 118612 - DNA, 16 bp, H. sapiens
ggttcaaaatacacaa

SEQ ID NO: 118613 - DNA, 16 bp, H. sapiens
ggttcaaacgattctc

SEQ ID NO: 118614 - DNA, 16 bp, H. sapiens
ggttcaaatcccaact

SEQ ID NO: 118615 - DNA, 16 bp, H. sapiens
ggttcaaattctagct

SEQ ID NO: 118616 - DNA, 16 bp, H. sapiens
ggttcaactttgtgag

SEQ ID NO: 118617 - DNA, 25 bp, H. sapiens
ggttcaagaactcccccaccatctt

SEQ ID NO: 118618 - DNA, 16 bp, H. sapiens
ggttcaagaccaccct

SEQ ID NO: 118619 - DNA, 16 bp, H. sapiens
ggttcaagcaattctg

SEQ ID NO: 118620 - DNA, 16 bp, H. sapiens
ggttcaagcagttctt

SEQ ID NO: 118621 - DNA, 16 bp, H. sapiens
ggttcaagccattctt

SEQ ID NO: 118622 - DNA, 19 bp, H. sapiens
ggttcaagcgattctcctc

SEQ ID NO: 118623 - DNA, 16 bp, H. sapiens
ggttcaagtctcagct

SEQ ID NO: 118624 - DNA, 16 bp, H. sapiens
ggttcaagtgagtctc

SEQ ID NO: 118625 - DNA, 16 bp, H. sapiens
ggttcaagtgatactt

SEQ ID NO: 118626 - DNA, 18 bp, H. sapiens
ggttcacaccattctcct

SEQ ID NO: 118627 - DNA, 16 bp, H. sapiens
ggttcacacctgtact

SEQ ID NO: 118628 - DNA, 16 bp, H. sapiens
ggttcacatttgtaat

SEQ ID NO: 118629 - DNA, 16 bp, H. sapiens
ggttcacccatgttgt

SEQ ID NO: 118630 - DNA, 19 bp, H. sapiens
ggttcaccccattctcctg

SEQ ID NO: 118631 - DNA, 16 bp, H. sapiens
ggttcacgccatcctc

SEQ ID NO: 118632 - DNA, 20 bp, H. sapiens
ggttcacgccattctcctga

SEQ ID NO: 118633 - DNA, 16 bp, H. sapiens
ggttcactgcaacctc

SEQ ID NO: 118634 - DNA, 16 bp, H. sapiens
ggttcactgccacctc

SEQ ID NO: 118635 - DNA, 16 bp, H. sapiens
ggttcaggagtttgag

SEQ ID NO: 118636 - DNA, 16 bp, H. sapiens
ggttcaggatgcattc

SEQ ID NO: 118637 - DNA, 16 bp, H. sapiens
ggttcaggatgcattt

SEQ ID NO: 118638 - DNA, 16 bp, H. sapiens
ggttcaggcaattctc

SEQ ID NO: 118639 - DNA, 16 bp, H. sapiens
ggttcaggctgcagtg

SEQ ID NO: 118640 - DNA, 16 bp, H. sapiens
ggttcatatatatata

SEQ ID NO: 118641 - DNA, 16 bp, H. sapiens
ggttcatctatgttgc

SEQ ID NO: 118642 - DNA, 33 bp, H. sapiens
ggttcatctcactagggagtgccagacagtggg

SEQ ID NO: 118643 - DNA, 26 bp, H. sapiens
ggttcatgccattctcctgcctcagc

SEQ ID NO: 118644 - DNA, 16 bp, H. sapiens
ggttccaatttatcca

SEQ ID NO: 118645 - DNA, 16 bp, H. sapiens
ggttccagaccagcct

SEQ ID NO: 118646 - DNA, 16 bp, H. sapiens
ggttccagcaattctc

SEQ ID NO: 118647 - DNA, 16 bp, H. sapiens
ggttccagctactcaa

SEQ ID NO: 118648 - DNA, 16 bp, H. sapiens
ggttccaggcagaggg

SEQ ID NO: 118649 - DNA, 16 bp, H. sapiens
ggttccagggattaag

SEQ ID NO: 118650 - DNA, 16 bp, H. sapiens
ggttcccaggcccacc

SEQ ID NO: 118651 - DNA, 16 bp, H. sapiens
ggttcccttctggccc

SEQ ID NO: 118652 - DNA, 16 bp, H. sapiens
ggttcctcaaacaatt

SEQ ID NO: 118653 - DNA, 16 bp, H. sapiens
ggttcctcagaaaatt

SEQ ID NO: 118654 - DNA, 16 bp, H. sapiens
ggttcctcattactta

SEQ ID NO: 118655 - DNA, 16 bp, H. sapiens
ggttcctgccagtggg

SEQ ID NO: 118656 - DNA, 16 bp, H. sapiens
ggttcctgggcctgtt

SEQ ID NO: 118657 - DNA, 16 bp, H. sapiens
ggttcgagaccaacct

SEQ ID NO: 118658 - DNA, 16 bp, H. sapiens
ggttctcaggcctttg

SEQ ID NO: 118659 - DNA, 16 bp, H. sapiens
ggttctctattatgtt

SEQ ID NO: 118660 - DNA, 16 bp, H. sapiens
ggttctctgcatttct

SEQ ID NO: 118661 - DNA, 16 bp, H. sapiens
ggttctgtgtatgtga

SEQ ID NO: 118662 - DNA, 16 bp, H. sapiens
ggttctgttcattttt

SEQ ID NO: 118663 - DNA, 16 bp, H. sapiens
ggttctgtttatatga

SEQ ID NO: 118664 - DNA, 16 bp, H. sapiens
ggttctttctattttc

SEQ ID NO: 118665 - DNA, 16 bp, H. sapiens
ggttgaaactttcagc

SEQ ID NO: 118666 - DNA, 16 bp, H. sapiens
ggttgaaagagttatt

SEQ ID NO: 118667 - DNA, 16 bp, H. sapiens
ggttgaaatgaaagaa

SEQ ID NO: 118668 - DNA, 16 bp, H. sapiens
ggttgaacagtgtccc

SEQ ID NO: 118669 - DNA, 16 bp, H. sapiens
ggttgaacccgggagg

SEQ ID NO: 118670 - DNA, 16 bp, H. sapiens
ggttgactctatgtct

SEQ ID NO: 118671 - DNA, 16 bp, H. sapiens
ggttgaggaccactgc

SEQ ID NO: 118672 - DNA, 16 bp, H. sapiens
ggttgaggaggcctca

SEQ ID NO: 118673 - DNA, 16 bp, H. sapiens
ggttgaggcaagtgga

SEQ ID NO: 118674 - DNA, 16 bp, H. sapiens
ggttgaggctggagaa

SEQ ID NO: 118675 - DNA, 16 bp, H. sapiens
ggttgcaatgggctga

SEQ ID NO: 118676 - DNA, 16 bp, H. sapiens
ggttgcagcagagaaa

SEQ ID NO: 118677 - DNA, 16 bp, H. sapiens
ggttgcaggtgtgtgg

SEQ ID NO: 118678 - DNA, 21 bp, H. sapiens
ggttgcagtgagccgagatcc

SEQ ID NO: 118679 - DNA, 16 bp, H. sapiens
ggttgcattattttga

SEQ ID NO: 118680 - DNA, 16 bp, H. sapiens
ggttgccagaagctgg

SEQ ID NO: 118681 - DNA, 16 bp, H. sapiens
ggttgccaggcagagg

SEQ ID NO: 118682 - DNA, 18 bp, H. sapiens
ggttgccaggcagagggt

SEQ ID NO: 118683 - DNA, 16 bp, H. sapiens
ggttgcccaggctagt

SEQ ID NO: 118684 - DNA, 16 bp, H. sapiens
ggttgcctaggactgg

SEQ ID NO: 118685 - DNA, 16 bp, H. sapiens
ggttgccttttcattt

SEQ ID NO: 118686 - DNA, 16 bp, H. sapiens
ggttgctgtaaggatt

SEQ ID NO: 118687 - DNA, 16 bp, H. sapiens
ggttggaaagtaagcc

SEQ ID NO: 118688 - DNA, 16 bp, H. sapiens
ggttggaaagtccaag

SEQ ID NO: 118689 - DNA, 16 bp, H. sapiens
ggttggaagaattaat

SEQ ID NO: 118690 - DNA, 16 bp, H. sapiens
ggttggacaagcttgc

SEQ ID NO: 118691 - DNA, 16 bp, H. sapiens
ggttggagaccagcct

SEQ ID NO: 118692 - DNA, 16 bp, H. sapiens
ggttggagccaccaca

SEQ ID NO: 118693 - DNA, 16 bp, H. sapiens
ggttggagggctggcc

SEQ ID NO: 118694 - DNA, 16 bp, H. sapiens
ggttggagtgcaatgg

SEQ ID NO: 118695 - DNA, 16 bp, H. sapiens
ggttggggaagtcctc

SEQ ID NO: 118696 - DNA, 16 bp, H. sapiens
ggttggggaggttctc

SEQ ID NO: 118697 - DNA, 16 bp, H. sapiens
ggttgggtgcagtggc

SEQ ID NO: 118698 - DNA, 16 bp, H. sapiens
ggttggtcaccagaaa

SEQ ID NO: 118699 - DNA, 16 bp, H. sapiens
ggttggtgaacacatc

SEQ ID NO: 118700 - DNA, 16 bp, H. sapiens
ggttggtgcaaaaata

SEQ ID NO: 118701 - DNA, 16 bp, H. sapiens
ggttggtgcagaagta

SEQ ID NO: 118702 - DNA, 16 bp, H. sapiens
ggttggtgccaagtct

SEQ ID NO: 118703 - DNA, 16 bp, H. sapiens
ggttgtctcttcactt

SEQ ID NO: 118704 - DNA, 16 bp, H. sapiens
ggttgtcttagaaacc

SEQ ID NO: 118705 - DNA, 16 bp, H. sapiens
ggttgtggtgagccta

SEQ ID NO: 118706 - DNA, 16 bp, H. sapiens
ggttgttgggaggatt

SEQ ID NO: 118707 - DNA, 16 bp, H. sapiens
ggttgttgtgaggact

SEQ ID NO: 118708 - DNA, 16 bp, H. sapiens
ggttgtttccactttg

SEQ ID NO: 118709 - DNA, 16 bp, H. sapiens
ggttgtttctactttt

SEQ ID NO: 118710 - DNA, 16 bp, H. sapiens
ggtttaagtgattctc

SEQ ID NO: 118711 - DNA, 16 bp, H. sapiens
ggtttaatgaaaatag

SEQ ID NO: 118712 - DNA, 16 bp, H. sapiens
ggtttacaaatatttt

SEQ ID NO: 118713 - DNA, 16 bp, H. sapiens
ggtttactgcaacctc

SEQ ID NO: 118714 - DNA, 16 bp, H. sapiens
ggtttataaaactgct

SEQ ID NO: 118715 - DNA, 16 bp, H. sapiens
ggtttatctctgtgag

SEQ ID NO: 118716 - DNA, 16 bp, H. sapiens
ggtttatgcagaaatt

SEQ ID NO: 118717 - DNA, 16 bp, H. sapiens
ggtttatttctcactc

SEQ ID NO: 118718 - DNA, 16 bp, H. sapiens
ggtttattttgccaag

SEQ ID NO: 118719 - DNA, 16 bp, H. sapiens
ggtttcaaacccctga

SEQ ID NO: 118720 - DNA, 16 bp, H. sapiens
ggtttcaaagaacttg

SEQ ID NO: 118721 - DNA, 16 bp, H. sapiens
ggtttcacattgttgg

SEQ ID NO: 118722 - DNA, 16 bp, H. sapiens
ggtttcaccatcttga

SEQ ID NO: 118723 - DNA, 16 bp, H. sapiens
ggtttcaccatgtcaa

SEQ ID NO: 118724 - DNA, 16 bp, H. sapiens
ggtttcagctcactgc

SEQ ID NO: 118725 - DNA, 16 bp, H. sapiens
ggtttcagttacctgc

SEQ ID NO: 118726 - DNA, 16 bp, H. sapiens
ggtttcatcatgttgc

SEQ ID NO: 118727 - DNA, 16 bp, H. sapiens
ggtttcattggctcat

SEQ ID NO: 118728 - DNA, 16 bp, H. sapiens
ggtttcatttgctctt

SEQ ID NO: 118729 - DNA, 16 bp, H. sapiens
ggtttccagaggaagg

SEQ ID NO: 118730 - DNA, 16 bp, H. sapiens
ggtttccccatactgt

SEQ ID NO: 118731 - DNA, 16 bp, H. sapiens
ggtttcctcatctgta

SEQ ID NO: 118732 - DNA, 16 bp, H. sapiens
ggtttcctgggccagg

SEQ ID NO: 118733 - DNA, 18 bp, H. sapiens
ggtttcgccatgttggcc

SEQ ID NO: 118734 - DNA, 16 bp, H. sapiens
ggtttcgccatgttgt

SEQ ID NO: 118735 - DNA, 18 bp, H. sapiens
ggtttcgctgtgttagcc

SEQ ID NO: 118736 - DNA, 16 bp, H. sapiens
ggtttctaatttaatt

SEQ ID NO: 118737 - DNA, 16 bp, H. sapiens
ggtttctcaacctcag

SEQ ID NO: 118738 - DNA, 16 bp, H. sapiens
ggtttctcagataact

SEQ ID NO: 118739 - DNA, 16 bp, H. sapiens
ggtttctccaggttgg

SEQ ID NO: 118740 - DNA, 16 bp, H. sapiens
ggtttctccccactga

SEQ ID NO: 118741 - DNA, 16 bp, H. sapiens
ggtttctctctctctc

SEQ ID NO: 118742 - DNA, 16 bp, H. sapiens
ggtttctgataaaagg

SEQ ID NO: 118743 - DNA, 16 bp, H. sapiens
ggtttctgcagagaga

SEQ ID NO: 118744 - DNA, 16 bp, H. sapiens
ggtttctggcctgagc

SEQ ID NO: 118745 - DNA, 16 bp, H. sapiens
ggtttctggggaggcc

SEQ ID NO: 118746 - DNA, 16 bp, H. sapiens
ggtttctttctgaggt

SEQ ID NO: 118747 - DNA, 16 bp, H. sapiens
ggtttctttttgaagt

SEQ ID NO: 118748 - DNA, 16 bp, H. sapiens
ggtttgaagatggagg

SEQ ID NO: 118749 - DNA, 16 bp, H. sapiens
ggtttgaatccaggct

SEQ ID NO: 118750 - DNA, 16 bp, H. sapiens
ggtttgaatcttgact

SEQ ID NO: 118751 - DNA, 16 bp, H. sapiens
ggtttgaatgccagct

SEQ ID NO: 118752 - DNA, 16 bp, H. sapiens
ggtttgaattctggct

SEQ ID NO: 118753 - DNA, 16 bp, H. sapiens
ggtttgacaccagcct

SEQ ID NO: 118754 - DNA, 16 bp, H. sapiens
ggtttgactatgtccc

SEQ ID NO: 118755 - DNA, 16 bp, H. sapiens
ggtttgagaacagcct

SEQ ID NO: 118756 - DNA, 16 bp, H. sapiens
ggtttgagaagttctc

SEQ ID NO: 118757 - DNA, 16 bp, H. sapiens
ggtttgagggccagat

SEQ ID NO: 118758 - DNA, 16 bp, H. sapiens
ggtttgaggtcttaga

SEQ ID NO: 118759 - DNA, 16 bp, H. sapiens
ggtttgcatttcttct

SEQ ID NO: 118760 - DNA, 16 bp, H. sapiens
ggtttgcatttgaaaa

SEQ ID NO: 118761 - DNA, 16 bp, H. sapiens
ggtttgcgctcctgtg

SEQ ID NO: 118762 - DNA, 16 bp, H. sapiens
ggtttgctgcaacctc

SEQ ID NO: 118763 - DNA, 16 bp, H. sapiens
ggtttggagtacaaat

SEQ ID NO: 118764 - DNA, 16 bp, H. sapiens
ggtttggcccagaaag

SEQ ID NO: 118765 - DNA, 16 bp, H. sapiens
ggtttggctatgttgc

SEQ ID NO: 118766 - DNA, 16 bp, H. sapiens
ggtttggctctctgtc

SEQ ID NO: 118767 - DNA, 16 bp, H. sapiens
ggtttggctgtatccc

SEQ ID NO: 118768 - DNA, 16 bp, H. sapiens
ggtttggggacccctg

SEQ ID NO: 118769 - DNA, 16 bp, H. sapiens
ggtttggggtacagat

SEQ ID NO: 118770 - DNA, 16 bp, H. sapiens
ggtttggggttttaca

SEQ ID NO: 118771 - DNA, 16 bp, H. sapiens
ggtttgtgccaccaca

SEQ ID NO: 118772 - DNA, 16 bp, H. sapiens
ggtttgtggaagatca

SEQ ID NO: 118773 - DNA, 17 bp, H. sapiens
ggtttgtggatgcacca

SEQ ID NO: 118774 - DNA, 16 bp, H. sapiens
ggtttgtttgccagct

SEQ ID NO: 118775 - DNA, 16 bp, H. sapiens
ggttttaaaaaaattt

SEQ ID NO: 118776 - DNA, 16 bp, H. sapiens
ggttttaaaaagagga

SEQ ID NO: 118777 - DNA, 16 bp, H. sapiens
ggttttaaaaataatt

SEQ ID NO: 118778 - DNA, 16 bp, H. sapiens
ggttttaaaatatgtc

SEQ ID NO: 118779 - DNA, 16 bp, H. sapiens
ggttttaaattgcatt

SEQ ID NO: 118780 - DNA, 16 bp, H. sapiens
ggttttaatcataaaa

SEQ ID NO: 118781 - DNA, 16 bp, H. sapiens
ggttttaatttctatt

SEQ ID NO: 118782 - DNA, 16 bp, H. sapiens
ggttttaatttctttc

SEQ ID NO: 118783 - DNA, 16 bp, H. sapiens
ggttttaccatgatgg

SEQ ID NO: 118784 - DNA, 16 bp, H. sapiens
ggttttatacattcta

SEQ ID NO: 118785 - DNA, 17 bp, H. sapiens
ggttttcaccatgttgc

SEQ ID NO: 118786 - DNA, 16 bp, H. sapiens
ggttttcactgtgttg

SEQ ID NO: 118787 - DNA, 16 bp, H. sapiens
ggttttcactttcttc

SEQ ID NO: 118788 - DNA, 16 bp, H. sapiens
ggttttcatgtctcta

SEQ ID NO: 118789 - DNA, 16 bp, H. sapiens
ggttttcatttctctt

SEQ ID NO: 118790 - DNA, 16 bp, H. sapiens
ggttttccaaagtggt

SEQ ID NO: 118791 - DNA, 16 bp, H. sapiens
ggttttccaatttatt

SEQ ID NO: 118792 - DNA, 16 bp, H. sapiens
ggttttcccctcacag

SEQ ID NO: 118793 - DNA, 16 bp, H. sapiens
ggttttcgccatgttg

SEQ ID NO: 118794 - DNA, 16 bp, H. sapiens
ggttttctgtagtgat

SEQ ID NO: 118795 - DNA, 16 bp, H. sapiens
ggttttctgtttactc

SEQ ID NO: 118796 - DNA, 16 bp, H. sapiens
ggttttcttatctata

SEQ ID NO: 118797 - DNA, 16 bp, H. sapiens
ggttttgaactactga

SEQ ID NO: 118798 - DNA, 16 bp, H. sapiens
ggttttgccattttgt

SEQ ID NO: 118799 - DNA, 16 bp, H. sapiens
ggttttgctctgtcat

SEQ ID NO: 118800 - DNA, 16 bp, H. sapiens
ggttttgctctgttgc

SEQ ID NO: 118801 - DNA, 16 bp, H. sapiens
ggttttgctgtctcag

SEQ ID NO: 118802 - DNA, 16 bp, H. sapiens
ggttttgcttctttat

SEQ ID NO: 118803 - DNA, 16 bp, H. sapiens
ggttttggtagcagga

SEQ ID NO: 118804 - DNA, 16 bp, H. sapiens
ggtttttaacatgaag

SEQ ID NO: 118805 - DNA, 16 bp, H. sapiens
ggtttttcaaggatag

SEQ ID NO: 118806 - DNA, 16 bp, H. sapiens
ggtttttctaagtata

SEQ ID NO: 118807 - DNA, 16 bp, H. sapiens
ggtttttctatttctg

SEQ ID NO: 118808 - DNA, 16 bp, H. sapiens
ggtttttctttatagc

SEQ ID NO: 118809 - DNA, 16 bp, H. sapiens
ggtttttgaaaggatc

SEQ ID NO: 118810 - DNA, 16 bp, H. sapiens
ggtttttgtggggact

SEQ ID NO: 118811 - DNA, 16 bp, H. sapiens
ggttttttgaaaagac

SEQ ID NO: 118812 - DNA, 16 bp, H. sapiens
gtaaaaatattttctt

SEQ ID NO: 118813 - DNA, 16 bp, H. sapiens
gtaaaaatggctttta

SEQ ID NO: 118814 - DNA, 16 bp, H. sapiens
gtaaaaatgttctccc

SEQ ID NO: 118815 - DNA, 16 bp, H. sapiens
gtaaaacaaatatttt

SEQ ID NO: 118816 - DNA, 16 bp, H. sapiens
gtaaaacccatctcta

SEQ ID NO: 118817 - DNA, 16 bp, H. sapiens
gtaaaaccccatttct

SEQ ID NO: 118818 - DNA, 19 bp, H. sapiens
gtaaaaccctgtctctacc

SEQ ID NO: 118819 - DNA, 16 bp, H. sapiens
gtaaaactattttaaa

SEQ ID NO: 118820 - DNA, 16 bp, H. sapiens
gtaaaactgtctttat

SEQ ID NO: 118821 - DNA, 16 bp, H. sapiens
gtaaaagcatcacatg

SEQ ID NO: 118822 - DNA, 16 bp, H. sapiens
gtaaaaggatggagaa

SEQ ID NO: 118823 - DNA, 16 bp, H. sapiens
gtaaaagttctccaag

SEQ ID NO: 118824 - DNA, 16 bp, H. sapiens
gtaaaataatccaggc

SEQ ID NO: 118825 - DNA, 16 bp, H. sapiens
gtaaaatacacataaa

SEQ ID NO: 118826 - DNA, 16 bp, H. sapiens
gtaaaatatgatttta

SEQ ID NO: 118827 - DNA, 16 bp, H. sapiens
gtaaaatattctttaa

SEQ ID NO: 118828 - DNA, 16 bp, H. sapiens
gtaaaatattttgact

SEQ ID NO: 118829 - DNA, 16 bp, H. sapiens
gtaaaatattttgatt

SEQ ID NO: 118830 - DNA, 16 bp, H. sapiens
gtaaaatgagaataat

SEQ ID NO: 118831 - DNA, 16 bp, H. sapiens
gtaaaatgcaaataaa

SEQ ID NO: 118832 - DNA, 16 bp, H. sapiens
gtaaaatgctaccaaa

SEQ ID NO: 118833 - DNA, 16 bp, H. sapiens
gtaaaatgctatcaaa

SEQ ID NO: 118834 - DNA, 16 bp, H. sapiens
gtaaaatggaccaatt

SEQ ID NO: 118835 - DNA, 16 bp, H. sapiens
gtaaaatgggataatg

SEQ ID NO: 118836 - DNA, 16 bp, H. sapiens
gtaaaattcaacagaa

SEQ ID NO: 118837 - DNA, 16 bp, H. sapiens
gtaaaattcacccttt

SEQ ID NO: 118838 - DNA, 16 bp, H. sapiens
gtaaaattttagatgg

SEQ ID NO: 118839 - DNA, 16 bp, H. sapiens
gtaaacaaattttaaa

SEQ ID NO: 118840 - DNA, 16 bp, H. sapiens
gtaaacaatcatattg

SEQ ID NO: 118841 - DNA, 16 bp, H. sapiens
gtaaacacacacacac

SEQ ID NO: 118842 - DNA, 16 bp, H. sapiens
gtaaacatttttgttt

SEQ ID NO: 118843 - DNA, 16 bp, H. sapiens
gtaaaccaggaagaag

SEQ ID NO: 118844 - DNA, 16 bp, H. sapiens
gtaaaccatatatctg

SEQ ID NO: 118845 - DNA, 16 bp, H. sapiens
gtaaactttataaaca

SEQ ID NO: 118846 - DNA, 16 bp, H. sapiens
gtaaacttttttaaaa

SEQ ID NO: 118847 - DNA, 16 bp, H. sapiens
gtaaagaccttgctga

SEQ ID NO: 118848 - DNA, 16 bp, H. sapiens
gtaaagatgggttttt

SEQ ID NO: 118849 - DNA, 16 bp, H. sapiens
gtaaagctgttttctt

SEQ ID NO: 118850 - DNA, 22 bp, H. sapiens
gtaaaggattaagtgctgtgct

SEQ ID NO: 118851 - DNA, 16 bp, H. sapiens
gtaaagggccagagag

SEQ ID NO: 118852 - DNA, 16 bp, H. sapiens
gtaaagtacttgatgt

SEQ ID NO: 118853 - DNA, 16 bp, H. sapiens
gtaaagtcagaaactt

SEQ ID NO: 118854 - DNA, 16 bp, H. sapiens
gtaaatacatatataa

SEQ ID NO: 118855 - DNA, 16 bp, H. sapiens
gtaaataccaaagagt

SEQ ID NO: 118856 - DNA, 16 bp, H. sapiens
gtaaatactcccacta

SEQ ID NO: 118857 - DNA, 16 bp, H. sapiens
gtaaatagttcaaaat

SEQ ID NO: 118858 - DNA, 16 bp, H. sapiens
gtaaatatatgtatac

SEQ ID NO: 118859 - DNA, 24 bp, H. sapiens
gtaaatatgcctcttatctcagct

SEQ ID NO: 118860 - DNA, 16 bp, H. sapiens
gtaaatatgtaaaatt

SEQ ID NO: 118861 - DNA, 16 bp, H. sapiens
gtaaatatttaaaact

SEQ ID NO: 118862 - DNA, 16 bp, H. sapiens
gtaaatatttatggaa

SEQ ID NO: 118863 - DNA, 16 bp, H. sapiens
gtaaatatttattctt

SEQ ID NO: 118864 - DNA, 16 bp, H. sapiens
gtaaatatttgtgaaa

SEQ ID NO: 118865 - DNA, 16 bp, H. sapiens
gtaaatatttgtttaa

SEQ ID NO: 118866 - DNA, 16 bp, H. sapiens
gtaaatcagacaccac

SEQ ID NO: 118867 - DNA, 16 bp, H. sapiens
gtaaatgaaataatac

SEQ ID NO: 118868 - DNA, 16 bp, H. sapiens
gtaaatgatgaaatta

SEQ ID NO: 118869 - DNA, 16 bp, H. sapiens
gtaaatgcatcaatca

SEQ ID NO: 118870 - DNA, 16 bp, H. sapiens
gtaaatgccattattt

SEQ ID NO: 118871 - DNA, 16 bp, H. sapiens
gtaaatgctttttttt

SEQ ID NO: 118872 - DNA, 16 bp, H. sapiens
gtaaatggaataaatg

SEQ ID NO: 118873 - DNA, 16 bp, H. sapiens
gtaaatgtttattgag

SEQ ID NO: 118874 - DNA, 16 bp, H. sapiens
gtaaatgtttcttttc

SEQ ID NO: 118875 - DNA, 16 bp, H. sapiens
gtaaatgtttgttgag

SEQ ID NO: 118876 - DNA, 16 bp, H. sapiens
gtaaattaaaaacctt

SEQ ID NO: 118877 - DNA, 16 bp, H. sapiens
gtaaattagtatagct

SEQ ID NO: 118878 - DNA, 16 bp, H. sapiens
gtaaattagttcaatc

SEQ ID NO: 118879 - DNA, 16 bp, H. sapiens
gtaaattatacatcaa

SEQ ID NO: 118880 - DNA, 16 bp, H. sapiens
gtaaattccagctact

SEQ ID NO: 118881 - DNA, 16 bp, H. sapiens
gtaaattctatcaaat

SEQ ID NO: 118882 - DNA, 16 bp, H. sapiens
gtaaattgaacaattt

SEQ ID NO: 118883 - DNA, 16 bp, H. sapiens
gtaaattgcatgttgt

SEQ ID NO: 118884 - DNA, 16 bp, H. sapiens
gtaaattttcttccat

SEQ ID NO: 118885 - DNA, 16 bp, H. sapiens
gtaaattttgaaaaat

SEQ ID NO: 118886 - DNA, 16 bp, H. sapiens
gtaaatttttgttgaa

SEQ ID NO: 118887 - DNA, 16 bp, H. sapiens
gtaacaaaagaccaca

SEQ ID NO: 118888 - DNA, 16 bp, H. sapiens
gtaacaaaatatctca

SEQ ID NO: 118889 - DNA, 16 bp, H. sapiens
gtaacaaactatctct

SEQ ID NO: 118890 - DNA, 16 bp, H. sapiens
gtaacaaattaccaaa

SEQ ID NO: 118891 - DNA, 16 bp, H. sapiens
gtaacaaattaccacc

SEQ ID NO: 118892 - DNA, 16 bp, H. sapiens
gtaacaacaacagcaa

SEQ ID NO: 118893 - DNA, 16 bp, H. sapiens
gtaacaactgtttcag

SEQ ID NO: 118894 - DNA, 16 bp, H. sapiens
gtaacacacacctgta

SEQ ID NO: 118895 - DNA, 16 bp, H. sapiens
gtaacagaaaggaaaa

SEQ ID NO: 118896 - DNA, 16 bp, H. sapiens
gtaacagaatatcaca

SEQ ID NO: 118897 - DNA, 16 bp, H. sapiens
gtaacagagccagact

SEQ ID NO: 118898 - DNA, 16 bp, H. sapiens
gtaacagatataataa

SEQ ID NO: 118899 - DNA, 18 bp, H. sapiens
gtaacagatgaggaagaa

SEQ ID NO: 118900 - DNA, 16 bp, H. sapiens
gtaacatcaaaggtca

SEQ ID NO: 118901 - DNA, 16 bp, H. sapiens
gtaaccacaaataaaa

SEQ ID NO: 118902 - DNA, 16 bp, H. sapiens
gtaaccccagctacta

SEQ ID NO: 118903 - DNA, 16 bp, H. sapiens
gtaaccttgaactcct

SEQ ID NO: 118904 - DNA, 16 bp, H. sapiens
gtaactagaataacca

SEQ ID NO: 118905 - DNA, 16 bp, H. sapiens
gtaactgagacagtga

SEQ ID NO: 118906 - DNA, 16 bp, H. sapiens
gtaactgagagtggtg

SEQ ID NO: 118907 - DNA, 16 bp, H. sapiens
gtaacttataaacaaa

SEQ ID NO: 118908 - DNA, 16 bp, H. sapiens
gtaacttgaatccaca

SEQ ID NO: 118909 - DNA, 16 bp, H. sapiens
gtaacttgttcaagat

SEQ ID NO: 118910 - DNA, 16 bp, H. sapiens
gtaactttacagaaat

SEQ ID NO: 118911 - DNA, 16 bp, H. sapiens
gtaactttagccccaa

SEQ ID NO: 118912 - DNA, 16 bp, H. sapiens
gtaactttgctgaatt

SEQ ID NO: 118913 - DNA, 16 bp, H. sapiens
gtaactttggaaaaca

SEQ ID NO: 118914 - DNA, 16 bp, H. sapiens
gtaactttttaaaata

SEQ ID NO: 118915 - DNA, 16 bp, H. sapiens
gtaagaaaatattttc

SEQ ID NO: 118916 - DNA, 16 bp, H. sapiens
gtaagaacaaaaaacc

SEQ ID NO: 118917 - DNA, 16 bp, H. sapiens
gtaagaaggcaccaag

SEQ ID NO: 118918 - DNA, 16 bp, H. sapiens
gtaagaatatagtata

SEQ ID NO: 118919 - DNA, 16 bp, H. sapiens
gtaagaccctgtctcc

SEQ ID NO: 118920 - DNA, 16 bp, H. sapiens
gtaagacctcaaactg

SEQ ID NO: 118921 - DNA, 16 bp, H. sapiens
gtaagagctcaataaa

SEQ ID NO: 118922 - DNA, 16 bp, H. sapiens
gtaagatgaatgcaca

SEQ ID NO: 118923 - DNA, 16 bp, H. sapiens
gtaagatttgggtggg

SEQ ID NO: 118924 - DNA, 16 bp, H. sapiens
gtaagatttttaaaaa

SEQ ID NO: 118925 - DNA, 16 bp, H. sapiens
gtaagccaccgcgccc

SEQ ID NO: 118926 - DNA, 16 bp, H. sapiens
gtaagccatgatggca

SEQ ID NO: 118927 - DNA, 16 bp, H. sapiens
gtaagccctcaataaa

SEQ ID NO: 118928 - DNA, 16 bp, H. sapiens
gtaagctctgcctcct

SEQ ID NO: 118929 - DNA, 16 bp, H. sapiens
gtaagcttcctgaggg

SEQ ID NO: 118930 - DNA, 16 bp, H. sapiens
gtaaggaagagaagtg

SEQ ID NO: 118931 - DNA, 16 bp, H. sapiens
gtaaggaatgtgggaa

SEQ ID NO: 118932 - DNA, 16 bp, H. sapiens
gtaaggactttggctt

SEQ ID NO: 118933 - DNA, 16 bp, H. sapiens
gtaagtaaagttttat

SEQ ID NO: 118934 - DNA, 16 bp, H. sapiens
gtaagtccaaaatcca

SEQ ID NO: 118935 - DNA, 16 bp, H. sapiens
gtaagtgaatgtgaag

SEQ ID NO: 118936 - DNA, 16 bp, H. sapiens
gtaagtgacagagtca

SEQ ID NO: 118937 - DNA, 16 bp, H. sapiens
gtaagtggatcacttg

SEQ ID NO: 118938 - DNA, 16 bp, H. sapiens
gtaagtggtgaagcca

SEQ ID NO: 118939 - DNA, 16 bp, H. sapiens
gtaagtgttctgagca

SEQ ID NO: 118940 - DNA, 16 bp, H. sapiens
gtaagtttttaaaatt

SEQ ID NO: 118941 - DNA, 16 bp, H. sapiens
gtaataaaaaatctac

SEQ ID NO: 118942 - DNA, 16 bp, H. sapiens
gtaataaatacatttt

SEQ ID NO: 118943 - DNA, 16 bp, H. sapiens
gtaataaatattcaaa

SEQ ID NO: 118944 - DNA, 16 bp, H. sapiens
gtaataaatctcttcc

SEQ ID NO: 118945 - DNA, 16 bp, H. sapiens
gtaataaatgtttatt

SEQ ID NO: 118946 - DNA, 16 bp, H. sapiens
gtaataaattaccaca

SEQ ID NO: 118947 - DNA, 16 bp, H. sapiens
gtaataattacatcat

SEQ ID NO: 118948 - DNA, 16 bp, H. sapiens
gtaataccagcacctt

SEQ ID NO: 118949 - DNA, 16 bp, H. sapiens
gtaatagaaataaagt

SEQ ID NO: 118950 - DNA, 16 bp, H. sapiens
gtaatatactttgaaa

SEQ ID NO: 118951 - DNA, 16 bp, H. sapiens
gtaatatatagattca

SEQ ID NO: 118952 - DNA, 16 bp, H. sapiens
gtaatatggtttggct

SEQ ID NO: 118953 - DNA, 16 bp, H. sapiens
gtaatattccattgta

SEQ ID NO: 118954 - DNA, 16 bp, H. sapiens
gtaatattctctgatg

SEQ ID NO: 118955 - DNA, 16 bp, H. sapiens
gtaatattttcctgtt

SEQ ID NO: 118956 - DNA, 16 bp, H. sapiens
gtaatcaagacagtat

SEQ ID NO: 118957 - DNA, 16 bp, H. sapiens
gtaatcacaacatttt

SEQ ID NO: 118958 - DNA, 16 bp, H. sapiens
gtaatcattttatttt

SEQ ID NO: 118959 - DNA, 16 bp, H. sapiens
gtaatccacccacctc

SEQ ID NO: 118960 - DNA, 16 bp, H. sapiens
gtaatcccagctacgc

SEQ ID NO: 118961 - DNA, 16 bp, H. sapiens
gtaatcccaggtactc

SEQ ID NO: 118962 - DNA, 16 bp, H. sapiens
gtaatcccagttaccc

SEQ ID NO: 118963 - DNA, 16 bp, H. sapiens
gtaatcctagaatttt

SEQ ID NO: 118964 - DNA, 16 bp, H. sapiens
gtaatctgacctttct

SEQ ID NO: 118965 - DNA, 16 bp, H. sapiens
gtaatctttggtaaat

SEQ ID NO: 118966 - DNA, 17 bp, H. sapiens
gtaatctttttgctggt

SEQ ID NO: 118967 - DNA, 16 bp, H. sapiens
gtaatgaatgagagtt

SEQ ID NO: 118968 - DNA, 16 bp, H. sapiens
gtaatgaatgtggcaa

SEQ ID NO: 118969 - DNA, 16 bp, H. sapiens
gtaatgccagcatttt

SEQ ID NO: 118970 - DNA, 16 bp, H. sapiens
gtaatgccagcgcttt

SEQ ID NO: 118971 - DNA, 16 bp, H. sapiens
gtaatgctgacctcat

SEQ ID NO: 118972 - DNA, 16 bp, H. sapiens
gtaatggatgaggaag

SEQ ID NO: 118973 - DNA, 16 bp, H. sapiens
gtaatggcctccagct

SEQ ID NO: 118974 - DNA, 16 bp, H. sapiens
gtaatggctcagtcaa

SEQ ID NO: 118975 - DNA, 16 bp, H. sapiens
gtaatgggcagaggct

SEQ ID NO: 118976 - DNA, 20 bp, H. sapiens
gtaatggtaaagggatcaat

SEQ ID NO: 118977 - DNA, 16 bp, H. sapiens
gtaatgtatgagagtt

SEQ ID NO: 118978 - DNA, 16 bp, H. sapiens
gtaatgtttcaggata

SEQ ID NO: 118979 - DNA, 16 bp, H. sapiens
gtaattacagtttttg

SEQ ID NO: 118980 - DNA, 16 bp, H. sapiens
gtaattaggccatgag

SEQ ID NO: 118981 - DNA, 16 bp, H. sapiens
gtaattccaaatgttg

SEQ ID NO: 118982 - DNA, 16 bp, H. sapiens
gtaattctaacacttt

SEQ ID NO: 118983 - DNA, 16 bp, H. sapiens
gtaattctcattgcag

SEQ ID NO: 118984 - DNA, 16 bp, H. sapiens
gtaattgaaccatggg

SEQ ID NO: 118985 - DNA, 16 bp, H. sapiens
gtaattgaatcatgaa

SEQ ID NO: 118986 - DNA, 16 bp, H. sapiens
gtaattgagactactg

SEQ ID NO: 118987 - DNA, 16 bp, H. sapiens
gtaattgctacaaact

SEQ ID NO: 118988 - DNA, 16 bp, H. sapiens
gtaattgtagcatttc

SEQ ID NO: 118989 - DNA, 16 bp, H. sapiens
gtaattgtatgatttt

SEQ ID NO: 118990 - DNA, 16 bp, H. sapiens
gtaattgttttgggac

SEQ ID NO: 118991 - DNA, 16 bp, H. sapiens
gtaatttaaaatattc

SEQ ID NO: 118992 - DNA, 16 bp, H. sapiens
gtaatttacagagaaa

SEQ ID NO: 118993 - DNA, 16 bp, H. sapiens
gtaatttataaagaag

SEQ ID NO: 118994 - DNA, 16 bp, H. sapiens
gtaatttatagattca

SEQ ID NO: 118995 - DNA, 16 bp, H. sapiens
gtaatttatggattca

SEQ ID NO: 118996 - DNA, 16 bp, H. sapiens
gtaatttcagtttttg

SEQ ID NO: 118997 - DNA, 16 bp, H. sapiens
gtaatttcatttgtct

SEQ ID NO: 118998 - DNA, 16 bp, H. sapiens
gtaatttctcattcct

SEQ ID NO: 118999 - DNA, 16 bp, H. sapiens
gtaatttgttacagca

SEQ ID NO: 119000 - DNA, 16 bp, H. sapiens
gtaattttaatacaaa

SEQ ID NO: 119001 - DNA, 16 bp, H. sapiens
gtaattttaatttctt

SEQ ID NO: 119002 - DNA, 16 bp, H. sapiens
gtaattttacacaata

SEQ ID NO: 119003 - DNA, 16 bp, H. sapiens
gtaattttagtagaca

SEQ ID NO: 119004 - DNA, 16 bp, H. sapiens
gtaatttttgtacatt

SEQ ID NO: 119005 - DNA, 16 bp, H. sapiens
gtaatttttttcatat

SEQ ID NO: 119006 - DNA, 16 bp, H. sapiens
gtacaaaaatcacaag

SEQ ID NO: 119007 - DNA, 16 bp, H. sapiens
gtacaaaagtttttaa

SEQ ID NO: 119008 - DNA, 16 bp, H. sapiens
gtacaaagaagagctg

SEQ ID NO: 119009 - DNA, 16 bp, H. sapiens
gtacaaagtttcaatt

SEQ ID NO: 119010 - DNA, 16 bp, H. sapiens
gtacaaagttttagtt

SEQ ID NO: 119011 - DNA, 16 bp, H. sapiens
gtacaacaaaccctca

SEQ ID NO: 119012 - DNA, 16 bp, H. sapiens
gtacaagaagcaaata

SEQ ID NO: 119013 - DNA, 16 bp, H. sapiens
gtacaaggagaagctg

SEQ ID NO: 119014 - DNA, 16 bp, H. sapiens
gtacaaggcaaggatg

SEQ ID NO: 119015 - DNA, 16 bp, H. sapiens
gtacaatggcacaatc

SEQ ID NO: 119016 - DNA, 16 bp, H. sapiens
gtacaatgtaatgttt

SEQ ID NO: 119017 - DNA, 16 bp, H. sapiens
gtacaatgttagctgt

SEQ ID NO: 119018 - DNA, 16 bp, H. sapiens
gtacacaaaagtcaag

SEQ ID NO: 119019 - DNA, 16 bp, H. sapiens
gtacacaatgtgcagg

SEQ ID NO: 119020 - DNA, 16 bp, H. sapiens
gtacacacatatatat

SEQ ID NO: 119021 - DNA, 16 bp, H. sapiens
gtacacaccaccatgc

SEQ ID NO: 119022 - DNA, 16 bp, H. sapiens
gtacacaccaccatgt

SEQ ID NO: 119023 - DNA, 16 bp, H. sapiens
gtacaccaccatacct

SEQ ID NO: 119024 - DNA, 17 bp, H. sapiens
gtacaccatggaatact

SEQ ID NO: 119025 - DNA, 16 bp, H. sapiens
gtacacctggaaaagc

SEQ ID NO: 119026 - DNA, 16 bp, H. sapiens
gtacacctggctctgc

SEQ ID NO: 119027 - DNA, 16 bp, H. sapiens
gtacactgctcagatg

SEQ ID NO: 119028 - DNA, 16 bp, H. sapiens
gtacactgtttgtggg

SEQ ID NO: 119029 - DNA, 16 bp, H. sapiens
gtacacttaaaatgga

SEQ ID NO: 119030 - DNA, 16 bp, H. sapiens
gtacagaaaaccaaat

SEQ ID NO: 119031 - DNA, 16 bp, H. sapiens
gtacagaatttcagtt

SEQ ID NO: 119032 - DNA, 16 bp, H. sapiens
gtacagacagggtttt

SEQ ID NO: 119033 - DNA, 16 bp, H. sapiens
gtacagagtttcagtt

SEQ ID NO: 119034 - DNA, 16 bp, H. sapiens
gtacagcaaaaataca

SEQ ID NO: 119035 - DNA, 16 bp, H. sapiens
gtacagcaaaccacta

SEQ ID NO: 119036 - DNA, 16 bp, H. sapiens
gtacagcagcagcaga

SEQ ID NO: 119037 - DNA, 16 bp, H. sapiens
gtacagcctgcagaat

SEQ ID NO: 119038 - DNA, 17 bp, H. sapiens
gtacaggtcaaaatgga

SEQ ID NO: 119039 - DNA, 16 bp, H. sapiens
gtacaggttatttcat

SEQ ID NO: 119040 - DNA, 16 bp, H. sapiens
gtacagtcatagctca

SEQ ID NO: 119041 - DNA, 16 bp, H. sapiens
gtacagtcatcccttg

SEQ ID NO: 119042 - DNA, 16 bp, H. sapiens
gtacagtcatgcactg

SEQ ID NO: 119043 - DNA, 16 bp, H. sapiens
gtacagtgagccaaga

SEQ ID NO: 119044 - DNA, 16 bp, H. sapiens
gtacagtggcaaaatc

SEQ ID NO: 119045 - DNA, 16 bp, H. sapiens
gtacagtgtcatgatc

SEQ ID NO: 119046 - DNA, 16 bp, H. sapiens
gtacatacacacatgc

SEQ ID NO: 119047 - DNA, 16 bp, H. sapiens
gtacatagtaggcact

SEQ ID NO: 119048 - DNA, 16 bp, H. sapiens
gtacatatatgtatat

SEQ ID NO: 119049 - DNA, 16 bp, H. sapiens
gtacatatcttaattt

SEQ ID NO: 119050 - DNA, 16 bp, H. sapiens
gtacatatgtgtgtat

SEQ ID NO: 119051 - DNA, 16 bp, H. sapiens
gtacatgaaacaaagt

SEQ ID NO: 119052 - DNA, 16 bp, H. sapiens
gtacatgctatcaaca

SEQ ID NO: 119053 - DNA, 16 bp, H. sapiens
gtacatgtatctttat

SEQ ID NO: 119054 - DNA, 16 bp, H. sapiens
gtacatgtgaagattt

SEQ ID NO: 119055 - DNA, 16 bp, H. sapiens
gtacatgtgaaggttt

SEQ ID NO: 119056 - DNA, 16 bp, H. sapiens
gtacatgtgcacaaag

SEQ ID NO: 119057 - DNA, 16 bp, H. sapiens
gtacatgtgcaggtct

SEQ ID NO: 119058 - DNA, 16 bp, H. sapiens
gtacatgtgcatgtgt

SEQ ID NO: 119059 - DNA, 16 bp, H. sapiens
gtacattggttcagtc

SEQ ID NO: 119060 - DNA, 16 bp, H. sapiens
gtacattgtaaaataa

SEQ ID NO: 119061 - DNA, 17 bp, H. sapiens
gtacatttgttcaactc

SEQ ID NO: 119062 - DNA, 16 bp, H. sapiens
gtacatttgtttgagt

SEQ ID NO: 119063 - DNA, 16 bp, H. sapiens
gtacatttttaaatga

SEQ ID NO: 119064 - DNA, 16 bp, H. sapiens
gtacattttttaaaaa

SEQ ID NO: 119065 - DNA, 16 bp, H. sapiens
gtaccaaaactgatat

SEQ ID NO: 119066 - DNA, 16 bp, H. sapiens
gtaccaatttaatgta

SEQ ID NO: 119067 - DNA, 16 bp, H. sapiens
gtaccacaaaaacagt

SEQ ID NO: 119068 - DNA, 16 bp, H. sapiens
gtaccacagtttatcc

SEQ ID NO: 119069 - DNA, 16 bp, H. sapiens
gtaccaccacacctgg

SEQ ID NO: 119070 - DNA, 16 bp, H. sapiens
gtaccactgcagctgc

SEQ ID NO: 119071 - DNA, 16 bp, H. sapiens
gtaccagcatctgctc

SEQ ID NO: 119072 - DNA, 16 bp, H. sapiens
gtaccagcatctgctt

SEQ ID NO: 119073 - DNA, 34 bp, H. sapiens
gtaccagccgctgcaaaatcatgccaaaatgtaa

SEQ ID NO: 119074 - DNA, 16 bp, H. sapiens
gtaccagctcagccat

SEQ ID NO: 119075 - DNA, 16 bp, H. sapiens
gtacccattttacaga

SEQ ID NO: 119076 - DNA, 16 bp, H. sapiens
gtaccccagcctgggc

SEQ ID NO: 119077 - DNA, 16 bp, H. sapiens
gtacccctcaacccct

SEQ ID NO: 119078 - DNA, 16 bp, H. sapiens
gtaccctgcagagcca

SEQ ID NO: 119079 - DNA, 16 bp, H. sapiens
gtaccggtctgtggcc

SEQ ID NO: 119080 - DNA, 16 bp, H. sapiens
gtacctacctcacagg

SEQ ID NO: 119081 - DNA, 16 bp, H. sapiens
gtacctagaacttaaa

SEQ ID NO: 119082 - DNA, 16 bp, H. sapiens
gtacctcagtttcttc

SEQ ID NO: 119083 - DNA, 16 bp, H. sapiens
gtacctgaaagagatg

SEQ ID NO: 119084 - DNA, 16 bp, H. sapiens
gtacctgagatatttt

SEQ ID NO: 119085 - DNA, 16 bp, H. sapiens
gtacctggaaaagctg

SEQ ID NO: 119086 - DNA, 16 bp, H. sapiens
gtacctggctaatttt

SEQ ID NO: 119087 - DNA, 16 bp, H. sapiens
gtacctgggaccacag

SEQ ID NO: 119088 - DNA, 16 bp, H. sapiens
gtacctgggactgcag

SEQ ID NO: 119089 - DNA, 16 bp, H. sapiens
gtacctgtagtcacag

SEQ ID NO: 119090 - DNA, 16 bp, H. sapiens
gtacctgtattcccag

SEQ ID NO: 119091 - DNA, 16 bp, H. sapiens
gtacctgtccatggcc

SEQ ID NO: 119092 - DNA, 16 bp, H. sapiens
gtacctgtctgtggcc

SEQ ID NO: 119093 - DNA, 16 bp, H. sapiens
gtacctgtgactttgt

SEQ ID NO: 119094 - DNA, 16 bp, H. sapiens
gtactacaggtgcgtg

SEQ ID NO: 119095 - DNA, 16 bp, H. sapiens
gtactacattttcttt

SEQ ID NO: 119096 - DNA, 16 bp, H. sapiens
gtactactgcactcca

SEQ ID NO: 119097 - DNA, 16 bp, H. sapiens
gtactaggcttaatac

SEQ ID NO: 119098 - DNA, 16 bp, H. sapiens
gtactcaggagtctga

SEQ ID NO: 119099 - DNA, 16 bp, H. sapiens
gtactccagccttggt

SEQ ID NO: 119100 - DNA, 16 bp, H. sapiens
gtactccatggtgtgt

SEQ ID NO: 119101 - DNA, 19 bp, H. sapiens
gtactcgggaggctgaggt

SEQ ID NO: 119102 - DNA, 16 bp, H. sapiens
gtactgaaaaaaatgt

SEQ ID NO: 119103 - DNA, 17 bp, H. sapiens
gtactgaatgggcaaaa

SEQ ID NO: 119104 - DNA, 16 bp, H. sapiens
gtactgctatgaacat

SEQ ID NO: 119105 - DNA, 16 bp, H. sapiens
gtactggaggctggaa

SEQ ID NO: 119106 - DNA, 16 bp, H. sapiens
gtactggggttacagg

SEQ ID NO: 119107 - DNA, 16 bp, H. sapiens
gtactggtccgtggcc

SEQ ID NO: 119108 - DNA, 16 bp, H. sapiens
gtactgtatgatttca

SEQ ID NO: 119109 - DNA, 16 bp, H. sapiens
gtactgtgtgtgtgtg

SEQ ID NO: 119110 - DNA, 16 bp, H. sapiens
gtacttagaaataaat

SEQ ID NO: 119111 - DNA, 16 bp, H. sapiens
gtacttcaaaacatca

SEQ ID NO: 119112 - DNA, 16 bp, H. sapiens
gtacttcatttctttt

SEQ ID NO: 119113 - DNA, 16 bp, H. sapiens
gtacttctcaaacttt

SEQ ID NO: 119114 - DNA, 16 bp, H. sapiens
gtacttcttacatata

SEQ ID NO: 119115 - DNA, 16 bp, H. sapiens
gtactttaaaataatt

SEQ ID NO: 119116 - DNA, 16 bp, H. sapiens
gtactttaaggtttgg

SEQ ID NO: 119117 - DNA, 16 bp, H. sapiens
gtactttcagtagaga

SEQ ID NO: 119118 - DNA, 16 bp, H. sapiens
gtactttgggaagtca

SEQ ID NO: 119119 - DNA, 24 bp, H. sapiens
gtactttgggaggccaaggcagga

SEQ ID NO: 119120 - DNA, 16 bp, H. sapiens
gtacttttggtgtcat

SEQ ID NO: 119121 - DNA, 16 bp, H. sapiens
gtagaaaagaaaagcc

SEQ ID NO: 119122 - DNA, 16 bp, H. sapiens
gtagaaaatattctca

SEQ ID NO: 119123 - DNA, 16 bp, H. sapiens
gtagaaacagggtttc

SEQ ID NO: 119124 - DNA, 16 bp, H. sapiens
gtagaaatgaaaactt

SEQ ID NO: 119125 - DNA, 16 bp, H. sapiens
gtagaaatgtaaaata

SEQ ID NO: 119126 - DNA, 16 bp, H. sapiens
gtagaaatttggaaaa

SEQ ID NO: 119127 - DNA, 16 bp, H. sapiens
gtagaagaaaacagct

SEQ ID NO: 119128 - DNA, 16 bp, H. sapiens
gtagaagaaatggata

SEQ ID NO: 119129 - DNA, 16 bp, H. sapiens
gtagaagcatttccat

SEQ ID NO: 119130 - DNA, 16 bp, H. sapiens
gtagaaggaggagctg

SEQ ID NO: 119131 - DNA, 16 bp, H. sapiens
gtagaaggatttataa

SEQ ID NO: 119132 - DNA, 16 bp, H. sapiens
gtagaaggggaggcag

SEQ ID NO: 119133 - DNA, 16 bp, H. sapiens
gtagaagtgttctgga

SEQ ID NO: 119134 - DNA, 16 bp, H. sapiens
gtagaatatgtgaagg

SEQ ID NO: 119135 - DNA, 16 bp, H. sapiens
gtagaatggaggttgc

SEQ ID NO: 119136 - DNA, 16 bp, H. sapiens
gtagaatttagcagtg

SEQ ID NO: 119137 - DNA, 16 bp, H. sapiens
gtagaatttattttaa

SEQ ID NO: 119138 - DNA, 16 bp, H. sapiens
gtagacattttaacaa

SEQ ID NO: 119139 - DNA, 16 bp, H. sapiens
gtagaccccagtgtct

SEQ ID NO: 119140 - DNA, 16 bp, H. sapiens
gtagacggggtttcac

SEQ ID NO: 119141 - DNA, 16 bp, H. sapiens
gtagactccagtgtct

SEQ ID NO: 119142 - DNA, 16 bp, H. sapiens
gtagagacagggcttc

SEQ ID NO: 119143 - DNA, 16 bp, H. sapiens
gtagagacaggggtct

SEQ ID NO: 119144 - DNA, 16 bp, H. sapiens
gtagagacaggtctca

SEQ ID NO: 119145 - DNA, 16 bp, H. sapiens
gtagagacatggtttt

SEQ ID NO: 119146 - DNA, 16 bp, H. sapiens
gtagagacgaggtctc

SEQ ID NO: 119147 - DNA, 18 bp, H. sapiens
gtagagacgaggtcttgc

SEQ ID NO: 119148 - DNA, 16 bp, H. sapiens
gtagagacgaggtttt

SEQ ID NO: 119149 - DNA, 16 bp, H. sapiens
gtagagacggtgtttc

SEQ ID NO: 119150 - DNA, 16 bp, H. sapiens
gtagagagagggtctt

SEQ ID NO: 119151 - DNA, 16 bp, H. sapiens
gtagagagctgaaact

SEQ ID NO: 119152 - DNA, 16 bp, H. sapiens
gtagagagggggtctc

SEQ ID NO: 119153 - DNA, 16 bp, H. sapiens
gtagagatagagtttc

SEQ ID NO: 119154 - DNA, 16 bp, H. sapiens
gtagagatagggtttt

SEQ ID NO: 119155 - DNA, 16 bp, H. sapiens
gtagagatcgcaccac

SEQ ID NO: 119156 - DNA, 16 bp, H. sapiens
gtagagatgaggtttc

SEQ ID NO: 119157 - DNA, 16 bp, H. sapiens
gtagagatggagtttt

SEQ ID NO: 119158 - DNA, 16 bp, H. sapiens
gtagagatggggtttt

SEQ ID NO: 119159 - DNA, 16 bp, H. sapiens
gtagagattgggtttc

SEQ ID NO: 119160 - DNA, 16 bp, H. sapiens
gtagagctgcccaaga

SEQ ID NO: 119161 - DNA, 16 bp, H. sapiens
gtagagctggagtctc

SEQ ID NO: 119162 - DNA, 16 bp, H. sapiens
gtagagctggggtctc

SEQ ID NO: 119163 - DNA, 16 bp, H. sapiens
gtagaggaggagctgg

SEQ ID NO: 119164 - DNA, 16 bp, H. sapiens
gtagaggatgcagtga

SEQ ID NO: 119165 - DNA, 16 bp, H. sapiens
gtagaggcaaggtttc

SEQ ID NO: 119166 - DNA, 16 bp, H. sapiens
gtagaggctgctgtga

SEQ ID NO: 119167 - DNA, 16 bp, H. sapiens
gtagaggtagggtctt

SEQ ID NO: 119168 - DNA, 16 bp, H. sapiens
gtagaggtgaggtttc

SEQ ID NO: 119169 - DNA, 16 bp, H. sapiens
gtagagtcagggtttt

SEQ ID NO: 119170 - DNA, 23 bp, H. sapiens
gtagataaaaccacaaagatggg

SEQ ID NO: 119171 - DNA, 16 bp, H. sapiens
gtagatatgaggcatt

SEQ ID NO: 119172 - DNA, 16 bp, H. sapiens
gtagatgccctttatc

SEQ ID NO: 119173 - DNA, 16 bp, H. sapiens
gtagatgtgattaaca

SEQ ID NO: 119174 - DNA, 16 bp, H. sapiens
gtagatgttcttcagt

SEQ ID NO: 119175 - DNA, 16 bp, H. sapiens
gtagattttagctgct

SEQ ID NO: 119176 - DNA, 16 bp, H. sapiens
gtagattttataaaca

SEQ ID NO: 119177 - DNA, 16 bp, H. sapiens
gtagcaaaatatcaca

SEQ ID NO: 119178 - DNA, 16 bp, H. sapiens
gtagcacatgtctgta

SEQ ID NO: 119179 - DNA, 16 bp, H. sapiens
gtagcactttgggagg

SEQ ID NO: 119180 - DNA, 16 bp, H. sapiens
gtagcagcagcagcaa

SEQ ID NO: 119181 - DNA, 16 bp, H. sapiens
gtagcagtgggatttg

SEQ ID NO: 119182 - DNA, 16 bp, H. sapiens
gtagcatgatctctgc

SEQ ID NO: 119183 - DNA, 16 bp, H. sapiens
gtagcattgaatctgt

SEQ ID NO: 119184 - DNA, 16 bp, H. sapiens
gtagcatttacattgt

SEQ ID NO: 119185 - DNA, 16 bp, H. sapiens
gtagccaggaccacag

SEQ ID NO: 119186 - DNA, 16 bp, H. sapiens
gtagccaggactacaa

SEQ ID NO: 119187 - DNA, 16 bp, H. sapiens
gtagccaggattacag

SEQ ID NO: 119188 - DNA, 16 bp, H. sapiens
gtagccaggcatggtg

SEQ ID NO: 119189 - DNA, 16 bp, H. sapiens
gtagccaggcgtggtg

SEQ ID NO: 119190 - DNA, 16 bp, H. sapiens
gtagcccagggtggag

SEQ ID NO: 119191 - DNA, 16 bp, H. sapiens
gtagccctcccccacc

SEQ ID NO: 119192 - DNA, 16 bp, H. sapiens
gtagccgggcatggtg

SEQ ID NO: 119193 - DNA, 17 bp, H. sapiens
gtagccgggcgtggtgg

SEQ ID NO: 119194 - DNA, 16 bp, H. sapiens
gtagcctctggtcctt

SEQ ID NO: 119195 - DNA, 16 bp, H. sapiens
gtagctatgactacag

SEQ ID NO: 119196 - DNA, 16 bp, H. sapiens
gtagctcacacctgta

SEQ ID NO: 119197 - DNA, 16 bp, H. sapiens
gtagctcagattacag

SEQ ID NO: 119198 - DNA, 16 bp, H. sapiens
gtagctcctctctgct

SEQ ID NO: 119199 - DNA, 16 bp, H. sapiens
gtagctccttcctgca

SEQ ID NO: 119200 - DNA, 16 bp, H. sapiens
gtagctgagaccacag

SEQ ID NO: 119201 - DNA, 16 bp, H. sapiens
gtagctgcaaccacag

SEQ ID NO: 119202 - DNA, 16 bp, H. sapiens
gtagctgccactacag

SEQ ID NO: 119203 - DNA, 16 bp, H. sapiens
gtagctgcgattacag

SEQ ID NO: 119204 - DNA, 16 bp, H. sapiens
gtagctgctgtaacaa

SEQ ID NO: 119205 - DNA, 16 bp, H. sapiens
gtagctggaaccacag

SEQ ID NO: 119206 - DNA, 16 bp, H. sapiens
gtagctggacatggtg

SEQ ID NO: 119207 - DNA, 16 bp, H. sapiens
gtagctgggaacacag

SEQ ID NO: 119208 - DNA, 16 bp, H. sapiens
gtagctgggaagctgg

SEQ ID NO: 119209 - DNA, 16 bp, H. sapiens
gtagctgggaatacag

SEQ ID NO: 119210 - DNA, 16 bp, H. sapiens
gtagctgggactacaa

SEQ ID NO: 119211 - DNA, 16 bp, H. sapiens
gtagctgggactacat

SEQ ID NO: 119212 - DNA, 18 bp, H. sapiens
gtagctgggagtacaggc

SEQ ID NO: 119213 - DNA, 16 bp, H. sapiens
gtagctgggatcacaa

SEQ ID NO: 119214 - DNA, 17 bp, H. sapiens
gtagctgggatgacagg

SEQ ID NO: 119215 - DNA, 16 bp, H. sapiens
gtagctgggcctacag

SEQ ID NO: 119216 - DNA, 16 bp, H. sapiens
gtagctgggcgtggtg

SEQ ID NO: 119217 - DNA, 16 bp, H. sapiens
gtagctgggtctacag

SEQ ID NO: 119218 - DNA, 16 bp, H. sapiens
gtagctggtagctggg

SEQ ID NO: 119219 - DNA, 16 bp, H. sapiens
gtagctgtgactaaag

SEQ ID NO: 119220 - DNA, 16 bp, H. sapiens
gtagctgtgtggcttt

SEQ ID NO: 119221 - DNA, 16 bp, H. sapiens
gtagcttcactcctga

SEQ ID NO: 119222 - DNA, 16 bp, H. sapiens
gtagcttggactacag

SEQ ID NO: 119223 - DNA, 16 bp, H. sapiens
gtagcttgtccaaggt

SEQ ID NO: 119224 - DNA, 16 bp, H. sapiens
gtagcttttctataca

SEQ ID NO: 119225 - DNA, 16 bp, H. sapiens
gtaggaacatggatga

SEQ ID NO: 119226 - DNA, 16 bp, H. sapiens
gtaggagaaaatcttc

SEQ ID NO: 119227 - DNA, 16 bp, H. sapiens
gtaggagagcagggtg

SEQ ID NO: 119228 - DNA, 16 bp, H. sapiens
gtaggaggatcacctg

SEQ ID NO: 119229 - DNA, 16 bp, H. sapiens
gtaggaggatcacttg

SEQ ID NO: 119230 - DNA, 16 bp, H. sapiens
gtaggcacttaataaa

SEQ ID NO: 119231 - DNA, 16 bp, H. sapiens
gtaggcacttacagct

SEQ ID NO: 119232 - DNA, 16 bp, H. sapiens
gtaggcagaataatag

SEQ ID NO: 119233 - DNA, 16 bp, H. sapiens
gtaggcatgagccacc

SEQ ID NO: 119234 - DNA, 16 bp, H. sapiens
gtaggccctcaataaa

SEQ ID NO: 119235 - DNA, 16 bp, H. sapiens
gtaggctggctgcact

SEQ ID NO: 119236 - DNA, 16 bp, H. sapiens
gtaggctttagaaggt

SEQ ID NO: 119237 - DNA, 16 bp, H. sapiens
gtaggctttataaaca

SEQ ID NO: 119238 - DNA, 16 bp, H. sapiens
gtagggatgaacctct

SEQ ID NO: 119239 - DNA, 16 bp, H. sapiens
gtagggatgaggtttc

SEQ ID NO: 119240 - DNA, 16 bp, H. sapiens
gtagggatgtggatga

SEQ ID NO: 119241 - DNA, 16 bp, H. sapiens
gtaggtacttaataaa

SEQ ID NO: 119242 - DNA, 16 bp, H. sapiens
gtaggtaggtaggtag

SEQ ID NO: 119243 - DNA, 16 bp, H. sapiens
gtaggtatgtggcttt

SEQ ID NO: 119244 - DNA, 16 bp, H. sapiens
gtaggtgggaccacag

SEQ ID NO: 119245 - DNA, 16 bp, H. sapiens
gtaggtggttttcccc

SEQ ID NO: 119246 - DNA, 16 bp, H. sapiens
gtaggtgtatgtgtgt

SEQ ID NO: 119247 - DNA, 16 bp, H. sapiens
gtaggtgtgtggcctt

SEQ ID NO: 119248 - DNA, 16 bp, H. sapiens
gtagtaaaaatacaaa

SEQ ID NO: 119249 - DNA, 16 bp, H. sapiens
gtagtaattactcttt

SEQ ID NO: 119250 - DNA, 16 bp, H. sapiens
gtagtaggtgctcagt

SEQ ID NO: 119251 - DNA, 16 bp, H. sapiens
gtagtagtagtagcag

SEQ ID NO: 119252 - DNA, 17 bp, H. sapiens
gtagtattggaagttct

SEQ ID NO: 119253 - DNA, 16 bp, H. sapiens
gtagtctcaaactcct

SEQ ID NO: 119254 - DNA, 16 bp, H. sapiens
gtagtgaaaccttgtc

SEQ ID NO: 119255 - DNA, 16 bp, H. sapiens
gtagtgacgaggtttc

SEQ ID NO: 119256 - DNA, 16 bp, H. sapiens
gtagtgagctccccat

SEQ ID NO: 119257 - DNA, 16 bp, H. sapiens
gtagtgatgggatttc

SEQ ID NO: 119258 - DNA, 16 bp, H. sapiens
gtagtggcagcagtag

SEQ ID NO: 119259 - DNA, 16 bp, H. sapiens
gtagtggcagtggtgg

SEQ ID NO: 119260 - DNA, 16 bp, H. sapiens
gtagtggtggccacag

SEQ ID NO: 119261 - DNA, 16 bp, H. sapiens
gtagtggtgggtgcct

SEQ ID NO: 119262 - DNA, 16 bp, H. sapiens
gtagtgttttctaatt

SEQ ID NO: 119263 - DNA, 16 bp, H. sapiens
gtagttaaaaatcaac

SEQ ID NO: 119264 - DNA, 16 bp, H. sapiens
gtagttaataataatg

SEQ ID NO: 119265 - DNA, 16 bp, H. sapiens
gtagttccagtccaaa

SEQ ID NO: 119266 - DNA, 16 bp, H. sapiens
gtagttcctataatcc

SEQ ID NO: 119267 - DNA, 16 bp, H. sapiens
gtagttctctttgaag

SEQ ID NO: 119268 - DNA, 16 bp, H. sapiens
gtagttgcaatagaga

SEQ ID NO: 119269 - DNA, 16 bp, H. sapiens
gtagtttcataatttg

SEQ ID NO: 119270 - DNA, 16 bp, H. sapiens
gtagtttcttaaaaag

SEQ ID NO: 119271 - DNA, 16 bp, H. sapiens
gtagtttgttcctttt

SEQ ID NO: 119272 - DNA, 16 bp, H. sapiens
gtataaaaatatgcat

SEQ ID NO: 119273 - DNA, 16 bp, H. sapiens
gtataaaaatggacac

SEQ ID NO: 119274 - DNA, 18 bp, H. sapiens
gtataaaacccgattgta

SEQ ID NO: 119275 - DNA, 16 bp, H. sapiens
gtataaaactcactgg

SEQ ID NO: 119276 - DNA, 16 bp, H. sapiens
gtataaactttttttt

SEQ ID NO: 119277 - DNA, 16 bp, H. sapiens
gtataaagttttagtt

SEQ ID NO: 119278 - DNA, 16 bp, H. sapiens
gtataaatattgacac

SEQ ID NO: 119279 - DNA, 16 bp, H. sapiens
gtataaatgtatatat

SEQ ID NO: 119280 - DNA, 16 bp, H. sapiens
gtataaggaggagctg

SEQ ID NO: 119281 - DNA, 16 bp, H. sapiens
gtataagtatgttcca

SEQ ID NO: 119282 - DNA, 16 bp, H. sapiens
gtataataaattattg

SEQ ID NO: 119283 - DNA, 16 bp, H. sapiens
gtataatatactatat

SEQ ID NO: 119284 - DNA, 16 bp, H. sapiens
gtatacacatatatac

SEQ ID NO: 119285 - DNA, 16 bp, H. sapiens
gtatacatgtgccata

SEQ ID NO: 119286 - DNA, 16 bp, H. sapiens
gtatacatgtgtaaca

SEQ ID NO: 119287 - DNA, 16 bp, H. sapiens
gtatacatgtgtcatg

SEQ ID NO: 119288 - DNA, 16 bp, H. sapiens
gtatacattgtgaaat

SEQ ID NO: 119289 - DNA, 16 bp, H. sapiens
gtatacatttatttat

SEQ ID NO: 119290 - DNA, 19 bp, H. sapiens
gtatacccagtaatgggat

SEQ ID NO: 119291 - DNA, 16 bp, H. sapiens
gtatactggaattgaa

SEQ ID NO: 119292 - DNA, 16 bp, H. sapiens
gtatactgtattctta

SEQ ID NO: 119293 - DNA, 16 bp, H. sapiens
gtatagtaatgcttgt

SEQ ID NO: 119294 - DNA, 16 bp, H. sapiens
gtatataaaaatacat

SEQ ID NO: 119295 - DNA, 16 bp, H. sapiens
gtatataaaaatgcta

SEQ ID NO: 119296 - DNA, 16 bp, H. sapiens
gtatataaaatacaat

SEQ ID NO: 119297 - DNA, 16 bp, H. sapiens
gtatataaagcaaata

SEQ ID NO: 119298 - DNA, 16 bp, H. sapiens
gtatataattatcagg

SEQ ID NO: 119299 - DNA, 16 bp, H. sapiens
gtatatacacacatac

SEQ ID NO: 119300 - DNA, 16 bp, H. sapiens
gtatatacacatatac

SEQ ID NO: 119301 - DNA, 17 bp, H. sapiens
gtatatacatatatatg

SEQ ID NO: 119302 - DNA, 16 bp, H. sapiens
gtatatacccagagga

SEQ ID NO: 119303 - DNA, 16 bp, H. sapiens
gtatatacttacatat

SEQ ID NO: 119304 - DNA, 16 bp, H. sapiens
gtatatataaaataca

SEQ ID NO: 119305 - DNA, 16 bp, H. sapiens
gtatatataagtatat

SEQ ID NO: 119306 - DNA, 16 bp, H. sapiens
gtatatataatgttta

SEQ ID NO: 119307 - DNA, 16 bp, H. sapiens
gtatatatacaatgga

SEQ ID NO: 119308 - DNA, 22 bp, H. sapiens
gtatatatacacacacacacat

SEQ ID NO: 119309 - DNA, 17 bp, H. sapiens
gtatatatacacgtata

SEQ ID NO: 119310 - DNA, 16 bp, H. sapiens
gtatatatacttatat

SEQ ID NO: 119311 - DNA, 16 bp, H. sapiens
gtatatataggaaaaa

SEQ ID NO: 119312 - DNA, 16 bp, H. sapiens
gtatatatagtatata

SEQ ID NO: 119313 - DNA, 18 bp, H. sapiens
gtatatatatatacacac

SEQ ID NO: 119314 - DNA, 18 bp, H. sapiens
gtatatatatatgtgtat

SEQ ID NO: 119315 - DNA, 17 bp, H. sapiens
gtatatatatgcatata

SEQ ID NO: 119316 - DNA, 16 bp, H. sapiens
gtatatatatgccatg

SEQ ID NO: 119317 - DNA, 16 bp, H. sapiens
gtatatatatgtacat

SEQ ID NO: 119318 - DNA, 16 bp, H. sapiens
gtatatatgcatattt

SEQ ID NO: 119319 - DNA, 17 bp, H. sapiens
gtatatatgtatatact

SEQ ID NO: 119320 - DNA, 17 bp, H. sapiens
gtatatatgtatgtatg

SEQ ID NO: 119321 - DNA, 16 bp, H. sapiens
gtatatatttacatgt

SEQ ID NO: 119322 - DNA, 16 bp, H. sapiens
gtatatatttacattt

SEQ ID NO: 119323 - DNA, 16 bp, H. sapiens
gtatatatttgtcaaa

SEQ ID NO: 119324 - DNA, 16 bp, H. sapiens
gtatatatttttcttc

SEQ ID NO: 119325 - DNA, 16 bp, H. sapiens
gtatatcatatataca

SEQ ID NO: 119326 - DNA, 16 bp, H. sapiens
gtatatcattgatggg

SEQ ID NO: 119327 - DNA, 16 bp, H. sapiens
gtatatccacacaatg

SEQ ID NO: 119328 - DNA, 16 bp, H. sapiens
gtatatccagtaatgg

SEQ ID NO: 119329 - DNA, 16 bp, H. sapiens
gtatatcttctttggg

SEQ ID NO: 119330 - DNA, 16 bp, H. sapiens
gtatatctttttccat

SEQ ID NO: 119331 - DNA, 16 bp, H. sapiens
gtatatgaaatataca

SEQ ID NO: 119332 - DNA, 16 bp, H. sapiens
gtatatgaagaaaatc

SEQ ID NO: 119333 - DNA, 16 bp, H. sapiens
gtatatgcattttttt

SEQ ID NO: 119334 - DNA, 16 bp, H. sapiens
gtatatggtcaaatga

SEQ ID NO: 119335 - DNA, 16 bp, H. sapiens
gtatatggtgaaaagt

SEQ ID NO: 119336 - DNA, 16 bp, H. sapiens
gtatatgtaccatata

SEQ ID NO: 119337 - DNA, 16 bp, H. sapiens
gtatatgtaccatgtt

SEQ ID NO: 119338 - DNA, 16 bp, H. sapiens
gtatatgtatataatg

SEQ ID NO: 119339 - DNA, 17 bp, H. sapiens
gtatatgtatatatgta

SEQ ID NO: 119340 - DNA, 16 bp, H. sapiens
gtatatgtgtgcatgt

SEQ ID NO: 119341 - DNA, 16 bp, H. sapiens
gtatatgtgtgtctat

SEQ ID NO: 119342 - DNA, 17 bp, H. sapiens
gtatatgtgtgtgtata

SEQ ID NO: 119343 - DNA, 16 bp, H. sapiens
gtatatgtgtgtgtgt

SEQ ID NO: 119344 - DNA, 16 bp, H. sapiens
gtatattctgtggtta

SEQ ID NO: 119345 - DNA, 16 bp, H. sapiens
gtatattctgttgatc

SEQ ID NO: 119346 - DNA, 16 bp, H. sapiens
gtatattgactttgta

SEQ ID NO: 119347 - DNA, 16 bp, H. sapiens
gtatatttgtatacat

SEQ ID NO: 119348 - DNA, 16 bp, H. sapiens
gtatatttgttttcta

SEQ ID NO: 119349 - DNA, 16 bp, H. sapiens
gtatattttctttggt

SEQ ID NO: 119350 - DNA, 16 bp, H. sapiens
gtatcaacagtgaagg

SEQ ID NO: 119351 - DNA, 16 bp, H. sapiens
gtatcaatatttcatt

SEQ ID NO: 119352 - DNA, 16 bp, H. sapiens
gtatcacagaggtttt

SEQ ID NO: 119353 - DNA, 16 bp, H. sapiens
gtatcactgcactcca

SEQ ID NO: 119354 - DNA, 16 bp, H. sapiens
gtatcacttgaggtca

SEQ ID NO: 119355 - DNA, 16 bp, H. sapiens
gtatcacttgtaatgt

SEQ ID NO: 119356 - DNA, 16 bp, H. sapiens
gtatcagatttttttt

SEQ ID NO: 119357 - DNA, 16 bp, H. sapiens
gtatcagtacttcatt

SEQ ID NO: 119358 - DNA, 16 bp, H. sapiens
gtatcatattttcttt

SEQ ID NO: 119359 - DNA, 16 bp, H. sapiens
gtatcatgcaatatac

SEQ ID NO: 119360 - DNA, 16 bp, H. sapiens
gtatccacctggggcc

SEQ ID NO: 119361 - DNA, 16 bp, H. sapiens
gtatccagtttcagct

SEQ ID NO: 119362 - DNA, 16 bp, H. sapiens
gtatccatgtgttctc

SEQ ID NO: 119363 - DNA, 16 bp, H. sapiens
gtatcctgcaagttta

SEQ ID NO: 119364 - DNA, 16 bp, H. sapiens
gtatctaaacatacct

SEQ ID NO: 119365 - DNA, 16 bp, H. sapiens
gtatctactatgtgcc

SEQ ID NO: 119366 - DNA, 16 bp, H. sapiens
gtatctatccagagga

SEQ ID NO: 119367 - DNA, 16 bp, H. sapiens
gtatctcaaaataaca

SEQ ID NO: 119368 - DNA, 16 bp, H. sapiens
gtatctcttcatctgg

SEQ ID NO: 119369 - DNA, 16 bp, H. sapiens
gtatctgacagaagaa

SEQ ID NO: 119370 - DNA, 16 bp, H. sapiens
gtatctgctggaagaa

SEQ ID NO: 119371 - DNA, 16 bp, H. sapiens
gtatcttatacttgtg

SEQ ID NO: 119372 - DNA, 16 bp, H. sapiens
gtatcttattgccaca

SEQ ID NO: 119373 - DNA, 16 bp, H. sapiens
gtatcttctcagacca

SEQ ID NO: 119374 - DNA, 16 bp, H. sapiens
gtatctttatagcaat

SEQ ID NO: 119375 - DNA, 16 bp, H. sapiens
gtatcttttaaaattt

SEQ ID NO: 119376 - DNA, 16 bp, H. sapiens
gtatcttttctatatt

SEQ ID NO: 119377 - DNA, 16 bp, H. sapiens
gtatcttttctgacca

SEQ ID NO: 119378 - DNA, 16 bp, H. sapiens
gtatcttttctgtgtt

SEQ ID NO: 119379 - DNA, 16 bp, H. sapiens
gtatctttttaaaaaa

SEQ ID NO: 119380 - DNA, 16 bp, H. sapiens
gtatgaaaatgggcta

SEQ ID NO: 119381 - DNA, 16 bp, H. sapiens
gtatgaagttcccagg

SEQ ID NO: 119382 - DNA, 16 bp, H. sapiens
gtatgagccaccctgc

SEQ ID NO: 119383 - DNA, 16 bp, H. sapiens
gtatgagggtgaagtt

SEQ ID NO: 119384 - DNA, 16 bp, H. sapiens
gtatgatcatagctca

SEQ ID NO: 119385 - DNA, 16 bp, H. sapiens
gtatgatgcctccagc

SEQ ID NO: 119386 - DNA, 16 bp, H. sapiens
gtatgatgctgttttg

SEQ ID NO: 119387 - DNA, 16 bp, H. sapiens
gtatgcaccaaacaac

SEQ ID NO: 119388 - DNA, 16 bp, H. sapiens
gtatgcagaagaataa

SEQ ID NO: 119389 - DNA, 16 bp, H. sapiens
gtatgcagaagtacag

SEQ ID NO: 119390 - DNA, 16 bp, H. sapiens
gtatgcatttatcaaa

SEQ ID NO: 119391 - DNA, 16 bp, H. sapiens
gtatggccaggcatgg

SEQ ID NO: 119392 - DNA, 16 bp, H. sapiens
gtatggcctgttgctc

SEQ ID NO: 119393 - DNA, 16 bp, H. sapiens
gtatggctagccagtt

SEQ ID NO: 119394 - DNA, 16 bp, H. sapiens
gtatgggtcagaagga

SEQ ID NO: 119395 - DNA, 16 bp, H. sapiens
gtatggtaattctatt

SEQ ID NO: 119396 - DNA, 16 bp, H. sapiens
gtatggtatataaatt

SEQ ID NO: 119397 - DNA, 16 bp, H. sapiens
gtatggtattttgtta

SEQ ID NO: 119398 - DNA, 16 bp, H. sapiens
gtatggtggcgtgcgc

SEQ ID NO: 119399 - DNA, 16 bp, H. sapiens
gtatggtgtgtatgtg

SEQ ID NO: 119400 - DNA, 16 bp, H. sapiens
gtatgtaaattatatc

SEQ ID NO: 119401 - DNA, 16 bp, H. sapiens
gtatgtaatacatata

SEQ ID NO: 119402 - DNA, 16 bp, H. sapiens
gtatgtacatatgcat

SEQ ID NO: 119403 - DNA, 16 bp, H. sapiens
gtatgtacccaaagaa

SEQ ID NO: 119404 - DNA, 16 bp, H. sapiens
gtatgtactacatttt

SEQ ID NO: 119405 - DNA, 24 bp, H. sapiens
gtatgtagaaagctgaaactggat

SEQ ID NO: 119406 - DNA, 16 bp, H. sapiens
gtatgtagagggaaat

SEQ ID NO: 119407 - DNA, 16 bp, H. sapiens
gtatgtagtgatatct

SEQ ID NO: 119408 - DNA, 16 bp, H. sapiens
gtatgtatccagtaat

SEQ ID NO: 119409 - DNA, 16 bp, H. sapiens
gtatgtatgtataatt

SEQ ID NO: 119410 - DNA, 16 bp, H. sapiens
gtatgtatgtatgtat

SEQ ID NO: 119411 - DNA, 16 bp, H. sapiens
gtatgtatgtatgtgc

SEQ ID NO: 119412 - DNA, 16 bp, H. sapiens
gtatgtatgtatttaa

SEQ ID NO: 119413 - DNA, 16 bp, H. sapiens
gtatgtatgtatttag

SEQ ID NO: 119414 - DNA, 16 bp, H. sapiens
gtatgtatgtgtgtat

SEQ ID NO: 119415 - DNA, 16 bp, H. sapiens
gtatgtattatgtatg

SEQ ID NO: 119416 - DNA, 16 bp, H. sapiens
gtatgtctcttcattt

SEQ ID NO: 119417 - DNA, 16 bp, H. sapiens
gtatgtctgcttttga

SEQ ID NO: 119418 - DNA, 16 bp, H. sapiens
gtatgtctttggagaa

SEQ ID NO: 119419 - DNA, 16 bp, H. sapiens
gtatgtgatgttcccc

SEQ ID NO: 119420 - DNA, 16 bp, H. sapiens
gtatgtgctgtgtgtg

SEQ ID NO: 119421 - DNA, 16 bp, H. sapiens
gtatgtgtatacacac

SEQ ID NO: 119422 - DNA, 16 bp, H. sapiens
gtatgtgtgcatatgt

SEQ ID NO: 119423 - DNA, 16 bp, H. sapiens
gtatgtgtgtatgtgc

SEQ ID NO: 119424 - DNA, 16 bp, H. sapiens
gtatgtgtgtctgttt

SEQ ID NO: 119425 - DNA, 16 bp, H. sapiens
gtatgtgtgtgcgtgc

SEQ ID NO: 119426 - DNA, 16 bp, H. sapiens
gtatgtgtgtgtgtaa

SEQ ID NO: 119427 - DNA, 16 bp, H. sapiens
gtatgttgaattttat

SEQ ID NO: 119428 - DNA, 16 bp, H. sapiens
gtatgttgtatctttt

SEQ ID NO: 119429 - DNA, 16 bp, H. sapiens
gtatgttgtttctttg

SEQ ID NO: 119430 - DNA, 16 bp, H. sapiens
gtattaaagatttaaa

SEQ ID NO: 119431 - DNA, 16 bp, H. sapiens
gtattaaatacatttt

SEQ ID NO: 119432 - DNA, 16 bp, H. sapiens
gtattaaccatcacaa

SEQ ID NO: 119433 - DNA, 16 bp, H. sapiens
gtattaggagatggga

SEQ ID NO: 119434 - DNA, 16 bp, H. sapiens
gtattaggtcattctt

SEQ ID NO: 119435 - DNA, 21 bp, H. sapiens
gtattagtagagacagggttt

SEQ ID NO: 119436 - DNA, 16 bp, H. sapiens
gtattagtatttcatt

SEQ ID NO: 119437 - DNA, 16 bp, H. sapiens
gtattagtgtatttta

SEQ ID NO: 119438 - DNA, 16 bp, H. sapiens
gtattattaaaaagtc

SEQ ID NO: 119439 - DNA, 16 bp, H. sapiens
gtattattattcccat

SEQ ID NO: 119440 - DNA, 16 bp, H. sapiens
gtattattccattttc

SEQ ID NO: 119441 - DNA, 16 bp, H. sapiens
gtattattttaagcca

SEQ ID NO: 119442 - DNA, 16 bp, H. sapiens
gtattattttcttcat

SEQ ID NO: 119443 - DNA, 16 bp, H. sapiens
gtattcaaaattattt

SEQ ID NO: 119444 - DNA, 16 bp, H. sapiens
gtattcaagagaccca

SEQ ID NO: 119445 - DNA, 16 bp, H. sapiens
gtattccatggtgtgt

SEQ ID NO: 119446 - DNA, 16 bp, H. sapiens
gtattccatggtttat

SEQ ID NO: 119447 - DNA, 16 bp, H. sapiens
gtattctgaaattctt

SEQ ID NO: 119448 - DNA, 16 bp, H. sapiens
gtattcttaaaaaaaa

SEQ ID NO: 119449 - DNA, 16 bp, H. sapiens
gtattcttagtagaga

SEQ ID NO: 119450 - DNA, 16 bp, H. sapiens
gtattcttttgaaaag

SEQ ID NO: 119451 - DNA, 16 bp, H. sapiens
gtattgaagtcctcca

SEQ ID NO: 119452 - DNA, 16 bp, H. sapiens
gtattgatccctttac

SEQ ID NO: 119453 - DNA, 16 bp, H. sapiens
gtattgatttaaaaaa

SEQ ID NO: 119454 - DNA, 16 bp, H. sapiens
gtattgccaaaagaga

SEQ ID NO: 119455 - DNA, 16 bp, H. sapiens
gtattgctcacttcaa

SEQ ID NO: 119456 - DNA, 16 bp, H. sapiens
gtattgtcagtgtttt

SEQ ID NO: 119457 - DNA, 16 bp, H. sapiens
gtattgttggtagaga

SEQ ID NO: 119458 - DNA, 16 bp, H. sapiens
gtattgtttataatag

SEQ ID NO: 119459 - DNA, 16 bp, H. sapiens
gtatttaacatttatt

SEQ ID NO: 119460 - DNA, 16 bp, H. sapiens
gtatttaccacatttt

SEQ ID NO: 119461 - DNA, 16 bp, H. sapiens
gtatttactcaagaaa

SEQ ID NO: 119462 - DNA, 16 bp, H. sapiens
gtatttaggccattta

SEQ ID NO: 119463 - DNA, 16 bp, H. sapiens
gtatttatctgaagat

SEQ ID NO: 119464 - DNA, 16 bp, H. sapiens
gtatttattgaacatt

SEQ ID NO: 119465 - DNA, 16 bp, H. sapiens
gtatttcaaaatagtt

SEQ ID NO: 119466 - DNA, 16 bp, H. sapiens
gtatttcattgtatgt

SEQ ID NO: 119467 - DNA, 16 bp, H. sapiens
gtatttcatttctcct

SEQ ID NO: 119468 - DNA, 16 bp, H. sapiens
gtatttccagaagaga

SEQ ID NO: 119469 - DNA, 16 bp, H. sapiens
gtatttcccctgcttg

SEQ ID NO: 119470 - DNA, 16 bp, H. sapiens
gtatttctgcctctag

SEQ ID NO: 119471 - DNA, 16 bp, H. sapiens
gtatttcttcaaagca

SEQ ID NO: 119472 - DNA, 16 bp, H. sapiens
gtatttcttcagagca

SEQ ID NO: 119473 - DNA, 16 bp, H. sapiens
gtatttcttgatagca

SEQ ID NO: 119474 - DNA, 16 bp, H. sapiens
gtatttctttatagca

SEQ ID NO: 119475 - DNA, 16 bp, H. sapiens
gtatttctttgatgat

SEQ ID NO: 119476 - DNA, 16 bp, H. sapiens
gtatttctttgtggtt

SEQ ID NO: 119477 - DNA, 16 bp, H. sapiens
gtatttgaagggactt

SEQ ID NO: 119478 - DNA, 16 bp, H. sapiens
gtatttgatttcctgt

SEQ ID NO: 119479 - DNA, 16 bp, H. sapiens
gtatttgtagtagaga

SEQ ID NO: 119480 - DNA, 16 bp, H. sapiens
gtattttaaaagcaaa

SEQ ID NO: 119481 - DNA, 16 bp, H. sapiens
gtattttaagtctttt

SEQ ID NO: 119482 - DNA, 16 bp, H. sapiens
gtattttacatgcatt

SEQ ID NO: 119483 - DNA, 16 bp, H. sapiens
gtattttagtagaaat

SEQ ID NO: 119484 - DNA, 16 bp, H. sapiens
gtattttcaaatattt

SEQ ID NO: 119485 - DNA, 16 bp, H. sapiens
gtattttcactgccct

SEQ ID NO: 119486 - DNA, 16 bp, H. sapiens
gtattttcagtagaga

SEQ ID NO: 119487 - DNA, 16 bp, H. sapiens
gtattttcagtatttt

SEQ ID NO: 119488 - DNA, 16 bp, H. sapiens
gtattttcagttgaga

SEQ ID NO: 119489 - DNA, 16 bp, H. sapiens
gtattttcatatgttt

SEQ ID NO: 119490 - DNA, 16 bp, H. sapiens
gtattttctaaatgtt

SEQ ID NO: 119491 - DNA, 16 bp, H. sapiens
gtattttgatagagat

SEQ ID NO: 119492 - DNA, 16 bp, H. sapiens
gtattttgcaaaaagt

SEQ ID NO: 119493 - DNA, 16 bp, H. sapiens
gtattttgcatgtgag

SEQ ID NO: 119494 - DNA, 16 bp, H. sapiens
gtattttgctatagca

SEQ ID NO: 119495 - DNA, 16 bp, H. sapiens
gtattttgctgaagat

SEQ ID NO: 119496 - DNA, 16 bp, H. sapiens
gtattttgctgctgtt

SEQ ID NO: 119497 - DNA, 16 bp, H. sapiens
gtattttgctttttaa

SEQ ID NO: 119498 - DNA, 16 bp, H. sapiens
gtattttgttctggca

SEQ ID NO: 119499 - DNA, 16 bp, H. sapiens
gtatttttaaaactca

SEQ ID NO: 119500 - DNA, 16 bp, H. sapiens
gtatttttaaatagag

SEQ ID NO: 119501 - DNA, 16 bp, H. sapiens
gtatttttaataaaga

SEQ ID NO: 119502 - DNA, 16 bp, H. sapiens
gtatttttaatagaga

SEQ ID NO: 119503 - DNA, 16 bp, H. sapiens
gtatttttagtaaaga

SEQ ID NO: 119504 - DNA, 16 bp, H. sapiens
gtatttttagtacaga

SEQ ID NO: 119505 - DNA, 16 bp, H. sapiens
gtatttttagtagaaa

SEQ ID NO: 119506 - DNA, 16 bp, H. sapiens
gtatttttagtagaca

SEQ ID NO: 119507 - DNA, 16 bp, H. sapiens
gtatttttagtagaga

SEQ ID NO: 119508 - DNA, 16 bp, H. sapiens
gtatttttagtagtgg

SEQ ID NO: 119509 - DNA, 16 bp, H. sapiens
gtatttttagtggaga

SEQ ID NO: 119510 - DNA, 16 bp, H. sapiens
gtatttttattaaaga

SEQ ID NO: 119511 - DNA, 16 bp, H. sapiens
gtatttttattagaaa

SEQ ID NO: 119512 - DNA, 16 bp, H. sapiens
gtatttttcatagaga

SEQ ID NO: 119513 - DNA, 16 bp, H. sapiens
gtatttttcattaaat

SEQ ID NO: 119514 - DNA, 16 bp, H. sapiens
gtatttttgcatctgt

SEQ ID NO: 119515 - DNA, 16 bp, H. sapiens
gtatttttggtaaaga

SEQ ID NO: 119516 - DNA, 16 bp, H. sapiens
gtatttttgtacagat

SEQ ID NO: 119517 - DNA, 16 bp, H. sapiens
gtattttttaaaggtt

SEQ ID NO: 119518 - DNA, 16 bp, H. sapiens
gtattttttatggaga

SEQ ID NO: 119519 - DNA, 16 bp, H. sapiens
gtattttttgaagaga

SEQ ID NO: 119520 - DNA, 16 bp, H. sapiens
gtattttttgtacaaa

SEQ ID NO: 119521 - DNA, 16 bp, H. sapiens
gtattttttgtacaga

SEQ ID NO: 119522 - DNA, 16 bp, H. sapiens
gtatttttttcaaatg

SEQ ID NO: 119523 - DNA, 16 bp, H. sapiens
gtatttttttctaaat

SEQ ID NO: 119524 - DNA, 16 bp, H. sapiens
gtatttttttgcagag

SEQ ID NO: 119525 - DNA, 16 bp, H. sapiens
gtatttttttgtaaag

SEQ ID NO: 119526 - DNA, 16 bp, H. sapiens
gtcaaaagataacaag

SEQ ID NO: 119527 - DNA, 16 bp, H. sapiens
gtcaaaagatacaaaa

SEQ ID NO: 119528 - DNA, 16 bp, H. sapiens
gtcaaaatcacaatga

SEQ ID NO: 119529 - DNA, 16 bp, H. sapiens
gtcaaaatccatagaa

SEQ ID NO: 119530 - DNA, 16 bp, H. sapiens
gtcaaagacaaagaga

SEQ ID NO: 119531 - DNA, 16 bp, H. sapiens
gtcaaaggattgagaa

SEQ ID NO: 119532 - DNA, 16 bp, H. sapiens
gtcaaataatgacaat

SEQ ID NO: 119533 - DNA, 16 bp, H. sapiens
gtcaaatggaaaaaaa

SEQ ID NO: 119534 - DNA, 16 bp, H. sapiens
gtcaaatggtattttt

SEQ ID NO: 119535 - DNA, 16 bp, H. sapiens
gtcaaattttccctgt

SEQ ID NO: 119536 - DNA, 16 bp, H. sapiens
gtcaacaataaaatca

SEQ ID NO: 119537 - DNA, 16 bp, H. sapiens
gtcaacagatcaagac

SEQ ID NO: 119538 - DNA, 20 bp, H. sapiens
gtcaacattagacagatcga

SEQ ID NO: 119539 - DNA, 16 bp, H. sapiens
gtcaaccaggctgcag

SEQ ID NO: 119540 - DNA, 16 bp, H. sapiens
gtcaactgcatttttc

SEQ ID NO: 119541 - DNA, 16 bp, H. sapiens
gtcaacttcttcctgg

SEQ ID NO: 119542 - DNA, 16 bp, H. sapiens
gtcaagagaaagaaaa

SEQ ID NO: 119543 - DNA, 16 bp, H. sapiens
gtcaagagaatgaaaa

SEQ ID NO: 119544 - DNA, 16 bp, H. sapiens
gtcaagatacagaaca

SEQ ID NO: 119545 - DNA, 16 bp, H. sapiens
gtcaagatgaagaaaa

SEQ ID NO: 119546 - DNA, 16 bp, H. sapiens
gtcaagattaaaattt

SEQ ID NO: 119547 - DNA, 16 bp, H. sapiens
gtcaagattctccaga

SEQ ID NO: 119548 - DNA, 16 bp, H. sapiens
gtcaagattttaaaaa

SEQ ID NO: 119549 - DNA, 16 bp, H. sapiens
gtcaagctgagagcca

SEQ ID NO: 119550 - DNA, 16 bp, H. sapiens
gtcaagctgggaacta

SEQ ID NO: 119551 - DNA, 16 bp, H. sapiens
gtcaagctgggaactg

SEQ ID NO: 119552 - DNA, 16 bp, H. sapiens
gtcaagctggtctcca

SEQ ID NO: 119553 - DNA, 16 bp, H. sapiens
gtcaaggaatttattc

SEQ ID NO: 119554 - DNA, 16 bp, H. sapiens
gtcaaggagaactaca

SEQ ID NO: 119555 - DNA, 16 bp, H. sapiens
gtcaaggatgcagaga

SEQ ID NO: 119556 - DNA, 16 bp, H. sapiens
gtcaaggatttcgagg

SEQ ID NO: 119557 - DNA, 16 bp, H. sapiens
gtcaaggcaggaggat

SEQ ID NO: 119558 - DNA, 16 bp, H. sapiens
gtcaaggcaggtggat

SEQ ID NO: 119559 - DNA, 16 bp, H. sapiens
gtcaaggctgcagtga

SEQ ID NO: 119560 - DNA, 17 bp, H. sapiens
gtcaaggctgcagtgaa

SEQ ID NO: 119561 - DNA, 16 bp, H. sapiens
gtcaaggtgggtggat

SEQ ID NO: 119562 - DNA, 16 bp, H. sapiens
gtcaataaatgtgatg

SEQ ID NO: 119563 - DNA, 16 bp, H. sapiens
gtcaataaatttctgt

SEQ ID NO: 119564 - DNA, 16 bp, H. sapiens
gtcaatgaaatagaaa

SEQ ID NO: 119565 - DNA, 16 bp, H. sapiens
gtcaattaaaattctt

SEQ ID NO: 119566 - DNA, 16 bp, H. sapiens
gtcaattgatcttcaa

SEQ ID NO: 119567 - DNA, 16 bp, H. sapiens
gtcaatttcagaataa

SEQ ID NO: 119568 - DNA, 16 bp, H. sapiens
gtcaattttgtcttct

SEQ ID NO: 119569 - DNA, 16 bp, H. sapiens
gtcacaaaacaagtct

SEQ ID NO: 119570 - DNA, 16 bp, H. sapiens
gtcacaaaagaacaaa

SEQ ID NO: 119571 - DNA, 16 bp, H. sapiens
gtcacaactcactgca

SEQ ID NO: 119572 - DNA, 16 bp, H. sapiens
gtcacaaggtcaagag

SEQ ID NO: 119573 - DNA, 16 bp, H. sapiens
gtcacacagctgctaa

SEQ ID NO: 119574 - DNA, 16 bp, H. sapiens
gtcacacagcttataa

SEQ ID NO: 119575 - DNA, 16 bp, H. sapiens
gtcacagaaggacaaa

SEQ ID NO: 119576 - DNA, 16 bp, H. sapiens
gtcacagccaagagga

SEQ ID NO: 119577 - DNA, 16 bp, H. sapiens
gtcacagctgcttggg

SEQ ID NO: 119578 - DNA, 16 bp, H. sapiens
gtcacaggttccaggg

SEQ ID NO: 119579 - DNA, 16 bp, H. sapiens
gtcacagtgctgcaga

SEQ ID NO: 119580 - DNA, 16 bp, H. sapiens
gtcacataaaactttg

SEQ ID NO: 119581 - DNA, 16 bp, H. sapiens
gtcacatgtatgtctt

SEQ ID NO: 119582 - DNA, 16 bp, H. sapiens
gtcacattctgaggta

SEQ ID NO: 119583 - DNA, 16 bp, H. sapiens
gtcaccacgctcggct

SEQ ID NO: 119584 - DNA, 16 bp, H. sapiens
gtcaccactcctcttc

SEQ ID NO: 119585 - DNA, 16 bp, H. sapiens
gtcaccaggctggaga

SEQ ID NO: 119586 - DNA, 16 bp, H. sapiens
gtcaccatcaccacca

SEQ ID NO: 119587 - DNA, 16 bp, H. sapiens
gtcaccatcaccatca

SEQ ID NO: 119588 - DNA, 16 bp, H. sapiens
gtcaccatcatcatca

SEQ ID NO: 119589 - DNA, 16 bp, H. sapiens
gtcaccatcctccaga

SEQ ID NO: 119590 - DNA, 16 bp, H. sapiens
gtcaccatgccaggct

SEQ ID NO: 119591 - DNA, 16 bp, H. sapiens
gtcaccatgcgacctg

SEQ ID NO: 119592 - DNA, 16 bp, H. sapiens
gtcaccatgtccagct

SEQ ID NO: 119593 - DNA, 17 bp, H. sapiens
gtcaccatgttggccag

SEQ ID NO: 119594 - DNA, 16 bp, H. sapiens
gtcacccaagaactct

SEQ ID NO: 119595 - DNA, 16 bp, H. sapiens
gtcacccaccaccatg

SEQ ID NO: 119596 - DNA, 16 bp, H. sapiens
gtcacccactcactca

SEQ ID NO: 119597 - DNA, 16 bp, H. sapiens
gtcacccaggctccag

SEQ ID NO: 119598 - DNA, 16 bp, H. sapiens
gtcacccaggctgcag

SEQ ID NO: 119599 - DNA, 16 bp, H. sapiens
gtcacccaggctgctg

SEQ ID NO: 119600 - DNA, 16 bp, H. sapiens
gtcacccaggctttag

SEQ ID NO: 119601 - DNA, 16 bp, H. sapiens
gtcacccagggtgaag

SEQ ID NO: 119602 - DNA, 16 bp, H. sapiens
gtcaccccagccaaca

SEQ ID NO: 119603 - DNA, 16 bp, H. sapiens
gtcacccctggaggcc

SEQ ID NO: 119604 - DNA, 16 bp, H. sapiens
gtcacccgggctgcag

SEQ ID NO: 119605 - DNA, 16 bp, H. sapiens
gtcaccctctgtcacc

SEQ ID NO: 119606 - DNA, 16 bp, H. sapiens
gtcaccctggctggaa

SEQ ID NO: 119607 - DNA, 16 bp, H. sapiens
gtcacctaggctgcag

SEQ ID NO: 119608 - DNA, 16 bp, H. sapiens
gtcacctatacttctg

SEQ ID NO: 119609 - DNA, 16 bp, H. sapiens
gtcacctctgcctccc

SEQ ID NO: 119610 - DNA, 16 bp, H. sapiens
gtcacctcttcagaga

SEQ ID NO: 119611 - DNA, 20 bp, H. sapiens
gtcacctgaggtcaggagtt

SEQ ID NO: 119612 - DNA, 16 bp, H. sapiens
gtcacctgtgctggag

SEQ ID NO: 119613 - DNA, 16 bp, H. sapiens
gtcaccttttgcagtg

SEQ ID NO: 119614 - DNA, 17 bp, H. sapiens
gtcacgatctcctgacc

SEQ ID NO: 119615 - DNA, 16 bp, H. sapiens
gtcactcaccctctct

SEQ ID NO: 119616 - DNA, 16 bp, H. sapiens
gtcactcaggctgcag

SEQ ID NO: 119617 - DNA, 16 bp, H. sapiens
gtcactcaggtagtga

SEQ ID NO: 119618 - DNA, 16 bp, H. sapiens
gtcactcctctgctca

SEQ ID NO: 119619 - DNA, 16 bp, H. sapiens
gtcactcctttctttg

SEQ ID NO: 119620 - DNA, 16 bp, H. sapiens
gtcactctggctgctg

SEQ ID NO: 119621 - DNA, 16 bp, H. sapiens
gtcactctgtgccttt

SEQ ID NO: 119622 - DNA, 16 bp, H. sapiens
gtcactgaggctggaa

SEQ ID NO: 119623 - DNA, 16 bp, H. sapiens
gtcactgcacccagct

SEQ ID NO: 119624 - DNA, 16 bp, H. sapiens
gtcactgcactgcagc

SEQ ID NO: 119625 - DNA, 17 bp, H. sapiens
gtcactgcagcctctgc

SEQ ID NO: 119626 - DNA, 16 bp, H. sapiens
gtcactgtgcccagcc

SEQ ID NO: 119627 - DNA, 16 bp, H. sapiens
gtcactgtgcttggcc

SEQ ID NO: 119628 - DNA, 16 bp, H. sapiens
gtcacttcccaccagg

SEQ ID NO: 119629 - DNA, 20 bp, H. sapiens
gtcacttgaggtcgggagtt

SEQ ID NO: 119630 - DNA, 16 bp, H. sapiens
gtcacttttcacagaa

SEQ ID NO: 119631 - DNA, 16 bp, H. sapiens
gtcactttttggttta

SEQ ID NO: 119632 - DNA, 16 bp, H. sapiens
gtcagaaaagtgcagt

SEQ ID NO: 119633 - DNA, 16 bp, H. sapiens
gtcagaagttccagac

SEQ ID NO: 119634 - DNA, 16 bp, H. sapiens
gtcagaatttcgagac

SEQ ID NO: 119635 - DNA, 16 bp, H. sapiens
gtcagacatggtggca

SEQ ID NO: 119636 - DNA, 16 bp, H. sapiens
gtcagacctaaagcca

SEQ ID NO: 119637 - DNA, 16 bp, H. sapiens
gtcagagaagatgttt

SEQ ID NO: 119638 - DNA, 16 bp, H. sapiens
gtcagagagccctggg

SEQ ID NO: 119639 - DNA, 16 bp, H. sapiens
gtcagaggccttttct

SEQ ID NO: 119640 - DNA, 16 bp, H. sapiens
gtcagagggaggaggc

SEQ ID NO: 119641 - DNA, 16 bp, H. sapiens
gtcagaggtcccagaa

SEQ ID NO: 119642 - DNA, 20 bp, H. sapiens
gtcagagtgaacaggcaacc

SEQ ID NO: 119643 - DNA, 24 bp, H. sapiens
gtcagagtgaacaggcaacctaca

SEQ ID NO: 119644 - DNA, 16 bp, H. sapiens
gtcagataaagaaaaa

SEQ ID NO: 119645 - DNA, 16 bp, H. sapiens
gtcagataatgtgatg

SEQ ID NO: 119646 - DNA, 16 bp, H. sapiens
gtcagatgcatacttt

SEQ ID NO: 119647 - DNA, 16 bp, H. sapiens
gtcagatgcatagttc

SEQ ID NO: 119648 - DNA, 16 bp, H. sapiens
gtcagattctccaagg

SEQ ID NO: 119649 - DNA, 16 bp, H. sapiens
gtcagcaaacaacaga

SEQ ID NO: 119650 - DNA, 16 bp, H. sapiens
gtcagcacaagataca

SEQ ID NO: 119651 - DNA, 16 bp, H. sapiens
gtcagcagatgatgaa

SEQ ID NO: 119652 - DNA, 16 bp, H. sapiens
gtcagcagcagcagca

SEQ ID NO: 119653 - DNA, 16 bp, H. sapiens
gtcagcaggaaaacat

SEQ ID NO: 119654 - DNA, 16 bp, H. sapiens
gtcagccaagctggag

SEQ ID NO: 119655 - DNA, 16 bp, H. sapiens
gtcagccaggctgaag

SEQ ID NO: 119656 - DNA, 16 bp, H. sapiens
gtcagccaggctgcag

SEQ ID NO: 119657 - DNA, 16 bp, H. sapiens
gtcagccctgtggaac

SEQ ID NO: 119658 - DNA, 16 bp, H. sapiens
gtcagcctgggcaaca

SEQ ID NO: 119659 - DNA, 16 bp, H. sapiens
gtcagcgagaccatga

SEQ ID NO: 119660 - DNA, 16 bp, H. sapiens
gtcagctgcttgattt

SEQ ID NO: 119661 - DNA, 16 bp, H. sapiens
gtcagctggtctcaaa

SEQ ID NO: 119662 - DNA, 17 bp, H. sapiens
gtcaggaaatccagacc

SEQ ID NO: 119663 - DNA, 16 bp, H. sapiens
gtcaggaatttggaaa

SEQ ID NO: 119664 - DNA, 16 bp, H. sapiens
gtcaggagacagagac

SEQ ID NO: 119665 - DNA, 16 bp, H. sapiens
gtcaggagatccaggc

SEQ ID NO: 119666 - DNA, 16 bp, H. sapiens
gtcaggagcctggcca

SEQ ID NO: 119667 - DNA, 16 bp, H. sapiens
gtcaggaggcagaagg

SEQ ID NO: 119668 - DNA, 17 bp, H. sapiens
gtcaggatacaaaatca

SEQ ID NO: 119669 - DNA, 16 bp, H. sapiens
gtcaggatcagctgct

SEQ ID NO: 119670 - DNA, 17 bp, H. sapiens
gtcaggatgacctgcct

SEQ ID NO: 119671 - DNA, 23 bp, H. sapiens
gtcaggccctccacaagaggtgg

SEQ ID NO: 119672 - DNA, 16 bp, H. sapiens
gtcaggctgcaaattt

SEQ ID NO: 119673 - DNA, 16 bp, H. sapiens
gtcaggctgtctcgaa

SEQ ID NO: 119674 - DNA, 16 bp, H. sapiens
gtcaggcttggtggct

SEQ ID NO: 119675 - DNA, 16 bp, H. sapiens
gtcagggacccacttg

SEQ ID NO: 119676 - DNA, 16 bp, H. sapiens
gtcagggaggacttcc

SEQ ID NO: 119677 - DNA, 18 bp, H. sapiens
gtcagggagttccctttc

SEQ ID NO: 119678 - DNA, 16 bp, H. sapiens
gtcaggggctggggga

SEQ ID NO: 119679 - DNA, 16 bp, H. sapiens
gtcagggtcaggcctg

SEQ ID NO: 119680 - DNA, 16 bp, H. sapiens
gtcagggtcagggtca

SEQ ID NO: 119681 - DNA, 16 bp, H. sapiens
gtcaggtgctgtgtgt

SEQ ID NO: 119682 - DNA, 16 bp, H. sapiens
gtcaggttacctacaa

SEQ ID NO: 119683 - DNA, 16 bp, H. sapiens
gtcaggtttgccaaag

SEQ ID NO: 119684 - DNA, 16 bp, H. sapiens
gtcagtactgaaacag

SEQ ID NO: 119685 - DNA, 16 bp, H. sapiens
gtcagtatggccattt

SEQ ID NO: 119686 - DNA, 16 bp, H. sapiens
gtcagtcccagtgaga

SEQ ID NO: 119687 - DNA, 16 bp, H. sapiens
gtcagtctgtctgtct

SEQ ID NO: 119688 - DNA, 16 bp, H. sapiens
gtcagtgatgatgagc

SEQ ID NO: 119689 - DNA, 16 bp, H. sapiens
gtcagtggatctacta

SEQ ID NO: 119690 - DNA, 16 bp, H. sapiens
gtcagtggatggaaaa

SEQ ID NO: 119691 - DNA, 16 bp, H. sapiens
gtcagtgggtgcagtg

SEQ ID NO: 119692 - DNA, 16 bp, H. sapiens
gtcagttcagagccag

SEQ ID NO: 119693 - DNA, 16 bp, H. sapiens
gtcagtttagcaagaa

SEQ ID NO: 119694 - DNA, 16 bp, H. sapiens
gtcagttttatctttt

SEQ ID NO: 119695 - DNA, 16 bp, H. sapiens
gtcagttttttaaaaa

SEQ ID NO: 119696 - DNA, 16 bp, H. sapiens
gtcataaaaaatgaaa

SEQ ID NO: 119697 - DNA, 16 bp, H. sapiens
gtcataaaacaagtct

SEQ ID NO: 119698 - DNA, 16 bp, H. sapiens
gtcataaaagacattg

SEQ ID NO: 119699 - DNA, 16 bp, H. sapiens
gtcataaaaggacaaa

SEQ ID NO: 119700 - DNA, 16 bp, H. sapiens
gtcatagaaaccagaa

SEQ ID NO: 119701 - DNA, 16 bp, H. sapiens
gtcatatcatttggat

SEQ ID NO: 119702 - DNA, 16 bp, H. sapiens
gtcatatctgagaaat

SEQ ID NO: 119703 - DNA, 16 bp, H. sapiens
gtcatatgcatagttt

SEQ ID NO: 119704 - DNA, 16 bp, H. sapiens
gtcatatgctacaaca

SEQ ID NO: 119705 - DNA, 16 bp, H. sapiens
gtcatatggtttttgt

SEQ ID NO: 119706 - DNA, 16 bp, H. sapiens
gtcatatttttcttct

SEQ ID NO: 119707 - DNA, 16 bp, H. sapiens
gtcatcaagacagaaa

SEQ ID NO: 119708 - DNA, 16 bp, H. sapiens
gtcatcaccctcactg

SEQ ID NO: 119709 - DNA, 16 bp, H. sapiens
gtcatcataatgctag

SEQ ID NO: 119710 - DNA, 16 bp, H. sapiens
gtcatcatcaccatca

SEQ ID NO: 119711 - DNA, 16 bp, H. sapiens
gtcatccagacagaaa

SEQ ID NO: 119712 - DNA, 16 bp, H. sapiens
gtcatccaggctggat

SEQ ID NO: 119713 - DNA, 16 bp, H. sapiens
gtcatcccttggtatc

SEQ ID NO: 119714 - DNA, 16 bp, H. sapiens
gtcatctaagttttaa

SEQ ID NO: 119715 - DNA, 16 bp, H. sapiens
gtcatctcagcccaaa

SEQ ID NO: 119716 - DNA, 16 bp, H. sapiens
gtcatctcagctactc

SEQ ID NO: 119717 - DNA, 16 bp, H. sapiens
gtcatctgaaggcttg

SEQ ID NO: 119718 - DNA, 20 bp, H. sapiens
gtcatctgaggtcaggagtt

SEQ ID NO: 119719 - DNA, 16 bp, H. sapiens
gtcatctgcaaacaaa

SEQ ID NO: 119720 - DNA, 16 bp, H. sapiens
gtcatctgcaagcaaa

SEQ ID NO: 119721 - DNA, 16 bp, H. sapiens
gtcatctgcctgcctc

SEQ ID NO: 119722 - DNA, 16 bp, H. sapiens
gtcatcttcccacctc

SEQ ID NO: 119723 - DNA, 16 bp, H. sapiens
gtcatctttgattttt

SEQ ID NO: 119724 - DNA, 16 bp, H. sapiens
gtcatctttggaaaat

SEQ ID NO: 119725 - DNA, 16 bp, H. sapiens
gtcatgaaagacaaga

SEQ ID NO: 119726 - DNA, 16 bp, H. sapiens
gtcatgaaatccttgc

SEQ ID NO: 119727 - DNA, 16 bp, H. sapiens
gtcatgaagcttccat

SEQ ID NO: 119728 - DNA, 16 bp, H. sapiens
gtcatgagccaccgca

SEQ ID NO: 119729 - DNA, 16 bp, H. sapiens
gtcatgatgtctgcaa

SEQ ID NO: 119730 - DNA, 16 bp, H. sapiens
gtcatgcagctggaag

SEQ ID NO: 119731 - DNA, 19 bp, H. sapiens
gtcatgcaggatgatgcca

SEQ ID NO: 119732 - DNA, 16 bp, H. sapiens
gtcatgcattgcttaa

SEQ ID NO: 119733 - DNA, 16 bp, H. sapiens
gtcatgctctgtcacc

SEQ ID NO: 119734 - DNA, 16 bp, H. sapiens
gtcatgctggtgtgct

SEQ ID NO: 119735 - DNA, 16 bp, H. sapiens
gtcatggtcactgttt

SEQ ID NO: 119736 - DNA, 17 bp, H. sapiens
gtcatggtggtgggcac

SEQ ID NO: 119737 - DNA, 16 bp, H. sapiens
gtcatgttggccaggc

SEQ ID NO: 119738 - DNA, 16 bp, H. sapiens
gtcattatttaatgat

SEQ ID NO: 119739 - DNA, 16 bp, H. sapiens
gtcattcacaacaaca

SEQ ID NO: 119740 - DNA, 17 bp, H. sapiens
gtcattcactgcaaggg

SEQ ID NO: 119741 - DNA, 16 bp, H. sapiens
gtcattcagcaaacat

SEQ ID NO: 119742 - DNA, 16 bp, H. sapiens
gtcattcaggagctgg

SEQ ID NO: 119743 - DNA, 16 bp, H. sapiens
gtcattcaggtgcagg

SEQ ID NO: 119744 - DNA, 16 bp, H. sapiens
gtcattcatggcaaca

SEQ ID NO: 119745 - DNA, 16 bp, H. sapiens
gtcattgaggctggag

SEQ ID NO: 119746 - DNA, 16 bp, H. sapiens
gtcattgcaaatgaca

SEQ ID NO: 119747 - DNA, 16 bp, H. sapiens
gtcatttaaaattttt

SEQ ID NO: 119748 - DNA, 16 bp, H. sapiens
gtcatttataaatgac

SEQ ID NO: 119749 - DNA, 16 bp, H. sapiens
gtcatttatgttcctc

SEQ ID NO: 119750 - DNA, 16 bp, H. sapiens
gtcatttcctttcttc

SEQ ID NO: 119751 - DNA, 16 bp, H. sapiens
gtcatttctccaagga

SEQ ID NO: 119752 - DNA, 16 bp, H. sapiens
gtcatttgtatgtttt

SEQ ID NO: 119753 - DNA, 16 bp, H. sapiens
gtcattttaaaatgta

SEQ ID NO: 119754 - DNA, 16 bp, H. sapiens
gtcattttcattttct

SEQ ID NO: 119755 - DNA, 16 bp, H. sapiens
gtcattttttaaaaga

SEQ ID NO: 119756 - DNA, 16 bp, H. sapiens
gtccaaaacccagcag

SEQ ID NO: 119757 - DNA, 16 bp, H. sapiens
gtccaaaaggaaaata

SEQ ID NO: 119758 - DNA, 16 bp, H. sapiens
gtccaaaggccagaga

SEQ ID NO: 119759 - DNA, 16 bp, H. sapiens
gtccaacaatggtaga

SEQ ID NO: 119760 - DNA, 17 bp, H. sapiens
gtccaacacctctacac

SEQ ID NO: 119761 - DNA, 16 bp, H. sapiens
gtccaagagtttgaga

SEQ ID NO: 119762 - DNA, 16 bp, H. sapiens
gtccaagatcaaggcc

SEQ ID NO: 119763 - DNA, 16 bp, H. sapiens
gtccaagatcaaggtg

SEQ ID NO: 119764 - DNA, 16 bp, H. sapiens
gtccaagatcagggtg

SEQ ID NO: 119765 - DNA, 16 bp, H. sapiens
gtccaagccaccacca

SEQ ID NO: 119766 - DNA, 16 bp, H. sapiens
gtccaaggccacctgg

SEQ ID NO: 119767 - DNA, 16 bp, H. sapiens
gtccaaggtcaaggca

SEQ ID NO: 119768 - DNA, 16 bp, H. sapiens
gtccacacaaagattt

SEQ ID NO: 119769 - DNA, 16 bp, H. sapiens
gtccacagtgcaaagt

SEQ ID NO: 119770 - DNA, 16 bp, H. sapiens
gtccacatcctgcagc

SEQ ID NO: 119771 - DNA, 16 bp, H. sapiens
gtccacccacctcagc

SEQ ID NO: 119772 - DNA, 16 bp, H. sapiens
gtccaccccagaccct

SEQ ID NO: 119773 - DNA, 16 bp, H. sapiens
gtccaccctgggcaac

SEQ ID NO: 119774 - DNA, 16 bp, H. sapiens
gtccacctctgcctcc

SEQ ID NO: 119775 - DNA, 16 bp, H. sapiens
gtccacgtgttctcat

SEQ ID NO: 119776 - DNA, 16 bp, H. sapiens
gtccactccataccct

SEQ ID NO: 119777 - DNA, 16 bp, H. sapiens
gtccagaaaggtggaa

SEQ ID NO: 119778 - DNA, 16 bp, H. sapiens
gtccagaatgatgttt

SEQ ID NO: 119779 - DNA, 16 bp, H. sapiens
gtccagagatgctgct

SEQ ID NO: 119780 - DNA, 16 bp, H. sapiens
gtccagagtctcatct

SEQ ID NO: 119781 - DNA, 16 bp, H. sapiens
gtccagcatcatcctg

SEQ ID NO: 119782 - DNA, 16 bp, H. sapiens
gtccagccactgtgca

SEQ ID NO: 119783 - DNA, 16 bp, H. sapiens
gtccagcccaggctgg

SEQ ID NO: 119784 - DNA, 16 bp, H. sapiens
gtccagcctgggcagc

SEQ ID NO: 119785 - DNA, 16 bp, H. sapiens
gtccagccttcagatg

SEQ ID NO: 119786 - DNA, 16 bp, H. sapiens
gtccagctctcagcag

SEQ ID NO: 119787 - DNA, 16 bp, H. sapiens
gtccaggacaggagat

SEQ ID NO: 119788 - DNA, 16 bp, H. sapiens
gtccaggagcagatgg

SEQ ID NO: 119789 - DNA, 16 bp, H. sapiens
gtccaggagcagtggc

SEQ ID NO: 119790 - DNA, 16 bp, H. sapiens
gtccaggagggaggtg

SEQ ID NO: 119791 - DNA, 16 bp, H. sapiens
gtccaggcaggagtgc

SEQ ID NO: 119792 - DNA, 17 bp, H. sapiens
gtccaggctagagtgca

SEQ ID NO: 119793 - DNA, 16 bp, H. sapiens
gtccaggctgctgtgc

SEQ ID NO: 119794 - DNA, 16 bp, H. sapiens
gtccaggctggaatgc

SEQ ID NO: 119795 - DNA, 16 bp, H. sapiens
gtccaggctggtcctg

SEQ ID NO: 119796 - DNA, 16 bp, H. sapiens
gtccagggccagatgg

SEQ ID NO: 119797 - DNA, 16 bp, H. sapiens
gtccaggggggtcacc

SEQ ID NO: 119798 - DNA, 16 bp, H. sapiens
gtccagggtggggcct

SEQ ID NO: 119799 - DNA, 16 bp, H. sapiens
gtccagtaccagatgg

SEQ ID NO: 119800 - DNA, 16 bp, H. sapiens
gtccagtttcagtctt

SEQ ID NO: 119801 - DNA, 16 bp, H. sapiens
gtccatccattcatct

SEQ ID NO: 119802 - DNA, 16 bp, H. sapiens
gtccatctcctcacag

SEQ ID NO: 119803 - DNA, 16 bp, H. sapiens
gtccatctgtccatcc

SEQ ID NO: 119804 - DNA, 16 bp, H. sapiens
gtccatcttcacactg

SEQ ID NO: 119805 - DNA, 16 bp, H. sapiens
gtccatgctggagtgc

SEQ ID NO: 119806 - DNA, 16 bp, H. sapiens
gtccatgggcagccat

SEQ ID NO: 119807 - DNA, 16 bp, H. sapiens
gtccatgtgctctcat

SEQ ID NO: 119808 - DNA, 16 bp, H. sapiens
gtccattcatatcctt

SEQ ID NO: 119809 - DNA, 16 bp, H. sapiens
gtccattcatccatct

SEQ ID NO: 119810 - DNA, 16 bp, H. sapiens
gtccattttaaaaatt

SEQ ID NO: 119811 - DNA, 16 bp, H. sapiens
gtccattttgatttga

SEQ ID NO: 119812 - DNA, 16 bp, H. sapiens
gtcccaaaaaaacaaa

SEQ ID NO: 119813 - DNA, 16 bp, H. sapiens
gtcccacaatatgctg

SEQ ID NO: 119814 - DNA, 48 bp, H. sapiens
gtcccacctccagccctaaggcggtttttccctatctcagtagatgga

SEQ ID NO: 119815 - DNA, 16 bp, H. sapiens
gtcccacctcctgcct

SEQ ID NO: 119816 - DNA, 16 bp, H. sapiens
gtcccactctgtggcc

SEQ ID NO: 119817 - DNA, 16 bp, H. sapiens
gtcccagaaggagaag

SEQ ID NO: 119818 - DNA, 16 bp, H. sapiens
gtcccagaggggcacc

SEQ ID NO: 119819 - DNA, 21 bp, H. sapiens
gtcccagatacttgggaggct

SEQ ID NO: 119820 - DNA, 16 bp, H. sapiens
gtcccagatgctcagg

SEQ ID NO: 119821 - DNA, 17 bp, H. sapiens
gtcccagcactttggga

SEQ ID NO: 119822 - DNA, 16 bp, H. sapiens
gtcccagcagcttggg

SEQ ID NO: 119823 - DNA, 16 bp, H. sapiens
gtcccagccacccagg

SEQ ID NO: 119824 - DNA, 16 bp, H. sapiens
gtcccagccactccag

SEQ ID NO: 119825 - DNA, 17 bp, H. sapiens
gtcccagccacttggga

SEQ ID NO: 119826 - DNA, 16 bp, H. sapiens
gtcccagcccaaatct

SEQ ID NO: 119827 - DNA, 17 bp, H. sapiens
gtcccagccctttggga

SEQ ID NO: 119828 - DNA, 16 bp, H. sapiens
gtcccagcctcttggg

SEQ ID NO: 119829 - DNA, 17 bp, H. sapiens
gtcccagctaattggga

SEQ ID NO: 119830 - DNA, 23 bp, H. sapiens
gtcccagctactcaggaggctga

SEQ ID NO: 119831 - DNA, 16 bp, H. sapiens
gtcccagctactctag

SEQ ID NO: 119832 - DNA, 16 bp, H. sapiens
gtcccagctccctggg

SEQ ID NO: 119833 - DNA, 16 bp, H. sapiens
gtcccagctccttggg

SEQ ID NO: 119834 - DNA, 16 bp, H. sapiens
gtcccagctctgccac

SEQ ID NO: 119835 - DNA, 16 bp, H. sapiens
gtcccagctgcctggg

SEQ ID NO: 119836 - DNA, 16 bp, H. sapiens
gtcccagctgctcaag

SEQ ID NO: 119837 - DNA, 16 bp, H. sapiens
gtcccaggaccagcag

SEQ ID NO: 119838 - DNA, 16 bp, H. sapiens
gtcccaggaggaggaa

SEQ ID NO: 119839 - DNA, 16 bp, H. sapiens
gtcccaggaggctgag

SEQ ID NO: 119840 - DNA, 16 bp, H. sapiens
gtcccaggctagagtg

SEQ ID NO: 119841 - DNA, 16 bp, H. sapiens
gtcccaggctggtctc

SEQ ID NO: 119842 - DNA, 16 bp, H. sapiens
gtcccagggagatgga

SEQ ID NO: 119843 - DNA, 16 bp, H. sapiens
gtcccaggtacccagg

SEQ ID NO: 119844 - DNA, 16 bp, H. sapiens
gtcccataagattata

SEQ ID NO: 119845 - DNA, 19 bp, H. sapiens
gtcccatgggtgggcctgt

SEQ ID NO: 119846 - DNA, 16 bp, H. sapiens
gtccccacacagagtc

SEQ ID NO: 119847 - DNA, 16 bp, H. sapiens
gtccccagagtccatt

SEQ ID NO: 119848 - DNA, 16 bp, H. sapiens
gtccccagccctgccc

SEQ ID NO: 119849 - DNA, 16 bp, H. sapiens
gtccccagtccccagg

SEQ ID NO: 119850 - DNA, 16 bp, H. sapiens
gtccccattccaggcc

SEQ ID NO: 119851 - DNA, 16 bp, H. sapiens
gtcccccagccccagg

SEQ ID NO: 119852 - DNA, 16 bp, H. sapiens
gtcccccagcctgaca

SEQ ID NO: 119853 - DNA, 16 bp, H. sapiens
gtcccccaggcccagc

SEQ ID NO: 119854 - DNA, 16 bp, H. sapiens
gtcccccaggccggag

SEQ ID NO: 119855 - DNA, 16 bp, H. sapiens
gtcccctccaaatccc

SEQ ID NO: 119856 - DNA, 16 bp, H. sapiens
gtcccctgatctgagt

SEQ ID NO: 119857 - DNA, 16 bp, H. sapiens
gtcccctgggcccact

SEQ ID NO: 119858 - DNA, 16 bp, H. sapiens
gtccccttttctccac

SEQ ID NO: 119859 - DNA, 16 bp, H. sapiens
gtcccgagtagctggg

SEQ ID NO: 119860 - DNA, 16 bp, H. sapiens
gtcccgcctcagcctc

SEQ ID NO: 119861 - DNA, 16 bp, H. sapiens
gtccctaatggcttcc

SEQ ID NO: 119862 - DNA, 16 bp, H. sapiens
gtccctcagctgcagg

SEQ ID NO: 119863 - DNA, 16 bp, H. sapiens
gtccctcatggcacag

SEQ ID NO: 119864 - DNA, 16 bp, H. sapiens
gtccctcccccaacac

SEQ ID NO: 119865 - DNA, 16 bp, H. sapiens
gtccctcctcaatttt

SEQ ID NO: 119866 - DNA, 16 bp, H. sapiens
gtccctctgggatgaa

SEQ ID NO: 119867 - DNA, 16 bp, H. sapiens
gtccctgacccccaag

SEQ ID NO: 119868 - DNA, 16 bp, H. sapiens
gtccctgactcctgga

SEQ ID NO: 119869 - DNA, 16 bp, H. sapiens
gtccctgacttcctgc

SEQ ID NO: 119870 - DNA, 16 bp, H. sapiens
gtccctgatccctgtg

SEQ ID NO: 119871 - DNA, 16 bp, H. sapiens
gtccctgcccatgtcc

SEQ ID NO: 119872 - DNA, 16 bp, H. sapiens
gtccctgccctcaagg

SEQ ID NO: 119873 - DNA, 16 bp, H. sapiens
gtccctgcctgacagc

SEQ ID NO: 119874 - DNA, 16 bp, H. sapiens
gtccctgccttcaagg

SEQ ID NO: 119875 - DNA, 16 bp, H. sapiens
gtccctgctctcaaag

SEQ ID NO: 119876 - DNA, 16 bp, H. sapiens
gtccctgctcttccca

SEQ ID NO: 119877 - DNA, 16 bp, H. sapiens
gtccctggaaaggaca

SEQ ID NO: 119878 - DNA, 16 bp, H. sapiens
gtccctgggccagcag

SEQ ID NO: 119879 - DNA, 16 bp, H. sapiens
gtccctgggcctggcc

SEQ ID NO: 119880 - DNA, 16 bp, H. sapiens
gtccctggttcctggc

SEQ ID NO: 119881 - DNA, 16 bp, H. sapiens
gtccctgtggccttcc

SEQ ID NO: 119882 - DNA, 16 bp, H. sapiens
gtcccttcctccagga

SEQ ID NO: 119883 - DNA, 16 bp, H. sapiens
gtcccttgagcccagg

SEQ ID NO: 119884 - DNA, 16 bp, H. sapiens
gtccctttattaaact

SEQ ID NO: 119885 - DNA, 17 bp, H. sapiens
gtccgcccgccttggcc

SEQ ID NO: 119886 - DNA, 16 bp, H. sapiens
gtccgcctctgcctcc

SEQ ID NO: 119887 - DNA, 16 bp, H. sapiens
gtccgtccgtccgtcc

SEQ ID NO: 119888 - DNA, 16 bp, H. sapiens
gtccgtgtgttctcat

SEQ ID NO: 119889 - DNA, 17 bp, H. sapiens
gtcctagcactttggga

SEQ ID NO: 119890 - DNA, 18 bp, H. sapiens
gtcctagctactcgggag

SEQ ID NO: 119891 - DNA, 16 bp, H. sapiens
gtcctcaaactcctgg

SEQ ID NO: 119892 - DNA, 16 bp, H. sapiens
gtcctcaacctttttg

SEQ ID NO: 119893 - DNA, 16 bp, H. sapiens
gtcctcagctctgcct

SEQ ID NO: 119894 - DNA, 16 bp, H. sapiens
gtcctcatctgtaaag

SEQ ID NO: 119895 - DNA, 16 bp, H. sapiens
gtcctcatggagaacc

SEQ ID NO: 119896 - DNA, 16 bp, H. sapiens
gtcctccagcctcagc

SEQ ID NO: 119897 - DNA, 16 bp, H. sapiens
gtcctccaggcctggg

SEQ ID NO: 119898 - DNA, 19 bp, H. sapiens
gtcctccatcttcaagaaa

SEQ ID NO: 119899 - DNA, 16 bp, H. sapiens
gtcctcccacctcagc

SEQ ID NO: 119900 - DNA, 16 bp, H. sapiens
gtcctcccaccttagc

SEQ ID NO: 119901 - DNA, 16 bp, H. sapiens
gtcctcccaccttggc

SEQ ID NO: 119902 - DNA, 16 bp, H. sapiens
gtcctcccgcctcagc

SEQ ID NO: 119903 - DNA, 16 bp, H. sapiens
gtcctcctgagcctgg

SEQ ID NO: 119904 - DNA, 16 bp, H. sapiens
gtcctcctgccttggc

SEQ ID NO: 119905 - DNA, 16 bp, H. sapiens
gtcctcctgcttcagc

SEQ ID NO: 119906 - DNA, 16 bp, H. sapiens
gtcctctcccagtgga

SEQ ID NO: 119907 - DNA, 16 bp, H. sapiens
gtcctctggctctggt

SEQ ID NO: 119908 - DNA, 16 bp, H. sapiens
gtcctcttccatttct

SEQ ID NO: 119909 - DNA, 16 bp, H. sapiens
gtcctctttactctcc

SEQ ID NO: 119910 - DNA, 16 bp, H. sapiens
gtcctgaacatccctc

SEQ ID NO: 119911 - DNA, 16 bp, H. sapiens
gtcctgaactcctggc

SEQ ID NO: 119912 - DNA, 16 bp, H. sapiens
gtcctgatgacatgtg

SEQ ID NO: 119913 - DNA, 16 bp, H. sapiens
gtcctgatgagtgttc

SEQ ID NO: 119914 - DNA, 16 bp, H. sapiens
gtcctgcaagctctat

SEQ ID NO: 119915 - DNA, 16 bp, H. sapiens
gtcctgcaggctggag

SEQ ID NO: 119916 - DNA, 16 bp, H. sapiens
gtcctgcctcagcctc

SEQ ID NO: 119917 - DNA, 16 bp, H. sapiens
gtcctgcctcagcttc

SEQ ID NO: 119918 - DNA, 17 bp, H. sapiens
gtcctgcctcagtctcc

SEQ ID NO: 119919 - DNA, 16 bp, H. sapiens
gtcctgctctgtcacc

SEQ ID NO: 119920 - DNA, 16 bp, H. sapiens
gtcctgctgcttgctg

SEQ ID NO: 119921 - DNA, 16 bp, H. sapiens
gtcctgcttttctgga

SEQ ID NO: 119922 - DNA, 16 bp, H. sapiens
gtcctggcagcattca

SEQ ID NO: 119923 - DNA, 21 bp, H. sapiens
gtcctggccaacatggtgaaa

SEQ ID NO: 119924 - DNA, 18 bp, H. sapiens
gtcctggctaacatggtg

SEQ ID NO: 119925 - DNA, 16 bp, H. sapiens
gtcctggctctgccat

SEQ ID NO: 119926 - DNA, 16 bp, H. sapiens
gtcctggctggtctca

SEQ ID NO: 119927 - DNA, 16 bp, H. sapiens
gtcctgggccacatgc

SEQ ID NO: 119928 - DNA, 16 bp, H. sapiens
gtcctgggcccagccc

SEQ ID NO: 119929 - DNA, 16 bp, H. sapiens
gtcctgggcctggccc

SEQ ID NO: 119930 - DNA, 16 bp, H. sapiens
gtcctgggctcaagtg

SEQ ID NO: 119931 - DNA, 16 bp, H. sapiens
gtcctgtgattaaggt

SEQ ID NO: 119932 - DNA, 16 bp, H. sapiens
gtcctgtggtcctgtg

SEQ ID NO: 119933 - DNA, 16 bp, H. sapiens
gtccttaaccttggca

SEQ ID NO: 119934 - DNA, 17 bp, H. sapiens
gtccttaaggcacagat

SEQ ID NO: 119935 - DNA, 16 bp, H. sapiens
gtccttactaaaaata

SEQ ID NO: 119936 - DNA, 16 bp, H. sapiens
gtccttataagaaaag

SEQ ID NO: 119937 - DNA, 16 bp, H. sapiens
gtccttatatgaagag

SEQ ID NO: 119938 - DNA, 16 bp, H. sapiens
gtccttatgagaagag

SEQ ID NO: 119939 - DNA, 16 bp, H. sapiens
gtccttcacatccctt

SEQ ID NO: 119940 - DNA, 16 bp, H. sapiens
gtccttcagttccatc

SEQ ID NO: 119941 - DNA, 16 bp, H. sapiens
gtccttgcaatagtga

SEQ ID NO: 119942 - DNA, 16 bp, H. sapiens
gtccttgcaatagttt

SEQ ID NO: 119943 - DNA, 16 bp, H. sapiens
gtccttgcccatgact

SEQ ID NO: 119944 - DNA, 16 bp, H. sapiens
gtccttgcccatgcca

SEQ ID NO: 119945 - DNA, 16 bp, H. sapiens
gtccttgcccctgcct

SEQ ID NO: 119946 - DNA, 16 bp, H. sapiens
gtccttgctcatgcct

SEQ ID NO: 119947 - DNA, 16 bp, H. sapiens
gtccttggagacctac

SEQ ID NO: 119948 - DNA, 16 bp, H. sapiens
gtccttgttcattctt

SEQ ID NO: 119949 - DNA, 16 bp, H. sapiens
gtcctttccagcaaca

SEQ ID NO: 119950 - DNA, 16 bp, H. sapiens
gtcctttccccacttt

SEQ ID NO: 119951 - DNA, 16 bp, H. sapiens
gtcctttgccaggaca

SEQ ID NO: 119952 - DNA, 16 bp, H. sapiens
gtcctttgtggcattt

SEQ ID NO: 119953 - DNA, 17 bp, H. sapiens
gtccttttttatggctg

SEQ ID NO: 119954 - DNA, 16 bp, H. sapiens
gtcgaggctgcagtgg

SEQ ID NO: 119955 - DNA, 16 bp, H. sapiens
gtcgccatgcccagct

SEQ ID NO: 119956 - DNA, 16 bp, H. sapiens
gtcgcctagtctggag

SEQ ID NO: 119957 - DNA, 16 bp, H. sapiens
gtcgctgcactccagc

SEQ ID NO: 119958 - DNA, 16 bp, H. sapiens
gtcggccaggctggtt

SEQ ID NO: 119959 - DNA, 16 bp, H. sapiens
gtcggccccagccctg

SEQ ID NO: 119960 - DNA, 16 bp, H. sapiens
gtcggctgcaaaggca

SEQ ID NO: 119961 - DNA, 16 bp, H. sapiens
gtcgggagattgagac

SEQ ID NO: 119962 - DNA, 16 bp, H. sapiens
gtcggggcacagcttg

SEQ ID NO: 119963 - DNA, 16 bp, H. sapiens
gtcgtggtgtgcacct

SEQ ID NO: 119964 - DNA, 16 bp, H. sapiens
gtctaacacttaagtc

SEQ ID NO: 119965 - DNA, 16 bp, H. sapiens
gtctaagaaggccacc

SEQ ID NO: 119966 - DNA, 16 bp, H. sapiens
gtctaatagaaatata

SEQ ID NO: 119967 - DNA, 16 bp, H. sapiens
gtctaatatccagtat

SEQ ID NO: 119968 - DNA, 16 bp, H. sapiens
gtctaatctgctgtta

SEQ ID NO: 119969 - DNA, 16 bp, H. sapiens
gtctacacaaagactt

SEQ ID NO: 119970 - DNA, 24 bp, H. sapiens
gtctacagaactctccaccccaaa

SEQ ID NO: 119971 - DNA, 16 bp, H. sapiens
gtctacagaggcaggt

SEQ ID NO: 119972 - DNA, 16 bp, H. sapiens
gtctacagcaacctca

SEQ ID NO: 119973 - DNA, 16 bp, H. sapiens
gtctacagctcccagc

SEQ ID NO: 119974 - DNA, 20 bp, H. sapiens
gtctaccaagcaaatggaaa

SEQ ID NO: 119975 - DNA, 16 bp, H. sapiens
gtctacctcggcctcc

SEQ ID NO: 119976 - DNA, 50 bp, H. sapiens
gtctacctctttctacacagacacggcaaccatccgatttctcaatcttt

SEQ ID NO: 119977 - DNA, 16 bp, H. sapiens
gtctactactccacaa

SEQ ID NO: 119978 - DNA, 16 bp, H. sapiens
gtctactgaatcagaa

SEQ ID NO: 119979 - DNA, 16 bp, H. sapiens
gtctactgatttaaat

SEQ ID NO: 119980 - DNA, 16 bp, H. sapiens
gtctacttttatgcca

SEQ ID NO: 119981 - DNA, 16 bp, H. sapiens
gtctagccaacatggc

SEQ ID NO: 119982 - DNA, 18 bp, H. sapiens
gtctagctcagggtttgt

SEQ ID NO: 119983 - DNA, 16 bp, H. sapiens
gtctataaaaagaaaa

SEQ ID NO: 119984 - DNA, 16 bp, H. sapiens
gtctatcaatattgtt

SEQ ID NO: 119985 - DNA, 16 bp, H. sapiens
gtctatcagcttaagg

SEQ ID NO: 119986 - DNA, 16 bp, H. sapiens
gtctatctatctatca

SEQ ID NO: 119987 - DNA, 16 bp, H. sapiens
gtctatgagtctgttt

SEQ ID NO: 119988 - DNA, 16 bp, H. sapiens
gtctatgtgtcttttt

SEQ ID NO: 119989 - DNA, 16 bp, H. sapiens
gtctatgtgtgtgtgt

SEQ ID NO: 119990 - DNA, 16 bp, H. sapiens
gtctatttctctgttt

SEQ ID NO: 119991 - DNA, 16 bp, H. sapiens
gtctattttacagaga

SEQ ID NO: 119992 - DNA, 16 bp, H. sapiens
gtctatttttatgtca

SEQ ID NO: 119993 - DNA, 16 bp, H. sapiens
gtctcaaaaaaaaaag

SEQ ID NO: 119994 - DNA, 17 bp, H. sapiens
gtctcaaaaaaaaattg

SEQ ID NO: 119995 - DNA, 16 bp, H. sapiens
gtctcaaaaaaaaggg

SEQ ID NO: 119996 - DNA, 16 bp, H. sapiens
gtctcaaaaaacaaat

SEQ ID NO: 119997 - DNA, 16 bp, H. sapiens
gtctcaaaaaacagaa

SEQ ID NO: 119998 - DNA, 16 bp, H. sapiens
gtctcaaaaaagaaaa

SEQ ID NO: 119999 - DNA, 16 bp, H. sapiens
gtctcaaaaaagaaga

SEQ ID NO: 120000 - DNA, 16 bp, H. sapiens
gtctcaaaaaataaag

SEQ ID NO: 120001 - DNA, 16 bp, H. sapiens
gtctcaaaaatgaaat

SEQ ID NO: 120002 - DNA, 16 bp, H. sapiens
gtctcaaaagaacaaa

SEQ ID NO: 120003 - DNA, 16 bp, H. sapiens
gtctcaaaagacaaaa

SEQ ID NO: 120004 - DNA, 16 bp, H. sapiens
gtctcaaagaaaagga

SEQ ID NO: 120005 - DNA, 16 bp, H. sapiens
gtctcaaagagatatt

SEQ ID NO: 120006 - DNA, 16 bp, H. sapiens
gtctcaaagcaaacaa

SEQ ID NO: 120007 - DNA, 16 bp, H. sapiens
gtctcaaatgcctgag

SEQ ID NO: 120008 - DNA, 16 bp, H. sapiens
gtctcaaatttaaaaa

SEQ ID NO: 120009 - DNA, 16 bp, H. sapiens
gtctcaacatggctgc

SEQ ID NO: 120010 - DNA, 16 bp, H. sapiens
gtctcaacctcccaag

SEQ ID NO: 120011 - DNA, 16 bp, H. sapiens
gtctcaagagaaaaaa

SEQ ID NO: 120012 - DNA, 16 bp, H. sapiens
gtctcaagctcctgga

SEQ ID NO: 120013 - DNA, 16 bp, H. sapiens
gtctcaagggtggcag

SEQ ID NO: 120014 - DNA, 16 bp, H. sapiens
gtctcaataaatttta

SEQ ID NO: 120015 - DNA, 20 bp, H. sapiens
gtctcaatagatgcagaaaa

SEQ ID NO: 120016 - DNA, 16 bp, H. sapiens
gtctcacacacaaaaa

SEQ ID NO: 120017 - DNA, 16 bp, H. sapiens
gtctcacacacacaca

SEQ ID NO: 120018 - DNA, 16 bp, H. sapiens
gtctcacactgtcacc

SEQ ID NO: 120019 - DNA, 16 bp, H. sapiens
gtctcacagctctgga

SEQ ID NO: 120020 - DNA, 16 bp, H. sapiens
gtctcacccaaggctc

SEQ ID NO: 120021 - DNA, 16 bp, H. sapiens
gtctcacctccagcct

SEQ ID NO: 120022 - DNA, 16 bp, H. sapiens
gtctcactatgtcgcc

SEQ ID NO: 120023 - DNA, 16 bp, H. sapiens
gtctcactctgtcagc

SEQ ID NO: 120024 - DNA, 16 bp, H. sapiens
gtctcactctgtggtc

SEQ ID NO: 120025 - DNA, 16 bp, H. sapiens
gtctcactctgttacc

SEQ ID NO: 120026 - DNA, 16 bp, H. sapiens
gtctcactctgttgct

SEQ ID NO: 120027 - DNA, 16 bp, H. sapiens
gtctcactgcagcctc

SEQ ID NO: 120028 - DNA, 16 bp, H. sapiens
gtctcactgtcaccag

SEQ ID NO: 120029 - DNA, 16 bp, H. sapiens
gtctcactgtgtctcc

SEQ ID NO: 120030 - DNA, 16 bp, H. sapiens
gtctcactttgttact

SEQ ID NO: 120031 - DNA, 16 bp, H. sapiens
gtctcagaaaaaaaat

SEQ ID NO: 120032 - DNA, 16 bp, H. sapiens
gtctcagaaaaagaga

SEQ ID NO: 120033 - DNA, 16 bp, H. sapiens
gtctcagaaagaaaaa

SEQ ID NO: 120034 - DNA, 16 bp, H. sapiens
gtctcagaccaaaatc

SEQ ID NO: 120035 - DNA, 16 bp, H. sapiens
gtctcagagacagttt

SEQ ID NO: 120036 - DNA, 16 bp, H. sapiens
gtctcagcacatcatt

SEQ ID NO: 120037 - DNA, 16 bp, H. sapiens
gtctcagcccagaatc

SEQ ID NO: 120038 - DNA, 16 bp, H. sapiens
gtctcagccccaaaac

SEQ ID NO: 120039 - DNA, 16 bp, H. sapiens
gtctcagcctccccag

SEQ ID NO: 120040 - DNA, 16 bp, H. sapiens
gtctcagctcactgca

SEQ ID NO: 120041 - DNA, 17 bp, H. sapiens
gtctcagctgctcggga

SEQ ID NO: 120042 - DNA, 16 bp, H. sapiens
gtctcagctggcagag

SEQ ID NO: 120043 - DNA, 16 bp, H. sapiens
gtctcagcttccccag

SEQ ID NO: 120044 - DNA, 16 bp, H. sapiens
gtctcaggctctgctt

SEQ ID NO: 120045 - DNA, 16 bp, H. sapiens
gtctcaggggtgacag

SEQ ID NO: 120046 - DNA, 16 bp, H. sapiens
gtctcaggtatttctt

SEQ ID NO: 120047 - DNA, 16 bp, H. sapiens
gtctcagtttccacat

SEQ ID NO: 120048 - DNA, 16 bp, H. sapiens
gtctcagtttccccaa

SEQ ID NO: 120049 - DNA, 16 bp, H. sapiens
gtctcataggcagaag

SEQ ID NO: 120050 - DNA, 16 bp, H. sapiens
gtctcatctcctgacc

SEQ ID NO: 120051 - DNA, 16 bp, H. sapiens
gtctcatctgaaggct

SEQ ID NO: 120052 - DNA, 16 bp, H. sapiens
gtctcatgcctataat

SEQ ID NO: 120053 - DNA, 16 bp, H. sapiens
gtctcattctgtcact

SEQ ID NO: 120054 - DNA, 16 bp, H. sapiens
gtctccaaacaaacaa

SEQ ID NO: 120055 - DNA, 16 bp, H. sapiens
gtctccaaagtccatt

SEQ ID NO: 120056 - DNA, 16 bp, H. sapiens
gtctccaactcctgat

SEQ ID NO: 120057 - DNA, 16 bp, H. sapiens
gtctccaactcctgtg

SEQ ID NO: 120058 - DNA, 16 bp, H. sapiens
gtctccaagaagtctg

SEQ ID NO: 120059 - DNA, 16 bp, H. sapiens
gtctccacaatctttt

SEQ ID NO: 120060 - DNA, 16 bp, H. sapiens
gtctccacagaaaata

SEQ ID NO: 120061 - DNA, 16 bp, H. sapiens
gtctccagaagaaaaa

SEQ ID NO: 120062 - DNA, 16 bp, H. sapiens
gtctccagctcccagc

SEQ ID NO: 120063 - DNA, 16 bp, H. sapiens
gtctccagctgcatga

SEQ ID NO: 120064 - DNA, 16 bp, H. sapiens
gtctccagcttgcaaa

SEQ ID NO: 120065 - DNA, 16 bp, H. sapiens
gtctccaggactgtga

SEQ ID NO: 120066 - DNA, 16 bp, H. sapiens
gtctccaggcctgtga

SEQ ID NO: 120067 - DNA, 16 bp, H. sapiens
gtctccagggttcaag

SEQ ID NO: 120068 - DNA, 16 bp, H. sapiens
gtctccatctcctgcc

SEQ ID NO: 120069 - DNA, 16 bp, H. sapiens
gtctccatctctgtct

SEQ ID NO: 120070 - DNA, 16 bp, H. sapiens
gtctccattttcattt

SEQ ID NO: 120071 - DNA, 16 bp, H. sapiens
gtctcccagggtggag

SEQ ID NO: 120072 - DNA, 16 bp, H. sapiens
gtctcccaggtcctgc

SEQ ID NO: 120073 - DNA, 16 bp, H. sapiens
gtctcccaggttcagg

SEQ ID NO: 120074 - DNA, 16 bp, H. sapiens
gtctcccatcagcccc

SEQ ID NO: 120075 - DNA, 42 bp, H. sapiens
gtctcccatgtctacttctatccacacagacccggcaaccat

SEQ ID NO: 120076 - DNA, 16 bp, H. sapiens
gtctccctccatctct

SEQ ID NO: 120077 - DNA, 16 bp, H. sapiens
gtctccctccgttgcc

SEQ ID NO: 120078 - DNA, 16 bp, H. sapiens
gtctccctggctcaag

SEQ ID NO: 120079 - DNA, 16 bp, H. sapiens
gtctcctcatctgtga

SEQ ID NO: 120080 - DNA, 16 bp, H. sapiens
gtctcctcccatctcc

SEQ ID NO: 120081 - DNA, 16 bp, H. sapiens
gtctcctgaaggagtc

SEQ ID NO: 120082 - DNA, 17 bp, H. sapiens
gtctcctgacctcgtga

SEQ ID NO: 120083 - DNA, 16 bp, H. sapiens
gtctcctgagcagctg

SEQ ID NO: 120084 - DNA, 16 bp, H. sapiens
gtctcctgggctcaag

SEQ ID NO: 120085 - DNA, 16 bp, H. sapiens
gtctccttatgttgcc

SEQ ID NO: 120086 - DNA, 16 bp, H. sapiens
gtctcctttgatcttt

SEQ ID NO: 120087 - DNA, 16 bp, H. sapiens
gtctcgaacctctgac

SEQ ID NO: 120088 - DNA, 16 bp, H. sapiens
gtctcgccctgtcacc

SEQ ID NO: 120089 - DNA, 16 bp, H. sapiens
gtctcgccttgtcgcc

SEQ ID NO: 120090 - DNA, 16 bp, H. sapiens
gtctcgctccatcacc

SEQ ID NO: 120091 - DNA, 21 bp, H. sapiens
gtctcgctctgtcacccaggt

SEQ ID NO: 120092 - DNA, 16 bp, H. sapiens
gtctcggcctcccaca

SEQ ID NO: 120093 - DNA, 16 bp, H. sapiens
gtctctaaaaatacaa

SEQ ID NO: 120094 - DNA, 16 bp, H. sapiens
gtctctaaataaataa

SEQ ID NO: 120095 - DNA, 16 bp, H. sapiens
gtctctacaaaaagga

SEQ ID NO: 120096 - DNA, 16 bp, H. sapiens
gtctctacaaaacaac

SEQ ID NO: 120097 - DNA, 16 bp, H. sapiens
gtctctactaaaaatt

SEQ ID NO: 120098 - DNA, 16 bp, H. sapiens
gtctctactaaaatta

SEQ ID NO: 120099 - DNA, 16 bp, H. sapiens
gtctctatctctatct

SEQ ID NO: 120100 - DNA, 16 bp, H. sapiens
gtctctatgaaaaata

SEQ ID NO: 120101 - DNA, 16 bp, H. sapiens
gtctctatttaaaaaa

SEQ ID NO: 120102 - DNA, 16 bp, H. sapiens
gtctctcaaaaaaaaa

SEQ ID NO: 120103 - DNA, 16 bp, H. sapiens
gtctctcacaaggctg

SEQ ID NO: 120104 - DNA, 16 bp, H. sapiens
gtctctcagctgcagg

SEQ ID NO: 120105 - DNA, 16 bp, H. sapiens
gtctctcaggttaaat

SEQ ID NO: 120106 - DNA, 16 bp, H. sapiens
gtctctcctggagctg

SEQ ID NO: 120107 - DNA, 16 bp, H. sapiens
gtctctcgtcccaccc

SEQ ID NO: 120108 - DNA, 16 bp, H. sapiens
gtctctctctctctca

SEQ ID NO: 120109 - DNA, 16 bp, H. sapiens
gtctctctctgtagcc

SEQ ID NO: 120110 - DNA, 16 bp, H. sapiens
gtctctctctgtcacc

SEQ ID NO: 120111 - DNA, 17 bp, H. sapiens
gtctctctgtctctctg

SEQ ID NO: 120112 - DNA, 16 bp, H. sapiens
gtctctgaaaaataat

SEQ ID NO: 120113 - DNA, 16 bp, H. sapiens
gtctctgagattctca

SEQ ID NO: 120114 - DNA, 16 bp, H. sapiens
gtctctgataaaaata

SEQ ID NO: 120115 - DNA, 16 bp, H. sapiens
gtctctgcagcctgca

SEQ ID NO: 120116 - DNA, 16 bp, H. sapiens
gtctctgccttcaagg

SEQ ID NO: 120117 - DNA, 16 bp, H. sapiens
gtctctgctgttggca

SEQ ID NO: 120118 - DNA, 16 bp, H. sapiens
gtctctggtaaccacc

SEQ ID NO: 120119 - DNA, 16 bp, H. sapiens
gtctctggtgggaaac

SEQ ID NO: 120120 - DNA, 16 bp, H. sapiens
gtctctgtcacaacta

SEQ ID NO: 120121 - DNA, 16 bp, H. sapiens
gtctctgtcacagcta

SEQ ID NO: 120122 - DNA, 16 bp, H. sapiens
gtctctgtcacccaag

SEQ ID NO: 120123 - DNA, 16 bp, H. sapiens
gtctctgtctctctct

SEQ ID NO: 120124 - DNA, 16 bp, H. sapiens
gtctctgtctctgtct

SEQ ID NO: 120125 - DNA, 16 bp, H. sapiens
gtctctgtctgtgtct

SEQ ID NO: 120126 - DNA, 16 bp, H. sapiens
gtctctgtgtgtgcat

SEQ ID NO: 120127 - DNA, 16 bp, H. sapiens
gtctctgttctgttcc

SEQ ID NO: 120128 - DNA, 16 bp, H. sapiens
gtctcttaacctctct

SEQ ID NO: 120129 - DNA, 16 bp, H. sapiens
gtctcttcactttgct

SEQ ID NO: 120130 - DNA, 16 bp, H. sapiens
gtctcttcattctgtt

SEQ ID NO: 120131 - DNA, 17 bp, H. sapiens
gtctcttgacctcgtga

SEQ ID NO: 120132 - DNA, 16 bp, H. sapiens
gtctcttgtgacagtt

SEQ ID NO: 120133 - DNA, 16 bp, H. sapiens
gtctgaaaaagacttt

SEQ ID NO: 120134 - DNA, 16 bp, H. sapiens
gtctgaaaaagatttt

SEQ ID NO: 120135 - DNA, 16 bp, H. sapiens
gtctgaaaaggctata

SEQ ID NO: 120136 - DNA, 16 bp, H. sapiens
gtctgaaactcctgac

SEQ ID NO: 120137 - DNA, 16 bp, H. sapiens
gtctgaacaaaatggt

SEQ ID NO: 120138 - DNA, 16 bp, H. sapiens
gtctgaatttttaaaa

SEQ ID NO: 120139 - DNA, 16 bp, H. sapiens
gtctgaccccagagcc

SEQ ID NO: 120140 - DNA, 16 bp, H. sapiens
gtctgacctgagcacc

SEQ ID NO: 120141 - DNA, 16 bp, H. sapiens
gtctgactccaaagcc

SEQ ID NO: 120142 - DNA, 16 bp, H. sapiens
gtctgactccaaagtc

SEQ ID NO: 120143 - DNA, 16 bp, H. sapiens
gtctgactccagagtc

SEQ ID NO: 120144 - DNA, 16 bp, H. sapiens
gtctgacttcttttgc

SEQ ID NO: 120145 - DNA, 16 bp, H. sapiens
gtctgagagacagctt

SEQ ID NO: 120146 - DNA, 16 bp, H. sapiens
gtctgagatcagcctg

SEQ ID NO: 120147 - DNA, 16 bp, H. sapiens
gtctgagatcagggtg

SEQ ID NO: 120148 - DNA, 16 bp, H. sapiens
gtctgagatccaggtg

SEQ ID NO: 120149 - DNA, 16 bp, H. sapiens
gtctgagatgcctgac

SEQ ID NO: 120150 - DNA, 16 bp, H. sapiens
gtctgagcaacatagc

SEQ ID NO: 120151 - DNA, 16 bp, H. sapiens
gtctgagccaccacac

SEQ ID NO: 120152 - DNA, 16 bp, H. sapiens
gtctgaggaaaaaaaa

SEQ ID NO: 120153 - DNA, 16 bp, H. sapiens
gtctgaggaacagaaa

SEQ ID NO: 120154 - DNA, 16 bp, H. sapiens
gtctgaggaaggaggg

SEQ ID NO: 120155 - DNA, 16 bp, H. sapiens
gtctgaggagcagaaa

SEQ ID NO: 120156 - DNA, 16 bp, H. sapiens
gtctgaggctggagaa

SEQ ID NO: 120157 - DNA, 16 bp, H. sapiens
gtctgaggtgggagaa

SEQ ID NO: 120158 - DNA, 16 bp, H. sapiens
gtctgatgagaaagag

SEQ ID NO: 120159 - DNA, 16 bp, H. sapiens
gtctgatttcattctt

SEQ ID NO: 120160 - DNA, 16 bp, H. sapiens
gtctgcaagctggaaa

SEQ ID NO: 120161 - DNA, 16 bp, H. sapiens
gtctgcagaggcaggc

SEQ ID NO: 120162 - DNA, 16 bp, H. sapiens
gtctgcagtttttcca

SEQ ID NO: 120163 - DNA, 16 bp, H. sapiens
gtctgccaccacgccc

SEQ ID NO: 120164 - DNA, 16 bp, H. sapiens
gtctgcctagaatttc

SEQ ID NO: 120165 - DNA, 16 bp, H. sapiens
gtctgcctcggcctcc

SEQ ID NO: 120166 - DNA, 18 bp, H. sapiens
gtctgcctgcctcggcct

SEQ ID NO: 120167 - DNA, 16 bp, H. sapiens
gtctgcctgtctgcct

SEQ ID NO: 120168 - DNA, 17 bp, H. sapiens
gtctgcctgttctcaga

SEQ ID NO: 120169 - DNA, 16 bp, H. sapiens
gtctgccttccccagc

SEQ ID NO: 120170 - DNA, 16 bp, H. sapiens
gtctgcgggggccgct

SEQ ID NO: 120171 - DNA, 21 bp, H. sapiens
gtctgctaagtagcgggtgtt

SEQ ID NO: 120172 - DNA, 16 bp, H. sapiens
gtctgctccagaccct

SEQ ID NO: 120173 - DNA, 16 bp, H. sapiens
gtctgctgaagctgca

SEQ ID NO: 120174 - DNA, 16 bp, H. sapiens
gtctgctgaccttccc

SEQ ID NO: 120175 - DNA, 16 bp, H. sapiens
gtctgctggggctgcc

SEQ ID NO: 120176 - DNA, 16 bp, H. sapiens
gtctgcttcccctttg

SEQ ID NO: 120177 - DNA, 16 bp, H. sapiens
gtctgctttgggaaag

SEQ ID NO: 120178 - DNA, 16 bp, H. sapiens
gtctggaactgaacct

SEQ ID NO: 120179 - DNA, 16 bp, H. sapiens
gtctggaatggacctc

SEQ ID NO: 120180 - DNA, 16 bp, H. sapiens
gtctggaattttggta

SEQ ID NO: 120181 - DNA, 16 bp, H. sapiens
gtctggagaggacctc

SEQ ID NO: 120182 - DNA, 16 bp, H. sapiens
gtctggagggtggtgg

SEQ ID NO: 120183 - DNA, 16 bp, H. sapiens
gtctggagtgcacctc

SEQ ID NO: 120184 - DNA, 16 bp, H. sapiens
gtctggagtgctgtgg

SEQ ID NO: 120185 - DNA, 16 bp, H. sapiens
gtctggagtggacctc

SEQ ID NO: 120186 - DNA, 16 bp, H. sapiens
gtctggcagagacaca

SEQ ID NO: 120187 - DNA, 16 bp, H. sapiens
gtctggccaacaaggt

SEQ ID NO: 120188 - DNA, 16 bp, H. sapiens
gtctggccacagtggc

SEQ ID NO: 120189 - DNA, 16 bp, H. sapiens
gtctggccatgatctg

SEQ ID NO: 120190 - DNA, 16 bp, H. sapiens
gtctggcccaggctgg

SEQ ID NO: 120191 - DNA, 16 bp, H. sapiens
gtctggcctttgccct

SEQ ID NO: 120192 - DNA, 16 bp, H. sapiens
gtctggctccagggcc

SEQ ID NO: 120193 - DNA, 16 bp, H. sapiens
gtctggctctgtcccc

SEQ ID NO: 120194 - DNA, 16 bp, H. sapiens
gtctggctctgttgac

SEQ ID NO: 120195 - DNA, 16 bp, H. sapiens
gtctggctgcctgtgg

SEQ ID NO: 120196 - DNA, 16 bp, H. sapiens
gtctggctgtgttgcc

SEQ ID NO: 120197 - DNA, 16 bp, H. sapiens
gtctgggagacagagt

SEQ ID NO: 120198 - DNA, 16 bp, H. sapiens
gtctggggcaagttct

SEQ ID NO: 120199 - DNA, 16 bp, H. sapiens
gtctggggtgggcctg

SEQ ID NO: 120200 - DNA, 16 bp, H. sapiens
gtctgggtgggcacca

SEQ ID NO: 120201 - DNA, 16 bp, H. sapiens
gtctgggtggggcctg

SEQ ID NO: 120202 - DNA, 16 bp, H. sapiens
gtctggtgatagctgg

SEQ ID NO: 120203 - DNA, 16 bp, H. sapiens
gtctgtaaaatgaaga

SEQ ID NO: 120204 - DNA, 16 bp, H. sapiens
gtctgtaaacccagct

SEQ ID NO: 120205 - DNA, 16 bp, H. sapiens
gtctgtaatggatttt

SEQ ID NO: 120206 - DNA, 16 bp, H. sapiens
gtctgtatgtctgtgt

SEQ ID NO: 120207 - DNA, 16 bp, H. sapiens
gtctgtatgtgtgtat

SEQ ID NO: 120208 - DNA, 16 bp, H. sapiens
gtctgtcacccaggct

SEQ ID NO: 120209 - DNA, 16 bp, H. sapiens
gtctgtcatcccagca

SEQ ID NO: 120210 - DNA, 16 bp, H. sapiens
gtctgtccgtccgtcc

SEQ ID NO: 120211 - DNA, 16 bp, H. sapiens
gtctgtcctcacactg

SEQ ID NO: 120212 - DNA, 16 bp, H. sapiens
gtctgtccttccttcc

SEQ ID NO: 120213 - DNA, 16 bp, H. sapiens
gtctgtctctctctct

SEQ ID NO: 120214 - DNA, 16 bp, H. sapiens
gtctgtctctgtcacc

SEQ ID NO: 120215 - DNA, 16 bp, H. sapiens
gtctgtctctgtcatc

SEQ ID NO: 120216 - DNA, 16 bp, H. sapiens
gtctgtctgattccag

SEQ ID NO: 120217 - DNA, 16 bp, H. sapiens
gtctgtctgtctgtca

SEQ ID NO: 120218 - DNA, 16 bp, H. sapiens
gtctgtctgtgtcttg

SEQ ID NO: 120219 - DNA, 16 bp, H. sapiens
gtctgtgaattctttt

SEQ ID NO: 120220 - DNA, 16 bp, H. sapiens
gtctgtgatttcctca

SEQ ID NO: 120221 - DNA, 16 bp, H. sapiens
gtctgtgccctgcccc

SEQ ID NO: 120222 - DNA, 16 bp, H. sapiens
gtctgtggtcctagct

SEQ ID NO: 120223 - DNA, 16 bp, H. sapiens
gtctgtgtctccaccc

SEQ ID NO: 120224 - DNA, 16 bp, H. sapiens
gtctgtgtgcatgtgt

SEQ ID NO: 120225 - DNA, 16 bp, H. sapiens
gtctgtgtgtctgtct

SEQ ID NO: 120226 - DNA, 16 bp, H. sapiens
gtctgtgtgtgtacat

SEQ ID NO: 120227 - DNA, 16 bp, H. sapiens
gtctgtgtgtgtgcgc

SEQ ID NO: 120228 - DNA, 16 bp, H. sapiens
gtctgtgtttttaaaa

SEQ ID NO: 120229 - DNA, 16 bp, H. sapiens
gtctgttaggtccatt

SEQ ID NO: 120230 - DNA, 16 bp, H. sapiens
gtctgttcataccctt

SEQ ID NO: 120231 - DNA, 16 bp, H. sapiens
gtctgttcctgctgct

SEQ ID NO: 120232 - DNA, 16 bp, H. sapiens
gtctgttcctgtcctt

SEQ ID NO: 120233 - DNA, 16 bp, H. sapiens
gtctgttggctgcata

SEQ ID NO: 120234 - DNA, 16 bp, H. sapiens
gtctgttgttagtctg

SEQ ID NO: 120235 - DNA, 16 bp, H. sapiens
gtctgttttgttcatt

SEQ ID NO: 120236 - DNA, 16 bp, H. sapiens
gtctgttttttatgcc

SEQ ID NO: 120237 - DNA, 16 bp, H. sapiens
gtcttaaaaaggaagg

SEQ ID NO: 120238 - DNA, 16 bp, H. sapiens
gtcttaaaaataaata

SEQ ID NO: 120239 - DNA, 16 bp, H. sapiens
gtcttaacacatttaa

SEQ ID NO: 120240 - DNA, 16 bp, H. sapiens
gtcttaataaatttaa

SEQ ID NO: 120241 - DNA, 16 bp, H. sapiens
gtcttaattttgttat

SEQ ID NO: 120242 - DNA, 16 bp, H. sapiens
gtcttactcatcttta

SEQ ID NO: 120243 - DNA, 16 bp, H. sapiens
gtcttactctattgcc

SEQ ID NO: 120244 - DNA, 16 bp, H. sapiens
gtcttactctgtcaac

SEQ ID NO: 120245 - DNA, 17 bp, H. sapiens
gtcttagctactcagga

SEQ ID NO: 120246 - DNA, 16 bp, H. sapiens
gtcttattcatttttc

SEQ ID NO: 120247 - DNA, 16 bp, H. sapiens
gtcttatttattaaag

SEQ ID NO: 120248 - DNA, 16 bp, H. sapiens
gtcttattttgaaaag

SEQ ID NO: 120249 - DNA, 16 bp, H. sapiens
gtcttatttttttaaa

SEQ ID NO: 120250 - DNA, 16 bp, H. sapiens
gtcttcaagctcactg

SEQ ID NO: 120251 - DNA, 16 bp, H. sapiens
gtcttcaagctctgaa

SEQ ID NO: 120252 - DNA, 16 bp, H. sapiens
gtcttcaaggagaact

SEQ ID NO: 120253 - DNA, 16 bp, H. sapiens
gtcttcaatccatctt

SEQ ID NO: 120254 - DNA, 16 bp, H. sapiens
gtcttcacatggctgg

SEQ ID NO: 120255 - DNA, 16 bp, H. sapiens
gtcttcagaattgtca

SEQ ID NO: 120256 - DNA, 16 bp, H. sapiens
gtcttcagcttggagg

SEQ ID NO: 120257 - DNA, 16 bp, H. sapiens
gtcttcatatggctgg

SEQ ID NO: 120258 - DNA, 16 bp, H. sapiens
gtcttcatcctcatcc

SEQ ID NO: 120259 - DNA, 16 bp, H. sapiens
gtcttcatttccttat

SEQ ID NO: 120260 - DNA, 16 bp, H. sapiens
gtcttcatttctgaag

SEQ ID NO: 120261 - DNA, 16 bp, H. sapiens
gtcttccaacaaagaa

SEQ ID NO: 120262 - DNA, 16 bp, H. sapiens
gtcttccaagtagcta

SEQ ID NO: 120263 - DNA, 16 bp, H. sapiens
gtcttccacaaaacct

SEQ ID NO: 120264 - DNA, 16 bp, H. sapiens
gtcttccctctgtcca

SEQ ID NO: 120265 - DNA, 16 bp, H. sapiens
gtcttcctccccaaaa

SEQ ID NO: 120266 - DNA, 16 bp, H. sapiens
gtcttcctctgtggcc

SEQ ID NO: 120267 - DNA, 16 bp, H. sapiens
gtcttcctttgtcacc

SEQ ID NO: 120268 - DNA, 16 bp, H. sapiens
gtcttctcatttgtaa

SEQ ID NO: 120269 - DNA, 16 bp, H. sapiens
gtcttctctaactccc

SEQ ID NO: 120270 - DNA, 16 bp, H. sapiens
gtcttctgctgtctca

SEQ ID NO: 120271 - DNA, 16 bp, H. sapiens
gtcttcttgatttctt

SEQ ID NO: 120272 - DNA, 16 bp, H. sapiens
gtcttctttggggaaa

SEQ ID NO: 120273 - DNA, 16 bp, H. sapiens
gtcttcttttgagata

SEQ ID NO: 120274 - DNA, 16 bp, H. sapiens
gtcttgaaagcagcaa

SEQ ID NO: 120275 - DNA, 16 bp, H. sapiens
gtcttgaacacctgga

SEQ ID NO: 120276 - DNA, 16 bp, H. sapiens
gtcttgaacccctagg

SEQ ID NO: 120277 - DNA, 16 bp, H. sapiens
gtcttgaactactggc

SEQ ID NO: 120278 - DNA, 16 bp, H. sapiens
gtcttgaactcctcaa

SEQ ID NO: 120279 - DNA, 16 bp, H. sapiens
gtcttgagctcttggg

SEQ ID NO: 120280 - DNA, 16 bp, H. sapiens
gtcttgatttgcattt

SEQ ID NO: 120281 - DNA, 16 bp, H. sapiens
gtcttgccctgtcacc

SEQ ID NO: 120282 - DNA, 16 bp, H. sapiens
gtcttgccttgttgcc

SEQ ID NO: 120283 - DNA, 16 bp, H. sapiens
gtcttgccttttcatt

SEQ ID NO: 120284 - DNA, 16 bp, H. sapiens
gtcttgctacgttgcc

SEQ ID NO: 120285 - DNA, 16 bp, H. sapiens
gtcttgctcagcagat

SEQ ID NO: 120286 - DNA, 16 bp, H. sapiens
gtcttgctctgacacc

SEQ ID NO: 120287 - DNA, 16 bp, H. sapiens
gtcttgctctggtgcc

SEQ ID NO: 120288 - DNA, 16 bp, H. sapiens
gtcttgctctgtcacc

SEQ ID NO: 120289 - DNA, 17 bp, H. sapiens
gtcttgctctgtcacct

SEQ ID NO: 120290 - DNA, 16 bp, H. sapiens
gtcttgctctgtcact

SEQ ID NO: 120291 - DNA, 16 bp, H. sapiens
gtcttgctctgtcatc

SEQ ID NO: 120292 - DNA, 16 bp, H. sapiens
gtcttgctctttcgcc

SEQ ID NO: 120293 - DNA, 16 bp, H. sapiens
gtcttgctgtcttggg

SEQ ID NO: 120294 - DNA, 16 bp, H. sapiens
gtcttgctgtgtcact

SEQ ID NO: 120295 - DNA, 16 bp, H. sapiens
gtcttgctttagctat

SEQ ID NO: 120296 - DNA, 16 bp, H. sapiens
gtcttgctttttaaaa

SEQ ID NO: 120297 - DNA, 16 bp, H. sapiens
gtcttggacttttttt

SEQ ID NO: 120298 - DNA, 16 bp, H. sapiens
gtcttggctgggcatg

SEQ ID NO: 120299 - DNA, 16 bp, H. sapiens
gtcttgggggaaaaaa

SEQ ID NO: 120300 - DNA, 16 bp, H. sapiens
gtcttggtaaaataac

SEQ ID NO: 120301 - DNA, 16 bp, H. sapiens
gtcttgtcccagttct

SEQ ID NO: 120302 - DNA, 16 bp, H. sapiens
gtcttgttggccaggc

SEQ ID NO: 120303 - DNA, 16 bp, H. sapiens
gtctttaaaaaaaaaa

SEQ ID NO: 120304 - DNA, 16 bp, H. sapiens
gtctttaaaaaataaa

SEQ ID NO: 120305 - DNA, 16 bp, H. sapiens
gtctttaagagactca

SEQ ID NO: 120306 - DNA, 16 bp, H. sapiens
gtctttatattttaaa

SEQ ID NO: 120307 - DNA, 16 bp, H. sapiens
gtctttcacagtggtt

SEQ ID NO: 120308 - DNA, 16 bp, H. sapiens
gtctttcagaccacag

SEQ ID NO: 120309 - DNA, 16 bp, H. sapiens
gtctttcatcaatttt

SEQ ID NO: 120310 - DNA, 16 bp, H. sapiens
gtctttcccatgatgt

SEQ ID NO: 120311 - DNA, 16 bp, H. sapiens
gtctttcccatggtgt

SEQ ID NO: 120312 - DNA, 16 bp, H. sapiens
gtctttcctcagcctc

SEQ ID NO: 120313 - DNA, 16 bp, H. sapiens
gtctttcctcctgcta

SEQ ID NO: 120314 - DNA, 16 bp, H. sapiens
gtctttcctgtgctct

SEQ ID NO: 120315 - DNA, 16 bp, H. sapiens
gtctttctgtgcttgg

SEQ ID NO: 120316 - DNA, 16 bp, H. sapiens
gtctttctttgttgcc

SEQ ID NO: 120317 - DNA, 16 bp, H. sapiens
gtctttgaagttgctg

SEQ ID NO: 120318 - DNA, 16 bp, H. sapiens
gtctttgatccatttg

SEQ ID NO: 120319 - DNA, 16 bp, H. sapiens
gtctttgcctgctgcc

SEQ ID NO: 120320 - DNA, 16 bp, H. sapiens
gtctttggaacttgcc

SEQ ID NO: 120321 - DNA, 16 bp, H. sapiens
gtctttggtattttgt

SEQ ID NO: 120322 - DNA, 16 bp, H. sapiens
gtctttgtagcagcat

SEQ ID NO: 120323 - DNA, 16 bp, H. sapiens
gtctttgtccattttg

SEQ ID NO: 120324 - DNA, 16 bp, H. sapiens
gtctttgtccccagtt

SEQ ID NO: 120325 - DNA, 16 bp, H. sapiens
gtctttgtctttcatg

SEQ ID NO: 120326 - DNA, 16 bp, H. sapiens
gtctttgtgacctgta

SEQ ID NO: 120327 - DNA, 16 bp, H. sapiens
gtctttgtgactggct

SEQ ID NO: 120328 - DNA, 16 bp, H. sapiens
gtctttgtgtcctcat

SEQ ID NO: 120329 - DNA, 16 bp, H. sapiens
gtctttgttctcactg

SEQ ID NO: 120330 - DNA, 16 bp, H. sapiens
gtctttgttctcatta

SEQ ID NO: 120331 - DNA, 16 bp, H. sapiens
gtcttttaagtctctt

SEQ ID NO: 120332 - DNA, 16 bp, H. sapiens
gtcttttcacattttt

SEQ ID NO: 120333 - DNA, 16 bp, H. sapiens
gtcttttctacatcta

SEQ ID NO: 120334 - DNA, 16 bp, H. sapiens
gtcttttctttataaa

SEQ ID NO: 120335 - DNA, 16 bp, H. sapiens
gtcttttgaagacagc

SEQ ID NO: 120336 - DNA, 16 bp, H. sapiens
gtcttttgtaaatatt

SEQ ID NO: 120337 - DNA, 16 bp, H. sapiens
gtcttttgtaactggc

SEQ ID NO: 120338 - DNA, 16 bp, H. sapiens
gtctttttaaaaaaaa

SEQ ID NO: 120339 - DNA, 16 bp, H. sapiens
gtctttttcagcttct

SEQ ID NO: 120340 - DNA, 16 bp, H. sapiens
gtctttttcttgtaaa

SEQ ID NO: 120341 - DNA, 16 bp, H. sapiens
gtctttttgatagtag

SEQ ID NO: 120342 - DNA, 16 bp, H. sapiens
gtcttttttgatcatt

SEQ ID NO: 120343 - DNA, 16 bp, H. sapiens
gtctttttttaaaaaa

SEQ ID NO: 120344 - DNA, 16 bp, H. sapiens
gtgaaaaaaagcaaga

SEQ ID NO: 120345 - DNA, 16 bp, H. sapiens
gtgaaaaaagaaacat

SEQ ID NO: 120346 - DNA, 16 bp, H. sapiens
gtgaaaaaggagacat

SEQ ID NO: 120347 - DNA, 16 bp, H. sapiens
gtgaaaaataaatttc

SEQ ID NO: 120348 - DNA, 16 bp, H. sapiens
gtgaaaaattaatctt

SEQ ID NO: 120349 - DNA, 16 bp, H. sapiens
gtgaaaacatttaaaa

SEQ ID NO: 120350 - DNA, 16 bp, H. sapiens
gtgaaaaccttggtaa

SEQ ID NO: 120351 - DNA, 16 bp, H. sapiens
gtgaaaactgactaat

SEQ ID NO: 120352 - DNA, 16 bp, H. sapiens
gtgaaaagaaacaggt

SEQ ID NO: 120353 - DNA, 16 bp, H. sapiens
gtgaaaagacaacctg

SEQ ID NO: 120354 - DNA, 16 bp, H. sapiens
gtgaaaagagagactg

SEQ ID NO: 120355 - DNA, 16 bp, H. sapiens
gtgaaaaggaaacact

SEQ ID NO: 120356 - DNA, 16 bp, H. sapiens
gtgaaaagtgacattg

SEQ ID NO: 120357 - DNA, 16 bp, H. sapiens
gtgaaaatattttgaa

SEQ ID NO: 120358 - DNA, 16 bp, H. sapiens
gtgaaaatcagagaaa

SEQ ID NO: 120359 - DNA, 16 bp, H. sapiens
gtgaaaatccatctca

SEQ ID NO: 120360 - DNA, 16 bp, H. sapiens
gtgaaaatgaaaaatg

SEQ ID NO: 120361 - DNA, 16 bp, H. sapiens
gtgaaaatggaaatat

SEQ ID NO: 120362 - DNA, 16 bp, H. sapiens
gtgaaaatggacatac

SEQ ID NO: 120363 - DNA, 16 bp, H. sapiens
gtgaaaatggcaatac

SEQ ID NO: 120364 - DNA, 16 bp, H. sapiens
gtgaaaatggccttac

SEQ ID NO: 120365 - DNA, 16 bp, H. sapiens
gtgaaaattaccaaaa

SEQ ID NO: 120366 - DNA, 16 bp, H. sapiens
gtgaaaattagctggg

SEQ ID NO: 120367 - DNA, 16 bp, H. sapiens
gtgaaacacacacaca

SEQ ID NO: 120368 - DNA, 16 bp, H. sapiens
gtgaaacactgcctct

SEQ ID NO: 120369 - DNA, 16 bp, H. sapiens
gtgaaacagaacagaa

SEQ ID NO: 120370 - DNA, 16 bp, H. sapiens
gtgaaacccagtgtct

SEQ ID NO: 120371 - DNA, 18 bp, H. sapiens
gtgaaaccccatctctat

SEQ ID NO: 120372 - DNA, 16 bp, H. sapiens
gtgaaaccccatcttc

SEQ ID NO: 120373 - DNA, 16 bp, H. sapiens
gtgaaacccccgcctc

SEQ ID NO: 120374 - DNA, 16 bp, H. sapiens
gtgaaaccccttatct

SEQ ID NO: 120375 - DNA, 16 bp, H. sapiens
gtgaaaccctggctct

SEQ ID NO: 120376 - DNA, 16 bp, H. sapiens
gtgaaaccctgtcttt

SEQ ID NO: 120377 - DNA, 16 bp, H. sapiens
gtgaaacctcgtctcc

SEQ ID NO: 120378 - DNA, 16 bp, H. sapiens
gtgaaacctcgtctct

SEQ ID NO: 120379 - DNA, 16 bp, H. sapiens
gtgaaacctgcctcta

SEQ ID NO: 120380 - DNA, 16 bp, H. sapiens
gtgaaactctgtccca

SEQ ID NO: 120381 - DNA, 16 bp, H. sapiens
gtgaaagaaaaatatt

SEQ ID NO: 120382 - DNA, 16 bp, H. sapiens
gtgaaagaagccaagc

SEQ ID NO: 120383 - DNA, 16 bp, H. sapiens
gtgaaagaagccagcc

SEQ ID NO: 120384 - DNA, 16 bp, H. sapiens
gtgaaagactgaatac

SEQ ID NO: 120385 - DNA, 16 bp, H. sapiens
gtgaaagaggaagcaa

SEQ ID NO: 120386 - DNA, 16 bp, H. sapiens
gtgaaagagtaagact

SEQ ID NO: 120387 - DNA, 16 bp, H. sapiens
gtgaaagcaagtttat

SEQ ID NO: 120388 - DNA, 16 bp, H. sapiens
gtgaaagcagctgcag

SEQ ID NO: 120389 - DNA, 16 bp, H. sapiens
gtgaaagttgatcata

SEQ ID NO: 120390 - DNA, 16 bp, H. sapiens
gtgaaataaagatttt

SEQ ID NO: 120391 - DNA, 16 bp, H. sapiens
gtgaaatatcatctca

SEQ ID NO: 120392 - DNA, 16 bp, H. sapiens
gtgaaatcaaactaga

SEQ ID NO: 120393 - DNA, 16 bp, H. sapiens
gtgaaatcctgtctgt

SEQ ID NO: 120394 - DNA, 16 bp, H. sapiens
gtgaaatgaatgaatg

SEQ ID NO: 120395 - DNA, 16 bp, H. sapiens
gtgaaatgatgaaatg

SEQ ID NO: 120396 - DNA, 16 bp, H. sapiens
gtgaaatgctatctct

SEQ ID NO: 120397 - DNA, 16 bp, H. sapiens
gtgaaatggcgtgatc

SEQ ID NO: 120398 - DNA, 16 bp, H. sapiens
gtgaaatggggataat

SEQ ID NO: 120399 - DNA, 16 bp, H. sapiens
gtgaaatgttatctca

SEQ ID NO: 120400 - DNA, 16 bp, H. sapiens
gtgaaattattattat

SEQ ID NO: 120401 - DNA, 16 bp, H. sapiens
gtgaaattcaacagaa

SEQ ID NO: 120402 - DNA, 16 bp, H. sapiens
gtgaaattccttctcc

SEQ ID NO: 120403 - DNA, 16 bp, H. sapiens
gtgaaattggaatgtt

SEQ ID NO: 120404 - DNA, 16 bp, H. sapiens
gtgaacaaagcagaca

SEQ ID NO: 120405 - DNA, 16 bp, H. sapiens
gtgaacagtgcagcaa

SEQ ID NO: 120406 - DNA, 16 bp, H. sapiens
gtgaacatcacagaat

SEQ ID NO: 120407 - DNA, 16 bp, H. sapiens
gtgaacatgttttcaa

SEQ ID NO: 120408 - DNA, 16 bp, H. sapiens
gtgaaccaccatgccc

SEQ ID NO: 120409 - DNA, 16 bp, H. sapiens
gtgaaccactgtgccc

SEQ ID NO: 120410 - DNA, 19 bp, H. sapiens
gtgaacccaggaggtggag

SEQ ID NO: 120411 - DNA, 17 bp, H. sapiens
gtgaacccgggagatgg

SEQ ID NO: 120412 - DNA, 16 bp, H. sapiens
gtgaaccctactgtga

SEQ ID NO: 120413 - DNA, 16 bp, H. sapiens
gtgaaccctggaggca

SEQ ID NO: 120414 - DNA, 16 bp, H. sapiens
gtgaaccgagatcaca

SEQ ID NO: 120415 - DNA, 16 bp, H. sapiens
gtgaacctggaaggca

SEQ ID NO: 120416 - DNA, 20 bp, H. sapiens
gtgaacctgggaggcggagg

SEQ ID NO: 120417 - DNA, 16 bp, H. sapiens
gtgaactataacaagt

SEQ ID NO: 120418 - DNA, 16 bp, H. sapiens
gtgaacttcctgaggc

SEQ ID NO: 120419 - DNA, 18 bp, H. sapiens
gtgaacttgggaggtgga

SEQ ID NO: 120420 - DNA, 16 bp, H. sapiens
gtgaagaaaactaaaa

SEQ ID NO: 120421 - DNA, 16 bp, H. sapiens
gtgaagaaaagggaac

SEQ ID NO: 120422 - DNA, 16 bp, H. sapiens
gtgaagaaaagggaat

SEQ ID NO: 120423 - DNA, 16 bp, H. sapiens
gtgaagaaagtaaatg

SEQ ID NO: 120424 - DNA, 16 bp, H. sapiens
gtgaagaacaaaagaa

SEQ ID NO: 120425 - DNA, 16 bp, H. sapiens
gtgaagaagatgaaga

SEQ ID NO: 120426 - DNA, 16 bp, H. sapiens
gtgaagaagctggcca

SEQ ID NO: 120427 - DNA, 16 bp, H. sapiens
gtgaagaaggaaatat

SEQ ID NO: 120428 - DNA, 16 bp, H. sapiens
gtgaagaaggtcattg

SEQ ID NO: 120429 - DNA, 16 bp, H. sapiens
gtgaagaatgatgatg

SEQ ID NO: 120430 - DNA, 16 bp, H. sapiens
gtgaagaatgtcatca

SEQ ID NO: 120431 - DNA, 22 bp, H. sapiens
gtgaagacaagattagagaaaa

SEQ ID NO: 120432 - DNA, 16 bp, H. sapiens
gtgaagacagagcaga

SEQ ID NO: 120433 - DNA, 16 bp, H. sapiens
gtgaagacagtcattg

SEQ ID NO: 120434 - DNA, 16 bp, H. sapiens
gtgaagacatttcctt

SEQ ID NO: 120435 - DNA, 16 bp, H. sapiens
gtgaagagcgaaagaa

SEQ ID NO: 120436 - DNA, 16 bp, H. sapiens
gtgaagatccctgtcc

SEQ ID NO: 120437 - DNA, 16 bp, H. sapiens
gtgaagatgaaatgaa

SEQ ID NO: 120438 - DNA, 16 bp, H. sapiens
gtgaagatgatgatga

SEQ ID NO: 120439 - DNA, 16 bp, H. sapiens
gtgaagatgctgtaaa

SEQ ID NO: 120440 - DNA, 16 bp, H. sapiens
gtgaagatggaagcag

SEQ ID NO: 120441 - DNA, 16 bp, H. sapiens
gtgaagatggagaaga

SEQ ID NO: 120442 - DNA, 16 bp, H. sapiens
gtgaagatgtgcctgc

SEQ ID NO: 120443 - DNA, 16 bp, H. sapiens
gtgaagatgtttcctt

SEQ ID NO: 120444 - DNA, 16 bp, H. sapiens
gtgaagcagaggacat

SEQ ID NO: 120445 - DNA, 16 bp, H. sapiens
gtgaagcagggttttc

SEQ ID NO: 120446 - DNA, 16 bp, H. sapiens
gtgaagcccaatgcaa

SEQ ID NO: 120447 - DNA, 16 bp, H. sapiens
gtgaagcctcaggaag

SEQ ID NO: 120448 - DNA, 16 bp, H. sapiens
gtgaagctgcagactt

SEQ ID NO: 120449 - DNA, 16 bp, H. sapiens
gtgaagctggaagcca

SEQ ID NO: 120450 - DNA, 16 bp, H. sapiens
gtgaagctttcccagg

SEQ ID NO: 120451 - DNA, 16 bp, H. sapiens
gtgaaggaaagataca

SEQ ID NO: 120452 - DNA, 16 bp, H. sapiens
gtgaaggaagaaatat

SEQ ID NO: 120453 - DNA, 16 bp, H. sapiens
gtgaaggaagtgaagg

SEQ ID NO: 120454 - DNA, 16 bp, H. sapiens
gtgaaggagaagcaag

SEQ ID NO: 120455 - DNA, 16 bp, H. sapiens
gtgaaggccaggctga

SEQ ID NO: 120456 - DNA, 16 bp, H. sapiens
gtgaagggaaagcagg

SEQ ID NO: 120457 - DNA, 16 bp, H. sapiens
gtgaagggatagaaaa

SEQ ID NO: 120458 - DNA, 16 bp, H. sapiens
gtgaagggcctgatgg

SEQ ID NO: 120459 - DNA, 16 bp, H. sapiens
gtgaaggggaagctgg

SEQ ID NO: 120460 - DNA, 16 bp, H. sapiens
gtgaagtggagtggag

SEQ ID NO: 120461 - DNA, 16 bp, H. sapiens
gtgaataagtctgatg

SEQ ID NO: 120462 - DNA, 16 bp, H. sapiens
gtgaataatatcacag

SEQ ID NO: 120463 - DNA, 16 bp, H. sapiens
gtgaataatgctacag

SEQ ID NO: 120464 - DNA, 16 bp, H. sapiens
gtgaatattaccttat

SEQ ID NO: 120465 - DNA, 16 bp, H. sapiens
gtgaatccagccaggc

SEQ ID NO: 120466 - DNA, 17 bp, H. sapiens
gtgaatccaggaggcag

SEQ ID NO: 120467 - DNA, 16 bp, H. sapiens
gtgaatctatttctgg

SEQ ID NO: 120468 - DNA, 16 bp, H. sapiens
gtgaatctcttgaaga

SEQ ID NO: 120469 - DNA, 16 bp, H. sapiens
gtgaatgaatcaatga

SEQ ID NO: 120470 - DNA, 16 bp, H. sapiens
gtgaatgaatgaatga

SEQ ID NO: 120471 - DNA, 16 bp, H. sapiens
gtgaatgcaaacatcc

SEQ ID NO: 120472 - DNA, 16 bp, H. sapiens
gtgaatgctgctgtct

SEQ ID NO: 120473 - DNA, 16 bp, H. sapiens
gtgaatggacaaataa

SEQ ID NO: 120474 - DNA, 16 bp, H. sapiens
gtgaatgggattaagg

SEQ ID NO: 120475 - DNA, 16 bp, H. sapiens
gtgaatgtactgaatg

SEQ ID NO: 120476 - DNA, 16 bp, H. sapiens
gtgaatgtggtgaaaa

SEQ ID NO: 120477 - DNA, 16 bp, H. sapiens
gtgaatgtgtgtatgt

SEQ ID NO: 120478 - DNA, 16 bp, H. sapiens
gtgaatttcctctcct

SEQ ID NO: 120479 - DNA, 16 bp, H. sapiens
gtgaatttggagctga

SEQ ID NO: 120480 - DNA, 16 bp, H. sapiens
gtgaattttgacaaat

SEQ ID NO: 120481 - DNA, 16 bp, H. sapiens
gtgaattttgtggtat

SEQ ID NO: 120482 - DNA, 16 bp, H. sapiens
gtgacaaaaacaagca

SEQ ID NO: 120483 - DNA, 16 bp, H. sapiens
gtgacaaagaccctgt

SEQ ID NO: 120484 - DNA, 16 bp, H. sapiens
gtgacaaagtgagagc

SEQ ID NO: 120485 - DNA, 22 bp, H. sapiens
gtgacaaatgggatctaattaa

SEQ ID NO: 120486 - DNA, 16 bp, H. sapiens
gtgacaacagtgagac

SEQ ID NO: 120487 - DNA, 16 bp, H. sapiens
gtgacaaccagaaatg

SEQ ID NO: 120488 - DNA, 16 bp, H. sapiens
gtgacaagaacaagac

SEQ ID NO: 120489 - DNA, 16 bp, H. sapiens
gtgacaagagccaaac

SEQ ID NO: 120490 - DNA, 16 bp, H. sapiens
gtgacaatactttgca

SEQ ID NO: 120491 - DNA, 16 bp, H. sapiens
gtgacaatcaaaaatg

SEQ ID NO: 120492 - DNA, 16 bp, H. sapiens
gtgacacagcctcagg

SEQ ID NO: 120493 - DNA, 16 bp, H. sapiens
gtgacacagtaagact

SEQ ID NO: 120494 - DNA, 16 bp, H. sapiens
gtgacacagtcatagc

SEQ ID NO: 120495 - DNA, 16 bp, H. sapiens
gtgacaccctgtctcc

SEQ ID NO: 120496 - DNA, 16 bp, H. sapiens
gtgacagaactagacc

SEQ ID NO: 120497 - DNA, 16 bp, H. sapiens
gtgacagaagaagacc

SEQ ID NO: 120498 - DNA, 16 bp, H. sapiens
gtgacagacagagacc

SEQ ID NO: 120499 - DNA, 16 bp, H. sapiens
gtgacagacccacagc

SEQ ID NO: 120500 - DNA, 16 bp, H. sapiens
gtgacagagcaagatt

SEQ ID NO: 120501 - DNA, 16 bp, H. sapiens
gtgacagagcaaggca

SEQ ID NO: 120502 - DNA, 16 bp, H. sapiens
gtgacagagcagaact

SEQ ID NO: 120503 - DNA, 16 bp, H. sapiens
gtgacagagcaggatt

SEQ ID NO: 120504 - DNA, 16 bp, H. sapiens
gtgacagagccagagt

SEQ ID NO: 120505 - DNA, 16 bp, H. sapiens
gtgacagagcgagaca

SEQ ID NO: 120506 - DNA, 16 bp, H. sapiens
gtgacagaggaagacc

SEQ ID NO: 120507 - DNA, 16 bp, H. sapiens
gtgacagaggcagaag

SEQ ID NO: 120508 - DNA, 16 bp, H. sapiens
gtgacagaggctgtga

SEQ ID NO: 120509 - DNA, 17 bp, H. sapiens
gtgacagagggagactt

SEQ ID NO: 120510 - DNA, 16 bp, H. sapiens
gtgacagagtgaaact

SEQ ID NO: 120511 - DNA, 16 bp, H. sapiens
gtgacagagtgagagc

SEQ ID NO: 120512 - DNA, 16 bp, H. sapiens
gtgacagagtgggact

SEQ ID NO: 120513 - DNA, 16 bp, H. sapiens
gtgacagatggcacct

SEQ ID NO: 120514 - DNA, 16 bp, H. sapiens
gtgacagcacgtgtcc

SEQ ID NO: 120515 - DNA, 16 bp, H. sapiens
gtgacagctttgaaga

SEQ ID NO: 120516 - DNA, 16 bp, H. sapiens
gtgacagggtcttact

SEQ ID NO: 120517 - DNA, 16 bp, H. sapiens
gtgacagtgagactct

SEQ ID NO: 120518 - DNA, 16 bp, H. sapiens
gtgacagtgagactgt

SEQ ID NO: 120519 - DNA, 16 bp, H. sapiens
gtgacagtgagctgag

SEQ ID NO: 120520 - DNA, 16 bp, H. sapiens
gtgacagtgtgagact

SEQ ID NO: 120521 - DNA, 16 bp, H. sapiens
gtgacagtttacaaat

SEQ ID NO: 120522 - DNA, 16 bp, H. sapiens
gtgacagtttctcaga

SEQ ID NO: 120523 - DNA, 16 bp, H. sapiens
gtgacatagcaagact

SEQ ID NO: 120524 - DNA, 16 bp, H. sapiens
gtgacatcaacaagga

SEQ ID NO: 120525 - DNA, 16 bp, H. sapiens
gtgacatcagcaagat

SEQ ID NO: 120526 - DNA, 16 bp, H. sapiens
gtgacatgcctgctct

SEQ ID NO: 120527 - DNA, 16 bp, H. sapiens
gtgacatttggcttat

SEQ ID NO: 120528 - DNA, 16 bp, H. sapiens
gtgaccactgcctggc

SEQ ID NO: 120529 - DNA, 16 bp, H. sapiens
gtgaccagcaccacag

SEQ ID NO: 120530 - DNA, 16 bp, H. sapiens
gtgacccaaatcttca

SEQ ID NO: 120531 - DNA, 16 bp, H. sapiens
gtgacccacccgcctc

SEQ ID NO: 120532 - DNA, 16 bp, H. sapiens
gtgacccacctgcctc

SEQ ID NO: 120533 - DNA, 16 bp, H. sapiens
gtgacccactgcaccc

SEQ ID NO: 120534 - DNA, 16 bp, H. sapiens
gtgacccaggctggag

SEQ ID NO: 120535 - DNA, 16 bp, H. sapiens
gtgaccctgaactgga

SEQ ID NO: 120536 - DNA, 16 bp, H. sapiens
gtgacctacaaggaga

SEQ ID NO: 120537 - DNA, 16 bp, H. sapiens
gtgacctcaggcaaat

SEQ ID NO: 120538 - DNA, 16 bp, H. sapiens
gtgacctcaggtgatc

SEQ ID NO: 120539 - DNA, 24 bp, H. sapiens
gtgacctcatacaaaggcttggct

SEQ ID NO: 120540 - DNA, 16 bp, H. sapiens
gtgacctcgagcaagt

SEQ ID NO: 120541 - DNA, 16 bp, H. sapiens
gtgacctctgatcatc

SEQ ID NO: 120542 - DNA, 16 bp, H. sapiens
gtgacctctggaataa

SEQ ID NO: 120543 - DNA, 16 bp, H. sapiens
gtgacctggggcaagt

SEQ ID NO: 120544 - DNA, 16 bp, H. sapiens
gtgacctgtcctttct

SEQ ID NO: 120545 - DNA, 16 bp, H. sapiens
gtgaccttaaacaagt

SEQ ID NO: 120546 - DNA, 16 bp, H. sapiens
gtgaccttcctgcttc

SEQ ID NO: 120547 - DNA, 16 bp, H. sapiens
gtgaccttgggaaggt

SEQ ID NO: 120548 - DNA, 16 bp, H. sapiens
gtgaccttgggcaaac

SEQ ID NO: 120549 - DNA, 16 bp, H. sapiens
gtgaccttgggcaaat

SEQ ID NO: 120550 - DNA, 16 bp, H. sapiens
gtgaccttgggcaagt

SEQ ID NO: 120551 - DNA, 16 bp, H. sapiens
gtgacctttgccattt

SEQ ID NO: 120552 - DNA, 16 bp, H. sapiens
gtgaccttttttggaa

SEQ ID NO: 120553 - DNA, 16 bp, H. sapiens
gtgacgcacacctgta

SEQ ID NO: 120554 - DNA, 16 bp, H. sapiens
gtgactatgccactgc

SEQ ID NO: 120555 - DNA, 16 bp, H. sapiens
gtgactcaggaatgga

SEQ ID NO: 120556 - DNA, 16 bp, H. sapiens
gtgactcaggatggag

SEQ ID NO: 120557 - DNA, 16 bp, H. sapiens
gtgactccatctcaaa

SEQ ID NO: 120558 - DNA, 16 bp, H. sapiens
gtgactgagactctgt

SEQ ID NO: 120559 - DNA, 16 bp, H. sapiens
gtgactgagcaagact

SEQ ID NO: 120560 - DNA, 16 bp, H. sapiens
gtgactgtggttccca

SEQ ID NO: 120561 - DNA, 16 bp, H. sapiens
gtgactgtgtgagtca

SEQ ID NO: 120562 - DNA, 16 bp, H. sapiens
gtgactgtgtgtgtgt

SEQ ID NO: 120563 - DNA, 16 bp, H. sapiens
gtgactgttttttatt

SEQ ID NO: 120564 - DNA, 16 bp, H. sapiens
gtgacttaaacaacag

SEQ ID NO: 120565 - DNA, 16 bp, H. sapiens
gtgacttacccaaggt

SEQ ID NO: 120566 - DNA, 16 bp, H. sapiens
gtgacttaggtgctgt

SEQ ID NO: 120567 - DNA, 16 bp, H. sapiens
gtgacttcttgctgtg

SEQ ID NO: 120568 - DNA, 16 bp, H. sapiens
gtgacttgtccaagat

SEQ ID NO: 120569 - DNA, 16 bp, H. sapiens
gtgacttgtctgaggt

SEQ ID NO: 120570 - DNA, 16 bp, H. sapiens
gtgacttgttttggcc

SEQ ID NO: 120571 - DNA, 16 bp, H. sapiens
gtgactttaggcaagt

SEQ ID NO: 120572 - DNA, 17 bp, H. sapiens
gtgactttcttcacaga

SEQ ID NO: 120573 - DNA, 16 bp, H. sapiens
gtgactttgagaaagt

SEQ ID NO: 120574 - DNA, 16 bp, H. sapiens
gtgactttgatttgca

SEQ ID NO: 120575 - DNA, 16 bp, H. sapiens
gtgactttgctattgt

SEQ ID NO: 120576 - DNA, 16 bp, H. sapiens
gtgactttgggcaggt

SEQ ID NO: 120577 - DNA, 16 bp, H. sapiens
gtgagaaaatacattt

SEQ ID NO: 120578 - DNA, 16 bp, H. sapiens
gtgagaaataaattta

SEQ ID NO: 120579 - DNA, 16 bp, H. sapiens
gtgagaaatgatggtg

SEQ ID NO: 120580 - DNA, 16 bp, H. sapiens
gtgagaacacacagtg

SEQ ID NO: 120581 - DNA, 17 bp, H. sapiens
gtgagaacacatggaca

SEQ ID NO: 120582 - DNA, 16 bp, H. sapiens
gtgagaacacttgaaa

SEQ ID NO: 120583 - DNA, 16 bp, H. sapiens
gtgagaagtcactcac

SEQ ID NO: 120584 - DNA, 16 bp, H. sapiens
gtgagacactgcgcct

SEQ ID NO: 120585 - DNA, 16 bp, H. sapiens
gtgagacagagtcttg

SEQ ID NO: 120586 - DNA, 16 bp, H. sapiens
gtgagacagccaggtg

SEQ ID NO: 120587 - DNA, 16 bp, H. sapiens
gtgagacagtgtctca

SEQ ID NO: 120588 - DNA, 16 bp, H. sapiens
gtgagacccctgtctc

SEQ ID NO: 120589 - DNA, 16 bp, H. sapiens
gtgagaccctgtattt

SEQ ID NO: 120590 - DNA, 16 bp, H. sapiens
gtgagaccttgtctct

SEQ ID NO: 120591 - DNA, 16 bp, H. sapiens
gtgagactccaactct

SEQ ID NO: 120592 - DNA, 16 bp, H. sapiens
gtgagactccgtctct

SEQ ID NO: 120593 - DNA, 16 bp, H. sapiens
gtgagactcggtctct

SEQ ID NO: 120594 - DNA, 16 bp, H. sapiens
gtgagactctgtctcc

SEQ ID NO: 120595 - DNA, 16 bp, H. sapiens
gtgagactctgtgggc

SEQ ID NO: 120596 - DNA, 16 bp, H. sapiens
gtgagagacaaacact

SEQ ID NO: 120597 - DNA, 16 bp, H. sapiens
gtgagagactccatct

SEQ ID NO: 120598 - DNA, 16 bp, H. sapiens
gtgagagagagtgtgt

SEQ ID NO: 120599 - DNA, 16 bp, H. sapiens
gtgagagaggaagcaa

SEQ ID NO: 120600 - DNA, 16 bp, H. sapiens
gtgagagataggaatc

SEQ ID NO: 120601 - DNA, 16 bp, H. sapiens
gtgagagatggcatcc

SEQ ID NO: 120602 - DNA, 16 bp, H. sapiens
gtgagagcctcaggct

SEQ ID NO: 120603 - DNA, 16 bp, H. sapiens
gtgagagctacaattc

SEQ ID NO: 120604 - DNA, 16 bp, H. sapiens
gtgagaggatcatctg

SEQ ID NO: 120605 - DNA, 16 bp, H. sapiens
gtgagagtatttacac

SEQ ID NO: 120606 - DNA, 16 bp, H. sapiens
gtgagagtgagactcc

SEQ ID NO: 120607 - DNA, 16 bp, H. sapiens
gtgagagtgggagcaa

SEQ ID NO: 120608 - DNA, 16 bp, H. sapiens
gtgagatattttacat

SEQ ID NO: 120609 - DNA, 16 bp, H. sapiens
gtgagatgagatcatg

SEQ ID NO: 120610 - DNA, 16 bp, H. sapiens
gtgagatgcagcaaaa

SEQ ID NO: 120611 - DNA, 16 bp, H. sapiens
gtgagattctgtttca

SEQ ID NO: 120612 - DNA, 16 bp, H. sapiens
gtgagattgtggagaa

SEQ ID NO: 120613 - DNA, 16 bp, H. sapiens
gtgagatttatgtttt

SEQ ID NO: 120614 - DNA, 16 bp, H. sapiens
gtgagatttcatctct

SEQ ID NO: 120615 - DNA, 16 bp, H. sapiens
gtgagcaagagcaggg

SEQ ID NO: 120616 - DNA, 16 bp, H. sapiens
gtgagcaagagggccc

SEQ ID NO: 120617 - DNA, 16 bp, H. sapiens
gtgagcaaggtggaga

SEQ ID NO: 120618 - DNA, 16 bp, H. sapiens
gtgagcaccttttcat

SEQ ID NO: 120619 - DNA, 16 bp, H. sapiens
gtgagcagaggccagg

SEQ ID NO: 120620 - DNA, 16 bp, H. sapiens
gtgagcagcagcaaaa

SEQ ID NO: 120621 - DNA, 16 bp, H. sapiens
gtgagcagcaggacct

SEQ ID NO: 120622 - DNA, 16 bp, H. sapiens
gtgagcagcaggcgag

SEQ ID NO: 120623 - DNA, 16 bp, H. sapiens
gtgagcagggctgaga

SEQ ID NO: 120624 - DNA, 16 bp, H. sapiens
gtgagcagtgatcgca

SEQ ID NO: 120625 - DNA, 16 bp, H. sapiens
gtgagccaaaatctca

SEQ ID NO: 120626 - DNA, 16 bp, H. sapiens
gtgagccaacatcacg

SEQ ID NO: 120627 - DNA, 16 bp, H. sapiens
gtgagccaacgtgccc

SEQ ID NO: 120628 - DNA, 16 bp, H. sapiens
gtgagccaagactaca

SEQ ID NO: 120629 - DNA, 19 bp, H. sapiens
gtgagccaagactgcacca

SEQ ID NO: 120630 - DNA, 19 bp, H. sapiens
gtgagccaagatcgcgcca

SEQ ID NO: 120631 - DNA, 18 bp, H. sapiens
gtgagccaagattgcgct

SEQ ID NO: 120632 - DNA, 16 bp, H. sapiens
gtgagccaaggtcatg

SEQ ID NO: 120633 - DNA, 16 bp, H. sapiens
gtgagccaccaagccc

SEQ ID NO: 120634 - DNA, 16 bp, H. sapiens
gtgagccaccacacca

SEQ ID NO: 120635 - DNA, 16 bp, H. sapiens
gtgagccaccaccccc

SEQ ID NO: 120636 - DNA, 17 bp, H. sapiens
gtgagccaccacgccca

SEQ ID NO: 120637 - DNA, 16 bp, H. sapiens
gtgagccaccactccc

SEQ ID NO: 120638 - DNA, 16 bp, H. sapiens
gtgagccaccactcct

SEQ ID NO: 120639 - DNA, 16 bp, H. sapiens
gtgagccactacatcc

SEQ ID NO: 120640 - DNA, 16 bp, H. sapiens
gtgagccactgagctc

SEQ ID NO: 120641 - DNA, 16 bp, H. sapiens
gtgagccactgcaccc

SEQ ID NO: 120642 - DNA, 21 bp, H. sapiens
gtgagccactgcacccagccc

SEQ ID NO: 120643 - DNA, 21 bp, H. sapiens
gtgagccactgcacccggccg

SEQ ID NO: 120644 - DNA, 20 bp, H. sapiens
gtgagccactgcacctggct

SEQ ID NO: 120645 - DNA, 16 bp, H. sapiens
gtgagccactgcccca

SEQ ID NO: 120646 - DNA, 16 bp, H. sapiens
gtgagccactgccctc

SEQ ID NO: 120647 - DNA, 16 bp, H. sapiens
gtgagccactgcgtcc

SEQ ID NO: 120648 - DNA, 16 bp, H. sapiens
gtgagccactgtaccc

SEQ ID NO: 120649 - DNA, 16 bp, H. sapiens
gtgagccacttcaccc

SEQ ID NO: 120650 - DNA, 16 bp, H. sapiens
gtgagccagcctgaag

SEQ ID NO: 120651 - DNA, 16 bp, H. sapiens
gtgagccaggatggca

SEQ ID NO: 120652 - DNA, 16 bp, H. sapiens
gtgagccaggcccagg

SEQ ID NO: 120653 - DNA, 16 bp, H. sapiens
gtgagccatgatagtg

SEQ ID NO: 120654 - DNA, 16 bp, H. sapiens
gtgagccatgatcgtg

SEQ ID NO: 120655 - DNA, 16 bp, H. sapiens
gtgagccatgattctg

SEQ ID NO: 120656 - DNA, 16 bp, H. sapiens
gtgagccatggagccc

SEQ ID NO: 120657 - DNA, 16 bp, H. sapiens
gtgagccatggtgccc

SEQ ID NO: 120658 - DNA, 16 bp, H. sapiens
gtgagccattgcgccc

SEQ ID NO: 120659 - DNA, 19 bp, H. sapiens
gtgagcccagattgcgcca

SEQ ID NO: 120660 - DNA, 17 bp, H. sapiens
gtgagcccaggagttca

SEQ ID NO: 120661 - DNA, 16 bp, H. sapiens
gtgagccccaaagtgg

SEQ ID NO: 120662 - DNA, 16 bp, H. sapiens
gtgagcccccagcaca

SEQ ID NO: 120663 - DNA, 16 bp, H. sapiens
gtgagccctgggccct

SEQ ID NO: 120664 - DNA, 16 bp, H. sapiens
gtgagccgagaccgcg

SEQ ID NO: 120665 - DNA, 17 bp, H. sapiens
gtgagccgagatcgcac

SEQ ID NO: 120666 - DNA, 19 bp, H. sapiens
gtgagccgagatcgtacca

SEQ ID NO: 120667 - DNA, 19 bp, H. sapiens
gtgagccgagattgagcca

SEQ ID NO: 120668 - DNA, 19 bp, H. sapiens
gtgagccgagattgcacca

SEQ ID NO: 120669 - DNA, 19 bp, H. sapiens
gtgagccgaggtcgcgcca

SEQ ID NO: 120670 - DNA, 16 bp, H. sapiens
gtgagccgccgcgccc

SEQ ID NO: 120671 - DNA, 16 bp, H. sapiens
gtgagccgctgtgccc

SEQ ID NO: 120672 - DNA, 16 bp, H. sapiens
gtgagccgctgtgcct

SEQ ID NO: 120673 - DNA, 16 bp, H. sapiens
gtgagccgtgatcaca

SEQ ID NO: 120674 - DNA, 16 bp, H. sapiens
gtgagcctccacaccc

SEQ ID NO: 120675 - DNA, 16 bp, H. sapiens
gtgagcctctgcgcct

SEQ ID NO: 120676 - DNA, 16 bp, H. sapiens
gtgagcgccaccacgc

SEQ ID NO: 120677 - DNA, 19 bp, H. sapiens
gtgagcggagattgcgcca

SEQ ID NO: 120678 - DNA, 16 bp, H. sapiens
gtgagctaccacgccc

SEQ ID NO: 120679 - DNA, 16 bp, H. sapiens
gtgagctaccgcgccc

SEQ ID NO: 120680 - DNA, 16 bp, H. sapiens
gtgagctaccgtgccc

SEQ ID NO: 120681 - DNA, 16 bp, H. sapiens
gtgagctacctcgccc

SEQ ID NO: 120682 - DNA, 17 bp, H. sapiens
gtgagctatgatcgcac

SEQ ID NO: 120683 - DNA, 16 bp, H. sapiens
gtgagctatgattgcg

SEQ ID NO: 120684 - DNA, 16 bp, H. sapiens
gtgagctctgattgta

SEQ ID NO: 120685 - DNA, 16 bp, H. sapiens
gtgagctgaagcaggg

SEQ ID NO: 120686 - DNA, 16 bp, H. sapiens
gtgagctgagatggag

SEQ ID NO: 120687 - DNA, 16 bp, H. sapiens
gtgagctgagcttgca

SEQ ID NO: 120688 - DNA, 16 bp, H. sapiens
gtgagctgagttcatg

SEQ ID NO: 120689 - DNA, 16 bp, H. sapiens
gtgagctgggcatggt

SEQ ID NO: 120690 - DNA, 16 bp, H. sapiens
gtgagctgtgatcact

SEQ ID NO: 120691 - DNA, 16 bp, H. sapiens
gtgagcttgggcaaat

SEQ ID NO: 120692 - DNA, 16 bp, H. sapiens
gtgagcttttaaaaat

SEQ ID NO: 120693 - DNA, 16 bp, H. sapiens
gtgaggaaactgaggc

SEQ ID NO: 120694 - DNA, 16 bp, H. sapiens
gtgaggaagctgcagg

SEQ ID NO: 120695 - DNA, 16 bp, H. sapiens
gtgaggacacaaggag

SEQ ID NO: 120696 - DNA, 16 bp, H. sapiens
gtgaggacacagcagg

SEQ ID NO: 120697 - DNA, 18 bp, H. sapiens
gtgaggagcgtctctgcc

SEQ ID NO: 120698 - DNA, 16 bp, H. sapiens
gtgaggagtttgagac

SEQ ID NO: 120699 - DNA, 16 bp, H. sapiens
gtgaggatgaagagaa

SEQ ID NO: 120700 - DNA, 16 bp, H. sapiens
gtgaggatgatgatga

SEQ ID NO: 120701 - DNA, 16 bp, H. sapiens
gtgaggattatgggaa

SEQ ID NO: 120702 - DNA, 16 bp, H. sapiens
gtgaggcaaaaactga

SEQ ID NO: 120703 - DNA, 16 bp, H. sapiens
gtgaggcactgcctca

SEQ ID NO: 120704 - DNA, 16 bp, H. sapiens
gtgaggcagaggctgc

SEQ ID NO: 120705 - DNA, 16 bp, H. sapiens
gtgaggcaggagctgg

SEQ ID NO: 120706 - DNA, 16 bp, H. sapiens
gtgaggcattgcctca

SEQ ID NO: 120707 - DNA, 16 bp, H. sapiens
gtgaggccagcagtgg

SEQ ID NO: 120708 - DNA, 16 bp, H. sapiens
gtgaggccagcatcat

SEQ ID NO: 120709 - DNA, 16 bp, H. sapiens
gtgaggccaggagttc

SEQ ID NO: 120710 - DNA, 16 bp, H. sapiens
gtgaggccaggcgtgg

SEQ ID NO: 120711 - DNA, 16 bp, H. sapiens
gtgaggctgaggtggg

SEQ ID NO: 120712 - DNA, 16 bp, H. sapiens
gtgaggctggaggagg

SEQ ID NO: 120713 - DNA, 16 bp, H. sapiens
gtgaggcttaaatgag

SEQ ID NO: 120714 - DNA, 16 bp, H. sapiens
gtgagggacaaacaca

SEQ ID NO: 120715 - DNA, 16 bp, H. sapiens
gtgagggacaaatatt

SEQ ID NO: 120716 - DNA, 16 bp, H. sapiens
gtgagggaggagcagg

SEQ ID NO: 120717 - DNA, 16 bp, H. sapiens
gtgagggctaggaaaa

SEQ ID NO: 120718 - DNA, 16 bp, H. sapiens
gtgagggcttgagtta

SEQ ID NO: 120719 - DNA, 17 bp, H. sapiens
gtgaggggcacctctgc

SEQ ID NO: 120720 - DNA, 16 bp, H. sapiens
gtgagggtcaaacact

SEQ ID NO: 120721 - DNA, 16 bp, H. sapiens
gtgaggtcaagagttc

SEQ ID NO: 120722 - DNA, 16 bp, H. sapiens
gtgaggtgagattgtg

SEQ ID NO: 120723 - DNA, 17 bp, H. sapiens
gtgaggtgggagaattg

SEQ ID NO: 120724 - DNA, 16 bp, H. sapiens
gtgagtaataaatttc

SEQ ID NO: 120725 - DNA, 16 bp, H. sapiens
gtgagtattaaatgag

SEQ ID NO: 120726 - DNA, 16 bp, H. sapiens
gtgagtcaagatggca

SEQ ID NO: 120727 - DNA, 16 bp, H. sapiens
gtgagtcactgcgccc

SEQ ID NO: 120728 - DNA, 16 bp, H. sapiens
gtgagtcagtgagtgg

SEQ ID NO: 120729 - DNA, 16 bp, H. sapiens
gtgagtgaatgtgtga

SEQ ID NO: 120730 - DNA, 16 bp, H. sapiens
gtgagtgagctctcac

SEQ ID NO: 120731 - DNA, 16 bp, H. sapiens
gtgagtgagtgagtga

SEQ ID NO: 120732 - DNA, 16 bp, H. sapiens
gtgagtgcagcccatg

SEQ ID NO: 120733 - DNA, 16 bp, H. sapiens
gtgagtgtgaaggcct

SEQ ID NO: 120734 - DNA, 16 bp, H. sapiens
gtgagtgtgcacgtgt

SEQ ID NO: 120735 - DNA, 16 bp, H. sapiens
gtgagtgtggatgtgt

SEQ ID NO: 120736 - DNA, 16 bp, H. sapiens
gtgagtgttacagctc

SEQ ID NO: 120737 - DNA, 16 bp, H. sapiens
gtgagtgttacagttt

SEQ ID NO: 120738 - DNA, 16 bp, H. sapiens
gtgataaaataatatg

SEQ ID NO: 120739 - DNA, 16 bp, H. sapiens
gtgataaatatgttaa

SEQ ID NO: 120740 - DNA, 16 bp, H. sapiens
gtgataagagtgtctt

SEQ ID NO: 120741 - DNA, 16 bp, H. sapiens
gtgataatatggaaat

SEQ ID NO: 120742 - DNA, 16 bp, H. sapiens
gtgataatgatgatga

SEQ ID NO: 120743 - DNA, 16 bp, H. sapiens
gtgatacacaggcaaa

SEQ ID NO: 120744 - DNA, 16 bp, H. sapiens
gtgataccccatctct

SEQ ID NO: 120745 - DNA, 16 bp, H. sapiens
gtgatagagttctcac

SEQ ID NO: 120746 - DNA, 16 bp, H. sapiens
gtgatagcagcctgaa

SEQ ID NO: 120747 - DNA, 16 bp, H. sapiens
gtgatagtgaatgagt

SEQ ID NO: 120748 - DNA, 16 bp, H. sapiens
gtgatagtgccactgc

SEQ ID NO: 120749 - DNA, 16 bp, H. sapiens
gtgatatcagcaagat

SEQ ID NO: 120750 - DNA, 16 bp, H. sapiens
gtgatatgcccgcctc

SEQ ID NO: 120751 - DNA, 16 bp, H. sapiens
gtgatatggtttggat

SEQ ID NO: 120752 - DNA, 16 bp, H. sapiens
gtgatattcttcctaa

SEQ ID NO: 120753 - DNA, 16 bp, H. sapiens
gtgatattgagcatct

SEQ ID NO: 120754 - DNA, 16 bp, H. sapiens
gtgatattgattcttc

SEQ ID NO: 120755 - DNA, 16 bp, H. sapiens
gtgatattttgataca

SEQ ID NO: 120756 - DNA, 16 bp, H. sapiens
gtgatcaaggttaaca

SEQ ID NO: 120757 - DNA, 17 bp, H. sapiens
gtgatcaagtgggcttc

SEQ ID NO: 120758 - DNA, 16 bp, H. sapiens
gtgatcacactactgc

SEQ ID NO: 120759 - DNA, 16 bp, H. sapiens
gtgatcacagctcgct

SEQ ID NO: 120760 - DNA, 16 bp, H. sapiens
gtgatcaccaaggagg

SEQ ID NO: 120761 - DNA, 16 bp, H. sapiens
gtgatcacgccactgc

SEQ ID NO: 120762 - DNA, 16 bp, H. sapiens
gtgatcacggctcact

SEQ ID NO: 120763 - DNA, 16 bp, H. sapiens
gtgatcagaagcagca

SEQ ID NO: 120764 - DNA, 16 bp, H. sapiens
gtgatcagatcagggt

SEQ ID NO: 120765 - DNA, 16 bp, H. sapiens
gtgatcagccagctac

SEQ ID NO: 120766 - DNA, 16 bp, H. sapiens
gtgatcagcccgcctc

SEQ ID NO: 120767 - DNA, 16 bp, H. sapiens
gtgatcatgcctgtga

SEQ ID NO: 120768 - DNA, 16 bp, H. sapiens
gtgatcatggctcact

SEQ ID NO: 120769 - DNA, 16 bp, H. sapiens
gtgatccaccatgccc

SEQ ID NO: 120770 - DNA, 16 bp, H. sapiens
gtgatccacccgcctc

SEQ ID NO: 120771 - DNA, 16 bp, H. sapiens
gtgatccaccctcccc

SEQ ID NO: 120772 - DNA, 18 bp, H. sapiens
gtgatccacctgcctcag

SEQ ID NO: 120773 - DNA, 20 bp, H. sapiens
gtgatccacctgccttggct

SEQ ID NO: 120774 - DNA, 16 bp, H. sapiens
gtgatccacttgcctt

SEQ ID NO: 120775 - DNA, 16 bp, H. sapiens
gtgatccatccatctc

SEQ ID NO: 120776 - DNA, 16 bp, H. sapiens
gtgatccatccgcctc

SEQ ID NO: 120777 - DNA, 16 bp, H. sapiens
gtgatcccatttgttc

SEQ ID NO: 120778 - DNA, 16 bp, H. sapiens
gtgatccccctacctc

SEQ ID NO: 120779 - DNA, 16 bp, H. sapiens
gtgatccccttgcctc

SEQ ID NO: 120780 - DNA, 16 bp, H. sapiens
gtgatccgcccacttc

SEQ ID NO: 120781 - DNA, 16 bp, H. sapiens
gtgatccgcccgtctc

SEQ ID NO: 120782 - DNA, 16 bp, H. sapiens
gtgatccgctcacctc

SEQ ID NO: 120783 - DNA, 16 bp, H. sapiens
gtgatccgtctgcctc

SEQ ID NO: 120784 - DNA, 16 bp, H. sapiens
gtgatcctcacgcctc

SEQ ID NO: 120785 - DNA, 16 bp, H. sapiens
gtgatcctcccgcctc

SEQ ID NO: 120786 - DNA, 16 bp, H. sapiens
gtgatcctgccactgc

SEQ ID NO: 120787 - DNA, 16 bp, H. sapiens
gtgatccttccacctt

SEQ ID NO: 120788 - DNA, 16 bp, H. sapiens
gtgatcgggccactgc

SEQ ID NO: 120789 - DNA, 16 bp, H. sapiens
gtgatctaccctcctc

SEQ ID NO: 120790 - DNA, 17 bp, H. sapiens
gtgatctcaggtcactg

SEQ ID NO: 120791 - DNA, 16 bp, H. sapiens
gtgatctcggctcaat

SEQ ID NO: 120792 - DNA, 18 bp, H. sapiens
gtgatctcggctcactgt

SEQ ID NO: 120793 - DNA, 16 bp, H. sapiens
gtgatctctgcacaca

SEQ ID NO: 120794 - DNA, 16 bp, H. sapiens
gtgatctgattcttct

SEQ ID NO: 120795 - DNA, 16 bp, H. sapiens
gtgatctgcccacctc

SEQ ID NO: 120796 - DNA, 16 bp, H. sapiens
gtgatctgcccatctc

SEQ ID NO: 120797 - DNA, 16 bp, H. sapiens
gtgatctgcccgcctc

SEQ ID NO: 120798 - DNA, 16 bp, H. sapiens
gtgatctgccctcctc

SEQ ID NO: 120799 - DNA, 16 bp, H. sapiens
gtgatctgcctacctc

SEQ ID NO: 120800 - DNA, 16 bp, H. sapiens
gtgatctgcctgcccc

SEQ ID NO: 120801 - DNA, 16 bp, H. sapiens
gtgatctgcctgcgtc

SEQ ID NO: 120802 - DNA, 16 bp, H. sapiens
gtgatctgctggcctc

SEQ ID NO: 120803 - DNA, 16 bp, H. sapiens
gtgatctgcttgcctc

SEQ ID NO: 120804 - DNA, 16 bp, H. sapiens
gtgatctgcttgcttc

SEQ ID NO: 120805 - DNA, 16 bp, H. sapiens
gtgatctgtccacttc

SEQ ID NO: 120806 - DNA, 16 bp, H. sapiens
gtgatctgtccgcctc

SEQ ID NO: 120807 - DNA, 16 bp, H. sapiens
gtgatctgtctgcctc

SEQ ID NO: 120808 - DNA, 16 bp, H. sapiens
gtgatcttcaggctgg

SEQ ID NO: 120809 - DNA, 16 bp, H. sapiens
gtgatcttcccagctc

SEQ ID NO: 120810 - DNA, 16 bp, H. sapiens
gtgatcttgaacaagt

SEQ ID NO: 120811 - DNA, 17 bp, H. sapiens
gtgatcttggctcactt

SEQ ID NO: 120812 - DNA, 16 bp, H. sapiens
gtgatcttgggcaagt

SEQ ID NO: 120813 - DNA, 16 bp, H. sapiens
gtgatctttgatatta

SEQ ID NO: 120814 - DNA, 16 bp, H. sapiens
gtgatctttgcttttg

SEQ ID NO: 120815 - DNA, 16 bp, H. sapiens
gtgatcttttctgtct

SEQ ID NO: 120816 - DNA, 16 bp, H. sapiens
gtgatgaaaatgttct

SEQ ID NO: 120817 - DNA, 16 bp, H. sapiens
gtgatgaaaatgtttt

SEQ ID NO: 120818 - DNA, 16 bp, H. sapiens
gtgatgaaagaaaatt

SEQ ID NO: 120819 - DNA, 16 bp, H. sapiens
gtgatgaaataatctg

SEQ ID NO: 120820 - DNA, 16 bp, H. sapiens
gtgatgaaatcatctg

SEQ ID NO: 120821 - DNA, 16 bp, H. sapiens
gtgatgaaatgttcta

SEQ ID NO: 120822 - DNA, 16 bp, H. sapiens
gtgatgaagatgatga

SEQ ID NO: 120823 - DNA, 16 bp, H. sapiens
gtgatgacacagcaag

SEQ ID NO: 120824 - DNA, 16 bp, H. sapiens
gtgatgacatcaggtc

SEQ ID NO: 120825 - DNA, 16 bp, H. sapiens
gtgatgacgatgatga

SEQ ID NO: 120826 - DNA, 16 bp, H. sapiens
gtgatgaggagaatgg

SEQ ID NO: 120827 - DNA, 16 bp, H. sapiens
gtgatgaggatgagga

SEQ ID NO: 120828 - DNA, 16 bp, H. sapiens
gtgatgaggatgaggg

SEQ ID NO: 120829 - DNA, 16 bp, H. sapiens
gtgatgatgaagatga

SEQ ID NO: 120830 - DNA, 16 bp, H. sapiens
gtgatgatgacagtga

SEQ ID NO: 120831 - DNA, 16 bp, H. sapiens
gtgatgatgagaagaa

SEQ ID NO: 120832 - DNA, 16 bp, H. sapiens
gtgatgatgataatgg

SEQ ID NO: 120833 - DNA, 16 bp, H. sapiens
gtgatgatgatgacaa

SEQ ID NO: 120834 - DNA, 16 bp, H. sapiens
gtgatgatgatggtag

SEQ ID NO: 120835 - DNA, 16 bp, H. sapiens
gtgatgatggaggtgg

SEQ ID NO: 120836 - DNA, 16 bp, H. sapiens
gtgatgatggtgatga

SEQ ID NO: 120837 - DNA, 16 bp, H. sapiens
gtgatgatgtcattgc

SEQ ID NO: 120838 - DNA, 16 bp, H. sapiens
gtgatgcagctgcaag

SEQ ID NO: 120839 - DNA, 16 bp, H. sapiens
gtgatgcatcacattt

SEQ ID NO: 120840 - DNA, 16 bp, H. sapiens
gtgatgcccatgctgc

SEQ ID NO: 120841 - DNA, 16 bp, H. sapiens
gtgatgcctctagttt

SEQ ID NO: 120842 - DNA, 16 bp, H. sapiens
gtgatgcctgagctga

SEQ ID NO: 120843 - DNA, 16 bp, H. sapiens
gtgatgctgatgctac

SEQ ID NO: 120844 - DNA, 16 bp, H. sapiens
gtgatgctggggtttg

SEQ ID NO: 120845 - DNA, 16 bp, H. sapiens
gtgatgcttccacctc

SEQ ID NO: 120846 - DNA, 16 bp, H. sapiens
gtgatggaaacattct

SEQ ID NO: 120847 - DNA, 16 bp, H. sapiens
gtgatggagaaataaa

SEQ ID NO: 120848 - DNA, 16 bp, H. sapiens
gtgatggagtctcgct

SEQ ID NO: 120849 - DNA, 16 bp, H. sapiens
gtgatggatatattta

SEQ ID NO: 120850 - DNA, 16 bp, H. sapiens
gtgatggcaggcacct

SEQ ID NO: 120851 - DNA, 16 bp, H. sapiens
gtgatggcatgtgctt

SEQ ID NO: 120852 - DNA, 17 bp, H. sapiens
gtgatggcggctgggaa

SEQ ID NO: 120853 - DNA, 16 bp, H. sapiens
gtgatggcgtgatctc

SEQ ID NO: 120854 - DNA, 16 bp, H. sapiens
gtgatggctggagctg

SEQ ID NO: 120855 - DNA, 19 bp, H. sapiens
gtgatgggcattccagctt

SEQ ID NO: 120856 - DNA, 16 bp, H. sapiens
gtgatggtatctggag

SEQ ID NO: 120857 - DNA, 16 bp, H. sapiens
gtgatggtatttggaa

SEQ ID NO: 120858 - DNA, 16 bp, H. sapiens
gtgatggtgaatggtg

SEQ ID NO: 120859 - DNA, 16 bp, H. sapiens
gtgatggtgatgatga

SEQ ID NO: 120860 - DNA, 16 bp, H. sapiens
gtgatggtgatggaga

SEQ ID NO: 120861 - DNA, 16 bp, H. sapiens
gtgatggtgccactgc

SEQ ID NO: 120862 - DNA, 16 bp, H. sapiens
gtgatggtggagatgg

SEQ ID NO: 120863 - DNA, 16 bp, H. sapiens
gtgatggtggcagtgg

SEQ ID NO: 120864 - DNA, 16 bp, H. sapiens
gtgatggttgcacaac

SEQ ID NO: 120865 - DNA, 16 bp, H. sapiens
gtgatgtcagaggatg

SEQ ID NO: 120866 - DNA, 16 bp, H. sapiens
gtgatgtcggctcact

SEQ ID NO: 120867 - DNA, 16 bp, H. sapiens
gtgatgtgaagacaga

SEQ ID NO: 120868 - DNA, 16 bp, H. sapiens
gtgatgtgatcatggc

SEQ ID NO: 120869 - DNA, 16 bp, H. sapiens
gtgatgtggtcatttg

SEQ ID NO: 120870 - DNA, 16 bp, H. sapiens
gtgatgttgatctttt

SEQ ID NO: 120871 - DNA, 16 bp, H. sapiens
gtgatgttggagaact

SEQ ID NO: 120872 - DNA, 16 bp, H. sapiens
gtgatgtttgtacaac

SEQ ID NO: 120873 - DNA, 16 bp, H. sapiens
gtgattacaggtgtga

SEQ ID NO: 120874 - DNA, 16 bp, H. sapiens
gtgattaggtcatgag

SEQ ID NO: 120875 - DNA, 16 bp, H. sapiens
gtgattaggttatgag

SEQ ID NO: 120876 - DNA, 16 bp, H. sapiens
gtgattagtgatgttg

SEQ ID NO: 120877 - DNA, 16 bp, H. sapiens
gtgattatagttaaca

SEQ ID NO: 120878 - DNA, 16 bp, H. sapiens
gtgattatgaataaag

SEQ ID NO: 120879 - DNA, 16 bp, H. sapiens
gtgattattattcatt

SEQ ID NO: 120880 - DNA, 16 bp, H. sapiens
gtgattatttcacatt

SEQ ID NO: 120881 - DNA, 16 bp, H. sapiens
gtgattcgccctcctc

SEQ ID NO: 120882 - DNA, 16 bp, H. sapiens
gtgattctcaaacttt

SEQ ID NO: 120883 - DNA, 16 bp, H. sapiens
gtgattctcagcctcc

SEQ ID NO: 120884 - DNA, 16 bp, H. sapiens
gtgattctcctgtctt

SEQ ID NO: 120885 - DNA, 16 bp, H. sapiens
gtgattctcgtgcctt

SEQ ID NO: 120886 - DNA, 16 bp, H. sapiens
gtgattctggggactg

SEQ ID NO: 120887 - DNA, 16 bp, H. sapiens
gtgattgcaccactgt

SEQ ID NO: 120888 - DNA, 16 bp, H. sapiens
gtgattggaccatggg

SEQ ID NO: 120889 - DNA, 16 bp, H. sapiens
gtgattgtaccactgc

SEQ ID NO: 120890 - DNA, 16 bp, H. sapiens
gtgatttctgttattt

SEQ ID NO: 120891 - DNA, 16 bp, H. sapiens
gtgatttgctgcacct

SEQ ID NO: 120892 - DNA, 16 bp, H. sapiens
gtgatttgggggtccc

SEQ ID NO: 120893 - DNA, 16 bp, H. sapiens
gtgattttctatttcc

SEQ ID NO: 120894 - DNA, 16 bp, H. sapiens
gtgattttgatatgca

SEQ ID NO: 120895 - DNA, 16 bp, H. sapiens
gtgatttttaccattt

SEQ ID NO: 120896 - DNA, 16 bp, H. sapiens
gtgcaaaagaaaatga

SEQ ID NO: 120897 - DNA, 16 bp, H. sapiens
gtgcaaaagttcttta

SEQ ID NO: 120898 - DNA, 16 bp, H. sapiens
gtgcaaacatcagagt

SEQ ID NO: 120899 - DNA, 16 bp, H. sapiens
gtgcaacaactgtgct

SEQ ID NO: 120900 - DNA, 16 bp, H. sapiens
gtgcaaccaccaccac

SEQ ID NO: 120901 - DNA, 16 bp, H. sapiens
gtgcaagaccagcctg

SEQ ID NO: 120902 - DNA, 47 bp, H. sapiens
gtgcaagatgtgctttgttaaacagatgcttgaaggcagcatgctcc

SEQ ID NO: 120903 - DNA, 16 bp, H. sapiens
gtgcaagccactgtgc

SEQ ID NO: 120904 - DNA, 16 bp, H. sapiens
gtgcaagctgctggtg

SEQ ID NO: 120905 - DNA, 16 bp, H. sapiens
gtgcaaggctggttca

SEQ ID NO: 120906 - DNA, 16 bp, H. sapiens
gtgcaataaaaataga

SEQ ID NO: 120907 - DNA, 16 bp, H. sapiens
gtgcaatggtgcaatc

SEQ ID NO: 120908 - DNA, 16 bp, H. sapiens
gtgcaatggtttgatc

SEQ ID NO: 120909 - DNA, 16 bp, H. sapiens
gtgcacacacacaagc

SEQ ID NO: 120910 - DNA, 16 bp, H. sapiens
gtgcacacacacagac

SEQ ID NO: 120911 - DNA, 16 bp, H. sapiens
gtgcacacacacccca

SEQ ID NO: 120912 - DNA, 16 bp, H. sapiens
gtgcacacatgtgcac

SEQ ID NO: 120913 - DNA, 16 bp, H. sapiens
gtgcacaccaccactc

SEQ ID NO: 120914 - DNA, 16 bp, H. sapiens
gtgcacaccaccatcc

SEQ ID NO: 120915 - DNA, 16 bp, H. sapiens
gtgcacacctgtaatt

SEQ ID NO: 120916 - DNA, 17 bp, H. sapiens
gtgcacacctgtagtct

SEQ ID NO: 120917 - DNA, 16 bp, H. sapiens
gtgcacagtaaatgta

SEQ ID NO: 120918 - DNA, 16 bp, H. sapiens
gtgcacatgcatacac

SEQ ID NO: 120919 - DNA, 16 bp, H. sapiens
gtgcacatggcaggcc

SEQ ID NO: 120920 - DNA, 16 bp, H. sapiens
gtgcacatgtatgttt

SEQ ID NO: 120921 - DNA, 16 bp, H. sapiens
gtgcacatgtgtgttt

SEQ ID NO: 120922 - DNA, 16 bp, H. sapiens
gtgcacattttttttt

SEQ ID NO: 120923 - DNA, 16 bp, H. sapiens
gtgcaccaaaatctca

SEQ ID NO: 120924 - DNA, 16 bp, H. sapiens
gtgcaccaatcaacac

SEQ ID NO: 120925 - DNA, 16 bp, H. sapiens
gtgcaccaccacgcct

SEQ ID NO: 120926 - DNA, 16 bp, H. sapiens
gtgcaccaccacggcc

SEQ ID NO: 120927 - DNA, 16 bp, H. sapiens
gtgcaccaccatgcat

SEQ ID NO: 120928 - DNA, 16 bp, H. sapiens
gtgcaccactgcgcct

SEQ ID NO: 120929 - DNA, 16 bp, H. sapiens
gtgcacccagagaaaa

SEQ ID NO: 120930 - DNA, 16 bp, H. sapiens
gtgcaccccaactcca

SEQ ID NO: 120931 - DNA, 16 bp, H. sapiens
gtgcacctgcagtcct

SEQ ID NO: 120932 - DNA, 16 bp, H. sapiens
gtgcacctgtagttct

SEQ ID NO: 120933 - DNA, 16 bp, H. sapiens
gtgcacgcacacacac

SEQ ID NO: 120934 - DNA, 16 bp, H. sapiens
gtgcacgcgcacacac

SEQ ID NO: 120935 - DNA, 16 bp, H. sapiens
gtgcacgtgtgtgtgt

SEQ ID NO: 120936 - DNA, 16 bp, H. sapiens
gtgcagaaagcagcca

SEQ ID NO: 120937 - DNA, 16 bp, H. sapiens
gtgcagaactggacag

SEQ ID NO: 120938 - DNA, 16 bp, H. sapiens
gtgcagaagaaaaatg

SEQ ID NO: 120939 - DNA, 16 bp, H. sapiens
gtgcagaagctctgta

SEQ ID NO: 120940 - DNA, 16 bp, H. sapiens
gtgcagaagctcttca

SEQ ID NO: 120941 - DNA, 16 bp, H. sapiens
gtgcagaagctctttc

SEQ ID NO: 120942 - DNA, 16 bp, H. sapiens
gtgcagaagggaaacg

SEQ ID NO: 120943 - DNA, 16 bp, H. sapiens
gtgcagagcaaaaggg

SEQ ID NO: 120944 - DNA, 16 bp, H. sapiens
gtgcagagcgtgcagg

SEQ ID NO: 120945 - DNA, 16 bp, H. sapiens
gtgcagaggctcatgc

SEQ ID NO: 120946 - DNA, 16 bp, H. sapiens
gtgcagaggctgcagg

SEQ ID NO: 120947 - DNA, 16 bp, H. sapiens
gtgcagatatcttttc

SEQ ID NO: 120948 - DNA, 16 bp, H. sapiens
gtgcagatggaggcag

SEQ ID NO: 120949 - DNA, 16 bp, H. sapiens
gtgcagcaaaatctca

SEQ ID NO: 120950 - DNA, 16 bp, H. sapiens
gtgcagcaaaccaaca

SEQ ID NO: 120951 - DNA, 16 bp, H. sapiens
gtgcagcagaggcagc

SEQ ID NO: 120952 - DNA, 16 bp, H. sapiens
gtgcagcagcgccatc

SEQ ID NO: 120953 - DNA, 16 bp, H. sapiens
gtgcagcagctgctgc

SEQ ID NO: 120954 - DNA, 16 bp, H. sapiens
gtgcagccagcctacc

SEQ ID NO: 120955 - DNA, 16 bp, H. sapiens
gtgcagcccacagaga

SEQ ID NO: 120956 - DNA, 16 bp, H. sapiens
gtgcagcccatggaga

SEQ ID NO: 120957 - DNA, 16 bp, H. sapiens
gtgcagccccagcctc

SEQ ID NO: 120958 - DNA, 16 bp, H. sapiens
gtgcagccttatttct

SEQ ID NO: 120959 - DNA, 16 bp, H. sapiens
gtgcagcggctgccac

SEQ ID NO: 120960 - DNA, 16 bp, H. sapiens
gtgcagctgcagctgc

SEQ ID NO: 120961 - DNA, 16 bp, H. sapiens
gtgcaggaagtgcagg

SEQ ID NO: 120962 - DNA, 16 bp, H. sapiens
gtgcaggaccagatgg

SEQ ID NO: 120963 - DNA, 16 bp, H. sapiens
gtgcaggagaactccc

SEQ ID NO: 120964 - DNA, 16 bp, H. sapiens
gtgcaggatatgcagg

SEQ ID NO: 120965 - DNA, 16 bp, H. sapiens
gtgcagggcagcaggg

SEQ ID NO: 120966 - DNA, 16 bp, H. sapiens
gtgcagggtgggagga

SEQ ID NO: 120967 - DNA, 16 bp, H. sapiens
gtgcaggtggcctggg

SEQ ID NO: 120968 - DNA, 16 bp, H. sapiens
gtgcaggtgtctttat

SEQ ID NO: 120969 - DNA, 16 bp, H. sapiens
gtgcagtagcatgatc

SEQ ID NO: 120970 - DNA, 16 bp, H. sapiens
gtgcagtcatttggag

SEQ ID NO: 120971 - DNA, 16 bp, H. sapiens
gtgcagtgagccaaga

SEQ ID NO: 120972 - DNA, 16 bp, H. sapiens
gtgcagtgcagtggct

SEQ ID NO: 120973 - DNA, 16 bp, H. sapiens
gtgcagtggcacagtc

SEQ ID NO: 120974 - DNA, 18 bp, H. sapiens
gtgcagtggcgcaatctg

SEQ ID NO: 120975 - DNA, 16 bp, H. sapiens
gtgcagtggcgccctc

SEQ ID NO: 120976 - DNA, 19 bp, H. sapiens
gtgcagtggcgcgatcttg

SEQ ID NO: 120977 - DNA, 16 bp, H. sapiens
gtgcagtggctcaagc

SEQ ID NO: 120978 - DNA, 16 bp, H. sapiens
gtgcagtggctccagc

SEQ ID NO: 120979 - DNA, 16 bp, H. sapiens
gtgcagtggctcgatc

SEQ ID NO: 120980 - DNA, 16 bp, H. sapiens
gtgcagtggcttatgc

SEQ ID NO: 120981 - DNA, 16 bp, H. sapiens
gtgcagtgggggactg

SEQ ID NO: 120982 - DNA, 16 bp, H. sapiens
gtgcagtgggtgcaat

SEQ ID NO: 120983 - DNA, 16 bp, H. sapiens
gtgcagtggtgccctc

SEQ ID NO: 120984 - DNA, 16 bp, H. sapiens
gtgcataataaatatt

SEQ ID NO: 120985 - DNA, 16 bp, H. sapiens
gtgcataccaccacac

SEQ ID NO: 120986 - DNA, 16 bp, H. sapiens
gtgcatatgtgtgtga

SEQ ID NO: 120987 - DNA, 16 bp, H. sapiens
gtgcatctatagtccc

SEQ ID NO: 120988 - DNA, 16 bp, H. sapiens
gtgcatctgtaatccc

SEQ ID NO: 120989 - DNA, 16 bp, H. sapiens
gtgcatgacttcacag

SEQ ID NO: 120990 - DNA, 16 bp, H. sapiens
gtgcatgagtgtatgt

SEQ ID NO: 120991 - DNA, 16 bp, H. sapiens
gtgcatgcacacacac

SEQ ID NO: 120992 - DNA, 16 bp, H. sapiens
gtgcatgcatacacac

SEQ ID NO: 120993 - DNA, 16 bp, H. sapiens
gtgcatgccaccaggc

SEQ ID NO: 120994 - DNA, 16 bp, H. sapiens
gtgcatgccactgcac

SEQ ID NO: 120995 - DNA, 16 bp, H. sapiens
gtgcatgcctatggtc

SEQ ID NO: 120996 - DNA, 16 bp, H. sapiens
gtgcatgcctgtagtc

SEQ ID NO: 120997 - DNA, 16 bp, H. sapiens
gtgcatgcctgtagtg

SEQ ID NO: 120998 - DNA, 16 bp, H. sapiens
gtgcatgcctgtgatc

SEQ ID NO: 120999 - DNA, 16 bp, H. sapiens
gtgcatgctgattggt

SEQ ID NO: 121000 - DNA, 16 bp, H. sapiens
gtgcatggtggctcac

SEQ ID NO: 121001 - DNA, 16 bp, H. sapiens
gtgcatggtggtgggc

SEQ ID NO: 121002 - DNA, 16 bp, H. sapiens
gtgcatggtggtgggt

SEQ ID NO: 121003 - DNA, 16 bp, H. sapiens
gtgcatgtctgtgtgt

SEQ ID NO: 121004 - DNA, 16 bp, H. sapiens
gtgcatgtctgtgttc

SEQ ID NO: 121005 - DNA, 16 bp, H. sapiens
gtgcatgtgcatgcat

SEQ ID NO: 121006 - DNA, 16 bp, H. sapiens
gtgcatgtgcctttat

SEQ ID NO: 121007 - DNA, 16 bp, H. sapiens
gtgcatgtgtgcatat

SEQ ID NO: 121008 - DNA, 16 bp, H. sapiens
gtgcatgtgtgcatgg

SEQ ID NO: 121009 - DNA, 16 bp, H. sapiens
gtgcatgtgtgcgtgc

SEQ ID NO: 121010 - DNA, 16 bp, H. sapiens
gtgcatgtgtgtatgc

SEQ ID NO: 121011 - DNA, 16 bp, H. sapiens
gtgcatgtgtgtgtgc

SEQ ID NO: 121012 - DNA, 16 bp, H. sapiens
gtgcattcattcattc

SEQ ID NO: 121013 - DNA, 16 bp, H. sapiens
gtgcatttaaaaataa

SEQ ID NO: 121014 - DNA, 16 bp, H. sapiens
gtgcatttacaaatct

SEQ ID NO: 121015 - DNA, 16 bp, H. sapiens
gtgcattttactgtat

SEQ ID NO: 121016 - DNA, 16 bp, H. sapiens
gtgccaaaaatgttgg

SEQ ID NO: 121017 - DNA, 16 bp, H. sapiens
gtgccaacacgcctgg

SEQ ID NO: 121018 - DNA, 16 bp, H. sapiens
gtgccaaggctgagaa

SEQ ID NO: 121019 - DNA, 16 bp, H. sapiens
gtgccaatgcactcca

SEQ ID NO: 121020 - DNA, 16 bp, H. sapiens
gtgccacaatgcccag

SEQ ID NO: 121021 - DNA, 16 bp, H. sapiens
gtgccacacacttaaa

SEQ ID NO: 121022 - DNA, 16 bp, H. sapiens
gtgccaccacactcgg

SEQ ID NO: 121023 - DNA, 16 bp, H. sapiens
gtgccaccacatctgg

SEQ ID NO: 121024 - DNA, 16 bp, H. sapiens
gtgccaccacgcccgg

SEQ ID NO: 121025 - DNA, 16 bp, H. sapiens
gtgccaccacgtctgg

SEQ ID NO: 121026 - DNA, 16 bp, H. sapiens
gtgccaccaggcccag

SEQ ID NO: 121027 - DNA, 16 bp, H. sapiens
gtgccaccatgccagg

SEQ ID NO: 121028 - DNA, 24 bp, H. sapiens
gtgccaccatgcccggctaatttt

SEQ ID NO: 121029 - DNA, 16 bp, H. sapiens
gtgccaccatggccag

SEQ ID NO: 121030 - DNA, 16 bp, H. sapiens
gtgccaccatgtttgg

SEQ ID NO: 121031 - DNA, 16 bp, H. sapiens
gtgccacccaactggg

SEQ ID NO: 121032 - DNA, 16 bp, H. sapiens
gtgccacgttggtttg

SEQ ID NO: 121033 - DNA, 16 bp, H. sapiens
gtgccactatgcccag

SEQ ID NO: 121034 - DNA, 16 bp, H. sapiens
gtgccactgaattcca

SEQ ID NO: 121035 - DNA, 16 bp, H. sapiens
gtgccactgcaccagc

SEQ ID NO: 121036 - DNA, 18 bp, H. sapiens
gtgccactgcactccaga

SEQ ID NO: 121037 - DNA, 22 bp, H. sapiens
gtgccactgcactctagcctga

SEQ ID NO: 121038 - DNA, 16 bp, H. sapiens
gtgccactgcacttta

SEQ ID NO: 121039 - DNA, 16 bp, H. sapiens
gtgccactgccctcta

SEQ ID NO: 121040 - DNA, 16 bp, H. sapiens
gtgccactggccacag

SEQ ID NO: 121041 - DNA, 16 bp, H. sapiens
gtgccagacactgttt

SEQ ID NO: 121042 - DNA, 16 bp, H. sapiens
gtgccagcagcagtgg

SEQ ID NO: 121043 - DNA, 16 bp, H. sapiens
gtgccagcatgatcag

SEQ ID NO: 121044 - DNA, 16 bp, H. sapiens
gtgccagcatggtcag

SEQ ID NO: 121045 - DNA, 16 bp, H. sapiens
gtgccagcatggtcgg

SEQ ID NO: 121046 - DNA, 16 bp, H. sapiens
gtgccagcccatgcca

SEQ ID NO: 121047 - DNA, 16 bp, H. sapiens
gtgccagcctgggtga

SEQ ID NO: 121048 - DNA, 16 bp, H. sapiens
gtgccagctgctcagg

SEQ ID NO: 121049 - DNA, 16 bp, H. sapiens
gtgccaggaacacaca

SEQ ID NO: 121050 - DNA, 16 bp, H. sapiens
gtgccaggaactgagg

SEQ ID NO: 121051 - DNA, 16 bp, H. sapiens
gtgccaggcactgggg

SEQ ID NO: 121052 - DNA, 16 bp, H. sapiens
gtgccaggcactgggt

SEQ ID NO: 121053 - DNA, 16 bp, H. sapiens
gtgccaggccccatgc

SEQ ID NO: 121054 - DNA, 16 bp, H. sapiens
gtgccaggccctgtgc

SEQ ID NO: 121055 - DNA, 16 bp, H. sapiens
gtgccaggttggtgtg

SEQ ID NO: 121056 - DNA, 17 bp, H. sapiens
gtgccagtgcaggtcct

SEQ ID NO: 121057 - DNA, 16 bp, H. sapiens
gtgccagtgcattcca

SEQ ID NO: 121058 - DNA, 16 bp, H. sapiens
gtgccagtttccaaag

SEQ ID NO: 121059 - DNA, 16 bp, H. sapiens
gtgccatcacacctgg

SEQ ID NO: 121060 - DNA, 16 bp, H. sapiens
gtgccatcccagctca

SEQ ID NO: 121061 - DNA, 16 bp, H. sapiens
gtgccatctcggctcg

SEQ ID NO: 121062 - DNA, 16 bp, H. sapiens
gtgccatctttttttt

SEQ ID NO: 121063 - DNA, 16 bp, H. sapiens
gtgccatgggaggcag

SEQ ID NO: 121064 - DNA, 17 bp, H. sapiens
gtgccatgttgatgtgc

SEQ ID NO: 121065 - DNA, 16 bp, H. sapiens
gtgccattgcactgca

SEQ ID NO: 121066 - DNA, 16 bp, H. sapiens
gtgcccaacaccatgc

SEQ ID NO: 121067 - DNA, 16 bp, H. sapiens
gtgcccacagccaccc

SEQ ID NO: 121068 - DNA, 16 bp, H. sapiens
gtgcccacccagactg

SEQ ID NO: 121069 - DNA, 16 bp, H. sapiens
gtgcccactctgtgcc

SEQ ID NO: 121070 - DNA, 16 bp, H. sapiens
gtgcccagcaaatttt

SEQ ID NO: 121071 - DNA, 16 bp, H. sapiens
gtgcccagcacagagc

SEQ ID NO: 121072 - DNA, 16 bp, H. sapiens
gtgcccagcactgagc

SEQ ID NO: 121073 - DNA, 16 bp, H. sapiens
gtgcccagcactgggc

SEQ ID NO: 121074 - DNA, 16 bp, H. sapiens
gtgcccagcagctcat

SEQ ID NO: 121075 - DNA, 16 bp, H. sapiens
gtgcccagcccaaaat

SEQ ID NO: 121076 - DNA, 16 bp, H. sapiens
gtgcccagccccattc

SEQ ID NO: 121077 - DNA, 16 bp, H. sapiens
gtgcccagcccctcct

SEQ ID NO: 121078 - DNA, 16 bp, H. sapiens
gtgcccagccctgttt

SEQ ID NO: 121079 - DNA, 16 bp, H. sapiens
gtgcccagcctagaaa

SEQ ID NO: 121080 - DNA, 16 bp, H. sapiens
gtgcccagcctcccct

SEQ ID NO: 121081 - DNA, 16 bp, H. sapiens
gtgcccagcctcttcc

SEQ ID NO: 121082 - DNA, 16 bp, H. sapiens
gtgcccagcctcttct

SEQ ID NO: 121083 - DNA, 16 bp, H. sapiens
gtgcccagcctgaaaa

SEQ ID NO: 121084 - DNA, 16 bp, H. sapiens
gtgcccagctaatttt

SEQ ID NO: 121085 - DNA, 16 bp, H. sapiens
gtgcccaggctggtct

SEQ ID NO: 121086 - DNA, 16 bp, H. sapiens
gtgcccagggagggca

SEQ ID NO: 121087 - DNA, 16 bp, H. sapiens
gtgcccagttaatttt

SEQ ID NO: 121088 - DNA, 16 bp, H. sapiens
gtgccccaccatgccc

SEQ ID NO: 121089 - DNA, 16 bp, H. sapiens
gtgccccaggctggag

SEQ ID NO: 121090 - DNA, 16 bp, H. sapiens
gtgcccccacccccag

SEQ ID NO: 121091 - DNA, 16 bp, H. sapiens
gtgccccccaccccag

SEQ ID NO: 121092 - DNA, 16 bp, H. sapiens
gtgccccttcccccat

SEQ ID NO: 121093 - DNA, 16 bp, H. sapiens
gtgcccgccaccaagc

SEQ ID NO: 121094 - DNA, 16 bp, H. sapiens
gtgcccgccaccacgg

SEQ ID NO: 121095 - DNA, 17 bp, H. sapiens
gtgcccgccaccatgcc

SEQ ID NO: 121096 - DNA, 16 bp, H. sapiens
gtgcccgccactgcgc

SEQ ID NO: 121097 - DNA, 16 bp, H. sapiens
gtgcccgccgccacac

SEQ ID NO: 121098 - DNA, 16 bp, H. sapiens
gtgcccggcccctttt

SEQ ID NO: 121099 - DNA, 16 bp, H. sapiens
gtgcccggcctcattt

SEQ ID NO: 121100 - DNA, 16 bp, H. sapiens
gtgccctgcatcccag

SEQ ID NO: 121101 - DNA, 16 bp, H. sapiens
gtgccctgcatctcag

SEQ ID NO: 121102 - DNA, 16 bp, H. sapiens
gtgccctggatgtggg

SEQ ID NO: 121103 - DNA, 16 bp, H. sapiens
gtgcccttataaaaaa

SEQ ID NO: 121104 - DNA, 16 bp, H. sapiens
gtgcccttataaagag

SEQ ID NO: 121105 - DNA, 16 bp, H. sapiens
gtgccgccacacccgg

SEQ ID NO: 121106 - DNA, 16 bp, H. sapiens
gtgccgccatgcccag

SEQ ID NO: 121107 - DNA, 24 bp, H. sapiens
gtgccgggattgcagacggagtct

SEQ ID NO: 121108 - DNA, 17 bp, H. sapiens
gtgccggtgcaggtcct

SEQ ID NO: 121109 - DNA, 16 bp, H. sapiens
gtgccgtggtgcaatc

SEQ ID NO: 121110 - DNA, 16 bp, H. sapiens
gtgcctactatgtgcc

SEQ ID NO: 121111 - DNA, 16 bp, H. sapiens
gtgcctaggacagtgc

SEQ ID NO: 121112 - DNA, 16 bp, H. sapiens
gtgcctatagtctcag

SEQ ID NO: 121113 - DNA, 16 bp, H. sapiens
gtgcctcagcctccct

SEQ ID NO: 121114 - DNA, 16 bp, H. sapiens
gtgcctcagcctctca

SEQ ID NO: 121115 - DNA, 16 bp, H. sapiens
gtgcctcagccttctg

SEQ ID NO: 121116 - DNA, 16 bp, H. sapiens
gtgcctcagcttcctt

SEQ ID NO: 121117 - DNA, 16 bp, H. sapiens
gtgcctcaggcctgta

SEQ ID NO: 121118 - DNA, 16 bp, H. sapiens
gtgcctcagtctcctg

SEQ ID NO: 121119 - DNA, 16 bp, H. sapiens
gtgcctcagtttactt

SEQ ID NO: 121120 - DNA, 16 bp, H. sapiens
gtgcctcagtttccct

SEQ ID NO: 121121 - DNA, 16 bp, H. sapiens
gtgcctcagtttcctg

SEQ ID NO: 121122 - DNA, 16 bp, H. sapiens
gtgcctcagtttcctt

SEQ ID NO: 121123 - DNA, 16 bp, H. sapiens
gtgcctcagtttctat

SEQ ID NO: 121124 - DNA, 16 bp, H. sapiens
gtgcctcagtttctct

SEQ ID NO: 121125 - DNA, 16 bp, H. sapiens
gtgcctcagttttctg

SEQ ID NO: 121126 - DNA, 16 bp, H. sapiens
gtgcctccacccaaat

SEQ ID NO: 121127 - DNA, 16 bp, H. sapiens
gtgcctccagccctgc

SEQ ID NO: 121128 - DNA, 16 bp, H. sapiens
gtgcctccattttctc

SEQ ID NO: 121129 - DNA, 16 bp, H. sapiens
gtgcctctgcctcctg

SEQ ID NO: 121130 - DNA, 16 bp, H. sapiens
gtgcctctgtgtgtgt

SEQ ID NO: 121131 - DNA, 16 bp, H. sapiens
gtgcctcttcctcttc

SEQ ID NO: 121132 - DNA, 16 bp, H. sapiens
gtgcctgacaccacgc

SEQ ID NO: 121133 - DNA, 16 bp, H. sapiens
gtgcctgagcacacat

SEQ ID NO: 121134 - DNA, 16 bp, H. sapiens
gtgcctgagcctccca

SEQ ID NO: 121135 - DNA, 16 bp, H. sapiens
gtgcctgagtgtgtgt

SEQ ID NO: 121136 - DNA, 16 bp, H. sapiens
gtgcctgcattcccag

SEQ ID NO: 121137 - DNA, 16 bp, H. sapiens
gtgcctgcctatagtc

SEQ ID NO: 121138 - DNA, 16 bp, H. sapiens
gtgcctgcctcggcct

SEQ ID NO: 121139 - DNA, 16 bp, H. sapiens
gtgcctgccttggcct

SEQ ID NO: 121140 - DNA, 16 bp, H. sapiens
gtgcctgcctttcctg

SEQ ID NO: 121141 - DNA, 18 bp, H. sapiens
gtgcctgcggtcccagct

SEQ ID NO: 121142 - DNA, 16 bp, H. sapiens
gtgcctgctccttcct

SEQ ID NO: 121143 - DNA, 16 bp, H. sapiens
gtgcctgctctgtgcc

SEQ ID NO: 121144 - DNA, 16 bp, H. sapiens
gtgcctgcttccccct

SEQ ID NO: 121145 - DNA, 16 bp, H. sapiens
gtgcctggaactgact

SEQ ID NO: 121146 - DNA, 16 bp, H. sapiens
gtgcctggagctgagg

SEQ ID NO: 121147 - DNA, 16 bp, H. sapiens
gtgcctggagtctcag

SEQ ID NO: 121148 - DNA, 16 bp, H. sapiens
gtgcctggcacagaag

SEQ ID NO: 121149 - DNA, 16 bp, H. sapiens
gtgcctggcacagagt

SEQ ID NO: 121150 - DNA, 16 bp, H. sapiens
gtgcctggcacttagt

SEQ ID NO: 121151 - DNA, 16 bp, H. sapiens
gtgcctggccaagatt

SEQ ID NO: 121152 - DNA, 16 bp, H. sapiens
gtgcctggcccagaat

SEQ ID NO: 121153 - DNA, 16 bp, H. sapiens
gtgcctggcccagggc

SEQ ID NO: 121154 - DNA, 16 bp, H. sapiens
gtgcctggcccatggt

SEQ ID NO: 121155 - DNA, 16 bp, H. sapiens
gtgcctggcccccaaa

SEQ ID NO: 121156 - DNA, 16 bp, H. sapiens
gtgcctggccccttct

SEQ ID NO: 121157 - DNA, 16 bp, H. sapiens
gtgcctggcctggagt

SEQ ID NO: 121158 - DNA, 16 bp, H. sapiens
gtgcctggcctggcct

SEQ ID NO: 121159 - DNA, 16 bp, H. sapiens
gtgcctggctaatttt

SEQ ID NO: 121160 - DNA, 16 bp, H. sapiens
gtgcctggctgttttt

SEQ ID NO: 121161 - DNA, 16 bp, H. sapiens
gtgcctgtaatatcag

SEQ ID NO: 121162 - DNA, 18 bp, H. sapiens
gtgcctgtagtcccagct

SEQ ID NO: 121163 - DNA, 16 bp, H. sapiens
gtgcctgtagtcccat

SEQ ID NO: 121164 - DNA, 16 bp, H. sapiens
gtgcctgtagtcctag

SEQ ID NO: 121165 - DNA, 16 bp, H. sapiens
gtgcctgtgattccag

SEQ ID NO: 121166 - DNA, 16 bp, H. sapiens
gtgcctgtggtcccac

SEQ ID NO: 121167 - DNA, 16 bp, H. sapiens
gtgcctgtttcccctt

SEQ ID NO: 121168 - DNA, 16 bp, H. sapiens
gtgcctgtttcctcat

SEQ ID NO: 121169 - DNA, 16 bp, H. sapiens
gtgccttagcctccca

SEQ ID NO: 121170 - DNA, 16 bp, H. sapiens
gtgccttccctctgaa

SEQ ID NO: 121171 - DNA, 16 bp, H. sapiens
gtgccttgccttgcct

SEQ ID NO: 121172 - DNA, 16 bp, H. sapiens
gtgccttgtgtcccag

SEQ ID NO: 121173 - DNA, 16 bp, H. sapiens
gtgcctttacaaacct

SEQ ID NO: 121174 - DNA, 16 bp, H. sapiens
gtgcctttagtcccag

SEQ ID NO: 121175 - DNA, 16 bp, H. sapiens
gtgcctttgctcctct

SEQ ID NO: 121176 - DNA, 16 bp, H. sapiens
gtgcgcacctgtagtc

SEQ ID NO: 121177 - DNA, 16 bp, H. sapiens
gtgcgccaccacaccc

SEQ ID NO: 121178 - DNA, 16 bp, H. sapiens
gtgcgcctgtagtcct

SEQ ID NO: 121179 - DNA, 16 bp, H. sapiens
gtgcgcgcgcacacac

SEQ ID NO: 121180 - DNA, 16 bp, H. sapiens
gtgcgcgcgcgcgcac

SEQ ID NO: 121181 - DNA, 16 bp, H. sapiens
gtgcgcgcgcgtgcgc

SEQ ID NO: 121182 - DNA, 16 bp, H. sapiens
gtgcgcgtgtgcgtgt

SEQ ID NO: 121183 - DNA, 16 bp, H. sapiens
gtgcggcccagctcct

SEQ ID NO: 121184 - DNA, 16 bp, H. sapiens
gtgcgggatataatct

SEQ ID NO: 121185 - DNA, 16 bp, H. sapiens
gtgcgtatgtgtgtgt

SEQ ID NO: 121186 - DNA, 16 bp, H. sapiens
gtgcgtgagtgtgtgt

SEQ ID NO: 121187 - DNA, 16 bp, H. sapiens
gtgcgtgcacatgtgt

SEQ ID NO: 121188 - DNA, 16 bp, H. sapiens
gtgcgtgcatgtgtgc

SEQ ID NO: 121189 - DNA, 16 bp, H. sapiens
gtgcgtgccaccacgc

SEQ ID NO: 121190 - DNA, 16 bp, H. sapiens
gtgcgtgcgtgcgtgc

SEQ ID NO: 121191 - DNA, 16 bp, H. sapiens
gtgcgtgtagtcccag

SEQ ID NO: 121192 - DNA, 17 bp, H. sapiens
gtgcgtgtgtgtgtatg

SEQ ID NO: 121193 - DNA, 16 bp, H. sapiens
gtgcgtgtgtgtgtcc

SEQ ID NO: 121194 - DNA, 16 bp, H. sapiens
gtgcgtgtgtgtgtgc

SEQ ID NO: 121195 - DNA, 16 bp, H. sapiens
gtgcgtgtgtgtgttc

SEQ ID NO: 121196 - DNA, 16 bp, H. sapiens
gtgctaaaccatttat

SEQ ID NO: 121197 - DNA, 16 bp, H. sapiens
gtgctaacccattcat

SEQ ID NO: 121198 - DNA, 16 bp, H. sapiens
gtgctacaggccccat

SEQ ID NO: 121199 - DNA, 16 bp, H. sapiens
gtgctactataacaga

SEQ ID NO: 121200 - DNA, 16 bp, H. sapiens
gtgctaggaaaaaaaa

SEQ ID NO: 121201 - DNA, 16 bp, H. sapiens
gtgctaggcactgagg

SEQ ID NO: 121202 - DNA, 16 bp, H. sapiens
gtgctatcaagtagta

SEQ ID NO: 121203 - DNA, 16 bp, H. sapiens
gtgctcaaaagccaca

SEQ ID NO: 121204 - DNA, 16 bp, H. sapiens
gtgctcaatagtcaca

SEQ ID NO: 121205 - DNA, 16 bp, H. sapiens
gtgctcactgcagcct

SEQ ID NO: 121206 - DNA, 16 bp, H. sapiens
gtgctcagaagaagac

SEQ ID NO: 121207 - DNA, 16 bp, H. sapiens
gtgctcagattatagg

SEQ ID NO: 121208 - DNA, 16 bp, H. sapiens
gtgctcaggagtttga

SEQ ID NO: 121209 - DNA, 16 bp, H. sapiens
gtgctcagtgaatatt

SEQ ID NO: 121210 - DNA, 16 bp, H. sapiens
gtgctccacctgcctc

SEQ ID NO: 121211 - DNA, 16 bp, H. sapiens
gtgctcccaaatattc

SEQ ID NO: 121212 - DNA, 16 bp, H. sapiens
gtgctcccaggcttat

SEQ ID NO: 121213 - DNA, 16 bp, H. sapiens
gtgctcctcacttcct

SEQ ID NO: 121214 - DNA, 16 bp, H. sapiens
gtgctcctgctggggg

SEQ ID NO: 121215 - DNA, 16 bp, H. sapiens
gtgctctccagcctgg

SEQ ID NO: 121216 - DNA, 16 bp, H. sapiens
gtgctctgagagtgtg

SEQ ID NO: 121217 - DNA, 16 bp, H. sapiens
gtgctctggagactct

SEQ ID NO: 121218 - DNA, 16 bp, H. sapiens
gtgctgaaacaattgg

SEQ ID NO: 121219 - DNA, 16 bp, H. sapiens
gtgctgaagttgagaa

SEQ ID NO: 121220 - DNA, 16 bp, H. sapiens
gtgctgagataattgg

SEQ ID NO: 121221 - DNA, 16 bp, H. sapiens
gtgctgagattgcagg

SEQ ID NO: 121222 - DNA, 16 bp, H. sapiens
gtgctgagcacagtgc

SEQ ID NO: 121223 - DNA, 16 bp, H. sapiens
gtgctgaggcaggagg

SEQ ID NO: 121224 - DNA, 16 bp, H. sapiens
gtgctgaggttgggaa

SEQ ID NO: 121225 - DNA, 16 bp, H. sapiens
gtgctgatatggtttg

SEQ ID NO: 121226 - DNA, 16 bp, H. sapiens
gtgctgatgaagaagc

SEQ ID NO: 121227 - DNA, 16 bp, H. sapiens
gtgctgatgctgctgg

SEQ ID NO: 121228 - DNA, 16 bp, H. sapiens
gtgctgcaatggacat

SEQ ID NO: 121229 - DNA, 16 bp, H. sapiens
gtgctgccacacccag

SEQ ID NO: 121230 - DNA, 16 bp, H. sapiens
gtgctgctatgaacat

SEQ ID NO: 121231 - DNA, 16 bp, H. sapiens
gtgctgctgcattcgg

SEQ ID NO: 121232 - DNA, 16 bp, H. sapiens
gtgctgctgccatctc

SEQ ID NO: 121233 - DNA, 16 bp, H. sapiens
gtgctgctgctgctga

SEQ ID NO: 121234 - DNA, 16 bp, H. sapiens
gtgctgctggatttgg

SEQ ID NO: 121235 - DNA, 16 bp, H. sapiens
gtgctggaaaaactgg

SEQ ID NO: 121236 - DNA, 16 bp, H. sapiens
gtgctggagtccaagc

SEQ ID NO: 121237 - DNA, 16 bp, H. sapiens
gtgctggcagggctgg

SEQ ID NO: 121238 - DNA, 16 bp, H. sapiens
gtgctggcagtcctca

SEQ ID NO: 121239 - DNA, 16 bp, H. sapiens
gtgctggctcacgcct

SEQ ID NO: 121240 - DNA, 16 bp, H. sapiens
gtgctggctgtaggtg

SEQ ID NO: 121241 - DNA, 16 bp, H. sapiens
gtgctgggaaaacttg

SEQ ID NO: 121242 - DNA, 16 bp, H. sapiens
gtgctgggaagggaaa

SEQ ID NO: 121243 - DNA, 16 bp, H. sapiens
gtgctgggaattacag

SEQ ID NO: 121244 - DNA, 16 bp, H. sapiens
gtgctgggactgcagg

SEQ ID NO: 121245 - DNA, 16 bp, H. sapiens
gtgctgggaggtgtga

SEQ ID NO: 121246 - DNA, 16 bp, H. sapiens
gtgctgggataattag

SEQ ID NO: 121247 - DNA, 16 bp, H. sapiens
gtgctgggatgaaagg

SEQ ID NO: 121248 - DNA, 16 bp, H. sapiens
gtgctgggattgcaaa

SEQ ID NO: 121249 - DNA, 16 bp, H. sapiens
gtgctgggcacggtgg

SEQ ID NO: 121250 - DNA, 16 bp, H. sapiens
gtgctgggcactggag

SEQ ID NO: 121251 - DNA, 16 bp, H. sapiens
gtgctgggcactgtgg

SEQ ID NO: 121252 - DNA, 16 bp, H. sapiens
gtgctgggcatggtgg

SEQ ID NO: 121253 - DNA, 16 bp, H. sapiens
gtgctgggccctgggc

SEQ ID NO: 121254 - DNA, 16 bp, H. sapiens
gtgctgggggacccgg

SEQ ID NO: 121255 - DNA, 16 bp, H. sapiens
gtgctgggggtctcag

SEQ ID NO: 121256 - DNA, 16 bp, H. sapiens
gtgctggtatccacag

SEQ ID NO: 121257 - DNA, 16 bp, H. sapiens
gtgctggtattgcagg

SEQ ID NO: 121258 - DNA, 16 bp, H. sapiens
gtgctggtggccacag

SEQ ID NO: 121259 - DNA, 16 bp, H. sapiens
gtgctggtgggagtgt

SEQ ID NO: 121260 - DNA, 16 bp, H. sapiens
gtgctggttggcctcc

SEQ ID NO: 121261 - DNA, 16 bp, H. sapiens
gtgctgtctttgttct

SEQ ID NO: 121262 - DNA, 16 bp, H. sapiens
gtgctgtgaggaatgg

SEQ ID NO: 121263 - DNA, 16 bp, H. sapiens
gtgctgtgatcacagg

SEQ ID NO: 121264 - DNA, 16 bp, H. sapiens
gtgctgtggttcacac

SEQ ID NO: 121265 - DNA, 16 bp, H. sapiens
gtgctgtgtgctgtgt

SEQ ID NO: 121266 - DNA, 17 bp, H. sapiens
gtgctgttctcgtgata

SEQ ID NO: 121267 - DNA, 16 bp, H. sapiens
gtgcttaataaatact

SEQ ID NO: 121268 - DNA, 16 bp, H. sapiens
gtgcttagtaaatgtt

SEQ ID NO: 121269 - DNA, 16 bp, H. sapiens
gtgcttattttttaaa

SEQ ID NO: 121270 - DNA, 16 bp, H. sapiens
gtgcttcataaatatt

SEQ ID NO: 121271 - DNA, 16 bp, H. sapiens
gtgcttcccgagtgag

SEQ ID NO: 121272 - DNA, 16 bp, H. sapiens
gtgcttcctgggtgag

SEQ ID NO: 121273 - DNA, 16 bp, H. sapiens
gtgcttctttctttgg

SEQ ID NO: 121274 - DNA, 16 bp, H. sapiens
gtgcttgcgggccagc

SEQ ID NO: 121275 - DNA, 16 bp, H. sapiens
gtgcttgcttcccctt

SEQ ID NO: 121276 - DNA, 16 bp, H. sapiens
gtgcttgcttctcctt

SEQ ID NO: 121277 - DNA, 16 bp, H. sapiens
gtgcttggctttggtt

SEQ ID NO: 121278 - DNA, 16 bp, H. sapiens
gtgcttgtaatctcag

SEQ ID NO: 121279 - DNA, 16 bp, H. sapiens
gtgcttgtgaggtatt

SEQ ID NO: 121280 - DNA, 16 bp, H. sapiens
gtgctttcattttcaa

SEQ ID NO: 121281 - DNA, 16 bp, H. sapiens
gtgctttgcaaatatt

SEQ ID NO: 121282 - DNA, 16 bp, H. sapiens
gtgctttgggaggccg

SEQ ID NO: 121283 - DNA, 16 bp, H. sapiens
gtgcttttcttgtgat

SEQ ID NO: 121284 - DNA, 16 bp, H. sapiens
gtggaaaaaaggaaac

SEQ ID NO: 121285 - DNA, 16 bp, H. sapiens
gtggaaaaagaaatat

SEQ ID NO: 121286 - DNA, 16 bp, H. sapiens
gtggaaaaatcacaag

SEQ ID NO: 121287 - DNA, 16 bp, H. sapiens
gtggaaaacagcttgg

SEQ ID NO: 121288 - DNA, 16 bp, H. sapiens
gtggaaaacagtgtgg

SEQ ID NO: 121289 - DNA, 16 bp, H. sapiens
gtggaaaagctttttg

SEQ ID NO: 121290 - DNA, 16 bp, H. sapiens
gtggaaaagggaggca

SEQ ID NO: 121291 - DNA, 16 bp, H. sapiens
gtggaaaagtttggaa

SEQ ID NO: 121292 - DNA, 16 bp, H. sapiens
gtggaaaatgaaatat

SEQ ID NO: 121293 - DNA, 16 bp, H. sapiens
gtggaaaatggaatta

SEQ ID NO: 121294 - DNA, 16 bp, H. sapiens
gtggaaagataataaa

SEQ ID NO: 121295 - DNA, 16 bp, H. sapiens
gtggaaaggaaatgtg

SEQ ID NO: 121296 - DNA, 16 bp, H. sapiens
gtggaaaggaacaact

SEQ ID NO: 121297 - DNA, 16 bp, H. sapiens
gtggaaagtagtgtgg

SEQ ID NO: 121298 - DNA, 16 bp, H. sapiens
gtggaaagtgaaggag

SEQ ID NO: 121299 - DNA, 16 bp, H. sapiens
gtggaaagtttgctca

SEQ ID NO: 121300 - DNA, 16 bp, H. sapiens
gtggaaatgaaaaatg

SEQ ID NO: 121301 - DNA, 16 bp, H. sapiens
gtggaaatgcctggat

SEQ ID NO: 121302 - DNA, 16 bp, H. sapiens
gtggaaatggagagaa

SEQ ID NO: 121303 - DNA, 16 bp, H. sapiens
gtggaaattaaacaat

SEQ ID NO: 121304 - DNA, 17 bp, H. sapiens
gtggaaccaaaaaagaa

SEQ ID NO: 121305 - DNA, 16 bp, H. sapiens
gtggaacctcatctct

SEQ ID NO: 121306 - DNA, 16 bp, H. sapiens
gtggaactgctggatc

SEQ ID NO: 121307 - DNA, 16 bp, H. sapiens
gtggaagaaaaagcca

SEQ ID NO: 121308 - DNA, 16 bp, H. sapiens
gtggaagaaaatattt

SEQ ID NO: 121309 - DNA, 16 bp, H. sapiens
gtggaagaaaattttt

SEQ ID NO: 121310 - DNA, 16 bp, H. sapiens
gtggaagaatgaaact

SEQ ID NO: 121311 - DNA, 16 bp, H. sapiens
gtggaagacaaaggaa

SEQ ID NO: 121312 - DNA, 16 bp, H. sapiens
gtggaagacactgagc

SEQ ID NO: 121313 - DNA, 16 bp, H. sapiens
gtggaagacagatttg

SEQ ID NO: 121314 - DNA, 16 bp, H. sapiens
gtggaagacagcgtgg

SEQ ID NO: 121315 - DNA, 16 bp, H. sapiens
gtggaagacagtgtgt

SEQ ID NO: 121316 - DNA, 16 bp, H. sapiens
gtggaagacttcaaca

SEQ ID NO: 121317 - DNA, 16 bp, H. sapiens
gtggaagagcaagaga

SEQ ID NO: 121318 - DNA, 16 bp, H. sapiens
gtggaagatgaaggag

SEQ ID NO: 121319 - DNA, 16 bp, H. sapiens
gtggaagccactttgg

SEQ ID NO: 121320 - DNA, 16 bp, H. sapiens
gtggaagccctaagcc

SEQ ID NO: 121321 - DNA, 16 bp, H. sapiens
gtggaagctacaatga

SEQ ID NO: 121322 - DNA, 16 bp, H. sapiens
gtggaagctgccaaag

SEQ ID NO: 121323 - DNA, 16 bp, H. sapiens
gtggaagctgccaaga

SEQ ID NO: 121324 - DNA, 16 bp, H. sapiens
gtggaagctgccaagg

SEQ ID NO: 121325 - DNA, 16 bp, H. sapiens
gtggaagctttattct

SEQ ID NO: 121326 - DNA, 18 bp, H. sapiens
gtggaagctttgttcttt

SEQ ID NO: 121327 - DNA, 16 bp, H. sapiens
gtggaaggctgccctg

SEQ ID NO: 121328 - DNA, 16 bp, H. sapiens
gtggaaggggaggcag

SEQ ID NO: 121329 - DNA, 16 bp, H. sapiens
gtggaagtggcagtga

SEQ ID NO: 121330 - DNA, 16 bp, H. sapiens
gtggaatattcatgaa

SEQ ID NO: 121331 - DNA, 16 bp, H. sapiens
gtggaatatttttcca

SEQ ID NO: 121332 - DNA, 16 bp, H. sapiens
gtggaatcggtggtga

SEQ ID NO: 121333 - DNA, 16 bp, H. sapiens
gtggaatctaaaaaat

SEQ ID NO: 121334 - DNA, 16 bp, H. sapiens
gtggaatggaatggga

SEQ ID NO: 121335 - DNA, 16 bp, H. sapiens
gtggaattcacaatct

SEQ ID NO: 121336 - DNA, 16 bp, H. sapiens
gtggaattgctggtca

SEQ ID NO: 121337 - DNA, 16 bp, H. sapiens
gtggaatttcttcttc

SEQ ID NO: 121338 - DNA, 16 bp, H. sapiens
gtggaatttgaaatta

SEQ ID NO: 121339 - DNA, 16 bp, H. sapiens
gtggaattttctactt

SEQ ID NO: 121340 - DNA, 16 bp, H. sapiens
gtggacacagggtggg

SEQ ID NO: 121341 - DNA, 16 bp, H. sapiens
gtggacacatgaccca

SEQ ID NO: 121342 - DNA, 16 bp, H. sapiens
gtggacacctataatc

SEQ ID NO: 121343 - DNA, 16 bp, H. sapiens
gtggacagagggagga

SEQ ID NO: 121344 - DNA, 16 bp, H. sapiens
gtggacatccagtttt

SEQ ID NO: 121345 - DNA, 16 bp, H. sapiens
gtggacccaggaggcg

SEQ ID NO: 121346 - DNA, 16 bp, H. sapiens
gtggaccccaccacag

SEQ ID NO: 121347 - DNA, 16 bp, H. sapiens
gtggacctgaaagtga

SEQ ID NO: 121348 - DNA, 16 bp, H. sapiens
gtggacctttcagcag

SEQ ID NO: 121349 - DNA, 16 bp, H. sapiens
gtggacgcccctcccc

SEQ ID NO: 121350 - DNA, 16 bp, H. sapiens
gtggacgttgcagtga

SEQ ID NO: 121351 - DNA, 16 bp, H. sapiens
gtggactcacagcctg

SEQ ID NO: 121352 - DNA, 16 bp, H. sapiens
gtggactgagtaaagc

SEQ ID NO: 121353 - DNA, 16 bp, H. sapiens
gtggacttttggatta

SEQ ID NO: 121354 - DNA, 16 bp, H. sapiens
gtggagaaacccagca

SEQ ID NO: 121355 - DNA, 16 bp, H. sapiens
gtggagaaaccctgtc

SEQ ID NO: 121356 - DNA, 16 bp, H. sapiens
gtggagaaactggaat

SEQ ID NO: 121357 - DNA, 16 bp, H. sapiens
gtggagaaagaggaat

SEQ ID NO: 121358 - DNA, 16 bp, H. sapiens
gtggagaaatatgaac

SEQ ID NO: 121359 - DNA, 16 bp, H. sapiens
gtggagaaattggagc

SEQ ID NO: 121360 - DNA, 16 bp, H. sapiens
gtggagaaatttgaac

SEQ ID NO: 121361 - DNA, 30 bp, H. sapiens
gtggagaacctttgtgtctagctcagggat

SEQ ID NO: 121362 - DNA, 16 bp, H. sapiens
gtggagaacttttgtg

SEQ ID NO: 121363 - DNA, 16 bp, H. sapiens
gtggagaagctttttg

SEQ ID NO: 121364 - DNA, 16 bp, H. sapiens
gtggagaagtcagaac

SEQ ID NO: 121365 - DNA, 16 bp, H. sapiens
gtggagaagttggaac

SEQ ID NO: 121366 - DNA, 16 bp, H. sapiens
gtggagaatgtgcagg

SEQ ID NO: 121367 - DNA, 16 bp, H. sapiens
gtggagacggggattc

SEQ ID NO: 121368 - DNA, 16 bp, H. sapiens
gtggagacggggtttt

SEQ ID NO: 121369 - DNA, 16 bp, H. sapiens
gtggagagagaatctg

SEQ ID NO: 121370 - DNA, 16 bp, H. sapiens
gtggagagagagagac

SEQ ID NO: 121371 - DNA, 16 bp, H. sapiens
gtggagagggccctgg

SEQ ID NO: 121372 - DNA, 16 bp, H. sapiens
gtggagatcgcgccac

SEQ ID NO: 121373 - DNA, 16 bp, H. sapiens
gtggagatcgcgccat

SEQ ID NO: 121374 - DNA, 16 bp, H. sapiens
gtggagatgggatttt

SEQ ID NO: 121375 - DNA, 16 bp, H. sapiens
gtggagatggggtttt

SEQ ID NO: 121376 - DNA, 16 bp, H. sapiens
gtggagatttaagatg

SEQ ID NO: 121377 - DNA, 16 bp, H. sapiens
gtggagcaagatggtg

SEQ ID NO: 121378 - DNA, 16 bp, H. sapiens
gtggagcagctgggct

SEQ ID NO: 121379 - DNA, 16 bp, H. sapiens
gtggagcaggagagac

SEQ ID NO: 121380 - DNA, 16 bp, H. sapiens
gtggagcagggctacc

SEQ ID NO: 121381 - DNA, 16 bp, H. sapiens
gtggagctaagcagcc

SEQ ID NO: 121382 - DNA, 16 bp, H. sapiens
gtggagctcaggaggt

SEQ ID NO: 121383 - DNA, 17 bp, H. sapiens
gtggagctgaagagcca

SEQ ID NO: 121384 - DNA, 16 bp, H. sapiens
gtggagctggcagtga

SEQ ID NO: 121385 - DNA, 16 bp, H. sapiens
gtggaggaaactgagg

SEQ ID NO: 121386 - DNA, 16 bp, H. sapiens
gtggaggaagtcactg

SEQ ID NO: 121387 - DNA, 16 bp, H. sapiens
gtggaggacagtgtgg

SEQ ID NO: 121388 - DNA, 16 bp, H. sapiens
gtggaggacttcaaca

SEQ ID NO: 121389 - DNA, 16 bp, H. sapiens
gtggaggagacagaca

SEQ ID NO: 121390 - DNA, 16 bp, H. sapiens
gtggaggagcagaggc

SEQ ID NO: 121391 - DNA, 16 bp, H. sapiens
gtggaggcagaggcag

SEQ ID NO: 121392 - DNA, 16 bp, H. sapiens
gtggaggcagaggttg

SEQ ID NO: 121393 - DNA, 16 bp, H. sapiens
gtggaggcagcagtga

SEQ ID NO: 121394 - DNA, 16 bp, H. sapiens
gtggaggcaggaggag

SEQ ID NO: 121395 - DNA, 16 bp, H. sapiens
gtggaggctccaaccc

SEQ ID NO: 121396 - DNA, 16 bp, H. sapiens
gtggaggctgcagtaa

SEQ ID NO: 121397 - DNA, 16 bp, H. sapiens
gtggaggctgcagtca

SEQ ID NO: 121398 - DNA, 16 bp, H. sapiens
gtggaggctgcagtga

SEQ ID NO: 121399 - DNA, 16 bp, H. sapiens
gtggaggctgctgtga

SEQ ID NO: 121400 - DNA, 16 bp, H. sapiens
gtggaggctgggagga

SEQ ID NO: 121401 - DNA, 16 bp, H. sapiens
gtggagggagaggccc

SEQ ID NO: 121402 - DNA, 16 bp, H. sapiens
gtggagggcaagggga

SEQ ID NO: 121403 - DNA, 16 bp, H. sapiens
gtggaggggctggccc

SEQ ID NO: 121404 - DNA, 16 bp, H. sapiens
gtggaggtgctgggag

SEQ ID NO: 121405 - DNA, 16 bp, H. sapiens
gtggaggtggcaggag

SEQ ID NO: 121406 - DNA, 16 bp, H. sapiens
gtggaggtggtgctgg

SEQ ID NO: 121407 - DNA, 16 bp, H. sapiens
gtggaggttacaatga

SEQ ID NO: 121408 - DNA, 16 bp, H. sapiens
gtggaggttctcaaac

SEQ ID NO: 121409 - DNA, 16 bp, H. sapiens
gtggaggttgcagaga

SEQ ID NO: 121410 - DNA, 16 bp, H. sapiens
gtggaggttgcagtga

SEQ ID NO: 121411 - DNA, 16 bp, H. sapiens
gtggagtcaaaggaga

SEQ ID NO: 121412 - DNA, 16 bp, H. sapiens
gtggagtctccctctg

SEQ ID NO: 121413 - DNA, 16 bp, H. sapiens
gtggagtgcagtggtg

SEQ ID NO: 121414 - DNA, 17 bp, H. sapiens
gtggagtgcagtggtgt

SEQ ID NO: 121415 - DNA, 16 bp, H. sapiens
gtggagtggcttgagc

SEQ ID NO: 121416 - DNA, 16 bp, H. sapiens
gtggagttgggaagag

SEQ ID NO: 121417 - DNA, 16 bp, H. sapiens
gtggagtttcactctg

SEQ ID NO: 121418 - DNA, 16 bp, H. sapiens
gtggagttttccagag

SEQ ID NO: 121419 - DNA, 16 bp, H. sapiens
gtggagtttttaaaaa

SEQ ID NO: 121420 - DNA, 16 bp, H. sapiens
gtggataataacaaac

SEQ ID NO: 121421 - DNA, 16 bp, H. sapiens
gtggatcacctgaagg

SEQ ID NO: 121422 - DNA, 16 bp, H. sapiens
gtggatcacctgagat

SEQ ID NO: 121423 - DNA, 16 bp, H. sapiens
gtggatcacctgagga

SEQ ID NO: 121424 - DNA, 16 bp, H. sapiens
gtggatcacgaggtta

SEQ ID NO: 121425 - DNA, 16 bp, H. sapiens
gtggatcacggggtca

SEQ ID NO: 121426 - DNA, 16 bp, H. sapiens
gtggatcatgagatca

SEQ ID NO: 121427 - DNA, 16 bp, H. sapiens
gtggatccctgaggtc

SEQ ID NO: 121428 - DNA, 16 bp, H. sapiens
gtggatcctgaggtca

SEQ ID NO: 121429 - DNA, 16 bp, H. sapiens
gtggatgaaccttgaa

SEQ ID NO: 121430 - DNA, 16 bp, H. sapiens
gtggatgaactgcaac

SEQ ID NO: 121431 - DNA, 16 bp, H. sapiens
gtggatgacctgaggt

SEQ ID NO: 121432 - DNA, 16 bp, H. sapiens
gtggatggagctggag

SEQ ID NO: 121433 - DNA, 16 bp, H. sapiens
gtggatggatggaagg

SEQ ID NO: 121434 - DNA, 16 bp, H. sapiens
gtggatggatggacag

SEQ ID NO: 121435 - DNA, 16 bp, H. sapiens
gtggatgttaaagcca

SEQ ID NO: 121436 - DNA, 16 bp, H. sapiens
gtggattacattaatt

SEQ ID NO: 121437 - DNA, 16 bp, H. sapiens
gtggattacctgaggt

SEQ ID NO: 121438 - DNA, 16 bp, H. sapiens
gtggattcacagctga

SEQ ID NO: 121439 - DNA, 16 bp, H. sapiens
gtggattgtgaagatt

SEQ ID NO: 121440 - DNA, 16 bp, H. sapiens
gtggatttcttgagct

SEQ ID NO: 121441 - DNA, 16 bp, H. sapiens
gtggattttcttctgc

SEQ ID NO: 121442 - DNA, 17 bp, H. sapiens
gtggcaaaaccccatct

SEQ ID NO: 121443 - DNA, 19 bp, H. sapiens
gtggcaaaacctcgtctct

SEQ ID NO: 121444 - DNA, 16 bp, H. sapiens
gtggcaaagcattcaa

SEQ ID NO: 121445 - DNA, 16 bp, H. sapiens
gtggcaaagccaggac

SEQ ID NO: 121446 - DNA, 16 bp, H. sapiens
gtggcaagagaaaaat

SEQ ID NO: 121447 - DNA, 16 bp, H. sapiens
gtggcacaatcacaat

SEQ ID NO: 121448 - DNA, 16 bp, H. sapiens
gtggcacacatctgtg

SEQ ID NO: 121449 - DNA, 16 bp, H. sapiens
gtggcacaggcctgtg

SEQ ID NO: 121450 - DNA, 16 bp, H. sapiens
gtggcacagtcttggc

SEQ ID NO: 121451 - DNA, 16 bp, H. sapiens
gtggcacatatctgtg

SEQ ID NO: 121452 - DNA, 16 bp, H. sapiens
gtggcacatgcctgtg

SEQ ID NO: 121453 - DNA, 19 bp, H. sapiens
gtggcaccatcttggctca

SEQ ID NO: 121454 - DNA, 16 bp, H. sapiens
gtggcaccctcaggag

SEQ ID NO: 121455 - DNA, 16 bp, H. sapiens
gtggcacctggaagct

SEQ ID NO: 121456 - DNA, 16 bp, H. sapiens
gtggcacctttgcctg

SEQ ID NO: 121457 - DNA, 20 bp, H. sapiens
gtggcacgatctcggctcac

SEQ ID NO: 121458 - DNA, 17 bp, H. sapiens
gtggcacgatctcggtt

SEQ ID NO: 121459 - DNA, 16 bp, H. sapiens
gtggcacgtgcctata

SEQ ID NO: 121460 - DNA, 16 bp, H. sapiens
gtggcacgtgcctgta

SEQ ID NO: 121461 - DNA, 16 bp, H. sapiens
gtggcactcatctgta

SEQ ID NO: 121462 - DNA, 16 bp, H. sapiens
gtggcacttacctgta

SEQ ID NO: 121463 - DNA, 16 bp, H. sapiens
gtggcagacccctgta

SEQ ID NO: 121464 - DNA, 16 bp, H. sapiens
gtggcagagacagaag

SEQ ID NO: 121465 - DNA, 16 bp, H. sapiens
gtggcagagctgggac

SEQ ID NO: 121466 - DNA, 16 bp, H. sapiens
gtggcagaggcagaag

SEQ ID NO: 121467 - DNA, 16 bp, H. sapiens
gtggcagaggtggagg

SEQ ID NO: 121468 - DNA, 16 bp, H. sapiens
gtggcagaggttgcag

SEQ ID NO: 121469 - DNA, 16 bp, H. sapiens
gtggcagatcatcagg

SEQ ID NO: 121470 - DNA, 16 bp, H. sapiens
gtggcagcagcaggct

SEQ ID NO: 121471 - DNA, 16 bp, H. sapiens
gtggcagcatgcgcct

SEQ ID NO: 121472 - DNA, 16 bp, H. sapiens
gtggcagccgctgcac

SEQ ID NO: 121473 - DNA, 16 bp, H. sapiens
gtggcagctaaatgat

SEQ ID NO: 121474 - DNA, 16 bp, H. sapiens
gtggcaggagacagaa

SEQ ID NO: 121475 - DNA, 16 bp, H. sapiens
gtggcaggagacagag

SEQ ID NO: 121476 - DNA, 16 bp, H. sapiens
gtggcaggcaagaaag

SEQ ID NO: 121477 - DNA, 16 bp, H. sapiens
gtggcaggcacctaca

SEQ ID NO: 121478 - DNA, 17 bp, H. sapiens
gtggcaggcacctgtat

SEQ ID NO: 121479 - DNA, 16 bp, H. sapiens
gtggcaggcaggcctc

SEQ ID NO: 121480 - DNA, 16 bp, H. sapiens
gtggcaggcatctgtg

SEQ ID NO: 121481 - DNA, 16 bp, H. sapiens
gtggcaggccacttcc

SEQ ID NO: 121482 - DNA, 16 bp, H. sapiens
gtggcaggcgcctgta

SEQ ID NO: 121483 - DNA, 16 bp, H. sapiens
gtggcagggcacagtg

SEQ ID NO: 121484 - DNA, 16 bp, H. sapiens
gtggcagggcagggtg

SEQ ID NO: 121485 - DNA, 16 bp, H. sapiens
gtggcagggccaggac

SEQ ID NO: 121486 - DNA, 16 bp, H. sapiens
gtggcagggctggggc

SEQ ID NO: 121487 - DNA, 16 bp, H. sapiens
gtggcaggtgagcaag

SEQ ID NO: 121488 - DNA, 16 bp, H. sapiens
gtggcaggtgtctgta

SEQ ID NO: 121489 - DNA, 16 bp, H. sapiens
gtggcagtggagatgg

SEQ ID NO: 121490 - DNA, 16 bp, H. sapiens
gtggcagtggcagagg

SEQ ID NO: 121491 - DNA, 16 bp, H. sapiens
gtggcagtggcagcag

SEQ ID NO: 121492 - DNA, 16 bp, H. sapiens
gtggcagtggggatgg

SEQ ID NO: 121493 - DNA, 16 bp, H. sapiens
gtggcagtggtggcag

SEQ ID NO: 121494 - DNA, 16 bp, H. sapiens
gtggcagttttcaaag

SEQ ID NO: 121495 - DNA, 16 bp, H. sapiens
gtggcataatctcagc

SEQ ID NO: 121496 - DNA, 16 bp, H. sapiens
gtggcatatacctgta

SEQ ID NO: 121497 - DNA, 16 bp, H. sapiens
gtggcatccgcctgta

SEQ ID NO: 121498 - DNA, 16 bp, H. sapiens
gtggcatgatatattt

SEQ ID NO: 121499 - DNA, 16 bp, H. sapiens
gtggcatgatctctgc

SEQ ID NO: 121500 - DNA, 16 bp, H. sapiens
gtggcatgcatctgtg

SEQ ID NO: 121501 - DNA, 16 bp, H. sapiens
gtggcatgggctcatg

SEQ ID NO: 121502 - DNA, 16 bp, H. sapiens
gtggcatttagcccat

SEQ ID NO: 121503 - DNA, 16 bp, H. sapiens
gtggccaacacggtga

SEQ ID NO: 121504 - DNA, 18 bp, H. sapiens
gtggccaacatggtgaaa

SEQ ID NO: 121505 - DNA, 16 bp, H. sapiens
gtggccaagctggtac

SEQ ID NO: 121506 - DNA, 16 bp, H. sapiens
gtggccagaggagcag

SEQ ID NO: 121507 - DNA, 17 bp, H. sapiens
gtggccaggcacggtgg

SEQ ID NO: 121508 - DNA, 16 bp, H. sapiens
gtggccaggcgcggtg

SEQ ID NO: 121509 - DNA, 16 bp, H. sapiens
gtggccaggctggtct

SEQ ID NO: 121510 - DNA, 16 bp, H. sapiens
gtggccaggggtggtg

SEQ ID NO: 121511 - DNA, 16 bp, H. sapiens
gtggccaggtatggtg

SEQ ID NO: 121512 - DNA, 21 bp, H. sapiens
gtggccaggtgcagtggctca

SEQ ID NO: 121513 - DNA, 16 bp, H. sapiens
gtggccatcttctatg

SEQ ID NO: 121514 - DNA, 16 bp, H. sapiens
gtggccatggtggcag

SEQ ID NO: 121515 - DNA, 16 bp, H. sapiens
gtggccattgcttttg

SEQ ID NO: 121516 - DNA, 16 bp, H. sapiens
gtggcccacacctgtg

SEQ ID NO: 121517 - DNA, 16 bp, H. sapiens
gtggcccaggcaggag

SEQ ID NO: 121518 - DNA, 16 bp, H. sapiens
gtggcccaggccagag

SEQ ID NO: 121519 - DNA, 16 bp, H. sapiens
gtggcccaggctgcag

SEQ ID NO: 121520 - DNA, 16 bp, H. sapiens
gtggcccaggctggtg

SEQ ID NO: 121521 - DNA, 16 bp, H. sapiens
gtggcccagggaaggc

SEQ ID NO: 121522 - DNA, 16 bp, H. sapiens
gtggcccccacccagg

SEQ ID NO: 121523 - DNA, 16 bp, H. sapiens
gtggcccctgctgctg

SEQ ID NO: 121524 - DNA, 16 bp, H. sapiens
gtggccgaggcaggtg

SEQ ID NO: 121525 - DNA, 16 bp, H. sapiens
gtggcctccagtgtgg

SEQ ID NO: 121526 - DNA, 16 bp, H. sapiens
gtggcctcctgtgtgg

SEQ ID NO: 121527 - DNA, 16 bp, H. sapiens
gtggcctcttcaggcc

SEQ ID NO: 121528 - DNA, 29 bp, H. sapiens
gtggcctgacagtctctaccagtcctgct

SEQ ID NO: 121529 - DNA, 16 bp, H. sapiens
gtggcctgggctggag

SEQ ID NO: 121530 - DNA, 16 bp, H. sapiens
gtggcctgggtgacag

SEQ ID NO: 121531 - DNA, 16 bp, H. sapiens
gtggccttgacctccc

SEQ ID NO: 121532 - DNA, 16 bp, H. sapiens
gtggccttgagcaagt

SEQ ID NO: 121533 - DNA, 16 bp, H. sapiens
gtggccttgctgagct

SEQ ID NO: 121534 - DNA, 16 bp, H. sapiens
gtggcctttgtgtctg

SEQ ID NO: 121535 - DNA, 16 bp, H. sapiens
gtggcgaaacctcgtc

SEQ ID NO: 121536 - DNA, 16 bp, H. sapiens
gtggcgaatgcctgta

SEQ ID NO: 121537 - DNA, 16 bp, H. sapiens
gtggcgcaacctcagc

SEQ ID NO: 121538 - DNA, 16 bp, H. sapiens
gtggcgcaatctcact

SEQ ID NO: 121539 - DNA, 20 bp, H. sapiens
gtggcgcaatctcagctcac

SEQ ID NO: 121540 - DNA, 16 bp, H. sapiens
gtggcgcacgcctgtg

SEQ ID NO: 121541 - DNA, 16 bp, H. sapiens
gtggcgcgatcccagc

SEQ ID NO: 121542 - DNA, 16 bp, H. sapiens
gtggcgcgatcttgac

SEQ ID NO: 121543 - DNA, 26 bp, H. sapiens
gtggcgcgatcttggctcactgcaac

SEQ ID NO: 121544 - DNA, 16 bp, H. sapiens
gtggcgctttccagag

SEQ ID NO: 121545 - DNA, 16 bp, H. sapiens
gtggcggctgcctgta

SEQ ID NO: 121546 - DNA, 16 bp, H. sapiens
gtggcgggcgcctgta

SEQ ID NO: 121547 - DNA, 16 bp, H. sapiens
gtggcgggtgcctata

SEQ ID NO: 121548 - DNA, 16 bp, H. sapiens
gtggcgtgatctcggg

SEQ ID NO: 121549 - DNA, 19 bp, H. sapiens
gtggcgtgatcttggctca

SEQ ID NO: 121550 - DNA, 16 bp, H. sapiens
gtggcgtgtgcatgta

SEQ ID NO: 121551 - DNA, 16 bp, H. sapiens
gtggctactgtgttgg

SEQ ID NO: 121552 - DNA, 16 bp, H. sapiens
gtggctagtggctact

SEQ ID NO: 121553 - DNA, 16 bp, H. sapiens
gtggctattcacagat

SEQ ID NO: 121554 - DNA, 16 bp, H. sapiens
gtggctattcacaggt

SEQ ID NO: 121555 - DNA, 16 bp, H. sapiens
gtggctcacaaggtca

SEQ ID NO: 121556 - DNA, 16 bp, H. sapiens
gtggctcacagcagcc

SEQ ID NO: 121557 - DNA, 16 bp, H. sapiens
gtggctcacagcctgt

SEQ ID NO: 121558 - DNA, 16 bp, H. sapiens
gtggctcacatctgca

SEQ ID NO: 121559 - DNA, 17 bp, H. sapiens
gtggctcacgcttgtaa

SEQ ID NO: 121560 - DNA, 16 bp, H. sapiens
gtggctcagcccagct

SEQ ID NO: 121561 - DNA, 16 bp, H. sapiens
gtggctcagtctcagc

SEQ ID NO: 121562 - DNA, 16 bp, H. sapiens
gtggctcatgcacttt

SEQ ID NO: 121563 - DNA, 16 bp, H. sapiens
gtggctccaagccaag

SEQ ID NO: 121564 - DNA, 16 bp, H. sapiens
gtggctccatcacagc

SEQ ID NO: 121565 - DNA, 16 bp, H. sapiens
gtggctcccccagccc

SEQ ID NO: 121566 - DNA, 16 bp, H. sapiens
gtggctcccgcctgta

SEQ ID NO: 121567 - DNA, 22 bp, H. sapiens
gtggctcccgcctgtaatccca

SEQ ID NO: 121568 - DNA, 16 bp, H. sapiens
gtggctccctgtgttc

SEQ ID NO: 121569 - DNA, 17 bp, H. sapiens
gtggctcgatcttggct

SEQ ID NO: 121570 - DNA, 16 bp, H. sapiens
gtggctcgcacctgtg

SEQ ID NO: 121571 - DNA, 16 bp, H. sapiens
gtggctcgcttcttca

SEQ ID NO: 121572 - DNA, 16 bp, H. sapiens
gtggctcgtgcctgta

SEQ ID NO: 121573 - DNA, 16 bp, H. sapiens
gtggctctcagtggga

SEQ ID NO: 121574 - DNA, 16 bp, H. sapiens
gtggctctcccagcac

SEQ ID NO: 121575 - DNA, 16 bp, H. sapiens
gtggctctggcctgta

SEQ ID NO: 121576 - DNA, 16 bp, H. sapiens
gtggctgaaacctgta

SEQ ID NO: 121577 - DNA, 16 bp, H. sapiens
gtggctgaggcagaga

SEQ ID NO: 121578 - DNA, 16 bp, H. sapiens
gtggctgaggcgggag

SEQ ID NO: 121579 - DNA, 16 bp, H. sapiens
gtggctgagggaggag

SEQ ID NO: 121580 - DNA, 16 bp, H. sapiens
gtggctgaggtaggag

SEQ ID NO: 121581 - DNA, 16 bp, H. sapiens
gtggctgaggtgggag

SEQ ID NO: 121582 - DNA, 16 bp, H. sapiens
gtggctgcagaacagc

SEQ ID NO: 121583 - DNA, 16 bp, H. sapiens
gtggctgcagcagagt

SEQ ID NO: 121584 - DNA, 16 bp, H. sapiens
gtggctgcagctgtgc

SEQ ID NO: 121585 - DNA, 16 bp, H. sapiens
gtggctgcagtgagct

SEQ ID NO: 121586 - DNA, 16 bp, H. sapiens
gtggctgcctctgggg

SEQ ID NO: 121587 - DNA, 16 bp, H. sapiens
gtggctgctccatttt

SEQ ID NO: 121588 - DNA, 16 bp, H. sapiens
gtggctgctctcacag

SEQ ID NO: 121589 - DNA, 16 bp, H. sapiens
gtggctgctgactgat

SEQ ID NO: 121590 - DNA, 16 bp, H. sapiens
gtggctgctgtgggag

SEQ ID NO: 121591 - DNA, 16 bp, H. sapiens
gtggctggacgtggtg

SEQ ID NO: 121592 - DNA, 16 bp, H. sapiens
gtggctggagacccca

SEQ ID NO: 121593 - DNA, 16 bp, H. sapiens
gtggctggagcagctg

SEQ ID NO: 121594 - DNA, 16 bp, H. sapiens
gtggctggcagaggca

SEQ ID NO: 121595 - DNA, 16 bp, H. sapiens
gtggctgggacacaga

SEQ ID NO: 121596 - DNA, 16 bp, H. sapiens
gtggctgggacacagg

SEQ ID NO: 121597 - DNA, 16 bp, H. sapiens
gtggctgggactacag

SEQ ID NO: 121598 - DNA, 16 bp, H. sapiens
gtggctgggagcagtg

SEQ ID NO: 121599 - DNA, 16 bp, H. sapiens
gtggctgggcaaggtg

SEQ ID NO: 121600 - DNA, 16 bp, H. sapiens
gtggctgggtacagtg

SEQ ID NO: 121601 - DNA, 16 bp, H. sapiens
gtggctgggtccaggg

SEQ ID NO: 121602 - DNA, 16 bp, H. sapiens
gtggctggtccacctg

SEQ ID NO: 121603 - DNA, 16 bp, H. sapiens
gtggctggtgcctgta

SEQ ID NO: 121604 - DNA, 16 bp, H. sapiens
gtggctggtgcctgtg

SEQ ID NO: 121605 - DNA, 16 bp, H. sapiens
gtggctgtaattccag

SEQ ID NO: 121606 - DNA, 16 bp, H. sapiens
gtggctgtggctgtga

SEQ ID NO: 121607 - DNA, 16 bp, H. sapiens
gtggctgtgggcaagt

SEQ ID NO: 121608 - DNA, 16 bp, H. sapiens
gtggctgtgtccccac

SEQ ID NO: 121609 - DNA, 16 bp, H. sapiens
gtggcttaaaacaaca

SEQ ID NO: 121610 - DNA, 16 bp, H. sapiens
gtggcttaaaacaact

SEQ ID NO: 121611 - DNA, 16 bp, H. sapiens
gtggcttaaacaacac

SEQ ID NO: 121612 - DNA, 16 bp, H. sapiens
gtggcttacacttgta

SEQ ID NO: 121613 - DNA, 16 bp, H. sapiens
gtggcttatttagttc

SEQ ID NO: 121614 - DNA, 16 bp, H. sapiens
gtggcttcactcctga

SEQ ID NO: 121615 - DNA, 16 bp, H. sapiens
gtggcttggtagtggc

SEQ ID NO: 121616 - DNA, 16 bp, H. sapiens
gtggctttggtggcag

SEQ ID NO: 121617 - DNA, 16 bp, H. sapiens
gtgggaaagtgtggaa

SEQ ID NO: 121618 - DNA, 16 bp, H. sapiens
gtgggaaagtttggag

SEQ ID NO: 121619 - DNA, 31 bp, H. sapiens
gtgggaaatcaggggtctcacagccttcaga

SEQ ID NO: 121620 - DNA, 16 bp, H. sapiens
gtgggaaccagggctg

SEQ ID NO: 121621 - DNA, 16 bp, H. sapiens
gtgggaaccctgagct

SEQ ID NO: 121622 - DNA, 16 bp, H. sapiens
gtgggaacctgggagg

SEQ ID NO: 121623 - DNA, 16 bp, H. sapiens
gtgggaactggggctg

SEQ ID NO: 121624 - DNA, 16 bp, H. sapiens
gtgggaagaaaaggtg

SEQ ID NO: 121625 - DNA, 16 bp, H. sapiens
gtgggaagaggccagg

SEQ ID NO: 121626 - DNA, 16 bp, H. sapiens
gtgggaagatttcttg

SEQ ID NO: 121627 - DNA, 16 bp, H. sapiens
gtgggaaggactttgt

SEQ ID NO: 121628 - DNA, 16 bp, H. sapiens
gtgggaatggaaagga

SEQ ID NO: 121629 - DNA, 16 bp, H. sapiens
gtgggaatgtcaatta

SEQ ID NO: 121630 - DNA, 16 bp, H. sapiens
gtgggacagagcagga

SEQ ID NO: 121631 - DNA, 16 bp, H. sapiens
gtgggacaggatgtgg

SEQ ID NO: 121632 - DNA, 16 bp, H. sapiens
gtgggaccaggtagag

SEQ ID NO: 121633 - DNA, 16 bp, H. sapiens
gtgggaccccactgga

SEQ ID NO: 121634 - DNA, 16 bp, H. sapiens
gtgggacccgctgagc

SEQ ID NO: 121635 - DNA, 16 bp, H. sapiens
gtgggactacaggcac

SEQ ID NO: 121636 - DNA, 16 bp, H. sapiens
gtgggagaaggcagag

SEQ ID NO: 121637 - DNA, 16 bp, H. sapiens
gtgggagaagtttctg

SEQ ID NO: 121638 - DNA, 18 bp, H. sapiens
gtgggagaattgcttgag

SEQ ID NO: 121639 - DNA, 16 bp, H. sapiens
gtgggagacagtgaca

SEQ ID NO: 121640 - DNA, 16 bp, H. sapiens
gtgggagagacagaaa

SEQ ID NO: 121641 - DNA, 16 bp, H. sapiens
gtgggagataattgaa

SEQ ID NO: 121642 - DNA, 16 bp, H. sapiens
gtgggagatgattgga

SEQ ID NO: 121643 - DNA, 16 bp, H. sapiens
gtgggagcaaaacatt

SEQ ID NO: 121644 - DNA, 16 bp, H. sapiens
gtgggagcaagagaga

SEQ ID NO: 121645 - DNA, 16 bp, H. sapiens
gtgggagcaggcacat

SEQ ID NO: 121646 - DNA, 16 bp, H. sapiens
gtgggagcagggtgag

SEQ ID NO: 121647 - DNA, 16 bp, H. sapiens
gtgggagccagggctg

SEQ ID NO: 121648 - DNA, 16 bp, H. sapiens
gtgggaggagcctcag

SEQ ID NO: 121649 - DNA, 16 bp, H. sapiens
gtgggaggatcactta

SEQ ID NO: 121650 - DNA, 25 bp, H. sapiens
gtgggaggatcacttgagcctggga

SEQ ID NO: 121651 - DNA, 16 bp, H. sapiens
gtgggaggatggctcg

SEQ ID NO: 121652 - DNA, 16 bp, H. sapiens
gtgggaggattgactg

SEQ ID NO: 121653 - DNA, 16 bp, H. sapiens
gtgggaggattgctta

SEQ ID NO: 121654 - DNA, 17 bp, H. sapiens
gtgggaggccgaggcag

SEQ ID NO: 121655 - DNA, 16 bp, H. sapiens
gtgggagggacccagc

SEQ ID NO: 121656 - DNA, 16 bp, H. sapiens
gtgggagggactgggt

SEQ ID NO: 121657 - DNA, 16 bp, H. sapiens
gtgggagggaggcaga

SEQ ID NO: 121658 - DNA, 16 bp, H. sapiens
gtgggagggccagttt

SEQ ID NO: 121659 - DNA, 16 bp, H. sapiens
gtgggaggggcagcag

SEQ ID NO: 121660 - DNA, 16 bp, H. sapiens
gtgggaggtgatttga

SEQ ID NO: 121661 - DNA, 16 bp, H. sapiens
gtgggaggtggaggca

SEQ ID NO: 121662 - DNA, 16 bp, H. sapiens
gtgggagtactccaac

SEQ ID NO: 121663 - DNA, 16 bp, H. sapiens
gtgggagtgagactgg

SEQ ID NO: 121664 - DNA, 16 bp, H. sapiens
gtgggatctcactatg

SEQ ID NO: 121665 - DNA, 16 bp, H. sapiens
gtgggattacaggtgt

SEQ ID NO: 121666 - DNA, 16 bp, H. sapiens
gtgggatttatcacag

SEQ ID NO: 121667 - DNA, 16 bp, H. sapiens
gtgggcaaagaacatg

SEQ ID NO: 121668 - DNA, 16 bp, H. sapiens
gtgggcaagagccttt

SEQ ID NO: 121669 - DNA, 16 bp, H. sapiens
gtgggcaagggacatg

SEQ ID NO: 121670 - DNA, 16 bp, H. sapiens
gtgggcaccttgaaaa

SEQ ID NO: 121671 - DNA, 16 bp, H. sapiens
gtgggcagagatcaca

SEQ ID NO: 121672 - DNA, 16 bp, H. sapiens
gtgggcagaggccagg

SEQ ID NO: 121673 - DNA, 16 bp, H. sapiens
gtgggcagatcaccta

SEQ ID NO: 121674 - DNA, 16 bp, H. sapiens
gtgggcagattgcttg

SEQ ID NO: 121675 - DNA, 16 bp, H. sapiens
gtgggcagcagcaggg

SEQ ID NO: 121676 - DNA, 16 bp, H. sapiens
gtgggcagcccaggag

SEQ ID NO: 121677 - DNA, 16 bp, H. sapiens
gtgggcagctgggcag

SEQ ID NO: 121678 - DNA, 16 bp, H. sapiens
gtgggcaggcagggag

SEQ ID NO: 121679 - DNA, 16 bp, H. sapiens
gtgggcaggggccagg

SEQ ID NO: 121680 - DNA, 16 bp, H. sapiens
gtgggcagtgtctgtg

SEQ ID NO: 121681 - DNA, 16 bp, H. sapiens
gtgggcatcatggcca

SEQ ID NO: 121682 - DNA, 16 bp, H. sapiens
gtgggcatttagtggt

SEQ ID NO: 121683 - DNA, 16 bp, H. sapiens
gtgggccaagcccagg

SEQ ID NO: 121684 - DNA, 16 bp, H. sapiens
gtgggccaccacgccc

SEQ ID NO: 121685 - DNA, 16 bp, H. sapiens
gtgggccaggcccagt

SEQ ID NO: 121686 - DNA, 16 bp, H. sapiens
gtgggccaggccctgt

SEQ ID NO: 121687 - DNA, 16 bp, H. sapiens
gtgggccagggccagg

SEQ ID NO: 121688 - DNA, 16 bp, H. sapiens
gtgggcccaatctaat

SEQ ID NO: 121689 - DNA, 16 bp, H. sapiens
gtgggccccacccagt

SEQ ID NO: 121690 - DNA, 16 bp, H. sapiens
gtgggcctcagtttcc

SEQ ID NO: 121691 - DNA, 16 bp, H. sapiens
gtgggcctctccatag

SEQ ID NO: 121692 - DNA, 16 bp, H. sapiens
gtgggcctgacctaat

SEQ ID NO: 121693 - DNA, 16 bp, H. sapiens
gtgggcggaccacctg

SEQ ID NO: 121694 - DNA, 16 bp, H. sapiens
gtgggctcccaaggtc

SEQ ID NO: 121695 - DNA, 16 bp, H. sapiens
gtgggctcccatggcc

SEQ ID NO: 121696 - DNA, 16 bp, H. sapiens
gtgggctcccctctgg

SEQ ID NO: 121697 - DNA, 16 bp, H. sapiens
gtgggctcctctctgg

SEQ ID NO: 121698 - DNA, 16 bp, H. sapiens
gtgggctgagcccagg

SEQ ID NO: 121699 - DNA, 16 bp, H. sapiens
gtgggctgcatccact

SEQ ID NO: 121700 - DNA, 16 bp, H. sapiens
gtgggcttcgtccctg

SEQ ID NO: 121701 - DNA, 16 bp, H. sapiens
gtggggaaactgaggc

SEQ ID NO: 121702 - DNA, 16 bp, H. sapiens
gtggggaaataggaac

SEQ ID NO: 121703 - DNA, 16 bp, H. sapiens
gtggggaagctgaggc

SEQ ID NO: 121704 - DNA, 16 bp, H. sapiens
gtggggacatcagcag

SEQ ID NO: 121705 - DNA, 16 bp, H. sapiens
gtggggactctgtgtt

SEQ ID NO: 121706 - DNA, 16 bp, H. sapiens
gtggggactgtggcaa

SEQ ID NO: 121707 - DNA, 16 bp, H. sapiens
gtggggacttagagaa

SEQ ID NO: 121708 - DNA, 16 bp, H. sapiens
gtggggacttggaaaa

SEQ ID NO: 121709 - DNA, 16 bp, H. sapiens
gtggggacttggagaa

SEQ ID NO: 121710 - DNA, 16 bp, H. sapiens
gtggggagaaatctta

SEQ ID NO: 121711 - DNA, 16 bp, H. sapiens
gtggggagcacctctg

SEQ ID NO: 121712 - DNA, 16 bp, H. sapiens
gtggggaggagcctgg

SEQ ID NO: 121713 - DNA, 16 bp, H. sapiens
gtggggatgcctgcct

SEQ ID NO: 121714 - DNA, 16 bp, H. sapiens
gtggggcactgaagaa

SEQ ID NO: 121715 - DNA, 16 bp, H. sapiens
gtggggccagagccca

SEQ ID NO: 121716 - DNA, 16 bp, H. sapiens
gtggggccaggcatgg

SEQ ID NO: 121717 - DNA, 16 bp, H. sapiens
gtggggccagggcagg

SEQ ID NO: 121718 - DNA, 16 bp, H. sapiens
gtggggccaggtggag

SEQ ID NO: 121719 - DNA, 16 bp, H. sapiens
gtggggccgggcatgg

SEQ ID NO: 121720 - DNA, 16 bp, H. sapiens
gtggggcctcatggga

SEQ ID NO: 121721 - DNA, 16 bp, H. sapiens
gtggggcctgctggga

SEQ ID NO: 121722 - DNA, 16 bp, H. sapiens
gtggggcctgtgggag

SEQ ID NO: 121723 - DNA, 16 bp, H. sapiens
gtggggcctttgccag

SEQ ID NO: 121724 - DNA, 16 bp, H. sapiens
gtggggctgaggcagg

SEQ ID NO: 121725 - DNA, 16 bp, H. sapiens
gtggggctggcccagg

SEQ ID NO: 121726 - DNA, 16 bp, H. sapiens
gtggggctgggcacag

SEQ ID NO: 121727 - DNA, 16 bp, H. sapiens
gtgggggaaaaaaacc

SEQ ID NO: 121728 - DNA, 26 bp, H. sapiens
gtgggggagattacaaagtacattga

SEQ ID NO: 121729 - DNA, 16 bp, H. sapiens
gtgggggaggctcagg

SEQ ID NO: 121730 - DNA, 16 bp, H. sapiens
gtgggggcagggcaca

SEQ ID NO: 121731 - DNA, 16 bp, H. sapiens
gtgggggctccagccc

SEQ ID NO: 121732 - DNA, 16 bp, H. sapiens
gtgggggctcccctgg

SEQ ID NO: 121733 - DNA, 16 bp, H. sapiens
gtgggggctgaggcag

SEQ ID NO: 121734 - DNA, 16 bp, H. sapiens
gtggggggcagcccct

SEQ ID NO: 121735 - DNA, 16 bp, H. sapiens
gtggggggctaaggga

SEQ ID NO: 121736 - DNA, 16 bp, H. sapiens
gtggggggtgcctctg

SEQ ID NO: 121737 - DNA, 17 bp, H. sapiens
gtgggggtgtcagcccc

SEQ ID NO: 121738 - DNA, 16 bp, H. sapiens
gtggggtacaatgtga

SEQ ID NO: 121739 - DNA, 16 bp, H. sapiens
gtggggtcggagcccc

SEQ ID NO: 121740 - DNA, 16 bp, H. sapiens
gtggggtctcactatg

SEQ ID NO: 121741 - DNA, 16 bp, H. sapiens
gtggggtctttaagag

SEQ ID NO: 121742 - DNA, 16 bp, H. sapiens
gtggggtgctgctcca

SEQ ID NO: 121743 - DNA, 16 bp, H. sapiens
gtggggtgggagcccc

SEQ ID NO: 121744 - DNA, 16 bp, H. sapiens
gtggggtggtgcacac

SEQ ID NO: 121745 - DNA, 16 bp, H. sapiens
gtggggtgtggtggca

SEQ ID NO: 121746 - DNA, 16 bp, H. sapiens
gtggggttttgtcatg

SEQ ID NO: 121747 - DNA, 16 bp, H. sapiens
gtgggtagaggccaag

SEQ ID NO: 121748 - DNA, 16 bp, H. sapiens
gtgggtatgaagtggt

SEQ ID NO: 121749 - DNA, 16 bp, H. sapiens
gtgggtcacctgaggt

SEQ ID NO: 121750 - DNA, 16 bp, H. sapiens
gtgggtcacttgaggc

SEQ ID NO: 121751 - DNA, 16 bp, H. sapiens
gtgggtcagaaattca

SEQ ID NO: 121752 - DNA, 16 bp, H. sapiens
gtgggtcctcaccaga

SEQ ID NO: 121753 - DNA, 16 bp, H. sapiens
gtgggtcctggaacca

SEQ ID NO: 121754 - DNA, 16 bp, H. sapiens
gtgggtgaataatcag

SEQ ID NO: 121755 - DNA, 16 bp, H. sapiens
gtgggtgacagagcca

SEQ ID NO: 121756 - DNA, 16 bp, H. sapiens
gtgggtgacagtgaac

SEQ ID NO: 121757 - DNA, 16 bp, H. sapiens
gtgggtgagcagccaa

SEQ ID NO: 121758 - DNA, 16 bp, H. sapiens
gtgggtgaggcaggag

SEQ ID NO: 121759 - DNA, 16 bp, H. sapiens
gtgggtgatatggttt

SEQ ID NO: 121760 - DNA, 16 bp, H. sapiens
gtgggtgcagcccaca

SEQ ID NO: 121761 - DNA, 16 bp, H. sapiens
gtgggtgcagcccact

SEQ ID NO: 121762 - DNA, 16 bp, H. sapiens
gtgggtgcaggagcca

SEQ ID NO: 121763 - DNA, 16 bp, H. sapiens
gtgggtgccaggggct

SEQ ID NO: 121764 - DNA, 16 bp, H. sapiens
gtgggtgctggagaca

SEQ ID NO: 121765 - DNA, 16 bp, H. sapiens
gtgggtggactgcctg

SEQ ID NO: 121766 - DNA, 19 bp, H. sapiens
gtgggtggatcacttgagc

SEQ ID NO: 121767 - DNA, 16 bp, H. sapiens
gtgggtggatggatga

SEQ ID NO: 121768 - DNA, 16 bp, H. sapiens
gtgggtgtgtatatat

SEQ ID NO: 121769 - DNA, 16 bp, H. sapiens
gtgggtgttcaataaa

SEQ ID NO: 121770 - DNA, 16 bp, H. sapiens
gtgggttcctgtgcag

SEQ ID NO: 121771 - DNA, 16 bp, H. sapiens
gtgggttcgtggtctt

SEQ ID NO: 121772 - DNA, 16 bp, H. sapiens
gtgggttcttgggcag

SEQ ID NO: 121773 - DNA, 16 bp, H. sapiens
gtgggttttagtatat

SEQ ID NO: 121774 - DNA, 16 bp, H. sapiens
gtgggttttctgttta

SEQ ID NO: 121775 - DNA, 16 bp, H. sapiens
gtgggtttttaaaatt

SEQ ID NO: 121776 - DNA, 16 bp, H. sapiens
gtggtaatgagtgagt

SEQ ID NO: 121777 - DNA, 16 bp, H. sapiens
gtggtagaagaagatt

SEQ ID NO: 121778 - DNA, 16 bp, H. sapiens
gtggtagcatgtgtca

SEQ ID NO: 121779 - DNA, 16 bp, H. sapiens
gtggtagccaggatgg

SEQ ID NO: 121780 - DNA, 16 bp, H. sapiens
gtggtataatctcagc

SEQ ID NO: 121781 - DNA, 16 bp, H. sapiens
gtggtatatacatatg

SEQ ID NO: 121782 - DNA, 16 bp, H. sapiens
gtggtatctcattgtg

SEQ ID NO: 121783 - DNA, 16 bp, H. sapiens
gtggtatcttattgtg

SEQ ID NO: 121784 - DNA, 16 bp, H. sapiens
gtggtattggcaaaag

SEQ ID NO: 121785 - DNA, 16 bp, H. sapiens
gtggtatttctgaggc

SEQ ID NO: 121786 - DNA, 16 bp, H. sapiens
gtggtatttgtgtatc

SEQ ID NO: 121787 - DNA, 16 bp, H. sapiens
gtggtcaaattctgga

SEQ ID NO: 121788 - DNA, 16 bp, H. sapiens
gtggtcacaccactgc

SEQ ID NO: 121789 - DNA, 16 bp, H. sapiens
gtggtcacagctactc

SEQ ID NO: 121790 - DNA, 16 bp, H. sapiens
gtggtcaccatgcagt

SEQ ID NO: 121791 - DNA, 16 bp, H. sapiens
gtggtcagaacttgag

SEQ ID NO: 121792 - DNA, 16 bp, H. sapiens
gtggtcaggaaaggcc

SEQ ID NO: 121793 - DNA, 16 bp, H. sapiens
gtggtcagggaagcct

SEQ ID NO: 121794 - DNA, 16 bp, H. sapiens
gtggtcatctgcaagc

SEQ ID NO: 121795 - DNA, 16 bp, H. sapiens
gtggtccacctgcctt

SEQ ID NO: 121796 - DNA, 16 bp, H. sapiens
gtggtcccaactactc

SEQ ID NO: 121797 - DNA, 16 bp, H. sapiens
gtggtcccagatactt

SEQ ID NO: 121798 - DNA, 16 bp, H. sapiens
gtggtcctcctgcctc

SEQ ID NO: 121799 - DNA, 16 bp, H. sapiens
gtggtcctcctgcctt

SEQ ID NO: 121800 - DNA, 16 bp, H. sapiens
gtggtcgcagctactc

SEQ ID NO: 121801 - DNA, 16 bp, H. sapiens
gtggtctcagctcact

SEQ ID NO: 121802 - DNA, 18 bp, H. sapiens
gtggtctcgaactcctga

SEQ ID NO: 121803 - DNA, 16 bp, H. sapiens
gtggtctcttatcagg

SEQ ID NO: 121804 - DNA, 16 bp, H. sapiens
gtggtctggataaaag

SEQ ID NO: 121805 - DNA, 16 bp, H. sapiens
gtggtcttgccatgtt

SEQ ID NO: 121806 - DNA, 16 bp, H. sapiens
gtggtcttgctcagcg

SEQ ID NO: 121807 - DNA, 16 bp, H. sapiens
gtggtcttgctggcct

SEQ ID NO: 121808 - DNA, 20 bp, H. sapiens
gtggtgaaaccccgtctcca

SEQ ID NO: 121809 - DNA, 17 bp, H. sapiens
gtggtgaaacccggtct

SEQ ID NO: 121810 - DNA, 16 bp, H. sapiens
gtggtgaaactccatc

SEQ ID NO: 121811 - DNA, 16 bp, H. sapiens
gtggtgaaagaggaca

SEQ ID NO: 121812 - DNA, 16 bp, H. sapiens
gtggtgaaagggaaca

SEQ ID NO: 121813 - DNA, 16 bp, H. sapiens
gtggtgaaagtgggaa

SEQ ID NO: 121814 - DNA, 16 bp, H. sapiens
gtggtgacagatggca

SEQ ID NO: 121815 - DNA, 16 bp, H. sapiens
gtggtgactcacgcct

SEQ ID NO: 121816 - DNA, 16 bp, H. sapiens
gtggtgaggcttgctg

SEQ ID NO: 121817 - DNA, 16 bp, H. sapiens
gtggtgatgctggtgg

SEQ ID NO: 121818 - DNA, 16 bp, H. sapiens
gtggtgatggtgataa

SEQ ID NO: 121819 - DNA, 16 bp, H. sapiens
gtggtgatgtatgcct

SEQ ID NO: 121820 - DNA, 19 bp, H. sapiens
gtggtgcaatctcggctca

SEQ ID NO: 121821 - DNA, 24 bp, H. sapiens
gtggtgcaatctcggctcactgcg

SEQ ID NO: 121822 - DNA, 16 bp, H. sapiens
gtggtgcaatcttggt

SEQ ID NO: 121823 - DNA, 16 bp, H. sapiens
gtggtgcaggatatgg

SEQ ID NO: 121824 - DNA, 16 bp, H. sapiens
gtggtgcaggcctgta

SEQ ID NO: 121825 - DNA, 16 bp, H. sapiens
gtggtgcaggcctgtg

SEQ ID NO: 121826 - DNA, 16 bp, H. sapiens
gtggtgcccacccaga

SEQ ID NO: 121827 - DNA, 16 bp, H. sapiens
gtggtgcctgcctgtg

SEQ ID NO: 121828 - DNA, 17 bp, H. sapiens
gtggtgcgatcttggct

SEQ ID NO: 121829 - DNA, 16 bp, H. sapiens
gtggtgcgattatagc

SEQ ID NO: 121830 - DNA, 17 bp, H. sapiens
gtggtgcggtcttggct

SEQ ID NO: 121831 - DNA, 16 bp, H. sapiens
gtggtgctgctgctgc

SEQ ID NO: 121832 - DNA, 16 bp, H. sapiens
gtggtgctggaggtgg

SEQ ID NO: 121833 - DNA, 16 bp, H. sapiens
gtggtgctgggtgcct

SEQ ID NO: 121834 - DNA, 16 bp, H. sapiens
gtggtgctggtggtga

SEQ ID NO: 121835 - DNA, 16 bp, H. sapiens
gtggtggaaaagaaaa

SEQ ID NO: 121836 - DNA, 16 bp, H. sapiens
gtggtggacaagcttt

SEQ ID NO: 121837 - DNA, 21 bp, H. sapiens
gtggtggcacatgcctgtggt

SEQ ID NO: 121838 - DNA, 16 bp, H. sapiens
gtggtggcagcagtgg

SEQ ID NO: 121839 - DNA, 16 bp, H. sapiens
gtggtggcagctgcct

SEQ ID NO: 121840 - DNA, 16 bp, H. sapiens
gtggtggcaggctggg

SEQ ID NO: 121841 - DNA, 16 bp, H. sapiens
gtggtggcagggatgg

SEQ ID NO: 121842 - DNA, 16 bp, H. sapiens
gtggtggcagggccta

SEQ ID NO: 121843 - DNA, 19 bp, H. sapiens
gtggtggcaggtgcctgta

SEQ ID NO: 121844 - DNA, 16 bp, H. sapiens
gtggtggcagtggcag

SEQ ID NO: 121845 - DNA, 16 bp, H. sapiens
gtggtggcagtggcca

SEQ ID NO: 121846 - DNA, 16 bp, H. sapiens
gtggtggcagtggtgg

SEQ ID NO: 121847 - DNA, 16 bp, H. sapiens
gtggtggcattacagg

SEQ ID NO: 121848 - DNA, 16 bp, H. sapiens
gtggtggccacaggag

SEQ ID NO: 121849 - DNA, 16 bp, H. sapiens
gtggtggccaggctgg

SEQ ID NO: 121850 - DNA, 16 bp, H. sapiens
gtggtggcccacacct

SEQ ID NO: 121851 - DNA, 16 bp, H. sapiens
gtggtggcccactcct

SEQ ID NO: 121852 - DNA, 16 bp, H. sapiens
gtggtggccggcacct

SEQ ID NO: 121853 - DNA, 16 bp, H. sapiens
gtggtggcctatgcct

SEQ ID NO: 121854 - DNA, 16 bp, H. sapiens
gtggtggcctgtgcct

SEQ ID NO: 121855 - DNA, 16 bp, H. sapiens
gtggtggcggccgcct

SEQ ID NO: 121856 - DNA, 16 bp, H. sapiens
gtggtggcgggcatct

SEQ ID NO: 121857 - DNA, 16 bp, H. sapiens
gtggtggcgtgtacct

SEQ ID NO: 121858 - DNA, 16 bp, H. sapiens
gtggtggctcacgcct

SEQ ID NO: 121859 - DNA, 16 bp, H. sapiens
gtggtggctcactcct

SEQ ID NO: 121860 - DNA, 16 bp, H. sapiens
gtggtggctcagacct

SEQ ID NO: 121861 - DNA, 16 bp, H. sapiens
gtggtggctgcagaac

SEQ ID NO: 121862 - DNA, 16 bp, H. sapiens
gtggtggcttatacct

SEQ ID NO: 121863 - DNA, 16 bp, H. sapiens
gtggtggcttgcacct

SEQ ID NO: 121864 - DNA, 16 bp, H. sapiens
gtggtgggatgtgcct

SEQ ID NO: 121865 - DNA, 16 bp, H. sapiens
gtggtgggcacctgca

SEQ ID NO: 121866 - DNA, 16 bp, H. sapiens
gtggtgggccagggtg

SEQ ID NO: 121867 - DNA, 16 bp, H. sapiens
gtggtgggctggattt

SEQ ID NO: 121868 - DNA, 16 bp, H. sapiens
gtggtgggggctgtcc

SEQ ID NO: 121869 - DNA, 16 bp, H. sapiens
gtggtggtagcagcag

SEQ ID NO: 121870 - DNA, 16 bp, H. sapiens
gtggtggtctggaacc

SEQ ID NO: 121871 - DNA, 16 bp, H. sapiens
gtggtggtgaatgcct

SEQ ID NO: 121872 - DNA, 16 bp, H. sapiens
gtggtggtgacagtgg

SEQ ID NO: 121873 - DNA, 16 bp, H. sapiens
gtggtggtgcacacgt

SEQ ID NO: 121874 - DNA, 16 bp, H. sapiens
gtggtggtgcatgcct

SEQ ID NO: 121875 - DNA, 16 bp, H. sapiens
gtggtggtggcacatg

SEQ ID NO: 121876 - DNA, 16 bp, H. sapiens
gtggtggtggtggcag

SEQ ID NO: 121877 - DNA, 16 bp, H. sapiens
gtggtggtggtggcca

SEQ ID NO: 121878 - DNA, 16 bp, H. sapiens
gtggtggtgtacacct

SEQ ID NO: 121879 - DNA, 16 bp, H. sapiens
gtggtggtgtgatgat

SEQ ID NO: 121880 - DNA, 16 bp, H. sapiens
gtggtggtgtgcacat

SEQ ID NO: 121881 - DNA, 16 bp, H. sapiens
gtggtggtgttcacct

SEQ ID NO: 121882 - DNA, 16 bp, H. sapiens
gtggtggttcgcacct

SEQ ID NO: 121883 - DNA, 17 bp, H. sapiens
gtggtgtaggcacccaa

SEQ ID NO: 121884 - DNA, 16 bp, H. sapiens
gtggtgtgatcaaagc

SEQ ID NO: 121885 - DNA, 21 bp, H. sapiens
gtggtgtgatcttggctcacc

SEQ ID NO: 121886 - DNA, 16 bp, H. sapiens
gtggtgtgcacctgtg

SEQ ID NO: 121887 - DNA, 16 bp, H. sapiens
gtggtgtgtacctgta

SEQ ID NO: 121888 - DNA, 16 bp, H. sapiens
gtggtgtgtgcctgtg

SEQ ID NO: 121889 - DNA, 16 bp, H. sapiens
gtggtgtgtgtgaatg

SEQ ID NO: 121890 - DNA, 16 bp, H. sapiens
gtggttaagaacatgg

SEQ ID NO: 121891 - DNA, 16 bp, H. sapiens
gtggttaagagcatgg

SEQ ID NO: 121892 - DNA, 16 bp, H. sapiens
gtggttacatgggtat

SEQ ID NO: 121893 - DNA, 16 bp, H. sapiens
gtggttaccagagact

SEQ ID NO: 121894 - DNA, 16 bp, H. sapiens
gtggttaggagcatgg

SEQ ID NO: 121895 - DNA, 16 bp, H. sapiens
gtggttaggtcatgag

SEQ ID NO: 121896 - DNA, 16 bp, H. sapiens
gtggttcacacatgta

SEQ ID NO: 121897 - DNA, 16 bp, H. sapiens
gtggttcacagctgta

SEQ ID NO: 121898 - DNA, 16 bp, H. sapiens
gtggttcatgactgta

SEQ ID NO: 121899 - DNA, 16 bp, H. sapiens
gtggttctcagacttg

SEQ ID NO: 121900 - DNA, 16 bp, H. sapiens
gtggttcttaaacttg

SEQ ID NO: 121901 - DNA, 16 bp, H. sapiens
gtggttcttaaacttt

SEQ ID NO: 121902 - DNA, 16 bp, H. sapiens
gtggttgccagggact

SEQ ID NO: 121903 - DNA, 16 bp, H. sapiens
gtggttgccaggggct

SEQ ID NO: 121904 - DNA, 16 bp, H. sapiens
gtggttggctgcacct

SEQ ID NO: 121905 - DNA, 16 bp, H. sapiens
gtggttgtgggcgcct

SEQ ID NO: 121906 - DNA, 16 bp, H. sapiens
gtggtttaaaaaaaaa

SEQ ID NO: 121907 - DNA, 16 bp, H. sapiens
gtggtttaaaacaaca

SEQ ID NO: 121908 - DNA, 16 bp, H. sapiens
gtggtttcaaagaaca

SEQ ID NO: 121909 - DNA, 16 bp, H. sapiens
gtggtttcagaattgt

SEQ ID NO: 121910 - DNA, 16 bp, H. sapiens
gtggtttccaggggtt

SEQ ID NO: 121911 - DNA, 16 bp, H. sapiens
gtggtttctgtctcct

SEQ ID NO: 121912 - DNA, 16 bp, H. sapiens
gtggttttcaaaatgt

SEQ ID NO: 121913 - DNA, 16 bp, H. sapiens
gtggttttccttgtag

SEQ ID NO: 121914 - DNA, 16 bp, H. sapiens
gtggttttgatttaca

SEQ ID NO: 121915 - DNA, 16 bp, H. sapiens
gtggttttgatttcca

SEQ ID NO: 121916 - DNA, 16 bp, H. sapiens
gtggttttgccatgtt

SEQ ID NO: 121917 - DNA, 16 bp, H. sapiens
gtgtaactttacagaa

SEQ ID NO: 121918 - DNA, 16 bp, H. sapiens
gtgtaaggccattatt

SEQ ID NO: 121919 - DNA, 16 bp, H. sapiens
gtgtaagttaatactt

SEQ ID NO: 121920 - DNA, 16 bp, H. sapiens
gtgtaataatggaaat

SEQ ID NO: 121921 - DNA, 17 bp, H. sapiens
gtgtaatcccagctact

SEQ ID NO: 121922 - DNA, 16 bp, H. sapiens
gtgtaatctcagctta

SEQ ID NO: 121923 - DNA, 16 bp, H. sapiens
gtgtaatttttaaaaa

SEQ ID NO: 121924 - DNA, 16 bp, H. sapiens
gtgtacacctgtaatc

SEQ ID NO: 121925 - DNA, 16 bp, H. sapiens
gtgtacagcagcagca

SEQ ID NO: 121926 - DNA, 16 bp, H. sapiens
gtgtacatacatgtat

SEQ ID NO: 121927 - DNA, 16 bp, H. sapiens
gtgtacatgtgtgtgt

SEQ ID NO: 121928 - DNA, 16 bp, H. sapiens
gtgtacattgtaccca

SEQ ID NO: 121929 - DNA, 27 bp, H. sapiens
gtgtacccaacagctccgaagagacag

SEQ ID NO: 121930 - DNA, 16 bp, H. sapiens
gtgtaccctttaccca

SEQ ID NO: 121931 - DNA, 16 bp, H. sapiens
gtgtactaaaaataca

SEQ ID NO: 121932 - DNA, 16 bp, H. sapiens
gtgtactcaacagctc

SEQ ID NO: 121933 - DNA, 16 bp, H. sapiens
gtgtacttaatgccac

SEQ ID NO: 121934 - DNA, 16 bp, H. sapiens
gtgtagatttatttct

SEQ ID NO: 121935 - DNA, 16 bp, H. sapiens
gtgtagcaattcctca

SEQ ID NO: 121936 - DNA, 16 bp, H. sapiens
gtgtagctaccttcat

SEQ ID NO: 121937 - DNA, 16 bp, H. sapiens
gtgtagtattccatta

SEQ ID NO: 121938 - DNA, 16 bp, H. sapiens
gtgtagtcccagctac

SEQ ID NO: 121939 - DNA, 16 bp, H. sapiens
gtgtataattgttcat

SEQ ID NO: 121940 - DNA, 16 bp, H. sapiens
gtgtatacacatatat

SEQ ID NO: 121941 - DNA, 17 bp, H. sapiens
gtgtatacctatgtaac

SEQ ID NO: 121942 - DNA, 16 bp, H. sapiens
gtgtatactgctctgg

SEQ ID NO: 121943 - DNA, 16 bp, H. sapiens
gtgtatagaaatgcaa

SEQ ID NO: 121944 - DNA, 16 bp, H. sapiens
gtgtatatacacatat

SEQ ID NO: 121945 - DNA, 18 bp, H. sapiens
gtgtatatatatacacac

SEQ ID NO: 121946 - DNA, 16 bp, H. sapiens
gtgtatatatatatgc

SEQ ID NO: 121947 - DNA, 16 bp, H. sapiens
gtgtatatattccaca

SEQ ID NO: 121948 - DNA, 18 bp, H. sapiens
gtgtatatgtatatatat

SEQ ID NO: 121949 - DNA, 16 bp, H. sapiens
gtgtatatgtgtatat

SEQ ID NO: 121950 - DNA, 16 bp, H. sapiens
gtgtatccatcacctg

SEQ ID NO: 121951 - DNA, 16 bp, H. sapiens
gtgtatctctttgtat

SEQ ID NO: 121952 - DNA, 16 bp, H. sapiens
gtgtatctgtgtatgt

SEQ ID NO: 121953 - DNA, 16 bp, H. sapiens
gtgtatgagtgtgaat

SEQ ID NO: 121954 - DNA, 16 bp, H. sapiens
gtgtatgccaccatgc

SEQ ID NO: 121955 - DNA, 16 bp, H. sapiens
gtgtatgtatacacat

SEQ ID NO: 121956 - DNA, 16 bp, H. sapiens
gtgtatgtatatatac

SEQ ID NO: 121957 - DNA, 16 bp, H. sapiens
gtgtatgtatgagtgt

SEQ ID NO: 121958 - DNA, 16 bp, H. sapiens
gtgtatgtgaaacata

SEQ ID NO: 121959 - DNA, 16 bp, H. sapiens
gtgtatgtgagtgtgc

SEQ ID NO: 121960 - DNA, 16 bp, H. sapiens
gtgtatgtgcacatat

SEQ ID NO: 121961 - DNA, 16 bp, H. sapiens
gtgtatgtgcatgtgt

SEQ ID NO: 121962 - DNA, 16 bp, H. sapiens
gtgtatgtgtatttaa

SEQ ID NO: 121963 - DNA, 16 bp, H. sapiens
gtgtatgtgtctgttt

SEQ ID NO: 121964 - DNA, 16 bp, H. sapiens
gtgtatgtgtgtaggg

SEQ ID NO: 121965 - DNA, 16 bp, H. sapiens
gtgtatgtgtgtatgt

SEQ ID NO: 121966 - DNA, 18 bp, H. sapiens
gtgtatgtgtgtatgtat

SEQ ID NO: 121967 - DNA, 16 bp, H. sapiens
gtgtatgtgtgtgatg

SEQ ID NO: 121968 - DNA, 16 bp, H. sapiens
gtgtatgtgtgtgtgc

SEQ ID NO: 121969 - DNA, 16 bp, H. sapiens
gtgtatgttgtgtatg

SEQ ID NO: 121970 - DNA, 16 bp, H. sapiens
gtgtattagttcattt

SEQ ID NO: 121971 - DNA, 16 bp, H. sapiens
gtgtatttgtgtgtgc

SEQ ID NO: 121972 - DNA, 16 bp, H. sapiens
gtgtattttacactta

SEQ ID NO: 121973 - DNA, 16 bp, H. sapiens
gtgtattttatgtgta

SEQ ID NO: 121974 - DNA, 16 bp, H. sapiens
gtgtcaacttgattag

SEQ ID NO: 121975 - DNA, 16 bp, H. sapiens
gtgtcaacttgattgg

SEQ ID NO: 121976 - DNA, 16 bp, H. sapiens
gtgtcaagagcctgga

SEQ ID NO: 121977 - DNA, 16 bp, H. sapiens
gtgtcaaggaaaaaca

SEQ ID NO: 121978 - DNA, 16 bp, H. sapiens
gtgtcaagggtgactg

SEQ ID NO: 121979 - DNA, 16 bp, H. sapiens
gtgtcacacctgtaat

SEQ ID NO: 121980 - DNA, 16 bp, H. sapiens
gtgtcaccacacccag

SEQ ID NO: 121981 - DNA, 16 bp, H. sapiens
gtgtcagaatggaatt

SEQ ID NO: 121982 - DNA, 16 bp, H. sapiens
gtgtcagaattgaatt

SEQ ID NO: 121983 - DNA, 16 bp, H. sapiens
gtgtcagcaggattgg

SEQ ID NO: 121984 - DNA, 16 bp, H. sapiens
gtgtcagcagggttgg

SEQ ID NO: 121985 - DNA, 16 bp, H. sapiens
gtgtcagctgagtttg

SEQ ID NO: 121986 - DNA, 16 bp, H. sapiens
gtgtcagctgatccat

SEQ ID NO: 121987 - DNA, 16 bp, H. sapiens
gtgtcagctggggctg

SEQ ID NO: 121988 - DNA, 16 bp, H. sapiens
gtgtcaggtatttctt

SEQ ID NO: 121989 - DNA, 16 bp, H. sapiens
gtgtcaggtgcctgta

SEQ ID NO: 121990 - DNA, 16 bp, H. sapiens
gtgtcatcacagctca

SEQ ID NO: 121991 - DNA, 16 bp, H. sapiens
gtgtcatctgagacaa

SEQ ID NO: 121992 - DNA, 16 bp, H. sapiens
gtgtcatgggccatgg

SEQ ID NO: 121993 - DNA, 16 bp, H. sapiens
gtgtcatgtctaagaa

SEQ ID NO: 121994 - DNA, 16 bp, H. sapiens
gtgtcattacatgtga

SEQ ID NO: 121995 - DNA, 16 bp, H. sapiens
gtgtcattcaggctgg

SEQ ID NO: 121996 - DNA, 16 bp, H. sapiens
gtgtccacacatacat

SEQ ID NO: 121997 - DNA, 16 bp, H. sapiens
gtgtccaggaagaatg

SEQ ID NO: 121998 - DNA, 16 bp, H. sapiens
gtgtccaggcagaagc

SEQ ID NO: 121999 - DNA, 16 bp, H. sapiens
gtgtccagggttttta

SEQ ID NO: 122000 - DNA, 16 bp, H. sapiens
gtgtccatgtgttctt

SEQ ID NO: 122001 - DNA, 16 bp, H. sapiens
gtgtcccagcagaagg

SEQ ID NO: 122002 - DNA, 16 bp, H. sapiens
gtgtcccagcagctcc

SEQ ID NO: 122003 - DNA, 16 bp, H. sapiens
gtgtcccagctccagg

SEQ ID NO: 122004 - DNA, 16 bp, H. sapiens
gtgtcccagggattct

SEQ ID NO: 122005 - DNA, 16 bp, H. sapiens
gtgtccctggcctcta

SEQ ID NO: 122006 - DNA, 16 bp, H. sapiens
gtgtcctcaccaaaat

SEQ ID NO: 122007 - DNA, 16 bp, H. sapiens
gtgtcctcctttattt

SEQ ID NO: 122008 - DNA, 16 bp, H. sapiens
gtgtcctcttttattt

SEQ ID NO: 122009 - DNA, 16 bp, H. sapiens
gtgtcctgaggcctcc

SEQ ID NO: 122010 - DNA, 16 bp, H. sapiens
gtgtccttataagaag

SEQ ID NO: 122011 - DNA, 16 bp, H. sapiens
gtgtcctttcccccac

SEQ ID NO: 122012 - DNA, 16 bp, H. sapiens
gtgtcctttgcaggaa

SEQ ID NO: 122013 - DNA, 16 bp, H. sapiens
gtgtctaaactccaaa

SEQ ID NO: 122014 - DNA, 16 bp, H. sapiens
gtgtctactaaaaata

SEQ ID NO: 122015 - DNA, 16 bp, H. sapiens
gtgtctatgaggatgt

SEQ ID NO: 122016 - DNA, 16 bp, H. sapiens
gtgtctcaatttcctc

SEQ ID NO: 122017 - DNA, 16 bp, H. sapiens
gtgtctcacacttgta

SEQ ID NO: 122018 - DNA, 16 bp, H. sapiens
gtgtctcacctatctg

SEQ ID NO: 122019 - DNA, 16 bp, H. sapiens
gtgtctcccaggtcct

SEQ ID NO: 122020 - DNA, 16 bp, H. sapiens
gtgtctcccccacccc

SEQ ID NO: 122021 - DNA, 16 bp, H. sapiens
gtgtctccctgtgttg

SEQ ID NO: 122022 - DNA, 16 bp, H. sapiens
gtgtctctgcaggtga

SEQ ID NO: 122023 - DNA, 16 bp, H. sapiens
gtgtctctgccaggct

SEQ ID NO: 122024 - DNA, 16 bp, H. sapiens
gtgtctctgtttcctt

SEQ ID NO: 122025 - DNA, 16 bp, H. sapiens
gtgtctgaagtgaggg

SEQ ID NO: 122026 - DNA, 16 bp, H. sapiens
gtgtctgagctcagcc

SEQ ID NO: 122027 - DNA, 16 bp, H. sapiens
gtgtctgccctggtgc

SEQ ID NO: 122028 - DNA, 16 bp, H. sapiens
gtgtctggagagggcc

SEQ ID NO: 122029 - DNA, 16 bp, H. sapiens
gtgtctggcatatagt

SEQ ID NO: 122030 - DNA, 16 bp, H. sapiens
gtgtctggcttccttc

SEQ ID NO: 122031 - DNA, 16 bp, H. sapiens
gtgtctggtgaaggcc

SEQ ID NO: 122032 - DNA, 16 bp, H. sapiens
gtgtctggtgaggacc

SEQ ID NO: 122033 - DNA, 16 bp, H. sapiens
gtgtctggtgggggcc

SEQ ID NO: 122034 - DNA, 16 bp, H. sapiens
gtgtctggtttccatt

SEQ ID NO: 122035 - DNA, 18 bp, H. sapiens
gtgtctgtagtcccagct

SEQ ID NO: 122036 - DNA, 16 bp, H. sapiens
gtgtctgtctgtctgt

SEQ ID NO: 122037 - DNA, 16 bp, H. sapiens
gtgtctgtgagagtat

SEQ ID NO: 122038 - DNA, 16 bp, H. sapiens
gtgtctgtgagtgtgt

SEQ ID NO: 122039 - DNA, 16 bp, H. sapiens
gtgtctgtgcacgtga

SEQ ID NO: 122040 - DNA, 26 bp, H. sapiens
gtgtctgtgtagaaagaagtagacat

SEQ ID NO: 122041 - DNA, 16 bp, H. sapiens
gtgtctgtgtctgtct

SEQ ID NO: 122042 - DNA, 16 bp, H. sapiens
gtgtctgtgtctgtga

SEQ ID NO: 122043 - DNA, 16 bp, H. sapiens
gtgtctgtgtctgtgg

SEQ ID NO: 122044 - DNA, 17 bp, H. sapiens
gtgtctgtgtctgtgtg

SEQ ID NO: 122045 - DNA, 16 bp, H. sapiens
gtgtctgtgtgtttgc

SEQ ID NO: 122046 - DNA, 16 bp, H. sapiens
gtgtctgttatttcct

SEQ ID NO: 122047 - DNA, 16 bp, H. sapiens
gtgtcttctctgattt

SEQ ID NO: 122048 - DNA, 16 bp, H. sapiens
gtgtgaaatggcatct

SEQ ID NO: 122049 - DNA, 16 bp, H. sapiens
gtgtgaaccccaaata

SEQ ID NO: 122050 - DNA, 16 bp, H. sapiens
gtgtgaacctgggagg

SEQ ID NO: 122051 - DNA, 16 bp, H. sapiens
gtgtgaacctgggagt

SEQ ID NO: 122052 - DNA, 16 bp, H. sapiens
gtgtgaactcaggagg

SEQ ID NO: 122053 - DNA, 16 bp, H. sapiens
gtgtgaagagaccacc

SEQ ID NO: 122054 - DNA, 18 bp, H. sapiens
gtgtgaagtgacagcctt

SEQ ID NO: 122055 - DNA, 16 bp, H. sapiens
gtgtgaatgtatgtat

SEQ ID NO: 122056 - DNA, 16 bp, H. sapiens
gtgtgaatgtggtgaa

SEQ ID NO: 122057 - DNA, 16 bp, H. sapiens
gtgtgacagagagaga

SEQ ID NO: 122058 - DNA, 16 bp, H. sapiens
gtgtgacccactgtgc

SEQ ID NO: 122059 - DNA, 16 bp, H. sapiens
gtgtgacctcaggcag

SEQ ID NO: 122060 - DNA, 16 bp, H. sapiens
gtgtgaccttgagcag

SEQ ID NO: 122061 - DNA, 16 bp, H. sapiens
gtgtgaccttgggcag

SEQ ID NO: 122062 - DNA, 16 bp, H. sapiens
gtgtgagaataaacta

SEQ ID NO: 122063 - DNA, 16 bp, H. sapiens
gtgtgagatgttcccc

SEQ ID NO: 122064 - DNA, 16 bp, H. sapiens
gtgtgagcagcaataa

SEQ ID NO: 122065 - DNA, 16 bp, H. sapiens
gtgtgagccacagggc

SEQ ID NO: 122066 - DNA, 16 bp, H. sapiens
gtgtgagccaccacat

SEQ ID NO: 122067 - DNA, 16 bp, H. sapiens
gtgtgagccaccaccc

SEQ ID NO: 122068 - DNA, 16 bp, H. sapiens
gtgtgagccaggatgg

SEQ ID NO: 122069 - DNA, 16 bp, H. sapiens
gtgtgagccatcgtgt

SEQ ID NO: 122070 - DNA, 16 bp, H. sapiens
gtgtgagccccttgag

SEQ ID NO: 122071 - DNA, 16 bp, H. sapiens
gtgtgagctgccatgc

SEQ ID NO: 122072 - DNA, 16 bp, H. sapiens
gtgtgaggcaccgcac

SEQ ID NO: 122073 - DNA, 16 bp, H. sapiens
gtgtgaggtggcatct

SEQ ID NO: 122074 - DNA, 16 bp, H. sapiens
gtgtgagtgcacgtgt

SEQ ID NO: 122075 - DNA, 16 bp, H. sapiens
gtgtgagtgtgagtga

SEQ ID NO: 122076 - DNA, 16 bp, H. sapiens
gtgtgagtgtgcgtgt

SEQ ID NO: 122077 - DNA, 16 bp, H. sapiens
gtgtgagtgtgtctgt

SEQ ID NO: 122078 - DNA, 16 bp, H. sapiens
gtgtgagtgtgtgtga

SEQ ID NO: 122079 - DNA, 16 bp, H. sapiens
gtgtgagtgtgtgtgc

SEQ ID NO: 122080 - DNA, 16 bp, H. sapiens
gtgtgatctccactca

SEQ ID NO: 122081 - DNA, 16 bp, H. sapiens
gtgtgatgatcccctt

SEQ ID NO: 122082 - DNA, 16 bp, H. sapiens
gtgtgatgctgaaaaa

SEQ ID NO: 122083 - DNA, 16 bp, H. sapiens
gtgtgatgggcacagg

SEQ ID NO: 122084 - DNA, 16 bp, H. sapiens
gtgtgatggtgggtgc

SEQ ID NO: 122085 - DNA, 16 bp, H. sapiens
gtgtgatggttaatac

SEQ ID NO: 122086 - DNA, 16 bp, H. sapiens
gtgtgatgttagctgt

SEQ ID NO: 122087 - DNA, 18 bp, H. sapiens
gtgtgatgttccccttcc

SEQ ID NO: 122088 - DNA, 16 bp, H. sapiens
gtgtgatgtttcaata

SEQ ID NO: 122089 - DNA, 16 bp, H. sapiens
gtgtgcaaaagcccag

SEQ ID NO: 122090 - DNA, 16 bp, H. sapiens
gtgtgcacacatgtgc

SEQ ID NO: 122091 - DNA, 16 bp, H. sapiens
gtgtgcacatatgttt

SEQ ID NO: 122092 - DNA, 16 bp, H. sapiens
gtgtgcacatgtgtgt

SEQ ID NO: 122093 - DNA, 16 bp, H. sapiens
gtgtgcaccaacacac

SEQ ID NO: 122094 - DNA, 16 bp, H. sapiens
gtgtgcacgtgcgtgc

SEQ ID NO: 122095 - DNA, 16 bp, H. sapiens
gtgtgcacgtgtgcgt

SEQ ID NO: 122096 - DNA, 16 bp, H. sapiens
gtgtgcacgtgtgtgc

SEQ ID NO: 122097 - DNA, 16 bp, H. sapiens
gtgtgcagcacctccc

SEQ ID NO: 122098 - DNA, 16 bp, H. sapiens
gtgtgcagcttaggga

SEQ ID NO: 122099 - DNA, 16 bp, H. sapiens
gtgtgcagtgtgtgtg

SEQ ID NO: 122100 - DNA, 16 bp, H. sapiens
gtgtgcatgcacacac

SEQ ID NO: 122101 - DNA, 16 bp, H. sapiens
gtgtgcatgcctgtgt

SEQ ID NO: 122102 - DNA, 16 bp, H. sapiens
gtgtgcatgcttgtgt

SEQ ID NO: 122103 - DNA, 16 bp, H. sapiens
gtgtgcatggtgtgtg

SEQ ID NO: 122104 - DNA, 16 bp, H. sapiens
gtgtgcatgtgcttgt

SEQ ID NO: 122105 - DNA, 16 bp, H. sapiens
gtgtgcatgtgggtgc

SEQ ID NO: 122106 - DNA, 16 bp, H. sapiens
gtgtgcatgtgtctat

SEQ ID NO: 122107 - DNA, 16 bp, H. sapiens
gtgtgcatgtgtgagg

SEQ ID NO: 122108 - DNA, 16 bp, H. sapiens
gtgtgcatgtgtgtgc

SEQ ID NO: 122109 - DNA, 16 bp, H. sapiens
gtgtgcatgtgtgtgg

SEQ ID NO: 122110 - DNA, 16 bp, H. sapiens
gtgtgcatgtttgtgt

SEQ ID NO: 122111 - DNA, 16 bp, H. sapiens
gtgtgcattaaactca

SEQ ID NO: 122112 - DNA, 16 bp, H. sapiens
gtgtgcattcaagtca

SEQ ID NO: 122113 - DNA, 16 bp, H. sapiens
gtgtgcattcttctca

SEQ ID NO: 122114 - DNA, 16 bp, H. sapiens
gtgtgccagccactgt

SEQ ID NO: 122115 - DNA, 16 bp, H. sapiens
gtgtgccaggcattgg

SEQ ID NO: 122116 - DNA, 16 bp, H. sapiens
gtgtgccaggctctgg

SEQ ID NO: 122117 - DNA, 16 bp, H. sapiens
gtgtgcccgtgtgtgt

SEQ ID NO: 122118 - DNA, 16 bp, H. sapiens
gtgtgcctctgtgtgt

SEQ ID NO: 122119 - DNA, 16 bp, H. sapiens
gtgtgcctggctgtgt

SEQ ID NO: 122120 - DNA, 16 bp, H. sapiens
gtgtgcctggtccagc

SEQ ID NO: 122121 - DNA, 17 bp, H. sapiens
gtgtgcctgtggtccca

SEQ ID NO: 122122 - DNA, 16 bp, H. sapiens
gtgtgcctgtgtgtgc

SEQ ID NO: 122123 - DNA, 19 bp, H. sapiens
gtgtgcctgtgtgtgtgtg

SEQ ID NO: 122124 - DNA, 16 bp, H. sapiens
gtgtgcgcacacacac

SEQ ID NO: 122125 - DNA, 16 bp, H. sapiens
gtgtgcgcgcgtgtgc

SEQ ID NO: 122126 - DNA, 16 bp, H. sapiens
gtgtgcgtctgtgtgt

SEQ ID NO: 122127 - DNA, 16 bp, H. sapiens
gtgtgcgtgcatgtgc

SEQ ID NO: 122128 - DNA, 16 bp, H. sapiens
gtgtgcgtgcgtgtgc

SEQ ID NO: 122129 - DNA, 16 bp, H. sapiens
gtgtgcgtgtgtatgt

SEQ ID NO: 122130 - DNA, 16 bp, H. sapiens
gtgtgcgtgtgtgcac

SEQ ID NO: 122131 - DNA, 16 bp, H. sapiens
gtgtgcgtgtgtgcag

SEQ ID NO: 122132 - DNA, 16 bp, H. sapiens
gtgtgcgtgtgtgcgc

SEQ ID NO: 122133 - DNA, 16 bp, H. sapiens
gtgtgctgcaggggca

SEQ ID NO: 122134 - DNA, 16 bp, H. sapiens
gtgtgctgcaggggtg

SEQ ID NO: 122135 - DNA, 16 bp, H. sapiens
gtgtgctggagccagc

SEQ ID NO: 122136 - DNA, 16 bp, H. sapiens
gtgtgcttgggggagg

SEQ ID NO: 122137 - DNA, 16 bp, H. sapiens
gtgtggaaaatggatt

SEQ ID NO: 122138 - DNA, 16 bp, H. sapiens
gtgtggaaattcctca

SEQ ID NO: 122139 - DNA, 16 bp, H. sapiens
gtgtggaatatctttt

SEQ ID NO: 122140 - DNA, 16 bp, H. sapiens
gtgtggacacagccaa

SEQ ID NO: 122141 - DNA, 16 bp, H. sapiens
gtgtggaccatttctt

SEQ ID NO: 122142 - DNA, 16 bp, H. sapiens
gtgtggaggggctggc

SEQ ID NO: 122143 - DNA, 16 bp, H. sapiens
gtgtggatgattttag

SEQ ID NO: 122144 - DNA, 16 bp, H. sapiens
gtgtggatgtatgtgt

SEQ ID NO: 122145 - DNA, 16 bp, H. sapiens
gtgtggatgtatgttt

SEQ ID NO: 122146 - DNA, 16 bp, H. sapiens
gtgtggatgtggtgaa

SEQ ID NO: 122147 - DNA, 16 bp, H. sapiens
gtgtggattcatctaa

SEQ ID NO: 122148 - DNA, 16 bp, H. sapiens
gtgtggattcatttca

SEQ ID NO: 122149 - DNA, 16 bp, H. sapiens
gtgtggcacctcccct

SEQ ID NO: 122150 - DNA, 16 bp, H. sapiens
gtgtggccaccatgcc

SEQ ID NO: 122151 - DNA, 16 bp, H. sapiens
gtgtggccagagtggg

SEQ ID NO: 122152 - DNA, 16 bp, H. sapiens
gtgtggccattttcac

SEQ ID NO: 122153 - DNA, 16 bp, H. sapiens
gtgtggcccaggaaag

SEQ ID NO: 122154 - DNA, 16 bp, H. sapiens
gtgtggccctgccaac

SEQ ID NO: 122155 - DNA, 16 bp, H. sapiens
gtgtggcctctctctc

SEQ ID NO: 122156 - DNA, 16 bp, H. sapiens
gtgtggcctttgggaa

SEQ ID NO: 122157 - DNA, 16 bp, H. sapiens
gtgtggcgtgtgtgta

SEQ ID NO: 122158 - DNA, 16 bp, H. sapiens
gtgtggctattcctca

SEQ ID NO: 122159 - DNA, 16 bp, H. sapiens
gtgtggctggagcagg

SEQ ID NO: 122160 - DNA, 16 bp, H. sapiens
gtgtggctggggaggc

SEQ ID NO: 122161 - DNA, 16 bp, H. sapiens
gtgtggctggggctgc

SEQ ID NO: 122162 - DNA, 16 bp, H. sapiens
gtgtggcttcatttct

SEQ ID NO: 122163 - DNA, 16 bp, H. sapiens
gtgtgggaccccactg

SEQ ID NO: 122164 - DNA, 16 bp, H. sapiens
gtgtgggcatgtgtgt

SEQ ID NO: 122165 - DNA, 16 bp, H. sapiens
gtgtgggccaggctgg

SEQ ID NO: 122166 - DNA, 16 bp, H. sapiens
gtgtggggaaaagaaa

SEQ ID NO: 122167 - DNA, 16 bp, H. sapiens
gtgtgggggaaactgc

SEQ ID NO: 122168 - DNA, 16 bp, H. sapiens
gtgtgggggtgcacac

SEQ ID NO: 122169 - DNA, 16 bp, H. sapiens
gtgtggtagcttatgc

SEQ ID NO: 122170 - DNA, 16 bp, H. sapiens
gtgtggtatctggaat

SEQ ID NO: 122171 - DNA, 16 bp, H. sapiens
gtgtggtccctttaaa

SEQ ID NO: 122172 - DNA, 16 bp, H. sapiens
gtgtggtgacacacgc

SEQ ID NO: 122173 - DNA, 16 bp, H. sapiens
gtgtggtgagaacatt

SEQ ID NO: 122174 - DNA, 16 bp, H. sapiens
gtgtggtgatgcatgc

SEQ ID NO: 122175 - DNA, 16 bp, H. sapiens
gtgtggtgcacccatt

SEQ ID NO: 122176 - DNA, 16 bp, H. sapiens
gtgtggtgctgtgcac

SEQ ID NO: 122177 - DNA, 16 bp, H. sapiens
gtgtggtggcacagtc

SEQ ID NO: 122178 - DNA, 16 bp, H. sapiens
gtgtggtggcagccgc

SEQ ID NO: 122179 - DNA, 16 bp, H. sapiens
gtgtggtggcaggccc

SEQ ID NO: 122180 - DNA, 16 bp, H. sapiens
gtgtggtggcatgtgt

SEQ ID NO: 122181 - DNA, 16 bp, H. sapiens
gtgtggtggcgcatgc

SEQ ID NO: 122182 - DNA, 16 bp, H. sapiens
gtgtggtggcgcgcac

SEQ ID NO: 122183 - DNA, 16 bp, H. sapiens
gtgtggtggcgtgcac

SEQ ID NO: 122184 - DNA, 16 bp, H. sapiens
gtgtggtgggccaaaa

SEQ ID NO: 122185 - DNA, 16 bp, H. sapiens
gtgtggtggggggcac

SEQ ID NO: 122186 - DNA, 16 bp, H. sapiens
gtgtggtggtgagcgc

SEQ ID NO: 122187 - DNA, 16 bp, H. sapiens
gtgtggtggtgcacac

SEQ ID NO: 122188 - DNA, 16 bp, H. sapiens
gtgtggtggtgcactc

SEQ ID NO: 122189 - DNA, 16 bp, H. sapiens
gtgtggtgtgaatgtg

SEQ ID NO: 122190 - DNA, 16 bp, H. sapiens
gtgtggttgctcatgc

SEQ ID NO: 122191 - DNA, 16 bp, H. sapiens
gtgtgtacacacatgc

SEQ ID NO: 122192 - DNA, 16 bp, H. sapiens
gtgtgtacatatgtaa

SEQ ID NO: 122193 - DNA, 16 bp, H. sapiens
gtgtgtacatgtgcac

SEQ ID NO: 122194 - DNA, 16 bp, H. sapiens
gtgtgtacgtgtgtat

SEQ ID NO: 122195 - DNA, 16 bp, H. sapiens
gtgtgtatacatgcat

SEQ ID NO: 122196 - DNA, 16 bp, H. sapiens
gtgtgtataggtgtgt

SEQ ID NO: 122197 - DNA, 16 bp, H. sapiens
gtgtgtatatataaaa

SEQ ID NO: 122198 - DNA, 16 bp, H. sapiens
gtgtgtatatataatg

SEQ ID NO: 122199 - DNA, 16 bp, H. sapiens
gtgtgtatatatgttt

SEQ ID NO: 122200 - DNA, 16 bp, H. sapiens
gtgtgtatatattttg

SEQ ID NO: 122201 - DNA, 16 bp, H. sapiens
gtgtgtatctatctat

SEQ ID NO: 122202 - DNA, 16 bp, H. sapiens
gtgtgtatggaatgtg

SEQ ID NO: 122203 - DNA, 16 bp, H. sapiens
gtgtgtatgtactaca

SEQ ID NO: 122204 - DNA, 16 bp, H. sapiens
gtgtgtatgtatgtgc

SEQ ID NO: 122205 - DNA, 16 bp, H. sapiens
gtgtgtatgtgcacgt

SEQ ID NO: 122206 - DNA, 16 bp, H. sapiens
gtgtgtatgtgtacaa

SEQ ID NO: 122207 - DNA, 16 bp, H. sapiens
gtgtgtatgtgtctgt

SEQ ID NO: 122208 - DNA, 16 bp, H. sapiens
gtgtgtatgtgtgtga

SEQ ID NO: 122209 - DNA, 16 bp, H. sapiens
gtgtgtatgtgtgtgc

SEQ ID NO: 122210 - DNA, 16 bp, H. sapiens
gtgtgtatttgtgtgc

SEQ ID NO: 122211 - DNA, 16 bp, H. sapiens
gtgtgtccacatcctt

SEQ ID NO: 122212 - DNA, 16 bp, H. sapiens
gtgtgtccagggaggg

SEQ ID NO: 122213 - DNA, 16 bp, H. sapiens
gtgtgtcctctcctct

SEQ ID NO: 122214 - DNA, 16 bp, H. sapiens
gtgtgtctctgcctgt

SEQ ID NO: 122215 - DNA, 16 bp, H. sapiens
gtgtgtctgtgagagt

SEQ ID NO: 122216 - DNA, 16 bp, H. sapiens
gtgtgtctgtgagtgt

SEQ ID NO: 122217 - DNA, 16 bp, H. sapiens
gtgtgtctgtgtctgc

SEQ ID NO: 122218 - DNA, 16 bp, H. sapiens
gtgtgtctgtgtgatg

SEQ ID NO: 122219 - DNA, 16 bp, H. sapiens
gtgtgtctgtgtgcag

SEQ ID NO: 122220 - DNA, 16 bp, H. sapiens
gtgtgtctgtgtgtat

SEQ ID NO: 122221 - DNA, 16 bp, H. sapiens
gtgtgtctgtgtgtgc

SEQ ID NO: 122222 - DNA, 16 bp, H. sapiens
gtgtgtctgtgtgttc

SEQ ID NO: 122223 - DNA, 16 bp, H. sapiens
gtgtgtctttatagat

SEQ ID NO: 122224 - DNA, 16 bp, H. sapiens
gtgtgtgaacgtgtgt

SEQ ID NO: 122225 - DNA, 16 bp, H. sapiens
gtgtgtgagaaactgc

SEQ ID NO: 122226 - DNA, 16 bp, H. sapiens
gtgtgtgagaaagaga

SEQ ID NO: 122227 - DNA, 16 bp, H. sapiens
gtgtgtgagagtgtgc

SEQ ID NO: 122228 - DNA, 16 bp, H. sapiens
gtgtgtgagtgtgtgc

SEQ ID NO: 122229 - DNA, 16 bp, H. sapiens
gtgtgtgatgttcccc

SEQ ID NO: 122230 - DNA, 16 bp, H. sapiens
gtgtgtgcacacgcac

SEQ ID NO: 122231 - DNA, 16 bp, H. sapiens
gtgtgtgcacatgcac

SEQ ID NO: 122232 - DNA, 16 bp, H. sapiens
gtgtgtgcacgtgcgc

SEQ ID NO: 122233 - DNA, 16 bp, H. sapiens
gtgtgtgcacgtgtgc

SEQ ID NO: 122234 - DNA, 16 bp, H. sapiens
gtgtgtgcagtgtgtg

SEQ ID NO: 122235 - DNA, 16 bp, H. sapiens
gtgtgtgcatacacac

SEQ ID NO: 122236 - DNA, 16 bp, H. sapiens
gtgtgtgcatatttgt

SEQ ID NO: 122237 - DNA, 16 bp, H. sapiens
gtgtgtgcatctgtgc

SEQ ID NO: 122238 - DNA, 16 bp, H. sapiens
gtgtgtgcatgcacat

SEQ ID NO: 122239 - DNA, 16 bp, H. sapiens
gtgtgtgcatgtatat

SEQ ID NO: 122240 - DNA, 16 bp, H. sapiens
gtgtgtgcatgtgtga

SEQ ID NO: 122241 - DNA, 16 bp, H. sapiens
gtgtgtgcatgtgtgc

SEQ ID NO: 122242 - DNA, 16 bp, H. sapiens
gtgtgtgcatgtttat

SEQ ID NO: 122243 - DNA, 16 bp, H. sapiens
gtgtgtgcctgcgtgt

SEQ ID NO: 122244 - DNA, 16 bp, H. sapiens
gtgtgtgcctgtggtg

SEQ ID NO: 122245 - DNA, 16 bp, H. sapiens
gtgtgtgcctgtgtgc

SEQ ID NO: 122246 - DNA, 16 bp, H. sapiens
gtgtgtgcgtgagtgt

SEQ ID NO: 122247 - DNA, 16 bp, H. sapiens
gtgtgtgcgtgcatgc

SEQ ID NO: 122248 - DNA, 16 bp, H. sapiens
gtgtgtgcgtgtgcgt

SEQ ID NO: 122249 - DNA, 16 bp, H. sapiens
gtgtgtggagacaggg

SEQ ID NO: 122250 - DNA, 16 bp, H. sapiens
gtgtgtggcaccaccc

SEQ ID NO: 122251 - DNA, 16 bp, H. sapiens
gtgtgtggcagagctg

SEQ ID NO: 122252 - DNA, 16 bp, H. sapiens
gtgtgtggcattgtgt

SEQ ID NO: 122253 - DNA, 16 bp, H. sapiens
gtgtgtggctcatgcc

SEQ ID NO: 122254 - DNA, 16 bp, H. sapiens
gtgtgtgtacacatac

SEQ ID NO: 122255 - DNA, 16 bp, H. sapiens
gtgtgtgtacacatgc

SEQ ID NO: 122256 - DNA, 16 bp, H. sapiens
gtgtgtgtatacacat

SEQ ID NO: 122257 - DNA, 16 bp, H. sapiens
gtgtgtgtatatataa

SEQ ID NO: 122258 - DNA, 18 bp, H. sapiens
gtgtgtgtatatatacat

SEQ ID NO: 122259 - DNA, 16 bp, H. sapiens
gtgtgtgtatctgtgc

SEQ ID NO: 122260 - DNA, 16 bp, H. sapiens
gtgtgtgtatgtcttt

SEQ ID NO: 122261 - DNA, 16 bp, H. sapiens
gtgtgtgtatgtgagg

SEQ ID NO: 122262 - DNA, 16 bp, H. sapiens
gtgtgtgtatgtgatt

SEQ ID NO: 122263 - DNA, 16 bp, H. sapiens
gtgtgtgtatgtggca

SEQ ID NO: 122264 - DNA, 16 bp, H. sapiens
gtgtgtgtatgtgtgc

SEQ ID NO: 122265 - DNA, 16 bp, H. sapiens
gtgtgtgtctgcgtgt

SEQ ID NO: 122266 - DNA, 16 bp, H. sapiens
gtgtgtgtctgtctgt

SEQ ID NO: 122267 - DNA, 16 bp, H. sapiens
gtgtgtgtctgtgtct

SEQ ID NO: 122268 - DNA, 16 bp, H. sapiens
gtgtgtgtgagagaga

SEQ ID NO: 122269 - DNA, 16 bp, H. sapiens
gtgtgtgtgagcatgc

SEQ ID NO: 122270 - DNA, 16 bp, H. sapiens
gtgtgtgtgagtgaga

SEQ ID NO: 122271 - DNA, 16 bp, H. sapiens
gtgtgtgtgagtgcgc

SEQ ID NO: 122272 - DNA, 16 bp, H. sapiens
gtgtgtgtgcacacgt

SEQ ID NO: 122273 - DNA, 16 bp, H. sapiens
gtgtgtgtgcacatga

SEQ ID NO: 122274 - DNA, 16 bp, H. sapiens
gtgtgtgtgcacatgc

SEQ ID NO: 122275 - DNA, 16 bp, H. sapiens
gtgtgtgtgcacattt

SEQ ID NO: 122276 - DNA, 16 bp, H. sapiens
gtgtgtgtgcacgcat

SEQ ID NO: 122277 - DNA, 17 bp, H. sapiens
gtgtgtgtgcacgcgcg

SEQ ID NO: 122278 - DNA, 16 bp, H. sapiens
gtgtgtgtgcacgtat

SEQ ID NO: 122279 - DNA, 16 bp, H. sapiens
gtgtgtgtgcaggtgt

SEQ ID NO: 122280 - DNA, 16 bp, H. sapiens
gtgtgtgtgcatgggg

SEQ ID NO: 122281 - DNA, 16 bp, H. sapiens
gtgtgtgtgcatgtat

SEQ ID NO: 122282 - DNA, 16 bp, H. sapiens
gtgtgtgtgcatgtgc

SEQ ID NO: 122283 - DNA, 19 bp, H. sapiens
gtgtgtgtgcatgtgtgta

SEQ ID NO: 122284 - DNA, 16 bp, H. sapiens
gtgtgtgtgcattctt

SEQ ID NO: 122285 - DNA, 16 bp, H. sapiens
gtgtgtgtgcatttat

SEQ ID NO: 122286 - DNA, 16 bp, H. sapiens
gtgtgtgtgcctgcat

SEQ ID NO: 122287 - DNA, 18 bp, H. sapiens
gtgtgtgtgcgcgcgcgt

SEQ ID NO: 122288 - DNA, 16 bp, H. sapiens
gtgtgtgtgcgcgcgt

SEQ ID NO: 122289 - DNA, 16 bp, H. sapiens
gtgtgtgtgcgcgtgc

SEQ ID NO: 122290 - DNA, 17 bp, H. sapiens
gtgtgtgtgcgtgcgtg

SEQ ID NO: 122291 - DNA, 16 bp, H. sapiens
gtgtgtgtgcgtgtgc

SEQ ID NO: 122292 - DNA, 16 bp, H. sapiens
gtgtgtgtgctgtgct

SEQ ID NO: 122293 - DNA, 16 bp, H. sapiens
gtgtgtgtgcttatgt

SEQ ID NO: 122294 - DNA, 16 bp, H. sapiens
gtgtgtgtgcttctgt

SEQ ID NO: 122295 - DNA, 16 bp, H. sapiens
gtgtgtgtgggcaggg

SEQ ID NO: 122296 - DNA, 16 bp, H. sapiens
gtgtgtgtggggggca

SEQ ID NO: 122297 - DNA, 16 bp, H. sapiens
gtgtgtgtggtgagaa

SEQ ID NO: 122298 - DNA, 16 bp, H. sapiens
gtgtgtgtgtaacaga

SEQ ID NO: 122299 - DNA, 16 bp, H. sapiens
gtgtgtgtgtaagtga

SEQ ID NO: 122300 - DNA, 16 bp, H. sapiens
gtgtgtgtgtacacac

SEQ ID NO: 122301 - DNA, 16 bp, H. sapiens
gtgtgtgtgtacacat

SEQ ID NO: 122302 - DNA, 16 bp, H. sapiens
gtgtgtgtgtacacct

SEQ ID NO: 122303 - DNA, 16 bp, H. sapiens
gtgtgtgtgtacactt

SEQ ID NO: 122304 - DNA, 16 bp, H. sapiens
gtgtgtgtgtacattc

SEQ ID NO: 122305 - DNA, 16 bp, H. sapiens
gtgtgtgtgtacgtgt

SEQ ID NO: 122306 - DNA, 16 bp, H. sapiens
gtgtgtgtgtataaat

SEQ ID NO: 122307 - DNA, 16 bp, H. sapiens
gtgtgtgtgtatacaa

SEQ ID NO: 122308 - DNA, 16 bp, H. sapiens
gtgtgtgtgtatataa

SEQ ID NO: 122309 - DNA, 17 bp, H. sapiens
gtgtgtgtgtatatatg

SEQ ID NO: 122310 - DNA, 16 bp, H. sapiens
gtgtgtgtgtatcatt

SEQ ID NO: 122311 - DNA, 16 bp, H. sapiens
gtgtgtgtgtatcttc

SEQ ID NO: 122312 - DNA, 16 bp, H. sapiens
gtgtgtgtgtatgaat

SEQ ID NO: 122313 - DNA, 16 bp, H. sapiens
gtgtgtgtgtatgtga

SEQ ID NO: 122314 - DNA, 16 bp, H. sapiens
gtgtgtgtgtatgttc

SEQ ID NO: 122315 - DNA, 16 bp, H. sapiens
gtgtgtgtgtattaag

SEQ ID NO: 122316 - DNA, 16 bp, H. sapiens
gtgtgtgtgtattaga

SEQ ID NO: 122317 - DNA, 16 bp, H. sapiens
gtgtgtgtgtattcac

SEQ ID NO: 122318 - DNA, 16 bp, H. sapiens
gtgtgtgtgtattttc

SEQ ID NO: 122319 - DNA, 16 bp, H. sapiens
gtgtgtgtgtccagga

SEQ ID NO: 122320 - DNA, 16 bp, H. sapiens
gtgtgtgtgtccctgc

SEQ ID NO: 122321 - DNA, 16 bp, H. sapiens
gtgtgtgtgtccgtgt

SEQ ID NO: 122322 - DNA, 17 bp, H. sapiens
gtgtgtgtgtctctctc

SEQ ID NO: 122323 - DNA, 16 bp, H. sapiens
gtgtgtgtgtctgtgc

SEQ ID NO: 122324 - DNA, 16 bp, H. sapiens
gtgtgtgtgtgagaac

SEQ ID NO: 122325 - DNA, 16 bp, H. sapiens
gtgtgtgtgtgatgag

SEQ ID NO: 122326 - DNA, 16 bp, H. sapiens
gtgtgtgtgtgcacgc

SEQ ID NO: 122327 - DNA, 22 bp, H. sapiens
gtgtgtgtgtgcacgtgtgtgt

SEQ ID NO: 122328 - DNA, 16 bp, H. sapiens
gtgtgtgtgtgcagca

SEQ ID NO: 122329 - DNA, 16 bp, H. sapiens
gtgtgtgtgtgcaggc

SEQ ID NO: 122330 - DNA, 16 bp, H. sapiens
gtgtgtgtgtgcaggg

SEQ ID NO: 122331 - DNA, 16 bp, H. sapiens
gtgtgtgtgtgcatga

SEQ ID NO: 122332 - DNA, 16 bp, H. sapiens
gtgtgtgtgtgcatgc

SEQ ID NO: 122333 - DNA, 16 bp, H. sapiens
gtgtgtgtgtgtaaga

SEQ ID NO: 122334 - DNA, 16 bp, H. sapiens
gtgtgtgtgtgtaagt

SEQ ID NO: 122335 - DNA, 16 bp, H. sapiens
gtgtgtgtgtgtacat

SEQ ID NO: 122336 - DNA, 16 bp, H. sapiens
gtgtgtgtgtgtactc

SEQ ID NO: 122337 - DNA, 16 bp, H. sapiens
gtgtgtgtgtgtagag

SEQ ID NO: 122338 - DNA, 16 bp, H. sapiens
gtgtgtgtgtgtccat

SEQ ID NO: 122339 - DNA, 16 bp, H. sapiens
gtgtgtgtgtgtccca

SEQ ID NO: 122340 - DNA, 16 bp, H. sapiens
gtgtgtgtgtgtctat

SEQ ID NO: 122341 - DNA, 16 bp, H. sapiens
gtgtgtgtgtgtctcc

SEQ ID NO: 122342 - DNA, 16 bp, H. sapiens
gtgtgtgtgtgtctga

SEQ ID NO: 122343 - DNA, 16 bp, H. sapiens
gtgtgtgtgtgtgaac

SEQ ID NO: 122344 - DNA, 16 bp, H. sapiens
gtgtgtgtgtgtgaat

SEQ ID NO: 122345 - DNA, 16 bp, H. sapiens
gtgtgtgtgtgtgacc

SEQ ID NO: 122346 - DNA, 16 bp, H. sapiens
gtgtgtgtgtgtgata

SEQ ID NO: 122347 - DNA, 16 bp, H. sapiens
gtgtgtgtgtgtgatc

SEQ ID NO: 122348 - DNA, 16 bp, H. sapiens
gtgtgtgtgtgtgcac

SEQ ID NO: 122349 - DNA, 16 bp, H. sapiens
gtgtgtgtgtgtggaa

SEQ ID NO: 122350 - DNA, 16 bp, H. sapiens
gtgtgtgtgtgtggca

SEQ ID NO: 122351 - DNA, 18 bp, H. sapiens
gtgtgtgtgtgtgtccct

SEQ ID NO: 122352 - DNA, 16 bp, H. sapiens
gtgtgtgtgtgttcgc

SEQ ID NO: 122353 - DNA, 16 bp, H. sapiens
gtgtgtgtgtttacac

SEQ ID NO: 122354 - DNA, 16 bp, H. sapiens
gtgtgtgtgtttagag

SEQ ID NO: 122355 - DNA, 16 bp, H. sapiens
gtgtgtgtgtttattc

SEQ ID NO: 122356 - DNA, 16 bp, H. sapiens
gtgtgtgtgtttgaag

SEQ ID NO: 122357 - DNA, 16 bp, H. sapiens
gtgtgtgtgtttgcag

SEQ ID NO: 122358 - DNA, 16 bp, H. sapiens
gtgtgtgtgtttggaa

SEQ ID NO: 122359 - DNA, 16 bp, H. sapiens
gtgtgtgtgttttcaa

SEQ ID NO: 122360 - DNA, 16 bp, H. sapiens
gtgtgtgttcttcccc

SEQ ID NO: 122361 - DNA, 16 bp, H. sapiens
gtgtgtgttgtgtgca

SEQ ID NO: 122362 - DNA, 16 bp, H. sapiens
gtgtgtgttgttcccc

SEQ ID NO: 122363 - DNA, 16 bp, H. sapiens
gtgtgtgtttaaatta

SEQ ID NO: 122364 - DNA, 16 bp, H. sapiens
gtgtgttaggccattc

SEQ ID NO: 122365 - DNA, 16 bp, H. sapiens
gtgtgttagtctgttt

SEQ ID NO: 122366 - DNA, 16 bp, H. sapiens
gtgtgttcctctcgac

SEQ ID NO: 122367 - DNA, 16 bp, H. sapiens
gtgtgttgcttaattt

SEQ ID NO: 122368 - DNA, 16 bp, H. sapiens
gtgtgttgggattaca

SEQ ID NO: 122369 - DNA, 16 bp, H. sapiens
gtgtgtttatgtgtct

SEQ ID NO: 122370 - DNA, 16 bp, H. sapiens
gtgtgtttgagatgga

SEQ ID NO: 122371 - DNA, 16 bp, H. sapiens
gtgtgtttgcacacac

SEQ ID NO: 122372 - DNA, 16 bp, H. sapiens
gtgtgtttgtgaatgt

SEQ ID NO: 122373 - DNA, 16 bp, H. sapiens
gtgtgtttgtgtgcat

SEQ ID NO: 122374 - DNA, 16 bp, H. sapiens
gtgtgttttgaaaatg

SEQ ID NO: 122375 - DNA, 16 bp, H. sapiens
gtgtgtttttcccctc

SEQ ID NO: 122376 - DNA, 16 bp, H. sapiens
gtgttaattaacttga

SEQ ID NO: 122377 - DNA, 16 bp, H. sapiens
gtgttaattgaatgca

SEQ ID NO: 122378 - DNA, 16 bp, H. sapiens
gtgttacaattcttaa

SEQ ID NO: 122379 - DNA, 17 bp, H. sapiens
gtgttacagctcataaa

SEQ ID NO: 122380 - DNA, 16 bp, H. sapiens
gtgttacagtgcactc

SEQ ID NO: 122381 - DNA, 16 bp, H. sapiens
gtgttagccaggacgg

SEQ ID NO: 122382 - DNA, 16 bp, H. sapiens
gtgttagtttgctgag

SEQ ID NO: 122383 - DNA, 16 bp, H. sapiens
gtgttatggactgaat

SEQ ID NO: 122384 - DNA, 16 bp, H. sapiens
gtgttcaagaggaagc

SEQ ID NO: 122385 - DNA, 16 bp, H. sapiens
gtgttcaataaatgct

SEQ ID NO: 122386 - DNA, 16 bp, H. sapiens
gtgttcaataaatgtt

SEQ ID NO: 122387 - DNA, 16 bp, H. sapiens
gtgttcacagtgactt

SEQ ID NO: 122388 - DNA, 16 bp, H. sapiens
gtgttcagtaaatatt

SEQ ID NO: 122389 - DNA, 16 bp, H. sapiens
gtgttcagtaaatgtt

SEQ ID NO: 122390 - DNA, 16 bp, H. sapiens
gtgttcatcagcagat

SEQ ID NO: 122391 - DNA, 16 bp, H. sapiens
gtgttcatgtgttctt

SEQ ID NO: 122392 - DNA, 16 bp, H. sapiens
gtgttccaagaaaact

SEQ ID NO: 122393 - DNA, 16 bp, H. sapiens
gtgttccaggcaccac

SEQ ID NO: 122394 - DNA, 16 bp, H. sapiens
gtgttccctgatcact

SEQ ID NO: 122395 - DNA, 16 bp, H. sapiens
gtgttcctcccacctc

SEQ ID NO: 122396 - DNA, 16 bp, H. sapiens
gtgttcctgcccaaat

SEQ ID NO: 122397 - DNA, 16 bp, H. sapiens
gtgttcctggaccaaa

SEQ ID NO: 122398 - DNA, 16 bp, H. sapiens
gtgttcctgtttctcc

SEQ ID NO: 122399 - DNA, 16 bp, H. sapiens
gtgttctatatcttga

SEQ ID NO: 122400 - DNA, 16 bp, H. sapiens
gtgttctcaacacaca

SEQ ID NO: 122401 - DNA, 16 bp, H. sapiens
gtgttctccctgtgtg

SEQ ID NO: 122402 - DNA, 16 bp, H. sapiens
gtgttctctattctat

SEQ ID NO: 122403 - DNA, 16 bp, H. sapiens
gtgttctcttcaattt

SEQ ID NO: 122404 - DNA, 16 bp, H. sapiens
gtgttctgtcatgttt

SEQ ID NO: 122405 - DNA, 16 bp, H. sapiens
gtgttgccatggcaat

SEQ ID NO: 122406 - DNA, 16 bp, H. sapiens
gtgttgcccaaactgg

SEQ ID NO: 122407 - DNA, 16 bp, H. sapiens
gtgttgcccaagctgg

SEQ ID NO: 122408 - DNA, 16 bp, H. sapiens
gtgttgcccaggctga

SEQ ID NO: 122409 - DNA, 17 bp, H. sapiens
gtgttgcccaggctgga

SEQ ID NO: 122410 - DNA, 16 bp, H. sapiens
gtgttgcctaggctgg

SEQ ID NO: 122411 - DNA, 16 bp, H. sapiens
gtgttggagagaatgt

SEQ ID NO: 122412 - DNA, 16 bp, H. sapiens
gtgttggccaggcaca

SEQ ID NO: 122413 - DNA, 16 bp, H. sapiens
gtgttggccaggctgt

SEQ ID NO: 122414 - DNA, 16 bp, H. sapiens
gtgttggccatgctgg

SEQ ID NO: 122415 - DNA, 16 bp, H. sapiens
gtgttgggaaaactgc

SEQ ID NO: 122416 - DNA, 16 bp, H. sapiens
gtgttgggggagggac

SEQ ID NO: 122417 - DNA, 16 bp, H. sapiens
gtgttggtcctgcagg

SEQ ID NO: 122418 - DNA, 16 bp, H. sapiens
gtgttgtccaagttgg

SEQ ID NO: 122419 - DNA, 16 bp, H. sapiens
gtgttgtggctcacac

SEQ ID NO: 122420 - DNA, 16 bp, H. sapiens
gtgttgttcaagggtc

SEQ ID NO: 122421 - DNA, 17 bp, H. sapiens
gtgttgttccttgacac

SEQ ID NO: 122422 - DNA, 16 bp, H. sapiens
gtgttgttttcacttt

SEQ ID NO: 122423 - DNA, 16 bp, H. sapiens
gtgtttatgtaaaatt

SEQ ID NO: 122424 - DNA, 16 bp, H. sapiens
gtgtttattagccatt

SEQ ID NO: 122425 - DNA, 16 bp, H. sapiens
gtgtttatttgccatc

SEQ ID NO: 122426 - DNA, 16 bp, H. sapiens
gtgtttattttctctc

SEQ ID NO: 122427 - DNA, 16 bp, H. sapiens
gtgtttcactatgttg

SEQ ID NO: 122428 - DNA, 16 bp, H. sapiens
gtgtttccaaagtgct

SEQ ID NO: 122429 - DNA, 16 bp, H. sapiens
gtgtttccattttaaa

SEQ ID NO: 122430 - DNA, 16 bp, H. sapiens
gtgtttctcaaattgt

SEQ ID NO: 122431 - DNA, 16 bp, H. sapiens
gtgtttctcaggctgg

SEQ ID NO: 122432 - DNA, 16 bp, H. sapiens
gtgtttctctggagaa

SEQ ID NO: 122433 - DNA, 16 bp, H. sapiens
gtgtttctcttgcctc

SEQ ID NO: 122434 - DNA, 16 bp, H. sapiens
gtgtttcttaaacttt

SEQ ID NO: 122435 - DNA, 21 bp, H. sapiens
gtgtttgaacaatatgaaatc

SEQ ID NO: 122436 - DNA, 16 bp, H. sapiens
gtgtttgataaatgtt

SEQ ID NO: 122437 - DNA, 16 bp, H. sapiens
gtgtttgctaaataaa

SEQ ID NO: 122438 - DNA, 16 bp, H. sapiens
gtgtttgctggaggtc

SEQ ID NO: 122439 - DNA, 16 bp, H. sapiens
gtgtttggcttatttt

SEQ ID NO: 122440 - DNA, 16 bp, H. sapiens
gtgtttgtcaggctgg

SEQ ID NO: 122441 - DNA, 16 bp, H. sapiens
gtgtttgtgcatgtgt

SEQ ID NO: 122442 - DNA, 16 bp, H. sapiens
gtgtttgtgccactgc

SEQ ID NO: 122443 - DNA, 16 bp, H. sapiens
gtgtttgtgtccctga

SEQ ID NO: 122444 - DNA, 16 bp, H. sapiens
gtgtttgtgtgtaact

SEQ ID NO: 122445 - DNA, 16 bp, H. sapiens
gtgtttgttaaataaa

SEQ ID NO: 122446 - DNA, 16 bp, H. sapiens
gtgttttacagttttt

SEQ ID NO: 122447 - DNA, 16 bp, H. sapiens
gtgttttctagttctg

SEQ ID NO: 122448 - DNA, 16 bp, H. sapiens
gtgttttctttttcag

SEQ ID NO: 122449 - DNA, 16 bp, H. sapiens
gtgttttgaaaatatt

SEQ ID NO: 122450 - DNA, 16 bp, H. sapiens
gtgtttttaaaataaa

SEQ ID NO: 122451 - DNA, 16 bp, H. sapiens
gtgtttttaatagacc

SEQ ID NO: 122452 - DNA, 16 bp, H. sapiens
gtgtttttaatagaga

SEQ ID NO: 122453 - DNA, 16 bp, H. sapiens
gtgtttttagcagaga

SEQ ID NO: 122454 - DNA, 16 bp, H. sapiens
gtgtttttagtagaga

SEQ ID NO: 122455 - DNA, 16 bp, H. sapiens
gtgtttttcttttaaa

SEQ ID NO: 122456 - DNA, 16 bp, H. sapiens
gtgtttttgcaggaga

SEQ ID NO: 122457 - DNA, 16 bp, H. sapiens
gtgtttttggatgaga

SEQ ID NO: 122458 - DNA, 16 bp, H. sapiens
gtgtttttgttctcat

SEQ ID NO: 122459 - DNA, 16 bp, H. sapiens
gttaaaaaaaaaatcc

SEQ ID NO: 122460 - DNA, 16 bp, H. sapiens
gttaaaaaaaattgtg

SEQ ID NO: 122461 - DNA, 16 bp, H. sapiens
gttaaaaactctaaat

SEQ ID NO: 122462 - DNA, 16 bp, H. sapiens
gttaaaaataatcaaa

SEQ ID NO: 122463 - DNA, 16 bp, H. sapiens
gttaaaaatagagtta

SEQ ID NO: 122464 - DNA, 16 bp, H. sapiens
gttaaaaatgcaggtt

SEQ ID NO: 122465 - DNA, 16 bp, H. sapiens
gttaaaacttcctttt

SEQ ID NO: 122466 - DNA, 16 bp, H. sapiens
gttaaaagaaattctt

SEQ ID NO: 122467 - DNA, 16 bp, H. sapiens
gttaaaagacaaaact

SEQ ID NO: 122468 - DNA, 16 bp, H. sapiens
gttaaaagcacagact

SEQ ID NO: 122469 - DNA, 16 bp, H. sapiens
gttaaaagggaaattc

SEQ ID NO: 122470 - DNA, 16 bp, H. sapiens
gttaaaagtaaaagga

SEQ ID NO: 122471 - DNA, 16 bp, H. sapiens
gttaaaatgaagattc

SEQ ID NO: 122472 - DNA, 16 bp, H. sapiens
gttaaaatgacaaatt

SEQ ID NO: 122473 - DNA, 16 bp, H. sapiens
gttaaaatggcttaca

SEQ ID NO: 122474 - DNA, 20 bp, H. sapiens
gttaaacagtccaacaattt

SEQ ID NO: 122475 - DNA, 16 bp, H. sapiens
gttaaacatttaccag

SEQ ID NO: 122476 - DNA, 16 bp, H. sapiens
gttaaacatttgtttt

SEQ ID NO: 122477 - DNA, 16 bp, H. sapiens
gttaaacctttgtttt

SEQ ID NO: 122478 - DNA, 16 bp, H. sapiens
gttaaactctgttaaa

SEQ ID NO: 122479 - DNA, 16 bp, H. sapiens
gttaaacttttctttt

SEQ ID NO: 122480 - DNA, 16 bp, H. sapiens
gttaaagcagttctcc

SEQ ID NO: 122481 - DNA, 16 bp, H. sapiens
gttaaaggaaaaactt

SEQ ID NO: 122482 - DNA, 16 bp, H. sapiens
gttaaataaaatgtat

SEQ ID NO: 122483 - DNA, 16 bp, H. sapiens
gttaaataaattatga

SEQ ID NO: 122484 - DNA, 16 bp, H. sapiens
gttaaataggttttct

SEQ ID NO: 122485 - DNA, 16 bp, H. sapiens
gttaaatctgaatttc

SEQ ID NO: 122486 - DNA, 16 bp, H. sapiens
gttaaattgtaggaca

SEQ ID NO: 122487 - DNA, 16 bp, H. sapiens
gttaaatttgtttcta

SEQ ID NO: 122488 - DNA, 22 bp, H. sapiens
gttaacacggtgaaaccctgtc

SEQ ID NO: 122489 - DNA, 16 bp, H. sapiens
gttaaccaggctggag

SEQ ID NO: 122490 - DNA, 16 bp, H. sapiens
gttaaccattttaaag

SEQ ID NO: 122491 - DNA, 16 bp, H. sapiens
gttaactttttaaaaa

SEQ ID NO: 122492 - DNA, 16 bp, H. sapiens
gttaagaaccactgat

SEQ ID NO: 122493 - DNA, 16 bp, H. sapiens
gttaagaaccattgct

SEQ ID NO: 122494 - DNA, 16 bp, H. sapiens
gttaagataaaagatt

SEQ ID NO: 122495 - DNA, 16 bp, H. sapiens
gttaagatgataaatt

SEQ ID NO: 122496 - DNA, 16 bp, H. sapiens
gttaagcaacttgccc

SEQ ID NO: 122497 - DNA, 16 bp, H. sapiens
gttaaggatcttgaga

SEQ ID NO: 122498 - DNA, 16 bp, H. sapiens
gttaaggattttagca

SEQ ID NO: 122499 - DNA, 16 bp, H. sapiens
gttaaggcttcaacat

SEQ ID NO: 122500 - DNA, 16 bp, H. sapiens
gttaagggaacaaatt

SEQ ID NO: 122501 - DNA, 16 bp, H. sapiens
gttaagtgaaaaaagc

SEQ ID NO: 122502 - DNA, 16 bp, H. sapiens
gttaagtgaaaatgct

SEQ ID NO: 122503 - DNA, 16 bp, H. sapiens
gttaagtgacttgcct

SEQ ID NO: 122504 - DNA, 16 bp, H. sapiens
gttaagtgacttgtcc

SEQ ID NO: 122505 - DNA, 16 bp, H. sapiens
gttaatatacaaaatt

SEQ ID NO: 122506 - DNA, 16 bp, H. sapiens
gttaatattgaaatgt

SEQ ID NO: 122507 - DNA, 16 bp, H. sapiens
gttaatattgatatat

SEQ ID NO: 122508 - DNA, 16 bp, H. sapiens
gttaatgacattgaag

SEQ ID NO: 122509 - DNA, 16 bp, H. sapiens
gttaatgcagctggtg

SEQ ID NO: 122510 - DNA, 16 bp, H. sapiens
gttaattattgcctca

SEQ ID NO: 122511 - DNA, 16 bp, H. sapiens
gttaattcttaatttt

SEQ ID NO: 122512 - DNA, 16 bp, H. sapiens
gttaattgactgttta

SEQ ID NO: 122513 - DNA, 16 bp, H. sapiens
gttaattgttttctga

SEQ ID NO: 122514 - DNA, 16 bp, H. sapiens
gttaattttgcatttt

SEQ ID NO: 122515 - DNA, 16 bp, H. sapiens
gttaatttttcttcta

SEQ ID NO: 122516 - DNA, 16 bp, H. sapiens
gttaatttttgtaaag

SEQ ID NO: 122517 - DNA, 16 bp, H. sapiens
gttacaaaaagagcta

SEQ ID NO: 122518 - DNA, 16 bp, H. sapiens
gttacaaaagactgtg

SEQ ID NO: 122519 - DNA, 16 bp, H. sapiens
gttacaattcttcaaa

SEQ ID NO: 122520 - DNA, 16 bp, H. sapiens
gttacacagttccaaa

SEQ ID NO: 122521 - DNA, 16 bp, H. sapiens
gttacagagaagaaaa

SEQ ID NO: 122522 - DNA, 16 bp, H. sapiens
gttacagcagcaggaa

SEQ ID NO: 122523 - DNA, 16 bp, H. sapiens
gttacagcagtaatag

SEQ ID NO: 122524 - DNA, 17 bp, H. sapiens
gttacagctcttaaggc

SEQ ID NO: 122525 - DNA, 22 bp, H. sapiens
gttacaggagtctcttaaaaag

SEQ ID NO: 122526 - DNA, 16 bp, H. sapiens
gttacagggctttgac

SEQ ID NO: 122527 - DNA, 17 bp, H. sapiens
gttacaggtgtgagcca

SEQ ID NO: 122528 - DNA, 16 bp, H. sapiens
gttacagtttattaca

SEQ ID NO: 122529 - DNA, 22 bp, H. sapiens
gttacatatgtatacatgtgcc

SEQ ID NO: 122530 - DNA, 25 bp, H. sapiens
gttacatatgtatacatgtgccatg

SEQ ID NO: 122531 - DNA, 16 bp, H. sapiens
gttacatcccaataaa

SEQ ID NO: 122532 - DNA, 16 bp, H. sapiens
gttacatcctgataaa

SEQ ID NO: 122533 - DNA, 16 bp, H. sapiens
gttacatgaataattt

SEQ ID NO: 122534 - DNA, 16 bp, H. sapiens
gttacattatatggca

SEQ ID NO: 122535 - DNA, 16 bp, H. sapiens
gttacccaggccagag

SEQ ID NO: 122536 - DNA, 16 bp, H. sapiens
gttacctgcagtcaac

SEQ ID NO: 122537 - DNA, 16 bp, H. sapiens
gttaccttacatagca

SEQ ID NO: 122538 - DNA, 16 bp, H. sapiens
gttactgaatatttta

SEQ ID NO: 122539 - DNA, 16 bp, H. sapiens
gttactgtattgaata

SEQ ID NO: 122540 - DNA, 16 bp, H. sapiens
gttactgtatttttca

SEQ ID NO: 122541 - DNA, 16 bp, H. sapiens
gttacttaaattttct

SEQ ID NO: 122542 - DNA, 16 bp, H. sapiens
gttacttgcagctgaa

SEQ ID NO: 122543 - DNA, 16 bp, H. sapiens
gttacttgtagccaaa

SEQ ID NO: 122544 - DNA, 16 bp, H. sapiens
gttacttgttattggt

SEQ ID NO: 122545 - DNA, 16 bp, H. sapiens
gttacttttcatattt

SEQ ID NO: 122546 - DNA, 16 bp, H. sapiens
gttagaaaagaaatgg

SEQ ID NO: 122547 - DNA, 16 bp, H. sapiens
gttagaaatgtaaatt

SEQ ID NO: 122548 - DNA, 16 bp, H. sapiens
gttagaatgtaaatta

SEQ ID NO: 122549 - DNA, 16 bp, H. sapiens
gttagacatttaaaag

SEQ ID NO: 122550 - DNA, 19 bp, H. sapiens
gttagaggaattgctaact

SEQ ID NO: 122551 - DNA, 16 bp, H. sapiens
gttagatgaatggcta

SEQ ID NO: 122552 - DNA, 16 bp, H. sapiens
gttagatttttttcct

SEQ ID NO: 122553 - DNA, 18 bp, H. sapiens
gttagccaggatggtccc

SEQ ID NO: 122554 - DNA, 16 bp, H. sapiens
gttagccaggatggtt

SEQ ID NO: 122555 - DNA, 17 bp, H. sapiens
gttagccatgatggtct

SEQ ID NO: 122556 - DNA, 16 bp, H. sapiens
gttagctgagcgtggt

SEQ ID NO: 122557 - DNA, 16 bp, H. sapiens
gttaggaaaactggat

SEQ ID NO: 122558 - DNA, 16 bp, H. sapiens
gttaggaaacctgctg

SEQ ID NO: 122559 - DNA, 16 bp, H. sapiens
gttaggttggtgcaaa

SEQ ID NO: 122560 - DNA, 16 bp, H. sapiens
gttagtcatttcctgg

SEQ ID NO: 122561 - DNA, 16 bp, H. sapiens
gttagtctgttttgca

SEQ ID NO: 122562 - DNA, 16 bp, H. sapiens
gttagttcagaatctg

SEQ ID NO: 122563 - DNA, 16 bp, H. sapiens
gttagtttttgacttt

SEQ ID NO: 122564 - DNA, 16 bp, H. sapiens
gttataatttctgttc

SEQ ID NO: 122565 - DNA, 16 bp, H. sapiens
gttatactaatttata

SEQ ID NO: 122566 - DNA, 16 bp, H. sapiens
gttatagcagcaggaa

SEQ ID NO: 122567 - DNA, 16 bp, H. sapiens
gttatataagagaatg

SEQ ID NO: 122568 - DNA, 16 bp, H. sapiens
gttatatatatagtta

SEQ ID NO: 122569 - DNA, 16 bp, H. sapiens
gttatatatgtgttgt

SEQ ID NO: 122570 - DNA, 16 bp, H. sapiens
gttatatgcaagtact

SEQ ID NO: 122571 - DNA, 16 bp, H. sapiens
gttatatgtaaatact

SEQ ID NO: 122572 - DNA, 16 bp, H. sapiens
gttatcatctccattt

SEQ ID NO: 122573 - DNA, 16 bp, H. sapiens
gttatctttttaaaaa

SEQ ID NO: 122574 - DNA, 16 bp, H. sapiens
gttatgaccaaaatgc

SEQ ID NO: 122575 - DNA, 16 bp, H. sapiens
gttatgcaagatgaat

SEQ ID NO: 122576 - DNA, 16 bp, H. sapiens
gttatgctgcccaggc

SEQ ID NO: 122577 - DNA, 16 bp, H. sapiens
gttatggcaaacagat

SEQ ID NO: 122578 - DNA, 16 bp, H. sapiens
gttatggcatccctag

SEQ ID NO: 122579 - DNA, 17 bp, H. sapiens
gttatgttgcccaggct

SEQ ID NO: 122580 - DNA, 16 bp, H. sapiens
gttattaagctaatca

SEQ ID NO: 122581 - DNA, 16 bp, H. sapiens
gttattaatattgata

SEQ ID NO: 122582 - DNA, 16 bp, H. sapiens
gttattacacaccaaa

SEQ ID NO: 122583 - DNA, 16 bp, H. sapiens
gttattagagaaatgc

SEQ ID NO: 122584 - DNA, 16 bp, H. sapiens
gttattatacttttca

SEQ ID NO: 122585 - DNA, 16 bp, H. sapiens
gttattatcctcattt

SEQ ID NO: 122586 - DNA, 16 bp, H. sapiens
gttattatctccattt

SEQ ID NO: 122587 - DNA, 16 bp, H. sapiens
gttattcaggaggctg

SEQ ID NO: 122588 - DNA, 16 bp, H. sapiens
gttattgatgggcatt

SEQ ID NO: 122589 - DNA, 16 bp, H. sapiens
gttattgattttagat

SEQ ID NO: 122590 - DNA, 16 bp, H. sapiens
gttattgtaaatggaa

SEQ ID NO: 122591 - DNA, 16 bp, H. sapiens
gttatttaaaaatgta

SEQ ID NO: 122592 - DNA, 16 bp, H. sapiens
gttatttaatcaaaca

SEQ ID NO: 122593 - DNA, 16 bp, H. sapiens
gttatttaatttctct

SEQ ID NO: 122594 - DNA, 16 bp, H. sapiens
gttatttagaactttc

SEQ ID NO: 122595 - DNA, 16 bp, H. sapiens
gttatttatatattct

SEQ ID NO: 122596 - DNA, 16 bp, H. sapiens
gttatttattttgcca

SEQ ID NO: 122597 - DNA, 16 bp, H. sapiens
gttatttcctgctttt

SEQ ID NO: 122598 - DNA, 16 bp, H. sapiens
gttatttgaaaccaat

SEQ ID NO: 122599 - DNA, 16 bp, H. sapiens
gttatttggcagagtg

SEQ ID NO: 122600 - DNA, 16 bp, H. sapiens
gttattttaagccaca

SEQ ID NO: 122601 - DNA, 16 bp, H. sapiens
gttatttttcctgatc

SEQ ID NO: 122602 - DNA, 16 bp, H. sapiens
gttcaaaattcaaaag

SEQ ID NO: 122603 - DNA, 16 bp, H. sapiens
gttcaaacccatcgca

SEQ ID NO: 122604 - DNA, 16 bp, H. sapiens
gttcaaagaggagctg

SEQ ID NO: 122605 - DNA, 16 bp, H. sapiens
gttcaaagcccagctc

SEQ ID NO: 122606 - DNA, 16 bp, H. sapiens
gttcaaataaggcaaa

SEQ ID NO: 122607 - DNA, 16 bp, H. sapiens
gttcaaatcccagctc

SEQ ID NO: 122608 - DNA, 16 bp, H. sapiens
gttcaaatcctgcctt

SEQ ID NO: 122609 - DNA, 16 bp, H. sapiens
gttcaaatgactctcc

SEQ ID NO: 122610 - DNA, 16 bp, H. sapiens
gttcaacaacagcctg

SEQ ID NO: 122611 - DNA, 16 bp, H. sapiens
gttcaacacacacaaa

SEQ ID NO: 122612 - DNA, 16 bp, H. sapiens
gttcaagaaattttcc

SEQ ID NO: 122613 - DNA, 16 bp, H. sapiens
gttcaagaccaacctt

SEQ ID NO: 122614 - DNA, 16 bp, H. sapiens
gttcaagaccagacag

SEQ ID NO: 122615 - DNA, 16 bp, H. sapiens
gttcaagaccagtgtg

SEQ ID NO: 122616 - DNA, 16 bp, H. sapiens
gttcaagagcagtctg

SEQ ID NO: 122617 - DNA, 16 bp, H. sapiens
gttcaagatcagcctg

SEQ ID NO: 122618 - DNA, 16 bp, H. sapiens
gttcaagatcagcttg

SEQ ID NO: 122619 - DNA, 16 bp, H. sapiens
gttcaagcagttctgc

SEQ ID NO: 122620 - DNA, 16 bp, H. sapiens
gttcaagccagtctcc

SEQ ID NO: 122621 - DNA, 16 bp, H. sapiens
gttcaagcgatcctcc

SEQ ID NO: 122622 - DNA, 16 bp, H. sapiens
gttcaagggcaagaag

SEQ ID NO: 122623 - DNA, 16 bp, H. sapiens
gttcaagtcattctcc

SEQ ID NO: 122624 - DNA, 16 bp, H. sapiens
gttcaagtcctgactc

SEQ ID NO: 122625 - DNA, 16 bp, H. sapiens
gttcaagtcctgcctc

SEQ ID NO: 122626 - DNA, 16 bp, H. sapiens
gttcaagtcttctgtt

SEQ ID NO: 122627 - DNA, 16 bp, H. sapiens
gttcaagtgaatctcc

SEQ ID NO: 122628 - DNA, 16 bp, H. sapiens
gttcaagtgactcttc

SEQ ID NO: 122629 - DNA, 16 bp, H. sapiens
gttcaagtgatctttc

SEQ ID NO: 122630 - DNA, 16 bp, H. sapiens
gttcaagtgtttctca

SEQ ID NO: 122631 - DNA, 16 bp, H. sapiens
gttcaataaatattta

SEQ ID NO: 122632 - DNA, 16 bp, H. sapiens
gttcaataaatgatgc

SEQ ID NO: 122633 - DNA, 16 bp, H. sapiens
gttcaatccattctcc

SEQ ID NO: 122634 - DNA, 16 bp, H. sapiens
gttcaatgtacacaaa

SEQ ID NO: 122635 - DNA, 16 bp, H. sapiens
gttcaattgttttaga

SEQ ID NO: 122636 - DNA, 16 bp, H. sapiens
gttcacagaactcagg

SEQ ID NO: 122637 - DNA, 16 bp, H. sapiens
gttcacagctggagag

SEQ ID NO: 122638 - DNA, 16 bp, H. sapiens
gttcacagtcccacca

SEQ ID NO: 122639 - DNA, 16 bp, H. sapiens
gttcacagttctggag

SEQ ID NO: 122640 - DNA, 16 bp, H. sapiens
gttcaccacaacctct

SEQ ID NO: 122641 - DNA, 16 bp, H. sapiens
gttcaccttgcctgct

SEQ ID NO: 122642 - DNA, 16 bp, H. sapiens
gttcacgccactctcc

SEQ ID NO: 122643 - DNA, 17 bp, H. sapiens
gttcacgcctgtaatct

SEQ ID NO: 122644 - DNA, 16 bp, H. sapiens
gttcactcttggtgtt

SEQ ID NO: 122645 - DNA, 16 bp, H. sapiens
gttcactgcagcctcc

SEQ ID NO: 122646 - DNA, 16 bp, H. sapiens
gttcactgcagcctcg

SEQ ID NO: 122647 - DNA, 16 bp, H. sapiens
gttcagaaaaggcaaa

SEQ ID NO: 122648 - DNA, 16 bp, H. sapiens
gttcagaaaataaaat

SEQ ID NO: 122649 - DNA, 16 bp, H. sapiens
gttcagagaccagcct

SEQ ID NO: 122650 - DNA, 16 bp, H. sapiens
gttcagagttccacag

SEQ ID NO: 122651 - DNA, 16 bp, H. sapiens
gttcagatttttcttg

SEQ ID NO: 122652 - DNA, 16 bp, H. sapiens
gttcagcaaatattta

SEQ ID NO: 122653 - DNA, 16 bp, H. sapiens
gttcagcctcccaagt

SEQ ID NO: 122654 - DNA, 16 bp, H. sapiens
gttcagctgtgccctg

SEQ ID NO: 122655 - DNA, 16 bp, H. sapiens
gttcagctttagtaga

SEQ ID NO: 122656 - DNA, 16 bp, H. sapiens
gttcaggagatggaga

SEQ ID NO: 122657 - DNA, 16 bp, H. sapiens
gttcaggaggccagaa

SEQ ID NO: 122658 - DNA, 16 bp, H. sapiens
gttcagtatatgcaaa

SEQ ID NO: 122659 - DNA, 16 bp, H. sapiens
gttcagtattatgttg

SEQ ID NO: 122660 - DNA, 16 bp, H. sapiens
gttcagtattttttca

SEQ ID NO: 122661 - DNA, 16 bp, H. sapiens
gttcagtggtaataaa

SEQ ID NO: 122662 - DNA, 16 bp, H. sapiens
gttcagtgtatactgt

SEQ ID NO: 122663 - DNA, 16 bp, H. sapiens
gttcagttaatttgct

SEQ ID NO: 122664 - DNA, 16 bp, H. sapiens
gttcagttcctggata

SEQ ID NO: 122665 - DNA, 16 bp, H. sapiens
gttcagtttcttttct

SEQ ID NO: 122666 - DNA, 16 bp, H. sapiens
gttcataatattttct

SEQ ID NO: 122667 - DNA, 16 bp, H. sapiens
gttcatagcagcatta

SEQ ID NO: 122668 - DNA, 16 bp, H. sapiens
gttcatccatgatgta

SEQ ID NO: 122669 - DNA, 16 bp, H. sapiens
gttcatccattcatcc

SEQ ID NO: 122670 - DNA, 16 bp, H. sapiens
gttcatctcactgagg

SEQ ID NO: 122671 - DNA, 16 bp, H. sapiens
gttcatgaaaatccac

SEQ ID NO: 122672 - DNA, 16 bp, H. sapiens
gttcatgaggtttaaa

SEQ ID NO: 122673 - DNA, 16 bp, H. sapiens
gttcatgccatgctcc

SEQ ID NO: 122674 - DNA, 16 bp, H. sapiens
gttcatgtcactatca

SEQ ID NO: 122675 - DNA, 16 bp, H. sapiens
gttcatgtctttcacc

SEQ ID NO: 122676 - DNA, 16 bp, H. sapiens
gttcattcacttattc

SEQ ID NO: 122677 - DNA, 16 bp, H. sapiens
gttcattcattatttg

SEQ ID NO: 122678 - DNA, 16 bp, H. sapiens
gttcattcattcagcc

SEQ ID NO: 122679 - DNA, 16 bp, H. sapiens
gttcattcattcattc

SEQ ID NO: 122680 - DNA, 16 bp, H. sapiens
gttcattcatttaaca

SEQ ID NO: 122681 - DNA, 16 bp, H. sapiens
gttcattgattgtaac

SEQ ID NO: 122682 - DNA, 16 bp, H. sapiens
gttcattgtagatttt

SEQ ID NO: 122683 - DNA, 16 bp, H. sapiens
gttcatttattcaaca

SEQ ID NO: 122684 - DNA, 16 bp, H. sapiens
gttccaaagctgaaga

SEQ ID NO: 122685 - DNA, 16 bp, H. sapiens
gttccaatcccagctc

SEQ ID NO: 122686 - DNA, 16 bp, H. sapiens
gttccaccacacctgg

SEQ ID NO: 122687 - DNA, 16 bp, H. sapiens
gttccacccaccttgg

SEQ ID NO: 122688 - DNA, 16 bp, H. sapiens
gttccagaccagccag

SEQ ID NO: 122689 - DNA, 16 bp, H. sapiens
gttccagcctctgccc

SEQ ID NO: 122690 - DNA, 16 bp, H. sapiens
gttccagcctgggtga

SEQ ID NO: 122691 - DNA, 16 bp, H. sapiens
gttccagctttggcca

SEQ ID NO: 122692 - DNA, 16 bp, H. sapiens
gttccaggacccccag

SEQ ID NO: 122693 - DNA, 16 bp, H. sapiens
gttccaggacccctgt

SEQ ID NO: 122694 - DNA, 16 bp, H. sapiens
gttccaggcactgtgc

SEQ ID NO: 122695 - DNA, 16 bp, H. sapiens
gttccaggcagaggaa

SEQ ID NO: 122696 - DNA, 16 bp, H. sapiens
gttccaggtgcagggg

SEQ ID NO: 122697 - DNA, 16 bp, H. sapiens
gttccagtggtggtgg

SEQ ID NO: 122698 - DNA, 16 bp, H. sapiens
gttccatataattttt

SEQ ID NO: 122699 - DNA, 16 bp, H. sapiens
gttccatcaatacctg

SEQ ID NO: 122700 - DNA, 16 bp, H. sapiens
gttccatccagaaagg

SEQ ID NO: 122701 - DNA, 16 bp, H. sapiens
gttccatctactgaga

SEQ ID NO: 122702 - DNA, 16 bp, H. sapiens
gttccatctgcctgga

SEQ ID NO: 122703 - DNA, 16 bp, H. sapiens
gttccatgaaggcaga

SEQ ID NO: 122704 - DNA, 16 bp, H. sapiens
gttccatgactttgct

SEQ ID NO: 122705 - DNA, 16 bp, H. sapiens
gttccatgattttgct

SEQ ID NO: 122706 - DNA, 16 bp, H. sapiens
gttccatgggctgtac

SEQ ID NO: 122707 - DNA, 16 bp, H. sapiens
gttccatgtggctggg

SEQ ID NO: 122708 - DNA, 16 bp, H. sapiens
gttccattctccctat

SEQ ID NO: 122709 - DNA, 16 bp, H. sapiens
gttccattcttctgca

SEQ ID NO: 122710 - DNA, 16 bp, H. sapiens
gttccattgttctgta

SEQ ID NO: 122711 - DNA, 16 bp, H. sapiens
gttccatttgatgatg

SEQ ID NO: 122712 - DNA, 16 bp, H. sapiens
gttcccaataacttcc

SEQ ID NO: 122713 - DNA, 16 bp, H. sapiens
gttcccacaaaagaca

SEQ ID NO: 122714 - DNA, 16 bp, H. sapiens
gttcccaccagccaga

SEQ ID NO: 122715 - DNA, 16 bp, H. sapiens
gttcccactgcctgga

SEQ ID NO: 122716 - DNA, 16 bp, H. sapiens
gttcccaggctggtct

SEQ ID NO: 122717 - DNA, 16 bp, H. sapiens
gttcccaggtgatgcc

SEQ ID NO: 122718 - DNA, 16 bp, H. sapiens
gttcccattccatgtg

SEQ ID NO: 122719 - DNA, 16 bp, H. sapiens
gttccccaggctggag

SEQ ID NO: 122720 - DNA, 16 bp, H. sapiens
gttcccgtaatcccca

SEQ ID NO: 122721 - DNA, 16 bp, H. sapiens
gttccctcaataccta

SEQ ID NO: 122722 - DNA, 16 bp, H. sapiens
gttccctctgcctggg

SEQ ID NO: 122723 - DNA, 16 bp, H. sapiens
gttccctgcctccaga

SEQ ID NO: 122724 - DNA, 16 bp, H. sapiens
gttcccttccatgcct

SEQ ID NO: 122725 - DNA, 16 bp, H. sapiens
gttccctttgcctgga

SEQ ID NO: 122726 - DNA, 16 bp, H. sapiens
gttccgcagggctggg

SEQ ID NO: 122727 - DNA, 16 bp, H. sapiens
gttcctaacaggccac

SEQ ID NO: 122728 - DNA, 16 bp, H. sapiens
gttcctatagtcccag

SEQ ID NO: 122729 - DNA, 16 bp, H. sapiens
gttcctccctcaacac

SEQ ID NO: 122730 - DNA, 16 bp, H. sapiens
gttcctcttcctcctg

SEQ ID NO: 122731 - DNA, 16 bp, H. sapiens
gttcctgataaaagga

SEQ ID NO: 122732 - DNA, 16 bp, H. sapiens
gttcctgcagggaagc

SEQ ID NO: 122733 - DNA, 16 bp, H. sapiens
gttcctgccctaccct

SEQ ID NO: 122734 - DNA, 16 bp, H. sapiens
gttcctgcctcagggc

SEQ ID NO: 122735 - DNA, 16 bp, H. sapiens
gttcctgcctttccca

SEQ ID NO: 122736 - DNA, 16 bp, H. sapiens
gttcctggagcagcag

SEQ ID NO: 122737 - DNA, 16 bp, H. sapiens
gttcctgggccaaatg

SEQ ID NO: 122738 - DNA, 16 bp, H. sapiens
gttcctgggtgtatct

SEQ ID NO: 122739 - DNA, 16 bp, H. sapiens
gttccttaaaaacagc

SEQ ID NO: 122740 - DNA, 16 bp, H. sapiens
gttccttaaatatttt

SEQ ID NO: 122741 - DNA, 16 bp, H. sapiens
gttccttacatatttt

SEQ ID NO: 122742 - DNA, 16 bp, H. sapiens
gttccttccagctctg

SEQ ID NO: 122743 - DNA, 16 bp, H. sapiens
gttccttcctccactg

SEQ ID NO: 122744 - DNA, 16 bp, H. sapiens
gttccttctagattct

SEQ ID NO: 122745 - DNA, 16 bp, H. sapiens
gttccttctcatttgg

SEQ ID NO: 122746 - DNA, 16 bp, H. sapiens
gttccttctggaggct

SEQ ID NO: 122747 - DNA, 16 bp, H. sapiens
gttccttggagaaatg

SEQ ID NO: 122748 - DNA, 16 bp, H. sapiens
gttccttgtatatttt

SEQ ID NO: 122749 - DNA, 16 bp, H. sapiens
gttcctttgcatgttt

SEQ ID NO: 122750 - DNA, 16 bp, H. sapiens
gttcctttggagaaga

SEQ ID NO: 122751 - DNA, 16 bp, H. sapiens
gttccttttcattatt

SEQ ID NO: 122752 - DNA, 16 bp, H. sapiens
gttcctttttctccac

SEQ ID NO: 122753 - DNA, 16 bp, H. sapiens
gttcgagacaagcctg

SEQ ID NO: 122754 - DNA, 16 bp, H. sapiens
gttcgagaccaacgtg

SEQ ID NO: 122755 - DNA, 16 bp, H. sapiens
gttcgagatcagccag

SEQ ID NO: 122756 - DNA, 16 bp, H. sapiens
gttcgagattagcctg

SEQ ID NO: 122757 - DNA, 16 bp, H. sapiens
gttcgggatcagcctg

SEQ ID NO: 122758 - DNA, 16 bp, H. sapiens
gttctaaaagtttttt

SEQ ID NO: 122759 - DNA, 16 bp, H. sapiens
gttctaaacatggaaa

SEQ ID NO: 122760 - DNA, 16 bp, H. sapiens
gttctaagaaatgcat

SEQ ID NO: 122761 - DNA, 16 bp, H. sapiens
gttctaagtactttac

SEQ ID NO: 122762 - DNA, 16 bp, H. sapiens
gttctaatttgcattt

SEQ ID NO: 122763 - DNA, 16 bp, H. sapiens
gttctagaggaacaga

SEQ ID NO: 122764 - DNA, 16 bp, H. sapiens
gttctagccaaagcaa

SEQ ID NO: 122765 - DNA, 16 bp, H. sapiens
gttctatagcactata

SEQ ID NO: 122766 - DNA, 16 bp, H. sapiens
gttctattgcatagta

SEQ ID NO: 122767 - DNA, 16 bp, H. sapiens
gttctcaaactcctga

SEQ ID NO: 122768 - DNA, 16 bp, H. sapiens
gttctcaaggagaatg

SEQ ID NO: 122769 - DNA, 16 bp, H. sapiens
gttctcaataaatgtt

SEQ ID NO: 122770 - DNA, 16 bp, H. sapiens
gttctcagatctcaga

SEQ ID NO: 122771 - DNA, 16 bp, H. sapiens
gttctcagccctggct

SEQ ID NO: 122772 - DNA, 16 bp, H. sapiens
gttctcatgcctcagc

SEQ ID NO: 122773 - DNA, 16 bp, H. sapiens
gttctcatgctgccaa

SEQ ID NO: 122774 - DNA, 16 bp, H. sapiens
gttctcatgctgtttt

SEQ ID NO: 122775 - DNA, 16 bp, H. sapiens
gttctcattctgtctt

SEQ ID NO: 122776 - DNA, 16 bp, H. sapiens
gttctcatttttttaa

SEQ ID NO: 122777 - DNA, 16 bp, H. sapiens
gttctccaactcctga

SEQ ID NO: 122778 - DNA, 16 bp, H. sapiens
gttctccaagtcccca

SEQ ID NO: 122779 - DNA, 16 bp, H. sapiens
gttctccacctcccca

SEQ ID NO: 122780 - DNA, 16 bp, H. sapiens
gttctccagcctcctc

SEQ ID NO: 122781 - DNA, 18 bp, H. sapiens
gttctcctgcctcagccc

SEQ ID NO: 122782 - DNA, 19 bp, H. sapiens
gttctcctgcctcagcctc

SEQ ID NO: 122783 - DNA, 19 bp, H. sapiens
gttctcctgcctcagcctt

SEQ ID NO: 122784 - DNA, 16 bp, H. sapiens
gttctccttgcctgct

SEQ ID NO: 122785 - DNA, 16 bp, H. sapiens
gttctcgatctcctga

SEQ ID NO: 122786 - DNA, 16 bp, H. sapiens
gttctcgtgcctcagc

SEQ ID NO: 122787 - DNA, 16 bp, H. sapiens
gttctctcacagttct

SEQ ID NO: 122788 - DNA, 16 bp, H. sapiens
gttctctgaccacaac

SEQ ID NO: 122789 - DNA, 16 bp, H. sapiens
gttctctgcctccaga

SEQ ID NO: 122790 - DNA, 16 bp, H. sapiens
gttctctgctcttgaa

SEQ ID NO: 122791 - DNA, 16 bp, H. sapiens
gttctctggatttcct

SEQ ID NO: 122792 - DNA, 16 bp, H. sapiens
gttctctggatttctt

SEQ ID NO: 122793 - DNA, 16 bp, H. sapiens
gttctcttgctggtga

SEQ ID NO: 122794 - DNA, 16 bp, H. sapiens
gttctcttttatggct

SEQ ID NO: 122795 - DNA, 16 bp, H. sapiens
gttctgaaacactctt

SEQ ID NO: 122796 - DNA, 16 bp, H. sapiens
gttctgaagtctgctt

SEQ ID NO: 122797 - DNA, 16 bp, H. sapiens
gttctgaatatccttg

SEQ ID NO: 122798 - DNA, 16 bp, H. sapiens
gttctgagaacatgtg

SEQ ID NO: 122799 - DNA, 16 bp, H. sapiens
gttctgaggacagaga

SEQ ID NO: 122800 - DNA, 16 bp, H. sapiens
gttctgcagcctctgc

SEQ ID NO: 122801 - DNA, 16 bp, H. sapiens
gttctgcaggctggac

SEQ ID NO: 122802 - DNA, 16 bp, H. sapiens
gttctgcctttctgga

SEQ ID NO: 122803 - DNA, 16 bp, H. sapiens
gttctggaccccactc

SEQ ID NO: 122804 - DNA, 16 bp, H. sapiens
gttctggacctcaagg

SEQ ID NO: 122805 - DNA, 16 bp, H. sapiens
gttctggaggacagtg

SEQ ID NO: 122806 - DNA, 16 bp, H. sapiens
gttctggaggccagaa

SEQ ID NO: 122807 - DNA, 16 bp, H. sapiens
gttctggaggctggag

SEQ ID NO: 122808 - DNA, 16 bp, H. sapiens
gttctggaggtggatg

SEQ ID NO: 122809 - DNA, 16 bp, H. sapiens
gttctggccagagcaa

SEQ ID NO: 122810 - DNA, 16 bp, H. sapiens
gttctggctcagggtc

SEQ ID NO: 122811 - DNA, 16 bp, H. sapiens
gttctgggccccactc

SEQ ID NO: 122812 - DNA, 16 bp, H. sapiens
gttctgggctcagaat

SEQ ID NO: 122813 - DNA, 16 bp, H. sapiens
gttctggtaccagtac

SEQ ID NO: 122814 - DNA, 16 bp, H. sapiens
gttctgtcacctaggc

SEQ ID NO: 122815 - DNA, 16 bp, H. sapiens
gttctgtccagggcaa

SEQ ID NO: 122816 - DNA, 16 bp, H. sapiens
gttctgtccttctaga

SEQ ID NO: 122817 - DNA, 16 bp, H. sapiens
gttctgtcgcccaggc

SEQ ID NO: 122818 - DNA, 16 bp, H. sapiens
gttctgtttctctggg

SEQ ID NO: 122819 - DNA, 16 bp, H. sapiens
gttcttaaaccacaaa

SEQ ID NO: 122820 - DNA, 16 bp, H. sapiens
gttcttaaagaaaaga

SEQ ID NO: 122821 - DNA, 16 bp, H. sapiens
gttcttaaaggtggtg

SEQ ID NO: 122822 - DNA, 21 bp, H. sapiens
gttcttagaccaaggaaaata

SEQ ID NO: 122823 - DNA, 16 bp, H. sapiens
gttcttcagtttttgg

SEQ ID NO: 122824 - DNA, 16 bp, H. sapiens
gttcttccatttgtgt

SEQ ID NO: 122825 - DNA, 16 bp, H. sapiens
gttcttcccccacctg

SEQ ID NO: 122826 - DNA, 16 bp, H. sapiens
gttcttcttgcctgct

SEQ ID NO: 122827 - DNA, 16 bp, H. sapiens
gttcttgaactcttgg

SEQ ID NO: 122828 - DNA, 16 bp, H. sapiens
gttcttgaggctggaa

SEQ ID NO: 122829 - DNA, 16 bp, H. sapiens
gttcttggacctcaca

SEQ ID NO: 122830 - DNA, 16 bp, H. sapiens
gttcttgggcgtacct

SEQ ID NO: 122831 - DNA, 16 bp, H. sapiens
gttcttgtcaggtttg

SEQ ID NO: 122832 - DNA, 16 bp, H. sapiens
gttcttgtcctttgca

SEQ ID NO: 122833 - DNA, 16 bp, H. sapiens
gttcttgtgattgtga

SEQ ID NO: 122834 - DNA, 16 bp, H. sapiens
gttcttgttttttaaa

SEQ ID NO: 122835 - DNA, 16 bp, H. sapiens
gttctttaaaatatat

SEQ ID NO: 122836 - DNA, 16 bp, H. sapiens
gttctttaagaaattt

SEQ ID NO: 122837 - DNA, 16 bp, H. sapiens
gttctttaagatgtat

SEQ ID NO: 122838 - DNA, 16 bp, H. sapiens
gttctttaaggaattt

SEQ ID NO: 122839 - DNA, 16 bp, H. sapiens
gttctttagtggcgat

SEQ ID NO: 122840 - DNA, 16 bp, H. sapiens
gttctttatacatttt

SEQ ID NO: 122841 - DNA, 16 bp, H. sapiens
gttctttgaaaaaaaa

SEQ ID NO: 122842 - DNA, 16 bp, H. sapiens
gttctttggcttagga

SEQ ID NO: 122843 - DNA, 16 bp, H. sapiens
gttctttgtacatttt

SEQ ID NO: 122844 - DNA, 16 bp, H. sapiens
gttctttgtagattgt

SEQ ID NO: 122845 - DNA, 16 bp, H. sapiens
gttctttgtagcttct

SEQ ID NO: 122846 - DNA, 16 bp, H. sapiens
gttctttgttcctatt

SEQ ID NO: 122847 - DNA, 16 bp, H. sapiens
gttcttttaattctga

SEQ ID NO: 122848 - DNA, 16 bp, H. sapiens
gttcttttccatgttt

SEQ ID NO: 122849 - DNA, 16 bp, H. sapiens
gttcttttgtcttagg

SEQ ID NO: 122850 - DNA, 16 bp, H. sapiens
gttctttttgcttagt

SEQ ID NO: 122851 - DNA, 16 bp, H. sapiens
gttgaaaaactaccta

SEQ ID NO: 122852 - DNA, 16 bp, H. sapiens
gttgaaaaactacctg

SEQ ID NO: 122853 - DNA, 16 bp, H. sapiens
gttgaaaaaggaaata

SEQ ID NO: 122854 - DNA, 16 bp, H. sapiens
gttgaaaatactgtaa

SEQ ID NO: 122855 - DNA, 16 bp, H. sapiens
gttgaaaatgaaagga

SEQ ID NO: 122856 - DNA, 16 bp, H. sapiens
gttgaaaatgcattta

SEQ ID NO: 122857 - DNA, 16 bp, H. sapiens
gttgaaacaaaaagga

SEQ ID NO: 122858 - DNA, 16 bp, H. sapiens
gttgaaactggacccc

SEQ ID NO: 122859 - DNA, 16 bp, H. sapiens
gttgaaactttgtttt

SEQ ID NO: 122860 - DNA, 16 bp, H. sapiens
gttgaaagaaattgaa

SEQ ID NO: 122861 - DNA, 16 bp, H. sapiens
gttgaaagaattaata

SEQ ID NO: 122862 - DNA, 16 bp, H. sapiens
gttgaaagtaaaagga

SEQ ID NO: 122863 - DNA, 16 bp, H. sapiens
gttgaaataatttaaa

SEQ ID NO: 122864 - DNA, 16 bp, H. sapiens
gttgaacatacctggc

SEQ ID NO: 122865 - DNA, 16 bp, H. sapiens
gttgaacatctttcat

SEQ ID NO: 122866 - DNA, 16 bp, H. sapiens
gttgaacccaggaggc

SEQ ID NO: 122867 - DNA, 16 bp, H. sapiens
gttgaacccaggaggt

SEQ ID NO: 122868 - DNA, 16 bp, H. sapiens
gttgaacctgggaggc

SEQ ID NO: 122869 - DNA, 16 bp, H. sapiens
gttgaactaatgtaca

SEQ ID NO: 122870 - DNA, 16 bp, H. sapiens
gttgaagaggttttaa

SEQ ID NO: 122871 - DNA, 16 bp, H. sapiens
gttgaagcttttgaat

SEQ ID NO: 122872 - DNA, 16 bp, H. sapiens
gttgaaggaaagaagc

SEQ ID NO: 122873 - DNA, 16 bp, H. sapiens
gttgaagtcctaactt

SEQ ID NO: 122874 - DNA, 16 bp, H. sapiens
gttgaagtcttcaact

SEQ ID NO: 122875 - DNA, 16 bp, H. sapiens
gttgaatctctgaaga

SEQ ID NO: 122876 - DNA, 22 bp, H. sapiens
gttgaatctctgaatagacgaa

SEQ ID NO: 122877 - DNA, 16 bp, H. sapiens
gttgaatctgtggatg

SEQ ID NO: 122878 - DNA, 16 bp, H. sapiens
gttgaatgaatgaata

SEQ ID NO: 122879 - DNA, 16 bp, H. sapiens
gttgaatgaatgaatt

SEQ ID NO: 122880 - DNA, 16 bp, H. sapiens
gttgaattttgtcaga

SEQ ID NO: 122881 - DNA, 16 bp, H. sapiens
gttgacagaagaaggc

SEQ ID NO: 122882 - DNA, 16 bp, H. sapiens
gttgactatagtcaat

SEQ ID NO: 122883 - DNA, 16 bp, H. sapiens
gttgactttctatctt

SEQ ID NO: 122884 - DNA, 16 bp, H. sapiens
gttgagaaacactgct

SEQ ID NO: 122885 - DNA, 16 bp, H. sapiens
gttgagaaccactact

SEQ ID NO: 122886 - DNA, 16 bp, H. sapiens
gttgagaaccattgct

SEQ ID NO: 122887 - DNA, 16 bp, H. sapiens
gttgagaactactgct

SEQ ID NO: 122888 - DNA, 16 bp, H. sapiens
gttgagagaaatgtaa

SEQ ID NO: 122889 - DNA, 17 bp, H. sapiens
gttgagagagagagaga

SEQ ID NO: 122890 - DNA, 16 bp, H. sapiens
gttgagcatccctaat

SEQ ID NO: 122891 - DNA, 16 bp, H. sapiens
gttgagcatctctaat

SEQ ID NO: 122892 - DNA, 16 bp, H. sapiens
gttgagcattttttca

SEQ ID NO: 122893 - DNA, 16 bp, H. sapiens
gttgagcccaggaggt

SEQ ID NO: 122894 - DNA, 16 bp, H. sapiens
gttgagcccaggagtt

SEQ ID NO: 122895 - DNA, 16 bp, H. sapiens
gttgagcggggtaagg

SEQ ID NO: 122896 - DNA, 16 bp, H. sapiens
gttgaggaaactgagg

SEQ ID NO: 122897 - DNA, 16 bp, H. sapiens
gttgaggcaagaggat

SEQ ID NO: 122898 - DNA, 16 bp, H. sapiens
gttgaggccaggagtt

SEQ ID NO: 122899 - DNA, 16 bp, H. sapiens
gttgaggccgggtgca

SEQ ID NO: 122900 - DNA, 16 bp, H. sapiens
gttgaggctgtagtga

SEQ ID NO: 122901 - DNA, 16 bp, H. sapiens
gttgaggctgtggtga

SEQ ID NO: 122902 - DNA, 16 bp, H. sapiens
gttgaggtcaggagtt

SEQ ID NO: 122903 - DNA, 16 bp, H. sapiens
gttgaggttgcagtga

SEQ ID NO: 122904 - DNA, 16 bp, H. sapiens
gttgagtatccctcat

SEQ ID NO: 122905 - DNA, 16 bp, H. sapiens
gttgagtgaataaatg

SEQ ID NO: 122906 - DNA, 16 bp, H. sapiens
gttgagttgtatgagt

SEQ ID NO: 122907 - DNA, 16 bp, H. sapiens
gttgataattgttgaa

SEQ ID NO: 122908 - DNA, 16 bp, H. sapiens
gttgatctttttaaaa

SEQ ID NO: 122909 - DNA, 16 bp, H. sapiens
gttgatggatatttgg

SEQ ID NO: 122910 - DNA, 16 bp, H. sapiens
gttgatgggaatgtga

SEQ ID NO: 122911 - DNA, 16 bp, H. sapiens
gttgatggtgatggtg

SEQ ID NO: 122912 - DNA, 16 bp, H. sapiens
gttgatgttgatggta

SEQ ID NO: 122913 - DNA, 16 bp, H. sapiens
gttgattaatgggtac

SEQ ID NO: 122914 - DNA, 16 bp, H. sapiens
gttgattctcattatt

SEQ ID NO: 122915 - DNA, 16 bp, H. sapiens
gttgattctttctcat

SEQ ID NO: 122916 - DNA, 16 bp, H. sapiens
gttgatttcaaccctc

SEQ ID NO: 122917 - DNA, 16 bp, H. sapiens
gttgatttctgcattt

SEQ ID NO: 122918 - DNA, 16 bp, H. sapiens
gttgatttttatcaaa

SEQ ID NO: 122919 - DNA, 16 bp, H. sapiens
gttgatttttgtatga

SEQ ID NO: 122920 - DNA, 16 bp, H. sapiens
gttgattttttaaaaa

SEQ ID NO: 122921 - DNA, 17 bp, H. sapiens
gttgcaaagaaaaagga

SEQ ID NO: 122922 - DNA, 16 bp, H. sapiens
gttgcaaagagctgag

SEQ ID NO: 122923 - DNA, 16 bp, H. sapiens
gttgcaagagttcttt

SEQ ID NO: 122924 - DNA, 16 bp, H. sapiens
gttgcaattacttttg

SEQ ID NO: 122925 - DNA, 16 bp, H. sapiens
gttgcaccactgcact

SEQ ID NO: 122926 - DNA, 16 bp, H. sapiens
gttgcactccagcctg

SEQ ID NO: 122927 - DNA, 16 bp, H. sapiens
gttgcagaaggaatgg

SEQ ID NO: 122928 - DNA, 16 bp, H. sapiens
gttgcagagaaaatgg

SEQ ID NO: 122929 - DNA, 16 bp, H. sapiens
gttgcaggaagctgag

SEQ ID NO: 122930 - DNA, 16 bp, H. sapiens
gttgcagggagtggag

SEQ ID NO: 122931 - DNA, 16 bp, H. sapiens
gttgcagtaaagaagc

SEQ ID NO: 122932 - DNA, 16 bp, H. sapiens
gttgcagtgagcaggg

SEQ ID NO: 122933 - DNA, 16 bp, H. sapiens
gttgcattttccaaaa

SEQ ID NO: 122934 - DNA, 16 bp, H. sapiens
gttgccactgctggct

SEQ ID NO: 122935 - DNA, 16 bp, H. sapiens
gttgccactgcttttg

SEQ ID NO: 122936 - DNA, 16 bp, H. sapiens
gttgccaggttggagt

SEQ ID NO: 122937 - DNA, 16 bp, H. sapiens
gttgccagttcactct

SEQ ID NO: 122938 - DNA, 16 bp, H. sapiens
gttgccatggcaatga

SEQ ID NO: 122939 - DNA, 16 bp, H. sapiens
gttgccatggcaatgg

SEQ ID NO: 122940 - DNA, 16 bp, H. sapiens
gttgccatggtgatgg

SEQ ID NO: 122941 - DNA, 16 bp, H. sapiens
gttgccattgcctttg

SEQ ID NO: 122942 - DNA, 16 bp, H. sapiens
gttgccattgctttta

SEQ ID NO: 122943 - DNA, 16 bp, H. sapiens
gttgcccaagctgggc

SEQ ID NO: 122944 - DNA, 16 bp, H. sapiens
gttgcccaaggtggag

SEQ ID NO: 122945 - DNA, 16 bp, H. sapiens
gttgcccagaccagag

SEQ ID NO: 122946 - DNA, 16 bp, H. sapiens
gttgcccaggctgccc

SEQ ID NO: 122947 - DNA, 16 bp, H. sapiens
gttgcccaggctggct

SEQ ID NO: 122948 - DNA, 16 bp, H. sapiens
gttgcccaggctgtta

SEQ ID NO: 122949 - DNA, 16 bp, H. sapiens
gttgcccagggtgggg

SEQ ID NO: 122950 - DNA, 16 bp, H. sapiens
gttgcccatttttatg

SEQ ID NO: 122951 - DNA, 16 bp, H. sapiens
gttgccctggctggcc

SEQ ID NO: 122952 - DNA, 16 bp, H. sapiens
gttgcctggggctggg

SEQ ID NO: 122953 - DNA, 16 bp, H. sapiens
gttgcctgtgtacttt

SEQ ID NO: 122954 - DNA, 16 bp, H. sapiens
gttgcctgttcaatct

SEQ ID NO: 122955 - DNA, 21 bp, H. sapiens
gttgccttaactcaagccctc

SEQ ID NO: 122956 - DNA, 16 bp, H. sapiens
gttgctattgcttttg

SEQ ID NO: 122957 - DNA, 16 bp, H. sapiens
gttgctcaagctggcc

SEQ ID NO: 122958 - DNA, 16 bp, H. sapiens
gttgctcatttttatg

SEQ ID NO: 122959 - DNA, 17 bp, H. sapiens
gttgctccacaccgcct

SEQ ID NO: 122960 - DNA, 16 bp, H. sapiens
gttgctctcgaactcc

SEQ ID NO: 122961 - DNA, 16 bp, H. sapiens
gttgctctggaggctg

SEQ ID NO: 122962 - DNA, 16 bp, H. sapiens
gttgctctggtttgaa

SEQ ID NO: 122963 - DNA, 16 bp, H. sapiens
gttgctgcaaaagaca

SEQ ID NO: 122964 - DNA, 16 bp, H. sapiens
gttgctgcaaaggata

SEQ ID NO: 122965 - DNA, 16 bp, H. sapiens
gttgctgccaaacaag

SEQ ID NO: 122966 - DNA, 16 bp, H. sapiens
gttgctgctgctgtta

SEQ ID NO: 122967 - DNA, 16 bp, H. sapiens
gttgctgctgttgttg

SEQ ID NO: 122968 - DNA, 18 bp, H. sapiens
gttgctgggattacaggc

SEQ ID NO: 122969 - DNA, 16 bp, H. sapiens
gttgctggggaggcct

SEQ ID NO: 122970 - DNA, 16 bp, H. sapiens
gttgctggggctggag

SEQ ID NO: 122971 - DNA, 16 bp, H. sapiens
gttgctgtctgtctca

SEQ ID NO: 122972 - DNA, 16 bp, H. sapiens
gttgctgtgtgtatca

SEQ ID NO: 122973 - DNA, 16 bp, H. sapiens
gttgctgttattattt

SEQ ID NO: 122974 - DNA, 16 bp, H. sapiens
gttgctgttgctggct

SEQ ID NO: 122975 - DNA, 16 bp, H. sapiens
gttgctgtttccagtc

SEQ ID NO: 122976 - DNA, 16 bp, H. sapiens
gttgcttatgcttttg

SEQ ID NO: 122977 - DNA, 16 bp, H. sapiens
gttgcttattttaaaa

SEQ ID NO: 122978 - DNA, 16 bp, H. sapiens
gttgcttcacatcctc

SEQ ID NO: 122979 - DNA, 16 bp, H. sapiens
gttgcttccaaatttt

SEQ ID NO: 122980 - DNA, 16 bp, H. sapiens
gttgcttccaagtttt

SEQ ID NO: 122981 - DNA, 16 bp, H. sapiens
gttgcttccacctttt

SEQ ID NO: 122982 - DNA, 16 bp, H. sapiens
gttgcttccatgtttt

SEQ ID NO: 122983 - DNA, 16 bp, H. sapiens
gttgcttgggaggctg

SEQ ID NO: 122984 - DNA, 16 bp, H. sapiens
gttggaaacactcttt

SEQ ID NO: 122985 - DNA, 16 bp, H. sapiens
gttggaaaggaagaaa

SEQ ID NO: 122986 - DNA, 16 bp, H. sapiens
gttggaaatgtagaaa

SEQ ID NO: 122987 - DNA, 16 bp, H. sapiens
gttggaacagcttgga

SEQ ID NO: 122988 - DNA, 16 bp, H. sapiens
gttggaacttctggcc

SEQ ID NO: 122989 - DNA, 16 bp, H. sapiens
gttggaagaagatgcc

SEQ ID NO: 122990 - DNA, 16 bp, H. sapiens
gttggaagaattaata

SEQ ID NO: 122991 - DNA, 16 bp, H. sapiens
gttggaatcaacttct

SEQ ID NO: 122992 - DNA, 16 bp, H. sapiens
gttggaattacaggag

SEQ ID NO: 122993 - DNA, 16 bp, H. sapiens
gttggaattatacagt

SEQ ID NO: 122994 - DNA, 16 bp, H. sapiens
gttggacaagcttgat

SEQ ID NO: 122995 - DNA, 16 bp, H. sapiens
gttggagaacagcctg

SEQ ID NO: 122996 - DNA, 16 bp, H. sapiens
gttggagaccagctgg

SEQ ID NO: 122997 - DNA, 16 bp, H. sapiens
gttggagatggagcct

SEQ ID NO: 122998 - DNA, 16 bp, H. sapiens
gttggaggtggggact

SEQ ID NO: 122999 - DNA, 16 bp, H. sapiens
gttggaggtggggccc

SEQ ID NO: 123000 - DNA, 16 bp, H. sapiens
gttggagtgcagtggc

SEQ ID NO: 123001 - DNA, 16 bp, H. sapiens
gttggagtgctgtggc

SEQ ID NO: 123002 - DNA, 16 bp, H. sapiens
gttggattaaagatga

SEQ ID NO: 123003 - DNA, 16 bp, H. sapiens
gttggcaagcttaaca

SEQ ID NO: 123004 - DNA, 16 bp, H. sapiens
gttggcaaggttgcag

SEQ ID NO: 123005 - DNA, 16 bp, H. sapiens
gttggcactcaataaa

SEQ ID NO: 123006 - DNA, 16 bp, H. sapiens
gttggcattgagtgtc

SEQ ID NO: 123007 - DNA, 16 bp, H. sapiens
gttggccaggatggac

SEQ ID NO: 123008 - DNA, 16 bp, H. sapiens
gttggccaggctcttc

SEQ ID NO: 123009 - DNA, 16 bp, H. sapiens
gttggccaggctgcag

SEQ ID NO: 123010 - DNA, 17 bp, H. sapiens
gttggccaggctggtgg

SEQ ID NO: 123011 - DNA, 16 bp, H. sapiens
gttggccgggctggcc

SEQ ID NO: 123012 - DNA, 16 bp, H. sapiens
gttggcctcccaaagt

SEQ ID NO: 123013 - DNA, 16 bp, H. sapiens
gttggcgtgcagtggc

SEQ ID NO: 123014 - DNA, 16 bp, H. sapiens
gttggctcacacctgt

SEQ ID NO: 123015 - DNA, 16 bp, H. sapiens
gttggctcctttcagc

SEQ ID NO: 123016 - DNA, 16 bp, H. sapiens
gttggctggttatttt

SEQ ID NO: 123017 - DNA, 16 bp, H. sapiens
gttggcttcaaagaac

SEQ ID NO: 123018 - DNA, 16 bp, H. sapiens
gttggctttttgaaaa

SEQ ID NO: 123019 - DNA, 16 bp, H. sapiens
gttgggaacatttcaa

SEQ ID NO: 123020 - DNA, 16 bp, H. sapiens
gttgggacttcaacat

SEQ ID NO: 123021 - DNA, 16 bp, H. sapiens
gttgggagagaagctg

SEQ ID NO: 123022 - DNA, 16 bp, H. sapiens
gttgggagatttctca

SEQ ID NO: 123023 - DNA, 16 bp, H. sapiens
gttgggattagaggca

SEQ ID NO: 123024 - DNA, 16 bp, H. sapiens
gttgggattccaggtg

SEQ ID NO: 123025 - DNA, 16 bp, H. sapiens
gttgggcaaccatcac

SEQ ID NO: 123026 - DNA, 16 bp, H. sapiens
gttgggcaaggtggct

SEQ ID NO: 123027 - DNA, 16 bp, H. sapiens
gttgggcaggtgggga

SEQ ID NO: 123028 - DNA, 16 bp, H. sapiens
gttgggcatgatggca

SEQ ID NO: 123029 - DNA, 16 bp, H. sapiens
gttgggcccagtggct

SEQ ID NO: 123030 - DNA, 16 bp, H. sapiens
gttgggctgctatttc

SEQ ID NO: 123031 - DNA, 19 bp, H. sapiens
gttgggctgggcgcagtgg

SEQ ID NO: 123032 - DNA, 16 bp, H. sapiens
gttgggctttttttca

SEQ ID NO: 123033 - DNA, 16 bp, H. sapiens
gttggggacccctggc

SEQ ID NO: 123034 - DNA, 16 bp, H. sapiens
gttggggacccctgtt

SEQ ID NO: 123035 - DNA, 16 bp, H. sapiens
gttggggatgaaatca

SEQ ID NO: 123036 - DNA, 16 bp, H. sapiens
gttggggttttctaaa

SEQ ID NO: 123037 - DNA, 16 bp, H. sapiens
gttgggtcaacaatga

SEQ ID NO: 123038 - DNA, 16 bp, H. sapiens
gttggtactcaataaa

SEQ ID NO: 123039 - DNA, 16 bp, H. sapiens
gttggtattacaggcg

SEQ ID NO: 123040 - DNA, 16 bp, H. sapiens
gttggtgaccttcaga

SEQ ID NO: 123041 - DNA, 16 bp, H. sapiens
gttggtgcgaaagtaa

SEQ ID NO: 123042 - DNA, 16 bp, H. sapiens
gttggtggagcagtca

SEQ ID NO: 123043 - DNA, 16 bp, H. sapiens
gttggtgggaatgtaa

SEQ ID NO: 123044 - DNA, 16 bp, H. sapiens
gttggtggggcaggag

SEQ ID NO: 123045 - DNA, 16 bp, H. sapiens
gttggttcttcaaaaa

SEQ ID NO: 123046 - DNA, 16 bp, H. sapiens
gttggttggccaggat

SEQ ID NO: 123047 - DNA, 16 bp, H. sapiens
gttggttggcctccag

SEQ ID NO: 123048 - DNA, 16 bp, H. sapiens
gttggtttctggtgag

SEQ ID NO: 123049 - DNA, 16 bp, H. sapiens
gttggttttgtatcct

SEQ ID NO: 123050 - DNA, 16 bp, H. sapiens
gttggttttttaaaaa

SEQ ID NO: 123051 - DNA, 16 bp, H. sapiens
gttgtaaatattttct

SEQ ID NO: 123052 - DNA, 16 bp, H. sapiens
gttgtacaacagatct

SEQ ID NO: 123053 - DNA, 16 bp, H. sapiens
gttgtacagattatgt

SEQ ID NO: 123054 - DNA, 16 bp, H. sapiens
gttgtagatatgcggc

SEQ ID NO: 123055 - DNA, 16 bp, H. sapiens
gttgtatttctataca

SEQ ID NO: 123056 - DNA, 16 bp, H. sapiens
gttgtcacaaattaca

SEQ ID NO: 123057 - DNA, 16 bp, H. sapiens
gttgtcagggaagtgg

SEQ ID NO: 123058 - DNA, 16 bp, H. sapiens
gttgtccaggctggag

SEQ ID NO: 123059 - DNA, 16 bp, H. sapiens
gttgtccttttcatag

SEQ ID NO: 123060 - DNA, 16 bp, H. sapiens
gttgtctcttcattct

SEQ ID NO: 123061 - DNA, 16 bp, H. sapiens
gttgtgaggattaaac

SEQ ID NO: 123062 - DNA, 16 bp, H. sapiens
gttgtgatggcctttg

SEQ ID NO: 123063 - DNA, 16 bp, H. sapiens
gttgtgcaaccattgc

SEQ ID NO: 123064 - DNA, 16 bp, H. sapiens
gttgtgcacatgctca

SEQ ID NO: 123065 - DNA, 16 bp, H. sapiens
gttgtgcagcacctct

SEQ ID NO: 123066 - DNA, 16 bp, H. sapiens
gttgtgcccacctttg

SEQ ID NO: 123067 - DNA, 16 bp, H. sapiens
gttgtggaagcatttt

SEQ ID NO: 123068 - DNA, 16 bp, H. sapiens
gttgtggagaaaagag

SEQ ID NO: 123069 - DNA, 16 bp, H. sapiens
gttgtggcctgatgct

SEQ ID NO: 123070 - DNA, 16 bp, H. sapiens
gttgtggtaaaataca

SEQ ID NO: 123071 - DNA, 16 bp, H. sapiens
gttgtggtatcaggat

SEQ ID NO: 123072 - DNA, 16 bp, H. sapiens
gttgtggtgaggatta

SEQ ID NO: 123073 - DNA, 16 bp, H. sapiens
gttgtggtgatctgtg

SEQ ID NO: 123074 - DNA, 16 bp, H. sapiens
gttgtgtctccatttt

SEQ ID NO: 123075 - DNA, 16 bp, H. sapiens
gttgtgtcttcgttct

SEQ ID NO: 123076 - DNA, 16 bp, H. sapiens
gttgtgtgtgtgtgca

SEQ ID NO: 123077 - DNA, 16 bp, H. sapiens
gttgtgttatcaaata

SEQ ID NO: 123078 - DNA, 16 bp, H. sapiens
gttgttataaagaaat

SEQ ID NO: 123079 - DNA, 16 bp, H. sapiens
gttgttatactatatt

SEQ ID NO: 123080 - DNA, 16 bp, H. sapiens
gttgttatactgtact

SEQ ID NO: 123081 - DNA, 16 bp, H. sapiens
gttgttatgagaatta

SEQ ID NO: 123082 - DNA, 16 bp, H. sapiens
gttgttcaatgggtat

SEQ ID NO: 123083 - DNA, 16 bp, H. sapiens
gttgttcagattcttt

SEQ ID NO: 123084 - DNA, 16 bp, H. sapiens
gttgttgatttttcag

SEQ ID NO: 123085 - DNA, 16 bp, H. sapiens
gttgttgctgctgtta

SEQ ID NO: 123086 - DNA, 16 bp, H. sapiens
gttgttggaagaattc

SEQ ID NO: 123087 - DNA, 16 bp, H. sapiens
gttgttgtcgttgtta

SEQ ID NO: 123088 - DNA, 16 bp, H. sapiens
gttgttgttactttct

SEQ ID NO: 123089 - DNA, 16 bp, H. sapiens
gttgttgttgttactt

SEQ ID NO: 123090 - DNA, 16 bp, H. sapiens
gttgttgttgttccat

SEQ ID NO: 123091 - DNA, 16 bp, H. sapiens
gttgttgtttttgaca

SEQ ID NO: 123092 - DNA, 16 bp, H. sapiens
gttgttgttttttaca

SEQ ID NO: 123093 - DNA, 16 bp, H. sapiens
gttgtttaatttccat

SEQ ID NO: 123094 - DNA, 16 bp, H. sapiens
gttgtttataaattac

SEQ ID NO: 123095 - DNA, 16 bp, H. sapiens
gttgtttatctgaaat

SEQ ID NO: 123096 - DNA, 16 bp, H. sapiens
gttgtttccagtcttt

SEQ ID NO: 123097 - DNA, 16 bp, H. sapiens
gttgtttcctgaattt

SEQ ID NO: 123098 - DNA, 16 bp, H. sapiens
gttgtttgagtttctt

SEQ ID NO: 123099 - DNA, 16 bp, H. sapiens
gttgtttgttcctcct

SEQ ID NO: 123100 - DNA, 18 bp, H. sapiens
gttgttttgagacggagt

SEQ ID NO: 123101 - DNA, 16 bp, H. sapiens
gttgttttgcctgtta

SEQ ID NO: 123102 - DNA, 16 bp, H. sapiens
gttgtttttaagccac

SEQ ID NO: 123103 - DNA, 16 bp, H. sapiens
gttgtttttcctgatc

SEQ ID NO: 123104 - DNA, 16 bp, H. sapiens
gtttaaaaaaatgttt

SEQ ID NO: 123105 - DNA, 16 bp, H. sapiens
gtttaaaaaacaaaca

SEQ ID NO: 123106 - DNA, 16 bp, H. sapiens
gtttaaaaaatgtttt

SEQ ID NO: 123107 - DNA, 16 bp, H. sapiens
gtttaaaaacaaacaa

SEQ ID NO: 123108 - DNA, 16 bp, H. sapiens
gtttaaaacacttgat

SEQ ID NO: 123109 - DNA, 16 bp, H. sapiens
gtttaaaatagcattt

SEQ ID NO: 123110 - DNA, 16 bp, H. sapiens
gtttaaaattctcttt

SEQ ID NO: 123111 - DNA, 16 bp, H. sapiens
gtttaaacagcagaaa

SEQ ID NO: 123112 - DNA, 16 bp, H. sapiens
gtttaaagtatgtttt

SEQ ID NO: 123113 - DNA, 16 bp, H. sapiens
gtttaaagtccgtttt

SEQ ID NO: 123114 - DNA, 20 bp, H. sapiens
gtttaacaccccactgtcaa

SEQ ID NO: 123115 - DNA, 16 bp, H. sapiens
gtttaaccatttgagg

SEQ ID NO: 123116 - DNA, 16 bp, H. sapiens
gtttaagaaaaacaaa

SEQ ID NO: 123117 - DNA, 16 bp, H. sapiens
gtttaagaccagcctg

SEQ ID NO: 123118 - DNA, 16 bp, H. sapiens
gtttaagcaacccagt

SEQ ID NO: 123119 - DNA, 16 bp, H. sapiens
gtttaagtccactgaa

SEQ ID NO: 123120 - DNA, 16 bp, H. sapiens
gtttaagtcttttatc

SEQ ID NO: 123121 - DNA, 16 bp, H. sapiens
gtttaagtgattcttc

SEQ ID NO: 123122 - DNA, 16 bp, H. sapiens
gtttaatagcatttta

SEQ ID NO: 123123 - DNA, 16 bp, H. sapiens
gtttaatggaattgtt

SEQ ID NO: 123124 - DNA, 16 bp, H. sapiens
gtttaatggacttaac

SEQ ID NO: 123125 - DNA, 16 bp, H. sapiens
gtttaattggctcatg

SEQ ID NO: 123126 - DNA, 16 bp, H. sapiens
gtttaatttccacata

SEQ ID NO: 123127 - DNA, 16 bp, H. sapiens
gtttaatttctttgta

SEQ ID NO: 123128 - DNA, 16 bp, H. sapiens
gtttaatttcttttaa

SEQ ID NO: 123129 - DNA, 16 bp, H. sapiens
gtttacaaaacaaaat

SEQ ID NO: 123130 - DNA, 16 bp, H. sapiens
gtttacaaaatatctt

SEQ ID NO: 123131 - DNA, 16 bp, H. sapiens
gtttacaaaatgcttt

SEQ ID NO: 123132 - DNA, 16 bp, H. sapiens
gtttacaaactgctga

SEQ ID NO: 123133 - DNA, 16 bp, H. sapiens
gtttacaaagtacttt

SEQ ID NO: 123134 - DNA, 17 bp, H. sapiens
gtttacacacacacaca

SEQ ID NO: 123135 - DNA, 16 bp, H. sapiens
gtttacactgtttctc

SEQ ID NO: 123136 - DNA, 16 bp, H. sapiens
gtttacacttccacca

SEQ ID NO: 123137 - DNA, 16 bp, H. sapiens
gtttacagaaaaatta

SEQ ID NO: 123138 - DNA, 16 bp, H. sapiens
gtttacagcagcttta

SEQ ID NO: 123139 - DNA, 16 bp, H. sapiens
gtttacagcatcttca

SEQ ID NO: 123140 - DNA, 16 bp, H. sapiens
gtttacatgctggatt

SEQ ID NO: 123141 - DNA, 16 bp, H. sapiens
gtttaccagtttatta

SEQ ID NO: 123142 - DNA, 16 bp, H. sapiens
gtttaccatgtgccag

SEQ ID NO: 123143 - DNA, 16 bp, H. sapiens
gtttactttataaatt

SEQ ID NO: 123144 - DNA, 16 bp, H. sapiens
gtttactttattgtaa

SEQ ID NO: 123145 - DNA, 16 bp, H. sapiens
gtttagaaagtaaaaa

SEQ ID NO: 123146 - DNA, 17 bp, H. sapiens
gtttagagacagggtct

SEQ ID NO: 123147 - DNA, 16 bp, H. sapiens
gtttagagggaaactt

SEQ ID NO: 123148 - DNA, 16 bp, H. sapiens
gtttagatgaggtcat

SEQ ID NO: 123149 - DNA, 16 bp, H. sapiens
gtttagatgcacaaat

SEQ ID NO: 123150 - DNA, 16 bp, H. sapiens
gtttagcattttcttt

SEQ ID NO: 123151 - DNA, 16 bp, H. sapiens
gtttagccaggatggt

SEQ ID NO: 123152 - DNA, 16 bp, H. sapiens
gtttaggcatttggaa

SEQ ID NO: 123153 - DNA, 16 bp, H. sapiens
gtttaggctgcagtga

SEQ ID NO: 123154 - DNA, 20 bp, H. sapiens
gtttagtagagacagggttt

SEQ ID NO: 123155 - DNA, 16 bp, H. sapiens
gtttagttttggggaa

SEQ ID NO: 123156 - DNA, 16 bp, H. sapiens
gtttataaaatacaaa

SEQ ID NO: 123157 - DNA, 16 bp, H. sapiens
gtttataaaatctaca

SEQ ID NO: 123158 - DNA, 16 bp, H. sapiens
gtttataaagaaattc

SEQ ID NO: 123159 - DNA, 16 bp, H. sapiens
gtttataaattgccca

SEQ ID NO: 123160 - DNA, 16 bp, H. sapiens
gtttatacagcatttt

SEQ ID NO: 123161 - DNA, 16 bp, H. sapiens
gtttatagcagcacaa

SEQ ID NO: 123162 - DNA, 16 bp, H. sapiens
gtttatattcttctta

SEQ ID NO: 123163 - DNA, 16 bp, H. sapiens
gtttatcaagacaatg

SEQ ID NO: 123164 - DNA, 16 bp, H. sapiens
gtttatcattttaaaa

SEQ ID NO: 123165 - DNA, 16 bp, H. sapiens
gtttatcttcttttga

SEQ ID NO: 123166 - DNA, 16 bp, H. sapiens
gtttatcttttcaaag

SEQ ID NO: 123167 - DNA, 16 bp, H. sapiens
gtttatgaagaaaaga

SEQ ID NO: 123168 - DNA, 16 bp, H. sapiens
gtttatgacaaaccca

SEQ ID NO: 123169 - DNA, 16 bp, H. sapiens
gtttatggaatattct

SEQ ID NO: 123170 - DNA, 16 bp, H. sapiens
gtttatggccagattt

SEQ ID NO: 123171 - DNA, 16 bp, H. sapiens
gtttatgtcctttgct

SEQ ID NO: 123172 - DNA, 16 bp, H. sapiens
gtttatgtcctttgtc

SEQ ID NO: 123173 - DNA, 16 bp, H. sapiens
gtttatgtgtgtgcat

SEQ ID NO: 123174 - DNA, 16 bp, H. sapiens
gtttattaaaaagttt

SEQ ID NO: 123175 - DNA, 16 bp, H. sapiens
gtttattaaacatttt

SEQ ID NO: 123176 - DNA, 16 bp, H. sapiens
gtttattaagaaagta

SEQ ID NO: 123177 - DNA, 16 bp, H. sapiens
gtttattatagaaaat

SEQ ID NO: 123178 - DNA, 16 bp, H. sapiens
gtttattcaacaaata

SEQ ID NO: 123179 - DNA, 16 bp, H. sapiens
gtttattcatgttgtc

SEQ ID NO: 123180 - DNA, 16 bp, H. sapiens
gtttattcattcatta

SEQ ID NO: 123181 - DNA, 16 bp, H. sapiens
gtttattcctaaatat

SEQ ID NO: 123182 - DNA, 16 bp, H. sapiens
gtttattgattttcgt

SEQ ID NO: 123183 - DNA, 16 bp, H. sapiens
gtttatttctcactca

SEQ ID NO: 123184 - DNA, 16 bp, H. sapiens
gtttatttgccaaagt

SEQ ID NO: 123185 - DNA, 16 bp, H. sapiens
gtttattttaaaacta

SEQ ID NO: 123186 - DNA, 16 bp, H. sapiens
gtttattttaaaagaa

SEQ ID NO: 123187 - DNA, 16 bp, H. sapiens
gtttatttttgtagag

SEQ ID NO: 123188 - DNA, 16 bp, H. sapiens
gtttcaaaaaaagaaa

SEQ ID NO: 123189 - DNA, 16 bp, H. sapiens
gtttcaaaaaataaat

SEQ ID NO: 123190 - DNA, 16 bp, H. sapiens
gtttcaaaacaaacaa

SEQ ID NO: 123191 - DNA, 16 bp, H. sapiens
gtttcaaacttgcatg

SEQ ID NO: 123192 - DNA, 16 bp, H. sapiens
gtttcaaataaaaaaa

SEQ ID NO: 123193 - DNA, 16 bp, H. sapiens
gtttcaaattttaaaa

SEQ ID NO: 123194 - DNA, 16 bp, H. sapiens
gtttcaacatatgaat

SEQ ID NO: 123195 - DNA, 16 bp, H. sapiens
gtttcaacatctgaat

SEQ ID NO: 123196 - DNA, 16 bp, H. sapiens
gtttcaagaaagttta

SEQ ID NO: 123197 - DNA, 16 bp, H. sapiens
gtttcaagaagttttt

SEQ ID NO: 123198 - DNA, 18 bp, H. sapiens
gtttcaagcgatcctcct

SEQ ID NO: 123199 - DNA, 16 bp, H. sapiens
gtttcaataaaacttt

SEQ ID NO: 123200 - DNA, 16 bp, H. sapiens
gtttcacagaagacaa

SEQ ID NO: 123201 - DNA, 16 bp, H. sapiens
gtttcaccatgccagc

SEQ ID NO: 123202 - DNA, 20 bp, H. sapiens
gtttcaccatgttagccagg

SEQ ID NO: 123203 - DNA, 16 bp, H. sapiens
gtttcaccctgttagt

SEQ ID NO: 123204 - DNA, 16 bp, H. sapiens
gtttcaccgtattagc

SEQ ID NO: 123205 - DNA, 23 bp, H. sapiens
gtttcaccgtgttagccaggatg

SEQ ID NO: 123206 - DNA, 16 bp, H. sapiens
gtttcactcgtcaccc

SEQ ID NO: 123207 - DNA, 16 bp, H. sapiens
gtttcactgggccaaa

SEQ ID NO: 123208 - DNA, 16 bp, H. sapiens
gtttcactgtgtgagc

SEQ ID NO: 123209 - DNA, 16 bp, H. sapiens
gtttcacttagcataa

SEQ ID NO: 123210 - DNA, 16 bp, H. sapiens
gtttcagaaaacaaaa

SEQ ID NO: 123211 - DNA, 16 bp, H. sapiens
gtttcagacagggtct

SEQ ID NO: 123212 - DNA, 16 bp, H. sapiens
gtttcagatttgggat

SEQ ID NO: 123213 - DNA, 16 bp, H. sapiens
gtttcagctcactgca

SEQ ID NO: 123214 - DNA, 16 bp, H. sapiens
gtttcaggaaacaaaa

SEQ ID NO: 123215 - DNA, 16 bp, H. sapiens
gtttcagggttttttt

SEQ ID NO: 123216 - DNA, 16 bp, H. sapiens
gtttcagtgacccaag

SEQ ID NO: 123217 - DNA, 16 bp, H. sapiens
gtttcagtgagtggag

SEQ ID NO: 123218 - DNA, 16 bp, H. sapiens
gtttcagtttgggaaa

SEQ ID NO: 123219 - DNA, 16 bp, H. sapiens
gtttcagttttataag

SEQ ID NO: 123220 - DNA, 16 bp, H. sapiens
gtttcataccagggat

SEQ ID NO: 123221 - DNA, 16 bp, H. sapiens
gtttcatcatgttgcc

SEQ ID NO: 123222 - DNA, 16 bp, H. sapiens
gtttcattatacatca

SEQ ID NO: 123223 - DNA, 16 bp, H. sapiens
gtttcattattttgca

SEQ ID NO: 123224 - DNA, 16 bp, H. sapiens
gtttcattctgtgaga

SEQ ID NO: 123225 - DNA, 16 bp, H. sapiens
gtttcattggaacaca

SEQ ID NO: 123226 - DNA, 16 bp, H. sapiens
gtttcatttgaatttt

SEQ ID NO: 123227 - DNA, 16 bp, H. sapiens
gtttcatttgccttct

SEQ ID NO: 123228 - DNA, 16 bp, H. sapiens
gtttcattttctaaat

SEQ ID NO: 123229 - DNA, 16 bp, H. sapiens
gtttccaaaaataaaa

SEQ ID NO: 123230 - DNA, 16 bp, H. sapiens
gtttccaaagtgctgg

SEQ ID NO: 123231 - DNA, 16 bp, H. sapiens
gtttccaacctggtga

SEQ ID NO: 123232 - DNA, 16 bp, H. sapiens
gtttccacatctgtga

SEQ ID NO: 123233 - DNA, 16 bp, H. sapiens
gtttccacatgttggc

SEQ ID NO: 123234 - DNA, 16 bp, H. sapiens
gtttccagaagagact

SEQ ID NO: 123235 - DNA, 16 bp, H. sapiens
gtttccagaggaagga

SEQ ID NO: 123236 - DNA, 16 bp, H. sapiens
gtttccagaggcctcc

SEQ ID NO: 123237 - DNA, 16 bp, H. sapiens
gtttccagctggtgaa

SEQ ID NO: 123238 - DNA, 16 bp, H. sapiens
gtttccagggctgggg

SEQ ID NO: 123239 - DNA, 16 bp, H. sapiens
gtttccagtttttgat

SEQ ID NO: 123240 - DNA, 16 bp, H. sapiens
gtttccatgtaattga

SEQ ID NO: 123241 - DNA, 16 bp, H. sapiens
gtttccatgtctgtaa

SEQ ID NO: 123242 - DNA, 16 bp, H. sapiens
gtttcccagaatgctt

SEQ ID NO: 123243 - DNA, 16 bp, H. sapiens
gtttcccagcctggag

SEQ ID NO: 123244 - DNA, 16 bp, H. sapiens
gtttcccatctgaaaa

SEQ ID NO: 123245 - DNA, 16 bp, H. sapiens
gtttccccacatcctt

SEQ ID NO: 123246 - DNA, 16 bp, H. sapiens
gtttccccacattggc

SEQ ID NO: 123247 - DNA, 16 bp, H. sapiens
gtttccccagcaccat

SEQ ID NO: 123248 - DNA, 16 bp, H. sapiens
gtttccccatttcttg

SEQ ID NO: 123249 - DNA, 16 bp, H. sapiens
gtttcccccatgccgt

SEQ ID NO: 123250 - DNA, 16 bp, H. sapiens
gtttccctacacaagc

SEQ ID NO: 123251 - DNA, 16 bp, H. sapiens
gtttccctcatgctgt

SEQ ID NO: 123252 - DNA, 16 bp, H. sapiens
gtttccctgtgttgcc

SEQ ID NO: 123253 - DNA, 16 bp, H. sapiens
gtttcctactgctgct

SEQ ID NO: 123254 - DNA, 16 bp, H. sapiens
gtttcctattgctgct

SEQ ID NO: 123255 - DNA, 16 bp, H. sapiens
gtttcctcacttctca

SEQ ID NO: 123256 - DNA, 16 bp, H. sapiens
gtttcctcatctctaa

SEQ ID NO: 123257 - DNA, 16 bp, H. sapiens
gtttcctcatttgaaa

SEQ ID NO: 123258 - DNA, 16 bp, H. sapiens
gtttcctcttcctgaa

SEQ ID NO: 123259 - DNA, 16 bp, H. sapiens
gtttcctgaatttgaa

SEQ ID NO: 123260 - DNA, 16 bp, H. sapiens
gtttccttctctgtaa

SEQ ID NO: 123261 - DNA, 16 bp, H. sapiens
gtttccttcttaattt

SEQ ID NO: 123262 - DNA, 16 bp, H. sapiens
gtttccttgctcctca

SEQ ID NO: 123263 - DNA, 16 bp, H. sapiens
gtttcctttgatgtgc

SEQ ID NO: 123264 - DNA, 16 bp, H. sapiens
gtttcctttgcctcca

SEQ ID NO: 123265 - DNA, 16 bp, H. sapiens
gtttccttttctgtgc

SEQ ID NO: 123266 - DNA, 16 bp, H. sapiens
gtttccttttggagtt

SEQ ID NO: 123267 - DNA, 16 bp, H. sapiens
gtttcgccatgttgcc

SEQ ID NO: 123268 - DNA, 16 bp, H. sapiens
gtttctaaaaatatat

SEQ ID NO: 123269 - DNA, 16 bp, H. sapiens
gtttctaaaggatggc

SEQ ID NO: 123270 - DNA, 16 bp, H. sapiens
gtttctaaataaacat

SEQ ID NO: 123271 - DNA, 16 bp, H. sapiens
gtttctaatgagaagt

SEQ ID NO: 123272 - DNA, 16 bp, H. sapiens
gtttctaatttttaaa

SEQ ID NO: 123273 - DNA, 16 bp, H. sapiens
gtttctacaaaaataa

SEQ ID NO: 123274 - DNA, 16 bp, H. sapiens
gtttctacacagcaaa

SEQ ID NO: 123275 - DNA, 16 bp, H. sapiens
gtttctactaaaaatt

SEQ ID NO: 123276 - DNA, 16 bp, H. sapiens
gtttctattaaaaaaa

SEQ ID NO: 123277 - DNA, 16 bp, H. sapiens
gtttctatttttctga

SEQ ID NO: 123278 - DNA, 16 bp, H. sapiens
gtttctccacagcctt

SEQ ID NO: 123279 - DNA, 16 bp, H. sapiens
gtttctcccacaacac

SEQ ID NO: 123280 - DNA, 16 bp, H. sapiens
gtttctcccacctcag

SEQ ID NO: 123281 - DNA, 16 bp, H. sapiens
gtttctctgatgacca

SEQ ID NO: 123282 - DNA, 16 bp, H. sapiens
gtttctcttgttattg

SEQ ID NO: 123283 - DNA, 16 bp, H. sapiens
gtttctgagttgtttc

SEQ ID NO: 123284 - DNA, 16 bp, H. sapiens
gtttctgatgagaaat

SEQ ID NO: 123285 - DNA, 16 bp, H. sapiens
gtttctgcacagcaaa

SEQ ID NO: 123286 - DNA, 16 bp, H. sapiens
gtttctgccatgttgg

SEQ ID NO: 123287 - DNA, 17 bp, H. sapiens
gtttctgccgagagatc

SEQ ID NO: 123288 - DNA, 16 bp, H. sapiens
gtttctgctgagaggc

SEQ ID NO: 123289 - DNA, 16 bp, H. sapiens
gtttctgctttcttca

SEQ ID NO: 123290 - DNA, 16 bp, H. sapiens
gtttctggaagaaaat

SEQ ID NO: 123291 - DNA, 16 bp, H. sapiens
gtttctggagctgctt

SEQ ID NO: 123292 - DNA, 16 bp, H. sapiens
gtttctggaggctggg

SEQ ID NO: 123293 - DNA, 16 bp, H. sapiens
gtttctggtgaggtct

SEQ ID NO: 123294 - DNA, 16 bp, H. sapiens
gtttctgtatctgtaa

SEQ ID NO: 123295 - DNA, 16 bp, H. sapiens
gtttctgtatttttag

SEQ ID NO: 123296 - DNA, 16 bp, H. sapiens
gtttctgttgagaaat

SEQ ID NO: 123297 - DNA, 16 bp, H. sapiens
gtttctgttgttttaa

SEQ ID NO: 123298 - DNA, 16 bp, H. sapiens
gtttcttacagttctg

SEQ ID NO: 123299 - DNA, 16 bp, H. sapiens
gtttcttcaataaata

SEQ ID NO: 123300 - DNA, 16 bp, H. sapiens
gtttcttcacagaatt

SEQ ID NO: 123301 - DNA, 16 bp, H. sapiens
gtttcttcatctacaa

SEQ ID NO: 123302 - DNA, 16 bp, H. sapiens
gtttcttcatctctaa

SEQ ID NO: 123303 - DNA, 16 bp, H. sapiens
gtttcttcatctgaaa

SEQ ID NO: 123304 - DNA, 16 bp, H. sapiens
gtttcttcatttgaaa

SEQ ID NO: 123305 - DNA, 16 bp, H. sapiens
gtttcttcctctggaa

SEQ ID NO: 123306 - DNA, 16 bp, H. sapiens
gtttcttccttcagat

SEQ ID NO: 123307 - DNA, 16 bp, H. sapiens
gtttcttgggctggtt

SEQ ID NO: 123308 - DNA, 16 bp, H. sapiens
gtttcttgtgcttgga

SEQ ID NO: 123309 - DNA, 16 bp, H. sapiens
gtttctttaataaatg

SEQ ID NO: 123310 - DNA, 16 bp, H. sapiens
gtttctttatatttaa

SEQ ID NO: 123311 - DNA, 16 bp, H. sapiens
gtttctttatccattc

SEQ ID NO: 123312 - DNA, 16 bp, H. sapiens
gtttcttttccttcta

SEQ ID NO: 123313 - DNA, 16 bp, H. sapiens
gtttctttttgaaaaa

SEQ ID NO: 123314 - DNA, 16 bp, H. sapiens
gtttctttttggagtg

SEQ ID NO: 123315 - DNA, 16 bp, H. sapiens
gtttgaaaagagaaag

SEQ ID NO: 123316 - DNA, 16 bp, H. sapiens
gtttgaaaatattttc

SEQ ID NO: 123317 - DNA, 16 bp, H. sapiens
gtttgaaaatcactgc

SEQ ID NO: 123318 - DNA, 18 bp, H. sapiens
gtttgaaaccagtctggc

SEQ ID NO: 123319 - DNA, 16 bp, H. sapiens
gtttgaaacttcttag

SEQ ID NO: 123320 - DNA, 16 bp, H. sapiens
gtttgaaattatttca

SEQ ID NO: 123321 - DNA, 16 bp, H. sapiens
gtttgaaattttccat

SEQ ID NO: 123322 - DNA, 16 bp, H. sapiens
gtttgaacccaggaga

SEQ ID NO: 123323 - DNA, 16 bp, H. sapiens
gtttgaacccaggagt

SEQ ID NO: 123324 - DNA, 16 bp, H. sapiens
gtttgaacccaggcag

SEQ ID NO: 123325 - DNA, 16 bp, H. sapiens
gtttgaaccctggagg

SEQ ID NO: 123326 - DNA, 16 bp, H. sapiens
gtttgaagaccacctt

SEQ ID NO: 123327 - DNA, 16 bp, H. sapiens
gtttgaatatggtttg

SEQ ID NO: 123328 - DNA, 16 bp, H. sapiens
gtttgaatattaaatg

SEQ ID NO: 123329 - DNA, 16 bp, H. sapiens
gtttgaatatttgtcc

SEQ ID NO: 123330 - DNA, 16 bp, H. sapiens
gtttgaatcccagttc

SEQ ID NO: 123331 - DNA, 16 bp, H. sapiens
gtttgaatgcctttta

SEQ ID NO: 123332 - DNA, 16 bp, H. sapiens
gtttgaccaaatattt

SEQ ID NO: 123333 - DNA, 16 bp, H. sapiens
gtttgacccagcaatc

SEQ ID NO: 123334 - DNA, 16 bp, H. sapiens
gtttgactggatatga

SEQ ID NO: 123335 - DNA, 16 bp, H. sapiens
gtttgagaaagagaaa

SEQ ID NO: 123336 - DNA, 16 bp, H. sapiens
gtttgagaaataaagg

SEQ ID NO: 123337 - DNA, 16 bp, H. sapiens
gtttgagaacctctgc

SEQ ID NO: 123338 - DNA, 16 bp, H. sapiens
gtttgagaactgctgg

SEQ ID NO: 123339 - DNA, 16 bp, H. sapiens
gtttgagaatcactga

SEQ ID NO: 123340 - DNA, 16 bp, H. sapiens
gtttgagacaatcctg

SEQ ID NO: 123341 - DNA, 16 bp, H. sapiens
gtttgagaccaacatg

SEQ ID NO: 123342 - DNA, 16 bp, H. sapiens
gtttgaggatacagtg

SEQ ID NO: 123343 - DNA, 16 bp, H. sapiens
gtttgaggccaccctg

SEQ ID NO: 123344 - DNA, 16 bp, H. sapiens
gtttgaggccagccag

SEQ ID NO: 123345 - DNA, 16 bp, H. sapiens
gtttgaggccaggagt

SEQ ID NO: 123346 - DNA, 16 bp, H. sapiens
gtttgagtcccaaaac

SEQ ID NO: 123347 - DNA, 16 bp, H. sapiens
gtttgagttccttgtg

SEQ ID NO: 123348 - DNA, 16 bp, H. sapiens
gtttgataaagatggg

SEQ ID NO: 123349 - DNA, 16 bp, H. sapiens
gtttgataaggataat

SEQ ID NO: 123350 - DNA, 16 bp, H. sapiens
gtttgatcatctgaaa

SEQ ID NO: 123351 - DNA, 16 bp, H. sapiens
gtttgatcttggctca

SEQ ID NO: 123352 - DNA, 16 bp, H. sapiens
gtttgatgttcccctc

SEQ ID NO: 123353 - DNA, 16 bp, H. sapiens
gtttgattgattgatt

SEQ ID NO: 123354 - DNA, 16 bp, H. sapiens
gtttgattgcttctag

SEQ ID NO: 123355 - DNA, 16 bp, H. sapiens
gtttgattttcctcat

SEQ ID NO: 123356 - DNA, 16 bp, H. sapiens
gtttgcaaaaagaaaa

SEQ ID NO: 123357 - DNA, 16 bp, H. sapiens
gtttgcaaagcacttt

SEQ ID NO: 123358 - DNA, 16 bp, H. sapiens
gtttgcaaatactttc

SEQ ID NO: 123359 - DNA, 16 bp, H. sapiens
gtttgcagatgaggaa

SEQ ID NO: 123360 - DNA, 16 bp, H. sapiens
gtttgcatagcttcag

SEQ ID NO: 123361 - DNA, 16 bp, H. sapiens
gtttgcatatattttc

SEQ ID NO: 123362 - DNA, 16 bp, H. sapiens
gtttgcattttttaaa

SEQ ID NO: 123363 - DNA, 16 bp, H. sapiens
gtttgcctggctatca

SEQ ID NO: 123364 - DNA, 16 bp, H. sapiens
gtttgccttatttgaa

SEQ ID NO: 123365 - DNA, 16 bp, H. sapiens
gtttgctaagaccatc

SEQ ID NO: 123366 - DNA, 16 bp, H. sapiens
gtttgctaaggatgat

SEQ ID NO: 123367 - DNA, 16 bp, H. sapiens
gtttgctcctttttat

SEQ ID NO: 123368 - DNA, 16 bp, H. sapiens
gtttgctcttgcctct

SEQ ID NO: 123369 - DNA, 16 bp, H. sapiens
gtttgctgaaaatcaa

SEQ ID NO: 123370 - DNA, 16 bp, H. sapiens
gtttgctgacctctgt

SEQ ID NO: 123371 - DNA, 16 bp, H. sapiens
gtttgctgggctccat

SEQ ID NO: 123372 - DNA, 16 bp, H. sapiens
gtttgcttgttttaat

SEQ ID NO: 123373 - DNA, 16 bp, H. sapiens
gtttggaaaatttgca

SEQ ID NO: 123374 - DNA, 16 bp, H. sapiens
gtttggaaaattttca

SEQ ID NO: 123375 - DNA, 16 bp, H. sapiens
gtttggaaacattctt

SEQ ID NO: 123376 - DNA, 16 bp, H. sapiens
gtttggaaatattgtt

SEQ ID NO: 123377 - DNA, 16 bp, H. sapiens
gtttggagagagaaac

SEQ ID NO: 123378 - DNA, 16 bp, H. sapiens
gtttggagatttttca

SEQ ID NO: 123379 - DNA, 16 bp, H. sapiens
gtttggatctgtgtcc

SEQ ID NO: 123380 - DNA, 16 bp, H. sapiens
gtttggatgtttgtcc

SEQ ID NO: 123381 - DNA, 16 bp, H. sapiens
gtttggatttttgtcc

SEQ ID NO: 123382 - DNA, 16 bp, H. sapiens
gtttggcaatgagttt

SEQ ID NO: 123383 - DNA, 16 bp, H. sapiens
gtttggccaggctggt

SEQ ID NO: 123384 - DNA, 16 bp, H. sapiens
gtttggctggctggct

SEQ ID NO: 123385 - DNA, 16 bp, H. sapiens
gtttggctgggcacag

SEQ ID NO: 123386 - DNA, 16 bp, H. sapiens
gtttggctggggacag

SEQ ID NO: 123387 - DNA, 16 bp, H. sapiens
gtttgggaaaataaaa

SEQ ID NO: 123388 - DNA, 16 bp, H. sapiens
gtttgggaatctccac

SEQ ID NO: 123389 - DNA, 16 bp, H. sapiens
gtttgggagcctgagg

SEQ ID NO: 123390 - DNA, 18 bp, H. sapiens
gtttgggaggccaaggcg

SEQ ID NO: 123391 - DNA, 16 bp, H. sapiens
gtttgggaggccgaag

SEQ ID NO: 123392 - DNA, 21 bp, H. sapiens
gtttgggaggctgaggcaggt

SEQ ID NO: 123393 - DNA, 16 bp, H. sapiens
gtttggggcttccacc

SEQ ID NO: 123394 - DNA, 16 bp, H. sapiens
gtttggtaaattttcc

SEQ ID NO: 123395 - DNA, 16 bp, H. sapiens
gtttggtactatccac

SEQ ID NO: 123396 - DNA, 16 bp, H. sapiens
gtttggtagaattcag

SEQ ID NO: 123397 - DNA, 16 bp, H. sapiens
gtttggtatacagatt

SEQ ID NO: 123398 - DNA, 16 bp, H. sapiens
gtttggtcttgcttct

SEQ ID NO: 123399 - DNA, 16 bp, H. sapiens
gtttggtgcaggagca

SEQ ID NO: 123400 - DNA, 16 bp, H. sapiens
gtttggtggcacatgc

SEQ ID NO: 123401 - DNA, 16 bp, H. sapiens
gtttggtggtgcatgc

SEQ ID NO: 123402 - DNA, 16 bp, H. sapiens
gtttgtaaaagaaaaa

SEQ ID NO: 123403 - DNA, 16 bp, H. sapiens
gtttgtaaaatgcacc

SEQ ID NO: 123404 - DNA, 16 bp, H. sapiens
gtttgtaaatgtacca

SEQ ID NO: 123405 - DNA, 16 bp, H. sapiens
gtttgtagttctcatt

SEQ ID NO: 123406 - DNA, 16 bp, H. sapiens
gtttgtctacaagtat

SEQ ID NO: 123407 - DNA, 16 bp, H. sapiens
gtttgtcttttaaaaa

SEQ ID NO: 123408 - DNA, 16 bp, H. sapiens
gtttgtgaaatgaatg

SEQ ID NO: 123409 - DNA, 19 bp, H. sapiens
gtttgtgaatgcaccaatc

SEQ ID NO: 123410 - DNA, 16 bp, H. sapiens
gtttgtgccactgcac

SEQ ID NO: 123411 - DNA, 16 bp, H. sapiens
gtttgtggtgatgctg

SEQ ID NO: 123412 - DNA, 16 bp, H. sapiens
gtttgtgtacaagttt

SEQ ID NO: 123413 - DNA, 16 bp, H. sapiens
gtttgtgtgtgtatga

SEQ ID NO: 123414 - DNA, 16 bp, H. sapiens
gtttgttaattttctg

SEQ ID NO: 123415 - DNA, 16 bp, H. sapiens
gtttgttcaggttttg

SEQ ID NO: 123416 - DNA, 16 bp, H. sapiens
gtttgttcatctgtaa

SEQ ID NO: 123417 - DNA, 16 bp, H. sapiens
gtttgttctcacactg

SEQ ID NO: 123418 - DNA, 16 bp, H. sapiens
gtttgttgtgaagatt

SEQ ID NO: 123419 - DNA, 16 bp, H. sapiens
gtttgttgtgagaatt

SEQ ID NO: 123420 - DNA, 16 bp, H. sapiens
gtttgtttgtttcaat

SEQ ID NO: 123421 - DNA, 16 bp, H. sapiens
gtttgttttaaagaaa

SEQ ID NO: 123422 - DNA, 16 bp, H. sapiens
gtttgttttatggccc

SEQ ID NO: 123423 - DNA, 16 bp, H. sapiens
gtttgttttttaaaca

SEQ ID NO: 123424 - DNA, 16 bp, H. sapiens
gttttaaaaatgagag

SEQ ID NO: 123425 - DNA, 16 bp, H. sapiens
gttttaaaacttttaa

SEQ ID NO: 123426 - DNA, 16 bp, H. sapiens
gttttaaaagaagaaa

SEQ ID NO: 123427 - DNA, 16 bp, H. sapiens
gttttaaaaggttttt

SEQ ID NO: 123428 - DNA, 16 bp, H. sapiens
gttttaaaagtgtttg

SEQ ID NO: 123429 - DNA, 16 bp, H. sapiens
gttttaaaagttaaaa

SEQ ID NO: 123430 - DNA, 16 bp, H. sapiens
gttttaaaatatgcat

SEQ ID NO: 123431 - DNA, 16 bp, H. sapiens
gttttaaaatgtgagg

SEQ ID NO: 123432 - DNA, 16 bp, H. sapiens
gttttaaaattcatgt

SEQ ID NO: 123433 - DNA, 16 bp, H. sapiens
gttttaaacctttaat

SEQ ID NO: 123434 - DNA, 16 bp, H. sapiens
gttttaaattgcattt

SEQ ID NO: 123435 - DNA, 16 bp, H. sapiens
gttttaaattgtgtgc

SEQ ID NO: 123436 - DNA, 16 bp, H. sapiens
gttttaacagtttttt

SEQ ID NO: 123437 - DNA, 16 bp, H. sapiens
gttttaacatcatatt

SEQ ID NO: 123438 - DNA, 16 bp, H. sapiens
gttttaacattttctt

SEQ ID NO: 123439 - DNA, 16 bp, H. sapiens
gttttaagaaagttta

SEQ ID NO: 123440 - DNA, 16 bp, H. sapiens
gttttaagagctcttt

SEQ ID NO: 123441 - DNA, 16 bp, H. sapiens
gttttaagcccctcat

SEQ ID NO: 123442 - DNA, 16 bp, H. sapiens
gttttaagccctgcat

SEQ ID NO: 123443 - DNA, 16 bp, H. sapiens
gttttaagcctcacat

SEQ ID NO: 123444 - DNA, 16 bp, H. sapiens
gttttaagcctcgcat

SEQ ID NO: 123445 - DNA, 16 bp, H. sapiens
gttttaattaatgaaa

SEQ ID NO: 123446 - DNA, 16 bp, H. sapiens
gttttaattactatag

SEQ ID NO: 123447 - DNA, 16 bp, H. sapiens
gttttaatttctaata

SEQ ID NO: 123448 - DNA, 16 bp, H. sapiens
gttttaatttcttaat

SEQ ID NO: 123449 - DNA, 16 bp, H. sapiens
gttttaatttgcatct

SEQ ID NO: 123450 - DNA, 16 bp, H. sapiens
gttttaatttgcattt

SEQ ID NO: 123451 - DNA, 16 bp, H. sapiens
gttttaattttgaagt

SEQ ID NO: 123452 - DNA, 16 bp, H. sapiens
gttttacaaaatgaaa

SEQ ID NO: 123453 - DNA, 16 bp, H. sapiens
gttttacagacaagga

SEQ ID NO: 123454 - DNA, 16 bp, H. sapiens
gttttacagatgagga

SEQ ID NO: 123455 - DNA, 16 bp, H. sapiens
gttttacagtttttag

SEQ ID NO: 123456 - DNA, 16 bp, H. sapiens
gttttacagtttttct

SEQ ID NO: 123457 - DNA, 16 bp, H. sapiens
gttttactggtgaatt

SEQ ID NO: 123458 - DNA, 16 bp, H. sapiens
gttttacttccttgtt

SEQ ID NO: 123459 - DNA, 16 bp, H. sapiens
gttttactttttaaaa

SEQ ID NO: 123460 - DNA, 16 bp, H. sapiens
gttttacttttttaaa

SEQ ID NO: 123461 - DNA, 16 bp, H. sapiens
gttttagagcagtttt

SEQ ID NO: 123462 - DNA, 16 bp, H. sapiens
gttttagcaaagtgct

SEQ ID NO: 123463 - DNA, 16 bp, H. sapiens
gttttagtagaaatgg

SEQ ID NO: 123464 - DNA, 16 bp, H. sapiens
gttttagtagagacag

SEQ ID NO: 123465 - DNA, 21 bp, H. sapiens
gttttagtagagacggggttt

SEQ ID NO: 123466 - DNA, 24 bp, H. sapiens
gttttagtagagacggggtttcat

SEQ ID NO: 123467 - DNA, 23 bp, H. sapiens
gttttagtagagacggggtttct

SEQ ID NO: 123468 - DNA, 16 bp, H. sapiens
gttttagtagagatgg

SEQ ID NO: 123469 - DNA, 16 bp, H. sapiens
gttttagttccttgta

SEQ ID NO: 123470 - DNA, 16 bp, H. sapiens
gttttataaatgtctg

SEQ ID NO: 123471 - DNA, 16 bp, H. sapiens
gttttatagtggcttt

SEQ ID NO: 123472 - DNA, 16 bp, H. sapiens
gttttatatttcaaaa

SEQ ID NO: 123473 - DNA, 16 bp, H. sapiens
gttttatgatttcagg

SEQ ID NO: 123474 - DNA, 16 bp, H. sapiens
gttttatgttttcaaa

SEQ ID NO: 123475 - DNA, 16 bp, H. sapiens
gttttattaaaacaca

SEQ ID NO: 123476 - DNA, 16 bp, H. sapiens
gttttattaaaactaa

SEQ ID NO: 123477 - DNA, 16 bp, H. sapiens
gttttattactattat

SEQ ID NO: 123478 - DNA, 16 bp, H. sapiens
gttttattagaacata

SEQ ID NO: 123479 - DNA, 16 bp, H. sapiens
gttttattcttcttca

SEQ ID NO: 123480 - DNA, 16 bp, H. sapiens
gttttattgtgtctat

SEQ ID NO: 123481 - DNA, 16 bp, H. sapiens
gttttatttcattaag

SEQ ID NO: 123482 - DNA, 16 bp, H. sapiens
gttttatttcattgag

SEQ ID NO: 123483 - DNA, 16 bp, H. sapiens
gttttatttcctcctt

SEQ ID NO: 123484 - DNA, 16 bp, H. sapiens
gttttatttggaaaat

SEQ ID NO: 123485 - DNA, 16 bp, H. sapiens
gttttattttcaataa

SEQ ID NO: 123486 - DNA, 16 bp, H. sapiens
gttttcaaaagtattt

SEQ ID NO: 123487 - DNA, 16 bp, H. sapiens
gttttcaaaatacaat

SEQ ID NO: 123488 - DNA, 16 bp, H. sapiens
gttttcaaagcctttg

SEQ ID NO: 123489 - DNA, 16 bp, H. sapiens
gttttcaaatatttga

SEQ ID NO: 123490 - DNA, 16 bp, H. sapiens
gttttcaaattttgtt

SEQ ID NO: 123491 - DNA, 16 bp, H. sapiens
gttttcaactcctttg

SEQ ID NO: 123492 - DNA, 16 bp, H. sapiens
gttttcacagggaatg

SEQ ID NO: 123493 - DNA, 16 bp, H. sapiens
gttttcacatggtctt

SEQ ID NO: 123494 - DNA, 16 bp, H. sapiens
gttttcaccattaaaa

SEQ ID NO: 123495 - DNA, 16 bp, H. sapiens
gttttcagagacaggg

SEQ ID NO: 123496 - DNA, 16 bp, H. sapiens
gttttcagctctgtca

SEQ ID NO: 123497 - DNA, 16 bp, H. sapiens
gttttcaggtatcttt

SEQ ID NO: 123498 - DNA, 16 bp, H. sapiens
gttttcagtgtacatg

SEQ ID NO: 123499 - DNA, 16 bp, H. sapiens
gttttcagtttggggc

SEQ ID NO: 123500 - DNA, 16 bp, H. sapiens
gttttcagtttttcac

SEQ ID NO: 123501 - DNA, 16 bp, H. sapiens
gttttcatatgcttgt

SEQ ID NO: 123502 - DNA, 16 bp, H. sapiens
gttttcatttatttca

SEQ ID NO: 123503 - DNA, 16 bp, H. sapiens
gttttcatttctcatg

SEQ ID NO: 123504 - DNA, 16 bp, H. sapiens
gttttcattttaatat

SEQ ID NO: 123505 - DNA, 16 bp, H. sapiens
gttttcattttgatga

SEQ ID NO: 123506 - DNA, 16 bp, H. sapiens
gttttcatttttaaat

SEQ ID NO: 123507 - DNA, 16 bp, H. sapiens
gttttccaaaggggct

SEQ ID NO: 123508 - DNA, 16 bp, H. sapiens
gttttccaagggaatg

SEQ ID NO: 123509 - DNA, 16 bp, H. sapiens
gttttccaatgtggtt

SEQ ID NO: 123510 - DNA, 16 bp, H. sapiens
gttttccagcttgcag

SEQ ID NO: 123511 - DNA, 16 bp, H. sapiens
gttttccatgatggct

SEQ ID NO: 123512 - DNA, 16 bp, H. sapiens
gttttccatttgcatg

SEQ ID NO: 123513 - DNA, 16 bp, H. sapiens
gttttcccagcatcat

SEQ ID NO: 123514 - DNA, 16 bp, H. sapiens
gttttcccagctactc

SEQ ID NO: 123515 - DNA, 16 bp, H. sapiens
gttttcccagctactt

SEQ ID NO: 123516 - DNA, 16 bp, H. sapiens
gttttcctagttcctt

SEQ ID NO: 123517 - DNA, 16 bp, H. sapiens
gttttcctcaagatct

SEQ ID NO: 123518 - DNA, 16 bp, H. sapiens
gttttcctctaggatt

SEQ ID NO: 123519 - DNA, 16 bp, H. sapiens
gttttcctgcccagcc

SEQ ID NO: 123520 - DNA, 16 bp, H. sapiens
gttttcctgcttgaat

SEQ ID NO: 123521 - DNA, 16 bp, H. sapiens
gttttccttcttacag

SEQ ID NO: 123522 - DNA, 16 bp, H. sapiens
gttttccttgaaatga

SEQ ID NO: 123523 - DNA, 16 bp, H. sapiens
gttttccttttaataa

SEQ ID NO: 123524 - DNA, 16 bp, H. sapiens
gttttccttttagtga

SEQ ID NO: 123525 - DNA, 16 bp, H. sapiens
gttttccttttttaca

SEQ ID NO: 123526 - DNA, 16 bp, H. sapiens
gttttctaaaaattaa

SEQ ID NO: 123527 - DNA, 16 bp, H. sapiens
gttttctaaagtggtt

SEQ ID NO: 123528 - DNA, 16 bp, H. sapiens
gttttctaaattttta

SEQ ID NO: 123529 - DNA, 16 bp, H. sapiens
gttttctaatttctct

SEQ ID NO: 123530 - DNA, 16 bp, H. sapiens
gttttctaggtagaga

SEQ ID NO: 123531 - DNA, 16 bp, H. sapiens
gttttctagttctgtg

SEQ ID NO: 123532 - DNA, 16 bp, H. sapiens
gttttctcatcagtaa

SEQ ID NO: 123533 - DNA, 16 bp, H. sapiens
gttttctcatctataa

SEQ ID NO: 123534 - DNA, 16 bp, H. sapiens
gttttctcatttgcaa

SEQ ID NO: 123535 - DNA, 16 bp, H. sapiens
gttttctcctctgtga

SEQ ID NO: 123536 - DNA, 16 bp, H. sapiens
gttttctccttcctgg

SEQ ID NO: 123537 - DNA, 16 bp, H. sapiens
gttttctctaaaataa

SEQ ID NO: 123538 - DNA, 16 bp, H. sapiens
gttttctctctgtgtg

SEQ ID NO: 123539 - DNA, 16 bp, H. sapiens
gttttctgaaagaaaa

SEQ ID NO: 123540 - DNA, 16 bp, H. sapiens
gttttctgagccctcc

SEQ ID NO: 123541 - DNA, 16 bp, H. sapiens
gttttctgcacctatc

SEQ ID NO: 123542 - DNA, 16 bp, H. sapiens
gttttctgttacttgc

SEQ ID NO: 123543 - DNA, 16 bp, H. sapiens
gttttctgttcctatg

SEQ ID NO: 123544 - DNA, 16 bp, H. sapiens
gttttctgttgctgct

SEQ ID NO: 123545 - DNA, 16 bp, H. sapiens
gttttcttagaatctg

SEQ ID NO: 123546 - DNA, 16 bp, H. sapiens
gttttcttctagttgt

SEQ ID NO: 123547 - DNA, 16 bp, H. sapiens
gttttcttgctattaa

SEQ ID NO: 123548 - DNA, 16 bp, H. sapiens
gttttcttgctgacct

SEQ ID NO: 123549 - DNA, 16 bp, H. sapiens
gttttctttccagaaa

SEQ ID NO: 123550 - DNA, 16 bp, H. sapiens
gttttctttctagaaa

SEQ ID NO: 123551 - DNA, 16 bp, H. sapiens
gttttctttgctgtgc

SEQ ID NO: 123552 - DNA, 16 bp, H. sapiens
gttttcttttaaaaag

SEQ ID NO: 123553 - DNA, 16 bp, H. sapiens
gttttcttttaaaaat

SEQ ID NO: 123554 - DNA, 16 bp, H. sapiens
gttttcttttaagaat

SEQ ID NO: 123555 - DNA, 16 bp, H. sapiens
gttttcttttcctcca

SEQ ID NO: 123556 - DNA, 16 bp, H. sapiens
gttttctttttaataa

SEQ ID NO: 123557 - DNA, 16 bp, H. sapiens
gttttcttttttaaaa

SEQ ID NO: 123558 - DNA, 16 bp, H. sapiens
gttttgaaactctctt

SEQ ID NO: 123559 - DNA, 16 bp, H. sapiens
gttttgaaaggttatt

SEQ ID NO: 123560 - DNA, 16 bp, H. sapiens
gttttgaaatatgaaa

SEQ ID NO: 123561 - DNA, 16 bp, H. sapiens
gttttgaaattgaaaa

SEQ ID NO: 123562 - DNA, 16 bp, H. sapiens
gttttgaaattttaaa

SEQ ID NO: 123563 - DNA, 16 bp, H. sapiens
gttttgagaatcaaat

SEQ ID NO: 123564 - DNA, 16 bp, H. sapiens
gttttgagagttcttc

SEQ ID NO: 123565 - DNA, 16 bp, H. sapiens
gttttgaggagtactg

SEQ ID NO: 123566 - DNA, 16 bp, H. sapiens
gttttgatttacattt

SEQ ID NO: 123567 - DNA, 16 bp, H. sapiens
gttttgatttgcattc

SEQ ID NO: 123568 - DNA, 16 bp, H. sapiens
gttttgatttgcattt

SEQ ID NO: 123569 - DNA, 16 bp, H. sapiens
gttttgcagatgagaa

SEQ ID NO: 123570 - DNA, 16 bp, H. sapiens
gttttgccatgttagc

SEQ ID NO: 123571 - DNA, 20 bp, H. sapiens
gttttgccatgttgcccaga

SEQ ID NO: 123572 - DNA, 16 bp, H. sapiens
gttttgcctcttccag

SEQ ID NO: 123573 - DNA, 16 bp, H. sapiens
gttttgcctttttaaa

SEQ ID NO: 123574 - DNA, 16 bp, H. sapiens
gttttgctcttgtccc

SEQ ID NO: 123575 - DNA, 16 bp, H. sapiens
gttttgctcttgttcc

SEQ ID NO: 123576 - DNA, 16 bp, H. sapiens
gttttgctgtgtctcc

SEQ ID NO: 123577 - DNA, 16 bp, H. sapiens
gttttgctttgcattt

SEQ ID NO: 123578 - DNA, 16 bp, H. sapiens
gttttggaagagtttg

SEQ ID NO: 123579 - DNA, 16 bp, H. sapiens
gttttggacatgaagt

SEQ ID NO: 123580 - DNA, 16 bp, H. sapiens
gttttggaggctggaa

SEQ ID NO: 123581 - DNA, 16 bp, H. sapiens
gttttggatttcttta

SEQ ID NO: 123582 - DNA, 16 bp, H. sapiens
gttttggcaggttttg

SEQ ID NO: 123583 - DNA, 16 bp, H. sapiens
gttttggctgggcgtg

SEQ ID NO: 123584 - DNA, 16 bp, H. sapiens
gttttgggccacacat

SEQ ID NO: 123585 - DNA, 16 bp, H. sapiens
gttttggtaccagtcc

SEQ ID NO: 123586 - DNA, 16 bp, H. sapiens
gttttggtatcacagt

SEQ ID NO: 123587 - DNA, 16 bp, H. sapiens
gttttggtatcagaat

SEQ ID NO: 123588 - DNA, 16 bp, H. sapiens
gttttgtaaaataaaa

SEQ ID NO: 123589 - DNA, 16 bp, H. sapiens
gttttgtaaataaagt

SEQ ID NO: 123590 - DNA, 16 bp, H. sapiens
gttttgtaaatgtctg

SEQ ID NO: 123591 - DNA, 16 bp, H. sapiens
gttttgtaagaaacca

SEQ ID NO: 123592 - DNA, 16 bp, H. sapiens
gttttgtagaagacaa

SEQ ID NO: 123593 - DNA, 16 bp, H. sapiens
gttttgtcatatctct

SEQ ID NO: 123594 - DNA, 16 bp, H. sapiens
gttttgtctgcagctc

SEQ ID NO: 123595 - DNA, 16 bp, H. sapiens
gttttgtcttttaaaa

SEQ ID NO: 123596 - DNA, 16 bp, H. sapiens
gttttgtgactggctt

SEQ ID NO: 123597 - DNA, 16 bp, H. sapiens
gttttgttctgtcacc

SEQ ID NO: 123598 - DNA, 16 bp, H. sapiens
gttttgttttacaaat

SEQ ID NO: 123599 - DNA, 16 bp, H. sapiens
gttttgttttgagaca

SEQ ID NO: 123600 - DNA, 16 bp, H. sapiens
gttttgtttttaaagg

SEQ ID NO: 123601 - DNA, 16 bp, H. sapiens
gttttgtttttaagag

SEQ ID NO: 123602 - DNA, 16 bp, H. sapiens
gttttgtttttgatac

SEQ ID NO: 123603 - DNA, 16 bp, H. sapiens
gtttttaaaaaggaat

SEQ ID NO: 123604 - DNA, 16 bp, H. sapiens
gtttttaaaaagtaaa

SEQ ID NO: 123605 - DNA, 16 bp, H. sapiens
gtttttaaaaatgcag

SEQ ID NO: 123606 - DNA, 16 bp, H. sapiens
gtttttaaaacatttt

SEQ ID NO: 123607 - DNA, 16 bp, H. sapiens
gtttttaaaacttatt

SEQ ID NO: 123608 - DNA, 16 bp, H. sapiens
gtttttaaacattttt

SEQ ID NO: 123609 - DNA, 16 bp, H. sapiens
gtttttaaagaaactg

SEQ ID NO: 123610 - DNA, 16 bp, H. sapiens
gtttttaaaggaaaaa

SEQ ID NO: 123611 - DNA, 16 bp, H. sapiens
gtttttaaagtattaa

SEQ ID NO: 123612 - DNA, 16 bp, H. sapiens
gtttttaaatgtcttt

SEQ ID NO: 123613 - DNA, 16 bp, H. sapiens
gtttttaaatgttctt

SEQ ID NO: 123614 - DNA, 16 bp, H. sapiens
gtttttaacatgaaaa

SEQ ID NO: 123615 - DNA, 16 bp, H. sapiens
gtttttaacttccttg

SEQ ID NO: 123616 - DNA, 16 bp, H. sapiens
gtttttaactttttaa

SEQ ID NO: 123617 - DNA, 16 bp, H. sapiens
gtttttaagttctttg

SEQ ID NO: 123618 - DNA, 16 bp, H. sapiens
gtttttaatcacaaat

SEQ ID NO: 123619 - DNA, 16 bp, H. sapiens
gtttttacaggcacag

SEQ ID NO: 123620 - DNA, 16 bp, H. sapiens
gtttttaccaaaaatg

SEQ ID NO: 123621 - DNA, 16 bp, H. sapiens
gtttttacttgcattt

SEQ ID NO: 123622 - DNA, 16 bp, H. sapiens
gtttttagacttttta

SEQ ID NO: 123623 - DNA, 16 bp, H. sapiens
gtttttatatgaagaa

SEQ ID NO: 123624 - DNA, 16 bp, H. sapiens
gtttttatatgaagtt

SEQ ID NO: 123625 - DNA, 16 bp, H. sapiens
gtttttatcaaatttg

SEQ ID NO: 123626 - DNA, 16 bp, H. sapiens
gtttttatcataaagg

SEQ ID NO: 123627 - DNA, 16 bp, H. sapiens
gtttttatccattctg

SEQ ID NO: 123628 - DNA, 16 bp, H. sapiens
gtttttatctgaaggt

SEQ ID NO: 123629 - DNA, 16 bp, H. sapiens
gtttttatggaggctt

SEQ ID NO: 123630 - DNA, 16 bp, H. sapiens
gtttttatttctaaaa

SEQ ID NO: 123631 - DNA, 16 bp, H. sapiens
gtttttattttgagaa

SEQ ID NO: 123632 - DNA, 16 bp, H. sapiens
gtttttcaaagggaat

SEQ ID NO: 123633 - DNA, 16 bp, H. sapiens
gtttttcaaggaattg

SEQ ID NO: 123634 - DNA, 16 bp, H. sapiens
gtttttcaccattcag

SEQ ID NO: 123635 - DNA, 16 bp, H. sapiens
gtttttcataatggtt

SEQ ID NO: 123636 - DNA, 16 bp, H. sapiens
gtttttcatatttaaa

SEQ ID NO: 123637 - DNA, 16 bp, H. sapiens
gtttttcattttctca

SEQ ID NO: 123638 - DNA, 16 bp, H. sapiens
gtttttccaaactgct

SEQ ID NO: 123639 - DNA, 16 bp, H. sapiens
gtttttcccttccggc

SEQ ID NO: 123640 - DNA, 16 bp, H. sapiens
gtttttcctttccatg

SEQ ID NO: 123641 - DNA, 16 bp, H. sapiens
gtttttctaaaggaaa

SEQ ID NO: 123642 - DNA, 16 bp, H. sapiens
gtttttctagttcctt

SEQ ID NO: 123643 - DNA, 16 bp, H. sapiens
gtttttctataaatta

SEQ ID NO: 123644 - DNA, 16 bp, H. sapiens
gtttttctcatctgca

SEQ ID NO: 123645 - DNA, 16 bp, H. sapiens
gtttttctggaaaaag

SEQ ID NO: 123646 - DNA, 16 bp, H. sapiens
gtttttctggagaacc

SEQ ID NO: 123647 - DNA, 16 bp, H. sapiens
gtttttctgtgcctgg

SEQ ID NO: 123648 - DNA, 16 bp, H. sapiens
gtttttcttaaagcac

SEQ ID NO: 123649 - DNA, 16 bp, H. sapiens
gtttttcttcatcttc

SEQ ID NO: 123650 - DNA, 16 bp, H. sapiens
gtttttgaaagagttt

SEQ ID NO: 123651 - DNA, 16 bp, H. sapiens
gtttttgaagtggctg

SEQ ID NO: 123652 - DNA, 16 bp, H. sapiens
gtttttgagaatgtgt

SEQ ID NO: 123653 - DNA, 16 bp, H. sapiens
gtttttgaggaacttc

SEQ ID NO: 123654 - DNA, 16 bp, H. sapiens
gtttttgcagagatgg

SEQ ID NO: 123655 - DNA, 16 bp, H. sapiens
gtttttgccattactt

SEQ ID NO: 123656 - DNA, 16 bp, H. sapiens
gtttttgcctacattt

SEQ ID NO: 123657 - DNA, 16 bp, H. sapiens
gtttttgctttttaaa

SEQ ID NO: 123658 - DNA, 16 bp, H. sapiens
gtttttggaaggaaga

SEQ ID NO: 123659 - DNA, 16 bp, H. sapiens
gtttttgggaaacagg

SEQ ID NO: 123660 - DNA, 16 bp, H. sapiens
gtttttggtgtccatt

SEQ ID NO: 123661 - DNA, 16 bp, H. sapiens
gtttttggttacatga

SEQ ID NO: 123662 - DNA, 16 bp, H. sapiens
gtttttgtaataaaaa

SEQ ID NO: 123663 - DNA, 16 bp, H. sapiens
gtttttgtccagtttg

SEQ ID NO: 123664 - DNA, 16 bp, H. sapiens
gtttttgtctttaaat

SEQ ID NO: 123665 - DNA, 16 bp, H. sapiens
gtttttgtgtcctctg

SEQ ID NO: 123666 - DNA, 16 bp, H. sapiens
gtttttgtgtggacat

SEQ ID NO: 123667 - DNA, 16 bp, H. sapiens
gtttttgttgcattta

SEQ ID NO: 123668 - DNA, 16 bp, H. sapiens
gttttttaaaaaacta

SEQ ID NO: 123669 - DNA, 16 bp, H. sapiens
gttttttaaaaaagca

SEQ ID NO: 123670 - DNA, 16 bp, H. sapiens
gttttttaaatgcttt

SEQ ID NO: 123671 - DNA, 23 bp, H. sapiens
gttttttatggctgcatagtatt

SEQ ID NO: 123672 - DNA, 16 bp, H. sapiens
gttttttattactgat

SEQ ID NO: 123673 - DNA, 16 bp, H. sapiens
gttttttctagttctg

SEQ ID NO: 123674 - DNA, 16 bp, H. sapiens
gttttttgaaaaagtt

SEQ ID NO: 123675 - DNA, 22 bp, H. sapiens
gttttttgagacagagtctcac

SEQ ID NO: 123676 - DNA, 20 bp, H. sapiens
gttttttgagacagagtctt

SEQ ID NO: 123677 - DNA, 20 bp, H. sapiens
gttttttgagacagggtctc

SEQ ID NO: 123678 - DNA, 16 bp, H. sapiens
gttttttgagatggtg

SEQ ID NO: 123679 - DNA, 16 bp, H. sapiens
gttttttgccttttag

SEQ ID NO: 123680 - DNA, 16 bp, H. sapiens
gttttttggaattttc

SEQ ID NO: 123681 - DNA, 18 bp, H. sapiens
gttttttgtagagatgga

SEQ ID NO: 123682 - DNA, 16 bp, H. sapiens
gttttttgtagattct

SEQ ID NO: 123683 - DNA, 16 bp, H. sapiens
gtttttttaaagaaaa

SEQ ID NO: 123684 - DNA, 16 bp, H. sapiens
gtttttttagtaaaga

SEQ ID NO: 123685 - DNA, 16 bp, H. sapiens
gtttttttccaattct

SEQ ID NO: 123686 - DNA, 16 bp, H. sapiens
gtttttttccccactt

SEQ ID NO: 123687 - DNA, 16 bp, H. sapiens
gtttttttctttaaaa

SEQ ID NO: 123688 - DNA, 18 bp, H. sapiens
gtttttttgagacagggt

SEQ ID NO: 123689 - DNA, 19 bp, H. sapiens
gtttttttgagacggagtc

SEQ ID NO: 123690 - DNA, 17 bp, H. sapiens
gttttttttgagacagg

SEQ ID NO: 123691 - DNA, 16 bp, H. sapiens
taaaaaaaaatacttg

SEQ ID NO: 123692 - DNA, 16 bp, H. sapiens
taaaaaaaaatccatg

SEQ ID NO: 123693 - DNA, 16 bp, H. sapiens
taaaaaaaaatcctct

SEQ ID NO: 123694 - DNA, 16 bp, H. sapiens
taaaaaaaagtcttaa

SEQ ID NO: 123695 - DNA, 16 bp, H. sapiens
taaaaaaaagttgttt

SEQ ID NO: 123696 - DNA, 16 bp, H. sapiens
taaaaaaaatcttgtt

SEQ ID NO: 123697 - DNA, 16 bp, H. sapiens
taaaaaaagatgagtt

SEQ ID NO: 123698 - DNA, 16 bp, H. sapiens
taaaaaaataagccag

SEQ ID NO: 123699 - DNA, 16 bp, H. sapiens
taaaaaaatagctggg

SEQ ID NO: 123700 - DNA, 16 bp, H. sapiens
taaaaaaatgctttat

SEQ ID NO: 123701 - DNA, 16 bp, H. sapiens
taaaaaacaaagtttt

SEQ ID NO: 123702 - DNA, 16 bp, H. sapiens
taaaaaactggaaaca

SEQ ID NO: 123703 - DNA, 16 bp, H. sapiens
taaaaaactgtatttt

SEQ ID NO: 123704 - DNA, 16 bp, H. sapiens
taaaaaagagcctgaa

SEQ ID NO: 123705 - DNA, 16 bp, H. sapiens
taaaaaagatacttgc

SEQ ID NO: 123706 - DNA, 16 bp, H. sapiens
taaaaaagcaaattca

SEQ ID NO: 123707 - DNA, 16 bp, H. sapiens
taaaaaagcaagagca

SEQ ID NO: 123708 - DNA, 16 bp, H. sapiens
taaaaaaggaaatatc

SEQ ID NO: 123709 - DNA, 16 bp, H. sapiens
taaaaaaggatgaatt

SEQ ID NO: 123710 - DNA, 16 bp, H. sapiens
taaaaaaggatgattt

SEQ ID NO: 123711 - DNA, 16 bp, H. sapiens
taaaaaaggatttttt

SEQ ID NO: 123712 - DNA, 16 bp, H. sapiens
taaaaaatatgtgaga

SEQ ID NO: 123713 - DNA, 16 bp, H. sapiens
taaaaaatcaatgtgc

SEQ ID NO: 123714 - DNA, 16 bp, H. sapiens
taaaaaatgatttgtt

SEQ ID NO: 123715 - DNA, 16 bp, H. sapiens
taaaaaatgttgagtt

SEQ ID NO: 123716 - DNA, 16 bp, H. sapiens
taaaaaatgttgatct

SEQ ID NO: 123717 - DNA, 16 bp, H. sapiens
taaaaaatgtttccaa

SEQ ID NO: 123718 - DNA, 16 bp, H. sapiens
taaaaaatgttttgtt

SEQ ID NO: 123719 - DNA, 16 bp, H. sapiens
taaaaaattaaatgac

SEQ ID NO: 123720 - DNA, 16 bp, H. sapiens
taaaaaattcacagaa

SEQ ID NO: 123721 - DNA, 16 bp, H. sapiens
taaaaaattgtttgaa

SEQ ID NO: 123722 - DNA, 16 bp, H. sapiens
taaaaacaaattgtat

SEQ ID NO: 123723 - DNA, 16 bp, H. sapiens
taaaaacaaatttgtt

SEQ ID NO: 123724 - DNA, 16 bp, H. sapiens
taaaaacacagaattt

SEQ ID NO: 123725 - DNA, 16 bp, H. sapiens
taaaaacacatacatg

SEQ ID NO: 123726 - DNA, 16 bp, H. sapiens
taaaaacacctttaaa

SEQ ID NO: 123727 - DNA, 16 bp, H. sapiens
taaaaacactggaaga

SEQ ID NO: 123728 - DNA, 16 bp, H. sapiens
taaaaacagaaaatgt

SEQ ID NO: 123729 - DNA, 16 bp, H. sapiens
taaaaacagctttaaa

SEQ ID NO: 123730 - DNA, 16 bp, H. sapiens
taaaaacataaatgta

SEQ ID NO: 123731 - DNA, 16 bp, H. sapiens
taaaaacatgacagaa

SEQ ID NO: 123732 - DNA, 16 bp, H. sapiens
taaaaacatgcaagaa

SEQ ID NO: 123733 - DNA, 16 bp, H. sapiens
taaaaacatgtccaca

SEQ ID NO: 123734 - DNA, 16 bp, H. sapiens
taaaaacattcctttt

SEQ ID NO: 123735 - DNA, 16 bp, H. sapiens
taaaaacatttaagaa

SEQ ID NO: 123736 - DNA, 16 bp, H. sapiens
taaaaacatttttact

SEQ ID NO: 123737 - DNA, 16 bp, H. sapiens
taaaaaccagagagaa

SEQ ID NO: 123738 - DNA, 16 bp, H. sapiens
taaaaaccagtgaatt

SEQ ID NO: 123739 - DNA, 16 bp, H. sapiens
taaaaaccattcttag

SEQ ID NO: 123740 - DNA, 16 bp, H. sapiens
taaaaacccatctcta

SEQ ID NO: 123741 - DNA, 16 bp, H. sapiens
taaaaacctgtacaca

SEQ ID NO: 123742 - DNA, 16 bp, H. sapiens
taaaaactacatgatt

SEQ ID NO: 123743 - DNA, 16 bp, H. sapiens
taaaaactactgaatt

SEQ ID NO: 123744 - DNA, 16 bp, H. sapiens
taaaaactataatctt

SEQ ID NO: 123745 - DNA, 16 bp, H. sapiens
taaaaactatagtttt

SEQ ID NO: 123746 - DNA, 16 bp, H. sapiens
taaaaactctcaagaa

SEQ ID NO: 123747 - DNA, 16 bp, H. sapiens
taaaaactggaaagga

SEQ ID NO: 123748 - DNA, 16 bp, H. sapiens
taaaaactggaaggaa

SEQ ID NO: 123749 - DNA, 16 bp, H. sapiens
taaaaacttctgttca

SEQ ID NO: 123750 - DNA, 16 bp, H. sapiens
taaaaacttgtttttt

SEQ ID NO: 123751 - DNA, 16 bp, H. sapiens
taaaaactttaaaaga

SEQ ID NO: 123752 - DNA, 16 bp, H. sapiens
taaaaactttggaaga

SEQ ID NO: 123753 - DNA, 16 bp, H. sapiens
taaaaacttttgtttt

SEQ ID NO: 123754 - DNA, 16 bp, H. sapiens
taaaaagaaaacctga

SEQ ID NO: 123755 - DNA, 16 bp, H. sapiens
taaaaagaaagcagag

SEQ ID NO: 123756 - DNA, 16 bp, H. sapiens
taaaaagaaatatgct

SEQ ID NO: 123757 - DNA, 16 bp, H. sapiens
taaaaagaacattttc

SEQ ID NO: 123758 - DNA, 16 bp, H. sapiens
taaaaagaactcttaa

SEQ ID NO: 123759 - DNA, 16 bp, H. sapiens
taaaaagacaacctaa

SEQ ID NO: 123760 - DNA, 16 bp, H. sapiens
taaaaagactgataat

SEQ ID NO: 123761 - DNA, 16 bp, H. sapiens
taaaaagatatgttga

SEQ ID NO: 123762 - DNA, 16 bp, H. sapiens
taaaaagatgaatttt

SEQ ID NO: 123763 - DNA, 16 bp, H. sapiens
taaaaagatgttttat

SEQ ID NO: 123764 - DNA, 16 bp, H. sapiens
taaaaagatttttctt

SEQ ID NO: 123765 - DNA, 16 bp, H. sapiens
taaaaagcaaacattt

SEQ ID NO: 123766 - DNA, 16 bp, H. sapiens
taaaaagcaatgagat

SEQ ID NO: 123767 - DNA, 16 bp, H. sapiens
taaaaagcacatttaa

SEQ ID NO: 123768 - DNA, 16 bp, H. sapiens
taaaaagcaggaagaa

SEQ ID NO: 123769 - DNA, 16 bp, H. sapiens
taaaaagcattaaaat

SEQ ID NO: 123770 - DNA, 16 bp, H. sapiens
taaaaagcattttaaa

SEQ ID NO: 123771 - DNA, 16 bp, H. sapiens
taaaaagcattttata

SEQ ID NO: 123772 - DNA, 16 bp, H. sapiens
taaaaagcctagaaga

SEQ ID NO: 123773 - DNA, 16 bp, H. sapiens
taaaaaggaacaagat

SEQ ID NO: 123774 - DNA, 16 bp, H. sapiens
taaaaaggaagaaact

SEQ ID NO: 123775 - DNA, 16 bp, H. sapiens
taaaaaggatcttatt

SEQ ID NO: 123776 - DNA, 16 bp, H. sapiens
taaaaagggtgaattt

SEQ ID NO: 123777 - DNA, 16 bp, H. sapiens
taaaaaggtattttat

SEQ ID NO: 123778 - DNA, 16 bp, H. sapiens
taaaaaggtattttta

SEQ ID NO: 123779 - DNA, 16 bp, H. sapiens
taaaaagtatctgaaa

SEQ ID NO: 123780 - DNA, 16 bp, H. sapiens
taaaaagtattttctt

SEQ ID NO: 123781 - DNA, 16 bp, H. sapiens
taaaaagtcacaaaat

SEQ ID NO: 123782 - DNA, 16 bp, H. sapiens
taaaaagtcaggaaag

SEQ ID NO: 123783 - DNA, 16 bp, H. sapiens
taaaaagtcataaaat

SEQ ID NO: 123784 - DNA, 16 bp, H. sapiens
taaaaagtggatctca

SEQ ID NO: 123785 - DNA, 16 bp, H. sapiens
taaaaagtgtgtgtgt

SEQ ID NO: 123786 - DNA, 16 bp, H. sapiens
taaaaagttaaaatct

SEQ ID NO: 123787 - DNA, 16 bp, H. sapiens
taaaaagttacaggaa

SEQ ID NO: 123788 - DNA, 16 bp, H. sapiens
taaaaagttattgaat

SEQ ID NO: 123789 - DNA, 16 bp, H. sapiens
taaaaagtttactttt

SEQ ID NO: 123790 - DNA, 16 bp, H. sapiens
taaaaagtttcttttt

SEQ ID NO: 123791 - DNA, 16 bp, H. sapiens
taaaaagttttgtaaa

SEQ ID NO: 123792 - DNA, 16 bp, H. sapiens
taaaaagttttttctt

SEQ ID NO: 123793 - DNA, 16 bp, H. sapiens
taaaaataaaagcagt

SEQ ID NO: 123794 - DNA, 16 bp, H. sapiens
taaaaataaatctgtt

SEQ ID NO: 123795 - DNA, 16 bp, H. sapiens
taaaaataaatgtaca

SEQ ID NO: 123796 - DNA, 16 bp, H. sapiens
taaaaataagaacatt

SEQ ID NO: 123797 - DNA, 16 bp, H. sapiens
taaaaataagacaatt

SEQ ID NO: 123798 - DNA, 16 bp, H. sapiens
taaaaataagacatgg

SEQ ID NO: 123799 - DNA, 16 bp, H. sapiens
taaaaataagcttttt

SEQ ID NO: 123800 - DNA, 16 bp, H. sapiens
taaaaataagtctttt

SEQ ID NO: 123801 - DNA, 16 bp, H. sapiens
taaaaataagtgtttt

SEQ ID NO: 123802 - DNA, 16 bp, H. sapiens
taaaaataatattgca

SEQ ID NO: 123803 - DNA, 16 bp, H. sapiens
taaaaataatgagatc

SEQ ID NO: 123804 - DNA, 16 bp, H. sapiens
taaaaataattatgct

SEQ ID NO: 123805 - DNA, 16 bp, H. sapiens
taaaaataattctctt

SEQ ID NO: 123806 - DNA, 16 bp, H. sapiens
taaaaataattttgga

SEQ ID NO: 123807 - DNA, 16 bp, H. sapiens
taaaaatacagtataa

SEQ ID NO: 123808 - DNA, 16 bp, H. sapiens
taaaaatacagtgaaa

SEQ ID NO: 123809 - DNA, 16 bp, H. sapiens
taaaaatacagtgtaa

SEQ ID NO: 123810 - DNA, 16 bp, H. sapiens
taaaaatactggaaga

SEQ ID NO: 123811 - DNA, 16 bp, H. sapiens
taaaaatactttgaaa

SEQ ID NO: 123812 - DNA, 16 bp, H. sapiens
taaaaatagaattgcc

SEQ ID NO: 123813 - DNA, 16 bp, H. sapiens
taaaaatagctttatt

SEQ ID NO: 123814 - DNA, 16 bp, H. sapiens
taaaaatagctttttt

SEQ ID NO: 123815 - DNA, 16 bp, H. sapiens
taaaaataggatgtgt

SEQ ID NO: 123816 - DNA, 16 bp, H. sapiens
taaaaataggcaaaag

SEQ ID NO: 123817 - DNA, 16 bp, H. sapiens
taaaaatagtttattg

SEQ ID NO: 123818 - DNA, 16 bp, H. sapiens
taaaaatagttttaga

SEQ ID NO: 123819 - DNA, 16 bp, H. sapiens
taaaaatataagaact

SEQ ID NO: 123820 - DNA, 16 bp, H. sapiens
taaaaatatatacctt

SEQ ID NO: 123821 - DNA, 16 bp, H. sapiens
taaaaatatctttgaa

SEQ ID NO: 123822 - DNA, 16 bp, H. sapiens
taaaaatatgaacaat

SEQ ID NO: 123823 - DNA, 16 bp, H. sapiens
taaaaatatgtatttc

SEQ ID NO: 123824 - DNA, 16 bp, H. sapiens
taaaaatatgtcaaaa

SEQ ID NO: 123825 - DNA, 16 bp, H. sapiens
taaaaatatgtcttaa

SEQ ID NO: 123826 - DNA, 16 bp, H. sapiens
taaaaatatgtgtata

SEQ ID NO: 123827 - DNA, 16 bp, H. sapiens
taaaaatattacagta

SEQ ID NO: 123828 - DNA, 16 bp, H. sapiens
taaaaatattactcta

SEQ ID NO: 123829 - DNA, 16 bp, H. sapiens
taaaaatattcatgta

SEQ ID NO: 123830 - DNA, 16 bp, H. sapiens
taaaaatattccttaa

SEQ ID NO: 123831 - DNA, 16 bp, H. sapiens
taaaaatattctttca

SEQ ID NO: 123832 - DNA, 16 bp, H. sapiens
taaaaatattgctttt

SEQ ID NO: 123833 - DNA, 16 bp, H. sapiens
taaaaatattgtttct

SEQ ID NO: 123834 - DNA, 16 bp, H. sapiens
taaaaatattgttttg

SEQ ID NO: 123835 - DNA, 16 bp, H. sapiens
taaaaatatttctcta

SEQ ID NO: 123836 - DNA, 16 bp, H. sapiens
taaaaatcaaagcaga

SEQ ID NO: 123837 - DNA, 16 bp, H. sapiens
taaaaatcactatttt

SEQ ID NO: 123838 - DNA, 16 bp, H. sapiens
taaaaatcagattatt

SEQ ID NO: 123839 - DNA, 16 bp, H. sapiens
taaaaatcaggaaaat

SEQ ID NO: 123840 - DNA, 16 bp, H. sapiens
taaaaatccacttgta

SEQ ID NO: 123841 - DNA, 16 bp, H. sapiens
taaaaatccattttat

SEQ ID NO: 123842 - DNA, 16 bp, H. sapiens
taaaaatcctggaaga

SEQ ID NO: 123843 - DNA, 16 bp, H. sapiens
taaaaatccttatttt

SEQ ID NO: 123844 - DNA, 16 bp, H. sapiens
taaaaatctattctct

SEQ ID NO: 123845 - DNA, 16 bp, H. sapiens
taaaaatctgtaaaat

SEQ ID NO: 123846 - DNA, 16 bp, H. sapiens
taaaaatctgtttatt

SEQ ID NO: 123847 - DNA, 16 bp, H. sapiens
taaaaatcttcccaca

SEQ ID NO: 123848 - DNA, 16 bp, H. sapiens
taaaaatctttgtctt

SEQ ID NO: 123849 - DNA, 16 bp, H. sapiens
taaaaatgaaaactga

SEQ ID NO: 123850 - DNA, 16 bp, H. sapiens
taaaaatgaaaattct

SEQ ID NO: 123851 - DNA, 16 bp, H. sapiens
taaaaatgaaacaatt

SEQ ID NO: 123852 - DNA, 16 bp, H. sapiens
taaaaatgaaacacat

SEQ ID NO: 123853 - DNA, 16 bp, H. sapiens
taaaaatgaaattgtt

SEQ ID NO: 123854 - DNA, 16 bp, H. sapiens
taaaaatgaacattaa

SEQ ID NO: 123855 - DNA, 16 bp, H. sapiens
taaaaatgaagacaca

SEQ ID NO: 123856 - DNA, 16 bp, H. sapiens
taaaaatgaagttttt

SEQ ID NO: 123857 - DNA, 16 bp, H. sapiens
taaaaatgaatacata

SEQ ID NO: 123858 - DNA, 16 bp, H. sapiens
taaaaatgaatgaact

SEQ ID NO: 123859 - DNA, 16 bp, H. sapiens
taaaaatgaccaataa

SEQ ID NO: 123860 - DNA, 16 bp, H. sapiens
taaaaatgagacagaa

SEQ ID NO: 123861 - DNA, 16 bp, H. sapiens
taaaaatgagcatttt

SEQ ID NO: 123862 - DNA, 16 bp, H. sapiens
taaaaatgatgatgat

SEQ ID NO: 123863 - DNA, 16 bp, H. sapiens
taaaaatgcaaaacat

SEQ ID NO: 123864 - DNA, 16 bp, H. sapiens
taaaaatgcaaatcaa

SEQ ID NO: 123865 - DNA, 16 bp, H. sapiens
taaaaatgcaaattct

SEQ ID NO: 123866 - DNA, 16 bp, H. sapiens
taaaaatgcaattaaa

SEQ ID NO: 123867 - DNA, 16 bp, H. sapiens
taaaaatgcacacaca

SEQ ID NO: 123868 - DNA, 16 bp, H. sapiens
taaaaatgcagaattt

SEQ ID NO: 123869 - DNA, 16 bp, H. sapiens
taaaaatgcagagaaa

SEQ ID NO: 123870 - DNA, 16 bp, H. sapiens
taaaaatgctaaaata

SEQ ID NO: 123871 - DNA, 16 bp, H. sapiens
taaaaatgcttattaa

SEQ ID NO: 123872 - DNA, 16 bp, H. sapiens
taaaaatgctttaaaa

SEQ ID NO: 123873 - DNA, 16 bp, H. sapiens
taaaaatgcttttaaa

SEQ ID NO: 123874 - DNA, 16 bp, H. sapiens
taaaaatggaaatcaa

SEQ ID NO: 123875 - DNA, 16 bp, H. sapiens
taaaaatggaaatgtt

SEQ ID NO: 123876 - DNA, 16 bp, H. sapiens
taaaaatggagaaatg

SEQ ID NO: 123877 - DNA, 16 bp, H. sapiens
taaaaatggataattt

SEQ ID NO: 123878 - DNA, 16 bp, H. sapiens
taaaaatggcaaagaa

SEQ ID NO: 123879 - DNA, 16 bp, H. sapiens
taaaaatggcttttaa

SEQ ID NO: 123880 - DNA, 16 bp, H. sapiens
taaaaatgggaatttc

SEQ ID NO: 123881 - DNA, 16 bp, H. sapiens
taaaaatggttttaaa

SEQ ID NO: 123882 - DNA, 16 bp, H. sapiens
taaaaatgtaaaactt

SEQ ID NO: 123883 - DNA, 16 bp, H. sapiens
taaaaatgtacaaatt

SEQ ID NO: 123884 - DNA, 16 bp, H. sapiens
taaaaatgtactttct

SEQ ID NO: 123885 - DNA, 16 bp, H. sapiens
taaaaatgtaggaaat

SEQ ID NO: 123886 - DNA, 16 bp, H. sapiens
taaaaatgtatatgga

SEQ ID NO: 123887 - DNA, 16 bp, H. sapiens
taaaaatgtatttgaa

SEQ ID NO: 123888 - DNA, 16 bp, H. sapiens
taaaaatgtattttct

SEQ ID NO: 123889 - DNA, 16 bp, H. sapiens
taaaaatgtcagaaaa

SEQ ID NO: 123890 - DNA, 16 bp, H. sapiens
taaaaatgtcttcatt

SEQ ID NO: 123891 - DNA, 16 bp, H. sapiens
taaaaatgtgtagcac

SEQ ID NO: 123892 - DNA, 16 bp, H. sapiens
taaaaatgtgttaata

SEQ ID NO: 123893 - DNA, 16 bp, H. sapiens
taaaaatgtgttatat

SEQ ID NO: 123894 - DNA, 16 bp, H. sapiens
taaaaatgtgttcttt

SEQ ID NO: 123895 - DNA, 16 bp, H. sapiens
taaaaatgtgtttata

SEQ ID NO: 123896 - DNA, 16 bp, H. sapiens
taaaaatgtgttttaa

SEQ ID NO: 123897 - DNA, 16 bp, H. sapiens
taaaaatgtgttttca

SEQ ID NO: 123898 - DNA, 16 bp, H. sapiens
taaaaatgttacttat

SEQ ID NO: 123899 - DNA, 16 bp, H. sapiens
taaaaatgttcccttt

SEQ ID NO: 123900 - DNA, 16 bp, H. sapiens
taaaaatgttgaattt

SEQ ID NO: 123901 - DNA, 16 bp, H. sapiens
taaaaatgtttctata

SEQ ID NO: 123902 - DNA, 16 bp, H. sapiens
taaaaatgtttgcatt

SEQ ID NO: 123903 - DNA, 16 bp, H. sapiens
taaaaatgttttaatg

SEQ ID NO: 123904 - DNA, 16 bp, H. sapiens
taaaaatgttttgctt

SEQ ID NO: 123905 - DNA, 16 bp, H. sapiens
taaaaattaaagcaat

SEQ ID NO: 123906 - DNA, 16 bp, H. sapiens
taaaaattaagaacat

SEQ ID NO: 123907 - DNA, 16 bp, H. sapiens
taaaaattacagaaat

SEQ ID NO: 123908 - DNA, 16 bp, H. sapiens
taaaaattactttcaa

SEQ ID NO: 123909 - DNA, 16 bp, H. sapiens
taaaaattacttttct

SEQ ID NO: 123910 - DNA, 19 bp, H. sapiens
taaaaattagctaggcatg

SEQ ID NO: 123911 - DNA, 16 bp, H. sapiens
taaaaattatacagaa

SEQ ID NO: 123912 - DNA, 16 bp, H. sapiens
taaaaattattcaaag

SEQ ID NO: 123913 - DNA, 16 bp, H. sapiens
taaaaattatttggaa

SEQ ID NO: 123914 - DNA, 16 bp, H. sapiens
taaaaattcagaaaat

SEQ ID NO: 123915 - DNA, 16 bp, H. sapiens
taaaaattcagataat

SEQ ID NO: 123916 - DNA, 16 bp, H. sapiens
taaaaattcatattct

SEQ ID NO: 123917 - DNA, 16 bp, H. sapiens
taaaaattctaaaaga

SEQ ID NO: 123918 - DNA, 16 bp, H. sapiens
taaaaattctagaaaa

SEQ ID NO: 123919 - DNA, 16 bp, H. sapiens
taaaaattcttcatat

SEQ ID NO: 123920 - DNA, 16 bp, H. sapiens
taaaaattgaaagttt

SEQ ID NO: 123921 - DNA, 16 bp, H. sapiens
taaaaattgtatgtgt

SEQ ID NO: 123922 - DNA, 16 bp, H. sapiens
taaaaattgtcaaaaa

SEQ ID NO: 123923 - DNA, 16 bp, H. sapiens
taaaaattgtgtatat

SEQ ID NO: 123924 - DNA, 16 bp, H. sapiens
taaaaattgttttgta

SEQ ID NO: 123925 - DNA, 16 bp, H. sapiens
taaaaatttcttccac

SEQ ID NO: 123926 - DNA, 16 bp, H. sapiens
taaaaattttatgtga

SEQ ID NO: 123927 - DNA, 16 bp, H. sapiens
taaaaattttccttta

SEQ ID NO: 123928 - DNA, 16 bp, H. sapiens
taaaaatttttagtag

SEQ ID NO: 123929 - DNA, 16 bp, H. sapiens
taaaacaaaaggttta

SEQ ID NO: 123930 - DNA, 16 bp, H. sapiens
taaaacaaaatgtatt

SEQ ID NO: 123931 - DNA, 16 bp, H. sapiens
taaaacaaagatgata

SEQ ID NO: 123932 - DNA, 16 bp, H. sapiens
taaaacaaagtttaaa

SEQ ID NO: 123933 - DNA, 16 bp, H. sapiens
taaaacaacacagatt

SEQ ID NO: 123934 - DNA, 16 bp, H. sapiens
taaaacaacacatatt

SEQ ID NO: 123935 - DNA, 16 bp, H. sapiens
taaaacaacagaaatt

SEQ ID NO: 123936 - DNA, 16 bp, H. sapiens
taaaacaacattttta

SEQ ID NO: 123937 - DNA, 16 bp, H. sapiens
taaaacaactagagaa

SEQ ID NO: 123938 - DNA, 16 bp, H. sapiens
taaaacaacttttcaa

SEQ ID NO: 123939 - DNA, 16 bp, H. sapiens
taaaacaagcctcaaa

SEQ ID NO: 123940 - DNA, 16 bp, H. sapiens
taaaacaagtacttct

SEQ ID NO: 123941 - DNA, 16 bp, H. sapiens
taaaacaagtctcaaa

SEQ ID NO: 123942 - DNA, 16 bp, H. sapiens
taaaacaagtttattt

SEQ ID NO: 123943 - DNA, 16 bp, H. sapiens
taaaacaataaaagtt

SEQ ID NO: 123944 - DNA, 16 bp, H. sapiens
taaaacaatagaaatt

SEQ ID NO: 123945 - DNA, 16 bp, H. sapiens
taaaacaatatttgaa

SEQ ID NO: 123946 - DNA, 16 bp, H. sapiens
taaaacaatgcatttt

SEQ ID NO: 123947 - DNA, 16 bp, H. sapiens
taaaacaatgtaaatg

SEQ ID NO: 123948 - DNA, 16 bp, H. sapiens
taaaacaatttgaaaa

SEQ ID NO: 123949 - DNA, 16 bp, H. sapiens
taaaacaattttgtaa

SEQ ID NO: 123950 - DNA, 16 bp, H. sapiens
taaaacacaaaatctt

SEQ ID NO: 123951 - DNA, 16 bp, H. sapiens
taaaacacagaaatac

SEQ ID NO: 123952 - DNA, 16 bp, H. sapiens
taaaacacagattttt

SEQ ID NO: 123953 - DNA, 16 bp, H. sapiens
taaaacaccaaaagga

SEQ ID NO: 123954 - DNA, 16 bp, H. sapiens
taaaacaccaaagcaa

SEQ ID NO: 123955 - DNA, 16 bp, H. sapiens
taaaacactgctcaaa

SEQ ID NO: 123956 - DNA, 16 bp, H. sapiens
taaaacagaaatcaga

SEQ ID NO: 123957 - DNA, 16 bp, H. sapiens
taaaacagaagtttaa

SEQ ID NO: 123958 - DNA, 16 bp, H. sapiens
taaaacagaatgagat

SEQ ID NO: 123959 - DNA, 16 bp, H. sapiens
taaaacagacttgaaa

SEQ ID NO: 123960 - DNA, 16 bp, H. sapiens
taaaacagcaagagaa

SEQ ID NO: 123961 - DNA, 16 bp, H. sapiens
taaaacaggctgcagt

SEQ ID NO: 123962 - DNA, 16 bp, H. sapiens
taaaacagtattttta

SEQ ID NO: 123963 - DNA, 16 bp, H. sapiens
taaaacagtatttttt

SEQ ID NO: 123964 - DNA, 16 bp, H. sapiens
taaaacagtgcctggc

SEQ ID NO: 123965 - DNA, 16 bp, H. sapiens
taaaacagtttttttt

SEQ ID NO: 123966 - DNA, 16 bp, H. sapiens
taaaacataatttttc

SEQ ID NO: 123967 - DNA, 16 bp, H. sapiens
taaaacatgaatgaaa

SEQ ID NO: 123968 - DNA, 16 bp, H. sapiens
taaaacatgatgagtt

SEQ ID NO: 123969 - DNA, 16 bp, H. sapiens
taaaacatgtttgaaa

SEQ ID NO: 123970 - DNA, 16 bp, H. sapiens
taaaacatgttttctt

SEQ ID NO: 123971 - DNA, 16 bp, H. sapiens
taaaacattcaaagaa

SEQ ID NO: 123972 - DNA, 16 bp, H. sapiens
taaaacattcagaaaa

SEQ ID NO: 123973 - DNA, 16 bp, H. sapiens
taaaacatttaacatt

SEQ ID NO: 123974 - DNA, 16 bp, H. sapiens
taaaacatttagaaaa

SEQ ID NO: 123975 - DNA, 16 bp, H. sapiens
taaaacatttagaaca

SEQ ID NO: 123976 - DNA, 16 bp, H. sapiens
taaaacatttattttg

SEQ ID NO: 123977 - DNA, 16 bp, H. sapiens
taaaacatttctatca

SEQ ID NO: 123978 - DNA, 16 bp, H. sapiens
taaaacatttgaaata

SEQ ID NO: 123979 - DNA, 16 bp, H. sapiens
taaaacatttgaaatt

SEQ ID NO: 123980 - DNA, 16 bp, H. sapiens
taaaacatttgttttt

SEQ ID NO: 123981 - DNA, 16 bp, H. sapiens
taaaacattttaatca

SEQ ID NO: 123982 - DNA, 16 bp, H. sapiens
taaaacattttgttta

SEQ ID NO: 123983 - DNA, 16 bp, H. sapiens
taaaacatttttagaa

SEQ ID NO: 123984 - DNA, 16 bp, H. sapiens
taaaacattttttcct

SEQ ID NO: 123985 - DNA, 16 bp, H. sapiens
taaaaccactagaaga

SEQ ID NO: 123986 - DNA, 16 bp, H. sapiens
taaaaccatcagacct

SEQ ID NO: 123987 - DNA, 16 bp, H. sapiens
taaaaccatcagatct

SEQ ID NO: 123988 - DNA, 16 bp, H. sapiens
taaaaccatttttaaa

SEQ ID NO: 123989 - DNA, 16 bp, H. sapiens
taaaacccaggaggca

SEQ ID NO: 123990 - DNA, 16 bp, H. sapiens
taaaacccatctgatg

SEQ ID NO: 123991 - DNA, 16 bp, H. sapiens
taaaacctcaaaagca

SEQ ID NO: 123992 - DNA, 16 bp, H. sapiens
taaaacctcatctcta

SEQ ID NO: 123993 - DNA, 16 bp, H. sapiens
taaaacctgaaaatat

SEQ ID NO: 123994 - DNA, 16 bp, H. sapiens
taaaaccttaaaaacc

SEQ ID NO: 123995 - DNA, 16 bp, H. sapiens
taaaaccttttgtttt

SEQ ID NO: 123996 - DNA, 16 bp, H. sapiens
taaaaccttttttctt

SEQ ID NO: 123997 - DNA, 16 bp, H. sapiens
taaaactacagtaatt

SEQ ID NO: 123998 - DNA, 16 bp, H. sapiens
taaaactactagaagg

SEQ ID NO: 123999 - DNA, 16 bp, H. sapiens
taaaactattgaaaaa

SEQ ID NO: 124000 - DNA, 16 bp, H. sapiens
taaaactcaggattaa

SEQ ID NO: 124001 - DNA, 16 bp, H. sapiens
taaaactccggtctcc

SEQ ID NO: 124002 - DNA, 16 bp, H. sapiens
taaaactcctaaaaga

SEQ ID NO: 124003 - DNA, 16 bp, H. sapiens
taaaactcctagaaga

SEQ ID NO: 124004 - DNA, 16 bp, H. sapiens
taaaactctcagcaaa

SEQ ID NO: 124005 - DNA, 16 bp, H. sapiens
taaaactcttagaata

SEQ ID NO: 124006 - DNA, 16 bp, H. sapiens
taaaactcttcagtgg

SEQ ID NO: 124007 - DNA, 16 bp, H. sapiens
taaaactgaaaactat

SEQ ID NO: 124008 - DNA, 16 bp, H. sapiens
taaaactgaaattaaa

SEQ ID NO: 124009 - DNA, 16 bp, H. sapiens
taaaactgaattattt

SEQ ID NO: 124010 - DNA, 16 bp, H. sapiens
taaaactgagaaattt

SEQ ID NO: 124011 - DNA, 16 bp, H. sapiens
taaaactgatttattt

SEQ ID NO: 124012 - DNA, 16 bp, H. sapiens
taaaactgatttttaa

SEQ ID NO: 124013 - DNA, 16 bp, H. sapiens
taaaactggatccctt

SEQ ID NO: 124014 - DNA, 16 bp, H. sapiens
taaaactggattgtgg

SEQ ID NO: 124015 - DNA, 16 bp, H. sapiens
taaaactgtaatcata

SEQ ID NO: 124016 - DNA, 16 bp, H. sapiens
taaaactgtatatatt

SEQ ID NO: 124017 - DNA, 16 bp, H. sapiens
taaaactgttctaaaa

SEQ ID NO: 124018 - DNA, 16 bp, H. sapiens
taaaacttaaaaccat

SEQ ID NO: 124019 - DNA, 16 bp, H. sapiens
taaaacttaaaagtat

SEQ ID NO: 124020 - DNA, 16 bp, H. sapiens
taaaacttaaaatgaa

SEQ ID NO: 124021 - DNA, 16 bp, H. sapiens
taaaacttattttgca

SEQ ID NO: 124022 - DNA, 16 bp, H. sapiens
taaaacttctataaat

SEQ ID NO: 124023 - DNA, 16 bp, H. sapiens
taaaacttctttcaaa

SEQ ID NO: 124024 - DNA, 16 bp, H. sapiens
taaaactttaaaactt

SEQ ID NO: 124025 - DNA, 16 bp, H. sapiens
taaaactttactgaaa

SEQ ID NO: 124026 - DNA, 16 bp, H. sapiens
taaaactttactgaag

SEQ ID NO: 124027 - DNA, 16 bp, H. sapiens
taaaactttccttttt

SEQ ID NO: 124028 - DNA, 16 bp, H. sapiens
taaaactttctttctt

SEQ ID NO: 124029 - DNA, 16 bp, H. sapiens
taaaactttggaaaat

SEQ ID NO: 124030 - DNA, 16 bp, H. sapiens
taaaactttgttaaat

SEQ ID NO: 124031 - DNA, 16 bp, H. sapiens
taaaacttttaaaact

SEQ ID NO: 124032 - DNA, 16 bp, H. sapiens
taaaagaaaaacctta

SEQ ID NO: 124033 - DNA, 16 bp, H. sapiens
taaaagaaaaacttga

SEQ ID NO: 124034 - DNA, 16 bp, H. sapiens
taaaagaaaaacttta

SEQ ID NO: 124035 - DNA, 16 bp, H. sapiens
taaaagaaaagacagc

SEQ ID NO: 124036 - DNA, 16 bp, H. sapiens
taaaagaaaatgatgt

SEQ ID NO: 124037 - DNA, 16 bp, H. sapiens
taaaagaaaattgctt

SEQ ID NO: 124038 - DNA, 16 bp, H. sapiens
taaaagaaacacattt

SEQ ID NO: 124039 - DNA, 16 bp, H. sapiens
taaaagaaacatttaa

SEQ ID NO: 124040 - DNA, 16 bp, H. sapiens
taaaagaaaccagggc

SEQ ID NO: 124041 - DNA, 16 bp, H. sapiens
taaaagaaactatttt

SEQ ID NO: 124042 - DNA, 16 bp, H. sapiens
taaaagaaagcagaga

SEQ ID NO: 124043 - DNA, 16 bp, H. sapiens
taaaagaaatacctaa

SEQ ID NO: 124044 - DNA, 16 bp, H. sapiens
taaaagaaatgcttaa

SEQ ID NO: 124045 - DNA, 16 bp, H. sapiens
taaaagaactacagaa

SEQ ID NO: 124046 - DNA, 16 bp, H. sapiens
taaaagaagttcttca

SEQ ID NO: 124047 - DNA, 16 bp, H. sapiens
taaaagaatgttgtcc

SEQ ID NO: 124048 - DNA, 16 bp, H. sapiens
taaaagaattcagcag

SEQ ID NO: 124049 - DNA, 16 bp, H. sapiens
taaaagacaaaatatt

SEQ ID NO: 124050 - DNA, 16 bp, H. sapiens
taaaagacaaatttaa

SEQ ID NO: 124051 - DNA, 16 bp, H. sapiens
taaaagacaagataat

SEQ ID NO: 124052 - DNA, 16 bp, H. sapiens
taaaagacaaggaaag

SEQ ID NO: 124053 - DNA, 16 bp, H. sapiens
taaaagacacaaacta

SEQ ID NO: 124054 - DNA, 16 bp, H. sapiens
taaaagagaaacagag

SEQ ID NO: 124055 - DNA, 16 bp, H. sapiens
taaaagagaagcagag

SEQ ID NO: 124056 - DNA, 16 bp, H. sapiens
taaaagagactttaaa

SEQ ID NO: 124057 - DNA, 16 bp, H. sapiens
taaaagagcagaaatt

SEQ ID NO: 124058 - DNA, 16 bp, H. sapiens
taaaagagcagatttt

SEQ ID NO: 124059 - DNA, 16 bp, H. sapiens
taaaagaggtttattt

SEQ ID NO: 124060 - DNA, 16 bp, H. sapiens
taaaagagttttgttt

SEQ ID NO: 124061 - DNA, 16 bp, H. sapiens
taaaagatacaaaatg

SEQ ID NO: 124062 - DNA, 16 bp, H. sapiens
taaaagatacagactg

SEQ ID NO: 124063 - DNA, 16 bp, H. sapiens
taaaagcaaaagaatt

SEQ ID NO: 124064 - DNA, 16 bp, H. sapiens
taaaagcaaaataatg

SEQ ID NO: 124065 - DNA, 16 bp, H. sapiens
taaaagcaaaggcagc

SEQ ID NO: 124066 - DNA, 16 bp, H. sapiens
taaaagcagaaaaagg

SEQ ID NO: 124067 - DNA, 16 bp, H. sapiens
taaaagcagaaggaaa

SEQ ID NO: 124068 - DNA, 16 bp, H. sapiens
taaaagcagctagaga

SEQ ID NO: 124069 - DNA, 16 bp, H. sapiens
taaaagcatacatttt

SEQ ID NO: 124070 - DNA, 16 bp, H. sapiens
taaaagcatttctgtt

SEQ ID NO: 124071 - DNA, 16 bp, H. sapiens
taaaagcattttattt

SEQ ID NO: 124072 - DNA, 16 bp, H. sapiens
taaaagccattaaatt

SEQ ID NO: 124073 - DNA, 16 bp, H. sapiens
taaaagctatctatga

SEQ ID NO: 124074 - DNA, 16 bp, H. sapiens
taaaagctattttaat

SEQ ID NO: 124075 - DNA, 16 bp, H. sapiens
taaaagctatttttta

SEQ ID NO: 124076 - DNA, 16 bp, H. sapiens
taaaagctgaaaaaat

SEQ ID NO: 124077 - DNA, 16 bp, H. sapiens
taaaagcttatttatt

SEQ ID NO: 124078 - DNA, 16 bp, H. sapiens
taaaagctttctgagg

SEQ ID NO: 124079 - DNA, 16 bp, H. sapiens
taaaagctttttttct

SEQ ID NO: 124080 - DNA, 16 bp, H. sapiens
taaaaggaaatttttt

SEQ ID NO: 124081 - DNA, 16 bp, H. sapiens
taaaaggagatttatt

SEQ ID NO: 124082 - DNA, 16 bp, H. sapiens
taaaaggagttctaaa

SEQ ID NO: 124083 - DNA, 16 bp, H. sapiens
taaaaggcaaatgtaa

SEQ ID NO: 124084 - DNA, 16 bp, H. sapiens
taaaagtaaattcaaa

SEQ ID NO: 124085 - DNA, 16 bp, H. sapiens
taaaagtaatggcaaa

SEQ ID NO: 124086 - DNA, 16 bp, H. sapiens
taaaagtacaaaaagt

SEQ ID NO: 124087 - DNA, 16 bp, H. sapiens
taaaagtacaaaactt

SEQ ID NO: 124088 - DNA, 16 bp, H. sapiens
taaaagtacacaaatt

SEQ ID NO: 124089 - DNA, 16 bp, H. sapiens
taaaagtacattaaaa

SEQ ID NO: 124090 - DNA, 16 bp, H. sapiens
taaaagtacattttaa

SEQ ID NO: 124091 - DNA, 16 bp, H. sapiens
taaaagtagaaatcaa

SEQ ID NO: 124092 - DNA, 16 bp, H. sapiens
taaaagtagaactaca

SEQ ID NO: 124093 - DNA, 16 bp, H. sapiens
taaaagtattagggca

SEQ ID NO: 124094 - DNA, 16 bp, H. sapiens
taaaagtatttgaaca

SEQ ID NO: 124095 - DNA, 16 bp, H. sapiens
taaaagtatttttctt

SEQ ID NO: 124096 - DNA, 16 bp, H. sapiens
taaaagtcatttttaa

SEQ ID NO: 124097 - DNA, 16 bp, H. sapiens
taaaagtcttagaaga

SEQ ID NO: 124098 - DNA, 16 bp, H. sapiens
taaaagtgaaaatgtt

SEQ ID NO: 124099 - DNA, 16 bp, H. sapiens
taaaagtgaaatcata

SEQ ID NO: 124100 - DNA, 16 bp, H. sapiens
taaaagtgaaattttt

SEQ ID NO: 124101 - DNA, 16 bp, H. sapiens
taaaagtgctactcca

SEQ ID NO: 124102 - DNA, 16 bp, H. sapiens
taaaagtggaagagag

SEQ ID NO: 124103 - DNA, 16 bp, H. sapiens
taaaagtgggagctaa

SEQ ID NO: 124104 - DNA, 16 bp, H. sapiens
taaaagtgtggaaaat

SEQ ID NO: 124105 - DNA, 16 bp, H. sapiens
taaaagtgttcatttt

SEQ ID NO: 124106 - DNA, 16 bp, H. sapiens
taaaagtgttcctttt

SEQ ID NO: 124107 - DNA, 16 bp, H. sapiens
taaaagtgttttgaaa

SEQ ID NO: 124108 - DNA, 16 bp, H. sapiens
taaaagttaaaaatca

SEQ ID NO: 124109 - DNA, 16 bp, H. sapiens
taaaagttagccaggc

SEQ ID NO: 124110 - DNA, 16 bp, H. sapiens
taaaagttagttcaaa

SEQ ID NO: 124111 - DNA, 16 bp, H. sapiens
taaaagttcataaaat

SEQ ID NO: 124112 - DNA, 16 bp, H. sapiens
taaaagttcttttttt

SEQ ID NO: 124113 - DNA, 16 bp, H. sapiens
taaaagttgctgttta

SEQ ID NO: 124114 - DNA, 16 bp, H. sapiens
taaaagttggaaataa

SEQ ID NO: 124115 - DNA, 16 bp, H. sapiens
taaaagtttaaaacat

SEQ ID NO: 124116 - DNA, 16 bp, H. sapiens
taaaagttttctttct

SEQ ID NO: 124117 - DNA, 16 bp, H. sapiens
taaaagttttgtttgt

SEQ ID NO: 124118 - DNA, 16 bp, H. sapiens
taaaataaaaactgtg

SEQ ID NO: 124119 - DNA, 16 bp, H. sapiens
taaaataaaagcaatg

SEQ ID NO: 124120 - DNA, 16 bp, H. sapiens
taaaataaaagcatct

SEQ ID NO: 124121 - DNA, 16 bp, H. sapiens
taaaataaaagctttt

SEQ ID NO: 124122 - DNA, 16 bp, H. sapiens
taaaataaaataactg

SEQ ID NO: 124123 - DNA, 16 bp, H. sapiens
taaaataaaatgactg

SEQ ID NO: 124124 - DNA, 16 bp, H. sapiens
taaaataaaatgcatg

SEQ ID NO: 124125 - DNA, 16 bp, H. sapiens
taaaataaaatgcatt

SEQ ID NO: 124126 - DNA, 16 bp, H. sapiens
taaaataaacatgttt

SEQ ID NO: 124127 - DNA, 16 bp, H. sapiens
taaaataaacattttg

SEQ ID NO: 124128 - DNA, 16 bp, H. sapiens
taaaataaagacattc

SEQ ID NO: 124129 - DNA, 16 bp, H. sapiens
taaaataaagacattt

SEQ ID NO: 124130 - DNA, 16 bp, H. sapiens
taaaataaaggtattt

SEQ ID NO: 124131 - DNA, 16 bp, H. sapiens
taaaataaagtacttt

SEQ ID NO: 124132 - DNA, 16 bp, H. sapiens
taaaataaatgacttt

SEQ ID NO: 124133 - DNA, 16 bp, H. sapiens
taaaataaatggcaaa

SEQ ID NO: 124134 - DNA, 16 bp, H. sapiens
taaaataaatgtatct

SEQ ID NO: 124135 - DNA, 16 bp, H. sapiens
taaaataaattgtgtt

SEQ ID NO: 124136 - DNA, 16 bp, H. sapiens
taaaataacactttta

SEQ ID NO: 124137 - DNA, 16 bp, H. sapiens
taaaataacatgtaaa

SEQ ID NO: 124138 - DNA, 16 bp, H. sapiens
taaaataacatttttc

SEQ ID NO: 124139 - DNA, 16 bp, H. sapiens
taaaataactatgaaa

SEQ ID NO: 124140 - DNA, 16 bp, H. sapiens
taaaataactcattta

SEQ ID NO: 124141 - DNA, 16 bp, H. sapiens
taaaataagccaagca

SEQ ID NO: 124142 - DNA, 16 bp, H. sapiens
taaaataagccagaaa

SEQ ID NO: 124143 - DNA, 16 bp, H. sapiens
taaaataaggctgaaa

SEQ ID NO: 124144 - DNA, 16 bp, H. sapiens
taaaataaggtcatta

SEQ ID NO: 124145 - DNA, 16 bp, H. sapiens
taaaataagtcaaaat

SEQ ID NO: 124146 - DNA, 16 bp, H. sapiens
taaaataataaatgct

SEQ ID NO: 124147 - DNA, 16 bp, H. sapiens
taaaataatgtccttt

SEQ ID NO: 124148 - DNA, 16 bp, H. sapiens
taaaataattctttca

SEQ ID NO: 124149 - DNA, 16 bp, H. sapiens
taaaataattttgcat

SEQ ID NO: 124150 - DNA, 16 bp, H. sapiens
taaaatacaaatgtct

SEQ ID NO: 124151 - DNA, 16 bp, H. sapiens
taaaatacaactttat

SEQ ID NO: 124152 - DNA, 16 bp, H. sapiens
taaaatacagtaaaat

SEQ ID NO: 124153 - DNA, 16 bp, H. sapiens
taaaatacatatggaa

SEQ ID NO: 124154 - DNA, 16 bp, H. sapiens
taaaatacatattctt

SEQ ID NO: 124155 - DNA, 16 bp, H. sapiens
taaaatacatgtttat

SEQ ID NO: 124156 - DNA, 16 bp, H. sapiens
taaaatacatttgtaa

SEQ ID NO: 124157 - DNA, 16 bp, H. sapiens
taaaatacctagaaat

SEQ ID NO: 124158 - DNA, 16 bp, H. sapiens
taaaatactacacatt

SEQ ID NO: 124159 - DNA, 16 bp, H. sapiens
taaaatactgaatttt

SEQ ID NO: 124160 - DNA, 16 bp, H. sapiens
taaaatactgtaaaat

SEQ ID NO: 124161 - DNA, 16 bp, H. sapiens
taaaatactgtaatta

SEQ ID NO: 124162 - DNA, 16 bp, H. sapiens
taaaatactttacata

SEQ ID NO: 124163 - DNA, 16 bp, H. sapiens
taaaatactttgtttt

SEQ ID NO: 124164 - DNA, 16 bp, H. sapiens
taaaatagaaatttac

SEQ ID NO: 124165 - DNA, 16 bp, H. sapiens
taaaatagactttttt

SEQ ID NO: 124166 - DNA, 16 bp, H. sapiens
taaaatagcaaatttt

SEQ ID NO: 124167 - DNA, 16 bp, H. sapiens
taaaatagcatttatt

SEQ ID NO: 124168 - DNA, 16 bp, H. sapiens
taaaataggccaggtg

SEQ ID NO: 124169 - DNA, 16 bp, H. sapiens
taaaatagggataata

SEQ ID NO: 124170 - DNA, 16 bp, H. sapiens
taaaatagggatagta

SEQ ID NO: 124171 - DNA, 16 bp, H. sapiens
taaaatagtagatttt

SEQ ID NO: 124172 - DNA, 16 bp, H. sapiens
taaaatagtttctctt

SEQ ID NO: 124173 - DNA, 16 bp, H. sapiens
taaaatatacactttt

SEQ ID NO: 124174 - DNA, 16 bp, H. sapiens
taaaatatatacactt

SEQ ID NO: 124175 - DNA, 16 bp, H. sapiens
taaaatatatgttaca

SEQ ID NO: 124176 - DNA, 16 bp, H. sapiens
taaaatatattcagtt

SEQ ID NO: 124177 - DNA, 16 bp, H. sapiens
taaaatatattcttca

SEQ ID NO: 124178 - DNA, 16 bp, H. sapiens
taaaatatatttggaa

SEQ ID NO: 124179 - DNA, 16 bp, H. sapiens
taaaatatccaatttt

SEQ ID NO: 124180 - DNA, 16 bp, H. sapiens
taaaatatccagtttt

SEQ ID NO: 124181 - DNA, 16 bp, H. sapiens
taaaatatgaattttg

SEQ ID NO: 124182 - DNA, 16 bp, H. sapiens
taaaatatgcattata

SEQ ID NO: 124183 - DNA, 16 bp, H. sapiens
taaaatatgtaaatac

SEQ ID NO: 124184 - DNA, 16 bp, H. sapiens
taaaatatgtaaatca

SEQ ID NO: 124185 - DNA, 16 bp, H. sapiens
taaaatatgtgtgtat

SEQ ID NO: 124186 - DNA, 16 bp, H. sapiens
taaaatattcagtaca

SEQ ID NO: 124187 - DNA, 16 bp, H. sapiens
taaaatattgaaaact

SEQ ID NO: 124188 - DNA, 16 bp, H. sapiens
taaaatatttaaacct

SEQ ID NO: 124189 - DNA, 16 bp, H. sapiens
taaaatatttacaatc

SEQ ID NO: 124190 - DNA, 16 bp, H. sapiens
taaaatatttaccatc

SEQ ID NO: 124191 - DNA, 16 bp, H. sapiens
taaaatatttactcat

SEQ ID NO: 124192 - DNA, 16 bp, H. sapiens
taaaatatttctggaa

SEQ ID NO: 124193 - DNA, 16 bp, H. sapiens
taaaatatttgaagag

SEQ ID NO: 124194 - DNA, 16 bp, H. sapiens
taaaatatttgaagga

SEQ ID NO: 124195 - DNA, 16 bp, H. sapiens
taaaatatttgtatgt

SEQ ID NO: 124196 - DNA, 16 bp, H. sapiens
taaaatatttgtcttt

SEQ ID NO: 124197 - DNA, 16 bp, H. sapiens
taaaatattttcacaa

SEQ ID NO: 124198 - DNA, 16 bp, H. sapiens
taaaatattttcattg

SEQ ID NO: 124199 - DNA, 16 bp, H. sapiens
taaaatattttccaaa

SEQ ID NO: 124200 - DNA, 16 bp, H. sapiens
taaaatattttcttgt

SEQ ID NO: 124201 - DNA, 16 bp, H. sapiens
taaaatattttgatga

SEQ ID NO: 124202 - DNA, 16 bp, H. sapiens
taaaatatttttatgg

SEQ ID NO: 124203 - DNA, 16 bp, H. sapiens
taaaatcaaaacaagt

SEQ ID NO: 124204 - DNA, 16 bp, H. sapiens
taaaatcaaaatgaat

SEQ ID NO: 124205 - DNA, 16 bp, H. sapiens
taaaatcaaatgtaaa

SEQ ID NO: 124206 - DNA, 16 bp, H. sapiens
taaaatcagaaattaa

SEQ ID NO: 124207 - DNA, 16 bp, H. sapiens
taaaatcagaacagaa

SEQ ID NO: 124208 - DNA, 16 bp, H. sapiens
taaaatcagatatttt

SEQ ID NO: 124209 - DNA, 16 bp, H. sapiens
taaaatcagcttgtca

SEQ ID NO: 124210 - DNA, 16 bp, H. sapiens
taaaatcatagaattt

SEQ ID NO: 124211 - DNA, 16 bp, H. sapiens
taaaatcatcctgaaa

SEQ ID NO: 124212 - DNA, 16 bp, H. sapiens
taaaatcatgtcatca

SEQ ID NO: 124213 - DNA, 16 bp, H. sapiens
taaaatcattcctttt

SEQ ID NO: 124214 - DNA, 16 bp, H. sapiens
taaaatccaaaacttt

SEQ ID NO: 124215 - DNA, 16 bp, H. sapiens
taaaatccaaaatgtt

SEQ ID NO: 124216 - DNA, 16 bp, H. sapiens
taaaatccagactcct

SEQ ID NO: 124217 - DNA, 16 bp, H. sapiens
taaaatccagcatccc

SEQ ID NO: 124218 - DNA, 16 bp, H. sapiens
taaaatccattggtct

SEQ ID NO: 124219 - DNA, 16 bp, H. sapiens
taaaatccctggaaga

SEQ ID NO: 124220 - DNA, 16 bp, H. sapiens
taaaatcctagcactt

SEQ ID NO: 124221 - DNA, 16 bp, H. sapiens
taaaatcctgtcattt

SEQ ID NO: 124222 - DNA, 16 bp, H. sapiens
taaaatccttctcaga

SEQ ID NO: 124223 - DNA, 16 bp, H. sapiens
taaaatcctttttaga

SEQ ID NO: 124224 - DNA, 16 bp, H. sapiens
taaaatctactgtctt

SEQ ID NO: 124225 - DNA, 16 bp, H. sapiens
taaaatctcattaaat

SEQ ID NO: 124226 - DNA, 16 bp, H. sapiens
taaaatctcattttct

SEQ ID NO: 124227 - DNA, 16 bp, H. sapiens
taaaatctctctctct

SEQ ID NO: 124228 - DNA, 16 bp, H. sapiens
taaaatctgattattt

SEQ ID NO: 124229 - DNA, 16 bp, H. sapiens
taaaatcttgaaaaaa

SEQ ID NO: 124230 - DNA, 16 bp, H. sapiens
taaaatctttttgttt

SEQ ID NO: 124231 - DNA, 16 bp, H. sapiens
taaaatgaaaatgttt

SEQ ID NO: 124232 - DNA, 16 bp, H. sapiens
taaaatgaaacatatt

SEQ ID NO: 124233 - DNA, 16 bp, H. sapiens
taaaatgaaagtattt

SEQ ID NO: 124234 - DNA, 16 bp, H. sapiens
taaaatgaaagttaca

SEQ ID NO: 124235 - DNA, 16 bp, H. sapiens
taaaatgaacttttaa

SEQ ID NO: 124236 - DNA, 16 bp, H. sapiens
taaaatgaagaaatca

SEQ ID NO: 124237 - DNA, 16 bp, H. sapiens
taaaatgaagctgaga

SEQ ID NO: 124238 - DNA, 16 bp, H. sapiens
taaaatgaaggacaaa

SEQ ID NO: 124239 - DNA, 16 bp, H. sapiens
taaaatgaaggcagaa

SEQ ID NO: 124240 - DNA, 16 bp, H. sapiens
taaaatgaatcattta

SEQ ID NO: 124241 - DNA, 16 bp, H. sapiens
taaaatgacatttatt

SEQ ID NO: 124242 - DNA, 16 bp, H. sapiens
taaaatgacttctttt

SEQ ID NO: 124243 - DNA, 16 bp, H. sapiens
taaaatgagaaatttt

SEQ ID NO: 124244 - DNA, 16 bp, H. sapiens
taaaatgagaattaca

SEQ ID NO: 124245 - DNA, 16 bp, H. sapiens
taaaatgagaggattg

SEQ ID NO: 124246 - DNA, 16 bp, H. sapiens
taaaatgagatttttt

SEQ ID NO: 124247 - DNA, 16 bp, H. sapiens
taaaatgaggataata

SEQ ID NO: 124248 - DNA, 16 bp, H. sapiens
taaaatgaggttaata

SEQ ID NO: 124249 - DNA, 16 bp, H. sapiens
taaaatgagtttggaa

SEQ ID NO: 124250 - DNA, 16 bp, H. sapiens
taaaatgatgtatttt

SEQ ID NO: 124251 - DNA, 16 bp, H. sapiens
taaaatgatttgggaa

SEQ ID NO: 124252 - DNA, 16 bp, H. sapiens
taaaatgattttctaa

SEQ ID NO: 124253 - DNA, 16 bp, H. sapiens
taaaatgcaaaactat

SEQ ID NO: 124254 - DNA, 16 bp, H. sapiens
taaaatgcaaaattca

SEQ ID NO: 124255 - DNA, 16 bp, H. sapiens
taaaatgcaaatgtca

SEQ ID NO: 124256 - DNA, 16 bp, H. sapiens
taaaatgcccagaata

SEQ ID NO: 124257 - DNA, 16 bp, H. sapiens
taaaatgctaaaaata

SEQ ID NO: 124258 - DNA, 16 bp, H. sapiens
taaaatgctaaaataa

SEQ ID NO: 124259 - DNA, 16 bp, H. sapiens
taaaatgctaaatatt

SEQ ID NO: 124260 - DNA, 16 bp, H. sapiens
taaaatgctctaaaat

SEQ ID NO: 124261 - DNA, 16 bp, H. sapiens
taaaatgctgctgaaa

SEQ ID NO: 124262 - DNA, 16 bp, H. sapiens
taaaatgctggcaaac

SEQ ID NO: 124263 - DNA, 16 bp, H. sapiens
taaaatgctgggatta

SEQ ID NO: 124264 - DNA, 16 bp, H. sapiens
taaaatgctttaaata

SEQ ID NO: 124265 - DNA, 16 bp, H. sapiens
taaaatggaaaatttt

SEQ ID NO: 124266 - DNA, 16 bp, H. sapiens
taaaatggaaataaca

SEQ ID NO: 124267 - DNA, 16 bp, H. sapiens
taaaatggaaatatct

SEQ ID NO: 124268 - DNA, 16 bp, H. sapiens
taaaatggaaattttt

SEQ ID NO: 124269 - DNA, 16 bp, H. sapiens
taaaatggaatgcttt

SEQ ID NO: 124270 - DNA, 16 bp, H. sapiens
taaaatggaattatat

SEQ ID NO: 124271 - DNA, 16 bp, H. sapiens
taaaatggagacaata

SEQ ID NO: 124272 - DNA, 16 bp, H. sapiens
taaaatggagataaat

SEQ ID NO: 124273 - DNA, 16 bp, H. sapiens
taaaatggagataact

SEQ ID NO: 124274 - DNA, 16 bp, H. sapiens
taaaatggaggtaata

SEQ ID NO: 124275 - DNA, 16 bp, H. sapiens
taaaatggcatagtat

SEQ ID NO: 124276 - DNA, 16 bp, H. sapiens
taaaatggctttgttt

SEQ ID NO: 124277 - DNA, 16 bp, H. sapiens
taaaatgggaagaaat

SEQ ID NO: 124278 - DNA, 16 bp, H. sapiens
taaaatgggaagataa

SEQ ID NO: 124279 - DNA, 16 bp, H. sapiens
taaaatgggaataatt

SEQ ID NO: 124280 - DNA, 16 bp, H. sapiens
taaaatgggaatcata

SEQ ID NO: 124281 - DNA, 16 bp, H. sapiens
taaaatgggagtaata

SEQ ID NO: 124282 - DNA, 16 bp, H. sapiens
taaaatgggccaaggt

SEQ ID NO: 124283 - DNA, 16 bp, H. sapiens
taaaatggggataaca

SEQ ID NO: 124284 - DNA, 16 bp, H. sapiens
taaaatggggataata

SEQ ID NO: 124285 - DNA, 16 bp, H. sapiens
taaaatggggataatt

SEQ ID NO: 124286 - DNA, 16 bp, H. sapiens
taaaatggggatgatg

SEQ ID NO: 124287 - DNA, 16 bp, H. sapiens
taaaatggggatgatt

SEQ ID NO: 124288 - DNA, 16 bp, H. sapiens
taaaatggggctaaca

SEQ ID NO: 124289 - DNA, 16 bp, H. sapiens
taaaatggtaaaaaca

SEQ ID NO: 124290 - DNA, 16 bp, H. sapiens
taaaatggtaaatttt

SEQ ID NO: 124291 - DNA, 16 bp, H. sapiens
taaaatggtaagtttt

SEQ ID NO: 124292 - DNA, 16 bp, H. sapiens
taaaatggtaatattt

SEQ ID NO: 124293 - DNA, 16 bp, H. sapiens
taaaatggtttttaaa

SEQ ID NO: 124294 - DNA, 16 bp, H. sapiens
taaaatgtaaaatgca

SEQ ID NO: 124295 - DNA, 16 bp, H. sapiens
taaaatgtaaacaata

SEQ ID NO: 124296 - DNA, 16 bp, H. sapiens
taaaatgtacaattta

SEQ ID NO: 124297 - DNA, 16 bp, H. sapiens
taaaatgtacagttaa

SEQ ID NO: 124298 - DNA, 16 bp, H. sapiens
taaaatgtacatattt

SEQ ID NO: 124299 - DNA, 16 bp, H. sapiens
taaaatgtataacaaa

SEQ ID NO: 124300 - DNA, 16 bp, H. sapiens
taaaatgtatataaca

SEQ ID NO: 124301 - DNA, 16 bp, H. sapiens
taaaatgtatgaagaa

SEQ ID NO: 124302 - DNA, 16 bp, H. sapiens
taaaatgtatgtgtat

SEQ ID NO: 124303 - DNA, 16 bp, H. sapiens
taaaatgtattatctt

SEQ ID NO: 124304 - DNA, 16 bp, H. sapiens
taaaatgtattatgta

SEQ ID NO: 124305 - DNA, 16 bp, H. sapiens
taaaatgtcattaaat

SEQ ID NO: 124306 - DNA, 16 bp, H. sapiens
taaaatgtcatttaaa

SEQ ID NO: 124307 - DNA, 16 bp, H. sapiens
taaaatgtccagaata

SEQ ID NO: 124308 - DNA, 16 bp, H. sapiens
taaaatgtgaaattca

SEQ ID NO: 124309 - DNA, 16 bp, H. sapiens
taaaatgtggaagtga

SEQ ID NO: 124310 - DNA, 16 bp, H. sapiens
taaaatgtgtatgaaa

SEQ ID NO: 124311 - DNA, 16 bp, H. sapiens
taaaatgtgtttggaa

SEQ ID NO: 124312 - DNA, 16 bp, H. sapiens
taaaatgtgtttttca

SEQ ID NO: 124313 - DNA, 16 bp, H. sapiens
taaaatgttaagtttt

SEQ ID NO: 124314 - DNA, 16 bp, H. sapiens
taaaatgttactttgt

SEQ ID NO: 124315 - DNA, 16 bp, H. sapiens
taaaatgttatcaaat

SEQ ID NO: 124316 - DNA, 16 bp, H. sapiens
taaaatgttgaaaatt

SEQ ID NO: 124317 - DNA, 16 bp, H. sapiens
taaaatgttgtatatt

SEQ ID NO: 124318 - DNA, 16 bp, H. sapiens
taaaatgtttaatgaa

SEQ ID NO: 124319 - DNA, 16 bp, H. sapiens
taaaatgtttaggaat

SEQ ID NO: 124320 - DNA, 16 bp, H. sapiens
taaaatgtttatgaaa

SEQ ID NO: 124321 - DNA, 16 bp, H. sapiens
taaaatgtttcattta

SEQ ID NO: 124322 - DNA, 16 bp, H. sapiens
taaaatgtttggaaaa

SEQ ID NO: 124323 - DNA, 16 bp, H. sapiens
taaaatgtttgttaaa

SEQ ID NO: 124324 - DNA, 16 bp, H. sapiens
taaaatgtttgttgaa

SEQ ID NO: 124325 - DNA, 16 bp, H. sapiens
taaaatgttttcattt

SEQ ID NO: 124326 - DNA, 16 bp, H. sapiens
taaaatgttttctatt

SEQ ID NO: 124327 - DNA, 16 bp, H. sapiens
taaaatgttttctttt

SEQ ID NO: 124328 - DNA, 16 bp, H. sapiens
taaaatgttttgcaaa

SEQ ID NO: 124329 - DNA, 16 bp, H. sapiens
taaaatgtttttacta

SEQ ID NO: 124330 - DNA, 16 bp, H. sapiens
taaaattaaaaactga

SEQ ID NO: 124331 - DNA, 16 bp, H. sapiens
taaaattaaaacagta

SEQ ID NO: 124332 - DNA, 16 bp, H. sapiens
taaaattaaaagcaag

SEQ ID NO: 124333 - DNA, 16 bp, H. sapiens
taaaattaaaatactg

SEQ ID NO: 124334 - DNA, 16 bp, H. sapiens
taaaattaaatgagca

SEQ ID NO: 124335 - DNA, 16 bp, H. sapiens
taaaattaaatttctg

SEQ ID NO: 124336 - DNA, 16 bp, H. sapiens
taaaattaagactttt

SEQ ID NO: 124337 - DNA, 16 bp, H. sapiens
taaaattaatttcacc

SEQ ID NO: 124338 - DNA, 16 bp, H. sapiens
taaaattacagaaaat

SEQ ID NO: 124339 - DNA, 16 bp, H. sapiens
taaaattacagaaatt

SEQ ID NO: 124340 - DNA, 16 bp, H. sapiens
taaaattacatttgtg

SEQ ID NO: 124341 - DNA, 16 bp, H. sapiens
taaaattactgaaaat

SEQ ID NO: 124342 - DNA, 16 bp, H. sapiens
taaaattatatttcag

SEQ ID NO: 124343 - DNA, 16 bp, H. sapiens
taaaattatatttcct

SEQ ID NO: 124344 - DNA, 16 bp, H. sapiens
taaaattatcagatct

SEQ ID NO: 124345 - DNA, 16 bp, H. sapiens
taaaattatcctttta

SEQ ID NO: 124346 - DNA, 16 bp, H. sapiens
taaaattatgagaatt

SEQ ID NO: 124347 - DNA, 16 bp, H. sapiens
taaaattatgatttct

SEQ ID NO: 124348 - DNA, 16 bp, H. sapiens
taaaattattatgtgt

SEQ ID NO: 124349 - DNA, 16 bp, H. sapiens
taaaattattcaaact

SEQ ID NO: 124350 - DNA, 16 bp, H. sapiens
taaaattattccaaat

SEQ ID NO: 124351 - DNA, 16 bp, H. sapiens
taaaattattctgttt

SEQ ID NO: 124352 - DNA, 16 bp, H. sapiens
taaaattattgcaaaa

SEQ ID NO: 124353 - DNA, 16 bp, H. sapiens
taaaattatttcagct

SEQ ID NO: 124354 - DNA, 16 bp, H. sapiens
taaaattcaacaccca

SEQ ID NO: 124355 - DNA, 16 bp, H. sapiens
taaaattcaacatcta

SEQ ID NO: 124356 - DNA, 16 bp, H. sapiens
taaaattcacagggaa

SEQ ID NO: 124357 - DNA, 16 bp, H. sapiens
taaaattcaccacttt

SEQ ID NO: 124358 - DNA, 16 bp, H. sapiens
taaaattcagaagaaa

SEQ ID NO: 124359 - DNA, 16 bp, H. sapiens
taaaattcaggctgag

SEQ ID NO: 124360 - DNA, 16 bp, H. sapiens
taaaattcatacttta

SEQ ID NO: 124361 - DNA, 16 bp, H. sapiens
taaaattcatatggaa

SEQ ID NO: 124362 - DNA, 16 bp, H. sapiens
taaaattcatcctttt

SEQ ID NO: 124363 - DNA, 16 bp, H. sapiens
taaaattcatgtgaaa

SEQ ID NO: 124364 - DNA, 16 bp, H. sapiens
taaaattcatttgaaa

SEQ ID NO: 124365 - DNA, 16 bp, H. sapiens
taaaattccattgtat

SEQ ID NO: 124366 - DNA, 16 bp, H. sapiens
taaaattccattttat

SEQ ID NO: 124367 - DNA, 16 bp, H. sapiens
taaaattcccattttt

SEQ ID NO: 124368 - DNA, 16 bp, H. sapiens
taaaattctattttgt

SEQ ID NO: 124369 - DNA, 16 bp, H. sapiens
taaaattctctgtttt

SEQ ID NO: 124370 - DNA, 16 bp, H. sapiens
taaaattctgtaattt

SEQ ID NO: 124371 - DNA, 16 bp, H. sapiens
taaaattctgtctcaa

SEQ ID NO: 124372 - DNA, 16 bp, H. sapiens
taaaattctgtgattt

SEQ ID NO: 124373 - DNA, 16 bp, H. sapiens
taaaattcttaaaatg

SEQ ID NO: 124374 - DNA, 16 bp, H. sapiens
taaaattcttgatttt

SEQ ID NO: 124375 - DNA, 16 bp, H. sapiens
taaaattgaaacattt

SEQ ID NO: 124376 - DNA, 16 bp, H. sapiens
taaaattgaatttctt

SEQ ID NO: 124377 - DNA, 16 bp, H. sapiens
taaaattgacataaaa

SEQ ID NO: 124378 - DNA, 16 bp, H. sapiens
taaaattgataaacat

SEQ ID NO: 124379 - DNA, 16 bp, H. sapiens
taaaattgataaacct

SEQ ID NO: 124380 - DNA, 16 bp, H. sapiens
taaaattgcacagaac

SEQ ID NO: 124381 - DNA, 16 bp, H. sapiens
taaaattggattatta

SEQ ID NO: 124382 - DNA, 16 bp, H. sapiens
taaaattgtacatatt

SEQ ID NO: 124383 - DNA, 16 bp, H. sapiens
taaaattgtctctttt

SEQ ID NO: 124384 - DNA, 16 bp, H. sapiens
taaaattgtgttttct

SEQ ID NO: 124385 - DNA, 16 bp, H. sapiens
taaaattgtttcaaaa

SEQ ID NO: 124386 - DNA, 16 bp, H. sapiens
taaaattgttttctct

SEQ ID NO: 124387 - DNA, 16 bp, H. sapiens
taaaattgttttgaaa

SEQ ID NO: 124388 - DNA, 16 bp, H. sapiens
taaaattgttttttct

SEQ ID NO: 124389 - DNA, 16 bp, H. sapiens
taaaatttaaaaagca

SEQ ID NO: 124390 - DNA, 16 bp, H. sapiens
taaaatttaacattcc

SEQ ID NO: 124391 - DNA, 16 bp, H. sapiens
taaaatttaagcaaaa

SEQ ID NO: 124392 - DNA, 16 bp, H. sapiens
taaaatttaccacctt

SEQ ID NO: 124393 - DNA, 16 bp, H. sapiens
taaaatttaccattta

SEQ ID NO: 124394 - DNA, 16 bp, H. sapiens
taaaatttatatggaa

SEQ ID NO: 124395 - DNA, 16 bp, H. sapiens
taaaatttatttctga

SEQ ID NO: 124396 - DNA, 16 bp, H. sapiens
taaaatttcaatttct

SEQ ID NO: 124397 - DNA, 16 bp, H. sapiens
taaaatttcagaaaat

SEQ ID NO: 124398 - DNA, 16 bp, H. sapiens
taaaatttcagaaatt

SEQ ID NO: 124399 - DNA, 16 bp, H. sapiens
taaaatttccagaaaa

SEQ ID NO: 124400 - DNA, 16 bp, H. sapiens
taaaatttccagaaat

SEQ ID NO: 124401 - DNA, 16 bp, H. sapiens
taaaatttccatttct

SEQ ID NO: 124402 - DNA, 16 bp, H. sapiens
taaaatttctcttttg

SEQ ID NO: 124403 - DNA, 16 bp, H. sapiens
taaaatttctgaaaaa

SEQ ID NO: 124404 - DNA, 16 bp, H. sapiens
taaaatttctgttctt

SEQ ID NO: 124405 - DNA, 16 bp, H. sapiens
taaaatttgaagtttt

SEQ ID NO: 124406 - DNA, 16 bp, H. sapiens
taaaatttgagaacca

SEQ ID NO: 124407 - DNA, 16 bp, H. sapiens
taaaatttgtaatttg

SEQ ID NO: 124408 - DNA, 16 bp, H. sapiens
taaaattttaacatga

SEQ ID NO: 124409 - DNA, 16 bp, H. sapiens
taaaattttattggaa

SEQ ID NO: 124410 - DNA, 16 bp, H. sapiens
taaaattttcaaatgt

SEQ ID NO: 124411 - DNA, 16 bp, H. sapiens
taaaattttcacattt

SEQ ID NO: 124412 - DNA, 16 bp, H. sapiens
taaaattttcattttg

SEQ ID NO: 124413 - DNA, 16 bp, H. sapiens
taaaattttgcttaaa

SEQ ID NO: 124414 - DNA, 16 bp, H. sapiens
taaaattttggaaaac

SEQ ID NO: 124415 - DNA, 16 bp, H. sapiens
taaaattttgtattct

SEQ ID NO: 124416 - DNA, 16 bp, H. sapiens
taaaattttgtgtaga

SEQ ID NO: 124417 - DNA, 16 bp, H. sapiens
taaacaaaaatggaat

SEQ ID NO: 124418 - DNA, 16 bp, H. sapiens
taaacaaaaggaattt

SEQ ID NO: 124419 - DNA, 16 bp, H. sapiens
taaacaaaatgtatat

SEQ ID NO: 124420 - DNA, 16 bp, H. sapiens
taaacaaaggaggttt

SEQ ID NO: 124421 - DNA, 16 bp, H. sapiens
taaacaaatgaatgaa

SEQ ID NO: 124422 - DNA, 16 bp, H. sapiens
taaacaaatggtggta

SEQ ID NO: 124423 - DNA, 16 bp, H. sapiens
taaacaacaacagcaa

SEQ ID NO: 124424 - DNA, 16 bp, H. sapiens
taaacaacacattttc

SEQ ID NO: 124425 - DNA, 16 bp, H. sapiens
taaacaacagaaactt

SEQ ID NO: 124426 - DNA, 16 bp, H. sapiens
taaacaacagacattt

SEQ ID NO: 124427 - DNA, 16 bp, H. sapiens
taaacaagattttaaa

SEQ ID NO: 124428 - DNA, 16 bp, H. sapiens
taaacaagctgtggta

SEQ ID NO: 124429 - DNA, 16 bp, H. sapiens
taaacaagtgaacaaa

SEQ ID NO: 124430 - DNA, 16 bp, H. sapiens
taaacaatgaaatatt

SEQ ID NO: 124431 - DNA, 16 bp, H. sapiens
taaacaatgaaccaaa

SEQ ID NO: 124432 - DNA, 16 bp, H. sapiens
taaacaatgaaccaat

SEQ ID NO: 124433 - DNA, 16 bp, H. sapiens
taaacaatgtgaatgt

SEQ ID NO: 124434 - DNA, 16 bp, H. sapiens
taaacaattctcaaaa

SEQ ID NO: 124435 - DNA, 16 bp, H. sapiens
taaacacaatgaaata

SEQ ID NO: 124436 - DNA, 16 bp, H. sapiens
taaacacagaaattga

SEQ ID NO: 124437 - DNA, 16 bp, H. sapiens
taaacacaggaaaaga

SEQ ID NO: 124438 - DNA, 16 bp, H. sapiens
taaacacatcatggag

SEQ ID NO: 124439 - DNA, 16 bp, H. sapiens
taaacactcaataaat

SEQ ID NO: 124440 - DNA, 16 bp, H. sapiens
taaacactttttaaaa

SEQ ID NO: 124441 - DNA, 16 bp, H. sapiens
taaacagaaaatggaa

SEQ ID NO: 124442 - DNA, 16 bp, H. sapiens
taaacagaaaattata

SEQ ID NO: 124443 - DNA, 16 bp, H. sapiens
taaacagaaaattatt

SEQ ID NO: 124444 - DNA, 16 bp, H. sapiens
taaacagaaacacata

SEQ ID NO: 124445 - DNA, 16 bp, H. sapiens
taaacagaagcaaaga

SEQ ID NO: 124446 - DNA, 16 bp, H. sapiens
taaacagaattatttg

SEQ ID NO: 124447 - DNA, 16 bp, H. sapiens
taaacagaattgaaaa

SEQ ID NO: 124448 - DNA, 16 bp, H. sapiens
taaacagaattttaaa

SEQ ID NO: 124449 - DNA, 16 bp, H. sapiens
taaacagacttaaaaa

SEQ ID NO: 124450 - DNA, 16 bp, H. sapiens
taaacagcaagtaata

SEQ ID NO: 124451 - DNA, 16 bp, H. sapiens
taaacaggaaagaatg

SEQ ID NO: 124452 - DNA, 16 bp, H. sapiens
taaacaggaagaaaat

SEQ ID NO: 124453 - DNA, 16 bp, H. sapiens
taaacaggaccaatga

SEQ ID NO: 124454 - DNA, 16 bp, H. sapiens
taaacagtattcaaat

SEQ ID NO: 124455 - DNA, 16 bp, H. sapiens
taaacagtgttgggaa

SEQ ID NO: 124456 - DNA, 16 bp, H. sapiens
taaacataaaagctaa

SEQ ID NO: 124457 - DNA, 16 bp, H. sapiens
taaacataatcagaaa

SEQ ID NO: 124458 - DNA, 16 bp, H. sapiens
taaacatacatgtgcg

SEQ ID NO: 124459 - DNA, 16 bp, H. sapiens
taaacatactcttact

SEQ ID NO: 124460 - DNA, 16 bp, H. sapiens
taaacatagaaaatgt

SEQ ID NO: 124461 - DNA, 16 bp, H. sapiens
taaacatatatgtgca

SEQ ID NO: 124462 - DNA, 16 bp, H. sapiens
taaacatatgaatgca

SEQ ID NO: 124463 - DNA, 16 bp, H. sapiens
taaacatatttttaag

SEQ ID NO: 124464 - DNA, 16 bp, H. sapiens
taaacatcagagcaga

SEQ ID NO: 124465 - DNA, 16 bp, H. sapiens
taaacatcatatatga

SEQ ID NO: 124466 - DNA, 16 bp, H. sapiens
taaacatcctataatg

SEQ ID NO: 124467 - DNA, 16 bp, H. sapiens
taaacatcttaacaga

SEQ ID NO: 124468 - DNA, 16 bp, H. sapiens
taaacatcttttcctt

SEQ ID NO: 124469 - DNA, 16 bp, H. sapiens
taaacatgaaagtgca

SEQ ID NO: 124470 - DNA, 16 bp, H. sapiens
taaacatgagggtgca

SEQ ID NO: 124471 - DNA, 16 bp, H. sapiens
taaacatgcaaaataa

SEQ ID NO: 124472 - DNA, 16 bp, H. sapiens
taaacatggaagtaca

SEQ ID NO: 124473 - DNA, 16 bp, H. sapiens
taaacatgtaaataaa

SEQ ID NO: 124474 - DNA, 16 bp, H. sapiens
taaacatgtttgtttt

SEQ ID NO: 124475 - DNA, 16 bp, H. sapiens
taaacattcttctcaa

SEQ ID NO: 124476 - DNA, 16 bp, H. sapiens
taaacattcttttcct

SEQ ID NO: 124477 - DNA, 16 bp, H. sapiens
taaacattgtttctat

SEQ ID NO: 124478 - DNA, 16 bp, H. sapiens
taaacatttaaagaag

SEQ ID NO: 124479 - DNA, 16 bp, H. sapiens
taaacatttcttgtag

SEQ ID NO: 124480 - DNA, 16 bp, H. sapiens
taaacatttcttttca

SEQ ID NO: 124481 - DNA, 16 bp, H. sapiens
taaacatttcttttga

SEQ ID NO: 124482 - DNA, 16 bp, H. sapiens
taaacatttgccaaat

SEQ ID NO: 124483 - DNA, 16 bp, H. sapiens
taaacatttgtgtaca

SEQ ID NO: 124484 - DNA, 16 bp, H. sapiens
taaacatttgtgtata

SEQ ID NO: 124485 - DNA, 16 bp, H. sapiens
taaacatttgtgtgca

SEQ ID NO: 124486 - DNA, 16 bp, H. sapiens
taaacatttgttttaa

SEQ ID NO: 124487 - DNA, 16 bp, H. sapiens
taaacattttaaaact

SEQ ID NO: 124488 - DNA, 16 bp, H. sapiens
taaacattttaaagat

SEQ ID NO: 124489 - DNA, 16 bp, H. sapiens
taaacattttaaattg

SEQ ID NO: 124490 - DNA, 16 bp, H. sapiens
taaacattttcataaa

SEQ ID NO: 124491 - DNA, 16 bp, H. sapiens
taaacattttctgttt

SEQ ID NO: 124492 - DNA, 16 bp, H. sapiens
taaacattttgatttt

SEQ ID NO: 124493 - DNA, 16 bp, H. sapiens
taaacattttgttaac

SEQ ID NO: 124494 - DNA, 16 bp, H. sapiens
taaacattttgttatt

SEQ ID NO: 124495 - DNA, 16 bp, H. sapiens
taaacatttttaaaag

SEQ ID NO: 124496 - DNA, 16 bp, H. sapiens
taaacatttttcaaaa

SEQ ID NO: 124497 - DNA, 16 bp, H. sapiens
taaacatttttctaaa

SEQ ID NO: 124498 - DNA, 16 bp, H. sapiens
taaacattttttgttt

SEQ ID NO: 124499 - DNA, 16 bp, H. sapiens
taaacattttttttgt

SEQ ID NO: 124500 - DNA, 16 bp, H. sapiens
taaaccaaatgtgatc

SEQ ID NO: 124501 - DNA, 16 bp, H. sapiens
taaaccaaattatttt

SEQ ID NO: 124502 - DNA, 16 bp, H. sapiens
taaaccaacagaaatt

SEQ ID NO: 124503 - DNA, 16 bp, H. sapiens
taaaccacatttattt

SEQ ID NO: 124504 - DNA, 16 bp, H. sapiens
taaaccagaaagaagt

SEQ ID NO: 124505 - DNA, 16 bp, H. sapiens
taaaccaggaagaagt

SEQ ID NO: 124506 - DNA, 16 bp, H. sapiens
taaaccatattgtttg

SEQ ID NO: 124507 - DNA, 16 bp, H. sapiens
taaacccaaaggaaaa

SEQ ID NO: 124508 - DNA, 16 bp, H. sapiens
taaacccatcgtaagt

SEQ ID NO: 124509 - DNA, 16 bp, H. sapiens
taaaccccagaaaatt

SEQ ID NO: 124510 - DNA, 16 bp, H. sapiens
taaacccctttccttt

SEQ ID NO: 124511 - DNA, 16 bp, H. sapiens
taaacctcttcccttt

SEQ ID NO: 124512 - DNA, 16 bp, H. sapiens
taaacctcttccttta

SEQ ID NO: 124513 - DNA, 16 bp, H. sapiens
taaacctctttatttt

SEQ ID NO: 124514 - DNA, 16 bp, H. sapiens
taaacctcttttctct

SEQ ID NO: 124515 - DNA, 16 bp, H. sapiens
taaacctgtttttttt

SEQ ID NO: 124516 - DNA, 16 bp, H. sapiens
taaacctttcttcttt

SEQ ID NO: 124517 - DNA, 16 bp, H. sapiens
taaacctttctttaca

SEQ ID NO: 124518 - DNA, 16 bp, H. sapiens
taaacctttttttaaa

SEQ ID NO: 124519 - DNA, 16 bp, H. sapiens
taaacggagtcttgct

SEQ ID NO: 124520 - DNA, 16 bp, H. sapiens
taaacgtggaaaggaa

SEQ ID NO: 124521 - DNA, 16 bp, H. sapiens
taaactagaaaaccta

SEQ ID NO: 124522 - DNA, 17 bp, H. sapiens
taaactaggtattgata

SEQ ID NO: 124523 - DNA, 16 bp, H. sapiens
taaactatagtcaccc

SEQ ID NO: 124524 - DNA, 16 bp, H. sapiens
taaactatctcaagaa

SEQ ID NO: 124525 - DNA, 16 bp, H. sapiens
taaactattgattatt

SEQ ID NO: 124526 - DNA, 16 bp, H. sapiens
taaactcattttaaaa

SEQ ID NO: 124527 - DNA, 16 bp, H. sapiens
taaactccatgaagac

SEQ ID NO: 124528 - DNA, 16 bp, H. sapiens
taaactctatatttta

SEQ ID NO: 124529 - DNA, 16 bp, H. sapiens
taaactcttccagaaa

SEQ ID NO: 124530 - DNA, 16 bp, H. sapiens
taaactgaaatttaaa

SEQ ID NO: 124531 - DNA, 16 bp, H. sapiens
taaactgaataaaaat

SEQ ID NO: 124532 - DNA, 16 bp, H. sapiens
taaactgaggctcaga

SEQ ID NO: 124533 - DNA, 16 bp, H. sapiens
taaactgattttattt

SEQ ID NO: 124534 - DNA, 16 bp, H. sapiens
taaactggagtgcagt

SEQ ID NO: 124535 - DNA, 16 bp, H. sapiens
taaactggttcatctg

SEQ ID NO: 124536 - DNA, 16 bp, H. sapiens
taaactgtggtacatt

SEQ ID NO: 124537 - DNA, 16 bp, H. sapiens
taaacttattcctcct

SEQ ID NO: 124538 - DNA, 16 bp, H. sapiens
taaacttccttaaaac

SEQ ID NO: 124539 - DNA, 16 bp, H. sapiens
taaacttgatattttt

SEQ ID NO: 124540 - DNA, 16 bp, H. sapiens
taaactttaaaatggt

SEQ ID NO: 124541 - DNA, 16 bp, H. sapiens
taaactttccttttag

SEQ ID NO: 124542 - DNA, 16 bp, H. sapiens
taaactttcttaaaac

SEQ ID NO: 124543 - DNA, 16 bp, H. sapiens
taaactttcttaaaat

SEQ ID NO: 124544 - DNA, 16 bp, H. sapiens
taaactttgtttaaat

SEQ ID NO: 124545 - DNA, 16 bp, H. sapiens
taaacttttaaagttt

SEQ ID NO: 124546 - DNA, 16 bp, H. sapiens
taaacttttcttctca

SEQ ID NO: 124547 - DNA, 16 bp, H. sapiens
taaactttttaaagaa

SEQ ID NO: 124548 - DNA, 16 bp, H. sapiens
taaactttttattttg

SEQ ID NO: 124549 - DNA, 16 bp, H. sapiens
taaagaaaaactcatt

SEQ ID NO: 124550 - DNA, 16 bp, H. sapiens
taaagaaaaagaggtt

SEQ ID NO: 124551 - DNA, 16 bp, H. sapiens
taaagaaaaagatgtt

SEQ ID NO: 124552 - DNA, 16 bp, H. sapiens
taaagaaaaagtggca

SEQ ID NO: 124553 - DNA, 16 bp, H. sapiens
taaagaaaaataatct

SEQ ID NO: 124554 - DNA, 16 bp, H. sapiens
taaagaaaacaatttt

SEQ ID NO: 124555 - DNA, 16 bp, H. sapiens
taaagaaaagaagttc

SEQ ID NO: 124556 - DNA, 16 bp, H. sapiens
taaagaaaagaattgt

SEQ ID NO: 124557 - DNA, 16 bp, H. sapiens
taaagaaaagacattt

SEQ ID NO: 124558 - DNA, 16 bp, H. sapiens
taaagaaaagagattt

SEQ ID NO: 124559 - DNA, 16 bp, H. sapiens
taaagaaaagaggtta

SEQ ID NO: 124560 - DNA, 16 bp, H. sapiens
taaagaaaagcaggaa

SEQ ID NO: 124561 - DNA, 16 bp, H. sapiens
taaagaaaagcatttt

SEQ ID NO: 124562 - DNA, 16 bp, H. sapiens
taaagaaaaggaattt

SEQ ID NO: 124563 - DNA, 16 bp, H. sapiens
taaagaaaaggatttt

SEQ ID NO: 124564 - DNA, 16 bp, H. sapiens
taaagaaaagttattt

SEQ ID NO: 124565 - DNA, 16 bp, H. sapiens
taaagaaaatatacag

SEQ ID NO: 124566 - DNA, 16 bp, H. sapiens
taaagaaaatattcag

SEQ ID NO: 124567 - DNA, 16 bp, H. sapiens
taaagaaaatatttct

SEQ ID NO: 124568 - DNA, 16 bp, H. sapiens
taaagaaaatgtggta

SEQ ID NO: 124569 - DNA, 16 bp, H. sapiens
taaagaaaatgttatt

SEQ ID NO: 124570 - DNA, 16 bp, H. sapiens
taaagaaaatgttttt

SEQ ID NO: 124571 - DNA, 16 bp, H. sapiens
taaagaaaatttggca

SEQ ID NO: 124572 - DNA, 16 bp, H. sapiens
taaagaaaattttcaa

SEQ ID NO: 124573 - DNA, 16 bp, H. sapiens
taaagaaacatctgag

SEQ ID NO: 124574 - DNA, 16 bp, H. sapiens
taaagaaactgaagtt

SEQ ID NO: 124575 - DNA, 16 bp, H. sapiens
taaagaaactgagaca

SEQ ID NO: 124576 - DNA, 16 bp, H. sapiens
taaagaaagattactt

SEQ ID NO: 124577 - DNA, 16 bp, H. sapiens
taaagaaagggatgtt

SEQ ID NO: 124578 - DNA, 16 bp, H. sapiens
taaagaaagtccttca

SEQ ID NO: 124579 - DNA, 16 bp, H. sapiens
taaagaaatacatatt

SEQ ID NO: 124580 - DNA, 16 bp, H. sapiens
taaagaaatacatgag

SEQ ID NO: 124581 - DNA, 16 bp, H. sapiens
taaagaaatactcaag

SEQ ID NO: 124582 - DNA, 16 bp, H. sapiens
taaagaaatacttgag

SEQ ID NO: 124583 - DNA, 16 bp, H. sapiens
taaagaaatcaacaag

SEQ ID NO: 124584 - DNA, 16 bp, H. sapiens
taaagaaatgatctga

SEQ ID NO: 124585 - DNA, 16 bp, H. sapiens
taaagaaatgcccaag

SEQ ID NO: 124586 - DNA, 16 bp, H. sapiens
taaagaaatgcttgtg

SEQ ID NO: 124587 - DNA, 16 bp, H. sapiens
taaagaaatgttcttt

SEQ ID NO: 124588 - DNA, 16 bp, H. sapiens
taaagaaatgttttaa

SEQ ID NO: 124589 - DNA, 16 bp, H. sapiens
taaagaaattattcat

SEQ ID NO: 124590 - DNA, 16 bp, H. sapiens
taaagaaattcctgag

SEQ ID NO: 124591 - DNA, 16 bp, H. sapiens
taaagaaattgaagag

SEQ ID NO: 124592 - DNA, 16 bp, H. sapiens
taaagaaattgccaaa

SEQ ID NO: 124593 - DNA, 16 bp, H. sapiens
taaagaaattgtgata

SEQ ID NO: 124594 - DNA, 16 bp, H. sapiens
taaagaaattgtggca

SEQ ID NO: 124595 - DNA, 16 bp, H. sapiens
taaagaacaaaaattt

SEQ ID NO: 124596 - DNA, 16 bp, H. sapiens
taaagaacacttaaaa

SEQ ID NO: 124597 - DNA, 16 bp, H. sapiens
taaagaacagacattt

SEQ ID NO: 124598 - DNA, 16 bp, H. sapiens
taaagaacccagaaaa

SEQ ID NO: 124599 - DNA, 16 bp, H. sapiens
taaagaactagaaaag

SEQ ID NO: 124600 - DNA, 16 bp, H. sapiens
taaagaactcatccat

SEQ ID NO: 124601 - DNA, 16 bp, H. sapiens
taaagaactcttaaaa

SEQ ID NO: 124602 - DNA, 16 bp, H. sapiens
taaagaactcttacaa

SEQ ID NO: 124603 - DNA, 16 bp, H. sapiens
taaagaactgagggtc

SEQ ID NO: 124604 - DNA, 16 bp, H. sapiens
taaagaactgcctgaa

SEQ ID NO: 124605 - DNA, 16 bp, H. sapiens
taaagaactgcctgag

SEQ ID NO: 124606 - DNA, 16 bp, H. sapiens
taaagaactggaaaag

SEQ ID NO: 124607 - DNA, 16 bp, H. sapiens
taaagaacttagtcat

SEQ ID NO: 124608 - DNA, 16 bp, H. sapiens
taaagaacttccttta

SEQ ID NO: 124609 - DNA, 16 bp, H. sapiens
taaagaactttaaaaa

SEQ ID NO: 124610 - DNA, 16 bp, H. sapiens
taaagaacttttaaaa

SEQ ID NO: 124611 - DNA, 16 bp, H. sapiens
taaagaactttttaaa

SEQ ID NO: 124612 - DNA, 16 bp, H. sapiens
taaagaagagagattt

SEQ ID NO: 124613 - DNA, 16 bp, H. sapiens
taaagaagcagtctgg

SEQ ID NO: 124614 - DNA, 16 bp, H. sapiens
taaagaagcatgttct

SEQ ID NO: 124615 - DNA, 16 bp, H. sapiens
taaagaagctttctga

SEQ ID NO: 124616 - DNA, 16 bp, H. sapiens
taaagaaggaaaatgt

SEQ ID NO: 124617 - DNA, 16 bp, H. sapiens
taaagaagtaattaag

SEQ ID NO: 124618 - DNA, 16 bp, H. sapiens
taaagaatatttacaa

SEQ ID NO: 124619 - DNA, 16 bp, H. sapiens
taaagaatgtggcaaa

SEQ ID NO: 124620 - DNA, 16 bp, H. sapiens
taaagaatgttttaaa

SEQ ID NO: 124621 - DNA, 16 bp, H. sapiens
taaagaattcagaagg

SEQ ID NO: 124622 - DNA, 16 bp, H. sapiens
taaagaattcttaaaa

SEQ ID NO: 124623 - DNA, 16 bp, H. sapiens
taaagaattttcaaaa

SEQ ID NO: 124624 - DNA, 16 bp, H. sapiens
taaagacaaggttttg

SEQ ID NO: 124625 - DNA, 16 bp, H. sapiens
taaagacaattatttt

SEQ ID NO: 124626 - DNA, 16 bp, H. sapiens
taaagacacacacaca

SEQ ID NO: 124627 - DNA, 16 bp, H. sapiens
taaagacacacacaga

SEQ ID NO: 124628 - DNA, 16 bp, H. sapiens
taaagacaccttattt

SEQ ID NO: 124629 - DNA, 16 bp, H. sapiens
taaagacagaatttat

SEQ ID NO: 124630 - DNA, 16 bp, H. sapiens
taaagacagagaaaat

SEQ ID NO: 124631 - DNA, 16 bp, H. sapiens
taaagacagatgcaca

SEQ ID NO: 124632 - DNA, 16 bp, H. sapiens
taaagacataaatata

SEQ ID NO: 124633 - DNA, 16 bp, H. sapiens
taaagacatatgcaca

SEQ ID NO: 124634 - DNA, 16 bp, H. sapiens
taaagacatcttattt

SEQ ID NO: 124635 - DNA, 16 bp, H. sapiens
taaagaccaaaggtag

SEQ ID NO: 124636 - DNA, 16 bp, H. sapiens
taaagaccctgctgat

SEQ ID NO: 124637 - DNA, 16 bp, H. sapiens
taaagactacaataaa

SEQ ID NO: 124638 - DNA, 16 bp, H. sapiens
taaagactccttcaaa

SEQ ID NO: 124639 - DNA, 16 bp, H. sapiens
taaagactgaaatgtt

SEQ ID NO: 124640 - DNA, 16 bp, H. sapiens
taaagacttaaatgtt

SEQ ID NO: 124641 - DNA, 16 bp, H. sapiens
taaagacttacatatt

SEQ ID NO: 124642 - DNA, 16 bp, H. sapiens
taaagacttgttgaat

SEQ ID NO: 124643 - DNA, 16 bp, H. sapiens
taaagactttaatgta

SEQ ID NO: 124644 - DNA, 16 bp, H. sapiens
taaagactttttaaat

SEQ ID NO: 124645 - DNA, 16 bp, H. sapiens
taaagagaaaatcttt

SEQ ID NO: 124646 - DNA, 16 bp, H. sapiens
taaagagaaagcagct

SEQ ID NO: 124647 - DNA, 16 bp, H. sapiens
taaagagaaattattt

SEQ ID NO: 124648 - DNA, 16 bp, H. sapiens
taaagagacatgaaaa

SEQ ID NO: 124649 - DNA, 16 bp, H. sapiens
taaagagagttcttca

SEQ ID NO: 124650 - DNA, 16 bp, H. sapiens
taaagagatgtgctgt

SEQ ID NO: 124651 - DNA, 16 bp, H. sapiens
taaagagcaaaataac

SEQ ID NO: 124652 - DNA, 16 bp, H. sapiens
taaagagctgaaagaa

SEQ ID NO: 124653 - DNA, 16 bp, H. sapiens
taaagagcttctgcaa

SEQ ID NO: 124654 - DNA, 16 bp, H. sapiens
taaagagcttttaaaa

SEQ ID NO: 124655 - DNA, 16 bp, H. sapiens
taaagaggaaactgag

SEQ ID NO: 124656 - DNA, 16 bp, H. sapiens
taaagaggaagtcaaa

SEQ ID NO: 124657 - DNA, 16 bp, H. sapiens
taaagaggaagttaaa

SEQ ID NO: 124658 - DNA, 16 bp, H. sapiens
taaagaggtaattaaa

SEQ ID NO: 124659 - DNA, 16 bp, H. sapiens
taaagaggtgaaagat

SEQ ID NO: 124660 - DNA, 16 bp, H. sapiens
taaagagtttcagttt

SEQ ID NO: 124661 - DNA, 16 bp, H. sapiens
taaagagtttggattt

SEQ ID NO: 124662 - DNA, 16 bp, H. sapiens
taaagataaaagcaga

SEQ ID NO: 124663 - DNA, 16 bp, H. sapiens
taaagatagacaaata

SEQ ID NO: 124664 - DNA, 16 bp, H. sapiens
taaagatatacttgag

SEQ ID NO: 124665 - DNA, 16 bp, H. sapiens
taaagatatggaatca

SEQ ID NO: 124666 - DNA, 16 bp, H. sapiens
taaagatatttttgaa

SEQ ID NO: 124667 - DNA, 16 bp, H. sapiens
taaagatctgaaagaa

SEQ ID NO: 124668 - DNA, 16 bp, H. sapiens
taaagatgaaaacata

SEQ ID NO: 124669 - DNA, 16 bp, H. sapiens
taaagatgaaaatttt

SEQ ID NO: 124670 - DNA, 16 bp, H. sapiens
taaagatgaatggtaa

SEQ ID NO: 124671 - DNA, 16 bp, H. sapiens
taaagatggagtttct

SEQ ID NO: 124672 - DNA, 16 bp, H. sapiens
taaagatgggttttca

SEQ ID NO: 124673 - DNA, 16 bp, H. sapiens
taaagatgtaattttt

SEQ ID NO: 124674 - DNA, 16 bp, H. sapiens
taaagatgtatttatt

SEQ ID NO: 124675 - DNA, 16 bp, H. sapiens
taaagatgtggagaaa

SEQ ID NO: 124676 - DNA, 16 bp, H. sapiens
taaagattgttttaaa

SEQ ID NO: 124677 - DNA, 16 bp, H. sapiens
taaagatttaaacata

SEQ ID NO: 124678 - DNA, 16 bp, H. sapiens
taaagatttcacaaaa

SEQ ID NO: 124679 - DNA, 16 bp, H. sapiens
taaagcaaaacatttt

SEQ ID NO: 124680 - DNA, 16 bp, H. sapiens
taaagcaaaattaaga

SEQ ID NO: 124681 - DNA, 16 bp, H. sapiens
taaagcaaatattctt

SEQ ID NO: 124682 - DNA, 16 bp, H. sapiens
taaagcaaatgaacaa

SEQ ID NO: 124683 - DNA, 16 bp, H. sapiens
taaagcaaccactaaa

SEQ ID NO: 124684 - DNA, 16 bp, H. sapiens
taaagcaagtcacaca

SEQ ID NO: 124685 - DNA, 16 bp, H. sapiens
taaagcaattcttgtg

SEQ ID NO: 124686 - DNA, 16 bp, H. sapiens
taaagcaatttaaaag

SEQ ID NO: 124687 - DNA, 16 bp, H. sapiens
taaagcaccaagcaga

SEQ ID NO: 124688 - DNA, 16 bp, H. sapiens
taaagcacttagaata

SEQ ID NO: 124689 - DNA, 16 bp, H. sapiens
taaagcagaaacagct

SEQ ID NO: 124690 - DNA, 16 bp, H. sapiens
taaagcagatgaccct

SEQ ID NO: 124691 - DNA, 16 bp, H. sapiens
taaagcagattacctt

SEQ ID NO: 124692 - DNA, 16 bp, H. sapiens
taaagcagctattata

SEQ ID NO: 124693 - DNA, 16 bp, H. sapiens
taaagcagtgtttctc

SEQ ID NO: 124694 - DNA, 16 bp, H. sapiens
taaagcataataataa

SEQ ID NO: 124695 - DNA, 16 bp, H. sapiens
taaagcataatttaaa

SEQ ID NO: 124696 - DNA, 16 bp, H. sapiens
taaagcataattttaa

SEQ ID NO: 124697 - DNA, 16 bp, H. sapiens
taaagcattatttctg

SEQ ID NO: 124698 - DNA, 16 bp, H. sapiens
taaagccattcaacaa

SEQ ID NO: 124699 - DNA, 16 bp, H. sapiens
taaagccttttaaaaa

SEQ ID NO: 124700 - DNA, 16 bp, H. sapiens
taaagccttttttttt

SEQ ID NO: 124701 - DNA, 16 bp, H. sapiens
taaagctaaaaatgaa

SEQ ID NO: 124702 - DNA, 16 bp, H. sapiens
taaagctattaaaata

SEQ ID NO: 124703 - DNA, 16 bp, H. sapiens
taaagctatttttaaa

SEQ ID NO: 124704 - DNA, 16 bp, H. sapiens
taaagctctgtttcct

SEQ ID NO: 124705 - DNA, 16 bp, H. sapiens
taaagctgaaactgga

SEQ ID NO: 124706 - DNA, 16 bp, H. sapiens
taaagctgctataaac

SEQ ID NO: 124707 - DNA, 16 bp, H. sapiens
taaagctgctctaaaa

SEQ ID NO: 124708 - DNA, 16 bp, H. sapiens
taaagctgttaaaaaa

SEQ ID NO: 124709 - DNA, 16 bp, H. sapiens
taaagctgttaaaata

SEQ ID NO: 124710 - DNA, 16 bp, H. sapiens
taaagctgttaagaaa

SEQ ID NO: 124711 - DNA, 16 bp, H. sapiens
taaagctgttattaaa

SEQ ID NO: 124712 - DNA, 16 bp, H. sapiens
taaagctgttatttaa

SEQ ID NO: 124713 - DNA, 16 bp, H. sapiens
taaagctgttttattt

SEQ ID NO: 124714 - DNA, 16 bp, H. sapiens
taaagctgttttttaa

SEQ ID NO: 124715 - DNA, 16 bp, H. sapiens
taaagcttttagaaga

SEQ ID NO: 124716 - DNA, 16 bp, H. sapiens
taaagcttttttattt

SEQ ID NO: 124717 - DNA, 16 bp, H. sapiens
taaaggaaaaaacttt

SEQ ID NO: 124718 - DNA, 16 bp, H. sapiens
taaaggaaaaaatgtt

SEQ ID NO: 124719 - DNA, 16 bp, H. sapiens
taaaggaaaaacttct

SEQ ID NO: 124720 - DNA, 16 bp, H. sapiens
taaaggaaaaagtttt

SEQ ID NO: 124721 - DNA, 16 bp, H. sapiens
taaaggaaaatattga

SEQ ID NO: 124722 - DNA, 16 bp, H. sapiens
taaaggaaatactaaa

SEQ ID NO: 124723 - DNA, 16 bp, H. sapiens
taaaggaaatatttca

SEQ ID NO: 124724 - DNA, 16 bp, H. sapiens
taaaggaaatgttttc

SEQ ID NO: 124725 - DNA, 16 bp, H. sapiens
taaaggaagtccttca

SEQ ID NO: 124726 - DNA, 16 bp, H. sapiens
taaaggaatacctgag

SEQ ID NO: 124727 - DNA, 16 bp, H. sapiens
taaaggaatgctggat

SEQ ID NO: 124728 - DNA, 16 bp, H. sapiens
taaaggaatggaggaa

SEQ ID NO: 124729 - DNA, 16 bp, H. sapiens
taaaggaattgaaatc

SEQ ID NO: 124730 - DNA, 16 bp, H. sapiens
taaaggacatgatctt

SEQ ID NO: 124731 - DNA, 16 bp, H. sapiens
taaaggagaaaaatca

SEQ ID NO: 124732 - DNA, 16 bp, H. sapiens
taaaggagaagaacaa

SEQ ID NO: 124733 - DNA, 16 bp, H. sapiens
taaaggatgagtagga

SEQ ID NO: 124734 - DNA, 16 bp, H. sapiens
taaaggatgttatttc

SEQ ID NO: 124735 - DNA, 16 bp, H. sapiens
taaaggattccacctc

SEQ ID NO: 124736 - DNA, 16 bp, H. sapiens
taaaggcatgtgccac

SEQ ID NO: 124737 - DNA, 16 bp, H. sapiens
taaaggccatgtatga

SEQ ID NO: 124738 - DNA, 16 bp, H. sapiens
taaaggcctcatctcc

SEQ ID NO: 124739 - DNA, 16 bp, H. sapiens
taaaggcggggtttca

SEQ ID NO: 124740 - DNA, 16 bp, H. sapiens
taaagggaagaaaaca

SEQ ID NO: 124741 - DNA, 16 bp, H. sapiens
taaagggatttttaaa

SEQ ID NO: 124742 - DNA, 16 bp, H. sapiens
taaagggccagacagt

SEQ ID NO: 124743 - DNA, 16 bp, H. sapiens
taaagggccagagagt

SEQ ID NO: 124744 - DNA, 16 bp, H. sapiens
taaaggggactttgtt

SEQ ID NO: 124745 - DNA, 16 bp, H. sapiens
taaaggggtggaggaa

SEQ ID NO: 124746 - DNA, 19 bp, H. sapiens
taaagggtctgtgctgagg

SEQ ID NO: 124747 - DNA, 16 bp, H. sapiens
taaagggttggaaaaa

SEQ ID NO: 124748 - DNA, 17 bp, H. sapiens
taaaggtaaagggatca

SEQ ID NO: 124749 - DNA, 16 bp, H. sapiens
taaaggtatatatttt

SEQ ID NO: 124750 - DNA, 16 bp, H. sapiens
taaaggtcttcatcct

SEQ ID NO: 124751 - DNA, 16 bp, H. sapiens
taaaggtggtgcggac

SEQ ID NO: 124752 - DNA, 16 bp, H. sapiens
taaaggttggggtggc

SEQ ID NO: 124753 - DNA, 17 bp, H. sapiens
taaaggtttcactgaat

SEQ ID NO: 124754 - DNA, 16 bp, H. sapiens
taaagtacatttttaa

SEQ ID NO: 124755 - DNA, 16 bp, H. sapiens
taaagtactaaaagaa

SEQ ID NO: 124756 - DNA, 16 bp, H. sapiens
taaagtactgggatta

SEQ ID NO: 124757 - DNA, 16 bp, H. sapiens
taaagtaggtactatt

SEQ ID NO: 124758 - DNA, 16 bp, H. sapiens
taaagtatgtatatat

SEQ ID NO: 124759 - DNA, 16 bp, H. sapiens
taaagtcaactgatta

SEQ ID NO: 124760 - DNA, 16 bp, H. sapiens
taaagtccaaagtctc

SEQ ID NO: 124761 - DNA, 16 bp, H. sapiens
taaagtctctctctct

SEQ ID NO: 124762 - DNA, 16 bp, H. sapiens
taaagtgaaaacaaat

SEQ ID NO: 124763 - DNA, 16 bp, H. sapiens
taaagtgaaagcaagt

SEQ ID NO: 124764 - DNA, 16 bp, H. sapiens
taaagtgcagtttaaa

SEQ ID NO: 124765 - DNA, 16 bp, H. sapiens
taaagtgctaggatta

SEQ ID NO: 124766 - DNA, 16 bp, H. sapiens
taaagtgctgaagaaa

SEQ ID NO: 124767 - DNA, 16 bp, H. sapiens
taaagtgctgagatta

SEQ ID NO: 124768 - DNA, 16 bp, H. sapiens
taaagtgctgggatta

SEQ ID NO: 124769 - DNA, 16 bp, H. sapiens
taaagtggcagtgttt

SEQ ID NO: 124770 - DNA, 16 bp, H. sapiens
taaagtgtaaaatgtg

SEQ ID NO: 124771 - DNA, 16 bp, H. sapiens
taaagtgtacaagtca

SEQ ID NO: 124772 - DNA, 16 bp, H. sapiens
taaagtgttaattaaa

SEQ ID NO: 124773 - DNA, 16 bp, H. sapiens
taaagtgttgggatta

SEQ ID NO: 124774 - DNA, 16 bp, H. sapiens
taaagtgttttatttc

SEQ ID NO: 124775 - DNA, 16 bp, H. sapiens
taaagtgttttcctga

SEQ ID NO: 124776 - DNA, 16 bp, H. sapiens
taaagtgtttttaaaa

SEQ ID NO: 124777 - DNA, 16 bp, H. sapiens
taaagttacaaaatga

SEQ ID NO: 124778 - DNA, 16 bp, H. sapiens
taaagttcaaaagcag

SEQ ID NO: 124779 - DNA, 16 bp, H. sapiens
taaagttcttatggaa

SEQ ID NO: 124780 - DNA, 16 bp, H. sapiens
taaagttgattttaaa

SEQ ID NO: 124781 - DNA, 16 bp, H. sapiens
taaagttggaatttat

SEQ ID NO: 124782 - DNA, 16 bp, H. sapiens
taaagtttgacttttt

SEQ ID NO: 124783 - DNA, 16 bp, H. sapiens
taaagtttgagaacca

SEQ ID NO: 124784 - DNA, 16 bp, H. sapiens
taaagtttgtaaaatt

SEQ ID NO: 124785 - DNA, 16 bp, H. sapiens
taaagtttgtcaattt

SEQ ID NO: 124786 - DNA, 16 bp, H. sapiens
taaagtttgtttatgc

SEQ ID NO: 124787 - DNA, 16 bp, H. sapiens
taaagtttgttttatc

SEQ ID NO: 124788 - DNA, 17 bp, H. sapiens
taaagttttagggtaca

SEQ ID NO: 124789 - DNA, 16 bp, H. sapiens
taaagttttattagaa

SEQ ID NO: 124790 - DNA, 16 bp, H. sapiens
taaagttttatttgaa

SEQ ID NO: 124791 - DNA, 16 bp, H. sapiens
taaagttttgggatac

SEQ ID NO: 124792 - DNA, 16 bp, H. sapiens
taaagtttttcttctt

SEQ ID NO: 124793 - DNA, 16 bp, H. sapiens
taaataaaaatctgaa

SEQ ID NO: 124794 - DNA, 16 bp, H. sapiens
taaataaaaatgctaa

SEQ ID NO: 124795 - DNA, 16 bp, H. sapiens
taaataaaaattagcc

SEQ ID NO: 124796 - DNA, 16 bp, H. sapiens
taaataaaaccatttt

SEQ ID NO: 124797 - DNA, 16 bp, H. sapiens
taaataaaagctttta

SEQ ID NO: 124798 - DNA, 16 bp, H. sapiens
taaataaaatctttga

SEQ ID NO: 124799 - DNA, 16 bp, H. sapiens
taaataaaatgataca

SEQ ID NO: 124800 - DNA, 16 bp, H. sapiens
taaataaaatgtacat

SEQ ID NO: 124801 - DNA, 16 bp, H. sapiens
taaataaaattcaaga

SEQ ID NO: 124802 - DNA, 16 bp, H. sapiens
taaataaacaaatgga

SEQ ID NO: 124803 - DNA, 16 bp, H. sapiens
taaataaacatctttt

SEQ ID NO: 124804 - DNA, 16 bp, H. sapiens
taaataaagcaaatat

SEQ ID NO: 124805 - DNA, 16 bp, H. sapiens
taaataaagctgctgt

SEQ ID NO: 124806 - DNA, 16 bp, H. sapiens
taaataaagtagtatt

SEQ ID NO: 124807 - DNA, 16 bp, H. sapiens
taaataaagttaaaca

SEQ ID NO: 124808 - DNA, 16 bp, H. sapiens
taaataaagtttgatt

SEQ ID NO: 124809 - DNA, 16 bp, H. sapiens
taaataaataaagctt

SEQ ID NO: 124810 - DNA, 16 bp, H. sapiens
taaataaataatgaca

SEQ ID NO: 124811 - DNA, 16 bp, H. sapiens
taaataaatacatgtt

SEQ ID NO: 124812 - DNA, 16 bp, H. sapiens
taaataaatacattga

SEQ ID NO: 124813 - DNA, 16 bp, H. sapiens
taaataaatacatttg

SEQ ID NO: 124814 - DNA, 16 bp, H. sapiens
taaataaatagcaaag

SEQ ID NO: 124815 - DNA, 16 bp, H. sapiens
taaataaatatgcttt

SEQ ID NO: 124816 - DNA, 16 bp, H. sapiens
taaataaatattcact

SEQ ID NO: 124817 - DNA, 16 bp, H. sapiens
taaataaatcaagatg

SEQ ID NO: 124818 - DNA, 16 bp, H. sapiens
taaataaatgcagaga

SEQ ID NO: 124819 - DNA, 16 bp, H. sapiens
taaataaatgctaaaa

SEQ ID NO: 124820 - DNA, 16 bp, H. sapiens
taaataaatggaatca

SEQ ID NO: 124821 - DNA, 16 bp, H. sapiens
taaataaatgtaactt

SEQ ID NO: 124822 - DNA, 16 bp, H. sapiens
taaataaatgtatatg

SEQ ID NO: 124823 - DNA, 16 bp, H. sapiens
taaataaatgtgtata

SEQ ID NO: 124824 - DNA, 16 bp, H. sapiens
taaataaatgtgtttt

SEQ ID NO: 124825 - DNA, 16 bp, H. sapiens
taaataaatgttagtt

SEQ ID NO: 124826 - DNA, 16 bp, H. sapiens
taaataaattttggta

SEQ ID NO: 124827 - DNA, 16 bp, H. sapiens
taaataacattttgtt

SEQ ID NO: 124828 - DNA, 16 bp, H. sapiens
taaataactaaaagta

SEQ ID NO: 124829 - DNA, 16 bp, H. sapiens
taaataactttccaaa

SEQ ID NO: 124830 - DNA, 16 bp, H. sapiens
taaataataaaacttg

SEQ ID NO: 124831 - DNA, 16 bp, H. sapiens
taaataataaagatca

SEQ ID NO: 124832 - DNA, 16 bp, H. sapiens
taaataatacatttct

SEQ ID NO: 124833 - DNA, 16 bp, H. sapiens
taaataatagacattt

SEQ ID NO: 124834 - DNA, 16 bp, H. sapiens
taaataatgcagaaaa

SEQ ID NO: 124835 - DNA, 16 bp, H. sapiens
taaataatgtcatttt

SEQ ID NO: 124836 - DNA, 16 bp, H. sapiens
taaataatgtgtacat

SEQ ID NO: 124837 - DNA, 16 bp, H. sapiens
taaataattcatttct

SEQ ID NO: 124838 - DNA, 16 bp, H. sapiens
taaataattctaccaa

SEQ ID NO: 124839 - DNA, 16 bp, H. sapiens
taaataatttgtaagt

SEQ ID NO: 124840 - DNA, 16 bp, H. sapiens
taaatacaaaaattag

SEQ ID NO: 124841 - DNA, 16 bp, H. sapiens
taaatacaaaattgca

SEQ ID NO: 124842 - DNA, 16 bp, H. sapiens
taaatacaaacatgca

SEQ ID NO: 124843 - DNA, 16 bp, H. sapiens
taaatacacatatatt

SEQ ID NO: 124844 - DNA, 16 bp, H. sapiens
taaatacagttttatt

SEQ ID NO: 124845 - DNA, 16 bp, H. sapiens
taaatacataaagcaa

SEQ ID NO: 124846 - DNA, 16 bp, H. sapiens
taaatacatacatatt

SEQ ID NO: 124847 - DNA, 16 bp, H. sapiens
taaatacatattttct

SEQ ID NO: 124848 - DNA, 16 bp, H. sapiens
taaatacatgtgtata

SEQ ID NO: 124849 - DNA, 16 bp, H. sapiens
taaatacatgttttca

SEQ ID NO: 124850 - DNA, 16 bp, H. sapiens
taaataccccagctcc

SEQ ID NO: 124851 - DNA, 16 bp, H. sapiens
taaatacctgaaaatg

SEQ ID NO: 124852 - DNA, 16 bp, H. sapiens
taaatactatcatttt

SEQ ID NO: 124853 - DNA, 16 bp, H. sapiens
taaatacttcagtatg

SEQ ID NO: 124854 - DNA, 16 bp, H. sapiens
taaatacttgctgaat

SEQ ID NO: 124855 - DNA, 16 bp, H. sapiens
taaatacttgtaaaat

SEQ ID NO: 124856 - DNA, 16 bp, H. sapiens
taaatacttgttgaag

SEQ ID NO: 124857 - DNA, 16 bp, H. sapiens
taaatactttatttca

SEQ ID NO: 124858 - DNA, 16 bp, H. sapiens
taaatagaaaacttga

SEQ ID NO: 124859 - DNA, 16 bp, H. sapiens
taaatagaaccaaaga

SEQ ID NO: 124860 - DNA, 16 bp, H. sapiens
taaatagaatacattt

SEQ ID NO: 124861 - DNA, 16 bp, H. sapiens
taaatagaatcataca

SEQ ID NO: 124862 - DNA, 16 bp, H. sapiens
taaatagcaataataa

SEQ ID NO: 124863 - DNA, 16 bp, H. sapiens
taaatagcagagctgg

SEQ ID NO: 124864 - DNA, 16 bp, H. sapiens
taaatagcattttatt

SEQ ID NO: 124865 - DNA, 16 bp, H. sapiens
taaatagcattttttt

SEQ ID NO: 124866 - DNA, 16 bp, H. sapiens
taaatagtggtgatgg

SEQ ID NO: 124867 - DNA, 16 bp, H. sapiens
taaatagtttgcaaat

SEQ ID NO: 124868 - DNA, 16 bp, H. sapiens
taaatagtttttttct

SEQ ID NO: 124869 - DNA, 16 bp, H. sapiens
taaatataaagataca

SEQ ID NO: 124870 - DNA, 16 bp, H. sapiens
taaatataaagcattt

SEQ ID NO: 124871 - DNA, 16 bp, H. sapiens
taaatatacacaattt

SEQ ID NO: 124872 - DNA, 16 bp, H. sapiens
taaatatacgtgtgca

SEQ ID NO: 124873 - DNA, 17 bp, H. sapiens
taaatatatatgcacct

SEQ ID NO: 124874 - DNA, 16 bp, H. sapiens
taaatatatggaatat

SEQ ID NO: 124875 - DNA, 16 bp, H. sapiens
taaatatatgtacaca

SEQ ID NO: 124876 - DNA, 16 bp, H. sapiens
taaatatatgtacata

SEQ ID NO: 124877 - DNA, 16 bp, H. sapiens
taaatatatgtgtgta

SEQ ID NO: 124878 - DNA, 16 bp, H. sapiens
taaatatatgttatgt

SEQ ID NO: 124879 - DNA, 16 bp, H. sapiens
taaatatattgtttct

SEQ ID NO: 124880 - DNA, 16 bp, H. sapiens
taaatatatttccaaa

SEQ ID NO: 124881 - DNA, 16 bp, H. sapiens
taaatatccaaattat

SEQ ID NO: 124882 - DNA, 16 bp, H. sapiens
taaatatcctgatttg

SEQ ID NO: 124883 - DNA, 16 bp, H. sapiens
taaatatctacatttt

SEQ ID NO: 124884 - DNA, 16 bp, H. sapiens
taaatatctactatgt

SEQ ID NO: 124885 - DNA, 16 bp, H. sapiens
taaatatctgtttaat

SEQ ID NO: 124886 - DNA, 16 bp, H. sapiens
taaatatcttgttttt

SEQ ID NO: 124887 - DNA, 16 bp, H. sapiens
taaatatcttttgaat

SEQ ID NO: 124888 - DNA, 16 bp, H. sapiens
taaatatctttttgtt

SEQ ID NO: 124889 - DNA, 16 bp, H. sapiens
taaatatgaatgaatg

SEQ ID NO: 124890 - DNA, 16 bp, H. sapiens
taaatatgcaatatat

SEQ ID NO: 124891 - DNA, 16 bp, H. sapiens
taaatatgcattcatt

SEQ ID NO: 124892 - DNA, 16 bp, H. sapiens
taaatatgctaattac

SEQ ID NO: 124893 - DNA, 16 bp, H. sapiens
taaatatgcttatttt

SEQ ID NO: 124894 - DNA, 16 bp, H. sapiens
taaatatgtacatatt

SEQ ID NO: 124895 - DNA, 16 bp, H. sapiens
taaatatgtatgcata

SEQ ID NO: 124896 - DNA, 16 bp, H. sapiens
taaatatgtatttagt

SEQ ID NO: 124897 - DNA, 16 bp, H. sapiens
taaatatgtcattttt

SEQ ID NO: 124898 - DNA, 16 bp, H. sapiens
taaatatgtttacata

SEQ ID NO: 124899 - DNA, 16 bp, H. sapiens
taaatatgtttacttt

SEQ ID NO: 124900 - DNA, 16 bp, H. sapiens
taaatatgttttaaag

SEQ ID NO: 124901 - DNA, 16 bp, H. sapiens
taaatatgttttctct

SEQ ID NO: 124902 - DNA, 16 bp, H. sapiens
taaatatgttttgaat

SEQ ID NO: 124903 - DNA, 16 bp, H. sapiens
taaatattatgaacaa

SEQ ID NO: 124904 - DNA, 16 bp, H. sapiens
taaatattcaatcatg

SEQ ID NO: 124905 - DNA, 16 bp, H. sapiens
taaatattcccactgt

SEQ ID NO: 124906 - DNA, 16 bp, H. sapiens
taaatattctacaatg

SEQ ID NO: 124907 - DNA, 16 bp, H. sapiens
taaatattgaaaggaa

SEQ ID NO: 124908 - DNA, 16 bp, H. sapiens
taaatattgaaggaaa

SEQ ID NO: 124909 - DNA, 16 bp, H. sapiens
taaatattgttaacat

SEQ ID NO: 124910 - DNA, 16 bp, H. sapiens
taaatatttaggattg

SEQ ID NO: 124911 - DNA, 16 bp, H. sapiens
taaatatttaggcttt

SEQ ID NO: 124912 - DNA, 16 bp, H. sapiens
taaatatttattgtct

SEQ ID NO: 124913 - DNA, 16 bp, H. sapiens
taaatatttcactcca

SEQ ID NO: 124914 - DNA, 16 bp, H. sapiens
taaatatttcaggctt

SEQ ID NO: 124915 - DNA, 16 bp, H. sapiens
taaatatttcagtatt

SEQ ID NO: 124916 - DNA, 16 bp, H. sapiens
taaatatttcattaca

SEQ ID NO: 124917 - DNA, 16 bp, H. sapiens
taaatatttccatatt

SEQ ID NO: 124918 - DNA, 16 bp, H. sapiens
taaatatttctgaata

SEQ ID NO: 124919 - DNA, 16 bp, H. sapiens
taaatatttctgtgaa

SEQ ID NO: 124920 - DNA, 16 bp, H. sapiens
taaatatttcttgaaa

SEQ ID NO: 124921 - DNA, 16 bp, H. sapiens
taaatatttcttgaat

SEQ ID NO: 124922 - DNA, 16 bp, H. sapiens
taaatatttctttctg

SEQ ID NO: 124923 - DNA, 16 bp, H. sapiens
taaatatttgatgaat

SEQ ID NO: 124924 - DNA, 16 bp, H. sapiens
taaatatttgcattta

SEQ ID NO: 124925 - DNA, 16 bp, H. sapiens
taaatatttgctgaat

SEQ ID NO: 124926 - DNA, 16 bp, H. sapiens
taaatatttgtaagtt

SEQ ID NO: 124927 - DNA, 16 bp, H. sapiens
taaatatttgtcattt

SEQ ID NO: 124928 - DNA, 16 bp, H. sapiens
taaatatttgtgaata

SEQ ID NO: 124929 - DNA, 16 bp, H. sapiens
taaatatttgttgaat

SEQ ID NO: 124930 - DNA, 16 bp, H. sapiens
taaatatttgttgact

SEQ ID NO: 124931 - DNA, 16 bp, H. sapiens
taaatattttactgaa

SEQ ID NO: 124932 - DNA, 16 bp, H. sapiens
taaatattttagactt

SEQ ID NO: 124933 - DNA, 16 bp, H. sapiens
taaatattttcaaaga

SEQ ID NO: 124934 - DNA, 16 bp, H. sapiens
taaatattttctgctt

SEQ ID NO: 124935 - DNA, 16 bp, H. sapiens
taaatattttgcatat

SEQ ID NO: 124936 - DNA, 16 bp, H. sapiens
taaatattttgctgaa

SEQ ID NO: 124937 - DNA, 16 bp, H. sapiens
taaatatttttcaagt

SEQ ID NO: 124938 - DNA, 16 bp, H. sapiens
taaatcaaaagttaga

SEQ ID NO: 124939 - DNA, 16 bp, H. sapiens
taaatcaaaatatttg

SEQ ID NO: 124940 - DNA, 16 bp, H. sapiens
taaatcaacagaataa

SEQ ID NO: 124941 - DNA, 21 bp, H. sapiens
taaatcaacagaatatacatt

SEQ ID NO: 124942 - DNA, 16 bp, H. sapiens
taaatcaagctattta

SEQ ID NO: 124943 - DNA, 18 bp, H. sapiens
taaatcaataaacgtaat

SEQ ID NO: 124944 - DNA, 16 bp, H. sapiens
taaatcaatgaataaa

SEQ ID NO: 124945 - DNA, 16 bp, H. sapiens
taaatcagaatctctg

SEQ ID NO: 124946 - DNA, 16 bp, H. sapiens
taaatcaggaagaatt

SEQ ID NO: 124947 - DNA, 16 bp, H. sapiens
taaatcaggggtcagc

SEQ ID NO: 124948 - DNA, 16 bp, H. sapiens
taaatcagtagactga

SEQ ID NO: 124949 - DNA, 16 bp, H. sapiens
taaatcagttatttta

SEQ ID NO: 124950 - DNA, 16 bp, H. sapiens
taaatcagttttattt

SEQ ID NO: 124951 - DNA, 16 bp, H. sapiens
taaatcatcctaccat

SEQ ID NO: 124952 - DNA, 16 bp, H. sapiens
taaatcatccttgcat

SEQ ID NO: 124953 - DNA, 16 bp, H. sapiens
taaatcatgaaattaa

SEQ ID NO: 124954 - DNA, 16 bp, H. sapiens
taaatcatgctgccat

SEQ ID NO: 124955 - DNA, 16 bp, H. sapiens
taaatcattctaccaa

SEQ ID NO: 124956 - DNA, 16 bp, H. sapiens
taaatcatttattcat

SEQ ID NO: 124957 - DNA, 16 bp, H. sapiens
taaatcattttcaaaa

SEQ ID NO: 124958 - DNA, 16 bp, H. sapiens
taaatccaaatactta

SEQ ID NO: 124959 - DNA, 16 bp, H. sapiens
taaatccctttctgct

SEQ ID NO: 124960 - DNA, 16 bp, H. sapiens
taaatctaaaatgatt

SEQ ID NO: 124961 - DNA, 16 bp, H. sapiens
taaatctaagacttga

SEQ ID NO: 124962 - DNA, 16 bp, H. sapiens
taaatctaagagttat

SEQ ID NO: 124963 - DNA, 16 bp, H. sapiens
taaatctataaaaatg

SEQ ID NO: 124964 - DNA, 16 bp, H. sapiens
taaatctatgttgttt

SEQ ID NO: 124965 - DNA, 17 bp, H. sapiens
taaatctcatgtcctca

SEQ ID NO: 124966 - DNA, 16 bp, H. sapiens
taaatctccaaaataa

SEQ ID NO: 124967 - DNA, 16 bp, H. sapiens
taaatctctctctttt

SEQ ID NO: 124968 - DNA, 16 bp, H. sapiens
taaatctcttctcttt

SEQ ID NO: 124969 - DNA, 16 bp, H. sapiens
taaatctctttaaata

SEQ ID NO: 124970 - DNA, 16 bp, H. sapiens
taaatctctttgcttt

SEQ ID NO: 124971 - DNA, 16 bp, H. sapiens
taaatctggcaaccct

SEQ ID NO: 124972 - DNA, 16 bp, H. sapiens
taaatctggcaatcct

SEQ ID NO: 124973 - DNA, 17 bp, H. sapiens
taaatcttgctgctgct

SEQ ID NO: 124974 - DNA, 16 bp, H. sapiens
taaatctttaaagaaa

SEQ ID NO: 124975 - DNA, 16 bp, H. sapiens
taaatctttattccat

SEQ ID NO: 124976 - DNA, 16 bp, H. sapiens
taaatctttgttgaat

SEQ ID NO: 124977 - DNA, 16 bp, H. sapiens
taaatcttttccattt

SEQ ID NO: 124978 - DNA, 16 bp, H. sapiens
taaatctttttcaaaa

SEQ ID NO: 124979 - DNA, 16 bp, H. sapiens
taaatgaaaatataac

SEQ ID NO: 124980 - DNA, 16 bp, H. sapiens
taaatgaaacaatgca

SEQ ID NO: 124981 - DNA, 16 bp, H. sapiens
taaatgaaataaagtg

SEQ ID NO: 124982 - DNA, 16 bp, H. sapiens
taaatgaaatcaaata

SEQ ID NO: 124983 - DNA, 16 bp, H. sapiens
taaatgaaattgattt

SEQ ID NO: 124984 - DNA, 16 bp, H. sapiens
taaatgaagagaatga

SEQ ID NO: 124985 - DNA, 16 bp, H. sapiens
taaatgaagaggatga

SEQ ID NO: 124986 - DNA, 16 bp, H. sapiens
taaatgaaggagagat

SEQ ID NO: 124987 - DNA, 16 bp, H. sapiens
taaatgaagtaattca

SEQ ID NO: 124988 - DNA, 16 bp, H. sapiens
taaatgaatcttggaa

SEQ ID NO: 124989 - DNA, 16 bp, H. sapiens
taaatgaatgaatatg

SEQ ID NO: 124990 - DNA, 16 bp, H. sapiens
taaatgaatgactttt

SEQ ID NO: 124991 - DNA, 16 bp, H. sapiens
taaatgaatggatgat

SEQ ID NO: 124992 - DNA, 16 bp, H. sapiens
taaatgaattaagcaa

SEQ ID NO: 124993 - DNA, 16 bp, H. sapiens
taaatgacagagctgg

SEQ ID NO: 124994 - DNA, 16 bp, H. sapiens
taaatgacattttaaa

SEQ ID NO: 124995 - DNA, 18 bp, H. sapiens
taaatgacgagttactgg

SEQ ID NO: 124996 - DNA, 16 bp, H. sapiens
taaatgactgaatgaa

SEQ ID NO: 124997 - DNA, 16 bp, H. sapiens
taaatgagaaaatgtg

SEQ ID NO: 124998 - DNA, 16 bp, H. sapiens
taaatgagaagcagag

SEQ ID NO: 124999 - DNA, 16 bp, H. sapiens
taaatgagataatcca

SEQ ID NO: 125000 - DNA, 16 bp, H. sapiens
taaatgagataatgca

SEQ ID NO: 125001 - DNA, 16 bp, H. sapiens
taaatgagataattca

SEQ ID NO: 125002 - DNA, 16 bp, H. sapiens
taaatgagctaaatgt

SEQ ID NO: 125003 - DNA, 16 bp, H. sapiens
taaatgaggaagctga

SEQ ID NO: 125004 - DNA, 16 bp, H. sapiens
taaatgagtaaatttt

SEQ ID NO: 125005 - DNA, 16 bp, H. sapiens
taaatgatcaaataaa

SEQ ID NO: 125006 - DNA, 16 bp, H. sapiens
taaatgatgaacaaat

SEQ ID NO: 125007 - DNA, 23 bp, H. sapiens
taaatgatgagttaatgggtgca

SEQ ID NO: 125008 - DNA, 16 bp, H. sapiens
taaatgatgttgagca

SEQ ID NO: 125009 - DNA, 16 bp, H. sapiens
taaatgatgttttaaa

SEQ ID NO: 125010 - DNA, 16 bp, H. sapiens
taaatgattgttttaa

SEQ ID NO: 125011 - DNA, 16 bp, H. sapiens
taaatgatttgcccaa

SEQ ID NO: 125012 - DNA, 16 bp, H. sapiens
taaatgcaatgtaaat

SEQ ID NO: 125013 - DNA, 16 bp, H. sapiens
taaatgcataatttat

SEQ ID NO: 125014 - DNA, 16 bp, H. sapiens
taaatgcatattttat

SEQ ID NO: 125015 - DNA, 16 bp, H. sapiens
taaatgccactgaatt

SEQ ID NO: 125016 - DNA, 16 bp, H. sapiens
taaatgcccacataaa

SEQ ID NO: 125017 - DNA, 16 bp, H. sapiens
taaatgctattatttt

SEQ ID NO: 125018 - DNA, 16 bp, H. sapiens
taaatgctcaataaat

SEQ ID NO: 125019 - DNA, 16 bp, H. sapiens
taaatgctcaataatt

SEQ ID NO: 125020 - DNA, 18 bp, H. sapiens
taaatgctccacttaaaa

SEQ ID NO: 125021 - DNA, 16 bp, H. sapiens
taaatgctgaatgaat

SEQ ID NO: 125022 - DNA, 16 bp, H. sapiens
taaatgcttgttgaat

SEQ ID NO: 125023 - DNA, 16 bp, H. sapiens
taaatgctttaagaaa

SEQ ID NO: 125024 - DNA, 16 bp, H. sapiens
taaatgctttcatttt

SEQ ID NO: 125025 - DNA, 16 bp, H. sapiens
taaatgcttttatttt

SEQ ID NO: 125026 - DNA, 16 bp, H. sapiens
taaatgcttttttaaa

SEQ ID NO: 125027 - DNA, 16 bp, H. sapiens
taaatggaaagatatg

SEQ ID NO: 125028 - DNA, 16 bp, H. sapiens
taaatggaaatgttta

SEQ ID NO: 125029 - DNA, 16 bp, H. sapiens
taaatggaatcataca

SEQ ID NO: 125030 - DNA, 16 bp, H. sapiens
taaatggaattatttt

SEQ ID NO: 125031 - DNA, 17 bp, H. sapiens
taaatggactaaattct

SEQ ID NO: 125032 - DNA, 16 bp, H. sapiens
taaatggatggataaa

SEQ ID NO: 125033 - DNA, 16 bp, H. sapiens
taaatggatgggtgga

SEQ ID NO: 125034 - DNA, 16 bp, H. sapiens
taaatggattaaaaac

SEQ ID NO: 125035 - DNA, 16 bp, H. sapiens
taaatggattgtttgt

SEQ ID NO: 125036 - DNA, 16 bp, H. sapiens
taaatggcaatgcaga

SEQ ID NO: 125037 - DNA, 16 bp, H. sapiens
taaatggcagaactgg

SEQ ID NO: 125038 - DNA, 16 bp, H. sapiens
taaatgggagttcatt

SEQ ID NO: 125039 - DNA, 16 bp, H. sapiens
taaatgggattataca

SEQ ID NO: 125040 - DNA, 16 bp, H. sapiens
taaatggggcatccat

SEQ ID NO: 125041 - DNA, 16 bp, H. sapiens
taaatggtaactatta

SEQ ID NO: 125042 - DNA, 16 bp, H. sapiens
taaatggtattatgtt

SEQ ID NO: 125043 - DNA, 16 bp, H. sapiens
taaatggtgctgggac

SEQ ID NO: 125044 - DNA, 16 bp, H. sapiens
taaatggtgtcaggaa

SEQ ID NO: 125045 - DNA, 16 bp, H. sapiens
taaatggttctgggat

SEQ ID NO: 125046 - DNA, 16 bp, H. sapiens
taaatggttgaaaaaa

SEQ ID NO: 125047 - DNA, 16 bp, H. sapiens
taaatgtaaaacacaa

SEQ ID NO: 125048 - DNA, 16 bp, H. sapiens
taaatgtaaaatgtga

SEQ ID NO: 125049 - DNA, 16 bp, H. sapiens
taaatgtaaaattcca

SEQ ID NO: 125050 - DNA, 16 bp, H. sapiens
taaatgtaaacctaaa

SEQ ID NO: 125051 - DNA, 16 bp, H. sapiens
taaatgtaaatatact

SEQ ID NO: 125052 - DNA, 16 bp, H. sapiens
taaatgtaaatgatat

SEQ ID NO: 125053 - DNA, 16 bp, H. sapiens
taaatgtaacagaaaa

SEQ ID NO: 125054 - DNA, 16 bp, H. sapiens
taaatgtaagcattta

SEQ ID NO: 125055 - DNA, 16 bp, H. sapiens
taaatgtagatgcaaa

SEQ ID NO: 125056 - DNA, 16 bp, H. sapiens
taaatgtatacaatat

SEQ ID NO: 125057 - DNA, 16 bp, H. sapiens
taaatgtatacacaca

SEQ ID NO: 125058 - DNA, 16 bp, H. sapiens
taaatgtatacatttt

SEQ ID NO: 125059 - DNA, 16 bp, H. sapiens
taaatgtatatgtgtg

SEQ ID NO: 125060 - DNA, 16 bp, H. sapiens
taaatgtatggtagaa

SEQ ID NO: 125061 - DNA, 16 bp, H. sapiens
taaatgtatgtatagc

SEQ ID NO: 125062 - DNA, 16 bp, H. sapiens
taaatgtatgtattta

SEQ ID NO: 125063 - DNA, 16 bp, H. sapiens
taaatgtattttacat

SEQ ID NO: 125064 - DNA, 16 bp, H. sapiens
taaatgtcattttaaa

SEQ ID NO: 125065 - DNA, 16 bp, H. sapiens
taaatgtctattgttt

SEQ ID NO: 125066 - DNA, 16 bp, H. sapiens
taaatgtctcccaaag

SEQ ID NO: 125067 - DNA, 16 bp, H. sapiens
taaatgtctgttgaat

SEQ ID NO: 125068 - DNA, 16 bp, H. sapiens
taaatgtgaaatgtca

SEQ ID NO: 125069 - DNA, 16 bp, H. sapiens
taaatgtgaattttaa

SEQ ID NO: 125070 - DNA, 16 bp, H. sapiens
taaatgtggaaatgaa

SEQ ID NO: 125071 - DNA, 16 bp, H. sapiens
taaatgtgtatatgta

SEQ ID NO: 125072 - DNA, 16 bp, H. sapiens
taaatgtgtatgcacc

SEQ ID NO: 125073 - DNA, 16 bp, H. sapiens
taaatgtgtgtgtata

SEQ ID NO: 125074 - DNA, 16 bp, H. sapiens
taaatgtgtgtgtgtg

SEQ ID NO: 125075 - DNA, 16 bp, H. sapiens
taaatgtgtttgagtt

SEQ ID NO: 125076 - DNA, 16 bp, H. sapiens
taaatgttaattatct

SEQ ID NO: 125077 - DNA, 16 bp, H. sapiens
taaatgttaattccct

SEQ ID NO: 125078 - DNA, 16 bp, H. sapiens
taaatgttaatttcat

SEQ ID NO: 125079 - DNA, 16 bp, H. sapiens
taaatgttagtttctt

SEQ ID NO: 125080 - DNA, 16 bp, H. sapiens
taaatgttataaatgt

SEQ ID NO: 125081 - DNA, 16 bp, H. sapiens
taaatgttatgtatat

SEQ ID NO: 125082 - DNA, 16 bp, H. sapiens
taaatgttattacaaa

SEQ ID NO: 125083 - DNA, 16 bp, H. sapiens
taaatgttatttttct

SEQ ID NO: 125084 - DNA, 16 bp, H. sapiens
taaatgttcagtaaat

SEQ ID NO: 125085 - DNA, 16 bp, H. sapiens
taaatgttcatgaaat

SEQ ID NO: 125086 - DNA, 16 bp, H. sapiens
taaatgttcattgaat

SEQ ID NO: 125087 - DNA, 16 bp, H. sapiens
taaatgttcccttttc

SEQ ID NO: 125088 - DNA, 16 bp, H. sapiens
taaatgttctagtagc

SEQ ID NO: 125089 - DNA, 16 bp, H. sapiens
taaatgttctataaat

SEQ ID NO: 125090 - DNA, 16 bp, H. sapiens
taaatgttctgtaaat

SEQ ID NO: 125091 - DNA, 16 bp, H. sapiens
taaatgttcttaccac

SEQ ID NO: 125092 - DNA, 16 bp, H. sapiens
taaatgttcttttttc

SEQ ID NO: 125093 - DNA, 16 bp, H. sapiens
taaatgttgaaaattt

SEQ ID NO: 125094 - DNA, 16 bp, H. sapiens
taaatgtttaacaact

SEQ ID NO: 125095 - DNA, 16 bp, H. sapiens
taaatgtttaacattt

SEQ ID NO: 125096 - DNA, 16 bp, H. sapiens
taaatgtttaaggtaa

SEQ ID NO: 125097 - DNA, 16 bp, H. sapiens
taaatgtttaataagt

SEQ ID NO: 125098 - DNA, 16 bp, H. sapiens
taaatgtttcaaaata

SEQ ID NO: 125099 - DNA, 16 bp, H. sapiens
taaatgtttcttgaat

SEQ ID NO: 125100 - DNA, 16 bp, H. sapiens
taaatgtttcttttca

SEQ ID NO: 125101 - DNA, 16 bp, H. sapiens
taaatgtttcttttct

SEQ ID NO: 125102 - DNA, 16 bp, H. sapiens
taaatgtttgaaatat

SEQ ID NO: 125103 - DNA, 16 bp, H. sapiens
taaatgtttgttgaat

SEQ ID NO: 125104 - DNA, 16 bp, H. sapiens
taaatgttttaatgaa

SEQ ID NO: 125105 - DNA, 16 bp, H. sapiens
taaatgttttatgaat

SEQ ID NO: 125106 - DNA, 16 bp, H. sapiens
taaatgttttatgtgt

SEQ ID NO: 125107 - DNA, 16 bp, H. sapiens
taaatgttttatttct

SEQ ID NO: 125108 - DNA, 16 bp, H. sapiens
taaatgttttccattt

SEQ ID NO: 125109 - DNA, 16 bp, H. sapiens
taaatgttttctcatt

SEQ ID NO: 125110 - DNA, 16 bp, H. sapiens
taaatgttttctgaat

SEQ ID NO: 125111 - DNA, 16 bp, H. sapiens
taaatgttttcttcaa

SEQ ID NO: 125112 - DNA, 16 bp, H. sapiens
taaatgtttttgcttt

SEQ ID NO: 125113 - DNA, 16 bp, H. sapiens
taaatgtttttggaat

SEQ ID NO: 125114 - DNA, 16 bp, H. sapiens
taaattaaaaatgcat

SEQ ID NO: 125115 - DNA, 16 bp, H. sapiens
taaattaacagcttat

SEQ ID NO: 125116 - DNA, 16 bp, H. sapiens
taaattaatttgggga

SEQ ID NO: 125117 - DNA, 16 bp, H. sapiens
taaattacactttaag

SEQ ID NO: 125118 - DNA, 16 bp, H. sapiens
taaattacatgaaata

SEQ ID NO: 125119 - DNA, 16 bp, H. sapiens
taaattagtacaactg

SEQ ID NO: 125120 - DNA, 16 bp, H. sapiens
taaattagtcttattt

SEQ ID NO: 125121 - DNA, 16 bp, H. sapiens
taaattagttcaacca

SEQ ID NO: 125122 - DNA, 16 bp, H. sapiens
taaattagttcaagca

SEQ ID NO: 125123 - DNA, 16 bp, H. sapiens
taaattatacttcagt

SEQ ID NO: 125124 - DNA, 16 bp, H. sapiens
taaattatcaaatttg

SEQ ID NO: 125125 - DNA, 16 bp, H. sapiens
taaattatctcattta

SEQ ID NO: 125126 - DNA, 16 bp, H. sapiens
taaattatctttctaa

SEQ ID NO: 125127 - DNA, 16 bp, H. sapiens
taaattatgctgctat

SEQ ID NO: 125128 - DNA, 16 bp, H. sapiens
taaattatggtaaaat

SEQ ID NO: 125129 - DNA, 16 bp, H. sapiens
taaattatggtatatt

SEQ ID NO: 125130 - DNA, 16 bp, H. sapiens
taaattattctgttat

SEQ ID NO: 125131 - DNA, 16 bp, H. sapiens
taaattattgttgact

SEQ ID NO: 125132 - DNA, 16 bp, H. sapiens
taaattattgtttcat

SEQ ID NO: 125133 - DNA, 16 bp, H. sapiens
taaattatttcaatct

SEQ ID NO: 125134 - DNA, 16 bp, H. sapiens
taaattatttcagcaa

SEQ ID NO: 125135 - DNA, 16 bp, H. sapiens
taaattatttcctttc

SEQ ID NO: 125136 - DNA, 16 bp, H. sapiens
taaattatttttccaa

SEQ ID NO: 125137 - DNA, 16 bp, H. sapiens
taaattcatcatttta

SEQ ID NO: 125138 - DNA, 16 bp, H. sapiens
taaattcctagaagtg

SEQ ID NO: 125139 - DNA, 16 bp, H. sapiens
taaattcctttaaaat

SEQ ID NO: 125140 - DNA, 16 bp, H. sapiens
taaattctctcagctt

SEQ ID NO: 125141 - DNA, 16 bp, H. sapiens
taaattctgtttttaa

SEQ ID NO: 125142 - DNA, 16 bp, H. sapiens
taaattctttcagaaa

SEQ ID NO: 125143 - DNA, 16 bp, H. sapiens
taaattctttctctgc

SEQ ID NO: 125144 - DNA, 16 bp, H. sapiens
taaattctttgccaag

SEQ ID NO: 125145 - DNA, 16 bp, H. sapiens
taaattgaaaatattg

SEQ ID NO: 125146 - DNA, 16 bp, H. sapiens
taaattgaacatcaaa

SEQ ID NO: 125147 - DNA, 16 bp, H. sapiens
taaattgaagtttaaa

SEQ ID NO: 125148 - DNA, 16 bp, H. sapiens
taaattgcaaaatttt

SEQ ID NO: 125149 - DNA, 16 bp, H. sapiens
taaattgcagacatca

SEQ ID NO: 125150 - DNA, 16 bp, H. sapiens
taaattgcatttctct

SEQ ID NO: 125151 - DNA, 16 bp, H. sapiens
taaattggaaaatatt

SEQ ID NO: 125152 - DNA, 16 bp, H. sapiens
taaattggaaacaaaa

SEQ ID NO: 125153 - DNA, 16 bp, H. sapiens
taaattggaatttcag

SEQ ID NO: 125154 - DNA, 16 bp, H. sapiens
taaattgtatacttta

SEQ ID NO: 125155 - DNA, 16 bp, H. sapiens
taaattgtatttcttt

SEQ ID NO: 125156 - DNA, 16 bp, H. sapiens
taaattgtgatacatt

SEQ ID NO: 125157 - DNA, 16 bp, H. sapiens
taaattgtggcaaaat

SEQ ID NO: 125158 - DNA, 16 bp, H. sapiens
taaattgtttatctct

SEQ ID NO: 125159 - DNA, 16 bp, H. sapiens
taaattgtttctcttt

SEQ ID NO: 125160 - DNA, 16 bp, H. sapiens
taaattgttttctgaa

SEQ ID NO: 125161 - DNA, 16 bp, H. sapiens
taaatttaaaacaaag

SEQ ID NO: 125162 - DNA, 16 bp, H. sapiens
taaatttaaaatgcta

SEQ ID NO: 125163 - DNA, 16 bp, H. sapiens
taaatttaaatgagtt

SEQ ID NO: 125164 - DNA, 16 bp, H. sapiens
taaatttaacagagat

SEQ ID NO: 125165 - DNA, 16 bp, H. sapiens
taaatttaaccaagaa

SEQ ID NO: 125166 - DNA, 16 bp, H. sapiens
taaatttaaccaagga

SEQ ID NO: 125167 - DNA, 16 bp, H. sapiens
taaatttaatgcaatt

SEQ ID NO: 125168 - DNA, 16 bp, H. sapiens
taaatttaatgcattt

SEQ ID NO: 125169 - DNA, 16 bp, H. sapiens
taaatttacagaaaaa

SEQ ID NO: 125170 - DNA, 16 bp, H. sapiens
taaatttattcataag

SEQ ID NO: 125171 - DNA, 16 bp, H. sapiens
taaatttattttgctt

SEQ ID NO: 125172 - DNA, 16 bp, H. sapiens
taaatttcaaatattc

SEQ ID NO: 125173 - DNA, 16 bp, H. sapiens
taaatttcaaatgtct

SEQ ID NO: 125174 - DNA, 16 bp, H. sapiens
taaatttcacatggaa

SEQ ID NO: 125175 - DNA, 16 bp, H. sapiens
taaatttcagaaaaca

SEQ ID NO: 125176 - DNA, 16 bp, H. sapiens
taaatttcagaagaaa

SEQ ID NO: 125177 - DNA, 16 bp, H. sapiens
taaatttcagttgttt

SEQ ID NO: 125178 - DNA, 16 bp, H. sapiens
taaatttcataaggaa

SEQ ID NO: 125179 - DNA, 16 bp, H. sapiens
taaatttcatttggaa

SEQ ID NO: 125180 - DNA, 16 bp, H. sapiens
taaatttctaaaaatg

SEQ ID NO: 125181 - DNA, 16 bp, H. sapiens
taaatttctagaaaca

SEQ ID NO: 125182 - DNA, 16 bp, H. sapiens
taaatttctatgttta

SEQ ID NO: 125183 - DNA, 16 bp, H. sapiens
taaatttctcagtttt

SEQ ID NO: 125184 - DNA, 16 bp, H. sapiens
taaatttctgcatttt

SEQ ID NO: 125185 - DNA, 16 bp, H. sapiens
taaatttctggaaata

SEQ ID NO: 125186 - DNA, 16 bp, H. sapiens
taaatttctgtcattt

SEQ ID NO: 125187 - DNA, 16 bp, H. sapiens
taaatttctgttcatt

SEQ ID NO: 125188 - DNA, 16 bp, H. sapiens
taaatttctgttgaat

SEQ ID NO: 125189 - DNA, 16 bp, H. sapiens
taaatttctgtttatt

SEQ ID NO: 125190 - DNA, 16 bp, H. sapiens
taaatttgaatttctg

SEQ ID NO: 125191 - DNA, 16 bp, H. sapiens
taaatttgattttctt

SEQ ID NO: 125192 - DNA, 16 bp, H. sapiens
taaatttgcattttta

SEQ ID NO: 125193 - DNA, 16 bp, H. sapiens
taaatttgctttaaaa

SEQ ID NO: 125194 - DNA, 16 bp, H. sapiens
taaatttgcttttaat

SEQ ID NO: 125195 - DNA, 16 bp, H. sapiens
taaatttggaatttat

SEQ ID NO: 125196 - DNA, 16 bp, H. sapiens
taaatttgggaaaaat

SEQ ID NO: 125197 - DNA, 16 bp, H. sapiens
taaatttgtacttttt

SEQ ID NO: 125198 - DNA, 16 bp, H. sapiens
taaatttgtcaaaact

SEQ ID NO: 125199 - DNA, 16 bp, H. sapiens
taaatttgtctttaaa

SEQ ID NO: 125200 - DNA, 16 bp, H. sapiens
taaatttgttttttca

SEQ ID NO: 125201 - DNA, 16 bp, H. sapiens
taaattttaaaatctg

SEQ ID NO: 125202 - DNA, 16 bp, H. sapiens
taaattttaaatgcaa

SEQ ID NO: 125203 - DNA, 16 bp, H. sapiens
taaattttaagttatg

SEQ ID NO: 125204 - DNA, 16 bp, H. sapiens
taaattttagaaaaca

SEQ ID NO: 125205 - DNA, 16 bp, H. sapiens
taaattttatgtggaa

SEQ ID NO: 125206 - DNA, 16 bp, H. sapiens
taaattttcaaaagca

SEQ ID NO: 125207 - DNA, 16 bp, H. sapiens
taaattttcctctatc

SEQ ID NO: 125208 - DNA, 16 bp, H. sapiens
taaattttcctcttaa

SEQ ID NO: 125209 - DNA, 16 bp, H. sapiens
taaattttcttatgtt

SEQ ID NO: 125210 - DNA, 16 bp, H. sapiens
taaattttgtctttaa

SEQ ID NO: 125211 - DNA, 16 bp, H. sapiens
taaattttgtgctttt

SEQ ID NO: 125212 - DNA, 16 bp, H. sapiens
taaattttgttttcat

SEQ ID NO: 125213 - DNA, 16 bp, H. sapiens
taaattttgttttcta

SEQ ID NO: 125214 - DNA, 16 bp, H. sapiens
taaatttttgttcatt

SEQ ID NO: 125215 - DNA, 16 bp, H. sapiens
taaattttttgaagaa

SEQ ID NO: 125216 - DNA, 16 bp, H. sapiens
taaattttttgagaaa

SEQ ID NO: 125217 - DNA, 16 bp, H. sapiens
taaattttttgagaca

SEQ ID NO: 125218 - DNA, 16 bp, H. sapiens
taacaaaagaaaagtt

SEQ ID NO: 125219 - DNA, 16 bp, H. sapiens
taacaaaagaaatgta

SEQ ID NO: 125220 - DNA, 16 bp, H. sapiens
taacaaaagacagatt

SEQ ID NO: 125221 - DNA, 16 bp, H. sapiens
taacaaaatatgtttt

SEQ ID NO: 125222 - DNA, 16 bp, H. sapiens
taacaaaatattgaaa

SEQ ID NO: 125223 - DNA, 16 bp, H. sapiens
taacaaaatattttct

SEQ ID NO: 125224 - DNA, 16 bp, H. sapiens
taacaaaatgacagga

SEQ ID NO: 125225 - DNA, 16 bp, H. sapiens
taacaaacacaaagga

SEQ ID NO: 125226 - DNA, 16 bp, H. sapiens
taacaaacagaaatga

SEQ ID NO: 125227 - DNA, 16 bp, H. sapiens
taacaaacctgaatgt

SEQ ID NO: 125228 - DNA, 16 bp, H. sapiens
taacaaacctgcacac

SEQ ID NO: 125229 - DNA, 18 bp, H. sapiens
taacaaacctgcacattc

SEQ ID NO: 125230 - DNA, 16 bp, H. sapiens
taacaaactgaaaaac

SEQ ID NO: 125231 - DNA, 16 bp, H. sapiens
taacaaagagaatgaa

SEQ ID NO: 125232 - DNA, 16 bp, H. sapiens
taacaaatatattcag

SEQ ID NO: 125233 - DNA, 16 bp, H. sapiens
taacaaatattttgta

SEQ ID NO: 125234 - DNA, 16 bp, H. sapiens
taacaaatgtatcact

SEQ ID NO: 125235 - DNA, 16 bp, H. sapiens
taacaaatgtgaaaaa

SEQ ID NO: 125236 - DNA, 16 bp, H. sapiens
taacaaatgtgtattg

SEQ ID NO: 125237 - DNA, 16 bp, H. sapiens
taacaaatgtttattc

SEQ ID NO: 125238 - DNA, 16 bp, H. sapiens
taacaaattatcccaa

SEQ ID NO: 125239 - DNA, 16 bp, H. sapiens
taacaaattatctcaa

SEQ ID NO: 125240 - DNA, 16 bp, H. sapiens
taacaaatttaagaat

SEQ ID NO: 125241 - DNA, 16 bp, H. sapiens
taacaaattttaagtg

SEQ ID NO: 125242 - DNA, 16 bp, H. sapiens
taacaacagcagcaac

SEQ ID NO: 125243 - DNA, 16 bp, H. sapiens
taacaactatttacat

SEQ ID NO: 125244 - DNA, 16 bp, H. sapiens
taacaacttctaccga

SEQ ID NO: 125245 - DNA, 16 bp, H. sapiens
taacaacttgaacatt

SEQ ID NO: 125246 - DNA, 16 bp, H. sapiens
taacaagaccccatct

SEQ ID NO: 125247 - DNA, 16 bp, H. sapiens
taacaagagcaaaact

SEQ ID NO: 125248 - DNA, 17 bp, H. sapiens
taacaagagtcaccttt

SEQ ID NO: 125249 - DNA, 16 bp, H. sapiens
taacaagcaaagagaa

SEQ ID NO: 125250 - DNA, 16 bp, H. sapiens
taacaagtgttggcaa

SEQ ID NO: 125251 - DNA, 16 bp, H. sapiens
taacaataatgaaaat

SEQ ID NO: 125252 - DNA, 16 bp, H. sapiens
taacaatagctgatga

SEQ ID NO: 125253 - DNA, 16 bp, H. sapiens
taacaatcactgcagt

SEQ ID NO: 125254 - DNA, 16 bp, H. sapiens
taacaattttgaaata

SEQ ID NO: 125255 - DNA, 16 bp, H. sapiens
taacacacacacacat

SEQ ID NO: 125256 - DNA, 16 bp, H. sapiens
taacacagtgaaactg

SEQ ID NO: 125257 - DNA, 16 bp, H. sapiens
taacaccgtgaaaccc

SEQ ID NO: 125258 - DNA, 19 bp, H. sapiens
taacactcactgcgaaggt

SEQ ID NO: 125259 - DNA, 16 bp, H. sapiens
taacactgtttttttt

SEQ ID NO: 125260 - DNA, 16 bp, H. sapiens
taacactttatttaca

SEQ ID NO: 125261 - DNA, 16 bp, H. sapiens
taacacttttataatt

SEQ ID NO: 125262 - DNA, 16 bp, H. sapiens
taacactttttaaatt

SEQ ID NO: 125263 - DNA, 16 bp, H. sapiens
taacagaaaattgtaa

SEQ ID NO: 125264 - DNA, 16 bp, H. sapiens
taacagaaattaattt

SEQ ID NO: 125265 - DNA, 16 bp, H. sapiens
taacagaagaacagaa

SEQ ID NO: 125266 - DNA, 16 bp, H. sapiens
taacagaccatcaaaa

SEQ ID NO: 125267 - DNA, 16 bp, H. sapiens
taacagacccacagct

SEQ ID NO: 125268 - DNA, 16 bp, H. sapiens
taacagagcatcaaaa

SEQ ID NO: 125269 - DNA, 16 bp, H. sapiens
taacagagcgagactt

SEQ ID NO: 125270 - DNA, 16 bp, H. sapiens
taacagagggagactc

SEQ ID NO: 125271 - DNA, 16 bp, H. sapiens
taacagagtaaacaga

SEQ ID NO: 125272 - DNA, 16 bp, H. sapiens
taacagatgatggtga

SEQ ID NO: 125273 - DNA, 16 bp, H. sapiens
taacagcaacaacaaa

SEQ ID NO: 125274 - DNA, 16 bp, H. sapiens
taacagcagcagcagc

SEQ ID NO: 125275 - DNA, 16 bp, H. sapiens
taacagcagcattatt

SEQ ID NO: 125276 - DNA, 16 bp, H. sapiens
taacagcattttaaaa

SEQ ID NO: 125277 - DNA, 16 bp, H. sapiens
taacagccaaaaagta

SEQ ID NO: 125278 - DNA, 16 bp, H. sapiens
taacagctttattgag

SEQ ID NO: 125279 - DNA, 16 bp, H. sapiens
taacaggaaaaaaatg

SEQ ID NO: 125280 - DNA, 16 bp, H. sapiens
taacaggagagactcc

SEQ ID NO: 125281 - DNA, 16 bp, H. sapiens
taacaggaggaatttt

SEQ ID NO: 125282 - DNA, 16 bp, H. sapiens
taacaggcaacctaca

SEQ ID NO: 125283 - DNA, 16 bp, H. sapiens
taacaggccactgacc

SEQ ID NO: 125284 - DNA, 18 bp, H. sapiens
taacaggctctgaaattc

SEQ ID NO: 125285 - DNA, 16 bp, H. sapiens
taacagggaaataact

SEQ ID NO: 125286 - DNA, 16 bp, H. sapiens
taacaggtgttcttaa

SEQ ID NO: 125287 - DNA, 16 bp, H. sapiens
taacaggtttttgaga

SEQ ID NO: 125288 - DNA, 16 bp, H. sapiens
taacagtattaattct

SEQ ID NO: 125289 - DNA, 16 bp, H. sapiens
taacagtgttgaacct

SEQ ID NO: 125290 - DNA, 16 bp, H. sapiens
taacagtgttttaaaa

SEQ ID NO: 125291 - DNA, 16 bp, H. sapiens
taacagtttaaaaaaa

SEQ ID NO: 125292 - DNA, 16 bp, H. sapiens
taacataatgtttttg

SEQ ID NO: 125293 - DNA, 16 bp, H. sapiens
taacatacatatttta

SEQ ID NO: 125294 - DNA, 16 bp, H. sapiens
taacatagcgagaccc

SEQ ID NO: 125295 - DNA, 16 bp, H. sapiens
taacatagtcatttat

SEQ ID NO: 125296 - DNA, 16 bp, H. sapiens
taacatatataaaatg

SEQ ID NO: 125297 - DNA, 16 bp, H. sapiens
taacatatatacatgt

SEQ ID NO: 125298 - DNA, 16 bp, H. sapiens
taacatatatagtata

SEQ ID NO: 125299 - DNA, 16 bp, H. sapiens
taacatatccacaggt

SEQ ID NO: 125300 - DNA, 16 bp, H. sapiens
taacatatttatcacc

SEQ ID NO: 125301 - DNA, 16 bp, H. sapiens
taacatatttgtatgt

SEQ ID NO: 125302 - DNA, 16 bp, H. sapiens
taacatcattattgta

SEQ ID NO: 125303 - DNA, 16 bp, H. sapiens
taacatctctgaaatc

SEQ ID NO: 125304 - DNA, 16 bp, H. sapiens
taacatcttgcattgg

SEQ ID NO: 125305 - DNA, 16 bp, H. sapiens
taacatgaaaatatta

SEQ ID NO: 125306 - DNA, 16 bp, H. sapiens
taacatgaaggataaa

SEQ ID NO: 125307 - DNA, 16 bp, H. sapiens
taacatgatgttttca

SEQ ID NO: 125308 - DNA, 16 bp, H. sapiens
taacatgctcctgaat

SEQ ID NO: 125309 - DNA, 17 bp, H. sapiens
taacatggtaaaaccct

SEQ ID NO: 125310 - DNA, 16 bp, H. sapiens
taacatggtgaaactc

SEQ ID NO: 125311 - DNA, 16 bp, H. sapiens
taacatgtattgagca

SEQ ID NO: 125312 - DNA, 16 bp, H. sapiens
taacattaaatgtgaa

SEQ ID NO: 125313 - DNA, 16 bp, H. sapiens
taacattaagaaaaat

SEQ ID NO: 125314 - DNA, 16 bp, H. sapiens
taacattacaacctca

SEQ ID NO: 125315 - DNA, 16 bp, H. sapiens
taacattagaaaataa

SEQ ID NO: 125316 - DNA, 16 bp, H. sapiens
taacattctcaaaatg

SEQ ID NO: 125317 - DNA, 16 bp, H. sapiens
taacattcttaaatat

SEQ ID NO: 125318 - DNA, 16 bp, H. sapiens
taacattgctgtcatt

SEQ ID NO: 125319 - DNA, 16 bp, H. sapiens
taacatttaaatctgt

SEQ ID NO: 125320 - DNA, 16 bp, H. sapiens
taacatttaccatctt

SEQ ID NO: 125321 - DNA, 16 bp, H. sapiens
taacatttatttagta

SEQ ID NO: 125322 - DNA, 16 bp, H. sapiens
taacatttctgaaatt

SEQ ID NO: 125323 - DNA, 16 bp, H. sapiens
taacatttctgtattt

SEQ ID NO: 125324 - DNA, 16 bp, H. sapiens
taacatttgacccagc

SEQ ID NO: 125325 - DNA, 16 bp, H. sapiens
taacattttaacattt

SEQ ID NO: 125326 - DNA, 16 bp, H. sapiens
taacattttattatga

SEQ ID NO: 125327 - DNA, 16 bp, H. sapiens
taacattttcatttct

SEQ ID NO: 125328 - DNA, 16 bp, H. sapiens
taacattttcctttct

SEQ ID NO: 125329 - DNA, 16 bp, H. sapiens
taacattttcctttta

SEQ ID NO: 125330 - DNA, 16 bp, H. sapiens
taacattttgaaaatt

SEQ ID NO: 125331 - DNA, 16 bp, H. sapiens
taacattttgaaagaa

SEQ ID NO: 125332 - DNA, 16 bp, H. sapiens
taacattttgctatat

SEQ ID NO: 125333 - DNA, 16 bp, H. sapiens
taacattttgtatatt

SEQ ID NO: 125334 - DNA, 16 bp, H. sapiens
taacattttgtatttt

SEQ ID NO: 125335 - DNA, 16 bp, H. sapiens
taacattttgttattt

SEQ ID NO: 125336 - DNA, 16 bp, H. sapiens
taacatttttaaatca

SEQ ID NO: 125337 - DNA, 16 bp, H. sapiens
taacatttttcattct

SEQ ID NO: 125338 - DNA, 16 bp, H. sapiens
taacatttttgagcac

SEQ ID NO: 125339 - DNA, 16 bp, H. sapiens
taacattttttccttc

SEQ ID NO: 125340 - DNA, 16 bp, H. sapiens
taacattttttgagaa

SEQ ID NO: 125341 - DNA, 16 bp, H. sapiens
taaccaaaaaccacct

SEQ ID NO: 125342 - DNA, 16 bp, H. sapiens
taaccaaagaagcaaa

SEQ ID NO: 125343 - DNA, 16 bp, H. sapiens
taaccaaaggaatata

SEQ ID NO: 125344 - DNA, 16 bp, H. sapiens
taaccaaataccatct

SEQ ID NO: 125345 - DNA, 16 bp, H. sapiens
taaccaagaagagaga

SEQ ID NO: 125346 - DNA, 16 bp, H. sapiens
taaccaatatttattg

SEQ ID NO: 125347 - DNA, 16 bp, H. sapiens
taaccacctcccaaag

SEQ ID NO: 125348 - DNA, 16 bp, H. sapiens
taaccacctttctact

SEQ ID NO: 125349 - DNA, 16 bp, H. sapiens
taaccactgataattc

SEQ ID NO: 125350 - DNA, 16 bp, H. sapiens
taaccactgttaacat

SEQ ID NO: 125351 - DNA, 16 bp, H. sapiens
taaccagaatgtataa

SEQ ID NO: 125352 - DNA, 16 bp, H. sapiens
taaccaggagtggtgg

SEQ ID NO: 125353 - DNA, 16 bp, H. sapiens
taaccagggaggtgaa

SEQ ID NO: 125354 - DNA, 16 bp, H. sapiens
taaccatattttaaaa

SEQ ID NO: 125355 - DNA, 16 bp, H. sapiens
taaccatttatctttt

SEQ ID NO: 125356 - DNA, 16 bp, H. sapiens
taaccatttgtctttt

SEQ ID NO: 125357 - DNA, 16 bp, H. sapiens
taaccatttttaaagt

SEQ ID NO: 125358 - DNA, 16 bp, H. sapiens
taaccatttttaagta

SEQ ID NO: 125359 - DNA, 16 bp, H. sapiens
taacccaaatgtccaa

SEQ ID NO: 125360 - DNA, 16 bp, H. sapiens
taacccaatgcaagaa

SEQ ID NO: 125361 - DNA, 16 bp, H. sapiens
taacccagtttaaaaa

SEQ ID NO: 125362 - DNA, 16 bp, H. sapiens
taacccctggcaacca

SEQ ID NO: 125363 - DNA, 16 bp, H. sapiens
taaccgggcgtggtgg

SEQ ID NO: 125364 - DNA, 16 bp, H. sapiens
taacctaaatcatctc

SEQ ID NO: 125365 - DNA, 16 bp, H. sapiens
taacctccagttccat

SEQ ID NO: 125366 - DNA, 16 bp, H. sapiens
taacctccgtctcctg

SEQ ID NO: 125367 - DNA, 16 bp, H. sapiens
taacctctcagtgcct

SEQ ID NO: 125368 - DNA, 16 bp, H. sapiens
taacctctctctctct

SEQ ID NO: 125369 - DNA, 16 bp, H. sapiens
taacctctctgtgcct

SEQ ID NO: 125370 - DNA, 16 bp, H. sapiens
taacctctgcctccta

SEQ ID NO: 125371 - DNA, 16 bp, H. sapiens
taacctctgtaagcct

SEQ ID NO: 125372 - DNA, 16 bp, H. sapiens
taacctgaggccagga

SEQ ID NO: 125373 - DNA, 16 bp, H. sapiens
taacctggaagccccc

SEQ ID NO: 125374 - DNA, 16 bp, H. sapiens
taacctgtacattgtg

SEQ ID NO: 125375 - DNA, 16 bp, H. sapiens
taaccttaaatgaaaa

SEQ ID NO: 125376 - DNA, 16 bp, H. sapiens
taaccttaattacatc

SEQ ID NO: 125377 - DNA, 16 bp, H. sapiens
taaccttacatgtaaa

SEQ ID NO: 125378 - DNA, 16 bp, H. sapiens
taaccttagcttactg

SEQ ID NO: 125379 - DNA, 16 bp, H. sapiens
taacctttctgagcct

SEQ ID NO: 125380 - DNA, 16 bp, H. sapiens
taactaacatttactg

SEQ ID NO: 125381 - DNA, 17 bp, H. sapiens
taactaatcccacttct

SEQ ID NO: 125382 - DNA, 16 bp, H. sapiens
taactacaaagcaaaa

SEQ ID NO: 125383 - DNA, 16 bp, H. sapiens
taactataagtatact

SEQ ID NO: 125384 - DNA, 16 bp, H. sapiens
taactatagttatcct

SEQ ID NO: 125385 - DNA, 16 bp, H. sapiens
taactatcctaaatat

SEQ ID NO: 125386 - DNA, 28 bp, H. sapiens
taactatcctaaatatatatgcacccaa

SEQ ID NO: 125387 - DNA, 16 bp, H. sapiens
taactatcctgaatat

SEQ ID NO: 125388 - DNA, 16 bp, H. sapiens
taactatccttaatat

SEQ ID NO: 125389 - DNA, 16 bp, H. sapiens
taactatttgttgaat

SEQ ID NO: 125390 - DNA, 16 bp, H. sapiens
taactattttaaatgt

SEQ ID NO: 125391 - DNA, 16 bp, H. sapiens
taactatttttaaatg

SEQ ID NO: 125392 - DNA, 16 bp, H. sapiens
taactcaaaattccaa

SEQ ID NO: 125393 - DNA, 16 bp, H. sapiens
taactcagtaatggaa

SEQ ID NO: 125394 - DNA, 16 bp, H. sapiens
taactcatcgtttaca

SEQ ID NO: 125395 - DNA, 16 bp, H. sapiens
taactcatgcctgaat

SEQ ID NO: 125396 - DNA, 16 bp, H. sapiens
taactcattctttgag

SEQ ID NO: 125397 - DNA, 16 bp, H. sapiens
taactcatttaatatt

SEQ ID NO: 125398 - DNA, 16 bp, H. sapiens
taactcatttaatcct

SEQ ID NO: 125399 - DNA, 16 bp, H. sapiens
taactccaagacacat

SEQ ID NO: 125400 - DNA, 16 bp, H. sapiens
taactcctgagctcag

SEQ ID NO: 125401 - DNA, 16 bp, H. sapiens
taactgaaatggaaaa

SEQ ID NO: 125402 - DNA, 16 bp, H. sapiens
taactgaaattttgta

SEQ ID NO: 125403 - DNA, 16 bp, H. sapiens
taactgaagatggatt

SEQ ID NO: 125404 - DNA, 16 bp, H. sapiens
taactgagaaaataat

SEQ ID NO: 125405 - DNA, 16 bp, H. sapiens
taactgcaacactata

SEQ ID NO: 125406 - DNA, 16 bp, H. sapiens
taactgcagcaggagc

SEQ ID NO: 125407 - DNA, 16 bp, H. sapiens
taactgccagtcctct

SEQ ID NO: 125408 - DNA, 16 bp, H. sapiens
taactgccctgctgac

SEQ ID NO: 125409 - DNA, 16 bp, H. sapiens
taactgcctgcctgac

SEQ ID NO: 125410 - DNA, 16 bp, H. sapiens
taactgctcaataaat

SEQ ID NO: 125411 - DNA, 16 bp, H. sapiens
taactgctgttagggg

SEQ ID NO: 125412 - DNA, 16 bp, H. sapiens
taactgcttaataaat

SEQ ID NO: 125413 - DNA, 16 bp, H. sapiens
taactggataaacaaa

SEQ ID NO: 125414 - DNA, 16 bp, H. sapiens
taactggctagccata

SEQ ID NO: 125415 - DNA, 16 bp, H. sapiens
taactgggcatcctgt

SEQ ID NO: 125416 - DNA, 16 bp, H. sapiens
taactgggcatggtga

SEQ ID NO: 125417 - DNA, 16 bp, H. sapiens
taactgggtgtggtag

SEQ ID NO: 125418 - DNA, 16 bp, H. sapiens
taactgggtgtggtgg

SEQ ID NO: 125419 - DNA, 20 bp, H. sapiens
taactgtctcctggacactg

SEQ ID NO: 125420 - DNA, 16 bp, H. sapiens
taacttaaagaaaata

SEQ ID NO: 125421 - DNA, 16 bp, H. sapiens
taacttattttttgta

SEQ ID NO: 125422 - DNA, 16 bp, H. sapiens
taacttcaagtgatcc

SEQ ID NO: 125423 - DNA, 16 bp, H. sapiens
taacttcaatattgtt

SEQ ID NO: 125424 - DNA, 16 bp, H. sapiens
taacttctctgaggct

SEQ ID NO: 125425 - DNA, 16 bp, H. sapiens
taacttctctgggcct

SEQ ID NO: 125426 - DNA, 16 bp, H. sapiens
taacttctctgtgcct

SEQ ID NO: 125427 - DNA, 16 bp, H. sapiens
taacttcttaatttct

SEQ ID NO: 125428 - DNA, 16 bp, H. sapiens
taacttcttcctgctg

SEQ ID NO: 125429 - DNA, 16 bp, H. sapiens
taacttcttgacattg

SEQ ID NO: 125430 - DNA, 16 bp, H. sapiens
taacttctttcaaaat

SEQ ID NO: 125431 - DNA, 16 bp, H. sapiens
taacttgagatctttc

SEQ ID NO: 125432 - DNA, 16 bp, H. sapiens
taacttgctgagattt

SEQ ID NO: 125433 - DNA, 16 bp, H. sapiens
taacttggccaaagga

SEQ ID NO: 125434 - DNA, 16 bp, H. sapiens
taacttgtcatttaca

SEQ ID NO: 125435 - DNA, 30 bp, H. sapiens
taacttgtggaatgctgagaaaggtaaaaa

SEQ ID NO: 125436 - DNA, 16 bp, H. sapiens
taacttgttttaattt

SEQ ID NO: 125437 - DNA, 16 bp, H. sapiens
taactttaaaaaagaa

SEQ ID NO: 125438 - DNA, 16 bp, H. sapiens
taactttaaaatgtta

SEQ ID NO: 125439 - DNA, 16 bp, H. sapiens
taactttagccccaac

SEQ ID NO: 125440 - DNA, 16 bp, H. sapiens
taactttatacccatt

SEQ ID NO: 125441 - DNA, 16 bp, H. sapiens
taactttcaaaatatt

SEQ ID NO: 125442 - DNA, 16 bp, H. sapiens
taactttcttgtactt

SEQ ID NO: 125443 - DNA, 16 bp, H. sapiens
taactttgttgcccag

SEQ ID NO: 125444 - DNA, 16 bp, H. sapiens
taacttttatttaagt

SEQ ID NO: 125445 - DNA, 16 bp, H. sapiens
taacttttatttcagt

SEQ ID NO: 125446 - DNA, 16 bp, H. sapiens
taacttttctgagcct

SEQ ID NO: 125447 - DNA, 16 bp, H. sapiens
taactttttaaacatt

SEQ ID NO: 125448 - DNA, 16 bp, H. sapiens
taactttttaaagaaa

SEQ ID NO: 125449 - DNA, 16 bp, H. sapiens
taactttttaagaaaa

SEQ ID NO: 125450 - DNA, 16 bp, H. sapiens
taactttttaagaaat

SEQ ID NO: 125451 - DNA, 16 bp, H. sapiens
taacttttttgtgtgt

SEQ ID NO: 125452 - DNA, 16 bp, H. sapiens
taagaaaaaatgttca

SEQ ID NO: 125453 - DNA, 16 bp, H. sapiens
taagaaaaatgcatat

SEQ ID NO: 125454 - DNA, 16 bp, H. sapiens
taagaaaaatgtattt

SEQ ID NO: 125455 - DNA, 16 bp, H. sapiens
taagaaaacatatttt

SEQ ID NO: 125456 - DNA, 16 bp, H. sapiens
taagaaaacccaattc

SEQ ID NO: 125457 - DNA, 16 bp, H. sapiens
taagaaaactgaagcc

SEQ ID NO: 125458 - DNA, 16 bp, H. sapiens
taagaaaatattcttt

SEQ ID NO: 125459 - DNA, 16 bp, H. sapiens
taagaaaatcaaagca

SEQ ID NO: 125460 - DNA, 16 bp, H. sapiens
taagaaaatcattttt

SEQ ID NO: 125461 - DNA, 16 bp, H. sapiens
taagaaaatgacattt

SEQ ID NO: 125462 - DNA, 16 bp, H. sapiens
taagaaaatgggaaat

SEQ ID NO: 125463 - DNA, 16 bp, H. sapiens
taagaaaatgtggccc

SEQ ID NO: 125464 - DNA, 16 bp, H. sapiens
taagaaaattaacaca

SEQ ID NO: 125465 - DNA, 16 bp, H. sapiens
taagaaaatttacaaa

SEQ ID NO: 125466 - DNA, 16 bp, H. sapiens
taagaaacagaaattt

SEQ ID NO: 125467 - DNA, 16 bp, H. sapiens
taagaaacttaaattt

SEQ ID NO: 125468 - DNA, 16 bp, H. sapiens
taagaaacttgaaaaa

SEQ ID NO: 125469 - DNA, 16 bp, H. sapiens
taagaaacttgcccaa

SEQ ID NO: 125470 - DNA, 16 bp, H. sapiens
taagaaacttttaaaa

SEQ ID NO: 125471 - DNA, 16 bp, H. sapiens
taagaaactttttttt

SEQ ID NO: 125472 - DNA, 16 bp, H. sapiens
taagaaagaacaagat

SEQ ID NO: 125473 - DNA, 16 bp, H. sapiens
taagaaagcaattcca

SEQ ID NO: 125474 - DNA, 16 bp, H. sapiens
taagaaagtttatgaa

SEQ ID NO: 125475 - DNA, 16 bp, H. sapiens
taagaaatacattttt

SEQ ID NO: 125476 - DNA, 16 bp, H. sapiens
taagaaatatttacaa

SEQ ID NO: 125477 - DNA, 16 bp, H. sapiens
taagaaatatttgtct

SEQ ID NO: 125478 - DNA, 16 bp, H. sapiens
taagaaatattttttg

SEQ ID NO: 125479 - DNA, 16 bp, H. sapiens
taagaaatcatcaaaa

SEQ ID NO: 125480 - DNA, 16 bp, H. sapiens
taagaaatgacttttt

SEQ ID NO: 125481 - DNA, 16 bp, H. sapiens
taagaaatgagataga

SEQ ID NO: 125482 - DNA, 16 bp, H. sapiens
taagaaatgcatttca

SEQ ID NO: 125483 - DNA, 16 bp, H. sapiens
taagaaatgctaaaga

SEQ ID NO: 125484 - DNA, 16 bp, H. sapiens
taagaaatgtttcttt

SEQ ID NO: 125485 - DNA, 16 bp, H. sapiens
taagaaattcagagaa

SEQ ID NO: 125486 - DNA, 16 bp, H. sapiens
taagaaatttggaaaa

SEQ ID NO: 125487 - DNA, 16 bp, H. sapiens
taagaacaaagacctg

SEQ ID NO: 125488 - DNA, 16 bp, H. sapiens
taagaacaaatatttt

SEQ ID NO: 125489 - DNA, 16 bp, H. sapiens
taagaacacttaacat

SEQ ID NO: 125490 - DNA, 16 bp, H. sapiens
taagaacattcacatt

SEQ ID NO: 125491 - DNA, 16 bp, H. sapiens
taagaacattgaaaaa

SEQ ID NO: 125492 - DNA, 16 bp, H. sapiens
taagaacatttaaaat

SEQ ID NO: 125493 - DNA, 16 bp, H. sapiens
taagaactcatgtgat

SEQ ID NO: 125494 - DNA, 16 bp, H. sapiens
taagaactggagcaag

SEQ ID NO: 125495 - DNA, 16 bp, H. sapiens
taagaacttaaacaaa

SEQ ID NO: 125496 - DNA, 16 bp, H. sapiens
taagaagaaagttcat

SEQ ID NO: 125497 - DNA, 16 bp, H. sapiens
taagaagaaagtttat

SEQ ID NO: 125498 - DNA, 16 bp, H. sapiens
taagaagaatcaatat

SEQ ID NO: 125499 - DNA, 16 bp, H. sapiens
taagaagacatgacaa

SEQ ID NO: 125500 - DNA, 16 bp, H. sapiens
taagaagaggaaatgt

SEQ ID NO: 125501 - DNA, 16 bp, H. sapiens
taagaatacttaaaat

SEQ ID NO: 125502 - DNA, 16 bp, H. sapiens
taagaatatacctaac

SEQ ID NO: 125503 - DNA, 16 bp, H. sapiens
taagaatatagcatat

SEQ ID NO: 125504 - DNA, 16 bp, H. sapiens
taagaatatttttgaa

SEQ ID NO: 125505 - DNA, 16 bp, H. sapiens
taagaatcaatattgt

SEQ ID NO: 125506 - DNA, 16 bp, H. sapiens
taagaatcacctggag

SEQ ID NO: 125507 - DNA, 16 bp, H. sapiens
taagaatgaatcttct

SEQ ID NO: 125508 - DNA, 16 bp, H. sapiens
taagaatgcttctgtc

SEQ ID NO: 125509 - DNA, 16 bp, H. sapiens
taagaatttatcctaa

SEQ ID NO: 125510 - DNA, 16 bp, H. sapiens
taagaattttcaaaat

SEQ ID NO: 125511 - DNA, 16 bp, H. sapiens
taagaatttttcagct

SEQ ID NO: 125512 - DNA, 16 bp, H. sapiens
taagacaaaaattgtt

SEQ ID NO: 125513 - DNA, 16 bp, H. sapiens
taagacaatcctaagc

SEQ ID NO: 125514 - DNA, 16 bp, H. sapiens
taagacacagacacac

SEQ ID NO: 125515 - DNA, 16 bp, H. sapiens
taagacatttattttt

SEQ ID NO: 125516 - DNA, 16 bp, H. sapiens
taagaccaacctttga

SEQ ID NO: 125517 - DNA, 16 bp, H. sapiens
taagaccatgggaaaa

SEQ ID NO: 125518 - DNA, 16 bp, H. sapiens
taagaccccaaactat

SEQ ID NO: 125519 - DNA, 17 bp, H. sapiens
taagaccctgtctcaaa

SEQ ID NO: 125520 - DNA, 16 bp, H. sapiens
taagacctcaaaccat

SEQ ID NO: 125521 - DNA, 16 bp, H. sapiens
taagacctcaaactat

SEQ ID NO: 125522 - DNA, 16 bp, H. sapiens
taagacctgaaactgt

SEQ ID NO: 125523 - DNA, 16 bp, H. sapiens
taagactatatatata

SEQ ID NO: 125524 - DNA, 16 bp, H. sapiens
taagactatgtctcaa

SEQ ID NO: 125525 - DNA, 16 bp, H. sapiens
taagactgcagtgagc

SEQ ID NO: 125526 - DNA, 16 bp, H. sapiens
taagacttcaaaagaa

SEQ ID NO: 125527 - DNA, 16 bp, H. sapiens
taagactttgggggct

SEQ ID NO: 125528 - DNA, 16 bp, H. sapiens
taagagaaaatacatt

SEQ ID NO: 125529 - DNA, 16 bp, H. sapiens
taagagaaataagcca

SEQ ID NO: 125530 - DNA, 16 bp, H. sapiens
taagagaagacaacac

SEQ ID NO: 125531 - DNA, 21 bp, H. sapiens
taagagaagttactatttatt

SEQ ID NO: 125532 - DNA, 16 bp, H. sapiens
taagagaatattatga

SEQ ID NO: 125533 - DNA, 16 bp, H. sapiens
taagagactgaaaaga

SEQ ID NO: 125534 - DNA, 16 bp, H. sapiens
taagagagaaactcca

SEQ ID NO: 125535 - DNA, 16 bp, H. sapiens
taagagagatgattta

SEQ ID NO: 125536 - DNA, 16 bp, H. sapiens
taagagaggacaaaaa

SEQ ID NO: 125537 - DNA, 21 bp, H. sapiens
taagagccaggcaccctttta

SEQ ID NO: 125538 - DNA, 16 bp, H. sapiens
taagagcgaaactctg

SEQ ID NO: 125539 - DNA, 16 bp, H. sapiens
taagagctcaataaat

SEQ ID NO: 125540 - DNA, 16 bp, H. sapiens
taagagctgtgagaca

SEQ ID NO: 125541 - DNA, 16 bp, H. sapiens
taagaggattgcttga

SEQ ID NO: 125542 - DNA, 16 bp, H. sapiens
taagagggaggcagga

SEQ ID NO: 125543 - DNA, 16 bp, H. sapiens
taagagtttttaatat

SEQ ID NO: 125544 - DNA, 16 bp, H. sapiens
taagataaaatatttg

SEQ ID NO: 125545 - DNA, 16 bp, H. sapiens
taagataatgtatata

SEQ ID NO: 125546 - DNA, 16 bp, H. sapiens
taagatacaaaaaatt

SEQ ID NO: 125547 - DNA, 16 bp, H. sapiens
taagatacacattttt

SEQ ID NO: 125548 - DNA, 16 bp, H. sapiens
taagatcacatcatct

SEQ ID NO: 125549 - DNA, 16 bp, H. sapiens
taagatcagaaacaaa

SEQ ID NO: 125550 - DNA, 16 bp, H. sapiens
taagatcaggaataag

SEQ ID NO: 125551 - DNA, 16 bp, H. sapiens
taagatctttgagaaa

SEQ ID NO: 125552 - DNA, 16 bp, H. sapiens
taagatctttttcaga

SEQ ID NO: 125553 - DNA, 16 bp, H. sapiens
taagatgattattttg

SEQ ID NO: 125554 - DNA, 16 bp, H. sapiens
taagatgattttttaa

SEQ ID NO: 125555 - DNA, 16 bp, H. sapiens
taagatgcacattttt

SEQ ID NO: 125556 - DNA, 16 bp, H. sapiens
taagatgtgtcttgct

SEQ ID NO: 125557 - DNA, 16 bp, H. sapiens
taagatgttaattgta

SEQ ID NO: 125558 - DNA, 16 bp, H. sapiens
taagatttcagatttt

SEQ ID NO: 125559 - DNA, 16 bp, H. sapiens
taagattttctatata

SEQ ID NO: 125560 - DNA, 16 bp, H. sapiens
taagattttgtttaaa

SEQ ID NO: 125561 - DNA, 16 bp, H. sapiens
taagatttttataaac

SEQ ID NO: 125562 - DNA, 16 bp, H. sapiens
taagatttttctttct

SEQ ID NO: 125563 - DNA, 16 bp, H. sapiens
taagatttttctttgt

SEQ ID NO: 125564 - DNA, 16 bp, H. sapiens
taagattttttttcta

SEQ ID NO: 125565 - DNA, 16 bp, H. sapiens
taagcaaaaggaagaa

SEQ ID NO: 125566 - DNA, 16 bp, H. sapiens
taagcaaaataaaact

SEQ ID NO: 125567 - DNA, 16 bp, H. sapiens
taagcaaagtgttgaa

SEQ ID NO: 125568 - DNA, 16 bp, H. sapiens
taagcaaatcaataaa

SEQ ID NO: 125569 - DNA, 16 bp, H. sapiens
taagcaatctagagat

SEQ ID NO: 125570 - DNA, 16 bp, H. sapiens
taagcaatgcatgact

SEQ ID NO: 125571 - DNA, 16 bp, H. sapiens
taagcaatttttaaaa

SEQ ID NO: 125572 - DNA, 17 bp, H. sapiens
taagcactcaataaatg

SEQ ID NO: 125573 - DNA, 16 bp, H. sapiens
taagcactcagtaaat

SEQ ID NO: 125574 - DNA, 16 bp, H. sapiens
taagcactttacacat

SEQ ID NO: 125575 - DNA, 16 bp, H. sapiens
taagcagaaggaagga

SEQ ID NO: 125576 - DNA, 16 bp, H. sapiens
taagcagaattttaaa

SEQ ID NO: 125577 - DNA, 16 bp, H. sapiens
taagcagagagatgga

SEQ ID NO: 125578 - DNA, 16 bp, H. sapiens
taagcagcaaagtgtt

SEQ ID NO: 125579 - DNA, 16 bp, H. sapiens
taagcagggaagtgac

SEQ ID NO: 125580 - DNA, 16 bp, H. sapiens
taagcagttctcccac

SEQ ID NO: 125581 - DNA, 16 bp, H. sapiens
taagcagtttttaaaa

SEQ ID NO: 125582 - DNA, 16 bp, H. sapiens
taagcatagaaaaggt

SEQ ID NO: 125583 - DNA, 16 bp, H. sapiens
taagcatatttatttt

SEQ ID NO: 125584 - DNA, 16 bp, H. sapiens
taagcatcttttcttt

SEQ ID NO: 125585 - DNA, 16 bp, H. sapiens
taagcattattttaaa

SEQ ID NO: 125586 - DNA, 16 bp, H. sapiens
taagcattgtttttat

SEQ ID NO: 125587 - DNA, 16 bp, H. sapiens
taagcatttattttta

SEQ ID NO: 125588 - DNA, 16 bp, H. sapiens
taagcatttttataaa

SEQ ID NO: 125589 - DNA, 16 bp, H. sapiens
taagcatttttcatat

SEQ ID NO: 125590 - DNA, 16 bp, H. sapiens
taagccaaaccctaac

SEQ ID NO: 125591 - DNA, 16 bp, H. sapiens
taagccaccagtctat

SEQ ID NO: 125592 - DNA, 16 bp, H. sapiens
taagccacccactctg

SEQ ID NO: 125593 - DNA, 16 bp, H. sapiens
taagccactgagattt

SEQ ID NO: 125594 - DNA, 16 bp, H. sapiens
taagccactgtgcttg

SEQ ID NO: 125595 - DNA, 16 bp, H. sapiens
taagccactgttattt

SEQ ID NO: 125596 - DNA, 16 bp, H. sapiens
taagccagaagagatt

SEQ ID NO: 125597 - DNA, 16 bp, H. sapiens
taagccagctgcagaa

SEQ ID NO: 125598 - DNA, 16 bp, H. sapiens
taagccaggcacaaag

SEQ ID NO: 125599 - DNA, 16 bp, H. sapiens
taagccagtgtctaga

SEQ ID NO: 125600 - DNA, 28 bp, H. sapiens
taagccatcatatcccctgtgacctgca

SEQ ID NO: 125601 - DNA, 16 bp, H. sapiens
taagccccaaatgcat

SEQ ID NO: 125602 - DNA, 16 bp, H. sapiens
taagccccaagccttg

SEQ ID NO: 125603 - DNA, 16 bp, H. sapiens
taagcctagtacccaa

SEQ ID NO: 125604 - DNA, 16 bp, H. sapiens
taagcctcaatttcct

SEQ ID NO: 125605 - DNA, 16 bp, H. sapiens
taagcctcagctttct

SEQ ID NO: 125606 - DNA, 16 bp, H. sapiens
taagcctcagtttctt

SEQ ID NO: 125607 - DNA, 16 bp, H. sapiens
taagccttggtggctt

SEQ ID NO: 125608 - DNA, 16 bp, H. sapiens
taagcctttaattcat

SEQ ID NO: 125609 - DNA, 16 bp, H. sapiens
taagccttttattttt

SEQ ID NO: 125610 - DNA, 16 bp, H. sapiens
taagccttttttaaaa

SEQ ID NO: 125611 - DNA, 16 bp, H. sapiens
taagcggctggcagag

SEQ ID NO: 125612 - DNA, 16 bp, H. sapiens
taagctatgagaacac

SEQ ID NO: 125613 - DNA, 19 bp, H. sapiens
taagctatgaggatgcaaa

SEQ ID NO: 125614 - DNA, 16 bp, H. sapiens
taagctccaggaaggc

SEQ ID NO: 125615 - DNA, 16 bp, H. sapiens
taagctcccacttata

SEQ ID NO: 125616 - DNA, 16 bp, H. sapiens
taagctgacaggcaac

SEQ ID NO: 125617 - DNA, 16 bp, H. sapiens
taagctgagatctaaa

SEQ ID NO: 125618 - DNA, 16 bp, H. sapiens
taagctgtttttcttt

SEQ ID NO: 125619 - DNA, 16 bp, H. sapiens
taagcttaatgaggaa

SEQ ID NO: 125620 - DNA, 16 bp, H. sapiens
taagcttcagtttcct

SEQ ID NO: 125621 - DNA, 16 bp, H. sapiens
taagcttcagttttct

SEQ ID NO: 125622 - DNA, 16 bp, H. sapiens
taagctttagtttcct

SEQ ID NO: 125623 - DNA, 16 bp, H. sapiens
taagcttttttcatat

SEQ ID NO: 125624 - DNA, 16 bp, H. sapiens
taaggaaaaaagacac

SEQ ID NO: 125625 - DNA, 16 bp, H. sapiens
taaggaaaaactgaaa

SEQ ID NO: 125626 - DNA, 16 bp, H. sapiens
taaggaaaaatatttt

SEQ ID NO: 125627 - DNA, 16 bp, H. sapiens
taaggaaaatgaggca

SEQ ID NO: 125628 - DNA, 16 bp, H. sapiens
taaggaaaatgtggca

SEQ ID NO: 125629 - DNA, 16 bp, H. sapiens
taaggaaacagaggct

SEQ ID NO: 125630 - DNA, 16 bp, H. sapiens
taaggaaactgaaaaa

SEQ ID NO: 125631 - DNA, 16 bp, H. sapiens
taaggaaactgaggca

SEQ ID NO: 125632 - DNA, 16 bp, H. sapiens
taaggaaagaagctgt

SEQ ID NO: 125633 - DNA, 16 bp, H. sapiens
taaggaaagagaacaa

SEQ ID NO: 125634 - DNA, 16 bp, H. sapiens
taaggaaataatttga

SEQ ID NO: 125635 - DNA, 16 bp, H. sapiens
taaggaaatgaagact

SEQ ID NO: 125636 - DNA, 16 bp, H. sapiens
taaggaaattgaaatt

SEQ ID NO: 125637 - DNA, 16 bp, H. sapiens
taaggaaattgaggct

SEQ ID NO: 125638 - DNA, 16 bp, H. sapiens
taaggaaccaaaaaag

SEQ ID NO: 125639 - DNA, 16 bp, H. sapiens
taaggaactaaaacaa

SEQ ID NO: 125640 - DNA, 16 bp, H. sapiens
taaggaactgaatttt

SEQ ID NO: 125641 - DNA, 16 bp, H. sapiens
taaggaacttaaagaa

SEQ ID NO: 125642 - DNA, 16 bp, H. sapiens
taaggaagaaatttgg

SEQ ID NO: 125643 - DNA, 16 bp, H. sapiens
taaggaagaatttttt

SEQ ID NO: 125644 - DNA, 16 bp, H. sapiens
taaggaagaggagttg

SEQ ID NO: 125645 - DNA, 16 bp, H. sapiens
taaggaaggaaataat

SEQ ID NO: 125646 - DNA, 16 bp, H. sapiens
taaggaatacaataaa

SEQ ID NO: 125647 - DNA, 17 bp, H. sapiens
taaggaatacttttagt

SEQ ID NO: 125648 - DNA, 16 bp, H. sapiens
taaggaatattgactc

SEQ ID NO: 125649 - DNA, 16 bp, H. sapiens
taaggaatgcaaacaa

SEQ ID NO: 125650 - DNA, 16 bp, H. sapiens
taaggaatgcttttag

SEQ ID NO: 125651 - DNA, 16 bp, H. sapiens
taaggaatgtgggaaa

SEQ ID NO: 125652 - DNA, 16 bp, H. sapiens
taaggaattggctcac

SEQ ID NO: 125653 - DNA, 16 bp, H. sapiens
taaggacaccagtcat

SEQ ID NO: 125654 - DNA, 16 bp, H. sapiens
taaggacagattttaa

SEQ ID NO: 125655 - DNA, 16 bp, H. sapiens
taaggacatttttttt

SEQ ID NO: 125656 - DNA, 16 bp, H. sapiens
taaggactcacacaaa

SEQ ID NO: 125657 - DNA, 16 bp, H. sapiens
taaggagagctgcttt

SEQ ID NO: 125658 - DNA, 16 bp, H. sapiens
taaggaggagtttccc

SEQ ID NO: 125659 - DNA, 16 bp, H. sapiens
taaggaggctgaggtg

SEQ ID NO: 125660 - DNA, 16 bp, H. sapiens
taaggagtgtaccact

SEQ ID NO: 125661 - DNA, 16 bp, H. sapiens
taaggagtgtgtgtgt

SEQ ID NO: 125662 - DNA, 16 bp, H. sapiens
taaggataaggataag

SEQ ID NO: 125663 - DNA, 16 bp, H. sapiens
taaggatgtgaagaaa

SEQ ID NO: 125664 - DNA, 16 bp, H. sapiens
taaggattttcttttt

SEQ ID NO: 125665 - DNA, 16 bp, H. sapiens
taaggcaaatgccgag

SEQ ID NO: 125666 - DNA, 16 bp, H. sapiens
taaggcaaatgctgag

SEQ ID NO: 125667 - DNA, 16 bp, H. sapiens
taaggcaagaaaatga

SEQ ID NO: 125668 - DNA, 16 bp, H. sapiens
taaggcagaagaatcg

SEQ ID NO: 125669 - DNA, 16 bp, H. sapiens
taaggcagtggttctc

SEQ ID NO: 125670 - DNA, 16 bp, H. sapiens
taaggcattttgttat

SEQ ID NO: 125671 - DNA, 16 bp, H. sapiens
taaggctcagaaaggt

SEQ ID NO: 125672 - DNA, 16 bp, H. sapiens
taaggctgttggaaaa

SEQ ID NO: 125673 - DNA, 16 bp, H. sapiens
taaggctgttttacag

SEQ ID NO: 125674 - DNA, 16 bp, H. sapiens
taaggctgttttgctt

SEQ ID NO: 125675 - DNA, 16 bp, H. sapiens
taagggaaataaatca

SEQ ID NO: 125676 - DNA, 43 bp, H. sapiens
taagggcagccagagagaaaggtcgggttacccacaaagggaa

SEQ ID NO: 125677 - DNA, 16 bp, H. sapiens
taaggggcttttcccc

SEQ ID NO: 125678 - DNA, 16 bp, H. sapiens
taaggggcttttccct

SEQ ID NO: 125679 - DNA, 17 bp, H. sapiens
taaggggtctagggagt

SEQ ID NO: 125680 - DNA, 16 bp, H. sapiens
taagggtctgctttgt

SEQ ID NO: 125681 - DNA, 16 bp, H. sapiens
taaggtaatatattca

SEQ ID NO: 125682 - DNA, 16 bp, H. sapiens
taaggtaggtgctatt

SEQ ID NO: 125683 - DNA, 16 bp, H. sapiens
taaggtcacatttaca

SEQ ID NO: 125684 - DNA, 17 bp, H. sapiens
taaggtcagaatcttct

SEQ ID NO: 125685 - DNA, 16 bp, H. sapiens
taaggtgaaactgtgg

SEQ ID NO: 125686 - DNA, 16 bp, H. sapiens
taaggtgagaggattg

SEQ ID NO: 125687 - DNA, 16 bp, H. sapiens
taaggtgatcctccca

SEQ ID NO: 125688 - DNA, 16 bp, H. sapiens
taaggtggtgtctgct

SEQ ID NO: 125689 - DNA, 16 bp, H. sapiens
taaggtgtcatttctc

SEQ ID NO: 125690 - DNA, 16 bp, H. sapiens
taaggttttattaaaa

SEQ ID NO: 125691 - DNA, 16 bp, H. sapiens
taagtaaaataagcca

SEQ ID NO: 125692 - DNA, 16 bp, H. sapiens
taagtaaaataagtca

SEQ ID NO: 125693 - DNA, 16 bp, H. sapiens
taagtaaacataaaat

SEQ ID NO: 125694 - DNA, 16 bp, H. sapiens
taagtaacttgcctaa

SEQ ID NO: 125695 - DNA, 16 bp, H. sapiens
taagtaatctagagat

SEQ ID NO: 125696 - DNA, 16 bp, H. sapiens
taagtaatttgcctaa

SEQ ID NO: 125697 - DNA, 16 bp, H. sapiens
taagtacattcatact

SEQ ID NO: 125698 - DNA, 16 bp, H. sapiens
taagtactcaagaaat

SEQ ID NO: 125699 - DNA, 16 bp, H. sapiens
taagtagatcccattt

SEQ ID NO: 125700 - DNA, 16 bp, H. sapiens
taagtagcagagccag

SEQ ID NO: 125701 - DNA, 16 bp, H. sapiens
taagtatcttttctga

SEQ ID NO: 125702 - DNA, 16 bp, H. sapiens
taagtattaacttaca

SEQ ID NO: 125703 - DNA, 16 bp, H. sapiens
taagtattcaataaat

SEQ ID NO: 125704 - DNA, 16 bp, H. sapiens
taagtatttaattcat

SEQ ID NO: 125705 - DNA, 16 bp, H. sapiens
taagtatttcatgttt

SEQ ID NO: 125706 - DNA, 16 bp, H. sapiens
taagtattttaggctt

SEQ ID NO: 125707 - DNA, 16 bp, H. sapiens
taagtcaccagctgca

SEQ ID NO: 125708 - DNA, 16 bp, H. sapiens
taagtcagagtctcct

SEQ ID NO: 125709 - DNA, 16 bp, H. sapiens
taagtcatttttctct

SEQ ID NO: 125710 - DNA, 16 bp, H. sapiens
taagtccctattaaat

SEQ ID NO: 125711 - DNA, 16 bp, H. sapiens
taagtcctaaccccca

SEQ ID NO: 125712 - DNA, 16 bp, H. sapiens
taagtcctaataaact

SEQ ID NO: 125713 - DNA, 16 bp, H. sapiens
taagtctattgtttct

SEQ ID NO: 125714 - DNA, 16 bp, H. sapiens
taagtctatttaaaaa

SEQ ID NO: 125715 - DNA, 16 bp, H. sapiens
taagtctcagaagatc

SEQ ID NO: 125716 - DNA, 16 bp, H. sapiens
taagtctcctgaggcc

SEQ ID NO: 125717 - DNA, 16 bp, H. sapiens
taagtcttaaaatcag

SEQ ID NO: 125718 - DNA, 16 bp, H. sapiens
taagtgaaaatgctat

SEQ ID NO: 125719 - DNA, 16 bp, H. sapiens
taagtgaaagaaacca

SEQ ID NO: 125720 - DNA, 16 bp, H. sapiens
taagtgaaagaagcca

SEQ ID NO: 125721 - DNA, 16 bp, H. sapiens
taagtgaaataaacca

SEQ ID NO: 125722 - DNA, 16 bp, H. sapiens
taagtgaaataagcca

SEQ ID NO: 125723 - DNA, 16 bp, H. sapiens
taagtgaaattgtttt

SEQ ID NO: 125724 - DNA, 16 bp, H. sapiens
taagtgaaggagaagt

SEQ ID NO: 125725 - DNA, 16 bp, H. sapiens
taagtgaatgaataaa

SEQ ID NO: 125726 - DNA, 16 bp, H. sapiens
taagtgacaaagccag

SEQ ID NO: 125727 - DNA, 16 bp, H. sapiens
taagtgacataagcca

SEQ ID NO: 125728 - DNA, 16 bp, H. sapiens
taagtgacttgctcaa

SEQ ID NO: 125729 - DNA, 16 bp, H. sapiens
taagtgagaacaggtg

SEQ ID NO: 125730 - DNA, 16 bp, H. sapiens
taagtgagaatatatg

SEQ ID NO: 125731 - DNA, 16 bp, H. sapiens
taagtgagatcatgaa

SEQ ID NO: 125732 - DNA, 16 bp, H. sapiens
taagtgagatcatgca

SEQ ID NO: 125733 - DNA, 16 bp, H. sapiens
taagtgatttttttct

SEQ ID NO: 125734 - DNA, 16 bp, H. sapiens
taagtgcagccagaga

SEQ ID NO: 125735 - DNA, 16 bp, H. sapiens
taagtgctcaataaat

SEQ ID NO: 125736 - DNA, 17 bp, H. sapiens
taagtgctgggattaca

SEQ ID NO: 125737 - DNA, 16 bp, H. sapiens
taagtgctgtggagaa

SEQ ID NO: 125738 - DNA, 16 bp, H. sapiens
taagtgcttaataaat

SEQ ID NO: 125739 - DNA, 16 bp, H. sapiens
taagtgcttgaggtga

SEQ ID NO: 125740 - DNA, 16 bp, H. sapiens
taagtgcttgataaat

SEQ ID NO: 125741 - DNA, 16 bp, H. sapiens
taagtggaaaaaagca

SEQ ID NO: 125742 - DNA, 16 bp, H. sapiens
taagtggaataataca

SEQ ID NO: 125743 - DNA, 16 bp, H. sapiens
taagtgggcaaaggat

SEQ ID NO: 125744 - DNA, 18 bp, H. sapiens
taagtgggtgcctcatga

SEQ ID NO: 125745 - DNA, 16 bp, H. sapiens
taagtgtaaaatacat

SEQ ID NO: 125746 - DNA, 16 bp, H. sapiens
taagtgtctgtcaaca

SEQ ID NO: 125747 - DNA, 16 bp, H. sapiens
taagtgtctgtggctt

SEQ ID NO: 125748 - DNA, 16 bp, H. sapiens
taagtgtctgtgtgtg

SEQ ID NO: 125749 - DNA, 16 bp, H. sapiens
taagtgtgagccactg

SEQ ID NO: 125750 - DNA, 16 bp, H. sapiens
taagtgtggtggcaca

SEQ ID NO: 125751 - DNA, 16 bp, H. sapiens
taagtgttccctcttc

SEQ ID NO: 125752 - DNA, 16 bp, H. sapiens
taagtgttcttatcac

SEQ ID NO: 125753 - DNA, 16 bp, H. sapiens
taagtgtttaattcat

SEQ ID NO: 125754 - DNA, 16 bp, H. sapiens
taagtgttttacatgc

SEQ ID NO: 125755 - DNA, 16 bp, H. sapiens
taagtgttttattctt

SEQ ID NO: 125756 - DNA, 16 bp, H. sapiens
taagttactattgact

SEQ ID NO: 125757 - DNA, 16 bp, H. sapiens
taagttcaatgtttct

SEQ ID NO: 125758 - DNA, 16 bp, H. sapiens
taagttccttagagat

SEQ ID NO: 125759 - DNA, 16 bp, H. sapiens
taagttccttgtagat

SEQ ID NO: 125760 - DNA, 16 bp, H. sapiens
taagttctagtatttg

SEQ ID NO: 125761 - DNA, 16 bp, H. sapiens
taagttctggtgtaca

SEQ ID NO: 125762 - DNA, 16 bp, H. sapiens
taagttctgtttttct

SEQ ID NO: 125763 - DNA, 16 bp, H. sapiens
taagttctttagcagt

SEQ ID NO: 125764 - DNA, 16 bp, H. sapiens
taagttcttttgtggt

SEQ ID NO: 125765 - DNA, 16 bp, H. sapiens
taagtttaaagagaaa

SEQ ID NO: 125766 - DNA, 16 bp, H. sapiens
taagtttacattttta

SEQ ID NO: 125767 - DNA, 16 bp, H. sapiens
taagtttatgattatg

SEQ ID NO: 125768 - DNA, 16 bp, H. sapiens
taagtttcaggataca

SEQ ID NO: 125769 - DNA, 16 bp, H. sapiens
taagtttccaacacat

SEQ ID NO: 125770 - DNA, 16 bp, H. sapiens
taagtttcctgagggc

SEQ ID NO: 125771 - DNA, 16 bp, H. sapiens
taagtttctattttat

SEQ ID NO: 125772 - DNA, 16 bp, H. sapiens
taagttttacattttt

SEQ ID NO: 125773 - DNA, 16 bp, H. sapiens
taagttttagggtaga

SEQ ID NO: 125774 - DNA, 16 bp, H. sapiens
taagttttcaaatttg

SEQ ID NO: 125775 - DNA, 16 bp, H. sapiens
taagttttcaacacat

SEQ ID NO: 125776 - DNA, 16 bp, H. sapiens
taagttttcaataaat

SEQ ID NO: 125777 - DNA, 16 bp, H. sapiens
taagttttgcattttt

SEQ ID NO: 125778 - DNA, 16 bp, H. sapiens
taagtttttaattcat

SEQ ID NO: 125779 - DNA, 16 bp, H. sapiens
taagtttttgtttctc

SEQ ID NO: 125780 - DNA, 21 bp, H. sapiens
taataaaaacttgctggtttt

SEQ ID NO: 125781 - DNA, 16 bp, H. sapiens
taataaaaacttgttg

SEQ ID NO: 125782 - DNA, 16 bp, H. sapiens
taataaaaagacaacc

SEQ ID NO: 125783 - DNA, 16 bp, H. sapiens
taataaaaagacaact

SEQ ID NO: 125784 - DNA, 16 bp, H. sapiens
taataaaaatatgtac

SEQ ID NO: 125785 - DNA, 16 bp, H. sapiens
taataaaaatcagttt

SEQ ID NO: 125786 - DNA, 16 bp, H. sapiens
taataaaaatctccca

SEQ ID NO: 125787 - DNA, 16 bp, H. sapiens
taataaaaatgtcaat

SEQ ID NO: 125788 - DNA, 16 bp, H. sapiens
taataaaacttttctt

SEQ ID NO: 125789 - DNA, 16 bp, H. sapiens
taataaaagacatgaa

SEQ ID NO: 125790 - DNA, 16 bp, H. sapiens
taataaaagccacata

SEQ ID NO: 125791 - DNA, 16 bp, H. sapiens
taataaaagccatcta

SEQ ID NO: 125792 - DNA, 16 bp, H. sapiens
taataaaagctatcta

SEQ ID NO: 125793 - DNA, 16 bp, H. sapiens
taataaaatgaaggca

SEQ ID NO: 125794 - DNA, 16 bp, H. sapiens
taataaaatgcaattt

SEQ ID NO: 125795 - DNA, 16 bp, H. sapiens
taataaacatatgaaa

SEQ ID NO: 125796 - DNA, 16 bp, H. sapiens
taataaacatattttg

SEQ ID NO: 125797 - DNA, 16 bp, H. sapiens
taataaacatttattg

SEQ ID NO: 125798 - DNA, 16 bp, H. sapiens
taataaaccttcacat

SEQ ID NO: 125799 - DNA, 16 bp, H. sapiens
taataaactgtttttt

SEQ ID NO: 125800 - DNA, 16 bp, H. sapiens
taataaacttgctttc

SEQ ID NO: 125801 - DNA, 16 bp, H. sapiens
taataaactttccttt

SEQ ID NO: 125802 - DNA, 16 bp, H. sapiens
taataaactttgtttt

SEQ ID NO: 125803 - DNA, 16 bp, H. sapiens
taataaagaagcacat

SEQ ID NO: 125804 - DNA, 16 bp, H. sapiens
taataaagaatacttt

SEQ ID NO: 125805 - DNA, 16 bp, H. sapiens
taataaagctattatt

SEQ ID NO: 125806 - DNA, 16 bp, H. sapiens
taataaagggatcaat

SEQ ID NO: 125807 - DNA, 16 bp, H. sapiens
taataaagtccagttt

SEQ ID NO: 125808 - DNA, 16 bp, H. sapiens
taataaagtcctttgt

SEQ ID NO: 125809 - DNA, 16 bp, H. sapiens
taataaagtctatttt

SEQ ID NO: 125810 - DNA, 16 bp, H. sapiens
taataaataaagacac

SEQ ID NO: 125811 - DNA, 16 bp, H. sapiens
taataaataaatgtgt

SEQ ID NO: 125812 - DNA, 16 bp, H. sapiens
taataaatacttattg

SEQ ID NO: 125813 - DNA, 16 bp, H. sapiens
taataaatatgtttca

SEQ ID NO: 125814 - DNA, 16 bp, H. sapiens
taataaatattccttt

SEQ ID NO: 125815 - DNA, 16 bp, H. sapiens
taataaatatttcaga

SEQ ID NO: 125816 - DNA, 16 bp, H. sapiens
taataaatattttctg

SEQ ID NO: 125817 - DNA, 16 bp, H. sapiens
taataaatatttttgg

SEQ ID NO: 125818 - DNA, 16 bp, H. sapiens
taataaatctttgcct

SEQ ID NO: 125819 - DNA, 16 bp, H. sapiens
taataaatgatagtta

SEQ ID NO: 125820 - DNA, 16 bp, H. sapiens
taataaatgctttgga

SEQ ID NO: 125821 - DNA, 16 bp, H. sapiens
taataaatggcagagt

SEQ ID NO: 125822 - DNA, 16 bp, H. sapiens
taataaatggtgctag

SEQ ID NO: 125823 - DNA, 16 bp, H. sapiens
taataaatgtccttat

SEQ ID NO: 125824 - DNA, 16 bp, H. sapiens
taataaatgtctttta

SEQ ID NO: 125825 - DNA, 16 bp, H. sapiens
taataaatgtttgttg

SEQ ID NO: 125826 - DNA, 16 bp, H. sapiens
taataaatgttttcat

SEQ ID NO: 125827 - DNA, 16 bp, H. sapiens
taataaattactcagt

SEQ ID NO: 125828 - DNA, 16 bp, H. sapiens
taataaatttgctttt

SEQ ID NO: 125829 - DNA, 16 bp, H. sapiens
taataacaaactccac

SEQ ID NO: 125830 - DNA, 17 bp, H. sapiens
taataacaaactcctcc

SEQ ID NO: 125831 - DNA, 16 bp, H. sapiens
taataacaaactcttc

SEQ ID NO: 125832 - DNA, 16 bp, H. sapiens
taataacaaacttctc

SEQ ID NO: 125833 - DNA, 16 bp, H. sapiens
taataacaatgtatta

SEQ ID NO: 125834 - DNA, 16 bp, H. sapiens
taataacagctattta

SEQ ID NO: 125835 - DNA, 16 bp, H. sapiens
taataacagtaataaa

SEQ ID NO: 125836 - DNA, 16 bp, H. sapiens
taataacatgaaaaca

SEQ ID NO: 125837 - DNA, 16 bp, H. sapiens
taataagcaattatag

SEQ ID NO: 125838 - DNA, 16 bp, H. sapiens
taataagtattgcctc

SEQ ID NO: 125839 - DNA, 16 bp, H. sapiens
taataataaaaacagt

SEQ ID NO: 125840 - DNA, 16 bp, H. sapiens
taataataacagttaa

SEQ ID NO: 125841 - DNA, 16 bp, H. sapiens
taataataacatcaac

SEQ ID NO: 125842 - DNA, 16 bp, H. sapiens
taataataataatcct

SEQ ID NO: 125843 - DNA, 16 bp, H. sapiens
taataataataatgca

SEQ ID NO: 125844 - DNA, 16 bp, H. sapiens
taataataataatgtc

SEQ ID NO: 125845 - DNA, 16 bp, H. sapiens
taataataatacatgt

SEQ ID NO: 125846 - DNA, 16 bp, H. sapiens
taataataatagcaat

SEQ ID NO: 125847 - DNA, 16 bp, H. sapiens
taataataatagtatg

SEQ ID NO: 125848 - DNA, 16 bp, H. sapiens
taataataatgggaga

SEQ ID NO: 125849 - DNA, 16 bp, H. sapiens
taataatagcaatagc

SEQ ID NO: 125850 - DNA, 16 bp, H. sapiens
taataatagcagtaat

SEQ ID NO: 125851 - DNA, 16 bp, H. sapiens
taataatagtaatagt

SEQ ID NO: 125852 - DNA, 16 bp, H. sapiens
taataatcacatcatg

SEQ ID NO: 125853 - DNA, 16 bp, H. sapiens
taataatccccacttg

SEQ ID NO: 125854 - DNA, 16 bp, H. sapiens
taataatctcaattat

SEQ ID NO: 125855 - DNA, 46 bp, H. sapiens
taataatgggagactttaacaccccactgtcaacattagacagatc

SEQ ID NO: 125856 - DNA, 16 bp, H. sapiens
taataatgtaaaacaa

SEQ ID NO: 125857 - DNA, 16 bp, H. sapiens
taataatgtaaacact

SEQ ID NO: 125858 - DNA, 16 bp, H. sapiens
taataattgcatttta

SEQ ID NO: 125859 - DNA, 16 bp, H. sapiens
taatacaaagaaagga

SEQ ID NO: 125860 - DNA, 16 bp, H. sapiens
taatacaaataaaatg

SEQ ID NO: 125861 - DNA, 16 bp, H. sapiens
taatacaaatggaaaa

SEQ ID NO: 125862 - DNA, 16 bp, H. sapiens
taatacaggaaattgg

SEQ ID NO: 125863 - DNA, 16 bp, H. sapiens
taatacagtaagacaa

SEQ ID NO: 125864 - DNA, 16 bp, H. sapiens
taatacagtattttta

SEQ ID NO: 125865 - DNA, 16 bp, H. sapiens
taatacagtgaaaaaa

SEQ ID NO: 125866 - DNA, 16 bp, H. sapiens
taatacatatttattg

SEQ ID NO: 125867 - DNA, 16 bp, H. sapiens
taatacatgttcatta

SEQ ID NO: 125868 - DNA, 16 bp, H. sapiens
taatacattgtaaatg

SEQ ID NO: 125869 - DNA, 16 bp, H. sapiens
taatacatttcttaaa

SEQ ID NO: 125870 - DNA, 16 bp, H. sapiens
taataccagcagtttg

SEQ ID NO: 125871 - DNA, 16 bp, H. sapiens
taatacctatgtgatg

SEQ ID NO: 125872 - DNA, 16 bp, H. sapiens
taatactgaaagtcct

SEQ ID NO: 125873 - DNA, 16 bp, H. sapiens
taatactggcataaaa

SEQ ID NO: 125874 - DNA, 16 bp, H. sapiens
taatacttacctcaca

SEQ ID NO: 125875 - DNA, 16 bp, H. sapiens
taatacttcattgtgt

SEQ ID NO: 125876 - DNA, 16 bp, H. sapiens
taatacttctataatt

SEQ ID NO: 125877 - DNA, 16 bp, H. sapiens
taatactttcactaat

SEQ ID NO: 125878 - DNA, 19 bp, H. sapiens
taatacttttagaggccct

SEQ ID NO: 125879 - DNA, 16 bp, H. sapiens
taatacttttgtcttt

SEQ ID NO: 125880 - DNA, 16 bp, H. sapiens
taatagaaaataaact

SEQ ID NO: 125881 - DNA, 16 bp, H. sapiens
taatagaaatacattt

SEQ ID NO: 125882 - DNA, 16 bp, H. sapiens
taatagaatggtttat

SEQ ID NO: 125883 - DNA, 18 bp, H. sapiens
taatagacatctatagaa

SEQ ID NO: 125884 - DNA, 16 bp, H. sapiens
taatagactgagtggg

SEQ ID NO: 125885 - DNA, 16 bp, H. sapiens
taatagagatggggtt

SEQ ID NO: 125886 - DNA, 16 bp, H. sapiens
taatagcaaagaataa

SEQ ID NO: 125887 - DNA, 16 bp, H. sapiens
taatagcaataataat

SEQ ID NO: 125888 - DNA, 16 bp, H. sapiens
taatagcagaaataaa

SEQ ID NO: 125889 - DNA, 16 bp, H. sapiens
taatagctaacattta

SEQ ID NO: 125890 - DNA, 16 bp, H. sapiens
taataggattgctgag

SEQ ID NO: 125891 - DNA, 16 bp, H. sapiens
taatataaacatttca

SEQ ID NO: 125892 - DNA, 16 bp, H. sapiens
taatataatgtaaatg

SEQ ID NO: 125893 - DNA, 16 bp, H. sapiens
taatataatgttttca

SEQ ID NO: 125894 - DNA, 16 bp, H. sapiens
taatataccattgtat

SEQ ID NO: 125895 - DNA, 16 bp, H. sapiens
taatatagattttggt

SEQ ID NO: 125896 - DNA, 16 bp, H. sapiens
taatatagtttgaagt

SEQ ID NO: 125897 - DNA, 16 bp, H. sapiens
taatatatactatatg

SEQ ID NO: 125898 - DNA, 16 bp, H. sapiens
taatatatgcaaagta

SEQ ID NO: 125899 - DNA, 16 bp, H. sapiens
taatatatgtaaaaca

SEQ ID NO: 125900 - DNA, 16 bp, H. sapiens
taatatatgtgaaagt

SEQ ID NO: 125901 - DNA, 16 bp, H. sapiens
taatatcagcactttg

SEQ ID NO: 125902 - DNA, 16 bp, H. sapiens
taatatcctttataat

SEQ ID NO: 125903 - DNA, 16 bp, H. sapiens
taatatctaaaatttg

SEQ ID NO: 125904 - DNA, 16 bp, H. sapiens
taatatctgatttttt

SEQ ID NO: 125905 - DNA, 16 bp, H. sapiens
taatatctttccattt

SEQ ID NO: 125906 - DNA, 16 bp, H. sapiens
taatatgctgtacagg

SEQ ID NO: 125907 - DNA, 16 bp, H. sapiens
taatatgctgttgaat

SEQ ID NO: 125908 - DNA, 16 bp, H. sapiens
taatatggtagccact

SEQ ID NO: 125909 - DNA, 16 bp, H. sapiens
taatatggtttggctg

SEQ ID NO: 125910 - DNA, 16 bp, H. sapiens
taatatgtgccaggca

SEQ ID NO: 125911 - DNA, 16 bp, H. sapiens
taatatgttcaagaaa

SEQ ID NO: 125912 - DNA, 16 bp, H. sapiens
taatatgttttattca

SEQ ID NO: 125913 - DNA, 16 bp, H. sapiens
taatattataaagatg

SEQ ID NO: 125914 - DNA, 16 bp, H. sapiens
taatattcatgtattt

SEQ ID NO: 125915 - DNA, 16 bp, H. sapiens
taatattccactgtat

SEQ ID NO: 125916 - DNA, 16 bp, H. sapiens
taatattccattttgt

SEQ ID NO: 125917 - DNA, 16 bp, H. sapiens
taatattctattgtgt

SEQ ID NO: 125918 - DNA, 16 bp, H. sapiens
taatattctgttttat

SEQ ID NO: 125919 - DNA, 16 bp, H. sapiens
taatattcttaaaatg

SEQ ID NO: 125920 - DNA, 16 bp, H. sapiens
taatattgatgatcct

SEQ ID NO: 125921 - DNA, 16 bp, H. sapiens
taatattgtaaagatg

SEQ ID NO: 125922 - DNA, 16 bp, H. sapiens
taatattgtgaaaatg

SEQ ID NO: 125923 - DNA, 16 bp, H. sapiens
taatatttaatgactg

SEQ ID NO: 125924 - DNA, 16 bp, H. sapiens
taatatttactttgtt

SEQ ID NO: 125925 - DNA, 16 bp, H. sapiens
taatatttatagcatt

SEQ ID NO: 125926 - DNA, 16 bp, H. sapiens
taatatttattgaaca

SEQ ID NO: 125927 - DNA, 16 bp, H. sapiens
taatatttcaaaatga

SEQ ID NO: 125928 - DNA, 16 bp, H. sapiens
taatatttccaaaaat

SEQ ID NO: 125929 - DNA, 16 bp, H. sapiens
taatatttcttgagtg

SEQ ID NO: 125930 - DNA, 16 bp, H. sapiens
taatattttaaaagga

SEQ ID NO: 125931 - DNA, 16 bp, H. sapiens
taatattttatgacat

SEQ ID NO: 125932 - DNA, 16 bp, H. sapiens
taatattttgacatat

SEQ ID NO: 125933 - DNA, 16 bp, H. sapiens
taatatttttgaggtt

SEQ ID NO: 125934 - DNA, 16 bp, H. sapiens
taatatttttggacca

SEQ ID NO: 125935 - DNA, 16 bp, H. sapiens
taatattttttgagac

SEQ ID NO: 125936 - DNA, 16 bp, H. sapiens
taatcaaactaaagag

SEQ ID NO: 125937 - DNA, 16 bp, H. sapiens
taatcaaatcaaggta

SEQ ID NO: 125938 - DNA, 16 bp, H. sapiens
taatcaaattaatgat

SEQ ID NO: 125939 - DNA, 16 bp, H. sapiens
taatcaagatagtgtg

SEQ ID NO: 125940 - DNA, 16 bp, H. sapiens
taatcaaggaaatgaa

SEQ ID NO: 125941 - DNA, 16 bp, H. sapiens
taatcaatcatgccta

SEQ ID NO: 125942 - DNA, 16 bp, H. sapiens
taatcaatcatgcctg

SEQ ID NO: 125943 - DNA, 16 bp, H. sapiens
taatcacaacagtaat

SEQ ID NO: 125944 - DNA, 16 bp, H. sapiens
taatcacaagggttct

SEQ ID NO: 125945 - DNA, 16 bp, H. sapiens
taatcacagagaaaaa

SEQ ID NO: 125946 - DNA, 19 bp, H. sapiens
taatcacagcactttggga

SEQ ID NO: 125947 - DNA, 16 bp, H. sapiens
taatcacagctactca

SEQ ID NO: 125948 - DNA, 16 bp, H. sapiens
taatcacatctacaaa

SEQ ID NO: 125949 - DNA, 16 bp, H. sapiens
taatcacatctgcaga

SEQ ID NO: 125950 - DNA, 16 bp, H. sapiens
taatcaccaagaaaat

SEQ ID NO: 125951 - DNA, 16 bp, H. sapiens
taatcacctctgcaaa

SEQ ID NO: 125952 - DNA, 16 bp, H. sapiens
taatcacctctttaaa

SEQ ID NO: 125953 - DNA, 16 bp, H. sapiens
taatcaccttctaaag

SEQ ID NO: 125954 - DNA, 16 bp, H. sapiens
taatcagaaagaaaat

SEQ ID NO: 125955 - DNA, 16 bp, H. sapiens
taatcagagactcaaa

SEQ ID NO: 125956 - DNA, 16 bp, H. sapiens
taatcagcaaaatcca

SEQ ID NO: 125957 - DNA, 16 bp, H. sapiens
taatcagcaaagtaaa

SEQ ID NO: 125958 - DNA, 16 bp, H. sapiens
taatcaggcaggcgtc

SEQ ID NO: 125959 - DNA, 16 bp, H. sapiens
taatcagggttctcca

SEQ ID NO: 125960 - DNA, 16 bp, H. sapiens
taatcagtgttttata

SEQ ID NO: 125961 - DNA, 16 bp, H. sapiens
taatcagtttttaaaa

SEQ ID NO: 125962 - DNA, 16 bp, H. sapiens
taatcataaaagaaat

SEQ ID NO: 125963 - DNA, 16 bp, H. sapiens
taatcatattttcaaa

SEQ ID NO: 125964 - DNA, 16 bp, H. sapiens
taatcatcaagaaaga

SEQ ID NO: 125965 - DNA, 16 bp, H. sapiens
taatcatgagaaaaat

SEQ ID NO: 125966 - DNA, 16 bp, H. sapiens
taatcatgtggttttg

SEQ ID NO: 125967 - DNA, 16 bp, H. sapiens
taatcattattttaga

SEQ ID NO: 125968 - DNA, 16 bp, H. sapiens
taatcattttaacaat

SEQ ID NO: 125969 - DNA, 16 bp, H. sapiens
taatccaaacactttg

SEQ ID NO: 125970 - DNA, 16 bp, H. sapiens
taatccaagttactca

SEQ ID NO: 125971 - DNA, 16 bp, H. sapiens
taatccaatatgactg

SEQ ID NO: 125972 - DNA, 16 bp, H. sapiens
taatccaatgtgactg

SEQ ID NO: 125973 - DNA, 16 bp, H. sapiens
taatccaattttttaa

SEQ ID NO: 125974 - DNA, 20 bp, H. sapiens
taatccagcatgtaaacaga

SEQ ID NO: 125975 - DNA, 16 bp, H. sapiens
taatccattcagccag

SEQ ID NO: 125976 - DNA, 16 bp, H. sapiens
taatcccaaatgtgat

SEQ ID NO: 125977 - DNA, 16 bp, H. sapiens
taatcccaacactctg

SEQ ID NO: 125978 - DNA, 16 bp, H. sapiens
taatcccaacacttct

SEQ ID NO: 125979 - DNA, 16 bp, H. sapiens
taatcccaacacttgg

SEQ ID NO: 125980 - DNA, 16 bp, H. sapiens
taatcccaacacttta

SEQ ID NO: 125981 - DNA, 17 bp, H. sapiens
taatcccaacactttga

SEQ ID NO: 125982 - DNA, 19 bp, H. sapiens
taatcccaacactttggga

SEQ ID NO: 125983 - DNA, 17 bp, H. sapiens
taatcccaacactttgt

SEQ ID NO: 125984 - DNA, 16 bp, H. sapiens
taatcccaacactttt

SEQ ID NO: 125985 - DNA, 16 bp, H. sapiens
taatcccaacagtttg

SEQ ID NO: 125986 - DNA, 16 bp, H. sapiens
taatcccaacatgttg

SEQ ID NO: 125987 - DNA, 16 bp, H. sapiens
taatcccaacatttta

SEQ ID NO: 125988 - DNA, 16 bp, H. sapiens
taatcccaacattttg

SEQ ID NO: 125989 - DNA, 16 bp, H. sapiens
taatcccaacgctttg

SEQ ID NO: 125990 - DNA, 16 bp, H. sapiens
taatcccaactacttg

SEQ ID NO: 125991 - DNA, 16 bp, H. sapiens
taatcccaagactttg

SEQ ID NO: 125992 - DNA, 17 bp, H. sapiens
taatcccaagcactttg

SEQ ID NO: 125993 - DNA, 16 bp, H. sapiens
taatcccaatactttg

SEQ ID NO: 125994 - DNA, 19 bp, H. sapiens
taatcccaccactttggga

SEQ ID NO: 125995 - DNA, 17 bp, H. sapiens
taatcccacctacttgg

SEQ ID NO: 125996 - DNA, 16 bp, H. sapiens
taatcccagaactctg

SEQ ID NO: 125997 - DNA, 16 bp, H. sapiens
taatcccagaacttcg

SEQ ID NO: 125998 - DNA, 19 bp, H. sapiens
taatcccagaactttggga

SEQ ID NO: 125999 - DNA, 16 bp, H. sapiens
taatcccagcaacttg

SEQ ID NO: 126000 - DNA, 16 bp, H. sapiens
taatcccagcaattca

SEQ ID NO: 126001 - DNA, 16 bp, H. sapiens
taatcccagcaattta

SEQ ID NO: 126002 - DNA, 19 bp, H. sapiens
taatcccagcaatttggga

SEQ ID NO: 126003 - DNA, 19 bp, H. sapiens
taatcccagcacattggga

SEQ ID NO: 126004 - DNA, 19 bp, H. sapiens
taatcccagcaccttggga

SEQ ID NO: 126005 - DNA, 19 bp, H. sapiens
taatcccagcacgttggga

SEQ ID NO: 126006 - DNA, 19 bp, H. sapiens
taatcccagcactctggga

SEQ ID NO: 126007 - DNA, 16 bp, H. sapiens
taatcccagcactgag

SEQ ID NO: 126008 - DNA, 19 bp, H. sapiens
taatcccagcactgtggga

SEQ ID NO: 126009 - DNA, 16 bp, H. sapiens
taatcccagcacttag

SEQ ID NO: 126010 - DNA, 16 bp, H. sapiens
taatcccagcacttca

SEQ ID NO: 126011 - DNA, 16 bp, H. sapiens
taatcccagcacttcc

SEQ ID NO: 126012 - DNA, 19 bp, H. sapiens
taatcccagcacttcggga

SEQ ID NO: 126013 - DNA, 16 bp, H. sapiens
taatcccagcacttct

SEQ ID NO: 126014 - DNA, 16 bp, H. sapiens
taatcccagcacttgg

SEQ ID NO: 126015 - DNA, 16 bp, H. sapiens
taatcccagcacttta

SEQ ID NO: 126016 - DNA, 16 bp, H. sapiens
taatcccagcactttc

SEQ ID NO: 126017 - DNA, 17 bp, H. sapiens
taatcccagcactttga

SEQ ID NO: 126018 - DNA, 17 bp, H. sapiens
taatcccagcactttgc

SEQ ID NO: 126019 - DNA, 18 bp, H. sapiens
taatcccagcactttgga

SEQ ID NO: 126020 - DNA, 20 bp, H. sapiens
taatcccagcactttggcag

SEQ ID NO: 126021 - DNA, 19 bp, H. sapiens
taatcccagcactttggga

SEQ ID NO: 126022 - DNA, 19 bp, H. sapiens
taatcccagcactttgggc

SEQ ID NO: 126023 - DNA, 19 bp, H. sapiens
taatcccagcactttgggg

SEQ ID NO: 126024 - DNA, 19 bp, H. sapiens
taatcccagcactttgggt

SEQ ID NO: 126025 - DNA, 18 bp, H. sapiens
taatcccagcactttggt

SEQ ID NO: 126026 - DNA, 17 bp, H. sapiens
taatcccagcactttgt

SEQ ID NO: 126027 - DNA, 16 bp, H. sapiens
taatcccagcactttt

SEQ ID NO: 126028 - DNA, 18 bp, H. sapiens
taatcccagcagtttgga

SEQ ID NO: 126029 - DNA, 19 bp, H. sapiens
taatcccagcagtttggga

SEQ ID NO: 126030 - DNA, 16 bp, H. sapiens
taatcccagcattgtg

SEQ ID NO: 126031 - DNA, 16 bp, H. sapiens
taatcccagcatttgg

SEQ ID NO: 126032 - DNA, 19 bp, H. sapiens
taatcccagcattttggga

SEQ ID NO: 126033 - DNA, 19 bp, H. sapiens
taatcccagccctttggga

SEQ ID NO: 126034 - DNA, 16 bp, H. sapiens
taatcccagcgctttc

SEQ ID NO: 126035 - DNA, 19 bp, H. sapiens
taatcccagctctttggga

SEQ ID NO: 126036 - DNA, 16 bp, H. sapiens
taatcccagctgctcc

SEQ ID NO: 126037 - DNA, 16 bp, H. sapiens
taatcccaggacttcg

SEQ ID NO: 126038 - DNA, 19 bp, H. sapiens
taatcccaggactttggga

SEQ ID NO: 126039 - DNA, 16 bp, H. sapiens
taatcccagtacttgg

SEQ ID NO: 126040 - DNA, 19 bp, H. sapiens
taatcccagtactttggga

SEQ ID NO: 126041 - DNA, 16 bp, H. sapiens
taatcccagtgcttta

SEQ ID NO: 126042 - DNA, 16 bp, H. sapiens
taatcccagtgctttg

SEQ ID NO: 126043 - DNA, 16 bp, H. sapiens
taatcccagtgctttt

SEQ ID NO: 126044 - DNA, 17 bp, H. sapiens
taatcccatcactttga

SEQ ID NO: 126045 - DNA, 19 bp, H. sapiens
taatcccatcactttggga

SEQ ID NO: 126046 - DNA, 18 bp, H. sapiens
taatccccaagacaatga

SEQ ID NO: 126047 - DNA, 16 bp, H. sapiens
taatccccaatgcaat

SEQ ID NO: 126048 - DNA, 16 bp, H. sapiens
taatccccacatgtca

SEQ ID NO: 126049 - DNA, 16 bp, H. sapiens
taatccccagatgttg

SEQ ID NO: 126050 - DNA, 16 bp, H. sapiens
taatccccatgtgtca

SEQ ID NO: 126051 - DNA, 16 bp, H. sapiens
taatccccatgtgttg

SEQ ID NO: 126052 - DNA, 19 bp, H. sapiens
taatcccgacactttggga

SEQ ID NO: 126053 - DNA, 16 bp, H. sapiens
taatccctgcactttg

SEQ ID NO: 126054 - DNA, 16 bp, H. sapiens
taatccgagtactttg

SEQ ID NO: 126055 - DNA, 16 bp, H. sapiens
taatcctaaaatttat

SEQ ID NO: 126056 - DNA, 16 bp, H. sapiens
taatcctaacacttta

SEQ ID NO: 126057 - DNA, 16 bp, H. sapiens
taatcctaacactttg

SEQ ID NO: 126058 - DNA, 16 bp, H. sapiens
taatcctaaccctttg

SEQ ID NO: 126059 - DNA, 20 bp, H. sapiens
taatcctagaactttgggag

SEQ ID NO: 126060 - DNA, 16 bp, H. sapiens
taatcctagcactctg

SEQ ID NO: 126061 - DNA, 17 bp, H. sapiens
taatcctagcactttga

SEQ ID NO: 126062 - DNA, 18 bp, H. sapiens
taatcctagcactttgga

SEQ ID NO: 126063 - DNA, 19 bp, H. sapiens
taatcctagcactttggga

SEQ ID NO: 126064 - DNA, 21 bp, H. sapiens
taatcctagcactttgggaga

SEQ ID NO: 126065 - DNA, 16 bp, H. sapiens
taatcctagcactttt

SEQ ID NO: 126066 - DNA, 16 bp, H. sapiens
taatcctagcattttg

SEQ ID NO: 126067 - DNA, 25 bp, H. sapiens
taatcctagctactcgggagactga

SEQ ID NO: 126068 - DNA, 19 bp, H. sapiens
taatcctagtactttggga

SEQ ID NO: 126069 - DNA, 16 bp, H. sapiens
taatcctagtgctttg

SEQ ID NO: 126070 - DNA, 16 bp, H. sapiens
taatcctagtgttttg

SEQ ID NO: 126071 - DNA, 16 bp, H. sapiens
taatcctcacaaccac

SEQ ID NO: 126072 - DNA, 16 bp, H. sapiens
taatcctcataataac

SEQ ID NO: 126073 - DNA, 16 bp, H. sapiens
taatcctcctgcctta

SEQ ID NO: 126074 - DNA, 16 bp, H. sapiens
taatccttgcaacaac

SEQ ID NO: 126075 - DNA, 16 bp, H. sapiens
taatcctttttaaaaa

SEQ ID NO: 126076 - DNA, 19 bp, H. sapiens
taatcgcagcactttggga

SEQ ID NO: 126077 - DNA, 16 bp, H. sapiens
taatcgcagtactttg

SEQ ID NO: 126078 - DNA, 16 bp, H. sapiens
taatcgtagcactttg

SEQ ID NO: 126079 - DNA, 16 bp, H. sapiens
taatcgtggtttttgc

SEQ ID NO: 126080 - DNA, 16 bp, H. sapiens
taatcgtggtttttgt

SEQ ID NO: 126081 - DNA, 16 bp, H. sapiens
taatctaagcttccac

SEQ ID NO: 126082 - DNA, 16 bp, H. sapiens
taatctattcatggat

SEQ ID NO: 126083 - DNA, 16 bp, H. sapiens
taatctattttctatc

SEQ ID NO: 126084 - DNA, 16 bp, H. sapiens
taatctcaaatcaaaa

SEQ ID NO: 126085 - DNA, 16 bp, H. sapiens
taatctcaaattattt

SEQ ID NO: 126086 - DNA, 16 bp, H. sapiens
taatctcaacaatttg

SEQ ID NO: 126087 - DNA, 16 bp, H. sapiens
taatctcaacactttg

SEQ ID NO: 126088 - DNA, 16 bp, H. sapiens
taatctcagcactctg

SEQ ID NO: 126089 - DNA, 19 bp, H. sapiens
taatctcagcactttggga

SEQ ID NO: 126090 - DNA, 19 bp, H. sapiens
taatctcagcattttggga

SEQ ID NO: 126091 - DNA, 16 bp, H. sapiens
taatctcatccagaaa

SEQ ID NO: 126092 - DNA, 16 bp, H. sapiens
taatctccaactcctg

SEQ ID NO: 126093 - DNA, 16 bp, H. sapiens
taatctctcccactgt

SEQ ID NO: 126094 - DNA, 16 bp, H. sapiens
taatctctctgagact

SEQ ID NO: 126095 - DNA, 16 bp, H. sapiens
taatctctggaacctg

SEQ ID NO: 126096 - DNA, 16 bp, H. sapiens
taatctctttattaaa

SEQ ID NO: 126097 - DNA, 16 bp, H. sapiens
taatctgaaatctgaa

SEQ ID NO: 126098 - DNA, 16 bp, H. sapiens
taatctgatttttaaa

SEQ ID NO: 126099 - DNA, 16 bp, H. sapiens
taatctgcaagtggat

SEQ ID NO: 126100 - DNA, 16 bp, H. sapiens
taatctgctttctgtc

SEQ ID NO: 126101 - DNA, 16 bp, H. sapiens
taatctgctttttgtc

SEQ ID NO: 126102 - DNA, 16 bp, H. sapiens
taatctggaacatttc

SEQ ID NO: 126103 - DNA, 16 bp, H. sapiens
taatctgtaaaatggg

SEQ ID NO: 126104 - DNA, 16 bp, H. sapiens
taatctgtacaagaaa

SEQ ID NO: 126105 - DNA, 16 bp, H. sapiens
taatctgtacaatgaa

SEQ ID NO: 126106 - DNA, 16 bp, H. sapiens
taatctgtcttctgtt

SEQ ID NO: 126107 - DNA, 16 bp, H. sapiens
taatctgtttacattc

SEQ ID NO: 126108 - DNA, 19 bp, H. sapiens
taatcttagcactttggga

SEQ ID NO: 126109 - DNA, 16 bp, H. sapiens
taatcttatcactttg

SEQ ID NO: 126110 - DNA, 16 bp, H. sapiens
taatcttatggggcca

SEQ ID NO: 126111 - DNA, 16 bp, H. sapiens
taatcttcacaaaaac

SEQ ID NO: 126112 - DNA, 16 bp, H. sapiens
taatcttcataacaat

SEQ ID NO: 126113 - DNA, 16 bp, H. sapiens
taatcttgtattttta

SEQ ID NO: 126114 - DNA, 16 bp, H. sapiens
taatcttgtcaaaaat

SEQ ID NO: 126115 - DNA, 16 bp, H. sapiens
taatctttaagaaatt

SEQ ID NO: 126116 - DNA, 16 bp, H. sapiens
taatctttataacaac

SEQ ID NO: 126117 - DNA, 16 bp, H. sapiens
taatctttctaaaaat

SEQ ID NO: 126118 - DNA, 16 bp, H. sapiens
taatctttgaggaaaa

SEQ ID NO: 126119 - DNA, 16 bp, H. sapiens
taatctttgctggcaa

SEQ ID NO: 126120 - DNA, 16 bp, H. sapiens
taatcttttcaataaa

SEQ ID NO: 126121 - DNA, 16 bp, H. sapiens
taatgaaaacaaatga

SEQ ID NO: 126122 - DNA, 16 bp, H. sapiens
taatgaaaacacaaca

SEQ ID NO: 126123 - DNA, 16 bp, H. sapiens
taatgaaaactgtaaa

SEQ ID NO: 126124 - DNA, 16 bp, H. sapiens
taatgaaaagaatgtg

SEQ ID NO: 126125 - DNA, 16 bp, H. sapiens
taatgaaaatgaaaac

SEQ ID NO: 126126 - DNA, 16 bp, H. sapiens
taatgaaaatggccat

SEQ ID NO: 126127 - DNA, 16 bp, H. sapiens
taatgaaaatgtttga

SEQ ID NO: 126128 - DNA, 16 bp, H. sapiens
taatgaaaccaatttt

SEQ ID NO: 126129 - DNA, 16 bp, H. sapiens
taatgaaactgaaaaa

SEQ ID NO: 126130 - DNA, 16 bp, H. sapiens
taatgaaagaaatcat

SEQ ID NO: 126131 - DNA, 16 bp, H. sapiens
taatgaaagatttttg

SEQ ID NO: 126132 - DNA, 16 bp, H. sapiens
taatgaaataatggat

SEQ ID NO: 126133 - DNA, 16 bp, H. sapiens
taatgaaataattaca

SEQ ID NO: 126134 - DNA, 16 bp, H. sapiens
taatgaaatgatgaaa

SEQ ID NO: 126135 - DNA, 16 bp, H. sapiens
taatgaaattgaaaac

SEQ ID NO: 126136 - DNA, 16 bp, H. sapiens
taatgaacaaagcctc

SEQ ID NO: 126137 - DNA, 16 bp, H. sapiens
taatgaagcttccata

SEQ ID NO: 126138 - DNA, 16 bp, H. sapiens
taatgaagtgttgaat

SEQ ID NO: 126139 - DNA, 16 bp, H. sapiens
taatgaatatgtatta

SEQ ID NO: 126140 - DNA, 16 bp, H. sapiens
taatgacaacaataat

SEQ ID NO: 126141 - DNA, 16 bp, H. sapiens
taatgacatttaaaaa

SEQ ID NO: 126142 - DNA, 16 bp, H. sapiens
taatgacattttcttt

SEQ ID NO: 126143 - DNA, 16 bp, H. sapiens
taatgagaccctgtct

SEQ ID NO: 126144 - DNA, 16 bp, H. sapiens
taatgagatcatgtct

SEQ ID NO: 126145 - DNA, 16 bp, H. sapiens
taatgaggaaactgag

SEQ ID NO: 126146 - DNA, 16 bp, H. sapiens
taatgaggagctgaat

SEQ ID NO: 126147 - DNA, 16 bp, H. sapiens
taatgaggatgtggag

SEQ ID NO: 126148 - DNA, 28 bp, H. sapiens
taatgagtctgagcatcactgggacatg

SEQ ID NO: 126149 - DNA, 16 bp, H. sapiens
taatgagtgagttctc

SEQ ID NO: 126150 - DNA, 16 bp, H. sapiens
taatgagtgtgaggtg

SEQ ID NO: 126151 - DNA, 16 bp, H. sapiens
taatgagttcatgtcc

SEQ ID NO: 126152 - DNA, 16 bp, H. sapiens
taatgatagctgatga

SEQ ID NO: 126153 - DNA, 16 bp, H. sapiens
taatgatagtgatgat

SEQ ID NO: 126154 - DNA, 16 bp, H. sapiens
taatgatcatctgagc

SEQ ID NO: 126155 - DNA, 16 bp, H. sapiens
taatgatgagcatttt

SEQ ID NO: 126156 - DNA, 16 bp, H. sapiens
taatgatgatgatgat

SEQ ID NO: 126157 - DNA, 16 bp, H. sapiens
taatgatgatgatgtt

SEQ ID NO: 126158 - DNA, 16 bp, H. sapiens
taatgatgttaagcat

SEQ ID NO: 126159 - DNA, 16 bp, H. sapiens
taatgatgttgaaaat

SEQ ID NO: 126160 - DNA, 16 bp, H. sapiens
taatgatgttgaactt

SEQ ID NO: 126161 - DNA, 16 bp, H. sapiens
taatgcaaactgttgt

SEQ ID NO: 126162 - DNA, 16 bp, H. sapiens
taatgcaaaggaaaag

SEQ ID NO: 126163 - DNA, 16 bp, H. sapiens
taatgcaataaaatat

SEQ ID NO: 126164 - DNA, 16 bp, H. sapiens
taatgcagaaaaagaa

SEQ ID NO: 126165 - DNA, 16 bp, H. sapiens
taatgcatcttaaaga

SEQ ID NO: 126166 - DNA, 16 bp, H. sapiens
taatgcattacatttt

SEQ ID NO: 126167 - DNA, 16 bp, H. sapiens
taatgcattataatta

SEQ ID NO: 126168 - DNA, 16 bp, H. sapiens
taatgccaaattattt

SEQ ID NO: 126169 - DNA, 16 bp, H. sapiens
taatgccagcacttcg

SEQ ID NO: 126170 - DNA, 16 bp, H. sapiens
taatgcccttctttgt

SEQ ID NO: 126171 - DNA, 16 bp, H. sapiens
taatgcctgatgatcc

SEQ ID NO: 126172 - DNA, 16 bp, H. sapiens
taatgctcacaacaac

SEQ ID NO: 126173 - DNA, 16 bp, H. sapiens
taatgctgcagctgat

SEQ ID NO: 126174 - DNA, 16 bp, H. sapiens
taatgcttaataaact

SEQ ID NO: 126175 - DNA, 16 bp, H. sapiens
taatgcttattttaaa

SEQ ID NO: 126176 - DNA, 16 bp, H. sapiens
taatgctttatatttt

SEQ ID NO: 126177 - DNA, 16 bp, H. sapiens
taatggaaaaaccaaa

SEQ ID NO: 126178 - DNA, 16 bp, H. sapiens
taatggaaaattacag

SEQ ID NO: 126179 - DNA, 16 bp, H. sapiens
taatggaaataaagtg

SEQ ID NO: 126180 - DNA, 16 bp, H. sapiens
taatggaagaaaatat

SEQ ID NO: 126181 - DNA, 16 bp, H. sapiens
taatggaagactttaa

SEQ ID NO: 126182 - DNA, 16 bp, H. sapiens
taatggaatcatgggg

SEQ ID NO: 126183 - DNA, 16 bp, H. sapiens
taatggacaaaataac

SEQ ID NO: 126184 - DNA, 16 bp, H. sapiens
taatggaggaacagaa

SEQ ID NO: 126185 - DNA, 16 bp, H. sapiens
taatggagtactattc

SEQ ID NO: 126186 - DNA, 16 bp, H. sapiens
taatggatacaaaatt

SEQ ID NO: 126187 - DNA, 16 bp, H. sapiens
taatggatacaaagtt

SEQ ID NO: 126188 - DNA, 16 bp, H. sapiens
taatggatgaggaaga

SEQ ID NO: 126189 - DNA, 16 bp, H. sapiens
taatggatttacagtt

SEQ ID NO: 126190 - DNA, 16 bp, H. sapiens
taatggatttttaaaa

SEQ ID NO: 126191 - DNA, 16 bp, H. sapiens
taatggcattaatccc

SEQ ID NO: 126192 - DNA, 16 bp, H. sapiens
taatggcccctgcttt

SEQ ID NO: 126193 - DNA, 16 bp, H. sapiens
taatggctgaaatttt

SEQ ID NO: 126194 - DNA, 16 bp, H. sapiens
taatggctgtgtttaa

SEQ ID NO: 126195 - DNA, 16 bp, H. sapiens
taatggcttccagttc

SEQ ID NO: 126196 - DNA, 16 bp, H. sapiens
taatgggaggctttaa

SEQ ID NO: 126197 - DNA, 16 bp, H. sapiens
taatgggcacaaaaaa

SEQ ID NO: 126198 - DNA, 16 bp, H. sapiens
taatgggtacaatgta

SEQ ID NO: 126199 - DNA, 16 bp, H. sapiens
taatggtaatttttaa

SEQ ID NO: 126200 - DNA, 16 bp, H. sapiens
taatggtctctaattc

SEQ ID NO: 126201 - DNA, 16 bp, H. sapiens
taatggtgaatacatg

SEQ ID NO: 126202 - DNA, 16 bp, H. sapiens
taatggtggaaatatt

SEQ ID NO: 126203 - DNA, 16 bp, H. sapiens
taatggttgaaaactt

SEQ ID NO: 126204 - DNA, 16 bp, H. sapiens
taatggtttttaaaaa

SEQ ID NO: 126205 - DNA, 16 bp, H. sapiens
taatggtttttccttt

SEQ ID NO: 126206 - DNA, 16 bp, H. sapiens
taatgtaaaaaagact

SEQ ID NO: 126207 - DNA, 16 bp, H. sapiens
taatgtaaaaatctaa

SEQ ID NO: 126208 - DNA, 20 bp, H. sapiens
taatgtaaaagagtcttgga

SEQ ID NO: 126209 - DNA, 16 bp, H. sapiens
taatgtaacatattca

SEQ ID NO: 126210 - DNA, 16 bp, H. sapiens
taatgtaatgtcctcc

SEQ ID NO: 126211 - DNA, 16 bp, H. sapiens
taatgtagaatcagtg

SEQ ID NO: 126212 - DNA, 16 bp, H. sapiens
taatgtataaagaaca

SEQ ID NO: 126213 - DNA, 16 bp, H. sapiens
taatgtataatgtata

SEQ ID NO: 126214 - DNA, 16 bp, H. sapiens
taatgtatacttgaaa

SEQ ID NO: 126215 - DNA, 16 bp, H. sapiens
taatgtatataatgta

SEQ ID NO: 126216 - DNA, 16 bp, H. sapiens
taatgtattcattcat

SEQ ID NO: 126217 - DNA, 16 bp, H. sapiens
taatgtattttacttt

SEQ ID NO: 126218 - DNA, 16 bp, H. sapiens
taatgtcaacactttg

SEQ ID NO: 126219 - DNA, 16 bp, H. sapiens
taatgtcaatttgttt

SEQ ID NO: 126220 - DNA, 16 bp, H. sapiens
taatgtcacaatctcc

SEQ ID NO: 126221 - DNA, 16 bp, H. sapiens
taatgtcagaattgaa

SEQ ID NO: 126222 - DNA, 16 bp, H. sapiens
taatgtcaggagctga

SEQ ID NO: 126223 - DNA, 16 bp, H. sapiens
taatgtcatgtatcca

SEQ ID NO: 126224 - DNA, 16 bp, H. sapiens
taatgtcctctggaat

SEQ ID NO: 126225 - DNA, 16 bp, H. sapiens
taatgtcctggagatt

SEQ ID NO: 126226 - DNA, 16 bp, H. sapiens
taatgtctccttttaa

SEQ ID NO: 126227 - DNA, 16 bp, H. sapiens
taatgtctgtattttt

SEQ ID NO: 126228 - DNA, 16 bp, H. sapiens
taatgtcttcaagatt

SEQ ID NO: 126229 - DNA, 16 bp, H. sapiens
taatgtcttcttttcc

SEQ ID NO: 126230 - DNA, 16 bp, H. sapiens
taatgtgaattttaaa

SEQ ID NO: 126231 - DNA, 16 bp, H. sapiens
taatgtgatattttaa

SEQ ID NO: 126232 - DNA, 16 bp, H. sapiens
taatgtgcaaaataac

SEQ ID NO: 126233 - DNA, 16 bp, H. sapiens
taatgtgcttattggc

SEQ ID NO: 126234 - DNA, 16 bp, H. sapiens
taatgtggcacatata

SEQ ID NO: 126235 - DNA, 16 bp, H. sapiens
taatgtggtaaattat

SEQ ID NO: 126236 - DNA, 16 bp, H. sapiens
taatgtgtacagagtt

SEQ ID NO: 126237 - DNA, 16 bp, H. sapiens
taatgtgtctggaatt

SEQ ID NO: 126238 - DNA, 16 bp, H. sapiens
taatgttaaatattct

SEQ ID NO: 126239 - DNA, 16 bp, H. sapiens
taatgttccattgtgt

SEQ ID NO: 126240 - DNA, 16 bp, H. sapiens
taatgttctctaggtt

SEQ ID NO: 126241 - DNA, 16 bp, H. sapiens
taatgttctttttaaa

SEQ ID NO: 126242 - DNA, 16 bp, H. sapiens
taatgttgagttttga

SEQ ID NO: 126243 - DNA, 16 bp, H. sapiens
taatgttgggtgtgtt

SEQ ID NO: 126244 - DNA, 16 bp, H. sapiens
taatgttgttttcatt

SEQ ID NO: 126245 - DNA, 16 bp, H. sapiens
taatgtttaatttaca

SEQ ID NO: 126246 - DNA, 16 bp, H. sapiens
taatgtttattaaatg

SEQ ID NO: 126247 - DNA, 16 bp, H. sapiens
taatgtttattaagca

SEQ ID NO: 126248 - DNA, 16 bp, H. sapiens
taatgtttattatttc

SEQ ID NO: 126249 - DNA, 16 bp, H. sapiens
taatgtttgtatcttt

SEQ ID NO: 126250 - DNA, 16 bp, H. sapiens
taatgttttctattta

SEQ ID NO: 126251 - DNA, 16 bp, H. sapiens
taatgttttctgattt

SEQ ID NO: 126252 - DNA, 16 bp, H. sapiens
taatgttttctttaaa

SEQ ID NO: 126253 - DNA, 16 bp, H. sapiens
taatgtttttaaggtt

SEQ ID NO: 126254 - DNA, 16 bp, H. sapiens
taatgtttttgaggtt

SEQ ID NO: 126255 - DNA, 16 bp, H. sapiens
taatgttttttaaaca

SEQ ID NO: 126256 - DNA, 16 bp, H. sapiens
taattaaaacagaaat

SEQ ID NO: 126257 - DNA, 16 bp, H. sapiens
taattaaagaaaaact

SEQ ID NO: 126258 - DNA, 16 bp, H. sapiens
taattaaatatgcttt

SEQ ID NO: 126259 - DNA, 16 bp, H. sapiens
taattaaatgtacatt

SEQ ID NO: 126260 - DNA, 16 bp, H. sapiens
taattaaattatgggg

SEQ ID NO: 126261 - DNA, 16 bp, H. sapiens
taattacaaagagaaa

SEQ ID NO: 126262 - DNA, 16 bp, H. sapiens
taattacaacaacttt

SEQ ID NO: 126263 - DNA, 16 bp, H. sapiens
taattacaataaatgt

SEQ ID NO: 126264 - DNA, 16 bp, H. sapiens
taattacagaagaaaa

SEQ ID NO: 126265 - DNA, 16 bp, H. sapiens
taattacagtatttta

SEQ ID NO: 126266 - DNA, 16 bp, H. sapiens
taattacatctgcaaa

SEQ ID NO: 126267 - DNA, 16 bp, H. sapiens
taattacatctgtaaa

SEQ ID NO: 126268 - DNA, 16 bp, H. sapiens
taattacattcacaat

SEQ ID NO: 126269 - DNA, 16 bp, H. sapiens
taattacattttgttt

SEQ ID NO: 126270 - DNA, 16 bp, H. sapiens
taattacatttttgta

SEQ ID NO: 126271 - DNA, 16 bp, H. sapiens
taattaccctggccag

SEQ ID NO: 126272 - DNA, 16 bp, H. sapiens
taattacctcccaaag

SEQ ID NO: 126273 - DNA, 16 bp, H. sapiens
taattactaaaatgta

SEQ ID NO: 126274 - DNA, 16 bp, H. sapiens
taattactataacttt

SEQ ID NO: 126275 - DNA, 16 bp, H. sapiens
taattactgtattttg

SEQ ID NO: 126276 - DNA, 16 bp, H. sapiens
taattactgtattttt

SEQ ID NO: 126277 - DNA, 16 bp, H. sapiens
taattactttgaatgt

SEQ ID NO: 126278 - DNA, 16 bp, H. sapiens
taattagaaaacccca

SEQ ID NO: 126279 - DNA, 16 bp, H. sapiens
taattagaaataaaca

SEQ ID NO: 126280 - DNA, 16 bp, H. sapiens
taattagcatataatt

SEQ ID NO: 126281 - DNA, 16 bp, H. sapiens
taattagcatattcat

SEQ ID NO: 126282 - DNA, 16 bp, H. sapiens
taattagcctgatttg

SEQ ID NO: 126283 - DNA, 16 bp, H. sapiens
taattagcttgattat

SEQ ID NO: 126284 - DNA, 16 bp, H. sapiens
taattagcttgattgt

SEQ ID NO: 126285 - DNA, 16 bp, H. sapiens
taattaggaaaagagg

SEQ ID NO: 126286 - DNA, 16 bp, H. sapiens
taattagtgatgctga

SEQ ID NO: 126287 - DNA, 16 bp, H. sapiens
taattatagattcaca

SEQ ID NO: 126288 - DNA, 16 bp, H. sapiens
taattatagatttaca

SEQ ID NO: 126289 - DNA, 16 bp, H. sapiens
taattatctcaaaata

SEQ ID NO: 126290 - DNA, 16 bp, H. sapiens
taattatcttccaaag

SEQ ID NO: 126291 - DNA, 16 bp, H. sapiens
taattattagagaaat

SEQ ID NO: 126292 - DNA, 16 bp, H. sapiens
taattattagtgatgt

SEQ ID NO: 126293 - DNA, 16 bp, H. sapiens
taattattatagcttt

SEQ ID NO: 126294 - DNA, 16 bp, H. sapiens
taattattgccattct

SEQ ID NO: 126295 - DNA, 16 bp, H. sapiens
taattatttacttttg

SEQ ID NO: 126296 - DNA, 16 bp, H. sapiens
taattatttctttgta

SEQ ID NO: 126297 - DNA, 16 bp, H. sapiens
taattatttgcctttt

SEQ ID NO: 126298 - DNA, 16 bp, H. sapiens
taattatttgttgtgg

SEQ ID NO: 126299 - DNA, 16 bp, H. sapiens
taattcaacccatggg

SEQ ID NO: 126300 - DNA, 16 bp, H. sapiens
taattcaagaaagaaa

SEQ ID NO: 126301 - DNA, 16 bp, H. sapiens
taattcaatatgactg

SEQ ID NO: 126302 - DNA, 16 bp, H. sapiens
taattcacacaccata

SEQ ID NO: 126303 - DNA, 16 bp, H. sapiens
taattcacatgccata

SEQ ID NO: 126304 - DNA, 16 bp, H. sapiens
taattcagaagaaaaa

SEQ ID NO: 126305 - DNA, 16 bp, H. sapiens
taattcagccactgtg

SEQ ID NO: 126306 - DNA, 16 bp, H. sapiens
taattcatcttcagtt

SEQ ID NO: 126307 - DNA, 16 bp, H. sapiens
taattcatttgtttat

SEQ ID NO: 126308 - DNA, 16 bp, H. sapiens
taattcattttaagaa

SEQ ID NO: 126309 - DNA, 16 bp, H. sapiens
taattcatttttattg

SEQ ID NO: 126310 - DNA, 16 bp, H. sapiens
taattccaacactttg

SEQ ID NO: 126311 - DNA, 16 bp, H. sapiens
taattccagaacattt

SEQ ID NO: 126312 - DNA, 16 bp, H. sapiens
taattccagcacttgg

SEQ ID NO: 126313 - DNA, 17 bp, H. sapiens
taattccagcactttga

SEQ ID NO: 126314 - DNA, 16 bp, H. sapiens
taattccagcatgttg

SEQ ID NO: 126315 - DNA, 16 bp, H. sapiens
taattccaggactttg

SEQ ID NO: 126316 - DNA, 16 bp, H. sapiens
taattcccattttaca

SEQ ID NO: 126317 - DNA, 16 bp, H. sapiens
taattcctggaacctg

SEQ ID NO: 126318 - DNA, 16 bp, H. sapiens
taattctagcactttg

SEQ ID NO: 126319 - DNA, 16 bp, H. sapiens
taattctcacaacaat

SEQ ID NO: 126320 - DNA, 16 bp, H. sapiens
taattctcacaactct

SEQ ID NO: 126321 - DNA, 16 bp, H. sapiens
taattctcagaacaac

SEQ ID NO: 126322 - DNA, 16 bp, H. sapiens
taattctcattgtaaa

SEQ ID NO: 126323 - DNA, 16 bp, H. sapiens
taattctccagcctca

SEQ ID NO: 126324 - DNA, 16 bp, H. sapiens
taattctgaaattatt

SEQ ID NO: 126325 - DNA, 16 bp, H. sapiens
taattctgattttaaa

SEQ ID NO: 126326 - DNA, 16 bp, H. sapiens
taattctgtatataaa

SEQ ID NO: 126327 - DNA, 16 bp, H. sapiens
taattctgtcattcct

SEQ ID NO: 126328 - DNA, 16 bp, H. sapiens
taattctgtgagttga

SEQ ID NO: 126329 - DNA, 16 bp, H. sapiens
taattctgttaaaaat

SEQ ID NO: 126330 - DNA, 16 bp, H. sapiens
taattcttatctttgt

SEQ ID NO: 126331 - DNA, 16 bp, H. sapiens
taattcttgcattttt

SEQ ID NO: 126332 - DNA, 16 bp, H. sapiens
taattcttgggtgttt

SEQ ID NO: 126333 - DNA, 16 bp, H. sapiens
taattcttgtaatttt

SEQ ID NO: 126334 - DNA, 16 bp, H. sapiens
taattctttattgtgg

SEQ ID NO: 126335 - DNA, 16 bp, H. sapiens
taattctttgttttgg

SEQ ID NO: 126336 - DNA, 16 bp, H. sapiens
taattctttttatgtg

SEQ ID NO: 126337 - DNA, 16 bp, H. sapiens
taattgaatcatgaag

SEQ ID NO: 126338 - DNA, 16 bp, H. sapiens
taattgaatcatgggg

SEQ ID NO: 126339 - DNA, 16 bp, H. sapiens
taattgagattattaa

SEQ ID NO: 126340 - DNA, 16 bp, H. sapiens
taattgataattgaag

SEQ ID NO: 126341 - DNA, 16 bp, H. sapiens
taattgatataaacaa

SEQ ID NO: 126342 - DNA, 16 bp, H. sapiens
taattgattttgaaat

SEQ ID NO: 126343 - DNA, 16 bp, H. sapiens
taattgcaaaaacaaa

SEQ ID NO: 126344 - DNA, 16 bp, H. sapiens
taattgcatggttttg

SEQ ID NO: 126345 - DNA, 16 bp, H. sapiens
taattgcctttctttt

SEQ ID NO: 126346 - DNA, 16 bp, H. sapiens
taattgctttatattt

SEQ ID NO: 126347 - DNA, 16 bp, H. sapiens
taattggagcattttg

SEQ ID NO: 126348 - DNA, 16 bp, H. sapiens
taattggattatttgt

SEQ ID NO: 126349 - DNA, 16 bp, H. sapiens
taattggattgtttgt

SEQ ID NO: 126350 - DNA, 16 bp, H. sapiens
taattggatttttaaa

SEQ ID NO: 126351 - DNA, 17 bp, H. sapiens
taattggcatagacata

SEQ ID NO: 126352 - DNA, 16 bp, H. sapiens
taattgggatatccat

SEQ ID NO: 126353 - DNA, 16 bp, H. sapiens
taattggtctggggtg

SEQ ID NO: 126354 - DNA, 16 bp, H. sapiens
taattggttacagcag

SEQ ID NO: 126355 - DNA, 16 bp, H. sapiens
taattggttttttaca

SEQ ID NO: 126356 - DNA, 16 bp, H. sapiens
taattgtatagttttg

SEQ ID NO: 126357 - DNA, 16 bp, H. sapiens
taattgtcagattcag

SEQ ID NO: 126358 - DNA, 16 bp, H. sapiens
taattgtgataaaata

SEQ ID NO: 126359 - DNA, 16 bp, H. sapiens
taattgtgattttaaa

SEQ ID NO: 126360 - DNA, 16 bp, H. sapiens
taattgtgtggaatga

SEQ ID NO: 126361 - DNA, 16 bp, H. sapiens
taatttaaaaagtcaa

SEQ ID NO: 126362 - DNA, 16 bp, H. sapiens
taatttaaaaatcact

SEQ ID NO: 126363 - DNA, 16 bp, H. sapiens
taatttaaaagttcat

SEQ ID NO: 126364 - DNA, 16 bp, H. sapiens
taatttaacaaaagaa

SEQ ID NO: 126365 - DNA, 16 bp, H. sapiens
taatttaatcttcatg

SEQ ID NO: 126366 - DNA, 16 bp, H. sapiens
taatttacacatattt

SEQ ID NO: 126367 - DNA, 16 bp, H. sapiens
taatttacacttccat

SEQ ID NO: 126368 - DNA, 16 bp, H. sapiens
taatttacatgaaaat

SEQ ID NO: 126369 - DNA, 16 bp, H. sapiens
taatttacatgtattt

SEQ ID NO: 126370 - DNA, 16 bp, H. sapiens
taatttactttgaaat

SEQ ID NO: 126371 - DNA, 16 bp, H. sapiens
taatttagaaaacaaa

SEQ ID NO: 126372 - DNA, 16 bp, H. sapiens
taatttagactttcaa

SEQ ID NO: 126373 - DNA, 16 bp, H. sapiens
taatttataaaagcaa

SEQ ID NO: 126374 - DNA, 16 bp, H. sapiens
taatttataaacaaga

SEQ ID NO: 126375 - DNA, 16 bp, H. sapiens
taatttataaattcag

SEQ ID NO: 126376 - DNA, 16 bp, H. sapiens
taatttataacaatct

SEQ ID NO: 126377 - DNA, 16 bp, H. sapiens
taatttatacagaaaa

SEQ ID NO: 126378 - DNA, 16 bp, H. sapiens
taatttatataccata

SEQ ID NO: 126379 - DNA, 16 bp, H. sapiens
taatttatgaagtaaa

SEQ ID NO: 126380 - DNA, 16 bp, H. sapiens
taatttattctctttg

SEQ ID NO: 126381 - DNA, 16 bp, H. sapiens
taatttatttcagaaa

SEQ ID NO: 126382 - DNA, 16 bp, H. sapiens
taatttatttgacatt

SEQ ID NO: 126383 - DNA, 16 bp, H. sapiens
taatttatttgcttat

SEQ ID NO: 126384 - DNA, 16 bp, H. sapiens
taatttcaaaaaagaa

SEQ ID NO: 126385 - DNA, 16 bp, H. sapiens
taatttcaaaattgtt

SEQ ID NO: 126386 - DNA, 16 bp, H. sapiens
taatttcacataattt

SEQ ID NO: 126387 - DNA, 16 bp, H. sapiens
taatttcagaaaaata

SEQ ID NO: 126388 - DNA, 16 bp, H. sapiens
taatttcagaaaataa

SEQ ID NO: 126389 - DNA, 16 bp, H. sapiens
taatttcagaaataat

SEQ ID NO: 126390 - DNA, 16 bp, H. sapiens
taatttcagatttttt

SEQ ID NO: 126391 - DNA, 16 bp, H. sapiens
taatttcaggtttttt

SEQ ID NO: 126392 - DNA, 16 bp, H. sapiens
taatttcagtttcttt

SEQ ID NO: 126393 - DNA, 16 bp, H. sapiens
taatttcataatgata

SEQ ID NO: 126394 - DNA, 16 bp, H. sapiens
taatttcatcatttca

SEQ ID NO: 126395 - DNA, 16 bp, H. sapiens
taatttcatgtttatt

SEQ ID NO: 126396 - DNA, 16 bp, H. sapiens
taatttcatttttctg

SEQ ID NO: 126397 - DNA, 16 bp, H. sapiens
taatttcatttttgat

SEQ ID NO: 126398 - DNA, 16 bp, H. sapiens
taatttccaaaagaaa

SEQ ID NO: 126399 - DNA, 16 bp, H. sapiens
taatttccaaaatata

SEQ ID NO: 126400 - DNA, 16 bp, H. sapiens
taatttccaaatgttt

SEQ ID NO: 126401 - DNA, 16 bp, H. sapiens
taatttccacacattt

SEQ ID NO: 126402 - DNA, 16 bp, H. sapiens
taatttccagtttaat

SEQ ID NO: 126403 - DNA, 16 bp, H. sapiens
taatttccattaaaaa

SEQ ID NO: 126404 - DNA, 16 bp, H. sapiens
taatttccttcaagaa

SEQ ID NO: 126405 - DNA, 16 bp, H. sapiens
taatttctaaagaaaa

SEQ ID NO: 126406 - DNA, 16 bp, H. sapiens
taatttctaagaaatt

SEQ ID NO: 126407 - DNA, 16 bp, H. sapiens
taatttctaagatttt

SEQ ID NO: 126408 - DNA, 16 bp, H. sapiens
taatttctattgattt

SEQ ID NO: 126409 - DNA, 16 bp, H. sapiens
taatttctcctcagaa

SEQ ID NO: 126410 - DNA, 16 bp, H. sapiens
taatttctgaaataaa

SEQ ID NO: 126411 - DNA, 16 bp, H. sapiens
taatttctgcattttt

SEQ ID NO: 126412 - DNA, 16 bp, H. sapiens
taatttctgcttttta

SEQ ID NO: 126413 - DNA, 16 bp, H. sapiens
taatttctgtgtattt

SEQ ID NO: 126414 - DNA, 16 bp, H. sapiens
taatttctgttttcct

SEQ ID NO: 126415 - DNA, 16 bp, H. sapiens
taatttctttcattga

SEQ ID NO: 126416 - DNA, 16 bp, H. sapiens
taatttctttgagaaa

SEQ ID NO: 126417 - DNA, 16 bp, H. sapiens
taatttgagaaaattt

SEQ ID NO: 126418 - DNA, 16 bp, H. sapiens
taatttgattttggaa

SEQ ID NO: 126419 - DNA, 16 bp, H. sapiens
taatttgcaaaaaaaa

SEQ ID NO: 126420 - DNA, 16 bp, H. sapiens
taatttgcaaaatttt

SEQ ID NO: 126421 - DNA, 16 bp, H. sapiens
taatttgcaaagaaaa

SEQ ID NO: 126422 - DNA, 16 bp, H. sapiens
taatttgcacatattt

SEQ ID NO: 126423 - DNA, 16 bp, H. sapiens
taatttgcattatttt

SEQ ID NO: 126424 - DNA, 16 bp, H. sapiens
taatttgcattcccac

SEQ ID NO: 126425 - DNA, 16 bp, H. sapiens
taatttgcatttcaaa

SEQ ID NO: 126426 - DNA, 16 bp, H. sapiens
taatttgcatttcttt

SEQ ID NO: 126427 - DNA, 16 bp, H. sapiens
taatttgcttgattta

SEQ ID NO: 126428 - DNA, 16 bp, H. sapiens
taatttggggaaattt

SEQ ID NO: 126429 - DNA, 16 bp, H. sapiens
taatttgggtttgtct

SEQ ID NO: 126430 - DNA, 16 bp, H. sapiens
taatttggtcttgagg

SEQ ID NO: 126431 - DNA, 16 bp, H. sapiens
taatttgtctatttct

SEQ ID NO: 126432 - DNA, 16 bp, H. sapiens
taatttgtgaagaaaa

SEQ ID NO: 126433 - DNA, 16 bp, H. sapiens
taatttgttacatagc

SEQ ID NO: 126434 - DNA, 16 bp, H. sapiens
taatttgttatagcag

SEQ ID NO: 126435 - DNA, 16 bp, H. sapiens
taatttgtttattcat

SEQ ID NO: 126436 - DNA, 16 bp, H. sapiens
taattttaaagcattt

SEQ ID NO: 126437 - DNA, 16 bp, H. sapiens
taattttaaatgtcaa

SEQ ID NO: 126438 - DNA, 16 bp, H. sapiens
taattttaacaaagtt

SEQ ID NO: 126439 - DNA, 16 bp, H. sapiens
taattttaactttgtg

SEQ ID NO: 126440 - DNA, 16 bp, H. sapiens
taattttaacttttgt

SEQ ID NO: 126441 - DNA, 16 bp, H. sapiens
taattttaatcacata

SEQ ID NO: 126442 - DNA, 16 bp, H. sapiens
taattttacctgtttc

SEQ ID NO: 126443 - DNA, 16 bp, H. sapiens
taattttacttctaag

SEQ ID NO: 126444 - DNA, 16 bp, H. sapiens
taattttacttttaag

SEQ ID NO: 126445 - DNA, 16 bp, H. sapiens
taattttagacattct

SEQ ID NO: 126446 - DNA, 16 bp, H. sapiens
taattttagattttca

SEQ ID NO: 126447 - DNA, 16 bp, H. sapiens
taattttatatgtcaa

SEQ ID NO: 126448 - DNA, 16 bp, H. sapiens
taattttcaaatattg

SEQ ID NO: 126449 - DNA, 16 bp, H. sapiens
taattttcaaattgtt

SEQ ID NO: 126450 - DNA, 16 bp, H. sapiens
taattttcagcctttt

SEQ ID NO: 126451 - DNA, 16 bp, H. sapiens
taattttcatgtgtca

SEQ ID NO: 126452 - DNA, 16 bp, H. sapiens
taattttcatttcact

SEQ ID NO: 126453 - DNA, 16 bp, H. sapiens
taattttccaaacttt

SEQ ID NO: 126454 - DNA, 16 bp, H. sapiens
taattttcccatctca

SEQ ID NO: 126455 - DNA, 16 bp, H. sapiens
taattttcctaaatat

SEQ ID NO: 126456 - DNA, 16 bp, H. sapiens
taattttctaaagttt

SEQ ID NO: 126457 - DNA, 16 bp, H. sapiens
taattttctagaaaaa

SEQ ID NO: 126458 - DNA, 16 bp, H. sapiens
taattttctatgaatt

SEQ ID NO: 126459 - DNA, 16 bp, H. sapiens
taattttctcactgtt

SEQ ID NO: 126460 - DNA, 16 bp, H. sapiens
taattttctctattgt

SEQ ID NO: 126461 - DNA, 16 bp, H. sapiens
taattttctcttcttg

SEQ ID NO: 126462 - DNA, 16 bp, H. sapiens
taattttctgttttga

SEQ ID NO: 126463 - DNA, 16 bp, H. sapiens
taattttcttcatgtt

SEQ ID NO: 126464 - DNA, 16 bp, H. sapiens
taattttctttgtgat

SEQ ID NO: 126465 - DNA, 16 bp, H. sapiens
taattttgaaaacttt

SEQ ID NO: 126466 - DNA, 16 bp, H. sapiens
taattttgaaatgatt

SEQ ID NO: 126467 - DNA, 16 bp, H. sapiens
taattttgaaatgtgt

SEQ ID NO: 126468 - DNA, 16 bp, H. sapiens
taattttgaagtaaaa

SEQ ID NO: 126469 - DNA, 16 bp, H. sapiens
taattttgagaaaatt

SEQ ID NO: 126470 - DNA, 16 bp, H. sapiens
taattttgatgaattg

SEQ ID NO: 126471 - DNA, 16 bp, H. sapiens
taattttgcatgtttt

SEQ ID NO: 126472 - DNA, 16 bp, H. sapiens
taattttgcatttgtt

SEQ ID NO: 126473 - DNA, 16 bp, H. sapiens
taattttgcatttttg

SEQ ID NO: 126474 - DNA, 16 bp, H. sapiens
taattttgctagatat

SEQ ID NO: 126475 - DNA, 16 bp, H. sapiens
taattttgctcatttt

SEQ ID NO: 126476 - DNA, 16 bp, H. sapiens
taattttgctttaaat

SEQ ID NO: 126477 - DNA, 16 bp, H. sapiens
taattttgctttaatt

SEQ ID NO: 126478 - DNA, 16 bp, H. sapiens
taattttggcaaaata

SEQ ID NO: 126479 - DNA, 16 bp, H. sapiens
taattttgtatcttga

SEQ ID NO: 126480 - DNA, 16 bp, H. sapiens
taattttgtgataaaa

SEQ ID NO: 126481 - DNA, 16 bp, H. sapiens
taattttgtgttttca

SEQ ID NO: 126482 - DNA, 16 bp, H. sapiens
taattttgttgaaaat

SEQ ID NO: 126483 - DNA, 16 bp, H. sapiens
taattttgttttcaaa

SEQ ID NO: 126484 - DNA, 16 bp, H. sapiens
taatttttaaaacaag

SEQ ID NO: 126485 - DNA, 16 bp, H. sapiens
taatttttaaagctat

SEQ ID NO: 126486 - DNA, 16 bp, H. sapiens
taatttttaagagtgt

SEQ ID NO: 126487 - DNA, 16 bp, H. sapiens
taatttttaatgtctt

SEQ ID NO: 126488 - DNA, 16 bp, H. sapiens
taatttttagaaagat

SEQ ID NO: 126489 - DNA, 16 bp, H. sapiens
taatttttatatgcat

SEQ ID NO: 126490 - DNA, 16 bp, H. sapiens
taatttttcaacaaat

SEQ ID NO: 126491 - DNA, 16 bp, H. sapiens
taatttttccttttgg

SEQ ID NO: 126492 - DNA, 16 bp, H. sapiens
taatttttctaaagta

SEQ ID NO: 126493 - DNA, 16 bp, H. sapiens
taatttttctgaactt

SEQ ID NO: 126494 - DNA, 16 bp, H. sapiens
taatttttctgagcct

SEQ ID NO: 126495 - DNA, 16 bp, H. sapiens
taatttttctgtagag

SEQ ID NO: 126496 - DNA, 16 bp, H. sapiens
taatttttctgtatat

SEQ ID NO: 126497 - DNA, 16 bp, H. sapiens
taatttttcttctgct

SEQ ID NO: 126498 - DNA, 16 bp, H. sapiens
taatttttgaaaactt

SEQ ID NO: 126499 - DNA, 16 bp, H. sapiens
taatttttgaactttt

SEQ ID NO: 126500 - DNA, 16 bp, H. sapiens
taatttttgacatttt

SEQ ID NO: 126501 - DNA, 16 bp, H. sapiens
taatttttgcatatat

SEQ ID NO: 126502 - DNA, 16 bp, H. sapiens
taatttttgcatattt

SEQ ID NO: 126503 - DNA, 16 bp, H. sapiens
taatttttgccagtct

SEQ ID NO: 126504 - DNA, 16 bp, H. sapiens
taatttttggagaaat

SEQ ID NO: 126505 - DNA, 16 bp, H. sapiens
taatttttgtaaagat

SEQ ID NO: 126506 - DNA, 16 bp, H. sapiens
taatttttgtactctt

SEQ ID NO: 126507 - DNA, 16 bp, H. sapiens
taatttttgtagagac

SEQ ID NO: 126508 - DNA, 16 bp, H. sapiens
taatttttgtcattct

SEQ ID NO: 126509 - DNA, 16 bp, H. sapiens
taatttttgtcttctc

SEQ ID NO: 126510 - DNA, 16 bp, H. sapiens
taatttttgtgtatga

SEQ ID NO: 126511 - DNA, 16 bp, H. sapiens
taattttttagcattt

SEQ ID NO: 126512 - DNA, 16 bp, H. sapiens
taattttttcagaaaa

SEQ ID NO: 126513 - DNA, 16 bp, H. sapiens
taattttttgagaaaa

SEQ ID NO: 126514 - DNA, 16 bp, H. sapiens
taatttttttccaaaa

SEQ ID NO: 126515 - DNA, 16 bp, H. sapiens
taatttttttgtagag

SEQ ID NO: 126516 - DNA, 16 bp, H. sapiens
taattttttttccagt

SEQ ID NO: 126517 - DNA, 16 bp, H. sapiens
tacaaaaaagttaaag

SEQ ID NO: 126518 - DNA, 16 bp, H. sapiens
tacaaaaaataaccag

SEQ ID NO: 126519 - DNA, 16 bp, H. sapiens
tacaaaaaataagcca

SEQ ID NO: 126520 - DNA, 16 bp, H. sapiens
tacaaaaaataattag

SEQ ID NO: 126521 - DNA, 16 bp, H. sapiens
tacaaaaacaggcagc

SEQ ID NO: 126522 - DNA, 16 bp, H. sapiens
tacaaaaacatggaaa

SEQ ID NO: 126523 - DNA, 16 bp, H. sapiens
tacaaaaagacttaga

SEQ ID NO: 126524 - DNA, 16 bp, H. sapiens
tacaaaaagattattt

SEQ ID NO: 126525 - DNA, 16 bp, H. sapiens
tacaaaaagtctgttt

SEQ ID NO: 126526 - DNA, 16 bp, H. sapiens
tacaaaaatactgttt

SEQ ID NO: 126527 - DNA, 16 bp, H. sapiens
tacaaaaatatcttct

SEQ ID NO: 126528 - DNA, 16 bp, H. sapiens
tacaaaaatcaaatga

SEQ ID NO: 126529 - DNA, 16 bp, H. sapiens
tacaaaaatcctcaat

SEQ ID NO: 126530 - DNA, 16 bp, H. sapiens
tacaaaaatccttaac

SEQ ID NO: 126531 - DNA, 16 bp, H. sapiens
tacaaaaattagctgc

SEQ ID NO: 126532 - DNA, 16 bp, H. sapiens
tacaaaaatttgctga

SEQ ID NO: 126533 - DNA, 16 bp, H. sapiens
tacaaaacaatgaatt

SEQ ID NO: 126534 - DNA, 16 bp, H. sapiens
tacaaaacactgctga

SEQ ID NO: 126535 - DNA, 16 bp, H. sapiens
tacaaaaccagtgttt

SEQ ID NO: 126536 - DNA, 16 bp, H. sapiens
tacaaaaccatttttt

SEQ ID NO: 126537 - DNA, 16 bp, H. sapiens
tacaaaagaaaaaggt

SEQ ID NO: 126538 - DNA, 16 bp, H. sapiens
tacaaaagaatatata

SEQ ID NO: 126539 - DNA, 16 bp, H. sapiens
tacaaaagatttaaaa

SEQ ID NO: 126540 - DNA, 16 bp, H. sapiens
tacaaaagtcaaaaag

SEQ ID NO: 126541 - DNA, 16 bp, H. sapiens
tacaaaagttttaaat

SEQ ID NO: 126542 - DNA, 16 bp, H. sapiens
tacaaaatagcagata

SEQ ID NO: 126543 - DNA, 16 bp, H. sapiens
tacaaaatatatatgt

SEQ ID NO: 126544 - DNA, 16 bp, H. sapiens
tacaaaatattttctt

SEQ ID NO: 126545 - DNA, 16 bp, H. sapiens
tacaaaatgaagataa

SEQ ID NO: 126546 - DNA, 16 bp, H. sapiens
tacaaaatgagtgttt

SEQ ID NO: 126547 - DNA, 16 bp, H. sapiens
tacaaaatggaataaa

SEQ ID NO: 126548 - DNA, 16 bp, H. sapiens
tacaaaatgtcaaaat

SEQ ID NO: 126549 - DNA, 16 bp, H. sapiens
tacaaaatgttgctga

SEQ ID NO: 126550 - DNA, 16 bp, H. sapiens
tacaaaatgtttttat

SEQ ID NO: 126551 - DNA, 16 bp, H. sapiens
tacaaaattctgatga

SEQ ID NO: 126552 - DNA, 16 bp, H. sapiens
tacaaaatttcagtta

SEQ ID NO: 126553 - DNA, 16 bp, H. sapiens
tacaaacaaaagaggt

SEQ ID NO: 126554 - DNA, 16 bp, H. sapiens
tacaaacaaccccatc

SEQ ID NO: 126555 - DNA, 16 bp, H. sapiens
tacaaacattcagacc

SEQ ID NO: 126556 - DNA, 16 bp, H. sapiens
tacaaaccaaggaaca

SEQ ID NO: 126557 - DNA, 18 bp, H. sapiens
tacaaaccactgctcaaa

SEQ ID NO: 126558 - DNA, 16 bp, H. sapiens
tacaaacctggacagc

SEQ ID NO: 126559 - DNA, 16 bp, H. sapiens
tacaaacttgtacagc

SEQ ID NO: 126560 - DNA, 16 bp, H. sapiens
tacaaactttacaaaa

SEQ ID NO: 126561 - DNA, 16 bp, H. sapiens
tacaaagaaaaccaca

SEQ ID NO: 126562 - DNA, 16 bp, H. sapiens
tacaaagaaaactcca

SEQ ID NO: 126563 - DNA, 16 bp, H. sapiens
tacaaagaaacttaga

SEQ ID NO: 126564 - DNA, 16 bp, H. sapiens
tacaaagaaatacctg

SEQ ID NO: 126565 - DNA, 16 bp, H. sapiens
tacaaagaaatcagaa

SEQ ID NO: 126566 - DNA, 16 bp, H. sapiens
tacaaagaactttctt

SEQ ID NO: 126567 - DNA, 16 bp, H. sapiens
tacaaagaatttttaa

SEQ ID NO: 126568 - DNA, 16 bp, H. sapiens
tacaaagagaactaca

SEQ ID NO: 126569 - DNA, 23 bp, H. sapiens
tacaaagaggagctggtaccatt

SEQ ID NO: 126570 - DNA, 16 bp, H. sapiens
tacaaagattttttaa

SEQ ID NO: 126571 - DNA, 16 bp, H. sapiens
tacaaagattttttta

SEQ ID NO: 126572 - DNA, 16 bp, H. sapiens
tacaaagcctgcctcc

SEQ ID NO: 126573 - DNA, 16 bp, H. sapiens
tacaaagctacagcaa

SEQ ID NO: 126574 - DNA, 16 bp, H. sapiens
tacaaagctacagtaa

SEQ ID NO: 126575 - DNA, 16 bp, H. sapiens
tacaaagctatagtaa

SEQ ID NO: 126576 - DNA, 16 bp, H. sapiens
tacaaaggaacaaaga

SEQ ID NO: 126577 - DNA, 16 bp, H. sapiens
tacaaaggagaaaact

SEQ ID NO: 126578 - DNA, 16 bp, H. sapiens
tacaaaggtgccaaga

SEQ ID NO: 126579 - DNA, 16 bp, H. sapiens
tacaaagtaaaaatat

SEQ ID NO: 126580 - DNA, 16 bp, H. sapiens
tacaaagtatacaaaa

SEQ ID NO: 126581 - DNA, 16 bp, H. sapiens
tacaaagtattttttt

SEQ ID NO: 126582 - DNA, 16 bp, H. sapiens
tacaaagtgagcacat

SEQ ID NO: 126583 - DNA, 16 bp, H. sapiens
tacaaagtttcagtta

SEQ ID NO: 126584 - DNA, 16 bp, H. sapiens
tacaaataatgttgct

SEQ ID NO: 126585 - DNA, 16 bp, H. sapiens
tacaaatacaattttt

SEQ ID NO: 126586 - DNA, 16 bp, H. sapiens
tacaaatataaagaat

SEQ ID NO: 126587 - DNA, 16 bp, H. sapiens
tacaaatataacttta

SEQ ID NO: 126588 - DNA, 16 bp, H. sapiens
tacaaatatgtaaaaa

SEQ ID NO: 126589 - DNA, 16 bp, H. sapiens
tacaaatatgtatata

SEQ ID NO: 126590 - DNA, 16 bp, H. sapiens
tacaaatattttacaa

SEQ ID NO: 126591 - DNA, 16 bp, H. sapiens
tacaaatattttcatt

SEQ ID NO: 126592 - DNA, 16 bp, H. sapiens
tacaaatgaaaacaat

SEQ ID NO: 126593 - DNA, 16 bp, H. sapiens
tacaaatgaagaaaat

SEQ ID NO: 126594 - DNA, 16 bp, H. sapiens
tacaaatgaagaaatt

SEQ ID NO: 126595 - DNA, 16 bp, H. sapiens
tacaaatgagaaaact

SEQ ID NO: 126596 - DNA, 16 bp, H. sapiens
tacaaatgcaaaaatt

SEQ ID NO: 126597 - DNA, 16 bp, H. sapiens
tacaaatggcaaagag

SEQ ID NO: 126598 - DNA, 16 bp, H. sapiens
tacaaatgtaaaaaat

SEQ ID NO: 126599 - DNA, 16 bp, H. sapiens
tacaaatgtaatcatt

SEQ ID NO: 126600 - DNA, 16 bp, H. sapiens
tacaaatgtatttaat

SEQ ID NO: 126601 - DNA, 16 bp, H. sapiens
tacaaatgtgaaaaat

SEQ ID NO: 126602 - DNA, 16 bp, H. sapiens
tacaaatgtggaaact

SEQ ID NO: 126603 - DNA, 16 bp, H. sapiens
tacaaatgtttttctt

SEQ ID NO: 126604 - DNA, 16 bp, H. sapiens
tacaaattataaaaag

SEQ ID NO: 126605 - DNA, 16 bp, H. sapiens
tacaaatttacaaatt

SEQ ID NO: 126606 - DNA, 16 bp, H. sapiens
tacaaatttattatct

SEQ ID NO: 126607 - DNA, 16 bp, H. sapiens
tacaaatttcaaattt

SEQ ID NO: 126608 - DNA, 16 bp, H. sapiens
tacaacaaagaattat

SEQ ID NO: 126609 - DNA, 16 bp, H. sapiens
tacaacaaatccctgt

SEQ ID NO: 126610 - DNA, 16 bp, H. sapiens
tacaacaacatgaatg

SEQ ID NO: 126611 - DNA, 16 bp, H. sapiens
tacaacaagagtgttt

SEQ ID NO: 126612 - DNA, 17 bp, H. sapiens
tacaacaatctgatctt

SEQ ID NO: 126613 - DNA, 16 bp, H. sapiens
tacaacaattgtcccc

SEQ ID NO: 126614 - DNA, 16 bp, H. sapiens
tacaacacactgatgg

SEQ ID NO: 126615 - DNA, 16 bp, H. sapiens
tacaacagcaaagaca

SEQ ID NO: 126616 - DNA, 16 bp, H. sapiens
tacaacatagtgacta

SEQ ID NO: 126617 - DNA, 16 bp, H. sapiens
tacaacatgacatttt

SEQ ID NO: 126618 - DNA, 16 bp, H. sapiens
tacaacatggatggat

SEQ ID NO: 126619 - DNA, 16 bp, H. sapiens
tacaacatttttttaa

SEQ ID NO: 126620 - DNA, 16 bp, H. sapiens
tacaaccactttgaaa

SEQ ID NO: 126621 - DNA, 16 bp, H. sapiens
tacaaccactttggaa

SEQ ID NO: 126622 - DNA, 16 bp, H. sapiens
tacaaccagaaatacc

SEQ ID NO: 126623 - DNA, 16 bp, H. sapiens
tacaaccatcaccatt

SEQ ID NO: 126624 - DNA, 16 bp, H. sapiens
tacaaccatgcccagc

SEQ ID NO: 126625 - DNA, 16 bp, H. sapiens
tacaacctacaaagat

SEQ ID NO: 126626 - DNA, 16 bp, H. sapiens
tacaactaaattatta

SEQ ID NO: 126627 - DNA, 16 bp, H. sapiens
tacaagaaaactacag

SEQ ID NO: 126628 - DNA, 16 bp, H. sapiens
tacaagaaacacattt

SEQ ID NO: 126629 - DNA, 16 bp, H. sapiens
tacaagaaacatactt

SEQ ID NO: 126630 - DNA, 16 bp, H. sapiens
tacaagaaacatggca

SEQ ID NO: 126631 - DNA, 16 bp, H. sapiens
tacaagaaatactgaa

SEQ ID NO: 126632 - DNA, 16 bp, H. sapiens
tacaagaaatatggga

SEQ ID NO: 126633 - DNA, 16 bp, H. sapiens
tacaagaaatgccaaa

SEQ ID NO: 126634 - DNA, 16 bp, H. sapiens
tacaagaaatgttaaa

SEQ ID NO: 126635 - DNA, 16 bp, H. sapiens
tacaagaagagaaaga

SEQ ID NO: 126636 - DNA, 16 bp, H. sapiens
tacaagaatggttcaa

SEQ ID NO: 126637 - DNA, 16 bp, H. sapiens
tacaagagacaaagaa

SEQ ID NO: 126638 - DNA, 16 bp, H. sapiens
tacaagagtgaaactc

SEQ ID NO: 126639 - DNA, 16 bp, H. sapiens
tacaagatgaaaaagt

SEQ ID NO: 126640 - DNA, 16 bp, H. sapiens
tacaagatgaataagt

SEQ ID NO: 126641 - DNA, 16 bp, H. sapiens
tacaagatttagaaaa

SEQ ID NO: 126642 - DNA, 16 bp, H. sapiens
tacaagcaaatggaag

SEQ ID NO: 126643 - DNA, 16 bp, H. sapiens
tacaagccaagaaatg

SEQ ID NO: 126644 - DNA, 16 bp, H. sapiens
tacaagccagaaaaga

SEQ ID NO: 126645 - DNA, 16 bp, H. sapiens
tacaagccagaagagg

SEQ ID NO: 126646 - DNA, 16 bp, H. sapiens
tacaagccagaagagt

SEQ ID NO: 126647 - DNA, 16 bp, H. sapiens
tacaagccagaagata

SEQ ID NO: 126648 - DNA, 16 bp, H. sapiens
tacaagccagggagag

SEQ ID NO: 126649 - DNA, 16 bp, H. sapiens
tacaagctcctgccac

SEQ ID NO: 126650 - DNA, 16 bp, H. sapiens
tacaaggaacccaaac

SEQ ID NO: 126651 - DNA, 16 bp, H. sapiens
tacaaggaactcaaac

SEQ ID NO: 126652 - DNA, 16 bp, H. sapiens
tacaaggaagttaaac

SEQ ID NO: 126653 - DNA, 16 bp, H. sapiens
tacaaggagaactaca

SEQ ID NO: 126654 - DNA, 16 bp, H. sapiens
tacaaggagaagctgg

SEQ ID NO: 126655 - DNA, 16 bp, H. sapiens
tacaaggattaaatga

SEQ ID NO: 126656 - DNA, 16 bp, H. sapiens
tacaaggctacagcaa

SEQ ID NO: 126657 - DNA, 16 bp, H. sapiens
tacaagggtacagtaa

SEQ ID NO: 126658 - DNA, 16 bp, H. sapiens
tacaaggtatgtagcc

SEQ ID NO: 126659 - DNA, 16 bp, H. sapiens
tacaaggtgaagcagc

SEQ ID NO: 126660 - DNA, 16 bp, H. sapiens
tacaagtacatgccac

SEQ ID NO: 126661 - DNA, 16 bp, H. sapiens
tacaagtcagaagaga

SEQ ID NO: 126662 - DNA, 16 bp, H. sapiens
tacaagtctttatgtg

SEQ ID NO: 126663 - DNA, 16 bp, H. sapiens
tacaagtgcatgtgtc

SEQ ID NO: 126664 - DNA, 17 bp, H. sapiens
tacaagtgtgagccact

SEQ ID NO: 126665 - DNA, 16 bp, H. sapiens
tacaagtgtgagccat

SEQ ID NO: 126666 - DNA, 16 bp, H. sapiens
tacaagttgagcatcc

SEQ ID NO: 126667 - DNA, 16 bp, H. sapiens
tacaagttgagtatcc

SEQ ID NO: 126668 - DNA, 16 bp, H. sapiens
tacaataaagcaagct

SEQ ID NO: 126669 - DNA, 16 bp, H. sapiens
tacaataaatgttttt

SEQ ID NO: 126670 - DNA, 16 bp, H. sapiens
tacaataaattattgc

SEQ ID NO: 126671 - DNA, 17 bp, H. sapiens
tacaataatagagagga

SEQ ID NO: 126672 - DNA, 16 bp, H. sapiens
tacaatacattttaaa

SEQ ID NO: 126673 - DNA, 16 bp, H. sapiens
tacaatagatcttttg

SEQ ID NO: 126674 - DNA, 16 bp, H. sapiens
tacaatagtgatgtta

SEQ ID NO: 126675 - DNA, 16 bp, H. sapiens
tacaatattgttaact

SEQ ID NO: 126676 - DNA, 16 bp, H. sapiens
tacaatatttgtcctt

SEQ ID NO: 126677 - DNA, 16 bp, H. sapiens
tacaatattttcaact

SEQ ID NO: 126678 - DNA, 16 bp, H. sapiens
tacaatattttgtttt

SEQ ID NO: 126679 - DNA, 16 bp, H. sapiens
tacaatatttttaaag

SEQ ID NO: 126680 - DNA, 16 bp, H. sapiens
tacaatatttttcctt

SEQ ID NO: 126681 - DNA, 16 bp, H. sapiens
tacaatcaacaaaatg

SEQ ID NO: 126682 - DNA, 16 bp, H. sapiens
tacaatcacaactcac

SEQ ID NO: 126683 - DNA, 16 bp, H. sapiens
tacaatcccaccagca

SEQ ID NO: 126684 - DNA, 16 bp, H. sapiens
tacaatcctggtggaa

SEQ ID NO: 126685 - DNA, 28 bp, H. sapiens
tacaatcgggttttataccgagacattc

SEQ ID NO: 126686 - DNA, 16 bp, H. sapiens
tacaatgaactgaaac

SEQ ID NO: 126687 - DNA, 16 bp, H. sapiens
tacaatgaagaaaata

SEQ ID NO: 126688 - DNA, 16 bp, H. sapiens
tacaatgacatgatct

SEQ ID NO: 126689 - DNA, 16 bp, H. sapiens
tacaatgacttatttt

SEQ ID NO: 126690 - DNA, 16 bp, H. sapiens
tacaatgaggagctgg

SEQ ID NO: 126691 - DNA, 16 bp, H. sapiens
tacaatgatttatatt

SEQ ID NO: 126692 - DNA, 16 bp, H. sapiens
tacaatgctggtggga

SEQ ID NO: 126693 - DNA, 16 bp, H. sapiens
tacaatggagaaaaaa

SEQ ID NO: 126694 - DNA, 16 bp, H. sapiens
tacaatggcaccatct

SEQ ID NO: 126695 - DNA, 16 bp, H. sapiens
tacaatggcatcaaaa

SEQ ID NO: 126696 - DNA, 16 bp, H. sapiens
tacaatggtgaacaag

SEQ ID NO: 126697 - DNA, 16 bp, H. sapiens
tacaatgtatttgtgt

SEQ ID NO: 126698 - DNA, 16 bp, H. sapiens
tacaatgtgatatttt

SEQ ID NO: 126699 - DNA, 16 bp, H. sapiens
tacaatgtgtaatgat

SEQ ID NO: 126700 - DNA, 16 bp, H. sapiens
tacaatgttattttta

SEQ ID NO: 126701 - DNA, 16 bp, H. sapiens
tacaatgtttgatttt

SEQ ID NO: 126702 - DNA, 16 bp, H. sapiens
tacaatgtttggtttt

SEQ ID NO: 126703 - DNA, 17 bp, H. sapiens
tacaattcaaaatgaga

SEQ ID NO: 126704 - DNA, 16 bp, H. sapiens
tacaattcaagatgag

SEQ ID NO: 126705 - DNA, 16 bp, H. sapiens
tacaattcagtggcat

SEQ ID NO: 126706 - DNA, 16 bp, H. sapiens
tacaattcagtggtat

SEQ ID NO: 126707 - DNA, 16 bp, H. sapiens
tacaattcattcatgt

SEQ ID NO: 126708 - DNA, 16 bp, H. sapiens
tacaatttgtcaatta

SEQ ID NO: 126709 - DNA, 16 bp, H. sapiens
tacaattttggaaaat

SEQ ID NO: 126710 - DNA, 16 bp, H. sapiens
tacaatttttgttaaa

SEQ ID NO: 126711 - DNA, 16 bp, H. sapiens
tacacaaaatatattt

SEQ ID NO: 126712 - DNA, 16 bp, H. sapiens
tacacaaacacagaca

SEQ ID NO: 126713 - DNA, 16 bp, H. sapiens
tacacaaatacttatt

SEQ ID NO: 126714 - DNA, 16 bp, H. sapiens
tacacaataaattatt

SEQ ID NO: 126715 - DNA, 16 bp, H. sapiens
tacacaatacagtatt

SEQ ID NO: 126716 - DNA, 16 bp, H. sapiens
tacacaatgaagaaag

SEQ ID NO: 126717 - DNA, 16 bp, H. sapiens
tacacaatttatattt

SEQ ID NO: 126718 - DNA, 16 bp, H. sapiens
tacacacacacacacg

SEQ ID NO: 126719 - DNA, 16 bp, H. sapiens
tacacacacacacatt

SEQ ID NO: 126720 - DNA, 16 bp, H. sapiens
tacacacacacacgca

SEQ ID NO: 126721 - DNA, 16 bp, H. sapiens
tacacacacacatgca

SEQ ID NO: 126722 - DNA, 16 bp, H. sapiens
tacacacacacgcatg

SEQ ID NO: 126723 - DNA, 16 bp, H. sapiens
tacacacacactgaca

SEQ ID NO: 126724 - DNA, 16 bp, H. sapiens
tacacacacagacaca

SEQ ID NO: 126725 - DNA, 16 bp, H. sapiens
tacacacacatacaca

SEQ ID NO: 126726 - DNA, 18 bp, H. sapiens
tacacacacatatacata

SEQ ID NO: 126727 - DNA, 16 bp, H. sapiens
tacacacacatgcaca

SEQ ID NO: 126728 - DNA, 16 bp, H. sapiens
tacacacacgcacaca

SEQ ID NO: 126729 - DNA, 16 bp, H. sapiens
tacacacactcacaca

SEQ ID NO: 126730 - DNA, 16 bp, H. sapiens
tacacacagacacaca

SEQ ID NO: 126731 - DNA, 16 bp, H. sapiens
tacacacagacataaa

SEQ ID NO: 126732 - DNA, 16 bp, H. sapiens
tacacacatacacaca

SEQ ID NO: 126733 - DNA, 16 bp, H. sapiens
tacacacatacacata

SEQ ID NO: 126734 - DNA, 16 bp, H. sapiens
tacacacatacatata

SEQ ID NO: 126735 - DNA, 16 bp, H. sapiens
tacacacatacatgta

SEQ ID NO: 126736 - DNA, 17 bp, H. sapiens
tacacacatatacacac

SEQ ID NO: 126737 - DNA, 16 bp, H. sapiens
tacacacatatacata

SEQ ID NO: 126738 - DNA, 16 bp, H. sapiens
tacacacatatatatt

SEQ ID NO: 126739 - DNA, 16 bp, H. sapiens
tacacacatatgcaca

SEQ ID NO: 126740 - DNA, 16 bp, H. sapiens
tacacacatcacaaag

SEQ ID NO: 126741 - DNA, 16 bp, H. sapiens
tacacacatgtgccac

SEQ ID NO: 126742 - DNA, 16 bp, H. sapiens
tacacacattcacaca

SEQ ID NO: 126743 - DNA, 16 bp, H. sapiens
tacacaccactgtgcc

SEQ ID NO: 126744 - DNA, 16 bp, H. sapiens
tacacactcatgcaca

SEQ ID NO: 126745 - DNA, 16 bp, H. sapiens
tacacactgctggtgg

SEQ ID NO: 126746 - DNA, 16 bp, H. sapiens
tacacactggattttg

SEQ ID NO: 126747 - DNA, 16 bp, H. sapiens
tacacactgtgtgtgt

SEQ ID NO: 126748 - DNA, 16 bp, H. sapiens
tacacactgttggtga

SEQ ID NO: 126749 - DNA, 16 bp, H. sapiens
tacacacttttaaata

SEQ ID NO: 126750 - DNA, 16 bp, H. sapiens
tacacagagaaacaca

SEQ ID NO: 126751 - DNA, 16 bp, H. sapiens
tacacagatgaagaaa

SEQ ID NO: 126752 - DNA, 16 bp, H. sapiens
tacacagggacataaa

SEQ ID NO: 126753 - DNA, 16 bp, H. sapiens
tacacagtaggtgctc

SEQ ID NO: 126754 - DNA, 16 bp, H. sapiens
tacacagtcaaattca

SEQ ID NO: 126755 - DNA, 16 bp, H. sapiens
tacacagtggaatact

SEQ ID NO: 126756 - DNA, 18 bp, H. sapiens
tacacataacaatattaa

SEQ ID NO: 126757 - DNA, 16 bp, H. sapiens
tacacataagaaaatt

SEQ ID NO: 126758 - DNA, 16 bp, H. sapiens
tacacataagataatt

SEQ ID NO: 126759 - DNA, 16 bp, H. sapiens
tacacatacatatatg

SEQ ID NO: 126760 - DNA, 16 bp, H. sapiens
tacacatacatattat

SEQ ID NO: 126761 - DNA, 16 bp, H. sapiens
tacacatacatgtaaa

SEQ ID NO: 126762 - DNA, 16 bp, H. sapiens
tacacatacattttat

SEQ ID NO: 126763 - DNA, 16 bp, H. sapiens
tacacatataaacaca

SEQ ID NO: 126764 - DNA, 16 bp, H. sapiens
tacacatatacatatg

SEQ ID NO: 126765 - DNA, 16 bp, H. sapiens
tacacatatatatatc

SEQ ID NO: 126766 - DNA, 16 bp, H. sapiens
tacacatatatcaaaa

SEQ ID NO: 126767 - DNA, 16 bp, H. sapiens
tacacatatatttata

SEQ ID NO: 126768 - DNA, 16 bp, H. sapiens
tacacatattttaaag

SEQ ID NO: 126769 - DNA, 16 bp, H. sapiens
tacacatcctattttt

SEQ ID NO: 126770 - DNA, 16 bp, H. sapiens
tacacatctgtggtcc

SEQ ID NO: 126771 - DNA, 16 bp, H. sapiens
tacacatgtatcctgg

SEQ ID NO: 126772 - DNA, 16 bp, H. sapiens
tacacatgtatttata

SEQ ID NO: 126773 - DNA, 16 bp, H. sapiens
tacacattaaaatcac

SEQ ID NO: 126774 - DNA, 16 bp, H. sapiens
tacacattgtatatat

SEQ ID NO: 126775 - DNA, 16 bp, H. sapiens
tacacatttaaaattt

SEQ ID NO: 126776 - DNA, 16 bp, H. sapiens
tacacatttatttaat

SEQ ID NO: 126777 - DNA, 16 bp, H. sapiens
tacacatttgtcaaaa

SEQ ID NO: 126778 - DNA, 16 bp, H. sapiens
tacacattttatatat

SEQ ID NO: 126779 - DNA, 16 bp, H. sapiens
tacaccaaaaccccat

SEQ ID NO: 126780 - DNA, 16 bp, H. sapiens
tacaccaaactcccat

SEQ ID NO: 126781 - DNA, 16 bp, H. sapiens
tacaccaatcagatgt

SEQ ID NO: 126782 - DNA, 16 bp, H. sapiens
tacaccacaaatatat

SEQ ID NO: 126783 - DNA, 16 bp, H. sapiens
tacaccaccatgcctg

SEQ ID NO: 126784 - DNA, 16 bp, H. sapiens
tacaccagcctgggtg

SEQ ID NO: 126785 - DNA, 16 bp, H. sapiens
tacaccatagaatatt

SEQ ID NO: 126786 - DNA, 16 bp, H. sapiens
tacaccatgcacctgg

SEQ ID NO: 126787 - DNA, 16 bp, H. sapiens
tacaccatggaaatca

SEQ ID NO: 126788 - DNA, 16 bp, H. sapiens
tacaccatggaagact

SEQ ID NO: 126789 - DNA, 16 bp, H. sapiens
tacaccatgttggcca

SEQ ID NO: 126790 - DNA, 17 bp, H. sapiens
tacacccagctaatttt

SEQ ID NO: 126791 - DNA, 16 bp, H. sapiens
tacacccatggagtct

SEQ ID NO: 126792 - DNA, 16 bp, H. sapiens
tacacccattccaaat

SEQ ID NO: 126793 - DNA, 16 bp, H. sapiens
tacacctactgtgata

SEQ ID NO: 126794 - DNA, 16 bp, H. sapiens
tacactagaagcccag

SEQ ID NO: 126795 - DNA, 16 bp, H. sapiens
tacactatgttggcca

SEQ ID NO: 126796 - DNA, 16 bp, H. sapiens
tacactcacacacaca

SEQ ID NO: 126797 - DNA, 16 bp, H. sapiens
tacactcatgtttata

SEQ ID NO: 126798 - DNA, 16 bp, H. sapiens
tacactccaacctggg

SEQ ID NO: 126799 - DNA, 16 bp, H. sapiens
tacactccaccctggg

SEQ ID NO: 126800 - DNA, 16 bp, H. sapiens
tacactccagcctagg

SEQ ID NO: 126801 - DNA, 16 bp, H. sapiens
tacactccagcctgag

SEQ ID NO: 126802 - DNA, 16 bp, H. sapiens
tacactccagcctgga

SEQ ID NO: 126803 - DNA, 16 bp, H. sapiens
tacactccagcctggg

SEQ ID NO: 126804 - DNA, 16 bp, H. sapiens
tacactccagcctgtg

SEQ ID NO: 126805 - DNA, 16 bp, H. sapiens
tacactcccagcaaca

SEQ ID NO: 126806 - DNA, 16 bp, H. sapiens
tacactctggcctggg

SEQ ID NO: 126807 - DNA, 16 bp, H. sapiens
tacactgaaaaaaata

SEQ ID NO: 126808 - DNA, 16 bp, H. sapiens
tacactgaaaataaaa

SEQ ID NO: 126809 - DNA, 16 bp, H. sapiens
tacactgctggtggga

SEQ ID NO: 126810 - DNA, 16 bp, H. sapiens
tacactgttgctggga

SEQ ID NO: 126811 - DNA, 16 bp, H. sapiens
tacactgttggtagaa

SEQ ID NO: 126812 - DNA, 16 bp, H. sapiens
tacactgttggtggga

SEQ ID NO: 126813 - DNA, 16 bp, H. sapiens
tacacttaaaattggt

SEQ ID NO: 126814 - DNA, 16 bp, H. sapiens
tacactttatatatat

SEQ ID NO: 126815 - DNA, 17 bp, H. sapiens
tacactttgggaggcca

SEQ ID NO: 126816 - DNA, 16 bp, H. sapiens
tacacttttcacaaaa

SEQ ID NO: 126817 - DNA, 16 bp, H. sapiens
tacacttttgatggga

SEQ ID NO: 126818 - DNA, 16 bp, H. sapiens
tacagaaaaaaattca

SEQ ID NO: 126819 - DNA, 16 bp, H. sapiens
tacagaaaaagagaga

SEQ ID NO: 126820 - DNA, 16 bp, H. sapiens
tacagaaaaattaact

SEQ ID NO: 126821 - DNA, 16 bp, H. sapiens
tacagaaaagtttgct

SEQ ID NO: 126822 - DNA, 16 bp, H. sapiens
tacagaaaataaaact

SEQ ID NO: 126823 - DNA, 16 bp, H. sapiens
tacagaaaataacaag

SEQ ID NO: 126824 - DNA, 16 bp, H. sapiens
tacagaaaatattatt

SEQ ID NO: 126825 - DNA, 16 bp, H. sapiens
tacagaaaatcaaaga

SEQ ID NO: 126826 - DNA, 16 bp, H. sapiens
tacagaaaatcatcaa

SEQ ID NO: 126827 - DNA, 16 bp, H. sapiens
tacagaaaatggaaaa

SEQ ID NO: 126828 - DNA, 16 bp, H. sapiens
tacagaaacagccaga

SEQ ID NO: 126829 - DNA, 16 bp, H. sapiens
tacagaaacatccaga

SEQ ID NO: 126830 - DNA, 16 bp, H. sapiens
tacagaaacattttta

SEQ ID NO: 126831 - DNA, 16 bp, H. sapiens
tacagaaagggaaaaa

SEQ ID NO: 126832 - DNA, 16 bp, H. sapiens
tacagaaagggaaact

SEQ ID NO: 126833 - DNA, 16 bp, H. sapiens
tacagaaagttcccat

SEQ ID NO: 126834 - DNA, 16 bp, H. sapiens
tacagaaataaaatat

SEQ ID NO: 126835 - DNA, 16 bp, H. sapiens
tacagaaatagaaaag

SEQ ID NO: 126836 - DNA, 16 bp, H. sapiens
tacagaaatagaaata

SEQ ID NO: 126837 - DNA, 16 bp, H. sapiens
tacagaaatatatttt

SEQ ID NO: 126838 - DNA, 16 bp, H. sapiens
tacagaaatcagccag

SEQ ID NO: 126839 - DNA, 16 bp, H. sapiens
tacagaaattacctgg

SEQ ID NO: 126840 - DNA, 16 bp, H. sapiens
tacagaaattatttta

SEQ ID NO: 126841 - DNA, 16 bp, H. sapiens
tacagaaccacagaat

SEQ ID NO: 126842 - DNA, 16 bp, H. sapiens
tacagaagaaatagaa

SEQ ID NO: 126843 - DNA, 16 bp, H. sapiens
tacagaagttttaaaa

SEQ ID NO: 126844 - DNA, 16 bp, H. sapiens
tacagaataataataa

SEQ ID NO: 126845 - DNA, 16 bp, H. sapiens
tacagaatataaaaat

SEQ ID NO: 126846 - DNA, 16 bp, H. sapiens
tacagaatatatttta

SEQ ID NO: 126847 - DNA, 16 bp, H. sapiens
tacagaatatattttt

SEQ ID NO: 126848 - DNA, 16 bp, H. sapiens
tacagaatatttaaaa

SEQ ID NO: 126849 - DNA, 16 bp, H. sapiens
tacagaatggctggat

SEQ ID NO: 126850 - DNA, 17 bp, H. sapiens
tacagaatgggagaaaa

SEQ ID NO: 126851 - DNA, 16 bp, H. sapiens
tacagaatgggcaaaa

SEQ ID NO: 126852 - DNA, 16 bp, H. sapiens
tacagaattctaagtt

SEQ ID NO: 126853 - DNA, 16 bp, H. sapiens
tacagaattttttttt

SEQ ID NO: 126854 - DNA, 16 bp, H. sapiens
tacagacaaggaaatg

SEQ ID NO: 126855 - DNA, 16 bp, H. sapiens
tacagacacacacata

SEQ ID NO: 126856 - DNA, 16 bp, H. sapiens
tacagacacacccagg

SEQ ID NO: 126857 - DNA, 16 bp, H. sapiens
tacagacatgaaccac

SEQ ID NO: 126858 - DNA, 16 bp, H. sapiens
tacagacatgagccat

SEQ ID NO: 126859 - DNA, 16 bp, H. sapiens
tacagacatgagctac

SEQ ID NO: 126860 - DNA, 16 bp, H. sapiens
tacagacattagccac

SEQ ID NO: 126861 - DNA, 16 bp, H. sapiens
tacagacattttcaaa

SEQ ID NO: 126862 - DNA, 16 bp, H. sapiens
tacagagaacaggaat

SEQ ID NO: 126863 - DNA, 16 bp, H. sapiens
tacagagaagaaaata

SEQ ID NO: 126864 - DNA, 16 bp, H. sapiens
tacagagaagaacaat

SEQ ID NO: 126865 - DNA, 16 bp, H. sapiens
tacagagaaggaaaaa

SEQ ID NO: 126866 - DNA, 16 bp, H. sapiens
tacagagacagagaga

SEQ ID NO: 126867 - DNA, 16 bp, H. sapiens
tacagagagttcccat

SEQ ID NO: 126868 - DNA, 16 bp, H. sapiens
tacagagatggcttct

SEQ ID NO: 126869 - DNA, 16 bp, H. sapiens
tacagagcaagactcc

SEQ ID NO: 126870 - DNA, 16 bp, H. sapiens
tacagaggaaaataaa

SEQ ID NO: 126871 - DNA, 16 bp, H. sapiens
tacagaggaggaaaca

SEQ ID NO: 126872 - DNA, 16 bp, H. sapiens
tacagagggcccctgg

SEQ ID NO: 126873 - DNA, 16 bp, H. sapiens
tacagagtctcactct

SEQ ID NO: 126874 - DNA, 16 bp, H. sapiens
tacagagtcttgctct

SEQ ID NO: 126875 - DNA, 16 bp, H. sapiens
tacagagtgagactcc

SEQ ID NO: 126876 - DNA, 16 bp, H. sapiens
tacagagtgggaaaaa

SEQ ID NO: 126877 - DNA, 16 bp, H. sapiens
tacagagtttcagttt

SEQ ID NO: 126878 - DNA, 16 bp, H. sapiens
tacagagtttctgttt

SEQ ID NO: 126879 - DNA, 16 bp, H. sapiens
tacagataagaaaaca

SEQ ID NO: 126880 - DNA, 16 bp, H. sapiens
tacagataagaaaacc

SEQ ID NO: 126881 - DNA, 16 bp, H. sapiens
tacagataaggaaaaa

SEQ ID NO: 126882 - DNA, 16 bp, H. sapiens
tacagatatggaaact

SEQ ID NO: 126883 - DNA, 16 bp, H. sapiens
tacagatattttaata

SEQ ID NO: 126884 - DNA, 16 bp, H. sapiens
tacagatattttttct

SEQ ID NO: 126885 - DNA, 16 bp, H. sapiens
tacagatgaagaagtt

SEQ ID NO: 126886 - DNA, 16 bp, H. sapiens
tacagatgaagcttct

SEQ ID NO: 126887 - DNA, 16 bp, H. sapiens
tacagatgaggaaaaa

SEQ ID NO: 126888 - DNA, 16 bp, H. sapiens
tacagatgaggaaaag

SEQ ID NO: 126889 - DNA, 16 bp, H. sapiens
tacagatgcatgccac

SEQ ID NO: 126890 - DNA, 16 bp, H. sapiens
tacagatggagaaaat

SEQ ID NO: 126891 - DNA, 16 bp, H. sapiens
tacagatggggaaacc

SEQ ID NO: 126892 - DNA, 16 bp, H. sapiens
tacagattaggagaaa

SEQ ID NO: 126893 - DNA, 17 bp, H. sapiens
tacagattatttcatca

SEQ ID NO: 126894 - DNA, 16 bp, H. sapiens
tacagattcagtgaaa

SEQ ID NO: 126895 - DNA, 16 bp, H. sapiens
tacagattcattgcaa

SEQ ID NO: 126896 - DNA, 16 bp, H. sapiens
tacagattggaaagaa

SEQ ID NO: 126897 - DNA, 16 bp, H. sapiens
tacagatttaatgcaa

SEQ ID NO: 126898 - DNA, 16 bp, H. sapiens
tacagattttatttat

SEQ ID NO: 126899 - DNA, 16 bp, H. sapiens
tacagattttggactt

SEQ ID NO: 126900 - DNA, 16 bp, H. sapiens
tacagcaaaggaaaca

SEQ ID NO: 126901 - DNA, 16 bp, H. sapiens
tacagcacatctcagt

SEQ ID NO: 126902 - DNA, 16 bp, H. sapiens
tacagcaccttcaact

SEQ ID NO: 126903 - DNA, 16 bp, H. sapiens
tacagcagaagtgatg

SEQ ID NO: 126904 - DNA, 16 bp, H. sapiens
tacagcagatacacaa

SEQ ID NO: 126905 - DNA, 16 bp, H. sapiens
tacagcagcaagagga

SEQ ID NO: 126906 - DNA, 16 bp, H. sapiens
tacagcagcaatggga

SEQ ID NO: 126907 - DNA, 16 bp, H. sapiens
tacagcagtgagcaaa

SEQ ID NO: 126908 - DNA, 16 bp, H. sapiens
tacagcatgttattgt

SEQ ID NO: 126909 - DNA, 16 bp, H. sapiens
tacagccatgtaccac

SEQ ID NO: 126910 - DNA, 16 bp, H. sapiens
tacagccccactcctg

SEQ ID NO: 126911 - DNA, 16 bp, H. sapiens
tacagccgggcgcagt

SEQ ID NO: 126912 - DNA, 16 bp, H. sapiens
tacagcctatggaacc

SEQ ID NO: 126913 - DNA, 16 bp, H. sapiens
tacagcctccctcccg

SEQ ID NO: 126914 - DNA, 16 bp, H. sapiens
tacagcctctcagctg

SEQ ID NO: 126915 - DNA, 16 bp, H. sapiens
tacagcctgaagaacc

SEQ ID NO: 126916 - DNA, 16 bp, H. sapiens
tacagcctgcagaagc

SEQ ID NO: 126917 - DNA, 16 bp, H. sapiens
tacagcctggatgaca

SEQ ID NO: 126918 - DNA, 16 bp, H. sapiens
tacagcctgggcaata

SEQ ID NO: 126919 - DNA, 16 bp, H. sapiens
tacagctatacaatgt

SEQ ID NO: 126920 - DNA, 16 bp, H. sapiens
tacagctcaggccatt

SEQ ID NO: 126921 - DNA, 16 bp, H. sapiens
tacagctcattgcagc

SEQ ID NO: 126922 - DNA, 16 bp, H. sapiens
tacagctccatccatg

SEQ ID NO: 126923 - DNA, 16 bp, H. sapiens
tacagctctcaggaga

SEQ ID NO: 126924 - DNA, 16 bp, H. sapiens
tacagctgtgcaccac

SEQ ID NO: 126925 - DNA, 16 bp, H. sapiens
tacagcttggtgtttg

SEQ ID NO: 126926 - DNA, 16 bp, H. sapiens
tacagctttcttttca

SEQ ID NO: 126927 - DNA, 16 bp, H. sapiens
tacaggaaaaaaatca

SEQ ID NO: 126928 - DNA, 16 bp, H. sapiens
tacaggaaaacaaaca

SEQ ID NO: 126929 - DNA, 16 bp, H. sapiens
tacaggaaaagcagaa

SEQ ID NO: 126930 - DNA, 16 bp, H. sapiens
tacaggaaacatggct

SEQ ID NO: 126931 - DNA, 16 bp, H. sapiens
tacaggaaatacagag

SEQ ID NO: 126932 - DNA, 16 bp, H. sapiens
tacaggaagcactgtc

SEQ ID NO: 126933 - DNA, 16 bp, H. sapiens
tacaggaagcatggct

SEQ ID NO: 126934 - DNA, 16 bp, H. sapiens
tacaggaatgttcata

SEQ ID NO: 126935 - DNA, 16 bp, H. sapiens
tacaggagatgaaaga

SEQ ID NO: 126936 - DNA, 16 bp, H. sapiens
tacaggagcacctaga

SEQ ID NO: 126937 - DNA, 16 bp, H. sapiens
tacaggaggaaaaaaa

SEQ ID NO: 126938 - DNA, 16 bp, H. sapiens
tacaggatgctcagtt

SEQ ID NO: 126939 - DNA, 16 bp, H. sapiens
tacaggcacctgcccc

SEQ ID NO: 126940 - DNA, 16 bp, H. sapiens
tacaggcacgcagcac

SEQ ID NO: 126941 - DNA, 16 bp, H. sapiens
tacaggcacttgccac

SEQ ID NO: 126942 - DNA, 18 bp, H. sapiens
tacaggcatgagccgctg

SEQ ID NO: 126943 - DNA, 16 bp, H. sapiens
tacaggcatgagtcac

SEQ ID NO: 126944 - DNA, 16 bp, H. sapiens
tacaggcatgcgccac

SEQ ID NO: 126945 - DNA, 16 bp, H. sapiens
tacaggccaggaaaga

SEQ ID NO: 126946 - DNA, 16 bp, H. sapiens
tacaggcccgagccac

SEQ ID NO: 126947 - DNA, 16 bp, H. sapiens
tacaggccgggcgtgg

SEQ ID NO: 126948 - DNA, 16 bp, H. sapiens
tacaggcctgacccac

SEQ ID NO: 126949 - DNA, 19 bp, H. sapiens
tacaggcgcccaccaccaa

SEQ ID NO: 126950 - DNA, 16 bp, H. sapiens
tacaggcgcccgcccc

SEQ ID NO: 126951 - DNA, 16 bp, H. sapiens
tacaggcgcgagccac

SEQ ID NO: 126952 - DNA, 17 bp, H. sapiens
tacaggcgcgtgccagc

SEQ ID NO: 126953 - DNA, 16 bp, H. sapiens
tacaggcgtgcaccag

SEQ ID NO: 126954 - DNA, 16 bp, H. sapiens
tacaggcgtgcgctac

SEQ ID NO: 126955 - DNA, 17 bp, H. sapiens
tacaggcgtgggccacc

SEQ ID NO: 126956 - DNA, 17 bp, H. sapiens
tacaggcgtgtgtcact

SEQ ID NO: 126957 - DNA, 16 bp, H. sapiens
tacaggctaaaacctt

SEQ ID NO: 126958 - DNA, 16 bp, H. sapiens
tacaggctcacgcctg

SEQ ID NO: 126959 - DNA, 16 bp, H. sapiens
tacaggctcccgccac

SEQ ID NO: 126960 - DNA, 17 bp, H. sapiens
tacagggaactcaaaca

SEQ ID NO: 126961 - DNA, 16 bp, H. sapiens
tacagggcccatgcaa

SEQ ID NO: 126962 - DNA, 22 bp, H. sapiens
tacagggtctagggcaaacctt

SEQ ID NO: 126963 - DNA, 16 bp, H. sapiens
tacagggttgttgtga

SEQ ID NO: 126964 - DNA, 16 bp, H. sapiens
tacagggtttcaccat

SEQ ID NO: 126965 - DNA, 16 bp, H. sapiens
tacaggtacatgccac

SEQ ID NO: 126966 - DNA, 16 bp, H. sapiens
tacaggtccctccctc

SEQ ID NO: 126967 - DNA, 16 bp, H. sapiens
tacaggtgcatgccat

SEQ ID NO: 126968 - DNA, 16 bp, H. sapiens
tacaggtgcctgccaa

SEQ ID NO: 126969 - DNA, 16 bp, H. sapiens
tacaggtggccgccac

SEQ ID NO: 126970 - DNA, 16 bp, H. sapiens
tacaggtgtgagtcat

SEQ ID NO: 126971 - DNA, 23 bp, H. sapiens
tacaggtgtgtgccaccacacct

SEQ ID NO: 126972 - DNA, 16 bp, H. sapiens
tacaggttgagtatcc

SEQ ID NO: 126973 - DNA, 16 bp, H. sapiens
tacaggtttgcagcct

SEQ ID NO: 126974 - DNA, 16 bp, H. sapiens
tacagtaaaaaaaatt

SEQ ID NO: 126975 - DNA, 16 bp, H. sapiens
tacagtaaaaacacag

SEQ ID NO: 126976 - DNA, 16 bp, H. sapiens
tacagtaaagaaacag

SEQ ID NO: 126977 - DNA, 16 bp, H. sapiens
tacagtaacaaaacag

SEQ ID NO: 126978 - DNA, 16 bp, H. sapiens
tacagtaagatatttt

SEQ ID NO: 126979 - DNA, 16 bp, H. sapiens
tacagtaggtgctcag

SEQ ID NO: 126980 - DNA, 16 bp, H. sapiens
tacagtataaaagatt

SEQ ID NO: 126981 - DNA, 16 bp, H. sapiens
tacagtatacactgct

SEQ ID NO: 126982 - DNA, 16 bp, H. sapiens
tacagtatatatatat

SEQ ID NO: 126983 - DNA, 16 bp, H. sapiens
tacagtatattgttat

SEQ ID NO: 126984 - DNA, 16 bp, H. sapiens
tacagtattcaataca

SEQ ID NO: 126985 - DNA, 16 bp, H. sapiens
tacagtatttatcttt

SEQ ID NO: 126986 - DNA, 16 bp, H. sapiens
tacagtatttgtcttc

SEQ ID NO: 126987 - DNA, 16 bp, H. sapiens
tacagtattttcaact

SEQ ID NO: 126988 - DNA, 16 bp, H. sapiens
tacagtatttttctgt

SEQ ID NO: 126989 - DNA, 16 bp, H. sapiens
tacagtatttttcttt

SEQ ID NO: 126990 - DNA, 16 bp, H. sapiens
tacagtatttttttta

SEQ ID NO: 126991 - DNA, 16 bp, H. sapiens
tacagtcacatgtcac

SEQ ID NO: 126992 - DNA, 16 bp, H. sapiens
tacagtcaccaaaaca

SEQ ID NO: 126993 - DNA, 16 bp, H. sapiens
tacagtcactctggaa

SEQ ID NO: 126994 - DNA, 16 bp, H. sapiens
tacagtcatctctcag

SEQ ID NO: 126995 - DNA, 16 bp, H. sapiens
tacagtcatgtatcac

SEQ ID NO: 126996 - DNA, 16 bp, H. sapiens
tacagtcatgtgccac

SEQ ID NO: 126997 - DNA, 16 bp, H. sapiens
tacagtcattatgaaa

SEQ ID NO: 126998 - DNA, 16 bp, H. sapiens
tacagtccttgtttct

SEQ ID NO: 126999 - DNA, 16 bp, H. sapiens
tacagtctccacctcc

SEQ ID NO: 127000 - DNA, 16 bp, H. sapiens
tacagtctgcagaact

SEQ ID NO: 127001 - DNA, 16 bp, H. sapiens
tacagtctgggcaaca

SEQ ID NO: 127002 - DNA, 16 bp, H. sapiens
tacagtcttgctctgt

SEQ ID NO: 127003 - DNA, 16 bp, H. sapiens
tacagtgaaatattat

SEQ ID NO: 127004 - DNA, 16 bp, H. sapiens
tacagtgaactgtgat

SEQ ID NO: 127005 - DNA, 16 bp, H. sapiens
tacagtgagatgtgat

SEQ ID NO: 127006 - DNA, 16 bp, H. sapiens
tacagtgagccgaggt

SEQ ID NO: 127007 - DNA, 16 bp, H. sapiens
tacagtgagctacgat

SEQ ID NO: 127008 - DNA, 16 bp, H. sapiens
tacagtgagtcgagat

SEQ ID NO: 127009 - DNA, 16 bp, H. sapiens
tacagtgattttgtat

SEQ ID NO: 127010 - DNA, 16 bp, H. sapiens
tacagtggcgcaatct

SEQ ID NO: 127011 - DNA, 16 bp, H. sapiens
tacagtggctgcacca

SEQ ID NO: 127012 - DNA, 16 bp, H. sapiens
tacagtggtgtgatct

SEQ ID NO: 127013 - DNA, 16 bp, H. sapiens
tacagtgtacactgct

SEQ ID NO: 127014 - DNA, 16 bp, H. sapiens
tacagtgtcttttttt

SEQ ID NO: 127015 - DNA, 16 bp, H. sapiens
tacagtgtgatatttc

SEQ ID NO: 127016 - DNA, 16 bp, H. sapiens
tacagtgtggatgaac

SEQ ID NO: 127017 - DNA, 16 bp, H. sapiens
tacagttaaaaaaata

SEQ ID NO: 127018 - DNA, 16 bp, H. sapiens
tacagttgaccttgaa

SEQ ID NO: 127019 - DNA, 16 bp, H. sapiens
tacagttgatcctcat

SEQ ID NO: 127020 - DNA, 16 bp, H. sapiens
tacagttgggcaaaat

SEQ ID NO: 127021 - DNA, 16 bp, H. sapiens
tacagttgtcccttga

SEQ ID NO: 127022 - DNA, 16 bp, H. sapiens
tacagtttaaatgata

SEQ ID NO: 127023 - DNA, 16 bp, H. sapiens
tacagtttcagttttc

SEQ ID NO: 127024 - DNA, 16 bp, H. sapiens
tacagtttcctcatct

SEQ ID NO: 127025 - DNA, 16 bp, H. sapiens
tacagtttctttaaaa

SEQ ID NO: 127026 - DNA, 16 bp, H. sapiens
tacagtttgagaaaca

SEQ ID NO: 127027 - DNA, 16 bp, H. sapiens
tacagtttgatgaatt

SEQ ID NO: 127028 - DNA, 16 bp, H. sapiens
tacagttttattttat

SEQ ID NO: 127029 - DNA, 16 bp, H. sapiens
tacagttttcagtgta

SEQ ID NO: 127030 - DNA, 16 bp, H. sapiens
tacagttttgtcattt

SEQ ID NO: 127031 - DNA, 16 bp, H. sapiens
tacagttttgtttgtt

SEQ ID NO: 127032 - DNA, 16 bp, H. sapiens
tacagttttgttttct

SEQ ID NO: 127033 - DNA, 16 bp, H. sapiens
tacataaaattagcca

SEQ ID NO: 127034 - DNA, 16 bp, H. sapiens
tacataaagaactctt

SEQ ID NO: 127035 - DNA, 16 bp, H. sapiens
tacataaaggtaaagg

SEQ ID NO: 127036 - DNA, 16 bp, H. sapiens
tacataaagtgcttag

SEQ ID NO: 127037 - DNA, 16 bp, H. sapiens
tacataaagtttaaaa

SEQ ID NO: 127038 - DNA, 16 bp, H. sapiens
tacataaatacacaca

SEQ ID NO: 127039 - DNA, 16 bp, H. sapiens
tacataaatatgtaat

SEQ ID NO: 127040 - DNA, 16 bp, H. sapiens
tacataatgtatataa

SEQ ID NO: 127041 - DNA, 16 bp, H. sapiens
tacataatgttttatt

SEQ ID NO: 127042 - DNA, 16 bp, H. sapiens
tacatacaatgaaatg

SEQ ID NO: 127043 - DNA, 16 bp, H. sapiens
tacatacacacacaca

SEQ ID NO: 127044 - DNA, 16 bp, H. sapiens
tacatacacatatgca

SEQ ID NO: 127045 - DNA, 16 bp, H. sapiens
tacatacaggggagag

SEQ ID NO: 127046 - DNA, 16 bp, H. sapiens
tacatacatacataca

SEQ ID NO: 127047 - DNA, 16 bp, H. sapiens
tacatacatacattta

SEQ ID NO: 127048 - DNA, 16 bp, H. sapiens
tacatacatagtatat

SEQ ID NO: 127049 - DNA, 16 bp, H. sapiens
tacatacatatacaca

SEQ ID NO: 127050 - DNA, 16 bp, H. sapiens
tacatacatatatata

SEQ ID NO: 127051 - DNA, 16 bp, H. sapiens
tacatacatatatgtg

SEQ ID NO: 127052 - DNA, 16 bp, H. sapiens
tacatacatatgcata

SEQ ID NO: 127053 - DNA, 16 bp, H. sapiens
tacatacatatttata

SEQ ID NO: 127054 - DNA, 16 bp, H. sapiens
tacatacatgtttata

SEQ ID NO: 127055 - DNA, 16 bp, H. sapiens
tacatacattatttta

SEQ ID NO: 127056 - DNA, 16 bp, H. sapiens
tacatacatttaaaat

SEQ ID NO: 127057 - DNA, 16 bp, H. sapiens
tacatacattttaata

SEQ ID NO: 127058 - DNA, 16 bp, H. sapiens
tacatacattttatat

SEQ ID NO: 127059 - DNA, 16 bp, H. sapiens
tacatacccaaaagaa

SEQ ID NO: 127060 - DNA, 16 bp, H. sapiens
tacatacctatatata

SEQ ID NO: 127061 - DNA, 17 bp, H. sapiens
tacatagaaactgaaca

SEQ ID NO: 127062 - DNA, 16 bp, H. sapiens
tacatagatatataat

SEQ ID NO: 127063 - DNA, 16 bp, H. sapiens
tacatagtaggtgtat

SEQ ID NO: 127064 - DNA, 16 bp, H. sapiens
tacatagtatataatg

SEQ ID NO: 127065 - DNA, 16 bp, H. sapiens
tacatagtatgtgtat

SEQ ID NO: 127066 - DNA, 16 bp, H. sapiens
tacatataatatgtat

SEQ ID NO: 127067 - DNA, 20 bp, H. sapiens
tacatatacaccatggaata

SEQ ID NO: 127068 - DNA, 16 bp, H. sapiens
tacatatacatgtata

SEQ ID NO: 127069 - DNA, 16 bp, H. sapiens
tacatatactatgttt

SEQ ID NO: 127070 - DNA, 16 bp, H. sapiens
tacatatagatgtata

SEQ ID NO: 127071 - DNA, 16 bp, H. sapiens
tacatatataaataga

SEQ ID NO: 127072 - DNA, 16 bp, H. sapiens
tacatatataatatac

SEQ ID NO: 127073 - DNA, 16 bp, H. sapiens
tacatatatacaatgt

SEQ ID NO: 127074 - DNA, 17 bp, H. sapiens
tacatatatacacatac

SEQ ID NO: 127075 - DNA, 16 bp, H. sapiens
tacatatatacatatg

SEQ ID NO: 127076 - DNA, 16 bp, H. sapiens
tacatatatacattta

SEQ ID NO: 127077 - DNA, 16 bp, H. sapiens
tacatatataccatgg

SEQ ID NO: 127078 - DNA, 16 bp, H. sapiens
tacatatatataacat

SEQ ID NO: 127079 - DNA, 16 bp, H. sapiens
tacatatatatagata

SEQ ID NO: 127080 - DNA, 16 bp, H. sapiens
tacatatatatgaaaa

SEQ ID NO: 127081 - DNA, 16 bp, H. sapiens
tacatatatatgcaca

SEQ ID NO: 127082 - DNA, 16 bp, H. sapiens
tacatatatattacat

SEQ ID NO: 127083 - DNA, 16 bp, H. sapiens
tacatatatatttaga

SEQ ID NO: 127084 - DNA, 16 bp, H. sapiens
tacatatatgtacaca

SEQ ID NO: 127085 - DNA, 16 bp, H. sapiens
tacatatatgtacata

SEQ ID NO: 127086 - DNA, 16 bp, H. sapiens
tacatatatttgcata

SEQ ID NO: 127087 - DNA, 16 bp, H. sapiens
tacatatatttgtata

SEQ ID NO: 127088 - DNA, 16 bp, H. sapiens
tacatatattttaaca

SEQ ID NO: 127089 - DNA, 16 bp, H. sapiens
tacatatcaaaacatc

SEQ ID NO: 127090 - DNA, 16 bp, H. sapiens
tacatatgcagaatgt

SEQ ID NO: 127091 - DNA, 16 bp, H. sapiens
tacatatgcatgcata

SEQ ID NO: 127092 - DNA, 16 bp, H. sapiens
tacatatgtaaaatat

SEQ ID NO: 127093 - DNA, 16 bp, H. sapiens
tacatatgtaaacata

SEQ ID NO: 127094 - DNA, 16 bp, H. sapiens
tacatatgtaaataac

SEQ ID NO: 127095 - DNA, 16 bp, H. sapiens
tacatatgtacacatg

SEQ ID NO: 127096 - DNA, 16 bp, H. sapiens
tacatatgtatatgta

SEQ ID NO: 127097 - DNA, 16 bp, H. sapiens
tacatatgtatgtatg

SEQ ID NO: 127098 - DNA, 16 bp, H. sapiens
tacatatgtgtataca

SEQ ID NO: 127099 - DNA, 16 bp, H. sapiens
tacatatgtgtatata

SEQ ID NO: 127100 - DNA, 16 bp, H. sapiens
tacatatgtttatata

SEQ ID NO: 127101 - DNA, 16 bp, H. sapiens
tacatatgtttatatt

SEQ ID NO: 127102 - DNA, 16 bp, H. sapiens
tacatattactatata

SEQ ID NO: 127103 - DNA, 16 bp, H. sapiens
tacatattatatacat

SEQ ID NO: 127104 - DNA, 16 bp, H. sapiens
tacatattatatatgt

SEQ ID NO: 127105 - DNA, 16 bp, H. sapiens
tacatattatatgtaa

SEQ ID NO: 127106 - DNA, 16 bp, H. sapiens
tacatattcaataaat

SEQ ID NO: 127107 - DNA, 16 bp, H. sapiens
tacatatttacacaca

SEQ ID NO: 127108 - DNA, 16 bp, H. sapiens
tacatatttagatata

SEQ ID NO: 127109 - DNA, 16 bp, H. sapiens
tacatatttatatgta

SEQ ID NO: 127110 - DNA, 16 bp, H. sapiens
tacatatttgaaaata

SEQ ID NO: 127111 - DNA, 16 bp, H. sapiens
tacatatttttaaaag

SEQ ID NO: 127112 - DNA, 16 bp, H. sapiens
tacatatttttaaatc

SEQ ID NO: 127113 - DNA, 16 bp, H. sapiens
tacatcaaaaaataag

SEQ ID NO: 127114 - DNA, 17 bp, H. sapiens
tacatcaaaaagcttat

SEQ ID NO: 127115 - DNA, 16 bp, H. sapiens
tacatcacagaatact

SEQ ID NO: 127116 - DNA, 16 bp, H. sapiens
tacatcaccacacctg

SEQ ID NO: 127117 - DNA, 16 bp, H. sapiens
tacatcagacaaaata

SEQ ID NO: 127118 - DNA, 16 bp, H. sapiens
tacatcagcatcacca

SEQ ID NO: 127119 - DNA, 16 bp, H. sapiens
tacatcataatcaaac

SEQ ID NO: 127120 - DNA, 16 bp, H. sapiens
tacatcctgggtgaca

SEQ ID NO: 127121 - DNA, 16 bp, H. sapiens
tacatctactatgtac

SEQ ID NO: 127122 - DNA, 16 bp, H. sapiens
tacatctatgtattta

SEQ ID NO: 127123 - DNA, 16 bp, H. sapiens
tacatctcattggcca

SEQ ID NO: 127124 - DNA, 16 bp, H. sapiens
tacatctctgttgttt

SEQ ID NO: 127125 - DNA, 16 bp, H. sapiens
tacatctggtccagct

SEQ ID NO: 127126 - DNA, 16 bp, H. sapiens
tacatcttcctccatc

SEQ ID NO: 127127 - DNA, 16 bp, H. sapiens
tacatcttctgaaatg

SEQ ID NO: 127128 - DNA, 16 bp, H. sapiens
tacatctttattttca

SEQ ID NO: 127129 - DNA, 16 bp, H. sapiens
tacatgaaaagatact

SEQ ID NO: 127130 - DNA, 16 bp, H. sapiens
tacatgaataaagaaa

SEQ ID NO: 127131 - DNA, 16 bp, H. sapiens
tacatgaatgaatgaa

SEQ ID NO: 127132 - DNA, 16 bp, H. sapiens
tacatgaatgtatata

SEQ ID NO: 127133 - DNA, 16 bp, H. sapiens
tacatgagccatgctg

SEQ ID NO: 127134 - DNA, 16 bp, H. sapiens
tacatgaggaaactga

SEQ ID NO: 127135 - DNA, 16 bp, H. sapiens
tacatgattttaaaaa

SEQ ID NO: 127136 - DNA, 16 bp, H. sapiens
tacatgcaatggaata

SEQ ID NO: 127137 - DNA, 16 bp, H. sapiens
tacatgcacacacaca

SEQ ID NO: 127138 - DNA, 16 bp, H. sapiens
tacatgcaggaaaaca

SEQ ID NO: 127139 - DNA, 17 bp, H. sapiens
tacatggaaattgaaca

SEQ ID NO: 127140 - DNA, 17 bp, H. sapiens
tacatggataagttctt

SEQ ID NO: 127141 - DNA, 16 bp, H. sapiens
tacatgggaattatgg

SEQ ID NO: 127142 - DNA, 16 bp, H. sapiens
tacatgggtgtgttca

SEQ ID NO: 127143 - DNA, 16 bp, H. sapiens
tacatggtggcaggga

SEQ ID NO: 127144 - DNA, 16 bp, H. sapiens
tacatgtaaaacattt

SEQ ID NO: 127145 - DNA, 16 bp, H. sapiens
tacatgtaaaatttta

SEQ ID NO: 127146 - DNA, 16 bp, H. sapiens
tacatgtaagacctga

SEQ ID NO: 127147 - DNA, 16 bp, H. sapiens
tacatgtaatatattt

SEQ ID NO: 127148 - DNA, 16 bp, H. sapiens
tacatgtaatatttta

SEQ ID NO: 127149 - DNA, 27 bp, H. sapiens
tacatgtaccctaaaacttaaagtata

SEQ ID NO: 127150 - DNA, 16 bp, H. sapiens
tacatgtataatatat

SEQ ID NO: 127151 - DNA, 16 bp, H. sapiens
tacatgtatatatcta

SEQ ID NO: 127152 - DNA, 16 bp, H. sapiens
tacatgtatatattgt

SEQ ID NO: 127153 - DNA, 16 bp, H. sapiens
tacatgtatatattta

SEQ ID NO: 127154 - DNA, 16 bp, H. sapiens
tacatgtattatatac

SEQ ID NO: 127155 - DNA, 16 bp, H. sapiens
tacatgtattatttct

SEQ ID NO: 127156 - DNA, 16 bp, H. sapiens
tacatgtatttatatt

SEQ ID NO: 127157 - DNA, 16 bp, H. sapiens
tacatgtatttgtttg

SEQ ID NO: 127158 - DNA, 16 bp, H. sapiens
tacatgtattttatta

SEQ ID NO: 127159 - DNA, 16 bp, H. sapiens
tacatgtatttttaaa

SEQ ID NO: 127160 - DNA, 16 bp, H. sapiens
tacatgtgagatgggt

SEQ ID NO: 127161 - DNA, 16 bp, H. sapiens
tacatgtgatattttg

SEQ ID NO: 127162 - DNA, 16 bp, H. sapiens
tacatgtgcacactgt

SEQ ID NO: 127163 - DNA, 18 bp, H. sapiens
tacatgtgcacagtgtgc

SEQ ID NO: 127164 - DNA, 20 bp, H. sapiens
tacatgtgcatgtgtcttta

SEQ ID NO: 127165 - DNA, 16 bp, H. sapiens
tacatgtgcctgtgtc

SEQ ID NO: 127166 - DNA, 16 bp, H. sapiens
tacatgtggagaatgt

SEQ ID NO: 127167 - DNA, 16 bp, H. sapiens
tacatgtgtaatatat

SEQ ID NO: 127168 - DNA, 16 bp, H. sapiens
tacatgtgtcatgctg

SEQ ID NO: 127169 - DNA, 16 bp, H. sapiens
tacatgtgtgtgtgta

SEQ ID NO: 127170 - DNA, 16 bp, H. sapiens
tacatgtgtgtgtgtg

SEQ ID NO: 127171 - DNA, 16 bp, H. sapiens
tacatgtgttagataa

SEQ ID NO: 127172 - DNA, 16 bp, H. sapiens
tacatgttgattttgt

SEQ ID NO: 127173 - DNA, 16 bp, H. sapiens
tacatgtttagttttt

SEQ ID NO: 127174 - DNA, 16 bp, H. sapiens
tacatgtttattgaat

SEQ ID NO: 127175 - DNA, 16 bp, H. sapiens
tacatgtttgaaattt

SEQ ID NO: 127176 - DNA, 16 bp, H. sapiens
tacatgtttgtatata

SEQ ID NO: 127177 - DNA, 16 bp, H. sapiens
tacatgttttaaacaa

SEQ ID NO: 127178 - DNA, 16 bp, H. sapiens
tacattaaagttaaaa

SEQ ID NO: 127179 - DNA, 16 bp, H. sapiens
tacattaaatgtaatt

SEQ ID NO: 127180 - DNA, 16 bp, H. sapiens
tacattagggtttact

SEQ ID NO: 127181 - DNA, 16 bp, H. sapiens
tacattatatatgtat

SEQ ID NO: 127182 - DNA, 16 bp, H. sapiens
tacattatctcactta

SEQ ID NO: 127183 - DNA, 16 bp, H. sapiens
tacattattattaact

SEQ ID NO: 127184 - DNA, 16 bp, H. sapiens
tacattattcattata

SEQ ID NO: 127185 - DNA, 16 bp, H. sapiens
tacattatttatgaaa

SEQ ID NO: 127186 - DNA, 16 bp, H. sapiens
tacattcataaggttt

SEQ ID NO: 127187 - DNA, 16 bp, H. sapiens
tacattcatagggttt

SEQ ID NO: 127188 - DNA, 16 bp, H. sapiens
tacattcatatatatg

SEQ ID NO: 127189 - DNA, 16 bp, H. sapiens
tacattccaaccagca

SEQ ID NO: 127190 - DNA, 16 bp, H. sapiens
tacattcccacctaca

SEQ ID NO: 127191 - DNA, 16 bp, H. sapiens
tacattctgcagttgt

SEQ ID NO: 127192 - DNA, 16 bp, H. sapiens
tacattctggatatta

SEQ ID NO: 127193 - DNA, 16 bp, H. sapiens
tacattgaaaaatttt

SEQ ID NO: 127194 - DNA, 16 bp, H. sapiens
tacattgaactgaatg

SEQ ID NO: 127195 - DNA, 16 bp, H. sapiens
tacattgaatttgtat

SEQ ID NO: 127196 - DNA, 16 bp, H. sapiens
tacattgctgctggga

SEQ ID NO: 127197 - DNA, 16 bp, H. sapiens
tacattgtataatgat

SEQ ID NO: 127198 - DNA, 17 bp, H. sapiens
tacattgtatctttgtt

SEQ ID NO: 127199 - DNA, 16 bp, H. sapiens
tacattgtgtttttgt

SEQ ID NO: 127200 - DNA, 16 bp, H. sapiens
tacatttaaaatgttt

SEQ ID NO: 127201 - DNA, 16 bp, H. sapiens
tacatttaaacatttt

SEQ ID NO: 127202 - DNA, 16 bp, H. sapiens
tacatttaagcattta

SEQ ID NO: 127203 - DNA, 16 bp, H. sapiens
tacatttaagtctgta

SEQ ID NO: 127204 - DNA, 16 bp, H. sapiens
tacatttagaaaaaaa

SEQ ID NO: 127205 - DNA, 16 bp, H. sapiens
tacatttatacaatgg

SEQ ID NO: 127206 - DNA, 16 bp, H. sapiens
tacatttatatattca

SEQ ID NO: 127207 - DNA, 16 bp, H. sapiens
tacatttatgtcttta

SEQ ID NO: 127208 - DNA, 16 bp, H. sapiens
tacatttatgttttat

SEQ ID NO: 127209 - DNA, 16 bp, H. sapiens
tacatttatttacaaa

SEQ ID NO: 127210 - DNA, 16 bp, H. sapiens
tacatttatttgaaaa

SEQ ID NO: 127211 - DNA, 16 bp, H. sapiens
tacatttcaaaatcaa

SEQ ID NO: 127212 - DNA, 16 bp, H. sapiens
tacatttccatttatt

SEQ ID NO: 127213 - DNA, 16 bp, H. sapiens
tacatttctaatcatt

SEQ ID NO: 127214 - DNA, 16 bp, H. sapiens
tacatttctgaaatga

SEQ ID NO: 127215 - DNA, 16 bp, H. sapiens
tacatttctgttcatt

SEQ ID NO: 127216 - DNA, 16 bp, H. sapiens
tacatttctgtttctt

SEQ ID NO: 127217 - DNA, 16 bp, H. sapiens
tacatttctttaaaaa

SEQ ID NO: 127218 - DNA, 16 bp, H. sapiens
tacatttctttgaaaa

SEQ ID NO: 127219 - DNA, 16 bp, H. sapiens
tacatttgaaaatcaa

SEQ ID NO: 127220 - DNA, 16 bp, H. sapiens
tacatttgaaaatttt

SEQ ID NO: 127221 - DNA, 16 bp, H. sapiens
tacatttgaaagaaaa

SEQ ID NO: 127222 - DNA, 17 bp, H. sapiens
tacatttgattggtgta

SEQ ID NO: 127223 - DNA, 16 bp, H. sapiens
tacatttgatttttaa

SEQ ID NO: 127224 - DNA, 16 bp, H. sapiens
tacatttgcatttaaa

SEQ ID NO: 127225 - DNA, 16 bp, H. sapiens
tacatttgtattttat

SEQ ID NO: 127226 - DNA, 16 bp, H. sapiens
tacattttaaaaatgt

SEQ ID NO: 127227 - DNA, 16 bp, H. sapiens
tacattttaaaacatt

SEQ ID NO: 127228 - DNA, 16 bp, H. sapiens
tacattttaaaagcaa

SEQ ID NO: 127229 - DNA, 16 bp, H. sapiens
tacattttaaatgtat

SEQ ID NO: 127230 - DNA, 16 bp, H. sapiens
tacattttaatagttt

SEQ ID NO: 127231 - DNA, 16 bp, H. sapiens
tacattttacaaatga

SEQ ID NO: 127232 - DNA, 16 bp, H. sapiens
tacattttagggaagc

SEQ ID NO: 127233 - DNA, 16 bp, H. sapiens
tacattttatagattc

SEQ ID NO: 127234 - DNA, 16 bp, H. sapiens
tacattttatatgtgt

SEQ ID NO: 127235 - DNA, 16 bp, H. sapiens
tacattttatgaaaat

SEQ ID NO: 127236 - DNA, 16 bp, H. sapiens
tacattttatgttatg

SEQ ID NO: 127237 - DNA, 16 bp, H. sapiens
tacattttattataca

SEQ ID NO: 127238 - DNA, 16 bp, H. sapiens
tacattttcaacttaa

SEQ ID NO: 127239 - DNA, 16 bp, H. sapiens
tacattttcaggaaaa

SEQ ID NO: 127240 - DNA, 16 bp, H. sapiens
tacattttcatttgtt

SEQ ID NO: 127241 - DNA, 16 bp, H. sapiens
tacattttctagaaaa

SEQ ID NO: 127242 - DNA, 16 bp, H. sapiens
tacattttctcattta

SEQ ID NO: 127243 - DNA, 16 bp, H. sapiens
tacattttctgctttt

SEQ ID NO: 127244 - DNA, 16 bp, H. sapiens
tacattttgaaatcag

SEQ ID NO: 127245 - DNA, 16 bp, H. sapiens
tacattttgattttat

SEQ ID NO: 127246 - DNA, 16 bp, H. sapiens
tacattttgcttttat

SEQ ID NO: 127247 - DNA, 16 bp, H. sapiens
tacattttgtaaggct

SEQ ID NO: 127248 - DNA, 16 bp, H. sapiens
tacattttgtttttaa

SEQ ID NO: 127249 - DNA, 16 bp, H. sapiens
tacatttttaaaatgt

SEQ ID NO: 127250 - DNA, 16 bp, H. sapiens
tacatttttaaagttt

SEQ ID NO: 127251 - DNA, 16 bp, H. sapiens
tacatttttaaatagt

SEQ ID NO: 127252 - DNA, 16 bp, H. sapiens
tacatttttaaatgta

SEQ ID NO: 127253 - DNA, 16 bp, H. sapiens
tacatttttaaatgtt

SEQ ID NO: 127254 - DNA, 16 bp, H. sapiens
tacatttttattgatt

SEQ ID NO: 127255 - DNA, 16 bp, H. sapiens
tacatttttcaaaact

SEQ ID NO: 127256 - DNA, 16 bp, H. sapiens
tacatttttcttaaaa

SEQ ID NO: 127257 - DNA, 16 bp, H. sapiens
tacatttttgaaaata

SEQ ID NO: 127258 - DNA, 16 bp, H. sapiens
tacatttttgtaaatc

SEQ ID NO: 127259 - DNA, 16 bp, H. sapiens
tacatttttgtttaat

SEQ ID NO: 127260 - DNA, 16 bp, H. sapiens
tacatttttgtttata

SEQ ID NO: 127261 - DNA, 16 bp, H. sapiens
tacatttttgtttgct

SEQ ID NO: 127262 - DNA, 16 bp, H. sapiens
tacattttttaaaatg

SEQ ID NO: 127263 - DNA, 16 bp, H. sapiens
tacatttttttaagta

SEQ ID NO: 127264 - DNA, 16 bp, H. sapiens
tacatttttttcctaa

SEQ ID NO: 127265 - DNA, 16 bp, H. sapiens
tacatttttttctgaa

SEQ ID NO: 127266 - DNA, 16 bp, H. sapiens
taccaaaaaaatggaa

SEQ ID NO: 127267 - DNA, 16 bp, H. sapiens
taccaaaaagacatat

SEQ ID NO: 127268 - DNA, 16 bp, H. sapiens
taccaaaaatacaaga

SEQ ID NO: 127269 - DNA, 16 bp, H. sapiens
taccaaaaatgcaaaa

SEQ ID NO: 127270 - DNA, 16 bp, H. sapiens
taccaaaaattgaaaa

SEQ ID NO: 127271 - DNA, 16 bp, H. sapiens
taccaaaacagaaata

SEQ ID NO: 127272 - DNA, 16 bp, H. sapiens
taccaaaacagatata

SEQ ID NO: 127273 - DNA, 16 bp, H. sapiens
taccaaaacttggcaa

SEQ ID NO: 127274 - DNA, 16 bp, H. sapiens
taccaaaagtacaaaa

SEQ ID NO: 127275 - DNA, 16 bp, H. sapiens
taccaaaatctgtatt

SEQ ID NO: 127276 - DNA, 16 bp, H. sapiens
taccaaagacatggaa

SEQ ID NO: 127277 - DNA, 16 bp, H. sapiens
taccaaagattactaa

SEQ ID NO: 127278 - DNA, 16 bp, H. sapiens
taccaaagcctggaag

SEQ ID NO: 127279 - DNA, 16 bp, H. sapiens
taccaaatatctcttt

SEQ ID NO: 127280 - DNA, 16 bp, H. sapiens
taccaaatgtttaaag

SEQ ID NO: 127281 - DNA, 16 bp, H. sapiens
taccaaccaaaaaaag

SEQ ID NO: 127282 - DNA, 16 bp, H. sapiens
taccaagaaccagaaa

SEQ ID NO: 127283 - DNA, 16 bp, H. sapiens
taccaagacagttgta

SEQ ID NO: 127284 - DNA, 16 bp, H. sapiens
taccaagcaaataaaa

SEQ ID NO: 127285 - DNA, 16 bp, H. sapiens
taccaagcaaatgtaa

SEQ ID NO: 127286 - DNA, 17 bp, H. sapiens
taccaagcaagtggaaa

SEQ ID NO: 127287 - DNA, 16 bp, H. sapiens
taccaagtttcaggta

SEQ ID NO: 127288 - DNA, 16 bp, H. sapiens
taccaataaaacttta

SEQ ID NO: 127289 - DNA, 16 bp, H. sapiens
taccaatcaaaaaaag

SEQ ID NO: 127290 - DNA, 16 bp, H. sapiens
taccaatgacattctt

SEQ ID NO: 127291 - DNA, 16 bp, H. sapiens
taccaatgtcaatttc

SEQ ID NO: 127292 - DNA, 16 bp, H. sapiens
taccaatttgctgtat

SEQ ID NO: 127293 - DNA, 16 bp, H. sapiens
taccacaaaccaggtg

SEQ ID NO: 127294 - DNA, 16 bp, H. sapiens
taccacaaactcagtg

SEQ ID NO: 127295 - DNA, 16 bp, H. sapiens
taccacaaactgagtg

SEQ ID NO: 127296 - DNA, 16 bp, H. sapiens
taccacaataaaaaag

SEQ ID NO: 127297 - DNA, 16 bp, H. sapiens
taccacaattaaaaat

SEQ ID NO: 127298 - DNA, 16 bp, H. sapiens
taccacaatttaaaaa

SEQ ID NO: 127299 - DNA, 16 bp, H. sapiens
taccacacccagctaa

SEQ ID NO: 127300 - DNA, 16 bp, H. sapiens
taccacacctggctaa

SEQ ID NO: 127301 - DNA, 16 bp, H. sapiens
taccacagctggtgct

SEQ ID NO: 127302 - DNA, 16 bp, H. sapiens
taccacagtttgttta

SEQ ID NO: 127303 - DNA, 16 bp, H. sapiens
taccacattttactta

SEQ ID NO: 127304 - DNA, 16 bp, H. sapiens
taccaccaagcccggc

SEQ ID NO: 127305 - DNA, 16 bp, H. sapiens
taccaccacaccaagc

SEQ ID NO: 127306 - DNA, 16 bp, H. sapiens
taccaccacacccggc

SEQ ID NO: 127307 - DNA, 16 bp, H. sapiens
taccaccacactcagc

SEQ ID NO: 127308 - DNA, 16 bp, H. sapiens
taccaccaccatcact

SEQ ID NO: 127309 - DNA, 23 bp, H. sapiens
taccaccacgcccggctaatttt

SEQ ID NO: 127310 - DNA, 16 bp, H. sapiens
taccaccactcccagc

SEQ ID NO: 127311 - DNA, 16 bp, H. sapiens
taccaccatcatcacc

SEQ ID NO: 127312 - DNA, 16 bp, H. sapiens
taccaccatgcctggc

SEQ ID NO: 127313 - DNA, 16 bp, H. sapiens
taccaccatggctggc

SEQ ID NO: 127314 - DNA, 16 bp, H. sapiens
taccaccatgtccagc

SEQ ID NO: 127315 - DNA, 16 bp, H. sapiens
taccacctcataccca

SEQ ID NO: 127316 - DNA, 20 bp, H. sapiens
taccacgcccagctaatttt

SEQ ID NO: 127317 - DNA, 16 bp, H. sapiens
taccactctctcctgg

SEQ ID NO: 127318 - DNA, 16 bp, H. sapiens
taccactgcagtggca

SEQ ID NO: 127319 - DNA, 16 bp, H. sapiens
taccactgccctccag

SEQ ID NO: 127320 - DNA, 16 bp, H. sapiens
taccactgctctccag

SEQ ID NO: 127321 - DNA, 16 bp, H. sapiens
taccacttcatactca

SEQ ID NO: 127322 - DNA, 16 bp, H. sapiens
taccagaagaaaacat

SEQ ID NO: 127323 - DNA, 16 bp, H. sapiens
taccagaaggagaaga

SEQ ID NO: 127324 - DNA, 16 bp, H. sapiens
taccagaatctcaggg

SEQ ID NO: 127325 - DNA, 16 bp, H. sapiens
taccagaatctctggc

SEQ ID NO: 127326 - DNA, 16 bp, H. sapiens
taccagaggctggggg

SEQ ID NO: 127327 - DNA, 16 bp, H. sapiens
taccagatactcagga

SEQ ID NO: 127328 - DNA, 16 bp, H. sapiens
taccagatttaaaatt

SEQ ID NO: 127329 - DNA, 16 bp, H. sapiens
taccagcaccatgaca

SEQ ID NO: 127330 - DNA, 16 bp, H. sapiens
taccagcacctgctct

SEQ ID NO: 127331 - DNA, 16 bp, H. sapiens
taccagccacagcaaa

SEQ ID NO: 127332 - DNA, 17 bp, H. sapiens
taccagccactgcaaaa

SEQ ID NO: 127333 - DNA, 16 bp, H. sapiens
taccagccactgcaga

SEQ ID NO: 127334 - DNA, 17 bp, H. sapiens
taccagccattgcaaaa

SEQ ID NO: 127335 - DNA, 16 bp, H. sapiens
taccagcccagagcct

SEQ ID NO: 127336 - DNA, 17 bp, H. sapiens
taccagcctgggcaaca

SEQ ID NO: 127337 - DNA, 16 bp, H. sapiens
taccagctcacattcc

SEQ ID NO: 127338 - DNA, 16 bp, H. sapiens
taccagctcagccaca

SEQ ID NO: 127339 - DNA, 32 bp, H. sapiens
taccagctgctgcaaaatcatgccaaaatgta

SEQ ID NO: 127340 - DNA, 16 bp, H. sapiens
taccagctgggcacag

SEQ ID NO: 127341 - DNA, 16 bp, H. sapiens
taccaggagagtgggg

SEQ ID NO: 127342 - DNA, 16 bp, H. sapiens
taccagggataaagag

SEQ ID NO: 127343 - DNA, 16 bp, H. sapiens
taccagtgcactccag

SEQ ID NO: 127344 - DNA, 16 bp, H. sapiens
taccagttagaatggc

SEQ ID NO: 127345 - DNA, 16 bp, H. sapiens
taccataaaatttact

SEQ ID NO: 127346 - DNA, 16 bp, H. sapiens
taccataatttactta

SEQ ID NO: 127347 - DNA, 19 bp, H. sapiens
taccatacccagctaattt

SEQ ID NO: 127348 - DNA, 16 bp, H. sapiens
taccatactggacagc

SEQ ID NO: 127349 - DNA, 16 bp, H. sapiens
taccatattttttact

SEQ ID NO: 127350 - DNA, 16 bp, H. sapiens
taccatcacattggag

SEQ ID NO: 127351 - DNA, 16 bp, H. sapiens
taccatccaggaaaac

SEQ ID NO: 127352 - DNA, 16 bp, H. sapiens
taccatctcattaaaa

SEQ ID NO: 127353 - DNA, 16 bp, H. sapiens
taccatctgacccagc

SEQ ID NO: 127354 - DNA, 16 bp, H. sapiens
taccatcttactcctg

SEQ ID NO: 127355 - DNA, 16 bp, H. sapiens
taccatgaggcttaca

SEQ ID NO: 127356 - DNA, 16 bp, H. sapiens
taccatgcccagctga

SEQ ID NO: 127357 - DNA, 20 bp, H. sapiens
taccatgcccggctaatttt

SEQ ID NO: 127358 - DNA, 16 bp, H. sapiens
taccatgctgttttgt

SEQ ID NO: 127359 - DNA, 16 bp, H. sapiens
taccatgtgccaagca

SEQ ID NO: 127360 - DNA, 16 bp, H. sapiens
taccatgtgccaggca

SEQ ID NO: 127361 - DNA, 16 bp, H. sapiens
taccatgttgcccaga

SEQ ID NO: 127362 - DNA, 16 bp, H. sapiens
taccatgttggcaagg

SEQ ID NO: 127363 - DNA, 16 bp, H. sapiens
taccatgttttctttt

SEQ ID NO: 127364 - DNA, 16 bp, H. sapiens
taccattatataatga

SEQ ID NO: 127365 - DNA, 20 bp, H. sapiens
taccattcaagacataggca

SEQ ID NO: 127366 - DNA, 19 bp, H. sapiens
taccattcaggacataggc

SEQ ID NO: 127367 - DNA, 21 bp, H. sapiens
taccattcaggacataggcac

SEQ ID NO: 127368 - DNA, 27 bp, H. sapiens
taccattcaggacataggcatgggcaa

SEQ ID NO: 127369 - DNA, 25 bp, H. sapiens
taccattcaggacataggcatgggg

SEQ ID NO: 127370 - DNA, 39 bp, H. sapiens
taccattcaggacataggcgtgggcaaggacttcatgtc

SEQ ID NO: 127371 - DNA, 19 bp, H. sapiens
taccattcaggccataggc

SEQ ID NO: 127372 - DNA, 16 bp, H. sapiens
taccattcctacagaa

SEQ ID NO: 127373 - DNA, 20 bp, H. sapiens
taccattccttctgaaacca

SEQ ID NO: 127374 - DNA, 22 bp, H. sapiens
taccattccttctgaaactatc

SEQ ID NO: 127375 - DNA, 16 bp, H. sapiens
taccattctggggact

SEQ ID NO: 127376 - DNA, 16 bp, H. sapiens
taccattgatattctt

SEQ ID NO: 127377 - DNA, 16 bp, H. sapiens
taccatttcacaccag

SEQ ID NO: 127378 - DNA, 16 bp, H. sapiens
taccatttgactcagc

SEQ ID NO: 127379 - DNA, 16 bp, H. sapiens
taccatttgatccagc

SEQ ID NO: 127380 - DNA, 16 bp, H. sapiens
taccattttacatttc

SEQ ID NO: 127381 - DNA, 16 bp, H. sapiens
tacccaaaccagacaa

SEQ ID NO: 127382 - DNA, 16 bp, H. sapiens
tacccaaagaaataga

SEQ ID NO: 127383 - DNA, 16 bp, H. sapiens
tacccaaagaactata

SEQ ID NO: 127384 - DNA, 16 bp, H. sapiens
tacccaacaactgcag

SEQ ID NO: 127385 - DNA, 16 bp, H. sapiens
tacccaacaattgcag

SEQ ID NO: 127386 - DNA, 16 bp, H. sapiens
tacccaacaggtaatt

SEQ ID NO: 127387 - DNA, 16 bp, H. sapiens
tacccaactaattttt

SEQ ID NO: 127388 - DNA, 16 bp, H. sapiens
tacccaacttcaaaat

SEQ ID NO: 127389 - DNA, 16 bp, H. sapiens
tacccaagaactgcag

SEQ ID NO: 127390 - DNA, 16 bp, H. sapiens
tacccaagagaaatga

SEQ ID NO: 127391 - DNA, 16 bp, H. sapiens
tacccaataaatattt

SEQ ID NO: 127392 - DNA, 16 bp, H. sapiens
tacccacacttctgtc

SEQ ID NO: 127393 - DNA, 16 bp, H. sapiens
tacccagaagtgagat

SEQ ID NO: 127394 - DNA, 16 bp, H. sapiens
tacccagagacacaaa

SEQ ID NO: 127395 - DNA, 16 bp, H. sapiens
tacccagaggaaaata

SEQ ID NO: 127396 - DNA, 16 bp, H. sapiens
tacccagcaatcccat

SEQ ID NO: 127397 - DNA, 16 bp, H. sapiens
tacccaggaggcggag

SEQ ID NO: 127398 - DNA, 16 bp, H. sapiens
tacccaggctggaggg

SEQ ID NO: 127399 - DNA, 16 bp, H. sapiens
tacccaggctggcctc

SEQ ID NO: 127400 - DNA, 16 bp, H. sapiens
tacccagtaatgaaat

SEQ ID NO: 127401 - DNA, 16 bp, H. sapiens
tacccagtctcaggaa

SEQ ID NO: 127402 - DNA, 16 bp, H. sapiens
tacccagtctcagtat

SEQ ID NO: 127403 - DNA, 17 bp, H. sapiens
tacccatctgacaaagt

SEQ ID NO: 127404 - DNA, 16 bp, H. sapiens
tacccatgaacttaaa

SEQ ID NO: 127405 - DNA, 16 bp, H. sapiens
tacccattaaccagcc

SEQ ID NO: 127406 - DNA, 16 bp, H. sapiens
tacccatttccaaagc

SEQ ID NO: 127407 - DNA, 16 bp, H. sapiens
tacccattttacagat

SEQ ID NO: 127408 - DNA, 16 bp, H. sapiens
taccccataaatatat

SEQ ID NO: 127409 - DNA, 18 bp, H. sapiens
taccccctgcttgctcaa

SEQ ID NO: 127410 - DNA, 16 bp, H. sapiens
tacccctgaacctgaa

SEQ ID NO: 127411 - DNA, 16 bp, H. sapiens
tacccctgaacttaaa

SEQ ID NO: 127412 - DNA, 16 bp, H. sapiens
tacccctgaactttaa

SEQ ID NO: 127413 - DNA, 16 bp, H. sapiens
tacccctgatgaacat

SEQ ID NO: 127414 - DNA, 16 bp, H. sapiens
tacccctgcactccag

SEQ ID NO: 127415 - DNA, 16 bp, H. sapiens
taccccttatttcctt

SEQ ID NO: 127416 - DNA, 16 bp, H. sapiens
taccctaagcaaatta

SEQ ID NO: 127417 - DNA, 16 bp, H. sapiens
taccctccccagcctc

SEQ ID NO: 127418 - DNA, 16 bp, H. sapiens
taccctgaccaccttg

SEQ ID NO: 127419 - DNA, 16 bp, H. sapiens
taccctgatttgatca

SEQ ID NO: 127420 - DNA, 16 bp, H. sapiens
taccctgcaaagccat

SEQ ID NO: 127421 - DNA, 16 bp, H. sapiens
taccctgcctcagcct

SEQ ID NO: 127422 - DNA, 16 bp, H. sapiens
taccctggaacttaaa

SEQ ID NO: 127423 - DNA, 16 bp, H. sapiens
tacccttctcagcctc

SEQ ID NO: 127424 - DNA, 16 bp, H. sapiens
tacccttctgacaaag

SEQ ID NO: 127425 - DNA, 17 bp, H. sapiens
taccctttcttccagtt

SEQ ID NO: 127426 - DNA, 16 bp, H. sapiens
taccggaatctctggg

SEQ ID NO: 127427 - DNA, 16 bp, H. sapiens
tacctaaaattaccag

SEQ ID NO: 127428 - DNA, 16 bp, H. sapiens
tacctaaacatagaaa

SEQ ID NO: 127429 - DNA, 16 bp, H. sapiens
tacctaatagtttttc

SEQ ID NO: 127430 - DNA, 16 bp, H. sapiens
tacctacctcaaaggg

SEQ ID NO: 127431 - DNA, 16 bp, H. sapiens
tacctacctcacagga

SEQ ID NO: 127432 - DNA, 16 bp, H. sapiens
tacctacctcactggg

SEQ ID NO: 127433 - DNA, 16 bp, H. sapiens
tacctagaaatggaat

SEQ ID NO: 127434 - DNA, 16 bp, H. sapiens
tacctaggaattaacc

SEQ ID NO: 127435 - DNA, 17 bp, H. sapiens
tacctaggctatatggt

SEQ ID NO: 127436 - DNA, 16 bp, H. sapiens
tacctaggtgatgggc

SEQ ID NO: 127437 - DNA, 16 bp, H. sapiens
tacctatcaggtatta

SEQ ID NO: 127438 - DNA, 16 bp, H. sapiens
tacctatctaacaaac

SEQ ID NO: 127439 - DNA, 18 bp, H. sapiens
tacctatgtaacaaacct

SEQ ID NO: 127440 - DNA, 17 bp, H. sapiens
tacctatgtaacaaact

SEQ ID NO: 127441 - DNA, 16 bp, H. sapiens
tacctatttaataaat

SEQ ID NO: 127442 - DNA, 16 bp, H. sapiens
tacctcaaaataataa

SEQ ID NO: 127443 - DNA, 16 bp, H. sapiens
tacctcaaaataatag

SEQ ID NO: 127444 - DNA, 16 bp, H. sapiens
tacctcacatctcaat

SEQ ID NO: 127445 - DNA, 16 bp, H. sapiens
tacctcacttcaaatt

SEQ ID NO: 127446 - DNA, 16 bp, H. sapiens
tacctcagactcccga

SEQ ID NO: 127447 - DNA, 22 bp, H. sapiens
tacctcagcctcccgagtagct

SEQ ID NO: 127448 - DNA, 16 bp, H. sapiens
tacctcagcttccaga

SEQ ID NO: 127449 - DNA, 16 bp, H. sapiens
tacctcatggagttgt

SEQ ID NO: 127450 - DNA, 16 bp, H. sapiens
tacctcattcttccta

SEQ ID NO: 127451 - DNA, 16 bp, H. sapiens
tacctcattcttttaa

SEQ ID NO: 127452 - DNA, 16 bp, H. sapiens
tacctcatttttcctg

SEQ ID NO: 127453 - DNA, 16 bp, H. sapiens
tacctccagggttcaa

SEQ ID NO: 127454 - DNA, 16 bp, H. sapiens
tacctcccacctggtc

SEQ ID NO: 127455 - DNA, 17 bp, H. sapiens
tacctcccaggatcaag

SEQ ID NO: 127456 - DNA, 16 bp, H. sapiens
tacctcctggattcaa

SEQ ID NO: 127457 - DNA, 16 bp, H. sapiens
tacctcctgggtcctg

SEQ ID NO: 127458 - DNA, 16 bp, H. sapiens
tacctcggccttccaa

SEQ ID NO: 127459 - DNA, 16 bp, H. sapiens
tacctcggcttcccaa

SEQ ID NO: 127460 - DNA, 16 bp, H. sapiens
tacctctcactgggtc

SEQ ID NO: 127461 - DNA, 16 bp, H. sapiens
tacctctcatagaatt

SEQ ID NO: 127462 - DNA, 16 bp, H. sapiens
tacctctccagcctca

SEQ ID NO: 127463 - DNA, 29 bp, H. sapiens
tacctctccccagctatctccaccacact

SEQ ID NO: 127464 - DNA, 16 bp, H. sapiens
tacctctgtaacaaac

SEQ ID NO: 127465 - DNA, 16 bp, H. sapiens
tacctgactccaaact

SEQ ID NO: 127466 - DNA, 26 bp, H. sapiens
tacctgacttcaaactatactacaac

SEQ ID NO: 127467 - DNA, 27 bp, H. sapiens
tacctgacttcaaactatactacaagc

SEQ ID NO: 127468 - DNA, 42 bp, H. sapiens
tacctgacttcaaactatactacaaggctacagtaaccaaaa

SEQ ID NO: 127469 - DNA, 47 bp, H. sapiens
tacctgacttcaaactatactacaaggctacagtaaccaaaacagca

SEQ ID NO: 127470 - DNA, 17 bp, H. sapiens
tacctgacttcaaactt

SEQ ID NO: 127471 - DNA, 16 bp, H. sapiens
tacctgacttcaaagt

SEQ ID NO: 127472 - DNA, 16 bp, H. sapiens
tacctgaggttgggag

SEQ ID NO: 127473 - DNA, 16 bp, H. sapiens
tacctgcactcctatg

SEQ ID NO: 127474 - DNA, 16 bp, H. sapiens
tacctgcagcttttcc

SEQ ID NO: 127475 - DNA, 16 bp, H. sapiens
tacctgctgtgtgacc

SEQ ID NO: 127476 - DNA, 16 bp, H. sapiens
tacctgcttccccttt

SEQ ID NO: 127477 - DNA, 16 bp, H. sapiens
tacctggaaattaaat

SEQ ID NO: 127478 - DNA, 16 bp, H. sapiens
tacctgggatgctgag

SEQ ID NO: 127479 - DNA, 16 bp, H. sapiens
tacctgggcgtggtgg

SEQ ID NO: 127480 - DNA, 16 bp, H. sapiens
tacctgggggccaggc

SEQ ID NO: 127481 - DNA, 16 bp, H. sapiens
tacctgggtgcagtgg

SEQ ID NO: 127482 - DNA, 16 bp, H. sapiens
tacctgtaatccaagc

SEQ ID NO: 127483 - DNA, 16 bp, H. sapiens
tacctgtaatcccagc

SEQ ID NO: 127484 - DNA, 17 bp, H. sapiens
tacctgtaatcctagct

SEQ ID NO: 127485 - DNA, 16 bp, H. sapiens
tacctgtcctagaacc

SEQ ID NO: 127486 - DNA, 16 bp, H. sapiens
tacctgtgcaggtttg

SEQ ID NO: 127487 - DNA, 16 bp, H. sapiens
tacctgtgtgcatgtg

SEQ ID NO: 127488 - DNA, 16 bp, H. sapiens
taccttacatggcaaa

SEQ ID NO: 127489 - DNA, 17 bp, H. sapiens
taccttaggtatttctc

SEQ ID NO: 127490 - DNA, 16 bp, H. sapiens
taccttatacaaaaat

SEQ ID NO: 127491 - DNA, 16 bp, H. sapiens
taccttatatagcaaa

SEQ ID NO: 127492 - DNA, 16 bp, H. sapiens
taccttcattttacaa

SEQ ID NO: 127493 - DNA, 16 bp, H. sapiens
taccttgaatataaat

SEQ ID NO: 127494 - DNA, 16 bp, H. sapiens
tacctttactgtccta

SEQ ID NO: 127495 - DNA, 16 bp, H. sapiens
tacctttagttaaata

SEQ ID NO: 127496 - DNA, 16 bp, H. sapiens
tacctttcaagtttat

SEQ ID NO: 127497 - DNA, 16 bp, H. sapiens
tacctttccatttatt

SEQ ID NO: 127498 - DNA, 16 bp, H. sapiens
tacctttcccagtctc

SEQ ID NO: 127499 - DNA, 16 bp, H. sapiens
tacctttgatctttga

SEQ ID NO: 127500 - DNA, 16 bp, H. sapiens
taccttttaaaattat

SEQ ID NO: 127501 - DNA, 16 bp, H. sapiens
taccttttaagcattt

SEQ ID NO: 127502 - DNA, 16 bp, H. sapiens
taccttttggtttaca

SEQ ID NO: 127503 - DNA, 16 bp, H. sapiens
tacctttttaaaaaca

SEQ ID NO: 127504 - DNA, 16 bp, H. sapiens
tacgcaaaggattata

SEQ ID NO: 127505 - DNA, 16 bp, H. sapiens
tacgcccagctaattt

SEQ ID NO: 127506 - DNA, 20 bp, H. sapiens
tacgcctgtaatcccagcag

SEQ ID NO: 127507 - DNA, 18 bp, H. sapiens
tacgggcatgagccacca

SEQ ID NO: 127508 - DNA, 16 bp, H. sapiens
tacgggcatgcaccac

SEQ ID NO: 127509 - DNA, 16 bp, H. sapiens
tacggtcccaccaaca

SEQ ID NO: 127510 - DNA, 16 bp, H. sapiens
tacgtatatgtatatg

SEQ ID NO: 127511 - DNA, 16 bp, H. sapiens
tacgtggatggtggca

SEQ ID NO: 127512 - DNA, 16 bp, H. sapiens
tacgttttcatttctc

SEQ ID NO: 127513 - DNA, 16 bp, H. sapiens
tactaaaaagacagaa

SEQ ID NO: 127514 - DNA, 16 bp, H. sapiens
tactaaaaatgcagaa

SEQ ID NO: 127515 - DNA, 16 bp, H. sapiens
tactaaaaatgtgaaa

SEQ ID NO: 127516 - DNA, 16 bp, H. sapiens
tactaaaagaaaacag

SEQ ID NO: 127517 - DNA, 16 bp, H. sapiens
tactaaaagtgaaaaa

SEQ ID NO: 127518 - DNA, 16 bp, H. sapiens
tactaaaatgcaaaaa

SEQ ID NO: 127519 - DNA, 16 bp, H. sapiens
tactaaaattagctgg

SEQ ID NO: 127520 - DNA, 16 bp, H. sapiens
tactaaagaagaaaag

SEQ ID NO: 127521 - DNA, 16 bp, H. sapiens
tactaaagaatacaaa

SEQ ID NO: 127522 - DNA, 16 bp, H. sapiens
tactaaagatataagt

SEQ ID NO: 127523 - DNA, 16 bp, H. sapiens
tactaaagctacaaaa

SEQ ID NO: 127524 - DNA, 16 bp, H. sapiens
tactaaatatacagaa

SEQ ID NO: 127525 - DNA, 16 bp, H. sapiens
tactaagaacacaaaa

SEQ ID NO: 127526 - DNA, 16 bp, H. sapiens
tactaattttgtgttt

SEQ ID NO: 127527 - DNA, 16 bp, H. sapiens
tactacaacctctgcc

SEQ ID NO: 127528 - DNA, 17 bp, H. sapiens
tactacactccagcctg

SEQ ID NO: 127529 - DNA, 16 bp, H. sapiens
tactacagcctcaacc

SEQ ID NO: 127530 - DNA, 16 bp, H. sapiens
tactacaggactacag

SEQ ID NO: 127531 - DNA, 16 bp, H. sapiens
tactacaggttgagta

SEQ ID NO: 127532 - DNA, 16 bp, H. sapiens
tactacatgccaagca

SEQ ID NO: 127533 - DNA, 16 bp, H. sapiens
tactactaccaccacc

SEQ ID NO: 127534 - DNA, 16 bp, H. sapiens
tactactactattatt

SEQ ID NO: 127535 - DNA, 16 bp, H. sapiens
tactactgaactgtac

SEQ ID NO: 127536 - DNA, 16 bp, H. sapiens
tactactgcagctgat

SEQ ID NO: 127537 - DNA, 16 bp, H. sapiens
tactacttccatctct

SEQ ID NO: 127538 - DNA, 16 bp, H. sapiens
tactagacataagaaa

SEQ ID NO: 127539 - DNA, 16 bp, H. sapiens
tactagctaaccgaat

SEQ ID NO: 127540 - DNA, 16 bp, H. sapiens
tactagtaaaccaaat

SEQ ID NO: 127541 - DNA, 16 bp, H. sapiens
tactagttttttaaaa

SEQ ID NO: 127542 - DNA, 16 bp, H. sapiens
tactataaacacctgt

SEQ ID NO: 127543 - DNA, 16 bp, H. sapiens
tactataaatacttct

SEQ ID NO: 127544 - DNA, 16 bp, H. sapiens
tactataacagaatac

SEQ ID NO: 127545 - DNA, 16 bp, H. sapiens
tactatcacaagaata

SEQ ID NO: 127546 - DNA, 16 bp, H. sapiens
tactatcatgaaaaca

SEQ ID NO: 127547 - DNA, 16 bp, H. sapiens
tactatccccatcaag

SEQ ID NO: 127548 - DNA, 16 bp, H. sapiens
tactatcttctcaatt

SEQ ID NO: 127549 - DNA, 16 bp, H. sapiens
tactatgataggaaat

SEQ ID NO: 127550 - DNA, 16 bp, H. sapiens
tactatgtatatgtat

SEQ ID NO: 127551 - DNA, 16 bp, H. sapiens
tactatgtgccaagaa

SEQ ID NO: 127552 - DNA, 16 bp, H. sapiens
tactatgtgccaggca

SEQ ID NO: 127553 - DNA, 16 bp, H. sapiens
tactatgtgccaggct

SEQ ID NO: 127554 - DNA, 16 bp, H. sapiens
tactatgtggcaggca

SEQ ID NO: 127555 - DNA, 16 bp, H. sapiens
tactatgtgtcagtca

SEQ ID NO: 127556 - DNA, 17 bp, H. sapiens
tactattcaggacatag

SEQ ID NO: 127557 - DNA, 16 bp, H. sapiens
tactattctcatggta

SEQ ID NO: 127558 - DNA, 16 bp, H. sapiens
tactattgccatttta

SEQ ID NO: 127559 - DNA, 16 bp, H. sapiens
tactattgttaaaatg

SEQ ID NO: 127560 - DNA, 16 bp, H. sapiens
tactatttcattgtgt

SEQ ID NO: 127561 - DNA, 16 bp, H. sapiens
tactatttgttgaaaa

SEQ ID NO: 127562 - DNA, 16 bp, H. sapiens
tactattttgctattt

SEQ ID NO: 127563 - DNA, 16 bp, H. sapiens
tactatttttgagaca

SEQ ID NO: 127564 - DNA, 16 bp, H. sapiens
tactcaaaataattga

SEQ ID NO: 127565 - DNA, 16 bp, H. sapiens
tactcaagaaatattt

SEQ ID NO: 127566 - DNA, 16 bp, H. sapiens
tactcaagaggccaag

SEQ ID NO: 127567 - DNA, 16 bp, H. sapiens
tactcaagcctgggtg

SEQ ID NO: 127568 - DNA, 16 bp, H. sapiens
tactcaataaatactt

SEQ ID NO: 127569 - DNA, 16 bp, H. sapiens
tactcaatgtttagct

SEQ ID NO: 127570 - DNA, 16 bp, H. sapiens
tactcacacacatata

SEQ ID NO: 127571 - DNA, 16 bp, H. sapiens
tactcaccatgggcct

SEQ ID NO: 127572 - DNA, 16 bp, H. sapiens
tactcagaaatgggat

SEQ ID NO: 127573 - DNA, 16 bp, H. sapiens
tactcagaagctgagg

SEQ ID NO: 127574 - DNA, 16 bp, H. sapiens
tactcagcaataaaaa

SEQ ID NO: 127575 - DNA, 16 bp, H. sapiens
tactcagcaggctgag

SEQ ID NO: 127576 - DNA, 16 bp, H. sapiens
tactcagcctcaggta

SEQ ID NO: 127577 - DNA, 16 bp, H. sapiens
tactcagccttaaaaa

SEQ ID NO: 127578 - DNA, 16 bp, H. sapiens
tactcaggaagccgag

SEQ ID NO: 127579 - DNA, 16 bp, H. sapiens
tactcaggaagctgaa

SEQ ID NO: 127580 - DNA, 16 bp, H. sapiens
tactcaggaggttggg

SEQ ID NO: 127581 - DNA, 16 bp, H. sapiens
tactcaggcatggtgg

SEQ ID NO: 127582 - DNA, 16 bp, H. sapiens
tactcatctgataaag

SEQ ID NO: 127583 - DNA, 16 bp, H. sapiens
tactcatgcctgtaat

SEQ ID NO: 127584 - DNA, 16 bp, H. sapiens
tactcattgtctcagt

SEQ ID NO: 127585 - DNA, 16 bp, H. sapiens
tactccacagacagag

SEQ ID NO: 127586 - DNA, 16 bp, H. sapiens
tactccacatcctcac

SEQ ID NO: 127587 - DNA, 20 bp, H. sapiens
tactccagcctggatgacag

SEQ ID NO: 127588 - DNA, 16 bp, H. sapiens
tactccagcctggcag

SEQ ID NO: 127589 - DNA, 17 bp, H. sapiens
tactccagcttgggtga

SEQ ID NO: 127590 - DNA, 17 bp, H. sapiens
tactccatcctgggtga

SEQ ID NO: 127591 - DNA, 16 bp, H. sapiens
tactccattgtgtgga

SEQ ID NO: 127592 - DNA, 16 bp, H. sapiens
tactcccagcactttg

SEQ ID NO: 127593 - DNA, 16 bp, H. sapiens
tactcccagctacctg

SEQ ID NO: 127594 - DNA, 16 bp, H. sapiens
tactcccagctacttg

SEQ ID NO: 127595 - DNA, 20 bp, H. sapiens
tactccgagctacaggagga

SEQ ID NO: 127596 - DNA, 16 bp, H. sapiens
tactcctaaatatttt

SEQ ID NO: 127597 - DNA, 16 bp, H. sapiens
tactcctgcaataatg

SEQ ID NO: 127598 - DNA, 16 bp, H. sapiens
tactcctgcctgggtg

SEQ ID NO: 127599 - DNA, 16 bp, H. sapiens
tactcggaggctgaga

SEQ ID NO: 127600 - DNA, 16 bp, H. sapiens
tactctatttttaaaa

SEQ ID NO: 127601 - DNA, 16 bp, H. sapiens
tactctcaccaacagt

SEQ ID NO: 127602 - DNA, 16 bp, H. sapiens
tactctctgcttccct

SEQ ID NO: 127603 - DNA, 16 bp, H. sapiens
tactctctggctcttt

SEQ ID NO: 127604 - DNA, 16 bp, H. sapiens
tactctggaagctgaa

SEQ ID NO: 127605 - DNA, 16 bp, H. sapiens
tactctggaggttgag

SEQ ID NO: 127606 - DNA, 16 bp, H. sapiens
tactctgtgccaggta

SEQ ID NO: 127607 - DNA, 16 bp, H. sapiens
tactctgttccactgg

SEQ ID NO: 127608 - DNA, 16 bp, H. sapiens
tactcttcaatttctt

SEQ ID NO: 127609 - DNA, 16 bp, H. sapiens
tactcttctgacaaag

SEQ ID NO: 127610 - DNA, 16 bp, H. sapiens
tactctttgtacctct

SEQ ID NO: 127611 - DNA, 16 bp, H. sapiens
tactcttttgtctttg

SEQ ID NO: 127612 - DNA, 16 bp, H. sapiens
tactgaaaaaaataca

SEQ ID NO: 127613 - DNA, 16 bp, H. sapiens
tactgaaaaatgcaaa

SEQ ID NO: 127614 - DNA, 16 bp, H. sapiens
tactgaaaaatgcatc

SEQ ID NO: 127615 - DNA, 16 bp, H. sapiens
tactgaaaacagaaaa

SEQ ID NO: 127616 - DNA, 16 bp, H. sapiens
tactgaaaataagaaa

SEQ ID NO: 127617 - DNA, 16 bp, H. sapiens
tactgaaaatacagaa

SEQ ID NO: 127618 - DNA, 16 bp, H. sapiens
tactgaaaatactaaa

SEQ ID NO: 127619 - DNA, 16 bp, H. sapiens
tactgaaaatataaaa

SEQ ID NO: 127620 - DNA, 16 bp, H. sapiens
tactgaaaatgaaaaa

SEQ ID NO: 127621 - DNA, 16 bp, H. sapiens
tactgaaagaaaaaga

SEQ ID NO: 127622 - DNA, 16 bp, H. sapiens
tactgaaagaaagaaa

SEQ ID NO: 127623 - DNA, 16 bp, H. sapiens
tactgaaatgggaaaa

SEQ ID NO: 127624 - DNA, 16 bp, H. sapiens
tactgaaattgaaaaa

SEQ ID NO: 127625 - DNA, 16 bp, H. sapiens
tactgaactatacact

SEQ ID NO: 127626 - DNA, 16 bp, H. sapiens
tactgaactccagcct

SEQ ID NO: 127627 - DNA, 16 bp, H. sapiens
tactgaagaaatcttt

SEQ ID NO: 127628 - DNA, 16 bp, H. sapiens
tactgaagattttttt

SEQ ID NO: 127629 - DNA, 16 bp, H. sapiens
tactgaagtataattt

SEQ ID NO: 127630 - DNA, 16 bp, H. sapiens
tactgaagtcattttt

SEQ ID NO: 127631 - DNA, 16 bp, H. sapiens
tactgaagtttttttt

SEQ ID NO: 127632 - DNA, 16 bp, H. sapiens
tactgaatagtattcc

SEQ ID NO: 127633 - DNA, 16 bp, H. sapiens
tactgaatatttattt

SEQ ID NO: 127634 - DNA, 16 bp, H. sapiens
tactgaatatttctgt

SEQ ID NO: 127635 - DNA, 16 bp, H. sapiens
tactgaatgtggaaaa

SEQ ID NO: 127636 - DNA, 16 bp, H. sapiens
tactgaattagaatct

SEQ ID NO: 127637 - DNA, 16 bp, H. sapiens
tactgaattggcaaaa

SEQ ID NO: 127638 - DNA, 16 bp, H. sapiens
tactgaatttgttgat

SEQ ID NO: 127639 - DNA, 16 bp, H. sapiens
tactgacacaaaaaca

SEQ ID NO: 127640 - DNA, 16 bp, H. sapiens
tactgacacacacaca

SEQ ID NO: 127641 - DNA, 16 bp, H. sapiens
tactgacagcactaga

SEQ ID NO: 127642 - DNA, 16 bp, H. sapiens
tactgacatttggggc

SEQ ID NO: 127643 - DNA, 16 bp, H. sapiens
tactgacattttaaaa

SEQ ID NO: 127644 - DNA, 16 bp, H. sapiens
tactgacctcgtgatc

SEQ ID NO: 127645 - DNA, 16 bp, H. sapiens
tactgacttcatagaa

SEQ ID NO: 127646 - DNA, 16 bp, H. sapiens
tactgaggagactgag

SEQ ID NO: 127647 - DNA, 16 bp, H. sapiens
tactgaggaggctgaa

SEQ ID NO: 127648 - DNA, 16 bp, H. sapiens
tactgaggaggctgag

SEQ ID NO: 127649 - DNA, 16 bp, H. sapiens
tactgagggaatttgt

SEQ ID NO: 127650 - DNA, 16 bp, H. sapiens
tactgagtcagaaact

SEQ ID NO: 127651 - DNA, 16 bp, H. sapiens
tactgataatatattt

SEQ ID NO: 127652 - DNA, 16 bp, H. sapiens
tactgatatggtttgg

SEQ ID NO: 127653 - DNA, 16 bp, H. sapiens
tactgatgaatggata

SEQ ID NO: 127654 - DNA, 16 bp, H. sapiens
tactgatgagaaaact

SEQ ID NO: 127655 - DNA, 16 bp, H. sapiens
tactgatgggcatttg

SEQ ID NO: 127656 - DNA, 16 bp, H. sapiens
tactgatttcctttgg

SEQ ID NO: 127657 - DNA, 16 bp, H. sapiens
tactgattttcatatg

SEQ ID NO: 127658 - DNA, 16 bp, H. sapiens
tactgattttgtttcc

SEQ ID NO: 127659 - DNA, 16 bp, H. sapiens
tactgatttttgtaag

SEQ ID NO: 127660 - DNA, 16 bp, H. sapiens
tactgcaacttctgcc

SEQ ID NO: 127661 - DNA, 16 bp, H. sapiens
tactgcaatagcctcc

SEQ ID NO: 127662 - DNA, 16 bp, H. sapiens
tactgcaccattttat

SEQ ID NO: 127663 - DNA, 16 bp, H. sapiens
tactgcactccagccc

SEQ ID NO: 127664 - DNA, 17 bp, H. sapiens
tactgcagcctgggcga

SEQ ID NO: 127665 - DNA, 16 bp, H. sapiens
tactgcagccttcacc

SEQ ID NO: 127666 - DNA, 16 bp, H. sapiens
tactgcaggaacagaa

SEQ ID NO: 127667 - DNA, 16 bp, H. sapiens
tactgcatgatcttac

SEQ ID NO: 127668 - DNA, 16 bp, H. sapiens
tactgcatgatgctga

SEQ ID NO: 127669 - DNA, 16 bp, H. sapiens
tactgcatgccaggca

SEQ ID NO: 127670 - DNA, 16 bp, H. sapiens
tactgcattccaacct

SEQ ID NO: 127671 - DNA, 16 bp, H. sapiens
tactgcatttcagcct

SEQ ID NO: 127672 - DNA, 16 bp, H. sapiens
tactgcatttttaaaa

SEQ ID NO: 127673 - DNA, 16 bp, H. sapiens
tactgcccaggctgga

SEQ ID NO: 127674 - DNA, 16 bp, H. sapiens
tactgcctcagcctcc

SEQ ID NO: 127675 - DNA, 16 bp, H. sapiens
tactgctcaaggtcat

SEQ ID NO: 127676 - DNA, 16 bp, H. sapiens
tactgcttgttctcac

SEQ ID NO: 127677 - DNA, 16 bp, H. sapiens
tactgctttgaatgtg

SEQ ID NO: 127678 - DNA, 16 bp, H. sapiens
tactgcttttgttgta

SEQ ID NO: 127679 - DNA, 16 bp, H. sapiens
tactggaagaaaaaaa

SEQ ID NO: 127680 - DNA, 16 bp, H. sapiens
tactggaagtcctagc

SEQ ID NO: 127681 - DNA, 16 bp, H. sapiens
tactggaatggaatgg

SEQ ID NO: 127682 - DNA, 16 bp, H. sapiens
tactggactttttttt

SEQ ID NO: 127683 - DNA, 16 bp, H. sapiens
tactggagaggatgtg

SEQ ID NO: 127684 - DNA, 16 bp, H. sapiens
tactggatcacagccc

SEQ ID NO: 127685 - DNA, 16 bp, H. sapiens
tactggcacaaaaaca

SEQ ID NO: 127686 - DNA, 16 bp, H. sapiens
tactggcagccagcct

SEQ ID NO: 127687 - DNA, 21 bp, H. sapiens
tactggctgggcacagtggct

SEQ ID NO: 127688 - DNA, 16 bp, H. sapiens
tactgggcatctaccc

SEQ ID NO: 127689 - DNA, 16 bp, H. sapiens
tactggggcactgcct

SEQ ID NO: 127690 - DNA, 16 bp, H. sapiens
tactgggttgaatggt

SEQ ID NO: 127691 - DNA, 16 bp, H. sapiens
tactggtacaaaaaga

SEQ ID NO: 127692 - DNA, 16 bp, H. sapiens
tactggtataaatata

SEQ ID NO: 127693 - DNA, 16 bp, H. sapiens
tactggtgccaaaaca

SEQ ID NO: 127694 - DNA, 16 bp, H. sapiens
tactgtaaatgtattt

SEQ ID NO: 127695 - DNA, 16 bp, H. sapiens
tactgtaactttttta

SEQ ID NO: 127696 - DNA, 16 bp, H. sapiens
tactgtaatattttta

SEQ ID NO: 127697 - DNA, 19 bp, H. sapiens
tactgtacttctacataca

SEQ ID NO: 127698 - DNA, 16 bp, H. sapiens
tactgtagccttgaag

SEQ ID NO: 127699 - DNA, 16 bp, H. sapiens
tactgtatataaaata

SEQ ID NO: 127700 - DNA, 16 bp, H. sapiens
tactgtatatattttt

SEQ ID NO: 127701 - DNA, 16 bp, H. sapiens
tactgtattgtatatt

SEQ ID NO: 127702 - DNA, 16 bp, H. sapiens
tactgtattgtgtact

SEQ ID NO: 127703 - DNA, 16 bp, H. sapiens
tactgtatttgtttat

SEQ ID NO: 127704 - DNA, 16 bp, H. sapiens
tactgtatttttactt

SEQ ID NO: 127705 - DNA, 16 bp, H. sapiens
tactgtatttttcaaa

SEQ ID NO: 127706 - DNA, 16 bp, H. sapiens
tactgtcttcctttgt

SEQ ID NO: 127707 - DNA, 16 bp, H. sapiens
tactgtgaaaggaaaa

SEQ ID NO: 127708 - DNA, 16 bp, H. sapiens
tactgtgaatactgct

SEQ ID NO: 127709 - DNA, 16 bp, H. sapiens
tactgtgcctaattta

SEQ ID NO: 127710 - DNA, 16 bp, H. sapiens
tactgtgcctggctaa

SEQ ID NO: 127711 - DNA, 16 bp, H. sapiens
tactgtggtttgaatg

SEQ ID NO: 127712 - DNA, 16 bp, H. sapiens
tactgtgtatcaggca

SEQ ID NO: 127713 - DNA, 16 bp, H. sapiens
tactgtgtgccaaaca

SEQ ID NO: 127714 - DNA, 16 bp, H. sapiens
tactgtgtgctaagca

SEQ ID NO: 127715 - DNA, 16 bp, H. sapiens
tactgtgtgctaggca

SEQ ID NO: 127716 - DNA, 16 bp, H. sapiens
tactgtgttttttaca

SEQ ID NO: 127717 - DNA, 16 bp, H. sapiens
tactgttaaaatgtca

SEQ ID NO: 127718 - DNA, 16 bp, H. sapiens
tactgttctcatggtg

SEQ ID NO: 127719 - DNA, 16 bp, H. sapiens
tactgttgaccagaaa

SEQ ID NO: 127720 - DNA, 16 bp, H. sapiens
tactgttggtgggaat

SEQ ID NO: 127721 - DNA, 16 bp, H. sapiens
tactgttgtggaatat

SEQ ID NO: 127722 - DNA, 16 bp, H. sapiens
tactgtttaatttcca

SEQ ID NO: 127723 - DNA, 16 bp, H. sapiens
tactgtttgaattttt

SEQ ID NO: 127724 - DNA, 16 bp, H. sapiens
tactgtttgccaggca

SEQ ID NO: 127725 - DNA, 16 bp, H. sapiens
tactgttttctaaaat

SEQ ID NO: 127726 - DNA, 16 bp, H. sapiens
tactgtttttaaaaag

SEQ ID NO: 127727 - DNA, 16 bp, H. sapiens
tacttaaaaaatgttt

SEQ ID NO: 127728 - DNA, 16 bp, H. sapiens
tacttaaaaccctcca

SEQ ID NO: 127729 - DNA, 16 bp, H. sapiens
tacttaaaaggaaaaa

SEQ ID NO: 127730 - DNA, 16 bp, H. sapiens
tacttaaatatttttg

SEQ ID NO: 127731 - DNA, 16 bp, H. sapiens
tacttaataaatgttt

SEQ ID NO: 127732 - DNA, 16 bp, H. sapiens
tacttaatctttctga

SEQ ID NO: 127733 - DNA, 16 bp, H. sapiens
tacttaatttctctgt

SEQ ID NO: 127734 - DNA, 16 bp, H. sapiens
tacttaatttgtttat

SEQ ID NO: 127735 - DNA, 16 bp, H. sapiens
tacttaccattgtgtt

SEQ ID NO: 127736 - DNA, 16 bp, H. sapiens
tacttactattgtgtt

SEQ ID NO: 127737 - DNA, 16 bp, H. sapiens
tacttagaaaaaccta

SEQ ID NO: 127738 - DNA, 16 bp, H. sapiens
tacttagcaatgaaaa

SEQ ID NO: 127739 - DNA, 18 bp, H. sapiens
tacttagcagactgggaa

SEQ ID NO: 127740 - DNA, 16 bp, H. sapiens
tacttagcatgttttc

SEQ ID NO: 127741 - DNA, 16 bp, H. sapiens
tacttaggaataattt

SEQ ID NO: 127742 - DNA, 16 bp, H. sapiens
tacttaggaggctgaa

SEQ ID NO: 127743 - DNA, 16 bp, H. sapiens
tacttaggatagcttt

SEQ ID NO: 127744 - DNA, 16 bp, H. sapiens
tacttatatgaggtac

SEQ ID NO: 127745 - DNA, 16 bp, H. sapiens
tacttatcatttttgt

SEQ ID NO: 127746 - DNA, 17 bp, H. sapiens
tacttatgcaaatttct

SEQ ID NO: 127747 - DNA, 16 bp, H. sapiens
tacttatggaaatttc

SEQ ID NO: 127748 - DNA, 16 bp, H. sapiens
tacttattcacatttc

SEQ ID NO: 127749 - DNA, 16 bp, H. sapiens
tacttattttttctga

SEQ ID NO: 127750 - DNA, 16 bp, H. sapiens
tacttatttttttgag

SEQ ID NO: 127751 - DNA, 16 bp, H. sapiens
tacttcaagttctggg

SEQ ID NO: 127752 - DNA, 16 bp, H. sapiens
tacttcagcctcctga

SEQ ID NO: 127753 - DNA, 16 bp, H. sapiens
tacttcagtttcctca

SEQ ID NO: 127754 - DNA, 16 bp, H. sapiens
tacttcatagaattgt

SEQ ID NO: 127755 - DNA, 16 bp, H. sapiens
tacttcatttttaaaa

SEQ ID NO: 127756 - DNA, 16 bp, H. sapiens
tacttccaggaattta

SEQ ID NO: 127757 - DNA, 16 bp, H. sapiens
tacttcctgacttcag

SEQ ID NO: 127758 - DNA, 16 bp, H. sapiens
tacttcctgtacagcc

SEQ ID NO: 127759 - DNA, 16 bp, H. sapiens
tacttctattttaaaa

SEQ ID NO: 127760 - DNA, 16 bp, H. sapiens
tacttctcaaaagaag

SEQ ID NO: 127761 - DNA, 16 bp, H. sapiens
tacttctcaaaagaca

SEQ ID NO: 127762 - DNA, 16 bp, H. sapiens
tacttctcagggctag

SEQ ID NO: 127763 - DNA, 16 bp, H. sapiens
tacttctcgcaggagt

SEQ ID NO: 127764 - DNA, 16 bp, H. sapiens
tacttctgtcagttca

SEQ ID NO: 127765 - DNA, 16 bp, H. sapiens
tacttctttaaaaaaa

SEQ ID NO: 127766 - DNA, 16 bp, H. sapiens
tacttgaaaaacaaaa

SEQ ID NO: 127767 - DNA, 16 bp, H. sapiens
tacttgaaaattttaa

SEQ ID NO: 127768 - DNA, 16 bp, H. sapiens
tacttgaaatttgcta

SEQ ID NO: 127769 - DNA, 16 bp, H. sapiens
tacttgagggtggagg

SEQ ID NO: 127770 - DNA, 16 bp, H. sapiens
tacttgcacaaaccta

SEQ ID NO: 127771 - DNA, 16 bp, H. sapiens
tacttgctattttggt

SEQ ID NO: 127772 - DNA, 16 bp, H. sapiens
tacttgggaaaaaaaa

SEQ ID NO: 127773 - DNA, 16 bp, H. sapiens
tacttgggaacctgag

SEQ ID NO: 127774 - DNA, 16 bp, H. sapiens
tacttgggatgctaag

SEQ ID NO: 127775 - DNA, 16 bp, H. sapiens
tacttggggaaaaaaa

SEQ ID NO: 127776 - DNA, 16 bp, H. sapiens
tacttgggtgacagga

SEQ ID NO: 127777 - DNA, 16 bp, H. sapiens
tacttgtacaaaaaca

SEQ ID NO: 127778 - DNA, 16 bp, H. sapiens
tacttgttttctagtt

SEQ ID NO: 127779 - DNA, 16 bp, H. sapiens
tactttaaaaaaatgt

SEQ ID NO: 127780 - DNA, 16 bp, H. sapiens
tactttaaaaggaaaa

SEQ ID NO: 127781 - DNA, 16 bp, H. sapiens
tactttaaaatgtaca

SEQ ID NO: 127782 - DNA, 16 bp, H. sapiens
tactttaaaatgtttg

SEQ ID NO: 127783 - DNA, 16 bp, H. sapiens
tactttaaatgtaaat

SEQ ID NO: 127784 - DNA, 16 bp, H. sapiens
tactttaaattgtttt

SEQ ID NO: 127785 - DNA, 16 bp, H. sapiens
tactttaaattttagg

SEQ ID NO: 127786 - DNA, 16 bp, H. sapiens
tactttaacaactgga

SEQ ID NO: 127787 - DNA, 16 bp, H. sapiens
tactttaactggagga

SEQ ID NO: 127788 - DNA, 16 bp, H. sapiens
tactttaagttccaga

SEQ ID NO: 127789 - DNA, 16 bp, H. sapiens
tactttacattttaaa

SEQ ID NO: 127790 - DNA, 16 bp, H. sapiens
tactttacttctgtaa

SEQ ID NO: 127791 - DNA, 16 bp, H. sapiens
tactttagaaaataaa

SEQ ID NO: 127792 - DNA, 16 bp, H. sapiens
tactttataataaagt

SEQ ID NO: 127793 - DNA, 16 bp, H. sapiens
tactttatatattctg

SEQ ID NO: 127794 - DNA, 16 bp, H. sapiens
tactttattctaagaa

SEQ ID NO: 127795 - DNA, 16 bp, H. sapiens
tactttatttttgaaa

SEQ ID NO: 127796 - DNA, 16 bp, H. sapiens
tactttccattcgatt

SEQ ID NO: 127797 - DNA, 16 bp, H. sapiens
tactttccatttttca

SEQ ID NO: 127798 - DNA, 16 bp, H. sapiens
tactttctatcttcat

SEQ ID NO: 127799 - DNA, 19 bp, H. sapiens
tactttctgcagaaagggt

SEQ ID NO: 127800 - DNA, 16 bp, H. sapiens
tactttgaaaaatatt

SEQ ID NO: 127801 - DNA, 16 bp, H. sapiens
tactttgaaaaatgtt

SEQ ID NO: 127802 - DNA, 16 bp, H. sapiens
tactttgaaaaattat

SEQ ID NO: 127803 - DNA, 16 bp, H. sapiens
tactttgaaatatata

SEQ ID NO: 127804 - DNA, 16 bp, H. sapiens
tactttgaatttcttt

SEQ ID NO: 127805 - DNA, 16 bp, H. sapiens
tactttgcaccaacct

SEQ ID NO: 127806 - DNA, 16 bp, H. sapiens
tactttgcctccttca

SEQ ID NO: 127807 - DNA, 16 bp, H. sapiens
tactttgctgaatatt

SEQ ID NO: 127808 - DNA, 16 bp, H. sapiens
tactttggctatgcag

SEQ ID NO: 127809 - DNA, 16 bp, H. sapiens
tactttgggagaccga

SEQ ID NO: 127810 - DNA, 16 bp, H. sapiens
tactttgggaggccaa

SEQ ID NO: 127811 - DNA, 19 bp, H. sapiens
tactttgggaggccaaggt

SEQ ID NO: 127812 - DNA, 19 bp, H. sapiens
tactttgggaggccgaggc

SEQ ID NO: 127813 - DNA, 16 bp, H. sapiens
tactttgggaggctga

SEQ ID NO: 127814 - DNA, 17 bp, H. sapiens
tactttgggaggctgag

SEQ ID NO: 127815 - DNA, 23 bp, H. sapiens
tactttgggaggctgaggcaggc

SEQ ID NO: 127816 - DNA, 20 bp, H. sapiens
tactttgggaggctgaggcg

SEQ ID NO: 127817 - DNA, 16 bp, H. sapiens
tactttggtcctggat

SEQ ID NO: 127818 - DNA, 16 bp, H. sapiens
tactttgtcttttact

SEQ ID NO: 127819 - DNA, 16 bp, H. sapiens
tactttgttatagcag

SEQ ID NO: 127820 - DNA, 16 bp, H. sapiens
tactttgtttaaaaaa

SEQ ID NO: 127821 - DNA, 16 bp, H. sapiens
tacttttaaaacatat

SEQ ID NO: 127822 - DNA, 16 bp, H. sapiens
tacttttaaaatgtct

SEQ ID NO: 127823 - DNA, 16 bp, H. sapiens
tacttttaactttttg

SEQ ID NO: 127824 - DNA, 16 bp, H. sapiens
tacttttaagttttag

SEQ ID NO: 127825 - DNA, 16 bp, H. sapiens
tacttttagaaataaa

SEQ ID NO: 127826 - DNA, 16 bp, H. sapiens
tacttttagtagagag

SEQ ID NO: 127827 - DNA, 16 bp, H. sapiens
tacttttcagagtcct

SEQ ID NO: 127828 - DNA, 16 bp, H. sapiens
tacttttcttgaagac

SEQ ID NO: 127829 - DNA, 16 bp, H. sapiens
tacttttgaaatattt

SEQ ID NO: 127830 - DNA, 16 bp, H. sapiens
tacttttgcactgacc

SEQ ID NO: 127831 - DNA, 16 bp, H. sapiens
tacttttgggttcaca

SEQ ID NO: 127832 - DNA, 16 bp, H. sapiens
tacttttgtacccatt

SEQ ID NO: 127833 - DNA, 16 bp, H. sapiens
tacttttgtcatttta

SEQ ID NO: 127834 - DNA, 16 bp, H. sapiens
tactttttaaaagtca

SEQ ID NO: 127835 - DNA, 16 bp, H. sapiens
tactttttaaagaata

SEQ ID NO: 127836 - DNA, 16 bp, H. sapiens
tactttttaaatgtaa

SEQ ID NO: 127837 - DNA, 16 bp, H. sapiens
tactttttaacaaaaa

SEQ ID NO: 127838 - DNA, 16 bp, H. sapiens
tactttttcctttctg

SEQ ID NO: 127839 - DNA, 16 bp, H. sapiens
tactttttgaactttt

SEQ ID NO: 127840 - DNA, 16 bp, H. sapiens
tactttttggctatta

SEQ ID NO: 127841 - DNA, 16 bp, H. sapiens
tacttttttaaaaaag

SEQ ID NO: 127842 - DNA, 16 bp, H. sapiens
tacttttttaaaagta

SEQ ID NO: 127843 - DNA, 16 bp, H. sapiens
tacttttttgatatag

SEQ ID NO: 127844 - DNA, 16 bp, H. sapiens
tagaaaaaaaaatcct

SEQ ID NO: 127845 - DNA, 16 bp, H. sapiens
tagaaaaaaaactact

SEQ ID NO: 127846 - DNA, 16 bp, H. sapiens
tagaaaaaaagtgttt

SEQ ID NO: 127847 - DNA, 16 bp, H. sapiens
tagaaaaaacaatttt

SEQ ID NO: 127848 - DNA, 16 bp, H. sapiens
tagaaaaaactacttt

SEQ ID NO: 127849 - DNA, 16 bp, H. sapiens
tagaaaaaactcttct

SEQ ID NO: 127850 - DNA, 16 bp, H. sapiens
tagaaaaaacttttaa

SEQ ID NO: 127851 - DNA, 16 bp, H. sapiens
tagaaaaacacacaca

SEQ ID NO: 127852 - DNA, 16 bp, H. sapiens
tagaaaaacatttcat

SEQ ID NO: 127853 - DNA, 16 bp, H. sapiens
tagaaaaagagtgttt

SEQ ID NO: 127854 - DNA, 16 bp, H. sapiens
tagaaaaagctgtgaa

SEQ ID NO: 127855 - DNA, 16 bp, H. sapiens
tagaaaaaggacatta

SEQ ID NO: 127856 - DNA, 16 bp, H. sapiens
tagaaaaatacatatt

SEQ ID NO: 127857 - DNA, 16 bp, H. sapiens
tagaaaaatattttga

SEQ ID NO: 127858 - DNA, 16 bp, H. sapiens
tagaaaaatcaccatt

SEQ ID NO: 127859 - DNA, 16 bp, H. sapiens
tagaaaaatcagaaat

SEQ ID NO: 127860 - DNA, 16 bp, H. sapiens
tagaaaaatgtgtaat

SEQ ID NO: 127861 - DNA, 16 bp, H. sapiens
tagaaaaatgttaact

SEQ ID NO: 127862 - DNA, 16 bp, H. sapiens
tagaaaaattaactga

SEQ ID NO: 127863 - DNA, 16 bp, H. sapiens
tagaaaaattagctga

SEQ ID NO: 127864 - DNA, 16 bp, H. sapiens
tagaaaaattggcaaa

SEQ ID NO: 127865 - DNA, 16 bp, H. sapiens
tagaaaacaaatacag

SEQ ID NO: 127866 - DNA, 16 bp, H. sapiens
tagaaaacaatatttt

SEQ ID NO: 127867 - DNA, 16 bp, H. sapiens
tagaaaacatttaaaa

SEQ ID NO: 127868 - DNA, 16 bp, H. sapiens
tagaaaacattttata

SEQ ID NO: 127869 - DNA, 16 bp, H. sapiens
tagaaaaccaaacatt

SEQ ID NO: 127870 - DNA, 16 bp, H. sapiens
tagaaaaccctgaaga

SEQ ID NO: 127871 - DNA, 16 bp, H. sapiens
tagaaaacctaaagga

SEQ ID NO: 127872 - DNA, 16 bp, H. sapiens
tagaaaacctagaaat

SEQ ID NO: 127873 - DNA, 16 bp, H. sapiens
tagaaaactggaaaaa

SEQ ID NO: 127874 - DNA, 16 bp, H. sapiens
tagaaaagaaaaactc

SEQ ID NO: 127875 - DNA, 16 bp, H. sapiens
tagaaaagaagagcaa

SEQ ID NO: 127876 - DNA, 16 bp, H. sapiens
tagaaaagatcaacaa

SEQ ID NO: 127877 - DNA, 16 bp, H. sapiens
tagaaaagcaaattct

SEQ ID NO: 127878 - DNA, 16 bp, H. sapiens
tagaaaagcaagagaa

SEQ ID NO: 127879 - DNA, 16 bp, H. sapiens
tagaaaagcattccat

SEQ ID NO: 127880 - DNA, 16 bp, H. sapiens
tagaaaaggaaatgta

SEQ ID NO: 127881 - DNA, 16 bp, H. sapiens
tagaaaaggtaaaact

SEQ ID NO: 127882 - DNA, 16 bp, H. sapiens
tagaaaaggtagagta

SEQ ID NO: 127883 - DNA, 16 bp, H. sapiens
tagaaaagtatgtaaa

SEQ ID NO: 127884 - DNA, 16 bp, H. sapiens
tagaaaataatcaaat

SEQ ID NO: 127885 - DNA, 16 bp, H. sapiens
tagaaaataattttac

SEQ ID NO: 127886 - DNA, 16 bp, H. sapiens
tagaaaatacattatt

SEQ ID NO: 127887 - DNA, 16 bp, H. sapiens
tagaaaatagtaacaa

SEQ ID NO: 127888 - DNA, 16 bp, H. sapiens
tagaaaatatccaaaa

SEQ ID NO: 127889 - DNA, 16 bp, H. sapiens
tagaaaatatgcattt

SEQ ID NO: 127890 - DNA, 16 bp, H. sapiens
tagaaaatattgttaa

SEQ ID NO: 127891 - DNA, 16 bp, H. sapiens
tagaaaatatttcaca

SEQ ID NO: 127892 - DNA, 16 bp, H. sapiens
tagaaaatatttttca

SEQ ID NO: 127893 - DNA, 16 bp, H. sapiens
tagaaaatcaaattca

SEQ ID NO: 127894 - DNA, 16 bp, H. sapiens
tagaaaatcagcaaag

SEQ ID NO: 127895 - DNA, 16 bp, H. sapiens
tagaaaatcccaaaga

SEQ ID NO: 127896 - DNA, 16 bp, H. sapiens
tagaaaatctagacaa

SEQ ID NO: 127897 - DNA, 16 bp, H. sapiens
tagaaaatctcagcaa

SEQ ID NO: 127898 - DNA, 16 bp, H. sapiens
tagaaaatctgaaaga

SEQ ID NO: 127899 - DNA, 16 bp, H. sapiens
tagaaaatgaagagca

SEQ ID NO: 127900 - DNA, 16 bp, H. sapiens
tagaaaatgagcaaag

SEQ ID NO: 127901 - DNA, 16 bp, H. sapiens
tagaaaatgcaaaata

SEQ ID NO: 127902 - DNA, 16 bp, H. sapiens
tagaaaatgcaaacta

SEQ ID NO: 127903 - DNA, 16 bp, H. sapiens
tagaaaatgcagaaat

SEQ ID NO: 127904 - DNA, 16 bp, H. sapiens
tagaaaatgctaaaga

SEQ ID NO: 127905 - DNA, 16 bp, H. sapiens
tagaaaatgctttttt

SEQ ID NO: 127906 - DNA, 16 bp, H. sapiens
tagaaaattattttgt

SEQ ID NO: 127907 - DNA, 16 bp, H. sapiens
tagaaaattccaagaa

SEQ ID NO: 127908 - DNA, 16 bp, H. sapiens
tagaaaattccagaaa

SEQ ID NO: 127909 - DNA, 16 bp, H. sapiens
tagaaaatttagaatt

SEQ ID NO: 127910 - DNA, 16 bp, H. sapiens
tagaaaatttggaaaa

SEQ ID NO: 127911 - DNA, 16 bp, H. sapiens
tagaaacaaagtctca

SEQ ID NO: 127912 - DNA, 16 bp, H. sapiens
tagaaacaattagaaa

SEQ ID NO: 127913 - DNA, 16 bp, H. sapiens
tagaaacacacacaca

SEQ ID NO: 127914 - DNA, 16 bp, H. sapiens
tagaaacagaaaatca

SEQ ID NO: 127915 - DNA, 16 bp, H. sapiens
tagaaacagaaagcaa

SEQ ID NO: 127916 - DNA, 16 bp, H. sapiens
tagaaacagaaataga

SEQ ID NO: 127917 - DNA, 16 bp, H. sapiens
tagaaacagaatgctt

SEQ ID NO: 127918 - DNA, 16 bp, H. sapiens
tagaaacattcaaatt

SEQ ID NO: 127919 - DNA, 16 bp, H. sapiens
tagaaacattttattt

SEQ ID NO: 127920 - DNA, 16 bp, H. sapiens
tagaaacatttttaca

SEQ ID NO: 127921 - DNA, 16 bp, H. sapiens
tagaaactgaggcaca

SEQ ID NO: 127922 - DNA, 16 bp, H. sapiens
tagaaagaacctatgt

SEQ ID NO: 127923 - DNA, 16 bp, H. sapiens
tagaaagaatcaatat

SEQ ID NO: 127924 - DNA, 16 bp, H. sapiens
tagaaagagagggaat

SEQ ID NO: 127925 - DNA, 16 bp, H. sapiens
tagaaagagtgaataa

SEQ ID NO: 127926 - DNA, 16 bp, H. sapiens
tagaaagatttatatt

SEQ ID NO: 127927 - DNA, 16 bp, H. sapiens
tagaaaggaatgtctg

SEQ ID NO: 127928 - DNA, 16 bp, H. sapiens
tagaaaggctgaggca

SEQ ID NO: 127929 - DNA, 16 bp, H. sapiens
tagaaagggaatgttc

SEQ ID NO: 127930 - DNA, 16 bp, H. sapiens
tagaaagtaaaaagtt

SEQ ID NO: 127931 - DNA, 16 bp, H. sapiens
tagaaagtgctcaata

SEQ ID NO: 127932 - DNA, 16 bp, H. sapiens
tagaaagttctttctt

SEQ ID NO: 127933 - DNA, 16 bp, H. sapiens
tagaaataaacttttt

SEQ ID NO: 127934 - DNA, 27 bp, H. sapiens
tagaaataaagatgttctttgaaacca

SEQ ID NO: 127935 - DNA, 16 bp, H. sapiens
tagaaataaagtgcat

SEQ ID NO: 127936 - DNA, 16 bp, H. sapiens
tagaaataacccaaat

SEQ ID NO: 127937 - DNA, 16 bp, H. sapiens
tagaaataattaagct

SEQ ID NO: 127938 - DNA, 16 bp, H. sapiens
tagaaatacaattgat

SEQ ID NO: 127939 - DNA, 16 bp, H. sapiens
tagaaatacagatttt

SEQ ID NO: 127940 - DNA, 16 bp, H. sapiens
tagaaatacataaaat

SEQ ID NO: 127941 - DNA, 16 bp, H. sapiens
tagaaataccagttga

SEQ ID NO: 127942 - DNA, 16 bp, H. sapiens
tagaaataccatatga

SEQ ID NO: 127943 - DNA, 21 bp, H. sapiens
tagaaataccatttgactcag

SEQ ID NO: 127944 - DNA, 16 bp, H. sapiens
tagaaatagacccaca

SEQ ID NO: 127945 - DNA, 16 bp, H. sapiens
tagaaatagcattgaa

SEQ ID NO: 127946 - DNA, 16 bp, H. sapiens
tagaaatatcatttga

SEQ ID NO: 127947 - DNA, 16 bp, H. sapiens
tagaaatattctgtat

SEQ ID NO: 127948 - DNA, 16 bp, H. sapiens
tagaaatatttttaag

SEQ ID NO: 127949 - DNA, 16 bp, H. sapiens
tagaaatcaacaacaa

SEQ ID NO: 127950 - DNA, 16 bp, H. sapiens
tagaaatcaataacaa

SEQ ID NO: 127951 - DNA, 16 bp, H. sapiens
tagaaatcacaacaaa

SEQ ID NO: 127952 - DNA, 16 bp, H. sapiens
tagaaatcagtatcaa

SEQ ID NO: 127953 - DNA, 16 bp, H. sapiens
tagaaatcattaacag

SEQ ID NO: 127954 - DNA, 16 bp, H. sapiens
tagaaatgacaccaaa

SEQ ID NO: 127955 - DNA, 16 bp, H. sapiens
tagaaatgatgaagct

SEQ ID NO: 127956 - DNA, 16 bp, H. sapiens
tagaaatgattaagct

SEQ ID NO: 127957 - DNA, 16 bp, H. sapiens
tagaaatgcacattct

SEQ ID NO: 127958 - DNA, 16 bp, H. sapiens
tagaaatgcagcatct

SEQ ID NO: 127959 - DNA, 16 bp, H. sapiens
tagaaatgctactggt

SEQ ID NO: 127960 - DNA, 16 bp, H. sapiens
tagaaatggtgagaga

SEQ ID NO: 127961 - DNA, 16 bp, H. sapiens
tagaaatgtaaatttt

SEQ ID NO: 127962 - DNA, 16 bp, H. sapiens
tagaaatgtatttctc

SEQ ID NO: 127963 - DNA, 16 bp, H. sapiens
tagaaatgttcccttt

SEQ ID NO: 127964 - DNA, 16 bp, H. sapiens
tagaaatgttctgtat

SEQ ID NO: 127965 - DNA, 16 bp, H. sapiens
tagaaattaaagctga

SEQ ID NO: 127966 - DNA, 16 bp, H. sapiens
tagaaattataacaaa

SEQ ID NO: 127967 - DNA, 16 bp, H. sapiens
tagaaattcttaattt

SEQ ID NO: 127968 - DNA, 16 bp, H. sapiens
tagaaatttagaattt

SEQ ID NO: 127969 - DNA, 16 bp, H. sapiens
tagaaattttttttct

SEQ ID NO: 127970 - DNA, 16 bp, H. sapiens
tagaacattttcatta

SEQ ID NO: 127971 - DNA, 16 bp, H. sapiens
tagaaccaatgacaaa

SEQ ID NO: 127972 - DNA, 16 bp, H. sapiens
tagaacccaggaggtg

SEQ ID NO: 127973 - DNA, 19 bp, H. sapiens
tagaactcagaattaagaa

SEQ ID NO: 127974 - DNA, 18 bp, H. sapiens
tagaactcaggattaaaa

SEQ ID NO: 127975 - DNA, 19 bp, H. sapiens
tagaactcaggattaagaa

SEQ ID NO: 127976 - DNA, 16 bp, H. sapiens
tagaactgaaagtata

SEQ ID NO: 127977 - DNA, 16 bp, H. sapiens
tagaactgataaacaa

SEQ ID NO: 127978 - DNA, 16 bp, H. sapiens
tagaacttgaaatttt

SEQ ID NO: 127979 - DNA, 16 bp, H. sapiens
tagaactttatttaca

SEQ ID NO: 127980 - DNA, 16 bp, H. sapiens
tagaacttttaaaatg

SEQ ID NO: 127981 - DNA, 16 bp, H. sapiens
tagaagaaaacactgg

SEQ ID NO: 127982 - DNA, 16 bp, H. sapiens
tagaagaaaacattag

SEQ ID NO: 127983 - DNA, 16 bp, H. sapiens
tagaagaaaacattga

SEQ ID NO: 127984 - DNA, 16 bp, H. sapiens
tagaagaaaatctatg

SEQ ID NO: 127985 - DNA, 16 bp, H. sapiens
tagaagaaaatgctga

SEQ ID NO: 127986 - DNA, 16 bp, H. sapiens
tagaagaaaattaatg

SEQ ID NO: 127987 - DNA, 16 bp, H. sapiens
tagaagaaagcataga

SEQ ID NO: 127988 - DNA, 16 bp, H. sapiens
tagaagaaatagctga

SEQ ID NO: 127989 - DNA, 16 bp, H. sapiens
tagaagaaatatctaa

SEQ ID NO: 127990 - DNA, 16 bp, H. sapiens
tagaagaaatattttt

SEQ ID NO: 127991 - DNA, 16 bp, H. sapiens
tagaagaactagaaaa

SEQ ID NO: 127992 - DNA, 16 bp, H. sapiens
tagaagaataaaactg

SEQ ID NO: 127993 - DNA, 16 bp, H. sapiens
tagaagaattaatatt

SEQ ID NO: 127994 - DNA, 16 bp, H. sapiens
tagaagagattttttt

SEQ ID NO: 127995 - DNA, 16 bp, H. sapiens
tagaagaggaaactaa

SEQ ID NO: 127996 - DNA, 16 bp, H. sapiens
tagaagaggcaaggaa

SEQ ID NO: 127997 - DNA, 16 bp, H. sapiens
tagaagatttgaacaa

SEQ ID NO: 127998 - DNA, 16 bp, H. sapiens
tagaagattttcatca

SEQ ID NO: 127999 - DNA, 16 bp, H. sapiens
tagaagcaactcaaat

SEQ ID NO: 128000 - DNA, 16 bp, H. sapiens
tagaagcagcagcagg

SEQ ID NO: 128001 - DNA, 16 bp, H. sapiens
tagaagccagaagaga

SEQ ID NO: 128002 - DNA, 16 bp, H. sapiens
tagaagccagggatgc

SEQ ID NO: 128003 - DNA, 16 bp, H. sapiens
tagaagctttctgaga

SEQ ID NO: 128004 - DNA, 16 bp, H. sapiens
tagaaggaaaagaaac

SEQ ID NO: 128005 - DNA, 16 bp, H. sapiens
tagaaggatcacctga

SEQ ID NO: 128006 - DNA, 16 bp, H. sapiens
tagaaggcaaagaatt

SEQ ID NO: 128007 - DNA, 16 bp, H. sapiens
tagaaggcaaaggaga

SEQ ID NO: 128008 - DNA, 16 bp, H. sapiens
tagaaggcatcttctt

SEQ ID NO: 128009 - DNA, 16 bp, H. sapiens
tagaaggctgaaactg

SEQ ID NO: 128010 - DNA, 16 bp, H. sapiens
tagaaggtgaaggaga

SEQ ID NO: 128011 - DNA, 20 bp, H. sapiens
tagaagtacctactgtcagt

SEQ ID NO: 128012 - DNA, 16 bp, H. sapiens
tagaagtcaataacag

SEQ ID NO: 128013 - DNA, 16 bp, H. sapiens
tagaagttggaaaagg

SEQ ID NO: 128014 - DNA, 16 bp, H. sapiens
tagaagtttatcaatt

SEQ ID NO: 128015 - DNA, 16 bp, H. sapiens
tagaagtttctgctgc

SEQ ID NO: 128016 - DNA, 16 bp, H. sapiens
tagaataaaatctgaa

SEQ ID NO: 128017 - DNA, 16 bp, H. sapiens
tagaataatgtttgac

SEQ ID NO: 128018 - DNA, 16 bp, H. sapiens
tagaataggagaaaat

SEQ ID NO: 128019 - DNA, 16 bp, H. sapiens
tagaatagtggttctc

SEQ ID NO: 128020 - DNA, 16 bp, H. sapiens
tagaatatagaaatac

SEQ ID NO: 128021 - DNA, 16 bp, H. sapiens
tagaatatggcaaaag

SEQ ID NO: 128022 - DNA, 16 bp, H. sapiens
tagaatattttcatta

SEQ ID NO: 128023 - DNA, 16 bp, H. sapiens
tagaatcatggtggaa

SEQ ID NO: 128024 - DNA, 16 bp, H. sapiens
tagaatgaattatttt

SEQ ID NO: 128025 - DNA, 16 bp, H. sapiens
tagaatgatctatatt

SEQ ID NO: 128026 - DNA, 16 bp, H. sapiens
tagaatgatttacaat

SEQ ID NO: 128027 - DNA, 16 bp, H. sapiens
tagaatgatttatatt

SEQ ID NO: 128028 - DNA, 16 bp, H. sapiens
tagaatgctcttcccc

SEQ ID NO: 128029 - DNA, 16 bp, H. sapiens
tagaatgtaaactcca

SEQ ID NO: 128030 - DNA, 16 bp, H. sapiens
tagaatgtaagctcca

SEQ ID NO: 128031 - DNA, 16 bp, H. sapiens
tagaatgtaagctccc

SEQ ID NO: 128032 - DNA, 16 bp, H. sapiens
tagaatgtataaagaa

SEQ ID NO: 128033 - DNA, 16 bp, H. sapiens
tagaatgtgatgtttt

SEQ ID NO: 128034 - DNA, 16 bp, H. sapiens
tagaatgttttataaa

SEQ ID NO: 128035 - DNA, 16 bp, H. sapiens
tagaatgtttttcttt

SEQ ID NO: 128036 - DNA, 16 bp, H. sapiens
tagaattaataaacaa

SEQ ID NO: 128037 - DNA, 16 bp, H. sapiens
tagaattacagacatg

SEQ ID NO: 128038 - DNA, 16 bp, H. sapiens
tagaattaccctatga

SEQ ID NO: 128039 - DNA, 16 bp, H. sapiens
tagaattatacaatat

SEQ ID NO: 128040 - DNA, 16 bp, H. sapiens
tagaattatcatataa

SEQ ID NO: 128041 - DNA, 16 bp, H. sapiens
tagaattccagattac

SEQ ID NO: 128042 - DNA, 16 bp, H. sapiens
tagaattgtatataaa

SEQ ID NO: 128043 - DNA, 16 bp, H. sapiens
tagaatttaattttct

SEQ ID NO: 128044 - DNA, 16 bp, H. sapiens
tagaatttagaaaaag

SEQ ID NO: 128045 - DNA, 16 bp, H. sapiens
tagaatttagatttaa

SEQ ID NO: 128046 - DNA, 16 bp, H. sapiens
tagaatttatgtaaac

SEQ ID NO: 128047 - DNA, 16 bp, H. sapiens
tagaatttgccaggct

SEQ ID NO: 128048 - DNA, 16 bp, H. sapiens
tagaatttgctttaaa

SEQ ID NO: 128049 - DNA, 16 bp, H. sapiens
tagaatttggctttga

SEQ ID NO: 128050 - DNA, 16 bp, H. sapiens
tagaatttgtgaaggg

SEQ ID NO: 128051 - DNA, 16 bp, H. sapiens
tagaattttcagattt

SEQ ID NO: 128052 - DNA, 16 bp, H. sapiens
tagaatttttaaaatg

SEQ ID NO: 128053 - DNA, 16 bp, H. sapiens
tagacaaacagagaac

SEQ ID NO: 128054 - DNA, 16 bp, H. sapiens
tagacaaattaaattt

SEQ ID NO: 128055 - DNA, 16 bp, H. sapiens
tagacacaataaaata

SEQ ID NO: 128056 - DNA, 16 bp, H. sapiens
tagacacacacacaca

SEQ ID NO: 128057 - DNA, 16 bp, H. sapiens
tagacacagggtcttg

SEQ ID NO: 128058 - DNA, 16 bp, H. sapiens
tagacacagggtttca

SEQ ID NO: 128059 - DNA, 16 bp, H. sapiens
tagacacaggttttca

SEQ ID NO: 128060 - DNA, 16 bp, H. sapiens
tagacacattaaaaaa

SEQ ID NO: 128061 - DNA, 16 bp, H. sapiens
tagacactgggtttca

SEQ ID NO: 128062 - DNA, 16 bp, H. sapiens
tagacacttctcaaaa

SEQ ID NO: 128063 - DNA, 16 bp, H. sapiens
tagacagaagacagta

SEQ ID NO: 128064 - DNA, 16 bp, H. sapiens
tagacagaagcatttt

SEQ ID NO: 128065 - DNA, 16 bp, H. sapiens
tagacagacagacaga

SEQ ID NO: 128066 - DNA, 16 bp, H. sapiens
tagacagataaactca

SEQ ID NO: 128067 - DNA, 16 bp, H. sapiens
tagacagggtctcact

SEQ ID NO: 128068 - DNA, 16 bp, H. sapiens
tagacagttctccaaa

SEQ ID NO: 128069 - DNA, 16 bp, H. sapiens
tagacataagaaatga

SEQ ID NO: 128070 - DNA, 16 bp, H. sapiens
tagacattatatatat

SEQ ID NO: 128071 - DNA, 16 bp, H. sapiens
tagacattttatttat

SEQ ID NO: 128072 - DNA, 16 bp, H. sapiens
tagacattttctttct

SEQ ID NO: 128073 - DNA, 16 bp, H. sapiens
tagacatttttcaaaa

SEQ ID NO: 128074 - DNA, 16 bp, H. sapiens
tagaccaatggatttt

SEQ ID NO: 128075 - DNA, 16 bp, H. sapiens
tagaccacatgatagg

SEQ ID NO: 128076 - DNA, 16 bp, H. sapiens
tagaccagggtttctc

SEQ ID NO: 128077 - DNA, 16 bp, H. sapiens
tagaccatgagctcct

SEQ ID NO: 128078 - DNA, 16 bp, H. sapiens
tagacccagaagagag

SEQ ID NO: 128079 - DNA, 16 bp, H. sapiens
tagacccagaggagca

SEQ ID NO: 128080 - DNA, 16 bp, H. sapiens
tagaccctcactggga

SEQ ID NO: 128081 - DNA, 16 bp, H. sapiens
tagacctctttttctt

SEQ ID NO: 128082 - DNA, 16 bp, H. sapiens
tagacctgggttcaaa

SEQ ID NO: 128083 - DNA, 16 bp, H. sapiens
tagacctgtctcctgg

SEQ ID NO: 128084 - DNA, 16 bp, H. sapiens
tagacggggtttcacc

SEQ ID NO: 128085 - DNA, 16 bp, H. sapiens
tagactaaagaagaaa

SEQ ID NO: 128086 - DNA, 16 bp, H. sapiens
tagactgaggcaggag

SEQ ID NO: 128087 - DNA, 16 bp, H. sapiens
tagactgcctgggttc

SEQ ID NO: 128088 - DNA, 16 bp, H. sapiens
tagactggacataagc

SEQ ID NO: 128089 - DNA, 16 bp, H. sapiens
tagactggagtgcagt

SEQ ID NO: 128090 - DNA, 18 bp, H. sapiens
tagactggattaagaaag

SEQ ID NO: 128091 - DNA, 16 bp, H. sapiens
tagactggcctagcct

SEQ ID NO: 128092 - DNA, 16 bp, H. sapiens
tagactgtgagctcct

SEQ ID NO: 128093 - DNA, 16 bp, H. sapiens
tagacttacagaaaaa

SEQ ID NO: 128094 - DNA, 16 bp, H. sapiens
tagacttataagtcta

SEQ ID NO: 128095 - DNA, 16 bp, H. sapiens
tagacttgattaagaa

SEQ ID NO: 128096 - DNA, 16 bp, H. sapiens
tagactttggagtcag

SEQ ID NO: 128097 - DNA, 16 bp, H. sapiens
tagagaaaaaaattca

SEQ ID NO: 128098 - DNA, 16 bp, H. sapiens
tagagaaaaggaaacc

SEQ ID NO: 128099 - DNA, 16 bp, H. sapiens
tagagaaaatcaatga

SEQ ID NO: 128100 - DNA, 16 bp, H. sapiens
tagagaaagaagaaca

SEQ ID NO: 128101 - DNA, 16 bp, H. sapiens
tagagaaagagtctca

SEQ ID NO: 128102 - DNA, 16 bp, H. sapiens
tagagaaagagtttca

SEQ ID NO: 128103 - DNA, 16 bp, H. sapiens
tagagaaagatattaa

SEQ ID NO: 128104 - DNA, 16 bp, H. sapiens
tagagaaataaaatgt

SEQ ID NO: 128105 - DNA, 16 bp, H. sapiens
tagagaaatgcaaacc

SEQ ID NO: 128106 - DNA, 16 bp, H. sapiens
tagagaacattatgtt

SEQ ID NO: 128107 - DNA, 16 bp, H. sapiens
tagagaacctggaaat

SEQ ID NO: 128108 - DNA, 16 bp, H. sapiens
tagagaactacagaaa

SEQ ID NO: 128109 - DNA, 19 bp, H. sapiens
tagagaagaacataaatga

SEQ ID NO: 128110 - DNA, 16 bp, H. sapiens
tagagaagatccaaat

SEQ ID NO: 128111 - DNA, 16 bp, H. sapiens
tagagaagtgcttaaa

SEQ ID NO: 128112 - DNA, 16 bp, H. sapiens
tagagaatgggtttca

SEQ ID NO: 128113 - DNA, 16 bp, H. sapiens
tagagacaaaaagtag

SEQ ID NO: 128114 - DNA, 16 bp, H. sapiens
tagagacaagcctggg

SEQ ID NO: 128115 - DNA, 16 bp, H. sapiens
tagagacaaggttttg

SEQ ID NO: 128116 - DNA, 16 bp, H. sapiens
tagagacaagttttca

SEQ ID NO: 128117 - DNA, 16 bp, H. sapiens
tagagacagggattca

SEQ ID NO: 128118 - DNA, 16 bp, H. sapiens
tagagacaggggtctc

SEQ ID NO: 128119 - DNA, 16 bp, H. sapiens
tagagacagggtctca

SEQ ID NO: 128120 - DNA, 16 bp, H. sapiens
tagagacagggtctct

SEQ ID NO: 128121 - DNA, 16 bp, H. sapiens
tagagacagggtctta

SEQ ID NO: 128122 - DNA, 16 bp, H. sapiens
tagagacagggtcttg

SEQ ID NO: 128123 - DNA, 16 bp, H. sapiens
tagagacagggtttcg

SEQ ID NO: 128124 - DNA, 16 bp, H. sapiens
tagagacagggtttct

SEQ ID NO: 128125 - DNA, 16 bp, H. sapiens
tagagacagggtttta

SEQ ID NO: 128126 - DNA, 16 bp, H. sapiens
tagagacaggtgtctc

SEQ ID NO: 128127 - DNA, 16 bp, H. sapiens
tagagacaggtttccc

SEQ ID NO: 128128 - DNA, 16 bp, H. sapiens
tagagaccagtctggg

SEQ ID NO: 128129 - DNA, 16 bp, H. sapiens
tagagaccgggtttca

SEQ ID NO: 128130 - DNA, 16 bp, H. sapiens
tagagacctcagaaat

SEQ ID NO: 128131 - DNA, 16 bp, H. sapiens
tagagacgaggtccca

SEQ ID NO: 128132 - DNA, 17 bp, H. sapiens
tagagacgaggtttcat

SEQ ID NO: 128133 - DNA, 16 bp, H. sapiens
tagagacgggggtctc

SEQ ID NO: 128134 - DNA, 20 bp, H. sapiens
tagagacggggtttcactgg

SEQ ID NO: 128135 - DNA, 17 bp, H. sapiens
tagagacggggtttcat

SEQ ID NO: 128136 - DNA, 16 bp, H. sapiens
tagagacggggttttg

SEQ ID NO: 128137 - DNA, 16 bp, H. sapiens
tagagacggggttttt

SEQ ID NO: 128138 - DNA, 16 bp, H. sapiens
tagagacgggtttcac

SEQ ID NO: 128139 - DNA, 16 bp, H. sapiens
tagagactggctttca

SEQ ID NO: 128140 - DNA, 16 bp, H. sapiens
tagagactggggtttc

SEQ ID NO: 128141 - DNA, 17 bp, H. sapiens
tagagacttgttgaatg

SEQ ID NO: 128142 - DNA, 16 bp, H. sapiens
tagagagaaatttata

SEQ ID NO: 128143 - DNA, 16 bp, H. sapiens
tagagagcagtggcat

SEQ ID NO: 128144 - DNA, 18 bp, H. sapiens
tagagagccaaatcatga

SEQ ID NO: 128145 - DNA, 16 bp, H. sapiens
tagagaggaacataac

SEQ ID NO: 128146 - DNA, 16 bp, H. sapiens
tagagagtccagaaat

SEQ ID NO: 128147 - DNA, 16 bp, H. sapiens
tagagataaggtttca

SEQ ID NO: 128148 - DNA, 16 bp, H. sapiens
tagagataatttttaa

SEQ ID NO: 128149 - DNA, 16 bp, H. sapiens
tagagatagggttttg

SEQ ID NO: 128150 - DNA, 16 bp, H. sapiens
tagagatcatgccact

SEQ ID NO: 128151 - DNA, 16 bp, H. sapiens
tagagatctgtggagc

SEQ ID NO: 128152 - DNA, 16 bp, H. sapiens
tagagatgagaaaaca

SEQ ID NO: 128153 - DNA, 16 bp, H. sapiens
tagagatgagatttta

SEQ ID NO: 128154 - DNA, 16 bp, H. sapiens
tagagatgaggtctcc

SEQ ID NO: 128155 - DNA, 16 bp, H. sapiens
tagagatgaggtttcg

SEQ ID NO: 128156 - DNA, 16 bp, H. sapiens
tagagatgaggtttct

SEQ ID NO: 128157 - DNA, 16 bp, H. sapiens
tagagatggagctttg

SEQ ID NO: 128158 - DNA, 16 bp, H. sapiens
tagagatggagtttga

SEQ ID NO: 128159 - DNA, 16 bp, H. sapiens
tagagatggcatctca

SEQ ID NO: 128160 - DNA, 16 bp, H. sapiens
tagagatgggggtctc

SEQ ID NO: 128161 - DNA, 20 bp, H. sapiens
tagagatggggtttcaccac

SEQ ID NO: 128162 - DNA, 20 bp, H. sapiens
tagagatggggtttcgccag

SEQ ID NO: 128163 - DNA, 16 bp, H. sapiens
tagagatggggtttta

SEQ ID NO: 128164 - DNA, 16 bp, H. sapiens
tagagatggtgttttg

SEQ ID NO: 128165 - DNA, 16 bp, H. sapiens
tagagcaggaggaaga

SEQ ID NO: 128166 - DNA, 16 bp, H. sapiens
tagagcagtgaaaata

SEQ ID NO: 128167 - DNA, 16 bp, H. sapiens
tagagcagttttatgt

SEQ ID NO: 128168 - DNA, 16 bp, H. sapiens
tagagcctccagaggg

SEQ ID NO: 128169 - DNA, 16 bp, H. sapiens
tagagccttcagaaag

SEQ ID NO: 128170 - DNA, 17 bp, H. sapiens
tagagcgaggattatta

SEQ ID NO: 128171 - DNA, 16 bp, H. sapiens
tagagctcgggctgtg

SEQ ID NO: 128172 - DNA, 16 bp, H. sapiens
tagagctggaatttga

SEQ ID NO: 128173 - DNA, 16 bp, H. sapiens
tagagcttgggccatg

SEQ ID NO: 128174 - DNA, 16 bp, H. sapiens
tagaggaaaacataag

SEQ ID NO: 128175 - DNA, 16 bp, H. sapiens
tagaggaaaacctagg

SEQ ID NO: 128176 - DNA, 16 bp, H. sapiens
tagaggaaatggacaa

SEQ ID NO: 128177 - DNA, 16 bp, H. sapiens
tagaggaactagaaaa

SEQ ID NO: 128178 - DNA, 16 bp, H. sapiens
tagaggagcaagagca

SEQ ID NO: 128179 - DNA, 16 bp, H. sapiens
tagaggaggagctgga

SEQ ID NO: 128180 - DNA, 16 bp, H. sapiens
tagaggatgcagtgag

SEQ ID NO: 128181 - DNA, 16 bp, H. sapiens
tagaggcagaaagtag

SEQ ID NO: 128182 - DNA, 16 bp, H. sapiens
tagaggcaggatttca

SEQ ID NO: 128183 - DNA, 16 bp, H. sapiens
tagaggcaggattttg

SEQ ID NO: 128184 - DNA, 16 bp, H. sapiens
tagaggcagggtctca

SEQ ID NO: 128185 - DNA, 16 bp, H. sapiens
tagaggctgcctacat

SEQ ID NO: 128186 - DNA, 16 bp, H. sapiens
tagaggctgggcacag

SEQ ID NO: 128187 - DNA, 16 bp, H. sapiens
tagaggctgggtgcag

SEQ ID NO: 128188 - DNA, 16 bp, H. sapiens
tagagggtatttaaac

SEQ ID NO: 128189 - DNA, 16 bp, H. sapiens
tagagggtggtgatgg

SEQ ID NO: 128190 - DNA, 16 bp, H. sapiens
tagagggttgggactt

SEQ ID NO: 128191 - DNA, 17 bp, H. sapiens
tagaggtcttagttcca

SEQ ID NO: 128192 - DNA, 16 bp, H. sapiens
tagaggtgggaaggcc

SEQ ID NO: 128193 - DNA, 19 bp, H. sapiens
tagaggtgtttgtagtatt

SEQ ID NO: 128194 - DNA, 16 bp, H. sapiens
tagaggttctctatga

SEQ ID NO: 128195 - DNA, 16 bp, H. sapiens
tagaggttgcagtgag

SEQ ID NO: 128196 - DNA, 16 bp, H. sapiens
tagaggttgccgtgag

SEQ ID NO: 128197 - DNA, 18 bp, H. sapiens
tagagtgagactccgtct

SEQ ID NO: 128198 - DNA, 16 bp, H. sapiens
tagagtgagactgtct

SEQ ID NO: 128199 - DNA, 16 bp, H. sapiens
tagagtgcagtgatgt

SEQ ID NO: 128200 - DNA, 16 bp, H. sapiens
tagagtgggaggcagg

SEQ ID NO: 128201 - DNA, 16 bp, H. sapiens
tagagtgtgtgtgtgt

SEQ ID NO: 128202 - DNA, 16 bp, H. sapiens
tagagttgggggtctt

SEQ ID NO: 128203 - DNA, 16 bp, H. sapiens
tagagtttacattcta

SEQ ID NO: 128204 - DNA, 16 bp, H. sapiens
tagataaaaccagaaa

SEQ ID NO: 128205 - DNA, 16 bp, H. sapiens
tagataaaatcacaaa

SEQ ID NO: 128206 - DNA, 16 bp, H. sapiens
tagataaacgtgtgcc

SEQ ID NO: 128207 - DNA, 16 bp, H. sapiens
tagataaactggaaat

SEQ ID NO: 128208 - DNA, 16 bp, H. sapiens
tagataaataaataca

SEQ ID NO: 128209 - DNA, 16 bp, H. sapiens
tagataaatccacgaa

SEQ ID NO: 128210 - DNA, 16 bp, H. sapiens
tagataaatttgggga

SEQ ID NO: 128211 - DNA, 16 bp, H. sapiens
tagataactaatacag

SEQ ID NO: 128212 - DNA, 16 bp, H. sapiens
tagataatctgaatag

SEQ ID NO: 128213 - DNA, 16 bp, H. sapiens
tagataattgatagat

SEQ ID NO: 128214 - DNA, 16 bp, H. sapiens
tagatacactaaaaat

SEQ ID NO: 128215 - DNA, 16 bp, H. sapiens
tagatacatatataca

SEQ ID NO: 128216 - DNA, 16 bp, H. sapiens
tagatagataatagat

SEQ ID NO: 128217 - DNA, 16 bp, H. sapiens
tagatagatagataaa

SEQ ID NO: 128218 - DNA, 16 bp, H. sapiens
tagatagatagataag

SEQ ID NO: 128219 - DNA, 16 bp, H. sapiens
tagatagtttgcaaat

SEQ ID NO: 128220 - DNA, 16 bp, H. sapiens
tagatatagaattctg

SEQ ID NO: 128221 - DNA, 16 bp, H. sapiens
tagatatagatagatg

SEQ ID NO: 128222 - DNA, 16 bp, H. sapiens
tagatataggtatata

SEQ ID NO: 128223 - DNA, 16 bp, H. sapiens
tagatatgaaattctg

SEQ ID NO: 128224 - DNA, 16 bp, H. sapiens
tagatatgcagtgtta

SEQ ID NO: 128225 - DNA, 16 bp, H. sapiens
tagatatggggtttcg

SEQ ID NO: 128226 - DNA, 16 bp, H. sapiens
tagatatgtatatatg

SEQ ID NO: 128227 - DNA, 16 bp, H. sapiens
tagatatgtatgtata

SEQ ID NO: 128228 - DNA, 16 bp, H. sapiens
tagatattaacatttt

SEQ ID NO: 128229 - DNA, 16 bp, H. sapiens
tagatattttattctg

SEQ ID NO: 128230 - DNA, 16 bp, H. sapiens
tagatatttttcaaaa

SEQ ID NO: 128231 - DNA, 16 bp, H. sapiens
tagatcacattttctt

SEQ ID NO: 128232 - DNA, 16 bp, H. sapiens
tagatcattttttaaa

SEQ ID NO: 128233 - DNA, 16 bp, H. sapiens
tagatcccttgcatgc

SEQ ID NO: 128234 - DNA, 16 bp, H. sapiens
tagatccttatcagat

SEQ ID NO: 128235 - DNA, 16 bp, H. sapiens
tagatctttcctcctt

SEQ ID NO: 128236 - DNA, 16 bp, H. sapiens
tagatctttgaggaat

SEQ ID NO: 128237 - DNA, 16 bp, H. sapiens
tagatcttttaattgt

SEQ ID NO: 128238 - DNA, 16 bp, H. sapiens
tagatgaaacaagatt

SEQ ID NO: 128239 - DNA, 16 bp, H. sapiens
tagatgaaacagcctt

SEQ ID NO: 128240 - DNA, 16 bp, H. sapiens
tagatgaaatagacca

SEQ ID NO: 128241 - DNA, 16 bp, H. sapiens
tagatgaaattttaaa

SEQ ID NO: 128242 - DNA, 16 bp, H. sapiens
tagatgaagaaattga

SEQ ID NO: 128243 - DNA, 16 bp, H. sapiens
tagatgaagcagaaga

SEQ ID NO: 128244 - DNA, 16 bp, H. sapiens
tagatgaagctggaag

SEQ ID NO: 128245 - DNA, 16 bp, H. sapiens
tagatgaataaatgaa

SEQ ID NO: 128246 - DNA, 16 bp, H. sapiens
tagatgacgggttgat

SEQ ID NO: 128247 - DNA, 16 bp, H. sapiens
tagatgactggttgat

SEQ ID NO: 128248 - DNA, 16 bp, H. sapiens
tagatgagaaaactaa

SEQ ID NO: 128249 - DNA, 16 bp, H. sapiens
tagatgagaaatctga

SEQ ID NO: 128250 - DNA, 16 bp, H. sapiens
tagatgatatagatat

SEQ ID NO: 128251 - DNA, 16 bp, H. sapiens
tagatgatctttgctg

SEQ ID NO: 128252 - DNA, 16 bp, H. sapiens
tagatgatgatgatga

SEQ ID NO: 128253 - DNA, 16 bp, H. sapiens
tagatgatgggttgat

SEQ ID NO: 128254 - DNA, 16 bp, H. sapiens
tagatgcaaaaaaaat

SEQ ID NO: 128255 - DNA, 16 bp, H. sapiens
tagatgcagaagaagc

SEQ ID NO: 128256 - DNA, 16 bp, H. sapiens
tagatgccattaaaaa

SEQ ID NO: 128257 - DNA, 16 bp, H. sapiens
tagatgctaaataaat

SEQ ID NO: 128258 - DNA, 16 bp, H. sapiens
tagatgctattaagaa

SEQ ID NO: 128259 - DNA, 16 bp, H. sapiens
tagatgctcaataaat

SEQ ID NO: 128260 - DNA, 16 bp, H. sapiens
tagatggtattttaaa

SEQ ID NO: 128261 - DNA, 17 bp, H. sapiens
tagatggtgagggctct

SEQ ID NO: 128262 - DNA, 16 bp, H. sapiens
tagatggttggatgga

SEQ ID NO: 128263 - DNA, 16 bp, H. sapiens
tagatgtaaaaatctt

SEQ ID NO: 128264 - DNA, 16 bp, H. sapiens
tagatgtaacaccaaa

SEQ ID NO: 128265 - DNA, 16 bp, H. sapiens
tagatgtaccataatt

SEQ ID NO: 128266 - DNA, 16 bp, H. sapiens
tagatgtctatttggt

SEQ ID NO: 128267 - DNA, 16 bp, H. sapiens
tagatgtctgttaggt

SEQ ID NO: 128268 - DNA, 16 bp, H. sapiens
tagatgtggccatgtg

SEQ ID NO: 128269 - DNA, 16 bp, H. sapiens
tagattaacagaatct

SEQ ID NO: 128270 - DNA, 16 bp, H. sapiens
tagattacatataata

SEQ ID NO: 128271 - DNA, 16 bp, H. sapiens
tagattagtgattgcc

SEQ ID NO: 128272 - DNA, 16 bp, H. sapiens
tagattattgttaact

SEQ ID NO: 128273 - DNA, 16 bp, H. sapiens
tagattcagggggcac

SEQ ID NO: 128274 - DNA, 16 bp, H. sapiens
tagattcataaagcaa

SEQ ID NO: 128275 - DNA, 16 bp, H. sapiens
tagattcattaatttt

SEQ ID NO: 128276 - DNA, 16 bp, H. sapiens
tagattctggacatta

SEQ ID NO: 128277 - DNA, 17 bp, H. sapiens
tagattctggatattag

SEQ ID NO: 128278 - DNA, 16 bp, H. sapiens
tagattgattccatgt

SEQ ID NO: 128279 - DNA, 16 bp, H. sapiens
tagattgctttgggca

SEQ ID NO: 128280 - DNA, 16 bp, H. sapiens
tagatttattgatttg

SEQ ID NO: 128281 - DNA, 16 bp, H. sapiens
tagatttcaagaaaaa

SEQ ID NO: 128282 - DNA, 16 bp, H. sapiens
tagatttcagaggatt

SEQ ID NO: 128283 - DNA, 16 bp, H. sapiens
tagatttgcctcttct

SEQ ID NO: 128284 - DNA, 16 bp, H. sapiens
tagatttgcctttttg

SEQ ID NO: 128285 - DNA, 16 bp, H. sapiens
tagattttctttaaaa

SEQ ID NO: 128286 - DNA, 16 bp, H. sapiens
tagattttgaagactt

SEQ ID NO: 128287 - DNA, 16 bp, H. sapiens
tagattttgaagattt

SEQ ID NO: 128288 - DNA, 16 bp, H. sapiens
tagattttgaagtcag

SEQ ID NO: 128289 - DNA, 16 bp, H. sapiens
tagatttttaaaaaca

SEQ ID NO: 128290 - DNA, 16 bp, H. sapiens
tagatttttctccatc

SEQ ID NO: 128291 - DNA, 16 bp, H. sapiens
tagattttttaaagta

SEQ ID NO: 128292 - DNA, 16 bp, H. sapiens
tagatttttttccccc

SEQ ID NO: 128293 - DNA, 16 bp, H. sapiens
tagcaaaactccatct

SEQ ID NO: 128294 - DNA, 16 bp, H. sapiens
tagcaaaagaaataat

SEQ ID NO: 128295 - DNA, 16 bp, H. sapiens
tagcaaaagactggaa

SEQ ID NO: 128296 - DNA, 16 bp, H. sapiens
tagcaaaatatataaa

SEQ ID NO: 128297 - DNA, 16 bp, H. sapiens
tagcaaaatggcagaa

SEQ ID NO: 128298 - DNA, 16 bp, H. sapiens
tagcaaagaattggaa

SEQ ID NO: 128299 - DNA, 16 bp, H. sapiens
tagcaaagacatggga

SEQ ID NO: 128300 - DNA, 16 bp, H. sapiens
tagcaaaggcatggaa

SEQ ID NO: 128301 - DNA, 16 bp, H. sapiens
tagcaaatatttattg

SEQ ID NO: 128302 - DNA, 16 bp, H. sapiens
tagcaaatattttatg

SEQ ID NO: 128303 - DNA, 16 bp, H. sapiens
tagcaaatcaaatcca

SEQ ID NO: 128304 - DNA, 16 bp, H. sapiens
tagcaaatgaaaatac

SEQ ID NO: 128305 - DNA, 16 bp, H. sapiens
tagcaaatgctggtga

SEQ ID NO: 128306 - DNA, 16 bp, H. sapiens
tagcaaattaattgaa

SEQ ID NO: 128307 - DNA, 16 bp, H. sapiens
tagcaaattatcaaac

SEQ ID NO: 128308 - DNA, 16 bp, H. sapiens
tagcaaattttgaaat

SEQ ID NO: 128309 - DNA, 16 bp, H. sapiens
tagcaacagcagcagc

SEQ ID NO: 128310 - DNA, 16 bp, H. sapiens
tagcaacatggatgga

SEQ ID NO: 128311 - DNA, 16 bp, H. sapiens
tagcaactttattcat

SEQ ID NO: 128312 - DNA, 16 bp, H. sapiens
tagcaagacaggcaaa

SEQ ID NO: 128313 - DNA, 16 bp, H. sapiens
tagcaagaccccatcc

SEQ ID NO: 128314 - DNA, 16 bp, H. sapiens
tagcaagaccccatct

SEQ ID NO: 128315 - DNA, 16 bp, H. sapiens
tagcaagactctgtct

SEQ ID NO: 128316 - DNA, 19 bp, H. sapiens
tagcaagattaataaagaa

SEQ ID NO: 128317 - DNA, 22 bp, H. sapiens
tagcaaggaaggccaacattca

SEQ ID NO: 128318 - DNA, 16 bp, H. sapiens
tagcaataaagcattt

SEQ ID NO: 128319 - DNA, 16 bp, H. sapiens
tagcaataaggtattt

SEQ ID NO: 128320 - DNA, 16 bp, H. sapiens
tagcaatgagcacacc

SEQ ID NO: 128321 - DNA, 16 bp, H. sapiens
tagcaatggggtttca

SEQ ID NO: 128322 - DNA, 16 bp, H. sapiens
tagcacactacagcct

SEQ ID NO: 128323 - DNA, 16 bp, H. sapiens
tagcacagaaacagaa

SEQ ID NO: 128324 - DNA, 16 bp, H. sapiens
tagcacagacttggaa

SEQ ID NO: 128325 - DNA, 16 bp, H. sapiens
tagcacatgcttgtaa

SEQ ID NO: 128326 - DNA, 16 bp, H. sapiens
tagcacattgggaggc

SEQ ID NO: 128327 - DNA, 16 bp, H. sapiens
tagcacattttcttta

SEQ ID NO: 128328 - DNA, 16 bp, H. sapiens
tagcaccatcccctca

SEQ ID NO: 128329 - DNA, 16 bp, H. sapiens
tagcacctatttttat

SEQ ID NO: 128330 - DNA, 19 bp, H. sapiens
tagcactttgggaggccaa

SEQ ID NO: 128331 - DNA, 19 bp, H. sapiens
tagcactttgggaggctga

SEQ ID NO: 128332 - DNA, 16 bp, H. sapiens
tagcagaaaagaaata

SEQ ID NO: 128333 - DNA, 16 bp, H. sapiens
tagcagaagaaaggaa

SEQ ID NO: 128334 - DNA, 16 bp, H. sapiens
tagcagaagacatgaa

SEQ ID NO: 128335 - DNA, 16 bp, H. sapiens
tagcagaaggcaagag

SEQ ID NO: 128336 - DNA, 16 bp, H. sapiens
tagcagaaggcaagca

SEQ ID NO: 128337 - DNA, 16 bp, H. sapiens
tagcagaatctaaatt

SEQ ID NO: 128338 - DNA, 16 bp, H. sapiens
tagcagagctgggatt

SEQ ID NO: 128339 - DNA, 16 bp, H. sapiens
tagcagagtagggtga

SEQ ID NO: 128340 - DNA, 16 bp, H. sapiens
tagcagcagcagcagt

SEQ ID NO: 128341 - DNA, 16 bp, H. sapiens
tagcagcatcatttat

SEQ ID NO: 128342 - DNA, 16 bp, H. sapiens
tagcagcatctctgac

SEQ ID NO: 128343 - DNA, 16 bp, H. sapiens
tagcagggcatggtgg

SEQ ID NO: 128344 - DNA, 16 bp, H. sapiens
tagcagggcgtggtgg

SEQ ID NO: 128345 - DNA, 16 bp, H. sapiens
tagcagggtgagaatg

SEQ ID NO: 128346 - DNA, 16 bp, H. sapiens
tagcaggtgctcaata

SEQ ID NO: 128347 - DNA, 16 bp, H. sapiens
tagcaggtgtggtggt

SEQ ID NO: 128348 - DNA, 16 bp, H. sapiens
tagcagtcactctcca

SEQ ID NO: 128349 - DNA, 16 bp, H. sapiens
tagcagtgagccaaga

SEQ ID NO: 128350 - DNA, 18 bp, H. sapiens
tagcagtgagccgagatt

SEQ ID NO: 128351 - DNA, 16 bp, H. sapiens
tagcagtggggttgct

SEQ ID NO: 128352 - DNA, 16 bp, H. sapiens
tagcagtttttaaaaa

SEQ ID NO: 128353 - DNA, 16 bp, H. sapiens
tagcataattcttaaa

SEQ ID NO: 128354 - DNA, 16 bp, H. sapiens
tagcatattttgaagt

SEQ ID NO: 128355 - DNA, 16 bp, H. sapiens
tagcatgatctcagct

SEQ ID NO: 128356 - DNA, 17 bp, H. sapiens
tagcatgatgcctccag

SEQ ID NO: 128357 - DNA, 16 bp, H. sapiens
tagcatgatgttttca

SEQ ID NO: 128358 - DNA, 16 bp, H. sapiens
tagcatgggaaagacc

SEQ ID NO: 128359 - DNA, 16 bp, H. sapiens
tagcatgtgatactgt

SEQ ID NO: 128360 - DNA, 16 bp, H. sapiens
tagcattcacattgta

SEQ ID NO: 128361 - DNA, 16 bp, H. sapiens
tagcattgaatatgta

SEQ ID NO: 128362 - DNA, 16 bp, H. sapiens
tagcattgatggtctt

SEQ ID NO: 128363 - DNA, 16 bp, H. sapiens
tagcatttaaaaaaat

SEQ ID NO: 128364 - DNA, 16 bp, H. sapiens
tagcatttattttaaa

SEQ ID NO: 128365 - DNA, 16 bp, H. sapiens
tagcatttgttgattt

SEQ ID NO: 128366 - DNA, 16 bp, H. sapiens
tagcattttaaaaata

SEQ ID NO: 128367 - DNA, 16 bp, H. sapiens
tagcattttatttatt

SEQ ID NO: 128368 - DNA, 16 bp, H. sapiens
tagcattttttaaatt

SEQ ID NO: 128369 - DNA, 16 bp, H. sapiens
tagccaaaaagcagaa

SEQ ID NO: 128370 - DNA, 16 bp, H. sapiens
tagccaaaaggcagaa

SEQ ID NO: 128371 - DNA, 16 bp, H. sapiens
tagccaaaaggtagaa

SEQ ID NO: 128372 - DNA, 17 bp, H. sapiens
tagccaaaccatatcat

SEQ ID NO: 128373 - DNA, 16 bp, H. sapiens
tagccaaagcaatctg

SEQ ID NO: 128374 - DNA, 16 bp, H. sapiens
tagccaaattttaaaa

SEQ ID NO: 128375 - DNA, 16 bp, H. sapiens
tagccaacatggtgaa

SEQ ID NO: 128376 - DNA, 16 bp, H. sapiens
tagccaaccaaatcca

SEQ ID NO: 128377 - DNA, 16 bp, H. sapiens
tagccaagacatggaa

SEQ ID NO: 128378 - DNA, 16 bp, H. sapiens
tagccaagataaggaa

SEQ ID NO: 128379 - DNA, 16 bp, H. sapiens
tagccaagatagggaa

SEQ ID NO: 128380 - DNA, 16 bp, H. sapiens
tagccaagatatggaa

SEQ ID NO: 128381 - DNA, 16 bp, H. sapiens
tagccaagatttggaa

SEQ ID NO: 128382 - DNA, 16 bp, H. sapiens
tagccaagggaagcct

SEQ ID NO: 128383 - DNA, 16 bp, H. sapiens
tagccaagtgcggtgg

SEQ ID NO: 128384 - DNA, 16 bp, H. sapiens
tagccaagtgtggtag

SEQ ID NO: 128385 - DNA, 16 bp, H. sapiens
tagccaagtgtggtga

SEQ ID NO: 128386 - DNA, 16 bp, H. sapiens
tagccacagaaagaat

SEQ ID NO: 128387 - DNA, 16 bp, H. sapiens
tagccacagctggagc

SEQ ID NO: 128388 - DNA, 16 bp, H. sapiens
tagccacatgtgacta

SEQ ID NO: 128389 - DNA, 16 bp, H. sapiens
tagccacatgtggcta

SEQ ID NO: 128390 - DNA, 16 bp, H. sapiens
tagccacatgtggtta

SEQ ID NO: 128391 - DNA, 16 bp, H. sapiens
tagccaccacagctga

SEQ ID NO: 128392 - DNA, 16 bp, H. sapiens
tagccaccaccaccac

SEQ ID NO: 128393 - DNA, 16 bp, H. sapiens
tagccaccccaacctt

SEQ ID NO: 128394 - DNA, 16 bp, H. sapiens
tagccaccctgttgtg

SEQ ID NO: 128395 - DNA, 16 bp, H. sapiens
tagccacgcatggtgg

SEQ ID NO: 128396 - DNA, 16 bp, H. sapiens
tagccagagagaaagg

SEQ ID NO: 128397 - DNA, 16 bp, H. sapiens
tagccagatatggtgg

SEQ ID NO: 128398 - DNA, 16 bp, H. sapiens
tagccagctttcccag

SEQ ID NO: 128399 - DNA, 16 bp, H. sapiens
tagccaggagtggtgg

SEQ ID NO: 128400 - DNA, 16 bp, H. sapiens
tagccaggcacagtgg

SEQ ID NO: 128401 - DNA, 16 bp, H. sapiens
tagccaggcatcgtgg

SEQ ID NO: 128402 - DNA, 16 bp, H. sapiens
tagccaggcatggtaa

SEQ ID NO: 128403 - DNA, 16 bp, H. sapiens
tagccaggcatggtag

SEQ ID NO: 128404 - DNA, 16 bp, H. sapiens
tagccaggcatggttg

SEQ ID NO: 128405 - DNA, 16 bp, H. sapiens
tagccaggcctggtgg

SEQ ID NO: 128406 - DNA, 16 bp, H. sapiens
tagccaggcgcagtgg

SEQ ID NO: 128407 - DNA, 16 bp, H. sapiens
tagccaggcgtgatag

SEQ ID NO: 128408 - DNA, 16 bp, H. sapiens
tagccaggcttggtgg

SEQ ID NO: 128409 - DNA, 16 bp, H. sapiens
tagccaggtatggtgg

SEQ ID NO: 128410 - DNA, 16 bp, H. sapiens
tagccaggtgccatgg

SEQ ID NO: 128411 - DNA, 16 bp, H. sapiens
tagccaggtgtgatgg

SEQ ID NO: 128412 - DNA, 16 bp, H. sapiens
tagccaggtgtggtga

SEQ ID NO: 128413 - DNA, 16 bp, H. sapiens
tagccaggtgtggtgc

SEQ ID NO: 128414 - DNA, 16 bp, H. sapiens
tagccaggtgtggtgg

SEQ ID NO: 128415 - DNA, 16 bp, H. sapiens
tagccaggtgtggtgt

SEQ ID NO: 128416 - DNA, 16 bp, H. sapiens
tagccagttgtggtgg

SEQ ID NO: 128417 - DNA, 16 bp, H. sapiens
tagccagttttaccag

SEQ ID NO: 128418 - DNA, 16 bp, H. sapiens
tagccagttttccaaa

SEQ ID NO: 128419 - DNA, 16 bp, H. sapiens
tagccatcctagtagg

SEQ ID NO: 128420 - DNA, 16 bp, H. sapiens
tagccatctgcaagcc

SEQ ID NO: 128421 - DNA, 16 bp, H. sapiens
tagccatgcatggtgg

SEQ ID NO: 128422 - DNA, 16 bp, H. sapiens
tagccattccacagtg

SEQ ID NO: 128423 - DNA, 17 bp, H. sapiens
tagcccacttacattta

SEQ ID NO: 128424 - DNA, 16 bp, H. sapiens
tagcccaggaaatgac

SEQ ID NO: 128425 - DNA, 16 bp, H. sapiens
tagcccagtgcttggc

SEQ ID NO: 128426 - DNA, 16 bp, H. sapiens
tagccccaaactgaaa

SEQ ID NO: 128427 - DNA, 16 bp, H. sapiens
tagccccagctattca

SEQ ID NO: 128428 - DNA, 16 bp, H. sapiens
tagcccctttattttg

SEQ ID NO: 128429 - DNA, 16 bp, H. sapiens
tagcccggctaatttt

SEQ ID NO: 128430 - DNA, 16 bp, H. sapiens
tagccctcagaaggaa

SEQ ID NO: 128431 - DNA, 16 bp, H. sapiens
tagccgagcgtggtgg

SEQ ID NO: 128432 - DNA, 16 bp, H. sapiens
tagccggatatggtgg

SEQ ID NO: 128433 - DNA, 16 bp, H. sapiens
tagccggatgtggtga

SEQ ID NO: 128434 - DNA, 16 bp, H. sapiens
tagccgggcacggtgg

SEQ ID NO: 128435 - DNA, 16 bp, H. sapiens
tagccgggcatcgtgg

SEQ ID NO: 128436 - DNA, 16 bp, H. sapiens
tagccgggcatggtga

SEQ ID NO: 128437 - DNA, 16 bp, H. sapiens
tagccgggcatggtgg

SEQ ID NO: 128438 - DNA, 16 bp, H. sapiens
tagccgggcatggtgt

SEQ ID NO: 128439 - DNA, 16 bp, H. sapiens
tagccgggcctggtgg

SEQ ID NO: 128440 - DNA, 16 bp, H. sapiens
tagccgggcgcagtgg

SEQ ID NO: 128441 - DNA, 18 bp, H. sapiens
tagccgggcgtagtggca

SEQ ID NO: 128442 - DNA, 17 bp, H. sapiens
tagccgggcgtggtgat

SEQ ID NO: 128443 - DNA, 16 bp, H. sapiens
tagccgggtgtggtgg

SEQ ID NO: 128444 - DNA, 16 bp, H. sapiens
tagcctaaaactggaa

SEQ ID NO: 128445 - DNA, 16 bp, H. sapiens
tagcctaatttgtatt

SEQ ID NO: 128446 - DNA, 16 bp, H. sapiens
tagcctacgtgcacat

SEQ ID NO: 128447 - DNA, 16 bp, H. sapiens
tagcctagcatggtgg

SEQ ID NO: 128448 - DNA, 16 bp, H. sapiens
tagcctagcctatctt

SEQ ID NO: 128449 - DNA, 16 bp, H. sapiens
tagcctattgctccta

SEQ ID NO: 128450 - DNA, 16 bp, H. sapiens
tagcctcaatctccca

SEQ ID NO: 128451 - DNA, 16 bp, H. sapiens
tagcctccagaattgt

SEQ ID NO: 128452 - DNA, 18 bp, H. sapiens
tagcctcccaaagtgcta

SEQ ID NO: 128453 - DNA, 18 bp, H. sapiens
tagcctcctgagtagcta

SEQ ID NO: 128454 - DNA, 16 bp, H. sapiens
tagcctctctgtgcct

SEQ ID NO: 128455 - DNA, 16 bp, H. sapiens
tagcctgacatggtgg

SEQ ID NO: 128456 - DNA, 17 bp, H. sapiens
tagcctgagtgacagag

SEQ ID NO: 128457 - DNA, 16 bp, H. sapiens
tagcctggatgacaca

SEQ ID NO: 128458 - DNA, 16 bp, H. sapiens
tagcctggcatgttgg

SEQ ID NO: 128459 - DNA, 16 bp, H. sapiens
tagcctggccatcatg

SEQ ID NO: 128460 - DNA, 16 bp, H. sapiens
tagcctggctgcttct

SEQ ID NO: 128461 - DNA, 16 bp, H. sapiens
tagcctgggcaacaca

SEQ ID NO: 128462 - DNA, 20 bp, H. sapiens
tagcctgggcaacagagcaa

SEQ ID NO: 128463 - DNA, 20 bp, H. sapiens
tagcctgggcaacagagtga

SEQ ID NO: 128464 - DNA, 16 bp, H. sapiens
tagcctgggcaacagg

SEQ ID NO: 128465 - DNA, 16 bp, H. sapiens
tagcctgggctggagt

SEQ ID NO: 128466 - DNA, 16 bp, H. sapiens
tagcctggggtggtgg

SEQ ID NO: 128467 - DNA, 16 bp, H. sapiens
tagcctgggtgactga

SEQ ID NO: 128468 - DNA, 16 bp, H. sapiens
tagcctgggtgataga

SEQ ID NO: 128469 - DNA, 16 bp, H. sapiens
tagccttgtagaatga

SEQ ID NO: 128470 - DNA, 16 bp, H. sapiens
tagcctttataataaa

SEQ ID NO: 128471 - DNA, 16 bp, H. sapiens
tagcctttccaaagaa

SEQ ID NO: 128472 - DNA, 16 bp, H. sapiens
tagccttttagtatag

SEQ ID NO: 128473 - DNA, 16 bp, H. sapiens
tagccttttcatgttt

SEQ ID NO: 128474 - DNA, 16 bp, H. sapiens
tagcctttttagattg

SEQ ID NO: 128475 - DNA, 17 bp, H. sapiens
tagcctttttatccaaa

SEQ ID NO: 128476 - DNA, 16 bp, H. sapiens
tagcgcactgcagcct

SEQ ID NO: 128477 - DNA, 16 bp, H. sapiens
tagcggggcatggtgg

SEQ ID NO: 128478 - DNA, 16 bp, H. sapiens
tagctaaagttaaaaa

SEQ ID NO: 128479 - DNA, 16 bp, H. sapiens
tagctaagatcattga

SEQ ID NO: 128480 - DNA, 16 bp, H. sapiens
tagctaatagatgctg

SEQ ID NO: 128481 - DNA, 16 bp, H. sapiens
tagctaatattttttg

SEQ ID NO: 128482 - DNA, 16 bp, H. sapiens
tagctaatttttaaaa

SEQ ID NO: 128483 - DNA, 16 bp, H. sapiens
tagctaatttttcttt

SEQ ID NO: 128484 - DNA, 16 bp, H. sapiens
tagctacaaaaataaa

SEQ ID NO: 128485 - DNA, 16 bp, H. sapiens
tagctacatttgagcc

SEQ ID NO: 128486 - DNA, 17 bp, H. sapiens
tagctactcagaaggct

SEQ ID NO: 128487 - DNA, 16 bp, H. sapiens
tagctagagaggccaa

SEQ ID NO: 128488 - DNA, 16 bp, H. sapiens
tagctaggcatggtgg

SEQ ID NO: 128489 - DNA, 16 bp, H. sapiens
tagctaggcgtggtgg

SEQ ID NO: 128490 - DNA, 16 bp, H. sapiens
tagctaggtgtggtgg

SEQ ID NO: 128491 - DNA, 16 bp, H. sapiens
tagctatattttatat

SEQ ID NO: 128492 - DNA, 16 bp, H. sapiens
tagctatgtgaccttg

SEQ ID NO: 128493 - DNA, 16 bp, H. sapiens
tagctatgtgactttg

SEQ ID NO: 128494 - DNA, 16 bp, H. sapiens
tagctattattattaa

SEQ ID NO: 128495 - DNA, 16 bp, H. sapiens
tagctattgtaaacag

SEQ ID NO: 128496 - DNA, 16 bp, H. sapiens
tagctatttaaaaata

SEQ ID NO: 128497 - DNA, 16 bp, H. sapiens
tagctatttaaaataa

SEQ ID NO: 128498 - DNA, 16 bp, H. sapiens
tagctatttgaaacta

SEQ ID NO: 128499 - DNA, 16 bp, H. sapiens
tagctattttgaaata

SEQ ID NO: 128500 - DNA, 17 bp, H. sapiens
tagctcaaggtttgtga

SEQ ID NO: 128501 - DNA, 16 bp, H. sapiens
tagctcaccgcaacct

SEQ ID NO: 128502 - DNA, 16 bp, H. sapiens
tagctcactgcaacct

SEQ ID NO: 128503 - DNA, 16 bp, H. sapiens
tagctcactgcagcct

SEQ ID NO: 128504 - DNA, 16 bp, H. sapiens
tagctcactgcagtct

SEQ ID NO: 128505 - DNA, 16 bp, H. sapiens
tagctcaggcctgtaa

SEQ ID NO: 128506 - DNA, 16 bp, H. sapiens
tagctcatttttaaat

SEQ ID NO: 128507 - DNA, 16 bp, H. sapiens
tagctcctacttatga

SEQ ID NO: 128508 - DNA, 16 bp, H. sapiens
tagctcctataattcc

SEQ ID NO: 128509 - DNA, 16 bp, H. sapiens
tagctctgtggcccag

SEQ ID NO: 128510 - DNA, 16 bp, H. sapiens
tagctgaatagaccaa

SEQ ID NO: 128511 - DNA, 16 bp, H. sapiens
tagctgagaccacaga

SEQ ID NO: 128512 - DNA, 16 bp, H. sapiens
tagctgagctaaggag

SEQ ID NO: 128513 - DNA, 16 bp, H. sapiens
tagctgaggatggtgg

SEQ ID NO: 128514 - DNA, 16 bp, H. sapiens
tagctgagtgtgctgg

SEQ ID NO: 128515 - DNA, 16 bp, H. sapiens
tagctgattattttgc

SEQ ID NO: 128516 - DNA, 20 bp, H. sapiens
tagctgctcaggaggctgaa

SEQ ID NO: 128517 - DNA, 16 bp, H. sapiens
tagctgctcttgccac

SEQ ID NO: 128518 - DNA, 16 bp, H. sapiens
tagctggaactacagt

SEQ ID NO: 128519 - DNA, 16 bp, H. sapiens
tagctggaatgacagg

SEQ ID NO: 128520 - DNA, 16 bp, H. sapiens
tagctggacatggtgg

SEQ ID NO: 128521 - DNA, 16 bp, H. sapiens
tagctggacatggtgt

SEQ ID NO: 128522 - DNA, 16 bp, H. sapiens
tagctggacgtgatgg

SEQ ID NO: 128523 - DNA, 16 bp, H. sapiens
tagctggatatggtgg

SEQ ID NO: 128524 - DNA, 21 bp, H. sapiens
tagctggatccctaggagtct

SEQ ID NO: 128525 - DNA, 16 bp, H. sapiens
tagctggatgcagtgg

SEQ ID NO: 128526 - DNA, 16 bp, H. sapiens
tagctggatgtggtgg

SEQ ID NO: 128527 - DNA, 16 bp, H. sapiens
tagctggctgtggtgg

SEQ ID NO: 128528 - DNA, 16 bp, H. sapiens
tagctggcttctttac

SEQ ID NO: 128529 - DNA, 19 bp, H. sapiens
tagctgggaatacaggtgc

SEQ ID NO: 128530 - DNA, 16 bp, H. sapiens
tagctgggaatatagg

SEQ ID NO: 128531 - DNA, 16 bp, H. sapiens
tagctgggacaacaga

SEQ ID NO: 128532 - DNA, 16 bp, H. sapiens
tagctgggaccacaca

SEQ ID NO: 128533 - DNA, 16 bp, H. sapiens
tagctgggactaaagg

SEQ ID NO: 128534 - DNA, 22 bp, H. sapiens
tagctgggactacaggtgccca

SEQ ID NO: 128535 - DNA, 17 bp, H. sapiens
tagctgggactaccagc

SEQ ID NO: 128536 - DNA, 16 bp, H. sapiens
tagctgggactagggg

SEQ ID NO: 128537 - DNA, 16 bp, H. sapiens
tagctgggactcaggc

SEQ ID NO: 128538 - DNA, 17 bp, H. sapiens
tagctgggactgcaggt

SEQ ID NO: 128539 - DNA, 16 bp, H. sapiens
tagctgggagcagtgg

SEQ ID NO: 128540 - DNA, 16 bp, H. sapiens
tagctgggagtggtgg

SEQ ID NO: 128541 - DNA, 16 bp, H. sapiens
tagctgggataatagg

SEQ ID NO: 128542 - DNA, 16 bp, H. sapiens
tagctgggatgacagt

SEQ ID NO: 128543 - DNA, 16 bp, H. sapiens
tagctgggattacaga

SEQ ID NO: 128544 - DNA, 16 bp, H. sapiens
tagctgggcacggtgg

SEQ ID NO: 128545 - DNA, 16 bp, H. sapiens
tagctgggcactgtgg

SEQ ID NO: 128546 - DNA, 16 bp, H. sapiens
tagctgggcctgcagg

SEQ ID NO: 128547 - DNA, 16 bp, H. sapiens
tagctgggcctggtgg

SEQ ID NO: 128548 - DNA, 16 bp, H. sapiens
tagctgggcgcagtgg

SEQ ID NO: 128549 - DNA, 16 bp, H. sapiens
tagctgggcgcggtgg

SEQ ID NO: 128550 - DNA, 16 bp, H. sapiens
tagctggggactacag

SEQ ID NO: 128551 - DNA, 16 bp, H. sapiens
tagctggggatggtgg

SEQ ID NO: 128552 - DNA, 16 bp, H. sapiens
tagctggggctccagg

SEQ ID NO: 128553 - DNA, 16 bp, H. sapiens
tagctgggggtggtgg

SEQ ID NO: 128554 - DNA, 16 bp, H. sapiens
tagctggggtgacaga

SEQ ID NO: 128555 - DNA, 16 bp, H. sapiens
tagctgggtgcagtga

SEQ ID NO: 128556 - DNA, 16 bp, H. sapiens
tagctgggtgcagtgg

SEQ ID NO: 128557 - DNA, 16 bp, H. sapiens
tagctgggtggtggtg

SEQ ID NO: 128558 - DNA, 16 bp, H. sapiens
tagctgggtttggtgg

SEQ ID NO: 128559 - DNA, 29 bp, H. sapiens
tagctgtaattgaggtattgactgctttt

SEQ ID NO: 128560 - DNA, 16 bp, H. sapiens
tagctgtatgaccttg

SEQ ID NO: 128561 - DNA, 16 bp, H. sapiens
tagctgtgctggcagc

SEQ ID NO: 128562 - DNA, 16 bp, H. sapiens
tagctgtgtaaccttg

SEQ ID NO: 128563 - DNA, 16 bp, H. sapiens
tagctgtgtgaccttg

SEQ ID NO: 128564 - DNA, 16 bp, H. sapiens
tagctgtgtgatcttg

SEQ ID NO: 128565 - DNA, 16 bp, H. sapiens
tagctgtgtgtggtgg

SEQ ID NO: 128566 - DNA, 16 bp, H. sapiens
tagctgtttattttgc

SEQ ID NO: 128567 - DNA, 16 bp, H. sapiens
tagctgttttaagaaa

SEQ ID NO: 128568 - DNA, 16 bp, H. sapiens
tagcttactgcaacct

SEQ ID NO: 128569 - DNA, 16 bp, H. sapiens
tagcttactgcagcct

SEQ ID NO: 128570 - DNA, 16 bp, H. sapiens
tagcttataaataaca

SEQ ID NO: 128571 - DNA, 16 bp, H. sapiens
tagcttcagacttttc

SEQ ID NO: 128572 - DNA, 16 bp, H. sapiens
tagcttcaggatgggg

SEQ ID NO: 128573 - DNA, 16 bp, H. sapiens
tagcttcattctagtt

SEQ ID NO: 128574 - DNA, 16 bp, H. sapiens
tagcttctcttgaaaa

SEQ ID NO: 128575 - DNA, 16 bp, H. sapiens
tagcttgaattacagg

SEQ ID NO: 128576 - DNA, 16 bp, H. sapiens
tagcttgagcctggga

SEQ ID NO: 128577 - DNA, 16 bp, H. sapiens
tagcttgcaaaatttt

SEQ ID NO: 128578 - DNA, 16 bp, H. sapiens
tagcttgggtgacaga

SEQ ID NO: 128579 - DNA, 16 bp, H. sapiens
tagcttggtgtggtgg

SEQ ID NO: 128580 - DNA, 16 bp, H. sapiens
tagctttaggggtaca

SEQ ID NO: 128581 - DNA, 16 bp, H. sapiens
tagctttattgagata

SEQ ID NO: 128582 - DNA, 16 bp, H. sapiens
tagctttattttttaa

SEQ ID NO: 128583 - DNA, 16 bp, H. sapiens
tagctttcagcctgtc

SEQ ID NO: 128584 - DNA, 16 bp, H. sapiens
tagctttcattatttt

SEQ ID NO: 128585 - DNA, 16 bp, H. sapiens
tagctttgaatgatct

SEQ ID NO: 128586 - DNA, 16 bp, H. sapiens
tagcttttaaatttgt

SEQ ID NO: 128587 - DNA, 16 bp, H. sapiens
tagcttttgaatttat

SEQ ID NO: 128588 - DNA, 16 bp, H. sapiens
tagcttttgagaatgc

SEQ ID NO: 128589 - DNA, 16 bp, H. sapiens
tagcttttgatttaaa

SEQ ID NO: 128590 - DNA, 16 bp, H. sapiens
tagctttttttaaaaa

SEQ ID NO: 128591 - DNA, 16 bp, H. sapiens
taggaaaaaaaatact

SEQ ID NO: 128592 - DNA, 16 bp, H. sapiens
taggaaaaaatgctca

SEQ ID NO: 128593 - DNA, 16 bp, H. sapiens
taggaaaaacttttct

SEQ ID NO: 128594 - DNA, 16 bp, H. sapiens
taggaaaaatcaatat

SEQ ID NO: 128595 - DNA, 16 bp, H. sapiens
taggaaaacaatagaa

SEQ ID NO: 128596 - DNA, 43 bp, H. sapiens
taggaaaaccagagacctttgttcacttgtttatctgctgacc

SEQ ID NO: 128597 - DNA, 37 bp, H. sapiens
taggaaaagaggaagtcaaattgtccctgcttgcaga

SEQ ID NO: 128598 - DNA, 16 bp, H. sapiens
taggaaatatactttt

SEQ ID NO: 128599 - DNA, 16 bp, H. sapiens
taggaaatgtccagaa

SEQ ID NO: 128600 - DNA, 16 bp, H. sapiens
taggaaattaatacag

SEQ ID NO: 128601 - DNA, 16 bp, H. sapiens
taggaaattccaaggg

SEQ ID NO: 128602 - DNA, 16 bp, H. sapiens
taggaacacttttaca

SEQ ID NO: 128603 - DNA, 16 bp, H. sapiens
taggaacagtatcaca

SEQ ID NO: 128604 - DNA, 16 bp, H. sapiens
taggaacattcaaaat

SEQ ID NO: 128605 - DNA, 16 bp, H. sapiens
taggaagaaacaatat

SEQ ID NO: 128606 - DNA, 16 bp, H. sapiens
taggaagaaccaatat

SEQ ID NO: 128607 - DNA, 16 bp, H. sapiens
taggaagaatcaatat

SEQ ID NO: 128608 - DNA, 16 bp, H. sapiens
taggaagattttagaa

SEQ ID NO: 128609 - DNA, 22 bp, H. sapiens
taggaatccaacttacaaggga

SEQ ID NO: 128610 - DNA, 16 bp, H. sapiens
taggaatctgcatttt

SEQ ID NO: 128611 - DNA, 16 bp, H. sapiens
taggaatgaatttaac

SEQ ID NO: 128612 - DNA, 16 bp, H. sapiens
taggacaggtctgatg

SEQ ID NO: 128613 - DNA, 16 bp, H. sapiens
taggaccacaggcatg

SEQ ID NO: 128614 - DNA, 16 bp, H. sapiens
taggactacaggcaca

SEQ ID NO: 128615 - DNA, 16 bp, H. sapiens
taggagaaaaaggcat

SEQ ID NO: 128616 - DNA, 16 bp, H. sapiens
taggagaaaacataag

SEQ ID NO: 128617 - DNA, 16 bp, H. sapiens
taggagaaataaattt

SEQ ID NO: 128618 - DNA, 16 bp, H. sapiens
taggagaatcacttga

SEQ ID NO: 128619 - DNA, 16 bp, H. sapiens
taggagattgaggctg

SEQ ID NO: 128620 - DNA, 18 bp, H. sapiens
taggagctggttttttga

SEQ ID NO: 128621 - DNA, 16 bp, H. sapiens
taggaggaagggactt

SEQ ID NO: 128622 - DNA, 16 bp, H. sapiens
taggaggaataagttc

SEQ ID NO: 128623 - DNA, 16 bp, H. sapiens
taggaggatcatttga

SEQ ID NO: 128624 - DNA, 16 bp, H. sapiens
taggaggcccaggtgg

SEQ ID NO: 128625 - DNA, 16 bp, H. sapiens
taggaggccgagacag

SEQ ID NO: 128626 - DNA, 18 bp, H. sapiens
taggaggccgaggcagga

SEQ ID NO: 128627 - DNA, 16 bp, H. sapiens
taggagggttgcttga

SEQ ID NO: 128628 - DNA, 16 bp, H. sapiens
taggaggtcagcacaa

SEQ ID NO: 128629 - DNA, 16 bp, H. sapiens
taggaggtggggactt

SEQ ID NO: 128630 - DNA, 16 bp, H. sapiens
taggagtagaattgct

SEQ ID NO: 128631 - DNA, 16 bp, H. sapiens
taggagtggaattgct

SEQ ID NO: 128632 - DNA, 16 bp, H. sapiens
taggagtggaatttct

SEQ ID NO: 128633 - DNA, 16 bp, H. sapiens
taggagtggttagaga

SEQ ID NO: 128634 - DNA, 16 bp, H. sapiens
taggagttcaaaacta

SEQ ID NO: 128635 - DNA, 16 bp, H. sapiens
taggagttcaagatca

SEQ ID NO: 128636 - DNA, 16 bp, H. sapiens
taggagtttgaggttg

SEQ ID NO: 128637 - DNA, 16 bp, H. sapiens
taggagttttattgtt

SEQ ID NO: 128638 - DNA, 16 bp, H. sapiens
taggatacaaaatcaa

SEQ ID NO: 128639 - DNA, 16 bp, H. sapiens
taggatcatgccactg

SEQ ID NO: 128640 - DNA, 16 bp, H. sapiens
taggatcatgttatct

SEQ ID NO: 128641 - DNA, 16 bp, H. sapiens
taggatgactataatt

SEQ ID NO: 128642 - DNA, 16 bp, H. sapiens
taggattacaagcatg

SEQ ID NO: 128643 - DNA, 16 bp, H. sapiens
taggattacaagtgcc

SEQ ID NO: 128644 - DNA, 16 bp, H. sapiens
taggattacaggcatg

SEQ ID NO: 128645 - DNA, 25 bp, H. sapiens
taggattacaggcatgagccactgt

SEQ ID NO: 128646 - DNA, 16 bp, H. sapiens
taggattacaggcgag

SEQ ID NO: 128647 - DNA, 16 bp, H. sapiens
taggattacaggcgta

SEQ ID NO: 128648 - DNA, 16 bp, H. sapiens
taggattctttcttta

SEQ ID NO: 128649 - DNA, 16 bp, H. sapiens
taggattgctttttct

SEQ ID NO: 128650 - DNA, 16 bp, H. sapiens
taggattttgaagcaa

SEQ ID NO: 128651 - DNA, 16 bp, H. sapiens
taggatttttaaaaat

SEQ ID NO: 128652 - DNA, 16 bp, H. sapiens
taggatttttacattt

SEQ ID NO: 128653 - DNA, 16 bp, H. sapiens
taggatttttggaatg

SEQ ID NO: 128654 - DNA, 16 bp, H. sapiens
taggcaaaaactggaa

SEQ ID NO: 128655 - DNA, 16 bp, H. sapiens
taggcaaaggatttga

SEQ ID NO: 128656 - DNA, 16 bp, H. sapiens
taggcaaattcacaaa

SEQ ID NO: 128657 - DNA, 16 bp, H. sapiens
taggcaaattcagaga

SEQ ID NO: 128658 - DNA, 16 bp, H. sapiens
taggcaacaaaatgag

SEQ ID NO: 128659 - DNA, 16 bp, H. sapiens
taggcaacaaagtgaa

SEQ ID NO: 128660 - DNA, 16 bp, H. sapiens
taggcaacagagtgag

SEQ ID NO: 128661 - DNA, 16 bp, H. sapiens
taggcaacgtagcaag

SEQ ID NO: 128662 - DNA, 16 bp, H. sapiens
taggcaagagaaagaa

SEQ ID NO: 128663 - DNA, 16 bp, H. sapiens
taggcaagataaagaa

SEQ ID NO: 128664 - DNA, 17 bp, H. sapiens
taggcaataggaatttt

SEQ ID NO: 128665 - DNA, 16 bp, H. sapiens
taggcaatgatttctt

SEQ ID NO: 128666 - DNA, 16 bp, H. sapiens
taggcaattataacat

SEQ ID NO: 128667 - DNA, 18 bp, H. sapiens
taggcacagtggctcaca

SEQ ID NO: 128668 - DNA, 16 bp, H. sapiens
taggcagaaaactgaa

SEQ ID NO: 128669 - DNA, 16 bp, H. sapiens
taggcagaaaattgaa

SEQ ID NO: 128670 - DNA, 16 bp, H. sapiens
taggcagaagaaagaa

SEQ ID NO: 128671 - DNA, 16 bp, H. sapiens
taggcagaataatggc

SEQ ID NO: 128672 - DNA, 16 bp, H. sapiens
taggcatgagccacca

SEQ ID NO: 128673 - DNA, 16 bp, H. sapiens
taggcatgagccattg

SEQ ID NO: 128674 - DNA, 16 bp, H. sapiens
taggcatgagtcactg

SEQ ID NO: 128675 - DNA, 16 bp, H. sapiens
taggcatggtggctca

SEQ ID NO: 128676 - DNA, 16 bp, H. sapiens
taggcattcaataaat

SEQ ID NO: 128677 - DNA, 16 bp, H. sapiens
taggcatttattgtta

SEQ ID NO: 128678 - DNA, 16 bp, H. sapiens
taggccaaaccaatgt

SEQ ID NO: 128679 - DNA, 16 bp, H. sapiens
taggccaaggtgggtg

SEQ ID NO: 128680 - DNA, 22 bp, H. sapiens
taggccaggcgcggtggctcac

SEQ ID NO: 128681 - DNA, 16 bp, H. sapiens
taggccaggctggtct

SEQ ID NO: 128682 - DNA, 16 bp, H. sapiens
taggcctcagcccagg

SEQ ID NO: 128683 - DNA, 16 bp, H. sapiens
taggcgattttgtcat

SEQ ID NO: 128684 - DNA, 16 bp, H. sapiens
taggcgtgagccacca

SEQ ID NO: 128685 - DNA, 16 bp, H. sapiens
taggcgtgagccaccg

SEQ ID NO: 128686 - DNA, 17 bp, H. sapiens
taggcgtgagccaccgt

SEQ ID NO: 128687 - DNA, 16 bp, H. sapiens
taggcgtgagccactg

SEQ ID NO: 128688 - DNA, 19 bp, H. sapiens
taggcgtgagccactgcat

SEQ ID NO: 128689 - DNA, 16 bp, H. sapiens
taggcgtgagcctctg

SEQ ID NO: 128690 - DNA, 16 bp, H. sapiens
taggcgtgatggctca

SEQ ID NO: 128691 - DNA, 16 bp, H. sapiens
taggctagagtgcagt

SEQ ID NO: 128692 - DNA, 19 bp, H. sapiens
taggctagagtgcagtggc

SEQ ID NO: 128693 - DNA, 16 bp, H. sapiens
taggctagagtgtagt

SEQ ID NO: 128694 - DNA, 16 bp, H. sapiens
taggctatttattact

SEQ ID NO: 128695 - DNA, 20 bp, H. sapiens
taggctcaaaataaaaggat

SEQ ID NO: 128696 - DNA, 17 bp, H. sapiens
taggctgagacaggaga

SEQ ID NO: 128697 - DNA, 16 bp, H. sapiens
taggctgaggaggaag

SEQ ID NO: 128698 - DNA, 21 bp, H. sapiens
taggctggagtgcaatggcac

SEQ ID NO: 128699 - DNA, 19 bp, H. sapiens
taggctggagtgcaatggt

SEQ ID NO: 128700 - DNA, 23 bp, H. sapiens
taggctggagtgcagtggtgcga

SEQ ID NO: 128701 - DNA, 16 bp, H. sapiens
taggctgggcacagtg

SEQ ID NO: 128702 - DNA, 16 bp, H. sapiens
taggctgggcatagtg

SEQ ID NO: 128703 - DNA, 16 bp, H. sapiens
taggctgggtgcagtg

SEQ ID NO: 128704 - DNA, 18 bp, H. sapiens
taggctggtcttgaactc

SEQ ID NO: 128705 - DNA, 18 bp, H. sapiens
taggctggtcttgaactg

SEQ ID NO: 128706 - DNA, 16 bp, H. sapiens
taggctttgcaggcca

SEQ ID NO: 128707 - DNA, 16 bp, H. sapiens
taggctttgtgagcca

SEQ ID NO: 128708 - DNA, 16 bp, H. sapiens
tagggaaaaaaatcta

SEQ ID NO: 128709 - DNA, 16 bp, H. sapiens
tagggaaaactgggtg

SEQ ID NO: 128710 - DNA, 16 bp, H. sapiens
tagggaaactgaggca

SEQ ID NO: 128711 - DNA, 16 bp, H. sapiens
tagggaagctgagaca

SEQ ID NO: 128712 - DNA, 16 bp, H. sapiens
tagggaaggatctgtt

SEQ ID NO: 128713 - DNA, 16 bp, H. sapiens
tagggaatcctttctg

SEQ ID NO: 128714 - DNA, 16 bp, H. sapiens
tagggacacacagcca

SEQ ID NO: 128715 - DNA, 16 bp, H. sapiens
tagggacagggtttta

SEQ ID NO: 128716 - DNA, 31 bp, H. sapiens
tagggacatggatgaagctggaaaccatcat

SEQ ID NO: 128717 - DNA, 16 bp, H. sapiens
tagggacttgagcatc

SEQ ID NO: 128718 - DNA, 16 bp, H. sapiens
tagggacttggagaac

SEQ ID NO: 128719 - DNA, 16 bp, H. sapiens
tagggagaaagcattc

SEQ ID NO: 128720 - DNA, 16 bp, H. sapiens
tagggagtcctttcct

SEQ ID NO: 128721 - DNA, 16 bp, H. sapiens
tagggatctttcacct

SEQ ID NO: 128722 - DNA, 16 bp, H. sapiens
tagggatggaaaagga

SEQ ID NO: 128723 - DNA, 16 bp, H. sapiens
tagggcaagcttgtat

SEQ ID NO: 128724 - DNA, 16 bp, H. sapiens
tagggcccaccctgat

SEQ ID NO: 128725 - DNA, 16 bp, H. sapiens
tagggcctttaggagg

SEQ ID NO: 128726 - DNA, 16 bp, H. sapiens
tagggctgccattaca

SEQ ID NO: 128727 - DNA, 16 bp, H. sapiens
taggggctcaataaat

SEQ ID NO: 128728 - DNA, 17 bp, H. sapiens
tagggtacatgtgcaca

SEQ ID NO: 128729 - DNA, 16 bp, H. sapiens
tagggtatgtggtgga

SEQ ID NO: 128730 - DNA, 16 bp, H. sapiens
tagggtcttgttctgt

SEQ ID NO: 128731 - DNA, 16 bp, H. sapiens
tagggtgggctgccca

SEQ ID NO: 128732 - DNA, 16 bp, H. sapiens
tagggtggggcaaaat

SEQ ID NO: 128733 - DNA, 16 bp, H. sapiens
tagggttacagattaa

SEQ ID NO: 128734 - DNA, 16 bp, H. sapiens
tagggttacaggcatg

SEQ ID NO: 128735 - DNA, 16 bp, H. sapiens
tagggttagggtaggg

SEQ ID NO: 128736 - DNA, 17 bp, H. sapiens
tagggtttcaccatgtc

SEQ ID NO: 128737 - DNA, 22 bp, H. sapiens
tagggtttcaccatgttggtca

SEQ ID NO: 128738 - DNA, 16 bp, H. sapiens
tagggtttttaaaaaa

SEQ ID NO: 128739 - DNA, 16 bp, H. sapiens
taggtaaaatccaagt

SEQ ID NO: 128740 - DNA, 17 bp, H. sapiens
taggtaaacaaagcagc

SEQ ID NO: 128741 - DNA, 16 bp, H. sapiens
taggtactcagtaaat

SEQ ID NO: 128742 - DNA, 16 bp, H. sapiens
taggtactgttattat

SEQ ID NO: 128743 - DNA, 16 bp, H. sapiens
taggtatatagccaaa

SEQ ID NO: 128744 - DNA, 16 bp, H. sapiens
taggtatttacctaag

SEQ ID NO: 128745 - DNA, 16 bp, H. sapiens
taggtatttgtcttaa

SEQ ID NO: 128746 - DNA, 16 bp, H. sapiens
taggtattttattccc

SEQ ID NO: 128747 - DNA, 16 bp, H. sapiens
taggtattttttgtag

SEQ ID NO: 128748 - DNA, 16 bp, H. sapiens
taggtcagcacctttt

SEQ ID NO: 128749 - DNA, 21 bp, H. sapiens
taggtcaggagatcgagacca

SEQ ID NO: 128750 - DNA, 16 bp, H. sapiens
taggtcatgagagctc

SEQ ID NO: 128751 - DNA, 16 bp, H. sapiens
taggtcatgggggctc

SEQ ID NO: 128752 - DNA, 16 bp, H. sapiens
taggtccaagagtcca

SEQ ID NO: 128753 - DNA, 16 bp, H. sapiens
taggtgagtctcttaa

SEQ ID NO: 128754 - DNA, 16 bp, H. sapiens
taggtgcacaataaat

SEQ ID NO: 128755 - DNA, 16 bp, H. sapiens
taggtgctcaataaat

SEQ ID NO: 128756 - DNA, 16 bp, H. sapiens
taggtgctcagtaaat

SEQ ID NO: 128757 - DNA, 16 bp, H. sapiens
taggtggacatggtgg

SEQ ID NO: 128758 - DNA, 16 bp, H. sapiens
taggtgggagtgacca

SEQ ID NO: 128759 - DNA, 16 bp, H. sapiens
taggtgtgacccacca

SEQ ID NO: 128760 - DNA, 18 bp, H. sapiens
taggtgtgagccaccgcg

SEQ ID NO: 128761 - DNA, 16 bp, H. sapiens
taggtgtgagccactg

SEQ ID NO: 128762 - DNA, 16 bp, H. sapiens
taggtgtgagctactg

SEQ ID NO: 128763 - DNA, 16 bp, H. sapiens
taggttcatccatgtt

SEQ ID NO: 128764 - DNA, 16 bp, H. sapiens
taggttccacttgtca

SEQ ID NO: 128765 - DNA, 16 bp, H. sapiens
taggttcttgaaaact

SEQ ID NO: 128766 - DNA, 17 bp, H. sapiens
taggttcttttctattt

SEQ ID NO: 128767 - DNA, 16 bp, H. sapiens
taggttgattccatat

SEQ ID NO: 128768 - DNA, 16 bp, H. sapiens
taggttgcagtgagcc

SEQ ID NO: 128769 - DNA, 16 bp, H. sapiens
taggtttggacattta

SEQ ID NO: 128770 - DNA, 16 bp, H. sapiens
taggttttattctagg

SEQ ID NO: 128771 - DNA, 16 bp, H. sapiens
taggttttctatctct

SEQ ID NO: 128772 - DNA, 16 bp, H. sapiens
taggttttgttctagg

SEQ ID NO: 128773 - DNA, 16 bp, H. sapiens
taggtttttgtgtgaa

SEQ ID NO: 128774 - DNA, 16 bp, H. sapiens
tagtaaaaatatggta

SEQ ID NO: 128775 - DNA, 16 bp, H. sapiens
tagtaaaacctcatct

SEQ ID NO: 128776 - DNA, 16 bp, H. sapiens
tagtaaagatggagtt

SEQ ID NO: 128777 - DNA, 16 bp, H. sapiens
tagtaaatgacagagc

SEQ ID NO: 128778 - DNA, 16 bp, H. sapiens
tagtaaatggcagagc

SEQ ID NO: 128779 - DNA, 16 bp, H. sapiens
tagtaaatttattttc

SEQ ID NO: 128780 - DNA, 16 bp, H. sapiens
tagtaacatcaaagat

SEQ ID NO: 128781 - DNA, 17 bp, H. sapiens
tagtaaccaaaacagca

SEQ ID NO: 128782 - DNA, 16 bp, H. sapiens
tagtaacctaaaactt

SEQ ID NO: 128783 - DNA, 16 bp, H. sapiens
tagtaagaccctgtct

SEQ ID NO: 128784 - DNA, 16 bp, H. sapiens
tagtaagcactcaaaa

SEQ ID NO: 128785 - DNA, 16 bp, H. sapiens
tagtaagtggcagaac

SEQ ID NO: 128786 - DNA, 16 bp, H. sapiens
tagtaagtggtagagc

SEQ ID NO: 128787 - DNA, 16 bp, H. sapiens
tagtaagttttgaaat

SEQ ID NO: 128788 - DNA, 16 bp, H. sapiens
tagtaataataacaac

SEQ ID NO: 128789 - DNA, 16 bp, H. sapiens
tagtaataataatgat

SEQ ID NO: 128790 - DNA, 16 bp, H. sapiens
tagtaatcaaatatat

SEQ ID NO: 128791 - DNA, 32 bp, H. sapiens
tagtaatgggagactttaacaccccactgtca

SEQ ID NO: 128792 - DNA, 16 bp, H. sapiens
tagtaattttacagtt

SEQ ID NO: 128793 - DNA, 16 bp, H. sapiens
tagtacagacagggtc

SEQ ID NO: 128794 - DNA, 16 bp, H. sapiens
tagtacagttgaccct

SEQ ID NO: 128795 - DNA, 17 bp, H. sapiens
tagtacatggcctgctg

SEQ ID NO: 128796 - DNA, 16 bp, H. sapiens
tagtaccagctcttct

SEQ ID NO: 128797 - DNA, 16 bp, H. sapiens
tagtactggaagtact

SEQ ID NO: 128798 - DNA, 16 bp, H. sapiens
tagtagaagaaataat

SEQ ID NO: 128799 - DNA, 17 bp, H. sapiens
tagtagagaccgggttt

SEQ ID NO: 128800 - DNA, 16 bp, H. sapiens
tagtagcaatggggtt

SEQ ID NO: 128801 - DNA, 16 bp, H. sapiens
tagtaggataatgaag

SEQ ID NO: 128802 - DNA, 16 bp, H. sapiens
tagtaggtgctcaaaa

SEQ ID NO: 128803 - DNA, 16 bp, H. sapiens
tagtaggtgtatatat

SEQ ID NO: 128804 - DNA, 16 bp, H. sapiens
tagtaggtgttcaaaa

SEQ ID NO: 128805 - DNA, 16 bp, H. sapiens
tagtaggtgttcagta

SEQ ID NO: 128806 - DNA, 16 bp, H. sapiens
tagtagtagtagtagt

SEQ ID NO: 128807 - DNA, 16 bp, H. sapiens
tagtagtcccagctac

SEQ ID NO: 128808 - DNA, 16 bp, H. sapiens
tagtatcaaagaagaa

SEQ ID NO: 128809 - DNA, 16 bp, H. sapiens
tagtatctacctcaaa

SEQ ID NO: 128810 - DNA, 16 bp, H. sapiens
tagtatctcattatgg

SEQ ID NO: 128811 - DNA, 16 bp, H. sapiens
tagtatgctgtcttca

SEQ ID NO: 128812 - DNA, 16 bp, H. sapiens
tagtattagaaggtgg

SEQ ID NO: 128813 - DNA, 16 bp, H. sapiens
tagtattattttcatt

SEQ ID NO: 128814 - DNA, 16 bp, H. sapiens
tagtattccactgtgt

SEQ ID NO: 128815 - DNA, 16 bp, H. sapiens
tagtattccatcgtgt

SEQ ID NO: 128816 - DNA, 35 bp, H. sapiens
tagtattccatggtgtatatgtgccacactttctt

SEQ ID NO: 128817 - DNA, 16 bp, H. sapiens
tagtattccattgtgt

SEQ ID NO: 128818 - DNA, 16 bp, H. sapiens
tagtattcctttgtat

SEQ ID NO: 128819 - DNA, 16 bp, H. sapiens
tagtatttcattatgt

SEQ ID NO: 128820 - DNA, 16 bp, H. sapiens
tagtatttgtgtatct

SEQ ID NO: 128821 - DNA, 16 bp, H. sapiens
tagtcaaaaagtagaa

SEQ ID NO: 128822 - DNA, 16 bp, H. sapiens
tagtcaaaattataga

SEQ ID NO: 128823 - DNA, 16 bp, H. sapiens
tagtcaaactgctgaa

SEQ ID NO: 128824 - DNA, 16 bp, H. sapiens
tagtcaaattcataga

SEQ ID NO: 128825 - DNA, 16 bp, H. sapiens
tagtcaataattattt

SEQ ID NO: 128826 - DNA, 16 bp, H. sapiens
tagtcacaatagcaaa

SEQ ID NO: 128827 - DNA, 16 bp, H. sapiens
tagtcaccatgatgta

SEQ ID NO: 128828 - DNA, 16 bp, H. sapiens
tagtcactgtggaaaa

SEQ ID NO: 128829 - DNA, 16 bp, H. sapiens
tagtcagagaaatgca

SEQ ID NO: 128830 - DNA, 16 bp, H. sapiens
tagtcaggaggctgag

SEQ ID NO: 128831 - DNA, 16 bp, H. sapiens
tagtcaggcacggtgg

SEQ ID NO: 128832 - DNA, 16 bp, H. sapiens
tagtcaggcatggtgg

SEQ ID NO: 128833 - DNA, 16 bp, H. sapiens
tagtcaggtgtggtgg

SEQ ID NO: 128834 - DNA, 16 bp, H. sapiens
tagtcatcaataccag

SEQ ID NO: 128835 - DNA, 16 bp, H. sapiens
tagtcatcatggaaat

SEQ ID NO: 128836 - DNA, 16 bp, H. sapiens
tagtcatcctacagtg

SEQ ID NO: 128837 - DNA, 16 bp, H. sapiens
tagtcatggcagaagg

SEQ ID NO: 128838 - DNA, 16 bp, H. sapiens
tagtcatgtgttgctt

SEQ ID NO: 128839 - DNA, 16 bp, H. sapiens
tagtcattaaggaaat

SEQ ID NO: 128840 - DNA, 16 bp, H. sapiens
tagtcattagggaaat

SEQ ID NO: 128841 - DNA, 16 bp, H. sapiens
tagtcattcaataaat

SEQ ID NO: 128842 - DNA, 16 bp, H. sapiens
tagtccaaaatgtcaa

SEQ ID NO: 128843 - DNA, 16 bp, H. sapiens
tagtcccagcactctg

SEQ ID NO: 128844 - DNA, 16 bp, H. sapiens
tagtcccaggtactcg

SEQ ID NO: 128845 - DNA, 16 bp, H. sapiens
tagtcccccaaagtct

SEQ ID NO: 128846 - DNA, 16 bp, H. sapiens
tagtcctgtatttctt

SEQ ID NO: 128847 - DNA, 16 bp, H. sapiens
tagtcctttctcagat

SEQ ID NO: 128848 - DNA, 16 bp, H. sapiens
tagtcgcagctacttg

SEQ ID NO: 128849 - DNA, 16 bp, H. sapiens
tagtcgggcgtggtgg

SEQ ID NO: 128850 - DNA, 16 bp, H. sapiens
tagtctatggtatttt

SEQ ID NO: 128851 - DNA, 16 bp, H. sapiens
tagtctcaaacttctg

SEQ ID NO: 128852 - DNA, 17 bp, H. sapiens
tagtctcaataaaccag

SEQ ID NO: 128853 - DNA, 16 bp, H. sapiens
tagtctcactagccct

SEQ ID NO: 128854 - DNA, 16 bp, H. sapiens
tagtctcactctgttg

SEQ ID NO: 128855 - DNA, 16 bp, H. sapiens
tagtctcattctgtca

SEQ ID NO: 128856 - DNA, 16 bp, H. sapiens
tagtctcgctctgtcg

SEQ ID NO: 128857 - DNA, 17 bp, H. sapiens
tagtctctcaaagtgct

SEQ ID NO: 128858 - DNA, 27 bp, H. sapiens
tagtctggccaacatggtgaaacccca

SEQ ID NO: 128859 - DNA, 16 bp, H. sapiens
tagtctggtgtggtgg

SEQ ID NO: 128860 - DNA, 16 bp, H. sapiens
tagtctttgcagtctg

SEQ ID NO: 128861 - DNA, 16 bp, H. sapiens
tagtgaaacctcattt

SEQ ID NO: 128862 - DNA, 16 bp, H. sapiens
tagtgaacagccttgg

SEQ ID NO: 128863 - DNA, 16 bp, H. sapiens
tagtgaacattgtacc

SEQ ID NO: 128864 - DNA, 16 bp, H. sapiens
tagtgaagacatggaa

SEQ ID NO: 128865 - DNA, 16 bp, H. sapiens
tagtgaagcaaattaa

SEQ ID NO: 128866 - DNA, 16 bp, H. sapiens
tagtgaataagtctca

SEQ ID NO: 128867 - DNA, 16 bp, H. sapiens
tagtgaatgaatctca

SEQ ID NO: 128868 - DNA, 16 bp, H. sapiens
tagtgaatgagtctca

SEQ ID NO: 128869 - DNA, 16 bp, H. sapiens
tagtgagacctggtct

SEQ ID NO: 128870 - DNA, 16 bp, H. sapiens
tagtgagctatgatca

SEQ ID NO: 128871 - DNA, 16 bp, H. sapiens
tagtgatattgacaat

SEQ ID NO: 128872 - DNA, 17 bp, H. sapiens
tagtgatcctcctgcct

SEQ ID NO: 128873 - DNA, 16 bp, H. sapiens
tagtgatgatgaacat

SEQ ID NO: 128874 - DNA, 16 bp, H. sapiens
tagtgatgatggtgat

SEQ ID NO: 128875 - DNA, 16 bp, H. sapiens
tagtgatgctggaaat

SEQ ID NO: 128876 - DNA, 16 bp, H. sapiens
tagtgatggtggtggt

SEQ ID NO: 128877 - DNA, 16 bp, H. sapiens
tagtgatgtctgccat

SEQ ID NO: 128878 - DNA, 16 bp, H. sapiens
tagtgattaagtctca

SEQ ID NO: 128879 - DNA, 16 bp, H. sapiens
tagtgcaactgagaaa

SEQ ID NO: 128880 - DNA, 16 bp, H. sapiens
tagtgcacctgaaggg

SEQ ID NO: 128881 - DNA, 17 bp, H. sapiens
tagtgcagtggcgcgat

SEQ ID NO: 128882 - DNA, 16 bp, H. sapiens
tagtgccattgcattc

SEQ ID NO: 128883 - DNA, 16 bp, H. sapiens
tagtgccgcaataaat

SEQ ID NO: 128884 - DNA, 16 bp, H. sapiens
tagtgcctcatgcctg

SEQ ID NO: 128885 - DNA, 16 bp, H. sapiens
tagtgctgcaatgaat

SEQ ID NO: 128886 - DNA, 16 bp, H. sapiens
tagtgctgtggtgaac

SEQ ID NO: 128887 - DNA, 17 bp, H. sapiens
tagtggagctgtgagaa

SEQ ID NO: 128888 - DNA, 16 bp, H. sapiens
tagtggaggagacaga

SEQ ID NO: 128889 - DNA, 16 bp, H. sapiens
tagtggcacagtctca

SEQ ID NO: 128890 - DNA, 16 bp, H. sapiens
tagtggcatgctcctg

SEQ ID NO: 128891 - DNA, 16 bp, H. sapiens
tagtggctaccatatt

SEQ ID NO: 128892 - DNA, 16 bp, H. sapiens
tagtggctcacgcctg

SEQ ID NO: 128893 - DNA, 16 bp, H. sapiens
tagtggctcatgcctg

SEQ ID NO: 128894 - DNA, 16 bp, H. sapiens
tagtgggaatataaat

SEQ ID NO: 128895 - DNA, 16 bp, H. sapiens
tagtgggaggtgtttg

SEQ ID NO: 128896 - DNA, 16 bp, H. sapiens
tagtggtgatgatggt

SEQ ID NO: 128897 - DNA, 16 bp, H. sapiens
tagtggtgatggttgt

SEQ ID NO: 128898 - DNA, 16 bp, H. sapiens
tagtggtgggctcctg

SEQ ID NO: 128899 - DNA, 16 bp, H. sapiens
tagtggtgtgatcatg

SEQ ID NO: 128900 - DNA, 16 bp, H. sapiens
tagtggtgttctctgt

SEQ ID NO: 128901 - DNA, 16 bp, H. sapiens
tagtggttcatgcctg

SEQ ID NO: 128902 - DNA, 16 bp, H. sapiens
tagtggttttcaaact

SEQ ID NO: 128903 - DNA, 16 bp, H. sapiens
tagtgtacccatcacc

SEQ ID NO: 128904 - DNA, 16 bp, H. sapiens
tagtgtactcatcacc

SEQ ID NO: 128905 - DNA, 16 bp, H. sapiens
tagtgtccttataaaa

SEQ ID NO: 128906 - DNA, 16 bp, H. sapiens
tagtgtgtatatatgt

SEQ ID NO: 128907 - DNA, 16 bp, H. sapiens
tagtgtgtgcgtgtgt

SEQ ID NO: 128908 - DNA, 17 bp, H. sapiens
tagtgtgtgtatgtgtg

SEQ ID NO: 128909 - DNA, 16 bp, H. sapiens
tagtgttaaaagaaaa

SEQ ID NO: 128910 - DNA, 16 bp, H. sapiens
tagtgttctattgtat

SEQ ID NO: 128911 - DNA, 16 bp, H. sapiens
tagtgttctctgtatt

SEQ ID NO: 128912 - DNA, 16 bp, H. sapiens
tagtgttgtaataaac

SEQ ID NO: 128913 - DNA, 16 bp, H. sapiens
tagtgtttctgcagag

SEQ ID NO: 128914 - DNA, 16 bp, H. sapiens
tagtgtttgtcaggtt

SEQ ID NO: 128915 - DNA, 16 bp, H. sapiens
tagtgttttgtagttc

SEQ ID NO: 128916 - DNA, 16 bp, H. sapiens
tagttaaatttgaatt

SEQ ID NO: 128917 - DNA, 16 bp, H. sapiens
tagttaacatttactg

SEQ ID NO: 128918 - DNA, 16 bp, H. sapiens
tagttaataattcttt

SEQ ID NO: 128919 - DNA, 16 bp, H. sapiens
tagttaatagtaatat

SEQ ID NO: 128920 - DNA, 16 bp, H. sapiens
tagttaatagtattat

SEQ ID NO: 128921 - DNA, 16 bp, H. sapiens
tagttactgtagcctt

SEQ ID NO: 128922 - DNA, 17 bp, H. sapiens
tagttacttcctagata

SEQ ID NO: 128923 - DNA, 16 bp, H. sapiens
tagttactttttaaat

SEQ ID NO: 128924 - DNA, 16 bp, H. sapiens
tagttatcttttaaaa

SEQ ID NO: 128925 - DNA, 16 bp, H. sapiens
tagttatttcttctct

SEQ ID NO: 128926 - DNA, 16 bp, H. sapiens
tagttatttttcctaa

SEQ ID NO: 128927 - DNA, 16 bp, H. sapiens
tagttcaaaatatttt

SEQ ID NO: 128928 - DNA, 16 bp, H. sapiens
tagttcaaataatttt

SEQ ID NO: 128929 - DNA, 19 bp, H. sapiens
tagttcaaccactgtggaa

SEQ ID NO: 128930 - DNA, 19 bp, H. sapiens
tagttcaaccattgtggaa

SEQ ID NO: 128931 - DNA, 16 bp, H. sapiens
tagttcacagcagcct

SEQ ID NO: 128932 - DNA, 16 bp, H. sapiens
tagttcactgaagcct

SEQ ID NO: 128933 - DNA, 16 bp, H. sapiens
tagttcagtgtctgcc

SEQ ID NO: 128934 - DNA, 16 bp, H. sapiens
tagttcattaattttt

SEQ ID NO: 128935 - DNA, 16 bp, H. sapiens
tagttcattccttttt

SEQ ID NO: 128936 - DNA, 16 bp, H. sapiens
tagttcatttacattc

SEQ ID NO: 128937 - DNA, 16 bp, H. sapiens
tagttcatttggtgaa

SEQ ID NO: 128938 - DNA, 16 bp, H. sapiens
tagttccaactacttg

SEQ ID NO: 128939 - DNA, 16 bp, H. sapiens
tagttccagctactcc

SEQ ID NO: 128940 - DNA, 20 bp, H. sapiens
tagttcgaccattgtggaag

SEQ ID NO: 128941 - DNA, 16 bp, H. sapiens
tagttctaagagtttt

SEQ ID NO: 128942 - DNA, 16 bp, H. sapiens
tagttctccttgaaga

SEQ ID NO: 128943 - DNA, 16 bp, H. sapiens
tagttctgcttttagc

SEQ ID NO: 128944 - DNA, 16 bp, H. sapiens
tagttctggatccttg

SEQ ID NO: 128945 - DNA, 16 bp, H. sapiens
tagttctttagggaat

SEQ ID NO: 128946 - DNA, 16 bp, H. sapiens
tagttctttgtagcag

SEQ ID NO: 128947 - DNA, 16 bp, H. sapiens
tagttctttgtatatt

SEQ ID NO: 128948 - DNA, 16 bp, H. sapiens
tagttcttttaattct

SEQ ID NO: 128949 - DNA, 16 bp, H. sapiens
tagttctttttgtaga

SEQ ID NO: 128950 - DNA, 16 bp, H. sapiens
tagttcttttttaaat

SEQ ID NO: 128951 - DNA, 16 bp, H. sapiens
tagttgaaatttcctt

SEQ ID NO: 128952 - DNA, 16 bp, H. sapiens
tagttgcaacagagac

SEQ ID NO: 128953 - DNA, 20 bp, H. sapiens
tagttgccccagtgactgtt

SEQ ID NO: 128954 - DNA, 16 bp, H. sapiens
tagttgggcaaaatca

SEQ ID NO: 128955 - DNA, 16 bp, H. sapiens
tagttgtagatccttg

SEQ ID NO: 128956 - DNA, 16 bp, H. sapiens
tagttgttataccata

SEQ ID NO: 128957 - DNA, 16 bp, H. sapiens
tagttgttcaataaat

SEQ ID NO: 128958 - DNA, 16 bp, H. sapiens
tagtttagtccatgca

SEQ ID NO: 128959 - DNA, 16 bp, H. sapiens
tagtttataaagaaag

SEQ ID NO: 128960 - DNA, 16 bp, H. sapiens
tagtttatatatatag

SEQ ID NO: 128961 - DNA, 16 bp, H. sapiens
tagtttatgcacataa

SEQ ID NO: 128962 - DNA, 16 bp, H. sapiens
tagtttattataaagg

SEQ ID NO: 128963 - DNA, 16 bp, H. sapiens
tagtttatttgcatag

SEQ ID NO: 128964 - DNA, 16 bp, H. sapiens
tagtttattttcatgc

SEQ ID NO: 128965 - DNA, 16 bp, H. sapiens
tagtttattttcatta

SEQ ID NO: 128966 - DNA, 16 bp, H. sapiens
tagtttcacttcccta

SEQ ID NO: 128967 - DNA, 16 bp, H. sapiens
tagtttcagaattgct

SEQ ID NO: 128968 - DNA, 16 bp, H. sapiens
tagtttcagtaagaat

SEQ ID NO: 128969 - DNA, 16 bp, H. sapiens
tagtttcatttcattg

SEQ ID NO: 128970 - DNA, 16 bp, H. sapiens
tagtttctgtctttct

SEQ ID NO: 128971 - DNA, 16 bp, H. sapiens
tagtttcttcatctat

SEQ ID NO: 128972 - DNA, 16 bp, H. sapiens
tagtttcttgaggaac

SEQ ID NO: 128973 - DNA, 16 bp, H. sapiens
tagtttcttttgatgt

SEQ ID NO: 128974 - DNA, 16 bp, H. sapiens
tagtttgaatgtttgt

SEQ ID NO: 128975 - DNA, 16 bp, H. sapiens
tagtttgactttttct

SEQ ID NO: 128976 - DNA, 16 bp, H. sapiens
tagtttgatagaaata

SEQ ID NO: 128977 - DNA, 16 bp, H. sapiens
tagtttgattccactg

SEQ ID NO: 128978 - DNA, 16 bp, H. sapiens
tagtttgcaaatattt

SEQ ID NO: 128979 - DNA, 17 bp, H. sapiens
tagtttgccaagaatga

SEQ ID NO: 128980 - DNA, 16 bp, H. sapiens
tagtttgctgacccct

SEQ ID NO: 128981 - DNA, 16 bp, H. sapiens
tagtttgctgaggaaa

SEQ ID NO: 128982 - DNA, 16 bp, H. sapiens
tagtttgtgtgcataa

SEQ ID NO: 128983 - DNA, 16 bp, H. sapiens
tagttttaaaatacat

SEQ ID NO: 128984 - DNA, 16 bp, H. sapiens
tagttttaaagttttg

SEQ ID NO: 128985 - DNA, 16 bp, H. sapiens
tagttttacagaaaaa

SEQ ID NO: 128986 - DNA, 16 bp, H. sapiens
tagttttacttttaaa

SEQ ID NO: 128987 - DNA, 16 bp, H. sapiens
tagttttaggtttaca

SEQ ID NO: 128988 - DNA, 16 bp, H. sapiens
tagttttagttttctg

SEQ ID NO: 128989 - DNA, 16 bp, H. sapiens
tagttttataataagt

SEQ ID NO: 128990 - DNA, 16 bp, H. sapiens
tagttttatttcaaaa

SEQ ID NO: 128991 - DNA, 16 bp, H. sapiens
tagttttcaaattatt

SEQ ID NO: 128992 - DNA, 16 bp, H. sapiens
tagttttccttgtaaa

SEQ ID NO: 128993 - DNA, 16 bp, H. sapiens
tagttttctgttactg

SEQ ID NO: 128994 - DNA, 16 bp, H. sapiens
tagttttcttttctgg

SEQ ID NO: 128995 - DNA, 16 bp, H. sapiens
tagttttgagcaattt

SEQ ID NO: 128996 - DNA, 16 bp, H. sapiens
tagttttgctttttcc

SEQ ID NO: 128997 - DNA, 16 bp, H. sapiens
tagtttttatctgaaa

SEQ ID NO: 128998 - DNA, 16 bp, H. sapiens
tagtttttatgagaag

SEQ ID NO: 128999 - DNA, 16 bp, H. sapiens
tagtttttcaaaaatt

SEQ ID NO: 129000 - DNA, 16 bp, H. sapiens
tagtttttcaacaaat

SEQ ID NO: 129001 - DNA, 16 bp, H. sapiens
tagtttttcagctctt

SEQ ID NO: 129002 - DNA, 16 bp, H. sapiens
tagtttttcagtcttt

SEQ ID NO: 129003 - DNA, 16 bp, H. sapiens
tagtttttcttctagg

SEQ ID NO: 129004 - DNA, 16 bp, H. sapiens
tagtttttggctatta

SEQ ID NO: 129005 - DNA, 16 bp, H. sapiens
tagttttttgaaaaat

SEQ ID NO: 129006 - DNA, 16 bp, H. sapiens
tagtttttttcctaat

SEQ ID NO: 129007 - DNA, 16 bp, H. sapiens
tagtttttttgaggaa

SEQ ID NO: 129008 - DNA, 16 bp, H. sapiens
tataaaaaaattagct

SEQ ID NO: 129009 - DNA, 16 bp, H. sapiens
tataaaaaccatggaa

SEQ ID NO: 129010 - DNA, 16 bp, H. sapiens
tataaaaagaaacatt

SEQ ID NO: 129011 - DNA, 16 bp, H. sapiens
tataaaaataaatgca

SEQ ID NO: 129012 - DNA, 16 bp, H. sapiens
tataaaaataatgttg

SEQ ID NO: 129013 - DNA, 16 bp, H. sapiens
tataaaaatacatgca

SEQ ID NO: 129014 - DNA, 16 bp, H. sapiens
tataaaaatattacct

SEQ ID NO: 129015 - DNA, 16 bp, H. sapiens
tataaaaatcatttct

SEQ ID NO: 129016 - DNA, 16 bp, H. sapiens
tataaaaatcttagaa

SEQ ID NO: 129017 - DNA, 16 bp, H. sapiens
tataaaaatgcttaaa

SEQ ID NO: 129018 - DNA, 16 bp, H. sapiens
tataaaaatgtagtta

SEQ ID NO: 129019 - DNA, 16 bp, H. sapiens
tataaaaatgtttgaa

SEQ ID NO: 129020 - DNA, 16 bp, H. sapiens
tataaaaatgttttct

SEQ ID NO: 129021 - DNA, 16 bp, H. sapiens
tataaaaattctgttt

SEQ ID NO: 129022 - DNA, 16 bp, H. sapiens
tataaaaattggccag

SEQ ID NO: 129023 - DNA, 16 bp, H. sapiens
tataaaacactgatga

SEQ ID NO: 129024 - DNA, 16 bp, H. sapiens
tataaaacaggaataa

SEQ ID NO: 129025 - DNA, 16 bp, H. sapiens
tataaaacatttcatt

SEQ ID NO: 129026 - DNA, 16 bp, H. sapiens
tataaaaccaaactgt

SEQ ID NO: 129027 - DNA, 16 bp, H. sapiens
tataaaaccatcaaat

SEQ ID NO: 129028 - DNA, 16 bp, H. sapiens
tataaaactctgagaa

SEQ ID NO: 129029 - DNA, 16 bp, H. sapiens
tataaaacttgatttt

SEQ ID NO: 129030 - DNA, 16 bp, H. sapiens
tataaaagaaaacatg

SEQ ID NO: 129031 - DNA, 16 bp, H. sapiens
tataaaagctttaaaa

SEQ ID NO: 129032 - DNA, 16 bp, H. sapiens
tataaaagtagataca

SEQ ID NO: 129033 - DNA, 16 bp, H. sapiens
tataaaataaaacatg

SEQ ID NO: 129034 - DNA, 16 bp, H. sapiens
tataaaataaaacttg

SEQ ID NO: 129035 - DNA, 16 bp, H. sapiens
tataaaataaatgtct

SEQ ID NO: 129036 - DNA, 16 bp, H. sapiens
tataaaatacagaata

SEQ ID NO: 129037 - DNA, 16 bp, H. sapiens
tataaaatacattgtt

SEQ ID NO: 129038 - DNA, 16 bp, H. sapiens
tataaaatacctagga

SEQ ID NO: 129039 - DNA, 16 bp, H. sapiens
tataaaatggaatatt

SEQ ID NO: 129040 - DNA, 16 bp, H. sapiens
tataaaatggagataa

SEQ ID NO: 129041 - DNA, 16 bp, H. sapiens
tataaaatgggggtaa

SEQ ID NO: 129042 - DNA, 16 bp, H. sapiens
tataaaatggtgtagt

SEQ ID NO: 129043 - DNA, 16 bp, H. sapiens
tataaaatgtatgtaa

SEQ ID NO: 129044 - DNA, 16 bp, H. sapiens
tataaaatgtctcttt

SEQ ID NO: 129045 - DNA, 16 bp, H. sapiens
tataaaatgttattca

SEQ ID NO: 129046 - DNA, 16 bp, H. sapiens
tataaaatgttttatg

SEQ ID NO: 129047 - DNA, 16 bp, H. sapiens
tataaaattaatcatc

SEQ ID NO: 129048 - DNA, 16 bp, H. sapiens
tataaacaatggaaat

SEQ ID NO: 129049 - DNA, 16 bp, H. sapiens
tataaacacctctact

SEQ ID NO: 129050 - DNA, 16 bp, H. sapiens
tataaacacctctatg

SEQ ID NO: 129051 - DNA, 16 bp, H. sapiens
tataaacataactttt

SEQ ID NO: 129052 - DNA, 16 bp, H. sapiens
tataaacatgtatgca

SEQ ID NO: 129053 - DNA, 16 bp, H. sapiens
tataaacatgtatgta

SEQ ID NO: 129054 - DNA, 16 bp, H. sapiens
tataaacatgtttata

SEQ ID NO: 129055 - DNA, 16 bp, H. sapiens
tataaacatgttttaa

SEQ ID NO: 129056 - DNA, 16 bp, H. sapiens
tataaacattcttgta

SEQ ID NO: 129057 - DNA, 16 bp, H. sapiens
tataaacatttatgtt

SEQ ID NO: 129058 - DNA, 16 bp, H. sapiens
tataaacccagcactt

SEQ ID NO: 129059 - DNA, 16 bp, H. sapiens
tataaaccttttataa

SEQ ID NO: 129060 - DNA, 16 bp, H. sapiens
tataaactgctttggg

SEQ ID NO: 129061 - DNA, 16 bp, H. sapiens
tataaactgtaaagtg

SEQ ID NO: 129062 - DNA, 16 bp, H. sapiens
tataaactgtattttt

SEQ ID NO: 129063 - DNA, 16 bp, H. sapiens
tataaagaaaattctg

SEQ ID NO: 129064 - DNA, 16 bp, H. sapiens
tataaagaaactgcat

SEQ ID NO: 129065 - DNA, 16 bp, H. sapiens
tataaagacacacaaa

SEQ ID NO: 129066 - DNA, 16 bp, H. sapiens
tataaagacatatgca

SEQ ID NO: 129067 - DNA, 16 bp, H. sapiens
tataaagatacatgca

SEQ ID NO: 129068 - DNA, 16 bp, H. sapiens
tataaagatgtatttt

SEQ ID NO: 129069 - DNA, 16 bp, H. sapiens
tataaagatgtcagtt

SEQ ID NO: 129070 - DNA, 16 bp, H. sapiens
tataaagcaatatata

SEQ ID NO: 129071 - DNA, 16 bp, H. sapiens
tataaagcatttagaa

SEQ ID NO: 129072 - DNA, 16 bp, H. sapiens
tataaagctaaaataa

SEQ ID NO: 129073 - DNA, 16 bp, H. sapiens
tataaagctacagtaa

SEQ ID NO: 129074 - DNA, 16 bp, H. sapiens
tataaaggaaaactta

SEQ ID NO: 129075 - DNA, 16 bp, H. sapiens
tataaaggaaagagtt

SEQ ID NO: 129076 - DNA, 16 bp, H. sapiens
tataaaggaatattat

SEQ ID NO: 129077 - DNA, 16 bp, H. sapiens
tataaaggccttttaa

SEQ ID NO: 129078 - DNA, 16 bp, H. sapiens
tataaagtacttagaa

SEQ ID NO: 129079 - DNA, 16 bp, H. sapiens
tataaagttaaacata

SEQ ID NO: 129080 - DNA, 16 bp, H. sapiens
tataaataatgctgcc

SEQ ID NO: 129081 - DNA, 16 bp, H. sapiens
tataaatacatatgta

SEQ ID NO: 129082 - DNA, 16 bp, H. sapiens
tataaatagactcata

SEQ ID NO: 129083 - DNA, 16 bp, H. sapiens
tataaatatatatgca

SEQ ID NO: 129084 - DNA, 16 bp, H. sapiens
tataaatatatgcatt

SEQ ID NO: 129085 - DNA, 16 bp, H. sapiens
tataaatatatttgca

SEQ ID NO: 129086 - DNA, 16 bp, H. sapiens
tataaatatgtacata

SEQ ID NO: 129087 - DNA, 16 bp, H. sapiens
tataaatatgtagata

SEQ ID NO: 129088 - DNA, 16 bp, H. sapiens
tataaatatttccaaa

SEQ ID NO: 129089 - DNA, 19 bp, H. sapiens
tataaatcatgctgctata

SEQ ID NO: 129090 - DNA, 33 bp, H. sapiens
tataaatcatgctgctataaagacacatgcaca

SEQ ID NO: 129091 - DNA, 16 bp, H. sapiens
tataaatgaaacaaga

SEQ ID NO: 129092 - DNA, 16 bp, H. sapiens
tataaatgaagaaact

SEQ ID NO: 129093 - DNA, 16 bp, H. sapiens
tataaatgagaaaatc

SEQ ID NO: 129094 - DNA, 16 bp, H. sapiens
tataaatgaggaaaat

SEQ ID NO: 129095 - DNA, 16 bp, H. sapiens
tataaatggaaacaaa

SEQ ID NO: 129096 - DNA, 16 bp, H. sapiens
tataaatggaatcata

SEQ ID NO: 129097 - DNA, 16 bp, H. sapiens
tataaatgggatcata

SEQ ID NO: 129098 - DNA, 16 bp, H. sapiens
tataaatgtatataga

SEQ ID NO: 129099 - DNA, 16 bp, H. sapiens
tataaatgtgatacat

SEQ ID NO: 129100 - DNA, 16 bp, H. sapiens
tataaatgtgtatgtg

SEQ ID NO: 129101 - DNA, 16 bp, H. sapiens
tataaatgtgtttata

SEQ ID NO: 129102 - DNA, 16 bp, H. sapiens
tataaattaacctaat

SEQ ID NO: 129103 - DNA, 16 bp, H. sapiens
tataaattaagcttta

SEQ ID NO: 129104 - DNA, 16 bp, H. sapiens
tataaattactttgga

SEQ ID NO: 129105 - DNA, 16 bp, H. sapiens
tataaattaggcacaa

SEQ ID NO: 129106 - DNA, 16 bp, H. sapiens
tataaattatgctact

SEQ ID NO: 129107 - DNA, 16 bp, H. sapiens
tataaatttgagagct

SEQ ID NO: 129108 - DNA, 16 bp, H. sapiens
tataaatttgtttctt

SEQ ID NO: 129109 - DNA, 16 bp, H. sapiens
tataaattttcctcta

SEQ ID NO: 129110 - DNA, 16 bp, H. sapiens
tataaatttttggcag

SEQ ID NO: 129111 - DNA, 16 bp, H. sapiens
tataaattttttgaga

SEQ ID NO: 129112 - DNA, 16 bp, H. sapiens
tataacaaacctgcac

SEQ ID NO: 129113 - DNA, 16 bp, H. sapiens
tataacagcacaattt

SEQ ID NO: 129114 - DNA, 16 bp, H. sapiens
tataacagtattaaga

SEQ ID NO: 129115 - DNA, 16 bp, H. sapiens
tataaccattttggaa

SEQ ID NO: 129116 - DNA, 16 bp, H. sapiens
tataacccattattta

SEQ ID NO: 129117 - DNA, 16 bp, H. sapiens
tataacctgcctttgc

SEQ ID NO: 129118 - DNA, 16 bp, H. sapiens
tataacctgtgaaaat

SEQ ID NO: 129119 - DNA, 16 bp, H. sapiens
tataactgtattatat

SEQ ID NO: 129120 - DNA, 16 bp, H. sapiens
tataactttgtaactt

SEQ ID NO: 129121 - DNA, 16 bp, H. sapiens
tataacttttgactcc

SEQ ID NO: 129122 - DNA, 16 bp, H. sapiens
tataagaaatttcaaa

SEQ ID NO: 129123 - DNA, 16 bp, H. sapiens
tataagaattctttat

SEQ ID NO: 129124 - DNA, 16 bp, H. sapiens
tataagagttctcttt

SEQ ID NO: 129125 - DNA, 16 bp, H. sapiens
tataagatcatattat

SEQ ID NO: 129126 - DNA, 16 bp, H. sapiens
tataagcactcccttt

SEQ ID NO: 129127 - DNA, 16 bp, H. sapiens
tataagcattcctttt

SEQ ID NO: 129128 - DNA, 16 bp, H. sapiens
tataagctttttaaaa

SEQ ID NO: 129129 - DNA, 16 bp, H. sapiens
tataaggaaaagagat

SEQ ID NO: 129130 - DNA, 16 bp, H. sapiens
tataaggaaatacctg

SEQ ID NO: 129131 - DNA, 16 bp, H. sapiens
tataaggacacagtca

SEQ ID NO: 129132 - DNA, 16 bp, H. sapiens
tataaggccagcatta

SEQ ID NO: 129133 - DNA, 16 bp, H. sapiens
tataagggaaacagag

SEQ ID NO: 129134 - DNA, 16 bp, H. sapiens
tataagggcgctaatc

SEQ ID NO: 129135 - DNA, 16 bp, H. sapiens
tataaggtggaaggaa

SEQ ID NO: 129136 - DNA, 16 bp, H. sapiens
tataagtcaagtttga

SEQ ID NO: 129137 - DNA, 16 bp, H. sapiens
tataagtgagaacata

SEQ ID NO: 129138 - DNA, 16 bp, H. sapiens
tataagtgagagctaa

SEQ ID NO: 129139 - DNA, 16 bp, H. sapiens
tataagtgggagcaaa

SEQ ID NO: 129140 - DNA, 16 bp, H. sapiens
tataagtgtgtgtgtg

SEQ ID NO: 129141 - DNA, 16 bp, H. sapiens
tataataaaatgatac

SEQ ID NO: 129142 - DNA, 16 bp, H. sapiens
tataataaacatgtat

SEQ ID NO: 129143 - DNA, 16 bp, H. sapiens
tataataatgatgata

SEQ ID NO: 129144 - DNA, 16 bp, H. sapiens
tataatacattgtttt

SEQ ID NO: 129145 - DNA, 16 bp, H. sapiens
tataatagcaataaaa

SEQ ID NO: 129146 - DNA, 16 bp, H. sapiens
tataataggccacaaa

SEQ ID NO: 129147 - DNA, 16 bp, H. sapiens
tataatatataatgtg

SEQ ID NO: 129148 - DNA, 16 bp, H. sapiens
tataatatatacacat

SEQ ID NO: 129149 - DNA, 16 bp, H. sapiens
tataatatggaatata

SEQ ID NO: 129150 - DNA, 16 bp, H. sapiens
tataatatgtaataca

SEQ ID NO: 129151 - DNA, 16 bp, H. sapiens
tataatatgtgtatat

SEQ ID NO: 129152 - DNA, 16 bp, H. sapiens
tataatattgagtctt

SEQ ID NO: 129153 - DNA, 16 bp, H. sapiens
tataatcagaaaaata

SEQ ID NO: 129154 - DNA, 16 bp, H. sapiens
tataatcccagcattt

SEQ ID NO: 129155 - DNA, 16 bp, H. sapiens
tataatcccagctagt

SEQ ID NO: 129156 - DNA, 16 bp, H. sapiens
tataatcctagctact

SEQ ID NO: 129157 - DNA, 16 bp, H. sapiens
tataatctcagctact

SEQ ID NO: 129158 - DNA, 16 bp, H. sapiens
tataatctgaatcaat

SEQ ID NO: 129159 - DNA, 16 bp, H. sapiens
tataatcttatgggac

SEQ ID NO: 129160 - DNA, 16 bp, H. sapiens
tataatgaaaccaatt

SEQ ID NO: 129161 - DNA, 16 bp, H. sapiens
tataatgaagctgaaa

SEQ ID NO: 129162 - DNA, 16 bp, H. sapiens
tataatgaagtgttga

SEQ ID NO: 129163 - DNA, 16 bp, H. sapiens
tataatgacaataata

SEQ ID NO: 129164 - DNA, 16 bp, H. sapiens
tataatgactttcttt

SEQ ID NO: 129165 - DNA, 16 bp, H. sapiens
tataatgagcagtgaa

SEQ ID NO: 129166 - DNA, 16 bp, H. sapiens
tataatgcaaatattt

SEQ ID NO: 129167 - DNA, 16 bp, H. sapiens
tataatgcaagccaca

SEQ ID NO: 129168 - DNA, 16 bp, H. sapiens
tataatgctttttata

SEQ ID NO: 129169 - DNA, 16 bp, H. sapiens
tataatgtatacatta

SEQ ID NO: 129170 - DNA, 16 bp, H. sapiens
tataatgtatgtataa

SEQ ID NO: 129171 - DNA, 16 bp, H. sapiens
tataatgtatgtatgt

SEQ ID NO: 129172 - DNA, 16 bp, H. sapiens
tataatgtattttgaa

SEQ ID NO: 129173 - DNA, 16 bp, H. sapiens
tataatgtgaagtcag

SEQ ID NO: 129174 - DNA, 16 bp, H. sapiens
tataatgtgtgtgtgt

SEQ ID NO: 129175 - DNA, 16 bp, H. sapiens
tataatgttcatattt

SEQ ID NO: 129176 - DNA, 16 bp, H. sapiens
tataatgttgaataga

SEQ ID NO: 129177 - DNA, 16 bp, H. sapiens
tataatgttttaagaa

SEQ ID NO: 129178 - DNA, 16 bp, H. sapiens
tataattatgtaagat

SEQ ID NO: 129179 - DNA, 16 bp, H. sapiens
tataattatgtcatct

SEQ ID NO: 129180 - DNA, 16 bp, H. sapiens
tataattatttctgta

SEQ ID NO: 129181 - DNA, 16 bp, H. sapiens
tataattcaagatgat

SEQ ID NO: 129182 - DNA, 16 bp, H. sapiens
tataattcagtatttt

SEQ ID NO: 129183 - DNA, 16 bp, H. sapiens
tataattctgtcattt

SEQ ID NO: 129184 - DNA, 16 bp, H. sapiens
tataattctgtttata

SEQ ID NO: 129185 - DNA, 16 bp, H. sapiens
tataattctttttgta

SEQ ID NO: 129186 - DNA, 16 bp, H. sapiens
tataattgaaacaaaa

SEQ ID NO: 129187 - DNA, 16 bp, H. sapiens
tataattgacaaaaat

SEQ ID NO: 129188 - DNA, 16 bp, H. sapiens
tataattgatgaacct

SEQ ID NO: 129189 - DNA, 16 bp, H. sapiens
tataattgtatatatg

SEQ ID NO: 129190 - DNA, 16 bp, H. sapiens
tataatttcattcata

SEQ ID NO: 129191 - DNA, 16 bp, H. sapiens
tataatttgaagtgag

SEQ ID NO: 129192 - DNA, 16 bp, H. sapiens
tataattttagaagat

SEQ ID NO: 129193 - DNA, 16 bp, H. sapiens
tataattttgagaaaa

SEQ ID NO: 129194 - DNA, 16 bp, H. sapiens
tataattttgattctt

SEQ ID NO: 129195 - DNA, 16 bp, H. sapiens
tatacaaaagtaaatt

SEQ ID NO: 129196 - DNA, 16 bp, H. sapiens
tatacaaacacataga

SEQ ID NO: 129197 - DNA, 16 bp, H. sapiens
tatacaaatacataca

SEQ ID NO: 129198 - DNA, 16 bp, H. sapiens
tatacaaatgagaaaa

SEQ ID NO: 129199 - DNA, 16 bp, H. sapiens
tatacaaccatcagat

SEQ ID NO: 129200 - DNA, 16 bp, H. sapiens
tatacaacttgatgtt

SEQ ID NO: 129201 - DNA, 16 bp, H. sapiens
tatacaatcatgtcat

SEQ ID NO: 129202 - DNA, 16 bp, H. sapiens
tatacaatcatgtcgt

SEQ ID NO: 129203 - DNA, 16 bp, H. sapiens
tatacaatgcagtatt

SEQ ID NO: 129204 - DNA, 16 bp, H. sapiens
tatacaattatgattt

SEQ ID NO: 129205 - DNA, 16 bp, H. sapiens
tatacaattatgtcat

SEQ ID NO: 129206 - DNA, 16 bp, H. sapiens
tatacacaaaagaata

SEQ ID NO: 129207 - DNA, 16 bp, H. sapiens
tatacacaaatgttca

SEQ ID NO: 129208 - DNA, 16 bp, H. sapiens
tatacacaaatgttta

SEQ ID NO: 129209 - DNA, 16 bp, H. sapiens
tatacacaagagaaat

SEQ ID NO: 129210 - DNA, 16 bp, H. sapiens
tatacacacacacaca

SEQ ID NO: 129211 - DNA, 16 bp, H. sapiens
tatacacacacacacc

SEQ ID NO: 129212 - DNA, 16 bp, H. sapiens
tatacacacacatacc

SEQ ID NO: 129213 - DNA, 16 bp, H. sapiens
tatacacacatacaca

SEQ ID NO: 129214 - DNA, 16 bp, H. sapiens
tatacacacatacata

SEQ ID NO: 129215 - DNA, 16 bp, H. sapiens
tatacacacatatata

SEQ ID NO: 129216 - DNA, 16 bp, H. sapiens
tatacacagtggaata

SEQ ID NO: 129217 - DNA, 16 bp, H. sapiens
tatacacatacatgca

SEQ ID NO: 129218 - DNA, 16 bp, H. sapiens
tatacacatatacaca

SEQ ID NO: 129219 - DNA, 16 bp, H. sapiens
tatacacatatacata

SEQ ID NO: 129220 - DNA, 16 bp, H. sapiens
tatacacatatcaaaa

SEQ ID NO: 129221 - DNA, 16 bp, H. sapiens
tatacacatgtgtgta

SEQ ID NO: 129222 - DNA, 17 bp, H. sapiens
tatacaccaataataga

SEQ ID NO: 129223 - DNA, 16 bp, H. sapiens
tatacacgtacataca

SEQ ID NO: 129224 - DNA, 16 bp, H. sapiens
tatacacgtatatata

SEQ ID NO: 129225 - DNA, 16 bp, H. sapiens
tatacactgtagaata

SEQ ID NO: 129226 - DNA, 16 bp, H. sapiens
tatacactttaaaatg

SEQ ID NO: 129227 - DNA, 16 bp, H. sapiens
tatacactttttaaaa

SEQ ID NO: 129228 - DNA, 16 bp, H. sapiens
tatacagaaaaaccta

SEQ ID NO: 129229 - DNA, 16 bp, H. sapiens
tatacagaaaatccta

SEQ ID NO: 129230 - DNA, 16 bp, H. sapiens
tatacagaaaatgaaa

SEQ ID NO: 129231 - DNA, 16 bp, H. sapiens
tatacagaaatagaaa

SEQ ID NO: 129232 - DNA, 16 bp, H. sapiens
tatacagaaatataat

SEQ ID NO: 129233 - DNA, 16 bp, H. sapiens
tatacagacacacaca

SEQ ID NO: 129234 - DNA, 16 bp, H. sapiens
tatacagatggaaaat

SEQ ID NO: 129235 - DNA, 16 bp, H. sapiens
tatacagccttaaaaa

SEQ ID NO: 129236 - DNA, 16 bp, H. sapiens
tatacaggcaaaaaat

SEQ ID NO: 129237 - DNA, 16 bp, H. sapiens
tatacagtatatatta

SEQ ID NO: 129238 - DNA, 16 bp, H. sapiens
tatacataaaatgtaa

SEQ ID NO: 129239 - DNA, 16 bp, H. sapiens
tatacataatacattt

SEQ ID NO: 129240 - DNA, 16 bp, H. sapiens
tatacataatgaggta

SEQ ID NO: 129241 - DNA, 16 bp, H. sapiens
tatacatacacacaca

SEQ ID NO: 129242 - DNA, 16 bp, H. sapiens
tatacatacataattt

SEQ ID NO: 129243 - DNA, 16 bp, H. sapiens
tatacatacatacata

SEQ ID NO: 129244 - DNA, 16 bp, H. sapiens
tatacatacatataca

SEQ ID NO: 129245 - DNA, 16 bp, H. sapiens
tatacatacatatatg

SEQ ID NO: 129246 - DNA, 16 bp, H. sapiens
tatacatacatgtgta

SEQ ID NO: 129247 - DNA, 16 bp, H. sapiens
tatacatactatgttt

SEQ ID NO: 129248 - DNA, 16 bp, H. sapiens
tatacatagaaaatcc

SEQ ID NO: 129249 - DNA, 16 bp, H. sapiens
tatacatagatatata

SEQ ID NO: 129250 - DNA, 16 bp, H. sapiens
tatacatatacataca

SEQ ID NO: 129251 - DNA, 16 bp, H. sapiens
tatacatatataacta

SEQ ID NO: 129252 - DNA, 16 bp, H. sapiens
tatacatatatgtgta

SEQ ID NO: 129253 - DNA, 16 bp, H. sapiens
tatacatatattttca

SEQ ID NO: 129254 - DNA, 16 bp, H. sapiens
tatacatatgcatttt

SEQ ID NO: 129255 - DNA, 19 bp, H. sapiens
tatacatcaataacagaca

SEQ ID NO: 129256 - DNA, 18 bp, H. sapiens
tatacatccagatggcct

SEQ ID NO: 129257 - DNA, 16 bp, H. sapiens
tatacatctattctat

SEQ ID NO: 129258 - DNA, 16 bp, H. sapiens
tatacatgaaaaaatt

SEQ ID NO: 129259 - DNA, 16 bp, H. sapiens
tatacatgaaacataa

SEQ ID NO: 129260 - DNA, 16 bp, H. sapiens
tatacatgtatcaaaa

SEQ ID NO: 129261 - DNA, 16 bp, H. sapiens
tatacatgtatgtatt

SEQ ID NO: 129262 - DNA, 16 bp, H. sapiens
tatacatgtatgtgta

SEQ ID NO: 129263 - DNA, 16 bp, H. sapiens
tatacatgtgtatata

SEQ ID NO: 129264 - DNA, 16 bp, H. sapiens
tatacatgttattaaa

SEQ ID NO: 129265 - DNA, 16 bp, H. sapiens
tatacattaattcatt

SEQ ID NO: 129266 - DNA, 16 bp, H. sapiens
tatacattatgtatat

SEQ ID NO: 129267 - DNA, 16 bp, H. sapiens
tatacattatgtatta

SEQ ID NO: 129268 - DNA, 16 bp, H. sapiens
tatacattctatgtat

SEQ ID NO: 129269 - DNA, 16 bp, H. sapiens
tatacattctggatac

SEQ ID NO: 129270 - DNA, 16 bp, H. sapiens
tatacattgtatacat

SEQ ID NO: 129271 - DNA, 16 bp, H. sapiens
tatacattgtgaaatg

SEQ ID NO: 129272 - DNA, 16 bp, H. sapiens
tatacattgtggaatg

SEQ ID NO: 129273 - DNA, 16 bp, H. sapiens
tatacatttaagaaag

SEQ ID NO: 129274 - DNA, 16 bp, H. sapiens
tatacatttctttaaa

SEQ ID NO: 129275 - DNA, 16 bp, H. sapiens
tatacatttgacaaag

SEQ ID NO: 129276 - DNA, 16 bp, H. sapiens
tatacattttacatat

SEQ ID NO: 129277 - DNA, 16 bp, H. sapiens
tatacattttaggaag

SEQ ID NO: 129278 - DNA, 16 bp, H. sapiens
tatacattttttaagt

SEQ ID NO: 129279 - DNA, 16 bp, H. sapiens
tatacattttttgaga

SEQ ID NO: 129280 - DNA, 16 bp, H. sapiens
tataccaaaaggaaaa

SEQ ID NO: 129281 - DNA, 16 bp, H. sapiens
tataccaggaaaggga

SEQ ID NO: 129282 - DNA, 16 bp, H. sapiens
tataccagtaccatgt

SEQ ID NO: 129283 - DNA, 16 bp, H. sapiens
tataccataaatattt

SEQ ID NO: 129284 - DNA, 16 bp, H. sapiens
tataccatattttaaa

SEQ ID NO: 129285 - DNA, 16 bp, H. sapiens
tataccattttttaaa

SEQ ID NO: 129286 - DNA, 16 bp, H. sapiens
tatacccaaagattat

SEQ ID NO: 129287 - DNA, 16 bp, H. sapiens
tatacccaaagggaaa

SEQ ID NO: 129288 - DNA, 16 bp, H. sapiens
tatacccagaaaaccc

SEQ ID NO: 129289 - DNA, 16 bp, H. sapiens
tatacccagcaaaact

SEQ ID NO: 129290 - DNA, 16 bp, H. sapiens
tataccctttatcatt

SEQ ID NO: 129291 - DNA, 16 bp, H. sapiens
tatacctcaataaaac

SEQ ID NO: 129292 - DNA, 19 bp, H. sapiens
tatacgcaaatcaataaac

SEQ ID NO: 129293 - DNA, 16 bp, H. sapiens
tatacgtacatacaca

SEQ ID NO: 129294 - DNA, 16 bp, H. sapiens
tatactaatttacatt

SEQ ID NO: 129295 - DNA, 16 bp, H. sapiens
tatactacaaggctat

SEQ ID NO: 129296 - DNA, 16 bp, H. sapiens
tatactagcaacaaac

SEQ ID NO: 129297 - DNA, 16 bp, H. sapiens
tatactatacttttaa

SEQ ID NO: 129298 - DNA, 16 bp, H. sapiens
tatactatatacatat

SEQ ID NO: 129299 - DNA, 16 bp, H. sapiens
tatactatatattgta

SEQ ID NO: 129300 - DNA, 16 bp, H. sapiens
tatactatgttcatgg

SEQ ID NO: 129301 - DNA, 16 bp, H. sapiens
tatactcagtaatgag

SEQ ID NO: 129302 - DNA, 16 bp, H. sapiens
tatactcatgtaacaa

SEQ ID NO: 129303 - DNA, 16 bp, H. sapiens
tatactccagcctggc

SEQ ID NO: 129304 - DNA, 16 bp, H. sapiens
tatactccagcctggg

SEQ ID NO: 129305 - DNA, 16 bp, H. sapiens
tatactctttttaaaa

SEQ ID NO: 129306 - DNA, 16 bp, H. sapiens
tatactgaaatatata

SEQ ID NO: 129307 - DNA, 18 bp, H. sapiens
tatactgaatgggcaaaa

SEQ ID NO: 129308 - DNA, 16 bp, H. sapiens
tatactgacttctttt

SEQ ID NO: 129309 - DNA, 16 bp, H. sapiens
tatactgtatatttta

SEQ ID NO: 129310 - DNA, 16 bp, H. sapiens
tatactgtatgtatat

SEQ ID NO: 129311 - DNA, 16 bp, H. sapiens
tatactgtattatttt

SEQ ID NO: 129312 - DNA, 16 bp, H. sapiens
tatactgtatttttac

SEQ ID NO: 129313 - DNA, 16 bp, H. sapiens
tatactgtggaatact

SEQ ID NO: 129314 - DNA, 16 bp, H. sapiens
tatactgttaatcttt

SEQ ID NO: 129315 - DNA, 16 bp, H. sapiens
tatacttaaaaattgt

SEQ ID NO: 129316 - DNA, 16 bp, H. sapiens
tatacttaaaatgggt

SEQ ID NO: 129317 - DNA, 16 bp, H. sapiens
tatacttaatgccact

SEQ ID NO: 129318 - DNA, 17 bp, H. sapiens
tatacttcagctcaaaa

SEQ ID NO: 129319 - DNA, 16 bp, H. sapiens
tatacttggcttgatt

SEQ ID NO: 129320 - DNA, 16 bp, H. sapiens
tatactttaaaacaat

SEQ ID NO: 129321 - DNA, 16 bp, H. sapiens
tatactttaaaatggt

SEQ ID NO: 129322 - DNA, 16 bp, H. sapiens
tatagaaaacattttt

SEQ ID NO: 129323 - DNA, 16 bp, H. sapiens
tatagaaaatctgaaa

SEQ ID NO: 129324 - DNA, 16 bp, H. sapiens
tatagaaataatacat

SEQ ID NO: 129325 - DNA, 16 bp, H. sapiens
tatagaacatttcatc

SEQ ID NO: 129326 - DNA, 16 bp, H. sapiens
tatagaagaggaaact

SEQ ID NO: 129327 - DNA, 16 bp, H. sapiens
tatagacacacataca

SEQ ID NO: 129328 - DNA, 16 bp, H. sapiens
tatagacacacatata

SEQ ID NO: 129329 - DNA, 16 bp, H. sapiens
tatagacaggcttgag

SEQ ID NO: 129330 - DNA, 16 bp, H. sapiens
tatagacatacacaca

SEQ ID NO: 129331 - DNA, 16 bp, H. sapiens
tatagacatatatttt

SEQ ID NO: 129332 - DNA, 16 bp, H. sapiens
tatagagacagtaaaa

SEQ ID NO: 129333 - DNA, 16 bp, H. sapiens
tatagagagagatata

SEQ ID NO: 129334 - DNA, 16 bp, H. sapiens
tatagataacatcact

SEQ ID NO: 129335 - DNA, 16 bp, H. sapiens
tatagataacatttta

SEQ ID NO: 129336 - DNA, 16 bp, H. sapiens
tatagataaggaaatt

SEQ ID NO: 129337 - DNA, 16 bp, H. sapiens
tatagatagtatatat

SEQ ID NO: 129338 - DNA, 16 bp, H. sapiens
tatagatatacagata

SEQ ID NO: 129339 - DNA, 16 bp, H. sapiens
tatagatgagaagact

SEQ ID NO: 129340 - DNA, 16 bp, H. sapiens
tatagattatggatat

SEQ ID NO: 129341 - DNA, 16 bp, H. sapiens
tatagcaatgcaaaat

SEQ ID NO: 129342 - DNA, 16 bp, H. sapiens
tatagcagattctact

SEQ ID NO: 129343 - DNA, 16 bp, H. sapiens
tatagcagcaaaattc

SEQ ID NO: 129344 - DNA, 16 bp, H. sapiens
tatagcaggaaagaaa

SEQ ID NO: 129345 - DNA, 16 bp, H. sapiens
tatagcagttttattt

SEQ ID NO: 129346 - DNA, 16 bp, H. sapiens
tatagcatgttactgt

SEQ ID NO: 129347 - DNA, 16 bp, H. sapiens
tatagccccagctact

SEQ ID NO: 129348 - DNA, 16 bp, H. sapiens
tatagctatagatata

SEQ ID NO: 129349 - DNA, 16 bp, H. sapiens
tataggaaacataaat

SEQ ID NO: 129350 - DNA, 16 bp, H. sapiens
tataggcacatgccac

SEQ ID NO: 129351 - DNA, 18 bp, H. sapiens
tataggcacatgtaggtt

SEQ ID NO: 129352 - DNA, 16 bp, H. sapiens
tataggcacctgccac

SEQ ID NO: 129353 - DNA, 16 bp, H. sapiens
tataggcatgcaccac

SEQ ID NO: 129354 - DNA, 16 bp, H. sapiens
tataggcatggaccac

SEQ ID NO: 129355 - DNA, 16 bp, H. sapiens
tataggccaggcatgg

SEQ ID NO: 129356 - DNA, 16 bp, H. sapiens
tataggcgcatgccac

SEQ ID NO: 129357 - DNA, 17 bp, H. sapiens
tataggctcaaaataaa

SEQ ID NO: 129358 - DNA, 16 bp, H. sapiens
tatagggcacttacca

SEQ ID NO: 129359 - DNA, 16 bp, H. sapiens
tataggtaaatttaaa

SEQ ID NO: 129360 - DNA, 16 bp, H. sapiens
tataggtgagaaaaca

SEQ ID NO: 129361 - DNA, 16 bp, H. sapiens
tataggtgcccgccac

SEQ ID NO: 129362 - DNA, 16 bp, H. sapiens
tataggtgtgagctat

SEQ ID NO: 129363 - DNA, 16 bp, H. sapiens
tatagtaaaatgattt

SEQ ID NO: 129364 - DNA, 16 bp, H. sapiens
tatagtaaacaataat

SEQ ID NO: 129365 - DNA, 16 bp, H. sapiens
tatagtaaccatttca

SEQ ID NO: 129366 - DNA, 16 bp, H. sapiens
tatagtaatgcaagaa

SEQ ID NO: 129367 - DNA, 16 bp, H. sapiens
tatagtacaatgattt

SEQ ID NO: 129368 - DNA, 16 bp, H. sapiens
tatagtatatgtatat

SEQ ID NO: 129369 - DNA, 16 bp, H. sapiens
tatagtcactttggaa

SEQ ID NO: 129370 - DNA, 16 bp, H. sapiens
tatagtcatgtgccac

SEQ ID NO: 129371 - DNA, 16 bp, H. sapiens
tatagtcccaactact

SEQ ID NO: 129372 - DNA, 16 bp, H. sapiens
tatagtcccagctact

SEQ ID NO: 129373 - DNA, 16 bp, H. sapiens
tatagtcctagctact

SEQ ID NO: 129374 - DNA, 16 bp, H. sapiens
tatagtctcagctact

SEQ ID NO: 129375 - DNA, 16 bp, H. sapiens
tatagtgaccttcttt

SEQ ID NO: 129376 - DNA, 16 bp, H. sapiens
tatagtgagaccctat

SEQ ID NO: 129377 - DNA, 16 bp, H. sapiens
tatagtgagctgtgat

SEQ ID NO: 129378 - DNA, 16 bp, H. sapiens
tatagtggcaagtgag

SEQ ID NO: 129379 - DNA, 16 bp, H. sapiens
tatagtgtatatataa

SEQ ID NO: 129380 - DNA, 16 bp, H. sapiens
tatagttaaaaacaat

SEQ ID NO: 129381 - DNA, 16 bp, H. sapiens
tatagttatatagata

SEQ ID NO: 129382 - DNA, 16 bp, H. sapiens
tatagttccagctgct

SEQ ID NO: 129383 - DNA, 16 bp, H. sapiens
tatagttggaatcata

SEQ ID NO: 129384 - DNA, 16 bp, H. sapiens
tatagtttgaatgtat

SEQ ID NO: 129385 - DNA, 16 bp, H. sapiens
tatagtttggatatgt

SEQ ID NO: 129386 - DNA, 16 bp, H. sapiens
tatagttttacattta

SEQ ID NO: 129387 - DNA, 16 bp, H. sapiens
tatagttttcagcata

SEQ ID NO: 129388 - DNA, 16 bp, H. sapiens
tatagttttgagagtt

SEQ ID NO: 129389 - DNA, 16 bp, H. sapiens
tatagttttgccattt

SEQ ID NO: 129390 - DNA, 16 bp, H. sapiens
tatagttttgggtctt

SEQ ID NO: 129391 - DNA, 16 bp, H. sapiens
tatagtttttatcttg

SEQ ID NO: 129392 - DNA, 16 bp, H. sapiens
tatataaaaatatgtg

SEQ ID NO: 129393 - DNA, 16 bp, H. sapiens
tatataaaatagcaaa

SEQ ID NO: 129394 - DNA, 16 bp, H. sapiens
tatataaaatatgcaa

SEQ ID NO: 129395 - DNA, 16 bp, H. sapiens
tatataaacaaatgag

SEQ ID NO: 129396 - DNA, 16 bp, H. sapiens
tatataaacagaacca

SEQ ID NO: 129397 - DNA, 16 bp, H. sapiens
tatataaacatatatg

SEQ ID NO: 129398 - DNA, 16 bp, H. sapiens
tatataaagcaaacat

SEQ ID NO: 129399 - DNA, 16 bp, H. sapiens
tatataaagcacttaa

SEQ ID NO: 129400 - DNA, 16 bp, H. sapiens
tatataaaggggagtt

SEQ ID NO: 129401 - DNA, 16 bp, H. sapiens
tatataaatcattcta

SEQ ID NO: 129402 - DNA, 16 bp, H. sapiens
tatataaatggaattg

SEQ ID NO: 129403 - DNA, 16 bp, H. sapiens
tatataaatgtgtgtg

SEQ ID NO: 129404 - DNA, 16 bp, H. sapiens
tatataacaaacttgc

SEQ ID NO: 129405 - DNA, 16 bp, H. sapiens
tatataacatacatat

SEQ ID NO: 129406 - DNA, 16 bp, H. sapiens
tatataacatttacat

SEQ ID NO: 129407 - DNA, 16 bp, H. sapiens
tatataactaatttgt

SEQ ID NO: 129408 - DNA, 16 bp, H. sapiens
tatataaggaatttga

SEQ ID NO: 129409 - DNA, 16 bp, H. sapiens
tatataaggcaaatat

SEQ ID NO: 129410 - DNA, 16 bp, H. sapiens
tatataagtatataca

SEQ ID NO: 129411 - DNA, 16 bp, H. sapiens
tatataatacatatgt

SEQ ID NO: 129412 - DNA, 16 bp, H. sapiens
tatataatatatgcta

SEQ ID NO: 129413 - DNA, 16 bp, H. sapiens
tatataatatgtgtgt

SEQ ID NO: 129414 - DNA, 16 bp, H. sapiens
tatataatgtatgtat

SEQ ID NO: 129415 - DNA, 16 bp, H. sapiens
tatataatgtgtgtat

SEQ ID NO: 129416 - DNA, 16 bp, H. sapiens
tatataatgtttacat

SEQ ID NO: 129417 - DNA, 16 bp, H. sapiens
tatatacacaaacata

SEQ ID NO: 129418 - DNA, 16 bp, H. sapiens
tatatacacatataat

SEQ ID NO: 129419 - DNA, 16 bp, H. sapiens
tatatacacatataca

SEQ ID NO: 129420 - DNA, 16 bp, H. sapiens
tatatacacatatata

SEQ ID NO: 129421 - DNA, 16 bp, H. sapiens
tatatacacatgcaca

SEQ ID NO: 129422 - DNA, 16 bp, H. sapiens
tatatacagtatatta

SEQ ID NO: 129423 - DNA, 17 bp, H. sapiens
tatatacagttgaccct

SEQ ID NO: 129424 - DNA, 16 bp, H. sapiens
tatatacataaaaatg

SEQ ID NO: 129425 - DNA, 16 bp, H. sapiens
tatatacatacacata

SEQ ID NO: 129426 - DNA, 16 bp, H. sapiens
tatatacatacataca

SEQ ID NO: 129427 - DNA, 16 bp, H. sapiens
tatatacatatataca

SEQ ID NO: 129428 - DNA, 20 bp, H. sapiens
tatatacatatatacatata

SEQ ID NO: 129429 - DNA, 16 bp, H. sapiens
tatatacatatatgca

SEQ ID NO: 129430 - DNA, 16 bp, H. sapiens
tatatacatatttgaa

SEQ ID NO: 129431 - DNA, 16 bp, H. sapiens
tatatacatccatata

SEQ ID NO: 129432 - DNA, 16 bp, H. sapiens
tatatacatgcatgca

SEQ ID NO: 129433 - DNA, 16 bp, H. sapiens
tatatacatgtaatat

SEQ ID NO: 129434 - DNA, 19 bp, H. sapiens
tatataccaataacagaca

SEQ ID NO: 129435 - DNA, 16 bp, H. sapiens
tatataccacattttt

SEQ ID NO: 129436 - DNA, 16 bp, H. sapiens
tatataccatatataa

SEQ ID NO: 129437 - DNA, 16 bp, H. sapiens
tatataccatgtaata

SEQ ID NO: 129438 - DNA, 16 bp, H. sapiens
tatatacccaaaggaa

SEQ ID NO: 129439 - DNA, 16 bp, H. sapiens
tatatacctatttata

SEQ ID NO: 129440 - DNA, 16 bp, H. sapiens
tatatacgtatatata

SEQ ID NO: 129441 - DNA, 16 bp, H. sapiens
tatatactaatatgta

SEQ ID NO: 129442 - DNA, 16 bp, H. sapiens
tatatactgtaaatat

SEQ ID NO: 129443 - DNA, 16 bp, H. sapiens
tatatactgtataatt

SEQ ID NO: 129444 - DNA, 16 bp, H. sapiens
tatatactgtgttttt

SEQ ID NO: 129445 - DNA, 16 bp, H. sapiens
tatatacttgtatata

SEQ ID NO: 129446 - DNA, 16 bp, H. sapiens
tatatactttacatat

SEQ ID NO: 129447 - DNA, 16 bp, H. sapiens
tatatagaacattcca

SEQ ID NO: 129448 - DNA, 16 bp, H. sapiens
tatatagacacacaca

SEQ ID NO: 129449 - DNA, 16 bp, H. sapiens
tatatagagagagaat

SEQ ID NO: 129450 - DNA, 16 bp, H. sapiens
tatatagagagagagc

SEQ ID NO: 129451 - DNA, 16 bp, H. sapiens
tatatagagagagtta

SEQ ID NO: 129452 - DNA, 16 bp, H. sapiens
tatatagagagataga

SEQ ID NO: 129453 - DNA, 16 bp, H. sapiens
tatatagatatataga

SEQ ID NO: 129454 - DNA, 16 bp, H. sapiens
tatatagatatatgta

SEQ ID NO: 129455 - DNA, 16 bp, H. sapiens
tatatagctttatttt

SEQ ID NO: 129456 - DNA, 16 bp, H. sapiens
tatataggaaagtgat

SEQ ID NO: 129457 - DNA, 16 bp, H. sapiens
tatataggtaaatata

SEQ ID NO: 129458 - DNA, 16 bp, H. sapiens
tatatagtaactatat

SEQ ID NO: 129459 - DNA, 16 bp, H. sapiens
tatatagtatatatac

SEQ ID NO: 129460 - DNA, 16 bp, H. sapiens
tatatagtatatgtat

SEQ ID NO: 129461 - DNA, 16 bp, H. sapiens
tatatagtcaactgat

SEQ ID NO: 129462 - DNA, 16 bp, H. sapiens
tatatagtgtatgtgt

SEQ ID NO: 129463 - DNA, 16 bp, H. sapiens
tatatagtgtgtgtgt

SEQ ID NO: 129464 - DNA, 16 bp, H. sapiens
tatatataaaactgtg

SEQ ID NO: 129465 - DNA, 16 bp, H. sapiens
tatatataaaatctgt

SEQ ID NO: 129466 - DNA, 16 bp, H. sapiens
tatatataaatatgtg

SEQ ID NO: 129467 - DNA, 16 bp, H. sapiens
tatatataacacatat

SEQ ID NO: 129468 - DNA, 16 bp, H. sapiens
tatatataacatgcat

SEQ ID NO: 129469 - DNA, 16 bp, H. sapiens
tatatataatatgtgt

SEQ ID NO: 129470 - DNA, 16 bp, H. sapiens
tatatataatgcattt

SEQ ID NO: 129471 - DNA, 16 bp, H. sapiens
tatatataatgtgtgt

SEQ ID NO: 129472 - DNA, 16 bp, H. sapiens
tatatatacaaaatgg

SEQ ID NO: 129473 - DNA, 16 bp, H. sapiens
tatatatacaatcatg

SEQ ID NO: 129474 - DNA, 16 bp, H. sapiens
tatatatacacaccat

SEQ ID NO: 129475 - DNA, 16 bp, H. sapiens
tatatatacacatgta

SEQ ID NO: 129476 - DNA, 16 bp, H. sapiens
tatatatacataaaga

SEQ ID NO: 129477 - DNA, 16 bp, H. sapiens
tatatatacatataca

SEQ ID NO: 129478 - DNA, 16 bp, H. sapiens
tatatatacatgtata

SEQ ID NO: 129479 - DNA, 16 bp, H. sapiens
tatatatacatttgtg

SEQ ID NO: 129480 - DNA, 16 bp, H. sapiens
tatatataccatttat

SEQ ID NO: 129481 - DNA, 16 bp, H. sapiens
tatatatacgcatata

SEQ ID NO: 129482 - DNA, 16 bp, H. sapiens
tatatatagagataga

SEQ ID NO: 129483 - DNA, 16 bp, H. sapiens
tatatatagatatatg

SEQ ID NO: 129484 - DNA, 16 bp, H. sapiens
tatatatagatctata

SEQ ID NO: 129485 - DNA, 16 bp, H. sapiens
tatatataggtatata

SEQ ID NO: 129486 - DNA, 16 bp, H. sapiens
tatatatagtatgtgt

SEQ ID NO: 129487 - DNA, 16 bp, H. sapiens
tatatatataaagcac

SEQ ID NO: 129488 - DNA, 16 bp, H. sapiens
tatatatataattcct

SEQ ID NO: 129489 - DNA, 21 bp, H. sapiens
tatatatatacacacacacat

SEQ ID NO: 129490 - DNA, 16 bp, H. sapiens
tatatatatacacacc

SEQ ID NO: 129491 - DNA, 18 bp, H. sapiens
tatatatatacacatatg

SEQ ID NO: 129492 - DNA, 16 bp, H. sapiens
tatatatatacatgta

SEQ ID NO: 129493 - DNA, 16 bp, H. sapiens
tatatatatacgtata

SEQ ID NO: 129494 - DNA, 16 bp, H. sapiens
tatatatatagagaga

SEQ ID NO: 129495 - DNA, 16 bp, H. sapiens
tatatatatagccata

SEQ ID NO: 129496 - DNA, 16 bp, H. sapiens
tatatatatagtcaaa

SEQ ID NO: 129497 - DNA, 16 bp, H. sapiens
tatatatatagttatg

SEQ ID NO: 129498 - DNA, 16 bp, H. sapiens
tatatatatataaacc

SEQ ID NO: 129499 - DNA, 16 bp, H. sapiens
tatatatatatacagt

SEQ ID NO: 129500 - DNA, 16 bp, H. sapiens
tatatatatatagcta

SEQ ID NO: 129501 - DNA, 16 bp, H. sapiens
tatatatatatagtga

SEQ ID NO: 129502 - DNA, 16 bp, H. sapiens
tatatatatatagtgt

SEQ ID NO: 129503 - DNA, 16 bp, H. sapiens
tatatatatatatagc

SEQ ID NO: 129504 - DNA, 16 bp, H. sapiens
tatatatatatatgcc

SEQ ID NO: 129505 - DNA, 16 bp, H. sapiens
tatatatatatatggc

SEQ ID NO: 129506 - DNA, 16 bp, H. sapiens
tatatatatatgagtt

SEQ ID NO: 129507 - DNA, 16 bp, H. sapiens
tatatatatatgatag

SEQ ID NO: 129508 - DNA, 16 bp, H. sapiens
tatatatatatgcatg

SEQ ID NO: 129509 - DNA, 16 bp, H. sapiens
tatatatatatgctaa

SEQ ID NO: 129510 - DNA, 16 bp, H. sapiens
tatatatatatggaca

SEQ ID NO: 129511 - DNA, 16 bp, H. sapiens
tatatatatatgtatc

SEQ ID NO: 129512 - DNA, 23 bp, H. sapiens
tatatatatatgtgtgtgtgtat

SEQ ID NO: 129513 - DNA, 16 bp, H. sapiens
tatatatatctcacat

SEQ ID NO: 129514 - DNA, 16 bp, H. sapiens
tatatatatgtacaca

SEQ ID NO: 129515 - DNA, 16 bp, H. sapiens
tatatatatgtagata

SEQ ID NO: 129516 - DNA, 16 bp, H. sapiens
tatatatatgtatatc

SEQ ID NO: 129517 - DNA, 16 bp, H. sapiens
tatatatatgtcaaaa

SEQ ID NO: 129518 - DNA, 17 bp, H. sapiens
tatatatatgtgtgtat

SEQ ID NO: 129519 - DNA, 16 bp, H. sapiens
tatatatatgttcata

SEQ ID NO: 129520 - DNA, 16 bp, H. sapiens
tatatatatgtttttc

SEQ ID NO: 129521 - DNA, 16 bp, H. sapiens
tatatatattctctct

SEQ ID NO: 129522 - DNA, 16 bp, H. sapiens
tatatatatttgcata

SEQ ID NO: 129523 - DNA, 16 bp, H. sapiens
tatatatatttgtgtg

SEQ ID NO: 129524 - DNA, 16 bp, H. sapiens
tatatatattttacac

SEQ ID NO: 129525 - DNA, 16 bp, H. sapiens
tatatatattttgcta

SEQ ID NO: 129526 - DNA, 16 bp, H. sapiens
tatatatctaaacata

SEQ ID NO: 129527 - DNA, 16 bp, H. sapiens
tatatatctcttttgg

SEQ ID NO: 129528 - DNA, 16 bp, H. sapiens
tatatatctgtatttt

SEQ ID NO: 129529 - DNA, 16 bp, H. sapiens
tatatatgaacatata

SEQ ID NO: 129530 - DNA, 16 bp, H. sapiens
tatatatgaatgcata

SEQ ID NO: 129531 - DNA, 16 bp, H. sapiens
tatatatgcacacaca

SEQ ID NO: 129532 - DNA, 16 bp, H. sapiens
tatatatgcaccccat

SEQ ID NO: 129533 - DNA, 16 bp, H. sapiens
tatatatgcatatatt

SEQ ID NO: 129534 - DNA, 16 bp, H. sapiens
tatatatgccaggcac

SEQ ID NO: 129535 - DNA, 16 bp, H. sapiens
tatatatgggaaaata

SEQ ID NO: 129536 - DNA, 16 bp, H. sapiens
tatatatggtcatata

SEQ ID NO: 129537 - DNA, 16 bp, H. sapiens
tatatatggtgtatat

SEQ ID NO: 129538 - DNA, 16 bp, H. sapiens
tatatatgtaaataca

SEQ ID NO: 129539 - DNA, 16 bp, H. sapiens
tatatatgtacatata

SEQ ID NO: 129540 - DNA, 16 bp, H. sapiens
tatatatgtactacat

SEQ ID NO: 129541 - DNA, 16 bp, H. sapiens
tatatatgtacttata

SEQ ID NO: 129542 - DNA, 16 bp, H. sapiens
tatatatgtagcatat

SEQ ID NO: 129543 - DNA, 16 bp, H. sapiens
tatatatgtatacaca

SEQ ID NO: 129544 - DNA, 16 bp, H. sapiens
tatatatgtatacata

SEQ ID NO: 129545 - DNA, 16 bp, H. sapiens
tatatatgtatactta

SEQ ID NO: 129546 - DNA, 16 bp, H. sapiens
tatatatgtatagtat

SEQ ID NO: 129547 - DNA, 16 bp, H. sapiens
tatatatgtatatgtg

SEQ ID NO: 129548 - DNA, 16 bp, H. sapiens
tatatatgtatgtaaa

SEQ ID NO: 129549 - DNA, 16 bp, H. sapiens
tatatatgtatgtata

SEQ ID NO: 129550 - DNA, 16 bp, H. sapiens
tatatatgtatttact

SEQ ID NO: 129551 - DNA, 16 bp, H. sapiens
tatatatgtatttctg

SEQ ID NO: 129552 - DNA, 16 bp, H. sapiens
tatatatgtatttgaa

SEQ ID NO: 129553 - DNA, 16 bp, H. sapiens
tatatatgtgcacaca

SEQ ID NO: 129554 - DNA, 16 bp, H. sapiens
tatatatgtgcatgca

SEQ ID NO: 129555 - DNA, 16 bp, H. sapiens
tatatatgtgtgaata

SEQ ID NO: 129556 - DNA, 16 bp, H. sapiens
tatatatgttatgtgt

SEQ ID NO: 129557 - DNA, 16 bp, H. sapiens
tatatatgtttatttc

SEQ ID NO: 129558 - DNA, 16 bp, H. sapiens
tatatatgtttctata

SEQ ID NO: 129559 - DNA, 16 bp, H. sapiens
tatatattacatacat

SEQ ID NO: 129560 - DNA, 16 bp, H. sapiens
tatatattcatatgtg

SEQ ID NO: 129561 - DNA, 16 bp, H. sapiens
tatatattccatatat

SEQ ID NO: 129562 - DNA, 16 bp, H. sapiens
tatatattcttttgta

SEQ ID NO: 129563 - DNA, 16 bp, H. sapiens
tatatattgatatgta

SEQ ID NO: 129564 - DNA, 16 bp, H. sapiens
tatatattgcacatat

SEQ ID NO: 129565 - DNA, 16 bp, H. sapiens
tatatattgctgaatt

SEQ ID NO: 129566 - DNA, 16 bp, H. sapiens
tatatattgtatgtgt

SEQ ID NO: 129567 - DNA, 16 bp, H. sapiens
tatatattgtgaaatg

SEQ ID NO: 129568 - DNA, 16 bp, H. sapiens
tatatatttgaatgaa

SEQ ID NO: 129569 - DNA, 16 bp, H. sapiens
tatatatttgcatata

SEQ ID NO: 129570 - DNA, 16 bp, H. sapiens
tatatatttgcatttg

SEQ ID NO: 129571 - DNA, 16 bp, H. sapiens
tatatatttgtgtatg

SEQ ID NO: 129572 - DNA, 16 bp, H. sapiens
tatatatttgttcaat

SEQ ID NO: 129573 - DNA, 16 bp, H. sapiens
tatatattttaagatg

SEQ ID NO: 129574 - DNA, 16 bp, H. sapiens
tatatattttatacac

SEQ ID NO: 129575 - DNA, 16 bp, H. sapiens
tatatatttttaaagc

SEQ ID NO: 129576 - DNA, 16 bp, H. sapiens
tatatatttttctgtg

SEQ ID NO: 129577 - DNA, 16 bp, H. sapiens
tatatattttttcagt

SEQ ID NO: 129578 - DNA, 16 bp, H. sapiens
tatatattttttccag

SEQ ID NO: 129579 - DNA, 16 bp, H. sapiens
tatatcaagtactctt

SEQ ID NO: 129580 - DNA, 16 bp, H. sapiens
tatatcaataagaaaa

SEQ ID NO: 129581 - DNA, 16 bp, H. sapiens
tatatcacaaatattt

SEQ ID NO: 129582 - DNA, 16 bp, H. sapiens
tatatcacattttctt

SEQ ID NO: 129583 - DNA, 16 bp, H. sapiens
tatatcagaaaaaaat

SEQ ID NO: 129584 - DNA, 16 bp, H. sapiens
tatatcagaacttcat

SEQ ID NO: 129585 - DNA, 16 bp, H. sapiens
tatatcagagacttga

SEQ ID NO: 129586 - DNA, 16 bp, H. sapiens
tatatcagataaattt

SEQ ID NO: 129587 - DNA, 16 bp, H. sapiens
tatatcattttaacaa

SEQ ID NO: 129588 - DNA, 16 bp, H. sapiens
tatatcattttgtatt

SEQ ID NO: 129589 - DNA, 16 bp, H. sapiens
tatatccagagaaaat

SEQ ID NO: 129590 - DNA, 16 bp, H. sapiens
tatatccatataacaa

SEQ ID NO: 129591 - DNA, 16 bp, H. sapiens
tatatccatatctata

SEQ ID NO: 129592 - DNA, 18 bp, H. sapiens
tatatcccacacctggct

SEQ ID NO: 129593 - DNA, 16 bp, H. sapiens
tatatctaatttgtat

SEQ ID NO: 129594 - DNA, 16 bp, H. sapiens
tatatctacacataca

SEQ ID NO: 129595 - DNA, 16 bp, H. sapiens
tatatctatatataca

SEQ ID NO: 129596 - DNA, 16 bp, H. sapiens
tatatctatgtatata

SEQ ID NO: 129597 - DNA, 16 bp, H. sapiens
tatatctattatgtat

SEQ ID NO: 129598 - DNA, 16 bp, H. sapiens
tatatctatttttatg

SEQ ID NO: 129599 - DNA, 16 bp, H. sapiens
tatatctccatttatt

SEQ ID NO: 129600 - DNA, 16 bp, H. sapiens
tatatctctatatata

SEQ ID NO: 129601 - DNA, 16 bp, H. sapiens
tatatctctcttttgg

SEQ ID NO: 129602 - DNA, 16 bp, H. sapiens
tatatctgtatatata

SEQ ID NO: 129603 - DNA, 16 bp, H. sapiens
tatatctgtatatatg

SEQ ID NO: 129604 - DNA, 16 bp, H. sapiens
tatatctgtgtatata

SEQ ID NO: 129605 - DNA, 16 bp, H. sapiens
tatatcttatacatat

SEQ ID NO: 129606 - DNA, 16 bp, H. sapiens
tatatgaaaaggcaaa

SEQ ID NO: 129607 - DNA, 16 bp, H. sapiens
tatatgaaaatgcaaa

SEQ ID NO: 129608 - DNA, 16 bp, H. sapiens
tatatgaaacataagt

SEQ ID NO: 129609 - DNA, 16 bp, H. sapiens
tatatgaaatatgtat

SEQ ID NO: 129610 - DNA, 16 bp, H. sapiens
tatatgaaatattttg

SEQ ID NO: 129611 - DNA, 16 bp, H. sapiens
tatatgaagaaaatga

SEQ ID NO: 129612 - DNA, 16 bp, H. sapiens
tatatgaagaactcct

SEQ ID NO: 129613 - DNA, 16 bp, H. sapiens
tatatgaagaactctt

SEQ ID NO: 129614 - DNA, 16 bp, H. sapiens
tatatgaagagagaga

SEQ ID NO: 129615 - DNA, 16 bp, H. sapiens
tatatgaatatataca

SEQ ID NO: 129616 - DNA, 16 bp, H. sapiens
tatatgaatatatagt

SEQ ID NO: 129617 - DNA, 16 bp, H. sapiens
tatatgaatatatgtg

SEQ ID NO: 129618 - DNA, 16 bp, H. sapiens
tatatgacatataaaa

SEQ ID NO: 129619 - DNA, 16 bp, H. sapiens
tatatgacatcgctaa

SEQ ID NO: 129620 - DNA, 16 bp, H. sapiens
tatatgacctttcaga

SEQ ID NO: 129621 - DNA, 16 bp, H. sapiens
tatatgactttttaaa

SEQ ID NO: 129622 - DNA, 16 bp, H. sapiens
tatatgagaaaatatt

SEQ ID NO: 129623 - DNA, 16 bp, H. sapiens
tatatgagataatata

SEQ ID NO: 129624 - DNA, 16 bp, H. sapiens
tatatgatattctaga

SEQ ID NO: 129625 - DNA, 16 bp, H. sapiens
tatatgcaaataaaat

SEQ ID NO: 129626 - DNA, 16 bp, H. sapiens
tatatgcaaatataaa

SEQ ID NO: 129627 - DNA, 16 bp, H. sapiens
tatatgcaacatatat

SEQ ID NO: 129628 - DNA, 16 bp, H. sapiens
tatatgcaagtgtata

SEQ ID NO: 129629 - DNA, 16 bp, H. sapiens
tatatgcaatgtccag

SEQ ID NO: 129630 - DNA, 16 bp, H. sapiens
tatatgcacatacata

SEQ ID NO: 129631 - DNA, 16 bp, H. sapiens
tatatgcacatataca

SEQ ID NO: 129632 - DNA, 16 bp, H. sapiens
tatatgcactgggaaa

SEQ ID NO: 129633 - DNA, 16 bp, H. sapiens
tatatgcatatatttt

SEQ ID NO: 129634 - DNA, 17 bp, H. sapiens
tatatgcatgtgtgtgt

SEQ ID NO: 129635 - DNA, 16 bp, H. sapiens
tatatgcatttatgta

SEQ ID NO: 129636 - DNA, 16 bp, H. sapiens
tatatgcattttctca

SEQ ID NO: 129637 - DNA, 16 bp, H. sapiens
tatatgcatttttaat

SEQ ID NO: 129638 - DNA, 16 bp, H. sapiens
tatatgccaggcattg

SEQ ID NO: 129639 - DNA, 16 bp, H. sapiens
tatatgcccaaagaaa

SEQ ID NO: 129640 - DNA, 16 bp, H. sapiens
tatatgctaccaataa

SEQ ID NO: 129641 - DNA, 16 bp, H. sapiens
tatatgctatctataa

SEQ ID NO: 129642 - DNA, 16 bp, H. sapiens
tatatgcttatatatt

SEQ ID NO: 129643 - DNA, 16 bp, H. sapiens
tatatggaaatgcaaa

SEQ ID NO: 129644 - DNA, 16 bp, H. sapiens
tatatggaaccaaaaa

SEQ ID NO: 129645 - DNA, 16 bp, H. sapiens
tatatggagagagaga

SEQ ID NO: 129646 - DNA, 16 bp, H. sapiens
tatatggcttttatta

SEQ ID NO: 129647 - DNA, 16 bp, H. sapiens
tatatggtatatatga

SEQ ID NO: 129648 - DNA, 16 bp, H. sapiens
tatatgtaaaatggag

SEQ ID NO: 129649 - DNA, 16 bp, H. sapiens
tatatgtaaatataca

SEQ ID NO: 129650 - DNA, 16 bp, H. sapiens
tatatgtaatgtatat

SEQ ID NO: 129651 - DNA, 16 bp, H. sapiens
tatatgtaattgtaat

SEQ ID NO: 129652 - DNA, 16 bp, H. sapiens
tatatgtaattgtata

SEQ ID NO: 129653 - DNA, 16 bp, H. sapiens
tatatgtacatattca

SEQ ID NO: 129654 - DNA, 16 bp, H. sapiens
tatatgtacattatat

SEQ ID NO: 129655 - DNA, 16 bp, H. sapiens
tatatgtaccacattt

SEQ ID NO: 129656 - DNA, 16 bp, H. sapiens
tatatgtactatattt

SEQ ID NO: 129657 - DNA, 16 bp, H. sapiens
tatatgtagatatata

SEQ ID NO: 129658 - DNA, 16 bp, H. sapiens
tatatgtagcatatat

SEQ ID NO: 129659 - DNA, 19 bp, H. sapiens
tatatgtatacatatatat

SEQ ID NO: 129660 - DNA, 16 bp, H. sapiens
tatatgtatataaaca

SEQ ID NO: 129661 - DNA, 16 bp, H. sapiens
tatatgtatataactt

SEQ ID NO: 129662 - DNA, 16 bp, H. sapiens
tatatgtatatataca

SEQ ID NO: 129663 - DNA, 16 bp, H. sapiens
tatatgtatatatcac

SEQ ID NO: 129664 - DNA, 16 bp, H. sapiens
tatatgtatatatgca

SEQ ID NO: 129665 - DNA, 16 bp, H. sapiens
tatatgtatatattag

SEQ ID NO: 129666 - DNA, 16 bp, H. sapiens
tatatgtatatcacat

SEQ ID NO: 129667 - DNA, 16 bp, H. sapiens
tatatgtatatgtata

SEQ ID NO: 129668 - DNA, 16 bp, H. sapiens
tatatgtatgtaaaat

SEQ ID NO: 129669 - DNA, 16 bp, H. sapiens
tatatgtatgtataat

SEQ ID NO: 129670 - DNA, 16 bp, H. sapiens
tatatgtatgtgtata

SEQ ID NO: 129671 - DNA, 16 bp, H. sapiens
tatatgtatgtgtgtt

SEQ ID NO: 129672 - DNA, 16 bp, H. sapiens
tatatgtatgtttgta

SEQ ID NO: 129673 - DNA, 16 bp, H. sapiens
tatatgtattacattt

SEQ ID NO: 129674 - DNA, 16 bp, H. sapiens
tatatgtattttacca

SEQ ID NO: 129675 - DNA, 16 bp, H. sapiens
tatatgtcaattttta

SEQ ID NO: 129676 - DNA, 16 bp, H. sapiens
tatatgtcatttatat

SEQ ID NO: 129677 - DNA, 16 bp, H. sapiens
tatatgtcattttatt

SEQ ID NO: 129678 - DNA, 16 bp, H. sapiens
tatatgtgaaaatgct

SEQ ID NO: 129679 - DNA, 16 bp, H. sapiens
tatatgtgaatatata

SEQ ID NO: 129680 - DNA, 16 bp, H. sapiens
tatatgtgatatgtat

SEQ ID NO: 129681 - DNA, 16 bp, H. sapiens
tatatgtgcagaatgt

SEQ ID NO: 129682 - DNA, 16 bp, H. sapiens
tatatgtgcatatgtt

SEQ ID NO: 129683 - DNA, 16 bp, H. sapiens
tatatgtgccaccttt

SEQ ID NO: 129684 - DNA, 16 bp, H. sapiens
tatatgtgccactttt

SEQ ID NO: 129685 - DNA, 16 bp, H. sapiens
tatatgtgtacatata

SEQ ID NO: 129686 - DNA, 16 bp, H. sapiens
tatatgtgtataatgt

SEQ ID NO: 129687 - DNA, 16 bp, H. sapiens
tatatgtgtatacata

SEQ ID NO: 129688 - DNA, 16 bp, H. sapiens
tatatgtgtatataca

SEQ ID NO: 129689 - DNA, 16 bp, H. sapiens
tatatgtgtctgtgtg

SEQ ID NO: 129690 - DNA, 16 bp, H. sapiens
tatatgtgtgtacata

SEQ ID NO: 129691 - DNA, 16 bp, H. sapiens
tatatgtgtgtgggtg

SEQ ID NO: 129692 - DNA, 16 bp, H. sapiens
tatatgtgtgtgtatt

SEQ ID NO: 129693 - DNA, 16 bp, H. sapiens
tatatgttacaaatat

SEQ ID NO: 129694 - DNA, 16 bp, H. sapiens
tatatgttacaatgta

SEQ ID NO: 129695 - DNA, 16 bp, H. sapiens
tatatgttatatatac

SEQ ID NO: 129696 - DNA, 16 bp, H. sapiens
tatatgtttacatatt

SEQ ID NO: 129697 - DNA, 16 bp, H. sapiens
tatatgtttacatgtt

SEQ ID NO: 129698 - DNA, 16 bp, H. sapiens
tatatgtttctgtgtg

SEQ ID NO: 129699 - DNA, 16 bp, H. sapiens
tatattaaaaaatgct

SEQ ID NO: 129700 - DNA, 16 bp, H. sapiens
tatattaaatgtacat

SEQ ID NO: 129701 - DNA, 16 bp, H. sapiens
tatattaagttaaaca

SEQ ID NO: 129702 - DNA, 16 bp, H. sapiens
tatattaatggaatca

SEQ ID NO: 129703 - DNA, 16 bp, H. sapiens
tatattacaaagccat

SEQ ID NO: 129704 - DNA, 16 bp, H. sapiens
tatattacacatataa

SEQ ID NO: 129705 - DNA, 16 bp, H. sapiens
tatattatatatgcaa

SEQ ID NO: 129706 - DNA, 16 bp, H. sapiens
tatattatatatgcat

SEQ ID NO: 129707 - DNA, 16 bp, H. sapiens
tatattatttcatgta

SEQ ID NO: 129708 - DNA, 16 bp, H. sapiens
tatattcaaaagaaaa

SEQ ID NO: 129709 - DNA, 16 bp, H. sapiens
tatattcaagagaaat

SEQ ID NO: 129710 - DNA, 16 bp, H. sapiens
tatattcacagaattg

SEQ ID NO: 129711 - DNA, 16 bp, H. sapiens
tatattcacataaaat

SEQ ID NO: 129712 - DNA, 16 bp, H. sapiens
tatattcacatataaa

SEQ ID NO: 129713 - DNA, 16 bp, H. sapiens
tatattcagaagaaaa

SEQ ID NO: 129714 - DNA, 16 bp, H. sapiens
tatattcagatatata

SEQ ID NO: 129715 - DNA, 16 bp, H. sapiens
tatattcagtatatat

SEQ ID NO: 129716 - DNA, 16 bp, H. sapiens
tatattcagttaaaat

SEQ ID NO: 129717 - DNA, 16 bp, H. sapiens
tatattcatacatatt

SEQ ID NO: 129718 - DNA, 16 bp, H. sapiens
tatattcatatataca

SEQ ID NO: 129719 - DNA, 16 bp, H. sapiens
tatattcatatgtatt

SEQ ID NO: 129720 - DNA, 16 bp, H. sapiens
tatattcattaaaagt

SEQ ID NO: 129721 - DNA, 16 bp, H. sapiens
tatattcattaattca

SEQ ID NO: 129722 - DNA, 16 bp, H. sapiens
tatattccatctactg

SEQ ID NO: 129723 - DNA, 16 bp, H. sapiens
tatattcctgcagtag

SEQ ID NO: 129724 - DNA, 16 bp, H. sapiens
tatattccttaaaata

SEQ ID NO: 129725 - DNA, 16 bp, H. sapiens
tatattctagataaaa

SEQ ID NO: 129726 - DNA, 16 bp, H. sapiens
tatattctcatcagca

SEQ ID NO: 129727 - DNA, 16 bp, H. sapiens
tatattctgaatacaa

SEQ ID NO: 129728 - DNA, 16 bp, H. sapiens
tatattctgagacttt

SEQ ID NO: 129729 - DNA, 16 bp, H. sapiens
tatattctgcttatta

SEQ ID NO: 129730 - DNA, 16 bp, H. sapiens
tatattctggatacta

SEQ ID NO: 129731 - DNA, 16 bp, H. sapiens
tatattctgtttatta

SEQ ID NO: 129732 - DNA, 16 bp, H. sapiens
tatattcttactgatt

SEQ ID NO: 129733 - DNA, 16 bp, H. sapiens
tatattcttcaaaaat

SEQ ID NO: 129734 - DNA, 16 bp, H. sapiens
tatattcttctgcagt

SEQ ID NO: 129735 - DNA, 16 bp, H. sapiens
tatattgaaatatagt

SEQ ID NO: 129736 - DNA, 16 bp, H. sapiens
tatattgaatagaaat

SEQ ID NO: 129737 - DNA, 16 bp, H. sapiens
tatattgcttgatgct

SEQ ID NO: 129738 - DNA, 16 bp, H. sapiens
tatattgtgtaatgat

SEQ ID NO: 129739 - DNA, 16 bp, H. sapiens
tatattgtgtatatgt

SEQ ID NO: 129740 - DNA, 16 bp, H. sapiens
tatattgtgtatgtgt

SEQ ID NO: 129741 - DNA, 16 bp, H. sapiens
tatattgttgaatttg

SEQ ID NO: 129742 - DNA, 16 bp, H. sapiens
tatatttaaagtgctg

SEQ ID NO: 129743 - DNA, 16 bp, H. sapiens
tatatttaagttcctt

SEQ ID NO: 129744 - DNA, 16 bp, H. sapiens
tatatttacatatgta

SEQ ID NO: 129745 - DNA, 16 bp, H. sapiens
tatatttataacacat

SEQ ID NO: 129746 - DNA, 16 bp, H. sapiens
tatatttatatgcaaa

SEQ ID NO: 129747 - DNA, 16 bp, H. sapiens
tatatttatggggcac

SEQ ID NO: 129748 - DNA, 16 bp, H. sapiens
tatatttattcctaaa

SEQ ID NO: 129749 - DNA, 16 bp, H. sapiens
tatatttcaaagtaaa

SEQ ID NO: 129750 - DNA, 16 bp, H. sapiens
tatatttcaaatgaat

SEQ ID NO: 129751 - DNA, 16 bp, H. sapiens
tatatttcagaatagc

SEQ ID NO: 129752 - DNA, 16 bp, H. sapiens
tatatttcagttaaaa

SEQ ID NO: 129753 - DNA, 16 bp, H. sapiens
tatatttcagttttct

SEQ ID NO: 129754 - DNA, 16 bp, H. sapiens
tatatttcatttcaaa

SEQ ID NO: 129755 - DNA, 16 bp, H. sapiens
tatatttcctatataa

SEQ ID NO: 129756 - DNA, 16 bp, H. sapiens
tatatttccttaaaat

SEQ ID NO: 129757 - DNA, 16 bp, H. sapiens
tatatttctatgcatt

SEQ ID NO: 129758 - DNA, 16 bp, H. sapiens
tatatttcttaatgtt

SEQ ID NO: 129759 - DNA, 16 bp, H. sapiens
tatatttcttattatg

SEQ ID NO: 129760 - DNA, 16 bp, H. sapiens
tatatttctttgatat

SEQ ID NO: 129761 - DNA, 16 bp, H. sapiens
tatatttgaaaaacaa

SEQ ID NO: 129762 - DNA, 16 bp, H. sapiens
tatatttgaagaaaat

SEQ ID NO: 129763 - DNA, 16 bp, H. sapiens
tatatttgcatatttt

SEQ ID NO: 129764 - DNA, 16 bp, H. sapiens
tatatttgcttttaaa

SEQ ID NO: 129765 - DNA, 16 bp, H. sapiens
tatatttgtatacaaa

SEQ ID NO: 129766 - DNA, 16 bp, H. sapiens
tatatttgtatatact

SEQ ID NO: 129767 - DNA, 16 bp, H. sapiens
tatatttgtgaatata

SEQ ID NO: 129768 - DNA, 16 bp, H. sapiens
tatatttgtgtatgta

SEQ ID NO: 129769 - DNA, 16 bp, H. sapiens
tatatttgttgaaata

SEQ ID NO: 129770 - DNA, 16 bp, H. sapiens
tatattttaaaactct

SEQ ID NO: 129771 - DNA, 16 bp, H. sapiens
tatattttaaacagaa

SEQ ID NO: 129772 - DNA, 16 bp, H. sapiens
tatattttaaagctat

SEQ ID NO: 129773 - DNA, 16 bp, H. sapiens
tatattttaaagtcag

SEQ ID NO: 129774 - DNA, 16 bp, H. sapiens
tatattttaatgtaca

SEQ ID NO: 129775 - DNA, 16 bp, H. sapiens
tatattttaccaaatt

SEQ ID NO: 129776 - DNA, 16 bp, H. sapiens
tatattttaccacaat

SEQ ID NO: 129777 - DNA, 16 bp, H. sapiens
tatattttagaaatgt

SEQ ID NO: 129778 - DNA, 16 bp, H. sapiens
tatattttagtagaga

SEQ ID NO: 129779 - DNA, 16 bp, H. sapiens
tatattttagtcattt

SEQ ID NO: 129780 - DNA, 16 bp, H. sapiens
tatattttatttctga

SEQ ID NO: 129781 - DNA, 16 bp, H. sapiens
tatattttcaggaatt

SEQ ID NO: 129782 - DNA, 16 bp, H. sapiens
tatattttcatatgaa

SEQ ID NO: 129783 - DNA, 16 bp, H. sapiens
tatattttcatatgct

SEQ ID NO: 129784 - DNA, 16 bp, H. sapiens
tatattttcctttgaa

SEQ ID NO: 129785 - DNA, 16 bp, H. sapiens
tatattttctaatgtt

SEQ ID NO: 129786 - DNA, 16 bp, H. sapiens
tatattttctgaatat

SEQ ID NO: 129787 - DNA, 16 bp, H. sapiens
tatattttctgaattt

SEQ ID NO: 129788 - DNA, 16 bp, H. sapiens
tatattttctttgaaa

SEQ ID NO: 129789 - DNA, 16 bp, H. sapiens
tatattttgcatattt

SEQ ID NO: 129790 - DNA, 16 bp, H. sapiens
tatattttgccaaatt

SEQ ID NO: 129791 - DNA, 16 bp, H. sapiens
tatattttggggaaaa

SEQ ID NO: 129792 - DNA, 16 bp, H. sapiens
tatattttggggctct

SEQ ID NO: 129793 - DNA, 16 bp, H. sapiens
tatattttgggggtat

SEQ ID NO: 129794 - DNA, 16 bp, H. sapiens
tatatttttaaaactc

SEQ ID NO: 129795 - DNA, 16 bp, H. sapiens
tatatttttaaaagca

SEQ ID NO: 129796 - DNA, 16 bp, H. sapiens
tatatttttaaagtac

SEQ ID NO: 129797 - DNA, 16 bp, H. sapiens
tatatttttagaagag

SEQ ID NO: 129798 - DNA, 16 bp, H. sapiens
tatatttttatgtcat

SEQ ID NO: 129799 - DNA, 16 bp, H. sapiens
tatatttttgaaacag

SEQ ID NO: 129800 - DNA, 16 bp, H. sapiens
tatattttttaaagca

SEQ ID NO: 129801 - DNA, 16 bp, H. sapiens
tatattttttaaagct

SEQ ID NO: 129802 - DNA, 16 bp, H. sapiens
tatattttttaatgct

SEQ ID NO: 129803 - DNA, 16 bp, H. sapiens
tatatttttttctaag

SEQ ID NO: 129804 - DNA, 16 bp, H. sapiens
tatcaaaaatggaaaa

SEQ ID NO: 129805 - DNA, 16 bp, H. sapiens
tatcaaaacaccatgt

SEQ ID NO: 129806 - DNA, 16 bp, H. sapiens
tatcaaaacatttcat

SEQ ID NO: 129807 - DNA, 16 bp, H. sapiens
tatcaaaaccaagaaa

SEQ ID NO: 129808 - DNA, 16 bp, H. sapiens
tatcaaaaccagaaaa

SEQ ID NO: 129809 - DNA, 16 bp, H. sapiens
tatcaaaatatcccat

SEQ ID NO: 129810 - DNA, 16 bp, H. sapiens
tatcaaaatatctcat

SEQ ID NO: 129811 - DNA, 16 bp, H. sapiens
tatcaaaatcccagct

SEQ ID NO: 129812 - DNA, 16 bp, H. sapiens
tatcaaaatgtatttt

SEQ ID NO: 129813 - DNA, 16 bp, H. sapiens
tatcaaaatgtcaaaa

SEQ ID NO: 129814 - DNA, 16 bp, H. sapiens
tatcaaacatcaggaa

SEQ ID NO: 129815 - DNA, 16 bp, H. sapiens
tatcaaactaccaatg

SEQ ID NO: 129816 - DNA, 16 bp, H. sapiens
tatcaaaggacttttc

SEQ ID NO: 129817 - DNA, 16 bp, H. sapiens
tatcaaatgatttttt

SEQ ID NO: 129818 - DNA, 16 bp, H. sapiens
tatcaacagaatgagg

SEQ ID NO: 129819 - DNA, 16 bp, H. sapiens
tatcaacatcattttt

SEQ ID NO: 129820 - DNA, 16 bp, H. sapiens
tatcaacattaatagg

SEQ ID NO: 129821 - DNA, 16 bp, H. sapiens
tatcaagaaaatgaaa

SEQ ID NO: 129822 - DNA, 16 bp, H. sapiens
tatcaagaaatacctg

SEQ ID NO: 129823 - DNA, 16 bp, H. sapiens
tatcaagatgaaatca

SEQ ID NO: 129824 - DNA, 16 bp, H. sapiens
tatcaagatgcaaatg

SEQ ID NO: 129825 - DNA, 16 bp, H. sapiens
tatcaagcacctacta

SEQ ID NO: 129826 - DNA, 17 bp, H. sapiens
tatcaagcagaacagga

SEQ ID NO: 129827 - DNA, 16 bp, H. sapiens
tatcaagccacaaaaa

SEQ ID NO: 129828 - DNA, 16 bp, H. sapiens
tatcaagccagtagca

SEQ ID NO: 129829 - DNA, 16 bp, H. sapiens
tatcaagttgaagaag

SEQ ID NO: 129830 - DNA, 16 bp, H. sapiens
tatcaataaacagaca

SEQ ID NO: 129831 - DNA, 16 bp, H. sapiens
tatcaataattacatt

SEQ ID NO: 129832 - DNA, 28 bp, H. sapiens
tatcaatctcttcccacacaaggcaaat

SEQ ID NO: 129833 - DNA, 16 bp, H. sapiens
tatcaatgtcaatatc

SEQ ID NO: 129834 - DNA, 16 bp, H. sapiens
tatcaatgttaaattt

SEQ ID NO: 129835 - DNA, 16 bp, H. sapiens
tatcaatgttatttat

SEQ ID NO: 129836 - DNA, 16 bp, H. sapiens
tatcaatgttattttt

SEQ ID NO: 129837 - DNA, 16 bp, H. sapiens
tatcaattctgttgat

SEQ ID NO: 129838 - DNA, 16 bp, H. sapiens
tatcaattttgttaat

SEQ ID NO: 129839 - DNA, 16 bp, H. sapiens
tatcaatttttattgc

SEQ ID NO: 129840 - DNA, 16 bp, H. sapiens
tatcacaaggaaagaa

SEQ ID NO: 129841 - DNA, 16 bp, H. sapiens
tatcacaaggacataa

SEQ ID NO: 129842 - DNA, 16 bp, H. sapiens
tatcacaatttttaaa

SEQ ID NO: 129843 - DNA, 16 bp, H. sapiens
tatcacagaaataaaa

SEQ ID NO: 129844 - DNA, 16 bp, H. sapiens
tatcacagcattattc

SEQ ID NO: 129845 - DNA, 16 bp, H. sapiens
tatcacattggagatt

SEQ ID NO: 129846 - DNA, 16 bp, H. sapiens
tatcaccagagaaaaa

SEQ ID NO: 129847 - DNA, 16 bp, H. sapiens
tatcaccccaaaagga

SEQ ID NO: 129848 - DNA, 16 bp, H. sapiens
tatcacctccatttta

SEQ ID NO: 129849 - DNA, 16 bp, H. sapiens
tatcacctggaaactt

SEQ ID NO: 129850 - DNA, 16 bp, H. sapiens
tatcacgagaatagca

SEQ ID NO: 129851 - DNA, 17 bp, H. sapiens
tatcacgaggtcaggag

SEQ ID NO: 129852 - DNA, 16 bp, H. sapiens
tatcactgtcttccat

SEQ ID NO: 129853 - DNA, 16 bp, H. sapiens
tatcactttaaaaaat

SEQ ID NO: 129854 - DNA, 16 bp, H. sapiens
tatcagaaaaaaaatt

SEQ ID NO: 129855 - DNA, 16 bp, H. sapiens
tatcagaaactcaaaa

SEQ ID NO: 129856 - DNA, 16 bp, H. sapiens
tatcagaaatgaaaca

SEQ ID NO: 129857 - DNA, 16 bp, H. sapiens
tatcagaattttaaaa

SEQ ID NO: 129858 - DNA, 16 bp, H. sapiens
tatcagacaaaacaaa

SEQ ID NO: 129859 - DNA, 16 bp, H. sapiens
tatcagagagcccagt

SEQ ID NO: 129860 - DNA, 16 bp, H. sapiens
tatcagaggctgagaa

SEQ ID NO: 129861 - DNA, 16 bp, H. sapiens
tatcagagggtggaga

SEQ ID NO: 129862 - DNA, 16 bp, H. sapiens
tatcagataaatttta

SEQ ID NO: 129863 - DNA, 16 bp, H. sapiens
tatcagatatatgtat

SEQ ID NO: 129864 - DNA, 16 bp, H. sapiens
tatcagatatgtgttt

SEQ ID NO: 129865 - DNA, 16 bp, H. sapiens
tatcagatgtatgatt

SEQ ID NO: 129866 - DNA, 18 bp, H. sapiens
tatcagcaatggaagatg

SEQ ID NO: 129867 - DNA, 16 bp, H. sapiens
tatcagcagcagcagc

SEQ ID NO: 129868 - DNA, 16 bp, H. sapiens
tatcagcattttgggc

SEQ ID NO: 129869 - DNA, 16 bp, H. sapiens
tatcagcattttggtc

SEQ ID NO: 129870 - DNA, 16 bp, H. sapiens
tatcagcctcatttta

SEQ ID NO: 129871 - DNA, 16 bp, H. sapiens
tatcagctactcggga

SEQ ID NO: 129872 - DNA, 16 bp, H. sapiens
tatcagctcagccaca

SEQ ID NO: 129873 - DNA, 16 bp, H. sapiens
tatcagctgatgaatg

SEQ ID NO: 129874 - DNA, 17 bp, H. sapiens
tatcagcttaagaaact

SEQ ID NO: 129875 - DNA, 29 bp, H. sapiens
tatcagcttaaggagattttgggctgaga

SEQ ID NO: 129876 - DNA, 16 bp, H. sapiens
tatcaggaagatgctg

SEQ ID NO: 129877 - DNA, 16 bp, H. sapiens
tatcaggaggacagca

SEQ ID NO: 129878 - DNA, 16 bp, H. sapiens
tatcaggatgatgcag

SEQ ID NO: 129879 - DNA, 16 bp, H. sapiens
tatcaggcctgcccct

SEQ ID NO: 129880 - DNA, 16 bp, H. sapiens
tatcaggctgggtgtg

SEQ ID NO: 129881 - DNA, 16 bp, H. sapiens
tatcaggtactatgct

SEQ ID NO: 129882 - DNA, 16 bp, H. sapiens
tatcagtcataattat

SEQ ID NO: 129883 - DNA, 17 bp, H. sapiens
tatcagtgattgaagat

SEQ ID NO: 129884 - DNA, 16 bp, H. sapiens
tatcagtgccattttt

SEQ ID NO: 129885 - DNA, 16 bp, H. sapiens
tatcagtgcttcattt

SEQ ID NO: 129886 - DNA, 16 bp, H. sapiens
tatcagtgttaatttc

SEQ ID NO: 129887 - DNA, 16 bp, H. sapiens
tatcagttatacctca

SEQ ID NO: 129888 - DNA, 16 bp, H. sapiens
tatcagttttcctttt

SEQ ID NO: 129889 - DNA, 16 bp, H. sapiens
tatcagttttgcttca

SEQ ID NO: 129890 - DNA, 16 bp, H. sapiens
tatcagttttgtttca

SEQ ID NO: 129891 - DNA, 16 bp, H. sapiens
tatcataaaggatatt

SEQ ID NO: 129892 - DNA, 16 bp, H. sapiens
tatcatactgttttga

SEQ ID NO: 129893 - DNA, 16 bp, H. sapiens
tatcatatcatatatc

SEQ ID NO: 129894 - DNA, 16 bp, H. sapiens
tatcatatcatcagca

SEQ ID NO: 129895 - DNA, 16 bp, H. sapiens
tatcatattgaatggg

SEQ ID NO: 129896 - DNA, 16 bp, H. sapiens
tatcatcatcatcatc

SEQ ID NO: 129897 - DNA, 16 bp, H. sapiens
tatcatctcattttat

SEQ ID NO: 129898 - DNA, 16 bp, H. sapiens
tatcatctttggagaa

SEQ ID NO: 129899 - DNA, 16 bp, H. sapiens
tatcatcttttgagaa

SEQ ID NO: 129900 - DNA, 16 bp, H. sapiens
tatcatgaatgcagga

SEQ ID NO: 129901 - DNA, 16 bp, H. sapiens
tatcatgagaacagca

SEQ ID NO: 129902 - DNA, 16 bp, H. sapiens
tatcatgctacctgac

SEQ ID NO: 129903 - DNA, 16 bp, H. sapiens
tatcatgtttttaaaa

SEQ ID NO: 129904 - DNA, 16 bp, H. sapiens
tatcattaatcattag

SEQ ID NO: 129905 - DNA, 16 bp, H. sapiens
tatcattatcttcatt

SEQ ID NO: 129906 - DNA, 16 bp, H. sapiens
tatcattcattttgaa

SEQ ID NO: 129907 - DNA, 16 bp, H. sapiens
tatcattgatgggaat

SEQ ID NO: 129908 - DNA, 16 bp, H. sapiens
tatcattgccatttta

SEQ ID NO: 129909 - DNA, 16 bp, H. sapiens
tatcattggcaacaaa

SEQ ID NO: 129910 - DNA, 16 bp, H. sapiens
tatcattgttattgtt

SEQ ID NO: 129911 - DNA, 16 bp, H. sapiens
tatcatttgtaaaatg

SEQ ID NO: 129912 - DNA, 16 bp, H. sapiens
tatcattttataatga

SEQ ID NO: 129913 - DNA, 16 bp, H. sapiens
tatcatttttattgtg

SEQ ID NO: 129914 - DNA, 16 bp, H. sapiens
tatcattttttgttgc

SEQ ID NO: 129915 - DNA, 16 bp, H. sapiens
tatccaaaaaatcatt

SEQ ID NO: 129916 - DNA, 16 bp, H. sapiens
tatccaaagaaatata

SEQ ID NO: 129917 - DNA, 16 bp, H. sapiens
tatccaacacgaactg

SEQ ID NO: 129918 - DNA, 16 bp, H. sapiens
tatccaagatgtaaga

SEQ ID NO: 129919 - DNA, 16 bp, H. sapiens
tatccaataaatatca

SEQ ID NO: 129920 - DNA, 16 bp, H. sapiens
tatccaatacagtagc

SEQ ID NO: 129921 - DNA, 16 bp, H. sapiens
tatccacaccaaaacc

SEQ ID NO: 129922 - DNA, 16 bp, H. sapiens
tatccacacctccaac

SEQ ID NO: 129923 - DNA, 16 bp, H. sapiens
tatccacatgcagaaa

SEQ ID NO: 129924 - DNA, 16 bp, H. sapiens
tatccacccaccttgg

SEQ ID NO: 129925 - DNA, 17 bp, H. sapiens
tatccacccgcctcagc

SEQ ID NO: 129926 - DNA, 16 bp, H. sapiens
tatccaccttctgaag

SEQ ID NO: 129927 - DNA, 16 bp, H. sapiens
tatccactagatgcca

SEQ ID NO: 129928 - DNA, 16 bp, H. sapiens
tatccactcatctgtc

SEQ ID NO: 129929 - DNA, 16 bp, H. sapiens
tatccagaagaagaga

SEQ ID NO: 129930 - DNA, 16 bp, H. sapiens
tatccagaagatctgg

SEQ ID NO: 129931 - DNA, 17 bp, H. sapiens
tatccagaccccaagag

SEQ ID NO: 129932 - DNA, 16 bp, H. sapiens
tatccagaggaaaaga

SEQ ID NO: 129933 - DNA, 22 bp, H. sapiens
tatccagccaaactaagcttcg

SEQ ID NO: 129934 - DNA, 16 bp, H. sapiens
tatccagccccaaatg

SEQ ID NO: 129935 - DNA, 16 bp, H. sapiens
tatccaggcacagtgg

SEQ ID NO: 129936 - DNA, 16 bp, H. sapiens
tatccaggccatcacc

SEQ ID NO: 129937 - DNA, 16 bp, H. sapiens
tatccaggtgtagtgg

SEQ ID NO: 129938 - DNA, 16 bp, H. sapiens
tatccaggtgtggtgg

SEQ ID NO: 129939 - DNA, 16 bp, H. sapiens
tatccagtgaaaacat

SEQ ID NO: 129940 - DNA, 16 bp, H. sapiens
tatccagtttgccact

SEQ ID NO: 129941 - DNA, 16 bp, H. sapiens
tatccagttttcctgg

SEQ ID NO: 129942 - DNA, 16 bp, H. sapiens
tatccatacaatgaaa

SEQ ID NO: 129943 - DNA, 16 bp, H. sapiens
tatccatatgacaaag

SEQ ID NO: 129944 - DNA, 16 bp, H. sapiens
tatccatatgcaaaag

SEQ ID NO: 129945 - DNA, 16 bp, H. sapiens
tatccatatgcaaaat

SEQ ID NO: 129946 - DNA, 16 bp, H. sapiens
tatccatccacccacc

SEQ ID NO: 129947 - DNA, 16 bp, H. sapiens
tatccatccatccacc

SEQ ID NO: 129948 - DNA, 16 bp, H. sapiens
tatccatccatgcatc

SEQ ID NO: 129949 - DNA, 16 bp, H. sapiens
tatccatctatcaatc

SEQ ID NO: 129950 - DNA, 16 bp, H. sapiens
tatccatctcttttag

SEQ ID NO: 129951 - DNA, 16 bp, H. sapiens
tatccatctgacaaga

SEQ ID NO: 129952 - DNA, 16 bp, H. sapiens
tatccatgaacatgaa

SEQ ID NO: 129953 - DNA, 16 bp, H. sapiens
tatccatgctgtatat

SEQ ID NO: 129954 - DNA, 16 bp, H. sapiens
tatccatgttgtagca

SEQ ID NO: 129955 - DNA, 16 bp, H. sapiens
tatccattacctcaaa

SEQ ID NO: 129956 - DNA, 16 bp, H. sapiens
tatccattcatctgtg

SEQ ID NO: 129957 - DNA, 16 bp, H. sapiens
tatccattcatttgct

SEQ ID NO: 129958 - DNA, 28 bp, H. sapiens
tatccatttcttctagattttctagttt

SEQ ID NO: 129959 - DNA, 16 bp, H. sapiens
tatccattttataaat

SEQ ID NO: 129960 - DNA, 18 bp, H. sapiens
tatcccaacactttggga

SEQ ID NO: 129961 - DNA, 16 bp, H. sapiens
tatcccaccaaactaa

SEQ ID NO: 129962 - DNA, 16 bp, H. sapiens
tatcccaccttcttcc

SEQ ID NO: 129963 - DNA, 16 bp, H. sapiens
tatcccagaacttaga

SEQ ID NO: 129964 - DNA, 16 bp, H. sapiens
tatcccagcactttga

SEQ ID NO: 129965 - DNA, 18 bp, H. sapiens
tatcccagcactttggga

SEQ ID NO: 129966 - DNA, 18 bp, H. sapiens
tatcccagctactcagga

SEQ ID NO: 129967 - DNA, 16 bp, H. sapiens
tatcccagctactctg

SEQ ID NO: 129968 - DNA, 16 bp, H. sapiens
tatcccattctccatg

SEQ ID NO: 129969 - DNA, 16 bp, H. sapiens
tatcccattggttctg

SEQ ID NO: 129970 - DNA, 16 bp, H. sapiens
tatcccattttttaaa

SEQ ID NO: 129971 - DNA, 16 bp, H. sapiens
tatccccagtgcccag

SEQ ID NO: 129972 - DNA, 16 bp, H. sapiens
tatccccattgtatct

SEQ ID NO: 129973 - DNA, 16 bp, H. sapiens
tatccccattttacaa

SEQ ID NO: 129974 - DNA, 16 bp, H. sapiens
tatccctagtacctag

SEQ ID NO: 129975 - DNA, 16 bp, H. sapiens
tatccctcagcctctt

SEQ ID NO: 129976 - DNA, 16 bp, H. sapiens
tatccctctgacaaag

SEQ ID NO: 129977 - DNA, 16 bp, H. sapiens
tatccctctttttaaa

SEQ ID NO: 129978 - DNA, 16 bp, H. sapiens
tatccctgagcctgag

SEQ ID NO: 129979 - DNA, 16 bp, H. sapiens
tatcctaaatatattt

SEQ ID NO: 129980 - DNA, 20 bp, H. sapiens
tatcctagaatctttgtgct

SEQ ID NO: 129981 - DNA, 16 bp, H. sapiens
tatcctatgttttctt

SEQ ID NO: 129982 - DNA, 16 bp, H. sapiens
tatcctattatttctg

SEQ ID NO: 129983 - DNA, 16 bp, H. sapiens
tatcctcacataaaaa

SEQ ID NO: 129984 - DNA, 16 bp, H. sapiens
tatcctcagcaaatta

SEQ ID NO: 129985 - DNA, 16 bp, H. sapiens
tatcctcattttaaaa

SEQ ID NO: 129986 - DNA, 20 bp, H. sapiens
tatcctccagaccccagaat

SEQ ID NO: 129987 - DNA, 16 bp, H. sapiens
tatcctcccgcctcgg

SEQ ID NO: 129988 - DNA, 16 bp, H. sapiens
tatcctcctgccttgg

SEQ ID NO: 129989 - DNA, 16 bp, H. sapiens
tatcctctagaatttt

SEQ ID NO: 129990 - DNA, 16 bp, H. sapiens
tatcctgaaatacatt

SEQ ID NO: 129991 - DNA, 16 bp, H. sapiens
tatcctgaagctttac

SEQ ID NO: 129992 - DNA, 16 bp, H. sapiens
tatcctgagattttgc

SEQ ID NO: 129993 - DNA, 16 bp, H. sapiens
tatcctgcctcagccc

SEQ ID NO: 129994 - DNA, 16 bp, H. sapiens
tatcctggacatttca

SEQ ID NO: 129995 - DNA, 22 bp, H. sapiens
tatcctggccaacatggtgaaa

SEQ ID NO: 129996 - DNA, 16 bp, H. sapiens
tatcctggtcaacatg

SEQ ID NO: 129997 - DNA, 16 bp, H. sapiens
tatcctggttattaat

SEQ ID NO: 129998 - DNA, 16 bp, H. sapiens
tatcctgttttatttc

SEQ ID NO: 129999 - DNA, 16 bp, H. sapiens
tatccttaaatgtaaa

SEQ ID NO: 130000 - DNA, 16 bp, H. sapiens
tatccttaatgaacat

SEQ ID NO: 130001 - DNA, 16 bp, H. sapiens
tatccttaccaacact

SEQ ID NO: 130002 - DNA, 16 bp, H. sapiens
tatccttgatgagcat

SEQ ID NO: 130003 - DNA, 16 bp, H. sapiens
tatccttgtttacaga

SEQ ID NO: 130004 - DNA, 16 bp, H. sapiens
tatcctttataataaa

SEQ ID NO: 130005 - DNA, 16 bp, H. sapiens
tatcctttctccactg

SEQ ID NO: 130006 - DNA, 16 bp, H. sapiens
tatcctttgtaataaa

SEQ ID NO: 130007 - DNA, 16 bp, H. sapiens
tatccttttgtgactg

SEQ ID NO: 130008 - DNA, 16 bp, H. sapiens
tatcgattttgttgat

SEQ ID NO: 130009 - DNA, 16 bp, H. sapiens
tatctaaaaaacccca

SEQ ID NO: 130010 - DNA, 16 bp, H. sapiens
tatctaaaaatgtatt

SEQ ID NO: 130011 - DNA, 16 bp, H. sapiens
tatctaaaatttttca

SEQ ID NO: 130012 - DNA, 16 bp, H. sapiens
tatctaaagatagaaa

SEQ ID NO: 130013 - DNA, 16 bp, H. sapiens
tatctaaaggaaaata

SEQ ID NO: 130014 - DNA, 23 bp, H. sapiens
tatctacaaccatctgatctttg

SEQ ID NO: 130015 - DNA, 16 bp, H. sapiens
tatctagaaaacccca

SEQ ID NO: 130016 - DNA, 17 bp, H. sapiens
tatctaggaagtaacta

SEQ ID NO: 130017 - DNA, 16 bp, H. sapiens
tatctaggaagtaagt

SEQ ID NO: 130018 - DNA, 16 bp, H. sapiens
tatctagttctgtgaa

SEQ ID NO: 130019 - DNA, 16 bp, H. sapiens
tatctataatctatct

SEQ ID NO: 130020 - DNA, 16 bp, H. sapiens
tatctatacaatggaa

SEQ ID NO: 130021 - DNA, 16 bp, H. sapiens
tatctatacatacaca

SEQ ID NO: 130022 - DNA, 16 bp, H. sapiens
tatctatagatatata

SEQ ID NO: 130023 - DNA, 16 bp, H. sapiens
tatctatatatgcata

SEQ ID NO: 130024 - DNA, 16 bp, H. sapiens
tatctatatatgtgta

SEQ ID NO: 130025 - DNA, 16 bp, H. sapiens
tatctatatgtatccc

SEQ ID NO: 130026 - DNA, 16 bp, H. sapiens
tatctatatgtatgta

SEQ ID NO: 130027 - DNA, 16 bp, H. sapiens
tatctatctaatctat

SEQ ID NO: 130028 - DNA, 16 bp, H. sapiens
tatctatctatctata

SEQ ID NO: 130029 - DNA, 16 bp, H. sapiens
tatctatggctgtttt

SEQ ID NO: 130030 - DNA, 16 bp, H. sapiens
tatctatgtaacaaat

SEQ ID NO: 130031 - DNA, 16 bp, H. sapiens
tatctatgtatatgta

SEQ ID NO: 130032 - DNA, 16 bp, H. sapiens
tatctatttatctgtc

SEQ ID NO: 130033 - DNA, 16 bp, H. sapiens
tatctattttgttaat

SEQ ID NO: 130034 - DNA, 16 bp, H. sapiens
tatctcaaaataagaa

SEQ ID NO: 130035 - DNA, 16 bp, H. sapiens
tatctcaaaataatag

SEQ ID NO: 130036 - DNA, 16 bp, H. sapiens
tatctcaagttcaaag

SEQ ID NO: 130037 - DNA, 16 bp, H. sapiens
tatctcaataaagttt

SEQ ID NO: 130038 - DNA, 16 bp, H. sapiens
tatctcacaattctgg

SEQ ID NO: 130039 - DNA, 16 bp, H. sapiens
tatctcacaggttttg

SEQ ID NO: 130040 - DNA, 16 bp, H. sapiens
tatctcagaaaataaa

SEQ ID NO: 130041 - DNA, 16 bp, H. sapiens
tatctcagaacttaaa

SEQ ID NO: 130042 - DNA, 16 bp, H. sapiens
tatctcagaagttgta

SEQ ID NO: 130043 - DNA, 16 bp, H. sapiens
tatctcagagatattg

SEQ ID NO: 130044 - DNA, 16 bp, H. sapiens
tatctcagtgtgtgag

SEQ ID NO: 130045 - DNA, 16 bp, H. sapiens
tatctcatgtacctca

SEQ ID NO: 130046 - DNA, 16 bp, H. sapiens
tatctcattgcaattt

SEQ ID NO: 130047 - DNA, 16 bp, H. sapiens
tatctcatttaatctt

SEQ ID NO: 130048 - DNA, 16 bp, H. sapiens
tatctcatttaatttg

SEQ ID NO: 130049 - DNA, 16 bp, H. sapiens
tatctcattttaaaaa

SEQ ID NO: 130050 - DNA, 16 bp, H. sapiens
tatctccagatacagt

SEQ ID NO: 130051 - DNA, 16 bp, H. sapiens
tatctccagcatctag

SEQ ID NO: 130052 - DNA, 16 bp, H. sapiens
tatctccagcccagac

SEQ ID NO: 130053 - DNA, 16 bp, H. sapiens
tatctccagggcatgt

SEQ ID NO: 130054 - DNA, 16 bp, H. sapiens
tatctccagtgtctag

SEQ ID NO: 130055 - DNA, 16 bp, H. sapiens
tatctcccttcgctga

SEQ ID NO: 130056 - DNA, 16 bp, H. sapiens
tatctcctatttcatt

SEQ ID NO: 130057 - DNA, 16 bp, H. sapiens
tatctctacaaaaaaa

SEQ ID NO: 130058 - DNA, 16 bp, H. sapiens
tatctctactaaaaac

SEQ ID NO: 130059 - DNA, 16 bp, H. sapiens
tatctctactaaaatt

SEQ ID NO: 130060 - DNA, 16 bp, H. sapiens
tatctctatatagata

SEQ ID NO: 130061 - DNA, 16 bp, H. sapiens
tatctctcagaccaca

SEQ ID NO: 130062 - DNA, 16 bp, H. sapiens
tatctctcattgtttt

SEQ ID NO: 130063 - DNA, 16 bp, H. sapiens
tatctctcctaatgct

SEQ ID NO: 130064 - DNA, 16 bp, H. sapiens
tatctctctcaagttc

SEQ ID NO: 130065 - DNA, 16 bp, H. sapiens
tatctctgatgaatat

SEQ ID NO: 130066 - DNA, 16 bp, H. sapiens
tatctctgtgaagaat

SEQ ID NO: 130067 - DNA, 16 bp, H. sapiens
tatctctgtttgcaga

SEQ ID NO: 130068 - DNA, 16 bp, H. sapiens
tatctctgttttggca

SEQ ID NO: 130069 - DNA, 16 bp, H. sapiens
tatctcttaaaaaaga

SEQ ID NO: 130070 - DNA, 16 bp, H. sapiens
tatctcttaacaggtt

SEQ ID NO: 130071 - DNA, 16 bp, H. sapiens
tatctgaaaacaaaaa

SEQ ID NO: 130072 - DNA, 16 bp, H. sapiens
tatctgaaaatgtgga

SEQ ID NO: 130073 - DNA, 16 bp, H. sapiens
tatctgaagaagaaat

SEQ ID NO: 130074 - DNA, 16 bp, H. sapiens
tatctgaataaaataa

SEQ ID NO: 130075 - DNA, 16 bp, H. sapiens
tatctgaatttttaaa

SEQ ID NO: 130076 - DNA, 16 bp, H. sapiens
tatctgacttcaaact

SEQ ID NO: 130077 - DNA, 16 bp, H. sapiens
tatctgagactacagg

SEQ ID NO: 130078 - DNA, 16 bp, H. sapiens
tatctgagactggata

SEQ ID NO: 130079 - DNA, 16 bp, H. sapiens
tatctgataaaataga

SEQ ID NO: 130080 - DNA, 16 bp, H. sapiens
tatctgattccaaagc

SEQ ID NO: 130081 - DNA, 16 bp, H. sapiens
tatctgcagtcccagc

SEQ ID NO: 130082 - DNA, 16 bp, H. sapiens
tatctgcatttccatg

SEQ ID NO: 130083 - DNA, 18 bp, H. sapiens
tatctgcccacctcggcc

SEQ ID NO: 130084 - DNA, 20 bp, H. sapiens
tatctgcccgcctcggcctc

SEQ ID NO: 130085 - DNA, 16 bp, H. sapiens
tatctgcctgtctgtc

SEQ ID NO: 130086 - DNA, 16 bp, H. sapiens
tatctggaggaagaaa

SEQ ID NO: 130087 - DNA, 16 bp, H. sapiens
tatctggatcttctct

SEQ ID NO: 130088 - DNA, 16 bp, H. sapiens
tatctggatgcctttt

SEQ ID NO: 130089 - DNA, 16 bp, H. sapiens
tatctggctaactttt

SEQ ID NO: 130090 - DNA, 16 bp, H. sapiens
tatctggcttatttca

SEQ ID NO: 130091 - DNA, 16 bp, H. sapiens
tatctgggaatatctt

SEQ ID NO: 130092 - DNA, 16 bp, H. sapiens
tatctggtggaagaaa

SEQ ID NO: 130093 - DNA, 16 bp, H. sapiens
tatctgtaaaatgcaa

SEQ ID NO: 130094 - DNA, 16 bp, H. sapiens
tatctgtaaaatgggg

SEQ ID NO: 130095 - DNA, 16 bp, H. sapiens
tatctgtaagatgggg

SEQ ID NO: 130096 - DNA, 16 bp, H. sapiens
tatctgtaatatatat

SEQ ID NO: 130097 - DNA, 16 bp, H. sapiens
tatctgtatctatata

SEQ ID NO: 130098 - DNA, 16 bp, H. sapiens
tatctgtatctttata

SEQ ID NO: 130099 - DNA, 16 bp, H. sapiens
tatctgtctgtctgtc

SEQ ID NO: 130100 - DNA, 16 bp, H. sapiens
tatctgtctttttgtg

SEQ ID NO: 130101 - DNA, 16 bp, H. sapiens
tatctgtgaaaatgct

SEQ ID NO: 130102 - DNA, 16 bp, H. sapiens
tatctgtggctgcttt

SEQ ID NO: 130103 - DNA, 16 bp, H. sapiens
tatctgtgggagctaa

SEQ ID NO: 130104 - DNA, 17 bp, H. sapiens
tatctgtgtgtgtgtgt

SEQ ID NO: 130105 - DNA, 16 bp, H. sapiens
tatctgttatgatgat

SEQ ID NO: 130106 - DNA, 16 bp, H. sapiens
tatcttaaaaatggaa

SEQ ID NO: 130107 - DNA, 16 bp, H. sapiens
tatcttaaaatataca

SEQ ID NO: 130108 - DNA, 16 bp, H. sapiens
tatcttaaaattcata

SEQ ID NO: 130109 - DNA, 16 bp, H. sapiens
tatcttacaattctgg

SEQ ID NO: 130110 - DNA, 16 bp, H. sapiens
tatcttacatggcaaa

SEQ ID NO: 130111 - DNA, 16 bp, H. sapiens
tatcttcatgtaaaaa

SEQ ID NO: 130112 - DNA, 16 bp, H. sapiens
tatcttcatttaaaaa

SEQ ID NO: 130113 - DNA, 16 bp, H. sapiens
tatcttcattttaaag

SEQ ID NO: 130114 - DNA, 16 bp, H. sapiens
tatcttcattttacag

SEQ ID NO: 130115 - DNA, 16 bp, H. sapiens
tatcttcctgatggat

SEQ ID NO: 130116 - DNA, 16 bp, H. sapiens
tatcttctcccagttt

SEQ ID NO: 130117 - DNA, 16 bp, H. sapiens
tatcttcttcagagaa

SEQ ID NO: 130118 - DNA, 16 bp, H. sapiens
tatcttctttgatgaa

SEQ ID NO: 130119 - DNA, 16 bp, H. sapiens
tatcttcttttatgaa

SEQ ID NO: 130120 - DNA, 16 bp, H. sapiens
tatcttcttttcagaa

SEQ ID NO: 130121 - DNA, 16 bp, H. sapiens
tatcttgaaaaagaaa

SEQ ID NO: 130122 - DNA, 16 bp, H. sapiens
tatcttgaaatataca

SEQ ID NO: 130123 - DNA, 16 bp, H. sapiens
tatcttgaatttttat

SEQ ID NO: 130124 - DNA, 16 bp, H. sapiens
tatcttggaaaaaaaa

SEQ ID NO: 130125 - DNA, 16 bp, H. sapiens
tatcttggggatgaga

SEQ ID NO: 130126 - DNA, 16 bp, H. sapiens
tatcttggttaaagta

SEQ ID NO: 130127 - DNA, 16 bp, H. sapiens
tatcttgttcatcttt

SEQ ID NO: 130128 - DNA, 16 bp, H. sapiens
tatctttactatgttg

SEQ ID NO: 130129 - DNA, 16 bp, H. sapiens
tatctttaggtctttg

SEQ ID NO: 130130 - DNA, 16 bp, H. sapiens
tatctttatagcaaca

SEQ ID NO: 130131 - DNA, 16 bp, H. sapiens
tatctttattgcagca

SEQ ID NO: 130132 - DNA, 16 bp, H. sapiens
tatctttcaaaagtga

SEQ ID NO: 130133 - DNA, 16 bp, H. sapiens
tatctttccaggaatt

SEQ ID NO: 130134 - DNA, 16 bp, H. sapiens
tatctttccattacac

SEQ ID NO: 130135 - DNA, 16 bp, H. sapiens
tatctttgtaataaaa

SEQ ID NO: 130136 - DNA, 16 bp, H. sapiens
tatctttgtgaatttt

SEQ ID NO: 130137 - DNA, 16 bp, H. sapiens
tatctttgtttgtaga

SEQ ID NO: 130138 - DNA, 16 bp, H. sapiens
tatcttttaaagatat

SEQ ID NO: 130139 - DNA, 16 bp, H. sapiens
tatcttttcaaaaatc

SEQ ID NO: 130140 - DNA, 16 bp, H. sapiens
tatcttttcaacaaat

SEQ ID NO: 130141 - DNA, 16 bp, H. sapiens
tatcttttcagcaatg

SEQ ID NO: 130142 - DNA, 16 bp, H. sapiens
tatcttttccaaaaaa

SEQ ID NO: 130143 - DNA, 16 bp, H. sapiens
tatcttttctgaccat

SEQ ID NO: 130144 - DNA, 16 bp, H. sapiens
tatcttttgagaagtg

SEQ ID NO: 130145 - DNA, 16 bp, H. sapiens
tatctttttaatagaa

SEQ ID NO: 130146 - DNA, 16 bp, H. sapiens
tatctttttcaaataa

SEQ ID NO: 130147 - DNA, 16 bp, H. sapiens
tatctttttgaaattt

SEQ ID NO: 130148 - DNA, 16 bp, H. sapiens
tatcttttttaaaaga

SEQ ID NO: 130149 - DNA, 16 bp, H. sapiens
tatcttttttgtgtaa

SEQ ID NO: 130150 - DNA, 16 bp, H. sapiens
tatgaaaaaaagctta

SEQ ID NO: 130151 - DNA, 16 bp, H. sapiens
tatgaaaaaaatacat

SEQ ID NO: 130152 - DNA, 16 bp, H. sapiens
tatgaaaaaataccca

SEQ ID NO: 130153 - DNA, 16 bp, H. sapiens
tatgaaaaaatgatca

SEQ ID NO: 130154 - DNA, 16 bp, H. sapiens
tatgaaaaaatgctca

SEQ ID NO: 130155 - DNA, 16 bp, H. sapiens
tatgaaaaaatgtcca

SEQ ID NO: 130156 - DNA, 16 bp, H. sapiens
tatgaaaaaatgtgca

SEQ ID NO: 130157 - DNA, 16 bp, H. sapiens
tatgaaaaagtcaaaa

SEQ ID NO: 130158 - DNA, 16 bp, H. sapiens
tatgaaaaatacaaat

SEQ ID NO: 130159 - DNA, 16 bp, H. sapiens
tatgaaaactttaaaa

SEQ ID NO: 130160 - DNA, 16 bp, H. sapiens
tatgaaaagaaagttt

SEQ ID NO: 130161 - DNA, 16 bp, H. sapiens
tatgaaaaggtgttca

SEQ ID NO: 130162 - DNA, 16 bp, H. sapiens
tatgaaaataaaatca

SEQ ID NO: 130163 - DNA, 16 bp, H. sapiens
tatgaaaatagttttt

SEQ ID NO: 130164 - DNA, 16 bp, H. sapiens
tatgaaaatattacat

SEQ ID NO: 130165 - DNA, 16 bp, H. sapiens
tatgaaaatcaactca

SEQ ID NO: 130166 - DNA, 16 bp, H. sapiens
tatgaaaatcctagaa

SEQ ID NO: 130167 - DNA, 16 bp, H. sapiens
tatgaaaattaaccag

SEQ ID NO: 130168 - DNA, 16 bp, H. sapiens
tatgaaagtataaaac

SEQ ID NO: 130169 - DNA, 16 bp, H. sapiens
tatgaaagttctagat

SEQ ID NO: 130170 - DNA, 16 bp, H. sapiens
tatgaaatattttcat

SEQ ID NO: 130171 - DNA, 16 bp, H. sapiens
tatgaaatgccttcaa

SEQ ID NO: 130172 - DNA, 16 bp, H. sapiens
tatgaaatgctgtatg

SEQ ID NO: 130173 - DNA, 16 bp, H. sapiens
tatgaaatggaatgga

SEQ ID NO: 130174 - DNA, 16 bp, H. sapiens
tatgaaatgtccagaa

SEQ ID NO: 130175 - DNA, 16 bp, H. sapiens
tatgaaattatgtaaa

SEQ ID NO: 130176 - DNA, 16 bp, H. sapiens
tatgaaattctggatt

SEQ ID NO: 130177 - DNA, 16 bp, H. sapiens
tatgaaattcttgatt

SEQ ID NO: 130178 - DNA, 16 bp, H. sapiens
tatgaaattcttggtt

SEQ ID NO: 130179 - DNA, 16 bp, H. sapiens
tatgaaatttagaatt

SEQ ID NO: 130180 - DNA, 16 bp, H. sapiens
tatgaacaaatgctca

SEQ ID NO: 130181 - DNA, 16 bp, H. sapiens
tatgaacagacacttt

SEQ ID NO: 130182 - DNA, 16 bp, H. sapiens
tatgaacagtcacttc

SEQ ID NO: 130183 - DNA, 16 bp, H. sapiens
tatgaacatatataca

SEQ ID NO: 130184 - DNA, 16 bp, H. sapiens
tatgaacatgcatgtg

SEQ ID NO: 130185 - DNA, 16 bp, H. sapiens
tatgaacatttgtgta

SEQ ID NO: 130186 - DNA, 16 bp, H. sapiens
tatgaacattttcaaa

SEQ ID NO: 130187 - DNA, 16 bp, H. sapiens
tatgaacatttttatg

SEQ ID NO: 130188 - DNA, 16 bp, H. sapiens
tatgaactcatggatt

SEQ ID NO: 130189 - DNA, 16 bp, H. sapiens
tatgaactttaaagtt

SEQ ID NO: 130190 - DNA, 16 bp, H. sapiens
tatgaagaaaagagat

SEQ ID NO: 130191 - DNA, 16 bp, H. sapiens
tatgaagaaaatctgg

SEQ ID NO: 130192 - DNA, 16 bp, H. sapiens
tatgaagaaaatggaa

SEQ ID NO: 130193 - DNA, 16 bp, H. sapiens
tatgaagaaacagaaa

SEQ ID NO: 130194 - DNA, 16 bp, H. sapiens
tatgaagaaacaggaa

SEQ ID NO: 130195 - DNA, 16 bp, H. sapiens
tatgaagaaactacat

SEQ ID NO: 130196 - DNA, 16 bp, H. sapiens
tatgaagaaatggaaa

SEQ ID NO: 130197 - DNA, 16 bp, H. sapiens
tatgaagaattattaa

SEQ ID NO: 130198 - DNA, 16 bp, H. sapiens
tatgaagacaataaaa

SEQ ID NO: 130199 - DNA, 16 bp, H. sapiens
tatgaagacagaggca

SEQ ID NO: 130200 - DNA, 16 bp, H. sapiens
tatgaagatattttta

SEQ ID NO: 130201 - DNA, 16 bp, H. sapiens
tatgaagatgaaatga

SEQ ID NO: 130202 - DNA, 16 bp, H. sapiens
tatgaagcaaatatta

SEQ ID NO: 130203 - DNA, 16 bp, H. sapiens
tatgaagccagcatca

SEQ ID NO: 130204 - DNA, 16 bp, H. sapiens
tatgaagccagtatta

SEQ ID NO: 130205 - DNA, 16 bp, H. sapiens
tatgaagctagtatta

SEQ ID NO: 130206 - DNA, 16 bp, H. sapiens
tatgaaggaaaagacc

SEQ ID NO: 130207 - DNA, 16 bp, H. sapiens
tatgaaggtgttttct

SEQ ID NO: 130208 - DNA, 16 bp, H. sapiens
tatgaagtagtatctc

SEQ ID NO: 130209 - DNA, 16 bp, H. sapiens
tatgaagtattcttgc

SEQ ID NO: 130210 - DNA, 16 bp, H. sapiens
tatgaagttaaaacca

SEQ ID NO: 130211 - DNA, 16 bp, H. sapiens
tatgaagtttgtcttt

SEQ ID NO: 130212 - DNA, 16 bp, H. sapiens
tatgaataaaactgct

SEQ ID NO: 130213 - DNA, 16 bp, H. sapiens
tatgaataaagatgct

SEQ ID NO: 130214 - DNA, 16 bp, H. sapiens
tatgaataatgctgtt

SEQ ID NO: 130215 - DNA, 16 bp, H. sapiens
tatgaatatatattca

SEQ ID NO: 130216 - DNA, 16 bp, H. sapiens
tatgaatatatgaata

SEQ ID NO: 130217 - DNA, 16 bp, H. sapiens
tatgaatatccagttt

SEQ ID NO: 130218 - DNA, 16 bp, H. sapiens
tatgaatatgtatata

SEQ ID NO: 130219 - DNA, 16 bp, H. sapiens
tatgaatatttctgta

SEQ ID NO: 130220 - DNA, 16 bp, H. sapiens
tatgaatcatcacttc

SEQ ID NO: 130221 - DNA, 16 bp, H. sapiens
tatgaatgaagctgct

SEQ ID NO: 130222 - DNA, 16 bp, H. sapiens
tatgaatgtaatgaat

SEQ ID NO: 130223 - DNA, 16 bp, H. sapiens
tatgaatgttcttaat

SEQ ID NO: 130224 - DNA, 16 bp, H. sapiens
tatgaatttgtcaaaa

SEQ ID NO: 130225 - DNA, 16 bp, H. sapiens
tatgaattttacaata

SEQ ID NO: 130226 - DNA, 16 bp, H. sapiens
tatgaattttaggttt

SEQ ID NO: 130227 - DNA, 16 bp, H. sapiens
tatgaattttgaaata

SEQ ID NO: 130228 - DNA, 16 bp, H. sapiens
tatgacaaaaccacag

SEQ ID NO: 130229 - DNA, 16 bp, H. sapiens
tatgacaaaattattt

SEQ ID NO: 130230 - DNA, 16 bp, H. sapiens
tatgacaaacccacaa

SEQ ID NO: 130231 - DNA, 16 bp, H. sapiens
tatgacaaacccatag

SEQ ID NO: 130232 - DNA, 16 bp, H. sapiens
tatgacaaacctacag

SEQ ID NO: 130233 - DNA, 16 bp, H. sapiens
tatgacaaagccacag

SEQ ID NO: 130234 - DNA, 16 bp, H. sapiens
tatgacaaatccacag

SEQ ID NO: 130235 - DNA, 16 bp, H. sapiens
tatgacaaatgtttct

SEQ ID NO: 130236 - DNA, 16 bp, H. sapiens
tatgacaagagatagg

SEQ ID NO: 130237 - DNA, 16 bp, H. sapiens
tatgacaatattttaa

SEQ ID NO: 130238 - DNA, 16 bp, H. sapiens
tatgacacagcaattc

SEQ ID NO: 130239 - DNA, 16 bp, H. sapiens
tatgacaggatcaaat

SEQ ID NO: 130240 - DNA, 16 bp, H. sapiens
tatgacatatacatat

SEQ ID NO: 130241 - DNA, 16 bp, H. sapiens
tatgacatatattata

SEQ ID NO: 130242 - DNA, 16 bp, H. sapiens
tatgacattctggaag

SEQ ID NO: 130243 - DNA, 16 bp, H. sapiens
tatgaccacaccactg

SEQ ID NO: 130244 - DNA, 16 bp, H. sapiens
tatgaccacatgacca

SEQ ID NO: 130245 - DNA, 16 bp, H. sapiens
tatgacccagcaattg

SEQ ID NO: 130246 - DNA, 16 bp, H. sapiens
tatgaccttctaggaa

SEQ ID NO: 130247 - DNA, 16 bp, H. sapiens
tatgactcccaatatc

SEQ ID NO: 130248 - DNA, 16 bp, H. sapiens
tatgactgagtaatat

SEQ ID NO: 130249 - DNA, 16 bp, H. sapiens
tatgactgtgtcctta

SEQ ID NO: 130250 - DNA, 16 bp, H. sapiens
tatgactttctggaaa

SEQ ID NO: 130251 - DNA, 16 bp, H. sapiens
tatgacttttattgtg

SEQ ID NO: 130252 - DNA, 16 bp, H. sapiens
tatgactttttaattt

SEQ ID NO: 130253 - DNA, 16 bp, H. sapiens
tatgagaaaatatttt

SEQ ID NO: 130254 - DNA, 16 bp, H. sapiens
tatgagaaaattaatt

SEQ ID NO: 130255 - DNA, 17 bp, H. sapiens
tatgagaaacccacagc

SEQ ID NO: 130256 - DNA, 16 bp, H. sapiens
tatgagaataaaatga

SEQ ID NO: 130257 - DNA, 16 bp, H. sapiens
tatgagaatctaatgc

SEQ ID NO: 130258 - DNA, 16 bp, H. sapiens
tatgagaattaaatgt

SEQ ID NO: 130259 - DNA, 16 bp, H. sapiens
tatgagaccagcatca

SEQ ID NO: 130260 - DNA, 16 bp, H. sapiens
tatgagagctacaaga

SEQ ID NO: 130261 - DNA, 16 bp, H. sapiens
tatgagatatatatat

SEQ ID NO: 130262 - DNA, 16 bp, H. sapiens
tatgagattatatata

SEQ ID NO: 130263 - DNA, 17 bp, H. sapiens
tatgagccaccacacct

SEQ ID NO: 130264 - DNA, 16 bp, H. sapiens
tatgagccactgtgcc

SEQ ID NO: 130265 - DNA, 16 bp, H. sapiens
tatgagccctttgtca

SEQ ID NO: 130266 - DNA, 16 bp, H. sapiens
tatgaggaagaaaata

SEQ ID NO: 130267 - DNA, 16 bp, H. sapiens
tatgaggaggctggag

SEQ ID NO: 130268 - DNA, 17 bp, H. sapiens
tatgaggccagcatcat

SEQ ID NO: 130269 - DNA, 16 bp, H. sapiens
tatgaggtagatatta

SEQ ID NO: 130270 - DNA, 16 bp, H. sapiens
tatgaggtttaaggaa

SEQ ID NO: 130271 - DNA, 16 bp, H. sapiens
tatgagtgaaatcatg

SEQ ID NO: 130272 - DNA, 16 bp, H. sapiens
tatgagtgaccaatgg

SEQ ID NO: 130273 - DNA, 16 bp, H. sapiens
tatgagtgagaacatg

SEQ ID NO: 130274 - DNA, 16 bp, H. sapiens
tatgagtgtgtctgtg

SEQ ID NO: 130275 - DNA, 16 bp, H. sapiens
tatgagtgtgtgtgtg

SEQ ID NO: 130276 - DNA, 16 bp, H. sapiens
tatgagtttttaaaat

SEQ ID NO: 130277 - DNA, 16 bp, H. sapiens
tatgataatctaatgc

SEQ ID NO: 130278 - DNA, 16 bp, H. sapiens
tatgataccaaaagca

SEQ ID NO: 130279 - DNA, 16 bp, H. sapiens
tatgatagcatcaaaa

SEQ ID NO: 130280 - DNA, 16 bp, H. sapiens
tatgatattgtctgtg

SEQ ID NO: 130281 - DNA, 16 bp, H. sapiens
tatgatcatatatttt

SEQ ID NO: 130282 - DNA, 16 bp, H. sapiens
tatgatcatgtcactg

SEQ ID NO: 130283 - DNA, 16 bp, H. sapiens
tatgatcattattatt

SEQ ID NO: 130284 - DNA, 16 bp, H. sapiens
tatgatccagcaattg

SEQ ID NO: 130285 - DNA, 16 bp, H. sapiens
tatgatcctgaagaca

SEQ ID NO: 130286 - DNA, 16 bp, H. sapiens
tatgatcttgggcaag

SEQ ID NO: 130287 - DNA, 16 bp, H. sapiens
tatgatctttgacaaa

SEQ ID NO: 130288 - DNA, 16 bp, H. sapiens
tatgatgatgatgatt

SEQ ID NO: 130289 - DNA, 16 bp, H. sapiens
tatgatgatgccactg

SEQ ID NO: 130290 - DNA, 16 bp, H. sapiens
tatgatgtacaacatg

SEQ ID NO: 130291 - DNA, 16 bp, H. sapiens
tatgatgtctttgtct

SEQ ID NO: 130292 - DNA, 16 bp, H. sapiens
tatgatgtgctgctgg

SEQ ID NO: 130293 - DNA, 16 bp, H. sapiens
tatgattatttcaaca

SEQ ID NO: 130294 - DNA, 16 bp, H. sapiens
tatgattatttcattt

SEQ ID NO: 130295 - DNA, 16 bp, H. sapiens
tatgattattttaaca

SEQ ID NO: 130296 - DNA, 16 bp, H. sapiens
tatgattcagcaatct

SEQ ID NO: 130297 - DNA, 16 bp, H. sapiens
tatgattccattttct

SEQ ID NO: 130298 - DNA, 16 bp, H. sapiens
tatgattgatcctgtc

SEQ ID NO: 130299 - DNA, 16 bp, H. sapiens
tatgattgtactactg

SEQ ID NO: 130300 - DNA, 16 bp, H. sapiens
tatgatttcaattctt

SEQ ID NO: 130301 - DNA, 16 bp, H. sapiens
tatgatttcaattttc

SEQ ID NO: 130302 - DNA, 16 bp, H. sapiens
tatgcaaaaaataaat

SEQ ID NO: 130303 - DNA, 16 bp, H. sapiens
tatgcaaaagtaaaat

SEQ ID NO: 130304 - DNA, 16 bp, H. sapiens
tatgcaaaatatacaa

SEQ ID NO: 130305 - DNA, 16 bp, H. sapiens
tatgcaaaatatatat

SEQ ID NO: 130306 - DNA, 16 bp, H. sapiens
tatgcaaagagactgg

SEQ ID NO: 130307 - DNA, 16 bp, H. sapiens
tatgcaaataaatata

SEQ ID NO: 130308 - DNA, 16 bp, H. sapiens
tatgcaaatagttgtt

SEQ ID NO: 130309 - DNA, 16 bp, H. sapiens
tatgcaaatatataaa

SEQ ID NO: 130310 - DNA, 16 bp, H. sapiens
tatgcaaatgaacttt

SEQ ID NO: 130311 - DNA, 16 bp, H. sapiens
tatgcaaatgttcata

SEQ ID NO: 130312 - DNA, 16 bp, H. sapiens
tatgcaagagaaagaa

SEQ ID NO: 130313 - DNA, 16 bp, H. sapiens
tatgcaatcatcacca

SEQ ID NO: 130314 - DNA, 16 bp, H. sapiens
tatgcaatttttattt

SEQ ID NO: 130315 - DNA, 16 bp, H. sapiens
tatgcacatacacaca

SEQ ID NO: 130316 - DNA, 16 bp, H. sapiens
tatgcagaagaatgga

SEQ ID NO: 130317 - DNA, 16 bp, H. sapiens
tatgcagacaagtgaa

SEQ ID NO: 130318 - DNA, 16 bp, H. sapiens
tatgcagatgaggaaa

SEQ ID NO: 130319 - DNA, 16 bp, H. sapiens
tatgcagcaataaaaa

SEQ ID NO: 130320 - DNA, 16 bp, H. sapiens
tatgcagccaaaatac

SEQ ID NO: 130321 - DNA, 17 bp, H. sapiens
tatgcagccaacagaca

SEQ ID NO: 130322 - DNA, 16 bp, H. sapiens
tatgcagccatataaa

SEQ ID NO: 130323 - DNA, 16 bp, H. sapiens
tatgcagctattgatc

SEQ ID NO: 130324 - DNA, 16 bp, H. sapiens
tatgcaggcctgtctg

SEQ ID NO: 130325 - DNA, 16 bp, H. sapiens
tatgcagggcttaaaa

SEQ ID NO: 130326 - DNA, 16 bp, H. sapiens
tatgcatacatgcaca

SEQ ID NO: 130327 - DNA, 16 bp, H. sapiens
tatgcatatacaaaaa

SEQ ID NO: 130328 - DNA, 16 bp, H. sapiens
tatgcatatatacatg

SEQ ID NO: 130329 - DNA, 16 bp, H. sapiens
tatgcatatatatttg

SEQ ID NO: 130330 - DNA, 16 bp, H. sapiens
tatgcatatctatata

SEQ ID NO: 130331 - DNA, 16 bp, H. sapiens
tatgcatatgtacata

SEQ ID NO: 130332 - DNA, 16 bp, H. sapiens
tatgcatatgtatgtt

SEQ ID NO: 130333 - DNA, 16 bp, H. sapiens
tatgcatgtaagaaat

SEQ ID NO: 130334 - DNA, 16 bp, H. sapiens
tatgcatgtatcttta

SEQ ID NO: 130335 - DNA, 16 bp, H. sapiens
tatgcattcatgacat

SEQ ID NO: 130336 - DNA, 16 bp, H. sapiens
tatgcatttatgtata

SEQ ID NO: 130337 - DNA, 16 bp, H. sapiens
tatgcattttaaaatt

SEQ ID NO: 130338 - DNA, 16 bp, H. sapiens
tatgcattttatttta

SEQ ID NO: 130339 - DNA, 16 bp, H. sapiens
tatgcatttttttcct

SEQ ID NO: 130340 - DNA, 16 bp, H. sapiens
tatgccaaaaggaaaa

SEQ ID NO: 130341 - DNA, 16 bp, H. sapiens
tatgccaaagaaaagc

SEQ ID NO: 130342 - DNA, 16 bp, H. sapiens
tatgccaccacacctg

SEQ ID NO: 130343 - DNA, 16 bp, H. sapiens
tatgccaccacgccca

SEQ ID NO: 130344 - DNA, 16 bp, H. sapiens
tatgccaccatgccca

SEQ ID NO: 130345 - DNA, 16 bp, H. sapiens
tatgccatattttctt

SEQ ID NO: 130346 - DNA, 16 bp, H. sapiens
tatgcccacagagcct

SEQ ID NO: 130347 - DNA, 16 bp, H. sapiens
tatgcccactctcacc

SEQ ID NO: 130348 - DNA, 17 bp, H. sapiens
tatgcccagctaatttt

SEQ ID NO: 130349 - DNA, 16 bp, H. sapiens
tatgcccgactaattt

SEQ ID NO: 130350 - DNA, 16 bp, H. sapiens
tatgccctctctcacc

SEQ ID NO: 130351 - DNA, 16 bp, H. sapiens
tatgcctataatccca

SEQ ID NO: 130352 - DNA, 16 bp, H. sapiens
tatgcctccaacaaag

SEQ ID NO: 130353 - DNA, 16 bp, H. sapiens
tatgcctgtaatccag

SEQ ID NO: 130354 - DNA, 16 bp, H. sapiens
tatgcctttattagca

SEQ ID NO: 130355 - DNA, 16 bp, H. sapiens
tatgcctttgtgttct

SEQ ID NO: 130356 - DNA, 16 bp, H. sapiens
tatgccttttatttat

SEQ ID NO: 130357 - DNA, 16 bp, H. sapiens
tatgctaagtgaaagt

SEQ ID NO: 130358 - DNA, 16 bp, H. sapiens
tatgctatgtttttcc

SEQ ID NO: 130359 - DNA, 16 bp, H. sapiens
tatgctgaaaattata

SEQ ID NO: 130360 - DNA, 16 bp, H. sapiens
tatgctggcagcaata

SEQ ID NO: 130361 - DNA, 16 bp, H. sapiens
tatgctgtattcagga

SEQ ID NO: 130362 - DNA, 16 bp, H. sapiens
tatgctgtcttcaaga

SEQ ID NO: 130363 - DNA, 16 bp, H. sapiens
tatgctgttggatttg

SEQ ID NO: 130364 - DNA, 16 bp, H. sapiens
tatgcttataattttt

SEQ ID NO: 130365 - DNA, 16 bp, H. sapiens
tatgctttaaaataaa

SEQ ID NO: 130366 - DNA, 16 bp, H. sapiens
tatgctttcattttct

SEQ ID NO: 130367 - DNA, 16 bp, H. sapiens
tatgcttttttaaaaa

SEQ ID NO: 130368 - DNA, 16 bp, H. sapiens
tatggaaaaattattt

SEQ ID NO: 130369 - DNA, 16 bp, H. sapiens
tatggaaaaattttaa

SEQ ID NO: 130370 - DNA, 16 bp, H. sapiens
tatggaaaacaaatta

SEQ ID NO: 130371 - DNA, 16 bp, H. sapiens
tatggaaaacaatatg

SEQ ID NO: 130372 - DNA, 16 bp, H. sapiens
tatggaaaacactgtg

SEQ ID NO: 130373 - DNA, 16 bp, H. sapiens
tatggaaaacagtatg

SEQ ID NO: 130374 - DNA, 16 bp, H. sapiens
tatggaaaacagtgtg

SEQ ID NO: 130375 - DNA, 16 bp, H. sapiens
tatggaaaacggtatg

SEQ ID NO: 130376 - DNA, 16 bp, H. sapiens
tatggaaaagaaagac

SEQ ID NO: 130377 - DNA, 16 bp, H. sapiens
tatggaaaagacaaaa

SEQ ID NO: 130378 - DNA, 16 bp, H. sapiens
tatggaaaatacagag

SEQ ID NO: 130379 - DNA, 16 bp, H. sapiens
tatggaaaatagtatg

SEQ ID NO: 130380 - DNA, 16 bp, H. sapiens
tatggaaaatatttat

SEQ ID NO: 130381 - DNA, 16 bp, H. sapiens
tatggaaacaaaaaag

SEQ ID NO: 130382 - DNA, 16 bp, H. sapiens
tatggaaacaatctaa

SEQ ID NO: 130383 - DNA, 17 bp, H. sapiens
tatggaaacacctggat

SEQ ID NO: 130384 - DNA, 17 bp, H. sapiens
tatggaaatgcctggat

SEQ ID NO: 130385 - DNA, 16 bp, H. sapiens
tatggaaatgtctgga

SEQ ID NO: 130386 - DNA, 16 bp, H. sapiens
tatggaaattcctcaa

SEQ ID NO: 130387 - DNA, 16 bp, H. sapiens
tatggaaattggctca

SEQ ID NO: 130388 - DNA, 16 bp, H. sapiens
tatggaaccaataaag

SEQ ID NO: 130389 - DNA, 16 bp, H. sapiens
tatggaaccatgaaag

SEQ ID NO: 130390 - DNA, 16 bp, H. sapiens
tatggaagataatttt

SEQ ID NO: 130391 - DNA, 16 bp, H. sapiens
tatggaatggaatcga

SEQ ID NO: 130392 - DNA, 16 bp, H. sapiens
tatggacactgaaatt

SEQ ID NO: 130393 - DNA, 16 bp, H. sapiens
tatggacagaaaaaag

SEQ ID NO: 130394 - DNA, 16 bp, H. sapiens
tatggacagaaaatgg

SEQ ID NO: 130395 - DNA, 16 bp, H. sapiens
tatggacaggaggcag

SEQ ID NO: 130396 - DNA, 17 bp, H. sapiens
tatggacatttattagt

SEQ ID NO: 130397 - DNA, 25 bp, H. sapiens
tatggaccaggttctccttttgtaa

SEQ ID NO: 130398 - DNA, 20 bp, H. sapiens
tatggacccaactcccctta

SEQ ID NO: 130399 - DNA, 16 bp, H. sapiens
tatggactgaattgtg

SEQ ID NO: 130400 - DNA, 16 bp, H. sapiens
tatggactttggatga

SEQ ID NO: 130401 - DNA, 16 bp, H. sapiens
tatggagaaaagtttg

SEQ ID NO: 130402 - DNA, 16 bp, H. sapiens
tatggagaaacaggaa

SEQ ID NO: 130403 - DNA, 16 bp, H. sapiens
tatggagaaactgaaa

SEQ ID NO: 130404 - DNA, 16 bp, H. sapiens
tatggagaaataggaa

SEQ ID NO: 130405 - DNA, 16 bp, H. sapiens
tatggagaaatcagaa

SEQ ID NO: 130406 - DNA, 16 bp, H. sapiens
tatggagaccaaggtt

SEQ ID NO: 130407 - DNA, 16 bp, H. sapiens
tatggagcaacaggaa

SEQ ID NO: 130408 - DNA, 16 bp, H. sapiens
tatggaggacagtttg

SEQ ID NO: 130409 - DNA, 16 bp, H. sapiens
tatggatatggatatg

SEQ ID NO: 130410 - DNA, 16 bp, H. sapiens
tatggatatgtgtgtg

SEQ ID NO: 130411 - DNA, 16 bp, H. sapiens
tatggatgagaaaaca

SEQ ID NO: 130412 - DNA, 16 bp, H. sapiens
tatggattagaagaat

SEQ ID NO: 130413 - DNA, 16 bp, H. sapiens
tatggatttttaaaaa

SEQ ID NO: 130414 - DNA, 16 bp, H. sapiens
tatggcaaaaaccaca

SEQ ID NO: 130415 - DNA, 16 bp, H. sapiens
tatggcaagagataga

SEQ ID NO: 130416 - DNA, 16 bp, H. sapiens
tatggcacatgtatac

SEQ ID NO: 130417 - DNA, 16 bp, H. sapiens
tatggcagaacaattt

SEQ ID NO: 130418 - DNA, 16 bp, H. sapiens
tatggcagccctagca

SEQ ID NO: 130419 - DNA, 16 bp, H. sapiens
tatggcagccctagga

SEQ ID NO: 130420 - DNA, 16 bp, H. sapiens
tatggcaggatttcct

SEQ ID NO: 130421 - DNA, 16 bp, H. sapiens
tatggcattttaaaat

SEQ ID NO: 130422 - DNA, 16 bp, H. sapiens
tatggcattttaattt

SEQ ID NO: 130423 - DNA, 16 bp, H. sapiens
tatggccattttagtg

SEQ ID NO: 130424 - DNA, 16 bp, H. sapiens
tatggccattttcaaa

SEQ ID NO: 130425 - DNA, 16 bp, H. sapiens
tatggcctgcagaacc

SEQ ID NO: 130426 - DNA, 16 bp, H. sapiens
tatggcctgcagtgca

SEQ ID NO: 130427 - DNA, 44 bp, H. sapiens
tatggctagccagttttcccagcaccatttattaaatagggaat

SEQ ID NO: 130428 - DNA, 16 bp, H. sapiens
tatggctattttcatg

SEQ ID NO: 130429 - DNA, 16 bp, H. sapiens
tatggcttaaaaaaaa

SEQ ID NO: 130430 - DNA, 16 bp, H. sapiens
tatgggaccaccattg

SEQ ID NO: 130431 - DNA, 16 bp, H. sapiens
tatgggactatgtaaa

SEQ ID NO: 130432 - DNA, 17 bp, H. sapiens
tatgggagactggggct

SEQ ID NO: 130433 - DNA, 19 bp, H. sapiens
tatgggcaaggacttcatg

SEQ ID NO: 130434 - DNA, 16 bp, H. sapiens
tatgggctgaactgtg

SEQ ID NO: 130435 - DNA, 17 bp, H. sapiens
tatgggctgggcacagt

SEQ ID NO: 130436 - DNA, 16 bp, H. sapiens
tatggggaaaaaaatg

SEQ ID NO: 130437 - DNA, 16 bp, H. sapiens
tatggggaaaatattt

SEQ ID NO: 130438 - DNA, 16 bp, H. sapiens
tatggggccagcatca

SEQ ID NO: 130439 - DNA, 16 bp, H. sapiens
tatgggggaaactgtc

SEQ ID NO: 130440 - DNA, 16 bp, H. sapiens
tatgggggcagtttcc

SEQ ID NO: 130441 - DNA, 16 bp, H. sapiens
tatgggttttgaaaaa

SEQ ID NO: 130442 - DNA, 16 bp, H. sapiens
tatggtaaaaccccgt

SEQ ID NO: 130443 - DNA, 16 bp, H. sapiens
tatggtagaaaaattt

SEQ ID NO: 130444 - DNA, 17 bp, H. sapiens
tatggtagctcatgcct

SEQ ID NO: 130445 - DNA, 16 bp, H. sapiens
tatggtagctctattt

SEQ ID NO: 130446 - DNA, 16 bp, H. sapiens
tatggtagtcactagc

SEQ ID NO: 130447 - DNA, 16 bp, H. sapiens
tatggtatatgaatta

SEQ ID NO: 130448 - DNA, 16 bp, H. sapiens
tatggtatgtaaatta

SEQ ID NO: 130449 - DNA, 16 bp, H. sapiens
tatggtatgtgagtta

SEQ ID NO: 130450 - DNA, 16 bp, H. sapiens
tatggtattggtgaaa

SEQ ID NO: 130451 - DNA, 16 bp, H. sapiens
tatggtcaattgattt

SEQ ID NO: 130452 - DNA, 16 bp, H. sapiens
tatggtcccagctact

SEQ ID NO: 130453 - DNA, 16 bp, H. sapiens
tatggtctctgtgcag

SEQ ID NO: 130454 - DNA, 16 bp, H. sapiens
tatggtgaaaatggaa

SEQ ID NO: 130455 - DNA, 16 bp, H. sapiens
tatggtgaaacaccat

SEQ ID NO: 130456 - DNA, 29 bp, H. sapiens
tatggtgaaaccccatctctactaaaaaa

SEQ ID NO: 130457 - DNA, 25 bp, H. sapiens
tatggtgaaaccccgtctctactac

SEQ ID NO: 130458 - DNA, 20 bp, H. sapiens
tatggtgaaacccgtctcta

SEQ ID NO: 130459 - DNA, 20 bp, H. sapiens
tatggtgaaaccctgtctgt

SEQ ID NO: 130460 - DNA, 16 bp, H. sapiens
tatggtgaacagtgct

SEQ ID NO: 130461 - DNA, 16 bp, H. sapiens
tatggtgaagaaggaa

SEQ ID NO: 130462 - DNA, 16 bp, H. sapiens
tatggtgagagagagg

SEQ ID NO: 130463 - DNA, 16 bp, H. sapiens
tatggtgatctgtgat

SEQ ID NO: 130464 - DNA, 16 bp, H. sapiens
tatggtggaaaagcaa

SEQ ID NO: 130465 - DNA, 16 bp, H. sapiens
tatggtggaaaatgaa

SEQ ID NO: 130466 - DNA, 17 bp, H. sapiens
tatggtggctcacacct

SEQ ID NO: 130467 - DNA, 17 bp, H. sapiens
tatggtggctcatgcct

SEQ ID NO: 130468 - DNA, 16 bp, H. sapiens
tatggtggtgatgatg

SEQ ID NO: 130469 - DNA, 16 bp, H. sapiens
tatggttggaatcata

SEQ ID NO: 130470 - DNA, 16 bp, H. sapiens
tatggtttctactgaa

SEQ ID NO: 130471 - DNA, 16 bp, H. sapiens
tatggtttctttgaat

SEQ ID NO: 130472 - DNA, 16 bp, H. sapiens
tatggtttgaatatgt

SEQ ID NO: 130473 - DNA, 16 bp, H. sapiens
tatggtttgattctgt

SEQ ID NO: 130474 - DNA, 16 bp, H. sapiens
tatggtttggatttgc

SEQ ID NO: 130475 - DNA, 16 bp, H. sapiens
tatggttttaaaaatg

SEQ ID NO: 130476 - DNA, 16 bp, H. sapiens
tatggtttttctgtgt

SEQ ID NO: 130477 - DNA, 16 bp, H. sapiens
tatgtaaaaaacctgc

SEQ ID NO: 130478 - DNA, 17 bp, H. sapiens
tatgtaaaaagaccaaa

SEQ ID NO: 130479 - DNA, 16 bp, H. sapiens
tatgtaaaaatacttt

SEQ ID NO: 130480 - DNA, 16 bp, H. sapiens
tatgtaaaaatgaaag

SEQ ID NO: 130481 - DNA, 16 bp, H. sapiens
tatgtaaaaatgcaga

SEQ ID NO: 130482 - DNA, 16 bp, H. sapiens
tatgtaaaataaacat

SEQ ID NO: 130483 - DNA, 16 bp, H. sapiens
tatgtaaaataaatca

SEQ ID NO: 130484 - DNA, 16 bp, H. sapiens
tatgtaaaatatgtat

SEQ ID NO: 130485 - DNA, 16 bp, H. sapiens
tatgtaaacaaatgag

SEQ ID NO: 130486 - DNA, 16 bp, H. sapiens
tatgtaaagaattctt

SEQ ID NO: 130487 - DNA, 16 bp, H. sapiens
tatgtaaagttttctt

SEQ ID NO: 130488 - DNA, 16 bp, H. sapiens
tatgtaaataaagttt

SEQ ID NO: 130489 - DNA, 16 bp, H. sapiens
tatgtaaatatatatg

SEQ ID NO: 130490 - DNA, 16 bp, H. sapiens
tatgtaaatatatgaa

SEQ ID NO: 130491 - DNA, 16 bp, H. sapiens
tatgtaaatatgtatg

SEQ ID NO: 130492 - DNA, 16 bp, H. sapiens
tatgtaaatcattgtt

SEQ ID NO: 130493 - DNA, 16 bp, H. sapiens
tatgtaaatgaatgtg

SEQ ID NO: 130494 - DNA, 16 bp, H. sapiens
tatgtaaatgtatata

SEQ ID NO: 130495 - DNA, 16 bp, H. sapiens
tatgtaaattatgcct

SEQ ID NO: 130496 - DNA, 16 bp, H. sapiens
tatgtaaattttacct

SEQ ID NO: 130497 - DNA, 16 bp, H. sapiens
tatgtaacaaaattgc

SEQ ID NO: 130498 - DNA, 16 bp, H. sapiens
tatgtaacaaacatgc

SEQ ID NO: 130499 - DNA, 16 bp, H. sapiens
tatgtaacatatatgt

SEQ ID NO: 130500 - DNA, 16 bp, H. sapiens
tatgtaacattttaaa

SEQ ID NO: 130501 - DNA, 16 bp, H. sapiens
tatgtaacatttttct

SEQ ID NO: 130502 - DNA, 16 bp, H. sapiens
tatgtaactatttttt

SEQ ID NO: 130503 - DNA, 16 bp, H. sapiens
tatgtaacttaaaatt

SEQ ID NO: 130504 - DNA, 16 bp, H. sapiens
tatgtaagaagtacat

SEQ ID NO: 130505 - DNA, 16 bp, H. sapiens
tatgtaagatgtacat

SEQ ID NO: 130506 - DNA, 16 bp, H. sapiens
tatgtaataatcacat

SEQ ID NO: 130507 - DNA, 16 bp, H. sapiens
tatgtaatatatgtaa

SEQ ID NO: 130508 - DNA, 16 bp, H. sapiens
tatgtaatatgtgtat

SEQ ID NO: 130509 - DNA, 16 bp, H. sapiens
tatgtaatttttaaag

SEQ ID NO: 130510 - DNA, 16 bp, H. sapiens
tatgtacaaatatgta

SEQ ID NO: 130511 - DNA, 16 bp, H. sapiens
tatgtacaacattttc

SEQ ID NO: 130512 - DNA, 16 bp, H. sapiens
tatgtacaagttttta

SEQ ID NO: 130513 - DNA, 16 bp, H. sapiens
tatgtacacttaaaaa

SEQ ID NO: 130514 - DNA, 16 bp, H. sapiens
tatgtacagaaaaaaa

SEQ ID NO: 130515 - DNA, 16 bp, H. sapiens
tatgtacataaatatg

SEQ ID NO: 130516 - DNA, 16 bp, H. sapiens
tatgtacatatatata

SEQ ID NO: 130517 - DNA, 16 bp, H. sapiens
tatgtacattttatat

SEQ ID NO: 130518 - DNA, 16 bp, H. sapiens
tatgtaccacatttgc

SEQ ID NO: 130519 - DNA, 16 bp, H. sapiens
tatgtaccacattttt

SEQ ID NO: 130520 - DNA, 16 bp, H. sapiens
tatgtaccagacacta

SEQ ID NO: 130521 - DNA, 16 bp, H. sapiens
tatgtaccaggctctg

SEQ ID NO: 130522 - DNA, 16 bp, H. sapiens
tatgtaccatgttttc

SEQ ID NO: 130523 - DNA, 16 bp, H. sapiens
tatgtacccaaaggaa

SEQ ID NO: 130524 - DNA, 16 bp, H. sapiens
tatgtacccacaaaaa

SEQ ID NO: 130525 - DNA, 16 bp, H. sapiens
tatgtacgtatatata

SEQ ID NO: 130526 - DNA, 16 bp, H. sapiens
tatgtacttaaaatat

SEQ ID NO: 130527 - DNA, 16 bp, H. sapiens
tatgtagaaaacccca

SEQ ID NO: 130528 - DNA, 16 bp, H. sapiens
tatgtaggagaatgtc

SEQ ID NO: 130529 - DNA, 16 bp, H. sapiens
tatgtagtttttaaaa

SEQ ID NO: 130530 - DNA, 16 bp, H. sapiens
tatgtataagtatata

SEQ ID NO: 130531 - DNA, 16 bp, H. sapiens
tatgtatacatgtata

SEQ ID NO: 130532 - DNA, 16 bp, H. sapiens
tatgtatacatttatt

SEQ ID NO: 130533 - DNA, 16 bp, H. sapiens
tatgtatacatttgta

SEQ ID NO: 130534 - DNA, 16 bp, H. sapiens
tatgtatataacattt

SEQ ID NO: 130535 - DNA, 16 bp, H. sapiens
tatgtatatacaaaaa

SEQ ID NO: 130536 - DNA, 16 bp, H. sapiens
tatgtatatacacaca

SEQ ID NO: 130537 - DNA, 16 bp, H. sapiens
tatgtatatataagaa

SEQ ID NO: 130538 - DNA, 16 bp, H. sapiens
tatgtatatatacatg

SEQ ID NO: 130539 - DNA, 16 bp, H. sapiens
tatgtatatatataca

SEQ ID NO: 130540 - DNA, 16 bp, H. sapiens
tatgtatatatgtgta

SEQ ID NO: 130541 - DNA, 16 bp, H. sapiens
tatgtatatctatata

SEQ ID NO: 130542 - DNA, 16 bp, H. sapiens
tatgtatatgtataaa

SEQ ID NO: 130543 - DNA, 16 bp, H. sapiens
tatgtatatgtcatat

SEQ ID NO: 130544 - DNA, 16 bp, H. sapiens
tatgtatatgtctgta

SEQ ID NO: 130545 - DNA, 16 bp, H. sapiens
tatgtatatgtctgtg

SEQ ID NO: 130546 - DNA, 16 bp, H. sapiens
tatgtatatgtgatat

SEQ ID NO: 130547 - DNA, 16 bp, H. sapiens
tatgtatattctatat

SEQ ID NO: 130548 - DNA, 16 bp, H. sapiens
tatgtatattgcagca

SEQ ID NO: 130549 - DNA, 16 bp, H. sapiens
tatgtatattttatca

SEQ ID NO: 130550 - DNA, 16 bp, H. sapiens
tatgtatcaataataa

SEQ ID NO: 130551 - DNA, 16 bp, H. sapiens
tatgtatctagaaatt

SEQ ID NO: 130552 - DNA, 16 bp, H. sapiens
tatgtatctatttatt

SEQ ID NO: 130553 - DNA, 16 bp, H. sapiens
tatgtatctgtatcta

SEQ ID NO: 130554 - DNA, 16 bp, H. sapiens
tatgtatctgtgtgtg

SEQ ID NO: 130555 - DNA, 16 bp, H. sapiens
tatgtatctttataat

SEQ ID NO: 130556 - DNA, 16 bp, H. sapiens
tatgtatgatatatat

SEQ ID NO: 130557 - DNA, 16 bp, H. sapiens
tatgtatgcatatatt

SEQ ID NO: 130558 - DNA, 16 bp, H. sapiens
tatgtatgtagatata

SEQ ID NO: 130559 - DNA, 16 bp, H. sapiens
tatgtatgtataaata

SEQ ID NO: 130560 - DNA, 16 bp, H. sapiens
tatgtatgtatgtatc

SEQ ID NO: 130561 - DNA, 16 bp, H. sapiens
tatgtatgtatgtatt

SEQ ID NO: 130562 - DNA, 16 bp, H. sapiens
tatgtatgtgtaaata

SEQ ID NO: 130563 - DNA, 16 bp, H. sapiens
tatgtatgtgtacata

SEQ ID NO: 130564 - DNA, 16 bp, H. sapiens
tatgtatgtgtgcaca

SEQ ID NO: 130565 - DNA, 16 bp, H. sapiens
tatgtatgttatactt

SEQ ID NO: 130566 - DNA, 16 bp, H. sapiens
tatgtattatctcaca

SEQ ID NO: 130567 - DNA, 16 bp, H. sapiens
tatgtattatgtatgt

SEQ ID NO: 130568 - DNA, 16 bp, H. sapiens
tatgtattattttcta

SEQ ID NO: 130569 - DNA, 16 bp, H. sapiens
tatgtattctttaaaa

SEQ ID NO: 130570 - DNA, 16 bp, H. sapiens
tatgtattgtaaatat

SEQ ID NO: 130571 - DNA, 16 bp, H. sapiens
tatgtatttaaaaaca

SEQ ID NO: 130572 - DNA, 16 bp, H. sapiens
tatgtatttacatata

SEQ ID NO: 130573 - DNA, 16 bp, H. sapiens
tatgtatttatcattt

SEQ ID NO: 130574 - DNA, 16 bp, H. sapiens
tatgtatttcatcttt

SEQ ID NO: 130575 - DNA, 16 bp, H. sapiens
tatgtatttgtaaaaa

SEQ ID NO: 130576 - DNA, 16 bp, H. sapiens
tatgtatttttctaat

SEQ ID NO: 130577 - DNA, 16 bp, H. sapiens
tatgtcaaagggacac

SEQ ID NO: 130578 - DNA, 16 bp, H. sapiens
tatgtcaagtaatttt

SEQ ID NO: 130579 - DNA, 16 bp, H. sapiens
tatgtcaggaaacagg

SEQ ID NO: 130580 - DNA, 16 bp, H. sapiens
tatgtcagtatgttca

SEQ ID NO: 130581 - DNA, 16 bp, H. sapiens
tatgtcatatatatgt

SEQ ID NO: 130582 - DNA, 16 bp, H. sapiens
tatgtcattaaacatc

SEQ ID NO: 130583 - DNA, 16 bp, H. sapiens
tatgtcattatttatt

SEQ ID NO: 130584 - DNA, 16 bp, H. sapiens
tatgtcatttaaaatt

SEQ ID NO: 130585 - DNA, 16 bp, H. sapiens
tatgtcatttatttat

SEQ ID NO: 130586 - DNA, 16 bp, H. sapiens
tatgtcatttcatttc

SEQ ID NO: 130587 - DNA, 16 bp, H. sapiens
tatgtccaaaggaaat

SEQ ID NO: 130588 - DNA, 16 bp, H. sapiens
tatgtccattttaatg

SEQ ID NO: 130589 - DNA, 16 bp, H. sapiens
tatgtctacacaaaac

SEQ ID NO: 130590 - DNA, 16 bp, H. sapiens
tatgtctattttatat

SEQ ID NO: 130591 - DNA, 16 bp, H. sapiens
tatgtctgaagaacaa

SEQ ID NO: 130592 - DNA, 16 bp, H. sapiens
tatgtctgtgtgtttg

SEQ ID NO: 130593 - DNA, 16 bp, H. sapiens
tatgtctgttttcatg

SEQ ID NO: 130594 - DNA, 16 bp, H. sapiens
tatgtcttcaaaagtt

SEQ ID NO: 130595 - DNA, 16 bp, H. sapiens
tatgtcttctgagaaa

SEQ ID NO: 130596 - DNA, 16 bp, H. sapiens
tatgtctttatcagca

SEQ ID NO: 130597 - DNA, 16 bp, H. sapiens
tatgtctttattagca

SEQ ID NO: 130598 - DNA, 16 bp, H. sapiens
tatgtctttggaaaaa

SEQ ID NO: 130599 - DNA, 16 bp, H. sapiens
tatgtctttggttttg

SEQ ID NO: 130600 - DNA, 16 bp, H. sapiens
tatgtctttgtgtcct

SEQ ID NO: 130601 - DNA, 16 bp, H. sapiens
tatgtctttttaatat

SEQ ID NO: 130602 - DNA, 16 bp, H. sapiens
tatgtctttttttaaa

SEQ ID NO: 130603 - DNA, 16 bp, H. sapiens
tatgtgaaaagaaaat

SEQ ID NO: 130604 - DNA, 16 bp, H. sapiens
tatgtgaaaataaatt

SEQ ID NO: 130605 - DNA, 16 bp, H. sapiens
tatgtgaaatataaat

SEQ ID NO: 130606 - DNA, 16 bp, H. sapiens
tatgtgaattatgtct

SEQ ID NO: 130607 - DNA, 16 bp, H. sapiens
tatgtgaattatttca

SEQ ID NO: 130608 - DNA, 16 bp, H. sapiens
tatgtgaattttagaa

SEQ ID NO: 130609 - DNA, 16 bp, H. sapiens
tatgtgaatttttaaa

SEQ ID NO: 130610 - DNA, 16 bp, H. sapiens
tatgtgaccttggaaa

SEQ ID NO: 130611 - DNA, 17 bp, H. sapiens
tatgtgagggacaaacc

SEQ ID NO: 130612 - DNA, 16 bp, H. sapiens
tatgtgagtgacaaac

SEQ ID NO: 130613 - DNA, 16 bp, H. sapiens
tatgtgatcaataaat

SEQ ID NO: 130614 - DNA, 16 bp, H. sapiens
tatgtgatcgatttta

SEQ ID NO: 130615 - DNA, 16 bp, H. sapiens
tatgtgattgatttta

SEQ ID NO: 130616 - DNA, 16 bp, H. sapiens
tatgtgcacacacaca

SEQ ID NO: 130617 - DNA, 16 bp, H. sapiens
tatgtgcagtttattg

SEQ ID NO: 130618 - DNA, 16 bp, H. sapiens
tatgtgcatgtatctt

SEQ ID NO: 130619 - DNA, 16 bp, H. sapiens
tatgtgccaaacactg

SEQ ID NO: 130620 - DNA, 16 bp, H. sapiens
tatgtgccaggcacta

SEQ ID NO: 130621 - DNA, 16 bp, H. sapiens
tatgtgccaggccctg

SEQ ID NO: 130622 - DNA, 16 bp, H. sapiens
tatgtgcctgtgtgtg

SEQ ID NO: 130623 - DNA, 16 bp, H. sapiens
tatgtgcctgtttttt

SEQ ID NO: 130624 - DNA, 16 bp, H. sapiens
tatgtgctagacactg

SEQ ID NO: 130625 - DNA, 16 bp, H. sapiens
tatgtgctaggcactg

SEQ ID NO: 130626 - DNA, 16 bp, H. sapiens
tatgtgctgggcattg

SEQ ID NO: 130627 - DNA, 16 bp, H. sapiens
tatgtgcttccaaaat

SEQ ID NO: 130628 - DNA, 16 bp, H. sapiens
tatgtggaaaggcaaa

SEQ ID NO: 130629 - DNA, 16 bp, H. sapiens
tatgtggaatttttaa

SEQ ID NO: 130630 - DNA, 16 bp, H. sapiens
tatgtggactcttttt

SEQ ID NO: 130631 - DNA, 16 bp, H. sapiens
tatgtggcacatgact

SEQ ID NO: 130632 - DNA, 17 bp, H. sapiens
tatgtggcacattttct

SEQ ID NO: 130633 - DNA, 16 bp, H. sapiens
tatgtggcagacactg

SEQ ID NO: 130634 - DNA, 16 bp, H. sapiens
tatgtggcttttatta

SEQ ID NO: 130635 - DNA, 16 bp, H. sapiens
tatgtgggaactctct

SEQ ID NO: 130636 - DNA, 16 bp, H. sapiens
tatgtgggtaaatata

SEQ ID NO: 130637 - DNA, 16 bp, H. sapiens
tatgtgggtttatttc

SEQ ID NO: 130638 - DNA, 16 bp, H. sapiens
tatgtggtccatcatt

SEQ ID NO: 130639 - DNA, 16 bp, H. sapiens
tatgtggtctttgtga

SEQ ID NO: 130640 - DNA, 16 bp, H. sapiens
tatgtgtaatatacat

SEQ ID NO: 130641 - DNA, 16 bp, H. sapiens
tatgtgtaatatatat

SEQ ID NO: 130642 - DNA, 16 bp, H. sapiens
tatgtgtacatacaca

SEQ ID NO: 130643 - DNA, 16 bp, H. sapiens
tatgtgtacatatata

SEQ ID NO: 130644 - DNA, 16 bp, H. sapiens
tatgtgtacatgcatg

SEQ ID NO: 130645 - DNA, 16 bp, H. sapiens
tatgtgtatacatata

SEQ ID NO: 130646 - DNA, 16 bp, H. sapiens
tatgtgtataccacat

SEQ ID NO: 130647 - DNA, 16 bp, H. sapiens
tatgtgtatatatgtt

SEQ ID NO: 130648 - DNA, 16 bp, H. sapiens
tatgtgtatatgcatg

SEQ ID NO: 130649 - DNA, 16 bp, H. sapiens
tatgtgtatatgtgtg

SEQ ID NO: 130650 - DNA, 16 bp, H. sapiens
tatgtgtatgcaaata

SEQ ID NO: 130651 - DNA, 16 bp, H. sapiens
tatgtgtatgtaaata

SEQ ID NO: 130652 - DNA, 16 bp, H. sapiens
tatgtgtatgtacata

SEQ ID NO: 130653 - DNA, 16 bp, H. sapiens
tatgtgtatgtgcatg

SEQ ID NO: 130654 - DNA, 16 bp, H. sapiens
tatgtgtatgtgcgtg

SEQ ID NO: 130655 - DNA, 16 bp, H. sapiens
tatgtgtatgtgtgtc

SEQ ID NO: 130656 - DNA, 16 bp, H. sapiens
tatgtgtattatgtat

SEQ ID NO: 130657 - DNA, 16 bp, H. sapiens
tatgtgtatttataaa

SEQ ID NO: 130658 - DNA, 16 bp, H. sapiens
tatgtgtatttatgta

SEQ ID NO: 130659 - DNA, 16 bp, H. sapiens
tatgtgtatttgtgta

SEQ ID NO: 130660 - DNA, 16 bp, H. sapiens
tatgtgtcaggcattt

SEQ ID NO: 130661 - DNA, 16 bp, H. sapiens
tatgtgtgaatgtgtg

SEQ ID NO: 130662 - DNA, 16 bp, H. sapiens
tatgtgtgcatgagtg

SEQ ID NO: 130663 - DNA, 16 bp, H. sapiens
tatgtgtgcctgtgtc

SEQ ID NO: 130664 - DNA, 16 bp, H. sapiens
tatgtgtgcctttata

SEQ ID NO: 130665 - DNA, 16 bp, H. sapiens
tatgtgtggtgtgtgc

SEQ ID NO: 130666 - DNA, 16 bp, H. sapiens
tatgtgtgtatattca

SEQ ID NO: 130667 - DNA, 16 bp, H. sapiens
tatgtgtgtatgtata

SEQ ID NO: 130668 - DNA, 16 bp, H. sapiens
tatgtgtgtatgtgaa

SEQ ID NO: 130669 - DNA, 16 bp, H. sapiens
tatgtgtgtctttaat

SEQ ID NO: 130670 - DNA, 16 bp, H. sapiens
tatgtgtgtgactgtg

SEQ ID NO: 130671 - DNA, 16 bp, H. sapiens
tatgtgtgtgtatgtc

SEQ ID NO: 130672 - DNA, 16 bp, H. sapiens
tatgtgtgtgtatgtg

SEQ ID NO: 130673 - DNA, 16 bp, H. sapiens
tatgtgtgtgtctgtg

SEQ ID NO: 130674 - DNA, 16 bp, H. sapiens
tatgtgtgtgtgcaca

SEQ ID NO: 130675 - DNA, 16 bp, H. sapiens
tatgtgtgtgtgcatg

SEQ ID NO: 130676 - DNA, 16 bp, H. sapiens
tatgtgtgtgtgcatt

SEQ ID NO: 130677 - DNA, 16 bp, H. sapiens
tatgtgtgtgtgtgaa

SEQ ID NO: 130678 - DNA, 16 bp, H. sapiens
tatgtgtgtgtgtgcg

SEQ ID NO: 130679 - DNA, 16 bp, H. sapiens
tatgtgtgtgtgtgtc

SEQ ID NO: 130680 - DNA, 16 bp, H. sapiens
tatgtgtgttttaaaa

SEQ ID NO: 130681 - DNA, 16 bp, H. sapiens
tatgtgttaaataaat

SEQ ID NO: 130682 - DNA, 16 bp, H. sapiens
tatgtgtttctgttta

SEQ ID NO: 130683 - DNA, 16 bp, H. sapiens
tatgtgttttacattt

SEQ ID NO: 130684 - DNA, 16 bp, H. sapiens
tatgttaaataaaaca

SEQ ID NO: 130685 - DNA, 16 bp, H. sapiens
tatgttaaataagagt

SEQ ID NO: 130686 - DNA, 16 bp, H. sapiens
tatgttaacttatttt

SEQ ID NO: 130687 - DNA, 16 bp, H. sapiens
tatgttaagtcacaaa

SEQ ID NO: 130688 - DNA, 16 bp, H. sapiens
tatgttaattatacct

SEQ ID NO: 130689 - DNA, 16 bp, H. sapiens
tatgttaattctatgt

SEQ ID NO: 130690 - DNA, 16 bp, H. sapiens
tatgttacatttattt

SEQ ID NO: 130691 - DNA, 16 bp, H. sapiens
tatgttacatttttat

SEQ ID NO: 130692 - DNA, 16 bp, H. sapiens
tatgttattgatgtca

SEQ ID NO: 130693 - DNA, 16 bp, H. sapiens
tatgttattggtaagg

SEQ ID NO: 130694 - DNA, 16 bp, H. sapiens
tatgttccaggcattg

SEQ ID NO: 130695 - DNA, 16 bp, H. sapiens
tatgttctaaatattt

SEQ ID NO: 130696 - DNA, 16 bp, H. sapiens
tatgttctataaagtt

SEQ ID NO: 130697 - DNA, 16 bp, H. sapiens
tatgttctcaataaat

SEQ ID NO: 130698 - DNA, 16 bp, H. sapiens
tatgttcttcagggat

SEQ ID NO: 130699 - DNA, 16 bp, H. sapiens
tatgttgaaacctaat

SEQ ID NO: 130700 - DNA, 16 bp, H. sapiens
tatgttgaaatactaa

SEQ ID NO: 130701 - DNA, 16 bp, H. sapiens
tatgttgaaatcctaa

SEQ ID NO: 130702 - DNA, 16 bp, H. sapiens
tatgttgaagtcttaa

SEQ ID NO: 130703 - DNA, 16 bp, H. sapiens
tatgttgaggtatttt

SEQ ID NO: 130704 - DNA, 16 bp, H. sapiens
tatgttgcccagacta

SEQ ID NO: 130705 - DNA, 16 bp, H. sapiens
tatgttgcccaggctc

SEQ ID NO: 130706 - DNA, 16 bp, H. sapiens
tatgttgcccagggtg

SEQ ID NO: 130707 - DNA, 16 bp, H. sapiens
tatgttgcccaggttg

SEQ ID NO: 130708 - DNA, 16 bp, H. sapiens
tatgttgcccgggctg

SEQ ID NO: 130709 - DNA, 16 bp, H. sapiens
tatgttgcctaggctg

SEQ ID NO: 130710 - DNA, 16 bp, H. sapiens
tatgttgctcaggctg

SEQ ID NO: 130711 - DNA, 16 bp, H. sapiens
tatgttggctgtgagt

SEQ ID NO: 130712 - DNA, 16 bp, H. sapiens
tatgttgtctataaga

SEQ ID NO: 130713 - DNA, 16 bp, H. sapiens
tatgtttaaagtaatt

SEQ ID NO: 130714 - DNA, 16 bp, H. sapiens
tatgtttaagacttta

SEQ ID NO: 130715 - DNA, 16 bp, H. sapiens
tatgtttacaattgtt

SEQ ID NO: 130716 - DNA, 16 bp, H. sapiens
tatgtttaccttttta

SEQ ID NO: 130717 - DNA, 16 bp, H. sapiens
tatgtttacttttata

SEQ ID NO: 130718 - DNA, 16 bp, H. sapiens
tatgtttagatatgca

SEQ ID NO: 130719 - DNA, 16 bp, H. sapiens
tatgtttatccaaaag

SEQ ID NO: 130720 - DNA, 16 bp, H. sapiens
tatgtttatcgcggca

SEQ ID NO: 130721 - DNA, 16 bp, H. sapiens
tatgtttatcttttaa

SEQ ID NO: 130722 - DNA, 16 bp, H. sapiens
tatgtttattacggca

SEQ ID NO: 130723 - DNA, 16 bp, H. sapiens
tatgtttattgcggca

SEQ ID NO: 130724 - DNA, 16 bp, H. sapiens
tatgtttattgtggca

SEQ ID NO: 130725 - DNA, 16 bp, H. sapiens
tatgtttccatgtgtt

SEQ ID NO: 130726 - DNA, 16 bp, H. sapiens
tatgtttccatttctc

SEQ ID NO: 130727 - DNA, 16 bp, H. sapiens
tatgtttctagaaatt

SEQ ID NO: 130728 - DNA, 16 bp, H. sapiens
tatgtttctctccacc

SEQ ID NO: 130729 - DNA, 16 bp, H. sapiens
tatgtttctctggaga

SEQ ID NO: 130730 - DNA, 16 bp, H. sapiens
tatgtttctttttaaa

SEQ ID NO: 130731 - DNA, 16 bp, H. sapiens
tatgtttgtcaggctg

SEQ ID NO: 130732 - DNA, 16 bp, H. sapiens
tatgtttgtgagattt

SEQ ID NO: 130733 - DNA, 16 bp, H. sapiens
tatgtttgtgtctgtg

SEQ ID NO: 130734 - DNA, 16 bp, H. sapiens
tatgttttaaatatct

SEQ ID NO: 130735 - DNA, 16 bp, H. sapiens
tatgttttaagaaaaa

SEQ ID NO: 130736 - DNA, 16 bp, H. sapiens
tatgttttatatacat

SEQ ID NO: 130737 - DNA, 16 bp, H. sapiens
tatgttttattcatct

SEQ ID NO: 130738 - DNA, 16 bp, H. sapiens
tatgttttcagaaatt

SEQ ID NO: 130739 - DNA, 16 bp, H. sapiens
tatgttttcatttgct

SEQ ID NO: 130740 - DNA, 16 bp, H. sapiens
tatgttttccaaactt

SEQ ID NO: 130741 - DNA, 16 bp, H. sapiens
tatgttttcttccaga

SEQ ID NO: 130742 - DNA, 16 bp, H. sapiens
tatgttttgaaatcag

SEQ ID NO: 130743 - DNA, 16 bp, H. sapiens
tatgttttggctgtgt

SEQ ID NO: 130744 - DNA, 16 bp, H. sapiens
tatgttttgtagagac

SEQ ID NO: 130745 - DNA, 16 bp, H. sapiens
tatgttttgtttccat

SEQ ID NO: 130746 - DNA, 16 bp, H. sapiens
tatgtttttaaaaagt

SEQ ID NO: 130747 - DNA, 16 bp, H. sapiens
tatgtttttaaagata

SEQ ID NO: 130748 - DNA, 16 bp, H. sapiens
tatgtttttcaaaata

SEQ ID NO: 130749 - DNA, 16 bp, H. sapiens
tatgttttttaaaaag

SEQ ID NO: 130750 - DNA, 16 bp, H. sapiens
tatgttttttcttaaa

SEQ ID NO: 130751 - DNA, 16 bp, H. sapiens
tattaaaaaatgtaca

SEQ ID NO: 130752 - DNA, 16 bp, H. sapiens
tattaaaaacagattt

SEQ ID NO: 130753 - DNA, 16 bp, H. sapiens
tattaaaaagtaaaca

SEQ ID NO: 130754 - DNA, 16 bp, H. sapiens
tattaaaaagtcacaa

SEQ ID NO: 130755 - DNA, 16 bp, H. sapiens
tattaaaaagtctaaa

SEQ ID NO: 130756 - DNA, 16 bp, H. sapiens
tattaaaaatagcaaa

SEQ ID NO: 130757 - DNA, 16 bp, H. sapiens
tattaaaaatgcaaaa

SEQ ID NO: 130758 - DNA, 16 bp, H. sapiens
tattaaaaatgcagat

SEQ ID NO: 130759 - DNA, 16 bp, H. sapiens
tattaaaacacacata

SEQ ID NO: 130760 - DNA, 16 bp, H. sapiens
tattaaaacagaaaat

SEQ ID NO: 130761 - DNA, 16 bp, H. sapiens
tattaaaacagtattt

SEQ ID NO: 130762 - DNA, 16 bp, H. sapiens
tattaaaactgataaa

SEQ ID NO: 130763 - DNA, 16 bp, H. sapiens
tattaaaaggattata

SEQ ID NO: 130764 - DNA, 16 bp, H. sapiens
tattaaaatagaaaca

SEQ ID NO: 130765 - DNA, 16 bp, H. sapiens
tattaaaatgactatt

SEQ ID NO: 130766 - DNA, 16 bp, H. sapiens
tattaaaatgtatgta

SEQ ID NO: 130767 - DNA, 16 bp, H. sapiens
tattaaaatgtctaaa

SEQ ID NO: 130768 - DNA, 16 bp, H. sapiens
tattaaaattccaatg

SEQ ID NO: 130769 - DNA, 16 bp, H. sapiens
tattaaacacattact

SEQ ID NO: 130770 - DNA, 16 bp, H. sapiens
tattaaacatttacca

SEQ ID NO: 130771 - DNA, 16 bp, H. sapiens
tattaaagaaaacatt

SEQ ID NO: 130772 - DNA, 16 bp, H. sapiens
tattaaagaaactgaa

SEQ ID NO: 130773 - DNA, 16 bp, H. sapiens
tattaaagagactgtt

SEQ ID NO: 130774 - DNA, 16 bp, H. sapiens
tattaaagattacaca

SEQ ID NO: 130775 - DNA, 16 bp, H. sapiens
tattaaaggagaagaa

SEQ ID NO: 130776 - DNA, 16 bp, H. sapiens
tattaaaggcattcag

SEQ ID NO: 130777 - DNA, 16 bp, H. sapiens
tattaaataagatgtc

SEQ ID NO: 130778 - DNA, 16 bp, H. sapiens
tattaaatactgtatt

SEQ ID NO: 130779 - DNA, 16 bp, H. sapiens
tattaaatatttcagt

SEQ ID NO: 130780 - DNA, 16 bp, H. sapiens
tattaaatcttctgat

SEQ ID NO: 130781 - DNA, 16 bp, H. sapiens
tattaaatgaaaaaca

SEQ ID NO: 130782 - DNA, 16 bp, H. sapiens
tattaaatgtgcaata

SEQ ID NO: 130783 - DNA, 16 bp, H. sapiens
tattaaatgtttcttt

SEQ ID NO: 130784 - DNA, 16 bp, H. sapiens
tattaacaacagaaat

SEQ ID NO: 130785 - DNA, 16 bp, H. sapiens
tattaacaagtcaaaa

SEQ ID NO: 130786 - DNA, 16 bp, H. sapiens
tattaacccatcacct

SEQ ID NO: 130787 - DNA, 16 bp, H. sapiens
tattaaccctttatca

SEQ ID NO: 130788 - DNA, 16 bp, H. sapiens
tattaacctgaaatgt

SEQ ID NO: 130789 - DNA, 16 bp, H. sapiens
tattaactacactaga

SEQ ID NO: 130790 - DNA, 16 bp, H. sapiens
tattaactcattgaat

SEQ ID NO: 130791 - DNA, 16 bp, H. sapiens
tattaactcatttgat

SEQ ID NO: 130792 - DNA, 16 bp, H. sapiens
tattaactccatttta

SEQ ID NO: 130793 - DNA, 16 bp, H. sapiens
tattaactctttatca

SEQ ID NO: 130794 - DNA, 16 bp, H. sapiens
tattaactgaagaaaa

SEQ ID NO: 130795 - DNA, 16 bp, H. sapiens
tattaagaaaatcaca

SEQ ID NO: 130796 - DNA, 16 bp, H. sapiens
tattaagaggtggagc

SEQ ID NO: 130797 - DNA, 16 bp, H. sapiens
tattaagcacttactc

SEQ ID NO: 130798 - DNA, 16 bp, H. sapiens
tattaagcctagtacc

SEQ ID NO: 130799 - DNA, 16 bp, H. sapiens
tattaaggaattattt

SEQ ID NO: 130800 - DNA, 16 bp, H. sapiens
tattaagtggaagtgg

SEQ ID NO: 130801 - DNA, 16 bp, H. sapiens
tattaagtgttcaata

SEQ ID NO: 130802 - DNA, 16 bp, H. sapiens
tattaatagtaacaat

SEQ ID NO: 130803 - DNA, 16 bp, H. sapiens
tattaatagttcattt

SEQ ID NO: 130804 - DNA, 16 bp, H. sapiens
tattaatatagctatt

SEQ ID NO: 130805 - DNA, 16 bp, H. sapiens
tattaatatatgcatt

SEQ ID NO: 130806 - DNA, 16 bp, H. sapiens
tattaatattttggaa

SEQ ID NO: 130807 - DNA, 16 bp, H. sapiens
tattaatcatgttttt

SEQ ID NO: 130808 - DNA, 16 bp, H. sapiens
tattaatcctttgtca

SEQ ID NO: 130809 - DNA, 16 bp, H. sapiens
tattaatcttttgtca

SEQ ID NO: 130810 - DNA, 16 bp, H. sapiens
tattaatgaaattgaa

SEQ ID NO: 130811 - DNA, 16 bp, H. sapiens
tattaatggacattta

SEQ ID NO: 130812 - DNA, 16 bp, H. sapiens
tattaatgtgatgtat

SEQ ID NO: 130813 - DNA, 16 bp, H. sapiens
tattaatgttaatttc

SEQ ID NO: 130814 - DNA, 16 bp, H. sapiens
tattaattactttggg

SEQ ID NO: 130815 - DNA, 16 bp, H. sapiens
tattaattcttctgat

SEQ ID NO: 130816 - DNA, 16 bp, H. sapiens
tattaatttggggaaa

SEQ ID NO: 130817 - DNA, 16 bp, H. sapiens
tattacaaaagaagaa

SEQ ID NO: 130818 - DNA, 16 bp, H. sapiens
tattacaaacaatatt

SEQ ID NO: 130819 - DNA, 16 bp, H. sapiens
tattacaaataaagct

SEQ ID NO: 130820 - DNA, 16 bp, H. sapiens
tattacaaatgaaaaa

SEQ ID NO: 130821 - DNA, 16 bp, H. sapiens
tattacaaatgaggaa

SEQ ID NO: 130822 - DNA, 16 bp, H. sapiens
tattacacattttaaa

SEQ ID NO: 130823 - DNA, 16 bp, H. sapiens
tattacagaaataaat

SEQ ID NO: 130824 - DNA, 16 bp, H. sapiens
tattacagatgaagaa

SEQ ID NO: 130825 - DNA, 16 bp, H. sapiens
tattacaggaaaagaa

SEQ ID NO: 130826 - DNA, 16 bp, H. sapiens
tattacaggagtgagc

SEQ ID NO: 130827 - DNA, 18 bp, H. sapiens
tattacaggtgtgagcca

SEQ ID NO: 130828 - DNA, 16 bp, H. sapiens
tattacagtatttttt

SEQ ID NO: 130829 - DNA, 16 bp, H. sapiens
tattacatgaaaaata

SEQ ID NO: 130830 - DNA, 16 bp, H. sapiens
tattaccacattttct

SEQ ID NO: 130831 - DNA, 17 bp, H. sapiens
tattaccattcaggaca

SEQ ID NO: 130832 - DNA, 16 bp, H. sapiens
tattacccaagctgga

SEQ ID NO: 130833 - DNA, 16 bp, H. sapiens
tattacccctatttta

SEQ ID NO: 130834 - DNA, 16 bp, H. sapiens
tattacctgagtgaca

SEQ ID NO: 130835 - DNA, 16 bp, H. sapiens
tattacctttaaaaaa

SEQ ID NO: 130836 - DNA, 16 bp, H. sapiens
tattactcaagaaata

SEQ ID NO: 130837 - DNA, 16 bp, H. sapiens
tattactcccatttta

SEQ ID NO: 130838 - DNA, 16 bp, H. sapiens
tattactgaaagaggc

SEQ ID NO: 130839 - DNA, 16 bp, H. sapiens
tattactgaataatat

SEQ ID NO: 130840 - DNA, 16 bp, H. sapiens
tattactgcctcagtt

SEQ ID NO: 130841 - DNA, 16 bp, H. sapiens
tattactgctctcatg

SEQ ID NO: 130842 - DNA, 16 bp, H. sapiens
tattactgtctttatt

SEQ ID NO: 130843 - DNA, 16 bp, H. sapiens
tattactttaagaaaa

SEQ ID NO: 130844 - DNA, 16 bp, H. sapiens
tattactttgtaatat

SEQ ID NO: 130845 - DNA, 16 bp, H. sapiens
tattagaaacatttaa

SEQ ID NO: 130846 - DNA, 16 bp, H. sapiens
tattagaaacattttt

SEQ ID NO: 130847 - DNA, 16 bp, H. sapiens
tattagaaagtgaaaa

SEQ ID NO: 130848 - DNA, 16 bp, H. sapiens
tattagaaatgaagaa

SEQ ID NO: 130849 - DNA, 16 bp, H. sapiens
tattagaattttgaaa

SEQ ID NO: 130850 - DNA, 16 bp, H. sapiens
tattagacaaaacaga

SEQ ID NO: 130851 - DNA, 16 bp, H. sapiens
tattagcaatgaacaa

SEQ ID NO: 130852 - DNA, 16 bp, H. sapiens
tattagccaagatggt

SEQ ID NO: 130853 - DNA, 16 bp, H. sapiens
tattagcctgtaattt

SEQ ID NO: 130854 - DNA, 16 bp, H. sapiens
tattaggcatcagaga

SEQ ID NO: 130855 - DNA, 16 bp, H. sapiens
tattaggtacatatat

SEQ ID NO: 130856 - DNA, 16 bp, H. sapiens
tattagtcaaggttct

SEQ ID NO: 130857 - DNA, 16 bp, H. sapiens
tattagtcagggttct

SEQ ID NO: 130858 - DNA, 16 bp, H. sapiens
tattagtccattttca

SEQ ID NO: 130859 - DNA, 16 bp, H. sapiens
tattagtccgttttca

SEQ ID NO: 130860 - DNA, 16 bp, H. sapiens
tattagtctgttctca

SEQ ID NO: 130861 - DNA, 16 bp, H. sapiens
tattagtctgttttca

SEQ ID NO: 130862 - DNA, 16 bp, H. sapiens
tattagttcattttca

SEQ ID NO: 130863 - DNA, 16 bp, H. sapiens
tattataaacaacact

SEQ ID NO: 130864 - DNA, 16 bp, H. sapiens
tattataaaggataca

SEQ ID NO: 130865 - DNA, 16 bp, H. sapiens
tattataaataatgct

SEQ ID NO: 130866 - DNA, 16 bp, H. sapiens
tattataaatggtatt

SEQ ID NO: 130867 - DNA, 16 bp, H. sapiens
tattatacacacacac

SEQ ID NO: 130868 - DNA, 16 bp, H. sapiens
tattatacatacacat

SEQ ID NO: 130869 - DNA, 16 bp, H. sapiens
tattataccaaaaaga

SEQ ID NO: 130870 - DNA, 18 bp, H. sapiens
tattatactggaacagct

SEQ ID NO: 130871 - DNA, 16 bp, H. sapiens
tattatatactgtatt

SEQ ID NO: 130872 - DNA, 16 bp, H. sapiens
tattatatatgatcat

SEQ ID NO: 130873 - DNA, 16 bp, H. sapiens
tattatatcaaaaaga

SEQ ID NO: 130874 - DNA, 16 bp, H. sapiens
tattatatcacaatat

SEQ ID NO: 130875 - DNA, 16 bp, H. sapiens
tattatatgctgtatt

SEQ ID NO: 130876 - DNA, 16 bp, H. sapiens
tattatatgtacatat

SEQ ID NO: 130877 - DNA, 16 bp, H. sapiens
tattatatgtagatat

SEQ ID NO: 130878 - DNA, 16 bp, H. sapiens
tattatcacaccactg

SEQ ID NO: 130879 - DNA, 16 bp, H. sapiens
tattatcaccatcatt

SEQ ID NO: 130880 - DNA, 16 bp, H. sapiens
tattatcagtattatt

SEQ ID NO: 130881 - DNA, 16 bp, H. sapiens
tattatcattacattg

SEQ ID NO: 130882 - DNA, 16 bp, H. sapiens
tattatcattcagttc

SEQ ID NO: 130883 - DNA, 16 bp, H. sapiens
tattatcattcttgct

SEQ ID NO: 130884 - DNA, 16 bp, H. sapiens
tattatccaggctggt

SEQ ID NO: 130885 - DNA, 16 bp, H. sapiens
tattatcccatttaat

SEQ ID NO: 130886 - DNA, 16 bp, H. sapiens
tattatccctatttta

SEQ ID NO: 130887 - DNA, 16 bp, H. sapiens
tattatcctcattttg

SEQ ID NO: 130888 - DNA, 16 bp, H. sapiens
tattatcgttattatt

SEQ ID NO: 130889 - DNA, 16 bp, H. sapiens
tattatctgaatttta

SEQ ID NO: 130890 - DNA, 16 bp, H. sapiens
tattatgaaaaacttt

SEQ ID NO: 130891 - DNA, 16 bp, H. sapiens
tattatgaatgagatt

SEQ ID NO: 130892 - DNA, 16 bp, H. sapiens
tattatgcagctatta

SEQ ID NO: 130893 - DNA, 16 bp, H. sapiens
tattatgcaggtgggt

SEQ ID NO: 130894 - DNA, 16 bp, H. sapiens
tattatgcatatataa

SEQ ID NO: 130895 - DNA, 16 bp, H. sapiens
tattatgtaagaaaat

SEQ ID NO: 130896 - DNA, 16 bp, H. sapiens
tattatgtacatatat

SEQ ID NO: 130897 - DNA, 16 bp, H. sapiens
tattatgttgagtgaa

SEQ ID NO: 130898 - DNA, 16 bp, H. sapiens
tattatgttgatgtat

SEQ ID NO: 130899 - DNA, 16 bp, H. sapiens
tattattaaaaagaca

SEQ ID NO: 130900 - DNA, 16 bp, H. sapiens
tattattatttcaaag

SEQ ID NO: 130901 - DNA, 16 bp, H. sapiens
tattattcagtcacaa

SEQ ID NO: 130902 - DNA, 16 bp, H. sapiens
tattattcctatttca

SEQ ID NO: 130903 - DNA, 16 bp, H. sapiens
tattattctgtccctg

SEQ ID NO: 130904 - DNA, 16 bp, H. sapiens
tattattgaagaaaat

SEQ ID NO: 130905 - DNA, 16 bp, H. sapiens
tattattgactataat

SEQ ID NO: 130906 - DNA, 16 bp, H. sapiens
tattattgactatagc

SEQ ID NO: 130907 - DNA, 16 bp, H. sapiens
tattattgagaaaatt

SEQ ID NO: 130908 - DNA, 16 bp, H. sapiens
tattattgataagtaa

SEQ ID NO: 130909 - DNA, 16 bp, H. sapiens
tattattgctgttatt

SEQ ID NO: 130910 - DNA, 16 bp, H. sapiens
tattattggacattta

SEQ ID NO: 130911 - DNA, 16 bp, H. sapiens
tattattggctgtaca

SEQ ID NO: 130912 - DNA, 16 bp, H. sapiens
tattattgtgtgagag

SEQ ID NO: 130913 - DNA, 16 bp, H. sapiens
tattatttaaggaata

SEQ ID NO: 130914 - DNA, 16 bp, H. sapiens
tattatttcctaaaat

SEQ ID NO: 130915 - DNA, 16 bp, H. sapiens
tattatttctccttca

SEQ ID NO: 130916 - DNA, 16 bp, H. sapiens
tattatttctttgaat

SEQ ID NO: 130917 - DNA, 16 bp, H. sapiens
tattatttgccatttt

SEQ ID NO: 130918 - DNA, 16 bp, H. sapiens
tattatttggaataaa

SEQ ID NO: 130919 - DNA, 16 bp, H. sapiens
tattatttgttgaaaa

SEQ ID NO: 130920 - DNA, 16 bp, H. sapiens
tattattttaaatgtc

SEQ ID NO: 130921 - DNA, 16 bp, H. sapiens
tattattttagagagg

SEQ ID NO: 130922 - DNA, 16 bp, H. sapiens
tattattttagcattt

SEQ ID NO: 130923 - DNA, 16 bp, H. sapiens
tattattttccaaaag

SEQ ID NO: 130924 - DNA, 16 bp, H. sapiens
tattattttgaaatac

SEQ ID NO: 130925 - DNA, 16 bp, H. sapiens
tattattttgcttaat

SEQ ID NO: 130926 - DNA, 16 bp, H. sapiens
tattattttgttctca

SEQ ID NO: 130927 - DNA, 16 bp, H. sapiens
tattatttttaaagca

SEQ ID NO: 130928 - DNA, 16 bp, H. sapiens
tattatttttcagaga

SEQ ID NO: 130929 - DNA, 16 bp, H. sapiens
tattatttttgaaaca

SEQ ID NO: 130930 - DNA, 16 bp, H. sapiens
tattatttttgagatg

SEQ ID NO: 130931 - DNA, 16 bp, H. sapiens
tattcaaaggaaaaga

SEQ ID NO: 130932 - DNA, 16 bp, H. sapiens
tattcaaataggaaaa

SEQ ID NO: 130933 - DNA, 16 bp, H. sapiens
tattcaacaaataatt

SEQ ID NO: 130934 - DNA, 16 bp, H. sapiens
tattcaacatagtcct

SEQ ID NO: 130935 - DNA, 16 bp, H. sapiens
tattcaagaaaataga

SEQ ID NO: 130936 - DNA, 16 bp, H. sapiens
tattcaagaaatattt

SEQ ID NO: 130937 - DNA, 16 bp, H. sapiens
tattcaagaaatcatt

SEQ ID NO: 130938 - DNA, 16 bp, H. sapiens
tattcaagatggagtc

SEQ ID NO: 130939 - DNA, 16 bp, H. sapiens
tattcaaggaaataaa

SEQ ID NO: 130940 - DNA, 16 bp, H. sapiens
tattcaaggctactat

SEQ ID NO: 130941 - DNA, 16 bp, H. sapiens
tattcaagtgaaagga

SEQ ID NO: 130942 - DNA, 16 bp, H. sapiens
tattcaataaatgata

SEQ ID NO: 130943 - DNA, 16 bp, H. sapiens
tattcaatcaaatact

SEQ ID NO: 130944 - DNA, 16 bp, H. sapiens
tattcaatgaacattt

SEQ ID NO: 130945 - DNA, 16 bp, H. sapiens
tattcaatgaatattt

SEQ ID NO: 130946 - DNA, 16 bp, H. sapiens
tattcaattcaattca

SEQ ID NO: 130947 - DNA, 16 bp, H. sapiens
tattcacaaaagcaaa

SEQ ID NO: 130948 - DNA, 16 bp, H. sapiens
tattcacaatagccaa

SEQ ID NO: 130949 - DNA, 16 bp, H. sapiens
tattcacaggcatgat

SEQ ID NO: 130950 - DNA, 16 bp, H. sapiens
tattcacaggtgcagt

SEQ ID NO: 130951 - DNA, 16 bp, H. sapiens
tattcacagtagccaa

SEQ ID NO: 130952 - DNA, 16 bp, H. sapiens
tattcacctgacctct

SEQ ID NO: 130953 - DNA, 16 bp, H. sapiens
tattcactattgtgag

SEQ ID NO: 130954 - DNA, 16 bp, H. sapiens
tattcacttgattatt

SEQ ID NO: 130955 - DNA, 16 bp, H. sapiens
tattcagaaaaaaact

SEQ ID NO: 130956 - DNA, 16 bp, H. sapiens
tattcagaaaatatta

SEQ ID NO: 130957 - DNA, 16 bp, H. sapiens
tattcagaaaatattt

SEQ ID NO: 130958 - DNA, 16 bp, H. sapiens
tattcagaatatatga

SEQ ID NO: 130959 - DNA, 16 bp, H. sapiens
tattcagaatttcaag

SEQ ID NO: 130960 - DNA, 16 bp, H. sapiens
tattcagagattgaac

SEQ ID NO: 130961 - DNA, 16 bp, H. sapiens
tattcagatgttttgc

SEQ ID NO: 130962 - DNA, 16 bp, H. sapiens
tattcagattgtctat

SEQ ID NO: 130963 - DNA, 16 bp, H. sapiens
tattcagatttcacta

SEQ ID NO: 130964 - DNA, 16 bp, H. sapiens
tattcagatttctcca

SEQ ID NO: 130965 - DNA, 16 bp, H. sapiens
tattcagattttccca

SEQ ID NO: 130966 - DNA, 16 bp, H. sapiens
tattcagcaacaaaaa

SEQ ID NO: 130967 - DNA, 16 bp, H. sapiens
tattcagcaagaaaaa

SEQ ID NO: 130968 - DNA, 16 bp, H. sapiens
tattcagcaattaaaa

SEQ ID NO: 130969 - DNA, 16 bp, H. sapiens
tattcagcactaaaaa

SEQ ID NO: 130970 - DNA, 16 bp, H. sapiens
tattcagcattgtact

SEQ ID NO: 130971 - DNA, 16 bp, H. sapiens
tattcagccataaaaa

SEQ ID NO: 130972 - DNA, 16 bp, H. sapiens
tattcagcctcaaaaa

SEQ ID NO: 130973 - DNA, 16 bp, H. sapiens
tattcagcctgaagaa

SEQ ID NO: 130974 - DNA, 16 bp, H. sapiens
tattcagcttttaaaa

SEQ ID NO: 130975 - DNA, 16 bp, H. sapiens
tattcaggagacacat

SEQ ID NO: 130976 - DNA, 16 bp, H. sapiens
tattcaggcaacaact

SEQ ID NO: 130977 - DNA, 16 bp, H. sapiens
tattcagggattcaag

SEQ ID NO: 130978 - DNA, 16 bp, H. sapiens
tattcagtttttccag

SEQ ID NO: 130979 - DNA, 16 bp, H. sapiens
tattcataaatgaaat

SEQ ID NO: 130980 - DNA, 16 bp, H. sapiens
tattcataaggaatat

SEQ ID NO: 130981 - DNA, 16 bp, H. sapiens
tattcataatggccaa

SEQ ID NO: 130982 - DNA, 16 bp, H. sapiens
tattcatagcagtttt

SEQ ID NO: 130983 - DNA, 16 bp, H. sapiens
tattcatatatataca

SEQ ID NO: 130984 - DNA, 16 bp, H. sapiens
tattcatcaaaatatt

SEQ ID NO: 130985 - DNA, 16 bp, H. sapiens
tattcatcaattaaaa

SEQ ID NO: 130986 - DNA, 16 bp, H. sapiens
tattcatccctccctc

SEQ ID NO: 130987 - DNA, 16 bp, H. sapiens
tattcatcttttcaaa

SEQ ID NO: 130988 - DNA, 16 bp, H. sapiens
tattcatgataaaaat

SEQ ID NO: 130989 - DNA, 16 bp, H. sapiens
tattcatgccactgca

SEQ ID NO: 130990 - DNA, 16 bp, H. sapiens
tattcatgtaaacaaa

SEQ ID NO: 130991 - DNA, 16 bp, H. sapiens
tattcatgtattattt

SEQ ID NO: 130992 - DNA, 16 bp, H. sapiens
tattcatgtctttaaa

SEQ ID NO: 130993 - DNA, 16 bp, H. sapiens
tattcatgttttatat

SEQ ID NO: 130994 - DNA, 16 bp, H. sapiens
tattcattaaatgaat

SEQ ID NO: 130995 - DNA, 16 bp, H. sapiens
tattcattaagtgaaa

SEQ ID NO: 130996 - DNA, 16 bp, H. sapiens
tattcattaagtggaa

SEQ ID NO: 130997 - DNA, 16 bp, H. sapiens
tattcattcaataaat

SEQ ID NO: 130998 - DNA, 16 bp, H. sapiens
tattcattcactcact

SEQ ID NO: 130999 - DNA, 16 bp, H. sapiens
tattcattcacttaaa

SEQ ID NO: 131000 - DNA, 16 bp, H. sapiens
tattcattcagtaaac

SEQ ID NO: 131001 - DNA, 16 bp, H. sapiens
tattcattcagtcatt

SEQ ID NO: 131002 - DNA, 16 bp, H. sapiens
tattcattcatctgtg

SEQ ID NO: 131003 - DNA, 16 bp, H. sapiens
tattcattccttcatt

SEQ ID NO: 131004 - DNA, 16 bp, H. sapiens
tattcattctatctaa

SEQ ID NO: 131005 - DNA, 16 bp, H. sapiens
tattcattctgccatt

SEQ ID NO: 131006 - DNA, 16 bp, H. sapiens
tattcattgaataaat

SEQ ID NO: 131007 - DNA, 16 bp, H. sapiens
tattcattgtttttaa

SEQ ID NO: 131008 - DNA, 16 bp, H. sapiens
tattcatttaatcctc

SEQ ID NO: 131009 - DNA, 16 bp, H. sapiens
tattcatttagatttt

SEQ ID NO: 131010 - DNA, 16 bp, H. sapiens
tattcatttatcaaaa

SEQ ID NO: 131011 - DNA, 16 bp, H. sapiens
tattcattttcaaata

SEQ ID NO: 131012 - DNA, 21 bp, H. sapiens
tattccaaaactgaccacata

SEQ ID NO: 131013 - DNA, 16 bp, H. sapiens
tattccaaagtatttt

SEQ ID NO: 131014 - DNA, 16 bp, H. sapiens
tattccagctactcag

SEQ ID NO: 131015 - DNA, 16 bp, H. sapiens
tattccagtgtgtgtg

SEQ ID NO: 131016 - DNA, 16 bp, H. sapiens
tattccatagtgtgtg

SEQ ID NO: 131017 - DNA, 16 bp, H. sapiens
tattccatatatatat

SEQ ID NO: 131018 - DNA, 16 bp, H. sapiens
tattccatggtatata

SEQ ID NO: 131019 - DNA, 20 bp, H. sapiens
tattccatggtgtatatgta

SEQ ID NO: 131020 - DNA, 16 bp, H. sapiens
tattccattatcttct

SEQ ID NO: 131021 - DNA, 16 bp, H. sapiens
tattccattgtataga

SEQ ID NO: 131022 - DNA, 16 bp, H. sapiens
tattccatttacataa

SEQ ID NO: 131023 - DNA, 16 bp, H. sapiens
tattccattttaaaat

SEQ ID NO: 131024 - DNA, 16 bp, H. sapiens
tattccattttgtaga

SEQ ID NO: 131025 - DNA, 16 bp, H. sapiens
tattcccagcacctgg

SEQ ID NO: 131026 - DNA, 16 bp, H. sapiens
tattcccagctacatg

SEQ ID NO: 131027 - DNA, 16 bp, H. sapiens
tattccccatggataa

SEQ ID NO: 131028 - DNA, 16 bp, H. sapiens
tattccctttgaaaac

SEQ ID NO: 131029 - DNA, 16 bp, H. sapiens
tattcctaacactttg

SEQ ID NO: 131030 - DNA, 16 bp, H. sapiens
tattcctaacagccaa

SEQ ID NO: 131031 - DNA, 16 bp, H. sapiens
tattcctaagaatttt

SEQ ID NO: 131032 - DNA, 16 bp, H. sapiens
tattcctatcaaacta

SEQ ID NO: 131033 - DNA, 16 bp, H. sapiens
tattcctcaaaactgt

SEQ ID NO: 131034 - DNA, 16 bp, H. sapiens
tattcctcattttaca

SEQ ID NO: 131035 - DNA, 16 bp, H. sapiens
tattcctcctgatgct

SEQ ID NO: 131036 - DNA, 16 bp, H. sapiens
tattcctgcagtcatt

SEQ ID NO: 131037 - DNA, 16 bp, H. sapiens
tattcctgctcttttt

SEQ ID NO: 131038 - DNA, 16 bp, H. sapiens
tattcctgggataaac

SEQ ID NO: 131039 - DNA, 16 bp, H. sapiens
tattcctggttcaatc

SEQ ID NO: 131040 - DNA, 16 bp, H. sapiens
tattcctgtaaaccaa

SEQ ID NO: 131041 - DNA, 16 bp, H. sapiens
tattccttatctgaaa

SEQ ID NO: 131042 - DNA, 16 bp, H. sapiens
tattcctttaattcag

SEQ ID NO: 131043 - DNA, 16 bp, H. sapiens
tattcctttctgtttg

SEQ ID NO: 131044 - DNA, 16 bp, H. sapiens
tattcctttttatggc

SEQ ID NO: 131045 - DNA, 16 bp, H. sapiens
tattctaaacatttca

SEQ ID NO: 131046 - DNA, 16 bp, H. sapiens
tattctaaattttttg

SEQ ID NO: 131047 - DNA, 16 bp, H. sapiens
tattctacaaatattt

SEQ ID NO: 131048 - DNA, 16 bp, H. sapiens
tattctactttaaaaa

SEQ ID NO: 131049 - DNA, 16 bp, H. sapiens
tattctaggtacctca

SEQ ID NO: 131050 - DNA, 16 bp, H. sapiens
tattctagttcagggt

SEQ ID NO: 131051 - DNA, 16 bp, H. sapiens
tattctatgtatatat

SEQ ID NO: 131052 - DNA, 16 bp, H. sapiens
tattctattgatttaa

SEQ ID NO: 131053 - DNA, 16 bp, H. sapiens
tattctattgtgtata

SEQ ID NO: 131054 - DNA, 16 bp, H. sapiens
tattctcacagctcca

SEQ ID NO: 131055 - DNA, 16 bp, H. sapiens
tattctcagctactca

SEQ ID NO: 131056 - DNA, 16 bp, H. sapiens
tattctcattatttca

SEQ ID NO: 131057 - DNA, 16 bp, H. sapiens
tattctcctacatgta

SEQ ID NO: 131058 - DNA, 17 bp, H. sapiens
tattctcctgcctcagt

SEQ ID NO: 131059 - DNA, 16 bp, H. sapiens
tattctccttcctgtg

SEQ ID NO: 131060 - DNA, 16 bp, H. sapiens
tattctctgtgaagca

SEQ ID NO: 131061 - DNA, 16 bp, H. sapiens
tattctcttcatagca

SEQ ID NO: 131062 - DNA, 16 bp, H. sapiens
tattctctttgtacca

SEQ ID NO: 131063 - DNA, 16 bp, H. sapiens
tattctgaacatttca

SEQ ID NO: 131064 - DNA, 16 bp, H. sapiens
tattctgaatattaac

SEQ ID NO: 131065 - DNA, 16 bp, H. sapiens
tattctgaatattttt

SEQ ID NO: 131066 - DNA, 16 bp, H. sapiens
tattctgattgctgct

SEQ ID NO: 131067 - DNA, 16 bp, H. sapiens
tattctgatttctatc

SEQ ID NO: 131068 - DNA, 16 bp, H. sapiens
tattctgcctaccaca

SEQ ID NO: 131069 - DNA, 16 bp, H. sapiens
tattctggacatttca

SEQ ID NO: 131070 - DNA, 16 bp, H. sapiens
tattctggacatttta

SEQ ID NO: 131071 - DNA, 16 bp, H. sapiens
tattctggacgtttca

SEQ ID NO: 131072 - DNA, 16 bp, H. sapiens
tattctggattatttt

SEQ ID NO: 131073 - DNA, 16 bp, H. sapiens
tattctgtaattataa

SEQ ID NO: 131074 - DNA, 16 bp, H. sapiens
tattctgtataatact

SEQ ID NO: 131075 - DNA, 16 bp, H. sapiens
tattctgtatgatgct

SEQ ID NO: 131076 - DNA, 16 bp, H. sapiens
tattctgtatttgtct

SEQ ID NO: 131077 - DNA, 16 bp, H. sapiens
tattctgtgataaaaa

SEQ ID NO: 131078 - DNA, 16 bp, H. sapiens
tattctgtgattgttg

SEQ ID NO: 131079 - DNA, 16 bp, H. sapiens
tattctgtgccaggca

SEQ ID NO: 131080 - DNA, 16 bp, H. sapiens
tattctgtgtcttttg

SEQ ID NO: 131081 - DNA, 16 bp, H. sapiens
tattctgttccactga

SEQ ID NO: 131082 - DNA, 16 bp, H. sapiens
tattctgtttttaaaa

SEQ ID NO: 131083 - DNA, 16 bp, H. sapiens
tattcttaagtatttt

SEQ ID NO: 131084 - DNA, 16 bp, H. sapiens
tattcttaggtttgga

SEQ ID NO: 131085 - DNA, 16 bp, H. sapiens
tattcttatcctcatt

SEQ ID NO: 131086 - DNA, 16 bp, H. sapiens
tattcttattttgaaa

SEQ ID NO: 131087 - DNA, 16 bp, H. sapiens
tattcttcagctttaa

SEQ ID NO: 131088 - DNA, 16 bp, H. sapiens
tattcttcatagaaat

SEQ ID NO: 131089 - DNA, 16 bp, H. sapiens
tattcttgttattaat

SEQ ID NO: 131090 - DNA, 16 bp, H. sapiens
tattctttaagtttta

SEQ ID NO: 131091 - DNA, 16 bp, H. sapiens
tattctttatcaagtt

SEQ ID NO: 131092 - DNA, 16 bp, H. sapiens
tattctttcaacaaat

SEQ ID NO: 131093 - DNA, 16 bp, H. sapiens
tattctttcatttcca

SEQ ID NO: 131094 - DNA, 16 bp, H. sapiens
tattctttgaatattt

SEQ ID NO: 131095 - DNA, 16 bp, H. sapiens
tattcttttgaaaaaa

SEQ ID NO: 131096 - DNA, 16 bp, H. sapiens
tattctttttcaaagt

SEQ ID NO: 131097 - DNA, 16 bp, H. sapiens
tattctttttgcttaa

SEQ ID NO: 131098 - DNA, 16 bp, H. sapiens
tattctttttgtagct

SEQ ID NO: 131099 - DNA, 16 bp, H. sapiens
tattgaaaaaaatctg

SEQ ID NO: 131100 - DNA, 16 bp, H. sapiens
tattgaaaatattttc

SEQ ID NO: 131101 - DNA, 16 bp, H. sapiens
tattgaaagtttttaa

SEQ ID NO: 131102 - DNA, 16 bp, H. sapiens
tattgaaatgctactg

SEQ ID NO: 131103 - DNA, 16 bp, H. sapiens
tattgaaatggaaaaa

SEQ ID NO: 131104 - DNA, 16 bp, H. sapiens
tattgaacacttacta

SEQ ID NO: 131105 - DNA, 16 bp, H. sapiens
tattgaacatttttat

SEQ ID NO: 131106 - DNA, 16 bp, H. sapiens
tattgaactctggggg

SEQ ID NO: 131107 - DNA, 16 bp, H. sapiens
tattgaagaaactgtt

SEQ ID NO: 131108 - DNA, 16 bp, H. sapiens
tattgaagaaagaatt

SEQ ID NO: 131109 - DNA, 16 bp, H. sapiens
tattgaaggacatctt

SEQ ID NO: 131110 - DNA, 16 bp, H. sapiens
tattgaagtataacat

SEQ ID NO: 131111 - DNA, 16 bp, H. sapiens
tattgaagttgtttat

SEQ ID NO: 131112 - DNA, 16 bp, H. sapiens
tattgaatatctcatg

SEQ ID NO: 131113 - DNA, 16 bp, H. sapiens
tattgaatattttaag

SEQ ID NO: 131114 - DNA, 16 bp, H. sapiens
tattgaatcagaatct

SEQ ID NO: 131115 - DNA, 16 bp, H. sapiens
tattgaatgaagaaat

SEQ ID NO: 131116 - DNA, 16 bp, H. sapiens
tattgaatgaataaat

SEQ ID NO: 131117 - DNA, 16 bp, H. sapiens
tattgaatgaataatt

SEQ ID NO: 131118 - DNA, 16 bp, H. sapiens
tattgaatgaatgaaa

SEQ ID NO: 131119 - DNA, 16 bp, H. sapiens
tattgaatgctttttt

SEQ ID NO: 131120 - DNA, 16 bp, H. sapiens
tattgacatttaaaaa

SEQ ID NO: 131121 - DNA, 16 bp, H. sapiens
tattgacattttgggt

SEQ ID NO: 131122 - DNA, 16 bp, H. sapiens
tattgacatttttaaa

SEQ ID NO: 131123 - DNA, 16 bp, H. sapiens
tattgacttatttaat

SEQ ID NO: 131124 - DNA, 16 bp, H. sapiens
tattgagataataatt

SEQ ID NO: 131125 - DNA, 16 bp, H. sapiens
tattgagcacttaaaa

SEQ ID NO: 131126 - DNA, 16 bp, H. sapiens
tattgagcatttttta

SEQ ID NO: 131127 - DNA, 16 bp, H. sapiens
tattgaggatttttcc

SEQ ID NO: 131128 - DNA, 16 bp, H. sapiens
tattgagtgagttctc

SEQ ID NO: 131129 - DNA, 16 bp, H. sapiens
tattgagtgcctgtta

SEQ ID NO: 131130 - DNA, 16 bp, H. sapiens
tattgagttttgagag

SEQ ID NO: 131131 - DNA, 16 bp, H. sapiens
tattgataaatgcaac

SEQ ID NO: 131132 - DNA, 16 bp, H. sapiens
tattgatattttctat

SEQ ID NO: 131133 - DNA, 16 bp, H. sapiens
tattgatattttgacc

SEQ ID NO: 131134 - DNA, 16 bp, H. sapiens
tattgatcatcagaga

SEQ ID NO: 131135 - DNA, 16 bp, H. sapiens
tattgatgaagaaact

SEQ ID NO: 131136 - DNA, 16 bp, H. sapiens
tattgatgatgttaag

SEQ ID NO: 131137 - DNA, 16 bp, H. sapiens
tattgatggggttgtt

SEQ ID NO: 131138 - DNA, 16 bp, H. sapiens
tattgatgttttaaaa

SEQ ID NO: 131139 - DNA, 16 bp, H. sapiens
tattgattattctaat

SEQ ID NO: 131140 - DNA, 16 bp, H. sapiens
tattgattggcatatg

SEQ ID NO: 131141 - DNA, 16 bp, H. sapiens
tattgatttcatttat

SEQ ID NO: 131142 - DNA, 16 bp, H. sapiens
tattgatttttctaat

SEQ ID NO: 131143 - DNA, 16 bp, H. sapiens
tattgatttttttccc

SEQ ID NO: 131144 - DNA, 16 bp, H. sapiens
tattgcaaatgaaatt

SEQ ID NO: 131145 - DNA, 16 bp, H. sapiens
tattgcacaggctgga

SEQ ID NO: 131146 - DNA, 16 bp, H. sapiens
tattgcagtaaagaaa

SEQ ID NO: 131147 - DNA, 16 bp, H. sapiens
tattgcagtagcaact

SEQ ID NO: 131148 - DNA, 16 bp, H. sapiens
tattgcattcttgaaa

SEQ ID NO: 131149 - DNA, 16 bp, H. sapiens
tattgcattgtaatat

SEQ ID NO: 131150 - DNA, 16 bp, H. sapiens
tattgcatttaatttt

SEQ ID NO: 131151 - DNA, 16 bp, H. sapiens
tattgcatttatttga

SEQ ID NO: 131152 - DNA, 16 bp, H. sapiens
tattgccattttacag

SEQ ID NO: 131153 - DNA, 16 bp, H. sapiens
tattgcctcaacttca

SEQ ID NO: 131154 - DNA, 16 bp, H. sapiens
tattgcctttatgttg

SEQ ID NO: 131155 - DNA, 16 bp, H. sapiens
tattgctaaattattt

SEQ ID NO: 131156 - DNA, 16 bp, H. sapiens
tattgctataaacatt

SEQ ID NO: 131157 - DNA, 16 bp, H. sapiens
tattgctattgtaaat

SEQ ID NO: 131158 - DNA, 16 bp, H. sapiens
tattgctcccatcttt

SEQ ID NO: 131159 - DNA, 16 bp, H. sapiens
tattgctgaattatat

SEQ ID NO: 131160 - DNA, 16 bp, H. sapiens
tattgctgagcagtat

SEQ ID NO: 131161 - DNA, 16 bp, H. sapiens
tattgctgctcacact

SEQ ID NO: 131162 - DNA, 16 bp, H. sapiens
tattgctgctgctgct

SEQ ID NO: 131163 - DNA, 16 bp, H. sapiens
tattgctggggctttg

SEQ ID NO: 131164 - DNA, 16 bp, H. sapiens
tattgctggtgataat

SEQ ID NO: 131165 - DNA, 16 bp, H. sapiens
tattgctgtataacaa

SEQ ID NO: 131166 - DNA, 16 bp, H. sapiens
tattgctgtatagaaa

SEQ ID NO: 131167 - DNA, 16 bp, H. sapiens
tattgctgtgtaaaaa

SEQ ID NO: 131168 - DNA, 16 bp, H. sapiens
tattgcttatcttgag

SEQ ID NO: 131169 - DNA, 16 bp, H. sapiens
tattgcttcaatttca

SEQ ID NO: 131170 - DNA, 16 bp, H. sapiens
tattgcttccatttta

SEQ ID NO: 131171 - DNA, 16 bp, H. sapiens
tattgcttccttcagg

SEQ ID NO: 131172 - DNA, 16 bp, H. sapiens
tattgctttaaagttt

SEQ ID NO: 131173 - DNA, 16 bp, H. sapiens
tattgctttccatttg

SEQ ID NO: 131174 - DNA, 16 bp, H. sapiens
tattgctttgttcccc

SEQ ID NO: 131175 - DNA, 16 bp, H. sapiens
tattgctttgttgccc

SEQ ID NO: 131176 - DNA, 16 bp, H. sapiens
tattgcttttccattt

SEQ ID NO: 131177 - DNA, 16 bp, H. sapiens
tattgctttttaaagt

SEQ ID NO: 131178 - DNA, 16 bp, H. sapiens
tattggaaaaggaaaa

SEQ ID NO: 131179 - DNA, 16 bp, H. sapiens
tattggaacacagtca

SEQ ID NO: 131180 - DNA, 16 bp, H. sapiens
tattggaagtaatatc

SEQ ID NO: 131181 - DNA, 16 bp, H. sapiens
tattggacagcacaga

SEQ ID NO: 131182 - DNA, 16 bp, H. sapiens
tattggacagcactgc

SEQ ID NO: 131183 - DNA, 16 bp, H. sapiens
tattggatcagggccc

SEQ ID NO: 131184 - DNA, 16 bp, H. sapiens
tattggattaaataaa

SEQ ID NO: 131185 - DNA, 16 bp, H. sapiens
tattggattaaggccc

SEQ ID NO: 131186 - DNA, 16 bp, H. sapiens
tattggccaggctggg

SEQ ID NO: 131187 - DNA, 16 bp, H. sapiens
tattggctatttgtat

SEQ ID NO: 131188 - DNA, 16 bp, H. sapiens
tattggctgataattg

SEQ ID NO: 131189 - DNA, 16 bp, H. sapiens
tattggctgtggattt

SEQ ID NO: 131190 - DNA, 16 bp, H. sapiens
tattggggaacctgcc

SEQ ID NO: 131191 - DNA, 16 bp, H. sapiens
tattgggtaatcattc

SEQ ID NO: 131192 - DNA, 16 bp, H. sapiens
tattgggtattatgct

SEQ ID NO: 131193 - DNA, 16 bp, H. sapiens
tattggtaaaatgcag

SEQ ID NO: 131194 - DNA, 16 bp, H. sapiens
tattggtagagatggg

SEQ ID NO: 131195 - DNA, 16 bp, H. sapiens
tattggtcaaagaata

SEQ ID NO: 131196 - DNA, 16 bp, H. sapiens
tattggttttcatcca

SEQ ID NO: 131197 - DNA, 16 bp, H. sapiens
tattgtaaaagggatt

SEQ ID NO: 131198 - DNA, 16 bp, H. sapiens
tattgtaaagattaaa

SEQ ID NO: 131199 - DNA, 16 bp, H. sapiens
tattgtaaatgcaatt

SEQ ID NO: 131200 - DNA, 16 bp, H. sapiens
tattgtaaatggcatt

SEQ ID NO: 131201 - DNA, 16 bp, H. sapiens
tattgtaagaatacag

SEQ ID NO: 131202 - DNA, 16 bp, H. sapiens
tattgtaagtgggatt

SEQ ID NO: 131203 - DNA, 16 bp, H. sapiens
tattgtagtcttcata

SEQ ID NO: 131204 - DNA, 16 bp, H. sapiens
tattgtatacttgaaa

SEQ ID NO: 131205 - DNA, 16 bp, H. sapiens
tattgtatttacccat

SEQ ID NO: 131206 - DNA, 16 bp, H. sapiens
tattgtattttacaaa

SEQ ID NO: 131207 - DNA, 16 bp, H. sapiens
tattgtcaaattattt

SEQ ID NO: 131208 - DNA, 16 bp, H. sapiens
tattgtcagtatttta

SEQ ID NO: 131209 - DNA, 16 bp, H. sapiens
tattgtcatcattatt

SEQ ID NO: 131210 - DNA, 16 bp, H. sapiens
tattgtcattgttgtt

SEQ ID NO: 131211 - DNA, 16 bp, H. sapiens
tattgtccaggctgga

SEQ ID NO: 131212 - DNA, 16 bp, H. sapiens
tattgtctccatttta

SEQ ID NO: 131213 - DNA, 16 bp, H. sapiens
tattgtcttattttaa

SEQ ID NO: 131214 - DNA, 16 bp, H. sapiens
tattgtcttcctttgt

SEQ ID NO: 131215 - DNA, 17 bp, H. sapiens
tattgtgaaaatgacca

SEQ ID NO: 131216 - DNA, 16 bp, H. sapiens
tattgtgaaacatttt

SEQ ID NO: 131217 - DNA, 16 bp, H. sapiens
tattgtgaagagtaaa

SEQ ID NO: 131218 - DNA, 16 bp, H. sapiens
tattgtgacttacttt

SEQ ID NO: 131219 - DNA, 16 bp, H. sapiens
tattgtgatataataa

SEQ ID NO: 131220 - DNA, 16 bp, H. sapiens
tattgtgattaatgct

SEQ ID NO: 131221 - DNA, 16 bp, H. sapiens
tattgttaactataat

SEQ ID NO: 131222 - DNA, 16 bp, H. sapiens
tattgttaagatggca

SEQ ID NO: 131223 - DNA, 16 bp, H. sapiens
tattgttaagtgaaaa

SEQ ID NO: 131224 - DNA, 16 bp, H. sapiens
tattgttactattatt

SEQ ID NO: 131225 - DNA, 16 bp, H. sapiens
tattgttattaactat

SEQ ID NO: 131226 - DNA, 16 bp, H. sapiens
tattgttcataatatc

SEQ ID NO: 131227 - DNA, 16 bp, H. sapiens
tattgttgccatattt

SEQ ID NO: 131228 - DNA, 16 bp, H. sapiens
tattgttgccattttt

SEQ ID NO: 131229 - DNA, 16 bp, H. sapiens
tattgttggccaggca

SEQ ID NO: 131230 - DNA, 16 bp, H. sapiens
tattgtttaatttcaa

SEQ ID NO: 131231 - DNA, 16 bp, H. sapiens
tattgtttacatttat

SEQ ID NO: 131232 - DNA, 16 bp, H. sapiens
tattgtttagctccca

SEQ ID NO: 131233 - DNA, 16 bp, H. sapiens
tattgtttatttgaag

SEQ ID NO: 131234 - DNA, 16 bp, H. sapiens
tattgtttccatcttt

SEQ ID NO: 131235 - DNA, 16 bp, H. sapiens
tattgttttatgccac

SEQ ID NO: 131236 - DNA, 16 bp, H. sapiens
tattgttttcttaaaa

SEQ ID NO: 131237 - DNA, 16 bp, H. sapiens
tattgtttttaaattc

SEQ ID NO: 131238 - DNA, 16 bp, H. sapiens
tatttaaaaacaaaga

SEQ ID NO: 131239 - DNA, 16 bp, H. sapiens
tatttaaaaaggagaa

SEQ ID NO: 131240 - DNA, 16 bp, H. sapiens
tatttaaaacagtttt

SEQ ID NO: 131241 - DNA, 16 bp, H. sapiens
tatttaaaagacattt

SEQ ID NO: 131242 - DNA, 16 bp, H. sapiens
tatttaaaagcatttt

SEQ ID NO: 131243 - DNA, 16 bp, H. sapiens
tatttaaaatagcaaa

SEQ ID NO: 131244 - DNA, 16 bp, H. sapiens
tatttaaaatatgctt

SEQ ID NO: 131245 - DNA, 16 bp, H. sapiens
tatttaaaatgctcaa

SEQ ID NO: 131246 - DNA, 16 bp, H. sapiens
tatttaaaattctgaa

SEQ ID NO: 131247 - DNA, 16 bp, H. sapiens
tatttaaacagaaaaa

SEQ ID NO: 131248 - DNA, 16 bp, H. sapiens
tatttaaacattcaaa

SEQ ID NO: 131249 - DNA, 16 bp, H. sapiens
tatttaaagcaaatat

SEQ ID NO: 131250 - DNA, 16 bp, H. sapiens
tatttaaagggaaaag

SEQ ID NO: 131251 - DNA, 16 bp, H. sapiens
tatttaaaggtgtttt

SEQ ID NO: 131252 - DNA, 16 bp, H. sapiens
tatttaaagtgagaga

SEQ ID NO: 131253 - DNA, 16 bp, H. sapiens
tatttaaagttatttc

SEQ ID NO: 131254 - DNA, 16 bp, H. sapiens
tatttaaatagagatg

SEQ ID NO: 131255 - DNA, 16 bp, H. sapiens
tatttaaatatctgtt

SEQ ID NO: 131256 - DNA, 16 bp, H. sapiens
tatttaaatgcatttt

SEQ ID NO: 131257 - DNA, 16 bp, H. sapiens
tatttaaattctttgt

SEQ ID NO: 131258 - DNA, 16 bp, H. sapiens
tatttaacaaattgaa

SEQ ID NO: 131259 - DNA, 16 bp, H. sapiens
tatttaacacacattt

SEQ ID NO: 131260 - DNA, 16 bp, H. sapiens
tatttaacattttaga

SEQ ID NO: 131261 - DNA, 16 bp, H. sapiens
tatttaacattttcca

SEQ ID NO: 131262 - DNA, 16 bp, H. sapiens
tatttaaccaaaagaa

SEQ ID NO: 131263 - DNA, 16 bp, H. sapiens
tatttaactctttaaa

SEQ ID NO: 131264 - DNA, 16 bp, H. sapiens
tatttaagaaaatgta

SEQ ID NO: 131265 - DNA, 16 bp, H. sapiens
tatttaagaaaatgtt

SEQ ID NO: 131266 - DNA, 16 bp, H. sapiens
tatttaaggtgtgcaa

SEQ ID NO: 131267 - DNA, 16 bp, H. sapiens
tatttaagtcatttct

SEQ ID NO: 131268 - DNA, 16 bp, H. sapiens
tatttaagtctttaat

SEQ ID NO: 131269 - DNA, 16 bp, H. sapiens
tatttaataaatgatg

SEQ ID NO: 131270 - DNA, 16 bp, H. sapiens
tatttaatagggaatc

SEQ ID NO: 131271 - DNA, 16 bp, H. sapiens
tatttaatattttcag

SEQ ID NO: 131272 - DNA, 16 bp, H. sapiens
tatttaatcctttcaa

SEQ ID NO: 131273 - DNA, 16 bp, H. sapiens
tatttaatgatgaaag

SEQ ID NO: 131274 - DNA, 16 bp, H. sapiens
tatttaatggaaaatt

SEQ ID NO: 131275 - DNA, 16 bp, H. sapiens
tatttaattaggaaaa

SEQ ID NO: 131276 - DNA, 16 bp, H. sapiens
tatttaattgcatttt

SEQ ID NO: 131277 - DNA, 16 bp, H. sapiens
tatttaattttccaga

SEQ ID NO: 131278 - DNA, 16 bp, H. sapiens
tatttacaaaaatgtt

SEQ ID NO: 131279 - DNA, 16 bp, H. sapiens
tatttacaaaccatat

SEQ ID NO: 131280 - DNA, 16 bp, H. sapiens
tatttacaaagatgtg

SEQ ID NO: 131281 - DNA, 16 bp, H. sapiens
tatttacaaatgtttt

SEQ ID NO: 131282 - DNA, 16 bp, H. sapiens
tatttacaataggaaa

SEQ ID NO: 131283 - DNA, 16 bp, H. sapiens
tatttacaatatcaaa

SEQ ID NO: 131284 - DNA, 16 bp, H. sapiens
tatttacacaatgcct

SEQ ID NO: 131285 - DNA, 16 bp, H. sapiens
tatttacatatttgtt

SEQ ID NO: 131286 - DNA, 16 bp, H. sapiens
tatttacatggcattt

SEQ ID NO: 131287 - DNA, 16 bp, H. sapiens
tatttactaaagaata

SEQ ID NO: 131288 - DNA, 16 bp, H. sapiens
tatttactaagcattt

SEQ ID NO: 131289 - DNA, 16 bp, H. sapiens
tatttactatctgccc

SEQ ID NO: 131290 - DNA, 16 bp, H. sapiens
tatttactatttggct

SEQ ID NO: 131291 - DNA, 16 bp, H. sapiens
tatttactgaataaat

SEQ ID NO: 131292 - DNA, 16 bp, H. sapiens
tatttactttaagagg

SEQ ID NO: 131293 - DNA, 16 bp, H. sapiens
tatttactttgagatg

SEQ ID NO: 131294 - DNA, 16 bp, H. sapiens
tatttactttggaaaa

SEQ ID NO: 131295 - DNA, 16 bp, H. sapiens
tatttagaaaaaccaa

SEQ ID NO: 131296 - DNA, 16 bp, H. sapiens
tatttagaaaacccca

SEQ ID NO: 131297 - DNA, 16 bp, H. sapiens
tatttagaaaatacat

SEQ ID NO: 131298 - DNA, 16 bp, H. sapiens
tatttagaaaatccca

SEQ ID NO: 131299 - DNA, 16 bp, H. sapiens
tatttagaaacattta

SEQ ID NO: 131300 - DNA, 16 bp, H. sapiens
tatttagaaagcccca

SEQ ID NO: 131301 - DNA, 16 bp, H. sapiens
tatttagaaataaagt

SEQ ID NO: 131302 - DNA, 16 bp, H. sapiens
tatttagaaatgtatt

SEQ ID NO: 131303 - DNA, 16 bp, H. sapiens
tatttagacttgtttt

SEQ ID NO: 131304 - DNA, 16 bp, H. sapiens
tatttagagagagaga

SEQ ID NO: 131305 - DNA, 16 bp, H. sapiens
tatttagaggtatgtt

SEQ ID NO: 131306 - DNA, 16 bp, H. sapiens
tatttagatcatttac

SEQ ID NO: 131307 - DNA, 16 bp, H. sapiens
tatttagatctttaat

SEQ ID NO: 131308 - DNA, 16 bp, H. sapiens
tatttagcatttatta

SEQ ID NO: 131309 - DNA, 16 bp, H. sapiens
tatttaggtcttcttt

SEQ ID NO: 131310 - DNA, 16 bp, H. sapiens
tatttagttttccatt

SEQ ID NO: 131311 - DNA, 16 bp, H. sapiens
tatttataaaaacaag

SEQ ID NO: 131312 - DNA, 16 bp, H. sapiens
tatttataaaaatagg

SEQ ID NO: 131313 - DNA, 16 bp, H. sapiens
tatttataaaccatat

SEQ ID NO: 131314 - DNA, 16 bp, H. sapiens
tatttataagtgaaat

SEQ ID NO: 131315 - DNA, 16 bp, H. sapiens
tatttataatagcaac

SEQ ID NO: 131316 - DNA, 16 bp, H. sapiens
tatttatacccacttt

SEQ ID NO: 131317 - DNA, 16 bp, H. sapiens
tatttatatgatggaa

SEQ ID NO: 131318 - DNA, 16 bp, H. sapiens
tatttatatgtaacat

SEQ ID NO: 131319 - DNA, 16 bp, H. sapiens
tatttatatttggaaa

SEQ ID NO: 131320 - DNA, 16 bp, H. sapiens
tatttatccaaatgag

SEQ ID NO: 131321 - DNA, 16 bp, H. sapiens
tatttatcctgcttga

SEQ ID NO: 131322 - DNA, 16 bp, H. sapiens
tatttatcctttcaaa

SEQ ID NO: 131323 - DNA, 16 bp, H. sapiens
tatttatctaaaggaa

SEQ ID NO: 131324 - DNA, 16 bp, H. sapiens
tatttatctacctatc

SEQ ID NO: 131325 - DNA, 16 bp, H. sapiens
tatttatctttccaaa

SEQ ID NO: 131326 - DNA, 16 bp, H. sapiens
tatttatgaagaatat

SEQ ID NO: 131327 - DNA, 16 bp, H. sapiens
tatttatgacatattt

SEQ ID NO: 131328 - DNA, 16 bp, H. sapiens
tatttatgatgatgat

SEQ ID NO: 131329 - DNA, 16 bp, H. sapiens
tatttatgcaaataat

SEQ ID NO: 131330 - DNA, 16 bp, H. sapiens
tatttatgcatattta

SEQ ID NO: 131331 - DNA, 16 bp, H. sapiens
tatttatggaaataaa

SEQ ID NO: 131332 - DNA, 16 bp, H. sapiens
tatttatggaagaaat

SEQ ID NO: 131333 - DNA, 16 bp, H. sapiens
tatttatggagtgcct

SEQ ID NO: 131334 - DNA, 16 bp, H. sapiens
tatttatgtaacattt

SEQ ID NO: 131335 - DNA, 16 bp, H. sapiens
tatttatgtagcactt

SEQ ID NO: 131336 - DNA, 16 bp, H. sapiens
tatttatgtatcattt

SEQ ID NO: 131337 - DNA, 16 bp, H. sapiens
tatttatgtcttttgc

SEQ ID NO: 131338 - DNA, 16 bp, H. sapiens
tatttatgtgaaatgt

SEQ ID NO: 131339 - DNA, 16 bp, H. sapiens
tatttatgtgataaat

SEQ ID NO: 131340 - DNA, 16 bp, H. sapiens
tatttatgtttgagac

SEQ ID NO: 131341 - DNA, 16 bp, H. sapiens
tatttatgttttacat

SEQ ID NO: 131342 - DNA, 16 bp, H. sapiens
tatttattaagaactt

SEQ ID NO: 131343 - DNA, 16 bp, H. sapiens
tatttattaagcactt

SEQ ID NO: 131344 - DNA, 16 bp, H. sapiens
tatttattaagctctt

SEQ ID NO: 131345 - DNA, 16 bp, H. sapiens
tatttattaagtgtct

SEQ ID NO: 131346 - DNA, 16 bp, H. sapiens
tatttattaagttctt

SEQ ID NO: 131347 - DNA, 16 bp, H. sapiens
tatttattacaatctc

SEQ ID NO: 131348 - DNA, 16 bp, H. sapiens
tatttattacagaaaa

SEQ ID NO: 131349 - DNA, 16 bp, H. sapiens
tatttattactgttat

SEQ ID NO: 131350 - DNA, 16 bp, H. sapiens
tatttattatagcatt

SEQ ID NO: 131351 - DNA, 16 bp, H. sapiens
tatttattcaaaaaca

SEQ ID NO: 131352 - DNA, 16 bp, H. sapiens
tatttattcacttaaa

SEQ ID NO: 131353 - DNA, 16 bp, H. sapiens
tatttattcattcagt

SEQ ID NO: 131354 - DNA, 16 bp, H. sapiens
tatttattgaacatct

SEQ ID NO: 131355 - DNA, 16 bp, H. sapiens
tatttattgacaattt

SEQ ID NO: 131356 - DNA, 16 bp, H. sapiens
tatttattgactgtct

SEQ ID NO: 131357 - DNA, 16 bp, H. sapiens
tatttattgagcgcct

SEQ ID NO: 131358 - DNA, 16 bp, H. sapiens
tatttattgagcttct

SEQ ID NO: 131359 - DNA, 16 bp, H. sapiens
tatttattgagctttt

SEQ ID NO: 131360 - DNA, 16 bp, H. sapiens
tatttattgagtgcat

SEQ ID NO: 131361 - DNA, 16 bp, H. sapiens
tatttattgagtgtct

SEQ ID NO: 131362 - DNA, 16 bp, H. sapiens
tatttattgatcatct

SEQ ID NO: 131363 - DNA, 16 bp, H. sapiens
tatttattggatacaa

SEQ ID NO: 131364 - DNA, 16 bp, H. sapiens
tatttattggtcattt

SEQ ID NO: 131365 - DNA, 16 bp, H. sapiens
tatttattgtacattt

SEQ ID NO: 131366 - DNA, 16 bp, H. sapiens
tatttattgtgcactt

SEQ ID NO: 131367 - DNA, 16 bp, H. sapiens
tatttatttagaaatg

SEQ ID NO: 131368 - DNA, 16 bp, H. sapiens
tatttatttagaatga

SEQ ID NO: 131369 - DNA, 16 bp, H. sapiens
tatttatttagagtca

SEQ ID NO: 131370 - DNA, 16 bp, H. sapiens
tatttatttcagacag

SEQ ID NO: 131371 - DNA, 16 bp, H. sapiens
tatttatttctgattc

SEQ ID NO: 131372 - DNA, 16 bp, H. sapiens
tatttatttctgtata

SEQ ID NO: 131373 - DNA, 16 bp, H. sapiens
tatttatttgaaatgg

SEQ ID NO: 131374 - DNA, 16 bp, H. sapiens
tatttatttgacaaaa

SEQ ID NO: 131375 - DNA, 16 bp, H. sapiens
tatttatttgggtctc

SEQ ID NO: 131376 - DNA, 16 bp, H. sapiens
tatttatttgtgagac

SEQ ID NO: 131377 - DNA, 16 bp, H. sapiens
tatttattttacagaa

SEQ ID NO: 131378 - DNA, 16 bp, H. sapiens
tatttattttctcaga

SEQ ID NO: 131379 - DNA, 16 bp, H. sapiens
tatttattttctggaa

SEQ ID NO: 131380 - DNA, 16 bp, H. sapiens
tatttattttggtaga

SEQ ID NO: 131381 - DNA, 16 bp, H. sapiens
tatttatttttccctg

SEQ ID NO: 131382 - DNA, 16 bp, H. sapiens
tatttatttttctgca

SEQ ID NO: 131383 - DNA, 16 bp, H. sapiens
tatttatttttggcat

SEQ ID NO: 131384 - DNA, 16 bp, H. sapiens
tatttcaaaaaattga

SEQ ID NO: 131385 - DNA, 16 bp, H. sapiens
tatttcaaaagaaaaa

SEQ ID NO: 131386 - DNA, 16 bp, H. sapiens
tatttcaaaaggaaat

SEQ ID NO: 131387 - DNA, 16 bp, H. sapiens
tatttcaaaataaaag

SEQ ID NO: 131388 - DNA, 16 bp, H. sapiens
tatttcaaaataaaga

SEQ ID NO: 131389 - DNA, 16 bp, H. sapiens
tatttcaaaatagcta

SEQ ID NO: 131390 - DNA, 16 bp, H. sapiens
tatttcaaaatggcta

SEQ ID NO: 131391 - DNA, 16 bp, H. sapiens
tatttcaaacaaaaca

SEQ ID NO: 131392 - DNA, 16 bp, H. sapiens
tatttcaaacttttaa

SEQ ID NO: 131393 - DNA, 16 bp, H. sapiens
tatttcaaagaaaaat

SEQ ID NO: 131394 - DNA, 16 bp, H. sapiens
tatttcaaagaaatat

SEQ ID NO: 131395 - DNA, 16 bp, H. sapiens
tatttcaaagaatttt

SEQ ID NO: 131396 - DNA, 16 bp, H. sapiens
tatttcaaagcatttt

SEQ ID NO: 131397 - DNA, 16 bp, H. sapiens
tatttcaaaggagaaa

SEQ ID NO: 131398 - DNA, 16 bp, H. sapiens
tatttcaaagtatttt

SEQ ID NO: 131399 - DNA, 16 bp, H. sapiens
tatttcaaagtttttt

SEQ ID NO: 131400 - DNA, 16 bp, H. sapiens
tatttcaaataaatga

SEQ ID NO: 131401 - DNA, 16 bp, H. sapiens
tatttcaaattgtttt

SEQ ID NO: 131402 - DNA, 16 bp, H. sapiens
tatttcaaattttgaa

SEQ ID NO: 131403 - DNA, 16 bp, H. sapiens
tatttcaacaacaaaa

SEQ ID NO: 131404 - DNA, 16 bp, H. sapiens
tatttcaagaattttt

SEQ ID NO: 131405 - DNA, 16 bp, H. sapiens
tatttcaagataattt

SEQ ID NO: 131406 - DNA, 16 bp, H. sapiens
tatttcaagatggatt

SEQ ID NO: 131407 - DNA, 16 bp, H. sapiens
tatttcaagtattttt

SEQ ID NO: 131408 - DNA, 16 bp, H. sapiens
tatttcaatttctttg

SEQ ID NO: 131409 - DNA, 16 bp, H. sapiens
tatttcacattgtatg

SEQ ID NO: 131410 - DNA, 16 bp, H. sapiens
tatttcacccctgcag

SEQ ID NO: 131411 - DNA, 16 bp, H. sapiens
tatttcacctttgttt

SEQ ID NO: 131412 - DNA, 16 bp, H. sapiens
tatttcacgtagcata

SEQ ID NO: 131413 - DNA, 16 bp, H. sapiens
tatttcactgtggtct

SEQ ID NO: 131414 - DNA, 16 bp, H. sapiens
tatttcacttaaaata

SEQ ID NO: 131415 - DNA, 16 bp, H. sapiens
tatttcagaaaagaaa

SEQ ID NO: 131416 - DNA, 16 bp, H. sapiens
tatttcagaaaatgtt

SEQ ID NO: 131417 - DNA, 16 bp, H. sapiens
tatttcagaaatattt

SEQ ID NO: 131418 - DNA, 16 bp, H. sapiens
tatttcagaataaaat

SEQ ID NO: 131419 - DNA, 16 bp, H. sapiens
tatttcagaatatttt

SEQ ID NO: 131420 - DNA, 16 bp, H. sapiens
tatttcagataaaata

SEQ ID NO: 131421 - DNA, 16 bp, H. sapiens
tatttcaggagaaaat

SEQ ID NO: 131422 - DNA, 16 bp, H. sapiens
tatttcagtatatatt

SEQ ID NO: 131423 - DNA, 16 bp, H. sapiens
tatttcagtgaaataa

SEQ ID NO: 131424 - DNA, 16 bp, H. sapiens
tatttcagttcttttg

SEQ ID NO: 131425 - DNA, 16 bp, H. sapiens
tatttcataatgaaaa

SEQ ID NO: 131426 - DNA, 16 bp, H. sapiens
tatttcatagattttt

SEQ ID NO: 131427 - DNA, 16 bp, H. sapiens
tatttcatatgaaaaa

SEQ ID NO: 131428 - DNA, 16 bp, H. sapiens
tatttcatatgtttta

SEQ ID NO: 131429 - DNA, 16 bp, H. sapiens
tatttcatatttcaaa

SEQ ID NO: 131430 - DNA, 16 bp, H. sapiens
tatttcatgtacccca

SEQ ID NO: 131431 - DNA, 16 bp, H. sapiens
tatttcatgttattta

SEQ ID NO: 131432 - DNA, 16 bp, H. sapiens
tatttcatgtttatat

SEQ ID NO: 131433 - DNA, 16 bp, H. sapiens
tatttcatgtttttga

SEQ ID NO: 131434 - DNA, 16 bp, H. sapiens
tatttcattaagaaaa

SEQ ID NO: 131435 - DNA, 16 bp, H. sapiens
tatttcattctcttgt

SEQ ID NO: 131436 - DNA, 16 bp, H. sapiens
tatttcattgaatttt

SEQ ID NO: 131437 - DNA, 16 bp, H. sapiens
tatttcattgatttga

SEQ ID NO: 131438 - DNA, 16 bp, H. sapiens
tatttcattgtaattt

SEQ ID NO: 131439 - DNA, 16 bp, H. sapiens
tatttcatttaatcct

SEQ ID NO: 131440 - DNA, 16 bp, H. sapiens
tatttcatttgatatt

SEQ ID NO: 131441 - DNA, 16 bp, H. sapiens
tatttcattttcttgc

SEQ ID NO: 131442 - DNA, 16 bp, H. sapiens
tatttcattttgaatt

SEQ ID NO: 131443 - DNA, 16 bp, H. sapiens
tatttcattttggata

SEQ ID NO: 131444 - DNA, 16 bp, H. sapiens
tatttccaaaaaaggt

SEQ ID NO: 131445 - DNA, 16 bp, H. sapiens
tatttccaaaataaat

SEQ ID NO: 131446 - DNA, 16 bp, H. sapiens
tatttccaaaatgttt

SEQ ID NO: 131447 - DNA, 16 bp, H. sapiens
tatttccaaagaaaat

SEQ ID NO: 131448 - DNA, 16 bp, H. sapiens
tatttccaaataagat

SEQ ID NO: 131449 - DNA, 16 bp, H. sapiens
tatttccaaattttaa

SEQ ID NO: 131450 - DNA, 16 bp, H. sapiens
tatttccaatattttg

SEQ ID NO: 131451 - DNA, 16 bp, H. sapiens
tatttccaatgaaaat

SEQ ID NO: 131452 - DNA, 16 bp, H. sapiens
tatttccattaaaata

SEQ ID NO: 131453 - DNA, 16 bp, H. sapiens
tatttccctctcctgc

SEQ ID NO: 131454 - DNA, 16 bp, H. sapiens
tatttccctgtctcct

SEQ ID NO: 131455 - DNA, 16 bp, H. sapiens
tatttccctgtttctt

SEQ ID NO: 131456 - DNA, 16 bp, H. sapiens
tatttcctaaaagaaa

SEQ ID NO: 131457 - DNA, 16 bp, H. sapiens
tatttcctaaaatatt

SEQ ID NO: 131458 - DNA, 16 bp, H. sapiens
tatttcctgaatttca

SEQ ID NO: 131459 - DNA, 16 bp, H. sapiens
tatttccttaaaaaaa

SEQ ID NO: 131460 - DNA, 16 bp, H. sapiens
tatttccttaaaaaat

SEQ ID NO: 131461 - DNA, 16 bp, H. sapiens
tatttccttaggaaaa

SEQ ID NO: 131462 - DNA, 16 bp, H. sapiens
tatttccttatgattg

SEQ ID NO: 131463 - DNA, 16 bp, H. sapiens
tatttccttcccctgc

SEQ ID NO: 131464 - DNA, 16 bp, H. sapiens
tatttccttgatcagt

SEQ ID NO: 131465 - DNA, 16 bp, H. sapiens
tatttccttgcctttt

SEQ ID NO: 131466 - DNA, 16 bp, H. sapiens
tatttcctttcaaaaa

SEQ ID NO: 131467 - DNA, 16 bp, H. sapiens
tatttcctttgaaaat

SEQ ID NO: 131468 - DNA, 16 bp, H. sapiens
tatttctaaaaatgtt

SEQ ID NO: 131469 - DNA, 16 bp, H. sapiens
tatttctaaagaaaat

SEQ ID NO: 131470 - DNA, 16 bp, H. sapiens
tatttctaaataaaca

SEQ ID NO: 131471 - DNA, 16 bp, H. sapiens
tatttctaagcatttt

SEQ ID NO: 131472 - DNA, 16 bp, H. sapiens
tatttctaccacattt

SEQ ID NO: 131473 - DNA, 16 bp, H. sapiens
tatttctaggttctct

SEQ ID NO: 131474 - DNA, 16 bp, H. sapiens
tatttctagtttttca

SEQ ID NO: 131475 - DNA, 16 bp, H. sapiens
tatttctataaagaat

SEQ ID NO: 131476 - DNA, 16 bp, H. sapiens
tatttctatatattag

SEQ ID NO: 131477 - DNA, 16 bp, H. sapiens
tatttctattgtttaa

SEQ ID NO: 131478 - DNA, 16 bp, H. sapiens
tatttctattttaagt

SEQ ID NO: 131479 - DNA, 16 bp, H. sapiens
tatttctcaaaaaaga

SEQ ID NO: 131480 - DNA, 16 bp, H. sapiens
tatttctcagcagaaa

SEQ ID NO: 131481 - DNA, 16 bp, H. sapiens
tatttctcataattct

SEQ ID NO: 131482 - DNA, 16 bp, H. sapiens
tatttctcatggttct

SEQ ID NO: 131483 - DNA, 16 bp, H. sapiens
tatttctcattaaaaa

SEQ ID NO: 131484 - DNA, 16 bp, H. sapiens
tatttctccaaagcct

SEQ ID NO: 131485 - DNA, 16 bp, H. sapiens
tatttctccaaataaa

SEQ ID NO: 131486 - DNA, 16 bp, H. sapiens
tatttctcctctgctt

SEQ ID NO: 131487 - DNA, 16 bp, H. sapiens
tatttctcctttgtgt

SEQ ID NO: 131488 - DNA, 16 bp, H. sapiens
tatttctctgaagatt

SEQ ID NO: 131489 - DNA, 16 bp, H. sapiens
tatttctctggagaac

SEQ ID NO: 131490 - DNA, 16 bp, H. sapiens
tatttctgaaaaaaaa

SEQ ID NO: 131491 - DNA, 16 bp, H. sapiens
tatttctgaaaaataa

SEQ ID NO: 131492 - DNA, 16 bp, H. sapiens
tatttctgaaacaatt

SEQ ID NO: 131493 - DNA, 16 bp, H. sapiens
tatttctgaagaaaat

SEQ ID NO: 131494 - DNA, 16 bp, H. sapiens
tatttctgaagttttt

SEQ ID NO: 131495 - DNA, 16 bp, H. sapiens
tatttctgacaatttt

SEQ ID NO: 131496 - DNA, 16 bp, H. sapiens
tatttctgatgaaaat

SEQ ID NO: 131497 - DNA, 16 bp, H. sapiens
tatttctgatgcctct

SEQ ID NO: 131498 - DNA, 16 bp, H. sapiens
tatttctgcatgtttt

SEQ ID NO: 131499 - DNA, 16 bp, H. sapiens
tatttctgccttaatt

SEQ ID NO: 131500 - DNA, 16 bp, H. sapiens
tatttctggaaaaaat

SEQ ID NO: 131501 - DNA, 16 bp, H. sapiens
tatttctggaagagat

SEQ ID NO: 131502 - DNA, 16 bp, H. sapiens
tatttctggatatttt

SEQ ID NO: 131503 - DNA, 16 bp, H. sapiens
tatttctggattttta

SEQ ID NO: 131504 - DNA, 16 bp, H. sapiens
tatttctggcctctct

SEQ ID NO: 131505 - DNA, 16 bp, H. sapiens
tatttctggcttttga

SEQ ID NO: 131506 - DNA, 16 bp, H. sapiens
tatttctgggttctct

SEQ ID NO: 131507 - DNA, 16 bp, H. sapiens
tatttctggtcacaaa

SEQ ID NO: 131508 - DNA, 16 bp, H. sapiens
tatttctgtataacaa

SEQ ID NO: 131509 - DNA, 16 bp, H. sapiens
tatttctgtatataaa

SEQ ID NO: 131510 - DNA, 16 bp, H. sapiens
tatttctgtattcatt

SEQ ID NO: 131511 - DNA, 16 bp, H. sapiens
tatttctgtcatttta

SEQ ID NO: 131512 - DNA, 16 bp, H. sapiens
tatttctgtgaaaaaa

SEQ ID NO: 131513 - DNA, 16 bp, H. sapiens
tatttctgtgaaaatt

SEQ ID NO: 131514 - DNA, 16 bp, H. sapiens
tatttctgtgaaatca

SEQ ID NO: 131515 - DNA, 16 bp, H. sapiens
tatttctgtgaaccaa

SEQ ID NO: 131516 - DNA, 16 bp, H. sapiens
tatttctgtgaggtca

SEQ ID NO: 131517 - DNA, 16 bp, H. sapiens
tatttctgtggcatca

SEQ ID NO: 131518 - DNA, 16 bp, H. sapiens
tatttcttaagaaaaa

SEQ ID NO: 131519 - DNA, 16 bp, H. sapiens
tatttcttacaattct

SEQ ID NO: 131520 - DNA, 16 bp, H. sapiens
tatttcttacaattgc

SEQ ID NO: 131521 - DNA, 16 bp, H. sapiens
tatttcttacacttct

SEQ ID NO: 131522 - DNA, 16 bp, H. sapiens
tatttcttagaaatat

SEQ ID NO: 131523 - DNA, 16 bp, H. sapiens
tatttcttatttgaaa

SEQ ID NO: 131524 - DNA, 16 bp, H. sapiens
tatttcttcaaatctt

SEQ ID NO: 131525 - DNA, 16 bp, H. sapiens
tatttcttcataaaat

SEQ ID NO: 131526 - DNA, 16 bp, H. sapiens
tatttcttcatagcag

SEQ ID NO: 131527 - DNA, 16 bp, H. sapiens
tatttcttcatttgct

SEQ ID NO: 131528 - DNA, 16 bp, H. sapiens
tatttcttccataaat

SEQ ID NO: 131529 - DNA, 16 bp, H. sapiens
tatttcttcctcttgc

SEQ ID NO: 131530 - DNA, 16 bp, H. sapiens
tatttcttcctggttt

SEQ ID NO: 131531 - DNA, 16 bp, H. sapiens
tatttcttccttaaaa

SEQ ID NO: 131532 - DNA, 16 bp, H. sapiens
tatttcttctctgatc

SEQ ID NO: 131533 - DNA, 16 bp, H. sapiens
tatttcttcttaaaaa

SEQ ID NO: 131534 - DNA, 16 bp, H. sapiens
tatttcttcttcacat

SEQ ID NO: 131535 - DNA, 16 bp, H. sapiens
tatttcttcttgagtg

SEQ ID NO: 131536 - DNA, 16 bp, H. sapiens
tatttcttcttgagtt

SEQ ID NO: 131537 - DNA, 16 bp, H. sapiens
tatttcttgccctctg

SEQ ID NO: 131538 - DNA, 16 bp, H. sapiens
tatttcttgctcatat

SEQ ID NO: 131539 - DNA, 16 bp, H. sapiens
tatttcttgtcctctg

SEQ ID NO: 131540 - DNA, 16 bp, H. sapiens
tatttctttaaaaact

SEQ ID NO: 131541 - DNA, 16 bp, H. sapiens
tatttctttaaataag

SEQ ID NO: 131542 - DNA, 16 bp, H. sapiens
tatttctttaatgaat

SEQ ID NO: 131543 - DNA, 16 bp, H. sapiens
tatttctttagaaaaa

SEQ ID NO: 131544 - DNA, 16 bp, H. sapiens
tatttctttagaaaat

SEQ ID NO: 131545 - DNA, 16 bp, H. sapiens
tatttctttccaaatt

SEQ ID NO: 131546 - DNA, 16 bp, H. sapiens
tatttctttcctaaat

SEQ ID NO: 131547 - DNA, 16 bp, H. sapiens
tatttctttctcctga

SEQ ID NO: 131548 - DNA, 16 bp, H. sapiens
tatttctttctctaaa

SEQ ID NO: 131549 - DNA, 16 bp, H. sapiens
tatttctttgaaattt

SEQ ID NO: 131550 - DNA, 16 bp, H. sapiens
tatttctttgaagttt

SEQ ID NO: 131551 - DNA, 16 bp, H. sapiens
tatttctttgcatgtc

SEQ ID NO: 131552 - DNA, 16 bp, H. sapiens
tatttcttttaaacaa

SEQ ID NO: 131553 - DNA, 16 bp, H. sapiens
tatttcttttccccaa

SEQ ID NO: 131554 - DNA, 16 bp, H. sapiens
tatttgaaaaaatatg

SEQ ID NO: 131555 - DNA, 16 bp, H. sapiens
tatttgaaaacagaaa

SEQ ID NO: 131556 - DNA, 16 bp, H. sapiens
tatttgaaaatcaatc

SEQ ID NO: 131557 - DNA, 16 bp, H. sapiens
tatttgaaactaatga

SEQ ID NO: 131558 - DNA, 16 bp, H. sapiens
tatttgaaacttttaa

SEQ ID NO: 131559 - DNA, 16 bp, H. sapiens
tatttgaaatagaaat

SEQ ID NO: 131560 - DNA, 16 bp, H. sapiens
tatttgaaatcatttt

SEQ ID NO: 131561 - DNA, 16 bp, H. sapiens
tatttgaaatgtataa

SEQ ID NO: 131562 - DNA, 16 bp, H. sapiens
tatttgaaatgtgttt

SEQ ID NO: 131563 - DNA, 16 bp, H. sapiens
tatttgaaattcttct

SEQ ID NO: 131564 - DNA, 16 bp, H. sapiens
tatttgaaatttttct

SEQ ID NO: 131565 - DNA, 16 bp, H. sapiens
tatttgaacatttatt

SEQ ID NO: 131566 - DNA, 16 bp, H. sapiens
tatttgaagaaaatat

SEQ ID NO: 131567 - DNA, 16 bp, H. sapiens
tatttgaagagaaaaa

SEQ ID NO: 131568 - DNA, 16 bp, H. sapiens
tatttgaagcttttct

SEQ ID NO: 131569 - DNA, 16 bp, H. sapiens
tatttgaatacgcttt

SEQ ID NO: 131570 - DNA, 16 bp, H. sapiens
tatttgaatattctct

SEQ ID NO: 131571 - DNA, 16 bp, H. sapiens
tatttgaatatttgaa

SEQ ID NO: 131572 - DNA, 16 bp, H. sapiens
tatttgaatcttcttt

SEQ ID NO: 131573 - DNA, 16 bp, H. sapiens
tatttgaatcttgtct

SEQ ID NO: 131574 - DNA, 16 bp, H. sapiens
tatttgaattatttct

SEQ ID NO: 131575 - DNA, 16 bp, H. sapiens
tatttgaatttttcta

SEQ ID NO: 131576 - DNA, 16 bp, H. sapiens
tatttgacatatttta

SEQ ID NO: 131577 - DNA, 16 bp, H. sapiens
tatttgaccaaaaaaa

SEQ ID NO: 131578 - DNA, 16 bp, H. sapiens
tatttgacttgttgta

SEQ ID NO: 131579 - DNA, 16 bp, H. sapiens
tatttgactttatttc

SEQ ID NO: 131580 - DNA, 16 bp, H. sapiens
tatttgagaaatttaa

SEQ ID NO: 131581 - DNA, 16 bp, H. sapiens
tatttgagatcttttt

SEQ ID NO: 131582 - DNA, 16 bp, H. sapiens
tatttgagggaaaaaa

SEQ ID NO: 131583 - DNA, 16 bp, H. sapiens
tatttgaggtttacaa

SEQ ID NO: 131584 - DNA, 16 bp, H. sapiens
tatttgagttgtttct

SEQ ID NO: 131585 - DNA, 16 bp, H. sapiens
tatttgagttttaaaa

SEQ ID NO: 131586 - DNA, 16 bp, H. sapiens
tatttgatacattttt

SEQ ID NO: 131587 - DNA, 16 bp, H. sapiens
tatttgatagcacaac

SEQ ID NO: 131588 - DNA, 16 bp, H. sapiens
tatttgatatcaaata

SEQ ID NO: 131589 - DNA, 16 bp, H. sapiens
tatttgatggtacaaa

SEQ ID NO: 131590 - DNA, 16 bp, H. sapiens
tatttgattacatttt

SEQ ID NO: 131591 - DNA, 16 bp, H. sapiens
tatttgattatgtatg

SEQ ID NO: 131592 - DNA, 16 bp, H. sapiens
tatttgatttcttaaa

SEQ ID NO: 131593 - DNA, 16 bp, H. sapiens
tatttgattttccatt

SEQ ID NO: 131594 - DNA, 16 bp, H. sapiens
tatttgcaataaaaaa

SEQ ID NO: 131595 - DNA, 16 bp, H. sapiens
tatttgcaattaaaaa

SEQ ID NO: 131596 - DNA, 16 bp, H. sapiens
tatttgcagaatacat

SEQ ID NO: 131597 - DNA, 16 bp, H. sapiens
tatttgcataaagaaa

SEQ ID NO: 131598 - DNA, 16 bp, H. sapiens
tatttgcatagttttg

SEQ ID NO: 131599 - DNA, 16 bp, H. sapiens
tatttgcatataacct

SEQ ID NO: 131600 - DNA, 16 bp, H. sapiens
tatttgcatatacata

SEQ ID NO: 131601 - DNA, 16 bp, H. sapiens
tatttgcatatgcata

SEQ ID NO: 131602 - DNA, 16 bp, H. sapiens
tatttgcatattacct

SEQ ID NO: 131603 - DNA, 16 bp, H. sapiens
tatttgcatgtaacct

SEQ ID NO: 131604 - DNA, 16 bp, H. sapiens
tatttgcattaatttt

SEQ ID NO: 131605 - DNA, 16 bp, H. sapiens
tatttgcattttagaa

SEQ ID NO: 131606 - DNA, 16 bp, H. sapiens
tatttgcatttttaaa

SEQ ID NO: 131607 - DNA, 16 bp, H. sapiens
tatttgcatttttact

SEQ ID NO: 131608 - DNA, 16 bp, H. sapiens
tatttgccaggctggt

SEQ ID NO: 131609 - DNA, 16 bp, H. sapiens
tatttgccatttaaaa

SEQ ID NO: 131610 - DNA, 16 bp, H. sapiens
tatttgccttttaaaa

SEQ ID NO: 131611 - DNA, 16 bp, H. sapiens
tatttgctaaaataaa

SEQ ID NO: 131612 - DNA, 16 bp, H. sapiens
tatttgctattgtgaa

SEQ ID NO: 131613 - DNA, 16 bp, H. sapiens
tatttgctcaaataaa

SEQ ID NO: 131614 - DNA, 16 bp, H. sapiens
tatttgctcatttatt

SEQ ID NO: 131615 - DNA, 16 bp, H. sapiens
tatttgctgaatgaat

SEQ ID NO: 131616 - DNA, 16 bp, H. sapiens
tatttgctgactgaat

SEQ ID NO: 131617 - DNA, 16 bp, H. sapiens
tatttgctgtgcagaa

SEQ ID NO: 131618 - DNA, 16 bp, H. sapiens
tatttgcttatttaat

SEQ ID NO: 131619 - DNA, 16 bp, H. sapiens
tatttgcttcaaaata

SEQ ID NO: 131620 - DNA, 16 bp, H. sapiens
tatttgctttaaatat

SEQ ID NO: 131621 - DNA, 16 bp, H. sapiens
tatttgctttatgtat

SEQ ID NO: 131622 - DNA, 16 bp, H. sapiens
tatttgctttttaaaa

SEQ ID NO: 131623 - DNA, 16 bp, H. sapiens
tatttgcttttttaaa

SEQ ID NO: 131624 - DNA, 16 bp, H. sapiens
tatttgcttttttcac

SEQ ID NO: 131625 - DNA, 16 bp, H. sapiens
tatttggaaaaattaa

SEQ ID NO: 131626 - DNA, 16 bp, H. sapiens
tatttggaaacaaaaa

SEQ ID NO: 131627 - DNA, 16 bp, H. sapiens
tatttggaaagagggt

SEQ ID NO: 131628 - DNA, 16 bp, H. sapiens
tatttggaaataaagt

SEQ ID NO: 131629 - DNA, 16 bp, H. sapiens
tatttggaaatatata

SEQ ID NO: 131630 - DNA, 16 bp, H. sapiens
tatttggaatatatat

SEQ ID NO: 131631 - DNA, 16 bp, H. sapiens
tatttggaattttaaa

SEQ ID NO: 131632 - DNA, 16 bp, H. sapiens
tatttggagaaagggc

SEQ ID NO: 131633 - DNA, 16 bp, H. sapiens
tatttggagataagac

SEQ ID NO: 131634 - DNA, 16 bp, H. sapiens
tatttggagggctttg

SEQ ID NO: 131635 - DNA, 16 bp, H. sapiens
tatttggagtcttttg

SEQ ID NO: 131636 - DNA, 16 bp, H. sapiens
tatttggagttttaaa

SEQ ID NO: 131637 - DNA, 16 bp, H. sapiens
tatttggagtttttct

SEQ ID NO: 131638 - DNA, 16 bp, H. sapiens
tatttggatattttct

SEQ ID NO: 131639 - DNA, 16 bp, H. sapiens
tatttggattgttttc

SEQ ID NO: 131640 - DNA, 16 bp, H. sapiens
tatttggcaataaaaa

SEQ ID NO: 131641 - DNA, 16 bp, H. sapiens
tatttggctataaaaa

SEQ ID NO: 131642 - DNA, 16 bp, H. sapiens
tatttgggaaaataaa

SEQ ID NO: 131643 - DNA, 16 bp, H. sapiens
tatttgggaaatattt

SEQ ID NO: 131644 - DNA, 16 bp, H. sapiens
tatttgggattttaaa

SEQ ID NO: 131645 - DNA, 16 bp, H. sapiens
tatttggggaaaatat

SEQ ID NO: 131646 - DNA, 16 bp, H. sapiens
tatttggggatttttc

SEQ ID NO: 131647 - DNA, 16 bp, H. sapiens
tatttgggggaagaaa

SEQ ID NO: 131648 - DNA, 16 bp, H. sapiens
tatttgggtcttcttt

SEQ ID NO: 131649 - DNA, 16 bp, H. sapiens
tatttgggtgatgggt

SEQ ID NO: 131650 - DNA, 16 bp, H. sapiens
tatttggtaaaataaa

SEQ ID NO: 131651 - DNA, 16 bp, H. sapiens
tatttggtaaatgaat

SEQ ID NO: 131652 - DNA, 16 bp, H. sapiens
tatttggtataaaaat

SEQ ID NO: 131653 - DNA, 16 bp, H. sapiens
tatttggtctttgacc

SEQ ID NO: 131654 - DNA, 16 bp, H. sapiens
tatttggtggtctctt

SEQ ID NO: 131655 - DNA, 16 bp, H. sapiens
tatttggttaaaaaaa

SEQ ID NO: 131656 - DNA, 16 bp, H. sapiens
tatttggttaaacatt

SEQ ID NO: 131657 - DNA, 16 bp, H. sapiens
tatttggttcttttaa

SEQ ID NO: 131658 - DNA, 16 bp, H. sapiens
tatttggtttttcacc

SEQ ID NO: 131659 - DNA, 16 bp, H. sapiens
tatttgtaaaatagag

SEQ ID NO: 131660 - DNA, 16 bp, H. sapiens
tatttgtaaaatgaag

SEQ ID NO: 131661 - DNA, 16 bp, H. sapiens
tatttgtaaaatgtaa

SEQ ID NO: 131662 - DNA, 16 bp, H. sapiens
tatttgtaaacaggat

SEQ ID NO: 131663 - DNA, 16 bp, H. sapiens
tatttgtaaatcatgt

SEQ ID NO: 131664 - DNA, 16 bp, H. sapiens
tatttgtaaattttcc

SEQ ID NO: 131665 - DNA, 16 bp, H. sapiens
tatttgtaatctttta

SEQ ID NO: 131666 - DNA, 16 bp, H. sapiens
tatttgtacaaataaa

SEQ ID NO: 131667 - DNA, 16 bp, H. sapiens
tatttgtacttttaaa

SEQ ID NO: 131668 - DNA, 16 bp, H. sapiens
tatttgtagaataaat

SEQ ID NO: 131669 - DNA, 16 bp, H. sapiens
tatttgtagagatgga

SEQ ID NO: 131670 - DNA, 16 bp, H. sapiens
tatttgtatataactt

SEQ ID NO: 131671 - DNA, 16 bp, H. sapiens
tatttgtatatagaaa

SEQ ID NO: 131672 - DNA, 16 bp, H. sapiens
tatttgtcaattaaaa

SEQ ID NO: 131673 - DNA, 16 bp, H. sapiens
tatttgtcaatttaaa

SEQ ID NO: 131674 - DNA, 16 bp, H. sapiens
tatttgtcaattttaa

SEQ ID NO: 131675 - DNA, 16 bp, H. sapiens
tatttgtcagttatac

SEQ ID NO: 131676 - DNA, 16 bp, H. sapiens
tatttgtcataatttt

SEQ ID NO: 131677 - DNA, 16 bp, H. sapiens
tatttgtcctttgtgt

SEQ ID NO: 131678 - DNA, 16 bp, H. sapiens
tatttgtcttattaat

SEQ ID NO: 131679 - DNA, 16 bp, H. sapiens
tatttgtctttctctg

SEQ ID NO: 131680 - DNA, 16 bp, H. sapiens
tatttgtgaaaagaaa

SEQ ID NO: 131681 - DNA, 16 bp, H. sapiens
tatttgtgaaattaat

SEQ ID NO: 131682 - DNA, 16 bp, H. sapiens
tatttgtgaatttgat

SEQ ID NO: 131683 - DNA, 16 bp, H. sapiens
tatttgtgcatatttt

SEQ ID NO: 131684 - DNA, 16 bp, H. sapiens
tatttgtggaatgaaa

SEQ ID NO: 131685 - DNA, 16 bp, H. sapiens
tatttgtggaatgaat

SEQ ID NO: 131686 - DNA, 16 bp, H. sapiens
tatttgtggattctgt

SEQ ID NO: 131687 - DNA, 16 bp, H. sapiens
tatttgtggggtacag

SEQ ID NO: 131688 - DNA, 16 bp, H. sapiens
tatttgtgtgactttt

SEQ ID NO: 131689 - DNA, 16 bp, H. sapiens
tatttgtgtgtataca

SEQ ID NO: 131690 - DNA, 16 bp, H. sapiens
tatttgtgtgtctaaa

SEQ ID NO: 131691 - DNA, 16 bp, H. sapiens
tatttgtgtgttcact

SEQ ID NO: 131692 - DNA, 16 bp, H. sapiens
tatttgttaaagaaac

SEQ ID NO: 131693 - DNA, 16 bp, H. sapiens
tatttgttattgtgaa

SEQ ID NO: 131694 - DNA, 16 bp, H. sapiens
tatttgttcaataaat

SEQ ID NO: 131695 - DNA, 16 bp, H. sapiens
tatttgttcattaatt

SEQ ID NO: 131696 - DNA, 16 bp, H. sapiens
tatttgttgaagaaat

SEQ ID NO: 131697 - DNA, 16 bp, H. sapiens
tatttgttgaaggaat

SEQ ID NO: 131698 - DNA, 16 bp, H. sapiens
tatttgttgaataaat

SEQ ID NO: 131699 - DNA, 16 bp, H. sapiens
tatttgttgaatcagt

SEQ ID NO: 131700 - DNA, 16 bp, H. sapiens
tatttgttgagctcct

SEQ ID NO: 131701 - DNA, 16 bp, H. sapiens
tatttgtttacatgtc

SEQ ID NO: 131702 - DNA, 16 bp, H. sapiens
tatttgtttcaaataa

SEQ ID NO: 131703 - DNA, 16 bp, H. sapiens
tatttgtttcataaat

SEQ ID NO: 131704 - DNA, 16 bp, H. sapiens
tatttgtttccaaaat

SEQ ID NO: 131705 - DNA, 16 bp, H. sapiens
tatttgtttgttcact

SEQ ID NO: 131706 - DNA, 16 bp, H. sapiens
tatttgttttaagaaa

SEQ ID NO: 131707 - DNA, 16 bp, H. sapiens
tatttgttttacatat

SEQ ID NO: 131708 - DNA, 16 bp, H. sapiens
tattttaaaaacaagt

SEQ ID NO: 131709 - DNA, 16 bp, H. sapiens
tattttaaaaactcta

SEQ ID NO: 131710 - DNA, 16 bp, H. sapiens
tattttaaaaagtttg

SEQ ID NO: 131711 - DNA, 16 bp, H. sapiens
tattttaaaaatcttg

SEQ ID NO: 131712 - DNA, 16 bp, H. sapiens
tattttaaaaatgtgt

SEQ ID NO: 131713 - DNA, 16 bp, H. sapiens
tattttaaaaccagaa

SEQ ID NO: 131714 - DNA, 16 bp, H. sapiens
tattttaaaactactt

SEQ ID NO: 131715 - DNA, 16 bp, H. sapiens
tattttaaaactgttt

SEQ ID NO: 131716 - DNA, 16 bp, H. sapiens
tattttaaaacttcaa

SEQ ID NO: 131717 - DNA, 16 bp, H. sapiens
tattttaaaagataca

SEQ ID NO: 131718 - DNA, 16 bp, H. sapiens
tattttaaaaggaaac

SEQ ID NO: 131719 - DNA, 16 bp, H. sapiens
tattttaaaagtagaa

SEQ ID NO: 131720 - DNA, 16 bp, H. sapiens
tattttaaaagttgaa

SEQ ID NO: 131721 - DNA, 16 bp, H. sapiens
tattttaaaataacag

SEQ ID NO: 131722 - DNA, 16 bp, H. sapiens
tattttaaaataatgc

SEQ ID NO: 131723 - DNA, 16 bp, H. sapiens
tattttaaaatgctga

SEQ ID NO: 131724 - DNA, 16 bp, H. sapiens
tattttaaaatgcttt

SEQ ID NO: 131725 - DNA, 16 bp, H. sapiens
tattttaaaatgtaca

SEQ ID NO: 131726 - DNA, 16 bp, H. sapiens
tattttaaaatgtctt

SEQ ID NO: 131727 - DNA, 16 bp, H. sapiens
tattttaaacaaatag

SEQ ID NO: 131728 - DNA, 16 bp, H. sapiens
tattttaaacacttta

SEQ ID NO: 131729 - DNA, 16 bp, H. sapiens
tattttaaagaatgtt

SEQ ID NO: 131730 - DNA, 16 bp, H. sapiens
tattttaaagaggaaa

SEQ ID NO: 131731 - DNA, 16 bp, H. sapiens
tattttaaagataagg

SEQ ID NO: 131732 - DNA, 16 bp, H. sapiens
tattttaaagatgtca

SEQ ID NO: 131733 - DNA, 16 bp, H. sapiens
tattttaaagattctg

SEQ ID NO: 131734 - DNA, 16 bp, H. sapiens
tattttaaagcaaaaa

SEQ ID NO: 131735 - DNA, 16 bp, H. sapiens
tattttaaagcattta

SEQ ID NO: 131736 - DNA, 16 bp, H. sapiens
tattttaaaggcaaaa

SEQ ID NO: 131737 - DNA, 16 bp, H. sapiens
tattttaaagtacatt

SEQ ID NO: 131738 - DNA, 16 bp, H. sapiens
tattttaaagttaaga

SEQ ID NO: 131739 - DNA, 16 bp, H. sapiens
tattttaaatggaatt

SEQ ID NO: 131740 - DNA, 16 bp, H. sapiens
tattttaaattctcag

SEQ ID NO: 131741 - DNA, 16 bp, H. sapiens
tattttaacagaaata

SEQ ID NO: 131742 - DNA, 16 bp, H. sapiens
tattttaactgtattt

SEQ ID NO: 131743 - DNA, 16 bp, H. sapiens
tattttaagcattttt

SEQ ID NO: 131744 - DNA, 16 bp, H. sapiens
tattttaagccatttt

SEQ ID NO: 131745 - DNA, 16 bp, H. sapiens
tattttaaggaaaaat

SEQ ID NO: 131746 - DNA, 16 bp, H. sapiens
tattttaaggaattga

SEQ ID NO: 131747 - DNA, 16 bp, H. sapiens
tattttaaggaattgg

SEQ ID NO: 131748 - DNA, 16 bp, H. sapiens
tattttaatagctatt

SEQ ID NO: 131749 - DNA, 16 bp, H. sapiens
tattttaatatgcttt

SEQ ID NO: 131750 - DNA, 16 bp, H. sapiens
tattttaatgtaaatg

SEQ ID NO: 131751 - DNA, 16 bp, H. sapiens
tattttaattgcttta

SEQ ID NO: 131752 - DNA, 16 bp, H. sapiens
tattttacaaatgaaa

SEQ ID NO: 131753 - DNA, 16 bp, H. sapiens
tattttacaaatgaag

SEQ ID NO: 131754 - DNA, 16 bp, H. sapiens
tattttacaaatgaga

SEQ ID NO: 131755 - DNA, 16 bp, H. sapiens
tattttacaaatgagg

SEQ ID NO: 131756 - DNA, 16 bp, H. sapiens
tattttacaaatgcat

SEQ ID NO: 131757 - DNA, 16 bp, H. sapiens
tattttacaatgaaaa

SEQ ID NO: 131758 - DNA, 16 bp, H. sapiens
tattttacagaatttg

SEQ ID NO: 131759 - DNA, 16 bp, H. sapiens
tattttacagatgata

SEQ ID NO: 131760 - DNA, 16 bp, H. sapiens
tattttacagttttat

SEQ ID NO: 131761 - DNA, 16 bp, H. sapiens
tattttacattatttg

SEQ ID NO: 131762 - DNA, 16 bp, H. sapiens
tattttaccacaggtt

SEQ ID NO: 131763 - DNA, 16 bp, H. sapiens
tattttaccattaaat

SEQ ID NO: 131764 - DNA, 16 bp, H. sapiens
tattttacctatttcc

SEQ ID NO: 131765 - DNA, 16 bp, H. sapiens
tattttacttcaaaat

SEQ ID NO: 131766 - DNA, 16 bp, H. sapiens
tattttacttgaattt

SEQ ID NO: 131767 - DNA, 16 bp, H. sapiens
tattttacttttgaga

SEQ ID NO: 131768 - DNA, 16 bp, H. sapiens
tattttagaaaatgaa

SEQ ID NO: 131769 - DNA, 16 bp, H. sapiens
tattttagaaatgtat

SEQ ID NO: 131770 - DNA, 16 bp, H. sapiens
tattttagaatgaaaa

SEQ ID NO: 131771 - DNA, 16 bp, H. sapiens
tattttagaatttctt

SEQ ID NO: 131772 - DNA, 16 bp, H. sapiens
tattttagaattttct

SEQ ID NO: 131773 - DNA, 16 bp, H. sapiens
tattttagacttttaa

SEQ ID NO: 131774 - DNA, 16 bp, H. sapiens
tattttagagacaagg

SEQ ID NO: 131775 - DNA, 16 bp, H. sapiens
tattttagatacctta

SEQ ID NO: 131776 - DNA, 16 bp, H. sapiens
tattttaggaaaaata

SEQ ID NO: 131777 - DNA, 16 bp, H. sapiens
tattttaggaaaattt

SEQ ID NO: 131778 - DNA, 16 bp, H. sapiens
tattttaggacaagaa

SEQ ID NO: 131779 - DNA, 16 bp, H. sapiens
tattttaggccaggca

SEQ ID NO: 131780 - DNA, 16 bp, H. sapiens
tattttaggttcagtg

SEQ ID NO: 131781 - DNA, 27 bp, H. sapiens
tattttagtagagacggggtttcacca

SEQ ID NO: 131782 - DNA, 16 bp, H. sapiens
tattttagtcattctg

SEQ ID NO: 131783 - DNA, 16 bp, H. sapiens
tattttagttttctga

SEQ ID NO: 131784 - DNA, 16 bp, H. sapiens
tattttataaatggaa

SEQ ID NO: 131785 - DNA, 16 bp, H. sapiens
tattttataaattacc

SEQ ID NO: 131786 - DNA, 16 bp, H. sapiens
tattttataagcattt

SEQ ID NO: 131787 - DNA, 16 bp, H. sapiens
tattttatactttggg

SEQ ID NO: 131788 - DNA, 16 bp, H. sapiens
tattttatagaggaaa

SEQ ID NO: 131789 - DNA, 16 bp, H. sapiens
tattttatagtaaagt

SEQ ID NO: 131790 - DNA, 16 bp, H. sapiens
tattttatataaatgg

SEQ ID NO: 131791 - DNA, 16 bp, H. sapiens
tattttatatgattca

SEQ ID NO: 131792 - DNA, 16 bp, H. sapiens
tattttatatgcatta

SEQ ID NO: 131793 - DNA, 16 bp, H. sapiens
tattttatatgcttat

SEQ ID NO: 131794 - DNA, 16 bp, H. sapiens
tattttatcccattct

SEQ ID NO: 131795 - DNA, 16 bp, H. sapiens
tattttatgaaatgaa

SEQ ID NO: 131796 - DNA, 16 bp, H. sapiens
tattttatgacatttt

SEQ ID NO: 131797 - DNA, 16 bp, H. sapiens
tattttatgcattcat

SEQ ID NO: 131798 - DNA, 16 bp, H. sapiens
tattttatgcatttgt

SEQ ID NO: 131799 - DNA, 16 bp, H. sapiens
tattttatggaggatt

SEQ ID NO: 131800 - DNA, 16 bp, H. sapiens
tattttatgtaaaatg

SEQ ID NO: 131801 - DNA, 16 bp, H. sapiens
tattttatgtccattt

SEQ ID NO: 131802 - DNA, 16 bp, H. sapiens
tattttatgtgtggcc

SEQ ID NO: 131803 - DNA, 16 bp, H. sapiens
tattttatgtttctaa

SEQ ID NO: 131804 - DNA, 16 bp, H. sapiens
tattttattacactgg

SEQ ID NO: 131805 - DNA, 16 bp, H. sapiens
tattttattacagcag

SEQ ID NO: 131806 - DNA, 16 bp, H. sapiens
tattttattgacattt

SEQ ID NO: 131807 - DNA, 16 bp, H. sapiens
tattttattgtaagaa

SEQ ID NO: 131808 - DNA, 16 bp, H. sapiens
tattttattgtatgga

SEQ ID NO: 131809 - DNA, 16 bp, H. sapiens
tattttatttaacagt

SEQ ID NO: 131810 - DNA, 16 bp, H. sapiens
tattttatttactgta

SEQ ID NO: 131811 - DNA, 16 bp, H. sapiens
tattttattttcaaag

SEQ ID NO: 131812 - DNA, 16 bp, H. sapiens
tattttcaaaaagaaa

SEQ ID NO: 131813 - DNA, 16 bp, H. sapiens
tattttcaaaagatat

SEQ ID NO: 131814 - DNA, 16 bp, H. sapiens
tattttcaaagagaaa

SEQ ID NO: 131815 - DNA, 16 bp, H. sapiens
tattttcaaagcaaaa

SEQ ID NO: 131816 - DNA, 16 bp, H. sapiens
tattttcaaagttcat

SEQ ID NO: 131817 - DNA, 16 bp, H. sapiens
tattttcaaatgtaaa

SEQ ID NO: 131818 - DNA, 16 bp, H. sapiens
tattttcaaatgtatt

SEQ ID NO: 131819 - DNA, 16 bp, H. sapiens
tattttcaaattcaaa

SEQ ID NO: 131820 - DNA, 16 bp, H. sapiens
tattttcaaattgtat

SEQ ID NO: 131821 - DNA, 16 bp, H. sapiens
tattttcaagtatttt

SEQ ID NO: 131822 - DNA, 16 bp, H. sapiens
tattttcaagttattt

SEQ ID NO: 131823 - DNA, 16 bp, H. sapiens
tattttcacagaaaat

SEQ ID NO: 131824 - DNA, 16 bp, H. sapiens
tattttcacccatttt

SEQ ID NO: 131825 - DNA, 16 bp, H. sapiens
tattttcagaaaaaca

SEQ ID NO: 131826 - DNA, 16 bp, H. sapiens
tattttcagaaagaga

SEQ ID NO: 131827 - DNA, 16 bp, H. sapiens
tattttcagacagagt

SEQ ID NO: 131828 - DNA, 16 bp, H. sapiens
tattttcagagaaaat

SEQ ID NO: 131829 - DNA, 16 bp, H. sapiens
tattttcagagtattt

SEQ ID NO: 131830 - DNA, 16 bp, H. sapiens
tattttcagatgaaat

SEQ ID NO: 131831 - DNA, 16 bp, H. sapiens
tattttcagatgagga

SEQ ID NO: 131832 - DNA, 16 bp, H. sapiens
tattttcagtaataaa

SEQ ID NO: 131833 - DNA, 16 bp, H. sapiens
tattttcagtatatat

SEQ ID NO: 131834 - DNA, 16 bp, H. sapiens
tattttcagtgatttt

SEQ ID NO: 131835 - DNA, 16 bp, H. sapiens
tattttcagtgttttg

SEQ ID NO: 131836 - DNA, 16 bp, H. sapiens
tattttcagtttatga

SEQ ID NO: 131837 - DNA, 16 bp, H. sapiens
tattttcataatgttt

SEQ ID NO: 131838 - DNA, 16 bp, H. sapiens
tattttcatataacat

SEQ ID NO: 131839 - DNA, 16 bp, H. sapiens
tattttcatatgatta

SEQ ID NO: 131840 - DNA, 16 bp, H. sapiens
tattttcatcagaaat

SEQ ID NO: 131841 - DNA, 16 bp, H. sapiens
tattttcatctgctta

SEQ ID NO: 131842 - DNA, 16 bp, H. sapiens
tattttcatgaaaata

SEQ ID NO: 131843 - DNA, 16 bp, H. sapiens
tattttcatgtatgtt

SEQ ID NO: 131844 - DNA, 16 bp, H. sapiens
tattttcattaaacca

SEQ ID NO: 131845 - DNA, 16 bp, H. sapiens
tattttcattatctca

SEQ ID NO: 131846 - DNA, 16 bp, H. sapiens
tattttcattctcttg

SEQ ID NO: 131847 - DNA, 16 bp, H. sapiens
tattttcatttccaaa

SEQ ID NO: 131848 - DNA, 16 bp, H. sapiens
tattttcatttgctaa

SEQ ID NO: 131849 - DNA, 16 bp, H. sapiens
tattttcattttgcat

SEQ ID NO: 131850 - DNA, 16 bp, H. sapiens
tattttcatttttgaa

SEQ ID NO: 131851 - DNA, 16 bp, H. sapiens
tattttccaaaatgtt

SEQ ID NO: 131852 - DNA, 16 bp, H. sapiens
tattttccaaagaaaa

SEQ ID NO: 131853 - DNA, 16 bp, H. sapiens
tattttccaaagatga

SEQ ID NO: 131854 - DNA, 16 bp, H. sapiens
tattttccaaagtttt

SEQ ID NO: 131855 - DNA, 16 bp, H. sapiens
tattttccaaataatt

SEQ ID NO: 131856 - DNA, 16 bp, H. sapiens
tattttccaattgttt

SEQ ID NO: 131857 - DNA, 16 bp, H. sapiens
tattttccagtaacat

SEQ ID NO: 131858 - DNA, 16 bp, H. sapiens
tattttccagttattt

SEQ ID NO: 131859 - DNA, 16 bp, H. sapiens
tattttccagttttct

SEQ ID NO: 131860 - DNA, 16 bp, H. sapiens
tattttccagtttttc

SEQ ID NO: 131861 - DNA, 16 bp, H. sapiens
tattttccatttgaaa

SEQ ID NO: 131862 - DNA, 16 bp, H. sapiens
tattttccctgtgttt

SEQ ID NO: 131863 - DNA, 16 bp, H. sapiens
tattttcctctgaaaa

SEQ ID NO: 131864 - DNA, 16 bp, H. sapiens
tattttcctgaatatt

SEQ ID NO: 131865 - DNA, 16 bp, H. sapiens
tattttcctgtcttct

SEQ ID NO: 131866 - DNA, 16 bp, H. sapiens
tattttccttctcaaa

SEQ ID NO: 131867 - DNA, 16 bp, H. sapiens
tattttcctttcaaaa

SEQ ID NO: 131868 - DNA, 16 bp, H. sapiens
tattttcctttggaaa

SEQ ID NO: 131869 - DNA, 16 bp, H. sapiens
tattttcctttgtgaa

SEQ ID NO: 131870 - DNA, 16 bp, H. sapiens
tattttccttttcaaa

SEQ ID NO: 131871 - DNA, 16 bp, H. sapiens
tattttctaaaaagaa

SEQ ID NO: 131872 - DNA, 16 bp, H. sapiens
tattttctaaaagaaa

SEQ ID NO: 131873 - DNA, 16 bp, H. sapiens
tattttctaaagcaaa

SEQ ID NO: 131874 - DNA, 16 bp, H. sapiens
tattttctaataaatg

SEQ ID NO: 131875 - DNA, 16 bp, H. sapiens
tattttctaatgtcat

SEQ ID NO: 131876 - DNA, 16 bp, H. sapiens
tattttctagagaaaa

SEQ ID NO: 131877 - DNA, 16 bp, H. sapiens
tattttctatctctgt

SEQ ID NO: 131878 - DNA, 16 bp, H. sapiens
tattttctatctgtat

SEQ ID NO: 131879 - DNA, 16 bp, H. sapiens
tattttctatgtgcca

SEQ ID NO: 131880 - DNA, 16 bp, H. sapiens
tattttctcacacttt

SEQ ID NO: 131881 - DNA, 16 bp, H. sapiens
tattttctcagaaaat

SEQ ID NO: 131882 - DNA, 16 bp, H. sapiens
tattttctcattaaaa

SEQ ID NO: 131883 - DNA, 16 bp, H. sapiens
tattttctcccatcct

SEQ ID NO: 131884 - DNA, 16 bp, H. sapiens
tattttctctctctgt

SEQ ID NO: 131885 - DNA, 16 bp, H. sapiens
tattttctgaatgaaa

SEQ ID NO: 131886 - DNA, 16 bp, H. sapiens
tattttctgccttttg

SEQ ID NO: 131887 - DNA, 16 bp, H. sapiens
tattttctgcttaaaa

SEQ ID NO: 131888 - DNA, 16 bp, H. sapiens
tattttctgtagagat

SEQ ID NO: 131889 - DNA, 16 bp, H. sapiens
tattttctgtatatta

SEQ ID NO: 131890 - DNA, 16 bp, H. sapiens
tattttctgtcttcct

SEQ ID NO: 131891 - DNA, 16 bp, H. sapiens
tattttctgtgtctat

SEQ ID NO: 131892 - DNA, 16 bp, H. sapiens
tattttctgtttcctc

SEQ ID NO: 131893 - DNA, 16 bp, H. sapiens
tattttcttaaaagat

SEQ ID NO: 131894 - DNA, 16 bp, H. sapiens
tattttcttaaaattg

SEQ ID NO: 131895 - DNA, 16 bp, H. sapiens
tattttcttaaagttt

SEQ ID NO: 131896 - DNA, 16 bp, H. sapiens
tattttcttaaatgaa

SEQ ID NO: 131897 - DNA, 16 bp, H. sapiens
tattttcttagaataa

SEQ ID NO: 131898 - DNA, 16 bp, H. sapiens
tattttcttagaattt

SEQ ID NO: 131899 - DNA, 16 bp, H. sapiens
tattttcttatctgta

SEQ ID NO: 131900 - DNA, 16 bp, H. sapiens
tattttcttatgaaaa

SEQ ID NO: 131901 - DNA, 16 bp, H. sapiens
tattttcttcaaagca

SEQ ID NO: 131902 - DNA, 16 bp, H. sapiens
tattttcttcaagtct

SEQ ID NO: 131903 - DNA, 16 bp, H. sapiens
tattttcttccagttt

SEQ ID NO: 131904 - DNA, 16 bp, H. sapiens
tattttcttctctgtg

SEQ ID NO: 131905 - DNA, 16 bp, H. sapiens
tattttcttgaaaatg

SEQ ID NO: 131906 - DNA, 16 bp, H. sapiens
tattttcttgaacata

SEQ ID NO: 131907 - DNA, 16 bp, H. sapiens
tattttcttgacccct

SEQ ID NO: 131908 - DNA, 16 bp, H. sapiens
tattttctttgaaatt

SEQ ID NO: 131909 - DNA, 16 bp, H. sapiens
tattttctttgcaaaa

SEQ ID NO: 131910 - DNA, 16 bp, H. sapiens
tattttcttttgtaag

SEQ ID NO: 131911 - DNA, 16 bp, H. sapiens
tattttctttttagaa

SEQ ID NO: 131912 - DNA, 16 bp, H. sapiens
tattttgaaaaatgtc

SEQ ID NO: 131913 - DNA, 16 bp, H. sapiens
tattttgaaaactata

SEQ ID NO: 131914 - DNA, 16 bp, H. sapiens
tattttgaaaatgcaa

SEQ ID NO: 131915 - DNA, 16 bp, H. sapiens
tattttgaaagaaact

SEQ ID NO: 131916 - DNA, 16 bp, H. sapiens
tattttgaaagaaaga

SEQ ID NO: 131917 - DNA, 16 bp, H. sapiens
tattttgaaagaataa

SEQ ID NO: 131918 - DNA, 16 bp, H. sapiens
tattttgaaagtaaat

SEQ ID NO: 131919 - DNA, 16 bp, H. sapiens
tattttgaaatagagt

SEQ ID NO: 131920 - DNA, 16 bp, H. sapiens
tattttgaaatattct

SEQ ID NO: 131921 - DNA, 16 bp, H. sapiens
tattttgaaatctttt

SEQ ID NO: 131922 - DNA, 16 bp, H. sapiens
tattttgaaatgaatg

SEQ ID NO: 131923 - DNA, 16 bp, H. sapiens
tattttgaactaattt

SEQ ID NO: 131924 - DNA, 16 bp, H. sapiens
tattttgaagaaatat

SEQ ID NO: 131925 - DNA, 16 bp, H. sapiens
tattttgaatgttaaa

SEQ ID NO: 131926 - DNA, 16 bp, H. sapiens
tattttgaattttcca

SEQ ID NO: 131927 - DNA, 16 bp, H. sapiens
tattttgacatttatt

SEQ ID NO: 131928 - DNA, 16 bp, H. sapiens
tattttgagaaactgc

SEQ ID NO: 131929 - DNA, 16 bp, H. sapiens
tattttgagatgaagt

SEQ ID NO: 131930 - DNA, 16 bp, H. sapiens
tattttgagatggatt

SEQ ID NO: 131931 - DNA, 16 bp, H. sapiens
tattttgagattcatt

SEQ ID NO: 131932 - DNA, 16 bp, H. sapiens
tattttgagcctttgt

SEQ ID NO: 131933 - DNA, 16 bp, H. sapiens
tattttgagtagagac

SEQ ID NO: 131934 - DNA, 16 bp, H. sapiens
tattttgagttaactt

SEQ ID NO: 131935 - DNA, 16 bp, H. sapiens
tattttgataaaatgt

SEQ ID NO: 131936 - DNA, 16 bp, H. sapiens
tattttgataagaaat

SEQ ID NO: 131937 - DNA, 16 bp, H. sapiens
tattttgatatacata

SEQ ID NO: 131938 - DNA, 16 bp, H. sapiens
tattttgatgaaaatt

SEQ ID NO: 131939 - DNA, 16 bp, H. sapiens
tattttgatgaatata

SEQ ID NO: 131940 - DNA, 16 bp, H. sapiens
tattttgatggagatt

SEQ ID NO: 131941 - DNA, 16 bp, H. sapiens
tattttgcaaaatttt

SEQ ID NO: 131942 - DNA, 16 bp, H. sapiens
tattttgcacatttta

SEQ ID NO: 131943 - DNA, 16 bp, H. sapiens
tattttgcagagtttg

SEQ ID NO: 131944 - DNA, 16 bp, H. sapiens
tattttgcatatgaaa

SEQ ID NO: 131945 - DNA, 16 bp, H. sapiens
tattttgcatgtgttt

SEQ ID NO: 131946 - DNA, 16 bp, H. sapiens
tattttgcattttaaa

SEQ ID NO: 131947 - DNA, 16 bp, H. sapiens
tattttgcattttgaa

SEQ ID NO: 131948 - DNA, 16 bp, H. sapiens
tattttgcctatttct

SEQ ID NO: 131949 - DNA, 16 bp, H. sapiens
tattttgcctgatttt

SEQ ID NO: 131950 - DNA, 16 bp, H. sapiens
tattttgctaaaaata

SEQ ID NO: 131951 - DNA, 16 bp, H. sapiens
tattttgctataaaat

SEQ ID NO: 131952 - DNA, 16 bp, H. sapiens
tattttgctatagcag

SEQ ID NO: 131953 - DNA, 16 bp, H. sapiens
tattttgcttacattt

SEQ ID NO: 131954 - DNA, 16 bp, H. sapiens
tattttgctttaaatt

SEQ ID NO: 131955 - DNA, 16 bp, H. sapiens
tattttgctttttcca

SEQ ID NO: 131956 - DNA, 16 bp, H. sapiens
tattttggaaaaatat

SEQ ID NO: 131957 - DNA, 16 bp, H. sapiens
tattttggaaatacat

SEQ ID NO: 131958 - DNA, 16 bp, H. sapiens
tattttggaactctgg

SEQ ID NO: 131959 - DNA, 16 bp, H. sapiens
tattttggagaaaaaa

SEQ ID NO: 131960 - DNA, 16 bp, H. sapiens
tattttggagtttaaa

SEQ ID NO: 131961 - DNA, 16 bp, H. sapiens
tattttggataccagt

SEQ ID NO: 131962 - DNA, 16 bp, H. sapiens
tattttggattcagag

SEQ ID NO: 131963 - DNA, 16 bp, H. sapiens
tattttggattttaac

SEQ ID NO: 131964 - DNA, 16 bp, H. sapiens
tattttgggaaaaaaa

SEQ ID NO: 131965 - DNA, 16 bp, H. sapiens
tattttggggagaaaa

SEQ ID NO: 131966 - DNA, 16 bp, H. sapiens
tattttggggtggcat

SEQ ID NO: 131967 - DNA, 16 bp, H. sapiens
tattttggtaaaatat

SEQ ID NO: 131968 - DNA, 16 bp, H. sapiens
tattttggtagagatt

SEQ ID NO: 131969 - DNA, 16 bp, H. sapiens
tattttggtggagtct

SEQ ID NO: 131970 - DNA, 16 bp, H. sapiens
tattttgtaaaacaaa

SEQ ID NO: 131971 - DNA, 16 bp, H. sapiens
tattttgtaaatgaaa

SEQ ID NO: 131972 - DNA, 16 bp, H. sapiens
tattttgtaaatgcaa

SEQ ID NO: 131973 - DNA, 16 bp, H. sapiens
tattttgtaataaagt

SEQ ID NO: 131974 - DNA, 16 bp, H. sapiens
tattttgtaatagcag

SEQ ID NO: 131975 - DNA, 16 bp, H. sapiens
tattttgtataaatgg

SEQ ID NO: 131976 - DNA, 16 bp, H. sapiens
tattttgtatatatct

SEQ ID NO: 131977 - DNA, 16 bp, H. sapiens
tattttgtcattcatt

SEQ ID NO: 131978 - DNA, 16 bp, H. sapiens
tattttgtcattttca

SEQ ID NO: 131979 - DNA, 16 bp, H. sapiens
tattttgtctgctatt

SEQ ID NO: 131980 - DNA, 16 bp, H. sapiens
tattttgtctttcaaa

SEQ ID NO: 131981 - DNA, 16 bp, H. sapiens
tattttgtgaaacttt

SEQ ID NO: 131982 - DNA, 16 bp, H. sapiens
tattttgtgacatttt

SEQ ID NO: 131983 - DNA, 16 bp, H. sapiens
tattttgtggtaagaa

SEQ ID NO: 131984 - DNA, 16 bp, H. sapiens
tattttgtgtacacag

SEQ ID NO: 131985 - DNA, 16 bp, H. sapiens
tattttgttaaagcag

SEQ ID NO: 131986 - DNA, 16 bp, H. sapiens
tattttgttagaaaaa

SEQ ID NO: 131987 - DNA, 16 bp, H. sapiens
tattttgttcctcaaa

SEQ ID NO: 131988 - DNA, 16 bp, H. sapiens
tattttgttctttaaa

SEQ ID NO: 131989 - DNA, 16 bp, H. sapiens
tattttgttgaatgaa

SEQ ID NO: 131990 - DNA, 16 bp, H. sapiens
tattttgttgcctgtg

SEQ ID NO: 131991 - DNA, 16 bp, H. sapiens
tattttgtttcccatt

SEQ ID NO: 131992 - DNA, 16 bp, H. sapiens
tatttttaaaaagcaa

SEQ ID NO: 131993 - DNA, 16 bp, H. sapiens
tatttttaaaaagtga

SEQ ID NO: 131994 - DNA, 16 bp, H. sapiens
tatttttaaaacacac

SEQ ID NO: 131995 - DNA, 16 bp, H. sapiens
tatttttaaaagagat

SEQ ID NO: 131996 - DNA, 16 bp, H. sapiens
tatttttaaaagcatt

SEQ ID NO: 131997 - DNA, 16 bp, H. sapiens
tatttttaaaaggaat

SEQ ID NO: 131998 - DNA, 16 bp, H. sapiens
tatttttaaaatgcaa

SEQ ID NO: 131999 - DNA, 16 bp, H. sapiens
tatttttaaagaaact

SEQ ID NO: 132000 - DNA, 16 bp, H. sapiens
tatttttaaagacaaa

SEQ ID NO: 132001 - DNA, 16 bp, H. sapiens
tatttttaaagatgta

SEQ ID NO: 132002 - DNA, 16 bp, H. sapiens
tatttttaaagattct

SEQ ID NO: 132003 - DNA, 16 bp, H. sapiens
tatttttaaagcaaaa

SEQ ID NO: 132004 - DNA, 16 bp, H. sapiens
tatttttaaagcaatt

SEQ ID NO: 132005 - DNA, 16 bp, H. sapiens
tatttttaaagcagtt

SEQ ID NO: 132006 - DNA, 16 bp, H. sapiens
tatttttaaagcatgt

SEQ ID NO: 132007 - DNA, 16 bp, H. sapiens
tatttttaaagcattt

SEQ ID NO: 132008 - DNA, 16 bp, H. sapiens
tatttttaaagtttct

SEQ ID NO: 132009 - DNA, 16 bp, H. sapiens
tatttttaaataactg

SEQ ID NO: 132010 - DNA, 16 bp, H. sapiens
tatttttaaatagcta

SEQ ID NO: 132011 - DNA, 16 bp, H. sapiens
tatttttaaatatcca

SEQ ID NO: 132012 - DNA, 16 bp, H. sapiens
tatttttaaatcaaag

SEQ ID NO: 132013 - DNA, 16 bp, H. sapiens
tatttttaaatgaaga

SEQ ID NO: 132014 - DNA, 16 bp, H. sapiens
tatttttaaattaagg

SEQ ID NO: 132015 - DNA, 16 bp, H. sapiens
tatttttaagaaaaag

SEQ ID NO: 132016 - DNA, 16 bp, H. sapiens
tatttttaagaaaaca

SEQ ID NO: 132017 - DNA, 16 bp, H. sapiens
tatttttaagacaaaa

SEQ ID NO: 132018 - DNA, 16 bp, H. sapiens
tatttttaagacaaag

SEQ ID NO: 132019 - DNA, 16 bp, H. sapiens
tatttttaagactttt

SEQ ID NO: 132020 - DNA, 16 bp, H. sapiens
tatttttaatattctg

SEQ ID NO: 132021 - DNA, 16 bp, H. sapiens
tatttttaatgaaaca

SEQ ID NO: 132022 - DNA, 16 bp, H. sapiens
tatttttaatgtcatt

SEQ ID NO: 132023 - DNA, 16 bp, H. sapiens
tatttttaattttgca

SEQ ID NO: 132024 - DNA, 16 bp, H. sapiens
tatttttacatttatg

SEQ ID NO: 132025 - DNA, 16 bp, H. sapiens
tatttttacatttcca

SEQ ID NO: 132026 - DNA, 16 bp, H. sapiens
tatttttactcaaaat

SEQ ID NO: 132027 - DNA, 16 bp, H. sapiens
tatttttagaaaaaca

SEQ ID NO: 132028 - DNA, 16 bp, H. sapiens
tatttttagaaaatgt

SEQ ID NO: 132029 - DNA, 16 bp, H. sapiens
tatttttagaaactat

SEQ ID NO: 132030 - DNA, 16 bp, H. sapiens
tatttttagaagaaat

SEQ ID NO: 132031 - DNA, 16 bp, H. sapiens
tatttttagagactgg

SEQ ID NO: 132032 - DNA, 16 bp, H. sapiens
tatttttagtacagat

SEQ ID NO: 132033 - DNA, 16 bp, H. sapiens
tatttttagtggagac

SEQ ID NO: 132034 - DNA, 16 bp, H. sapiens
tatttttataaagcaa

SEQ ID NO: 132035 - DNA, 16 bp, H. sapiens
tatttttataactgaa

SEQ ID NO: 132036 - DNA, 16 bp, H. sapiens
tatttttatacaagta

SEQ ID NO: 132037 - DNA, 16 bp, H. sapiens
tatttttataccagta

SEQ ID NO: 132038 - DNA, 16 bp, H. sapiens
tatttttatagcaatg

SEQ ID NO: 132039 - DNA, 16 bp, H. sapiens
tatttttatgtacaga

SEQ ID NO: 132040 - DNA, 16 bp, H. sapiens
tatttttatgtttaca

SEQ ID NO: 132041 - DNA, 16 bp, H. sapiens
tatttttattactgta

SEQ ID NO: 132042 - DNA, 16 bp, H. sapiens
tatttttattggaaaa

SEQ ID NO: 132043 - DNA, 16 bp, H. sapiens
tatttttcaaagtctt

SEQ ID NO: 132044 - DNA, 16 bp, H. sapiens
tatttttcaaatgctt

SEQ ID NO: 132045 - DNA, 16 bp, H. sapiens
tatttttcacagtttt

SEQ ID NO: 132046 - DNA, 16 bp, H. sapiens
tatttttcagaaatat

SEQ ID NO: 132047 - DNA, 16 bp, H. sapiens
tatttttcagaagagt

SEQ ID NO: 132048 - DNA, 16 bp, H. sapiens
tatttttcagaatgtt

SEQ ID NO: 132049 - DNA, 16 bp, H. sapiens
tatttttcagagattt

SEQ ID NO: 132050 - DNA, 16 bp, H. sapiens
tatttttcagatgttt

SEQ ID NO: 132051 - DNA, 16 bp, H. sapiens
tatttttcagctctgt

SEQ ID NO: 132052 - DNA, 16 bp, H. sapiens
tatttttcagtaattt

SEQ ID NO: 132053 - DNA, 16 bp, H. sapiens
tatttttcatcatgtt

SEQ ID NO: 132054 - DNA, 16 bp, H. sapiens
tatttttcatgacctt

SEQ ID NO: 132055 - DNA, 16 bp, H. sapiens
tatttttccaaatgct

SEQ ID NO: 132056 - DNA, 16 bp, H. sapiens
tatttttccaatataa

SEQ ID NO: 132057 - DNA, 16 bp, H. sapiens
tatttttccagaaatt

SEQ ID NO: 132058 - DNA, 16 bp, H. sapiens
tatttttccaggaatt

SEQ ID NO: 132059 - DNA, 16 bp, H. sapiens
tatttttcctaatact

SEQ ID NO: 132060 - DNA, 16 bp, H. sapiens
tatttttcctcataaa

SEQ ID NO: 132061 - DNA, 16 bp, H. sapiens
tatttttcctccccta

SEQ ID NO: 132062 - DNA, 16 bp, H. sapiens
tatttttcctgatact

SEQ ID NO: 132063 - DNA, 16 bp, H. sapiens
tatttttcctgctcct

SEQ ID NO: 132064 - DNA, 16 bp, H. sapiens
tatttttccttttgca

SEQ ID NO: 132065 - DNA, 16 bp, H. sapiens
tatttttcgtagagat

SEQ ID NO: 132066 - DNA, 16 bp, H. sapiens
tatttttctaaaatca

SEQ ID NO: 132067 - DNA, 16 bp, H. sapiens
tatttttctaaaatgt

SEQ ID NO: 132068 - DNA, 16 bp, H. sapiens
tatttttctaagccaa

SEQ ID NO: 132069 - DNA, 16 bp, H. sapiens
tatttttctctggctg

SEQ ID NO: 132070 - DNA, 16 bp, H. sapiens
tatttttctctgtgaa

SEQ ID NO: 132071 - DNA, 16 bp, H. sapiens
tatttttctgccttct

SEQ ID NO: 132072 - DNA, 16 bp, H. sapiens
tatttttctgtaaaga

SEQ ID NO: 132073 - DNA, 16 bp, H. sapiens
tatttttctgtctccc

SEQ ID NO: 132074 - DNA, 16 bp, H. sapiens
tatttttctgtgaaat

SEQ ID NO: 132075 - DNA, 16 bp, H. sapiens
tatttttctgtgcctg

SEQ ID NO: 132076 - DNA, 16 bp, H. sapiens
tatttttctgttaaaa

SEQ ID NO: 132077 - DNA, 16 bp, H. sapiens
tatttttctgttggac

SEQ ID NO: 132078 - DNA, 16 bp, H. sapiens
tatttttcttagaaaa

SEQ ID NO: 132079 - DNA, 16 bp, H. sapiens
tatttttcttagaaat

SEQ ID NO: 132080 - DNA, 16 bp, H. sapiens
tatttttcttcctaaa

SEQ ID NO: 132081 - DNA, 16 bp, H. sapiens
tatttttcttctgaaa

SEQ ID NO: 132082 - DNA, 16 bp, H. sapiens
tatttttcttgcctta

SEQ ID NO: 132083 - DNA, 16 bp, H. sapiens
tatttttgaaaaatga

SEQ ID NO: 132084 - DNA, 16 bp, H. sapiens
tatttttgaaaaatgt

SEQ ID NO: 132085 - DNA, 16 bp, H. sapiens
tatttttgaaacattt

SEQ ID NO: 132086 - DNA, 16 bp, H. sapiens
tatttttgaaagaatt

SEQ ID NO: 132087 - DNA, 16 bp, H. sapiens
tatttttgaacatttg

SEQ ID NO: 132088 - DNA, 16 bp, H. sapiens
tatttttgaatagatg

SEQ ID NO: 132089 - DNA, 16 bp, H. sapiens
tatttttgagacagag

SEQ ID NO: 132090 - DNA, 16 bp, H. sapiens
tatttttgaggttcat

SEQ ID NO: 132091 - DNA, 16 bp, H. sapiens
tatttttgagttaaaa

SEQ ID NO: 132092 - DNA, 16 bp, H. sapiens
tatttttgatgaaaat

SEQ ID NO: 132093 - DNA, 16 bp, H. sapiens
tatttttgatgcattt

SEQ ID NO: 132094 - DNA, 16 bp, H. sapiens
tatttttgcaaagaaa

SEQ ID NO: 132095 - DNA, 16 bp, H. sapiens
tatttttgcagctgtt

SEQ ID NO: 132096 - DNA, 16 bp, H. sapiens
tatttttgcataaaat

SEQ ID NO: 132097 - DNA, 16 bp, H. sapiens
tatttttgcatatgga

SEQ ID NO: 132098 - DNA, 16 bp, H. sapiens
tatttttgccaaaaat

SEQ ID NO: 132099 - DNA, 16 bp, H. sapiens
tatttttgccatattt

SEQ ID NO: 132100 - DNA, 16 bp, H. sapiens
tatttttgccttcatt

SEQ ID NO: 132101 - DNA, 16 bp, H. sapiens
tatttttgctaaaaat

SEQ ID NO: 132102 - DNA, 16 bp, H. sapiens
tatttttgctggatat

SEQ ID NO: 132103 - DNA, 16 bp, H. sapiens
tatttttggaaacatt

SEQ ID NO: 132104 - DNA, 16 bp, H. sapiens
tatttttggacatttt

SEQ ID NO: 132105 - DNA, 16 bp, H. sapiens
tatttttggactgtgg

SEQ ID NO: 132106 - DNA, 16 bp, H. sapiens
tatttttggcaaaaat

SEQ ID NO: 132107 - DNA, 16 bp, H. sapiens
tatttttggcattctt

SEQ ID NO: 132108 - DNA, 16 bp, H. sapiens
tatttttgggagagac

SEQ ID NO: 132109 - DNA, 16 bp, H. sapiens
tatttttggttctaga

SEQ ID NO: 132110 - DNA, 16 bp, H. sapiens
tatttttgtaaaagaa

SEQ ID NO: 132111 - DNA, 16 bp, H. sapiens
tatttttgtaaatgaa

SEQ ID NO: 132112 - DNA, 16 bp, H. sapiens
tatttttgtaactatt

SEQ ID NO: 132113 - DNA, 16 bp, H. sapiens
tatttttgtaagtgat

SEQ ID NO: 132114 - DNA, 16 bp, H. sapiens
tatttttgtacatgtt

SEQ ID NO: 132115 - DNA, 16 bp, H. sapiens
tatttttgtagaatct

SEQ ID NO: 132116 - DNA, 16 bp, H. sapiens
tatttttgtagacttt

SEQ ID NO: 132117 - DNA, 16 bp, H. sapiens
tatttttgtagagctg

SEQ ID NO: 132118 - DNA, 16 bp, H. sapiens
tatttttgtatagctg

SEQ ID NO: 132119 - DNA, 16 bp, H. sapiens
tatttttgtcattact

SEQ ID NO: 132120 - DNA, 16 bp, H. sapiens
tattttttaaaaacct

SEQ ID NO: 132121 - DNA, 16 bp, H. sapiens
tattttttaaaagaga

SEQ ID NO: 132122 - DNA, 16 bp, H. sapiens
tattttttaaaagcct

SEQ ID NO: 132123 - DNA, 16 bp, H. sapiens
tattttttaaaccaaa

SEQ ID NO: 132124 - DNA, 16 bp, H. sapiens
tattttttaaagaaag

SEQ ID NO: 132125 - DNA, 16 bp, H. sapiens
tattttttaaagttca

SEQ ID NO: 132126 - DNA, 16 bp, H. sapiens
tattttttaaatgcat

SEQ ID NO: 132127 - DNA, 16 bp, H. sapiens
tattttttaaggcaaa

SEQ ID NO: 132128 - DNA, 16 bp, H. sapiens
tattttttaatagaga

SEQ ID NO: 132129 - DNA, 16 bp, H. sapiens
tattttttaatctgta

SEQ ID NO: 132130 - DNA, 16 bp, H. sapiens
tattttttagtagaga

SEQ ID NO: 132131 - DNA, 16 bp, H. sapiens
tattttttattgctga

SEQ ID NO: 132132 - DNA, 16 bp, H. sapiens
tattttttcaaaaatg

SEQ ID NO: 132133 - DNA, 16 bp, H. sapiens
tattttttcagaaata

SEQ ID NO: 132134 - DNA, 16 bp, H. sapiens
tattttttcagagaaa

SEQ ID NO: 132135 - DNA, 16 bp, H. sapiens
tattttttcatgcatt

SEQ ID NO: 132136 - DNA, 16 bp, H. sapiens
tattttttccagattt

SEQ ID NO: 132137 - DNA, 16 bp, H. sapiens
tattttttccatagca

SEQ ID NO: 132138 - DNA, 16 bp, H. sapiens
tattttttcctgattc

SEQ ID NO: 132139 - DNA, 16 bp, H. sapiens
tattttttcgagatgg

SEQ ID NO: 132140 - DNA, 16 bp, H. sapiens
tattttttctgagatg

SEQ ID NO: 132141 - DNA, 16 bp, H. sapiens
tattttttctttagaa

SEQ ID NO: 132142 - DNA, 16 bp, H. sapiens
tattttttgagaaagg

SEQ ID NO: 132143 - DNA, 16 bp, H. sapiens
tattttttgcagagac

SEQ ID NO: 132144 - DNA, 16 bp, H. sapiens
tattttttggtaaaga

SEQ ID NO: 132145 - DNA, 16 bp, H. sapiens
tattttttgtagagat

SEQ ID NO: 132146 - DNA, 16 bp, H. sapiens
tatttttttaaagcaa

SEQ ID NO: 132147 - DNA, 16 bp, H. sapiens
tatttttttaaatctg

SEQ ID NO: 132148 - DNA, 16 bp, H. sapiens
tatttttttaactgta

SEQ ID NO: 132149 - DNA, 16 bp, H. sapiens
tatttttttaagacag

SEQ ID NO: 132150 - DNA, 16 bp, H. sapiens
tatttttttcagtaat

SEQ ID NO: 132151 - DNA, 16 bp, H. sapiens
tatttttttccaaagt

SEQ ID NO: 132152 - DNA, 16 bp, H. sapiens
tatttttttccaaatg

SEQ ID NO: 132153 - DNA, 16 bp, H. sapiens
tatttttttccagctt

SEQ ID NO: 132154 - DNA, 16 bp, H. sapiens
tatttttttccagttg

SEQ ID NO: 132155 - DNA, 16 bp, H. sapiens
tatttttttctccaaa

SEQ ID NO: 132156 - DNA, 16 bp, H. sapiens
tatttttttcttagca

SEQ ID NO: 132157 - DNA, 16 bp, H. sapiens
tatttttttggagatg

SEQ ID NO: 132158 - DNA, 16 bp, H. sapiens
tatttttttgtagaga

SEQ ID NO: 132159 - DNA, 16 bp, H. sapiens
tatttttttgtggaga

SEQ ID NO: 132160 - DNA, 16 bp, H. sapiens
tcaaaaaaatgtttaa

SEQ ID NO: 132161 - DNA, 16 bp, H. sapiens
tcaaaaaaccatctcc

SEQ ID NO: 132162 - DNA, 16 bp, H. sapiens
tcaaaaaactacctat

SEQ ID NO: 132163 - DNA, 16 bp, H. sapiens
tcaaaaaagttaaata

SEQ ID NO: 132164 - DNA, 16 bp, H. sapiens
tcaaaaaataaagtat

SEQ ID NO: 132165 - DNA, 16 bp, H. sapiens
tcaaaaacaagcaaac

SEQ ID NO: 132166 - DNA, 16 bp, H. sapiens
tcaaaaacataatgtt

SEQ ID NO: 132167 - DNA, 16 bp, H. sapiens
tcaaaaacattgtgct

SEQ ID NO: 132168 - DNA, 16 bp, H. sapiens
tcaaaaacattttcta

SEQ ID NO: 132169 - DNA, 16 bp, H. sapiens
tcaaaaaccaaaggta

SEQ ID NO: 132170 - DNA, 16 bp, H. sapiens
tcaaaaacctgttaga

SEQ ID NO: 132171 - DNA, 16 bp, H. sapiens
tcaaaaagacaaaagg

SEQ ID NO: 132172 - DNA, 16 bp, H. sapiens
tcaaaaagacaaaagt

SEQ ID NO: 132173 - DNA, 16 bp, H. sapiens
tcaaaaagactgtttc

SEQ ID NO: 132174 - DNA, 16 bp, H. sapiens
tcaaaaagagagagag

SEQ ID NO: 132175 - DNA, 16 bp, H. sapiens
tcaaaaagcagtttct

SEQ ID NO: 132176 - DNA, 16 bp, H. sapiens
tcaaaaaggaagaaga

SEQ ID NO: 132177 - DNA, 16 bp, H. sapiens
tcaaaaaggagaaaga

SEQ ID NO: 132178 - DNA, 16 bp, H. sapiens
tcaaaaagtggacaaa

SEQ ID NO: 132179 - DNA, 16 bp, H. sapiens
tcaaaaagtgggcaga

SEQ ID NO: 132180 - DNA, 16 bp, H. sapiens
tcaaaaagtgtgtgaa

SEQ ID NO: 132181 - DNA, 16 bp, H. sapiens
tcaaaaagttaaatgt

SEQ ID NO: 132182 - DNA, 16 bp, H. sapiens
tcaaaaagttaatgaa

SEQ ID NO: 132183 - DNA, 16 bp, H. sapiens
tcaaaaataatagcta

SEQ ID NO: 132184 - DNA, 16 bp, H. sapiens
tcaaaaatacagtatt

SEQ ID NO: 132185 - DNA, 16 bp, H. sapiens
tcaaaaatacatttta

SEQ ID NO: 132186 - DNA, 16 bp, H. sapiens
tcaaaaatatacattt

SEQ ID NO: 132187 - DNA, 16 bp, H. sapiens
tcaaaaatgacaaaga

SEQ ID NO: 132188 - DNA, 16 bp, H. sapiens
tcaaaaatgttttcca

SEQ ID NO: 132189 - DNA, 16 bp, H. sapiens
tcaaaaattcaatgaa

SEQ ID NO: 132190 - DNA, 16 bp, H. sapiens
tcaaaaattggcaaat

SEQ ID NO: 132191 - DNA, 16 bp, H. sapiens
tcaaaaatttcagaaa

SEQ ID NO: 132192 - DNA, 16 bp, H. sapiens
tcaaaacaaaggcaaa

SEQ ID NO: 132193 - DNA, 16 bp, H. sapiens
tcaaaacaaccctatg

SEQ ID NO: 132194 - DNA, 16 bp, H. sapiens
tcaaaacaataagagc

SEQ ID NO: 132195 - DNA, 16 bp, H. sapiens
tcaaaacaatccttta

SEQ ID NO: 132196 - DNA, 16 bp, H. sapiens
tcaaaacagttatttt

SEQ ID NO: 132197 - DNA, 16 bp, H. sapiens
tcaaaacataacagat

SEQ ID NO: 132198 - DNA, 16 bp, H. sapiens
tcaaaacatcacatca

SEQ ID NO: 132199 - DNA, 16 bp, H. sapiens
tcaaaacatcacattt

SEQ ID NO: 132200 - DNA, 16 bp, H. sapiens
tcaaaaccaagaaatt

SEQ ID NO: 132201 - DNA, 16 bp, H. sapiens
tcaaaaccacaacaag

SEQ ID NO: 132202 - DNA, 16 bp, H. sapiens
tcaaaaccacaagata

SEQ ID NO: 132203 - DNA, 16 bp, H. sapiens
tcaaaaccaccctggg

SEQ ID NO: 132204 - DNA, 16 bp, H. sapiens
tcaaaaccagactggc

SEQ ID NO: 132205 - DNA, 17 bp, H. sapiens
tcaaaaccagcctggcc

SEQ ID NO: 132206 - DNA, 16 bp, H. sapiens
tcaaaaccatgtaaat

SEQ ID NO: 132207 - DNA, 16 bp, H. sapiens
tcaaaactatgatgag

SEQ ID NO: 132208 - DNA, 16 bp, H. sapiens
tcaaaactcactgaac

SEQ ID NO: 132209 - DNA, 16 bp, H. sapiens
tcaaaactcattgaac

SEQ ID NO: 132210 - DNA, 16 bp, H. sapiens
tcaaaactcttccagc

SEQ ID NO: 132211 - DNA, 16 bp, H. sapiens
tcaaaactgaaaagaa

SEQ ID NO: 132212 - DNA, 16 bp, H. sapiens
tcaaaacttcaggaaa

SEQ ID NO: 132213 - DNA, 16 bp, H. sapiens
tcaaaacttttaaaat

SEQ ID NO: 132214 - DNA, 16 bp, H. sapiens
tcaaaagaaagattca

SEQ ID NO: 132215 - DNA, 16 bp, H. sapiens
tcaaaagaaagtttca

SEQ ID NO: 132216 - DNA, 16 bp, H. sapiens
tcaaaagaaatgttta

SEQ ID NO: 132217 - DNA, 16 bp, H. sapiens
tcaaaagaaatttaaa

SEQ ID NO: 132218 - DNA, 16 bp, H. sapiens
tcaaaagaagactttt

SEQ ID NO: 132219 - DNA, 16 bp, H. sapiens
tcaaaagaaggcaaga

SEQ ID NO: 132220 - DNA, 16 bp, H. sapiens
tcaaaagaagtcatac

SEQ ID NO: 132221 - DNA, 16 bp, H. sapiens
tcaaaagaattttttt

SEQ ID NO: 132222 - DNA, 16 bp, H. sapiens
tcaaaagacataaaat

SEQ ID NO: 132223 - DNA, 16 bp, H. sapiens
tcaaaagacatttatg

SEQ ID NO: 132224 - DNA, 16 bp, H. sapiens
tcaaaagacttttctg

SEQ ID NO: 132225 - DNA, 16 bp, H. sapiens
tcaaaagcagccacag

SEQ ID NO: 132226 - DNA, 16 bp, H. sapiens
tcaaaagcaggaaata

SEQ ID NO: 132227 - DNA, 16 bp, H. sapiens
tcaaaagccttaaaat

SEQ ID NO: 132228 - DNA, 16 bp, H. sapiens
tcaaaagctgagacag

SEQ ID NO: 132229 - DNA, 16 bp, H. sapiens
tcaaaaggaagcagag

SEQ ID NO: 132230 - DNA, 16 bp, H. sapiens
tcaaaaggaatataaa

SEQ ID NO: 132231 - DNA, 16 bp, H. sapiens
tcaaaagggagaaatc

SEQ ID NO: 132232 - DNA, 16 bp, H. sapiens
tcaaaaggtagaaatg

SEQ ID NO: 132233 - DNA, 16 bp, H. sapiens
tcaaaagtcaaaatta

SEQ ID NO: 132234 - DNA, 16 bp, H. sapiens
tcaaaagtcagaaata

SEQ ID NO: 132235 - DNA, 16 bp, H. sapiens
tcaaaagtccacagta

SEQ ID NO: 132236 - DNA, 16 bp, H. sapiens
tcaaaagttatatatg

SEQ ID NO: 132237 - DNA, 16 bp, H. sapiens
tcaaaataaaatgtta

SEQ ID NO: 132238 - DNA, 16 bp, H. sapiens
tcaaaataaactttct

SEQ ID NO: 132239 - DNA, 16 bp, H. sapiens
tcaaaataaactttta

SEQ ID NO: 132240 - DNA, 16 bp, H. sapiens
tcaaaataaataatga

SEQ ID NO: 132241 - DNA, 16 bp, H. sapiens
tcaaaataaattaaag

SEQ ID NO: 132242 - DNA, 16 bp, H. sapiens
tcaaaataactaaaag

SEQ ID NO: 132243 - DNA, 16 bp, H. sapiens
tcaaaataataagagc

SEQ ID NO: 132244 - DNA, 16 bp, H. sapiens
tcaaaataataatgat

SEQ ID NO: 132245 - DNA, 16 bp, H. sapiens
tcaaaataatctcctt

SEQ ID NO: 132246 - DNA, 16 bp, H. sapiens
tcaaaataatgtaaat

SEQ ID NO: 132247 - DNA, 16 bp, H. sapiens
tcaaaataattgtttt

SEQ ID NO: 132248 - DNA, 16 bp, H. sapiens
tcaaaatagaaatgtt

SEQ ID NO: 132249 - DNA, 16 bp, H. sapiens
tcaaaatagtactgga

SEQ ID NO: 132250 - DNA, 16 bp, H. sapiens
tcaaaatatataagaa

SEQ ID NO: 132251 - DNA, 16 bp, H. sapiens
tcaaaatatatcacaa

SEQ ID NO: 132252 - DNA, 16 bp, H. sapiens
tcaaaatatgaaaatt

SEQ ID NO: 132253 - DNA, 16 bp, H. sapiens
tcaaaatatgccaaag

SEQ ID NO: 132254 - DNA, 16 bp, H. sapiens
tcaaaatattaaaatg

SEQ ID NO: 132255 - DNA, 16 bp, H. sapiens
tcaaaatattaatgaa

SEQ ID NO: 132256 - DNA, 16 bp, H. sapiens
tcaaaatattacatat

SEQ ID NO: 132257 - DNA, 16 bp, H. sapiens
tcaaaatattctttat

SEQ ID NO: 132258 - DNA, 16 bp, H. sapiens
tcaaaatatttgagaa

SEQ ID NO: 132259 - DNA, 16 bp, H. sapiens
tcaaaatattttctaa

SEQ ID NO: 132260 - DNA, 16 bp, H. sapiens
tcaaaatattttctgt

SEQ ID NO: 132261 - DNA, 16 bp, H. sapiens
tcaaaatcatgaaaat

SEQ ID NO: 132262 - DNA, 16 bp, H. sapiens
tcaaaatcccaatgac

SEQ ID NO: 132263 - DNA, 16 bp, H. sapiens
tcaaaatctgtaaaat

SEQ ID NO: 132264 - DNA, 16 bp, H. sapiens
tcaaaatgaaagagaa

SEQ ID NO: 132265 - DNA, 16 bp, H. sapiens
tcaaaatgattttaaa

SEQ ID NO: 132266 - DNA, 16 bp, H. sapiens
tcaaaatgctgggatt

SEQ ID NO: 132267 - DNA, 16 bp, H. sapiens
tcaaaatggaaaattt

SEQ ID NO: 132268 - DNA, 16 bp, H. sapiens
tcaaaatggatcaaaa

SEQ ID NO: 132269 - DNA, 16 bp, H. sapiens
tcaaaatggattaaag

SEQ ID NO: 132270 - DNA, 16 bp, H. sapiens
tcaaaatggtgaattt

SEQ ID NO: 132271 - DNA, 16 bp, H. sapiens
tcaaaatggttaagat

SEQ ID NO: 132272 - DNA, 16 bp, H. sapiens
tcaaaatgtatatgtt

SEQ ID NO: 132273 - DNA, 16 bp, H. sapiens
tcaaaatgtcaatagt

SEQ ID NO: 132274 - DNA, 16 bp, H. sapiens
tcaaaatgttaaatat

SEQ ID NO: 132275 - DNA, 16 bp, H. sapiens
tcaaaatgtttgtttt

SEQ ID NO: 132276 - DNA, 16 bp, H. sapiens
tcaaaatgttttttaa

SEQ ID NO: 132277 - DNA, 16 bp, H. sapiens
tcaaaattatttttgt

SEQ ID NO: 132278 - DNA, 16 bp, H. sapiens
tcaaaattccaatgat

SEQ ID NO: 132279 - DNA, 16 bp, H. sapiens
tcaaaattgttacaaa

SEQ ID NO: 132280 - DNA, 16 bp, H. sapiens
tcaaaattgttttcaa

SEQ ID NO: 132281 - DNA, 16 bp, H. sapiens
tcaaaatttaaaactt

SEQ ID NO: 132282 - DNA, 16 bp, H. sapiens
tcaaaatttattttcc

SEQ ID NO: 132283 - DNA, 16 bp, H. sapiens
tcaaacaaatgagcaa

SEQ ID NO: 132284 - DNA, 16 bp, H. sapiens
tcaaacaatattttta

SEQ ID NO: 132285 - DNA, 16 bp, H. sapiens
tcaaacagaaggagtc

SEQ ID NO: 132286 - DNA, 16 bp, H. sapiens
tcaaacagagacaatt

SEQ ID NO: 132287 - DNA, 16 bp, H. sapiens
tcaaacaggctttgtg

SEQ ID NO: 132288 - DNA, 16 bp, H. sapiens
tcaaacatcttttcat

SEQ ID NO: 132289 - DNA, 16 bp, H. sapiens
tcaaacatgaaagaga

SEQ ID NO: 132290 - DNA, 16 bp, H. sapiens
tcaaacatgttttcca

SEQ ID NO: 132291 - DNA, 16 bp, H. sapiens
tcaaacattattttgg

SEQ ID NO: 132292 - DNA, 16 bp, H. sapiens
tcaaaccagaactcag

SEQ ID NO: 132293 - DNA, 16 bp, H. sapiens
tcaaaccatagcagaa

SEQ ID NO: 132294 - DNA, 16 bp, H. sapiens
tcaaacccagatctgt

SEQ ID NO: 132295 - DNA, 16 bp, H. sapiens
tcaaaccccatctcta

SEQ ID NO: 132296 - DNA, 16 bp, H. sapiens
tcaaacccttgggctc

SEQ ID NO: 132297 - DNA, 16 bp, H. sapiens
tcaaacctgaagccag

SEQ ID NO: 132298 - DNA, 16 bp, H. sapiens
tcaaacctgaggaggg

SEQ ID NO: 132299 - DNA, 16 bp, H. sapiens
tcaaacgatcctcctg

SEQ ID NO: 132300 - DNA, 16 bp, H. sapiens
tcaaacgccatgctgg

SEQ ID NO: 132301 - DNA, 16 bp, H. sapiens
tcaaactatactatat

SEQ ID NO: 132302 - DNA, 16 bp, H. sapiens
tcaaactatcctcctg

SEQ ID NO: 132303 - DNA, 16 bp, H. sapiens
tcaaactattccaaaa

SEQ ID NO: 132304 - DNA, 16 bp, H. sapiens
tcaaactattgctgtt

SEQ ID NO: 132305 - DNA, 16 bp, H. sapiens
tcaaactcagcatgtc

SEQ ID NO: 132306 - DNA, 16 bp, H. sapiens
tcaaactccaaatggt

SEQ ID NO: 132307 - DNA, 17 bp, H. sapiens
tcaaactcctgaacttg

SEQ ID NO: 132308 - DNA, 16 bp, H. sapiens
tcaaactcctgacccc

SEQ ID NO: 132309 - DNA, 16 bp, H. sapiens
tcaaactcctggccct

SEQ ID NO: 132310 - DNA, 16 bp, H. sapiens
tcaaactcctggcctt

SEQ ID NO: 132311 - DNA, 16 bp, H. sapiens
tcaaactcctgggcct

SEQ ID NO: 132312 - DNA, 16 bp, H. sapiens
tcaaactctgggcctc

SEQ ID NO: 132313 - DNA, 16 bp, H. sapiens
tcaaactcttctaaaa

SEQ ID NO: 132314 - DNA, 16 bp, H. sapiens
tcaaactgaatccagc

SEQ ID NO: 132315 - DNA, 16 bp, H. sapiens
tcaaactgcctgggtt

SEQ ID NO: 132316 - DNA, 16 bp, H. sapiens
tcaaactggaacatca

SEQ ID NO: 132317 - DNA, 16 bp, H. sapiens
tcaaacttttccaaaa

SEQ ID NO: 132318 - DNA, 16 bp, H. sapiens
tcaaagaaaaatatta

SEQ ID NO: 132319 - DNA, 16 bp, H. sapiens
tcaaagaaaatgaaat

SEQ ID NO: 132320 - DNA, 16 bp, H. sapiens
tcaaagaaaattttat

SEQ ID NO: 132321 - DNA, 16 bp, H. sapiens
tcaaagaaatccaaat

SEQ ID NO: 132322 - DNA, 16 bp, H. sapiens
tcaaagaaatctgaga

SEQ ID NO: 132323 - DNA, 16 bp, H. sapiens
tcaaagaaatgcaaat

SEQ ID NO: 132324 - DNA, 16 bp, H. sapiens
tcaaagaaattcaaga

SEQ ID NO: 132325 - DNA, 16 bp, H. sapiens
tcaaagaaattcaagg

SEQ ID NO: 132326 - DNA, 16 bp, H. sapiens
tcaaagaaccaatttt

SEQ ID NO: 132327 - DNA, 16 bp, H. sapiens
tcaaagaactaatttt

SEQ ID NO: 132328 - DNA, 16 bp, H. sapiens
tcaaagaactgaaagt

SEQ ID NO: 132329 - DNA, 16 bp, H. sapiens
tcaaagaagaaaaagg

SEQ ID NO: 132330 - DNA, 16 bp, H. sapiens
tcaaagaagaaataga

SEQ ID NO: 132331 - DNA, 16 bp, H. sapiens
tcaaagaagaggaaaa

SEQ ID NO: 132332 - DNA, 16 bp, H. sapiens
tcaaagaagtcaaaga

SEQ ID NO: 132333 - DNA, 16 bp, H. sapiens
tcaaagaatataaaat

SEQ ID NO: 132334 - DNA, 16 bp, H. sapiens
tcaaagaatttaaata

SEQ ID NO: 132335 - DNA, 16 bp, H. sapiens
tcaaagaatttttaaa

SEQ ID NO: 132336 - DNA, 16 bp, H. sapiens
tcaaagaattttttaa

SEQ ID NO: 132337 - DNA, 16 bp, H. sapiens
tcaaagacaaaaatca

SEQ ID NO: 132338 - DNA, 16 bp, H. sapiens
tcaaagaccaaaacta

SEQ ID NO: 132339 - DNA, 22 bp, H. sapiens
tcaaagaccaaaggtagataaa

SEQ ID NO: 132340 - DNA, 17 bp, H. sapiens
tcaaagacctagaggca

SEQ ID NO: 132341 - DNA, 16 bp, H. sapiens
tcaaagacttaaagac

SEQ ID NO: 132342 - DNA, 16 bp, H. sapiens
tcaaagagaaggaaaa

SEQ ID NO: 132343 - DNA, 16 bp, H. sapiens
tcaaagagacacagga

SEQ ID NO: 132344 - DNA, 16 bp, H. sapiens
tcaaagagagaaggaa

SEQ ID NO: 132345 - DNA, 16 bp, H. sapiens
tcaaagagagagacag

SEQ ID NO: 132346 - DNA, 16 bp, H. sapiens
tcaaagagatatctat

SEQ ID NO: 132347 - DNA, 16 bp, H. sapiens
tcaaagagctaaaaaa

SEQ ID NO: 132348 - DNA, 16 bp, H. sapiens
tcaaagagcttacagt

SEQ ID NO: 132349 - DNA, 16 bp, H. sapiens
tcaaagataaagaaag

SEQ ID NO: 132350 - DNA, 16 bp, H. sapiens
tcaaagataattttaa

SEQ ID NO: 132351 - DNA, 16 bp, H. sapiens
tcaaagatatttattt

SEQ ID NO: 132352 - DNA, 16 bp, H. sapiens
tcaaagatcagttgac

SEQ ID NO: 132353 - DNA, 16 bp, H. sapiens
tcaaagatgcagtgag

SEQ ID NO: 132354 - DNA, 16 bp, H. sapiens
tcaaagattaaaggaa

SEQ ID NO: 132355 - DNA, 16 bp, H. sapiens
tcaaagatttaaatat

SEQ ID NO: 132356 - DNA, 16 bp, H. sapiens
tcaaagattttaaaat

SEQ ID NO: 132357 - DNA, 16 bp, H. sapiens
tcaaagatttttttaa

SEQ ID NO: 132358 - DNA, 16 bp, H. sapiens
tcaaagcaagtcacag

SEQ ID NO: 132359 - DNA, 16 bp, H. sapiens
tcaaagcagcaaagca

SEQ ID NO: 132360 - DNA, 16 bp, H. sapiens
tcaaagcccatgttct

SEQ ID NO: 132361 - DNA, 16 bp, H. sapiens
tcaaagctgaactgaa

SEQ ID NO: 132362 - DNA, 16 bp, H. sapiens
tcaaagctgcagtgag

SEQ ID NO: 132363 - DNA, 16 bp, H. sapiens
tcaaaggaaaaaaatc

SEQ ID NO: 132364 - DNA, 16 bp, H. sapiens
tcaaaggaaagtttca

SEQ ID NO: 132365 - DNA, 16 bp, H. sapiens
tcaaaggaaatgttta

SEQ ID NO: 132366 - DNA, 16 bp, H. sapiens
tcaaaggacatcatca

SEQ ID NO: 132367 - DNA, 16 bp, H. sapiens
tcaaaggagttctaaa

SEQ ID NO: 132368 - DNA, 16 bp, H. sapiens
tcaaaggatcttccca

SEQ ID NO: 132369 - DNA, 16 bp, H. sapiens
tcaaaggcatttcaga

SEQ ID NO: 132370 - DNA, 16 bp, H. sapiens
tcaaaggcatttttca

SEQ ID NO: 132371 - DNA, 16 bp, H. sapiens
tcaaagggcaataaaa

SEQ ID NO: 132372 - DNA, 16 bp, H. sapiens
tcaaaggtcaaggaca

SEQ ID NO: 132373 - DNA, 16 bp, H. sapiens
tcaaagtaaaatttaa

SEQ ID NO: 132374 - DNA, 17 bp, H. sapiens
tcaaagtactgggatta

SEQ ID NO: 132375 - DNA, 16 bp, H. sapiens
tcaaagtatctctcca

SEQ ID NO: 132376 - DNA, 16 bp, H. sapiens
tcaaagtattttctga

SEQ ID NO: 132377 - DNA, 16 bp, H. sapiens
tcaaagtcatccctct

SEQ ID NO: 132378 - DNA, 16 bp, H. sapiens
tcaaagtcattcatga

SEQ ID NO: 132379 - DNA, 16 bp, H. sapiens
tcaaagtgctggaatt

SEQ ID NO: 132380 - DNA, 16 bp, H. sapiens
tcaaagtgctggatta

SEQ ID NO: 132381 - DNA, 17 bp, H. sapiens
tcaaagtgctgggatta

SEQ ID NO: 132382 - DNA, 17 bp, H. sapiens
tcaaagtgctgggattg

SEQ ID NO: 132383 - DNA, 16 bp, H. sapiens
tcaaagtgtggtcctt

SEQ ID NO: 132384 - DNA, 16 bp, H. sapiens
tcaaagtgtggtctgg

SEQ ID NO: 132385 - DNA, 17 bp, H. sapiens
tcaaagtgttgggatta

SEQ ID NO: 132386 - DNA, 16 bp, H. sapiens
tcaaagttattttctt

SEQ ID NO: 132387 - DNA, 16 bp, H. sapiens
tcaaagtttgtttttt

SEQ ID NO: 132388 - DNA, 16 bp, H. sapiens
tcaaagttttgggatt

SEQ ID NO: 132389 - DNA, 16 bp, H. sapiens
tcaaataaaacccatc

SEQ ID NO: 132390 - DNA, 16 bp, H. sapiens
tcaaataaaagttaaa

SEQ ID NO: 132391 - DNA, 16 bp, H. sapiens
tcaaataaataaatga

SEQ ID NO: 132392 - DNA, 16 bp, H. sapiens
tcaaataactagcttt

SEQ ID NO: 132393 - DNA, 16 bp, H. sapiens
tcaaataataacagat

SEQ ID NO: 132394 - DNA, 16 bp, H. sapiens
tcaaataatgaaataa

SEQ ID NO: 132395 - DNA, 16 bp, H. sapiens
tcaaataattctcctg

SEQ ID NO: 132396 - DNA, 16 bp, H. sapiens
tcaaataattctgttt

SEQ ID NO: 132397 - DNA, 16 bp, H. sapiens
tcaaatactttgccca

SEQ ID NO: 132398 - DNA, 16 bp, H. sapiens
tcaaatagacataata

SEQ ID NO: 132399 - DNA, 16 bp, H. sapiens
tcaaatagcctttctt

SEQ ID NO: 132400 - DNA, 16 bp, H. sapiens
tcaaataggaacagag

SEQ ID NO: 132401 - DNA, 16 bp, H. sapiens
tcaaatatcacctcct

SEQ ID NO: 132402 - DNA, 16 bp, H. sapiens
tcaaatatgctttcca

SEQ ID NO: 132403 - DNA, 16 bp, H. sapiens
tcaaatatttactatt

SEQ ID NO: 132404 - DNA, 16 bp, H. sapiens
tcaaatatttattgtg

SEQ ID NO: 132405 - DNA, 16 bp, H. sapiens
tcaaatcaaaatggat

SEQ ID NO: 132406 - DNA, 16 bp, H. sapiens
tcaaatcagggtattt

SEQ ID NO: 132407 - DNA, 16 bp, H. sapiens
tcaaatcatcaggcat

SEQ ID NO: 132408 - DNA, 16 bp, H. sapiens
tcaaatccaaaggaaa

SEQ ID NO: 132409 - DNA, 16 bp, H. sapiens
tcaaatccaggaaata

SEQ ID NO: 132410 - DNA, 16 bp, H. sapiens
tcaaatccatctcctt

SEQ ID NO: 132411 - DNA, 16 bp, H. sapiens
tcaaatcccagttttg

SEQ ID NO: 132412 - DNA, 16 bp, H. sapiens
tcaaatcctagaaaat

SEQ ID NO: 132413 - DNA, 16 bp, H. sapiens
tcaaatcctgactcca

SEQ ID NO: 132414 - DNA, 16 bp, H. sapiens
tcaaatcctgccactg

SEQ ID NO: 132415 - DNA, 16 bp, H. sapiens
tcaaatcctgcttctg

SEQ ID NO: 132416 - DNA, 16 bp, H. sapiens
tcaaatctaaaaacat

SEQ ID NO: 132417 - DNA, 16 bp, H. sapiens
tcaaatctcatcttaa

SEQ ID NO: 132418 - DNA, 16 bp, H. sapiens
tcaaatctcatgagac

SEQ ID NO: 132419 - DNA, 16 bp, H. sapiens
tcaaatctgtgagatg

SEQ ID NO: 132420 - DNA, 16 bp, H. sapiens
tcaaatcttttgccca

SEQ ID NO: 132421 - DNA, 16 bp, H. sapiens
tcaaatgaaaatggat

SEQ ID NO: 132422 - DNA, 16 bp, H. sapiens
tcaaatgaatagtttg

SEQ ID NO: 132423 - DNA, 16 bp, H. sapiens
tcaaatgaattatttt

SEQ ID NO: 132424 - DNA, 16 bp, H. sapiens
tcaaatgacatttcta

SEQ ID NO: 132425 - DNA, 17 bp, H. sapiens
tcaaatgatccgcctgc

SEQ ID NO: 132426 - DNA, 16 bp, H. sapiens
tcaaatgattcttctg

SEQ ID NO: 132427 - DNA, 16 bp, H. sapiens
tcaaatgcatttattt

SEQ ID NO: 132428 - DNA, 16 bp, H. sapiens
tcaaatgccaccttct

SEQ ID NO: 132429 - DNA, 16 bp, H. sapiens
tcaaatgcttttgctg

SEQ ID NO: 132430 - DNA, 16 bp, H. sapiens
tcaaatgcttttttgg

SEQ ID NO: 132431 - DNA, 16 bp, H. sapiens
tcaaatggaaacatca

SEQ ID NO: 132432 - DNA, 16 bp, H. sapiens
tcaaatggaatagaat

SEQ ID NO: 132433 - DNA, 16 bp, H. sapiens
tcaaatggtttttctg

SEQ ID NO: 132434 - DNA, 16 bp, H. sapiens
tcaaatgtaaatattt

SEQ ID NO: 132435 - DNA, 16 bp, H. sapiens
tcaaatgtattttttt

SEQ ID NO: 132436 - DNA, 16 bp, H. sapiens
tcaaatgtcatctcct

SEQ ID NO: 132437 - DNA, 16 bp, H. sapiens
tcaaatgtccatcaat

SEQ ID NO: 132438 - DNA, 20 bp, H. sapiens
tcaaatgttaatctcctttg

SEQ ID NO: 132439 - DNA, 16 bp, H. sapiens
tcaaatgttaatgttt

SEQ ID NO: 132440 - DNA, 16 bp, H. sapiens
tcaaatgttacctctt

SEQ ID NO: 132441 - DNA, 16 bp, H. sapiens
tcaaatgttctttttt

SEQ ID NO: 132442 - DNA, 16 bp, H. sapiens
tcaaatgtttttttct

SEQ ID NO: 132443 - DNA, 16 bp, H. sapiens
tcaaattaccaatgtc

SEQ ID NO: 132444 - DNA, 16 bp, H. sapiens
tcaaattacctgactt

SEQ ID NO: 132445 - DNA, 16 bp, H. sapiens
tcaaattaggataatt

SEQ ID NO: 132446 - DNA, 16 bp, H. sapiens
tcaaattatactacaa

SEQ ID NO: 132447 - DNA, 16 bp, H. sapiens
tcaaattattttgttt

SEQ ID NO: 132448 - DNA, 18 bp, H. sapiens
tcaaattcctgacctcaa

SEQ ID NO: 132449 - DNA, 16 bp, H. sapiens
tcaaattcctggcctc

SEQ ID NO: 132450 - DNA, 16 bp, H. sapiens
tcaaattgatacataa

SEQ ID NO: 132451 - DNA, 17 bp, H. sapiens
tcaaattgctgggatta

SEQ ID NO: 132452 - DNA, 16 bp, H. sapiens
tcaaattggaaaagaa

SEQ ID NO: 132453 - DNA, 16 bp, H. sapiens
tcaaatttaggaaatt

SEQ ID NO: 132454 - DNA, 16 bp, H. sapiens
tcaaatttatggtgaa

SEQ ID NO: 132455 - DNA, 16 bp, H. sapiens
tcaaatttattggcat

SEQ ID NO: 132456 - DNA, 16 bp, H. sapiens
tcaaatttgatgaaaa

SEQ ID NO: 132457 - DNA, 16 bp, H. sapiens
tcaaatttggaaaaaa

SEQ ID NO: 132458 - DNA, 16 bp, H. sapiens
tcaaatttgtttattt

SEQ ID NO: 132459 - DNA, 16 bp, H. sapiens
tcaaattttccctctt

SEQ ID NO: 132460 - DNA, 16 bp, H. sapiens
tcaaattttgccaatt

SEQ ID NO: 132461 - DNA, 16 bp, H. sapiens
tcaaattttgcttttt

SEQ ID NO: 132462 - DNA, 16 bp, H. sapiens
tcaaatttttgtttta

SEQ ID NO: 132463 - DNA, 16 bp, H. sapiens
tcaacaaaaaattatg

SEQ ID NO: 132464 - DNA, 16 bp, H. sapiens
tcaacaaaactgacaa

SEQ ID NO: 132465 - DNA, 16 bp, H. sapiens
tcaacaaaatatacat

SEQ ID NO: 132466 - DNA, 16 bp, H. sapiens
tcaacaaaatgaaaga

SEQ ID NO: 132467 - DNA, 16 bp, H. sapiens
tcaacaaacatttaaa

SEQ ID NO: 132468 - DNA, 16 bp, H. sapiens
tcaacaaacttatttt

SEQ ID NO: 132469 - DNA, 16 bp, H. sapiens
tcaacaaagaaacaat

SEQ ID NO: 132470 - DNA, 16 bp, H. sapiens
tcaacaaatatttatc

SEQ ID NO: 132471 - DNA, 16 bp, H. sapiens
tcaacaaatggtagtt

SEQ ID NO: 132472 - DNA, 16 bp, H. sapiens
tcaacaaatgtttatt

SEQ ID NO: 132473 - DNA, 16 bp, H. sapiens
tcaacaagaagaaaac

SEQ ID NO: 132474 - DNA, 16 bp, H. sapiens
tcaacaagaagatcta

SEQ ID NO: 132475 - DNA, 16 bp, H. sapiens
tcaacaagaagattta

SEQ ID NO: 132476 - DNA, 17 bp, H. sapiens
tcaacaagacagaaagt

SEQ ID NO: 132477 - DNA, 16 bp, H. sapiens
tcaacaagcaaaatgc

SEQ ID NO: 132478 - DNA, 16 bp, H. sapiens
tcaacaagtgggtgaa

SEQ ID NO: 132479 - DNA, 16 bp, H. sapiens
tcaacaataaaatgaa

SEQ ID NO: 132480 - DNA, 16 bp, H. sapiens
tcaacaatgacaacaa

SEQ ID NO: 132481 - DNA, 16 bp, H. sapiens
tcaacacagctatttt

SEQ ID NO: 132482 - DNA, 16 bp, H. sapiens
tcaacaccagcctgga

SEQ ID NO: 132483 - DNA, 16 bp, H. sapiens
tcaacaccagcctggt

SEQ ID NO: 132484 - DNA, 16 bp, H. sapiens
tcaacaccatcctggc

SEQ ID NO: 132485 - DNA, 17 bp, H. sapiens
tcaacactccactgaca

SEQ ID NO: 132486 - DNA, 16 bp, H. sapiens
tcaacactgccacatt

SEQ ID NO: 132487 - DNA, 16 bp, H. sapiens
tcaacagaatgaaaaa

SEQ ID NO: 132488 - DNA, 16 bp, H. sapiens
tcaacagaatgaagga

SEQ ID NO: 132489 - DNA, 16 bp, H. sapiens
tcaacagatgaataaa

SEQ ID NO: 132490 - DNA, 16 bp, H. sapiens
tcaacagatgaatttt

SEQ ID NO: 132491 - DNA, 17 bp, H. sapiens
tcaacagatgcagaaaa

SEQ ID NO: 132492 - DNA, 16 bp, H. sapiens
tcaacagatgtttact

SEQ ID NO: 132493 - DNA, 16 bp, H. sapiens
tcaacagcaccatcaa

SEQ ID NO: 132494 - DNA, 16 bp, H. sapiens
tcaacagcagaatgaa

SEQ ID NO: 132495 - DNA, 16 bp, H. sapiens
tcaacagctgaatcaa

SEQ ID NO: 132496 - DNA, 16 bp, H. sapiens
tcaacaggaaaatgaa

SEQ ID NO: 132497 - DNA, 16 bp, H. sapiens
tcaacagtagaatgaa

SEQ ID NO: 132498 - DNA, 16 bp, H. sapiens
tcaacagtgccaaggt

SEQ ID NO: 132499 - DNA, 16 bp, H. sapiens
tcaacataataaaatc

SEQ ID NO: 132500 - DNA, 16 bp, H. sapiens
tcaacataatgaaata

SEQ ID NO: 132501 - DNA, 16 bp, H. sapiens
tcaacatagtatcgga

SEQ ID NO: 132502 - DNA, 16 bp, H. sapiens
tcaacatagtatttga

SEQ ID NO: 132503 - DNA, 16 bp, H. sapiens
tcaacatatatttgtt

SEQ ID NO: 132504 - DNA, 16 bp, H. sapiens
tcaacatatgaaaatc

SEQ ID NO: 132505 - DNA, 16 bp, H. sapiens
tcaacatatgtaaaat

SEQ ID NO: 132506 - DNA, 16 bp, H. sapiens
tcaacatcaaagacca

SEQ ID NO: 132507 - DNA, 16 bp, H. sapiens
tcaacatcactgtctt

SEQ ID NO: 132508 - DNA, 16 bp, H. sapiens
tcaacatcatcatcat

SEQ ID NO: 132509 - DNA, 16 bp, H. sapiens
tcaacatcctgcacca

SEQ ID NO: 132510 - DNA, 16 bp, H. sapiens
tcaacatgaagatgat

SEQ ID NO: 132511 - DNA, 16 bp, H. sapiens
tcaacatggagaaacc

SEQ ID NO: 132512 - DNA, 16 bp, H. sapiens
tcaacatggatgaatc

SEQ ID NO: 132513 - DNA, 17 bp, H. sapiens
tcaacatggtgaaacct

SEQ ID NO: 132514 - DNA, 17 bp, H. sapiens
tcaacatggtgaaatcc

SEQ ID NO: 132515 - DNA, 16 bp, H. sapiens
tcaacattaacaggag

SEQ ID NO: 132516 - DNA, 17 bp, H. sapiens
tcaacattcttaaagca

SEQ ID NO: 132517 - DNA, 16 bp, H. sapiens
tcaacattggacagat

SEQ ID NO: 132518 - DNA, 16 bp, H. sapiens
tcaacattgtactgaa

SEQ ID NO: 132519 - DNA, 16 bp, H. sapiens
tcaacatttttattaa

SEQ ID NO: 132520 - DNA, 16 bp, H. sapiens
tcaaccaactacagat

SEQ ID NO: 132521 - DNA, 16 bp, H. sapiens
tcaaccaactgtggat

SEQ ID NO: 132522 - DNA, 16 bp, H. sapiens
tcaaccaagaattcta

SEQ ID NO: 132523 - DNA, 16 bp, H. sapiens
tcaaccaatggaacag

SEQ ID NO: 132524 - DNA, 16 bp, H. sapiens
tcaaccaggtgtggtg

SEQ ID NO: 132525 - DNA, 16 bp, H. sapiens
tcaaccatggtggaag

SEQ ID NO: 132526 - DNA, 16 bp, H. sapiens
tcaacccaaatgacca

SEQ ID NO: 132527 - DNA, 16 bp, H. sapiens
tcaacccacaaggaga

SEQ ID NO: 132528 - DNA, 16 bp, H. sapiens
tcaacccagaatttaa

SEQ ID NO: 132529 - DNA, 16 bp, H. sapiens
tcaacccgtcatctgc

SEQ ID NO: 132530 - DNA, 16 bp, H. sapiens
tcaacccttgatccca

SEQ ID NO: 132531 - DNA, 16 bp, H. sapiens
tcaacctaagtgttca

SEQ ID NO: 132532 - DNA, 16 bp, H. sapiens
tcaacctcaatgccca

SEQ ID NO: 132533 - DNA, 16 bp, H. sapiens
tcaacctcacaaagtg

SEQ ID NO: 132534 - DNA, 16 bp, H. sapiens
tcaacctccacctcct

SEQ ID NO: 132535 - DNA, 16 bp, H. sapiens
tcaacctccagggttc

SEQ ID NO: 132536 - DNA, 16 bp, H. sapiens
tcaacctcccaaagtc

SEQ ID NO: 132537 - DNA, 16 bp, H. sapiens
tcaacctcctgagtgg

SEQ ID NO: 132538 - DNA, 16 bp, H. sapiens
tcaacctcctggcctc

SEQ ID NO: 132539 - DNA, 16 bp, H. sapiens
tcaacctgataaagaa

SEQ ID NO: 132540 - DNA, 16 bp, H. sapiens
tcaacctggacaacat

SEQ ID NO: 132541 - DNA, 16 bp, H. sapiens
tcaacctggccaacat

SEQ ID NO: 132542 - DNA, 16 bp, H. sapiens
tcaacctgggaggcag

SEQ ID NO: 132543 - DNA, 16 bp, H. sapiens
tcaacctgtcatttac

SEQ ID NO: 132544 - DNA, 16 bp, H. sapiens
tcaaccttagcaaaat

SEQ ID NO: 132545 - DNA, 16 bp, H. sapiens
tcaaccttgccagcat

SEQ ID NO: 132546 - DNA, 16 bp, H. sapiens
tcaacgatagactgga

SEQ ID NO: 132547 - DNA, 16 bp, H. sapiens
tcaactatttaaaaat

SEQ ID NO: 132548 - DNA, 16 bp, H. sapiens
tcaactcaaaatgggt

SEQ ID NO: 132549 - DNA, 16 bp, H. sapiens
tcaactcaatgaaata

SEQ ID NO: 132550 - DNA, 20 bp, H. sapiens
tcaactcataacttagaaac

SEQ ID NO: 132551 - DNA, 16 bp, H. sapiens
tcaactcatttcagca

SEQ ID NO: 132552 - DNA, 16 bp, H. sapiens
tcaactccaaaaggag

SEQ ID NO: 132553 - DNA, 16 bp, H. sapiens
tcaactccaaatacaa

SEQ ID NO: 132554 - DNA, 16 bp, H. sapiens
tcaactcctggactca

SEQ ID NO: 132555 - DNA, 16 bp, H. sapiens
tcaactctcccatttg

SEQ ID NO: 132556 - DNA, 16 bp, H. sapiens
tcaactgaaaatggat

SEQ ID NO: 132557 - DNA, 16 bp, H. sapiens
tcaactgagaagaaaa

SEQ ID NO: 132558 - DNA, 16 bp, H. sapiens
tcaactgatgtttgac

SEQ ID NO: 132559 - DNA, 16 bp, H. sapiens
tcaactgcttctgatg

SEQ ID NO: 132560 - DNA, 16 bp, H. sapiens
tcaactggaaggaagg

SEQ ID NO: 132561 - DNA, 16 bp, H. sapiens
tcaactgttttcattt

SEQ ID NO: 132562 - DNA, 16 bp, H. sapiens
tcaactgtttttattt

SEQ ID NO: 132563 - DNA, 16 bp, H. sapiens
tcaacttattcctggt

SEQ ID NO: 132564 - DNA, 16 bp, H. sapiens
tcaacttcctggcctc

SEQ ID NO: 132565 - DNA, 16 bp, H. sapiens
tcaacttctctgagcc

SEQ ID NO: 132566 - DNA, 16 bp, H. sapiens
tcaacttgactggatt

SEQ ID NO: 132567 - DNA, 16 bp, H. sapiens
tcaacttgactgggct

SEQ ID NO: 132568 - DNA, 16 bp, H. sapiens
tcaacttgattttttt

SEQ ID NO: 132569 - DNA, 17 bp, H. sapiens
tcaacttgtcatttaca

SEQ ID NO: 132570 - DNA, 16 bp, H. sapiens
tcaactttataagaaa

SEQ ID NO: 132571 - DNA, 16 bp, H. sapiens
tcaacttttatttaaa

SEQ ID NO: 132572 - DNA, 16 bp, H. sapiens
tcaacttttgcttttg

SEQ ID NO: 132573 - DNA, 16 bp, H. sapiens
tcaactttttaaaaaa

SEQ ID NO: 132574 - DNA, 16 bp, H. sapiens
tcaactttttatttca

SEQ ID NO: 132575 - DNA, 16 bp, H. sapiens
tcaactttttcaaaga

SEQ ID NO: 132576 - DNA, 16 bp, H. sapiens
tcaagaaaaaatatat

SEQ ID NO: 132577 - DNA, 16 bp, H. sapiens
tcaagaaaaaggaaga

SEQ ID NO: 132578 - DNA, 16 bp, H. sapiens
tcaagaaaagcctggg

SEQ ID NO: 132579 - DNA, 16 bp, H. sapiens
tcaagaaaaggaagaa

SEQ ID NO: 132580 - DNA, 16 bp, H. sapiens
tcaagaaaataaatga

SEQ ID NO: 132581 - DNA, 16 bp, H. sapiens
tcaagaaaatattagc

SEQ ID NO: 132582 - DNA, 16 bp, H. sapiens
tcaagaaaatgaaatt

SEQ ID NO: 132583 - DNA, 16 bp, H. sapiens
tcaagaaaatgaacat

SEQ ID NO: 132584 - DNA, 16 bp, H. sapiens
tcaagaaaatgagaag

SEQ ID NO: 132585 - DNA, 16 bp, H. sapiens
tcaagaaaatttaaaa

SEQ ID NO: 132586 - DNA, 16 bp, H. sapiens
tcaagaaagaattcag

SEQ ID NO: 132587 - DNA, 16 bp, H. sapiens
tcaagaaagcaatcct

SEQ ID NO: 132588 - DNA, 16 bp, H. sapiens
tcaagaaagtaaaaga

SEQ ID NO: 132589 - DNA, 16 bp, H. sapiens
tcaagaaagtcatggt

SEQ ID NO: 132590 - DNA, 16 bp, H. sapiens
tcaagaaagtgaaaaa

SEQ ID NO: 132591 - DNA, 16 bp, H. sapiens
tcaagaaatacttatt

SEQ ID NO: 132592 - DNA, 16 bp, H. sapiens
tcaagaaatatggaat

SEQ ID NO: 132593 - DNA, 16 bp, H. sapiens
tcaagaaatatgggac

SEQ ID NO: 132594 - DNA, 16 bp, H. sapiens
tcaagaaatatttact

SEQ ID NO: 132595 - DNA, 16 bp, H. sapiens
tcaagaaatatttatt

SEQ ID NO: 132596 - DNA, 16 bp, H. sapiens
tcaagaaatcaatgaa

SEQ ID NO: 132597 - DNA, 16 bp, H. sapiens
tcaagaaatcctccca

SEQ ID NO: 132598 - DNA, 16 bp, H. sapiens
tcaagaaatccttctg

SEQ ID NO: 132599 - DNA, 16 bp, H. sapiens
tcaagaacaaggcaaa

SEQ ID NO: 132600 - DNA, 16 bp, H. sapiens
tcaagaacaatttgaa

SEQ ID NO: 132601 - DNA, 16 bp, H. sapiens
tcaagaacacacaatg

SEQ ID NO: 132602 - DNA, 16 bp, H. sapiens
tcaagaacagaaaacc

SEQ ID NO: 132603 - DNA, 16 bp, H. sapiens
tcaagaacatttttat

SEQ ID NO: 132604 - DNA, 16 bp, H. sapiens
tcaagaaccagaaata

SEQ ID NO: 132605 - DNA, 16 bp, H. sapiens
tcaagaagaaagaaag

SEQ ID NO: 132606 - DNA, 16 bp, H. sapiens
tcaagaagaaatagat

SEQ ID NO: 132607 - DNA, 16 bp, H. sapiens
tcaagaagaagaaaga

SEQ ID NO: 132608 - DNA, 16 bp, H. sapiens
tcaagaagaatctgaa

SEQ ID NO: 132609 - DNA, 16 bp, H. sapiens
tcaagaagacagaaag

SEQ ID NO: 132610 - DNA, 16 bp, H. sapiens
tcaagaagctcaacaa

SEQ ID NO: 132611 - DNA, 16 bp, H. sapiens
tcaagaagctgaggca

SEQ ID NO: 132612 - DNA, 16 bp, H. sapiens
tcaagaagctggaaaa

SEQ ID NO: 132613 - DNA, 16 bp, H. sapiens
tcaagaagcttataat

SEQ ID NO: 132614 - DNA, 16 bp, H. sapiens
tcaagaaggcctgcct

SEQ ID NO: 132615 - DNA, 16 bp, H. sapiens
tcaagaagttctttga

SEQ ID NO: 132616 - DNA, 16 bp, H. sapiens
tcaagaatgaaaaagg

SEQ ID NO: 132617 - DNA, 16 bp, H. sapiens
tcaagaatgcagtgag

SEQ ID NO: 132618 - DNA, 16 bp, H. sapiens
tcaagaattcaagacc

SEQ ID NO: 132619 - DNA, 16 bp, H. sapiens
tcaagacacagacagt

SEQ ID NO: 132620 - DNA, 16 bp, H. sapiens
tcaagaccaccctgag

SEQ ID NO: 132621 - DNA, 16 bp, H. sapiens
tcaagaccagactagg

SEQ ID NO: 132622 - DNA, 16 bp, H. sapiens
tcaagaccagcatggg

SEQ ID NO: 132623 - DNA, 16 bp, H. sapiens
tcaagaccagcatggt

SEQ ID NO: 132624 - DNA, 16 bp, H. sapiens
tcaagaccagccaggc

SEQ ID NO: 132625 - DNA, 16 bp, H. sapiens
tcaagaccagcctgcc

SEQ ID NO: 132626 - DNA, 16 bp, H. sapiens
tcaagaccagcctgtg

SEQ ID NO: 132627 - DNA, 16 bp, H. sapiens
tcaagaccaggctgga

SEQ ID NO: 132628 - DNA, 16 bp, H. sapiens
tcaagaccagtctggt

SEQ ID NO: 132629 - DNA, 16 bp, H. sapiens
tcaagaccatcctgga

SEQ ID NO: 132630 - DNA, 16 bp, H. sapiens
tcaagacccacctggc

SEQ ID NO: 132631 - DNA, 16 bp, H. sapiens
tcaagacccagcagtg

SEQ ID NO: 132632 - DNA, 16 bp, H. sapiens
tcaagacccatcagcg

SEQ ID NO: 132633 - DNA, 16 bp, H. sapiens
tcaagactcattggtg

SEQ ID NO: 132634 - DNA, 16 bp, H. sapiens
tcaagacttcagtgga

SEQ ID NO: 132635 - DNA, 16 bp, H. sapiens
tcaagagaaaatgaaa

SEQ ID NO: 132636 - DNA, 16 bp, H. sapiens
tcaagagaaattattt

SEQ ID NO: 132637 - DNA, 16 bp, H. sapiens
tcaagagaacagcaca

SEQ ID NO: 132638 - DNA, 16 bp, H. sapiens
tcaagagaagaaacag

SEQ ID NO: 132639 - DNA, 16 bp, H. sapiens
tcaagagatgctcctg

SEQ ID NO: 132640 - DNA, 16 bp, H. sapiens
tcaagagcagcctgga

SEQ ID NO: 132641 - DNA, 16 bp, H. sapiens
tcaagaggaaaaaaat

SEQ ID NO: 132642 - DNA, 16 bp, H. sapiens
tcaagaggaaaaagaa

SEQ ID NO: 132643 - DNA, 16 bp, H. sapiens
tcaagaggaaatagaa

SEQ ID NO: 132644 - DNA, 16 bp, H. sapiens
tcaagaggaagcagaa

SEQ ID NO: 132645 - DNA, 16 bp, H. sapiens
tcaagaggaagcagag

SEQ ID NO: 132646 - DNA, 16 bp, H. sapiens
tcaagaggaatgcttc

SEQ ID NO: 132647 - DNA, 16 bp, H. sapiens
tcaagaggctgaagaa

SEQ ID NO: 132648 - DNA, 17 bp, H. sapiens
tcaagagtgaagctgca

SEQ ID NO: 132649 - DNA, 16 bp, H. sapiens
tcaagagtggggagaa

SEQ ID NO: 132650 - DNA, 16 bp, H. sapiens
tcaagagtttgagagc

SEQ ID NO: 132651 - DNA, 16 bp, H. sapiens
tcaagataaagaacat

SEQ ID NO: 132652 - DNA, 16 bp, H. sapiens
tcaagatcacacaact

SEQ ID NO: 132653 - DNA, 16 bp, H. sapiens
tcaagatcagccaggc

SEQ ID NO: 132654 - DNA, 16 bp, H. sapiens
tcaagatcagcctgaa

SEQ ID NO: 132655 - DNA, 16 bp, H. sapiens
tcaagatcagcctgat

SEQ ID NO: 132656 - DNA, 16 bp, H. sapiens
tcaagatcctcctgcc

SEQ ID NO: 132657 - DNA, 16 bp, H. sapiens
tcaagatcgcaccact

SEQ ID NO: 132658 - DNA, 16 bp, H. sapiens
tcaagatgagcctgga

SEQ ID NO: 132659 - DNA, 16 bp, H. sapiens
tcaagatggataaaag

SEQ ID NO: 132660 - DNA, 17 bp, H. sapiens
tcaagatggattaaaga

SEQ ID NO: 132661 - DNA, 16 bp, H. sapiens
tcaagatggcggctcc

SEQ ID NO: 132662 - DNA, 16 bp, H. sapiens
tcaagatggctgaata

SEQ ID NO: 132663 - DNA, 16 bp, H. sapiens
tcaagatgggatttgg

SEQ ID NO: 132664 - DNA, 16 bp, H. sapiens
tcaagatggtggctcc

SEQ ID NO: 132665 - DNA, 16 bp, H. sapiens
tcaagattcaggagaa

SEQ ID NO: 132666 - DNA, 16 bp, H. sapiens
tcaagattgttttgtc

SEQ ID NO: 132667 - DNA, 16 bp, H. sapiens
tcaagatttggaagca

SEQ ID NO: 132668 - DNA, 16 bp, H. sapiens
tcaagatttttatttt

SEQ ID NO: 132669 - DNA, 16 bp, H. sapiens
tcaagatttttttcct

SEQ ID NO: 132670 - DNA, 16 bp, H. sapiens
tcaagatttttttctt

SEQ ID NO: 132671 - DNA, 16 bp, H. sapiens
tcaagcaaagctatct

SEQ ID NO: 132672 - DNA, 16 bp, H. sapiens
tcaagcaacccttcca

SEQ ID NO: 132673 - DNA, 18 bp, H. sapiens
tcaagcaactctcctgct

SEQ ID NO: 132674 - DNA, 16 bp, H. sapiens
tcaagcaatacttcca

SEQ ID NO: 132675 - DNA, 16 bp, H. sapiens
tcaagcaatcctccca

SEQ ID NO: 132676 - DNA, 16 bp, H. sapiens
tcaagcaatcctcccg

SEQ ID NO: 132677 - DNA, 16 bp, H. sapiens
tcaagcaatgctccca

SEQ ID NO: 132678 - DNA, 16 bp, H. sapiens
tcaagcaattcagctt

SEQ ID NO: 132679 - DNA, 16 bp, H. sapiens
tcaagcaattctcccg

SEQ ID NO: 132680 - DNA, 16 bp, H. sapiens
tcaagcaattctccta

SEQ ID NO: 132681 - DNA, 16 bp, H. sapiens
tcaagcaattttcatg

SEQ ID NO: 132682 - DNA, 16 bp, H. sapiens
tcaagcagaagaatga

SEQ ID NO: 132683 - DNA, 16 bp, H. sapiens
tcaagcagaagaattt

SEQ ID NO: 132684 - DNA, 16 bp, H. sapiens
tcaagcagaagagaga

SEQ ID NO: 132685 - DNA, 16 bp, H. sapiens
tcaagcagaggaaaga

SEQ ID NO: 132686 - DNA, 16 bp, H. sapiens
tcaagcagagggaagg

SEQ ID NO: 132687 - DNA, 16 bp, H. sapiens
tcaagcagcaacattt

SEQ ID NO: 132688 - DNA, 16 bp, H. sapiens
tcaagcagtactcctg

SEQ ID NO: 132689 - DNA, 16 bp, H. sapiens
tcaagcagttctccca

SEQ ID NO: 132690 - DNA, 16 bp, H. sapiens
tcaagcagttttccca

SEQ ID NO: 132691 - DNA, 16 bp, H. sapiens
tcaagcataaaactgg

SEQ ID NO: 132692 - DNA, 16 bp, H. sapiens
tcaagcattttttttt

SEQ ID NO: 132693 - DNA, 16 bp, H. sapiens
tcaagccatcctcccg

SEQ ID NO: 132694 - DNA, 16 bp, H. sapiens
tcaagcccaggagttc

SEQ ID NO: 132695 - DNA, 16 bp, H. sapiens
tcaagcctcctgcctc

SEQ ID NO: 132696 - DNA, 24 bp, H. sapiens
tcaagcctggccaacatggtgaaa

SEQ ID NO: 132697 - DNA, 16 bp, H. sapiens
tcaagcctgggcaatg

SEQ ID NO: 132698 - DNA, 16 bp, H. sapiens
tcaagcctttctcctg

SEQ ID NO: 132699 - DNA, 16 bp, H. sapiens
tcaagcgatcatccca

SEQ ID NO: 132700 - DNA, 16 bp, H. sapiens
tcaagcgatcctccct

SEQ ID NO: 132701 - DNA, 20 bp, H. sapiens
tcaagcgattctcctgcctg

SEQ ID NO: 132702 - DNA, 16 bp, H. sapiens
tcaagcgattctcttt

SEQ ID NO: 132703 - DNA, 16 bp, H. sapiens
tcaagctacagatggt

SEQ ID NO: 132704 - DNA, 16 bp, H. sapiens
tcaagctaccctccca

SEQ ID NO: 132705 - DNA, 16 bp, H. sapiens
tcaagctatccttctg

SEQ ID NO: 132706 - DNA, 16 bp, H. sapiens
tcaagctggagtacag

SEQ ID NO: 132707 - DNA, 16 bp, H. sapiens
tcaagctttcagatga

SEQ ID NO: 132708 - DNA, 16 bp, H. sapiens
tcaaggaaacaaaaga

SEQ ID NO: 132709 - DNA, 16 bp, H. sapiens
tcaaggaaataacaga

SEQ ID NO: 132710 - DNA, 16 bp, H. sapiens
tcaaggaaataagaga

SEQ ID NO: 132711 - DNA, 16 bp, H. sapiens
tcaaggaaatcatgaa

SEQ ID NO: 132712 - DNA, 16 bp, H. sapiens
tcaaggaaccagagaa

SEQ ID NO: 132713 - DNA, 16 bp, H. sapiens
tcaaggaactggagaa

SEQ ID NO: 132714 - DNA, 16 bp, H. sapiens
tcaaggaacttaaaat

SEQ ID NO: 132715 - DNA, 16 bp, H. sapiens
tcaaggaagaaataaa

SEQ ID NO: 132716 - DNA, 16 bp, H. sapiens
tcaaggacaaaaaacc

SEQ ID NO: 132717 - DNA, 16 bp, H. sapiens
tcaaggagaaatacaa

SEQ ID NO: 132718 - DNA, 16 bp, H. sapiens
tcaaggagaaccacaa

SEQ ID NO: 132719 - DNA, 16 bp, H. sapiens
tcaaggagaacttcaa

SEQ ID NO: 132720 - DNA, 16 bp, H. sapiens
tcaaggagagaatctt

SEQ ID NO: 132721 - DNA, 16 bp, H. sapiens
tcaaggagctcacagt

SEQ ID NO: 132722 - DNA, 16 bp, H. sapiens
tcaaggaggcctgcct

SEQ ID NO: 132723 - DNA, 16 bp, H. sapiens
tcaaggaggccttcct

SEQ ID NO: 132724 - DNA, 16 bp, H. sapiens
tcaaggaggctggaga

SEQ ID NO: 132725 - DNA, 16 bp, H. sapiens
tcaaggagttctcctg

SEQ ID NO: 132726 - DNA, 16 bp, H. sapiens
tcaaggatatagaacc

SEQ ID NO: 132727 - DNA, 16 bp, H. sapiens
tcaaggatattgacct

SEQ ID NO: 132728 - DNA, 16 bp, H. sapiens
tcaaggatgtggagaa

SEQ ID NO: 132729 - DNA, 16 bp, H. sapiens
tcaaggcagaagaatt

SEQ ID NO: 132730 - DNA, 16 bp, H. sapiens
tcaaggcagaaggcaa

SEQ ID NO: 132731 - DNA, 16 bp, H. sapiens
tcaaggcagacctggg

SEQ ID NO: 132732 - DNA, 16 bp, H. sapiens
tcaaggcagcagtgag

SEQ ID NO: 132733 - DNA, 16 bp, H. sapiens
tcaaggccagcctggc

SEQ ID NO: 132734 - DNA, 16 bp, H. sapiens
tcaaggccatcctggc

SEQ ID NO: 132735 - DNA, 16 bp, H. sapiens
tcaaggcccaagggct

SEQ ID NO: 132736 - DNA, 16 bp, H. sapiens
tcaaggcccagctcag

SEQ ID NO: 132737 - DNA, 16 bp, H. sapiens
tcaaggccctagggct

SEQ ID NO: 132738 - DNA, 16 bp, H. sapiens
tcaaggcctgtgatgg

SEQ ID NO: 132739 - DNA, 16 bp, H. sapiens
tcaaggcgtcagcagg

SEQ ID NO: 132740 - DNA, 16 bp, H. sapiens
tcaaggctacaatgag

SEQ ID NO: 132741 - DNA, 16 bp, H. sapiens
tcaaggctacagtgaa

SEQ ID NO: 132742 - DNA, 16 bp, H. sapiens
tcaaggctacagtggg

SEQ ID NO: 132743 - DNA, 16 bp, H. sapiens
tcaaggctgcagtaag

SEQ ID NO: 132744 - DNA, 17 bp, H. sapiens
tcaaggctgcagtgaac

SEQ ID NO: 132745 - DNA, 16 bp, H. sapiens
tcaaggctgcggtgag

SEQ ID NO: 132746 - DNA, 16 bp, H. sapiens
tcaaggctgggacctc

SEQ ID NO: 132747 - DNA, 16 bp, H. sapiens
tcaaggcttcagtgaa

SEQ ID NO: 132748 - DNA, 16 bp, H. sapiens
tcaagggaaaagaaaa

SEQ ID NO: 132749 - DNA, 16 bp, H. sapiens
tcaagggaaattttaa

SEQ ID NO: 132750 - DNA, 16 bp, H. sapiens
tcaagggatcatccca

SEQ ID NO: 132751 - DNA, 20 bp, H. sapiens
tcaagggattctcctgcctc

SEQ ID NO: 132752 - DNA, 16 bp, H. sapiens
tcaagggcaggaccag

SEQ ID NO: 132753 - DNA, 16 bp, H. sapiens
tcaagggcttctcctg

SEQ ID NO: 132754 - DNA, 16 bp, H. sapiens
tcaaggggaggggaca

SEQ ID NO: 132755 - DNA, 16 bp, H. sapiens
tcaagggtcaacagta

SEQ ID NO: 132756 - DNA, 16 bp, H. sapiens
tcaaggtcacacagtg

SEQ ID NO: 132757 - DNA, 16 bp, H. sapiens
tcaaggtgctggccaa

SEQ ID NO: 132758 - DNA, 16 bp, H. sapiens
tcaaggtgctgggatt

SEQ ID NO: 132759 - DNA, 16 bp, H. sapiens
tcaagtaatctgcctg

SEQ ID NO: 132760 - DNA, 16 bp, H. sapiens
tcaagtacccagagac

SEQ ID NO: 132761 - DNA, 17 bp, H. sapiens
tcaagtagctgggactg

SEQ ID NO: 132762 - DNA, 16 bp, H. sapiens
tcaagtattctgtttt

SEQ ID NO: 132763 - DNA, 16 bp, H. sapiens
tcaagtatttattatt

SEQ ID NO: 132764 - DNA, 19 bp, H. sapiens
tcaagtcaatcctaagcca

SEQ ID NO: 132765 - DNA, 16 bp, H. sapiens
tcaagtcaggagtttg

SEQ ID NO: 132766 - DNA, 16 bp, H. sapiens
tcaagtccagcttggg

SEQ ID NO: 132767 - DNA, 16 bp, H. sapiens
tcaagtcccagctctg

SEQ ID NO: 132768 - DNA, 16 bp, H. sapiens
tcaagtctgcagtgag

SEQ ID NO: 132769 - DNA, 16 bp, H. sapiens
tcaagtgaaaggaaga

SEQ ID NO: 132770 - DNA, 16 bp, H. sapiens
tcaagtgatatttctg

SEQ ID NO: 132771 - DNA, 21 bp, H. sapiens
tcaagtgatccacccacctcg

SEQ ID NO: 132772 - DNA, 20 bp, H. sapiens
tcaagtgatccgcctgcctt

SEQ ID NO: 132773 - DNA, 16 bp, H. sapiens
tcaagtgatcctcaag

SEQ ID NO: 132774 - DNA, 17 bp, H. sapiens
tcaagtgatcctcccat

SEQ ID NO: 132775 - DNA, 21 bp, H. sapiens
tcaagtgatcctcccgcctcg

SEQ ID NO: 132776 - DNA, 16 bp, H. sapiens
tcaagtgatcctccta

SEQ ID NO: 132777 - DNA, 16 bp, H. sapiens
tcaagtgatcctcctg

SEQ ID NO: 132778 - DNA, 16 bp, H. sapiens
tcaagtgatctgccca

SEQ ID NO: 132779 - DNA, 21 bp, H. sapiens
tcaagtgatctgcccgcctca

SEQ ID NO: 132780 - DNA, 16 bp, H. sapiens
tcaagtgatgctcatg

SEQ ID NO: 132781 - DNA, 16 bp, H. sapiens
tcaagtgattatcttg

SEQ ID NO: 132782 - DNA, 16 bp, H. sapiens
tcaagtgattcacctg

SEQ ID NO: 132783 - DNA, 19 bp, H. sapiens
tcaagtgattcgcctgcct

SEQ ID NO: 132784 - DNA, 16 bp, H. sapiens
tcaagtgatttttctg

SEQ ID NO: 132785 - DNA, 16 bp, H. sapiens
tcaagtgctccacctg

SEQ ID NO: 132786 - DNA, 16 bp, H. sapiens
tcaagtggaagaaaga

SEQ ID NO: 132787 - DNA, 17 bp, H. sapiens
tcaagtgggcattttga

SEQ ID NO: 132788 - DNA, 16 bp, H. sapiens
tcaagtgggctttatc

SEQ ID NO: 132789 - DNA, 16 bp, H. sapiens
tcaagtggttccctga

SEQ ID NO: 132790 - DNA, 16 bp, H. sapiens
tcaagtgttctcacca

SEQ ID NO: 132791 - DNA, 16 bp, H. sapiens
tcaagttaattttttt

SEQ ID NO: 132792 - DNA, 16 bp, H. sapiens
tcaagttatcctcccg

SEQ ID NO: 132793 - DNA, 16 bp, H. sapiens
tcaagttgagattttt

SEQ ID NO: 132794 - DNA, 16 bp, H. sapiens
tcaagttggaaagaac

SEQ ID NO: 132795 - DNA, 16 bp, H. sapiens
tcaagttggagtgcag

SEQ ID NO: 132796 - DNA, 16 bp, H. sapiens
tcaagtttataatttt

SEQ ID NO: 132797 - DNA, 16 bp, H. sapiens
tcaagttttattatga

SEQ ID NO: 132798 - DNA, 16 bp, H. sapiens
tcaataaaactgttat

SEQ ID NO: 132799 - DNA, 16 bp, H. sapiens
tcaataaaactttttt

SEQ ID NO: 132800 - DNA, 16 bp, H. sapiens
tcaataaaagttgctg

SEQ ID NO: 132801 - DNA, 16 bp, H. sapiens
tcaataaaatgaagaa

SEQ ID NO: 132802 - DNA, 16 bp, H. sapiens
tcaataaaattgataa

SEQ ID NO: 132803 - DNA, 16 bp, H. sapiens
tcaataaacattagct

SEQ ID NO: 132804 - DNA, 16 bp, H. sapiens
tcaataaacatttatt

SEQ ID NO: 132805 - DNA, 16 bp, H. sapiens
tcaataaacatttgtt

SEQ ID NO: 132806 - DNA, 16 bp, H. sapiens
tcaataaacgttagct

SEQ ID NO: 132807 - DNA, 16 bp, H. sapiens
tcaataaacttgcttt

SEQ ID NO: 132808 - DNA, 16 bp, H. sapiens
tcaataaagcaagtca

SEQ ID NO: 132809 - DNA, 16 bp, H. sapiens
tcaataaagcacctct

SEQ ID NO: 132810 - DNA, 16 bp, H. sapiens
tcaataaagctcctct

SEQ ID NO: 132811 - DNA, 16 bp, H. sapiens
tcaataaagctgaaaa

SEQ ID NO: 132812 - DNA, 16 bp, H. sapiens
tcaataaagctgttta

SEQ ID NO: 132813 - DNA, 16 bp, H. sapiens
tcaataaagtttattt

SEQ ID NO: 132814 - DNA, 16 bp, H. sapiens
tcaataaataatcatt

SEQ ID NO: 132815 - DNA, 16 bp, H. sapiens
tcaataaatacttgtg

SEQ ID NO: 132816 - DNA, 16 bp, H. sapiens
tcaataaatacttgtt

SEQ ID NO: 132817 - DNA, 16 bp, H. sapiens
tcaataaatactttaa

SEQ ID NO: 132818 - DNA, 16 bp, H. sapiens
tcaataaatatgtatt

SEQ ID NO: 132819 - DNA, 16 bp, H. sapiens
tcaataaatattagca

SEQ ID NO: 132820 - DNA, 16 bp, H. sapiens
tcaataaatattagtt

SEQ ID NO: 132821 - DNA, 16 bp, H. sapiens
tcaataaatattgaat

SEQ ID NO: 132822 - DNA, 16 bp, H. sapiens
tcaataaatatttcta

SEQ ID NO: 132823 - DNA, 16 bp, H. sapiens
tcaataaatatttgag

SEQ ID NO: 132824 - DNA, 16 bp, H. sapiens
tcaataaatatttgct

SEQ ID NO: 132825 - DNA, 16 bp, H. sapiens
tcaataaatatttgtg

SEQ ID NO: 132826 - DNA, 16 bp, H. sapiens
tcaataaatattttct

SEQ ID NO: 132827 - DNA, 16 bp, H. sapiens
tcaataaatgcttact

SEQ ID NO: 132828 - DNA, 16 bp, H. sapiens
tcaataaatgcttatt

SEQ ID NO: 132829 - DNA, 16 bp, H. sapiens
tcaataaatgcttgtt

SEQ ID NO: 132830 - DNA, 16 bp, H. sapiens
tcaataaatgtcagct

SEQ ID NO: 132831 - DNA, 16 bp, H. sapiens
tcaataaatgtgatac

SEQ ID NO: 132832 - DNA, 16 bp, H. sapiens
tcaataaatgtgtatt

SEQ ID NO: 132833 - DNA, 16 bp, H. sapiens
tcaataaatgtgtttc

SEQ ID NO: 132834 - DNA, 16 bp, H. sapiens
tcaataaatgttagct

SEQ ID NO: 132835 - DNA, 16 bp, H. sapiens
tcaataaatgttattt

SEQ ID NO: 132836 - DNA, 16 bp, H. sapiens
tcaataaatgtttatt

SEQ ID NO: 132837 - DNA, 16 bp, H. sapiens
tcaataaatgtttctg

SEQ ID NO: 132838 - DNA, 16 bp, H. sapiens
tcaataaatgtttctt

SEQ ID NO: 132839 - DNA, 16 bp, H. sapiens
tcaataaatgtttgct

SEQ ID NO: 132840 - DNA, 17 bp, H. sapiens
tcaataaatttaagaaa

SEQ ID NO: 132841 - DNA, 16 bp, H. sapiens
tcaataacagaagaaa

SEQ ID NO: 132842 - DNA, 16 bp, H. sapiens
tcaataacattttaaa

SEQ ID NO: 132843 - DNA, 16 bp, H. sapiens
tcaatacctaatttgt

SEQ ID NO: 132844 - DNA, 16 bp, H. sapiens
tcaatagagacagaaa

SEQ ID NO: 132845 - DNA, 16 bp, H. sapiens
tcaatagataaacaaa

SEQ ID NO: 132846 - DNA, 16 bp, H. sapiens
tcaatagatatttatt

SEQ ID NO: 132847 - DNA, 16 bp, H. sapiens
tcaatagatgcaggaa

SEQ ID NO: 132848 - DNA, 16 bp, H. sapiens
tcaatagatgtagaaa

SEQ ID NO: 132849 - DNA, 16 bp, H. sapiens
tcaatagcaagaggaa

SEQ ID NO: 132850 - DNA, 16 bp, H. sapiens
tcaatagtagtttaat

SEQ ID NO: 132851 - DNA, 16 bp, H. sapiens
tcaatatatgtaaaat

SEQ ID NO: 132852 - DNA, 16 bp, H. sapiens
tcaatatatttttgaa

SEQ ID NO: 132853 - DNA, 16 bp, H. sapiens
tcaatatcaagaagat

SEQ ID NO: 132854 - DNA, 16 bp, H. sapiens
tcaatatcactgtttt

SEQ ID NO: 132855 - DNA, 16 bp, H. sapiens
tcaatatccaaaatat

SEQ ID NO: 132856 - DNA, 16 bp, H. sapiens
tcaatatgaaagaaaa

SEQ ID NO: 132857 - DNA, 16 bp, H. sapiens
tcaatattataaagat

SEQ ID NO: 132858 - DNA, 16 bp, H. sapiens
tcaatattatgaaaat

SEQ ID NO: 132859 - DNA, 21 bp, H. sapiens
tcaatattcaacattcttaaa

SEQ ID NO: 132860 - DNA, 16 bp, H. sapiens
tcaatattcaataaat

SEQ ID NO: 132861 - DNA, 16 bp, H. sapiens
tcaatattgaaaaaaa

SEQ ID NO: 132862 - DNA, 31 bp, H. sapiens
tcaatatttatactgactctaaatatgcctt

SEQ ID NO: 132863 - DNA, 16 bp, H. sapiens
tcaatatttcatcatt

SEQ ID NO: 132864 - DNA, 16 bp, H. sapiens
tcaatcaaaatctcag

SEQ ID NO: 132865 - DNA, 16 bp, H. sapiens
tcaatcaactagtgga

SEQ ID NO: 132866 - DNA, 16 bp, H. sapiens
tcaatcaatcaatcaa

SEQ ID NO: 132867 - DNA, 16 bp, H. sapiens
tcaatcaatcaatcat

SEQ ID NO: 132868 - DNA, 16 bp, H. sapiens
tcaatcagaaatgaaa

SEQ ID NO: 132869 - DNA, 16 bp, H. sapiens
tcaatccaaatgtcca

SEQ ID NO: 132870 - DNA, 17 bp, H. sapiens
tcaatccaatcaagttg

SEQ ID NO: 132871 - DNA, 16 bp, H. sapiens
tcaatccatcagcaaa

SEQ ID NO: 132872 - DNA, 16 bp, H. sapiens
tcaatcccttctagct

SEQ ID NO: 132873 - DNA, 16 bp, H. sapiens
tcaatcccttttataa

SEQ ID NO: 132874 - DNA, 16 bp, H. sapiens
tcaatctatatgtgtc

SEQ ID NO: 132875 - DNA, 16 bp, H. sapiens
tcaatctctctctctc

SEQ ID NO: 132876 - DNA, 16 bp, H. sapiens
tcaatctctgcctcct

SEQ ID NO: 132877 - DNA, 16 bp, H. sapiens
tcaatctcttcacctc

SEQ ID NO: 132878 - DNA, 16 bp, H. sapiens
tcaatctgaaataaaa

SEQ ID NO: 132879 - DNA, 16 bp, H. sapiens
tcaatcttgagttgat

SEQ ID NO: 132880 - DNA, 16 bp, H. sapiens
tcaatctttgaggttg

SEQ ID NO: 132881 - DNA, 16 bp, H. sapiens
tcaatgaaaagaaaag

SEQ ID NO: 132882 - DNA, 16 bp, H. sapiens
tcaatgaaaccaaaag

SEQ ID NO: 132883 - DNA, 16 bp, H. sapiens
tcaatgaaataaaaca

SEQ ID NO: 132884 - DNA, 16 bp, H. sapiens
tcaatgaaataaagca

SEQ ID NO: 132885 - DNA, 16 bp, H. sapiens
tcaatgaaataaagga

SEQ ID NO: 132886 - DNA, 16 bp, H. sapiens
tcaatgaaatacattt

SEQ ID NO: 132887 - DNA, 16 bp, H. sapiens
tcaatgaaattgaaaa

SEQ ID NO: 132888 - DNA, 16 bp, H. sapiens
tcaatgaagaaattaa

SEQ ID NO: 132889 - DNA, 16 bp, H. sapiens
tcaatgaagagaaaca

SEQ ID NO: 132890 - DNA, 16 bp, H. sapiens
tcaatgaataaataaa

SEQ ID NO: 132891 - DNA, 16 bp, H. sapiens
tcaatgaatgaataaa

SEQ ID NO: 132892 - DNA, 16 bp, H. sapiens
tcaatgactggcttca

SEQ ID NO: 132893 - DNA, 16 bp, H. sapiens
tcaatgagctcacaaa

SEQ ID NO: 132894 - DNA, 16 bp, H. sapiens
tcaatgagctctcaaa

SEQ ID NO: 132895 - DNA, 16 bp, H. sapiens
tcaatgagttttgaaa

SEQ ID NO: 132896 - DNA, 16 bp, H. sapiens
tcaatgatagagtgga

SEQ ID NO: 132897 - DNA, 16 bp, H. sapiens
tcaatgatgatgatga

SEQ ID NO: 132898 - DNA, 16 bp, H. sapiens
tcaatgcaattcccat

SEQ ID NO: 132899 - DNA, 16 bp, H. sapiens
tcaatgcaattcctat

SEQ ID NO: 132900 - DNA, 16 bp, H. sapiens
tcaatgccaaaaaaaa

SEQ ID NO: 132901 - DNA, 16 bp, H. sapiens
tcaatgccaaccccat

SEQ ID NO: 132902 - DNA, 16 bp, H. sapiens
tcaatgctacagtgag

SEQ ID NO: 132903 - DNA, 16 bp, H. sapiens
tcaatggaacaacaaa

SEQ ID NO: 132904 - DNA, 16 bp, H. sapiens
tcaatggacaaatgga

SEQ ID NO: 132905 - DNA, 16 bp, H. sapiens
tcaatggatacaaaat

SEQ ID NO: 132906 - DNA, 16 bp, H. sapiens
tcaatggattggatga

SEQ ID NO: 132907 - DNA, 16 bp, H. sapiens
tcaatggatttttaaa

SEQ ID NO: 132908 - DNA, 16 bp, H. sapiens
tcaatgggaaattaca

SEQ ID NO: 132909 - DNA, 16 bp, H. sapiens
tcaatgtaacaagaag

SEQ ID NO: 132910 - DNA, 16 bp, H. sapiens
tcaatgtaattttaaa

SEQ ID NO: 132911 - DNA, 16 bp, H. sapiens
tcaatgtgatggtatt

SEQ ID NO: 132912 - DNA, 16 bp, H. sapiens
tcaatgtgctgctgga

SEQ ID NO: 132913 - DNA, 16 bp, H. sapiens
tcaatgttataaattt

SEQ ID NO: 132914 - DNA, 17 bp, H. sapiens
tcaatgttcatcaaaga

SEQ ID NO: 132915 - DNA, 16 bp, H. sapiens
tcaatgttgttttaat

SEQ ID NO: 132916 - DNA, 16 bp, H. sapiens
tcaatgtttacttttt

SEQ ID NO: 132917 - DNA, 16 bp, H. sapiens
tcaatgttttataatt

SEQ ID NO: 132918 - DNA, 16 bp, H. sapiens
tcaattaaacctcttt

SEQ ID NO: 132919 - DNA, 16 bp, H. sapiens
tcaattaaatcagaat

SEQ ID NO: 132920 - DNA, 16 bp, H. sapiens
tcaattacctctcact

SEQ ID NO: 132921 - DNA, 16 bp, H. sapiens
tcaattacttccacct

SEQ ID NO: 132922 - DNA, 16 bp, H. sapiens
tcaattagaaaagaaa

SEQ ID NO: 132923 - DNA, 20 bp, H. sapiens
tcaattcaacaagagctaac

SEQ ID NO: 132924 - DNA, 16 bp, H. sapiens
tcaattcatacaaaac

SEQ ID NO: 132925 - DNA, 16 bp, H. sapiens
tcaattccaagcttca

SEQ ID NO: 132926 - DNA, 16 bp, H. sapiens
tcaattcctgacctca

SEQ ID NO: 132927 - DNA, 16 bp, H. sapiens
tcaattctgttatttt

SEQ ID NO: 132928 - DNA, 16 bp, H. sapiens
tcaattctgttccatt

SEQ ID NO: 132929 - DNA, 16 bp, H. sapiens
tcaattcttgcctcct

SEQ ID NO: 132930 - DNA, 16 bp, H. sapiens
tcaattcttttgtcat

SEQ ID NO: 132931 - DNA, 16 bp, H. sapiens
tcaattgatgcagaaa

SEQ ID NO: 132932 - DNA, 16 bp, H. sapiens
tcaattgatgttgaaa

SEQ ID NO: 132933 - DNA, 16 bp, H. sapiens
tcaattgattgatttt

SEQ ID NO: 132934 - DNA, 16 bp, H. sapiens
tcaattgctttgattt

SEQ ID NO: 132935 - DNA, 16 bp, H. sapiens
tcaattgtagttccca

SEQ ID NO: 132936 - DNA, 16 bp, H. sapiens
tcaatttaaaaatgag

SEQ ID NO: 132937 - DNA, 16 bp, H. sapiens
tcaatttaaaatttca

SEQ ID NO: 132938 - DNA, 16 bp, H. sapiens
tcaatttacagaaaaa

SEQ ID NO: 132939 - DNA, 16 bp, H. sapiens
tcaatttcagagcctt

SEQ ID NO: 132940 - DNA, 16 bp, H. sapiens
tcaatttcctcctcta

SEQ ID NO: 132941 - DNA, 16 bp, H. sapiens
tcaatttcctttcatt

SEQ ID NO: 132942 - DNA, 16 bp, H. sapiens
tcaatttctacaaaat

SEQ ID NO: 132943 - DNA, 16 bp, H. sapiens
tcaatttcttcatctt

SEQ ID NO: 132944 - DNA, 16 bp, H. sapiens
tcaatttctttacttg

SEQ ID NO: 132945 - DNA, 16 bp, H. sapiens
tcaatttgctgagcat

SEQ ID NO: 132946 - DNA, 16 bp, H. sapiens
tcaattttatgtattt

SEQ ID NO: 132947 - DNA, 16 bp, H. sapiens
tcaattttgctatgaa

SEQ ID NO: 132948 - DNA, 16 bp, H. sapiens
tcaatttttgaaaatt

SEQ ID NO: 132949 - DNA, 16 bp, H. sapiens
tcaatttttttgtaga

SEQ ID NO: 132950 - DNA, 16 bp, H. sapiens
tcacaaaaaagtaact

SEQ ID NO: 132951 - DNA, 16 bp, H. sapiens
tcacaaaaacagcatg

SEQ ID NO: 132952 - DNA, 21 bp, H. sapiens
tcacaaaaacatgtgttgtat

SEQ ID NO: 132953 - DNA, 16 bp, H. sapiens
tcacaaaaagacaaat

SEQ ID NO: 132954 - DNA, 16 bp, H. sapiens
tcacaaaagaagataa

SEQ ID NO: 132955 - DNA, 16 bp, H. sapiens
tcacaaaagacataaa

SEQ ID NO: 132956 - DNA, 16 bp, H. sapiens
tcacaaaagaccacac

SEQ ID NO: 132957 - DNA, 16 bp, H. sapiens
tcacaaaagaggaaac

SEQ ID NO: 132958 - DNA, 16 bp, H. sapiens
tcacaaaagcaaagat

SEQ ID NO: 132959 - DNA, 16 bp, H. sapiens
tcacaaaaggccacat

SEQ ID NO: 132960 - DNA, 16 bp, H. sapiens
tcacaaaataatttac

SEQ ID NO: 132961 - DNA, 16 bp, H. sapiens
tcacaaaatccagaaa

SEQ ID NO: 132962 - DNA, 16 bp, H. sapiens
tcacaaacataatatt

SEQ ID NO: 132963 - DNA, 16 bp, H. sapiens
tcacaaacctgagaaa

SEQ ID NO: 132964 - DNA, 16 bp, H. sapiens
tcacaaagaagcttct

SEQ ID NO: 132965 - DNA, 16 bp, H. sapiens
tcacaaagatattctc

SEQ ID NO: 132966 - DNA, 16 bp, H. sapiens
tcacaaagcaatttca

SEQ ID NO: 132967 - DNA, 16 bp, H. sapiens
tcacaaagcactttca

SEQ ID NO: 132968 - DNA, 16 bp, H. sapiens
tcacaaagccaagccc

SEQ ID NO: 132969 - DNA, 16 bp, H. sapiens
tcacaaagtacattct

SEQ ID NO: 132970 - DNA, 16 bp, H. sapiens
tcacaaatatcctttt

SEQ ID NO: 132971 - DNA, 16 bp, H. sapiens
tcacaaatatttattg

SEQ ID NO: 132972 - DNA, 16 bp, H. sapiens
tcacaaattctttttt

SEQ ID NO: 132973 - DNA, 16 bp, H. sapiens
tcacaacaacctcatg

SEQ ID NO: 132974 - DNA, 16 bp, H. sapiens
tcacaagaaaaggaaa

SEQ ID NO: 132975 - DNA, 16 bp, H. sapiens
tcacaagaagagcatg

SEQ ID NO: 132976 - DNA, 16 bp, H. sapiens
tcacaaggtaatgtca

SEQ ID NO: 132977 - DNA, 16 bp, H. sapiens
tcacaaggtcatgaga

SEQ ID NO: 132978 - DNA, 16 bp, H. sapiens
tcacaagttttttttt

SEQ ID NO: 132979 - DNA, 16 bp, H. sapiens
tcacaataaccctgtg

SEQ ID NO: 132980 - DNA, 16 bp, H. sapiens
tcacaatagtaacatc

SEQ ID NO: 132981 - DNA, 16 bp, H. sapiens
tcacaatcatgttgga

SEQ ID NO: 132982 - DNA, 16 bp, H. sapiens
tcacaatcattgtgga

SEQ ID NO: 132983 - DNA, 16 bp, H. sapiens
tcacaatgaaagaaaa

SEQ ID NO: 132984 - DNA, 16 bp, H. sapiens
tcacaatggccaaaag

SEQ ID NO: 132985 - DNA, 16 bp, H. sapiens
tcacaattctgaaggc

SEQ ID NO: 132986 - DNA, 16 bp, H. sapiens
tcacaattttttaaaa

SEQ ID NO: 132987 - DNA, 20 bp, H. sapiens
tcacacaaagcctgtttggt

SEQ ID NO: 132988 - DNA, 16 bp, H. sapiens
tcacacaataataatg

SEQ ID NO: 132989 - DNA, 16 bp, H. sapiens
tcacacacacacatac

SEQ ID NO: 132990 - DNA, 16 bp, H. sapiens
tcacacacacaggcac

SEQ ID NO: 132991 - DNA, 16 bp, H. sapiens
tcacacacacatgcac

SEQ ID NO: 132992 - DNA, 16 bp, H. sapiens
tcacacacactcacac

SEQ ID NO: 132993 - DNA, 16 bp, H. sapiens
tcacacacatacacac

SEQ ID NO: 132994 - DNA, 16 bp, H. sapiens
tcacacactcacacat

SEQ ID NO: 132995 - DNA, 16 bp, H. sapiens
tcacacagaaaataaa

SEQ ID NO: 132996 - DNA, 16 bp, H. sapiens
tcacacagatagtaag

SEQ ID NO: 132997 - DNA, 16 bp, H. sapiens
tcacacagccagccag

SEQ ID NO: 132998 - DNA, 16 bp, H. sapiens
tcacacagccagtgag

SEQ ID NO: 132999 - DNA, 16 bp, H. sapiens
tcacacagcctctcct

SEQ ID NO: 133000 - DNA, 16 bp, H. sapiens
tcacacagctaacaag

SEQ ID NO: 133001 - DNA, 16 bp, H. sapiens
tcacacagctaataag

SEQ ID NO: 133002 - DNA, 16 bp, H. sapiens
tcacacagctaatgag

SEQ ID NO: 133003 - DNA, 16 bp, H. sapiens
tcacacagctatgaag

SEQ ID NO: 133004 - DNA, 16 bp, H. sapiens
tcacacagctgagaag

SEQ ID NO: 133005 - DNA, 16 bp, H. sapiens
tcacacagctgctgag

SEQ ID NO: 133006 - DNA, 16 bp, H. sapiens
tcacacataaaataca

SEQ ID NO: 133007 - DNA, 16 bp, H. sapiens
tcacacatttaaaata

SEQ ID NO: 133008 - DNA, 16 bp, H. sapiens
tcacaccactgcacac

SEQ ID NO: 133009 - DNA, 16 bp, H. sapiens
tcacaccactgcacta

SEQ ID NO: 133010 - DNA, 16 bp, H. sapiens
tcacaccactgcattc

SEQ ID NO: 133011 - DNA, 16 bp, H. sapiens
tcacaccatatgcaaa

SEQ ID NO: 133012 - DNA, 16 bp, H. sapiens
tcacacccttctcctg

SEQ ID NO: 133013 - DNA, 16 bp, H. sapiens
tcacacctaagaaaat

SEQ ID NO: 133014 - DNA, 16 bp, H. sapiens
tcacacctgtaacccc

SEQ ID NO: 133015 - DNA, 16 bp, H. sapiens
tcacacctgtagcccc

SEQ ID NO: 133016 - DNA, 16 bp, H. sapiens
tcacacgtgtgtgtgt

SEQ ID NO: 133017 - DNA, 16 bp, H. sapiens
tcacactacccaactt

SEQ ID NO: 133018 - DNA, 16 bp, H. sapiens
tcacactagtcacatt

SEQ ID NO: 133019 - DNA, 16 bp, H. sapiens
tcacactcattaggat

SEQ ID NO: 133020 - DNA, 16 bp, H. sapiens
tcacactcctgagctc

SEQ ID NO: 133021 - DNA, 16 bp, H. sapiens
tcacactgaatgggca

SEQ ID NO: 133022 - DNA, 16 bp, H. sapiens
tcacactgcagggctg

SEQ ID NO: 133023 - DNA, 16 bp, H. sapiens
tcacactgctggtaaa

SEQ ID NO: 133024 - DNA, 16 bp, H. sapiens
tcacactgctggtggg

SEQ ID NO: 133025 - DNA, 16 bp, H. sapiens
tcacactgctgtaaag

SEQ ID NO: 133026 - DNA, 16 bp, H. sapiens
tcacactgtgaacttt

SEQ ID NO: 133027 - DNA, 16 bp, H. sapiens
tcacacttcctgattt

SEQ ID NO: 133028 - DNA, 16 bp, H. sapiens
tcacagaaaaggaaaa

SEQ ID NO: 133029 - DNA, 16 bp, H. sapiens
tcacagaaacacacac

SEQ ID NO: 133030 - DNA, 16 bp, H. sapiens
tcacagaaacatccag

SEQ ID NO: 133031 - DNA, 16 bp, H. sapiens
tcacagaaatagaaaa

SEQ ID NO: 133032 - DNA, 16 bp, H. sapiens
tcacagaaatagaaac

SEQ ID NO: 133033 - DNA, 16 bp, H. sapiens
tcacagaaatataaat

SEQ ID NO: 133034 - DNA, 16 bp, H. sapiens
tcacagaacctgggct

SEQ ID NO: 133035 - DNA, 17 bp, H. sapiens
tcacagaactggaaaaa

SEQ ID NO: 133036 - DNA, 16 bp, H. sapiens
tcacagaactggagaa

SEQ ID NO: 133037 - DNA, 16 bp, H. sapiens
tcacagaagaggtggg

SEQ ID NO: 133038 - DNA, 16 bp, H. sapiens
tcacagaaggacaaat

SEQ ID NO: 133039 - DNA, 16 bp, H. sapiens
tcacagaatgaattag

SEQ ID NO: 133040 - DNA, 16 bp, H. sapiens
tcacagaattttgaga

SEQ ID NO: 133041 - DNA, 16 bp, H. sapiens
tcacagaatttttttt

SEQ ID NO: 133042 - DNA, 16 bp, H. sapiens
tcacagacccacagac

SEQ ID NO: 133043 - DNA, 16 bp, H. sapiens
tcacagacctggaggc

SEQ ID NO: 133044 - DNA, 16 bp, H. sapiens
tcacagacttggaaaa

SEQ ID NO: 133045 - DNA, 16 bp, H. sapiens
tcacagagaataaaat

SEQ ID NO: 133046 - DNA, 16 bp, H. sapiens
tcacagagatgaacct

SEQ ID NO: 133047 - DNA, 16 bp, H. sapiens
tcacagaggaaaaaaa

SEQ ID NO: 133048 - DNA, 16 bp, H. sapiens
tcacagaggaggtgac

SEQ ID NO: 133049 - DNA, 16 bp, H. sapiens
tcacagaggaggtggc

SEQ ID NO: 133050 - DNA, 16 bp, H. sapiens
tcacagaggtaaagtg

SEQ ID NO: 133051 - DNA, 16 bp, H. sapiens
tcacagagtgagactc

SEQ ID NO: 133052 - DNA, 16 bp, H. sapiens
tcacagagttaaatat

SEQ ID NO: 133053 - DNA, 16 bp, H. sapiens
tcacagagttaaattt

SEQ ID NO: 133054 - DNA, 16 bp, H. sapiens
tcacagatagaagatt

SEQ ID NO: 133055 - DNA, 16 bp, H. sapiens
tcacagatatttattt

SEQ ID NO: 133056 - DNA, 16 bp, H. sapiens
tcacagatcaccataa

SEQ ID NO: 133057 - DNA, 16 bp, H. sapiens
tcacagatgaaaaaac

SEQ ID NO: 133058 - DNA, 16 bp, H. sapiens
tcacagatgaagaaat

SEQ ID NO: 133059 - DNA, 16 bp, H. sapiens
tcacagatgacatgat

SEQ ID NO: 133060 - DNA, 16 bp, H. sapiens
tcacagatgagaaact

SEQ ID NO: 133061 - DNA, 16 bp, H. sapiens
tcacagatgagacttt

SEQ ID NO: 133062 - DNA, 16 bp, H. sapiens
tcacagatggagcaat

SEQ ID NO: 133063 - DNA, 16 bp, H. sapiens
tcacagatttttttaa

SEQ ID NO: 133064 - DNA, 16 bp, H. sapiens
tcacagcactttgggg

SEQ ID NO: 133065 - DNA, 16 bp, H. sapiens
tcacagcagattcaga

SEQ ID NO: 133066 - DNA, 16 bp, H. sapiens
tcacagcagcactgtt

SEQ ID NO: 133067 - DNA, 16 bp, H. sapiens
tcacagcagcagcagc

SEQ ID NO: 133068 - DNA, 16 bp, H. sapiens
tcacagcagccctagg

SEQ ID NO: 133069 - DNA, 16 bp, H. sapiens
tcacagccacagccac

SEQ ID NO: 133070 - DNA, 16 bp, H. sapiens
tcacagccactgcact

SEQ ID NO: 133071 - DNA, 16 bp, H. sapiens
tcacagccacttggga

SEQ ID NO: 133072 - DNA, 16 bp, H. sapiens
tcacagccagtgccag

SEQ ID NO: 133073 - DNA, 16 bp, H. sapiens
tcacagcccagctggg

SEQ ID NO: 133074 - DNA, 16 bp, H. sapiens
tcacagccctcagaag

SEQ ID NO: 133075 - DNA, 16 bp, H. sapiens
tcacagcccttagaag

SEQ ID NO: 133076 - DNA, 16 bp, H. sapiens
tcacagcctcaccagc

SEQ ID NO: 133077 - DNA, 16 bp, H. sapiens
tcacagctactccaga

SEQ ID NO: 133078 - DNA, 16 bp, H. sapiens
tcacagctcactgaac

SEQ ID NO: 133079 - DNA, 16 bp, H. sapiens
tcacagctcttaaaat

SEQ ID NO: 133080 - DNA, 16 bp, H. sapiens
tcacagctgaattgta

SEQ ID NO: 133081 - DNA, 16 bp, H. sapiens
tcacagctggagagga

SEQ ID NO: 133082 - DNA, 16 bp, H. sapiens
tcacagctggcaccag

SEQ ID NO: 133083 - DNA, 16 bp, H. sapiens
tcacagctgtgtgacc

SEQ ID NO: 133084 - DNA, 17 bp, H. sapiens
tcacaggagcgtgaacc

SEQ ID NO: 133085 - DNA, 16 bp, H. sapiens
tcacaggcagccaact

SEQ ID NO: 133086 - DNA, 16 bp, H. sapiens
tcacaggcatgggcca

SEQ ID NO: 133087 - DNA, 16 bp, H. sapiens
tcacagggcggcagga

SEQ ID NO: 133088 - DNA, 16 bp, H. sapiens
tcacagggtcaagaga

SEQ ID NO: 133089 - DNA, 16 bp, H. sapiens
tcacagggtcattgtg

SEQ ID NO: 133090 - DNA, 16 bp, H. sapiens
tcacagtcatggtgga

SEQ ID NO: 133091 - DNA, 16 bp, H. sapiens
tcacagtcctcagaag

SEQ ID NO: 133092 - DNA, 16 bp, H. sapiens
tcacagtcctggaggc

SEQ ID NO: 133093 - DNA, 16 bp, H. sapiens
tcacagtctggaggct

SEQ ID NO: 133094 - DNA, 16 bp, H. sapiens
tcacagtgagctcttc

SEQ ID NO: 133095 - DNA, 16 bp, H. sapiens
tcacagtggcattatt

SEQ ID NO: 133096 - DNA, 16 bp, H. sapiens
tcacagtggctcacac

SEQ ID NO: 133097 - DNA, 16 bp, H. sapiens
tcacagtggctgaact

SEQ ID NO: 133098 - DNA, 16 bp, H. sapiens
tcacagttaagcatgg

SEQ ID NO: 133099 - DNA, 16 bp, H. sapiens
tcacagttctgaaggc

SEQ ID NO: 133100 - DNA, 16 bp, H. sapiens
tcacagttctgcagcc

SEQ ID NO: 133101 - DNA, 16 bp, H. sapiens
tcacagttctgcagga

SEQ ID NO: 133102 - DNA, 16 bp, H. sapiens
tcacagttctggaaac

SEQ ID NO: 133103 - DNA, 16 bp, H. sapiens
tcacagttctggaagc

SEQ ID NO: 133104 - DNA, 16 bp, H. sapiens
tcacagttctggaggc

SEQ ID NO: 133105 - DNA, 16 bp, H. sapiens
tcacagttgcagccat

SEQ ID NO: 133106 - DNA, 16 bp, H. sapiens
tcacagttttggaagc

SEQ ID NO: 133107 - DNA, 16 bp, H. sapiens
tcacagttttggaggt

SEQ ID NO: 133108 - DNA, 16 bp, H. sapiens
tcacataaatgaaatt

SEQ ID NO: 133109 - DNA, 16 bp, H. sapiens
tcacataaatgtcttc

SEQ ID NO: 133110 - DNA, 16 bp, H. sapiens
tcacataacttttatt

SEQ ID NO: 133111 - DNA, 16 bp, H. sapiens
tcacatactataaaat

SEQ ID NO: 133112 - DNA, 16 bp, H. sapiens
tcacataggatttcag

SEQ ID NO: 133113 - DNA, 16 bp, H. sapiens
tcacatataatgtaat

SEQ ID NO: 133114 - DNA, 16 bp, H. sapiens
tcacatatatattata

SEQ ID NO: 133115 - DNA, 16 bp, H. sapiens
tcacatattataaaat

SEQ ID NO: 133116 - DNA, 16 bp, H. sapiens
tcacatattctacaaa

SEQ ID NO: 133117 - DNA, 16 bp, H. sapiens
tcacatattttcttct

SEQ ID NO: 133118 - DNA, 16 bp, H. sapiens
tcacatcaagttaaaa

SEQ ID NO: 133119 - DNA, 17 bp, H. sapiens
tcacatcacaggactct

SEQ ID NO: 133120 - DNA, 16 bp, H. sapiens
tcacatccagggcaca

SEQ ID NO: 133121 - DNA, 16 bp, H. sapiens
tcacatccattatttt

SEQ ID NO: 133122 - DNA, 16 bp, H. sapiens
tcacatcccagctctg

SEQ ID NO: 133123 - DNA, 16 bp, H. sapiens
tcacatctactaggat

SEQ ID NO: 133124 - DNA, 16 bp, H. sapiens
tcacatctctttctct

SEQ ID NO: 133125 - DNA, 16 bp, H. sapiens
tcacatgaaaccaaaa

SEQ ID NO: 133126 - DNA, 16 bp, H. sapiens
tcacatgaggtcaggt

SEQ ID NO: 133127 - DNA, 16 bp, H. sapiens
tcacatgatggcttca

SEQ ID NO: 133128 - DNA, 16 bp, H. sapiens
tcacatggcaagagag

SEQ ID NO: 133129 - DNA, 16 bp, H. sapiens
tcacatggcattctcc

SEQ ID NO: 133130 - DNA, 16 bp, H. sapiens
tcacatggcattttaa

SEQ ID NO: 133131 - DNA, 16 bp, H. sapiens
tcacatggccaggtac

SEQ ID NO: 133132 - DNA, 16 bp, H. sapiens
tcacatggtattctcc

SEQ ID NO: 133133 - DNA, 16 bp, H. sapiens
tcacattaaatgtaaa

SEQ ID NO: 133134 - DNA, 16 bp, H. sapiens
tcacattatctaactt

SEQ ID NO: 133135 - DNA, 17 bp, H. sapiens
tcacattcaccaaagtt

SEQ ID NO: 133136 - DNA, 16 bp, H. sapiens
tcacattcattaatat

SEQ ID NO: 133137 - DNA, 16 bp, H. sapiens
tcacattctcaccagc

SEQ ID NO: 133138 - DNA, 16 bp, H. sapiens
tcacattgtacatctt

SEQ ID NO: 133139 - DNA, 16 bp, H. sapiens
tcacatttaaaacaaa

SEQ ID NO: 133140 - DNA, 16 bp, H. sapiens
tcacatttatttgtgt

SEQ ID NO: 133141 - DNA, 16 bp, H. sapiens
tcacatttcaaaacca

SEQ ID NO: 133142 - DNA, 16 bp, H. sapiens
tcacatttcaacatga

SEQ ID NO: 133143 - DNA, 16 bp, H. sapiens
tcacatttcaacctga

SEQ ID NO: 133144 - DNA, 16 bp, H. sapiens
tcacatttctctaatg

SEQ ID NO: 133145 - DNA, 16 bp, H. sapiens
tcacattttaaaattt

SEQ ID NO: 133146 - DNA, 16 bp, H. sapiens
tcacattttaaattat

SEQ ID NO: 133147 - DNA, 16 bp, H. sapiens
tcacattttaagaaaa

SEQ ID NO: 133148 - DNA, 16 bp, H. sapiens
tcacattttcaggtat

SEQ ID NO: 133149 - DNA, 16 bp, H. sapiens
tcacattttcttgctt

SEQ ID NO: 133150 - DNA, 16 bp, H. sapiens
tcacattttgcttttt

SEQ ID NO: 133151 - DNA, 16 bp, H. sapiens
tcacattttggtaatt

SEQ ID NO: 133152 - DNA, 16 bp, H. sapiens
tcaccaaagatgaaat

SEQ ID NO: 133153 - DNA, 16 bp, H. sapiens
tcaccaacacttgtta

SEQ ID NO: 133154 - DNA, 16 bp, H. sapiens
tcaccaacatcaaaga

SEQ ID NO: 133155 - DNA, 16 bp, H. sapiens
tcaccaacatccatct

SEQ ID NO: 133156 - DNA, 16 bp, H. sapiens
tcaccaaccaactatc

SEQ ID NO: 133157 - DNA, 17 bp, H. sapiens
tcaccaaccaactatct

SEQ ID NO: 133158 - DNA, 16 bp, H. sapiens
tcaccaagacagtggg

SEQ ID NO: 133159 - DNA, 16 bp, H. sapiens
tcaccaaggagatggt

SEQ ID NO: 133160 - DNA, 16 bp, H. sapiens
tcaccaaggctgaaat

SEQ ID NO: 133161 - DNA, 16 bp, H. sapiens
tcaccaaggctggaat

SEQ ID NO: 133162 - DNA, 16 bp, H. sapiens
tcaccaaggtgatggt

SEQ ID NO: 133163 - DNA, 16 bp, H. sapiens
tcaccaatttaaatgt

SEQ ID NO: 133164 - DNA, 16 bp, H. sapiens
tcaccacaaaaaaatg

SEQ ID NO: 133165 - DNA, 16 bp, H. sapiens
tcaccacaaaagaact

SEQ ID NO: 133166 - DNA, 16 bp, H. sapiens
tcaccacaagctgatt

SEQ ID NO: 133167 - DNA, 16 bp, H. sapiens
tcaccacactgccttc

SEQ ID NO: 133168 - DNA, 16 bp, H. sapiens
tcaccacagtcaagat

SEQ ID NO: 133169 - DNA, 16 bp, H. sapiens
tcaccacatctggaca

SEQ ID NO: 133170 - DNA, 16 bp, H. sapiens
tcaccaccaccagcac

SEQ ID NO: 133171 - DNA, 16 bp, H. sapiens
tcaccaccaccatcat

SEQ ID NO: 133172 - DNA, 16 bp, H. sapiens
tcaccaccaccattac

SEQ ID NO: 133173 - DNA, 16 bp, H. sapiens
tcaccaccatcaaaga

SEQ ID NO: 133174 - DNA, 16 bp, H. sapiens
tcaccaccatccatct

SEQ ID NO: 133175 - DNA, 16 bp, H. sapiens
tcaccaccatctatct

SEQ ID NO: 133176 - DNA, 16 bp, H. sapiens
tcaccaccatgcccaa

SEQ ID NO: 133177 - DNA, 16 bp, H. sapiens
tcaccacctccactgc

SEQ ID NO: 133178 - DNA, 16 bp, H. sapiens
tcaccacctccaggaa

SEQ ID NO: 133179 - DNA, 16 bp, H. sapiens
tcaccactcaagaact

SEQ ID NO: 133180 - DNA, 22 bp, H. sapiens
tcaccactcctattcaacatac

SEQ ID NO: 133181 - DNA, 16 bp, H. sapiens
tcaccactgcacttca

SEQ ID NO: 133182 - DNA, 16 bp, H. sapiens
tcaccacttctattca

SEQ ID NO: 133183 - DNA, 16 bp, H. sapiens
tcaccagaaaaggtaa

SEQ ID NO: 133184 - DNA, 16 bp, H. sapiens
tcaccagaagctgagc

SEQ ID NO: 133185 - DNA, 16 bp, H. sapiens
tcaccagacactgaaa

SEQ ID NO: 133186 - DNA, 16 bp, H. sapiens
tcaccagacagggaac

SEQ ID NO: 133187 - DNA, 16 bp, H. sapiens
tcaccagagaaatgca

SEQ ID NO: 133188 - DNA, 25 bp, H. sapiens
tcaccagcaacggaacaaagctgga

SEQ ID NO: 133189 - DNA, 16 bp, H. sapiens
tcaccagcatctgttt

SEQ ID NO: 133190 - DNA, 16 bp, H. sapiens
tcaccagctgtgtgat

SEQ ID NO: 133191 - DNA, 16 bp, H. sapiens
tcaccagctttcctgg

SEQ ID NO: 133192 - DNA, 16 bp, H. sapiens
tcaccaggcagggccc

SEQ ID NO: 133193 - DNA, 16 bp, H. sapiens
tcaccaggcccagcta

SEQ ID NO: 133194 - DNA, 16 bp, H. sapiens
tcaccaggcctgcctt

SEQ ID NO: 133195 - DNA, 17 bp, H. sapiens
tcaccaggctggagtgt

SEQ ID NO: 133196 - DNA, 16 bp, H. sapiens
tcaccagggacctgcc

SEQ ID NO: 133197 - DNA, 16 bp, H. sapiens
tcaccagggccctggg

SEQ ID NO: 133198 - DNA, 16 bp, H. sapiens
tcaccaggttcctccc

SEQ ID NO: 133199 - DNA, 16 bp, H. sapiens
tcaccagtgaagccac

SEQ ID NO: 133200 - DNA, 16 bp, H. sapiens
tcaccagtggaagctg

SEQ ID NO: 133201 - DNA, 16 bp, H. sapiens
tcaccagtggaggctg

SEQ ID NO: 133202 - DNA, 16 bp, H. sapiens
tcaccataaaggtctt

SEQ ID NO: 133203 - DNA, 16 bp, H. sapiens
tcaccatatataaaaa

SEQ ID NO: 133204 - DNA, 16 bp, H. sapiens
tcaccatcaccaacac

SEQ ID NO: 133205 - DNA, 21 bp, H. sapiens
tcaccatcatcaaagaccaaa

SEQ ID NO: 133206 - DNA, 16 bp, H. sapiens
tcaccatcatcgtcat

SEQ ID NO: 133207 - DNA, 16 bp, H. sapiens
tcaccatcatcttcat

SEQ ID NO: 133208 - DNA, 16 bp, H. sapiens
tcaccatccctggcta

SEQ ID NO: 133209 - DNA, 16 bp, H. sapiens
tcaccatccttcaagt

SEQ ID NO: 133210 - DNA, 16 bp, H. sapiens
tcaccatcgatcccac

SEQ ID NO: 133211 - DNA, 16 bp, H. sapiens
tcaccatcgtcaaaga

SEQ ID NO: 133212 - DNA, 16 bp, H. sapiens
tcaccatgcccagata

SEQ ID NO: 133213 - DNA, 16 bp, H. sapiens
tcaccatgcccggcta

SEQ ID NO: 133214 - DNA, 16 bp, H. sapiens
tcaccatgccctgcta

SEQ ID NO: 133215 - DNA, 16 bp, H. sapiens
tcaccatgctgcccag

SEQ ID NO: 133216 - DNA, 16 bp, H. sapiens
tcaccatgctggacag

SEQ ID NO: 133217 - DNA, 16 bp, H. sapiens
tcaccatgctggtcag

SEQ ID NO: 133218 - DNA, 16 bp, H. sapiens
tcaccatggcacacat

SEQ ID NO: 133219 - DNA, 16 bp, H. sapiens
tcaccatgtacaaaaa

SEQ ID NO: 133220 - DNA, 16 bp, H. sapiens
tcaccatgtgacatgt

SEQ ID NO: 133221 - DNA, 16 bp, H. sapiens
tcaccatgtgaggaca

SEQ ID NO: 133222 - DNA, 16 bp, H. sapiens
tcaccatgtggcccag

SEQ ID NO: 133223 - DNA, 16 bp, H. sapiens
tcaccatgttcatcag

SEQ ID NO: 133224 - DNA, 16 bp, H. sapiens
tcaccatgttgcctag

SEQ ID NO: 133225 - DNA, 17 bp, H. sapiens
tcaccatgttgggccag

SEQ ID NO: 133226 - DNA, 16 bp, H. sapiens
tcaccattgatcccac

SEQ ID NO: 133227 - DNA, 16 bp, H. sapiens
tcaccattttggtcag

SEQ ID NO: 133228 - DNA, 20 bp, H. sapiens
tcacccaaagtgctgggatt

SEQ ID NO: 133229 - DNA, 16 bp, H. sapiens
tcacccaactgctgca

SEQ ID NO: 133230 - DNA, 16 bp, H. sapiens
tcacccaagctagagt

SEQ ID NO: 133231 - DNA, 16 bp, H. sapiens
tcacccaagctgcagt

SEQ ID NO: 133232 - DNA, 18 bp, H. sapiens
tcacccacctcggcctcc

SEQ ID NO: 133233 - DNA, 16 bp, H. sapiens
tcacccacctgggcct

SEQ ID NO: 133234 - DNA, 17 bp, H. sapiens
tcacccaccttggcctc

SEQ ID NO: 133235 - DNA, 18 bp, H. sapiens
tcacccactttggcctcc

SEQ ID NO: 133236 - DNA, 16 bp, H. sapiens
tcacccagagcaactt

SEQ ID NO: 133237 - DNA, 16 bp, H. sapiens
tcacccagctaatttt

SEQ ID NO: 133238 - DNA, 16 bp, H. sapiens
tcacccaggagggagt

SEQ ID NO: 133239 - DNA, 16 bp, H. sapiens
tcacccaggatagagt

SEQ ID NO: 133240 - DNA, 16 bp, H. sapiens
tcacccaggccagact

SEQ ID NO: 133241 - DNA, 16 bp, H. sapiens
tcacccaggcgggagt

SEQ ID NO: 133242 - DNA, 16 bp, H. sapiens
tcacccaggctgcagt

SEQ ID NO: 133243 - DNA, 16 bp, H. sapiens
tcacccaggctggact

SEQ ID NO: 133244 - DNA, 17 bp, H. sapiens
tcacccaggctggagta

SEQ ID NO: 133245 - DNA, 17 bp, H. sapiens
tcacccaggctggagtc

SEQ ID NO: 133246 - DNA, 16 bp, H. sapiens
tcacccaggctggatc

SEQ ID NO: 133247 - DNA, 16 bp, H. sapiens
tcacccaggctggatt

SEQ ID NO: 133248 - DNA, 16 bp, H. sapiens
tcacccagtctggagg

SEQ ID NO: 133249 - DNA, 16 bp, H. sapiens
tcacccagtggatccc

SEQ ID NO: 133250 - DNA, 16 bp, H. sapiens
tcacccagtttcccct

SEQ ID NO: 133251 - DNA, 16 bp, H. sapiens
tcacccatcccagcag

SEQ ID NO: 133252 - DNA, 16 bp, H. sapiens
tcaccccaaaaagttc

SEQ ID NO: 133253 - DNA, 16 bp, H. sapiens
tcaccccacctcagcc

SEQ ID NO: 133254 - DNA, 16 bp, H. sapiens
tcaccccagggccagg

SEQ ID NO: 133255 - DNA, 16 bp, H. sapiens
tcaccccatttcccca

SEQ ID NO: 133256 - DNA, 16 bp, H. sapiens
tcacccccaaaagaaa

SEQ ID NO: 133257 - DNA, 16 bp, H. sapiens
tcacccccattttaca

SEQ ID NO: 133258 - DNA, 16 bp, H. sapiens
tcaccccggctggagt

SEQ ID NO: 133259 - DNA, 16 bp, H. sapiens
tcacccctggtcacct

SEQ ID NO: 133260 - DNA, 16 bp, H. sapiens
tcaccccttaccccaa

SEQ ID NO: 133261 - DNA, 18 bp, H. sapiens
tcacccctttctttgact

SEQ ID NO: 133262 - DNA, 16 bp, H. sapiens
tcacccgcctcagcct

SEQ ID NO: 133263 - DNA, 16 bp, H. sapiens
tcacccgcctgggcct

SEQ ID NO: 133264 - DNA, 16 bp, H. sapiens
tcaccctcaccaatgt

SEQ ID NO: 133265 - DNA, 16 bp, H. sapiens
tcaccctcatcctcat

SEQ ID NO: 133266 - DNA, 16 bp, H. sapiens
tcaccctcattttaca

SEQ ID NO: 133267 - DNA, 16 bp, H. sapiens
tcaccctcccaaagta

SEQ ID NO: 133268 - DNA, 16 bp, H. sapiens
tcaccctcctcccagc

SEQ ID NO: 133269 - DNA, 16 bp, H. sapiens
tcaccctcctgagtgg

SEQ ID NO: 133270 - DNA, 16 bp, H. sapiens
tcaccctgaaaccatc

SEQ ID NO: 133271 - DNA, 16 bp, H. sapiens
tcaccctgccacccag

SEQ ID NO: 133272 - DNA, 16 bp, H. sapiens
tcaccctgctgcccag

SEQ ID NO: 133273 - DNA, 16 bp, H. sapiens
tcaccctggctgcagt

SEQ ID NO: 133274 - DNA, 16 bp, H. sapiens
tcaccctgtcacccag

SEQ ID NO: 133275 - DNA, 16 bp, H. sapiens
tcaccctgtcgcccag

SEQ ID NO: 133276 - DNA, 16 bp, H. sapiens
tcaccctgttgctcag

SEQ ID NO: 133277 - DNA, 16 bp, H. sapiens
tcaccctgtttcccag

SEQ ID NO: 133278 - DNA, 16 bp, H. sapiens
tcacccttggcaggtg

SEQ ID NO: 133279 - DNA, 16 bp, H. sapiens
tcaccgaggctggagt

SEQ ID NO: 133280 - DNA, 16 bp, H. sapiens
tcaccgcaacttccgc

SEQ ID NO: 133281 - DNA, 16 bp, H. sapiens
tcaccgtaacctctgc

SEQ ID NO: 133282 - DNA, 16 bp, H. sapiens
tcaccgtggtggccag

SEQ ID NO: 133283 - DNA, 16 bp, H. sapiens
tcacctaaaaagggaa

SEQ ID NO: 133284 - DNA, 16 bp, H. sapiens
tcacctacctcagcct

SEQ ID NO: 133285 - DNA, 16 bp, H. sapiens
tcacctaggagcttgt

SEQ ID NO: 133286 - DNA, 16 bp, H. sapiens
tcacctaggtattaag

SEQ ID NO: 133287 - DNA, 16 bp, H. sapiens
tcacctcaattttttt

SEQ ID NO: 133288 - DNA, 16 bp, H. sapiens
tcacctcacacctgct

SEQ ID NO: 133289 - DNA, 16 bp, H. sapiens
tcacctcacctctctg

SEQ ID NO: 133290 - DNA, 16 bp, H. sapiens
tcacctcagcctcctg

SEQ ID NO: 133291 - DNA, 16 bp, H. sapiens
tcacctcaggaccact

SEQ ID NO: 133292 - DNA, 16 bp, H. sapiens
tcacctcaggctcctg

SEQ ID NO: 133293 - DNA, 16 bp, H. sapiens
tcacctcccaaataaa

SEQ ID NO: 133294 - DNA, 16 bp, H. sapiens
tcacctcccaccagac

SEQ ID NO: 133295 - DNA, 16 bp, H. sapiens
tcacctcccaccaggt

SEQ ID NO: 133296 - DNA, 16 bp, H. sapiens
tcacctcccacctggt

SEQ ID NO: 133297 - DNA, 16 bp, H. sapiens
tcacctcccacgaggc

SEQ ID NO: 133298 - DNA, 16 bp, H. sapiens
tcacctcccagatgat

SEQ ID NO: 133299 - DNA, 16 bp, H. sapiens
tcacctccccagagag

SEQ ID NO: 133300 - DNA, 16 bp, H. sapiens
tcacctccctccctgg

SEQ ID NO: 133301 - DNA, 16 bp, H. sapiens
tcacctcctgccatga

SEQ ID NO: 133302 - DNA, 16 bp, H. sapiens
tcacctcctgctgtat

SEQ ID NO: 133303 - DNA, 16 bp, H. sapiens
tcacctcggcttccca

SEQ ID NO: 133304 - DNA, 16 bp, H. sapiens
tcacctctaaaatggg

SEQ ID NO: 133305 - DNA, 16 bp, H. sapiens
tcacctctctgagcct

SEQ ID NO: 133306 - DNA, 16 bp, H. sapiens
tcacctctgtgagcct

SEQ ID NO: 133307 - DNA, 16 bp, H. sapiens
tcacctctttaaagac

SEQ ID NO: 133308 - DNA, 16 bp, H. sapiens
tcacctgaaccaggga

SEQ ID NO: 133309 - DNA, 16 bp, H. sapiens
tcacctgaagccagca

SEQ ID NO: 133310 - DNA, 16 bp, H. sapiens
tcacctgagccctggg

SEQ ID NO: 133311 - DNA, 16 bp, H. sapiens
tcacctgaggtcagac

SEQ ID NO: 133312 - DNA, 18 bp, H. sapiens
tcacctgaggtcagcagt

SEQ ID NO: 133313 - DNA, 16 bp, H. sapiens
tcacctgaggtcaggc

SEQ ID NO: 133314 - DNA, 16 bp, H. sapiens
tcacctgagtcaggag

SEQ ID NO: 133315 - DNA, 16 bp, H. sapiens
tcacctgcaaagggaa

SEQ ID NO: 133316 - DNA, 16 bp, H. sapiens
tcacctgccaccacac

SEQ ID NO: 133317 - DNA, 16 bp, H. sapiens
tcacctgccaccatgt

SEQ ID NO: 133318 - DNA, 16 bp, H. sapiens
tcacctgccccagcct

SEQ ID NO: 133319 - DNA, 16 bp, H. sapiens
tcacctgcctcagcct

SEQ ID NO: 133320 - DNA, 16 bp, H. sapiens
tcacctgcctccctct

SEQ ID NO: 133321 - DNA, 16 bp, H. sapiens
tcacctgctgctgtgt

SEQ ID NO: 133322 - DNA, 16 bp, H. sapiens
tcacctgcttggccct

SEQ ID NO: 133323 - DNA, 16 bp, H. sapiens
tcacctggaaagcttt

SEQ ID NO: 133324 - DNA, 16 bp, H. sapiens
tcacctggcctttcct

SEQ ID NO: 133325 - DNA, 16 bp, H. sapiens
tcacctggctaatttt

SEQ ID NO: 133326 - DNA, 17 bp, H. sapiens
tcacctgggaagtgcaa

SEQ ID NO: 133327 - DNA, 16 bp, H. sapiens
tcacctgggaatttgt

SEQ ID NO: 133328 - DNA, 16 bp, H. sapiens
tcacctgggatcttgt

SEQ ID NO: 133329 - DNA, 16 bp, H. sapiens
tcacctgggcccagga

SEQ ID NO: 133330 - DNA, 16 bp, H. sapiens
tcacctggggagcttt

SEQ ID NO: 133331 - DNA, 16 bp, H. sapiens
tcacctggggagtttt

SEQ ID NO: 133332 - DNA, 16 bp, H. sapiens
tcacctgggtgctgag

SEQ ID NO: 133333 - DNA, 16 bp, H. sapiens
tcacctgtaaaatggg

SEQ ID NO: 133334 - DNA, 19 bp, H. sapiens
tcacctgtggtcaggagtt

SEQ ID NO: 133335 - DNA, 16 bp, H. sapiens
tcacctgttgatggac

SEQ ID NO: 133336 - DNA, 16 bp, H. sapiens
tcaccttaaggagatt

SEQ ID NO: 133337 - DNA, 16 bp, H. sapiens
tcaccttccacaatga

SEQ ID NO: 133338 - DNA, 16 bp, H. sapiens
tcaccttccccagcta

SEQ ID NO: 133339 - DNA, 16 bp, H. sapiens
tcaccttctctgtgaa

SEQ ID NO: 133340 - DNA, 16 bp, H. sapiens
tcaccttctgccaaga

SEQ ID NO: 133341 - DNA, 16 bp, H. sapiens
tcaccttctgtcatga

SEQ ID NO: 133342 - DNA, 16 bp, H. sapiens
tcaccttgggggtgag

SEQ ID NO: 133343 - DNA, 16 bp, H. sapiens
tcaccttggtgattag

SEQ ID NO: 133344 - DNA, 16 bp, H. sapiens
tcaccttgtcagccag

SEQ ID NO: 133345 - DNA, 16 bp, H. sapiens
tcaccttgtgactgtg

SEQ ID NO: 133346 - DNA, 16 bp, H. sapiens
tcacctttgctccagt

SEQ ID NO: 133347 - DNA, 16 bp, H. sapiens
tcacctttggcctcaa

SEQ ID NO: 133348 - DNA, 17 bp, H. sapiens
tcacgacgtcaggagat

SEQ ID NO: 133349 - DNA, 16 bp, H. sapiens
tcacgaggctgaggca

SEQ ID NO: 133350 - DNA, 16 bp, H. sapiens
tcacgccaccatgccc

SEQ ID NO: 133351 - DNA, 16 bp, H. sapiens
tcacgctggagtgcag

SEQ ID NO: 133352 - DNA, 16 bp, H. sapiens
tcacggcaacctccac

SEQ ID NO: 133353 - DNA, 16 bp, H. sapiens
tcacggcttactgcaa

SEQ ID NO: 133354 - DNA, 18 bp, H. sapiens
tcacggtggctcacgcct

SEQ ID NO: 133355 - DNA, 17 bp, H. sapiens
tcacggtgttgcccagg

SEQ ID NO: 133356 - DNA, 16 bp, H. sapiens
tcacgtcctttgcagg

SEQ ID NO: 133357 - DNA, 16 bp, H. sapiens
tcacgtctccaacaac

SEQ ID NO: 133358 - DNA, 16 bp, H. sapiens
tcactaatgtcctttt

SEQ ID NO: 133359 - DNA, 16 bp, H. sapiens
tcactaattctttctt

SEQ ID NO: 133360 - DNA, 16 bp, H. sapiens
tcactacaaagagaat

SEQ ID NO: 133361 - DNA, 21 bp, H. sapiens
tcactacaacctccgcctcct

SEQ ID NO: 133362 - DNA, 16 bp, H. sapiens
tcactacaaccttgaa

SEQ ID NO: 133363 - DNA, 16 bp, H. sapiens
tcactacagtttggct

SEQ ID NO: 133364 - DNA, 16 bp, H. sapiens
tcactagcatttttat

SEQ ID NO: 133365 - DNA, 16 bp, H. sapiens
tcactatattgcccag

SEQ ID NO: 133366 - DNA, 16 bp, H. sapiens
tcactatgctgcccag

SEQ ID NO: 133367 - DNA, 16 bp, H. sapiens
tcactatgttctccag

SEQ ID NO: 133368 - DNA, 16 bp, H. sapiens
tcactatgttgcccag

SEQ ID NO: 133369 - DNA, 16 bp, H. sapiens
tcactatgttgctcag

SEQ ID NO: 133370 - DNA, 20 bp, H. sapiens
tcactatgttggccaggcta

SEQ ID NO: 133371 - DNA, 16 bp, H. sapiens
tcactattaaatatga

SEQ ID NO: 133372 - DNA, 16 bp, H. sapiens
tcactcaacaaacact

SEQ ID NO: 133373 - DNA, 16 bp, H. sapiens
tcactcactcaacaaa

SEQ ID NO: 133374 - DNA, 16 bp, H. sapiens
tcactcactcacccag

SEQ ID NO: 133375 - DNA, 16 bp, H. sapiens
tcactcactcactcac

SEQ ID NO: 133376 - DNA, 16 bp, H. sapiens
tcactcactcactctg

SEQ ID NO: 133377 - DNA, 16 bp, H. sapiens
tcactcactgcctccc

SEQ ID NO: 133378 - DNA, 16 bp, H. sapiens
tcactcagcataatga

SEQ ID NO: 133379 - DNA, 16 bp, H. sapiens
tcactcaggaaattac

SEQ ID NO: 133380 - DNA, 16 bp, H. sapiens
tcactcaggagcaggt

SEQ ID NO: 133381 - DNA, 16 bp, H. sapiens
tcactcaggctggagg

SEQ ID NO: 133382 - DNA, 16 bp, H. sapiens
tcactcaggctggtgt

SEQ ID NO: 133383 - DNA, 16 bp, H. sapiens
tcactcagggacccag

SEQ ID NO: 133384 - DNA, 16 bp, H. sapiens
tcactcagggcaatct

SEQ ID NO: 133385 - DNA, 17 bp, H. sapiens
tcactcagtgctcaatg

SEQ ID NO: 133386 - DNA, 16 bp, H. sapiens
tcactcatatgtctgg

SEQ ID NO: 133387 - DNA, 21 bp, H. sapiens
tcactcatatttggctcagaa

SEQ ID NO: 133388 - DNA, 16 bp, H. sapiens
tcactcattgactcac

SEQ ID NO: 133389 - DNA, 16 bp, H. sapiens
tcactcatttattcaa

SEQ ID NO: 133390 - DNA, 16 bp, H. sapiens
tcactccaaaaagaaa

SEQ ID NO: 133391 - DNA, 16 bp, H. sapiens
tcactccaacctctgc

SEQ ID NO: 133392 - DNA, 16 bp, H. sapiens
tcactccacctctctg

SEQ ID NO: 133393 - DNA, 16 bp, H. sapiens
tcactccatcgcccag

SEQ ID NO: 133394 - DNA, 16 bp, H. sapiens
tcactcccaaaagaaa

SEQ ID NO: 133395 - DNA, 16 bp, H. sapiens
tcactcccacctactc

SEQ ID NO: 133396 - DNA, 16 bp, H. sapiens
tcactcccattcccac

SEQ ID NO: 133397 - DNA, 16 bp, H. sapiens
tcactcccttgcttaa

SEQ ID NO: 133398 - DNA, 16 bp, H. sapiens
tcactcctgaagccaa

SEQ ID NO: 133399 - DNA, 16 bp, H. sapiens
tcactcctgtgattag

SEQ ID NO: 133400 - DNA, 16 bp, H. sapiens
tcactccttgaaaaca

SEQ ID NO: 133401 - DNA, 16 bp, H. sapiens
tcactcgaggccagga

SEQ ID NO: 133402 - DNA, 17 bp, H. sapiens
tcactctacaatcataa

SEQ ID NO: 133403 - DNA, 17 bp, H. sapiens
tcactctagcctgggtg

SEQ ID NO: 133404 - DNA, 16 bp, H. sapiens
tcactctcactcaggc

SEQ ID NO: 133405 - DNA, 16 bp, H. sapiens
tcactctctcctgctg

SEQ ID NO: 133406 - DNA, 16 bp, H. sapiens
tcactctctggggact

SEQ ID NO: 133407 - DNA, 16 bp, H. sapiens
tcactctctgtcaccc

SEQ ID NO: 133408 - DNA, 16 bp, H. sapiens
tcactctgtcacccaa

SEQ ID NO: 133409 - DNA, 20 bp, H. sapiens
tcactctgtcacccaggcta

SEQ ID NO: 133410 - DNA, 17 bp, H. sapiens
tcactctgtcacccagt

SEQ ID NO: 133411 - DNA, 16 bp, H. sapiens
tcactctgtcagccag

SEQ ID NO: 133412 - DNA, 16 bp, H. sapiens
tcactctgtcccaggc

SEQ ID NO: 133413 - DNA, 16 bp, H. sapiens
tcactctgtcccccag

SEQ ID NO: 133414 - DNA, 25 bp, H. sapiens
tcactctgtcgcccaggctggagta

SEQ ID NO: 133415 - DNA, 16 bp, H. sapiens
tcactctgtggcccag

SEQ ID NO: 133416 - DNA, 16 bp, H. sapiens
tcactctgtggtccag

SEQ ID NO: 133417 - DNA, 16 bp, H. sapiens
tcactctgttacctag

SEQ ID NO: 133418 - DNA, 16 bp, H. sapiens
tcactctgttgcccaa

SEQ ID NO: 133419 - DNA, 25 bp, H. sapiens
tcactctgttgcccaggctggagta

SEQ ID NO: 133420 - DNA, 16 bp, H. sapiens
tcactctgttgctcag

SEQ ID NO: 133421 - DNA, 16 bp, H. sapiens
tcactctgttttccag

SEQ ID NO: 133422 - DNA, 16 bp, H. sapiens
tcactcttgaattctt

SEQ ID NO: 133423 - DNA, 16 bp, H. sapiens
tcactcttgtcgccca

SEQ ID NO: 133424 - DNA, 20 bp, H. sapiens
tcactcttgttacccaggct

SEQ ID NO: 133425 - DNA, 16 bp, H. sapiens
tcactctttcacccag

SEQ ID NO: 133426 - DNA, 16 bp, H. sapiens
tcactctttcgcccag

SEQ ID NO: 133427 - DNA, 16 bp, H. sapiens
tcactctttgtgttgt

SEQ ID NO: 133428 - DNA, 16 bp, H. sapiens
tcactgaaaaaaaaat

SEQ ID NO: 133429 - DNA, 16 bp, H. sapiens
tcactgaaaatgaact

SEQ ID NO: 133430 - DNA, 16 bp, H. sapiens
tcactgaaacatctgc

SEQ ID NO: 133431 - DNA, 16 bp, H. sapiens
tcactgaaataaaaga

SEQ ID NO: 133432 - DNA, 16 bp, H. sapiens
tcactgaaatattttt

SEQ ID NO: 133433 - DNA, 16 bp, H. sapiens
tcactgaaggccagga

SEQ ID NO: 133434 - DNA, 16 bp, H. sapiens
tcactgaatattttaa

SEQ ID NO: 133435 - DNA, 16 bp, H. sapiens
tcactgaatccaggag

SEQ ID NO: 133436 - DNA, 16 bp, H. sapiens
tcactgagcacctact

SEQ ID NO: 133437 - DNA, 16 bp, H. sapiens
tcactgagcttcttgg

SEQ ID NO: 133438 - DNA, 16 bp, H. sapiens
tcactgatatgtggaa

SEQ ID NO: 133439 - DNA, 16 bp, H. sapiens
tcactgattcttttct

SEQ ID NO: 133440 - DNA, 16 bp, H. sapiens
tcactgatttttctct

SEQ ID NO: 133441 - DNA, 21 bp, H. sapiens
tcactgcaaactccacctcct

SEQ ID NO: 133442 - DNA, 16 bp, H. sapiens
tcactgcaacatcaac

SEQ ID NO: 133443 - DNA, 17 bp, H. sapiens
tcactgcaacctccact

SEQ ID NO: 133444 - DNA, 21 bp, H. sapiens
tcactgcaacctccgcctcca

SEQ ID NO: 133445 - DNA, 21 bp, H. sapiens
tcactgcaacctctgcctcca

SEQ ID NO: 133446 - DNA, 21 bp, H. sapiens
tcactgcaacctctgccttcc

SEQ ID NO: 133447 - DNA, 16 bp, H. sapiens
tcactgcaactcctgc

SEQ ID NO: 133448 - DNA, 16 bp, H. sapiens
tcactgcaagctctgt

SEQ ID NO: 133449 - DNA, 21 bp, H. sapiens
tcactgcaatctccacctccc

SEQ ID NO: 133450 - DNA, 16 bp, H. sapiens
tcactgcaatttctgc

SEQ ID NO: 133451 - DNA, 16 bp, H. sapiens
tcactgcacccagccc

SEQ ID NO: 133452 - DNA, 16 bp, H. sapiens
tcactgcaccctccac

SEQ ID NO: 133453 - DNA, 16 bp, H. sapiens
tcactgcaccctccgc

SEQ ID NO: 133454 - DNA, 16 bp, H. sapiens
tcactgcagaaatatt

SEQ ID NO: 133455 - DNA, 16 bp, H. sapiens
tcactgcagccacaaa

SEQ ID NO: 133456 - DNA, 16 bp, H. sapiens
tcactgcagccatgaa

SEQ ID NO: 133457 - DNA, 16 bp, H. sapiens
tcactgcagcctcaga

SEQ ID NO: 133458 - DNA, 17 bp, H. sapiens
tcactgcagcctccgct

SEQ ID NO: 133459 - DNA, 16 bp, H. sapiens
tcactgcagcctcctt

SEQ ID NO: 133460 - DNA, 16 bp, H. sapiens
tcactgcagcctctgt

SEQ ID NO: 133461 - DNA, 16 bp, H. sapiens
tcactgcagccttgat

SEQ ID NO: 133462 - DNA, 16 bp, H. sapiens
tcactgcagcttcaac

SEQ ID NO: 133463 - DNA, 16 bp, H. sapiens
tcactgcagctttaaa

SEQ ID NO: 133464 - DNA, 16 bp, H. sapiens
tcactgcagtctccac

SEQ ID NO: 133465 - DNA, 16 bp, H. sapiens
tcactgcatgctctgc

SEQ ID NO: 133466 - DNA, 16 bp, H. sapiens
tcactgccaccaccac

SEQ ID NO: 133467 - DNA, 20 bp, H. sapiens
tcactgccacctccgcctcc

SEQ ID NO: 133468 - DNA, 16 bp, H. sapiens
tcactgccaccttcac

SEQ ID NO: 133469 - DNA, 16 bp, H. sapiens
tcactgccatccccat

SEQ ID NO: 133470 - DNA, 16 bp, H. sapiens
tcactgcccagaccaa

SEQ ID NO: 133471 - DNA, 16 bp, H. sapiens
tcactgccctggaaag

SEQ ID NO: 133472 - DNA, 16 bp, H. sapiens
tcactgcctggggcca

SEQ ID NO: 133473 - DNA, 16 bp, H. sapiens
tcactgctacattccc

SEQ ID NO: 133474 - DNA, 16 bp, H. sapiens
tcactgctcagccccc

SEQ ID NO: 133475 - DNA, 16 bp, H. sapiens
tcactgctgccaaaga

SEQ ID NO: 133476 - DNA, 16 bp, H. sapiens
tcactgctgcccaggc

SEQ ID NO: 133477 - DNA, 16 bp, H. sapiens
tcactgctgcctccac

SEQ ID NO: 133478 - DNA, 16 bp, H. sapiens
tcactgctgtgtccct

SEQ ID NO: 133479 - DNA, 16 bp, H. sapiens
tcactggagctcagga

SEQ ID NO: 133480 - DNA, 16 bp, H. sapiens
tcactggcagctgatt

SEQ ID NO: 133481 - DNA, 16 bp, H. sapiens
tcactggccagagttt

SEQ ID NO: 133482 - DNA, 17 bp, H. sapiens
tcactggccatcaaaga

SEQ ID NO: 133483 - DNA, 16 bp, H. sapiens
tcactggtcaccagag

SEQ ID NO: 133484 - DNA, 16 bp, H. sapiens
tcactggtgtccctga

SEQ ID NO: 133485 - DNA, 16 bp, H. sapiens
tcactgtaaaataata

SEQ ID NO: 133486 - DNA, 16 bp, H. sapiens
tcactgtaaccctgaa

SEQ ID NO: 133487 - DNA, 17 bp, H. sapiens
tcactgtaacctcaaat

SEQ ID NO: 133488 - DNA, 16 bp, H. sapiens
tcactgtaacctcagc

SEQ ID NO: 133489 - DNA, 16 bp, H. sapiens
tcactgtaacctcttc

SEQ ID NO: 133490 - DNA, 16 bp, H. sapiens
tcactgtagcattatt

SEQ ID NO: 133491 - DNA, 16 bp, H. sapiens
tcactgtagctttgta

SEQ ID NO: 133492 - DNA, 16 bp, H. sapiens
tcactgtcacacaggc

SEQ ID NO: 133493 - DNA, 16 bp, H. sapiens
tcactgtcaccatcac

SEQ ID NO: 133494 - DNA, 16 bp, H. sapiens
tcactgtctatggcag

SEQ ID NO: 133495 - DNA, 16 bp, H. sapiens
tcactgtctctgtctc

SEQ ID NO: 133496 - DNA, 16 bp, H. sapiens
tcactgtcttctacct

SEQ ID NO: 133497 - DNA, 16 bp, H. sapiens
tcactgtcttctgcct

SEQ ID NO: 133498 - DNA, 16 bp, H. sapiens
tcactgtgaaatttca

SEQ ID NO: 133499 - DNA, 16 bp, H. sapiens
tcactgtgacctcaaa

SEQ ID NO: 133500 - DNA, 16 bp, H. sapiens
tcactgtgcctcagtt

SEQ ID NO: 133501 - DNA, 16 bp, H. sapiens
tcactgtggccagagg

SEQ ID NO: 133502 - DNA, 16 bp, H. sapiens
tcactgtggtcttgat

SEQ ID NO: 133503 - DNA, 16 bp, H. sapiens
tcactgtggttttggt

SEQ ID NO: 133504 - DNA, 16 bp, H. sapiens
tcactgtgttgcccag

SEQ ID NO: 133505 - DNA, 18 bp, H. sapiens
tcactgttcagttcccac

SEQ ID NO: 133506 - DNA, 16 bp, H. sapiens
tcactgttccctctgc

SEQ ID NO: 133507 - DNA, 16 bp, H. sapiens
tcactgttggcatata

SEQ ID NO: 133508 - DNA, 16 bp, H. sapiens
tcactgttgtccaggc

SEQ ID NO: 133509 - DNA, 16 bp, H. sapiens
tcactgtttaaaaaca

SEQ ID NO: 133510 - DNA, 19 bp, H. sapiens
tcacttaaacccaggaggc

SEQ ID NO: 133511 - DNA, 16 bp, H. sapiens
tcacttaacaaatatt

SEQ ID NO: 133512 - DNA, 16 bp, H. sapiens
tcacttaacattaggt

SEQ ID NO: 133513 - DNA, 16 bp, H. sapiens
tcacttaagataatgt

SEQ ID NO: 133514 - DNA, 16 bp, H. sapiens
tcacttaatcctcaca

SEQ ID NO: 133515 - DNA, 16 bp, H. sapiens
tcacttaatcctccca

SEQ ID NO: 133516 - DNA, 16 bp, H. sapiens
tcacttagaataaaat

SEQ ID NO: 133517 - DNA, 16 bp, H. sapiens
tcacttaggaaaatgg

SEQ ID NO: 133518 - DNA, 16 bp, H. sapiens
tcacttatatctttag

SEQ ID NO: 133519 - DNA, 16 bp, H. sapiens
tcacttatcaccaagg

SEQ ID NO: 133520 - DNA, 16 bp, H. sapiens
tcacttatgaagctca

SEQ ID NO: 133521 - DNA, 16 bp, H. sapiens
tcacttatttgtttat

SEQ ID NO: 133522 - DNA, 16 bp, H. sapiens
tcacttcaaagctgtc

SEQ ID NO: 133523 - DNA, 16 bp, H. sapiens
tcacttcacttctctg

SEQ ID NO: 133524 - DNA, 16 bp, H. sapiens
tcacttcagctcctga

SEQ ID NO: 133525 - DNA, 16 bp, H. sapiens
tcacttcatgtctctg

SEQ ID NO: 133526 - DNA, 17 bp, H. sapiens
tcacttcatgtctgtgt

SEQ ID NO: 133527 - DNA, 16 bp, H. sapiens
tcacttcattctcttc

SEQ ID NO: 133528 - DNA, 16 bp, H. sapiens
tcacttccaagatggc

SEQ ID NO: 133529 - DNA, 16 bp, H. sapiens
tcacttccacattttt

SEQ ID NO: 133530 - DNA, 16 bp, H. sapiens
tcacttccactcacat

SEQ ID NO: 133531 - DNA, 16 bp, H. sapiens
tcacttccatattttc

SEQ ID NO: 133532 - DNA, 16 bp, H. sapiens
tcacttcctcattttc

SEQ ID NO: 133533 - DNA, 16 bp, H. sapiens
tcacttcctgctgtgt

SEQ ID NO: 133534 - DNA, 16 bp, H. sapiens
tcacttctgaagccag

SEQ ID NO: 133535 - DNA, 16 bp, H. sapiens
tcacttgaacccggag

SEQ ID NO: 133536 - DNA, 16 bp, H. sapiens
tcacttgaaccctgga

SEQ ID NO: 133537 - DNA, 16 bp, H. sapiens
tcacttgaaccttggg

SEQ ID NO: 133538 - DNA, 16 bp, H. sapiens
tcacttgaattttttt

SEQ ID NO: 133539 - DNA, 16 bp, H. sapiens
tcacttgagctcacaa

SEQ ID NO: 133540 - DNA, 16 bp, H. sapiens
tcacttgaggcatttt

SEQ ID NO: 133541 - DNA, 16 bp, H. sapiens
tcacttgaggctagaa

SEQ ID NO: 133542 - DNA, 16 bp, H. sapiens
tcacttgcacccagga

SEQ ID NO: 133543 - DNA, 16 bp, H. sapiens
tcacttgcattgtttc

SEQ ID NO: 133544 - DNA, 16 bp, H. sapiens
tcacttgcccaaggtc

SEQ ID NO: 133545 - DNA, 16 bp, H. sapiens
tcacttgggttaaaac

SEQ ID NO: 133546 - DNA, 16 bp, H. sapiens
tcacttggttaagatg

SEQ ID NO: 133547 - DNA, 16 bp, H. sapiens
tcactttaaaatggtt

SEQ ID NO: 133548 - DNA, 16 bp, H. sapiens
tcactttaaatcaaaa

SEQ ID NO: 133549 - DNA, 16 bp, H. sapiens
tcactttaaattaaaa

SEQ ID NO: 133550 - DNA, 16 bp, H. sapiens
tcactttacaaaaaaa

SEQ ID NO: 133551 - DNA, 16 bp, H. sapiens
tcactttatttcattc

SEQ ID NO: 133552 - DNA, 17 bp, H. sapiens
tcactttcaggaacacc

SEQ ID NO: 133553 - DNA, 16 bp, H. sapiens
tcactttcagtctatg

SEQ ID NO: 133554 - DNA, 16 bp, H. sapiens
tcactttccttctctg

SEQ ID NO: 133555 - DNA, 16 bp, H. sapiens
tcactttctgcagttt

SEQ ID NO: 133556 - DNA, 16 bp, H. sapiens
tcactttgcataatgt

SEQ ID NO: 133557 - DNA, 16 bp, H. sapiens
tcactttgctgcccag

SEQ ID NO: 133558 - DNA, 16 bp, H. sapiens
tcactttggaaaacag

SEQ ID NO: 133559 - DNA, 16 bp, H. sapiens
tcactttggagcttta

SEQ ID NO: 133560 - DNA, 23 bp, H. sapiens
tcactttgggaggctgaggcagg

SEQ ID NO: 133561 - DNA, 20 bp, H. sapiens
tcactttgggaggctgaggt

SEQ ID NO: 133562 - DNA, 16 bp, H. sapiens
tcactttgttgcccag

SEQ ID NO: 133563 - DNA, 16 bp, H. sapiens
tcactttgttttccag

SEQ ID NO: 133564 - DNA, 16 bp, H. sapiens
tcacttttcttatctg

SEQ ID NO: 133565 - DNA, 16 bp, H. sapiens
tcacttttcttctctg

SEQ ID NO: 133566 - DNA, 16 bp, H. sapiens
tcacttttgttgtcca

SEQ ID NO: 133567 - DNA, 16 bp, H. sapiens
tcactttttaaaatat

SEQ ID NO: 133568 - DNA, 16 bp, H. sapiens
tcacttttttgatggt

SEQ ID NO: 133569 - DNA, 16 bp, H. sapiens
tcacttttttttgaga

SEQ ID NO: 133570 - DNA, 16 bp, H. sapiens
tcagaaaaaaagatta

SEQ ID NO: 133571 - DNA, 16 bp, H. sapiens
tcagaaaaaaatatta

SEQ ID NO: 133572 - DNA, 16 bp, H. sapiens
tcagaaaaaagaattt

SEQ ID NO: 133573 - DNA, 16 bp, H. sapiens
tcagaaaaaatacttg

SEQ ID NO: 133574 - DNA, 16 bp, H. sapiens
tcagaaaaaatattaa

SEQ ID NO: 133575 - DNA, 16 bp, H. sapiens
tcagaaaaagacaaat

SEQ ID NO: 133576 - DNA, 16 bp, H. sapiens
tcagaaaaataaaagt

SEQ ID NO: 133577 - DNA, 16 bp, H. sapiens
tcagaaaaattaatat

SEQ ID NO: 133578 - DNA, 16 bp, H. sapiens
tcagaaaacaaagaag

SEQ ID NO: 133579 - DNA, 16 bp, H. sapiens
tcagaaaacaaattaa

SEQ ID NO: 133580 - DNA, 16 bp, H. sapiens
tcagaaaacacacaca

SEQ ID NO: 133581 - DNA, 16 bp, H. sapiens
tcagaaaacagaaaac

SEQ ID NO: 133582 - DNA, 16 bp, H. sapiens
tcagaaaacagaaata

SEQ ID NO: 133583 - DNA, 16 bp, H. sapiens
tcagaaaacagaatct

SEQ ID NO: 133584 - DNA, 16 bp, H. sapiens
tcagaaaacaggaaga

SEQ ID NO: 133585 - DNA, 16 bp, H. sapiens
tcagaaaacatttatt

SEQ ID NO: 133586 - DNA, 16 bp, H. sapiens
tcagaaaaccaagaga

SEQ ID NO: 133587 - DNA, 16 bp, H. sapiens
tcagaaaacttacaat

SEQ ID NO: 133588 - DNA, 16 bp, H. sapiens
tcagaaaactttcaat

SEQ ID NO: 133589 - DNA, 16 bp, H. sapiens
tcagaaaagaagaaag

SEQ ID NO: 133590 - DNA, 16 bp, H. sapiens
tcagaaaagaatgttt

SEQ ID NO: 133591 - DNA, 16 bp, H. sapiens
tcagaaaagagaaaga

SEQ ID NO: 133592 - DNA, 16 bp, H. sapiens
tcagaaaagaggaaaa

SEQ ID NO: 133593 - DNA, 16 bp, H. sapiens
tcagaaaaggaagaaa

SEQ ID NO: 133594 - DNA, 16 bp, H. sapiens
tcagaaaataaaatat

SEQ ID NO: 133595 - DNA, 16 bp, H. sapiens
tcagaaaataaagaag

SEQ ID NO: 133596 - DNA, 16 bp, H. sapiens
tcagaaaataaatatt

SEQ ID NO: 133597 - DNA, 16 bp, H. sapiens
tcagaaaataaattat

SEQ ID NO: 133598 - DNA, 16 bp, H. sapiens
tcagaaaatacacaca

SEQ ID NO: 133599 - DNA, 16 bp, H. sapiens
tcagaaaatacagaga

SEQ ID NO: 133600 - DNA, 16 bp, H. sapiens
tcagaaaatagaggaa

SEQ ID NO: 133601 - DNA, 16 bp, H. sapiens
tcagaaaatgagttag

SEQ ID NO: 133602 - DNA, 16 bp, H. sapiens
tcagaaaatggggttt

SEQ ID NO: 133603 - DNA, 16 bp, H. sapiens
tcagaaaattaaaaat

SEQ ID NO: 133604 - DNA, 16 bp, H. sapiens
tcagaaaattccaaag

SEQ ID NO: 133605 - DNA, 16 bp, H. sapiens
tcagaaacaagacaaa

SEQ ID NO: 133606 - DNA, 16 bp, H. sapiens
tcagaaacaatgcaag

SEQ ID NO: 133607 - DNA, 16 bp, H. sapiens
tcagaaacagaaaatc

SEQ ID NO: 133608 - DNA, 16 bp, H. sapiens
tcagaaacagaaagtc

SEQ ID NO: 133609 - DNA, 16 bp, H. sapiens
tcagaaaccatggagg

SEQ ID NO: 133610 - DNA, 16 bp, H. sapiens
tcagaaactctggaga

SEQ ID NO: 133611 - DNA, 16 bp, H. sapiens
tcagaaactctgggaa

SEQ ID NO: 133612 - DNA, 17 bp, H. sapiens
tcagaaactgctctgtg

SEQ ID NO: 133613 - DNA, 16 bp, H. sapiens
tcagaaagaaaagagg

SEQ ID NO: 133614 - DNA, 16 bp, H. sapiens
tcagaaagaaacagaa

SEQ ID NO: 133615 - DNA, 16 bp, H. sapiens
tcagaaagaacaagag

SEQ ID NO: 133616 - DNA, 16 bp, H. sapiens
tcagaaagaaggaaaa

SEQ ID NO: 133617 - DNA, 16 bp, H. sapiens
tcagaaagagaagaga

SEQ ID NO: 133618 - DNA, 16 bp, H. sapiens
tcagaaagagagagag

SEQ ID NO: 133619 - DNA, 16 bp, H. sapiens
tcagaaagcaaagatg

SEQ ID NO: 133620 - DNA, 16 bp, H. sapiens
tcagaaagcaaaggtg

SEQ ID NO: 133621 - DNA, 16 bp, H. sapiens
tcagaaagctagaaag

SEQ ID NO: 133622 - DNA, 16 bp, H. sapiens
tcagaaagctgtgaaa

SEQ ID NO: 133623 - DNA, 16 bp, H. sapiens
tcagaaaggaagaaat

SEQ ID NO: 133624 - DNA, 16 bp, H. sapiens
tcagaaagtccaagca

SEQ ID NO: 133625 - DNA, 16 bp, H. sapiens
tcagaaagtgacattt

SEQ ID NO: 133626 - DNA, 16 bp, H. sapiens
tcagaaagtgctggga

SEQ ID NO: 133627 - DNA, 16 bp, H. sapiens
tcagaaatagacccac

SEQ ID NO: 133628 - DNA, 16 bp, H. sapiens
tcagaaatcagtttct

SEQ ID NO: 133629 - DNA, 16 bp, H. sapiens
tcagaaatctgttcta

SEQ ID NO: 133630 - DNA, 16 bp, H. sapiens
tcagaaatgaaaaaat

SEQ ID NO: 133631 - DNA, 16 bp, H. sapiens
tcagaaatgaaagaag

SEQ ID NO: 133632 - DNA, 16 bp, H. sapiens
tcagaaatgacaaaag

SEQ ID NO: 133633 - DNA, 16 bp, H. sapiens
tcagaaatgccctgcc

SEQ ID NO: 133634 - DNA, 16 bp, H. sapiens
tcagaaatgtcccttc

SEQ ID NO: 133635 - DNA, 16 bp, H. sapiens
tcagaaatgtgagaaa

SEQ ID NO: 133636 - DNA, 16 bp, H. sapiens
tcagaaattaaaatat

SEQ ID NO: 133637 - DNA, 16 bp, H. sapiens
tcagaaattatttttt

SEQ ID NO: 133638 - DNA, 16 bp, H. sapiens
tcagaaatttcttcca

SEQ ID NO: 133639 - DNA, 16 bp, H. sapiens
tcagaaattttatttt

SEQ ID NO: 133640 - DNA, 16 bp, H. sapiens
tcagaacaaagaaaat

SEQ ID NO: 133641 - DNA, 16 bp, H. sapiens
tcagaacaaagaatat

SEQ ID NO: 133642 - DNA, 16 bp, H. sapiens
tcagaacacatacatt

SEQ ID NO: 133643 - DNA, 16 bp, H. sapiens
tcagaacacttacatt

SEQ ID NO: 133644 - DNA, 16 bp, H. sapiens
tcagaacagaaagaga

SEQ ID NO: 133645 - DNA, 16 bp, H. sapiens
tcagaacccagcagcc

SEQ ID NO: 133646 - DNA, 16 bp, H. sapiens
tcagaacctgcatttt

SEQ ID NO: 133647 - DNA, 20 bp, H. sapiens
tcagaactcattgtacttaa

SEQ ID NO: 133648 - DNA, 16 bp, H. sapiens
tcagaacttgaagact

SEQ ID NO: 133649 - DNA, 16 bp, H. sapiens
tcagaagaaacaaaag

SEQ ID NO: 133650 - DNA, 16 bp, H. sapiens
tcagaagaaacaaact

SEQ ID NO: 133651 - DNA, 16 bp, H. sapiens
tcagaagaaagagatg

SEQ ID NO: 133652 - DNA, 16 bp, H. sapiens
tcagaagaaaggaaaa

SEQ ID NO: 133653 - DNA, 16 bp, H. sapiens
tcagaagaagaaagaa

SEQ ID NO: 133654 - DNA, 16 bp, H. sapiens
tcagaagaataaaata

SEQ ID NO: 133655 - DNA, 16 bp, H. sapiens
tcagaagaatgtatat

SEQ ID NO: 133656 - DNA, 16 bp, H. sapiens
tcagaagacagaaaaa

SEQ ID NO: 133657 - DNA, 16 bp, H. sapiens
tcagaagacagaaaca

SEQ ID NO: 133658 - DNA, 16 bp, H. sapiens
tcagaagacctgggtt

SEQ ID NO: 133659 - DNA, 16 bp, H. sapiens
tcagaagagacaaaag

SEQ ID NO: 133660 - DNA, 16 bp, H. sapiens
tcagaagaggagaaaa

SEQ ID NO: 133661 - DNA, 16 bp, H. sapiens
tcagaagcccagctgg

SEQ ID NO: 133662 - DNA, 17 bp, H. sapiens
tcagaaggaatggtacc

SEQ ID NO: 133663 - DNA, 16 bp, H. sapiens
tcagaaggagaaaaaa

SEQ ID NO: 133664 - DNA, 16 bp, H. sapiens
tcagaaggagagaaga

SEQ ID NO: 133665 - DNA, 16 bp, H. sapiens
tcagaaggctgaggag

SEQ ID NO: 133666 - DNA, 16 bp, H. sapiens
tcagaagttctggagg

SEQ ID NO: 133667 - DNA, 16 bp, H. sapiens
tcagaagtttaaaaaa

SEQ ID NO: 133668 - DNA, 16 bp, H. sapiens
tcagaagtttctgaga

SEQ ID NO: 133669 - DNA, 16 bp, H. sapiens
tcagaagtttttaatt

SEQ ID NO: 133670 - DNA, 16 bp, H. sapiens
tcagaagttttttttt

SEQ ID NO: 133671 - DNA, 16 bp, H. sapiens
tcagaatacacattct

SEQ ID NO: 133672 - DNA, 16 bp, H. sapiens
tcagaataccaatgac

SEQ ID NO: 133673 - DNA, 16 bp, H. sapiens
tcagaatagaggaaaa

SEQ ID NO: 133674 - DNA, 16 bp, H. sapiens
tcagaatcacagcaga

SEQ ID NO: 133675 - DNA, 16 bp, H. sapiens
tcagaatcatctgggg

SEQ ID NO: 133676 - DNA, 16 bp, H. sapiens
tcagaatcatggcaga

SEQ ID NO: 133677 - DNA, 16 bp, H. sapiens
tcagaatctccagggg

SEQ ID NO: 133678 - DNA, 16 bp, H. sapiens
tcagaatctctggggt

SEQ ID NO: 133679 - DNA, 16 bp, H. sapiens
tcagaatctgcatttt

SEQ ID NO: 133680 - DNA, 16 bp, H. sapiens
tcagaatctggaggaa

SEQ ID NO: 133681 - DNA, 16 bp, H. sapiens
tcagaatgctacaggg

SEQ ID NO: 133682 - DNA, 16 bp, H. sapiens
tcagaatggcctttac

SEQ ID NO: 133683 - DNA, 16 bp, H. sapiens
tcagaatggctgaaat

SEQ ID NO: 133684 - DNA, 16 bp, H. sapiens
tcagaatgtatttttt

SEQ ID NO: 133685 - DNA, 16 bp, H. sapiens
tcagaatgtgacccta

SEQ ID NO: 133686 - DNA, 16 bp, H. sapiens
tcagaatgtttttctt

SEQ ID NO: 133687 - DNA, 16 bp, H. sapiens
tcagaattgtctgaat

SEQ ID NO: 133688 - DNA, 16 bp, H. sapiens
tcagaattttaaaagc

SEQ ID NO: 133689 - DNA, 16 bp, H. sapiens
tcagaattttaaattt

SEQ ID NO: 133690 - DNA, 16 bp, H. sapiens
tcagacaaaaagaaag

SEQ ID NO: 133691 - DNA, 16 bp, H. sapiens
tcagacaaattaaatt

SEQ ID NO: 133692 - DNA, 16 bp, H. sapiens
tcagacaagaaaaaga

SEQ ID NO: 133693 - DNA, 16 bp, H. sapiens
tcagacaagagaagga

SEQ ID NO: 133694 - DNA, 16 bp, H. sapiens
tcagacattttaattt

SEQ ID NO: 133695 - DNA, 16 bp, H. sapiens
tcagaccacacaggga

SEQ ID NO: 133696 - DNA, 16 bp, H. sapiens
tcagaccacagtgcag

SEQ ID NO: 133697 - DNA, 16 bp, H. sapiens
tcagaccacagtggaa

SEQ ID NO: 133698 - DNA, 16 bp, H. sapiens
tcagaccagttctctg

SEQ ID NO: 133699 - DNA, 16 bp, H. sapiens
tcagaccatagtggaa

SEQ ID NO: 133700 - DNA, 16 bp, H. sapiens
tcagacccaggagtct

SEQ ID NO: 133701 - DNA, 20 bp, H. sapiens
tcagaccggttgtctgctct

SEQ ID NO: 133702 - DNA, 16 bp, H. sapiens
tcagacctctctcaga

SEQ ID NO: 133703 - DNA, 20 bp, H. sapiens
tcagacctctgagcccaagc

SEQ ID NO: 133704 - DNA, 16 bp, H. sapiens
tcagacctgaaaccag

SEQ ID NO: 133705 - DNA, 16 bp, H. sapiens
tcagacctgaagctag

SEQ ID NO: 133706 - DNA, 17 bp, H. sapiens
tcagactactgagtagc

SEQ ID NO: 133707 - DNA, 16 bp, H. sapiens
tcagactcctgacctt

SEQ ID NO: 133708 - DNA, 16 bp, H. sapiens
tcagactgacagcaga

SEQ ID NO: 133709 - DNA, 16 bp, H. sapiens
tcagactgattgtggg

SEQ ID NO: 133710 - DNA, 16 bp, H. sapiens
tcagactgctgagcta

SEQ ID NO: 133711 - DNA, 16 bp, H. sapiens
tcagactgctgtgctg

SEQ ID NO: 133712 - DNA, 16 bp, H. sapiens
tcagactggagtgcag

SEQ ID NO: 133713 - DNA, 16 bp, H. sapiens
tcagactggtctcaaa

SEQ ID NO: 133714 - DNA, 16 bp, H. sapiens
tcagactgtggcttca

SEQ ID NO: 133715 - DNA, 16 bp, H. sapiens
tcagacttctcagcct

SEQ ID NO: 133716 - DNA, 16 bp, H. sapiens
tcagacttttttttaa

SEQ ID NO: 133717 - DNA, 16 bp, H. sapiens
tcagagaaaatatttg

SEQ ID NO: 133718 - DNA, 16 bp, H. sapiens
tcagagaaacagaaag

SEQ ID NO: 133719 - DNA, 16 bp, H. sapiens
tcagagaaaggaaaat

SEQ ID NO: 133720 - DNA, 16 bp, H. sapiens
tcagagaaatacaaat

SEQ ID NO: 133721 - DNA, 16 bp, H. sapiens
tcagagaaatgaaaac

SEQ ID NO: 133722 - DNA, 16 bp, H. sapiens
tcagagaaatgaaaat

SEQ ID NO: 133723 - DNA, 16 bp, H. sapiens
tcagagaaatgcaaaa

SEQ ID NO: 133724 - DNA, 16 bp, H. sapiens
tcagagaaatgcaatt

SEQ ID NO: 133725 - DNA, 16 bp, H. sapiens
tcagagaaatttaaat

SEQ ID NO: 133726 - DNA, 16 bp, H. sapiens
tcagagaagatgcttg

SEQ ID NO: 133727 - DNA, 16 bp, H. sapiens
tcagagaagcaaatgc

SEQ ID NO: 133728 - DNA, 16 bp, H. sapiens
tcagagaaggcttccc

SEQ ID NO: 133729 - DNA, 16 bp, H. sapiens
tcagagaagtctgagg

SEQ ID NO: 133730 - DNA, 16 bp, H. sapiens
tcagagaagtgaaata

SEQ ID NO: 133731 - DNA, 16 bp, H. sapiens
tcagagaagtgaagtg

SEQ ID NO: 133732 - DNA, 16 bp, H. sapiens
tcagagaatactatga

SEQ ID NO: 133733 - DNA, 16 bp, H. sapiens
tcagagaatgtatgga

SEQ ID NO: 133734 - DNA, 16 bp, H. sapiens
tcagagaattgcttga

SEQ ID NO: 133735 - DNA, 16 bp, H. sapiens
tcagagaccacctcag

SEQ ID NO: 133736 - DNA, 16 bp, H. sapiens
tcagagacctgcagag

SEQ ID NO: 133737 - DNA, 16 bp, H. sapiens
tcagagaccttcaagg

SEQ ID NO: 133738 - DNA, 16 bp, H. sapiens
tcagagaccttcatgg

SEQ ID NO: 133739 - DNA, 16 bp, H. sapiens
tcagagactgaggtgg

SEQ ID NO: 133740 - DNA, 16 bp, H. sapiens
tcagagagaacagatt

SEQ ID NO: 133741 - DNA, 16 bp, H. sapiens
tcagagagaagcagct

SEQ ID NO: 133742 - DNA, 16 bp, H. sapiens
tcagagagagaattca

SEQ ID NO: 133743 - DNA, 16 bp, H. sapiens
tcagagagagagagag

SEQ ID NO: 133744 - DNA, 16 bp, H. sapiens
tcagagaggccttcct

SEQ ID NO: 133745 - DNA, 16 bp, H. sapiens
tcagagaggctgagtg

SEQ ID NO: 133746 - DNA, 16 bp, H. sapiens
tcagagagggggatgt

SEQ ID NO: 133747 - DNA, 16 bp, H. sapiens
tcagagatattgcagg

SEQ ID NO: 133748 - DNA, 16 bp, H. sapiens
tcagagatgaaaaagg

SEQ ID NO: 133749 - DNA, 16 bp, H. sapiens
tcagagatgccaggaa

SEQ ID NO: 133750 - DNA, 16 bp, H. sapiens
tcagagatgctgctaa

SEQ ID NO: 133751 - DNA, 16 bp, H. sapiens
tcagagatttaaaaaa

SEQ ID NO: 133752 - DNA, 16 bp, H. sapiens
tcagagatttcttctt

SEQ ID NO: 133753 - DNA, 16 bp, H. sapiens
tcagagattttttaaa

SEQ ID NO: 133754 - DNA, 16 bp, H. sapiens
tcagagatttttttca

SEQ ID NO: 133755 - DNA, 16 bp, H. sapiens
tcagagcaacttccag

SEQ ID NO: 133756 - DNA, 16 bp, H. sapiens
tcagagcaagagatga

SEQ ID NO: 133757 - DNA, 16 bp, H. sapiens
tcagagcagaaataaa

SEQ ID NO: 133758 - DNA, 16 bp, H. sapiens
tcagagcagaacaaaa

SEQ ID NO: 133759 - DNA, 16 bp, H. sapiens
tcagagcagaaccaaa

SEQ ID NO: 133760 - DNA, 16 bp, H. sapiens
tcagagcagaactgag

SEQ ID NO: 133761 - DNA, 16 bp, H. sapiens
tcagagcaggtgctgg

SEQ ID NO: 133762 - DNA, 16 bp, H. sapiens
tcagagccagcaggca

SEQ ID NO: 133763 - DNA, 16 bp, H. sapiens
tcagagcccaaggccc

SEQ ID NO: 133764 - DNA, 16 bp, H. sapiens
tcagagctcttggatg

SEQ ID NO: 133765 - DNA, 16 bp, H. sapiens
tcagagctggaaggga

SEQ ID NO: 133766 - DNA, 16 bp, H. sapiens
tcagagctgtcagcct

SEQ ID NO: 133767 - DNA, 16 bp, H. sapiens
tcagagctgtcctggg

SEQ ID NO: 133768 - DNA, 16 bp, H. sapiens
tcagaggaaagaattc

SEQ ID NO: 133769 - DNA, 16 bp, H. sapiens
tcagaggaaagcacac

SEQ ID NO: 133770 - DNA, 16 bp, H. sapiens
tcagaggaaatgcttt

SEQ ID NO: 133771 - DNA, 16 bp, H. sapiens
tcagaggaacaaaaag

SEQ ID NO: 133772 - DNA, 16 bp, H. sapiens
tcagaggaaggaacag

SEQ ID NO: 133773 - DNA, 16 bp, H. sapiens
tcagaggacaggctga

SEQ ID NO: 133774 - DNA, 16 bp, H. sapiens
tcagaggagagcccag

SEQ ID NO: 133775 - DNA, 16 bp, H. sapiens
tcagaggatcctccca

SEQ ID NO: 133776 - DNA, 16 bp, H. sapiens
tcagaggcataatttg

SEQ ID NO: 133777 - DNA, 16 bp, H. sapiens
tcagaggccaaggagg

SEQ ID NO: 133778 - DNA, 16 bp, H. sapiens
tcagaggcctgacacc

SEQ ID NO: 133779 - DNA, 16 bp, H. sapiens
tcagaggctgaggctg

SEQ ID NO: 133780 - DNA, 16 bp, H. sapiens
tcagaggctgggaaag

SEQ ID NO: 133781 - DNA, 16 bp, H. sapiens
tcagagggagaccgtg

SEQ ID NO: 133782 - DNA, 16 bp, H. sapiens
tcagaggtcttcatgg

SEQ ID NO: 133783 - DNA, 16 bp, H. sapiens
tcagagtagaaataaa

SEQ ID NO: 133784 - DNA, 16 bp, H. sapiens
tcagagtcagaggaga

SEQ ID NO: 133785 - DNA, 16 bp, H. sapiens
tcagagtgatactggc

SEQ ID NO: 133786 - DNA, 16 bp, H. sapiens
tcagagtgatggtttc

SEQ ID NO: 133787 - DNA, 16 bp, H. sapiens
tcagagtgcacaggca

SEQ ID NO: 133788 - DNA, 16 bp, H. sapiens
tcagagtggataaaaa

SEQ ID NO: 133789 - DNA, 16 bp, H. sapiens
tcagagttccagaaag

SEQ ID NO: 133790 - DNA, 16 bp, H. sapiens
tcagagtttgaagacc

SEQ ID NO: 133791 - DNA, 16 bp, H. sapiens
tcagagtttgaagact

SEQ ID NO: 133792 - DNA, 16 bp, H. sapiens
tcagagtttttaaaga

SEQ ID NO: 133793 - DNA, 16 bp, H. sapiens
tcagataaatgaaaat

SEQ ID NO: 133794 - DNA, 16 bp, H. sapiens
tcagataacctataaa

SEQ ID NO: 133795 - DNA, 16 bp, H. sapiens
tcagataaggcaaatg

SEQ ID NO: 133796 - DNA, 16 bp, H. sapiens
tcagatacatagtttg

SEQ ID NO: 133797 - DNA, 16 bp, H. sapiens
tcagatataagatttg

SEQ ID NO: 133798 - DNA, 16 bp, H. sapiens
tcagatattcggggtt

SEQ ID NO: 133799 - DNA, 16 bp, H. sapiens
tcagatcaaggagctt

SEQ ID NO: 133800 - DNA, 16 bp, H. sapiens
tcagatcacagtggaa

SEQ ID NO: 133801 - DNA, 16 bp, H. sapiens
tcagatcatcagtcat

SEQ ID NO: 133802 - DNA, 16 bp, H. sapiens
tcagatcatgtcactc

SEQ ID NO: 133803 - DNA, 16 bp, H. sapiens
tcagatcccacagatt

SEQ ID NO: 133804 - DNA, 16 bp, H. sapiens
tcagatcccacaggtt

SEQ ID NO: 133805 - DNA, 16 bp, H. sapiens
tcagatcccagcagca

SEQ ID NO: 133806 - DNA, 16 bp, H. sapiens
tcagatctaacagtgg

SEQ ID NO: 133807 - DNA, 16 bp, H. sapiens
tcagatctcatcagac

SEQ ID NO: 133808 - DNA, 16 bp, H. sapiens
tcagatcttgtgaaac

SEQ ID NO: 133809 - DNA, 16 bp, H. sapiens
tcagatgactgcagtt

SEQ ID NO: 133810 - DNA, 16 bp, H. sapiens
tcagatgagaaatgct

SEQ ID NO: 133811 - DNA, 16 bp, H. sapiens
tcagatgagcagattg

SEQ ID NO: 133812 - DNA, 16 bp, H. sapiens
tcagatgagcagcagc

SEQ ID NO: 133813 - DNA, 16 bp, H. sapiens
tcagatgaggaaaatg

SEQ ID NO: 133814 - DNA, 16 bp, H. sapiens
tcagatgaggaaattg

SEQ ID NO: 133815 - DNA, 16 bp, H. sapiens
tcagatgatgctgatg

SEQ ID NO: 133816 - DNA, 16 bp, H. sapiens
tcagatgatgggtgca

SEQ ID NO: 133817 - DNA, 16 bp, H. sapiens
tcagatgcatagtttg

SEQ ID NO: 133818 - DNA, 16 bp, H. sapiens
tcagatgctcgcctgt

SEQ ID NO: 133819 - DNA, 16 bp, H. sapiens
tcagatgctttttctg

SEQ ID NO: 133820 - DNA, 17 bp, H. sapiens
tcagatggagataagga

SEQ ID NO: 133821 - DNA, 16 bp, H. sapiens
tcagatggagatgaga

SEQ ID NO: 133822 - DNA, 16 bp, H. sapiens
tcagatggatggtttg

SEQ ID NO: 133823 - DNA, 16 bp, H. sapiens
tcagatggatgtagat

SEQ ID NO: 133824 - DNA, 16 bp, H. sapiens
tcagatggttgtatgt

SEQ ID NO: 133825 - DNA, 16 bp, H. sapiens
tcagatgtccagctgc

SEQ ID NO: 133826 - DNA, 16 bp, H. sapiens
tcagatgtgtccaggg

SEQ ID NO: 133827 - DNA, 16 bp, H. sapiens
tcagatgttaaaccaa

SEQ ID NO: 133828 - DNA, 16 bp, H. sapiens
tcagatgtttgcacag

SEQ ID NO: 133829 - DNA, 16 bp, H. sapiens
tcagatgttttgccca

SEQ ID NO: 133830 - DNA, 16 bp, H. sapiens
tcagattatttgtttt

SEQ ID NO: 133831 - DNA, 16 bp, H. sapiens
tcagattccttttttt

SEQ ID NO: 133832 - DNA, 17 bp, H. sapiens
tcagattctccaaggtc

SEQ ID NO: 133833 - DNA, 23 bp, H. sapiens
tcagattctgcatatgtagtaca

SEQ ID NO: 133834 - DNA, 16 bp, H. sapiens
tcagattcttcatctg

SEQ ID NO: 133835 - DNA, 16 bp, H. sapiens
tcagattgaacaggca

SEQ ID NO: 133836 - DNA, 16 bp, H. sapiens
tcagattggcaaagat

SEQ ID NO: 133837 - DNA, 16 bp, H. sapiens
tcagatttatttttat

SEQ ID NO: 133838 - DNA, 16 bp, H. sapiens
tcagatttcagatttt

SEQ ID NO: 133839 - DNA, 16 bp, H. sapiens
tcagatttcttcagtt

SEQ ID NO: 133840 - DNA, 16 bp, H. sapiens
tcagattttctggttt

SEQ ID NO: 133841 - DNA, 16 bp, H. sapiens
tcagattttgattttt

SEQ ID NO: 133842 - DNA, 16 bp, H. sapiens
tcagattttgtgagac

SEQ ID NO: 133843 - DNA, 16 bp, H. sapiens
tcagattttgttttct

SEQ ID NO: 133844 - DNA, 16 bp, H. sapiens
tcagatttttatttat

SEQ ID NO: 133845 - DNA, 16 bp, H. sapiens
tcagatttttctgttt

SEQ ID NO: 133846 - DNA, 16 bp, H. sapiens
tcagatttttcttctg

SEQ ID NO: 133847 - DNA, 16 bp, H. sapiens
tcagatttttgtatta

SEQ ID NO: 133848 - DNA, 16 bp, H. sapiens
tcagcaaaataaaaga

SEQ ID NO: 133849 - DNA, 16 bp, H. sapiens
tcagcaaaatccagaa

SEQ ID NO: 133850 - DNA, 16 bp, H. sapiens
tcagcaaacactacaa

SEQ ID NO: 133851 - DNA, 16 bp, H. sapiens
tcagcaaacagggaca

SEQ ID NO: 133852 - DNA, 16 bp, H. sapiens
tcagcaaacatttttt

SEQ ID NO: 133853 - DNA, 16 bp, H. sapiens
tcagcaaactgtggcc

SEQ ID NO: 133854 - DNA, 16 bp, H. sapiens
tcagcaaaggaaaaag

SEQ ID NO: 133855 - DNA, 16 bp, H. sapiens
tcagcaaagtaaacag

SEQ ID NO: 133856 - DNA, 16 bp, H. sapiens
tcagcaaatacttact

SEQ ID NO: 133857 - DNA, 16 bp, H. sapiens
tcagcaaatattcact

SEQ ID NO: 133858 - DNA, 16 bp, H. sapiens
tcagcaaatgtaaaaa

SEQ ID NO: 133859 - DNA, 18 bp, H. sapiens
tcagcaaatgtagaagaa

SEQ ID NO: 133860 - DNA, 16 bp, H. sapiens
tcagcaaatgtttatt

SEQ ID NO: 133861 - DNA, 16 bp, H. sapiens
tcagcaaatgtttgtt

SEQ ID NO: 133862 - DNA, 16 bp, H. sapiens
tcagcaaatttcaagt

SEQ ID NO: 133863 - DNA, 16 bp, H. sapiens
tcagcaacaaaaagaa

SEQ ID NO: 133864 - DNA, 16 bp, H. sapiens
tcagcaacaagagcga

SEQ ID NO: 133865 - DNA, 16 bp, H. sapiens
tcagcaacaaggctgt

SEQ ID NO: 133866 - DNA, 16 bp, H. sapiens
tcagcaacatgaaaat

SEQ ID NO: 133867 - DNA, 16 bp, H. sapiens
tcagcaacatggactt

SEQ ID NO: 133868 - DNA, 16 bp, H. sapiens
tcagcaacctcaaaga

SEQ ID NO: 133869 - DNA, 16 bp, H. sapiens
tcagcaactatttatt

SEQ ID NO: 133870 - DNA, 16 bp, H. sapiens
tcagcaagaccaagaa

SEQ ID NO: 133871 - DNA, 16 bp, H. sapiens
tcagcaagagaaaagc

SEQ ID NO: 133872 - DNA, 16 bp, H. sapiens
tcagcaagcagcccag

SEQ ID NO: 133873 - DNA, 16 bp, H. sapiens
tcagcaatacaaagaa

SEQ ID NO: 133874 - DNA, 16 bp, H. sapiens
tcagcaatattcactg

SEQ ID NO: 133875 - DNA, 16 bp, H. sapiens
tcagcaatggcagatg

SEQ ID NO: 133876 - DNA, 16 bp, H. sapiens
tcagcaatgttttgta

SEQ ID NO: 133877 - DNA, 16 bp, H. sapiens
tcagcaatttgattat

SEQ ID NO: 133878 - DNA, 16 bp, H. sapiens
tcagcaattttttaaa

SEQ ID NO: 133879 - DNA, 16 bp, H. sapiens
tcagcacactgtgtct

SEQ ID NO: 133880 - DNA, 16 bp, H. sapiens
tcagcacagaaataaa

SEQ ID NO: 133881 - DNA, 16 bp, H. sapiens
tcagcacagcagtctg

SEQ ID NO: 133882 - DNA, 16 bp, H. sapiens
tcagcaccacggacag

SEQ ID NO: 133883 - DNA, 16 bp, H. sapiens
tcagcaccagggacag

SEQ ID NO: 133884 - DNA, 16 bp, H. sapiens
tcagcaccatggacag

SEQ ID NO: 133885 - DNA, 16 bp, H. sapiens
tcagcacccaaacaca

SEQ ID NO: 133886 - DNA, 17 bp, H. sapiens
tcagcacccctttccag

SEQ ID NO: 133887 - DNA, 16 bp, H. sapiens
tcagcaccgcggacag

SEQ ID NO: 133888 - DNA, 16 bp, H. sapiens
tcagcacctagcacag

SEQ ID NO: 133889 - DNA, 16 bp, H. sapiens
tcagcactttgaagat

SEQ ID NO: 133890 - DNA, 18 bp, H. sapiens
tcagcactttgggaggca

SEQ ID NO: 133891 - DNA, 20 bp, H. sapiens
tcagcactttgggaggccag

SEQ ID NO: 133892 - DNA, 16 bp, H. sapiens
tcagcagaaactgtac

SEQ ID NO: 133893 - DNA, 16 bp, H. sapiens
tcagcagaaagaaatg

SEQ ID NO: 133894 - DNA, 16 bp, H. sapiens
tcagcagacagagcta

SEQ ID NO: 133895 - DNA, 16 bp, H. sapiens
tcagcagagacagggt

SEQ ID NO: 133896 - DNA, 16 bp, H. sapiens
tcagcagagcagccac

SEQ ID NO: 133897 - DNA, 16 bp, H. sapiens
tcagcagaggagacag

SEQ ID NO: 133898 - DNA, 16 bp, H. sapiens
tcagcagatcccaccc

SEQ ID NO: 133899 - DNA, 16 bp, H. sapiens
tcagcagatgaatgga

SEQ ID NO: 133900 - DNA, 16 bp, H. sapiens
tcagcagcagcagcaa

SEQ ID NO: 133901 - DNA, 16 bp, H. sapiens
tcagcagcagcagcat

SEQ ID NO: 133902 - DNA, 16 bp, H. sapiens
tcagcagcagtgtctg

SEQ ID NO: 133903 - DNA, 16 bp, H. sapiens
tcagcagcatccctga

SEQ ID NO: 133904 - DNA, 16 bp, H. sapiens
tcagcagcccttcatg

SEQ ID NO: 133905 - DNA, 16 bp, H. sapiens
tcagcagcggaggctg

SEQ ID NO: 133906 - DNA, 16 bp, H. sapiens
tcagcaggaagcagtt

SEQ ID NO: 133907 - DNA, 23 bp, H. sapiens
tcagcaggatgtgggtggggcca

SEQ ID NO: 133908 - DNA, 16 bp, H. sapiens
tcagcaggctctgggg

SEQ ID NO: 133909 - DNA, 16 bp, H. sapiens
tcagcagggagagcac

SEQ ID NO: 133910 - DNA, 16 bp, H. sapiens
tcagcagggctgtgct

SEQ ID NO: 133911 - DNA, 16 bp, H. sapiens
tcagcagtagtctggc

SEQ ID NO: 133912 - DNA, 16 bp, H. sapiens
tcagcagtctgcaacc

SEQ ID NO: 133913 - DNA, 16 bp, H. sapiens
tcagcagtgaagtcat

SEQ ID NO: 133914 - DNA, 16 bp, H. sapiens
tcagcagtgaggccat

SEQ ID NO: 133915 - DNA, 16 bp, H. sapiens
tcagcagtgctgaggt

SEQ ID NO: 133916 - DNA, 16 bp, H. sapiens
tcagcataattattct

SEQ ID NO: 133917 - DNA, 16 bp, H. sapiens
tcagcataattcttca

SEQ ID NO: 133918 - DNA, 16 bp, H. sapiens
tcagcatcaattaaaa

SEQ ID NO: 133919 - DNA, 16 bp, H. sapiens
tcagcatcacccagga

SEQ ID NO: 133920 - DNA, 16 bp, H. sapiens
tcagcatcactggtca

SEQ ID NO: 133921 - DNA, 16 bp, H. sapiens
tcagcatcacttggga

SEQ ID NO: 133922 - DNA, 16 bp, H. sapiens
tcagcatcagcatcag

SEQ ID NO: 133923 - DNA, 16 bp, H. sapiens
tcagcatcccctggga

SEQ ID NO: 133924 - DNA, 16 bp, H. sapiens
tcagcatctgcttctg

SEQ ID NO: 133925 - DNA, 16 bp, H. sapiens
tcagcatctgcttgtc

SEQ ID NO: 133926 - DNA, 16 bp, H. sapiens
tcagcatgaagcagtt

SEQ ID NO: 133927 - DNA, 16 bp, H. sapiens
tcagcatggcctggat

SEQ ID NO: 133928 - DNA, 16 bp, H. sapiens
tcagcatgtgaatttt

SEQ ID NO: 133929 - DNA, 16 bp, H. sapiens
tcagcatgtgtgtgtg

SEQ ID NO: 133930 - DNA, 16 bp, H. sapiens
tcagcatgttggtcaa

SEQ ID NO: 133931 - DNA, 16 bp, H. sapiens
tcagcattctccagag

SEQ ID NO: 133932 - DNA, 16 bp, H. sapiens
tcagcattgtactgga

SEQ ID NO: 133933 - DNA, 16 bp, H. sapiens
tcagcatttcaaagga

SEQ ID NO: 133934 - DNA, 16 bp, H. sapiens
tcagcatttccttgtc

SEQ ID NO: 133935 - DNA, 16 bp, H. sapiens
tcagcatttgaatcag

SEQ ID NO: 133936 - DNA, 16 bp, H. sapiens
tcagcattttattatt

SEQ ID NO: 133937 - DNA, 16 bp, H. sapiens
tcagcattttctctct

SEQ ID NO: 133938 - DNA, 16 bp, H. sapiens
tcagcattttgtagtt

SEQ ID NO: 133939 - DNA, 16 bp, H. sapiens
tcagcattttttaaag

SEQ ID NO: 133940 - DNA, 16 bp, H. sapiens
tcagccaaaatctcct

SEQ ID NO: 133941 - DNA, 16 bp, H. sapiens
tcagccaactgagtag

SEQ ID NO: 133942 - DNA, 16 bp, H. sapiens
tcagccaagatcgtgc

SEQ ID NO: 133943 - DNA, 16 bp, H. sapiens
tcagccaagtagctgg

SEQ ID NO: 133944 - DNA, 16 bp, H. sapiens
tcagccacagctgcag

SEQ ID NO: 133945 - DNA, 16 bp, H. sapiens
tcagccaccatacctg

SEQ ID NO: 133946 - DNA, 16 bp, H. sapiens
tcagccacccaaagtg

SEQ ID NO: 133947 - DNA, 16 bp, H. sapiens
tcagccactatggaaa

SEQ ID NO: 133948 - DNA, 16 bp, H. sapiens
tcagccactccagcca

SEQ ID NO: 133949 - DNA, 16 bp, H. sapiens
tcagccactgtaccca

SEQ ID NO: 133950 - DNA, 16 bp, H. sapiens
tcagccagagcagggc

SEQ ID NO: 133951 - DNA, 16 bp, H. sapiens
tcagccagctcagcct

SEQ ID NO: 133952 - DNA, 16 bp, H. sapiens
tcagccagctgtggtg

SEQ ID NO: 133953 - DNA, 16 bp, H. sapiens
tcagccaggagtctct

SEQ ID NO: 133954 - DNA, 16 bp, H. sapiens
tcagccaggcatagtg

SEQ ID NO: 133955 - DNA, 16 bp, H. sapiens
tcagccaggcgtggtg

SEQ ID NO: 133956 - DNA, 16 bp, H. sapiens
tcagccagggccccac

SEQ ID NO: 133957 - DNA, 16 bp, H. sapiens
tcagccaggtgctgtg

SEQ ID NO: 133958 - DNA, 16 bp, H. sapiens
tcagccaggtgtctct

SEQ ID NO: 133959 - DNA, 16 bp, H. sapiens
tcagccagtcatggtg

SEQ ID NO: 133960 - DNA, 16 bp, H. sapiens
tcagccatcttgaacc

SEQ ID NO: 133961 - DNA, 16 bp, H. sapiens
tcagccatggctaaaa

SEQ ID NO: 133962 - DNA, 16 bp, H. sapiens
tcagccattattactt

SEQ ID NO: 133963 - DNA, 16 bp, H. sapiens
tcagccattgtagaag

SEQ ID NO: 133964 - DNA, 16 bp, H. sapiens
tcagccattgtggaaa

SEQ ID NO: 133965 - DNA, 22 bp, H. sapiens
tcagcccaaaatctccttaagt

SEQ ID NO: 133966 - DNA, 16 bp, H. sapiens
tcagcccacttcagcc

SEQ ID NO: 133967 - DNA, 16 bp, H. sapiens
tcagcccagcactttg

SEQ ID NO: 133968 - DNA, 16 bp, H. sapiens
tcagcccagcttctgt

SEQ ID NO: 133969 - DNA, 16 bp, H. sapiens
tcagcccaggaggcag

SEQ ID NO: 133970 - DNA, 16 bp, H. sapiens
tcagcccaggaggttg

SEQ ID NO: 133971 - DNA, 16 bp, H. sapiens
tcagcccaggagttca

SEQ ID NO: 133972 - DNA, 16 bp, H. sapiens
tcagcccaggagtttg

SEQ ID NO: 133973 - DNA, 27 bp, H. sapiens
tcagccccaaatctccttaagctgata

SEQ ID NO: 133974 - DNA, 16 bp, H. sapiens
tcagccccacccacag

SEQ ID NO: 133975 - DNA, 16 bp, H. sapiens
tcagccccagccctgg

SEQ ID NO: 133976 - DNA, 16 bp, H. sapiens
tcagcccccacaagta

SEQ ID NO: 133977 - DNA, 16 bp, H. sapiens
tcagcccccacagctg

SEQ ID NO: 133978 - DNA, 16 bp, H. sapiens
tcagccccccaaagtg

SEQ ID NO: 133979 - DNA, 16 bp, H. sapiens
tcagccccccaagtat

SEQ ID NO: 133980 - DNA, 16 bp, H. sapiens
tcagcccccgagggcc

SEQ ID NO: 133981 - DNA, 16 bp, H. sapiens
tcagccccctgcctgg

SEQ ID NO: 133982 - DNA, 16 bp, H. sapiens
tcagcccctcagcccc

SEQ ID NO: 133983 - DNA, 16 bp, H. sapiens
tcagcccctccagcac

SEQ ID NO: 133984 - DNA, 16 bp, H. sapiens
tcagcccctgcccggc

SEQ ID NO: 133985 - DNA, 16 bp, H. sapiens
tcagcccctggcaatc

SEQ ID NO: 133986 - DNA, 16 bp, H. sapiens
tcagccgcccaaagtg

SEQ ID NO: 133987 - DNA, 16 bp, H. sapiens
tcagcctactgagtag

SEQ ID NO: 133988 - DNA, 16 bp, H. sapiens
tcagcctcacaaagtg

SEQ ID NO: 133989 - DNA, 16 bp, H. sapiens
tcagcctcagcactgt

SEQ ID NO: 133990 - DNA, 16 bp, H. sapiens
tcagcctcagctggga

SEQ ID NO: 133991 - DNA, 16 bp, H. sapiens
tcagcctcaggtgatc

SEQ ID NO: 133992 - DNA, 16 bp, H. sapiens
tcagcctccacctcct

SEQ ID NO: 133993 - DNA, 16 bp, H. sapiens
tcagcctccagaactc

SEQ ID NO: 133994 - DNA, 16 bp, H. sapiens
tcagcctccagaggag

SEQ ID NO: 133995 - DNA, 16 bp, H. sapiens
tcagcctcccaaaagc

SEQ ID NO: 133996 - DNA, 16 bp, H. sapiens
tcagcctcccaaaatg

SEQ ID NO: 133997 - DNA, 16 bp, H. sapiens
tcagcctcccaaagtc

SEQ ID NO: 133998 - DNA, 18 bp, H. sapiens
tcagcctcccaaagtgcc

SEQ ID NO: 133999 - DNA, 17 bp, H. sapiens
tcagcctcccaaagtgg

SEQ ID NO: 134000 - DNA, 16 bp, H. sapiens
tcagcctcccaagaag

SEQ ID NO: 134001 - DNA, 18 bp, H. sapiens
tcagcctcccaagcagct

SEQ ID NO: 134002 - DNA, 16 bp, H. sapiens
tcagcctcccaagcat

SEQ ID NO: 134003 - DNA, 17 bp, H. sapiens
tcagcctcccaagtaga

SEQ ID NO: 134004 - DNA, 16 bp, H. sapiens
tcagcctcccagactc

SEQ ID NO: 134005 - DNA, 16 bp, H. sapiens
tcagcctcccagagag

SEQ ID NO: 134006 - DNA, 16 bp, H. sapiens
tcagcctcccagaggg

SEQ ID NO: 134007 - DNA, 16 bp, H. sapiens
tcagcctcccagtagc

SEQ ID NO: 134008 - DNA, 16 bp, H. sapiens
tcagcctccccagtac

SEQ ID NO: 134009 - DNA, 16 bp, H. sapiens
tcagcctcccgagctg

SEQ ID NO: 134010 - DNA, 21 bp, H. sapiens
tcagcctcccgagtagctgga

SEQ ID NO: 134011 - DNA, 16 bp, H. sapiens
tcagcctccctgagtg

SEQ ID NO: 134012 - DNA, 16 bp, H. sapiens
tcagcctcctaaagag

SEQ ID NO: 134013 - DNA, 16 bp, H. sapiens
tcagcctcctcatctg

SEQ ID NO: 134014 - DNA, 16 bp, H. sapiens
tcagcctcctgaactg

SEQ ID NO: 134015 - DNA, 16 bp, H. sapiens
tcagcctcctgaatac

SEQ ID NO: 134016 - DNA, 16 bp, H. sapiens
tcagcctcctgagtaa

SEQ ID NO: 134017 - DNA, 18 bp, H. sapiens
tcagcctcctgagtagca

SEQ ID NO: 134018 - DNA, 16 bp, H. sapiens
tcagcctcctgagtgg

SEQ ID NO: 134019 - DNA, 16 bp, H. sapiens
tcagcctcctgggcag

SEQ ID NO: 134020 - DNA, 16 bp, H. sapiens
tcagcctcctgggctg

SEQ ID NO: 134021 - DNA, 18 bp, H. sapiens
tcagcctcctgtgtagct

SEQ ID NO: 134022 - DNA, 16 bp, H. sapiens
tcagcctccttcccca

SEQ ID NO: 134023 - DNA, 16 bp, H. sapiens
tcagcctcggtgacag

SEQ ID NO: 134024 - DNA, 16 bp, H. sapiens
tcagcctctagagtag

SEQ ID NO: 134025 - DNA, 17 bp, H. sapiens
tcagcctctcaagcagc

SEQ ID NO: 134026 - DNA, 16 bp, H. sapiens
tcagcctctcagaggg

SEQ ID NO: 134027 - DNA, 16 bp, H. sapiens
tcagcctctgattggc

SEQ ID NO: 134028 - DNA, 16 bp, H. sapiens
tcagcctctggagtgg

SEQ ID NO: 134029 - DNA, 16 bp, H. sapiens
tcagcctcttgggctc

SEQ ID NO: 134030 - DNA, 16 bp, H. sapiens
tcagcctgaagaagtt

SEQ ID NO: 134031 - DNA, 16 bp, H. sapiens
tcagcctgagtgacag

SEQ ID NO: 134032 - DNA, 16 bp, H. sapiens
tcagcctgcagaactg

SEQ ID NO: 134033 - DNA, 16 bp, H. sapiens
tcagcctgctgaatag

SEQ ID NO: 134034 - DNA, 16 bp, H. sapiens
tcagcctggaagacag

SEQ ID NO: 134035 - DNA, 16 bp, H. sapiens
tcagcctggcaacaga

SEQ ID NO: 134036 - DNA, 16 bp, H. sapiens
tcagcctggccaacat

SEQ ID NO: 134037 - DNA, 22 bp, H. sapiens
tcagcctggccaacgtggtgaa

SEQ ID NO: 134038 - DNA, 16 bp, H. sapiens
tcagcctgggccacag

SEQ ID NO: 134039 - DNA, 16 bp, H. sapiens
tcagcctgggccacat

SEQ ID NO: 134040 - DNA, 16 bp, H. sapiens
tcagcctggggaacat

SEQ ID NO: 134041 - DNA, 19 bp, H. sapiens
tcagcctgggtgacagaga

SEQ ID NO: 134042 - DNA, 16 bp, H. sapiens
tcagcctgtgcaacag

SEQ ID NO: 134043 - DNA, 16 bp, H. sapiens
tcagccttatgttccc

SEQ ID NO: 134044 - DNA, 16 bp, H. sapiens
tcagccttccaagtat

SEQ ID NO: 134045 - DNA, 16 bp, H. sapiens
tcagccttctcatctg

SEQ ID NO: 134046 - DNA, 16 bp, H. sapiens
tcagccttctgaagtg

SEQ ID NO: 134047 - DNA, 16 bp, H. sapiens
tcagccttctgagaag

SEQ ID NO: 134048 - DNA, 16 bp, H. sapiens
tcagcctttcaaaatg

SEQ ID NO: 134049 - DNA, 16 bp, H. sapiens
tcagcctttttgctct

SEQ ID NO: 134050 - DNA, 16 bp, H. sapiens
tcagcgtgacctggat

SEQ ID NO: 134051 - DNA, 16 bp, H. sapiens
tcagctaaagatgggg

SEQ ID NO: 134052 - DNA, 16 bp, H. sapiens
tcagctaatttttaat

SEQ ID NO: 134053 - DNA, 20 bp, H. sapiens
tcagctacttgggaggctga

SEQ ID NO: 134054 - DNA, 16 bp, H. sapiens
tcagctatcgttagtg

SEQ ID NO: 134055 - DNA, 16 bp, H. sapiens
tcagctattatttttt

SEQ ID NO: 134056 - DNA, 16 bp, H. sapiens
tcagctatttcttcta

SEQ ID NO: 134057 - DNA, 16 bp, H. sapiens
tcagctatttgggaag

SEQ ID NO: 134058 - DNA, 16 bp, H. sapiens
tcagctattttaaaaa

SEQ ID NO: 134059 - DNA, 16 bp, H. sapiens
tcagctcaaacatcac

SEQ ID NO: 134060 - DNA, 19 bp, H. sapiens
tcagctcaccacaacctct

SEQ ID NO: 134061 - DNA, 19 bp, H. sapiens
tcagctcaccgcaacctct

SEQ ID NO: 134062 - DNA, 16 bp, H. sapiens
tcagctcactgcagtc

SEQ ID NO: 134063 - DNA, 16 bp, H. sapiens
tcagctcactgccagc

SEQ ID NO: 134064 - DNA, 16 bp, H. sapiens
tcagctcacttgcaac

SEQ ID NO: 134065 - DNA, 16 bp, H. sapiens
tcagctcaggtctctc

SEQ ID NO: 134066 - DNA, 16 bp, H. sapiens
tcagctcatggcaacc

SEQ ID NO: 134067 - DNA, 19 bp, H. sapiens
tcagctcattgcaacctcc

SEQ ID NO: 134068 - DNA, 22 bp, H. sapiens
tcagctcattgcaacctctgcc

SEQ ID NO: 134069 - DNA, 16 bp, H. sapiens
tcagctccacctcctg

SEQ ID NO: 134070 - DNA, 16 bp, H. sapiens
tcagctccacctgcag

SEQ ID NO: 134071 - DNA, 16 bp, H. sapiens
tcagctccaggatttc

SEQ ID NO: 134072 - DNA, 16 bp, H. sapiens
tcagctccatcagctc

SEQ ID NO: 134073 - DNA, 16 bp, H. sapiens
tcagctccgtcagctc

SEQ ID NO: 134074 - DNA, 35 bp, H. sapiens
tcagctcctatctctgtatggcctggtttttccta

SEQ ID NO: 134075 - DNA, 16 bp, H. sapiens
tcagctcctccctggg

SEQ ID NO: 134076 - DNA, 16 bp, H. sapiens
tcagctcctgccctcc

SEQ ID NO: 134077 - DNA, 17 bp, H. sapiens
tcagctctgaaggctgt

SEQ ID NO: 134078 - DNA, 16 bp, H. sapiens
tcagctctgcaccaaa

SEQ ID NO: 134079 - DNA, 16 bp, H. sapiens
tcagctctggaacaag

SEQ ID NO: 134080 - DNA, 16 bp, H. sapiens
tcagctctggactaag

SEQ ID NO: 134081 - DNA, 16 bp, H. sapiens
tcagctctgtgagtga

SEQ ID NO: 134082 - DNA, 16 bp, H. sapiens
tcagctcttttgccca

SEQ ID NO: 134083 - DNA, 16 bp, H. sapiens
tcagctgagcgtggtg

SEQ ID NO: 134084 - DNA, 16 bp, H. sapiens
tcagctgaggaagatg

SEQ ID NO: 134085 - DNA, 16 bp, H. sapiens
tcagctgaggtcccag

SEQ ID NO: 134086 - DNA, 16 bp, H. sapiens
tcagctgccaggcagg

SEQ ID NO: 134087 - DNA, 16 bp, H. sapiens
tcagctgccttcagcc

SEQ ID NO: 134088 - DNA, 16 bp, H. sapiens
tcagctgctgctgctg

SEQ ID NO: 134089 - DNA, 16 bp, H. sapiens
tcagctggaaatgcag

SEQ ID NO: 134090 - DNA, 16 bp, H. sapiens
tcagctggagtgcagt

SEQ ID NO: 134091 - DNA, 16 bp, H. sapiens
tcagctggatgcagtg

SEQ ID NO: 134092 - DNA, 16 bp, H. sapiens
tcagctggctgtggtg

SEQ ID NO: 134093 - DNA, 16 bp, H. sapiens
tcagctgggagcatca

SEQ ID NO: 134094 - DNA, 16 bp, H. sapiens
tcagctgggagtggtg

SEQ ID NO: 134095 - DNA, 16 bp, H. sapiens
tcagctgggcatggtg

SEQ ID NO: 134096 - DNA, 16 bp, H. sapiens
tcagctgggtatggtg

SEQ ID NO: 134097 - DNA, 16 bp, H. sapiens
tcagctgggtgtggtg

SEQ ID NO: 134098 - DNA, 16 bp, H. sapiens
tcagctgtgaatctgt

SEQ ID NO: 134099 - DNA, 16 bp, H. sapiens
tcagctgtgccctctg

SEQ ID NO: 134100 - DNA, 16 bp, H. sapiens
tcagctgtgtcccaga

SEQ ID NO: 134101 - DNA, 16 bp, H. sapiens
tcagctgtgtccccac

SEQ ID NO: 134102 - DNA, 16 bp, H. sapiens
tcagcttcaaataaag

SEQ ID NO: 134103 - DNA, 16 bp, H. sapiens
tcagcttcatccccag

SEQ ID NO: 134104 - DNA, 16 bp, H. sapiens
tcagcttcatccctgg

SEQ ID NO: 134105 - DNA, 16 bp, H. sapiens
tcagcttcatggaaaa

SEQ ID NO: 134106 - DNA, 16 bp, H. sapiens
tcagcttccagagcag

SEQ ID NO: 134107 - DNA, 16 bp, H. sapiens
tcagcttccagagtag

SEQ ID NO: 134108 - DNA, 16 bp, H. sapiens
tcagcttcctcacctg

SEQ ID NO: 134109 - DNA, 16 bp, H. sapiens
tcagcttcctgaggcc

SEQ ID NO: 134110 - DNA, 18 bp, H. sapiens
tcagcttcctgagtagct

SEQ ID NO: 134111 - DNA, 16 bp, H. sapiens
tcagcttctccctctg

SEQ ID NO: 134112 - DNA, 16 bp, H. sapiens
tcagcttctggtgagg

SEQ ID NO: 134113 - DNA, 16 bp, H. sapiens
tcagcttcttcctggt

SEQ ID NO: 134114 - DNA, 16 bp, H. sapiens
tcagcttgcaaacagc

SEQ ID NO: 134115 - DNA, 16 bp, H. sapiens
tcagcttggctgttgt

SEQ ID NO: 134116 - DNA, 16 bp, H. sapiens
tcagcttgggtgacag

SEQ ID NO: 134117 - DNA, 16 bp, H. sapiens
tcagctttcccatctg

SEQ ID NO: 134118 - DNA, 16 bp, H. sapiens
tcagctttcctggttc

SEQ ID NO: 134119 - DNA, 16 bp, H. sapiens
tcagctttgctggggt

SEQ ID NO: 134120 - DNA, 16 bp, H. sapiens
tcagctttgggactca

SEQ ID NO: 134121 - DNA, 16 bp, H. sapiens
tcagctttgtcaaaga

SEQ ID NO: 134122 - DNA, 16 bp, H. sapiens
tcagctttgttaaaga

SEQ ID NO: 134123 - DNA, 16 bp, H. sapiens
tcagcttttggactcc

SEQ ID NO: 134124 - DNA, 16 bp, H. sapiens
tcaggaaaaaaaaatg

SEQ ID NO: 134125 - DNA, 16 bp, H. sapiens
tcaggaaaaaataatt

SEQ ID NO: 134126 - DNA, 16 bp, H. sapiens
tcaggaaaaaggcaag

SEQ ID NO: 134127 - DNA, 16 bp, H. sapiens
tcaggaaaaataacta

SEQ ID NO: 134128 - DNA, 16 bp, H. sapiens
tcaggaaaaataatta

SEQ ID NO: 134129 - DNA, 16 bp, H. sapiens
tcaggaaaacaattta

SEQ ID NO: 134130 - DNA, 16 bp, H. sapiens
tcaggaaaacacaaat

SEQ ID NO: 134131 - DNA, 16 bp, H. sapiens
tcaggaaaactgaatt

SEQ ID NO: 134132 - DNA, 16 bp, H. sapiens
tcaggaaacaagagat

SEQ ID NO: 134133 - DNA, 16 bp, H. sapiens
tcaggaaacataatca

SEQ ID NO: 134134 - DNA, 16 bp, H. sapiens
tcaggaaactcacaat

SEQ ID NO: 134135 - DNA, 16 bp, H. sapiens
tcaggaaacttaaaat

SEQ ID NO: 134136 - DNA, 16 bp, H. sapiens
tcaggaaacttacagt

SEQ ID NO: 134137 - DNA, 16 bp, H. sapiens
tcaggaaagaagaaag

SEQ ID NO: 134138 - DNA, 16 bp, H. sapiens
tcaggaaaggcctttc

SEQ ID NO: 134139 - DNA, 16 bp, H. sapiens
tcaggaaatacagaca

SEQ ID NO: 134140 - DNA, 16 bp, H. sapiens
tcaggaaatatttgtt

SEQ ID NO: 134141 - DNA, 16 bp, H. sapiens
tcaggaaatccagaga

SEQ ID NO: 134142 - DNA, 16 bp, H. sapiens
tcaggaacaccagtta

SEQ ID NO: 134143 - DNA, 16 bp, H. sapiens
tcaggaactacagaga

SEQ ID NO: 134144 - DNA, 16 bp, H. sapiens
tcaggaagaaaaagca

SEQ ID NO: 134145 - DNA, 16 bp, H. sapiens
tcaggaagaagttgaa

SEQ ID NO: 134146 - DNA, 16 bp, H. sapiens
tcaggaagctgagatg

SEQ ID NO: 134147 - DNA, 16 bp, H. sapiens
tcaggaagctgaggtg

SEQ ID NO: 134148 - DNA, 16 bp, H. sapiens
tcaggaagctttcact

SEQ ID NO: 134149 - DNA, 16 bp, H. sapiens
tcaggaaggagaagga

SEQ ID NO: 134150 - DNA, 16 bp, H. sapiens
tcaggaatgaagattt

SEQ ID NO: 134151 - DNA, 16 bp, H. sapiens
tcaggaattcatgacc

SEQ ID NO: 134152 - DNA, 16 bp, H. sapiens
tcaggacactggtctg

SEQ ID NO: 134153 - DNA, 16 bp, H. sapiens
tcaggacagtgggtgc

SEQ ID NO: 134154 - DNA, 31 bp, H. sapiens
tcaggacataggcatgggcaaggacttcgtg

SEQ ID NO: 134155 - DNA, 16 bp, H. sapiens
tcaggaccagcctggt

SEQ ID NO: 134156 - DNA, 16 bp, H. sapiens
tcaggacctcctgagg

SEQ ID NO: 134157 - DNA, 16 bp, H. sapiens
tcaggacctgaactca

SEQ ID NO: 134158 - DNA, 16 bp, H. sapiens
tcaggacctgatggct

SEQ ID NO: 134159 - DNA, 16 bp, H. sapiens
tcaggacctgcagcct

SEQ ID NO: 134160 - DNA, 16 bp, H. sapiens
tcaggacttcaagacc

SEQ ID NO: 134161 - DNA, 16 bp, H. sapiens
tcaggagaaaaataaa

SEQ ID NO: 134162 - DNA, 17 bp, H. sapiens
tcaggagaattgcttga

SEQ ID NO: 134163 - DNA, 16 bp, H. sapiens
tcaggagacctgggtt

SEQ ID NO: 134164 - DNA, 16 bp, H. sapiens
tcaggagactgaagtg

SEQ ID NO: 134165 - DNA, 16 bp, H. sapiens
tcaggagactgaggtg

SEQ ID NO: 134166 - DNA, 16 bp, H. sapiens
tcaggagagagtggca

SEQ ID NO: 134167 - DNA, 16 bp, H. sapiens
tcaggagataaagacc

SEQ ID NO: 134168 - DNA, 18 bp, H. sapiens
tcaggagcccagctggct

SEQ ID NO: 134169 - DNA, 16 bp, H. sapiens
tcaggagcccaggtgg

SEQ ID NO: 134170 - DNA, 16 bp, H. sapiens
tcaggagccttggctg

SEQ ID NO: 134171 - DNA, 16 bp, H. sapiens
tcaggagctcgagaac

SEQ ID NO: 134172 - DNA, 16 bp, H. sapiens
tcaggagcttttgtaa

SEQ ID NO: 134173 - DNA, 16 bp, H. sapiens
tcaggaggcagaagaa

SEQ ID NO: 134174 - DNA, 16 bp, H. sapiens
tcaggaggcctgaagg

SEQ ID NO: 134175 - DNA, 16 bp, H. sapiens
tcaggaggctagggca

SEQ ID NO: 134176 - DNA, 16 bp, H. sapiens
tcaggaggctgaagtg

SEQ ID NO: 134177 - DNA, 16 bp, H. sapiens
tcaggaggctgagcag

SEQ ID NO: 134178 - DNA, 16 bp, H. sapiens
tcaggaggctgagcca
